United States Patent 12,497,611 (COMPOSITIONS AND METHODS FOR HIGH-THROUGHPUT ACTIVATION SCREENING TO BOOST T CELL EFFECTOR FUNCTION) - sequence listing, part 2

SEQ ID NO: 27950 - DNA, 15 bp, Artificial Sequence
  dgRNA
  Tdg
tgatggcgaggccgc

SEQ ID NO: 27951 - DNA, 15 bp, Artificial Sequence
  dgRNA
  Psat1
tggggcgtcgggatg

SEQ ID NO: 27952 - DNA, 15 bp, Artificial Sequence
  dgRNA
  Psat1
ggggcgtcgggatgc

SEQ ID NO: 27953 - DNA, 15 bp, Artificial Sequence
  dgRNA
  Psat1
gcagggatgccgccg

SEQ ID NO: 27954 - DNA, 15 bp, Artificial Sequence
  dgRNA
  Psat1
cctgtgcacagacgc

SEQ ID NO: 27955 - DNA, 15 bp, Artificial Sequence
  dgRNA
  Lrrc8d
cccggagccggcgag

SEQ ID NO: 27956 - DNA, 15 bp, Artificial Sequence
  dgRNA
  Lrrc8d
gcctccgtcccgctc

SEQ ID NO: 27957 - DNA, 15 bp, Artificial Sequence
  dgRNA
  Lrrc8d
cctccgtcccgctcc

SEQ ID NO: 27958 - DNA, 15 bp, Artificial Sequence
  dgRNA
  Lrrc8d
ccgtcccgctccggg

SEQ ID NO: 27959 - DNA, 15 bp, Artificial Sequence
  dgRNA
  Esrra
gcgtgtgtatcgaca

SEQ ID NO: 27960 - DNA, 15 bp, Artificial Sequence
  dgRNA
  Esrra
gtcctccgggtacgc

SEQ ID NO: 27961 - DNA, 15 bp, Artificial Sequence
  dgRNA
  Esrra
ctcggatattagcat

SEQ ID NO: 27962 - DNA, 15 bp, Artificial Sequence
  dgRNA
  Esrra
tcggatattagcata

SEQ ID NO: 27963 - DNA, 15 bp, Artificial Sequence
  dgRNA
  Ssr3
cgccacgtaccctga

SEQ ID NO: 27964 - DNA, 15 bp, Artificial Sequence
  dgRNA
  Ssr3
gtaccctgaaggatg

SEQ ID NO: 27965 - DNA, 15 bp, Artificial Sequence
  dgRNA
  Ssr3
acgcttgtgaaacga

SEQ ID NO: 27966 - DNA, 15 bp, Artificial Sequence
  dgRNA
  Ssr3
gaaacgacggcaaga

SEQ ID NO: 27967 - DNA, 15 bp, Artificial Sequence
  dgRNA
  Scarf1
gtggcttcaatcttt

SEQ ID NO: 27968 - DNA, 15 bp, Artificial Sequence
  dgRNA
  Scarf1
cctgccctctcgggg

SEQ ID NO: 27969 - DNA, 15 bp, Artificial Sequence
  dgRNA
  Scarf1
tgagtggatttaggc

SEQ ID NO: 27970 - DNA, 15 bp, Artificial Sequence
  dgRNA
  Scarf1
gcacatagaaacgaa

SEQ ID NO: 27971 - DNA, 15 bp, Artificial Sequence
  dgRNA
  Adamts5
caccttgctaggttc

SEQ ID NO: 27972 - DNA, 15 bp, Artificial Sequence
  dgRNA
  Adamts5
ctcccccatcagatt

SEQ ID NO: 27973 - DNA, 15 bp, Artificial Sequence
  dgRNA
  Adamts5
ccatcagattaggcg

SEQ ID NO: 27974 - DNA, 15 bp, Artificial Sequence
  dgRNA
  Adamts5
agattaggcgcggac

SEQ ID NO: 27975 - DNA, 15 bp, Artificial Sequence
  dgRNA
  Golga5
atgccccgcccagtt

SEQ ID NO: 27976 - DNA, 15 bp, Artificial Sequence
  dgRNA
  Golga5
ccgcccagtttggct

SEQ ID NO: 27977 - DNA, 15 bp, Artificial Sequence
  dgRNA
  Golga5
cgcccagtttggctt

SEQ ID NO: 27978 - DNA, 15 bp, Artificial Sequence
  dgRNA
  Golga5
ttgggcccgcccctg

SEQ ID NO: 27979 - DNA, 15 bp, Artificial Sequence
  dgRNA
  Pask
aaggcgcgaagaaat

SEQ ID NO: 27980 - DNA, 15 bp, Artificial Sequence
  dgRNA
  Pask
aggcgcgaagaaatc

SEQ ID NO: 27981 - DNA, 15 bp, Artificial Sequence
  dgRNA
  Pask
agaaatcgggtcttt

SEQ ID NO: 27982 - DNA, 15 bp, Artificial Sequence
  dgRNA
  Pask
cttttggctcctccg

SEQ ID NO: 27983 - DNA, 15 bp, Artificial Sequence
  dgRNA
  Aipl1
aggaatgtggacggt

SEQ ID NO: 27984 - DNA, 15 bp, Artificial Sequence
  dgRNA
  Aipl1
ggaatgtggacggtg

SEQ ID NO: 27985 - DNA, 15 bp, Artificial Sequence
  dgRNA
  Aipl1
tgtcggggaatcccc

SEQ ID NO: 27986 - DNA, 15 bp, Artificial Sequence
  dgRNA
  Aipl1
gtcggggaatcccct

SEQ ID NO: 27987 - DNA, 15 bp, Artificial Sequence
  dgRNA
  Rgs9
atgctaatgagcgcg

SEQ ID NO: 27988 - DNA, 15 bp, Artificial Sequence
  dgRNA
  Rgs9
tgctcgctgattggt

SEQ ID NO: 27989 - DNA, 15 bp, Artificial Sequence
  dgRNA
  Rgs9
gctttgcatgtcggc

SEQ ID NO: 27990 - DNA, 15 bp, Artificial Sequence
  dgRNA
  Rgs9
atgtcggcgggtgcg

SEQ ID NO: 27991 - DNA, 15 bp, Artificial Sequence
  dgRNA
  Mex3d
cccgcacgtgcgggc

SEQ ID NO: 27992 - DNA, 15 bp, Artificial Sequence
  dgRNA
  Mex3d
cgtgcgggcgggcca

SEQ ID NO: 27993 - DNA, 15 bp, Artificial Sequence
  dgRNA
  Mex3d
gtgcgggcgggccag

SEQ ID NO: 27994 - DNA, 15 bp, Artificial Sequence
  dgRNA
  Mex3d
tgcgggcgggccagg

SEQ ID NO: 27995 - DNA, 15 bp, Artificial Sequence
  dgRNA
  Kcnip4
gcctgattgtttagc

SEQ ID NO: 27996 - DNA, 15 bp, Artificial Sequence
  dgRNA
  Kcnip4
tttattggtttccga

SEQ ID NO: 27997 - DNA, 15 bp, Artificial Sequence
  dgRNA
  Kcnip4
gattcattgatgagc

SEQ ID NO: 27998 - DNA, 15 bp, Artificial Sequence
  dgRNA
  Kcnip4
ccgcctccctcggca

SEQ ID NO: 27999 - DNA, 15 bp, Artificial Sequence
  dgRNA
  Isca1
ttagtgtacgccata

SEQ ID NO: 28000 - DNA, 15 bp, Artificial Sequence
  dgRNA
  Isca1
tgtacgccatacgga

SEQ ID NO: 28001 - DNA, 15 bp, Artificial Sequence
  dgRNA
  Isca1
accgcgaagcccgca

SEQ ID NO: 28002 - DNA, 15 bp, Artificial Sequence
  dgRNA
  Isca1
agcccgcaaggtcac

SEQ ID NO: 28003 - DNA, 15 bp, Artificial Sequence
  dgRNA
  Gpr25
caaagcctcggccta

SEQ ID NO: 28004 - DNA, 15 bp, Artificial Sequence
  dgRNA
  Gpr25
tcggcctagggtggc

SEQ ID NO: 28005 - DNA, 15 bp, Artificial Sequence
  dgRNA
  Gpr25
cagccgccctgcgcc

SEQ ID NO: 28006 - DNA, 15 bp, Artificial Sequence
  dgRNA
  Gpr25
cgccaggatgcacgc

SEQ ID NO: 28007 - DNA, 15 bp, Artificial Sequence
  dgRNA
  Ccdc96
agcctgtcagccggc

SEQ ID NO: 28008 - DNA, 15 bp, Artificial Sequence
  dgRNA
  Ccdc96
gcctgtcagccggcg

SEQ ID NO: 28009 - DNA, 15 bp, Artificial Sequence
  dgRNA
  Ccdc96
tcagccggcggggcg

SEQ ID NO: 28010 - DNA, 15 bp, Artificial Sequence
  dgRNA
  Ccdc96
cggaagtaggccgtg

SEQ ID NO: 28011 - DNA, 15 bp, Artificial Sequence
  dgRNA
  Mtbp
acgcgcaaactcacc

SEQ ID NO: 28012 - DNA, 15 bp, Artificial Sequence
  dgRNA
  Mtbp
cgcgcaaactcacct

SEQ ID NO: 28013 - DNA, 15 bp, Artificial Sequence
  dgRNA
  Mtbp
gcgcaaactcacctg

SEQ ID NO: 28014 - DNA, 15 bp, Artificial Sequence
  dgRNA
  Mtbp
gcgccctagagaagc

SEQ ID NO: 28015 - DNA, 15 bp, Artificial Sequence
  dgRNA
  Vmn1r38
tatctaatctttttc

SEQ ID NO: 28016 - DNA, 15 bp, Artificial Sequence
  dgRNA
  Ube2l6
taccccgcaagatgc

SEQ ID NO: 28017 - DNA, 15 bp, Artificial Sequence
  dgRNA
  Ube2l6
acgagatcgccaagc

SEQ ID NO: 28018 - DNA, 15 bp, Artificial Sequence
  dgRNA
  Ube2l6
cgagatcgccaagct

SEQ ID NO: 28019 - DNA, 15 bp, Artificial Sequence
  dgRNA
  Ube2l6
ccagatatccaccaa

SEQ ID NO: 28020 - DNA, 15 bp, Artificial Sequence
  dgRNA
  Gapvd1
tttaaaggaggtgta

SEQ ID NO: 28021 - DNA, 15 bp, Artificial Sequence
  dgRNA
  Gapvd1
tgtatggaagacggg

SEQ ID NO: 28022 - DNA, 15 bp, Artificial Sequence
  dgRNA
  Gapvd1
ggagcatgagactcg

SEQ ID NO: 28023 - DNA, 15 bp, Artificial Sequence
  dgRNA
  Gapvd1
gactcgtggtgttgc

SEQ ID NO: 28024 - DNA, 15 bp, Artificial Sequence
  dgRNA
  Bach2
atagagcctagatat

SEQ ID NO: 28025 - DNA, 15 bp, Artificial Sequence
  dgRNA
  Bach2
agatattggtaccta

SEQ ID NO: 28026 - DNA, 15 bp, Artificial Sequence
  dgRNA
  Bach2
gatattggtacctag

SEQ ID NO: 28027 - DNA, 15 bp, Artificial Sequence
  dgRNA
  Bach2
acactagaaccactg

SEQ ID NO: 28028 - DNA, 15 bp, Artificial Sequence
  dgRNA
  Olfr312
caactccatttgagt

SEQ ID NO: 28029 - DNA, 15 bp, Artificial Sequence
  dgRNA
  Olfr312
gaattaattaagacc

SEQ ID NO: 28030 - DNA, 15 bp, Artificial Sequence
  dgRNA
  Olfr312
agcagcctactcaaa

SEQ ID NO: 28031 - DNA, 15 bp, Artificial Sequence
  dgRNA
  Olfr312
ataataggtaggctt

SEQ ID NO: 28032 - DNA, 15 bp, Artificial Sequence
  dgRNA
  BC049762
cccacagatcgtgca

SEQ ID NO: 28033 - DNA, 15 bp, Artificial Sequence
  dgRNA
  BC049762
ccacagatcgtgcaa

SEQ ID NO: 28034 - DNA, 15 bp, Artificial Sequence
  dgRNA
  BC049762
cacagatcgtgcaag

SEQ ID NO: 28035 - DNA, 15 bp, Artificial Sequence
  dgRNA
  BC049762
tcgtgcaaggggacg

SEQ ID NO: 28036 - DNA, 15 bp, Artificial Sequence
  dgRNA
  Glyr1
ttcgttgtcacgagc

SEQ ID NO: 28037 - DNA, 15 bp, Artificial Sequence
  dgRNA
  Glyr1
gttgtcacgagccgg

SEQ ID NO: 28038 - DNA, 15 bp, Artificial Sequence
  dgRNA
  Glyr1
ttgtcacgagccgga

SEQ ID NO: 28039 - DNA, 15 bp, Artificial Sequence
  dgRNA
  Glyr1
tgtcacgagccggag

SEQ ID NO: 28040 - DNA, 15 bp, Artificial Sequence
  dgRNA
  Tbpl1
tcgccaacgaggagc

SEQ ID NO: 28041 - DNA, 15 bp, Artificial Sequence
  dgRNA
  Tbpl1
tggaaaataaaccgg

SEQ ID NO: 28042 - DNA, 15 bp, Artificial Sequence
  dgRNA
  Tbpl1
cttcaaatccacccc

SEQ ID NO: 28043 - DNA, 15 bp, Artificial Sequence
  dgRNA
  Tbpl1
caaatccaccccggg

SEQ ID NO: 28044 - DNA, 15 bp, Artificial Sequence
  dgRNA
  Lingo3
atgtgctaggcacgc

SEQ ID NO: 28045 - DNA, 15 bp, Artificial Sequence
  dgRNA
  Lingo3
tgtgctaggcacgcg

SEQ ID NO: 28046 - DNA, 15 bp, Artificial Sequence
  dgRNA
  Lingo3
ggcacgcggggtacc

SEQ ID NO: 28047 - DNA, 15 bp, Artificial Sequence
  dgRNA
  Lingo3
gcacgcggggtaccc

SEQ ID NO: 28048 - DNA, 15 bp, Artificial Sequence
  dgRNA
  Hist1h2bj
gccgatcagcttctg

SEQ ID NO: 28049 - DNA, 15 bp, Artificial Sequence
  dgRNA
  Hist1h2bj
ataatcgctttccat

SEQ ID NO: 28050 - DNA, 15 bp, Artificial Sequence
  dgRNA
  Hist1h2bj
acgtcatataggctt

SEQ ID NO: 28051 - DNA, 15 bp, Artificial Sequence
  dgRNA
  Hist1h2bj
ttgatgacgtcatat

SEQ ID NO: 28052 - DNA, 15 bp, Artificial Sequence
  dgRNA
  Fbxw8
gcttgcttggtacaa

SEQ ID NO: 28053 - DNA, 15 bp, Artificial Sequence
  dgRNA
  Fbxw8
gggatgtcgaagcag

SEQ ID NO: 28054 - DNA, 15 bp, Artificial Sequence
  dgRNA
  Fbxw8
gatgtcgaagcagag

SEQ ID NO: 28055 - DNA, 15 bp, Artificial Sequence
  dgRNA
  Fbxw8
cgaagcagaggggcg

SEQ ID NO: 28056 - DNA, 15 bp, Artificial Sequence
  dgRNA
  AI837181
ccgggattctcgcgc

SEQ ID NO: 28057 - DNA, 15 bp, Artificial Sequence
  dgRNA
  AI837181
ccgcccctagccttc

SEQ ID NO: 28058 - DNA, 15 bp, Artificial Sequence
  dgRNA
  AI837181
ttctggttccgcctc

SEQ ID NO: 28059 - DNA, 15 bp, Artificial Sequence
  dgRNA
  AI837181
tggcgggcgagcccg

SEQ ID NO: 28060 - DNA, 15 bp, Artificial Sequence
  dgRNA
  Rgmb
cacaaggaagccggc

SEQ ID NO: 28061 - DNA, 15 bp, Artificial Sequence
  dgRNA
  Rgmb
tgccccacccgcggg

SEQ ID NO: 28062 - DNA, 15 bp, Artificial Sequence
  dgRNA
  Rgmb
cccacccgcgggcgg

SEQ ID NO: 28063 - DNA, 15 bp, Artificial Sequence
  dgRNA
  Rgmb
cgcgggcggcggaca

SEQ ID NO: 28064 - DNA, 15 bp, Artificial Sequence
  dgRNA
  Celf5
tctctgccagcctcg

SEQ ID NO: 28065 - DNA, 15 bp, Artificial Sequence
  dgRNA
  Celf5
cccctgaagtagccg

SEQ ID NO: 28066 - DNA, 15 bp, Artificial Sequence
  dgRNA
  Celf5
cgaggcggccgccag

SEQ ID NO: 28067 - DNA, 15 bp, Artificial Sequence
  dgRNA
  Celf5
ccgccagaggcgctg

SEQ ID NO: 28068 - DNA, 15 bp, Artificial Sequence
  dgRNA
  Optc
gactcatccaagctg

SEQ ID NO: 28069 - DNA, 15 bp, Artificial Sequence
  dgRNA
  Hdac4
tccttagttaggtag

SEQ ID NO: 28070 - DNA, 15 bp, Artificial Sequence
  dgRNA
  Hdac4
tcacatcccaactga

SEQ ID NO: 28071 - DNA, 15 bp, Artificial Sequence
  dgRNA
  Hdac4
cgtttgctcttctcg

SEQ ID NO: 28072 - DNA, 15 bp, Artificial Sequence
  dgRNA
  Hdac4
ttctcgtggattact

SEQ ID NO: 28073 - DNA, 15 bp, Artificial Sequence
  dgRNA
  Slc45a1
cccggttgtccccaa

SEQ ID NO: 28074 - DNA, 15 bp, Artificial Sequence
  dgRNA
  Slc45a1
tccccaaaggtgcga

SEQ ID NO: 28075 - DNA, 15 bp, Artificial Sequence
  dgRNA
  Slc45a1
caaccggctgcttta

SEQ ID NO: 28076 - DNA, 15 bp, Artificial Sequence
  dgRNA
  Slc45a1
ctctgcgggacctag

SEQ ID NO: 28077 - DNA, 15 bp, Artificial Sequence
  dgRNA
  Btd
tgcggagttactttc

SEQ ID NO: 28078 - DNA, 15 bp, Artificial Sequence
  dgRNA
  Btd
cctaagagttgttgt

SEQ ID NO: 28079 - DNA, 15 bp, Artificial Sequence
  dgRNA
  Btd
ccgcttctgacagac

SEQ ID NO: 28080 - DNA, 15 bp, Artificial Sequence
  dgRNA
  Btd
aacggatttaagcaa

SEQ ID NO: 28081 - DNA, 15 bp, Artificial Sequence
  dgRNA
  Tnip3
ctacttgagacatcc

SEQ ID NO: 28082 - DNA, 15 bp, Artificial Sequence
  dgRNA
  Tnip3
tacttgagacatcct

SEQ ID NO: 28083 - DNA, 15 bp, Artificial Sequence
  dgRNA
  Tnip3
ttctcctactagagg

SEQ ID NO: 28084 - DNA, 15 bp, Artificial Sequence
  dgRNA
  Tnip3
agtttctcctactag

SEQ ID NO: 28085 - DNA, 15 bp, Artificial Sequence
  dgRNA
  Smc2
tccttagggcaaaag

SEQ ID NO: 28086 - DNA, 15 bp, Artificial Sequence
  dgRNA
  Smc2
ggaagcgcttcagtc

SEQ ID NO: 28087 - DNA, 15 bp, Artificial Sequence
  dgRNA
  Smc2
agagcgcagacgcct

SEQ ID NO: 28088 - DNA, 15 bp, Artificial Sequence
  dgRNA
  Smc2
cagacgcctcggagt

SEQ ID NO: 28089 - DNA, 15 bp, Artificial Sequence
  dgRNA
  Tmem183a
ctaaagaacgcggtc

SEQ ID NO: 28090 - DNA, 15 bp, Artificial Sequence
  dgRNA
  Tmem183a
aagaacgcggtctgg

SEQ ID NO: 28091 - DNA, 15 bp, Artificial Sequence
  dgRNA
  Tmem183a
cagcccgctccgctt

SEQ ID NO: 28092 - DNA, 15 bp, Artificial Sequence
  dgRNA
  Tmem183a
agcccgctccgcttt

SEQ ID NO: 28093 - DNA, 15 bp, Artificial Sequence
  dgRNA
  Pars2
ttgctaattcctaga

SEQ ID NO: 28094 - DNA, 15 bp, Artificial Sequence
  dgRNA
  Pars2
cctagagggcacttc

SEQ ID NO: 28095 - DNA, 15 bp, Artificial Sequence
  dgRNA
  Pars2
gcacttccggaatct

SEQ ID NO: 28096 - DNA, 15 bp, Artificial Sequence
  dgRNA
  Pars2
cttccggaatcttgg

SEQ ID NO: 28097 - DNA, 15 bp, Artificial Sequence
  dgRNA
  Ttll9
tgctacggcaaccaa

SEQ ID NO: 28098 - DNA, 15 bp, Artificial Sequence
  dgRNA
  Ttll9
tgcgtctcgttgcta

SEQ ID NO: 28099 - DNA, 15 bp, Artificial Sequence
  dgRNA
  Rnf4
ctagatgcagccgta

SEQ ID NO: 28100 - DNA, 15 bp, Artificial Sequence
  dgRNA
  Rnf4
tagatgcagccgtaa

SEQ ID NO: 28101 - DNA, 15 bp, Artificial Sequence
  dgRNA
  Rnf4
gggccaccgtatacc

SEQ ID NO: 28102 - DNA, 15 bp, Artificial Sequence
  dgRNA
  Rnf4
agtcaaacacccagc

SEQ ID NO: 28103 - DNA, 15 bp, Artificial Sequence
  dgRNA
  Stk11ip
tctctctctgccgaa

SEQ ID NO: 28104 - DNA, 15 bp, Artificial Sequence
  dgRNA
  Stk11ip
ctctctctgccgaag

SEQ ID NO: 28105 - DNA, 15 bp, Artificial Sequence
  dgRNA
  Stk11ip
agccgagctagacct

SEQ ID NO: 28106 - DNA, 15 bp, Artificial Sequence
  dgRNA
  Stk11ip
gccgagctagacctg

SEQ ID NO: 28107 - DNA, 15 bp, Artificial Sequence
  dgRNA
  Ece2
tgggcctcaaccaaa

SEQ ID NO: 28108 - DNA, 15 bp, Artificial Sequence
  dgRNA
  Ece2
agagcagcggttgcg

SEQ ID NO: 28109 - DNA, 15 bp, Artificial Sequence
  dgRNA
  Ece2
cggttgcgcggaacg

SEQ ID NO: 28110 - DNA, 15 bp, Artificial Sequence
  dgRNA
  Ece2
gcgcggaacgtggtc

SEQ ID NO: 28111 - DNA, 15 bp, Artificial Sequence
  dgRNA
  Timm17b
gcttaccaacaccga

SEQ ID NO: 28112 - DNA, 15 bp, Artificial Sequence
  dgRNA
  Timm17b
cttaccaacaccgaa

SEQ ID NO: 28113 - DNA, 15 bp, Artificial Sequence
  dgRNA
  Timm17b
acaccgaagggctct

SEQ ID NO: 28114 - DNA, 15 bp, Artificial Sequence
  dgRNA
  Timm17b
ggtttaaagcacaac

SEQ ID NO: 28115 - DNA, 15 bp, Artificial Sequence
  dgRNA
  Arfrp1
gcccccaaaaccgct

SEQ ID NO: 28116 - DNA, 15 bp, Artificial Sequence
  dgRNA
  Arfrp1
cccccaaaaccgcta

SEQ ID NO: 28117 - DNA, 15 bp, Artificial Sequence
  dgRNA
  Arfrp1
ccgctagggagcctg

SEQ ID NO: 28118 - DNA, 15 bp, Artificial Sequence
  dgRNA
  Arfrp1
gccgcggttccgccg

SEQ ID NO: 28119 - DNA, 15 bp, Artificial Sequence
  dgRNA
  Ndufaf2
ctcgggtccacacac

SEQ ID NO: 28120 - DNA, 15 bp, Artificial Sequence
  dgRNA
  Ndufaf2
ccacacaccggctgg

SEQ ID NO: 28121 - DNA, 15 bp, Artificial Sequence
  dgRNA
  Ndufaf2
gacagaccggggaac

SEQ ID NO: 28122 - DNA, 15 bp, Artificial Sequence
  dgRNA
  Ndufaf2
agaccggggaactgg

SEQ ID NO: 28123 - DNA, 15 bp, Artificial Sequence
  dgRNA
  Cfb
ccgtgtgaaagcaaa

SEQ ID NO: 28124 - DNA, 15 bp, Artificial Sequence
  dgRNA
  Olfr743
aatttttgcccaaac

SEQ ID NO: 28125 - DNA, 15 bp, Artificial Sequence
  dgRNA
  Ergic1
ggccttcccattcag

SEQ ID NO: 28126 - DNA, 15 bp, Artificial Sequence
  dgRNA
  Ergic1
cattcagcgggccct

SEQ ID NO: 28127 - DNA, 15 bp, Artificial Sequence
  dgRNA
  Ergic1
attcagcgggccctc

SEQ ID NO: 28128 - DNA, 15 bp, Artificial Sequence
  dgRNA
  Ergic1
ctcgggcccctttaa

SEQ ID NO: 28129 - DNA, 15 bp, Artificial Sequence
  dgRNA
  Slc3a1
gatgagtcagccacc

SEQ ID NO: 28130 - DNA, 15 bp, Artificial Sequence
  dgRNA
  Slc3a1
ttacgcaatcttcct

SEQ ID NO: 28131 - DNA, 15 bp, Artificial Sequence
  dgRNA
  Slc3a1
gcaatcttccttggc

SEQ ID NO: 28132 - DNA, 15 bp, Artificial Sequence
  dgRNA
  Slc3a1
agtaacagtatgtga

SEQ ID NO: 28133 - DNA, 15 bp, Artificial Sequence
  dgRNA
  Psd2
aatggcctggtccgt

SEQ ID NO: 28134 - DNA, 15 bp, Artificial Sequence
  dgRNA
  Psd2
atggcctggtccgtc

SEQ ID NO: 28135 - DNA, 15 bp, Artificial Sequence
  dgRNA
  Psd2
tggtccgtcgggaac

SEQ ID NO: 28136 - DNA, 15 bp, Artificial Sequence
  dgRNA
  Psd2
agttgggctctcccg

SEQ ID NO: 28137 - DNA, 15 bp, Artificial Sequence
  dgRNA
  Ubxn6
ggttccagtagctct

SEQ ID NO: 28138 - DNA, 15 bp, Artificial Sequence
  dgRNA
  Ubxn6
aggctgctcgctgtt

SEQ ID NO: 28139 - DNA, 15 bp, Artificial Sequence
  dgRNA
  Ubxn6
ctctttaagctcccc

SEQ ID NO: 28140 - DNA, 15 bp, Artificial Sequence
  dgRNA
  Ubxn6
tttaagctcccctgg

SEQ ID NO: 28141 - DNA, 15 bp, Artificial Sequence
  dgRNA
  Fastkd1
tggatcaaattcagc

SEQ ID NO: 28142 - DNA, 15 bp, Artificial Sequence
  dgRNA
  Fastkd1
ggatttagagccgac

SEQ ID NO: 28143 - DNA, 15 bp, Artificial Sequence
  dgRNA
  Fastkd1
acaactggttaacct

SEQ ID NO: 28144 - DNA, 15 bp, Artificial Sequence
  dgRNA
  Hp
cccgtcccactctct

SEQ ID NO: 28145 - DNA, 15 bp, Artificial Sequence
  dgRNA
  Hp
ccgtcccactctcta

SEQ ID NO: 28146 - DNA, 15 bp, Artificial Sequence
  dgRNA
  Hp
cgtcccactctctag

SEQ ID NO: 28147 - DNA, 15 bp, Artificial Sequence
  dgRNA
  Hp
ggttatccaccattg

SEQ ID NO: 28148 - DNA, 15 bp, Artificial Sequence
  dgRNA
  Hist1h2ab
gaggagctcaaattc

SEQ ID NO: 28149 - DNA, 15 bp, Artificial Sequence
  dgRNA
  Hist1h2ab
cgatatattaaccaa

SEQ ID NO: 28150 - DNA, 15 bp, Artificial Sequence
  dgRNA
  Hist1h2ab
gatatattaaccaat

SEQ ID NO: 28151 - DNA, 15 bp, Artificial Sequence
  dgRNA
  Hist1h2ab
atttatactaactgg

SEQ ID NO: 28152 - DNA, 15 bp, Artificial Sequence
  dgRNA
  Vmn1r223
tacgggatggcaaaa

SEQ ID NO: 28153 - DNA, 15 bp, Artificial Sequence
  dgRNA
  Pum1
tccccgagttcacac

SEQ ID NO: 28154 - DNA, 15 bp, Artificial Sequence
  dgRNA
  Pum1
cacaggccctgccgt

SEQ ID NO: 28155 - DNA, 15 bp, Artificial Sequence
  dgRNA
  Pum1
gccctgccgttggca

SEQ ID NO: 28156 - DNA, 15 bp, Artificial Sequence
  dgRNA
  Pum1
tgccaccgccggagc

SEQ ID NO: 28157 - DNA, 15 bp, Artificial Sequence
  dgRNA
  Olfr1284
gtaagaatggtgatc

SEQ ID NO: 28158 - DNA, 15 bp, Artificial Sequence
  dgRNA
  Jak3
ccctcttagttcatt

SEQ ID NO: 28159 - DNA, 15 bp, Artificial Sequence
  dgRNA
  Jak3
ttagttcattaggac

SEQ ID NO: 28160 - DNA, 15 bp, Artificial Sequence
  dgRNA
  Jak3
gttcattaggactgg

SEQ ID NO: 28161 - DNA, 15 bp, Artificial Sequence
  dgRNA
  Jak3
cgcagtgtgtctttt

SEQ ID NO: 28162 - DNA, 15 bp, Artificial Sequence
  dgRNA
  Abhd14b
cttcaaccctgtttt

SEQ ID NO: 28163 - DNA, 15 bp, Artificial Sequence
  dgRNA
  Abhd14b
gtttttggtgcacat

SEQ ID NO: 28164 - DNA, 15 bp, Artificial Sequence
  dgRNA
  Abhd14b
ttgatcaaagaacga

SEQ ID NO: 28165 - DNA, 15 bp, Artificial Sequence
  dgRNA
  Abhd14b
tgatcaaagaacgaa

SEQ ID NO: 28166 - DNA, 15 bp, Artificial Sequence
  dgRNA
  Plod2
tggagccccggcgtg

SEQ ID NO: 28167 - DNA, 15 bp, Artificial Sequence
  dgRNA
  Plod2
agccccggcgtgagg

SEQ ID NO: 28168 - DNA, 15 bp, Artificial Sequence
  dgRNA
  Plod2
tgaggcggtgcacgt

SEQ ID NO: 28169 - DNA, 15 bp, Artificial Sequence
  dgRNA
  Plod2
ggtgcacgtaggcgt

SEQ ID NO: 28170 - DNA, 15 bp, Artificial Sequence
  dgRNA
  Agfg1
acccttgccgcagcg

SEQ ID NO: 28171 - DNA, 15 bp, Artificial Sequence
  dgRNA
  Agfg1
cgcagtgactcctcc

SEQ ID NO: 28172 - DNA, 15 bp, Artificial Sequence
  dgRNA
  Agfg1
gcgccagcctgcact

SEQ ID NO: 28173 - DNA, 15 bp, Artificial Sequence
  dgRNA
  Agfg1
gcccccggctgcccg

SEQ ID NO: 28174 - DNA, 15 bp, Artificial Sequence
  dgRNA
  Galnt5
aagtactcaagtatc

SEQ ID NO: 28175 - DNA, 15 bp, Artificial Sequence
  dgRNA
  Galnt5
agtactcaagtatct

SEQ ID NO: 28176 - DNA, 15 bp, Artificial Sequence
  dgRNA
  Galnt5
gaggggttacaaacc

SEQ ID NO: 28177 - DNA, 15 bp, Artificial Sequence
  dgRNA
  Galnt5
tacacattaaccctg

SEQ ID NO: 28178 - DNA, 15 bp, Artificial Sequence
  dgRNA
  Lrrc49
gaatcaaacttcccg

SEQ ID NO: 28179 - DNA, 15 bp, Artificial Sequence
  dgRNA
  Lrrc49
aatcaaacttcccgc

SEQ ID NO: 28180 - DNA, 15 bp, Artificial Sequence
  dgRNA
  Lrrc49
ccgcgggcagtgttg

SEQ ID NO: 28181 - DNA, 15 bp, Artificial Sequence
  dgRNA
  Lrrc49
cgggcagtgttgagg

SEQ ID NO: 28182 - DNA, 15 bp, Artificial Sequence
  dgRNA
  Xlr5c
aggtgaaactcggct

SEQ ID NO: 28183 - DNA, 15 bp, Artificial Sequence
  dgRNA
  Nbr1
atccagacacgtcag

SEQ ID NO: 28184 - DNA, 15 bp, Artificial Sequence
  dgRNA
  Nbr1
agacacgtcagcgga

SEQ ID NO: 28185 - DNA, 15 bp, Artificial Sequence
  dgRNA
  Nbr1
gacacgtcagcggaa

SEQ ID NO: 28186 - DNA, 15 bp, Artificial Sequence
  dgRNA
  Nbr1
cgtcagcggaaggga

SEQ ID NO: 28187 - DNA, 15 bp, Artificial Sequence
  dgRNA
  Mrgprd
ttcccaaacccatga

SEQ ID NO: 28188 - DNA, 15 bp, Artificial Sequence
  dgRNA
  Mrgprd
tcccaaacccatgat

SEQ ID NO: 28189 - DNA, 15 bp, Artificial Sequence
  dgRNA
  Mrgprd
cccaaacccatgatg

SEQ ID NO: 28190 - DNA, 15 bp, Artificial Sequence
  dgRNA
  Mrgprd
tttatggactaggaa

SEQ ID NO: 28191 - DNA, 15 bp, Artificial Sequence
  dgRNA
  Wfdc15b
cagactggtccacgg

SEQ ID NO: 28192 - DNA, 15 bp, Artificial Sequence
  dgRNA
  Wfdc15b
ttggataaaacagac

SEQ ID NO: 28193 - DNA, 15 bp, Artificial Sequence
  dgRNA
  Wfdc15b
acgagagaacaaagg

SEQ ID NO: 28194 - DNA, 15 bp, Artificial Sequence
  dgRNA
  Tpo
caccagaagcttgag

SEQ ID NO: 28195 - DNA, 15 bp, Artificial Sequence
  dgRNA
  Tpo
agagtccatttatac

SEQ ID NO: 28196 - DNA, 15 bp, Artificial Sequence
  dgRNA
  Tpo
gagtccatttataca

SEQ ID NO: 28197 - DNA, 15 bp, Artificial Sequence
  dgRNA
  Tpo
actcaagcttctggt

SEQ ID NO: 28198 - DNA, 15 bp, Artificial Sequence
  dgRNA
  AI317395
tgagctccgtttcct

SEQ ID NO: 28199 - DNA, 15 bp, Artificial Sequence
  dgRNA
  AI317395
ttccggtttgactcc

SEQ ID NO: 28200 - DNA, 15 bp, Artificial Sequence
  dgRNA
  AI317395
ctccaggttggctag

SEQ ID NO: 28201 - DNA, 15 bp, Artificial Sequence
  dgRNA
  AI317395
acgccagtgctagct

SEQ ID NO: 28202 - DNA, 15 bp, Artificial Sequence
  dgRNA
  Olfr628
gcttctcaactagac

SEQ ID NO: 28203 - DNA, 15 bp, Artificial Sequence
  dgRNA
  Olfr628
caacctgtagacata

SEQ ID NO: 28204 - DNA, 15 bp, Artificial Sequence
  dgRNA
  Fmo9
gactatagctaatga

SEQ ID NO: 28205 - DNA, 15 bp, Artificial Sequence
  dgRNA
  Zfp647
tagcatgtgttacac

SEQ ID NO: 28206 - DNA, 15 bp, Artificial Sequence
  dgRNA
  Zfp647
ggcttcgtatgacag

SEQ ID NO: 28207 - DNA, 15 bp, Artificial Sequence
  dgRNA
  Zfp647
gcttcgtatgacaga

SEQ ID NO: 28208 - DNA, 15 bp, Artificial Sequence
  dgRNA
  Zfp647
tgacagagggccacc

SEQ ID NO: 28209 - DNA, 15 bp, Artificial Sequence
  dgRNA
  Cep85
cgcagagcgacgtac

SEQ ID NO: 28210 - DNA, 15 bp, Artificial Sequence
  dgRNA
  Cep85
agcgacgtaccggtc

SEQ ID NO: 28211 - DNA, 15 bp, Artificial Sequence
  dgRNA
  Cep85
cggaacctcctgcgc

SEQ ID NO: 28212 - DNA, 15 bp, Artificial Sequence
  dgRNA
  Cep85
ggaacctcctgcgca

SEQ ID NO: 28213 - DNA, 15 bp, Artificial Sequence
  dgRNA
  Pus7l
cagactgcctgcgat

SEQ ID NO: 28214 - DNA, 15 bp, Artificial Sequence
  dgRNA
  Pus7l
agactgcctgcgatc

SEQ ID NO: 28215 - DNA, 15 bp, Artificial Sequence
  dgRNA
  Pus7l
gcgatcgggatgctg

SEQ ID NO: 28216 - DNA, 15 bp, Artificial Sequence
  dgRNA
  Pus7l
cgatcgggatgctgc

SEQ ID NO: 28217 - DNA, 15 bp, Artificial Sequence
  dgRNA
  Fancc
ggagtttgacctatc

SEQ ID NO: 28218 - DNA, 15 bp, Artificial Sequence
  dgRNA
  Fancc
tcgcccacttcctcc

SEQ ID NO: 28219 - DNA, 15 bp, Artificial Sequence
  dgRNA
  Fancc
cttcccatcatgccg

SEQ ID NO: 28220 - DNA, 15 bp, Artificial Sequence
  dgRNA
  Fancc
agggttcaagcctgc

SEQ ID NO: 28221 - DNA, 15 bp, Artificial Sequence
  dgRNA
  Gpr146
agaactaaactgctc

SEQ ID NO: 28222 - DNA, 15 bp, Artificial Sequence
  dgRNA
  Gpr146
gaactaaactgctcc

SEQ ID NO: 28223 - DNA, 15 bp, Artificial Sequence
  dgRNA
  Gpr146
ctgtacccaacctgc

SEQ ID NO: 28224 - DNA, 15 bp, Artificial Sequence
  dgRNA
  Gpr146
ttgtctgtagaacta

SEQ ID NO: 28225 - DNA, 15 bp, Artificial Sequence
  dgRNA
  Wdr12
cacaagacgaacaga

SEQ ID NO: 28226 - DNA, 15 bp, Artificial Sequence
  dgRNA
  Wdr12
acaagacgaacagat

SEQ ID NO: 28227 - DNA, 15 bp, Artificial Sequence
  dgRNA
  Wdr12
tatctgcccggagaa

SEQ ID NO: 28228 - DNA, 15 bp, Artificial Sequence
  dgRNA
  Wdr12
atgagaccctaaatg

SEQ ID NO: 28229 - DNA, 15 bp, Artificial Sequence
  dgRNA
  Ptgs1
agatcttgcacctca

SEQ ID NO: 28230 - DNA, 15 bp, Artificial Sequence
  dgRNA
  Ptgs1
aaggatcgtgagtta

SEQ ID NO: 28231 - DNA, 15 bp, Artificial Sequence
  dgRNA
  Ptgs1
attaataaaacgtct

SEQ ID NO: 28232 - DNA, 15 bp, Artificial Sequence
  dgRNA
  Ptgs1
aaaacgtcttggcta

SEQ ID NO: 28233 - DNA, 15 bp, Artificial Sequence
  dgRNA
  Slc25a48
gaagctgtactgttg

SEQ ID NO: 28234 - DNA, 15 bp, Artificial Sequence
  dgRNA
  Slc25a48
attcccctaagagac

SEQ ID NO: 28235 - DNA, 15 bp, Artificial Sequence
  dgRNA
  Slc25a48
ttcccctaagagact

SEQ ID NO: 28236 - DNA, 15 bp, Artificial Sequence
  dgRNA
  Slc25a48
tggggccccgcctcc

SEQ ID NO: 28237 - DNA, 15 bp, Artificial Sequence
  dgRNA
  Coq10b
accgtaggtgaaccc

SEQ ID NO: 28238 - DNA, 15 bp, Artificial Sequence
  dgRNA
  Coq10b
cgaagattacataag

SEQ ID NO: 28239 - DNA, 15 bp, Artificial Sequence
  dgRNA
  Coq10b
taagtggcagactcc

SEQ ID NO: 28240 - DNA, 15 bp, Artificial Sequence
  dgRNA
  Coq10b
gatccgcgccccgat

SEQ ID NO: 28241 - DNA, 15 bp, Artificial Sequence
  dgRNA
  Defb38
ttggacattcactct

SEQ ID NO: 28242 - DNA, 15 bp, Artificial Sequence
  dgRNA
  Defb38
gctacttgtctgaac

SEQ ID NO: 28243 - DNA, 15 bp, Artificial Sequence
  dgRNA
  Defb38
gcctaatagagaggc

SEQ ID NO: 28244 - DNA, 15 bp, Artificial Sequence
  dgRNA
  Defb38
gctggcctaatagag

SEQ ID NO: 28245 - DNA, 15 bp, Artificial Sequence
  dgRNA
  Map4k3
accgggcgcgcgagc

SEQ ID NO: 28246 - DNA, 15 bp, Artificial Sequence
  dgRNA
  Map4k3
ccgggcgcgcgagcc

SEQ ID NO: 28247 - DNA, 15 bp, Artificial Sequence
  dgRNA
  Map4k3
agccgggggcgcgca

SEQ ID NO: 28248 - DNA, 15 bp, Artificial Sequence
  dgRNA
  Map4k3
cccgccgggagcgcg

SEQ ID NO: 28249 - DNA, 15 bp, Artificial Sequence
  dgRNA
  Peak1
gtcaactcctcccat

SEQ ID NO: 28250 - DNA, 15 bp, Artificial Sequence
  dgRNA
  Peak1
gctcggagaccgccg

SEQ ID NO: 28251 - DNA, 15 bp, Artificial Sequence
  dgRNA
  Peak1
gagaccgccgaggtt

SEQ ID NO: 28252 - DNA, 15 bp, Artificial Sequence
  dgRNA
  Peak1
cgccgaggtttggtg

SEQ ID NO: 28253 - DNA, 15 bp, Artificial Sequence
  dgRNA
  Sncaip
ccgagtatcgtttcc

SEQ ID NO: 28254 - DNA, 15 bp, Artificial Sequence
  dgRNA
  Sncaip
ttcccggttttatgc

SEQ ID NO: 28255 - DNA, 15 bp, Artificial Sequence
  dgRNA
  Sncaip
aaccttggaatggtt

SEQ ID NO: 28256 - DNA, 15 bp, Artificial Sequence
  dgRNA
  Sncaip
accttggaatggttt

SEQ ID NO: 28257 - DNA, 15 bp, Artificial Sequence
  dgRNA
  Ovgp1
ctccctgctagtgtc

SEQ ID NO: 28258 - DNA, 15 bp, Artificial Sequence
  dgRNA
  Ovgp1
tgctagtgtcaggtc

SEQ ID NO: 28259 - DNA, 15 bp, Artificial Sequence
  dgRNA
  Ovgp1
gctagtgtcaggtca

SEQ ID NO: 28260 - DNA, 15 bp, Artificial Sequence
  dgRNA
  Ovgp1
gggatattgatttgt

SEQ ID NO: 28261 - DNA, 15 bp, Artificial Sequence
  dgRNA
  Sdf2
tcccaccgaagaaaa

SEQ ID NO: 28262 - DNA, 15 bp, Artificial Sequence
  dgRNA
  Sdf2
tccggacccaccgca

SEQ ID NO: 28263 - DNA, 15 bp, Artificial Sequence
  dgRNA
  Sdf2
ccggacccaccgcaa

SEQ ID NO: 28264 - DNA, 15 bp, Artificial Sequence
  dgRNA
  Sdf2
gtagtacgtcacctc

SEQ ID NO: 28265 - DNA, 15 bp, Artificial Sequence
  dgRNA
  Slc25a25
tcccagtggactagc

SEQ ID NO: 28266 - DNA, 15 bp, Artificial Sequence
  dgRNA
  Slc25a25
cccagtggactagct

SEQ ID NO: 28267 - DNA, 15 bp, Artificial Sequence
  dgRNA
  Slc25a25
tactccgcctgtgat

SEQ ID NO: 28268 - DNA, 15 bp, Artificial Sequence
  dgRNA
  Slc25a25
tccgcctgtgattgg

SEQ ID NO: 28269 - DNA, 15 bp, Artificial Sequence
  dgRNA
  Fzd9
cacacgcctccagcg

SEQ ID NO: 28270 - DNA, 15 bp, Artificial Sequence
  dgRNA
  Fzd9
cgtggcagagaggcg

SEQ ID NO: 28271 - DNA, 15 bp, Artificial Sequence
  dgRNA
  Fzd9
acctttaaagcgcga

SEQ ID NO: 28272 - DNA, 15 bp, Artificial Sequence
  dgRNA
  Fzd9
cctttaaagcgcgac

SEQ ID NO: 28273 - DNA, 15 bp, Artificial Sequence
  dgRNA
  Ankrd55
gcacgcagtctgcgc

SEQ ID NO: 28274 - DNA, 15 bp, Artificial Sequence
  dgRNA
  Ankrd55
cgcagtctgcgctgg

SEQ ID NO: 28275 - DNA, 15 bp, Artificial Sequence
  dgRNA
  Ankrd55
tgcacatgctccgtc

SEQ ID NO: 28276 - DNA, 15 bp, Artificial Sequence
  dgRNA
  Ankrd55
gcgcagactgcgtgc

SEQ ID NO: 28277 - DNA, 15 bp, Artificial Sequence
  dgRNA
  Vmn1r199
aacacttgttagtac

SEQ ID NO: 28278 - DNA, 15 bp, Artificial Sequence
  dgRNA
  Tsks
ccgtgtgctctagac

SEQ ID NO: 28279 - DNA, 15 bp, Artificial Sequence
  dgRNA
  Tsks
tgtacaatcaaagcc

SEQ ID NO: 28280 - DNA, 15 bp, Artificial Sequence
  dgRNA
  Tsks
gtacaatcaaagcca

SEQ ID NO: 28281 - DNA, 15 bp, Artificial Sequence
  dgRNA
  Tsks
cggaagagtccactg

SEQ ID NO: 28282 - DNA, 15 bp, Artificial Sequence
  dgRNA
  Zfp13
ccttccgggaatcag

SEQ ID NO: 28283 - DNA, 15 bp, Artificial Sequence
  dgRNA
  Zfp13
gcactacatcactcg

SEQ ID NO: 28284 - DNA, 15 bp, Artificial Sequence
  dgRNA
  Zfp13
cactacatcactcgc

SEQ ID NO: 28285 - DNA, 15 bp, Artificial Sequence
  dgRNA
  Zfp13
actacatcactcgcg

SEQ ID NO: 28286 - DNA, 15 bp, Artificial Sequence
  dgRNA
  Man1c1
tggagctagcaggat

SEQ ID NO: 28287 - DNA, 15 bp, Artificial Sequence
  dgRNA
  Man1c1
cgcagcgccagcatt

SEQ ID NO: 28288 - DNA, 15 bp, Artificial Sequence
  dgRNA
  Man1c1
cgccagcatttggag

SEQ ID NO: 28289 - DNA, 15 bp, Artificial Sequence
  dgRNA
  Man1c1
agcatttggagcggg

SEQ ID NO: 28290 - DNA, 15 bp, Artificial Sequence
  dgRNA
  Cbfa2t2
agtgcaggccgctcc

SEQ ID NO: 28291 - DNA, 15 bp, Artificial Sequence
  dgRNA
  Cbfa2t2
aggccgctccaggat

SEQ ID NO: 28292 - DNA, 15 bp, Artificial Sequence
  dgRNA
  Cbfa2t2
ggataggacgcagcc

SEQ ID NO: 28293 - DNA, 15 bp, Artificial Sequence
  dgRNA
  Cbfa2t2
ggacgcagcctggcg

SEQ ID NO: 28294 - DNA, 15 bp, Artificial Sequence
  dgRNA
  Ret
tgatatgttgtacac

SEQ ID NO: 28295 - DNA, 15 bp, Artificial Sequence
  dgRNA
  Ret
cgcccccttgataaa

SEQ ID NO: 28296 - DNA, 15 bp, Artificial Sequence
  dgRNA
  Ret
ccccttgataaatgg

SEQ ID NO: 28297 - DNA, 15 bp, Artificial Sequence
  dgRNA
  Ret
cttgataaatggcgg

SEQ ID NO: 28298 - DNA, 15 bp, Artificial Sequence
  dgRNA
  Lamtor1
tcggagttagagact

SEQ ID NO: 28299 - DNA, 15 bp, Artificial Sequence
  dgRNA
  Lamtor1
tcctatcacgtgccg

SEQ ID NO: 28300 - DNA, 15 bp, Artificial Sequence
  dgRNA
  Lamtor1
cctatcacgtgccgc

SEQ ID NO: 28301 - DNA, 15 bp, Artificial Sequence
  dgRNA
  Lamtor1
cgggtccgctcacgt

SEQ ID NO: 28302 - DNA, 15 bp, Artificial Sequence
  dgRNA
  Rpap3
atcgaggggagtaaa

SEQ ID NO: 28303 - DNA, 15 bp, Artificial Sequence
  dgRNA
  Rpap3
gtcaatacgtcaaga

SEQ ID NO: 28304 - DNA, 15 bp, Artificial Sequence
  dgRNA
  Rpap3
tcaatacgtcaagat

SEQ ID NO: 28305 - DNA, 15 bp, Artificial Sequence
  dgRNA
  Rpap3
aagatgggtgcactt

SEQ ID NO: 28306 - DNA, 15 bp, Artificial Sequence
  dgRNA
  Ntrk2
cgccagcagtagcag

SEQ ID NO: 28307 - DNA, 15 bp, Artificial Sequence
  dgRNA
  Ntrk2
ggctgacgcagagca

SEQ ID NO: 28308 - DNA, 15 bp, Artificial Sequence
  dgRNA
  Ntrk2
gggctgacgcagagc

SEQ ID NO: 28309 - DNA, 15 bp, Artificial Sequence
  dgRNA
  Ntrk2
ggcgaagtgacgtga

SEQ ID NO: 28310 - DNA, 15 bp, Artificial Sequence
  dgRNA
  Adgrg2
ctcgccccgccacgc

SEQ ID NO: 28311 - DNA, 15 bp, Artificial Sequence
  dgRNA
  Adgrg2
tcgccccgccacgcc

SEQ ID NO: 28312 - DNA, 15 bp, Artificial Sequence
  dgRNA
  Adgrg2
ggcgggcaagtggtc

SEQ ID NO: 28313 - DNA, 15 bp, Artificial Sequence
  dgRNA
  Adgrg2
caagtggtccgggag

SEQ ID NO: 28314 - DNA, 15 bp, Artificial Sequence
  dgRNA
  Pak3
gaagggtgcgtgcct

SEQ ID NO: 28315 - DNA, 15 bp, Artificial Sequence
  dgRNA
  Pak3
aagtggcttccaccg

SEQ ID NO: 28316 - DNA, 15 bp, Artificial Sequence
  dgRNA
  Pak3
gcaaccacccccatc

SEQ ID NO: 28317 - DNA, 15 bp, Artificial Sequence
  dgRNA
  Pak3
taagggcttccccgg

SEQ ID NO: 28318 - DNA, 15 bp, Artificial Sequence
  dgRNA
  Sis
attcataattaatcg

SEQ ID NO: 28319 - DNA, 15 bp, Artificial Sequence
  dgRNA
  Il1rapl2
ctcctcatcccttta

SEQ ID NO: 28320 - DNA, 15 bp, Artificial Sequence
  dgRNA
  Il1rapl2
ggcaaggacactaga

SEQ ID NO: 28321 - DNA, 15 bp, Artificial Sequence
  dgRNA
  Il1rapl2
acgcttcccttctcg

SEQ ID NO: 28322 - DNA, 15 bp, Artificial Sequence
  dgRNA
  Il1rapl2
cgcttcccttctcga

SEQ ID NO: 28323 - DNA, 15 bp, Artificial Sequence
  dgRNA
  Hbp1
gcccgcccaccgaga

SEQ ID NO: 28324 - DNA, 15 bp, Artificial Sequence
  dgRNA
  Hbp1
caccgagacggacta

SEQ ID NO: 28325 - DNA, 15 bp, Artificial Sequence
  dgRNA
  Hbp1
tacggcactttccaa

SEQ ID NO: 28326 - DNA, 15 bp, Artificial Sequence
  dgRNA
  Hbp1
ggcggaaccttagag

SEQ ID NO: 28327 - DNA, 15 bp, Artificial Sequence
  dgRNA
  Gstm2
tctgactgcttagac

SEQ ID NO: 28328 - DNA, 15 bp, Artificial Sequence
  dgRNA
  Gstm2
atcttgccctgcccc

SEQ ID NO: 28329 - DNA, 15 bp, Artificial Sequence
  dgRNA
  Gstm2
gatatagctaatctc

SEQ ID NO: 28330 - DNA, 15 bp, Artificial Sequence
  dgRNA
  Gstm2
tttctattggaccat

SEQ ID NO: 28331 - DNA, 15 bp, Artificial Sequence
  dgRNA
  Aamp
gggcggagtcatgta

SEQ ID NO: 28332 - DNA, 15 bp, Artificial Sequence
  dgRNA
  Aamp
cggagtcatgtaagg

SEQ ID NO: 28333 - DNA, 15 bp, Artificial Sequence
  dgRNA
  Aamp
tctcccgccacgccc

SEQ ID NO: 28334 - DNA, 15 bp, Artificial Sequence
  dgRNA
  Aamp
caccactgtcgccat

SEQ ID NO: 28335 - DNA, 15 bp, Artificial Sequence
  dgRNA
  Shroom3
tctagcgctgagcgc

SEQ ID NO: 28336 - DNA, 15 bp, Artificial Sequence
  dgRNA
  Shroom3
agcgctggccaatcg

SEQ ID NO: 28337 - DNA, 15 bp, Artificial Sequence
  dgRNA
  Shroom3
gcggacggccaatcg

SEQ ID NO: 28338 - DNA, 15 bp, Artificial Sequence
  dgRNA
  Shroom3
atcgcggacgcttcc

SEQ ID NO: 28339 - DNA, 15 bp, Artificial Sequence
  dgRNA
  Chd6
cgaaacccaatagcg

SEQ ID NO: 28340 - DNA, 15 bp, Artificial Sequence
  dgRNA
  Chd6
acccaatagcgcggc

SEQ ID NO: 28341 - DNA, 15 bp, Artificial Sequence
  dgRNA
  Chd6
cccaatagcgcggca

SEQ ID NO: 28342 - DNA, 15 bp, Artificial Sequence
  dgRNA
  Chd6
atagcgcggcaggga

SEQ ID NO: 28343 - DNA, 15 bp, Artificial Sequence
  dgRNA
  Prkx
cgggagggcggcact

SEQ ID NO: 28344 - DNA, 15 bp, Artificial Sequence
  dgRNA
  Prkx
gggagggcggcactc

SEQ ID NO: 28345 - DNA, 15 bp, Artificial Sequence
  dgRNA
  Prkx
ggactacagaacacc

SEQ ID NO: 28346 - DNA, 15 bp, Artificial Sequence
  dgRNA
  Prkx
aaaccctgcccaacc

SEQ ID NO: 28347 - DNA, 15 bp, Artificial Sequence
  dgRNA
  Sgcb
ggggagttgatataa

SEQ ID NO: 28348 - DNA, 15 bp, Artificial Sequence
  dgRNA
  Sgcb
tttccgaagaacttg

SEQ ID NO: 28349 - DNA, 15 bp, Artificial Sequence
  dgRNA
  Sgcb
cacccatgcaacccg

SEQ ID NO: 28350 - DNA, 15 bp, Artificial Sequence
  dgRNA
  Sgcb
acccatgcaacccgc

SEQ ID NO: 28351 - DNA, 15 bp, Artificial Sequence
  dgRNA
  Grap2
tcttttctagccccc

SEQ ID NO: 28352 - DNA, 15 bp, Artificial Sequence
  dgRNA
  Grap2
aggcttgctatcaac

SEQ ID NO: 28353 - DNA, 15 bp, Artificial Sequence
  dgRNA
  2310061N02Rik
cttaataaccaaggg

SEQ ID NO: 28354 - DNA, 15 bp, Artificial Sequence
  dgRNA
  2310061N02Rik
ggtattttcgtgtga

SEQ ID NO: 28355 - DNA, 15 bp, Artificial Sequence
  dgRNA
  2310061N02Rik
gtattttcgtgtgaa

SEQ ID NO: 28356 - DNA, 15 bp, Artificial Sequence
  dgRNA
  2310061N02Rik
ttcgtgtgaagggtg

SEQ ID NO: 28357 - DNA, 15 bp, Artificial Sequence
  dgRNA
  Diaph1
cttcccccattggta

SEQ ID NO: 28358 - DNA, 15 bp, Artificial Sequence
  dgRNA
  Diaph1
ttcccccattggtag

SEQ ID NO: 28359 - DNA, 15 bp, Artificial Sequence
  dgRNA
  Diaph1
taggggctgcgggtc

SEQ ID NO: 28360 - DNA, 15 bp, Artificial Sequence
  dgRNA
  Diaph1
ggctgcgggtccggg

SEQ ID NO: 28361 - DNA, 15 bp, Artificial Sequence
  dgRNA
  Ralgps2
ctggggcacgcgcct

SEQ ID NO: 28362 - DNA, 15 bp, Artificial Sequence
  dgRNA
  Ralgps2
acgcgcctcggacac

SEQ ID NO: 28363 - DNA, 15 bp, Artificial Sequence
  dgRNA
  Ralgps2
cctcggacaccggta

SEQ ID NO: 28364 - DNA, 15 bp, Artificial Sequence
  dgRNA
  Ralgps2
ctcggacaccggtac

SEQ ID NO: 28365 - DNA, 15 bp, Artificial Sequence
  dgRNA
  Dync2li1
atcatctggcatcct

SEQ ID NO: 28366 - DNA, 15 bp, Artificial Sequence
  dgRNA
  Dync2li1
ggagaagtaagccga

SEQ ID NO: 28367 - DNA, 15 bp, Artificial Sequence
  dgRNA
  Dync2li1
gaagtaagccgaagg

SEQ ID NO: 28368 - DNA, 15 bp, Artificial Sequence
  dgRNA
  Dync2li1
actacacttcccatg

SEQ ID NO: 28369 - DNA, 15 bp, Artificial Sequence
  dgRNA
  St6gal1
atgacttgtttgatc

SEQ ID NO: 28370 - DNA, 15 bp, Artificial Sequence
  dgRNA
  St6gal1
tccatcgggacacgc

SEQ ID NO: 28371 - DNA, 15 bp, Artificial Sequence
  dgRNA
  St6gal1
ccatcgggacacgca

SEQ ID NO: 28372 - DNA, 15 bp, Artificial Sequence
  dgRNA
  St6gal1
catcgggacacgcag

SEQ ID NO: 28373 - DNA, 15 bp, Artificial Sequence
  dgRNA
  Scgb2b21
atatcaggctgcctc

SEQ ID NO: 28374 - DNA, 15 bp, Artificial Sequence
  dgRNA
  Fbxo48
cgctgtcactcagcg

SEQ ID NO: 28375 - DNA, 15 bp, Artificial Sequence
  dgRNA
  Fbxo48
actcagcggggacgc

SEQ ID NO: 28376 - DNA, 15 bp, Artificial Sequence
  dgRNA
  Fbxo48
acggtgatgaaacgc

SEQ ID NO: 28377 - DNA, 15 bp, Artificial Sequence
  dgRNA
  Fbxo48
cggtgatgaaacgca

SEQ ID NO: 28378 - DNA, 15 bp, Artificial Sequence
  dgRNA
  Olfr1265
tgagtgcactctgta

SEQ ID NO: 28379 - DNA, 15 bp, Artificial Sequence
  dgRNA
  Bcl2l15
gtctaattgtgccaa

SEQ ID NO: 28380 - DNA, 15 bp, Artificial Sequence
  dgRNA
  Bcl2l15
tctaattgtgccaaa

SEQ ID NO: 28381 - DNA, 15 bp, Artificial Sequence
  dgRNA
  Bcl2l15
gttacagaacctagc

SEQ ID NO: 28382 - DNA, 15 bp, Artificial Sequence
  dgRNA
  Bcl2l15
gtagaagactatact

SEQ ID NO: 28383 - DNA, 15 bp, Artificial Sequence
  dgRNA
  Plin4
cggcctgttagtcac

SEQ ID NO: 28384 - DNA, 15 bp, Artificial Sequence
  dgRNA
  Plin4
ggcctgttagtcact

SEQ ID NO: 28385 - DNA, 15 bp, Artificial Sequence
  dgRNA
  Plin4
aggcaccataaacag

SEQ ID NO: 28386 - DNA, 15 bp, Artificial Sequence
  dgRNA
  Plin4
accgcctgtgcgggc

SEQ ID NO: 28387 - DNA, 15 bp, Artificial Sequence
  dgRNA
  Pias3
cgtgtctcccgccgc

SEQ ID NO: 28388 - DNA, 15 bp, Artificial Sequence
  dgRNA
  Pias3
gtgtctcccgccgcc

SEQ ID NO: 28389 - DNA, 15 bp, Artificial Sequence
  dgRNA
  Pias3
ccgggagacttgccc

SEQ ID NO: 28390 - DNA, 15 bp, Artificial Sequence
  dgRNA
  Pias3
cttgccccggccatc

SEQ ID NO: 28391 - DNA, 15 bp, Artificial Sequence
  dgRNA
  Dnajb13
gagtcggcgtatctc

SEQ ID NO: 28392 - DNA, 15 bp, Artificial Sequence
  dgRNA
  Dnajb13
agtcggcgtatctct

SEQ ID NO: 28393 - DNA, 15 bp, Artificial Sequence
  dgRNA
  Dnajb13
acgccgactcggttt

SEQ ID NO: 28394 - DNA, 15 bp, Artificial Sequence
  dgRNA
  Dnajb13
agagatacgccgact

SEQ ID NO: 28395 - DNA, 15 bp, Artificial Sequence
  dgRNA
  Vldlr
cctagccaaggcgcc

SEQ ID NO: 28396 - DNA, 15 bp, Artificial Sequence
  dgRNA
  Vldlr
cggccgcaggttccc

SEQ ID NO: 28397 - DNA, 15 bp, Artificial Sequence
  dgRNA
  Vldlr
attaggacaggcacc

SEQ ID NO: 28398 - DNA, 15 bp, Artificial Sequence
  dgRNA
  Vldlr
ttaggacaggcaccc

SEQ ID NO: 28399 - DNA, 15 bp, Artificial Sequence
  dgRNA
  Eno2
ctgtttccctcgagt

SEQ ID NO: 28400 - DNA, 15 bp, Artificial Sequence
  dgRNA
  Eno2
ttccctcgagttggc

SEQ ID NO: 28401 - DNA, 15 bp, Artificial Sequence
  dgRNA
  Eno2
cgagttggctggaca

SEQ ID NO: 28402 - DNA, 15 bp, Artificial Sequence
  dgRNA
  Eno2
gcatccgtgtgctta

SEQ ID NO: 28403 - DNA, 15 bp, Artificial Sequence
  dgRNA
  Hist1h2bh
gagccctgtaaagtt

SEQ ID NO: 28404 - DNA, 15 bp, Artificial Sequence
  dgRNA
  Hist1h2bh
ggaccgaactttaca

SEQ ID NO: 28405 - DNA, 15 bp, Artificial Sequence
  dgRNA
  Hist1h2bh
cggaccgaactttac

SEQ ID NO: 28406 - DNA, 15 bp, Artificial Sequence
  dgRNA
  Hist1h2bh
agtatcacggagaag

SEQ ID NO: 28407 - DNA, 15 bp, Artificial Sequence
  dgRNA
  Jak1
aagctacttggtaag

SEQ ID NO: 28408 - DNA, 15 bp, Artificial Sequence
  dgRNA
  Jak1
gtaagcggaagcgag

SEQ ID NO: 28409 - DNA, 15 bp, Artificial Sequence
  dgRNA
  Jak1
agcggagacacttgc

SEQ ID NO: 28410 - DNA, 15 bp, Artificial Sequence
  dgRNA
  Jak1
gctggagtgcgagcc

SEQ ID NO: 28411 - DNA, 15 bp, Artificial Sequence
  dgRNA
  1700040L02Rik
tgtaattcgagcagc

SEQ ID NO: 28412 - DNA, 15 bp, Artificial Sequence
  dgRNA
  1700040L02Rik
aattcgagcagcagg

SEQ ID NO: 28413 - DNA, 15 bp, Artificial Sequence
  dgRNA
  1700040L02Rik
acgggctcccgtgag

SEQ ID NO: 28414 - DNA, 15 bp, Artificial Sequence
  dgRNA
  1700040L02Rik
cgggctcccgtgagt

SEQ ID NO: 28415 - DNA, 15 bp, Artificial Sequence
  dgRNA
  Elf5
ctgggtcccctcggt

SEQ ID NO: 28416 - DNA, 15 bp, Artificial Sequence
  dgRNA
  Elf5
ggtcccctcggtggg

SEQ ID NO: 28417 - DNA, 15 bp, Artificial Sequence
  dgRNA
  Elf5
ccctcggtgggtggt

SEQ ID NO: 28418 - DNA, 15 bp, Artificial Sequence
  dgRNA
  Elf5
tgtcaccgtcatcaa

SEQ ID NO: 28419 - DNA, 15 bp, Artificial Sequence
  dgRNA
  Arvcf
ggggttgccaaccct

SEQ ID NO: 28420 - DNA, 15 bp, Artificial Sequence
  dgRNA
  Arvcf
gggttgccaacccta

SEQ ID NO: 28421 - DNA, 15 bp, Artificial Sequence
  dgRNA
  Arvcf
ctagggtgtgatgct

SEQ ID NO: 28422 - DNA, 15 bp, Artificial Sequence
  dgRNA
  Arvcf
ggctggcagcccgtc

SEQ ID NO: 28423 - DNA, 15 bp, Artificial Sequence
  dgRNA
  Pqlc2
gcccagcaccgtagc

SEQ ID NO: 28424 - DNA, 15 bp, Artificial Sequence
  dgRNA
  Pqlc2
agcaccgtagcgggc

SEQ ID NO: 28425 - DNA, 15 bp, Artificial Sequence
  dgRNA
  Pqlc2
cgtagcgggccggag

SEQ ID NO: 28426 - DNA, 15 bp, Artificial Sequence
  dgRNA
  Pqlc2
gtagcgggccggaga

SEQ ID NO: 28427 - DNA, 15 bp, Artificial Sequence
  dgRNA
  Tmem106a
gtacctgaactagtt

SEQ ID NO: 28428 - DNA, 15 bp, Artificial Sequence
  dgRNA
  Tmem106a
gaactagtttggtcc

SEQ ID NO: 28429 - DNA, 15 bp, Artificial Sequence
  dgRNA
  Tmem106a
tgagactcgcagagc

SEQ ID NO: 28430 - DNA, 15 bp, Artificial Sequence
  dgRNA
  Tmem106a
tggacctagatggac

SEQ ID NO: 28431 - DNA, 15 bp, Artificial Sequence
  dgRNA
  Chd3
ctcagacgccggccc

SEQ ID NO: 28432 - DNA, 15 bp, Artificial Sequence
  dgRNA
  Chd3
tcagacgccggcccc

SEQ ID NO: 28433 - DNA, 15 bp, Artificial Sequence
  dgRNA
  Chd3
cagacgccggccccg

SEQ ID NO: 28434 - DNA, 15 bp, Artificial Sequence
  dgRNA
  Chd3
agacgccggccccgg

SEQ ID NO: 28435 - DNA, 15 bp, Artificial Sequence
  dgRNA
  Wapl
cgggctttagacacc

SEQ ID NO: 28436 - DNA, 15 bp, Artificial Sequence
  dgRNA
  Wapl
aactacaactcccgt

SEQ ID NO: 28437 - DNA, 15 bp, Artificial Sequence
  dgRNA
  Wapl
actacaactcccgtc

SEQ ID NO: 28438 - DNA, 15 bp, Artificial Sequence
  dgRNA
  Wapl
tcccgtcgggccacg

SEQ ID NO: 28439 - DNA, 15 bp, Artificial Sequence
  dgRNA
  Tcf7l1
taagttcgaggggta

SEQ ID NO: 28440 - DNA, 15 bp, Artificial Sequence
  dgRNA
  Tcf7l1
gttcgaggggtaggg

SEQ ID NO: 28441 - DNA, 15 bp, Artificial Sequence
  dgRNA
  Tcf7l1
tagggtggtcgcacg

SEQ ID NO: 28442 - DNA, 15 bp, Artificial Sequence
  dgRNA
  Tcf7l1
ggtggtcgcacgagg

SEQ ID NO: 28443 - DNA, 15 bp, Artificial Sequence
  dgRNA
  Car15
aggctgatgtggacc

SEQ ID NO: 28444 - DNA, 15 bp, Artificial Sequence
  dgRNA
  Car15
acctggacttggaac

SEQ ID NO: 28445 - DNA, 15 bp, Artificial Sequence
  dgRNA
  Car15
ggacttggaacgggt

SEQ ID NO: 28446 - DNA, 15 bp, Artificial Sequence
  dgRNA
  Car15
tcctagcctaagtct

SEQ ID NO: 28447 - DNA, 15 bp, Artificial Sequence
  dgRNA
  Mrpl46
acctacctcccccaa

SEQ ID NO: 28448 - DNA, 15 bp, Artificial Sequence
  dgRNA
  Mrpl46
aaacccgcccctcgc

SEQ ID NO: 28449 - DNA, 15 bp, Artificial Sequence
  dgRNA
  Mrpl46
tagaccactagaaag

SEQ ID NO: 28450 - DNA, 15 bp, Artificial Sequence
  dgRNA
  Mrpl46
ttagaccactagaaa

SEQ ID NO: 28451 - DNA, 15 bp, Artificial Sequence
  dgRNA
  Zfp85
tggattgtatgtaac

SEQ ID NO: 28452 - DNA, 15 bp, Artificial Sequence
  dgRNA
  Zfp85
agaatttaaagcgca

SEQ ID NO: 28453 - DNA, 15 bp, Artificial Sequence
  dgRNA
  Zfp85
acccggaaccaaaga

SEQ ID NO: 28454 - DNA, 15 bp, Artificial Sequence
  dgRNA
  Zfp85
acgcgaaggactacc

SEQ ID NO: 28455 - DNA, 15 bp, Artificial Sequence
  dgRNA
  Ocel1
attttcccaatagac

SEQ ID NO: 28456 - DNA, 15 bp, Artificial Sequence
  dgRNA
  Ocel1
gattccaacccagag

SEQ ID NO: 28457 - DNA, 15 bp, Artificial Sequence
  dgRNA
  Ocel1
ttaccccagtctatt

SEQ ID NO: 28458 - DNA, 15 bp, Artificial Sequence
  dgRNA
  Ocel1
tttaccccagtctat

SEQ ID NO: 28459 - DNA, 15 bp, Artificial Sequence
  dgRNA
  Camk2b
atgcgaggggagccg

SEQ ID NO: 28460 - DNA, 15 bp, Artificial Sequence
  dgRNA
  Camk2b
ggggagccgcggtgc

SEQ ID NO: 28461 - DNA, 15 bp, Artificial Sequence
  dgRNA
  Camk2b
ccgcggtgcgggtgc

SEQ ID NO: 28462 - DNA, 15 bp, Artificial Sequence
  dgRNA
  Camk2b
cgcggtgcgggtgca

SEQ ID NO: 28463 - DNA, 15 bp, Artificial Sequence
  dgRNA
  Sh3rf2
gggccctccactcag

SEQ ID NO: 28464 - DNA, 15 bp, Artificial Sequence
  dgRNA
  Sh3rf2
gtcatttgacgctcc

SEQ ID NO: 28465 - DNA, 15 bp, Artificial Sequence
  dgRNA
  Sh3rf2
tggagggccctagca

SEQ ID NO: 28466 - DNA, 15 bp, Artificial Sequence
  dgRNA
  Sh3rf2
ctgcaagggatcaga

SEQ ID NO: 28467 - DNA, 15 bp, Artificial Sequence
  dgRNA
  1810024B03Rik
ttcagcgaaccgccc

SEQ ID NO: 28468 - DNA, 15 bp, Artificial Sequence
  dgRNA
  1810024B03Rik
ccgccctggcacaac

SEQ ID NO: 28469 - DNA, 15 bp, Artificial Sequence
  dgRNA
  1810024B03Rik
caacaggtacaacgc

SEQ ID NO: 28470 - DNA, 15 bp, Artificial Sequence
  dgRNA
  1810024B03Rik
cgcaggacgaacgta

SEQ ID NO: 28471 - DNA, 15 bp, Artificial Sequence
  dgRNA
  Aacs
gttgtgcaataagtg

SEQ ID NO: 28472 - DNA, 15 bp, Artificial Sequence
  dgRNA
  Aacs
ttgtgcaataagtga

SEQ ID NO: 28473 - DNA, 15 bp, Artificial Sequence
  dgRNA
  Aacs
caataagtgagggcg

SEQ ID NO: 28474 - DNA, 15 bp, Artificial Sequence
  dgRNA
  Aacs
ttatcgcgcctgcgc

SEQ ID NO: 28475 - DNA, 15 bp, Artificial Sequence
  dgRNA
  1700028K03Rik
cccgcacaaccttct

SEQ ID NO: 28476 - DNA, 15 bp, Artificial Sequence
  dgRNA
  1700028K03Rik
gtctttagtcagagc

SEQ ID NO: 28477 - DNA, 15 bp, Artificial Sequence
  dgRNA
  1700028K03Rik
ggggttcattgacta

SEQ ID NO: 28478 - DNA, 15 bp, Artificial Sequence
  dgRNA
  1700028K03Rik
aaggttgtgcgggag

SEQ ID NO: 28479 - DNA, 15 bp, Artificial Sequence
  dgRNA
  Khk
gctctagtacatgtt

SEQ ID NO: 28480 - DNA, 15 bp, Artificial Sequence
  dgRNA
  Khk
ctagtacatgtttgg

SEQ ID NO: 28481 - DNA, 15 bp, Artificial Sequence
  dgRNA
  Khk
gttaagggacaggac

SEQ ID NO: 28482 - DNA, 15 bp, Artificial Sequence
  dgRNA
  Khk
acagagttctacgga

SEQ ID NO: 28483 - DNA, 15 bp, Artificial Sequence
  dgRNA
  Nrcam
tcctcaaggcgctca

SEQ ID NO: 28484 - DNA, 15 bp, Artificial Sequence
  dgRNA
  Nrcam
caaggcgctcaaggc

SEQ ID NO: 28485 - DNA, 15 bp, Artificial Sequence
  dgRNA
  Nrcam
gcctaagctgtgggt

SEQ ID NO: 28486 - DNA, 15 bp, Artificial Sequence
  dgRNA
  Nrcam
agggggttaggccgg

SEQ ID NO: 28487 - DNA, 15 bp, Artificial Sequence
  dgRNA
  Sec23b
gaagcgctctctgat

SEQ ID NO: 28488 - DNA, 15 bp, Artificial Sequence
  dgRNA
  Sec23b
tgattggctagagca

SEQ ID NO: 28489 - DNA, 15 bp, Artificial Sequence
  dgRNA
  Sec23b
cgcgaaatgacgttt

SEQ ID NO: 28490 - DNA, 15 bp, Artificial Sequence
  dgRNA
  Sec23b
aatgacgtttcggag

SEQ ID NO: 28491 - DNA, 15 bp, Artificial Sequence
  dgRNA
  Ucp1
ctggtgccaaatcag

SEQ ID NO: 28492 - DNA, 15 bp, Artificial Sequence
  dgRNA
  Ucp1
tttgggagtgacgcg

SEQ ID NO: 28493 - DNA, 15 bp, Artificial Sequence
  dgRNA
  Ucp1
ggagtgacgcgcggc

SEQ ID NO: 28494 - DNA, 15 bp, Artificial Sequence
  dgRNA
  Ucp1
gagtgacgcgcggct

SEQ ID NO: 28495 - DNA, 15 bp, Artificial Sequence
  dgRNA
  Rnf122
tctggctaggaggcg

SEQ ID NO: 28496 - DNA, 15 bp, Artificial Sequence
  dgRNA
  Rnf122
agctcccctgtccag

SEQ ID NO: 28497 - DNA, 15 bp, Artificial Sequence
  dgRNA
  Rnf122
tgtaaataatacccc

SEQ ID NO: 28498 - DNA, 15 bp, Artificial Sequence
  dgRNA
  Rnf122
ataataccccagggc

SEQ ID NO: 28499 - DNA, 15 bp, Artificial Sequence
  dgRNA
  Ackr4
aaggttatttaggcc

SEQ ID NO: 28500 - DNA, 15 bp, Artificial Sequence
  dgRNA
  Ackr4
ggttatttaggcctg

SEQ ID NO: 28501 - DNA, 15 bp, Artificial Sequence
  dgRNA
  Ackr4
gtgaatagacacccc

SEQ ID NO: 28502 - DNA, 15 bp, Artificial Sequence
  dgRNA
  Cxxc4
cgggccgaggtgagc

SEQ ID NO: 28503 - DNA, 15 bp, Artificial Sequence
  dgRNA
  Cxxc4
gcggtgcggagccgg

SEQ ID NO: 28504 - DNA, 15 bp, Artificial Sequence
  dgRNA
  Cxxc4
ggcggtgcggagccg

SEQ ID NO: 28505 - DNA, 15 bp, Artificial Sequence
  dgRNA
  Cxxc4
aggcggtgcggagcc

SEQ ID NO: 28506 - DNA, 15 bp, Artificial Sequence
  dgRNA
  Mfap5
ataacctttggaatg

SEQ ID NO: 28507 - DNA, 15 bp, Artificial Sequence
  dgRNA
  Mfap5
aggttatgaccacac

SEQ ID NO: 28508 - DNA, 15 bp, Artificial Sequence
  dgRNA
  Mfap5
gtgttacaataaggc

SEQ ID NO: 28509 - DNA, 15 bp, Artificial Sequence
  dgRNA
  Mfap5
agcagtgttacaata

SEQ ID NO: 28510 - DNA, 15 bp, Artificial Sequence
  dgRNA
  Kcnj12
ccgcctccctgagaa

SEQ ID NO: 28511 - DNA, 15 bp, Artificial Sequence
  dgRNA
  Kcnj12
cctgagaacggtcgc

SEQ ID NO: 28512 - DNA, 15 bp, Artificial Sequence
  dgRNA
  Kcnj12
ctgagaacggtcgcc

SEQ ID NO: 28513 - DNA, 15 bp, Artificial Sequence
  dgRNA
  Kcnj12
tgagaacggtcgccg

SEQ ID NO: 28514 - DNA, 15 bp, Artificial Sequence
  dgRNA
  Hkdc1
agacaatcgagtgtg

SEQ ID NO: 28515 - DNA, 15 bp, Artificial Sequence
  dgRNA
  Hkdc1
caatcgagtgtgtgg

SEQ ID NO: 28516 - DNA, 15 bp, Artificial Sequence
  dgRNA
  Hkdc1
tcgagtgtgtggcgg

SEQ ID NO: 28517 - DNA, 15 bp, Artificial Sequence
  dgRNA
  Hkdc1
cgagtgtgtggcgga

SEQ ID NO: 28518 - DNA, 15 bp, Artificial Sequence
  dgRNA
  Ppp2r5e
ctcagccgaacgtgc

SEQ ID NO: 28519 - DNA, 15 bp, Artificial Sequence
  dgRNA
  Ppp2r5e
ccgaacgtgctggcc

SEQ ID NO: 28520 - DNA, 15 bp, Artificial Sequence
  dgRNA
  Ppp2r5e
cgaacgtgctggcct

SEQ ID NO: 28521 - DNA, 15 bp, Artificial Sequence
  dgRNA
  Ppp2r5e
agtgaaggcgcgcgc

SEQ ID NO: 28522 - DNA, 15 bp, Artificial Sequence
  dgRNA
  Wnt7a
ccgccgcgagctcgg

SEQ ID NO: 28523 - DNA, 15 bp, Artificial Sequence
  dgRNA
  Wnt7a
ctcggaggagcgccg

SEQ ID NO: 28524 - DNA, 15 bp, Artificial Sequence
  dgRNA
  Wnt7a
tcggaggagcgccgc

SEQ ID NO: 28525 - DNA, 15 bp, Artificial Sequence
  dgRNA
  Wnt7a
gacatcctcgacccg

SEQ ID NO: 28526 - DNA, 15 bp, Artificial Sequence
  dgRNA
  Nr5a1
cacctgaccggattc

SEQ ID NO: 28527 - DNA, 15 bp, Artificial Sequence
  dgRNA
  Nr5a1
acctgaccggattcc

SEQ ID NO: 28528 - DNA, 15 bp, Artificial Sequence
  dgRNA
  Nr5a1
cctgaccggattccg

SEQ ID NO: 28529 - DNA, 15 bp, Artificial Sequence
  dgRNA
  Nr5a1
ctgaccggattccgg

SEQ ID NO: 28530 - DNA, 15 bp, Artificial Sequence
  dgRNA
  Npvf
ggagacttcataatg

SEQ ID NO: 28531 - DNA, 15 bp, Artificial Sequence
  dgRNA
  Npvf
gtgcttaattcattc

SEQ ID NO: 28532 - DNA, 15 bp, Artificial Sequence
  dgRNA
  Afg3l1
ccgccatcagctgtc

SEQ ID NO: 28533 - DNA, 15 bp, Artificial Sequence
  dgRNA
  Afg3l1
gcgcgaagcgacact

SEQ ID NO: 28534 - DNA, 15 bp, Artificial Sequence
  dgRNA
  Afg3l1
cgcgaagcgacactc

SEQ ID NO: 28535 - DNA, 15 bp, Artificial Sequence
  dgRNA
  Afg3l1
ggatcctaaggagca

SEQ ID NO: 28536 - DNA, 15 bp, Artificial Sequence
  dgRNA
  Igf2bp3
tggcgccggctgcag

SEQ ID NO: 28537 - DNA, 15 bp, Artificial Sequence
  dgRNA
  Igf2bp3
ctctaattgaggcgc

SEQ ID NO: 28538 - DNA, 15 bp, Artificial Sequence
  dgRNA
  Igf2bp3
tctaattgaggcgct

SEQ ID NO: 28539 - DNA, 15 bp, Artificial Sequence
  dgRNA
  Igf2bp3
ggcgccaggcgcgat

SEQ ID NO: 28540 - DNA, 15 bp, Artificial Sequence
  dgRNA
  Apoa4
taactcctttgatcc

SEQ ID NO: 28541 - DNA, 15 bp, Artificial Sequence
  dgRNA
  Apoa4
ggagttaatcatagt

SEQ ID NO: 28542 - DNA, 15 bp, Artificial Sequence
  dgRNA
  Apoa4
gtgatacccttggtc

SEQ ID NO: 28543 - DNA, 15 bp, Artificial Sequence
  dgRNA
  Scnm1
cgcgcgacgcaagcg

SEQ ID NO: 28544 - DNA, 15 bp, Artificial Sequence
  dgRNA
  Scnm1
ttgcgtcgcgcgaac

SEQ ID NO: 28545 - DNA, 15 bp, Artificial Sequence
  dgRNA
  Fcho2
ctccctgttgaccaa

SEQ ID NO: 28546 - DNA, 15 bp, Artificial Sequence
  dgRNA
  Fcho2
tagtcccagtctgcc

SEQ ID NO: 28547 - DNA, 15 bp, Artificial Sequence
  dgRNA
  Fcho2
gctggagatcctaga

SEQ ID NO: 28548 - DNA, 15 bp, Artificial Sequence
  dgRNA
  Fcho2
aggacgctggacgcg

SEQ ID NO: 28549 - DNA, 15 bp, Artificial Sequence
  dgRNA
  Olfr1259
gacctatagagtttt

SEQ ID NO: 28550 - DNA, 15 bp, Artificial Sequence
  dgRNA
  Olfr1259
gtctaaccttctctt

SEQ ID NO: 28551 - DNA, 15 bp, Artificial Sequence
  dgRNA
  Cdh4
ttcgtctgctcatac

SEQ ID NO: 28552 - DNA, 15 bp, Artificial Sequence
  dgRNA
  Cdh4
ctctagttgtcccac

SEQ ID NO: 28553 - DNA, 15 bp, Artificial Sequence
  dgRNA
  Cdh4
tgccagcgagcaacc

SEQ ID NO: 28554 - DNA, 15 bp, Artificial Sequence
  dgRNA
  Cdh4
aagcggctgagcgag

SEQ ID NO: 28555 - DNA, 15 bp, Artificial Sequence
  dgRNA
  Olfr17
attgtactctaaata

SEQ ID NO: 28556 - DNA, 15 bp, Artificial Sequence
  dgRNA
  Olfr17
cattgtactctaaat

SEQ ID NO: 28557 - DNA, 15 bp, Artificial Sequence
  dgRNA
  Olfr17
gggcattcaagattc

SEQ ID NO: 28558 - DNA, 15 bp, Artificial Sequence
  dgRNA
  Olfr557
attagtactcagttt

SEQ ID NO: 28559 - DNA, 15 bp, Artificial Sequence
  dgRNA
  Ostf1
tagcctcccctacgc

SEQ ID NO: 28560 - DNA, 15 bp, Artificial Sequence
  dgRNA
  Ostf1
agcctcccctacgca

SEQ ID NO: 28561 - DNA, 15 bp, Artificial Sequence
  dgRNA
  Ostf1
cctacgcagggcctg

SEQ ID NO: 28562 - DNA, 15 bp, Artificial Sequence
  dgRNA
  Ostf1
ctacgcagggcctga

SEQ ID NO: 28563 - DNA, 15 bp, Artificial Sequence
  dgRNA
  D2Wsu81e
gagccttactgggtt

SEQ ID NO: 28564 - DNA, 15 bp, Artificial Sequence
  dgRNA
  D2Wsu81e
gcgaactcgttgccc

SEQ ID NO: 28565 - DNA, 15 bp, Artificial Sequence
  dgRNA
  D2Wsu81e
ctccgcactcgcacg

SEQ ID NO: 28566 - DNA, 15 bp, Artificial Sequence
  dgRNA
  D2Wsu81e
cgccccactctccgc

SEQ ID NO: 28567 - DNA, 15 bp, Artificial Sequence
  dgRNA
  Mtf1
acagcccgctctcta

SEQ ID NO: 28568 - DNA, 15 bp, Artificial Sequence
  dgRNA
  Mtf1
ttcccggtgcggcac

SEQ ID NO: 28569 - DNA, 15 bp, Artificial Sequence
  dgRNA
  Mtf1
ccgcccacagcccgc

SEQ ID NO: 28570 - DNA, 15 bp, Artificial Sequence
  dgRNA
  Mtf1
cgcccacagcccgct

SEQ ID NO: 28571 - DNA, 15 bp, Artificial Sequence
  dgRNA
  Zfp712
taccctgactccccg

SEQ ID NO: 28572 - DNA, 15 bp, Artificial Sequence
  dgRNA
  Zfp712
agcctgacagtaact

SEQ ID NO: 28573 - DNA, 15 bp, Artificial Sequence
  dgRNA
  Zfp712
gcctgacagtaactt

SEQ ID NO: 28574 - DNA, 15 bp, Artificial Sequence
  dgRNA
  Zfp712
tcaaatcacctacca

SEQ ID NO: 28575 - DNA, 15 bp, Artificial Sequence
  dgRNA
  Hoxa7
ggggtctgattgcgt

SEQ ID NO: 28576 - DNA, 15 bp, Artificial Sequence
  dgRNA
  Hoxa7
gggtctgattgcgtc

SEQ ID NO: 28577 - DNA, 15 bp, Artificial Sequence
  dgRNA
  Hoxa7
ttgcgtcgggcgccc

SEQ ID NO: 28578 - DNA, 15 bp, Artificial Sequence
  dgRNA
  Hoxa7
cagcccggtgcaggc

SEQ ID NO: 28579 - DNA, 15 bp, Artificial Sequence
  dgRNA
  Olfr49
accagcctgatgaac

SEQ ID NO: 28580 - DNA, 15 bp, Artificial Sequence
  dgRNA
  Olfr49
atgaacaggacgcta

SEQ ID NO: 28581 - DNA, 15 bp, Artificial Sequence
  dgRNA
  Olfr49
actttacaaaattcg

SEQ ID NO: 28582 - DNA, 15 bp, Artificial Sequence
  dgRNA
  Olfr49
agcgtcctgttcatc

SEQ ID NO: 28583 - DNA, 15 bp, Artificial Sequence
  dgRNA
  Gm13757
aatactattgccctc

SEQ ID NO: 28584 - DNA, 15 bp, Artificial Sequence
  dgRNA
  Gm13757
gatatgagacataaa

SEQ ID NO: 28585 - DNA, 15 bp, Artificial Sequence
  dgRNA
  Gm13757
ggagggtcttgattc

SEQ ID NO: 28586 - DNA, 15 bp, Artificial Sequence
  dgRNA
  Wfdc17
tgttacaccacatct

SEQ ID NO: 28587 - DNA, 15 bp, Artificial Sequence
  dgRNA
  Wfdc17
tgacttctctctaat

SEQ ID NO: 28588 - DNA, 15 bp, Artificial Sequence
  dgRNA
  Ctc1
atcccatctagtctg

SEQ ID NO: 28589 - DNA, 15 bp, Artificial Sequence
  dgRNA
  Ctc1
ctgcttgacaagatc

SEQ ID NO: 28590 - DNA, 15 bp, Artificial Sequence
  dgRNA
  Ctc1
tgcttgacaagatca

SEQ ID NO: 28591 - DNA, 15 bp, Artificial Sequence
  dgRNA
  Ctc1
gactgtgcgctcgag

SEQ ID NO: 28592 - DNA, 15 bp, Artificial Sequence
  dgRNA
  Vps53
gcccgggcgacacta

SEQ ID NO: 28593 - DNA, 15 bp, Artificial Sequence
  dgRNA
  Vps53
gcgacactacggcgc

SEQ ID NO: 28594 - DNA, 15 bp, Artificial Sequence
  dgRNA
  Vps53
acactacggcgctgg

SEQ ID NO: 28595 - DNA, 15 bp, Artificial Sequence
  dgRNA
  Vps53
cactacggcgctggt

SEQ ID NO: 28596 - DNA, 15 bp, Artificial Sequence
  dgRNA
  Slc6a15
gtggactctgcgtca

SEQ ID NO: 28597 - DNA, 15 bp, Artificial Sequence
  dgRNA
  Slc6a15
tggactctgcgtcat

SEQ ID NO: 28598 - DNA, 15 bp, Artificial Sequence
  dgRNA
  Slc6a15
ctgcgtcatgggtga

SEQ ID NO: 28599 - DNA, 15 bp, Artificial Sequence
  dgRNA
  Slc6a15
tgcgtcatgggtgat

SEQ ID NO: 28600 - DNA, 15 bp, Artificial Sequence
  dgRNA
  Gnpda1
ctgaggcctacgccc

SEQ ID NO: 28601 - DNA, 15 bp, Artificial Sequence
  dgRNA
  Gnpda1
ccggcatcttgtttc

SEQ ID NO: 28602 - DNA, 15 bp, Artificial Sequence
  dgRNA
  Gnpda1
cggcatcttgtttca

SEQ ID NO: 28603 - DNA, 15 bp, Artificial Sequence
  dgRNA
  Gnpda1
ctgtgcaccccacgc

SEQ ID NO: 28604 - DNA, 15 bp, Artificial Sequence
  dgRNA
  Tmem57
cccggccacgcgtct

SEQ ID NO: 28605 - DNA, 15 bp, Artificial Sequence
  dgRNA
  Tmem57
aggccttatcctgat

SEQ ID NO: 28606 - DNA, 15 bp, Artificial Sequence
  dgRNA
  Tmem57
gtccttcaaaaaggc

SEQ ID NO: 28607 - DNA, 15 bp, Artificial Sequence
  dgRNA
  Tmem57
aaaaaggcgggctta

SEQ ID NO: 28608 - DNA, 15 bp, Artificial Sequence
  dgRNA
  5830473C10Rik
cgagatactgtagac

SEQ ID NO: 28609 - DNA, 15 bp, Artificial Sequence
  dgRNA
  5830473C10Rik
tggcatttaccaaac

SEQ ID NO: 28610 - DNA, 15 bp, Artificial Sequence
  dgRNA
  5830473C10Rik
tcgtttgctagcacg

SEQ ID NO: 28611 - DNA, 15 bp, Artificial Sequence
  dgRNA
  5830473C10Rik
aacgatgcacctgtt

SEQ ID NO: 28612 - DNA, 15 bp, Artificial Sequence
  dgRNA
  Nt5c2
aacgtgcatcaccct

SEQ ID NO: 28613 - DNA, 15 bp, Artificial Sequence
  dgRNA
  Nt5c2
ggagtttagcagctc

SEQ ID NO: 28614 - DNA, 15 bp, Artificial Sequence
  dgRNA
  Nt5c2
ccccgagccctgtga

SEQ ID NO: 28615 - DNA, 15 bp, Artificial Sequence
  dgRNA
  Nt5c2
cccgagccctgtgag

SEQ ID NO: 28616 - DNA, 15 bp, Artificial Sequence
  dgRNA
  Tnfaip8
agaccccgccctaat

SEQ ID NO: 28617 - DNA, 15 bp, Artificial Sequence
  dgRNA
  Tnfaip8
ccccgccctaatagg

SEQ ID NO: 28618 - DNA, 15 bp, Artificial Sequence
  dgRNA
  Tnfaip8
cttcgtccagcagtc

SEQ ID NO: 28619 - DNA, 15 bp, Artificial Sequence
  dgRNA
  Tnfaip8
ctggcggcagagacc

SEQ ID NO: 28620 - DNA, 15 bp, Artificial Sequence
  dgRNA
  Olfr1211
ctaagtaaattgaac

SEQ ID NO: 28621 - DNA, 15 bp, Artificial Sequence
  dgRNA
  Olfr1211
aacaagttagggtag

SEQ ID NO: 28622 - DNA, 15 bp, Artificial Sequence
  dgRNA
  Olfr1211
gttatcaacaagtta

SEQ ID NO: 28623 - DNA, 15 bp, Artificial Sequence
  dgRNA
  Olfr1211
tgttatcaacaagtt

SEQ ID NO: 28624 - DNA, 15 bp, Artificial Sequence
  dgRNA
  Nup54
acccccggaagtgat

SEQ ID NO: 28625 - DNA, 15 bp, Artificial Sequence
  dgRNA
  Nup54
cccggaagtgatcgg

SEQ ID NO: 28626 - DNA, 15 bp, Artificial Sequence
  dgRNA
  Nup54
gaagtgatcggtggt

SEQ ID NO: 28627 - DNA, 15 bp, Artificial Sequence
  dgRNA
  Nup54
acatggggtgttgta

SEQ ID NO: 28628 - DNA, 15 bp, Artificial Sequence
  dgRNA
  Lta
tctccacgaattgct

SEQ ID NO: 28629 - DNA, 15 bp, Artificial Sequence
  dgRNA
  Lta
tgctcggccgttcac

SEQ ID NO: 28630 - DNA, 15 bp, Artificial Sequence
  dgRNA
  Lta
cccttgactgctcac

SEQ ID NO: 28631 - DNA, 15 bp, Artificial Sequence
  dgRNA
  Lta
agcaattcgtggaga

SEQ ID NO: 28632 - DNA, 15 bp, Artificial Sequence
  dgRNA
  Hlx
ccgcagaaaacactt

SEQ ID NO: 28633 - DNA, 15 bp, Artificial Sequence
  dgRNA
  Hlx
gaaaacactttggcg

SEQ ID NO: 28634 - DNA, 15 bp, Artificial Sequence
  dgRNA
  Hlx
cactttggcgtggcc

SEQ ID NO: 28635 - DNA, 15 bp, Artificial Sequence
  dgRNA
  Hlx
actttggcgtggcca

SEQ ID NO: 28636 - DNA, 15 bp, Artificial Sequence
  dgRNA
  Cox6b2
acgcgctcttgtgcg

SEQ ID NO: 28637 - DNA, 15 bp, Artificial Sequence
  dgRNA
  Cox6b2
tgcgcggttctcaca

SEQ ID NO: 28638 - DNA, 15 bp, Artificial Sequence
  dgRNA
  Cox6b2
gcgcggttctcacaa

SEQ ID NO: 28639 - DNA, 15 bp, Artificial Sequence
  dgRNA
  Cox6b2
ctacaagaaccaagg

SEQ ID NO: 28640 - DNA, 15 bp, Artificial Sequence
  dgRNA
  Rbfa
aataaaaattccggg

SEQ ID NO: 28641 - DNA, 15 bp, Artificial Sequence
  dgRNA
  Rbfa
aaattccgggtggtt

SEQ ID NO: 28642 - DNA, 15 bp, Artificial Sequence
  dgRNA
  Rbfa
aattccgggtggttt

SEQ ID NO: 28643 - DNA, 15 bp, Artificial Sequence
  dgRNA
  Rbfa
tagccacgcccatgc

SEQ ID NO: 28644 - DNA, 15 bp, Artificial Sequence
  dgRNA
  Ctbp1
ggcgggtacagctgg

SEQ ID NO: 28645 - DNA, 15 bp, Artificial Sequence
  dgRNA
  Ctbp1
gctgggggcgtgtcc

SEQ ID NO: 28646 - DNA, 15 bp, Artificial Sequence
  dgRNA
  Ctbp1
gtgggggccgagcgt

SEQ ID NO: 28647 - DNA, 15 bp, Artificial Sequence
  dgRNA
  Ctbp1
tgggggccgagcgtc

SEQ ID NO: 28648 - DNA, 15 bp, Artificial Sequence
  dgRNA
  Lrrc14
cttagccaatgagag

SEQ ID NO: 28649 - DNA, 15 bp, Artificial Sequence
  dgRNA
  Lrrc14
aatgagagcggccgc

SEQ ID NO: 28650 - DNA, 15 bp, Artificial Sequence
  dgRNA
  Lrrc14
atgagagcggccgcc

SEQ ID NO: 28651 - DNA, 15 bp, Artificial Sequence
  dgRNA
  Lrrc14
agagcggccgccggg

SEQ ID NO: 28652 - DNA, 15 bp, Artificial Sequence
  dgRNA
  Olfr606
gattagaatggcgaa

SEQ ID NO: 28653 - DNA, 15 bp, Artificial Sequence
  dgRNA
  Olfr606
gagtaacagtggact

SEQ ID NO: 28654 - DNA, 15 bp, Artificial Sequence
  dgRNA
  Olfr606
ggcatttacaagtcc

SEQ ID NO: 28655 - DNA, 15 bp, Artificial Sequence
  dgRNA
  Olfr606
tgttactctctagtg

SEQ ID NO: 28656 - DNA, 15 bp, Artificial Sequence
  dgRNA
  Tmem139
gatttgagtaggccg

SEQ ID NO: 28657 - DNA, 15 bp, Artificial Sequence
  dgRNA
  Tmem139
aagtaattccaactc

SEQ ID NO: 28658 - DNA, 15 bp, Artificial Sequence
  dgRNA
  Tmem139
aaagaccatcgggag

SEQ ID NO: 28659 - DNA, 15 bp, Artificial Sequence
  dgRNA
  Tmem139
aagaccatcgggagt

SEQ ID NO: 28660 - DNA, 15 bp, Artificial Sequence
  dgRNA
  Rnf214
ccctcgggctccgct

SEQ ID NO: 28661 - DNA, 15 bp, Artificial Sequence
  dgRNA
  Rnf214
cctcgggctccgctt

SEQ ID NO: 28662 - DNA, 15 bp, Artificial Sequence
  dgRNA
  Rnf214
ctccgcttgggtctc

SEQ ID NO: 28663 - DNA, 15 bp, Artificial Sequence
  dgRNA
  Rnf214
tccgcttgggtctca

SEQ ID NO: 28664 - DNA, 15 bp, Artificial Sequence
  dgRNA
  Sbk3
tcctcgagaccaccg

SEQ ID NO: 28665 - DNA, 15 bp, Artificial Sequence
  dgRNA
  Sbk3
cgagaccaccgagga

SEQ ID NO: 28666 - DNA, 15 bp, Artificial Sequence
  dgRNA
  Sbk3
gagaccaccgaggat

SEQ ID NO: 28667 - DNA, 15 bp, Artificial Sequence
  dgRNA
  Sbk3
agaccaccgaggatg

SEQ ID NO: 28668 - DNA, 15 bp, Artificial Sequence
  dgRNA
  Wtap
gggcggggcgcagtc

SEQ ID NO: 28669 - DNA, 15 bp, Artificial Sequence
  dgRNA
  Wtap
ggggcgcagtccggg

SEQ ID NO: 28670 - DNA, 15 bp, Artificial Sequence
  dgRNA
  Wtap
gggcgcagtccgggc

SEQ ID NO: 28671 - DNA, 15 bp, Artificial Sequence
  dgRNA
  Wtap
ggcgcagtccgggcg

SEQ ID NO: 28672 - DNA, 15 bp, Artificial Sequence
  dgRNA
  Abcc1
agtgcggggttcttc

SEQ ID NO: 28673 - DNA, 15 bp, Artificial Sequence
  dgRNA
  Abcc1
gtgcggggttcttcc

SEQ ID NO: 28674 - DNA, 15 bp, Artificial Sequence
  dgRNA
  Abcc1
tcttccgggccgtgt

SEQ ID NO: 28675 - DNA, 15 bp, Artificial Sequence
  dgRNA
  Abcc1
ggccgtgtcggcttt

SEQ ID NO: 28676 - DNA, 15 bp, Artificial Sequence
  dgRNA
  Asah2
gacctttagtctaac

SEQ ID NO: 28677 - DNA, 15 bp, Artificial Sequence
  dgRNA
  Asah2
taacaggccttctgc

SEQ ID NO: 28678 - DNA, 15 bp, Artificial Sequence
  dgRNA
  Asah2
ggcctgttagactaa

SEQ ID NO: 28679 - DNA, 15 bp, Artificial Sequence
  dgRNA
  Nebl
tgggtaggcgcgcgc

SEQ ID NO: 28680 - DNA, 15 bp, Artificial Sequence
  dgRNA
  Nebl
gtaggcgcgcgctgg

SEQ ID NO: 28681 - DNA, 15 bp, Artificial Sequence
  dgRNA
  Nebl
taggcgcgcgctggt

SEQ ID NO: 28682 - DNA, 15 bp, Artificial Sequence
  dgRNA
  Nebl
gcgcgctggtgggtt

SEQ ID NO: 28683 - DNA, 15 bp, Artificial Sequence
  dgRNA
  Tdrd7
agagaacgaactttg

SEQ ID NO: 28684 - DNA, 15 bp, Artificial Sequence
  dgRNA
  Tdrd7
cacaccccgagcgtc

SEQ ID NO: 28685 - DNA, 15 bp, Artificial Sequence
  dgRNA
  Tdrd7
ccccgagcgtcagga

SEQ ID NO: 28686 - DNA, 15 bp, Artificial Sequence
  dgRNA
  Tdrd7
cgcgcagaaaccgct

SEQ ID NO: 28687 - DNA, 15 bp, Artificial Sequence
  dgRNA
  Ldah
gagcgggtaaaattc

SEQ ID NO: 28688 - DNA, 15 bp, Artificial Sequence
  dgRNA
  Ldah
cgggtaaaattcagg

SEQ ID NO: 28689 - DNA, 15 bp, Artificial Sequence
  dgRNA
  Ldah
ttgcaaagcgttcta

SEQ ID NO: 28690 - DNA, 15 bp, Artificial Sequence
  dgRNA
  Ldah
tgcaaagcgttctac

SEQ ID NO: 28691 - DNA, 15 bp, Artificial Sequence
  dgRNA
  Rnh1
agccccatgcatcag

SEQ ID NO: 28692 - DNA, 15 bp, Artificial Sequence
  dgRNA
  Rnh1
ccaagccctatcccc

SEQ ID NO: 28693 - DNA, 15 bp, Artificial Sequence
  dgRNA
  Rnh1
acctggtcggcctgt

SEQ ID NO: 28694 - DNA, 15 bp, Artificial Sequence
  dgRNA
  Rnh1
gagcctctgatgcat

SEQ ID NO: 28695 - DNA, 15 bp, Artificial Sequence
  dgRNA
  Psg29
cctcaatgtgttgct

SEQ ID NO: 28696 - DNA, 15 bp, Artificial Sequence
  dgRNA
  Psg29
ccaagcaacacattg

SEQ ID NO: 28697 - DNA, 15 bp, Artificial Sequence
  dgRNA
  Ndn
tgttagcatgatagt

SEQ ID NO: 28698 - DNA, 15 bp, Artificial Sequence
  dgRNA
  Cask
tcgggctcgggagcc

SEQ ID NO: 28699 - DNA, 15 bp, Artificial Sequence
  dgRNA
  Cask
cctcccacactcggg

SEQ ID NO: 28700 - DNA, 15 bp, Artificial Sequence
  dgRNA
  Cask
ctcccacactcggga

SEQ ID NO: 28701 - DNA, 15 bp, Artificial Sequence
  dgRNA
  Cask
cactcgggagggcgg

SEQ ID NO: 28702 - DNA, 15 bp, Artificial Sequence
  dgRNA
  Olfr594
catgcaatagtcttc

SEQ ID NO: 28703 - DNA, 15 bp, Artificial Sequence
  dgRNA
  Prl8a6
gtaggaacacgcaaa

SEQ ID NO: 28704 - DNA, 15 bp, Artificial Sequence
  dgRNA
  Nme1
gtaaacttcaaccct

SEQ ID NO: 28705 - DNA, 15 bp, Artificial Sequence
  dgRNA
  Nme1
tagaatgttcctacc

SEQ ID NO: 28706 - DNA, 15 bp, Artificial Sequence
  dgRNA
  Nme1
tcctacccggcacat

SEQ ID NO: 28707 - DNA, 15 bp, Artificial Sequence
  dgRNA
  Nme1
gtgagcgccacctgt

SEQ ID NO: 28708 - DNA, 15 bp, Artificial Sequence
  dgRNA
  Ccl8
ttcccggcagctgga

SEQ ID NO: 28709 - DNA, 15 bp, Artificial Sequence
  dgRNA
  Ccl8
tgatttcccggcagc

SEQ ID NO: 28710 - DNA, 15 bp, Artificial Sequence
  dgRNA
  Ccl8
tagagttgtgcctaa

SEQ ID NO: 28711 - DNA, 15 bp, Artificial Sequence
  dgRNA
  Slc12a1
agttactagttgatg

SEQ ID NO: 28712 - DNA, 15 bp, Artificial Sequence
  dgRNA
  Slc12a1
tgtggtacttacagt

SEQ ID NO: 28713 - DNA, 15 bp, Artificial Sequence
  dgRNA
  Slc12a1
ctcagggctaatgac

SEQ ID NO: 28714 - DNA, 15 bp, Artificial Sequence
  dgRNA
  Slc12a1
tgtgcgacgctaatg

SEQ ID NO: 28715 - DNA, 15 bp, Artificial Sequence
  dgRNA
  Brap
gcgggaaaactaagg

SEQ ID NO: 28716 - DNA, 15 bp, Artificial Sequence
  dgRNA
  Brap
aggacaaacgtagag

SEQ ID NO: 28717 - DNA, 15 bp, Artificial Sequence
  dgRNA
  Brap
gacaaacgtagagag

SEQ ID NO: 28718 - DNA, 15 bp, Artificial Sequence
  dgRNA
  Brap
ggtcaaacgcaaaat

SEQ ID NO: 28719 - DNA, 15 bp, Artificial Sequence
  dgRNA
  Tardbp
tagcatccgagcctc

SEQ ID NO: 28720 - DNA, 15 bp, Artificial Sequence
  dgRNA
  Tardbp
agcatccgagcctct

SEQ ID NO: 28721 - DNA, 15 bp, Artificial Sequence
  dgRNA
  Tardbp
gagcgcccctcctgc

SEQ ID NO: 28722 - DNA, 15 bp, Artificial Sequence
  dgRNA
  Tardbp
agcgcccctcctgca

SEQ ID NO: 28723 - DNA, 15 bp, Artificial Sequence
  dgRNA
  Mapk9
gacggcgagccgcct

SEQ ID NO: 28724 - DNA, 15 bp, Artificial Sequence
  dgRNA
  Mapk9
acggcgagccgccta

SEQ ID NO: 28725 - DNA, 15 bp, Artificial Sequence
  dgRNA
  Mapk9
cggcgagccgcctag

SEQ ID NO: 28726 - DNA, 15 bp, Artificial Sequence
  dgRNA
  Mapk9
ggcgagccgcctagg

SEQ ID NO: 28727 - DNA, 15 bp, Artificial Sequence
  dgRNA
  Olfr1140
tgctctaatttatct

SEQ ID NO: 28728 - DNA, 15 bp, Artificial Sequence
  dgRNA
  Dock8
tcggtcccgggtcag

SEQ ID NO: 28729 - DNA, 15 bp, Artificial Sequence
  dgRNA
  Dock8
gtcccgggtcagcgg

SEQ ID NO: 28730 - DNA, 15 bp, Artificial Sequence
  dgRNA
  Dock8
tcccgggtcagcggc

SEQ ID NO: 28731 - DNA, 15 bp, Artificial Sequence
  dgRNA
  Dock8
cccgggtcagcggcg

SEQ ID NO: 28732 - DNA, 15 bp, Artificial Sequence
  dgRNA
  Ctnnb1
cccctcgtcctcgcg

SEQ ID NO: 28733 - DNA, 15 bp, Artificial Sequence
  dgRNA
  Ctnnb1
ctcgtcctcgcgcgg

SEQ ID NO: 28734 - DNA, 15 bp, Artificial Sequence
  dgRNA
  Ctnnb1
gcggaacgctccgcg

SEQ ID NO: 28735 - DNA, 15 bp, Artificial Sequence
  dgRNA
  Ctnnb1
acgctccgcgcggag

SEQ ID NO: 28736 - DNA, 15 bp, Artificial Sequence
  dgRNA
  8030411F24Rik
acgtctccttctgtt

SEQ ID NO: 28737 - DNA, 15 bp, Artificial Sequence
  dgRNA
  8030411F24Rik
cgtctccttctgttt

SEQ ID NO: 28738 - DNA, 15 bp, Artificial Sequence
  dgRNA
  8030411F24Rik
acgtccctgaccctg

SEQ ID NO: 28739 - DNA, 15 bp, Artificial Sequence
  dgRNA
  Kctd9
taccaaccgttacct

SEQ ID NO: 28740 - DNA, 15 bp, Artificial Sequence
  dgRNA
  Kctd9
caaccgttacctcgg

SEQ ID NO: 28741 - DNA, 15 bp, Artificial Sequence
  dgRNA
  Kctd9
aaccgttacctcggt

SEQ ID NO: 28742 - DNA, 15 bp, Artificial Sequence
  dgRNA
  Kctd9
cgttacctcggtggg

SEQ ID NO: 28743 - DNA, 15 bp, Artificial Sequence
  dgRNA
  Aadac
taagagattgcgtcg

SEQ ID NO: 28744 - DNA, 15 bp, Artificial Sequence
  dgRNA
  Aadac
ttgcgtcgtggaatt

SEQ ID NO: 28745 - DNA, 15 bp, Artificial Sequence
  dgRNA
  Aadac
aagttaggtaacact

SEQ ID NO: 28746 - DNA, 15 bp, Artificial Sequence
  dgRNA
  Aadac
gtaacacttggtgac

SEQ ID NO: 28747 - DNA, 15 bp, Artificial Sequence
  dgRNA
  Kcnj11
ggcataccagcctag

SEQ ID NO: 28748 - DNA, 15 bp, Artificial Sequence
  dgRNA
  Kcnj11
taccagcctagaggt

SEQ ID NO: 28749 - DNA, 15 bp, Artificial Sequence
  dgRNA
  Kcnj11
gttggtacaagctta

SEQ ID NO: 28750 - DNA, 15 bp, Artificial Sequence
  dgRNA
  Kcnj11
gcttagggtaacctg

SEQ ID NO: 28751 - DNA, 15 bp, Artificial Sequence
  dgRNA
  Bmpr1b
ctctgaggacggctc

SEQ ID NO: 28752 - DNA, 15 bp, Artificial Sequence
  dgRNA
  Bmpr1b
tgaggacggctctgg

SEQ ID NO: 28753 - DNA, 15 bp, Artificial Sequence
  dgRNA
  Bmpr1b
ggacggctctggagg

SEQ ID NO: 28754 - DNA, 15 bp, Artificial Sequence
  dgRNA
  Bmpr1b
ggctgggaccgctcc

SEQ ID NO: 28755 - DNA, 15 bp, Artificial Sequence
  dgRNA
  Obp2b
acgtccctgtccatg

SEQ ID NO: 28756 - DNA, 15 bp, Artificial Sequence
  dgRNA
  Obp2b
cgtccctgtccatgg

SEQ ID NO: 28757 - DNA, 15 bp, Artificial Sequence
  dgRNA
  Obp2b
ccatgggggatataa

SEQ ID NO: 28758 - DNA, 15 bp, Artificial Sequence
  dgRNA
  Obp2b
tatcccccatggaca

SEQ ID NO: 28759 - DNA, 15 bp, Artificial Sequence
  dgRNA
  Chd9
cccacgctccccaag

SEQ ID NO: 28760 - DNA, 15 bp, Artificial Sequence
  dgRNA
  Chd9
cccccccgggctccg

SEQ ID NO: 28761 - DNA, 15 bp, Artificial Sequence
  dgRNA
  Chd9
cgggctccgcggtgt

SEQ ID NO: 28762 - DNA, 15 bp, Artificial Sequence
  dgRNA
  Chd9
ggaagccaccagcgt

SEQ ID NO: 28763 - DNA, 15 bp, Artificial Sequence
  dgRNA
  Spred3
ggtaatcctgattgc

SEQ ID NO: 28764 - DNA, 15 bp, Artificial Sequence
  dgRNA
  Spred3
gtaatcctgattgct

SEQ ID NO: 28765 - DNA, 15 bp, Artificial Sequence
  dgRNA
  Spred3
ctgattgctgggcgg

SEQ ID NO: 28766 - DNA, 15 bp, Artificial Sequence
  dgRNA
  Spred3
tgattgctgggcgga

SEQ ID NO: 28767 - DNA, 15 bp, Artificial Sequence
  dgRNA
  Dsc1
tctacctgggggtaa

SEQ ID NO: 28768 - DNA, 15 bp, Artificial Sequence
  dgRNA
  Dsc1
agggctgctcatgaa

SEQ ID NO: 28769 - DNA, 15 bp, Artificial Sequence
  dgRNA
  Dsc1
tatgtgttaagtggc

SEQ ID NO: 28770 - DNA, 15 bp, Artificial Sequence
  dgRNA
  Dsc1
gctctccccacttgt

SEQ ID NO: 28771 - DNA, 15 bp, Artificial Sequence
  dgRNA
  Isg20
tagcacactgacagc

SEQ ID NO: 28772 - DNA, 15 bp, Artificial Sequence
  dgRNA
  Isg20
gctggtaccattaac

SEQ ID NO: 28773 - DNA, 15 bp, Artificial Sequence
  dgRNA
  Isg20
ggtcccacaacttct

SEQ ID NO: 28774 - DNA, 15 bp, Artificial Sequence
  dgRNA
  Isg20
aggtcccacaacttc

SEQ ID NO: 28775 - DNA, 15 bp, Artificial Sequence
  dgRNA
  Pwp1
tcgtagatttgcata

SEQ ID NO: 28776 - DNA, 15 bp, Artificial Sequence
  dgRNA
  Pwp1
ctgaatcagctactg

SEQ ID NO: 28777 - DNA, 15 bp, Artificial Sequence
  dgRNA
  Pwp1
tacgactgcttcctg

SEQ ID NO: 28778 - DNA, 15 bp, Artificial Sequence
  dgRNA
  Pwp1
tgcatgagatgggcg

SEQ ID NO: 28779 - DNA, 15 bp, Artificial Sequence
  dgRNA
  Tmem198b
cctagattagagaag

SEQ ID NO: 28780 - DNA, 15 bp, Artificial Sequence
  dgRNA
  Tmem198b
gatgacatcacgggg

SEQ ID NO: 28781 - DNA, 15 bp, Artificial Sequence
  dgRNA
  Tmem198b
gaggatgacatcacg

SEQ ID NO: 28782 - DNA, 15 bp, Artificial Sequence
  dgRNA
  Tmem198b
atgcaattagcttgg

SEQ ID NO: 28783 - DNA, 15 bp, Artificial Sequence
  dgRNA
  Robo4
taaggcatgagggcc

SEQ ID NO: 28784 - DNA, 15 bp, Artificial Sequence
  dgRNA
  Robo4
tcagctgtaatcccc

SEQ ID NO: 28785 - DNA, 15 bp, Artificial Sequence
  dgRNA
  Robo4
cggatgcttcctgcc

SEQ ID NO: 28786 - DNA, 15 bp, Artificial Sequence
  dgRNA
  Tbx15
tgtgagcgcctgccc

SEQ ID NO: 28787 - DNA, 15 bp, Artificial Sequence
  dgRNA
  Tbx15
gagcgcctgcccggg

SEQ ID NO: 28788 - DNA, 15 bp, Artificial Sequence
  dgRNA
  Tbx15
agcgcctgcccgggt

SEQ ID NO: 28789 - DNA, 15 bp, Artificial Sequence
  dgRNA
  Tbx15
agtgctccatgcaac

SEQ ID NO: 28790 - DNA, 15 bp, Artificial Sequence
  dgRNA
  Fip1l1
agacgccgcgccgct

SEQ ID NO: 28791 - DNA, 15 bp, Artificial Sequence
  dgRNA
  Fip1l1
gacgccgcgccgctt

SEQ ID NO: 28792 - DNA, 15 bp, Artificial Sequence
  dgRNA
  Fip1l1
ggcacccaagcggcg

SEQ ID NO: 28793 - DNA, 15 bp, Artificial Sequence
  dgRNA
  Trip13
gatccgcaccttcgt

SEQ ID NO: 28794 - DNA, 15 bp, Artificial Sequence
  dgRNA
  Trip13
ggatccggtgagaag

SEQ ID NO: 28795 - DNA, 15 bp, Artificial Sequence
  dgRNA
  Trip13
gtgagaagcggctgc

SEQ ID NO: 28796 - DNA, 15 bp, Artificial Sequence
  dgRNA
  Trip13
tcgacctgcgccagt

SEQ ID NO: 28797 - DNA, 15 bp, Artificial Sequence
  dgRNA
  Pik3r6
caggtcacttgcatt

SEQ ID NO: 28798 - DNA, 15 bp, Artificial Sequence
  dgRNA
  Pik3r6
cattaggccagaata

SEQ ID NO: 28799 - DNA, 15 bp, Artificial Sequence
  dgRNA
  Pik3r6
gaataaggaaccccc

SEQ ID NO: 28800 - DNA, 15 bp, Artificial Sequence
  dgRNA
  Pik3r6
cagcaggatatgcct

SEQ ID NO: 28801 - DNA, 15 bp, Artificial Sequence
  dgRNA
  Egflam
ggcgagtgtcgaagt

SEQ ID NO: 28802 - DNA, 15 bp, Artificial Sequence
  dgRNA
  Egflam
aagtcggtcccaccc

SEQ ID NO: 28803 - DNA, 15 bp, Artificial Sequence
  dgRNA
  Egflam
cccggcccccaatct

SEQ ID NO: 28804 - DNA, 15 bp, Artificial Sequence
  dgRNA
  Egflam
aatctaggtcacccg

SEQ ID NO: 28805 - DNA, 15 bp, Artificial Sequence
  dgRNA
  Hdac7
aagcgtaaagcaccc

SEQ ID NO: 28806 - DNA, 15 bp, Artificial Sequence
  dgRNA
  Hdac7
tacgctgtgtatgca

SEQ ID NO: 28807 - DNA, 15 bp, Artificial Sequence
  dgRNA
  Hdac7
cgggtgcgtgcactc

SEQ ID NO: 28808 - DNA, 15 bp, Artificial Sequence
  dgRNA
  Hdac7
gtgcactcaggtatc

SEQ ID NO: 28809 - DNA, 15 bp, Artificial Sequence
  dgRNA
  Cbx7
gccagctgcccaatt

SEQ ID NO: 28810 - DNA, 15 bp, Artificial Sequence
  dgRNA
  Cbx7
cccaatttggtcagc

SEQ ID NO: 28811 - DNA, 15 bp, Artificial Sequence
  dgRNA
  Cbx7
aatttggtcagcagg

SEQ ID NO: 28812 - DNA, 15 bp, Artificial Sequence
  dgRNA
  Cbx7
tttggtcagcaggcg

SEQ ID NO: 28813 - DNA, 15 bp, Artificial Sequence
  dgRNA
  Angptl8
agcgtgatatcagca

SEQ ID NO: 28814 - DNA, 15 bp, Artificial Sequence
  dgRNA
  Angptl8
atcagtctgatgcaa

SEQ ID NO: 28815 - DNA, 15 bp, Artificial Sequence
  dgRNA
  Angptl8
ggctgagcctccgcc

SEQ ID NO: 28816 - DNA, 15 bp, Artificial Sequence
  dgRNA
  Angptl8
gcccttgtgcaacca

SEQ ID NO: 28817 - DNA, 15 bp, Artificial Sequence
  dgRNA
  Chpf2
ttctttagcgctaac

SEQ ID NO: 28818 - DNA, 15 bp, Artificial Sequence
  dgRNA
  Chpf2
tctttagcgctaaca

SEQ ID NO: 28819 - DNA, 15 bp, Artificial Sequence
  dgRNA
  Chpf2
gggttgagatgaatt

SEQ ID NO: 28820 - DNA, 15 bp, Artificial Sequence
  dgRNA
  Chpf2
ggttgagatgaattg

SEQ ID NO: 28821 - DNA, 15 bp, Artificial Sequence
  dgRNA
  Tfb2m
tctgcgcaaccctcc

SEQ ID NO: 28822 - DNA, 15 bp, Artificial Sequence
  dgRNA
  Tfb2m
cgcaaccctcccggc

SEQ ID NO: 28823 - DNA, 15 bp, Artificial Sequence
  dgRNA
  Tfb2m
aaccctcccggctgg

SEQ ID NO: 28824 - DNA, 15 bp, Artificial Sequence
  dgRNA
  Tfb2m
ctcccggctggcggc

SEQ ID NO: 28825 - DNA, 15 bp, Artificial Sequence
  dgRNA
  Clec4a2
gcatatcttgctgag

SEQ ID NO: 28826 - DNA, 15 bp, Artificial Sequence
  dgRNA
  Clec4a2
tcccttatctcgccc

SEQ ID NO: 28827 - DNA, 15 bp, Artificial Sequence
  dgRNA
  Clec4a2
gcaagtactgcaaag

SEQ ID NO: 28828 - DNA, 15 bp, Artificial Sequence
  dgRNA
  Clec4a2
accagggcgagataa

SEQ ID NO: 28829 - DNA, 15 bp, Artificial Sequence
  dgRNA
  Arhgap4
cgcctcgcttccgcg

SEQ ID NO: 28830 - DNA, 15 bp, Artificial Sequence
  dgRNA
  Arhgap4
gcctcgcttccgcgt

SEQ ID NO: 28831 - DNA, 15 bp, Artificial Sequence
  dgRNA
  Arhgap4
tccgcgtgggagcat

SEQ ID NO: 28832 - DNA, 15 bp, Artificial Sequence
  dgRNA
  Arhgap4
ccgcgtgggagcatt

SEQ ID NO: 28833 - DNA, 15 bp, Artificial Sequence
  dgRNA
  Cyth3
cagacaggaggttcg

SEQ ID NO: 28834 - DNA, 15 bp, Artificial Sequence
  dgRNA
  Cyth3
agagtgctgcgctgc

SEQ ID NO: 28835 - DNA, 15 bp, Artificial Sequence
  dgRNA
  Cyth3
cagctactgcaaggc

SEQ ID NO: 28836 - DNA, 15 bp, Artificial Sequence
  dgRNA
  Cyth3
tactgcaaggccggg

SEQ ID NO: 28837 - DNA, 15 bp, Artificial Sequence
  dgRNA
  Itgb1
accggacacagactg

SEQ ID NO: 28838 - DNA, 15 bp, Artificial Sequence
  dgRNA
  Itgb1
gacacagactgcggc

SEQ ID NO: 28839 - DNA, 15 bp, Artificial Sequence
  dgRNA
  Itgb1
acacagactgcggct

SEQ ID NO: 28840 - DNA, 15 bp, Artificial Sequence
  dgRNA
  Itgb1
ggctttccagccggg

SEQ ID NO: 28841 - DNA, 15 bp, Artificial Sequence
  dgRNA
  A630095E13Rik
ggcttggcattctat

SEQ ID NO: 28842 - DNA, 15 bp, Artificial Sequence
  dgRNA
  A630095E13Rik
gcttggcattctatt

SEQ ID NO: 28843 - DNA, 15 bp, Artificial Sequence
  dgRNA
  Pias1
tttaaatagtgcgtg

SEQ ID NO: 28844 - DNA, 15 bp, Artificial Sequence
  dgRNA
  Pias1
ttaaatagtgcgtgt

SEQ ID NO: 28845 - DNA, 15 bp, Artificial Sequence
  dgRNA
  Pias1
gcagctgtgcgtgcc

SEQ ID NO: 28846 - DNA, 15 bp, Artificial Sequence
  dgRNA
  Pias1
cagctgtgcgtgccc

SEQ ID NO: 28847 - DNA, 15 bp, Artificial Sequence
  dgRNA
  Hlf
cccaccaacgccgca

SEQ ID NO: 28848 - DNA, 15 bp, Artificial Sequence
  dgRNA
  Hlf
ccaccaacgccgcaa

SEQ ID NO: 28849 - DNA, 15 bp, Artificial Sequence
  dgRNA
  Hlf
caacgccgcaagggc

SEQ ID NO: 28850 - DNA, 15 bp, Artificial Sequence
  dgRNA
  Hlf
gaaaaacagcgcgtg

SEQ ID NO: 28851 - DNA, 15 bp, Artificial Sequence
  dgRNA
  Nfib
gagagagctcgagcg

SEQ ID NO: 28852 - DNA, 15 bp, Artificial Sequence
  dgRNA
  Nfib
tcgagcggggtccag

SEQ ID NO: 28853 - DNA, 15 bp, Artificial Sequence
  dgRNA
  Nfib
cgagcggggtccaga

SEQ ID NO: 28854 - DNA, 15 bp, Artificial Sequence
  dgRNA
  Nfib
accggttccaccctc

SEQ ID NO: 28855 - DNA, 15 bp, Artificial Sequence
  dgRNA
  Abcc9
aaataatccactcgc

SEQ ID NO: 28856 - DNA, 15 bp, Artificial Sequence
  dgRNA
  Abcc9
cgccggctgctgacc

SEQ ID NO: 28857 - DNA, 15 bp, Artificial Sequence
  dgRNA
  Abcc9
gccggctgctgaccc

SEQ ID NO: 28858 - DNA, 15 bp, Artificial Sequence
  dgRNA
  Abcc9
ggctgctgacccggg

SEQ ID NO: 28859 - DNA, 15 bp, Artificial Sequence
  dgRNA
  Serbp1
gagatcccgcctctc

SEQ ID NO: 28860 - DNA, 15 bp, Artificial Sequence
  dgRNA
  Serbp1
ctgcgcagtgcacgc

SEQ ID NO: 28861 - DNA, 15 bp, Artificial Sequence
  dgRNA
  Serbp1
tgcgcagtgcacgct

SEQ ID NO: 28862 - DNA, 15 bp, Artificial Sequence
  dgRNA
  Serbp1
agtagacagccatcc

SEQ ID NO: 28863 - DNA, 15 bp, Artificial Sequence
  dgRNA
  Hars
aggacgccggctttc

SEQ ID NO: 28864 - DNA, 15 bp, Artificial Sequence
  dgRNA
  Hars
ggccagtccgatttc

SEQ ID NO: 28865 - DNA, 15 bp, Artificial Sequence
  dgRNA
  Hars
aaagctaccgagagc

SEQ ID NO: 28866 - DNA, 15 bp, Artificial Sequence
  dgRNA
  Hars
agatcggagttagtt

SEQ ID NO: 28867 - DNA, 15 bp, Artificial Sequence
  dgRNA
  Rpap2
ccgagtatcacgaaa

SEQ ID NO: 28868 - DNA, 15 bp, Artificial Sequence
  dgRNA
  Rpap2
agtatcacgaaaagg

SEQ ID NO: 28869 - DNA, 15 bp, Artificial Sequence
  dgRNA
  Rpap2
aggtccttgccccgc

SEQ ID NO: 28870 - DNA, 15 bp, Artificial Sequence
  dgRNA
  Rpap2
ccagtttttgtcaat

SEQ ID NO: 28871 - DNA, 15 bp, Artificial Sequence
  dgRNA
  Orc2
aaccaaccgtacaac

SEQ ID NO: 28872 - DNA, 15 bp, Artificial Sequence
  dgRNA
  Orc2
accaaccgtacaacc

SEQ ID NO: 28873 - DNA, 15 bp, Artificial Sequence
  dgRNA
  Orc2
ccaaccgtacaaccg

SEQ ID NO: 28874 - DNA, 15 bp, Artificial Sequence
  dgRNA
  Orc2
ggcgtgctccgcgca

SEQ ID NO: 28875 - DNA, 15 bp, Artificial Sequence
  dgRNA
  Antxr2
ggtgcttagcatccc

SEQ ID NO: 28876 - DNA, 15 bp, Artificial Sequence
  dgRNA
  Antxr2
gaggctcgccccgcg

SEQ ID NO: 28877 - DNA, 15 bp, Artificial Sequence
  dgRNA
  Antxr2
ggcgcggcgccaggt

SEQ ID NO: 28878 - DNA, 15 bp, Artificial Sequence
  dgRNA
  Antxr2
gcgcggcgccaggtt

SEQ ID NO: 28879 - DNA, 15 bp, Artificial Sequence
  dgRNA
  Lgi2
ggtctgagccacggc

SEQ ID NO: 28880 - DNA, 15 bp, Artificial Sequence
  dgRNA
  Lgi2
gcgtgcattattcat

SEQ ID NO: 28881 - DNA, 15 bp, Artificial Sequence
  dgRNA
  Lgi2
cattattcattggtc

SEQ ID NO: 28882 - DNA, 15 bp, Artificial Sequence
  dgRNA
  Lgi2
attattcattggtcc

SEQ ID NO: 28883 - DNA, 15 bp, Artificial Sequence
  dgRNA
  Dnmt3l
ggggcaaagtaggtg

SEQ ID NO: 28884 - DNA, 15 bp, Artificial Sequence
  dgRNA
  Dnmt3l
agtaggtgggggccc

SEQ ID NO: 28885 - DNA, 15 bp, Artificial Sequence
  dgRNA
  Dnmt3l
cagggtagagcgtgc

SEQ ID NO: 28886 - DNA, 15 bp, Artificial Sequence
  dgRNA
  Dnmt3l
agggtagagcgtgca

SEQ ID NO: 28887 - DNA, 15 bp, Artificial Sequence
  dgRNA
  Ccdc33
tgtactgcatctgcg

SEQ ID NO: 28888 - DNA, 15 bp, Artificial Sequence
  dgRNA
  Ccdc33
ggtgattcagctaaa

SEQ ID NO: 28889 - DNA, 15 bp, Artificial Sequence
  dgRNA
  Ccdc33
actgtatgacatcac

SEQ ID NO: 28890 - DNA, 15 bp, Artificial Sequence
  dgRNA
  Ccdc33
ttagctgaatcacct

SEQ ID NO: 28891 - DNA, 15 bp, Artificial Sequence
  dgRNA
  Pacsin3
gcatcccgagccacc

SEQ ID NO: 28892 - DNA, 15 bp, Artificial Sequence
  dgRNA
  Pacsin3
cgagccacctggcgc

SEQ ID NO: 28893 - DNA, 15 bp, Artificial Sequence
  dgRNA
  Pacsin3
gagccacctggcgca

SEQ ID NO: 28894 - DNA, 15 bp, Artificial Sequence
  dgRNA
  Pacsin3
ctgcagtccccgctg

SEQ ID NO: 28895 - DNA, 15 bp, Artificial Sequence
  dgRNA
  Ccdc50
aggatttgtggtgcc

SEQ ID NO: 28896 - DNA, 15 bp, Artificial Sequence
  dgRNA
  Ccdc50
agataggctctgtcc

SEQ ID NO: 28897 - DNA, 15 bp, Artificial Sequence
  dgRNA
  Ccdc50
taggctctgtcccgg

SEQ ID NO: 28898 - DNA, 15 bp, Artificial Sequence
  dgRNA
  Ccdc50
ccggcggcgcctagc

SEQ ID NO: 28899 - DNA, 15 bp, Artificial Sequence
  dgRNA
  Sec14l3
gagttgtcccagggg

SEQ ID NO: 28900 - DNA, 15 bp, Artificial Sequence
  dgRNA
  Sec14l3
tagcccccagtgacc

SEQ ID NO: 28901 - DNA, 15 bp, Artificial Sequence
  dgRNA
  Sec14l3
gcccgtgtttggctc

SEQ ID NO: 28902 - DNA, 15 bp, Artificial Sequence
  dgRNA
  Sec14l3
gtgagggcccgtgtt

SEQ ID NO: 28903 - DNA, 15 bp, Artificial Sequence
  dgRNA
  Pcsk9
gtttaggcaggtagc

SEQ ID NO: 28904 - DNA, 15 bp, Artificial Sequence
  dgRNA
  Pcsk9
caggtagcgggaagt

SEQ ID NO: 28905 - DNA, 15 bp, Artificial Sequence
  dgRNA
  Pcsk9
aggtagcgggaagtc

SEQ ID NO: 28906 - DNA, 15 bp, Artificial Sequence
  dgRNA
  Pcsk9
cgcagtgaagagtca

SEQ ID NO: 28907 - DNA, 15 bp, Artificial Sequence
  dgRNA
  Tbc1d2b
ttttctcccgggata

SEQ ID NO: 28908 - DNA, 15 bp, Artificial Sequence
  dgRNA
  Tbc1d2b
tctcccgggataggg

SEQ ID NO: 28909 - DNA, 15 bp, Artificial Sequence
  dgRNA
  Tbc1d2b
caactagtagaggac

SEQ ID NO: 28910 - DNA, 15 bp, Artificial Sequence
  dgRNA
  Tbc1d2b
ctagtagaggacggg

SEQ ID NO: 28911 - DNA, 15 bp, Artificial Sequence
  dgRNA
  Pter
gtttcagagctggcg

SEQ ID NO: 28912 - DNA, 15 bp, Artificial Sequence
  dgRNA
  Pter
tttcagagctggcgc

SEQ ID NO: 28913 - DNA, 15 bp, Artificial Sequence
  dgRNA
  Pter
ctggcgcgggctcac

SEQ ID NO: 28914 - DNA, 15 bp, Artificial Sequence
  dgRNA
  Pter
tggcgcgggctcaca

SEQ ID NO: 28915 - DNA, 15 bp, Artificial Sequence
  dgRNA
  Ugt1a9
agtgacgttaaattc

SEQ ID NO: 28916 - DNA, 15 bp, Artificial Sequence
  dgRNA
  Atg9a
tacgtgaggatcttc

SEQ ID NO: 28917 - DNA, 15 bp, Artificial Sequence
  dgRNA
  Atg9a
acccaattcgagtcc

SEQ ID NO: 28918 - DNA, 15 bp, Artificial Sequence
  dgRNA
  Atg9a
accacgttcgaaaac

SEQ ID NO: 28919 - DNA, 15 bp, Artificial Sequence
  dgRNA
  Atg9a
actcgaattgggtct

SEQ ID NO: 28920 - DNA, 15 bp, Artificial Sequence
  dgRNA
  Tead2
gttcaggttcaggcc

SEQ ID NO: 28921 - DNA, 15 bp, Artificial Sequence
  dgRNA
  Tead2
cattgggactgcatg

SEQ ID NO: 28922 - DNA, 15 bp, Artificial Sequence
  dgRNA
  Tead2
tgcattgggactgca

SEQ ID NO: 28923 - DNA, 15 bp, Artificial Sequence
  dgRNA
  Tead2
gtgaggaatttgcat

SEQ ID NO: 28924 - DNA, 15 bp, Artificial Sequence
  dgRNA
  Entpd6
ggatccaagataagc

SEQ ID NO: 28925 - DNA, 15 bp, Artificial Sequence
  dgRNA
  Entpd6
gctattgcgcctgcg

SEQ ID NO: 28926 - DNA, 15 bp, Artificial Sequence
  dgRNA
  Entpd6
ttgcgcctgcgtggc

SEQ ID NO: 28927 - DNA, 15 bp, Artificial Sequence
  dgRNA
  Entpd6
ggctggcaaacgcca

SEQ ID NO: 28928 - DNA, 15 bp, Artificial Sequence
  dgRNA
  Zfp292
accttgccctcgccc

SEQ ID NO: 28929 - DNA, 15 bp, Artificial Sequence
  dgRNA
  Zfp292
gcagcactgccccgg

SEQ ID NO: 28930 - DNA, 15 bp, Artificial Sequence
  dgRNA
  Zfp292
tttgtacgtgcgccc

SEQ ID NO: 28931 - DNA, 15 bp, Artificial Sequence
  dgRNA
  Zfp292
ggcgtgccagcgcac

SEQ ID NO: 28932 - DNA, 15 bp, Artificial Sequence
  dgRNA
  Usp9x
gtctgggccccctag

SEQ ID NO: 28933 - DNA, 15 bp, Artificial Sequence
  dgRNA
  Usp9x
ccgggccgggcgctg

SEQ ID NO: 28934 - DNA, 15 bp, Artificial Sequence
  dgRNA
  Usp9x
cgggccgggcgctga

SEQ ID NO: 28935 - DNA, 15 bp, Artificial Sequence
  dgRNA
  Usp9x
gccgggcgctgaggg

SEQ ID NO: 28936 - DNA, 15 bp, Artificial Sequence
  dgRNA
  Opn5
gaacatctctccact

SEQ ID NO: 28937 - DNA, 15 bp, Artificial Sequence
  dgRNA
  Opn5
ggtaccaatcacctg

SEQ ID NO: 28938 - DNA, 15 bp, Artificial Sequence
  dgRNA
  Opn5
gtaccaatcacctgt

SEQ ID NO: 28939 - DNA, 15 bp, Artificial Sequence
  dgRNA
  Opn5
ttgtgagcggattca

SEQ ID NO: 28940 - DNA, 15 bp, Artificial Sequence
  dgRNA
  BC055324
ggaaagtcagacgcc

SEQ ID NO: 28941 - DNA, 15 bp, Artificial Sequence
  dgRNA
  BC055324
gaaagtcagacgcca

SEQ ID NO: 28942 - DNA, 15 bp, Artificial Sequence
  dgRNA
  BC055324
gggcgaacaaactac

SEQ ID NO: 28943 - DNA, 15 bp, Artificial Sequence
  dgRNA
  BC055324
ctcgccttcagccta

SEQ ID NO: 28944 - DNA, 15 bp, Artificial Sequence
  dgRNA
  Sik1
atctccgctccccct

SEQ ID NO: 28945 - DNA, 15 bp, Artificial Sequence
  dgRNA
  Sik1
ccgctccccctcggc

SEQ ID NO: 28946 - DNA, 15 bp, Artificial Sequence
  dgRNA
  Sik1
cccctcggcaggcac

SEQ ID NO: 28947 - DNA, 15 bp, Artificial Sequence
  dgRNA
  Sik1
ggccgcgcgtcgctc

SEQ ID NO: 28948 - DNA, 15 bp, Artificial Sequence
  dgRNA
  Nlrp5
atacaatctaattaa

SEQ ID NO: 28949 - DNA, 15 bp, Artificial Sequence
  dgRNA
  Nlrp5
tacaatctaattaag

SEQ ID NO: 28950 - DNA, 15 bp, Artificial Sequence
  dgRNA
  Nlrp5
aatctaattaagggg

SEQ ID NO: 28951 - DNA, 15 bp, Artificial Sequence
  dgRNA
  Nlrp5
atctaattaagggga

SEQ ID NO: 28952 - DNA, 15 bp, Artificial Sequence
  dgRNA
  Urad
agccttaagcggagg

SEQ ID NO: 28953 - DNA, 15 bp, Artificial Sequence
  dgRNA
  Urad
cttaagcggaggtgg

SEQ ID NO: 28954 - DNA, 15 bp, Artificial Sequence
  dgRNA
  Urad
gatagctcagtattc

SEQ ID NO: 28955 - DNA, 15 bp, Artificial Sequence
  dgRNA
  Urad
tgtgtttctcatcgc

SEQ ID NO: 28956 - DNA, 15 bp, Artificial Sequence
  dgRNA
  Olfr1199
gtgacacgtttcatt

SEQ ID NO: 28957 - DNA, 15 bp, Artificial Sequence
  dgRNA
  Ppip5k1
cgaaggttcactcaa

SEQ ID NO: 28958 - DNA, 15 bp, Artificial Sequence
  dgRNA
  Ppip5k1
ccgaaggttcactca

SEQ ID NO: 28959 - DNA, 15 bp, Artificial Sequence
  dgRNA
  Ppip5k1
cactgctagaaccga

SEQ ID NO: 28960 - DNA, 15 bp, Artificial Sequence
  dgRNA
  Kcnb2
cgatgcctattccag

SEQ ID NO: 28961 - DNA, 15 bp, Artificial Sequence
  dgRNA
  Kcnb2
atgttgtgagtaata

SEQ ID NO: 28962 - DNA, 15 bp, Artificial Sequence
  dgRNA
  Kcnb2
catcgccacatcagc

SEQ ID NO: 28963 - DNA, 15 bp, Artificial Sequence
  dgRNA
  Serf2
ccgctcttcgccctc

SEQ ID NO: 28964 - DNA, 15 bp, Artificial Sequence
  dgRNA
  Serf2
cgctcttcgccctcc

SEQ ID NO: 28965 - DNA, 15 bp, Artificial Sequence
  dgRNA
  Serf2
ttcgccctccgggac

SEQ ID NO: 28966 - DNA, 15 bp, Artificial Sequence
  dgRNA
  Serf2
atgaaagcgggcgcc

SEQ ID NO: 28967 - DNA, 15 bp, Artificial Sequence
  dgRNA
  Timm13
tgtacgcatgcgcag

SEQ ID NO: 28968 - DNA, 15 bp, Artificial Sequence
  dgRNA
  Timm13
gtacgcatgcgcagc

SEQ ID NO: 28969 - DNA, 15 bp, Artificial Sequence
  dgRNA
  Timm13
tacgcatgcgcagcg

SEQ ID NO: 28970 - DNA, 15 bp, Artificial Sequence
  dgRNA
  Timm13
gcatgcgcagcgggg

SEQ ID NO: 28971 - DNA, 15 bp, Artificial Sequence
  dgRNA
  Negr1
acggaaacggccgct

SEQ ID NO: 28972 - DNA, 15 bp, Artificial Sequence
  dgRNA
  Negr1
caacgcgcgcgagcc

SEQ ID NO: 28973 - DNA, 15 bp, Artificial Sequence
  dgRNA
  Negr1
aacgcgcgcgagccc

SEQ ID NO: 28974 - DNA, 15 bp, Artificial Sequence
  dgRNA
  Negr1
acgcgcgcgagcccg

SEQ ID NO: 28975 - DNA, 15 bp, Artificial Sequence
  dgRNA
  Zfp72
gctgactacttatga

SEQ ID NO: 28976 - DNA, 15 bp, Artificial Sequence
  dgRNA
  Zfp72
gatttaaattggcat

SEQ ID NO: 28977 - DNA, 15 bp, Artificial Sequence
  dgRNA
  Rsl1d1
tcggtgtcctccgga

SEQ ID NO: 28978 - DNA, 15 bp, Artificial Sequence
  dgRNA
  Rsl1d1
ccggaaggagcgaca

SEQ ID NO: 28979 - DNA, 15 bp, Artificial Sequence
  dgRNA
  Rsl1d1
cttagaaagagtcgg

SEQ ID NO: 28980 - DNA, 15 bp, Artificial Sequence
  dgRNA
  Rsl1d1
ccgctagaataactc

SEQ ID NO: 28981 - DNA, 15 bp, Artificial Sequence
  dgRNA
  Atg7
tgtagagtcactcgc

SEQ ID NO: 28982 - DNA, 15 bp, Artificial Sequence
  dgRNA
  Atg7
cttacaagccccaaa

SEQ ID NO: 28983 - DNA, 15 bp, Artificial Sequence
  dgRNA
  Atg7
ccccaaaaggcttac

SEQ ID NO: 28984 - DNA, 15 bp, Artificial Sequence
  dgRNA
  Atg7
ttcgccccgttattg

SEQ ID NO: 28985 - DNA, 15 bp, Artificial Sequence
  dgRNA
  Lect1
atactcaaacctgtc

SEQ ID NO: 28986 - DNA, 15 bp, Artificial Sequence
  dgRNA
  Lect1
tgagtaggctgctcc

SEQ ID NO: 28987 - DNA, 15 bp, Artificial Sequence
  dgRNA
  Lect1
gagtaggctgctcca

SEQ ID NO: 28988 - DNA, 15 bp, Artificial Sequence
  dgRNA
  Lect1
agttactagcttgcc

SEQ ID NO: 28989 - DNA, 15 bp, Artificial Sequence
  dgRNA
  Sri
tgccactaggtcgag

SEQ ID NO: 28990 - DNA, 15 bp, Artificial Sequence
  dgRNA
  Sri
gccactaggtcgaga

SEQ ID NO: 28991 - DNA, 15 bp, Artificial Sequence
  dgRNA
  Sri
gtcgagagggagaat

SEQ ID NO: 28992 - DNA, 15 bp, Artificial Sequence
  dgRNA
  Sri
tgatataaactcgtc

SEQ ID NO: 28993 - DNA, 15 bp, Artificial Sequence
  dgRNA
  Unc13b
gcggggtcggcagac

SEQ ID NO: 28994 - DNA, 15 bp, Artificial Sequence
  dgRNA
  Unc13b
cggggtcggcagact

SEQ ID NO: 28995 - DNA, 15 bp, Artificial Sequence
  dgRNA
  Unc13b
cagactgggcgcgag

SEQ ID NO: 28996 - DNA, 15 bp, Artificial Sequence
  dgRNA
  Unc13b
tgggcgcgagcggat

SEQ ID NO: 28997 - DNA, 15 bp, Artificial Sequence
  dgRNA
  Clmn
cacccaccctgcggg

SEQ ID NO: 28998 - DNA, 15 bp, Artificial Sequence
  dgRNA
  Clmn
acccaccctgcgggt

SEQ ID NO: 28999 - DNA, 15 bp, Artificial Sequence
  dgRNA
  Clmn
cccaccctgcgggtg

SEQ ID NO: 29000 - DNA, 15 bp, Artificial Sequence
  dgRNA
  Clmn
gcagtgagcgcgcgc

SEQ ID NO: 29001 - DNA, 15 bp, Artificial Sequence
  dgRNA
  Olfr1133
ctctaattcatgtac

SEQ ID NO: 29002 - DNA, 15 bp, Artificial Sequence
  dgRNA
  Rnase10
gagtagaacagttga

SEQ ID NO: 29003 - DNA, 15 bp, Artificial Sequence
  dgRNA
  Rnase10
ccgcccactgacctg

SEQ ID NO: 29004 - DNA, 15 bp, Artificial Sequence
  dgRNA
  Rnase10
gaagtatcctctacc

SEQ ID NO: 29005 - DNA, 15 bp, Artificial Sequence
  dgRNA
  Rnase10
atttaagcaaacgac

SEQ ID NO: 29006 - DNA, 15 bp, Artificial Sequence
  dgRNA
  Commd8
tttgagcccgcccgc

SEQ ID NO: 29007 - DNA, 15 bp, Artificial Sequence
  dgRNA
  Commd8
ctccagaaagtcacg

SEQ ID NO: 29008 - DNA, 15 bp, Artificial Sequence
  dgRNA
  Commd8
gtcacgtggacgaat

SEQ ID NO: 29009 - DNA, 15 bp, Artificial Sequence
  dgRNA
  Commd8
gcggtcgagactgag

SEQ ID NO: 29010 - DNA, 15 bp, Artificial Sequence
  dgRNA
  Drc7
gctgcatttgacaac

SEQ ID NO: 29011 - DNA, 15 bp, Artificial Sequence
  dgRNA
  Drc7
tccagcacactatgg

SEQ ID NO: 29012 - DNA, 15 bp, Artificial Sequence
  dgRNA
  Zfp354a
atttacctaacaagc

SEQ ID NO: 29013 - DNA, 15 bp, Artificial Sequence
  dgRNA
  Zfp354a
gcatcagacaaaccg

SEQ ID NO: 29014 - DNA, 15 bp, Artificial Sequence
  dgRNA
  Zfp354a
gcggccaccaccctc

SEQ ID NO: 29015 - DNA, 15 bp, Artificial Sequence
  dgRNA
  Zfp354a
tgcaggttagtggaa

SEQ ID NO: 29016 - DNA, 15 bp, Artificial Sequence
  dgRNA
  Ntrk3
gcaaagtctcggagt

SEQ ID NO: 29017 - DNA, 15 bp, Artificial Sequence
  dgRNA
  Ntrk3
cgtttccagagcttc

SEQ ID NO: 29018 - DNA, 15 bp, Artificial Sequence
  dgRNA
  Ntrk3
ctggaccccgcaagc

SEQ ID NO: 29019 - DNA, 15 bp, Artificial Sequence
  dgRNA
  Ntrk3
cggcgagcgccgagc

SEQ ID NO: 29020 - DNA, 15 bp, Artificial Sequence
  dgRNA
  Gml2
cggaacactgaagag

SEQ ID NO: 29021 - DNA, 15 bp, Artificial Sequence
  dgRNA
  Gml2
cggaacactgatgaa

SEQ ID NO: 29022 - DNA, 15 bp, Artificial Sequence
  dgRNA
  Gml2
ggttgggaatacttg

SEQ ID NO: 29023 - DNA, 15 bp, Artificial Sequence
  dgRNA
  Gml2
gttgggaatacttga

SEQ ID NO: 29024 - DNA, 15 bp, Artificial Sequence
  dgRNA
  Sst
gtgattgattttgcg

SEQ ID NO: 29025 - DNA, 15 bp, Artificial Sequence
  dgRNA
  Sst
attttgcgaggctaa

SEQ ID NO: 29026 - DNA, 15 bp, Artificial Sequence
  dgRNA
  Sst
ctgggggcgcctcct

SEQ ID NO: 29027 - DNA, 15 bp, Artificial Sequence
  dgRNA
  Sst
agcctgcacccacgc

SEQ ID NO: 29028 - DNA, 15 bp, Artificial Sequence
  dgRNA
  Klf15
gtctcacgtgcgcat

SEQ ID NO: 29029 - DNA, 15 bp, Artificial Sequence
  dgRNA
  Klf15
tcacgtgcgcatcgg

SEQ ID NO: 29030 - DNA, 15 bp, Artificial Sequence
  dgRNA
  Klf15
gatccacgaagagac

SEQ ID NO: 29031 - DNA, 15 bp, Artificial Sequence
  dgRNA
  Klf15
agaccggagagcgcg

SEQ ID NO: 29032 - DNA, 15 bp, Artificial Sequence
  dgRNA
  Lin7b
tctagagttccggag

SEQ ID NO: 29033 - DNA, 15 bp, Artificial Sequence
  dgRNA
  Lin7b
ctagagttccggagt

SEQ ID NO: 29034 - DNA, 15 bp, Artificial Sequence
  dgRNA
  Lin7b
tgttggttgccgtgt

SEQ ID NO: 29035 - DNA, 15 bp, Artificial Sequence
  dgRNA
  Lin7b
ggttgccgtgtgggc

SEQ ID NO: 29036 - DNA, 15 bp, Artificial Sequence
  dgRNA
  Pgpep1
gggcggggttggcta

SEQ ID NO: 29037 - DNA, 15 bp, Artificial Sequence
  dgRNA
  Pgpep1
ggcggggttggctag

SEQ ID NO: 29038 - DNA, 15 bp, Artificial Sequence
  dgRNA
  Pgpep1
ggtttctaggaggcg

SEQ ID NO: 29039 - DNA, 15 bp, Artificial Sequence
  dgRNA
  Pgpep1
ggcgtggcctaggaa

SEQ ID NO: 29040 - DNA, 15 bp, Artificial Sequence
  dgRNA
  Erich2
ttgattccaacagac

SEQ ID NO: 29041 - DNA, 15 bp, Artificial Sequence
  dgRNA
  Erich2
gcataagacctctaa

SEQ ID NO: 29042 - DNA, 15 bp, Artificial Sequence
  dgRNA
  Erich2
cataagacctctaaa

SEQ ID NO: 29043 - DNA, 15 bp, Artificial Sequence
  dgRNA
  Erich2
aggggacccgtctgt

SEQ ID NO: 29044 - DNA, 15 bp, Artificial Sequence
  dgRNA
  Olfr109
ctatggaggaactta

SEQ ID NO: 29045 - DNA, 15 bp, Artificial Sequence
  dgRNA
  Styxl1
ccgggacctagcgct

SEQ ID NO: 29046 - DNA, 15 bp, Artificial Sequence
  dgRNA
  Styxl1
tagcgctaggacaga

SEQ ID NO: 29047 - DNA, 15 bp, Artificial Sequence
  dgRNA
  Styxl1
ggacagacggtcacc

SEQ ID NO: 29048 - DNA, 15 bp, Artificial Sequence
  dgRNA
  Styxl1
acggtcaccaggatt

SEQ ID NO: 29049 - DNA, 15 bp, Artificial Sequence
  dgRNA
  Myh10
gcgatctctgcctcg

SEQ ID NO: 29050 - DNA, 15 bp, Artificial Sequence
  dgRNA
  Myh10
cgatctctgcctcgc

SEQ ID NO: 29051 - DNA, 15 bp, Artificial Sequence
  dgRNA
  Myh10
cctcgcgggatcgcc

SEQ ID NO: 29052 - DNA, 15 bp, Artificial Sequence
  dgRNA
  Myh10
cacccgccactgccc

SEQ ID NO: 29053 - DNA, 15 bp, Artificial Sequence
  dgRNA
  Ly6f
tatagctgttgagga

SEQ ID NO: 29054 - DNA, 15 bp, Artificial Sequence
  dgRNA
  Ly6f
tttagcaaggtttgt

SEQ ID NO: 29055 - DNA, 15 bp, Artificial Sequence
  dgRNA
  Ly6f
ggttaagatttagca

SEQ ID NO: 29056 - DNA, 15 bp, Artificial Sequence
  dgRNA
  Ly6f
ggccaacatgtttat

SEQ ID NO: 29057 - DNA, 15 bp, Artificial Sequence
  dgRNA
  Atp6ap1
tagaatcaacccgac

SEQ ID NO: 29058 - DNA, 15 bp, Artificial Sequence
  dgRNA
  Atp6ap1
aggagcgtgcgcgac

SEQ ID NO: 29059 - DNA, 15 bp, Artificial Sequence
  dgRNA
  Atp6ap1
agccaaccagcgaaa

SEQ ID NO: 29060 - DNA, 15 bp, Artificial Sequence
  dgRNA
  Atp6ap1
accagcgaaaaggag

SEQ ID NO: 29061 - DNA, 15 bp, Artificial Sequence
  dgRNA
  Lin37
cgccccccaggtgcc

SEQ ID NO: 29062 - DNA, 15 bp, Artificial Sequence
  dgRNA
  Lin37
tttgtttccggatac

SEQ ID NO: 29063 - DNA, 15 bp, Artificial Sequence
  dgRNA
  Lin37
ttgtttccggataca

SEQ ID NO: 29064 - DNA, 15 bp, Artificial Sequence
  dgRNA
  Lin37
ccggatacagggcct

SEQ ID NO: 29065 - DNA, 15 bp, Artificial Sequence
  dgRNA
  Qprt
tagggagaacggaat

SEQ ID NO: 29066 - DNA, 15 bp, Artificial Sequence
  dgRNA
  Qprt
gcttgagtgcaggtc

SEQ ID NO: 29067 - DNA, 15 bp, Artificial Sequence
  dgRNA
  Qprt
agcacaccactaaca

SEQ ID NO: 29068 - DNA, 15 bp, Artificial Sequence
  dgRNA
  Qprt
ctttccggccctcat

SEQ ID NO: 29069 - DNA, 15 bp, Artificial Sequence
  dgRNA
  Actr10
cgaccaacacagaac

SEQ ID NO: 29070 - DNA, 15 bp, Artificial Sequence
  dgRNA
  Actr10
cttactacgccgcgc

SEQ ID NO: 29071 - DNA, 15 bp, Artificial Sequence
  dgRNA
  Actr10
cggccgctgagcgag

SEQ ID NO: 29072 - DNA, 15 bp, Artificial Sequence
  dgRNA
  Actr10
tgagcgagaggaccc

SEQ ID NO: 29073 - DNA, 15 bp, Artificial Sequence
  dgRNA
  Srf
tgacagcagcgagtt

SEQ ID NO: 29074 - DNA, 15 bp, Artificial Sequence
  dgRNA
  Srf
aataagtgtcccctt

SEQ ID NO: 29075 - DNA, 15 bp, Artificial Sequence
  dgRNA
  Srf
ataagtgtccccttc

SEQ ID NO: 29076 - DNA, 15 bp, Artificial Sequence
  dgRNA
  Srf
tccccttcgggccaa

SEQ ID NO: 29077 - DNA, 15 bp, Artificial Sequence
  dgRNA
  Foxa3
ccatcgcaagcttcc

SEQ ID NO: 29078 - DNA, 15 bp, Artificial Sequence
  dgRNA
  Foxa3
caggtgccaggaccg

SEQ ID NO: 29079 - DNA, 15 bp, Artificial Sequence
  dgRNA
  Foxa3
ttcttgagatcccgc

SEQ ID NO: 29080 - DNA, 15 bp, Artificial Sequence
  dgRNA
  Foxa3
tcttgagatcccgca

SEQ ID NO: 29081 - DNA, 15 bp, Artificial Sequence
  dgRNA
  Efna3
gcgcgttgttcctaa

SEQ ID NO: 29082 - DNA, 15 bp, Artificial Sequence
  dgRNA
  Efna3
cgcgttgttcctaaa

SEQ ID NO: 29083 - DNA, 15 bp, Artificial Sequence
  dgRNA
  Efna3
gcgttgttcctaaag

SEQ ID NO: 29084 - DNA, 15 bp, Artificial Sequence
  dgRNA
  Efna3
aggggctacacagta

SEQ ID NO: 29085 - DNA, 15 bp, Artificial Sequence
  dgRNA
  Hsd17b2
cttaggggaatgagc

SEQ ID NO: 29086 - DNA, 15 bp, Artificial Sequence
  dgRNA
  Hsd17b2
gtttaaattacatcc

SEQ ID NO: 29087 - DNA, 15 bp, Artificial Sequence
  dgRNA
  Hsd17b2
cttgttcaaagggtg

SEQ ID NO: 29088 - DNA, 15 bp, Artificial Sequence
  dgRNA
  Hsd17b2
ttgttcaaagggtgc

SEQ ID NO: 29089 - DNA, 15 bp, Artificial Sequence
  dgRNA
  Blk
cgccctagttcccac

SEQ ID NO: 29090 - DNA, 15 bp, Artificial Sequence
  dgRNA
  Blk
tattagtggggtcac

SEQ ID NO: 29091 - DNA, 15 bp, Artificial Sequence
  dgRNA
  Blk
gatgctaatattagt

SEQ ID NO: 29092 - DNA, 15 bp, Artificial Sequence
  dgRNA
  Blk
tgatgctaatattag

SEQ ID NO: 29093 - DNA, 15 bp, Artificial Sequence
  dgRNA
  Kng2
ctcttgttccatacc

SEQ ID NO: 29094 - DNA, 15 bp, Artificial Sequence
  dgRNA
  Kng2
aagagcattgcaaca

SEQ ID NO: 29095 - DNA, 15 bp, Artificial Sequence
  dgRNA
  Tnpo3
tgacgagataagatt

SEQ ID NO: 29096 - DNA, 15 bp, Artificial Sequence
  dgRNA
  Tnpo3
aagacttacgcacct

SEQ ID NO: 29097 - DNA, 15 bp, Artificial Sequence
  dgRNA
  Tnpo3
ttctcctagtccggc

SEQ ID NO: 29098 - DNA, 15 bp, Artificial Sequence
  dgRNA
  Tnpo3
tctcctagtccggca

SEQ ID NO: 29099 - DNA, 15 bp, Artificial Sequence
  dgRNA
  Impad1
ccagcaacatcgccc

SEQ ID NO: 29100 - DNA, 15 bp, Artificial Sequence
  dgRNA
  Impad1
cccgcccccaattat

SEQ ID NO: 29101 - DNA, 15 bp, Artificial Sequence
  dgRNA
  Impad1
attatgggcccgccc

SEQ ID NO: 29102 - DNA, 15 bp, Artificial Sequence
  dgRNA
  Impad1
ttatgggcccgcccc

SEQ ID NO: 29103 - DNA, 15 bp, Artificial Sequence
  dgRNA
  Tcerg1l
aaaaaatcagccggc

SEQ ID NO: 29104 - DNA, 15 bp, Artificial Sequence
  dgRNA
  Tcerg1l
aaaaatcagccggct

SEQ ID NO: 29105 - DNA, 15 bp, Artificial Sequence
  dgRNA
  Tcerg1l
atcagccggctgggt

SEQ ID NO: 29106 - DNA, 15 bp, Artificial Sequence
  dgRNA
  Tcerg1l
tcagccggctgggtt

SEQ ID NO: 29107 - DNA, 15 bp, Artificial Sequence
  dgRNA
  Ict1
agaaaaatctcccgt

SEQ ID NO: 29108 - DNA, 15 bp, Artificial Sequence
  dgRNA
  Ict1
aaaatctcccgtagg

SEQ ID NO: 29109 - DNA, 15 bp, Artificial Sequence
  dgRNA
  Ict1
ctaccagatgtcagc

SEQ ID NO: 29110 - DNA, 15 bp, Artificial Sequence
  dgRNA
  Ict1
ccatcaccgccaagg

SEQ ID NO: 29111 - DNA, 15 bp, Artificial Sequence
  dgRNA
  Eapp
gcttaagttaagagg

SEQ ID NO: 29112 - DNA, 15 bp, Artificial Sequence
  dgRNA
  Eapp
ttgcatccttgtcac

SEQ ID NO: 29113 - DNA, 15 bp, Artificial Sequence
  dgRNA
  Eapp
ctggacggcttgcgc

SEQ ID NO: 29114 - DNA, 15 bp, Artificial Sequence
  dgRNA
  Eapp
cgcaggcgcacagga

SEQ ID NO: 29115 - DNA, 15 bp, Artificial Sequence
  dgRNA
  Fbxo41
gcactacggggatgg

SEQ ID NO: 29116 - DNA, 15 bp, Artificial Sequence
  dgRNA
  Fbxo41
ggcactacggggatg

SEQ ID NO: 29117 - DNA, 15 bp, Artificial Sequence
  dgRNA
  Fbxo41
gggcactacggggat

SEQ ID NO: 29118 - DNA, 15 bp, Artificial Sequence
  dgRNA
  Fbxo41
tgggcactacgggga

SEQ ID NO: 29119 - DNA, 15 bp, Artificial Sequence
  dgRNA
  Ntn4
ggcggcgacaatgac

SEQ ID NO: 29120 - DNA, 15 bp, Artificial Sequence
  dgRNA
  Ntn4
cgcgtctgcaccgcc

SEQ ID NO: 29121 - DNA, 15 bp, Artificial Sequence
  dgRNA
  Ntn4
cccggctgtcaagcg

SEQ ID NO: 29122 - DNA, 15 bp, Artificial Sequence
  dgRNA
  Ntn4
ccggctgtcaagcgc

SEQ ID NO: 29123 - DNA, 15 bp, Artificial Sequence
  dgRNA
  Amd1
catctgcaaccaagc

SEQ ID NO: 29124 - DNA, 15 bp, Artificial Sequence
  dgRNA
  Amd1
ccctgcactccccgt

SEQ ID NO: 29125 - DNA, 15 bp, Artificial Sequence
  dgRNA
  Amd1
cagccagccggcgtt

SEQ ID NO: 29126 - DNA, 15 bp, Artificial Sequence
  dgRNA
  Amd1
ttgactgacacgaag

SEQ ID NO: 29127 - DNA, 15 bp, Artificial Sequence
  dgRNA
  Tyw5
ctaaacacttgatca

SEQ ID NO: 29128 - DNA, 15 bp, Artificial Sequence
  dgRNA
  Tyw5
aacgctgaatgcacg

SEQ ID NO: 29129 - DNA, 15 bp, Artificial Sequence
  dgRNA
  Tyw5
actctttgtcgaaat

SEQ ID NO: 29130 - DNA, 15 bp, Artificial Sequence
  dgRNA
  Tyw5
aaataggcccaaata

SEQ ID NO: 29131 - DNA, 15 bp, Artificial Sequence
  dgRNA
  Ttc33
cttcagcggctaggc

SEQ ID NO: 29132 - DNA, 15 bp, Artificial Sequence
  dgRNA
  Ttc33
taggccggtcagact

SEQ ID NO: 29133 - DNA, 15 bp, Artificial Sequence
  dgRNA
  Ttc33
gccggtcagactagg

SEQ ID NO: 29134 - DNA, 15 bp, Artificial Sequence
  dgRNA
  Ttc33
acgggagtccattcc

SEQ ID NO: 29135 - DNA, 15 bp, Artificial Sequence
  dgRNA
  Zfp456
cgtacatctccgttg

SEQ ID NO: 29136 - DNA, 15 bp, Artificial Sequence
  dgRNA
  Zfp456
tctccgttgtggttc

SEQ ID NO: 29137 - DNA, 15 bp, Artificial Sequence
  dgRNA
  Zfp456
ctccgttgtggttct

SEQ ID NO: 29138 - DNA, 15 bp, Artificial Sequence
  dgRNA
  Zfp456
tgcaccttccactgt

SEQ ID NO: 29139 - DNA, 15 bp, Artificial Sequence
  dgRNA
  Osbpl9
tccgcggctccttcg

SEQ ID NO: 29140 - DNA, 15 bp, Artificial Sequence
  dgRNA
  Osbpl9
ttcgcggctcctttg

SEQ ID NO: 29141 - DNA, 15 bp, Artificial Sequence
  dgRNA
  Osbpl9
gccctgacgcccaac

SEQ ID NO: 29142 - DNA, 15 bp, Artificial Sequence
  dgRNA
  Osbpl9
ccctgacgcccaacg

SEQ ID NO: 29143 - DNA, 15 bp, Artificial Sequence
  dgRNA
  Lrrc8b
cgtcccaaggccggg

SEQ ID NO: 29144 - DNA, 15 bp, Artificial Sequence
  dgRNA
  Lrrc8b
ggccgggtggactct

SEQ ID NO: 29145 - DNA, 15 bp, Artificial Sequence
  dgRNA
  Lrrc8b
gccgggtggactctc

SEQ ID NO: 29146 - DNA, 15 bp, Artificial Sequence
  dgRNA
  Lrrc8b
ggtggactctcgggc

SEQ ID NO: 29147 - DNA, 15 bp, Artificial Sequence
  dgRNA
  Vmn1r195
cgtagagacaatcca

SEQ ID NO: 29148 - DNA, 15 bp, Artificial Sequence
  dgRNA
  Vmn1r195
tattctcactgatat

SEQ ID NO: 29149 - DNA, 15 bp, Artificial Sequence
  dgRNA
  Vmn1r195
aaatgatcacctcca

SEQ ID NO: 29150 - DNA, 15 bp, Artificial Sequence
  dgRNA
  Plpp6
tcaagctggtactcc

SEQ ID NO: 29151 - DNA, 15 bp, Artificial Sequence
  dgRNA
  Plpp6
tcccacgtctccgcc

SEQ ID NO: 29152 - DNA, 15 bp, Artificial Sequence
  dgRNA
  Plpp6
cacaatcgtgctctg

SEQ ID NO: 29153 - DNA, 15 bp, Artificial Sequence
  dgRNA
  Plpp6
tcgtgctctgcggct

SEQ ID NO: 29154 - DNA, 15 bp, Artificial Sequence
  dgRNA
  Itgb1bp1
ccaacacacaacttc

SEQ ID NO: 29155 - DNA, 15 bp, Artificial Sequence
  dgRNA
  Itgb1bp1
gcgctctagcgttcc

SEQ ID NO: 29156 - DNA, 15 bp, Artificial Sequence
  dgRNA
  Itgb1bp1
tcccggagctagatt

SEQ ID NO: 29157 - DNA, 15 bp, Artificial Sequence
  dgRNA
  Itgb1bp1
cggccctccaacttc

SEQ ID NO: 29158 - DNA, 15 bp, Artificial Sequence
  dgRNA
  Fbrs
aggacctgatcggcc

SEQ ID NO: 29159 - DNA, 15 bp, Artificial Sequence
  dgRNA
  Fbrs
gctacctgaatgccc

SEQ ID NO: 29160 - DNA, 15 bp, Artificial Sequence
  dgRNA
  Fbrs
cctgaatgcccaggg

SEQ ID NO: 29161 - DNA, 15 bp, Artificial Sequence
  dgRNA
  Fbrs
gcagggggctcggcc

SEQ ID NO: 29162 - DNA, 15 bp, Artificial Sequence
  dgRNA
  Ttc41
ccgatgcccgaagcg

SEQ ID NO: 29163 - DNA, 15 bp, Artificial Sequence
  dgRNA
  Ttc41
gtggctccttgcgat

SEQ ID NO: 29164 - DNA, 15 bp, Artificial Sequence
  dgRNA
  Ttc41
tggctccttgcgatt

SEQ ID NO: 29165 - DNA, 15 bp, Artificial Sequence
  dgRNA
  Ttc41
attgggcttgtccag

SEQ ID NO: 29166 - DNA, 15 bp, Artificial Sequence
  dgRNA
  Pmel
ggatgaaatcagttc

SEQ ID NO: 29167 - DNA, 15 bp, Artificial Sequence
  dgRNA
  Pmel
catccctttctatat

SEQ ID NO: 29168 - DNA, 15 bp, Artificial Sequence
  dgRNA
  Pmel
ctgacacacttattc

SEQ ID NO: 29169 - DNA, 15 bp, Artificial Sequence
  dgRNA
  Pmel
gtttctggtttcgct

SEQ ID NO: 29170 - DNA, 15 bp, Artificial Sequence
  dgRNA
  Ttr
attgagtagcagatc

SEQ ID NO: 29171 - DNA, 15 bp, Artificial Sequence
  dgRNA
  Ttr
taagtagtcttactc

SEQ ID NO: 29172 - DNA, 15 bp, Artificial Sequence
  dgRNA
  Acot7
agaacaatgcctacc

SEQ ID NO: 29173 - DNA, 15 bp, Artificial Sequence
  dgRNA
  Acot7
gtggggcaagtccaa

SEQ ID NO: 29174 - DNA, 15 bp, Artificial Sequence
  dgRNA
  Acot7
tggggcaagtccaaa

SEQ ID NO: 29175 - DNA, 15 bp, Artificial Sequence
  dgRNA
  Etfb
cccagcggtccgccg

SEQ ID NO: 29176 - DNA, 15 bp, Artificial Sequence
  dgRNA
  Etfb
aattccgcttcctat

SEQ ID NO: 29177 - DNA, 15 bp, Artificial Sequence
  dgRNA
  Etfb
ttctgagttgtgcga

SEQ ID NO: 29178 - DNA, 15 bp, Artificial Sequence
  dgRNA
  Etfb
tgtgcgacggttgat

SEQ ID NO: 29179 - DNA, 15 bp, Artificial Sequence
  dgRNA
  Pkp2
cgagccgagaatacg

SEQ ID NO: 29180 - DNA, 15 bp, Artificial Sequence
  dgRNA
  Pkp2
gagccgagaatacgt

SEQ ID NO: 29181 - DNA, 15 bp, Artificial Sequence
  dgRNA
  Pkp2
agccgagaatacgtg

SEQ ID NO: 29182 - DNA, 15 bp, Artificial Sequence
  dgRNA
  Pkp2
gccgagaatacgtgg

SEQ ID NO: 29183 - DNA, 15 bp, Artificial Sequence
  dgRNA
  Theg
agcccaatcataacc

SEQ ID NO: 29184 - DNA, 15 bp, Artificial Sequence
  dgRNA
  Theg
gtttatggactccac

SEQ ID NO: 29185 - DNA, 15 bp, Artificial Sequence
  dgRNA
  Theg
gcccctccagtgggt

SEQ ID NO: 29186 - DNA, 15 bp, Artificial Sequence
  dgRNA
  Theg
tgcccctccagtggg

SEQ ID NO: 29187 - DNA, 15 bp, Artificial Sequence
  dgRNA
  Duox2
gctgcgctcctgacc

SEQ ID NO: 29188 - DNA, 15 bp, Artificial Sequence
  dgRNA
  Duox2
gcatcagacagggtt

SEQ ID NO: 29189 - DNA, 15 bp, Artificial Sequence
  dgRNA
  Duox2
catcagacagggtta

SEQ ID NO: 29190 - DNA, 15 bp, Artificial Sequence
  dgRNA
  Duox2
cgcgtcgtgaagatg

SEQ ID NO: 29191 - DNA, 15 bp, Artificial Sequence
  dgRNA
  Gm5460
ggcaatcatctctca

SEQ ID NO: 29192 - DNA, 15 bp, Artificial Sequence
  dgRNA
  Gm5460
tctctggacttataa

SEQ ID NO: 29193 - DNA, 15 bp, Artificial Sequence
  dgRNA
  Gm5460
gcaattatggcaaag

SEQ ID NO: 29194 - DNA, 15 bp, Artificial Sequence
  dgRNA
  Gm5460
caacttgtgcaatta

SEQ ID NO: 29195 - DNA, 15 bp, Artificial Sequence
  dgRNA
  Cdkn2a
tcccccatccggagg

SEQ ID NO: 29196 - DNA, 15 bp, Artificial Sequence
  dgRNA
  Cdkn2a
cccccatccggaggt

SEQ ID NO: 29197 - DNA, 15 bp, Artificial Sequence
  dgRNA
  Cdkn2a
cccatccggaggtgg

SEQ ID NO: 29198 - DNA, 15 bp, Artificial Sequence
  dgRNA
  Cdkn2a
ccatccggaggtggg

SEQ ID NO: 29199 - DNA, 15 bp, Artificial Sequence
  dgRNA
  Etv2
ggaacaccaagatgc

SEQ ID NO: 29200 - DNA, 15 bp, Artificial Sequence
  dgRNA
  Etv2
ttaagcgtctaagag

SEQ ID NO: 29201 - DNA, 15 bp, Artificial Sequence
  dgRNA
  Etv2
taagcgtctaagaga

SEQ ID NO: 29202 - DNA, 15 bp, Artificial Sequence
  dgRNA
  Etv2
tgcagacgtctactc

SEQ ID NO: 29203 - DNA, 15 bp, Artificial Sequence
  dgRNA
  Arhgap21
ctctaaccgaccttc

SEQ ID NO: 29204 - DNA, 15 bp, Artificial Sequence
  dgRNA
  Arhgap21
taattgttgcatgag

SEQ ID NO: 29205 - DNA, 15 bp, Artificial Sequence
  dgRNA
  Arhgap21
tacttcttcgtattg

SEQ ID NO: 29206 - DNA, 15 bp, Artificial Sequence
  dgRNA
  Arhgap21
acttcttcgtattgt

SEQ ID NO: 29207 - DNA, 15 bp, Artificial Sequence
  dgRNA
  Plekhb2
ttgagagcaacgcct

SEQ ID NO: 29208 - DNA, 15 bp, Artificial Sequence
  dgRNA
  Plekhb2
gcaacgccttggctt

SEQ ID NO: 29209 - DNA, 15 bp, Artificial Sequence
  dgRNA
  Plekhb2
cttcggccctgcacc

SEQ ID NO: 29210 - DNA, 15 bp, Artificial Sequence
  dgRNA
  Plekhb2
ttcggccctgcaccc

SEQ ID NO: 29211 - DNA, 15 bp, Artificial Sequence
  dgRNA
  Hoxb3
tagactttgcttagg

SEQ ID NO: 29212 - DNA, 15 bp, Artificial Sequence
  dgRNA
  Hoxb3
ttaggtggaaagata

SEQ ID NO: 29213 - DNA, 15 bp, Artificial Sequence
  dgRNA
  Hoxb3
ggattgccccatccc

SEQ ID NO: 29214 - DNA, 15 bp, Artificial Sequence
  dgRNA
  Hoxb3
gattgccccatccca

SEQ ID NO: 29215 - DNA, 15 bp, Artificial Sequence
  dgRNA
  Nrf1
ccccctcctcggcgg

SEQ ID NO: 29216 - DNA, 15 bp, Artificial Sequence
  dgRNA
  Nrf1
gctcgccattgccgc

SEQ ID NO: 29217 - DNA, 15 bp, Artificial Sequence
  dgRNA
  Nrf1
cgccattgccgctgg

SEQ ID NO: 29218 - DNA, 15 bp, Artificial Sequence
  dgRNA
  Nrf1
attgccgctggtggc

SEQ ID NO: 29219 - DNA, 15 bp, Artificial Sequence
  dgRNA
  Tsr1
ccgggagactcctgc

SEQ ID NO: 29220 - DNA, 15 bp, Artificial Sequence
  dgRNA
  Tsr1
cagaggactgcagcg

SEQ ID NO: 29221 - DNA, 15 bp, Artificial Sequence
  dgRNA
  Tsr1
agaggactgcagcgt

SEQ ID NO: 29222 - DNA, 15 bp, Artificial Sequence
  dgRNA
  Tsr1
ctctgcggacactca

SEQ ID NO: 29223 - DNA, 15 bp, Artificial Sequence
  dgRNA
  1700012A03Rik
gagttgactgaagac

SEQ ID NO: 29224 - DNA, 15 bp, Artificial Sequence
  dgRNA
  Uhrf2
agggcgagctggcct

SEQ ID NO: 29225 - DNA, 15 bp, Artificial Sequence
  dgRNA
  Uhrf2
tccgagtaacggctc

SEQ ID NO: 29226 - DNA, 15 bp, Artificial Sequence
  dgRNA
  Uhrf2
atattagcgcccccc

SEQ ID NO: 29227 - DNA, 15 bp, Artificial Sequence
  dgRNA
  Uhrf2
cccccaggctgtgcg

SEQ ID NO: 29228 - DNA, 15 bp, Artificial Sequence
  dgRNA
  Ranbp2
gggcactgccatttt

SEQ ID NO: 29229 - DNA, 15 bp, Artificial Sequence
  dgRNA
  Ranbp2
ataaagcctttcccg

SEQ ID NO: 29230 - DNA, 15 bp, Artificial Sequence
  dgRNA
  Ranbp2
gcctttcccggggaa

SEQ ID NO: 29231 - DNA, 15 bp, Artificial Sequence
  dgRNA
  Ranbp2
cctttcccggggaaa

SEQ ID NO: 29232 - DNA, 15 bp, Artificial Sequence
  dgRNA
  Cmtm7
atgaacagcgcagca

SEQ ID NO: 29233 - DNA, 15 bp, Artificial Sequence
  dgRNA
  Cmtm7
cagcacggtatgctc

SEQ ID NO: 29234 - DNA, 15 bp, Artificial Sequence
  dgRNA
  Cmtm7
agcacggtatgctca

SEQ ID NO: 29235 - DNA, 15 bp, Artificial Sequence
  dgRNA
  Cmtm7
tgggcggtgcgctcc

SEQ ID NO: 29236 - DNA, 15 bp, Artificial Sequence
  dgRNA
  Eif5b
gacttcccgcagctg

SEQ ID NO: 29237 - DNA, 15 bp, Artificial Sequence
  dgRNA
  Eif5b
cagctgaggccgcgt

SEQ ID NO: 29238 - DNA, 15 bp, Artificial Sequence
  dgRNA
  Eif5b
tgaggccgcgtaggc

SEQ ID NO: 29239 - DNA, 15 bp, Artificial Sequence
  dgRNA
  Eif5b
gaggccgcgtaggca

SEQ ID NO: 29240 - DNA, 15 bp, Artificial Sequence
  dgRNA
  Svbp
gccaatttcaaccac

SEQ ID NO: 29241 - DNA, 15 bp, Artificial Sequence
  dgRNA
  Svbp
agcccggaaaagctt

SEQ ID NO: 29242 - DNA, 15 bp, Artificial Sequence
  dgRNA
  Svbp
gaaattggctagcac

SEQ ID NO: 29243 - DNA, 15 bp, Artificial Sequence
  dgRNA
  Svbp
cgggcttctagtttc

SEQ ID NO: 29244 - DNA, 15 bp, Artificial Sequence
  dgRNA
  Dbp
ggaaggcacgcggct

SEQ ID NO: 29245 - DNA, 15 bp, Artificial Sequence
  dgRNA
  Dbp
gaaggcacgcggctg

SEQ ID NO: 29246 - DNA, 15 bp, Artificial Sequence
  dgRNA
  Dbp
cgcggctggggtgca

SEQ ID NO: 29247 - DNA, 15 bp, Artificial Sequence
  dgRNA
  Dbp
ggtgcatggcccaag

SEQ ID NO: 29248 - DNA, 15 bp, Artificial Sequence
  dgRNA
  Slc22a16
ttgacgcacgtgcaa

SEQ ID NO: 29249 - DNA, 15 bp, Artificial Sequence
  dgRNA
  Slc22a16
ggcgtcaacacttct

SEQ ID NO: 29250 - DNA, 15 bp, Artificial Sequence
  dgRNA
  Slc22a16
tgaccccacaactca

SEQ ID NO: 29251 - DNA, 15 bp, Artificial Sequence
  dgRNA
  Slc22a16
atgaccccacaactc

SEQ ID NO: 29252 - DNA, 15 bp, Artificial Sequence
  dgRNA
  Tmed11
ttaaacttatctgcc

SEQ ID NO: 29253 - DNA, 15 bp, Artificial Sequence
  dgRNA
  Sstr2
ggctgccacccgccc

SEQ ID NO: 29254 - DNA, 15 bp, Artificial Sequence
  dgRNA
  Sstr2
ccgggccactgctag

SEQ ID NO: 29255 - DNA, 15 bp, Artificial Sequence
  dgRNA
  Sstr2
tagcggcgcagccac

SEQ ID NO: 29256 - DNA, 15 bp, Artificial Sequence
  dgRNA
  Sstr2
accggcgcgctcgcg

SEQ ID NO: 29257 - DNA, 15 bp, Artificial Sequence
  dgRNA
  Tox2
ggtgctccaaacatg

SEQ ID NO: 29258 - DNA, 15 bp, Artificial Sequence
  dgRNA
  Tox2
catgtgggcccaaat

SEQ ID NO: 29259 - DNA, 15 bp, Artificial Sequence
  dgRNA
  Tox2
atgtgggcccaaatt

SEQ ID NO: 29260 - DNA, 15 bp, Artificial Sequence
  dgRNA
  Tox2
ggcccaaattgggat

SEQ ID NO: 29261 - DNA, 15 bp, Artificial Sequence
  dgRNA
  Hap1
ctatctcgtcaccac

SEQ ID NO: 29262 - DNA, 15 bp, Artificial Sequence
  dgRNA
  Hap1
ccactaactgatcaa

SEQ ID NO: 29263 - DNA, 15 bp, Artificial Sequence
  dgRNA
  Hap1
ccctagcgccacgcg

SEQ ID NO: 29264 - DNA, 15 bp, Artificial Sequence
  dgRNA
  Hap1
cgtggtacagcccag

SEQ ID NO: 29265 - DNA, 15 bp, Artificial Sequence
  dgRNA
  Gps2
cggaaggatttatcc

SEQ ID NO: 29266 - DNA, 15 bp, Artificial Sequence
  dgRNA
  Gps2
atttatcctggccgc

SEQ ID NO: 29267 - DNA, 15 bp, Artificial Sequence
  dgRNA
  Gps2
ccggatatgacgtag

SEQ ID NO: 29268 - DNA, 15 bp, Artificial Sequence
  dgRNA
  Gps2
gccaaggcgcgccga

SEQ ID NO: 29269 - DNA, 15 bp, Artificial Sequence
  dgRNA
  Atp12a
aggcttgcgtgtcct

SEQ ID NO: 29270 - DNA, 15 bp, Artificial Sequence
  dgRNA
  Atp12a
ggcttgcgtgtcctc

SEQ ID NO: 29271 - DNA, 15 bp, Artificial Sequence
  dgRNA
  Atp12a
cgggtttcctacccc

SEQ ID NO: 29272 - DNA, 15 bp, Artificial Sequence
  dgRNA
  Atp12a
gagctgcgtcgcccc

SEQ ID NO: 29273 - DNA, 15 bp, Artificial Sequence
  dgRNA
  Sval2
catcctagcatatga

SEQ ID NO: 29274 - DNA, 15 bp, Artificial Sequence
  dgRNA
  Sval2
gattagggtgttctt

SEQ ID NO: 29275 - DNA, 15 bp, Artificial Sequence
  dgRNA
  Sval2
gtcagtatgagatta

SEQ ID NO: 29276 - DNA, 15 bp, Artificial Sequence
  dgRNA
  Sval2
cgtcagtatgagatt

SEQ ID NO: 29277 - DNA, 15 bp, Artificial Sequence
  dgRNA
  Tmem40
cagcagtaccctagg

SEQ ID NO: 29278 - DNA, 15 bp, Artificial Sequence
  dgRNA
  Tmem40
tcagagagtggccgg

SEQ ID NO: 29279 - DNA, 15 bp, Artificial Sequence
  dgRNA
  Tmem40
accacgagctgacag

SEQ ID NO: 29280 - DNA, 15 bp, Artificial Sequence
  dgRNA
  Tmem40
aatgtaggcctccta

SEQ ID NO: 29281 - DNA, 15 bp, Artificial Sequence
  dgRNA
  Rabep1
cggacccctcctccc

SEQ ID NO: 29282 - DNA, 15 bp, Artificial Sequence
  dgRNA
  Rabep1
tgatgagagagctat

SEQ ID NO: 29283 - DNA, 15 bp, Artificial Sequence
  dgRNA
  Rabep1
aggggtccggggcct

SEQ ID NO: 29284 - DNA, 15 bp, Artificial Sequence
  dgRNA
  Rabep1
cgctggcctaaggga

SEQ ID NO: 29285 - DNA, 15 bp, Artificial Sequence
  dgRNA
  Runx1t1
aaataagggttaact

SEQ ID NO: 29286 - DNA, 15 bp, Artificial Sequence
  dgRNA
  Runx1t1
gggttaacttggagc

SEQ ID NO: 29287 - DNA, 15 bp, Artificial Sequence
  dgRNA
  Runx1t1
ggttaacttggagct

SEQ ID NO: 29288 - DNA, 15 bp, Artificial Sequence
  dgRNA
  Runx1t1
ttaacaggcattact

SEQ ID NO: 29289 - DNA, 15 bp, Artificial Sequence
  dgRNA
  Olfr904
aagataatttgccga

SEQ ID NO: 29290 - DNA, 15 bp, Artificial Sequence
  dgRNA
  Olfr904
atttatatgctcacg

SEQ ID NO: 29291 - DNA, 15 bp, Artificial Sequence
  dgRNA
  Olfr904
tttatatgctcacgt

SEQ ID NO: 29292 - DNA, 15 bp, Artificial Sequence
  dgRNA
  Olfr904
ttatatgctcacgtg

SEQ ID NO: 29293 - DNA, 15 bp, Artificial Sequence
  dgRNA
  Upp1
agtcatttcccctac

SEQ ID NO: 29294 - DNA, 15 bp, Artificial Sequence
  dgRNA
  Upp1
gtcatttcccctact

SEQ ID NO: 29295 - DNA, 15 bp, Artificial Sequence
  dgRNA
  Upp1
gggcaagcgctcccc

SEQ ID NO: 29296 - DNA, 15 bp, Artificial Sequence
  dgRNA
  Upp1
gccgtcccacaacta

SEQ ID NO: 29297 - DNA, 15 bp, Artificial Sequence
  dgRNA
  Cyth2
tacccacagtccgat

SEQ ID NO: 29298 - DNA, 15 bp, Artificial Sequence
  dgRNA
  Cyth2
acagtccgattggtc

SEQ ID NO: 29299 - DNA, 15 bp, Artificial Sequence
  dgRNA
  Cyth2
tgtgcctattggtcc

SEQ ID NO: 29300 - DNA, 15 bp, Artificial Sequence
  dgRNA
  Cyth2
gatcctgtggggcta

SEQ ID NO: 29301 - DNA, 15 bp, Artificial Sequence
  dgRNA
  Olfr1451
actactaatggtaca

SEQ ID NO: 29302 - DNA, 15 bp, Artificial Sequence
  dgRNA
  Dbt
ttttacacctctcaa

SEQ ID NO: 29303 - DNA, 15 bp, Artificial Sequence
  dgRNA
  Dbt
tttacacctctcaag

SEQ ID NO: 29304 - DNA, 15 bp, Artificial Sequence
  dgRNA
  Dbt
ttacacctctcaagg

SEQ ID NO: 29305 - DNA, 15 bp, Artificial Sequence
  dgRNA
  Dbt
gcccctcgccctggt

SEQ ID NO: 29306 - DNA, 15 bp, Artificial Sequence
  dgRNA
  Ccdc14
ccccgggccgtctgt

SEQ ID NO: 29307 - DNA, 15 bp, Artificial Sequence
  dgRNA
  Ccdc14
ctcccactctccgcc

SEQ ID NO: 29308 - DNA, 15 bp, Artificial Sequence
  dgRNA
  Ccdc14
tcccactctccgcct

SEQ ID NO: 29309 - DNA, 15 bp, Artificial Sequence
  dgRNA
  Ccdc14
ctctccgcctgggcg

SEQ ID NO: 29310 - DNA, 15 bp, Artificial Sequence
  dgRNA
  Sypl
aaacgggccgttgtg

SEQ ID NO: 29311 - DNA, 15 bp, Artificial Sequence
  dgRNA
  Sypl
aacgggccgttgtga

SEQ ID NO: 29312 - DNA, 15 bp, Artificial Sequence
  dgRNA
  Sypl
gggccgttgtgaggg

SEQ ID NO: 29313 - DNA, 15 bp, Artificial Sequence
  dgRNA
  Sypl
ggccgttgtgagggc

SEQ ID NO: 29314 - DNA, 15 bp, Artificial Sequence
  dgRNA
  Has3
ctacaccaacttcca

SEQ ID NO: 29315 - DNA, 15 bp, Artificial Sequence
  dgRNA
  Has3
acggaactgccagcg

SEQ ID NO: 29316 - DNA, 15 bp, Artificial Sequence
  dgRNA
  Has3
agcgaggatgtcgga

SEQ ID NO: 29317 - DNA, 15 bp, Artificial Sequence
  dgRNA
  Has3
gcgaggatgtcggat

SEQ ID NO: 29318 - DNA, 15 bp, Artificial Sequence
  dgRNA
  Rnf169
ctcctgctaagcgaa

SEQ ID NO: 29319 - DNA, 15 bp, Artificial Sequence
  dgRNA
  Rnf169
taagcgaaaggccct

SEQ ID NO: 29320 - DNA, 15 bp, Artificial Sequence
  dgRNA
  Rnf169
atccccaggcggact

SEQ ID NO: 29321 - DNA, 15 bp, Artificial Sequence
  dgRNA
  Rnf169
ctttcgcttagcagg

SEQ ID NO: 29322 - DNA, 15 bp, Artificial Sequence
  dgRNA
  Mbp
gttatccggtggttc

SEQ ID NO: 29323 - DNA, 15 bp, Artificial Sequence
  dgRNA
  Mbp
ttatccggtggttct

SEQ ID NO: 29324 - DNA, 15 bp, Artificial Sequence
  dgRNA
  Mbp
tagacctctcttgcc

SEQ ID NO: 29325 - DNA, 15 bp, Artificial Sequence
  dgRNA
  Mbp
gcggtgcgggagcgt

SEQ ID NO: 29326 - DNA, 15 bp, Artificial Sequence
  dgRNA
  Xkrx
cctgtactgacttgt

SEQ ID NO: 29327 - DNA, 15 bp, Artificial Sequence
  dgRNA
  Xkrx
tgttggtctacattc

SEQ ID NO: 29328 - DNA, 15 bp, Artificial Sequence
  dgRNA
  Xkrx
ggactcaactagcca

SEQ ID NO: 29329 - DNA, 15 bp, Artificial Sequence
  dgRNA
  Xkrx
acggggcctcttttc

SEQ ID NO: 29330 - DNA, 15 bp, Artificial Sequence
  dgRNA
  Klf8
ccagcttcgggccag

SEQ ID NO: 29331 - DNA, 15 bp, Artificial Sequence
  dgRNA
  Klf8
cttcgggccagaggt

SEQ ID NO: 29332 - DNA, 15 bp, Artificial Sequence
  dgRNA
  Klf8
ttcgggccagaggta

SEQ ID NO: 29333 - DNA, 15 bp, Artificial Sequence
  dgRNA
  Klf8
cccaacaaaaatgtc

SEQ ID NO: 29334 - DNA, 15 bp, Artificial Sequence
  dgRNA
  P2rx4
caatcctaggcctga

SEQ ID NO: 29335 - DNA, 15 bp, Artificial Sequence
  dgRNA
  P2rx4
gacgccctcaggcct

SEQ ID NO: 29336 - DNA, 15 bp, Artificial Sequence
  dgRNA
  P2rx4
gataatgacgccctc

SEQ ID NO: 29337 - DNA, 15 bp, Artificial Sequence
  dgRNA
  P2rx4
gctcccggagggaca

SEQ ID NO: 29338 - DNA, 15 bp, Artificial Sequence
  dgRNA
  Ppp1r11
atcctttcagcacaa

SEQ ID NO: 29339 - DNA, 15 bp, Artificial Sequence
  dgRNA
  Ppp1r11
cgcactattgcatta

SEQ ID NO: 29340 - DNA, 15 bp, Artificial Sequence
  dgRNA
  Ppp1r11
actattgcattacgg

SEQ ID NO: 29341 - DNA, 15 bp, Artificial Sequence
  dgRNA
  Ppp1r11
acggcggaactattc

SEQ ID NO: 29342 - DNA, 15 bp, Artificial Sequence
  dgRNA
  Zfp418
attaagatcattgtg

SEQ ID NO: 29343 - DNA, 15 bp, Artificial Sequence
  dgRNA
  Zfp418
attatgggctgctgt

SEQ ID NO: 29344 - DNA, 15 bp, Artificial Sequence
  dgRNA
  Pon2
gtatcctcaaacacc

SEQ ID NO: 29345 - DNA, 15 bp, Artificial Sequence
  dgRNA
  Pon2
aagggaactccgcag

SEQ ID NO: 29346 - DNA, 15 bp, Artificial Sequence
  dgRNA
  Pon2
caccctaaagttttc

SEQ ID NO: 29347 - DNA, 15 bp, Artificial Sequence
  dgRNA
  Pon2
aggtgcagctgcgcg

SEQ ID NO: 29348 - DNA, 15 bp, Artificial Sequence
  dgRNA
  Tst
agggcgccggggaag

SEQ ID NO: 29349 - DNA, 15 bp, Artificial Sequence
  dgRNA
  Tst
gggcgccggggaagt

SEQ ID NO: 29350 - DNA, 15 bp, Artificial Sequence
  dgRNA
  Tst
cgccggggaagtggg

SEQ ID NO: 29351 - DNA, 15 bp, Artificial Sequence
  dgRNA
  Tst
gttacgattgcacgc

SEQ ID NO: 29352 - DNA, 15 bp, Artificial Sequence
  dgRNA
  Brca1
ctagtgacgacatac

SEQ ID NO: 29353 - DNA, 15 bp, Artificial Sequence
  dgRNA
  Brca1
ttccgctgacgtgtc

SEQ ID NO: 29354 - DNA, 15 bp, Artificial Sequence
  dgRNA
  Brca1
atcttgtgttccgaa

SEQ ID NO: 29355 - DNA, 15 bp, Artificial Sequence
  dgRNA
  Brca1
cgaaaggctagcgct

SEQ ID NO: 29356 - DNA, 15 bp, Artificial Sequence
  dgRNA
  Ntrk1
cgagggacattagga

SEQ ID NO: 29357 - DNA, 15 bp, Artificial Sequence
  dgRNA
  Ntrk1
attaggaaggcgagc

SEQ ID NO: 29358 - DNA, 15 bp, Artificial Sequence
  dgRNA
  Ntrk1
aggcgagctggcatt

SEQ ID NO: 29359 - DNA, 15 bp, Artificial Sequence
  dgRNA
  Ntrk1
cattagggcctcaaa

SEQ ID NO: 29360 - DNA, 15 bp, Artificial Sequence
  dgRNA
  H2-Q1
ggcaggtccattggg

SEQ ID NO: 29361 - DNA, 15 bp, Artificial Sequence
  dgRNA
  H2-Q1
ggtccattgggtggc

SEQ ID NO: 29362 - DNA, 15 bp, Artificial Sequence
  dgRNA
  H2-Q1
aaccagctactctgt

SEQ ID NO: 29363 - DNA, 15 bp, Artificial Sequence
  dgRNA
  H2-Q1
agtccacgcagctcg

SEQ ID NO: 29364 - DNA, 15 bp, Artificial Sequence
  dgRNA
  Nhlrc1
tgacgtgattatccc

SEQ ID NO: 29365 - DNA, 15 bp, Artificial Sequence
  dgRNA
  Nhlrc1
tcccaggtctgcgca

SEQ ID NO: 29366 - DNA, 15 bp, Artificial Sequence
  dgRNA
  Nhlrc1
tgcgcacggcgcatg

SEQ ID NO: 29367 - DNA, 15 bp, Artificial Sequence
  dgRNA
  Nhlrc1
cgtcgtgcgtccgcc

SEQ ID NO: 29368 - DNA, 15 bp, Artificial Sequence
  dgRNA
  Irx6
cccctctggcggccg

SEQ ID NO: 29369 - DNA, 15 bp, Artificial Sequence
  dgRNA
  Irx6
gtcacgttgagcctc

SEQ ID NO: 29370 - DNA, 15 bp, Artificial Sequence
  dgRNA
  Irx6
ctggccaccttggac

SEQ ID NO: 29371 - DNA, 15 bp, Artificial Sequence
  dgRNA
  Irx6
gcccctgcgcgcctt

SEQ ID NO: 29372 - DNA, 15 bp, Artificial Sequence
  dgRNA
  Mrgbp
cttatgaagctttat

SEQ ID NO: 29373 - DNA, 15 bp, Artificial Sequence
  dgRNA
  Mrgbp
gctacgctttcacag

SEQ ID NO: 29374 - DNA, 15 bp, Artificial Sequence
  dgRNA
  Mrgbp
ctacgctttcacagt

SEQ ID NO: 29375 - DNA, 15 bp, Artificial Sequence
  dgRNA
  Mrgbp
cccagacaatgagac

SEQ ID NO: 29376 - DNA, 15 bp, Artificial Sequence
  dgRNA
  Usp12
gtaggtgcttcacgt

SEQ ID NO: 29377 - DNA, 15 bp, Artificial Sequence
  dgRNA
  Usp12
cttcacgtcggcgct

SEQ ID NO: 29378 - DNA, 15 bp, Artificial Sequence
  dgRNA
  Usp12
ctaggacccatctgc

SEQ ID NO: 29379 - DNA, 15 bp, Artificial Sequence
  dgRNA
  Usp12
aggaggaacgcggca

SEQ ID NO: 29380 - DNA, 15 bp, Artificial Sequence
  dgRNA
  AK010878
aaagtggccgccgcc

SEQ ID NO: 29381 - DNA, 15 bp, Artificial Sequence
  dgRNA
  AK010878
aagtggccgccgcca

SEQ ID NO: 29382 - DNA, 15 bp, Artificial Sequence
  dgRNA
  AK010878
agtggccgccgccag

SEQ ID NO: 29383 - DNA, 15 bp, Artificial Sequence
  dgRNA
  AK010878
aggggcgtcgcgaga

SEQ ID NO: 29384 - DNA, 15 bp, Artificial Sequence
  dgRNA
  Cep131
cactccgggacttac

SEQ ID NO: 29385 - DNA, 15 bp, Artificial Sequence
  dgRNA
  Cep131
aactacccgaagatc

SEQ ID NO: 29386 - DNA, 15 bp, Artificial Sequence
  dgRNA
  Cep131
actacccgaagatca

SEQ ID NO: 29387 - DNA, 15 bp, Artificial Sequence
  dgRNA
  Cep131
acccgaagatcaggg

SEQ ID NO: 29388 - DNA, 15 bp, Artificial Sequence
  dgRNA
  2410016O06Rik
cacggagtctttatc

SEQ ID NO: 29389 - DNA, 15 bp, Artificial Sequence
  dgRNA
  2410016O06Rik
cagtgcatactaccg

SEQ ID NO: 29390 - DNA, 15 bp, Artificial Sequence
  dgRNA
  2410016O06Rik
taccgcggttttaaa

SEQ ID NO: 29391 - DNA, 15 bp, Artificial Sequence
  dgRNA
  2410016O06Rik
aaccgggctagctgt

SEQ ID NO: 29392 - DNA, 15 bp, Artificial Sequence
  dgRNA
  Nisch
ttcggagagttccga

SEQ ID NO: 29393 - DNA, 15 bp, Artificial Sequence
  dgRNA
  Nisch
gaccacaactgcccg

SEQ ID NO: 29394 - DNA, 15 bp, Artificial Sequence
  dgRNA
  Nisch
accacaactgcccga

SEQ ID NO: 29395 - DNA, 15 bp, Artificial Sequence
  dgRNA
  Nisch
ccacaactgcccgag

SEQ ID NO: 29396 - DNA, 15 bp, Artificial Sequence
  dgRNA
  Cd99l2
tcccgtctcgtgcag

SEQ ID NO: 29397 - DNA, 15 bp, Artificial Sequence
  dgRNA
  Cd99l2
cccgtctcgtgcagt

SEQ ID NO: 29398 - DNA, 15 bp, Artificial Sequence
  dgRNA
  Cd99l2
cccccgcaggcatct

SEQ ID NO: 29399 - DNA, 15 bp, Artificial Sequence
  dgRNA
  Cd99l2
cgccaccgccctccc

SEQ ID NO: 29400 - DNA, 15 bp, Artificial Sequence
  dgRNA
  Pcdhb21
tgcatagtcacatgg

SEQ ID NO: 29401 - DNA, 15 bp, Artificial Sequence
  dgRNA
  Pcdhb21
gtggcgctgcaggac

SEQ ID NO: 29402 - DNA, 15 bp, Artificial Sequence
  dgRNA
  Pcdhb21
caataaattactgtc

SEQ ID NO: 29403 - DNA, 15 bp, Artificial Sequence
  dgRNA
  Pcdhb21
actatgcaggtcatt

SEQ ID NO: 29404 - DNA, 15 bp, Artificial Sequence
  dgRNA
  Tmem89
cagggtgcttagatt

SEQ ID NO: 29405 - DNA, 15 bp, Artificial Sequence
  dgRNA
  Tmem89
agggtgcttagatta

SEQ ID NO: 29406 - DNA, 15 bp, Artificial Sequence
  dgRNA
  Tmem89
gtttgcccgttgcca

SEQ ID NO: 29407 - DNA, 15 bp, Artificial Sequence
  dgRNA
  Tmem89
cgttgccaaggtacc

SEQ ID NO: 29408 - DNA, 15 bp, Artificial Sequence
  dgRNA
  4933416C03Rik
gtacatagaggtacg

SEQ ID NO: 29409 - DNA, 15 bp, Artificial Sequence
  dgRNA
  4933416C03Rik
tacgtggagaccgcg

SEQ ID NO: 29410 - DNA, 15 bp, Artificial Sequence
  dgRNA
  4933416C03Rik
agaccgcgaggcctg

SEQ ID NO: 29411 - DNA, 15 bp, Artificial Sequence
  dgRNA
  4933416C03Rik
tgaggtggcgtcctg

SEQ ID NO: 29412 - DNA, 15 bp, Artificial Sequence
  dgRNA
  Lingo1
gatgccaagctaaaa

SEQ ID NO: 29413 - DNA, 15 bp, Artificial Sequence
  dgRNA
  Lingo1
ctattccaatattgc

SEQ ID NO: 29414 - DNA, 15 bp, Artificial Sequence
  dgRNA
  Lingo1
ccaatattgctggcc

SEQ ID NO: 29415 - DNA, 15 bp, Artificial Sequence
  dgRNA
  Lingo1
tttctagggatccta

SEQ ID NO: 29416 - DNA, 15 bp, Artificial Sequence
  dgRNA
  Maf1
ccaatcaacaccaag

SEQ ID NO: 29417 - DNA, 15 bp, Artificial Sequence
  dgRNA
  Maf1
caatcaacaccaaga

SEQ ID NO: 29418 - DNA, 15 bp, Artificial Sequence
  dgRNA
  Maf1
gccagtagaagtgga

SEQ ID NO: 29419 - DNA, 15 bp, Artificial Sequence
  dgRNA
  Maf1
ggtgaagccgagtgg

SEQ ID NO: 29420 - DNA, 15 bp, Artificial Sequence
  dgRNA
  Gpr33
aatcgagaaatggtt

SEQ ID NO: 29421 - DNA, 15 bp, Artificial Sequence
  dgRNA
  Gpr33
taataggataatgtc

SEQ ID NO: 29422 - DNA, 15 bp, Artificial Sequence
  dgRNA
  Gpr33
tcagttaaggttaat

SEQ ID NO: 29423 - DNA, 15 bp, Artificial Sequence
  dgRNA
  Gpr33
aacatactgctgtgg

SEQ ID NO: 29424 - DNA, 15 bp, Artificial Sequence
  dgRNA
  Zfp131
cttcgaagcgccgcg

SEQ ID NO: 29425 - DNA, 15 bp, Artificial Sequence
  dgRNA
  Zfp131
ttcgaagcgccgcgc

SEQ ID NO: 29426 - DNA, 15 bp, Artificial Sequence
  dgRNA
  Zfp131
tcgaagcgccgcgcg

SEQ ID NO: 29427 - DNA, 15 bp, Artificial Sequence
  dgRNA
  Zfp131
gccccgaatcccccc

SEQ ID NO: 29428 - DNA, 15 bp, Artificial Sequence
  dgRNA
  Oxct2a
aatggagtcccaaac

SEQ ID NO: 29429 - DNA, 15 bp, Artificial Sequence
  dgRNA
  Oxct2a
tggagtcccaaacag

SEQ ID NO: 29430 - DNA, 15 bp, Artificial Sequence
  dgRNA
  Oxct2a
acccacggccatccc

SEQ ID NO: 29431 - DNA, 15 bp, Artificial Sequence
  dgRNA
  Oxct2a
tgtgacgcagcgcag

SEQ ID NO: 29432 - DNA, 15 bp, Artificial Sequence
  dgRNA
  Nnt
ctgtaagcgtgcatc

SEQ ID NO: 29433 - DNA, 15 bp, Artificial Sequence
  dgRNA
  Nnt
taagcgtgcatctgg

SEQ ID NO: 29434 - DNA, 15 bp, Artificial Sequence
  dgRNA
  Nnt
ttgcagactggcgat

SEQ ID NO: 29435 - DNA, 15 bp, Artificial Sequence
  dgRNA
  Nnt
tgcagactggcgatc

SEQ ID NO: 29436 - DNA, 15 bp, Artificial Sequence
  dgRNA
  Tmx1
ttctagggcttttcg

SEQ ID NO: 29437 - DNA, 15 bp, Artificial Sequence
  dgRNA
  Tmx1
tctagggcttttcga

SEQ ID NO: 29438 - DNA, 15 bp, Artificial Sequence
  dgRNA
  Tmx1
tcgagggaccacagc

SEQ ID NO: 29439 - DNA, 15 bp, Artificial Sequence
  dgRNA
  Tmx1
cccgcaggaggaaca

SEQ ID NO: 29440 - DNA, 15 bp, Artificial Sequence
  dgRNA
  Gse1
ttggaccagcccggg

SEQ ID NO: 29441 - DNA, 15 bp, Artificial Sequence
  dgRNA
  Gse1
tgtttttacggctcg

SEQ ID NO: 29442 - DNA, 15 bp, Artificial Sequence
  dgRNA
  Gse1
gcgtgcgattcccga

SEQ ID NO: 29443 - DNA, 15 bp, Artificial Sequence
  dgRNA
  Gse1
cgtgcgattcccgac

SEQ ID NO: 29444 - DNA, 15 bp, Artificial Sequence
  dgRNA
  Ddx49
ccgagaactatagtt

SEQ ID NO: 29445 - DNA, 15 bp, Artificial Sequence
  dgRNA
  Ddx49
ccgtcaacaaacaca

SEQ ID NO: 29446 - DNA, 15 bp, Artificial Sequence
  dgRNA
  Ddx49
aaagcggtcaaagct

SEQ ID NO: 29447 - DNA, 15 bp, Artificial Sequence
  dgRNA
  Ddx49
ggtcaaagctcggat

SEQ ID NO: 29448 - DNA, 15 bp, Artificial Sequence
  dgRNA
  Idh1
cagaacactcggtct

SEQ ID NO: 29449 - DNA, 15 bp, Artificial Sequence
  dgRNA
  Idh1
cgatagcctgtcagt

SEQ ID NO: 29450 - DNA, 15 bp, Artificial Sequence
  dgRNA
  Idh1
tagcctgtcagtagg

SEQ ID NO: 29451 - DNA, 15 bp, Artificial Sequence
  dgRNA
  Idh1
tcgctcctcaactgc

SEQ ID NO: 29452 - DNA, 15 bp, Artificial Sequence
  dgRNA
  Spta1
aacacagcccaatac

SEQ ID NO: 29453 - DNA, 15 bp, Artificial Sequence
  dgRNA
  Spta1
gatgcaaaagtttgg

SEQ ID NO: 29454 - DNA, 15 bp, Artificial Sequence
  dgRNA
  Spta1
ggacatattcagttg

SEQ ID NO: 29455 - DNA, 15 bp, Artificial Sequence
  dgRNA
  Olfr1466
ggctagctatatata

SEQ ID NO: 29456 - DNA, 15 bp, Artificial Sequence
  dgRNA
  Olfr1466
gggctagctatatat

SEQ ID NO: 29457 - DNA, 15 bp, Artificial Sequence
  dgRNA
  Olfr1466
tatatatatagcgac

SEQ ID NO: 29458 - DNA, 15 bp, Artificial Sequence
  dgRNA
  Arhgef2
tccctcactcgcgcg

SEQ ID NO: 29459 - DNA, 15 bp, Artificial Sequence
  dgRNA
  Arhgef2
cgcgcgcggatcgac

SEQ ID NO: 29460 - DNA, 15 bp, Artificial Sequence
  dgRNA
  Arhgef2
ggatcgaccggagca

SEQ ID NO: 29461 - DNA, 15 bp, Artificial Sequence
  dgRNA
  Arhgef2
accggagcaaggagc

SEQ ID NO: 29462 - DNA, 15 bp, Artificial Sequence
  dgRNA
  Krtap26-1
gttatactcaatcga

SEQ ID NO: 29463 - DNA, 15 bp, Artificial Sequence
  dgRNA
  Krtap26-1
tactcaatcgatgga

SEQ ID NO: 29464 - DNA, 15 bp, Artificial Sequence
  dgRNA
  Krtap26-1
gatggaaggtatttc

SEQ ID NO: 29465 - DNA, 15 bp, Artificial Sequence
  dgRNA
  Krtap26-1
atttcagggatcatc

SEQ ID NO: 29466 - DNA, 15 bp, Artificial Sequence
  dgRNA
  Trp53tg5
tcttatcttataggg

SEQ ID NO: 29467 - DNA, 15 bp, Artificial Sequence
  dgRNA
  Trp53tg5
agctcagtatgaggc

SEQ ID NO: 29468 - DNA, 15 bp, Artificial Sequence
  dgRNA
  Trp53tg5
atgtgcgacagcatc

SEQ ID NO: 29469 - DNA, 15 bp, Artificial Sequence
  dgRNA
  Trp53tg5
aacataggatggtgc

SEQ ID NO: 29470 - DNA, 15 bp, Artificial Sequence
  dgRNA
  Ccdc27
accctttccctaaat

SEQ ID NO: 29471 - DNA, 15 bp, Artificial Sequence
  dgRNA
  Ccdc27
ctttccctaaattgg

SEQ ID NO: 29472 - DNA, 15 bp, Artificial Sequence
  dgRNA
  Ccdc27
ggcggtctgacccca

SEQ ID NO: 29473 - DNA, 15 bp, Artificial Sequence
  dgRNA
  Ccdc27
aggcggtctgacccc

SEQ ID NO: 29474 - DNA, 15 bp, Artificial Sequence
  dgRNA
  Comp
tatactgatcagctg

SEQ ID NO: 29475 - DNA, 15 bp, Artificial Sequence
  dgRNA
  Comp
atactgatcagctgc

SEQ ID NO: 29476 - DNA, 15 bp, Artificial Sequence
  dgRNA
  Comp
tgcgggtcatcccgc

SEQ ID NO: 29477 - DNA, 15 bp, Artificial Sequence
  dgRNA
  Comp
gcgggtcatcccgca

SEQ ID NO: 29478 - DNA, 15 bp, Artificial Sequence
  dgRNA
  Ccs
aatcggcttgaggtc

SEQ ID NO: 29479 - DNA, 15 bp, Artificial Sequence
  dgRNA
  Ccs
tttaccaggtggttc

SEQ ID NO: 29480 - DNA, 15 bp, Artificial Sequence
  dgRNA
  Ccs
gtggttccggctgag

SEQ ID NO: 29481 - DNA, 15 bp, Artificial Sequence
  dgRNA
  Ccs
tggttccggctgagc

SEQ ID NO: 29482 - DNA, 15 bp, Artificial Sequence
  dgRNA
  Pnkp
aagtaactctagcgt

SEQ ID NO: 29483 - DNA, 15 bp, Artificial Sequence
  dgRNA
  Pnkp
agtaactctagcgta

SEQ ID NO: 29484 - DNA, 15 bp, Artificial Sequence
  dgRNA
  Pnkp
gggatcaagtgacta

SEQ ID NO: 29485 - DNA, 15 bp, Artificial Sequence
  dgRNA
  Pnkp
gacccctatccgctc

SEQ ID NO: 29486 - DNA, 15 bp, Artificial Sequence
  dgRNA
  Slc4a4
cgcgcgctctgcgac

SEQ ID NO: 29487 - DNA, 15 bp, Artificial Sequence
  dgRNA
  Slc4a4
ccagcccacgccgcc

SEQ ID NO: 29488 - DNA, 15 bp, Artificial Sequence
  dgRNA
  Slc4a4
cagcccacgccgccc

SEQ ID NO: 29489 - DNA, 15 bp, Artificial Sequence
  dgRNA
  Slc4a4
agccccggcggcgcg

SEQ ID NO: 29490 - DNA, 15 bp, Artificial Sequence
  dgRNA
  Ifnk
cggaaaaaaagcgcc

SEQ ID NO: 29491 - DNA, 15 bp, Artificial Sequence
  dgRNA
  Ifnk
agcgcctggaggcaa

SEQ ID NO: 29492 - DNA, 15 bp, Artificial Sequence
  dgRNA
  Ifnk
ccgctgaagatatac

SEQ ID NO: 29493 - DNA, 15 bp, Artificial Sequence
  dgRNA
  Ifnk
tatatcttcagcggg

SEQ ID NO: 29494 - DNA, 15 bp, Artificial Sequence
  dgRNA
  Slc7a1
gtcgtcagctgtccg

SEQ ID NO: 29495 - DNA, 15 bp, Artificial Sequence
  dgRNA
  Slc7a1
ccgtggctccccagg

SEQ ID NO: 29496 - DNA, 15 bp, Artificial Sequence
  dgRNA
  Slc7a1
gctcagttgcggctg

SEQ ID NO: 29497 - DNA, 15 bp, Artificial Sequence
  dgRNA
  Slc7a1
cagttgcggctgcgg

SEQ ID NO: 29498 - DNA, 15 bp, Artificial Sequence
  dgRNA
  Shcbp1l
tgtttcaggacttaa

SEQ ID NO: 29499 - DNA, 15 bp, Artificial Sequence
  dgRNA
  Shcbp1l
ttcaggacttaaggg

SEQ ID NO: 29500 - DNA, 15 bp, Artificial Sequence
  dgRNA
  Shcbp1l
gacttaagggtggat

SEQ ID NO: 29501 - DNA, 15 bp, Artificial Sequence
  dgRNA
  Shcbp1l
gaccaacgagctcct

SEQ ID NO: 29502 - DNA, 15 bp, Artificial Sequence
  dgRNA
  9230110C19Rik
gagtcctcagtgtaa

SEQ ID NO: 29503 - DNA, 15 bp, Artificial Sequence
  dgRNA
  9230110C19Rik
atgcgtactgagcca

SEQ ID NO: 29504 - DNA, 15 bp, Artificial Sequence
  dgRNA
  9230110C19Rik
tgcgtactgagccaa

SEQ ID NO: 29505 - DNA, 15 bp, Artificial Sequence
  dgRNA
  9230110C19Rik
gcgtactgagccaag

SEQ ID NO: 29506 - DNA, 15 bp, Artificial Sequence
  dgRNA
  Atp1b3
gcagccccgccgcgc

SEQ ID NO: 29507 - DNA, 15 bp, Artificial Sequence
  dgRNA
  Atp1b3
tggcttcctcgcacc

SEQ ID NO: 29508 - DNA, 15 bp, Artificial Sequence
  dgRNA
  Atp1b3
ggcttcctcgcacct

SEQ ID NO: 29509 - DNA, 15 bp, Artificial Sequence
  dgRNA
  Atp1b3
tcctcgcacctgggc

SEQ ID NO: 29510 - DNA, 15 bp, Artificial Sequence
  dgRNA
  Ntn1
cactcctagcgcgag

SEQ ID NO: 29511 - DNA, 15 bp, Artificial Sequence
  dgRNA
  Ntn1
tcctagcgcgagtgg

SEQ ID NO: 29512 - DNA, 15 bp, Artificial Sequence
  dgRNA
  Ntn1
tagcgcgagtggtgg

SEQ ID NO: 29513 - DNA, 15 bp, Artificial Sequence
  dgRNA
  Ntn1
cgcgagtggtggcgg

SEQ ID NO: 29514 - DNA, 15 bp, Artificial Sequence
  dgRNA
  S100a3
gatgtgtgcgttgct

SEQ ID NO: 29515 - DNA, 15 bp, Artificial Sequence
  dgRNA
  S100a3
gtgtgcgttgctagg

SEQ ID NO: 29516 - DNA, 15 bp, Artificial Sequence
  dgRNA
  S100a3
tgtgcgttgctaggt

SEQ ID NO: 29517 - DNA, 15 bp, Artificial Sequence
  dgRNA
  S100a3
gcgttgctaggtggg

SEQ ID NO: 29518 - DNA, 15 bp, Artificial Sequence
  dgRNA
  Arid3b
agctgcttccggcct

SEQ ID NO: 29519 - DNA, 15 bp, Artificial Sequence
  dgRNA
  Arid3b
cccgccccgggctga

SEQ ID NO: 29520 - DNA, 15 bp, Artificial Sequence
  dgRNA
  Arid3b
ccccgggctgacggc

SEQ ID NO: 29521 - DNA, 15 bp, Artificial Sequence
  dgRNA
  Arid3b
cccgggctgacggcc

SEQ ID NO: 29522 - DNA, 15 bp, Artificial Sequence
  dgRNA
  Zhx1
aagcgaccgaggtcg

SEQ ID NO: 29523 - DNA, 15 bp, Artificial Sequence
  dgRNA
  Zhx1
agcgaccgaggtcgc

SEQ ID NO: 29524 - DNA, 15 bp, Artificial Sequence
  dgRNA
  Zhx1
gaccgaggtcgcggg

SEQ ID NO: 29525 - DNA, 15 bp, Artificial Sequence
  dgRNA
  Zhx1
cgaggtcgcgggagg

SEQ ID NO: 29526 - DNA, 15 bp, Artificial Sequence
  dgRNA
  Pcgf2
ctccccgagacccac

SEQ ID NO: 29527 - DNA, 15 bp, Artificial Sequence
  dgRNA
  Pcgf2
ccggaccccgaagcc

SEQ ID NO: 29528 - DNA, 15 bp, Artificial Sequence
  dgRNA
  Pcgf2
ccgaagccaggtaag

SEQ ID NO: 29529 - DNA, 15 bp, Artificial Sequence
  dgRNA
  Pcgf2
acctcgtaagcgtct

SEQ ID NO: 29530 - DNA, 15 bp, Artificial Sequence
  dgRNA
  Fut10
gccaatagccgggag

SEQ ID NO: 29531 - DNA, 15 bp, Artificial Sequence
  dgRNA
  Fut10
ggagaggtaccaata

SEQ ID NO: 29532 - DNA, 15 bp, Artificial Sequence
  dgRNA
  Fut10
gagaggtaccaataa

SEQ ID NO: 29533 - DNA, 15 bp, Artificial Sequence
  dgRNA
  Fut10
gcatccacgaaaacg

SEQ ID NO: 29534 - DNA, 15 bp, Artificial Sequence
  dgRNA
  Pde6g
gctacctactggact

SEQ ID NO: 29535 - DNA, 15 bp, Artificial Sequence
  dgRNA
  Pde6g
ctacctactggactt

SEQ ID NO: 29536 - DNA, 15 bp, Artificial Sequence
  dgRNA
  Pde6g
cctactggacttggg

SEQ ID NO: 29537 - DNA, 15 bp, Artificial Sequence
  dgRNA
  Pde6g
ctttcactggttgta

SEQ ID NO: 29538 - DNA, 15 bp, Artificial Sequence
  dgRNA
  Aste1
tagagctcgctgcct

SEQ ID NO: 29539 - DNA, 15 bp, Artificial Sequence
  dgRNA
  Aste1
gctcgctgcctcgga

SEQ ID NO: 29540 - DNA, 15 bp, Artificial Sequence
  dgRNA
  Aste1
ctgcctcggagggcg

SEQ ID NO: 29541 - DNA, 15 bp, Artificial Sequence
  dgRNA
  Aste1
ttaacatcgtcgcca

SEQ ID NO: 29542 - DNA, 15 bp, Artificial Sequence
  dgRNA
  Set
gccaaactcacgagt

SEQ ID NO: 29543 - DNA, 15 bp, Artificial Sequence
  dgRNA
  Set
ccaaactcacgagtt

SEQ ID NO: 29544 - DNA, 15 bp, Artificial Sequence
  dgRNA
  Set
caaactcacgagttg

SEQ ID NO: 29545 - DNA, 15 bp, Artificial Sequence
  dgRNA
  Set
aaactcacgagttgg

SEQ ID NO: 29546 - DNA, 15 bp, Artificial Sequence
  dgRNA
  Olfr139
ggatacctgcaaagt

SEQ ID NO: 29547 - DNA, 15 bp, Artificial Sequence
  dgRNA
  Olfr139
acctgcaaagtaggc

SEQ ID NO: 29548 - DNA, 15 bp, Artificial Sequence
  dgRNA
  Olfr139
ttgattttaatcggc

SEQ ID NO: 29549 - DNA, 15 bp, Artificial Sequence
  dgRNA
  Olfr139
ttagatctcacaata

SEQ ID NO: 29550 - DNA, 15 bp, Artificial Sequence
  dgRNA
  Nxn
tgtagaactcgggtc

SEQ ID NO: 29551 - DNA, 15 bp, Artificial Sequence
  dgRNA
  Nxn
actttagccacgtac

SEQ ID NO: 29552 - DNA, 15 bp, Artificial Sequence
  dgRNA
  Nxn
ttagccacgtaccgg

SEQ ID NO: 29553 - DNA, 15 bp, Artificial Sequence
  dgRNA
  Nxn
aagacgccagctgct

SEQ ID NO: 29554 - DNA, 15 bp, Artificial Sequence
  dgRNA
  Hadha
ctgccgctgccaaca

SEQ ID NO: 29555 - DNA, 15 bp, Artificial Sequence
  dgRNA
  Hadha
cgtccgcccacgccg

SEQ ID NO: 29556 - DNA, 15 bp, Artificial Sequence
  dgRNA
  Hadha
gtccgcccacgccga

SEQ ID NO: 29557 - DNA, 15 bp, Artificial Sequence
  dgRNA
  Hadha
tccgcccacgccgag

SEQ ID NO: 29558 - DNA, 15 bp, Artificial Sequence
  dgRNA
  Map4
ccagtcagttcctcg

SEQ ID NO: 29559 - DNA, 15 bp, Artificial Sequence
  dgRNA
  Map4
tagagcccaccagtc

SEQ ID NO: 29560 - DNA, 15 bp, Artificial Sequence
  dgRNA
  Map4
tgattatatggggcc

SEQ ID NO: 29561 - DNA, 15 bp, Artificial Sequence
  dgRNA
  Map4
gcaaaactgattata

SEQ ID NO: 29562 - DNA, 15 bp, Artificial Sequence
  dgRNA
  Pcdha11
gtgtcgctctttact

SEQ ID NO: 29563 - DNA, 15 bp, Artificial Sequence
  dgRNA
  Pcdha11
tcgctctttacttgg

SEQ ID NO: 29564 - DNA, 15 bp, Artificial Sequence
  dgRNA
  Pcdha11
gtgtacatccaccac

SEQ ID NO: 29565 - DNA, 15 bp, Artificial Sequence
  dgRNA
  Pcdha11
gtcgggttttgtatg

SEQ ID NO: 29566 - DNA, 15 bp, Artificial Sequence
  dgRNA
  Bckdha
cgcatgcgcccgtct

SEQ ID NO: 29567 - DNA, 15 bp, Artificial Sequence
  dgRNA
  Bckdha
gcatgcgcccgtcta

SEQ ID NO: 29568 - DNA, 15 bp, Artificial Sequence
  dgRNA
  Bckdha
agggcacgcccgagt

SEQ ID NO: 29569 - DNA, 15 bp, Artificial Sequence
  dgRNA
  Bckdha
gttggccctagcacg

SEQ ID NO: 29570 - DNA, 15 bp, Artificial Sequence
  dgRNA
  Ncoa5
gacagcagtcctgcg

SEQ ID NO: 29571 - DNA, 15 bp, Artificial Sequence
  dgRNA
  Ncoa5
acagcagtcctgcgc

SEQ ID NO: 29572 - DNA, 15 bp, Artificial Sequence
  dgRNA
  Ncoa5
cagcagtcctgcgcg

SEQ ID NO: 29573 - DNA, 15 bp, Artificial Sequence
  dgRNA
  Ncoa5
tcctgcgcggggcgc

SEQ ID NO: 29574 - DNA, 15 bp, Artificial Sequence
  dgRNA
  B3gnt6
ccactctcacagggg

SEQ ID NO: 29575 - DNA, 15 bp, Artificial Sequence
  dgRNA
  B3gnt6
tagcaagggttgtcc

SEQ ID NO: 29576 - DNA, 15 bp, Artificial Sequence
  dgRNA
  B3gnt6
gcatttgaccaatcc

SEQ ID NO: 29577 - DNA, 15 bp, Artificial Sequence
  dgRNA
  B3gnt6
cccttgctacacact

SEQ ID NO: 29578 - DNA, 15 bp, Artificial Sequence
  dgRNA
  Ctla2b
cctagtccttgcgtc

SEQ ID NO: 29579 - DNA, 15 bp, Artificial Sequence
  dgRNA
  Ctla2b
ccaggccgaggcttc

SEQ ID NO: 29580 - DNA, 15 bp, Artificial Sequence
  dgRNA
  Ctla2b
aactagcagtgctcc

SEQ ID NO: 29581 - DNA, 15 bp, Artificial Sequence
  dgRNA
  Ctla2b
taggctgagtcatac

SEQ ID NO: 29582 - DNA, 15 bp, Artificial Sequence
  dgRNA
  Slc41a1
cagctcaagaaacgc

SEQ ID NO: 29583 - DNA, 15 bp, Artificial Sequence
  dgRNA
  Slc41a1
agctcaagaaacgcc

SEQ ID NO: 29584 - DNA, 15 bp, Artificial Sequence
  dgRNA
  Slc41a1
gctcaagaaacgccg

SEQ ID NO: 29585 - DNA, 15 bp, Artificial Sequence
  dgRNA
  Slc41a1
gaaacgccggggaaa

SEQ ID NO: 29586 - DNA, 15 bp, Artificial Sequence
  dgRNA
  Tmprss9
gcatggcggtcacaa

SEQ ID NO: 29587 - DNA, 15 bp, Artificial Sequence
  dgRNA
  Tmprss9
gatcaagtctcctta

SEQ ID NO: 29588 - DNA, 15 bp, Artificial Sequence
  dgRNA
  Tmprss9
agtctccttaaggat

SEQ ID NO: 29589 - DNA, 15 bp, Artificial Sequence
  dgRNA
  Tmprss9
tgggacaaattggct

SEQ ID NO: 29590 - DNA, 15 bp, Artificial Sequence
  dgRNA
  Kcnj1
gtgagctatagagcg

SEQ ID NO: 29591 - DNA, 15 bp, Artificial Sequence
  dgRNA
  Kcnj1
gcgtggcaaagaaaa

SEQ ID NO: 29592 - DNA, 15 bp, Artificial Sequence
  dgRNA
  Kcnj1
cgtggcaaagaaaag

SEQ ID NO: 29593 - DNA, 15 bp, Artificial Sequence
  dgRNA
  Kcnj1
aaaggggggccatgc

SEQ ID NO: 29594 - DNA, 15 bp, Artificial Sequence
  dgRNA
  Bnip3
gcgcactcctgcctc

SEQ ID NO: 29595 - DNA, 15 bp, Artificial Sequence
  dgRNA
  Bnip3
ccgccccccagccaa

SEQ ID NO: 29596 - DNA, 15 bp, Artificial Sequence
  dgRNA
  Bnip3
gcagaagtggaccgg

SEQ ID NO: 29597 - DNA, 15 bp, Artificial Sequence
  dgRNA
  Bnip3
tgcagaagtggaccg

SEQ ID NO: 29598 - DNA, 15 bp, Artificial Sequence
  dgRNA
  Pde1c
ggcacaccggaaacc

SEQ ID NO: 29599 - DNA, 15 bp, Artificial Sequence
  dgRNA
  Pde1c
gcacaccggaaaccg

SEQ ID NO: 29600 - DNA, 15 bp, Artificial Sequence
  dgRNA
  Pde1c
gagggccccggtttc

SEQ ID NO: 29601 - DNA, 15 bp, Artificial Sequence
  dgRNA
  Nkain2
gctgtaagtgcatgc

SEQ ID NO: 29602 - DNA, 15 bp, Artificial Sequence
  dgRNA
  Nkain2
tacagcaaagagcgg

SEQ ID NO: 29603 - DNA, 15 bp, Artificial Sequence
  dgRNA
  Nkain2
actggggtgccgcta

SEQ ID NO: 29604 - DNA, 15 bp, Artificial Sequence
  dgRNA
  Nkain2
gtgagatatcaactg

SEQ ID NO: 29605 - DNA, 15 bp, Artificial Sequence
  dgRNA
  Olfr1121
tcaaggccgagaata

SEQ ID NO: 29606 - DNA, 15 bp, Artificial Sequence
  dgRNA
  Tecrl
gaagattactgtatc

SEQ ID NO: 29607 - DNA, 15 bp, Artificial Sequence
  dgRNA
  Tecrl
tactgtatccggaac

SEQ ID NO: 29608 - DNA, 15 bp, Artificial Sequence
  dgRNA
  Tecrl
actgtatccggaact

SEQ ID NO: 29609 - DNA, 15 bp, Artificial Sequence
  dgRNA
  Tecrl
gggtgacaccatata

SEQ ID NO: 29610 - DNA, 15 bp, Artificial Sequence
  dgRNA
  Hnrnpa1
aatagaacgcccaaa

SEQ ID NO: 29611 - DNA, 15 bp, Artificial Sequence
  dgRNA
  Hnrnpa1
atgccgtttcttagc

SEQ ID NO: 29612 - DNA, 15 bp, Artificial Sequence
  dgRNA
  Hnrnpa1
tgccgtttcttagca

SEQ ID NO: 29613 - DNA, 15 bp, Artificial Sequence
  dgRNA
  Hnrnpa1
gtcttcacgggccaa

SEQ ID NO: 29614 - DNA, 15 bp, Artificial Sequence
  dgRNA
  Galns
tgcacaccgccatat

SEQ ID NO: 29615 - DNA, 15 bp, Artificial Sequence
  dgRNA
  Galns
caccgccatattggc

SEQ ID NO: 29616 - DNA, 15 bp, Artificial Sequence
  dgRNA
  Galns
tcatgtgacccgatg

SEQ ID NO: 29617 - DNA, 15 bp, Artificial Sequence
  dgRNA
  Galns
tgtgacccgatgtgg

SEQ ID NO: 29618 - DNA, 15 bp, Artificial Sequence
  dgRNA
  Fscn3
cctacctcaattgct

SEQ ID NO: 29619 - DNA, 15 bp, Artificial Sequence
  dgRNA
  Fscn3
caattgcttggagtt

SEQ ID NO: 29620 - DNA, 15 bp, Artificial Sequence
  dgRNA
  Fscn3
gggacccacttcctt

SEQ ID NO: 29621 - DNA, 15 bp, Artificial Sequence
  dgRNA
  Fscn3
caagggcattctgct

SEQ ID NO: 29622 - DNA, 15 bp, Artificial Sequence
  dgRNA
  Cx3cl1
tatctggggatttta

SEQ ID NO: 29623 - DNA, 15 bp, Artificial Sequence
  dgRNA
  Cx3cl1
ttaaggggtgattgc

SEQ ID NO: 29624 - DNA, 15 bp, Artificial Sequence
  dgRNA
  Cx3cl1
taaggggtgattgct

SEQ ID NO: 29625 - DNA, 15 bp, Artificial Sequence
  dgRNA
  Cx3cl1
aaggggtgattgctg

SEQ ID NO: 29626 - DNA, 15 bp, Artificial Sequence
  dgRNA
  Upp2
gcggcgaccgggagc

SEQ ID NO: 29627 - DNA, 15 bp, Artificial Sequence
  dgRNA
  Upp2
tggctgcggagcgct

SEQ ID NO: 29628 - DNA, 15 bp, Artificial Sequence
  dgRNA
  Upp2
cggccaatgagtgtc

SEQ ID NO: 29629 - DNA, 15 bp, Artificial Sequence
  dgRNA
  Upp2
gagctgtgattaacc

SEQ ID NO: 29630 - DNA, 15 bp, Artificial Sequence
  dgRNA
  Asgr1
tatggttcaaagtcc

SEQ ID NO: 29631 - DNA, 15 bp, Artificial Sequence
  dgRNA
  Asgr1
tcaaagtcccggtgt

SEQ ID NO: 29632 - DNA, 15 bp, Artificial Sequence
  dgRNA
  Asgr1
gagtagacttggaac

SEQ ID NO: 29633 - DNA, 15 bp, Artificial Sequence
  dgRNA
  Asgr1
aggtaggagtagact

SEQ ID NO: 29634 - DNA, 15 bp, Artificial Sequence
  dgRNA
  Eif4g3
cagccaggcgacctt

SEQ ID NO: 29635 - DNA, 15 bp, Artificial Sequence
  dgRNA
  Eif4g3
ttccatttcgcactt

SEQ ID NO: 29636 - DNA, 15 bp, Artificial Sequence
  dgRNA
  Eif4g3
tccatttcgcacttt

SEQ ID NO: 29637 - DNA, 15 bp, Artificial Sequence
  dgRNA
  Eif4g3
tcgacataatgccca

SEQ ID NO: 29638 - DNA, 15 bp, Artificial Sequence
  dgRNA
  Ptpru
cgcatccgttgccca

SEQ ID NO: 29639 - DNA, 15 bp, Artificial Sequence
  dgRNA
  Rpl3l
gcccattcaaccctt

SEQ ID NO: 29640 - DNA, 15 bp, Artificial Sequence
  dgRNA
  Rpl3l
ctagctgccccacgc

SEQ ID NO: 29641 - DNA, 15 bp, Artificial Sequence
  dgRNA
  Rpl3l
acccaagggttgaat

SEQ ID NO: 29642 - DNA, 15 bp, Artificial Sequence
  dgRNA
  Rpl3l
aagaagggcctgcgt

SEQ ID NO: 29643 - DNA, 15 bp, Artificial Sequence
  dgRNA
  Pmm2
cccgccgcctgctac

SEQ ID NO: 29644 - DNA, 15 bp, Artificial Sequence
  dgRNA
  Pmm2
cgctgtacttgtcac

SEQ ID NO: 29645 - DNA, 15 bp, Artificial Sequence
  dgRNA
  Pmm2
tcaccggaaagttga

SEQ ID NO: 29646 - DNA, 15 bp, Artificial Sequence
  dgRNA
  Pmm2
caccggaaagttgaa

SEQ ID NO: 29647 - DNA, 15 bp, Artificial Sequence
  dgRNA
  Pyhin1
gagatgcactctgcc

SEQ ID NO: 29648 - DNA, 15 bp, Artificial Sequence
  dgRNA
  Pyhin1
atgcactctgccggg

SEQ ID NO: 29649 - DNA, 15 bp, Artificial Sequence
  dgRNA
  Pyhin1
tgcactctgccggga

SEQ ID NO: 29650 - DNA, 15 bp, Artificial Sequence
  dgRNA
  Pigv
ccgcgcacaaactgc

SEQ ID NO: 29651 - DNA, 15 bp, Artificial Sequence
  dgRNA
  Pigv
tgctggcgagtcaag

SEQ ID NO: 29652 - DNA, 15 bp, Artificial Sequence
  dgRNA
  Pigv
caggtgtcaccacgc

SEQ ID NO: 29653 - DNA, 15 bp, Artificial Sequence
  dgRNA
  Pigv
gtcaccacgccggga

SEQ ID NO: 29654 - DNA, 15 bp, Artificial Sequence
  dgRNA
  Olfr1019
ggtaattctagtgac

SEQ ID NO: 29655 - DNA, 15 bp, Artificial Sequence
  dgRNA
  Mcf2
ttccctacccctccg

SEQ ID NO: 29656 - DNA, 15 bp, Artificial Sequence
  dgRNA
  Mcf2
tccctacccctccgc

SEQ ID NO: 29657 - DNA, 15 bp, Artificial Sequence
  dgRNA
  Mcf2
ccgcgggcgtatctg

SEQ ID NO: 29658 - DNA, 15 bp, Artificial Sequence
  dgRNA
  Mcf2
cgcgggcgtatctgt

SEQ ID NO: 29659 - DNA, 15 bp, Artificial Sequence
  dgRNA
  Cbx6
ttaacttatctgaac

SEQ ID NO: 29660 - DNA, 15 bp, Artificial Sequence
  dgRNA
  Cbx6
cgaatacataaataa

SEQ ID NO: 29661 - DNA, 15 bp, Artificial Sequence
  dgRNA
  Cbx6
aatccccacaaggcc

SEQ ID NO: 29662 - DNA, 15 bp, Artificial Sequence
  dgRNA
  Cbx6
acgccacagcaggaa

SEQ ID NO: 29663 - DNA, 15 bp, Artificial Sequence
  dgRNA
  Uck2
tattttggcacacgg

SEQ ID NO: 29664 - DNA, 15 bp, Artificial Sequence
  dgRNA
  Uck2
attttggcacacgga

SEQ ID NO: 29665 - DNA, 15 bp, Artificial Sequence
  dgRNA
  Uck2
ttggcacacggaggg

SEQ ID NO: 29666 - DNA, 15 bp, Artificial Sequence
  dgRNA
  Uck2
tggcacacggagggt

SEQ ID NO: 29667 - DNA, 15 bp, Artificial Sequence
  dgRNA
  Smim12
atgtggcaacgtcac

SEQ ID NO: 29668 - DNA, 15 bp, Artificial Sequence
  dgRNA
  Smim12
tgtggcaacgtcaca

SEQ ID NO: 29669 - DNA, 15 bp, Artificial Sequence
  dgRNA
  Smim12
gtggcaacgtcacag

SEQ ID NO: 29670 - DNA, 15 bp, Artificial Sequence
  dgRNA
  Smim12
agcctccgagccgtc

SEQ ID NO: 29671 - DNA, 15 bp, Artificial Sequence
  dgRNA
  Pcyt1a
cggaactactctgtc

SEQ ID NO: 29672 - DNA, 15 bp, Artificial Sequence
  dgRNA
  Pcyt1a
tactctgtcaggttg

SEQ ID NO: 29673 - DNA, 15 bp, Artificial Sequence
  dgRNA
  Pcyt1a
gcattgacaagaggg

SEQ ID NO: 29674 - DNA, 15 bp, Artificial Sequence
  dgRNA
  Pcyt1a
tgacaagagggcggg

SEQ ID NO: 29675 - DNA, 15 bp, Artificial Sequence
  dgRNA
  Aldoa
gtgacctgcgggatg

SEQ ID NO: 29676 - DNA, 15 bp, Artificial Sequence
  dgRNA
  Aldoa
cgagtcacgtcctag

SEQ ID NO: 29677 - DNA, 15 bp, Artificial Sequence
  dgRNA
  Aldoa
agtcacgtcctagcg

SEQ ID NO: 29678 - DNA, 15 bp, Artificial Sequence
  dgRNA
  Aldoa
cacgtcctagcgggg

SEQ ID NO: 29679 - DNA, 15 bp, Artificial Sequence
  dgRNA
  Ncam1
gttaggaactatttg

SEQ ID NO: 29680 - DNA, 15 bp, Artificial Sequence
  dgRNA
  Ncam1
ggaactatttgtggt

SEQ ID NO: 29681 - DNA, 15 bp, Artificial Sequence
  dgRNA
  Ncam1
tatttgtggtcggcg

SEQ ID NO: 29682 - DNA, 15 bp, Artificial Sequence
  dgRNA
  Ncam1
ttgtggtcggcgtgg

SEQ ID NO: 29683 - DNA, 15 bp, Artificial Sequence
  dgRNA
  Hif1an
agcgagtcggcctta

SEQ ID NO: 29684 - DNA, 15 bp, Artificial Sequence
  dgRNA
  Hif1an
ctgcaggtcaccgct

SEQ ID NO: 29685 - DNA, 15 bp, Artificial Sequence
  dgRNA
  Hif1an
tgcaggtcaccgcta

SEQ ID NO: 29686 - DNA, 15 bp, Artificial Sequence
  dgRNA
  Hif1an
gcgctccttcaacct

SEQ ID NO: 29687 - DNA, 15 bp, Artificial Sequence
  dgRNA
  Olfr204
gatgctcactgcaaa

SEQ ID NO: 29688 - DNA, 15 bp, Artificial Sequence
  dgRNA
  Ovol1
gcgccatcgctctct

SEQ ID NO: 29689 - DNA, 15 bp, Artificial Sequence
  dgRNA
  Ovol1
cttcgcgagcagccg

SEQ ID NO: 29690 - DNA, 15 bp, Artificial Sequence
  dgRNA
  Ovol1
ttcgcgagcagccgc

SEQ ID NO: 29691 - DNA, 15 bp, Artificial Sequence
  dgRNA
  Ovol1
tcgcgagcagccgcg

SEQ ID NO: 29692 - DNA, 15 bp, Artificial Sequence
  dgRNA
  Agt
ggctcatctgccagt

SEQ ID NO: 29693 - DNA, 15 bp, Artificial Sequence
  dgRNA
  Agt
gctcatctgccagta

SEQ ID NO: 29694 - DNA, 15 bp, Artificial Sequence
  dgRNA
  Agt
gccagtagggcttcc

SEQ ID NO: 29695 - DNA, 15 bp, Artificial Sequence
  dgRNA
  Agt
ggccctgatccatct

SEQ ID NO: 29696 - DNA, 15 bp, Artificial Sequence
  dgRNA
  Grhl3
ccccctcagctaaga

SEQ ID NO: 29697 - DNA, 15 bp, Artificial Sequence
  dgRNA
  Grhl3
gagctccgcccctgc

SEQ ID NO: 29698 - DNA, 15 bp, Artificial Sequence
  dgRNA
  Grhl3
ggtacttggctcaaa

SEQ ID NO: 29699 - DNA, 15 bp, Artificial Sequence
  dgRNA
  Grhl3
aggtacttggctcaa

SEQ ID NO: 29700 - DNA, 15 bp, Artificial Sequence
  dgRNA
  Slc17a1
attaagcattaccct

SEQ ID NO: 29701 - DNA, 15 bp, Artificial Sequence
  dgRNA
  Slc17a1
acccttggcatgatg

SEQ ID NO: 29702 - DNA, 15 bp, Artificial Sequence
  dgRNA
  Slc17a1
agtttaccagcaagt

SEQ ID NO: 29703 - DNA, 15 bp, Artificial Sequence
  dgRNA
  Slc17a1
ggactagaaccttct

SEQ ID NO: 29704 - DNA, 15 bp, Artificial Sequence
  dgRNA
  Casc1
gctccgaccgtctgc

SEQ ID NO: 29705 - DNA, 15 bp, Artificial Sequence
  dgRNA
  Casc1
accgtctgccggaag

SEQ ID NO: 29706 - DNA, 15 bp, Artificial Sequence
  dgRNA
  Casc1
ccgtctgccggaagt

SEQ ID NO: 29707 - DNA, 15 bp, Artificial Sequence
  dgRNA
  Casc1
tctgccggaagtggg

SEQ ID NO: 29708 - DNA, 15 bp, Artificial Sequence
  dgRNA
  Banp
cagcgagtcaactct

SEQ ID NO: 29709 - DNA, 15 bp, Artificial Sequence
  dgRNA
  Banp
gtcaactctcggagc

SEQ ID NO: 29710 - DNA, 15 bp, Artificial Sequence
  dgRNA
  Banp
tcaactctcggagca

SEQ ID NO: 29711 - DNA, 15 bp, Artificial Sequence
  dgRNA
  Banp
caactctcggagcag

SEQ ID NO: 29712 - DNA, 15 bp, Artificial Sequence
  dgRNA
  Synj2
gcctgcctcgccgct

SEQ ID NO: 29713 - DNA, 15 bp, Artificial Sequence
  dgRNA
  Synj2
cctgcctcgccgctt

SEQ ID NO: 29714 - DNA, 15 bp, Artificial Sequence
  dgRNA
  Synj2
ctgcctcgccgcttg

SEQ ID NO: 29715 - DNA, 15 bp, Artificial Sequence
  dgRNA
  Synj2
tgcctcgccgcttgg

SEQ ID NO: 29716 - DNA, 15 bp, Artificial Sequence
  dgRNA
  Nktr
caatcagaaatctcg

SEQ ID NO: 29717 - DNA, 15 bp, Artificial Sequence
  dgRNA
  Nktr
tgcatgagtgagccg

SEQ ID NO: 29718 - DNA, 15 bp, Artificial Sequence
  dgRNA
  Nktr
acacgtctgcgcact

SEQ ID NO: 29719 - DNA, 15 bp, Artificial Sequence
  dgRNA
  Nktr
cacgtctgcgcactc

SEQ ID NO: 29720 - DNA, 15 bp, Artificial Sequence
  dgRNA
  Fbxl12
agcttcccgtgatct

SEQ ID NO: 29721 - DNA, 15 bp, Artificial Sequence
  dgRNA
  Fbxl12
gcttcccgtgatctc

SEQ ID NO: 29722 - DNA, 15 bp, Artificial Sequence
  dgRNA
  Fbxl12
ctcgtagctcgagcg

SEQ ID NO: 29723 - DNA, 15 bp, Artificial Sequence
  dgRNA
  Fbxl12
tcgagcgaggaaccc

SEQ ID NO: 29724 - DNA, 15 bp, Artificial Sequence
  dgRNA
  Wars2
gggccacctattcca

SEQ ID NO: 29725 - DNA, 15 bp, Artificial Sequence
  dgRNA
  Wars2
ctgcgctgcaaactt

SEQ ID NO: 29726 - DNA, 15 bp, Artificial Sequence
  dgRNA
  Wars2
ggtactgagctactt

SEQ ID NO: 29727 - DNA, 15 bp, Artificial Sequence
  dgRNA
  Wars2
gtagtaagcacaact

SEQ ID NO: 29728 - DNA, 15 bp, Artificial Sequence
  dgRNA
  Tmem39b
cctctaagtcagaac

SEQ ID NO: 29729 - DNA, 15 bp, Artificial Sequence
  dgRNA
  Tmem39b
ctctaagtcagaaca

SEQ ID NO: 29730 - DNA, 15 bp, Artificial Sequence
  dgRNA
  Tmem39b
gtgaagaaacacggg

SEQ ID NO: 29731 - DNA, 15 bp, Artificial Sequence
  dgRNA
  Tmem39b
ctgcgggaaaggcgt

SEQ ID NO: 29732 - DNA, 15 bp, Artificial Sequence
  dgRNA
  Arl1
ttctgcggaggcgga

SEQ ID NO: 29733 - DNA, 15 bp, Artificial Sequence
  dgRNA
  Arl1
tctgcggaggcggaa

SEQ ID NO: 29734 - DNA, 15 bp, Artificial Sequence
  dgRNA
  Arl1
gaagggtggtcggtc

SEQ ID NO: 29735 - DNA, 15 bp, Artificial Sequence
  dgRNA
  Arl1
gggtggtcggtcagg

SEQ ID NO: 29736 - DNA, 15 bp, Artificial Sequence
  dgRNA
  Grwd1
gacgcggttactttg

SEQ ID NO: 29737 - DNA, 15 bp, Artificial Sequence
  dgRNA
  Grwd1
gcggttactttgtgg

SEQ ID NO: 29738 - DNA, 15 bp, Artificial Sequence
  dgRNA
  Grwd1
cgcattaccttcttc

SEQ ID NO: 29739 - DNA, 15 bp, Artificial Sequence
  dgRNA
  Grwd1
aggtaacagtacagt

SEQ ID NO: 29740 - DNA, 15 bp, Artificial Sequence
  dgRNA
  Olfr692
cctatgacctaatta

SEQ ID NO: 29741 - DNA, 15 bp, Artificial Sequence
  dgRNA
  Olfr692
gagtcctcccatatg

SEQ ID NO: 29742 - DNA, 15 bp, Artificial Sequence
  dgRNA
  Olfr692
tccatgagtgttaga

SEQ ID NO: 29743 - DNA, 15 bp, Artificial Sequence
  dgRNA
  Olfr692
ccataattaggtcat

SEQ ID NO: 29744 - DNA, 15 bp, Artificial Sequence
  dgRNA
  Tmbim6
acagtcttgattgac

SEQ ID NO: 29745 - DNA, 15 bp, Artificial Sequence
  dgRNA
  Tmbim6
tgactctgacgaaag

SEQ ID NO: 29746 - DNA, 15 bp, Artificial Sequence
  dgRNA
  Tmbim6
tgaacgtgcagataa

SEQ ID NO: 29747 - DNA, 15 bp, Artificial Sequence
  dgRNA
  Tmbim6
gtgcagataacggac

SEQ ID NO: 29748 - DNA, 15 bp, Artificial Sequence
  dgRNA
  Nmur2
ctgcgtccaagtcac

SEQ ID NO: 29749 - DNA, 15 bp, Artificial Sequence
  dgRNA
  Nmur2
tgcgtccaagtcaca

SEQ ID NO: 29750 - DNA, 15 bp, Artificial Sequence
  dgRNA
  Nmur2
gcttaacaccctcat

SEQ ID NO: 29751 - DNA, 15 bp, Artificial Sequence
  dgRNA
  Nmur2
tggcctacagcgtgc

SEQ ID NO: 29752 - DNA, 15 bp, Artificial Sequence
  dgRNA
  Cldn11
tctgcgggtccctat

SEQ ID NO: 29753 - DNA, 15 bp, Artificial Sequence
  dgRNA
  Cldn11
ctgcgggtccctatc

SEQ ID NO: 29754 - DNA, 15 bp, Artificial Sequence
  dgRNA
  Cldn11
gggtccctatcggga

SEQ ID NO: 29755 - DNA, 15 bp, Artificial Sequence
  dgRNA
  Cldn11
ggtccctatcgggat

SEQ ID NO: 29756 - DNA, 15 bp, Artificial Sequence
  dgRNA
  Tppp
acagcgaccgcaccc

SEQ ID NO: 29757 - DNA, 15 bp, Artificial Sequence
  dgRNA
  Tppp
cagcgaccgcaccct

SEQ ID NO: 29758 - DNA, 15 bp, Artificial Sequence
  dgRNA
  Tppp
gcaccctgggtcgag

SEQ ID NO: 29759 - DNA, 15 bp, Artificial Sequence
  dgRNA
  Tppp
tcgagcggcgtccat

SEQ ID NO: 29760 - DNA, 15 bp, Artificial Sequence
  dgRNA
  Slco3a1
agggagctagcgcgg

SEQ ID NO: 29761 - DNA, 15 bp, Artificial Sequence
  dgRNA
  Slco3a1
agcgcggcggcagcg

SEQ ID NO: 29762 - DNA, 15 bp, Artificial Sequence
  dgRNA
  Slco3a1
caacctctctagccg

SEQ ID NO: 29763 - DNA, 15 bp, Artificial Sequence
  dgRNA
  Slco3a1
ctctctagccgcggc

SEQ ID NO: 29764 - DNA, 15 bp, Artificial Sequence
  dgRNA
  Sptbn4
cgcgtgctcgccatc

SEQ ID NO: 29765 - DNA, 15 bp, Artificial Sequence
  dgRNA
  Sptbn4
gcgtgctcgccatct

SEQ ID NO: 29766 - DNA, 15 bp, Artificial Sequence
  dgRNA
  Sptbn4
cgccatctgggcccg

SEQ ID NO: 29767 - DNA, 15 bp, Artificial Sequence
  dgRNA
  Sptbn4
gccatctgggcccgc

SEQ ID NO: 29768 - DNA, 15 bp, Artificial Sequence
  dgRNA
  Rap1gds1
gccgcaggctgcgcc

SEQ ID NO: 29769 - DNA, 15 bp, Artificial Sequence
  dgRNA
  Rap1gds1
cgctcgtccccgccg

SEQ ID NO: 29770 - DNA, 15 bp, Artificial Sequence
  dgRNA
  Rap1gds1
ggcggccgccccccg

SEQ ID NO: 29771 - DNA, 15 bp, Artificial Sequence
  dgRNA
  Rap1gds1
gcggccgccccccgc

SEQ ID NO: 29772 - DNA, 15 bp, Artificial Sequence
  dgRNA
  Magea3
tgcctactattacct

SEQ ID NO: 29773 - DNA, 15 bp, Artificial Sequence
  dgRNA
  Magea3
taggtaatagtaggc

SEQ ID NO: 29774 - DNA, 15 bp, Artificial Sequence
  dgRNA
  Magea3
gtcctaggtaatagt

SEQ ID NO: 29775 - DNA, 15 bp, Artificial Sequence
  dgRNA
  Samd12
catccatcactctcg

SEQ ID NO: 29776 - DNA, 15 bp, Artificial Sequence
  dgRNA
  Samd12
cggggttcccttccg

SEQ ID NO: 29777 - DNA, 15 bp, Artificial Sequence
  dgRNA
  Samd12
ggtccgtagaagagc

SEQ ID NO: 29778 - DNA, 15 bp, Artificial Sequence
  dgRNA
  Samd12
tatacgctcctactg

SEQ ID NO: 29779 - DNA, 15 bp, Artificial Sequence
  dgRNA
  Zfp945
agcagatgatttagg

SEQ ID NO: 29780 - DNA, 15 bp, Artificial Sequence
  dgRNA
  Zfp945
gcagatgatttaggg

SEQ ID NO: 29781 - DNA, 15 bp, Artificial Sequence
  dgRNA
  Zfp945
caggcctatagtaag

SEQ ID NO: 29782 - DNA, 15 bp, Artificial Sequence
  dgRNA
  Zfp945
aggcctatagtaagc

SEQ ID NO: 29783 - DNA, 15 bp, Artificial Sequence
  dgRNA
  Il20rb
tctaatggacgcaac

SEQ ID NO: 29784 - DNA, 15 bp, Artificial Sequence
  dgRNA
  Il20rb
ctaatggacgcaaca

SEQ ID NO: 29785 - DNA, 15 bp, Artificial Sequence
  dgRNA
  Il20rb
ctaggggctgaatac

SEQ ID NO: 29786 - DNA, 15 bp, Artificial Sequence
  dgRNA
  Il20rb
gttctacagtgctag

SEQ ID NO: 29787 - DNA, 15 bp, Artificial Sequence
  dgRNA
  Nfyc
gatatagaacgtcct

SEQ ID NO: 29788 - DNA, 15 bp, Artificial Sequence
  dgRNA
  Nfyc
atagaacgtcctcgg

SEQ ID NO: 29789 - DNA, 15 bp, Artificial Sequence
  dgRNA
  Nfyc
cccgcgcccctggga

SEQ ID NO: 29790 - DNA, 15 bp, Artificial Sequence
  dgRNA
  Nfyc
ccgcgcccctgggaa

SEQ ID NO: 29791 - DNA, 15 bp, Artificial Sequence
  dgRNA
  Cd93
cgtgatgaaggcaac

SEQ ID NO: 29792 - DNA, 15 bp, Artificial Sequence
  dgRNA
  Cd93
tcagaaggctattca

SEQ ID NO: 29793 - DNA, 15 bp, Artificial Sequence
  dgRNA
  Cd93
aaggctattcatggc

SEQ ID NO: 29794 - DNA, 15 bp, Artificial Sequence
  dgRNA
  Cd93
gcacaggatgcgccc

SEQ ID NO: 29795 - DNA, 15 bp, Artificial Sequence
  dgRNA
  Lrp3
gtcaggtcccaacct

SEQ ID NO: 29796 - DNA, 15 bp, Artificial Sequence
  dgRNA
  Lrp3
tcaggtcccaacctt

SEQ ID NO: 29797 - DNA, 15 bp, Artificial Sequence
  dgRNA
  Lrp3
ctcgactcattgtct

SEQ ID NO: 29798 - DNA, 15 bp, Artificial Sequence
  dgRNA
  Lrp3
cccagcacagtcgcc

SEQ ID NO: 29799 - DNA, 15 bp, Artificial Sequence
  dgRNA
  Fam188b
gcgcccagaactcat

SEQ ID NO: 29800 - DNA, 15 bp, Artificial Sequence
  dgRNA
  Fam188b
cagagagtagcggct

SEQ ID NO: 29801 - DNA, 15 bp, Artificial Sequence
  dgRNA
  Fam188b
agagtagcggcttgg

SEQ ID NO: 29802 - DNA, 15 bp, Artificial Sequence
  dgRNA
  Fam188b
gaacgcttgtttccc

SEQ ID NO: 29803 - DNA, 15 bp, Artificial Sequence
  dgRNA
  Psmd2
ccatgcatccagttg

SEQ ID NO: 29804 - DNA, 15 bp, Artificial Sequence
  dgRNA
  Psmd2
ttgtggtgaagctac

SEQ ID NO: 29805 - DNA, 15 bp, Artificial Sequence
  dgRNA
  Psmd2
gtgaagctacaggat

SEQ ID NO: 29806 - DNA, 15 bp, Artificial Sequence
  dgRNA
  Psmd2
caggatcggagagct

SEQ ID NO: 29807 - DNA, 15 bp, Artificial Sequence
  dgRNA
  Nptx2
cagaacccagccgcc

SEQ ID NO: 29808 - DNA, 15 bp, Artificial Sequence
  dgRNA
  Nptx2
agaacccagccgcct

SEQ ID NO: 29809 - DNA, 15 bp, Artificial Sequence
  dgRNA
  Nptx2
gcgtgacgcgaacgc

SEQ ID NO: 29810 - DNA, 15 bp, Artificial Sequence
  dgRNA
  Nptx2
tgacgcgaacgccgg

SEQ ID NO: 29811 - DNA, 15 bp, Artificial Sequence
  dgRNA
  Atp1b4
catgctagattattt

SEQ ID NO: 29812 - DNA, 15 bp, Artificial Sequence
  dgRNA
  Atp1b4
gggctcgtgccagca

SEQ ID NO: 29813 - DNA, 15 bp, Artificial Sequence
  dgRNA
  Atp1b4
aggttcacttttagt

SEQ ID NO: 29814 - DNA, 15 bp, Artificial Sequence
  dgRNA
  Atp1b4
atattctgggtcacg

SEQ ID NO: 29815 - DNA, 15 bp, Artificial Sequence
  dgRNA
  Ptger4
ccgccctccatcacc

SEQ ID NO: 29816 - DNA, 15 bp, Artificial Sequence
  dgRNA
  Ptger4
catcaccgggctcct

SEQ ID NO: 29817 - DNA, 15 bp, Artificial Sequence
  dgRNA
  Ptger4
caccgggctcctagg

SEQ ID NO: 29818 - DNA, 15 bp, Artificial Sequence
  dgRNA
  Ptger4
cctaggcggtgctag

SEQ ID NO: 29819 - DNA, 15 bp, Artificial Sequence
  dgRNA
  Pigp
ctagccccctcgctg

SEQ ID NO: 29820 - DNA, 15 bp, Artificial Sequence
  dgRNA
  Pigp
ccctcgctgcggtcg

SEQ ID NO: 29821 - DNA, 15 bp, Artificial Sequence
  dgRNA
  Pigp
tgcgcctgcgccaag

SEQ ID NO: 29822 - DNA, 15 bp, Artificial Sequence
  dgRNA
  Pigp
gcctgcgccaagcgg

SEQ ID NO: 29823 - DNA, 15 bp, Artificial Sequence
  dgRNA
  Oc90
tctttaattagagct

SEQ ID NO: 29824 - DNA, 15 bp, Artificial Sequence
  dgRNA
  Oc90
ctttaattagagctc

SEQ ID NO: 29825 - DNA, 15 bp, Artificial Sequence
  dgRNA
  Oc90
ctcgggtctcctcag

SEQ ID NO: 29826 - DNA, 15 bp, Artificial Sequence
  dgRNA
  Oc90
tcgggtctcctcaga

SEQ ID NO: 29827 - DNA, 15 bp, Artificial Sequence
  dgRNA
  Gm94
attgagcaaatcttc

SEQ ID NO: 29828 - DNA, 15 bp, Artificial Sequence
  dgRNA
  Ttll5
agtcctcgttctgat

SEQ ID NO: 29829 - DNA, 15 bp, Artificial Sequence
  dgRNA
  Ttll5
tctgattggctacgc

SEQ ID NO: 29830 - DNA, 15 bp, Artificial Sequence
  dgRNA
  Ttll5
tggctcagttcgagc

SEQ ID NO: 29831 - DNA, 15 bp, Artificial Sequence
  dgRNA
  Ttll5
gttcgagcaggcgat

SEQ ID NO: 29832 - DNA, 15 bp, Artificial Sequence
  dgRNA
  Raver1
cgcccttttattcaa

SEQ ID NO: 29833 - DNA, 15 bp, Artificial Sequence
  dgRNA
  Raver1
agggggcaacgctcg

SEQ ID NO: 29834 - DNA, 15 bp, Artificial Sequence
  dgRNA
  Raver1
gggggcaacgctcgc

SEQ ID NO: 29835 - DNA, 15 bp, Artificial Sequence
  dgRNA
  Raver1
ggggcaacgctcgcg

SEQ ID NO: 29836 - DNA, 15 bp, Artificial Sequence
  dgRNA
  Katnal1
cagtccgcaagacct

SEQ ID NO: 29837 - DNA, 15 bp, Artificial Sequence
  dgRNA
  Katnal1
caagacctcggccgc

SEQ ID NO: 29838 - DNA, 15 bp, Artificial Sequence
  dgRNA
  Katnal1
tcggccgccggcaac

SEQ ID NO: 29839 - DNA, 15 bp, Artificial Sequence
  dgRNA
  Katnal1
aacaggccgctcccc

SEQ ID NO: 29840 - DNA, 15 bp, Artificial Sequence
  dgRNA
  Nudt17
atgaacattacaccc

SEQ ID NO: 29841 - DNA, 15 bp, Artificial Sequence
  dgRNA
  Nudt17
aaagcctggctggcg

SEQ ID NO: 29842 - DNA, 15 bp, Artificial Sequence
  dgRNA
  Nudt17
ctggcgtgggccggc

SEQ ID NO: 29843 - DNA, 15 bp, Artificial Sequence
  dgRNA
  Nudt17
cacgcctccgcgagc

SEQ ID NO: 29844 - DNA, 15 bp, Artificial Sequence
  dgRNA
  Stam
agacgcccggggaca

SEQ ID NO: 29845 - DNA, 15 bp, Artificial Sequence
  dgRNA
  Stam
tagccgctaacccca

SEQ ID NO: 29846 - DNA, 15 bp, Artificial Sequence
  dgRNA
  Stam
agccgctaaccccac

SEQ ID NO: 29847 - DNA, 15 bp, Artificial Sequence
  dgRNA
  Stam
aaccccacgggcacg

SEQ ID NO: 29848 - DNA, 15 bp, Artificial Sequence
  dgRNA
  Ska2
cagccaatccccctg

SEQ ID NO: 29849 - DNA, 15 bp, Artificial Sequence
  dgRNA
  Ska2
gtgtctttgtccaac

SEQ ID NO: 29850 - DNA, 15 bp, Artificial Sequence
  dgRNA
  Ska2
gtgcgttttataacg

SEQ ID NO: 29851 - DNA, 15 bp, Artificial Sequence
  dgRNA
  Ska2
tgcgttttataacga

SEQ ID NO: 29852 - DNA, 15 bp, Artificial Sequence
  dgRNA
  Wdr47
catagcgtcacccga

SEQ ID NO: 29853 - DNA, 15 bp, Artificial Sequence
  dgRNA
  Wdr47
gtcacccgaaggttc

SEQ ID NO: 29854 - DNA, 15 bp, Artificial Sequence
  dgRNA
  Wdr47
gcccgcccccgtgtt

SEQ ID NO: 29855 - DNA, 15 bp, Artificial Sequence
  dgRNA
  Wdr47
ttaggccccgcctct

SEQ ID NO: 29856 - DNA, 15 bp, Artificial Sequence
  dgRNA
  Fam57a
tcgtgcacgtcctgc

SEQ ID NO: 29857 - DNA, 15 bp, Artificial Sequence
  dgRNA
  Fam57a
cgtgcacgtcctgca

SEQ ID NO: 29858 - DNA, 15 bp, Artificial Sequence
  dgRNA
  Fam57a
gcacgtcctgcaggg

SEQ ID NO: 29859 - DNA, 15 bp, Artificial Sequence
  dgRNA
  Fam57a
ctggccgcgcccgcg

SEQ ID NO: 29860 - DNA, 15 bp, Artificial Sequence
  dgRNA
  Lzts3
gccacccagcctttt

SEQ ID NO: 29861 - DNA, 15 bp, Artificial Sequence
  dgRNA
  Lzts3
gccttttgggcaggc

SEQ ID NO: 29862 - DNA, 15 bp, Artificial Sequence
  dgRNA
  Lzts3
gcgctcagcgaccaa

SEQ ID NO: 29863 - DNA, 15 bp, Artificial Sequence
  dgRNA
  Lzts3
cgctcagcgaccaaa

SEQ ID NO: 29864 - DNA, 15 bp, Artificial Sequence
  dgRNA
  Psma4
tggagtgcaaagcgt

SEQ ID NO: 29865 - DNA, 15 bp, Artificial Sequence
  dgRNA
  Psma4
agtgcaaagcgtagg

SEQ ID NO: 29866 - DNA, 15 bp, Artificial Sequence
  dgRNA
  Psma4
agcgtaggaggaatc

SEQ ID NO: 29867 - DNA, 15 bp, Artificial Sequence
  dgRNA
  Psma4
ccgcagccaaagccg

SEQ ID NO: 29868 - DNA, 15 bp, Artificial Sequence
  dgRNA
  Irf5
gcttaggagctataa

SEQ ID NO: 29869 - DNA, 15 bp, Artificial Sequence
  dgRNA
  Irf5
cttaggagctataat

SEQ ID NO: 29870 - DNA, 15 bp, Artificial Sequence
  dgRNA
  Irf5
ctgagttgtcccatc

SEQ ID NO: 29871 - DNA, 15 bp, Artificial Sequence
  dgRNA
  Irf5
tcccttaggtcaggg

SEQ ID NO: 29872 - DNA, 15 bp, Artificial Sequence
  dgRNA
  Rpap2
cacttcaggtagcgc

SEQ ID NO: 29873 - DNA, 15 bp, Artificial Sequence
  dgRNA
  Rpap2
cgcaggccgcactcc

SEQ ID NO: 29874 - DNA, 15 bp, Artificial Sequence
  dgRNA
  Rpap2
gacctgcgccgcacg

SEQ ID NO: 29875 - DNA, 15 bp, Artificial Sequence
  dgRNA
  Rpap2
tcgggctcgccgaac

SEQ ID NO: 29876 - DNA, 15 bp, Artificial Sequence
  dgRNA
  Olfr1128
tatgaattagactat

SEQ ID NO: 29877 - DNA, 15 bp, Artificial Sequence
  dgRNA
  Olfr1128
gtcttttctgttaac

SEQ ID NO: 29878 - DNA, 15 bp, Artificial Sequence
  dgRNA
  Olfr1128
catctggataaaccc

SEQ ID NO: 29879 - DNA, 15 bp, Artificial Sequence
  dgRNA
  Dhdh
gcttgggcaagagtt

SEQ ID NO: 29880 - DNA, 15 bp, Artificial Sequence
  dgRNA
  Dhdh
agaagggcgggcgca

SEQ ID NO: 29881 - DNA, 15 bp, Artificial Sequence
  dgRNA
  Dhdh
cggtttcacgtcctg

SEQ ID NO: 29882 - DNA, 15 bp, Artificial Sequence
  dgRNA
  Dhdh
gtcctgagggtcaaa

SEQ ID NO: 29883 - DNA, 15 bp, Artificial Sequence
  dgRNA
  Zfp457
gacgtcacaggcgat

SEQ ID NO: 29884 - DNA, 15 bp, Artificial Sequence
  dgRNA
  Zfp457
tgacgtcacaggcga

SEQ ID NO: 29885 - DNA, 15 bp, Artificial Sequence
  dgRNA
  Slc18a2
gttctagagcccctg

SEQ ID NO: 29886 - DNA, 15 bp, Artificial Sequence
  dgRNA
  Slc18a2
tccccagaatctgat

SEQ ID NO: 29887 - DNA, 15 bp, Artificial Sequence
  dgRNA
  Slc18a2
ccccagaatctgata

SEQ ID NO: 29888 - DNA, 15 bp, Artificial Sequence
  dgRNA
  Slc18a2
cagaatctgataggg

SEQ ID NO: 29889 - DNA, 15 bp, Artificial Sequence
  dgRNA
  Acap1
agtgtcccagatgga

SEQ ID NO: 29890 - DNA, 15 bp, Artificial Sequence
  dgRNA
  Fmn1
tatacctcctgatca

SEQ ID NO: 29891 - DNA, 15 bp, Artificial Sequence
  dgRNA
  Fmn1
acctcctgatcaagg

SEQ ID NO: 29892 - DNA, 15 bp, Artificial Sequence
  dgRNA
  Fmn1
ctgatcaaggcggat

SEQ ID NO: 29893 - DNA, 15 bp, Artificial Sequence
  dgRNA
  Fmn1
taagaagccgcagtc

SEQ ID NO: 29894 - DNA, 15 bp, Artificial Sequence
  dgRNA
  Arrdc4
tgcgggtgtttcacc

SEQ ID NO: 29895 - DNA, 15 bp, Artificial Sequence
  dgRNA
  Arrdc4
acaccccactgggac

SEQ ID NO: 29896 - DNA, 15 bp, Artificial Sequence
  dgRNA
  Arrdc4
ttaacacaccccact

SEQ ID NO: 29897 - DNA, 15 bp, Artificial Sequence
  dgRNA
  Arrdc4
gaaacacccgcactg

SEQ ID NO: 29898 - DNA, 15 bp, Artificial Sequence
  dgRNA
  Pifo
tgtagcccttccacc

SEQ ID NO: 29899 - DNA, 15 bp, Artificial Sequence
  dgRNA
  Pifo
cacctggtgcctagc

SEQ ID NO: 29900 - DNA, 15 bp, Artificial Sequence
  dgRNA
  Pifo
agcaacctgctgcgc

SEQ ID NO: 29901 - DNA, 15 bp, Artificial Sequence
  dgRNA
  Pifo
gcggttccgttccct

SEQ ID NO: 29902 - DNA, 15 bp, Artificial Sequence
  dgRNA
  Il16
ctaccgtccctgttt

SEQ ID NO: 29903 - DNA, 15 bp, Artificial Sequence
  dgRNA
  Il16
taccgtccctgtttg

SEQ ID NO: 29904 - DNA, 15 bp, Artificial Sequence
  dgRNA
  Il16
aaatctgtgccaggt

SEQ ID NO: 29905 - DNA, 15 bp, Artificial Sequence
  dgRNA
  Il16
gccatccctctgagc

SEQ ID NO: 29906 - DNA, 15 bp, Artificial Sequence
  dgRNA
  Dguok
aattaaaacgatgag

SEQ ID NO: 29907 - DNA, 15 bp, Artificial Sequence
  dgRNA
  Dguok
attaaaacgatgaga

SEQ ID NO: 29908 - DNA, 15 bp, Artificial Sequence
  dgRNA
  Dguok
acgatgagagggcta

SEQ ID NO: 29909 - DNA, 15 bp, Artificial Sequence
  dgRNA
  Dguok
ttagtatggtgtaca

SEQ ID NO: 29910 - DNA, 15 bp, Artificial Sequence
  dgRNA
  Sap30bp
cgcaatacattcctg

SEQ ID NO: 29911 - DNA, 15 bp, Artificial Sequence
  dgRNA
  Sap30bp
gcaatacattcctga

SEQ ID NO: 29912 - DNA, 15 bp, Artificial Sequence
  dgRNA
  Sap30bp
gtcgaccagagaact

SEQ ID NO: 29913 - DNA, 15 bp, Artificial Sequence
  dgRNA
  Sap30bp
ggaatcctttttcta

SEQ ID NO: 29914 - DNA, 15 bp, Artificial Sequence
  dgRNA
  Gfm1
gtcgagctcagacag

SEQ ID NO: 29915 - DNA, 15 bp, Artificial Sequence
  dgRNA
  Gfm1
cattactacggaggc

SEQ ID NO: 29916 - DNA, 15 bp, Artificial Sequence
  dgRNA
  Gfm1
gtgtcattactacgg

SEQ ID NO: 29917 - DNA, 15 bp, Artificial Sequence
  dgRNA
  Gfm1
gaggtgtcattacta

SEQ ID NO: 29918 - DNA, 15 bp, Artificial Sequence
  dgRNA
  S100a4
gactgggctggtcga

SEQ ID NO: 29919 - DNA, 15 bp, Artificial Sequence
  dgRNA
  S100a4
aataggtcagattgt

SEQ ID NO: 29920 - DNA, 15 bp, Artificial Sequence
  dgRNA
  S100a4
ataggtcagattgtt

SEQ ID NO: 29921 - DNA, 15 bp, Artificial Sequence
  dgRNA
  S100a4
cgaccagcccagtct

SEQ ID NO: 29922 - DNA, 15 bp, Artificial Sequence
  dgRNA
  Ppp1r8
gatgccctccgccag

SEQ ID NO: 29923 - DNA, 15 bp, Artificial Sequence
  dgRNA
  Ppp1r8
gccagaggcgctccc

SEQ ID NO: 29924 - DNA, 15 bp, Artificial Sequence
  dgRNA
  Ppp1r8
gcacgcgctgcgcac

SEQ ID NO: 29925 - DNA, 15 bp, Artificial Sequence
  dgRNA
  Ppp1r8
gtttgtaccttgatg

SEQ ID NO: 29926 - DNA, 15 bp, Artificial Sequence
  dgRNA
  1300017J02Rik
tatgcatgtgcgcgc

SEQ ID NO: 29927 - DNA, 15 bp, Artificial Sequence
  dgRNA
  1300017J02Rik
gcgcgccggctttcc

SEQ ID NO: 29928 - DNA, 15 bp, Artificial Sequence
  dgRNA
  1300017J02Rik
caccgtttccaccca

SEQ ID NO: 29929 - DNA, 15 bp, Artificial Sequence
  dgRNA
  1300017J02Rik
acccagggaccgaac

SEQ ID NO: 29930 - DNA, 15 bp, Artificial Sequence
  dgRNA
  Zdhhc25
caggttcgttcagag

SEQ ID NO: 29931 - DNA, 15 bp, Artificial Sequence
  dgRNA
  Zdhhc25
agggccaccacctat

SEQ ID NO: 29932 - DNA, 15 bp, Artificial Sequence
  dgRNA
  Zdhhc25
ccagccttcccccgc

SEQ ID NO: 29933 - DNA, 15 bp, Artificial Sequence
  dgRNA
  Zdhhc25
cccccgcaggccttg

SEQ ID NO: 29934 - DNA, 15 bp, Artificial Sequence
  dgRNA
  Arhgef40
agagcgaagaagacg

SEQ ID NO: 29935 - DNA, 15 bp, Artificial Sequence
  dgRNA
  Arhgef40
gagcgaagaagacgc

SEQ ID NO: 29936 - DNA, 15 bp, Artificial Sequence
  dgRNA
  Arhgef40
aagacgcgggaaacc

SEQ ID NO: 29937 - DNA, 15 bp, Artificial Sequence
  dgRNA
  Arhgef40
agacgcgggaaaccc

SEQ ID NO: 29938 - DNA, 15 bp, Artificial Sequence
  dgRNA
  Cenpm
gtggcggttcctgcc

SEQ ID NO: 29939 - DNA, 15 bp, Artificial Sequence
  dgRNA
  Cenpm
ggttcctgccaggcg

SEQ ID NO: 29940 - DNA, 15 bp, Artificial Sequence
  dgRNA
  Cenpm
tcagaaagccccgcc

SEQ ID NO: 29941 - DNA, 15 bp, Artificial Sequence
  dgRNA
  Cenpm
acgcatgtccgggcg

SEQ ID NO: 29942 - DNA, 15 bp, Artificial Sequence
  dgRNA
  Nemf
cccggtcattgttca

SEQ ID NO: 29943 - DNA, 15 bp, Artificial Sequence
  dgRNA
  Nemf
gacgcagtttcgaga

SEQ ID NO: 29944 - DNA, 15 bp, Artificial Sequence
  dgRNA
  Nemf
cactataagtaatat

SEQ ID NO: 29945 - DNA, 15 bp, Artificial Sequence
  dgRNA
  Nemf
ccgtccccttgtttg

SEQ ID NO: 29946 - DNA, 15 bp, Artificial Sequence
  dgRNA
  Eng
gggaggtctgttgcc

SEQ ID NO: 29947 - DNA, 15 bp, Artificial Sequence
  dgRNA
  Eng
cttcctctactcgcc

SEQ ID NO: 29948 - DNA, 15 bp, Artificial Sequence
  dgRNA
  Eng
ctctactcgcctggc

SEQ ID NO: 29949 - DNA, 15 bp, Artificial Sequence
  dgRNA
  Eng
ccggccccttctcta

SEQ ID NO: 29950 - DNA, 15 bp, Artificial Sequence
  dgRNA
  Mast3
atgctgggcaccgac

SEQ ID NO: 29951 - DNA, 15 bp, Artificial Sequence
  dgRNA
  Mast3
ctgggcaccgacagg

SEQ ID NO: 29952 - DNA, 15 bp, Artificial Sequence
  dgRNA
  Mast3
tgggcaccgacaggc

SEQ ID NO: 29953 - DNA, 15 bp, Artificial Sequence
  dgRNA
  Mast3
ccatcccagcgcttc

SEQ ID NO: 29954 - DNA, 15 bp, Artificial Sequence
  dgRNA
  Zfr2
ttaggcgtcctccgt

SEQ ID NO: 29955 - DNA, 15 bp, Artificial Sequence
  dgRNA
  Zfr2
taggcgtcctccgta

SEQ ID NO: 29956 - DNA, 15 bp, Artificial Sequence
  dgRNA
  Zfr2
aggcgtcctccgtag

SEQ ID NO: 29957 - DNA, 15 bp, Artificial Sequence
  dgRNA
  Zfr2
ggcgtcctccgtagg

SEQ ID NO: 29958 - DNA, 15 bp, Artificial Sequence
  dgRNA
  Cr1l
tccgaattcatcata

SEQ ID NO: 29959 - DNA, 15 bp, Artificial Sequence
  dgRNA
  Cr1l
tactgtatactagac

SEQ ID NO: 29960 - DNA, 15 bp, Artificial Sequence
  dgRNA
  Cr1l
cactgttgcagatta

SEQ ID NO: 29961 - DNA, 15 bp, Artificial Sequence
  dgRNA
  Cr1l
ttgcagattagggtt

SEQ ID NO: 29962 - DNA, 15 bp, Artificial Sequence
  dgRNA
  Cenpe
cgccttccccatcca

SEQ ID NO: 29963 - DNA, 15 bp, Artificial Sequence
  dgRNA
  Cenpe
actcgccgcagcact

SEQ ID NO: 29964 - DNA, 15 bp, Artificial Sequence
  dgRNA
  Cenpe
gcgagtccatggatg

SEQ ID NO: 29965 - DNA, 15 bp, Artificial Sequence
  dgRNA
  Cenpe
ggcgagtccatggat

SEQ ID NO: 29966 - DNA, 15 bp, Artificial Sequence
  dgRNA
  Fam134c
cgttctccgctccaa

SEQ ID NO: 29967 - DNA, 15 bp, Artificial Sequence
  dgRNA
  Fam134c
gttctccgctccaat

SEQ ID NO: 29968 - DNA, 15 bp, Artificial Sequence
  dgRNA
  Fam134c
cgctccaatgggagc

SEQ ID NO: 29969 - DNA, 15 bp, Artificial Sequence
  dgRNA
  Fam134c
gctccaatgggagct

SEQ ID NO: 29970 - DNA, 15 bp, Artificial Sequence
  dgRNA
  Pcx
tggcccggccctcct

SEQ ID NO: 29971 - DNA, 15 bp, Artificial Sequence
  dgRNA
  Pcx
cgggccagagaggcg

SEQ ID NO: 29972 - DNA, 15 bp, Artificial Sequence
  dgRNA
  Pcx
gggcgccgcctcctg

SEQ ID NO: 29973 - DNA, 15 bp, Artificial Sequence
  dgRNA
  Gne
tcatctatcgagaac

SEQ ID NO: 29974 - DNA, 15 bp, Artificial Sequence
  dgRNA
  Gne
catctatcgagaaca

SEQ ID NO: 29975 - DNA, 15 bp, Artificial Sequence
  dgRNA
  Gne
cctttcaaagaggcg

SEQ ID NO: 29976 - DNA, 15 bp, Artificial Sequence
  dgRNA
  Gne
gcttgagagttagtc

SEQ ID NO: 29977 - DNA, 15 bp, Artificial Sequence
  dgRNA
  Vegfa
cgagcgaacagagag

SEQ ID NO: 29978 - DNA, 15 bp, Artificial Sequence
  dgRNA
  Vegfa
gactgacctgctttt

SEQ ID NO: 29979 - DNA, 15 bp, Artificial Sequence
  dgRNA
  Vegfa
gtgaccgccagagcg

SEQ ID NO: 29980 - DNA, 15 bp, Artificial Sequence
  dgRNA
  Vegfa
tgagccctccccctt

SEQ ID NO: 29981 - DNA, 15 bp, Artificial Sequence
  dgRNA
  Kcnk3
cagtccttatttggc

SEQ ID NO: 29982 - DNA, 15 bp, Artificial Sequence
  dgRNA
  Kcnk3
tttggctgggcggga

SEQ ID NO: 29983 - DNA, 15 bp, Artificial Sequence
  dgRNA
  Kcnk3
gtggcggcccgcggc

SEQ ID NO: 29984 - DNA, 15 bp, Artificial Sequence
  dgRNA
  Kcnk3
tggcggcccgcggcc

SEQ ID NO: 29985 - DNA, 15 bp, Artificial Sequence
  dgRNA
  Tmem41a
tcacagggaaggcgt

SEQ ID NO: 29986 - DNA, 15 bp, Artificial Sequence
  dgRNA
  Tmem41a
agagcgatcagtccc

SEQ ID NO: 29987 - DNA, 15 bp, Artificial Sequence
  dgRNA
  Tmem41a
gcgatcagtccctgg

SEQ ID NO: 29988 - DNA, 15 bp, Artificial Sequence
  dgRNA
  Tmem41a
cgatcagtccctggc

SEQ ID NO: 29989 - DNA, 15 bp, Artificial Sequence
  dgRNA
  Pdzrn4
gtttattaaggatag

SEQ ID NO: 29990 - DNA, 15 bp, Artificial Sequence
  dgRNA
  Pdzrn4
catgttagcggggtg

SEQ ID NO: 29991 - DNA, 15 bp, Artificial Sequence
  dgRNA
  Pdzrn4
acatgttagcggggt

SEQ ID NO: 29992 - DNA, 15 bp, Artificial Sequence
  dgRNA
  Pdzrn4
aacatgttagcgggg

SEQ ID NO: 29993 - DNA, 15 bp, Artificial Sequence
  dgRNA
  Pum1
accccgctccctccg

SEQ ID NO: 29994 - DNA, 15 bp, Artificial Sequence
  dgRNA
  Pum1
ccgctccctccgcgg

SEQ ID NO: 29995 - DNA, 15 bp, Artificial Sequence
  dgRNA
  Pum1
gcacgggagcgcgca

SEQ ID NO: 29996 - DNA, 15 bp, Artificial Sequence
  dgRNA
  Pum1
ccgccgcggagggag

SEQ ID NO: 29997 - DNA, 15 bp, Artificial Sequence
  dgRNA
  Zfp719
gacttccgccagtgg

SEQ ID NO: 29998 - DNA, 15 bp, Artificial Sequence
  dgRNA
  Zfp719
gcatgcgcgccaccc

SEQ ID NO: 29999 - DNA, 15 bp, Artificial Sequence
  dgRNA
  Zfp719
catgcgcgccaccca

SEQ ID NO: 30000 - DNA, 15 bp, Artificial Sequence
  dgRNA
  Zfp719
cgtggtagtgaactg

SEQ ID NO: 30001 - DNA, 15 bp, Artificial Sequence
  dgRNA
  Jund
acgtctttcacgttg

SEQ ID NO: 30002 - DNA, 15 bp, Artificial Sequence
  dgRNA
  Jund
agtcttggtcagcta

SEQ ID NO: 30003 - DNA, 15 bp, Artificial Sequence
  dgRNA
  Jund
ggtcagctagggtac

SEQ ID NO: 30004 - DNA, 15 bp, Artificial Sequence
  dgRNA
  Jund
gtcagctagggtaca

SEQ ID NO: 30005 - DNA, 15 bp, Artificial Sequence
  dgRNA
  Chrnb1
cgactgcagttgctc

SEQ ID NO: 30006 - DNA, 15 bp, Artificial Sequence
  dgRNA
  Chrnb1
tgcagttgctccggg

SEQ ID NO: 30007 - DNA, 15 bp, Artificial Sequence
  dgRNA
  Chrnb1
cgggaccaagtcccg

SEQ ID NO: 30008 - DNA, 15 bp, Artificial Sequence
  dgRNA
  Chrnb1
gggaccaagtcccga

SEQ ID NO: 30009 - DNA, 15 bp, Artificial Sequence
  dgRNA
  Wdr33
tgcaggatgcctcat

SEQ ID NO: 30010 - DNA, 15 bp, Artificial Sequence
  dgRNA
  Wdr33
gcaggatgcctcatg

SEQ ID NO: 30011 - DNA, 15 bp, Artificial Sequence
  dgRNA
  Wdr33
tctattcgagcccta

SEQ ID NO: 30012 - DNA, 15 bp, Artificial Sequence
  dgRNA
  Wdr33
cctacggtagacctg

SEQ ID NO: 30013 - DNA, 15 bp, Artificial Sequence
  dgRNA
  Ackr3
cctagagagggttac

SEQ ID NO: 30014 - DNA, 15 bp, Artificial Sequence
  dgRNA
  Ackr3
catgcctgcgcgctg

SEQ ID NO: 30015 - DNA, 15 bp, Artificial Sequence
  dgRNA
  Ackr3
gcctgcgcgctgtgg

SEQ ID NO: 30016 - DNA, 15 bp, Artificial Sequence
  dgRNA
  Ackr3
cctgcgcgctgtggt

SEQ ID NO: 30017 - DNA, 15 bp, Artificial Sequence
  dgRNA
  D17Wsu92e
ttatgacgtcactga

SEQ ID NO: 30018 - DNA, 15 bp, Artificial Sequence
  dgRNA
  D17Wsu92e
tgacgtcactgaagg

SEQ ID NO: 30019 - DNA, 15 bp, Artificial Sequence
  dgRNA
  D17Wsu92e
gacgtcactgaaggc

SEQ ID NO: 30020 - DNA, 15 bp, Artificial Sequence
  dgRNA
  D17Wsu92e
ctgaaggcgggcttt

SEQ ID NO: 30021 - DNA, 15 bp, Artificial Sequence
  dgRNA
  Erg
aaccccattcacctg

SEQ ID NO: 30022 - DNA, 15 bp, Artificial Sequence
  dgRNA
  Erg
ctggcagacattact

SEQ ID NO: 30023 - DNA, 15 bp, Artificial Sequence
  dgRNA
  Erg
agacactattctgcg

SEQ ID NO: 30024 - DNA, 15 bp, Artificial Sequence
  dgRNA
  Erg
tctgcgtggttttac

SEQ ID NO: 30025 - DNA, 15 bp, Artificial Sequence
  dgRNA
  Ms4a5
aaatacggtgtcctt

SEQ ID NO: 30026 - DNA, 15 bp, Artificial Sequence
  dgRNA
  Ms4a5
aaaatacggtgtcct

SEQ ID NO: 30027 - DNA, 15 bp, Artificial Sequence
  dgRNA
  Ms4a5
tatgactagtagtct

SEQ ID NO: 30028 - DNA, 15 bp, Artificial Sequence
  dgRNA
  Ms4a5
ccattgcttgtgtat

SEQ ID NO: 30029 - DNA, 15 bp, Artificial Sequence
  dgRNA
  Trhr2
aacttacttatagat

SEQ ID NO: 30030 - DNA, 15 bp, Artificial Sequence
  dgRNA
  Trhr2
acctagtgcctggga

SEQ ID NO: 30031 - DNA, 15 bp, Artificial Sequence
  dgRNA
  Clcn7
gctggccaagcaatg

SEQ ID NO: 30032 - DNA, 15 bp, Artificial Sequence
  dgRNA
  Clcn7
accttttcttagatg

SEQ ID NO: 30033 - DNA, 15 bp, Artificial Sequence
  dgRNA
  Clcn7
gggtgatagtggaac

SEQ ID NO: 30034 - DNA, 15 bp, Artificial Sequence
  dgRNA
  Clcn7
tcatggtcatgtgcg

SEQ ID NO: 30035 - DNA, 15 bp, Artificial Sequence
  dgRNA
  Timeless
tcgctctcagccgag

SEQ ID NO: 30036 - DNA, 15 bp, Artificial Sequence
  dgRNA
  Timeless
ctctcagccgagtgg

SEQ ID NO: 30037 - DNA, 15 bp, Artificial Sequence
  dgRNA
  Timeless
tctcagccgagtggc

SEQ ID NO: 30038 - DNA, 15 bp, Artificial Sequence
  dgRNA
  Timeless
gccgagtggcgggaa

SEQ ID NO: 30039 - DNA, 15 bp, Artificial Sequence
  dgRNA
  Hars2
aggcctcgcttctct

SEQ ID NO: 30040 - DNA, 15 bp, Artificial Sequence
  dgRNA
  Hars2
ggcctcgcttctctc

SEQ ID NO: 30041 - DNA, 15 bp, Artificial Sequence
  dgRNA
  Hars2
ccttctatgctcctc

SEQ ID NO: 30042 - DNA, 15 bp, Artificial Sequence
  dgRNA
  Hars2
atcgaggggacggga

SEQ ID NO: 30043 - DNA, 15 bp, Artificial Sequence
  dgRNA
  Ildr1
aattgcaaggggtga

SEQ ID NO: 30044 - DNA, 15 bp, Artificial Sequence
  dgRNA
  Nucb1
cttgaaaacggacgc

SEQ ID NO: 30045 - DNA, 15 bp, Artificial Sequence
  dgRNA
  Nucb1
aaacctcatcggaaa

SEQ ID NO: 30046 - DNA, 15 bp, Artificial Sequence
  dgRNA
  Nucb1
aacctcatcggaaag

SEQ ID NO: 30047 - DNA, 15 bp, Artificial Sequence
  dgRNA
  Nucb1
ctcatcggaaagggg

SEQ ID NO: 30048 - DNA, 15 bp, Artificial Sequence
  dgRNA
  Mum1l1
tgccttctcatgagc

SEQ ID NO: 30049 - DNA, 15 bp, Artificial Sequence
  dgRNA
  Mum1l1
aaggggcggagcatc

SEQ ID NO: 30050 - DNA, 15 bp, Artificial Sequence
  dgRNA
  Mum1l1
ggggcggagcatccg

SEQ ID NO: 30051 - DNA, 15 bp, Artificial Sequence
  dgRNA
  Mum1l1
gcggagcatccgggg

SEQ ID NO: 30052 - DNA, 15 bp, Artificial Sequence
  dgRNA
  4-Sep
gcaggcaggcggcgt

SEQ ID NO: 30053 - DNA, 15 bp, Artificial Sequence
  dgRNA
  4-Sep
cagctgagccgtcct

SEQ ID NO: 30054 - DNA, 15 bp, Artificial Sequence
  dgRNA
  4-Sep
ctgagccgtccttgg

SEQ ID NO: 30055 - DNA, 15 bp, Artificial Sequence
  dgRNA
  4-Sep
tgagccgtccttgga

SEQ ID NO: 30056 - DNA, 15 bp, Artificial Sequence
  dgRNA
  Ap5s1
gccgaggggatcggc

SEQ ID NO: 30057 - DNA, 15 bp, Artificial Sequence
  dgRNA
  Ap5s1
aagcgtgtacgtcct

SEQ ID NO: 30058 - DNA, 15 bp, Artificial Sequence
  dgRNA
  Ap5s1
agcgtgtacgtcctc

SEQ ID NO: 30059 - DNA, 15 bp, Artificial Sequence
  dgRNA
  Ap5s1
gtcctcgggaagtcg

SEQ ID NO: 30060 - DNA, 15 bp, Artificial Sequence
  dgRNA
  Fzr1
gtgcccgcaagggac

SEQ ID NO: 30061 - DNA, 15 bp, Artificial Sequence
  dgRNA
  Fzr1
tgcccgcaagggaca

SEQ ID NO: 30062 - DNA, 15 bp, Artificial Sequence
  dgRNA
  Fzr1
gcctaggagaggcgt

SEQ ID NO: 30063 - DNA, 15 bp, Artificial Sequence
  dgRNA
  Fzr1
ggcgttggtaactcg

SEQ ID NO: 30064 - DNA, 15 bp, Artificial Sequence
  dgRNA
  Edar
tgcactgccgatgcc

SEQ ID NO: 30065 - DNA, 15 bp, Artificial Sequence
  dgRNA
  Edar
tgccgatgcctggcg

SEQ ID NO: 30066 - DNA, 15 bp, Artificial Sequence
  dgRNA
  Edar
cctggcgcggcctct

SEQ ID NO: 30067 - DNA, 15 bp, Artificial Sequence
  dgRNA
  Edar
ggcgcggcctctagg

SEQ ID NO: 30068 - DNA, 15 bp, Artificial Sequence
  dgRNA
  Gm4846
gttgctaaaattaat

SEQ ID NO: 30069 - DNA, 15 bp, Artificial Sequence
  dgRNA
  Olfr53
agtatgtgactcccc

SEQ ID NO: 30070 - DNA, 15 bp, Artificial Sequence
  dgRNA
  Olfr53
tgggtcattaagtca

SEQ ID NO: 30071 - DNA, 15 bp, Artificial Sequence
  dgRNA
  Olfr53
cataggatcaattaa

SEQ ID NO: 30072 - DNA, 15 bp, Artificial Sequence
  dgRNA
  Olfr53
gacaggcacttgtcc

SEQ ID NO: 30073 - DNA, 15 bp, Artificial Sequence
  dgRNA
  Khdrbs2
ggcctgagaacacgg

SEQ ID NO: 30074 - DNA, 15 bp, Artificial Sequence
  dgRNA
  Khdrbs2
gcctgagaacacggc

SEQ ID NO: 30075 - DNA, 15 bp, Artificial Sequence
  dgRNA
  Khdrbs2
gaacacggcgggcta

SEQ ID NO: 30076 - DNA, 15 bp, Artificial Sequence
  dgRNA
  Khdrbs2
cacggcgggctaagg

SEQ ID NO: 30077 - DNA, 15 bp, Artificial Sequence
  dgRNA
  Ercc1
ggctcaatgtcctct

SEQ ID NO: 30078 - DNA, 15 bp, Artificial Sequence
  dgRNA
  Ercc1
cgaccctgcccgctc

SEQ ID NO: 30079 - DNA, 15 bp, Artificial Sequence
  dgRNA
  Ercc1
gaccctgcccgctct

SEQ ID NO: 30080 - DNA, 15 bp, Artificial Sequence
  dgRNA
  Ercc1
ttaagccacagctgt

SEQ ID NO: 30081 - DNA, 15 bp, Artificial Sequence
  dgRNA
  Cr2
aaagcagacttcccg

SEQ ID NO: 30082 - DNA, 15 bp, Artificial Sequence
  dgRNA
  Cr2
cccagcgccaccgcg

SEQ ID NO: 30083 - DNA, 15 bp, Artificial Sequence
  dgRNA
  Cr2
agccgatgctattta

SEQ ID NO: 30084 - DNA, 15 bp, Artificial Sequence
  dgRNA
  Cr2
gccgatgctatttaa

SEQ ID NO: 30085 - DNA, 15 bp, Artificial Sequence
  dgRNA
  Tcte1
agaaagcacgagcgg

SEQ ID NO: 30086 - DNA, 15 bp, Artificial Sequence
  dgRNA
  Tcte1
gaggccgagagcata

SEQ ID NO: 30087 - DNA, 15 bp, Artificial Sequence
  dgRNA
  Tcte1
cttctgataaggagt

SEQ ID NO: 30088 - DNA, 15 bp, Artificial Sequence
  dgRNA
  Tcte1
gatgtacttctgata

SEQ ID NO: 30089 - DNA, 15 bp, Artificial Sequence
  dgRNA
  Mboat2
gcgcacgagtgcgcg

SEQ ID NO: 30090 - DNA, 15 bp, Artificial Sequence
  dgRNA
  Mboat2
cacgagtgcgcgagg

SEQ ID NO: 30091 - DNA, 15 bp, Artificial Sequence
  dgRNA
  Mboat2
acgagtgcgcgaggt

SEQ ID NO: 30092 - DNA, 15 bp, Artificial Sequence
  dgRNA
  Mboat2
cgagtgcgcgaggtg

SEQ ID NO: 30093 - DNA, 15 bp, Artificial Sequence
  dgRNA
  Il11ra1
ctgatttcagtggcg

SEQ ID NO: 30094 - DNA, 15 bp, Artificial Sequence
  dgRNA
  Il11ra1
tgatttcagtggcgt

SEQ ID NO: 30095 - DNA, 15 bp, Artificial Sequence
  dgRNA
  Il11ra1
cagtggcgtgggata

SEQ ID NO: 30096 - DNA, 15 bp, Artificial Sequence
  dgRNA
  Il11ra1
actagaccaaccccc

SEQ ID NO: 30097 - DNA, 15 bp, Artificial Sequence
  dgRNA
  Id3
tgacgccagtgagtc

SEQ ID NO: 30098 - DNA, 15 bp, Artificial Sequence
  dgRNA
  Id3
cgccagtgagtctgg

SEQ ID NO: 30099 - DNA, 15 bp, Artificial Sequence
  dgRNA
  Id3
agacgagcagcaaat

SEQ ID NO: 30100 - DNA, 15 bp, Artificial Sequence
  dgRNA
  Id3
gacgagcagcaaatt

SEQ ID NO: 30101 - DNA, 15 bp, Artificial Sequence
  dgRNA
  Slc43a3
gtcccaagctcttac

SEQ ID NO: 30102 - DNA, 15 bp, Artificial Sequence
  dgRNA
  Slc43a3
ccaagctcttactgg

SEQ ID NO: 30103 - DNA, 15 bp, Artificial Sequence
  dgRNA
  Slc43a3
gaggcggccaacctg

SEQ ID NO: 30104 - DNA, 15 bp, Artificial Sequence
  dgRNA
  Slc43a3
atgagagcgggaaac

SEQ ID NO: 30105 - DNA, 15 bp, Artificial Sequence
  dgRNA
  Creb3l2
tccgcccacattccg

SEQ ID NO: 30106 - DNA, 15 bp, Artificial Sequence
  dgRNA
  Creb3l2
cacattccgaggact

SEQ ID NO: 30107 - DNA, 15 bp, Artificial Sequence
  dgRNA
  Creb3l2
attccgaggactagg

SEQ ID NO: 30108 - DNA, 15 bp, Artificial Sequence
  dgRNA
  Creb3l2
gcgcgactctccctc

SEQ ID NO: 30109 - DNA, 15 bp, Artificial Sequence
  dgRNA
  Cux1
ggcggcggcgccgtg

SEQ ID NO: 30110 - DNA, 15 bp, Artificial Sequence
  dgRNA
  Cux1
ggcggcgccgtgagg

SEQ ID NO: 30111 - DNA, 15 bp, Artificial Sequence
  dgRNA
  Cux1
gcgccgtgaggagga

SEQ ID NO: 30112 - DNA, 15 bp, Artificial Sequence
  dgRNA
  Cux1
aggagtccgcgtccg

SEQ ID NO: 30113 - DNA, 15 bp, Artificial Sequence
  dgRNA
  Rnf103
catcagcgcatcaga

SEQ ID NO: 30114 - DNA, 15 bp, Artificial Sequence
  dgRNA
  Rnf103
agcgcatcagagggc

SEQ ID NO: 30115 - DNA, 15 bp, Artificial Sequence
  dgRNA
  Rnf103
gcgcatcagagggct

SEQ ID NO: 30116 - DNA, 15 bp, Artificial Sequence
  dgRNA
  Rnf103
gcacagtaactcgga

SEQ ID NO: 30117 - DNA, 15 bp, Artificial Sequence
  dgRNA
  Myadml2
atgcaggtgcgtcag

SEQ ID NO: 30118 - DNA, 15 bp, Artificial Sequence
  dgRNA
  Myadml2
gcgtctagcatccag

SEQ ID NO: 30119 - DNA, 15 bp, Artificial Sequence
  dgRNA
  Myadml2
acttgtagtcccgaa

SEQ ID NO: 30120 - DNA, 15 bp, Artificial Sequence
  dgRNA
  Myadml2
cttgtagtcccgaaa

SEQ ID NO: 30121 - DNA, 15 bp, Artificial Sequence
  dgRNA
  C2cd2l
actgaaggggtgcac

SEQ ID NO: 30122 - DNA, 15 bp, Artificial Sequence
  dgRNA
  C2cd2l
ctgaaggggtgcaca

SEQ ID NO: 30123 - DNA, 15 bp, Artificial Sequence
  dgRNA
  C2cd2l
agggatttcaggacg

SEQ ID NO: 30124 - DNA, 15 bp, Artificial Sequence
  dgRNA
  C2cd2l
gatttcaggacgggg

SEQ ID NO: 30125 - DNA, 15 bp, Artificial Sequence
  dgRNA
  Tgfbi
gaggactagttcctt

SEQ ID NO: 30126 - DNA, 15 bp, Artificial Sequence
  dgRNA
  Tgfbi
gcactttgtgcgaag

SEQ ID NO: 30127 - DNA, 15 bp, Artificial Sequence
  dgRNA
  Tgfbi
cactttgtgcgaagt

SEQ ID NO: 30128 - DNA, 15 bp, Artificial Sequence
  dgRNA
  Tgfbi
tttgtgcgaagtggg

SEQ ID NO: 30129 - DNA, 15 bp, Artificial Sequence
  dgRNA
  Copg1
agcacccgcaaccgc

SEQ ID NO: 30130 - DNA, 15 bp, Artificial Sequence
  dgRNA
  Copg1
cgcaaccgcaggtct

SEQ ID NO: 30131 - DNA, 15 bp, Artificial Sequence
  dgRNA
  Copg1
cacgcccactttcct

SEQ ID NO: 30132 - DNA, 15 bp, Artificial Sequence
  dgRNA
  Copg1
ggttttggcaatctc

SEQ ID NO: 30133 - DNA, 15 bp, Artificial Sequence
  dgRNA
  Olfr453
ttcaaagcgtctgat

SEQ ID NO: 30134 - DNA, 15 bp, Artificial Sequence
  dgRNA
  Olfr453
cgtctgattggcaga

SEQ ID NO: 30135 - DNA, 15 bp, Artificial Sequence
  dgRNA
  Olfr453
gtgatttggcatcag

SEQ ID NO: 30136 - DNA, 15 bp, Artificial Sequence
  dgRNA
  Olfr453
cgctttgaatcacga

SEQ ID NO: 30137 - DNA, 15 bp, Artificial Sequence
  dgRNA
  Olfr1026
taactccaatgtcct

SEQ ID NO: 30138 - DNA, 15 bp, Artificial Sequence
  dgRNA
  Olfr1026
cgtgcatttacgagt

SEQ ID NO: 30139 - DNA, 15 bp, Artificial Sequence
  dgRNA
  Olfr1026
catttacgagtcgga

SEQ ID NO: 30140 - DNA, 15 bp, Artificial Sequence
  dgRNA
  Olfr1026
atttacgagtcggaa

SEQ ID NO: 30141 - DNA, 15 bp, Artificial Sequence
  dgRNA
  Itpripl2
gtaggtactctacag

SEQ ID NO: 30142 - DNA, 15 bp, Artificial Sequence
  dgRNA
  Itpripl2
agcggcagacagcta

SEQ ID NO: 30143 - DNA, 15 bp, Artificial Sequence
  dgRNA
  Itpripl2
gcggcagacagctag

SEQ ID NO: 30144 - DNA, 15 bp, Artificial Sequence
  dgRNA
  Itpripl2
ctgccacgccgccag

SEQ ID NO: 30145 - DNA, 15 bp, Artificial Sequence
  dgRNA
  Zc3h12a
cgcccagacttcgtg

SEQ ID NO: 30146 - DNA, 15 bp, Artificial Sequence
  dgRNA
  Zc3h12a
gacttcgtgtggcca

SEQ ID NO: 30147 - DNA, 15 bp, Artificial Sequence
  dgRNA
  Zc3h12a
acttcgtgtggccag

SEQ ID NO: 30148 - DNA, 15 bp, Artificial Sequence
  dgRNA
  Zc3h12a
cgtggctagagatgc

SEQ ID NO: 30149 - DNA, 15 bp, Artificial Sequence
  dgRNA
  Nmd3
cattttaaagatacg

SEQ ID NO: 30150 - DNA, 15 bp, Artificial Sequence
  dgRNA
  Nmd3
attttaaagatacgg

SEQ ID NO: 30151 - DNA, 15 bp, Artificial Sequence
  dgRNA
  Nmd3
ttaaagatacggggg

SEQ ID NO: 30152 - DNA, 15 bp, Artificial Sequence
  dgRNA
  Nmd3
taaagatacgggggc

SEQ ID NO: 30153 - DNA, 15 bp, Artificial Sequence
  dgRNA
  BC003331
tcggccccagttttt

SEQ ID NO: 30154 - DNA, 15 bp, Artificial Sequence
  dgRNA
  BC003331
cggccccagtttttt

SEQ ID NO: 30155 - DNA, 15 bp, Artificial Sequence
  dgRNA
  BC003331
ggccccagttttttg

SEQ ID NO: 30156 - DNA, 15 bp, Artificial Sequence
  dgRNA
  BC003331
cgcttacgcgcgctc

SEQ ID NO: 30157 - DNA, 15 bp, Artificial Sequence
  dgRNA
  Pdcd4
tggctggtggccgag

SEQ ID NO: 30158 - DNA, 15 bp, Artificial Sequence
  dgRNA
  Pdcd4
gcgcgcatgcgccga

SEQ ID NO: 30159 - DNA, 15 bp, Artificial Sequence
  dgRNA
  Pdcd4
tctgcctcgccgcct

SEQ ID NO: 30160 - DNA, 15 bp, Artificial Sequence
  dgRNA
  Pdcd4
gcctcggctgcagct

SEQ ID NO: 30161 - DNA, 15 bp, Artificial Sequence
  dgRNA
  Ybx3
aggtgaaagacgtct

SEQ ID NO: 30162 - DNA, 15 bp, Artificial Sequence
  dgRNA
  Ybx3
ggtgaaagacgtctt

SEQ ID NO: 30163 - DNA, 15 bp, Artificial Sequence
  dgRNA
  Ybx3
gtgaaagacgtcttg

SEQ ID NO: 30164 - DNA, 15 bp, Artificial Sequence
  dgRNA
  Ybx3
aagacgtcttgggga

SEQ ID NO: 30165 - DNA, 15 bp, Artificial Sequence
  dgRNA
  Atxn7l3
tccatcctccggtcg

SEQ ID NO: 30166 - DNA, 15 bp, Artificial Sequence
  dgRNA
  Atxn7l3
acgcgcgcgcgctcc

SEQ ID NO: 30167 - DNA, 15 bp, Artificial Sequence
  dgRNA
  Atxn7l3
gccgcaccccccgcc

SEQ ID NO: 30168 - DNA, 15 bp, Artificial Sequence
  dgRNA
  Atxn7l3
cccgcccgggagagg

SEQ ID NO: 30169 - DNA, 15 bp, Artificial Sequence
  dgRNA
  Unc5a
tcaggcgttgcccga

SEQ ID NO: 30170 - DNA, 15 bp, Artificial Sequence
  dgRNA
  Unc5a
caggcgttgcccgaa

SEQ ID NO: 30171 - DNA, 15 bp, Artificial Sequence
  dgRNA
  Unc5a
gcccgaagggatccc

SEQ ID NO: 30172 - DNA, 15 bp, Artificial Sequence
  dgRNA
  Unc5a
agggatccccggtgc

SEQ ID NO: 30173 - DNA, 15 bp, Artificial Sequence
  dgRNA
  Napg
tgcagtcgccaacgc

SEQ ID NO: 30174 - DNA, 15 bp, Artificial Sequence
  dgRNA
  Napg
gcttaaagtgccttc

SEQ ID NO: 30175 - DNA, 15 bp, Artificial Sequence
  dgRNA
  Napg
caccgcgcttgcgcg

SEQ ID NO: 30176 - DNA, 15 bp, Artificial Sequence
  dgRNA
  Napg
cattccacccatttc

SEQ ID NO: 30177 - DNA, 15 bp, Artificial Sequence
  dgRNA
  Slc6a11
ggcgctgggcgcaca

SEQ ID NO: 30178 - DNA, 15 bp, Artificial Sequence
  dgRNA
  Slc6a11
gcgcccctaccatcc

SEQ ID NO: 30179 - DNA, 15 bp, Artificial Sequence
  dgRNA
  Slc6a11
cgcccctaccatccc

SEQ ID NO: 30180 - DNA, 15 bp, Artificial Sequence
  dgRNA
  Slc6a11
atcccgggattcaag

SEQ ID NO: 30181 - DNA, 15 bp, Artificial Sequence
  dgRNA
  Mak16
atatgtgcgctccta

SEQ ID NO: 30182 - DNA, 15 bp, Artificial Sequence
  dgRNA
  Mak16
gcgctcctagggcaa

SEQ ID NO: 30183 - DNA, 15 bp, Artificial Sequence
  dgRNA
  Mak16
ggcaagggctgccgg

SEQ ID NO: 30184 - DNA, 15 bp, Artificial Sequence
  dgRNA
  Mak16
ggaggcgagcacgcc

SEQ ID NO: 30185 - DNA, 15 bp, Artificial Sequence
  dgRNA
  Lipe
tcaagaagaaaatcg

SEQ ID NO: 30186 - DNA, 15 bp, Artificial Sequence
  dgRNA
  Lipe
aggcttaatcctccc

SEQ ID NO: 30187 - DNA, 15 bp, Artificial Sequence
  dgRNA
  Lipe
cgcatgtgcgagtct

SEQ ID NO: 30188 - DNA, 15 bp, Artificial Sequence
  dgRNA
  Lipe
gcatgtgcgagtctc

SEQ ID NO: 30189 - DNA, 15 bp, Artificial Sequence
  dgRNA
  Nhs
cgtctctggactgcc

SEQ ID NO: 30190 - DNA, 15 bp, Artificial Sequence
  dgRNA
  Nhs
cggatcgctccttgc

SEQ ID NO: 30191 - DNA, 15 bp, Artificial Sequence
  dgRNA
  Nhs
ctctcctcgctcagg

SEQ ID NO: 30192 - DNA, 15 bp, Artificial Sequence
  dgRNA
  Nhs
tcaggtgggcgcgcc

SEQ ID NO: 30193 - DNA, 15 bp, Artificial Sequence
  dgRNA
  Cebpzos
acttgggtgtgaccg

SEQ ID NO: 30194 - DNA, 15 bp, Artificial Sequence
  dgRNA
  Cebpzos
cttgggtgtgaccgc

SEQ ID NO: 30195 - DNA, 15 bp, Artificial Sequence
  dgRNA
  Cebpzos
ggtgtgaccgcgggc

SEQ ID NO: 30196 - DNA, 15 bp, Artificial Sequence
  dgRNA
  Cebpzos
acagctagttaggtc

SEQ ID NO: 30197 - DNA, 15 bp, Artificial Sequence
  dgRNA
  Mid1
tggatagagttaact

SEQ ID NO: 30198 - DNA, 15 bp, Artificial Sequence
  dgRNA
  Mid1
agttaactaggttaa

SEQ ID NO: 30199 - DNA, 15 bp, Artificial Sequence
  dgRNA
  Mid1
ttaacttctttcacc

SEQ ID NO: 30200 - DNA, 15 bp, Artificial Sequence
  dgRNA
  Mid1
catgaattgcattcc

SEQ ID NO: 30201 - DNA, 15 bp, Artificial Sequence
  dgRNA
  Akap5
cagcggtgatgcgtc

SEQ ID NO: 30202 - DNA, 15 bp, Artificial Sequence
  dgRNA
  Akap5
agcggtgatgcgtcc

SEQ ID NO: 30203 - DNA, 15 bp, Artificial Sequence
  dgRNA
  Akap5
gcggtgatgcgtccg

SEQ ID NO: 30204 - DNA, 15 bp, Artificial Sequence
  dgRNA
  Akap5
gtgatgcgtccgggg

SEQ ID NO: 30205 - DNA, 15 bp, Artificial Sequence
  dgRNA
  Ube2t
gcgcgccaatttgag

SEQ ID NO: 30206 - DNA, 15 bp, Artificial Sequence
  dgRNA
  Ube2t
tgagcggtgcgtgag

SEQ ID NO: 30207 - DNA, 15 bp, Artificial Sequence
  dgRNA
  Ube2t
gcaagctctgagcgg

SEQ ID NO: 30208 - DNA, 15 bp, Artificial Sequence
  dgRNA
  Ube2t
gcggtggccaatagg

SEQ ID NO: 30209 - DNA, 15 bp, Artificial Sequence
  dgRNA
  Stub1
tcaacgacagaccat

SEQ ID NO: 30210 - DNA, 15 bp, Artificial Sequence
  dgRNA
  Stub1
caacgacagaccatg

SEQ ID NO: 30211 - DNA, 15 bp, Artificial Sequence
  dgRNA
  Stub1
tgcaggcgctctcca

SEQ ID NO: 30212 - DNA, 15 bp, Artificial Sequence
  dgRNA
  Stub1
cccatgaccgcgaga

SEQ ID NO: 30213 - DNA, 15 bp, Artificial Sequence
  dgRNA
  4930563M21Rik
gagcttatccatgta

SEQ ID NO: 30214 - DNA, 15 bp, Artificial Sequence
  dgRNA
  4930563M21Rik
tcctacgtacagtaa

SEQ ID NO: 30215 - DNA, 15 bp, Artificial Sequence
  dgRNA
  4930563M21Rik
ggtagtgttgacaga

SEQ ID NO: 30216 - DNA, 15 bp, Artificial Sequence
  dgRNA
  4930563M21Rik
tggtcattccttaca

SEQ ID NO: 30217 - DNA, 15 bp, Artificial Sequence
  dgRNA
  Fam134a
cctcaacgcccgccc

SEQ ID NO: 30218 - DNA, 15 bp, Artificial Sequence
  dgRNA
  Fam134a
ggaagcacaccttcg

SEQ ID NO: 30219 - DNA, 15 bp, Artificial Sequence
  dgRNA
  Fam134a
gaagcacaccttcgt

SEQ ID NO: 30220 - DNA, 15 bp, Artificial Sequence
  dgRNA
  Fam134a
gcaggatcacgacag

SEQ ID NO: 30221 - DNA, 15 bp, Artificial Sequence
  dgRNA
  Swi5
gtgcagagcgcccct

SEQ ID NO: 30222 - DNA, 15 bp, Artificial Sequence
  dgRNA
  Swi5
cgccccttggacgct

SEQ ID NO: 30223 - DNA, 15 bp, Artificial Sequence
  dgRNA
  Swi5
agaacgatgaacgac

SEQ ID NO: 30224 - DNA, 15 bp, Artificial Sequence
  dgRNA
  Swi5
gaacgatgaacgaca

SEQ ID NO: 30225 - DNA, 15 bp, Artificial Sequence
  dgRNA
  Gal
taccgggcggagcag

SEQ ID NO: 30226 - DNA, 15 bp, Artificial Sequence
  dgRNA
  Gal
cctcgggagcgagag

SEQ ID NO: 30227 - DNA, 15 bp, Artificial Sequence
  dgRNA
  Gal
gagcgagagcggttc

SEQ ID NO: 30228 - DNA, 15 bp, Artificial Sequence
  dgRNA
  Gal
cggttccggtcacag

SEQ ID NO: 30229 - DNA, 15 bp, Artificial Sequence
  dgRNA
  Ythdf3
cgagcccaacgctca

SEQ ID NO: 30230 - DNA, 15 bp, Artificial Sequence
  dgRNA
  Ythdf3
tacagctgcgcctcc

SEQ ID NO: 30231 - DNA, 15 bp, Artificial Sequence
  dgRNA
  Ythdf3
ctccgatgacgtgca

SEQ ID NO: 30232 - DNA, 15 bp, Artificial Sequence
  dgRNA
  Ythdf3
cgatgacgtgcacgg

SEQ ID NO: 30233 - DNA, 15 bp, Artificial Sequence
  dgRNA
  Fam107a
ttgtgcctctcaatc

SEQ ID NO: 30234 - DNA, 15 bp, Artificial Sequence
  dgRNA
  Fam107a
gcctctcaatcaggg

SEQ ID NO: 30235 - DNA, 15 bp, Artificial Sequence
  dgRNA
  Fam107a
ggaacaaggcgaaca

SEQ ID NO: 30236 - DNA, 15 bp, Artificial Sequence
  dgRNA
  Fam107a
gctttgttcggaaca

SEQ ID NO: 30237 - DNA, 15 bp, Artificial Sequence
  dgRNA
  Cyp2d12
aaggatcctgatcct

SEQ ID NO: 30238 - DNA, 15 bp, Artificial Sequence
  dgRNA
  Cyp2d12
tgacctggtgtaggg

SEQ ID NO: 30239 - DNA, 15 bp, Artificial Sequence
  dgRNA
  Cyp2d12
ccttctgccttataa

SEQ ID NO: 30240 - DNA, 15 bp, Artificial Sequence
  dgRNA
  Cyp2d12
caaacacctaggatc

SEQ ID NO: 30241 - DNA, 15 bp, Artificial Sequence
  dgRNA
  Prpf38a
gacgctcgctcgtcc

SEQ ID NO: 30242 - DNA, 15 bp, Artificial Sequence
  dgRNA
  Prpf38a
tcctccgggagacca

SEQ ID NO: 30243 - DNA, 15 bp, Artificial Sequence
  dgRNA
  Prpf38a
ttctgattggcgttt

SEQ ID NO: 30244 - DNA, 15 bp, Artificial Sequence
  dgRNA
  Prpf38a
ctcgccacgccctcc

SEQ ID NO: 30245 - DNA, 15 bp, Artificial Sequence
  dgRNA
  Dok2
ttgcatgttactcac

SEQ ID NO: 30246 - DNA, 15 bp, Artificial Sequence
  dgRNA
  Dok2
gaaagtccggggtga

SEQ ID NO: 30247 - DNA, 15 bp, Artificial Sequence
  dgRNA
  Dok2
gttcaagaaagtccg

SEQ ID NO: 30248 - DNA, 15 bp, Artificial Sequence
  dgRNA
  Dok2
ggctgataggccctg

SEQ ID NO: 30249 - DNA, 15 bp, Artificial Sequence
  dgRNA
  Dkk1
gtgacccacactcta

SEQ ID NO: 30250 - DNA, 15 bp, Artificial Sequence
  dgRNA
  Dkk1
cactctaaggtgagc

SEQ ID NO: 30251 - DNA, 15 bp, Artificial Sequence
  dgRNA
  Dkk1
ctcaccttagagtgt

SEQ ID NO: 30252 - DNA, 15 bp, Artificial Sequence
  dgRNA
  Dkk1
gctcaccttagagtg

SEQ ID NO: 30253 - DNA, 15 bp, Artificial Sequence
  dgRNA
  Pced1b
tacttagccagccgt

SEQ ID NO: 30254 - DNA, 15 bp, Artificial Sequence
  dgRNA
  Pced1b
gaccactcacagcgc

SEQ ID NO: 30255 - DNA, 15 bp, Artificial Sequence
  dgRNA
  Pced1b
accactcacagcgct

SEQ ID NO: 30256 - DNA, 15 bp, Artificial Sequence
  dgRNA
  Pced1b
gaagccgcagcggct

SEQ ID NO: 30257 - DNA, 15 bp, Artificial Sequence
  dgRNA
  Olfr275
actctcaatttagag

SEQ ID NO: 30258 - DNA, 15 bp, Artificial Sequence
  dgRNA
  Olfr275
gcacgtttgaacaat

SEQ ID NO: 30259 - DNA, 15 bp, Artificial Sequence
  dgRNA
  Olfr275
ccttcatatgaactt

SEQ ID NO: 30260 - DNA, 15 bp, Artificial Sequence
  dgRNA
  Ceacam11
tataaggccatataa

SEQ ID NO: 30261 - DNA, 15 bp, Artificial Sequence
  dgRNA
  Ceacam11
aggccatataagggc

SEQ ID NO: 30262 - DNA, 15 bp, Artificial Sequence
  dgRNA
  Ceacam11
ccatataagggccgg

SEQ ID NO: 30263 - DNA, 15 bp, Artificial Sequence
  dgRNA
  Ceacam11
cctccggcccttata

SEQ ID NO: 30264 - DNA, 15 bp, Artificial Sequence
  dgRNA
  Syt13
gctctcctggcaata

SEQ ID NO: 30265 - DNA, 15 bp, Artificial Sequence
  dgRNA
  Syt13
ctctcctggcaatag

SEQ ID NO: 30266 - DNA, 15 bp, Artificial Sequence
  dgRNA
  Syt13
tctcctggcaatagg

SEQ ID NO: 30267 - DNA, 15 bp, Artificial Sequence
  dgRNA
  Syt13
ctggcaatagggggc

SEQ ID NO: 30268 - DNA, 15 bp, Artificial Sequence
  dgRNA
  Slc29a4
agactgagtggccgt

SEQ ID NO: 30269 - DNA, 15 bp, Artificial Sequence
  dgRNA
  Slc29a4
cgtaggccccactgg

SEQ ID NO: 30270 - DNA, 15 bp, Artificial Sequence
  dgRNA
  Slc29a4
actggaggccggacc

SEQ ID NO: 30271 - DNA, 15 bp, Artificial Sequence
  dgRNA
  Slc29a4
ctggaggccggacct

SEQ ID NO: 30272 - DNA, 15 bp, Artificial Sequence
  dgRNA
  Lrrc38
gaagcccaaccatcc

SEQ ID NO: 30273 - DNA, 15 bp, Artificial Sequence
  dgRNA
  Lrrc38
caacttcgcagcccc

SEQ ID NO: 30274 - DNA, 15 bp, Artificial Sequence
  dgRNA
  Lrrc38
cttcgcagccccagg

SEQ ID NO: 30275 - DNA, 15 bp, Artificial Sequence
  dgRNA
  Lrrc38
tcgcagccccaggcg

SEQ ID NO: 30276 - DNA, 15 bp, Artificial Sequence
  dgRNA
  Eda2r
gccagacttgtgact

SEQ ID NO: 30277 - DNA, 15 bp, Artificial Sequence
  dgRNA
  Eda2r
gtcctttcaggggcg

SEQ ID NO: 30278 - DNA, 15 bp, Artificial Sequence
  dgRNA
  Eda2r
agttactaaagctcc

SEQ ID NO: 30279 - DNA, 15 bp, Artificial Sequence
  dgRNA
  Eda2r
gccaagtcacaagtc

SEQ ID NO: 30280 - DNA, 15 bp, Artificial Sequence
  dgRNA
  Tapt1
tggcggcggccaccg

SEQ ID NO: 30281 - DNA, 15 bp, Artificial Sequence
  dgRNA
  Tapt1
cgccgctgacgccaa

SEQ ID NO: 30282 - DNA, 15 bp, Artificial Sequence
  dgRNA
  Tapt1
gccaatggcgcgcgc

SEQ ID NO: 30283 - DNA, 15 bp, Artificial Sequence
  dgRNA
  Tapt1
atggcgcgcgccggc

SEQ ID NO: 30284 - DNA, 15 bp, Artificial Sequence
  dgRNA
  Tead2
tacccagtccttaga

SEQ ID NO: 30285 - DNA, 15 bp, Artificial Sequence
  dgRNA
  Tead2
ttccaagcctaccgc

SEQ ID NO: 30286 - DNA, 15 bp, Artificial Sequence
  dgRNA
  Tead2
tccaagcctaccgcc

SEQ ID NO: 30287 - DNA, 15 bp, Artificial Sequence
  dgRNA
  Tead2
gattcatgactttag

SEQ ID NO: 30288 - DNA, 15 bp, Artificial Sequence
  dgRNA
  Rcn2
ggggctatcttctca

SEQ ID NO: 30289 - DNA, 15 bp, Artificial Sequence
  dgRNA
  Rcn2
gggctatcttctcaa

SEQ ID NO: 30290 - DNA, 15 bp, Artificial Sequence
  dgRNA
  Rcn2
atcttctcaagggta

SEQ ID NO: 30291 - DNA, 15 bp, Artificial Sequence
  dgRNA
  Rcn2
ttctcaagggtacgg

SEQ ID NO: 30292 - DNA, 15 bp, Artificial Sequence
  dgRNA
  Pja2
ggccgtgaagtctat

SEQ ID NO: 30293 - DNA, 15 bp, Artificial Sequence
  dgRNA
  Pja2
attggctgcgccctc

SEQ ID NO: 30294 - DNA, 15 bp, Artificial Sequence
  dgRNA
  Pja2
ttggctgcgccctca

SEQ ID NO: 30295 - DNA, 15 bp, Artificial Sequence
  dgRNA
  Pja2
tgcgccctcaggggg

SEQ ID NO: 30296 - DNA, 15 bp, Artificial Sequence
  dgRNA
  Ttc27
cgcatgttccaaagc

SEQ ID NO: 30297 - DNA, 15 bp, Artificial Sequence
  dgRNA
  Ttc27
actagcaacaactcc

SEQ ID NO: 30298 - DNA, 15 bp, Artificial Sequence
  dgRNA
  Ttc27
cccggttactgcgac

SEQ ID NO: 30299 - DNA, 15 bp, Artificial Sequence
  dgRNA
  Ttc27
aaccgagtctccgat

SEQ ID NO: 30300 - DNA, 15 bp, Artificial Sequence
  dgRNA
  Axin2
aatcaatcagaactc

SEQ ID NO: 30301 - DNA, 15 bp, Artificial Sequence
  dgRNA
  Axin2
cggccgagaacaccc

SEQ ID NO: 30302 - DNA, 15 bp, Artificial Sequence
  dgRNA
  Axin2
ggccgagaacacccc

SEQ ID NO: 30303 - DNA, 15 bp, Artificial Sequence
  dgRNA
  Axin2
gccgagaacaccccg

SEQ ID NO: 30304 - DNA, 15 bp, Artificial Sequence
  dgRNA
  Cct8
cattaacttaggaca

SEQ ID NO: 30305 - DNA, 15 bp, Artificial Sequence
  dgRNA
  Cct8
attaacttaggacaa

SEQ ID NO: 30306 - DNA, 15 bp, Artificial Sequence
  dgRNA
  Cct8
ggacaagggacacga

SEQ ID NO: 30307 - DNA, 15 bp, Artificial Sequence
  dgRNA
  Cct8
gacaagggacacgaa

SEQ ID NO: 30308 - DNA, 15 bp, Artificial Sequence
  dgRNA
  Mettl10
gggtaaatgtaatgt

SEQ ID NO: 30309 - DNA, 15 bp, Artificial Sequence
  dgRNA
  Mettl10
gtaatgttggctgga

SEQ ID NO: 30310 - DNA, 15 bp, Artificial Sequence
  dgRNA
  Mettl10
gctggaaggctatct

SEQ ID NO: 30311 - DNA, 15 bp, Artificial Sequence
  dgRNA
  Mettl10
ctaagtgtgcaatgc

SEQ ID NO: 30312 - DNA, 15 bp, Artificial Sequence
  dgRNA
  Mesp1
tctctccgtgtctag

SEQ ID NO: 30313 - DNA, 15 bp, Artificial Sequence
  dgRNA
  Mesp1
gaaaaaaatggcgta

SEQ ID NO: 30314 - DNA, 15 bp, Artificial Sequence
  dgRNA
  Mesp1
gtccctaataaatga

SEQ ID NO: 30315 - DNA, 15 bp, Artificial Sequence
  dgRNA
  Mesp1
agggacctctagaca

SEQ ID NO: 30316 - DNA, 15 bp, Artificial Sequence
  dgRNA
  Col6a2
tcagtcagaatactg

SEQ ID NO: 30317 - DNA, 15 bp, Artificial Sequence
  dgRNA
  Col6a2
gagccctggcccaac

SEQ ID NO: 30318 - DNA, 15 bp, Artificial Sequence
  dgRNA
  Col6a2
agaatagcttctacg

SEQ ID NO: 30319 - DNA, 15 bp, Artificial Sequence
  dgRNA
  Col6a2
aatagcttctacggg

SEQ ID NO: 30320 - DNA, 15 bp, Artificial Sequence
  dgRNA
  Uqcrc2
agctgcaatctagtc

SEQ ID NO: 30321 - DNA, 15 bp, Artificial Sequence
  dgRNA
  Uqcrc2
gctgcaatctagtcc

SEQ ID NO: 30322 - DNA, 15 bp, Artificial Sequence
  dgRNA
  Uqcrc2
gctcgtcccgcctac

SEQ ID NO: 30323 - DNA, 15 bp, Artificial Sequence
  dgRNA
  Uqcrc2
gcactgcatgcgtag

SEQ ID NO: 30324 - DNA, 15 bp, Artificial Sequence
  dgRNA
  Notch3
gacctgagtgtaccg

SEQ ID NO: 30325 - DNA, 15 bp, Artificial Sequence
  dgRNA
  Notch3
ggcttggcgggtaga

SEQ ID NO: 30326 - DNA, 15 bp, Artificial Sequence
  dgRNA
  Notch3
gcttggcgggtagaa

SEQ ID NO: 30327 - DNA, 15 bp, Artificial Sequence
  dgRNA
  Notch3
gaagggtcggacccc

SEQ ID NO: 30328 - DNA, 15 bp, Artificial Sequence
  dgRNA
  Mttp
cttaggtcctgattt

SEQ ID NO: 30329 - DNA, 15 bp, Artificial Sequence
  dgRNA
  Mttp
tgattaaacgcaggt

SEQ ID NO: 30330 - DNA, 15 bp, Artificial Sequence
  dgRNA
  Mttp
atgattaaacgcagg

SEQ ID NO: 30331 - DNA, 15 bp, Artificial Sequence
  dgRNA
  Mttp
ttaatgattaaacgc

SEQ ID NO: 30332 - DNA, 15 bp, Artificial Sequence
  dgRNA
  Slc25a25
gaatcgccttcgagc

SEQ ID NO: 30333 - DNA, 15 bp, Artificial Sequence
  dgRNA
  Slc25a25
gccttcgagctggca

SEQ ID NO: 30334 - DNA, 15 bp, Artificial Sequence
  dgRNA
  Slc25a25
ccccctcattgatcc

SEQ ID NO: 30335 - DNA, 15 bp, Artificial Sequence
  dgRNA
  Slc25a25
ccggagccgacatac

SEQ ID NO: 30336 - DNA, 15 bp, Artificial Sequence
  dgRNA
  Hnrnpa2b1
gccttccgcaattca

SEQ ID NO: 30337 - DNA, 15 bp, Artificial Sequence
  dgRNA
  Hnrnpa2b1
tcccgctgtacctaa

SEQ ID NO: 30338 - DNA, 15 bp, Artificial Sequence
  dgRNA
  Hnrnpa2b1
cccgctgtacctaaa

SEQ ID NO: 30339 - DNA, 15 bp, Artificial Sequence
  dgRNA
  Hnrnpa2b1
ccgctgtacctaaag

SEQ ID NO: 30340 - DNA, 15 bp, Artificial Sequence
  dgRNA
  Abhd16a
tgaacactcctctcg

SEQ ID NO: 30341 - DNA, 15 bp, Artificial Sequence
  dgRNA
  Abhd16a
cgtggcgagaacgtc

SEQ ID NO: 30342 - DNA, 15 bp, Artificial Sequence
  dgRNA
  Abhd16a
gcgagaacgtcaggc

SEQ ID NO: 30343 - DNA, 15 bp, Artificial Sequence
  dgRNA
  Abhd16a
ctggaccctgccacg

SEQ ID NO: 30344 - DNA, 15 bp, Artificial Sequence
  dgRNA
  Gpcpd1
cagccagatgggcta

SEQ ID NO: 30345 - DNA, 15 bp, Artificial Sequence
  dgRNA
  Gpcpd1
tgggctaaggctgtc

SEQ ID NO: 30346 - DNA, 15 bp, Artificial Sequence
  dgRNA
  Gpcpd1
ctgtcgggccacctc

SEQ ID NO: 30347 - DNA, 15 bp, Artificial Sequence
  dgRNA
  Gpcpd1
acgcagcccgccccc

SEQ ID NO: 30348 - DNA, 15 bp, Artificial Sequence
  dgRNA
  Cnpy3
gatagttcctctcat

SEQ ID NO: 30349 - DNA, 15 bp, Artificial Sequence
  dgRNA
  Cnpy3
gccgagcgaacccat

SEQ ID NO: 30350 - DNA, 15 bp, Artificial Sequence
  dgRNA
  Cnpy3
tggttgcgtcgcccg

SEQ ID NO: 30351 - DNA, 15 bp, Artificial Sequence
  dgRNA
  Cnpy3
ggttgcgtcgcccgc

SEQ ID NO: 30352 - DNA, 15 bp, Artificial Sequence
  dgRNA
  Rgn
aggggccaccaatga

SEQ ID NO: 30353 - DNA, 15 bp, Artificial Sequence
  dgRNA
  Rgn
ctgcccaccccttgg

SEQ ID NO: 30354 - DNA, 15 bp, Artificial Sequence
  dgRNA
  Rgn
attggtggcccctct

SEQ ID NO: 30355 - DNA, 15 bp, Artificial Sequence
  dgRNA
  Rgn
gggcagctccctcat

SEQ ID NO: 30356 - DNA, 15 bp, Artificial Sequence
  dgRNA
  Scyl3
acagcaggccaatcc

SEQ ID NO: 30357 - DNA, 15 bp, Artificial Sequence
  dgRNA
  Scyl3
gggggcagtcacaac

SEQ ID NO: 30358 - DNA, 15 bp, Artificial Sequence
  dgRNA
  Scyl3
caaccggaaaagttc

SEQ ID NO: 30359 - DNA, 15 bp, Artificial Sequence
  dgRNA
  Scyl3
acaagtaagggggcg

SEQ ID NO: 30360 - DNA, 15 bp, Artificial Sequence
  dgRNA
  Insl5
tctgaacgtcaatag

SEQ ID NO: 30361 - DNA, 15 bp, Artificial Sequence
  dgRNA
  Lactb2
caagaagctcagcga

SEQ ID NO: 30362 - DNA, 15 bp, Artificial Sequence
  dgRNA
  Lactb2
gctcagcgacggagc

SEQ ID NO: 30363 - DNA, 15 bp, Artificial Sequence
  dgRNA
  Lactb2
cgacggagccggctg

SEQ ID NO: 30364 - DNA, 15 bp, Artificial Sequence
  dgRNA
  Lactb2
gaggccagtgcgggc

SEQ ID NO: 30365 - DNA, 15 bp, Artificial Sequence
  dgRNA
  Fam71f2
gggaaggtcatcgct

SEQ ID NO: 30366 - DNA, 15 bp, Artificial Sequence
  dgRNA
  Fam71f2
catcgctcggctgcc

SEQ ID NO: 30367 - DNA, 15 bp, Artificial Sequence
  dgRNA
  Fam71f2
atcgctcggctgcct

SEQ ID NO: 30368 - DNA, 15 bp, Artificial Sequence
  dgRNA
  Fam71f2
tcgctcggctgcctg

SEQ ID NO: 30369 - DNA, 15 bp, Artificial Sequence
  dgRNA
  Ccnj
aggtgagcggccctc

SEQ ID NO: 30370 - DNA, 15 bp, Artificial Sequence
  dgRNA
  Ccnj
ggcgccgacagaccg

SEQ ID NO: 30371 - DNA, 15 bp, Artificial Sequence
  dgRNA
  Ccnj
gccgacagaccgcgg

SEQ ID NO: 30372 - DNA, 15 bp, Artificial Sequence
  dgRNA
  Ccnj
cagagcgagaccgcc

SEQ ID NO: 30373 - DNA, 15 bp, Artificial Sequence
  dgRNA
  Sox8
accccgcctcagccg

SEQ ID NO: 30374 - DNA, 15 bp, Artificial Sequence
  dgRNA
  Sox8
ccccgcctcagccga

SEQ ID NO: 30375 - DNA, 15 bp, Artificial Sequence
  dgRNA
  Sox8
ctcagccgagggatc

SEQ ID NO: 30376 - DNA, 15 bp, Artificial Sequence
  dgRNA
  Sox8
cgagggatcaggctg

SEQ ID NO: 30377 - DNA, 15 bp, Artificial Sequence
  dgRNA
  Fbxl21
cggggcatctttaag

SEQ ID NO: 30378 - DNA, 15 bp, Artificial Sequence
  dgRNA
  Fbxl21
ggcagccacttccgg

SEQ ID NO: 30379 - DNA, 15 bp, Artificial Sequence
  dgRNA
  Fbxl21
ccacttccgggggcg

SEQ ID NO: 30380 - DNA, 15 bp, Artificial Sequence
  dgRNA
  Fbxl21
ttccgggggcgaggc

SEQ ID NO: 30381 - DNA, 15 bp, Artificial Sequence
  dgRNA
  Bace1
gctctgctagagcta

SEQ ID NO: 30382 - DNA, 15 bp, Artificial Sequence
  dgRNA
  Bace1
aaatgctttcccgct

SEQ ID NO: 30383 - DNA, 15 bp, Artificial Sequence
  dgRNA
  Bace1
gagtgaactccatct

SEQ ID NO: 30384 - DNA, 15 bp, Artificial Sequence
  dgRNA
  Bace1
actccatctcggcag

SEQ ID NO: 30385 - DNA, 15 bp, Artificial Sequence
  dgRNA
  Cd160
gtgtgatggagcaac

SEQ ID NO: 30386 - DNA, 15 bp, Artificial Sequence
  dgRNA
  Cd160
aaaactacaggggcg

SEQ ID NO: 30387 - DNA, 15 bp, Artificial Sequence
  dgRNA
  Cd160
aaactacaggggcgg

SEQ ID NO: 30388 - DNA, 15 bp, Artificial Sequence
  dgRNA
  Cd160
aaggccgagctgtga

SEQ ID NO: 30389 - DNA, 15 bp, Artificial Sequence
  dgRNA
  Klc3
cgacagcttgtctag

SEQ ID NO: 30390 - DNA, 15 bp, Artificial Sequence
  dgRNA
  Klc3
ccgacagcttgtcta

SEQ ID NO: 30391 - DNA, 15 bp, Artificial Sequence
  dgRNA
  Klc3
gccgacagcttgtct

SEQ ID NO: 30392 - DNA, 15 bp, Artificial Sequence
  dgRNA
  Klc3
gctggaggtgtctag

SEQ ID NO: 30393 - DNA, 15 bp, Artificial Sequence
  dgRNA
  Arl5c
aagctggaccgccct

SEQ ID NO: 30394 - DNA, 15 bp, Artificial Sequence
  dgRNA
  Arl5c
ctggaccgcccttgg

SEQ ID NO: 30395 - DNA, 15 bp, Artificial Sequence
  dgRNA
  Arl5c
tggaccgcccttgga

SEQ ID NO: 30396 - DNA, 15 bp, Artificial Sequence
  dgRNA
  Arl5c
agggtttccccccag

SEQ ID NO: 30397 - DNA, 15 bp, Artificial Sequence
  dgRNA
  Jdp2
ggagagcgcaccgga

SEQ ID NO: 30398 - DNA, 15 bp, Artificial Sequence
  dgRNA
  Jdp2
gagcgcaccggacgg

SEQ ID NO: 30399 - DNA, 15 bp, Artificial Sequence
  dgRNA
  Jdp2
cgcaccggacggagg

SEQ ID NO: 30400 - DNA, 15 bp, Artificial Sequence
  dgRNA
  Jdp2
ccggacggaggagga

SEQ ID NO: 30401 - DNA, 15 bp, Artificial Sequence
  dgRNA
  Klhl9
tacaagcttacataa

SEQ ID NO: 30402 - DNA, 15 bp, Artificial Sequence
  dgRNA
  Klhl9
taatggaccctgcac

SEQ ID NO: 30403 - DNA, 15 bp, Artificial Sequence
  dgRNA
  Klhl9
ctgcaccggcctcgc

SEQ ID NO: 30404 - DNA, 15 bp, Artificial Sequence
  dgRNA
  Klhl9
accggcctcgctggc

SEQ ID NO: 30405 - DNA, 15 bp, Artificial Sequence
  dgRNA
  Pcdha5
ttccaacgtcaaaaa

SEQ ID NO: 30406 - DNA, 15 bp, Artificial Sequence
  dgRNA
  Pcdha5
cgtcaaaaaaggata

SEQ ID NO: 30407 - DNA, 15 bp, Artificial Sequence
  dgRNA
  Pcdha5
aggatcttccatttt

SEQ ID NO: 30408 - DNA, 15 bp, Artificial Sequence
  dgRNA
  Pcdha5
atccttttttgacgt

SEQ ID NO: 30409 - DNA, 15 bp, Artificial Sequence
  dgRNA
  Krtap1-5
tggccgcatactctt

SEQ ID NO: 30410 - DNA, 15 bp, Artificial Sequence
  dgRNA
  Krtap1-5
gacatattatgggga

SEQ ID NO: 30411 - DNA, 15 bp, Artificial Sequence
  dgRNA
  Krtap1-5
cttgtgacatattat

SEQ ID NO: 30412 - DNA, 15 bp, Artificial Sequence
  dgRNA
  Krtap1-5
acttgtgacatatta

SEQ ID NO: 30413 - DNA, 15 bp, Artificial Sequence
  dgRNA
  Trove2
tcacctgccgcgcgc

SEQ ID NO: 30414 - DNA, 15 bp, Artificial Sequence
  dgRNA
  Trove2
gcgccggagcacaga

SEQ ID NO: 30415 - DNA, 15 bp, Artificial Sequence
  dgRNA
  Trove2
gacgctctagccacc

SEQ ID NO: 30416 - DNA, 15 bp, Artificial Sequence
  dgRNA
  Trove2
acgctctagccaccc

SEQ ID NO: 30417 - DNA, 15 bp, Artificial Sequence
  dgRNA
  Frmd4a
tggactagatcgagg

SEQ ID NO: 30418 - DNA, 15 bp, Artificial Sequence
  dgRNA
  Frmd4a
ggactagatcgaggg

SEQ ID NO: 30419 - DNA, 15 bp, Artificial Sequence
  dgRNA
  Frmd4a
tagatcgagggggga

SEQ ID NO: 30420 - DNA, 15 bp, Artificial Sequence
  dgRNA
  Frmd4a
agatcgaggggggat

SEQ ID NO: 30421 - DNA, 15 bp, Artificial Sequence
  dgRNA
  Golt1a
tcccacgttgttcag

SEQ ID NO: 30422 - DNA, 15 bp, Artificial Sequence
  dgRNA
  Golt1a
cacgttgttcagagg

SEQ ID NO: 30423 - DNA, 15 bp, Artificial Sequence
  dgRNA
  Golt1a
agtagccatttgtgt

SEQ ID NO: 30424 - DNA, 15 bp, Artificial Sequence
  dgRNA
  Golt1a
ggcgccccggccctt

SEQ ID NO: 30425 - DNA, 15 bp, Artificial Sequence
  dgRNA
  Adh4
aaatctggtggcagc

SEQ ID NO: 30426 - DNA, 15 bp, Artificial Sequence
  dgRNA
  Adh4
aatctggtggcagct

SEQ ID NO: 30427 - DNA, 15 bp, Artificial Sequence
  dgRNA
  Trim17
gagttgacgccacaa

SEQ ID NO: 30428 - DNA, 15 bp, Artificial Sequence
  dgRNA
  Trim17
ctagaccatatttgt

SEQ ID NO: 30429 - DNA, 15 bp, Artificial Sequence
  dgRNA
  Trim17
gctagaccatatttg

SEQ ID NO: 30430 - DNA, 15 bp, Artificial Sequence
  dgRNA
  Trim17
gcggtgacagaaata

SEQ ID NO: 30431 - DNA, 15 bp, Artificial Sequence
  dgRNA
  Tmem140
ttcgcacagtaaaat

SEQ ID NO: 30432 - DNA, 15 bp, Artificial Sequence
  dgRNA
  Tmem140
tcgcacagtaaaatc

SEQ ID NO: 30433 - DNA, 15 bp, Artificial Sequence
  dgRNA
  Tmem140
atcgggaccctcacc

SEQ ID NO: 30434 - DNA, 15 bp, Artificial Sequence
  dgRNA
  Tmem140
agggtgcgccagttg

SEQ ID NO: 30435 - DNA, 15 bp, Artificial Sequence
  dgRNA
  Erc2
tgccaggaggcgctg

SEQ ID NO: 30436 - DNA, 15 bp, Artificial Sequence
  dgRNA
  Erc2
ggaggcgctgcggag

SEQ ID NO: 30437 - DNA, 15 bp, Artificial Sequence
  dgRNA
  Erc2
tgctgccccccgcgg

SEQ ID NO: 30438 - DNA, 15 bp, Artificial Sequence
  dgRNA
  Erc2
cccgcggaggtgccc

SEQ ID NO: 30439 - DNA, 15 bp, Artificial Sequence
  dgRNA
  Guca1b
caccgctaagctgcc

SEQ ID NO: 30440 - DNA, 15 bp, Artificial Sequence
  dgRNA
  Guca1b
accgctaagctgccc

SEQ ID NO: 30441 - DNA, 15 bp, Artificial Sequence
  dgRNA
  Guca1b
ccgctaagctgcccg

SEQ ID NO: 30442 - DNA, 15 bp, Artificial Sequence
  dgRNA
  Guca1b
gcctcgcccctccac

SEQ ID NO: 30443 - DNA, 15 bp, Artificial Sequence
  dgRNA
  Prm1
gcccatatttggaca

SEQ ID NO: 30444 - DNA, 15 bp, Artificial Sequence
  dgRNA
  Prm1
atttggacatggtac

SEQ ID NO: 30445 - DNA, 15 bp, Artificial Sequence
  dgRNA
  Prm1
ggtacaggtcctcac

SEQ ID NO: 30446 - DNA, 15 bp, Artificial Sequence
  dgRNA
  Prm1
ttagtcactcagctt

SEQ ID NO: 30447 - DNA, 15 bp, Artificial Sequence
  dgRNA
  Fxyd1
cgcaggctcccctcc

SEQ ID NO: 30448 - DNA, 15 bp, Artificial Sequence
  dgRNA
  Tab3
gagatcgcttacagc

SEQ ID NO: 30449 - DNA, 15 bp, Artificial Sequence
  dgRNA
  Tab3
cgcttacagcaggcc

SEQ ID NO: 30450 - DNA, 15 bp, Artificial Sequence
  dgRNA
  Tab3
tacagcaggcccggg

SEQ ID NO: 30451 - DNA, 15 bp, Artificial Sequence
  dgRNA
  Tab3
gtgtctggcgagcga

SEQ ID NO: 30452 - DNA, 15 bp, Artificial Sequence
  dgRNA
  Hcn3
taagccacgccctct

SEQ ID NO: 30453 - DNA, 15 bp, Artificial Sequence
  dgRNA
  Hcn3
aagccacgccctctc

SEQ ID NO: 30454 - DNA, 15 bp, Artificial Sequence
  dgRNA
  Hcn3
cctctcgggaaagtg

SEQ ID NO: 30455 - DNA, 15 bp, Artificial Sequence
  dgRNA
  Hcn3
ctctcgggaaagtgt

SEQ ID NO: 30456 - DNA, 15 bp, Artificial Sequence
  dgRNA
  Camkk1
cgccccctctacccc

SEQ ID NO: 30457 - DNA, 15 bp, Artificial Sequence
  dgRNA
  Camkk1
gccccctctacccct

SEQ ID NO: 30458 - DNA, 15 bp, Artificial Sequence
  dgRNA
  Camkk1
ggaccggactctgat

SEQ ID NO: 30459 - DNA, 15 bp, Artificial Sequence
  dgRNA
  Camkk1
ttggacatctctgcg

SEQ ID NO: 30460 - DNA, 15 bp, Artificial Sequence
  dgRNA
  Bcs1l
gcccgtgctactcta

SEQ ID NO: 30461 - DNA, 15 bp, Artificial Sequence
  dgRNA
  Bcs1l
accatcgagaattgc

SEQ ID NO: 30462 - DNA, 15 bp, Artificial Sequence
  dgRNA
  Bcs1l
ccatcgagaattgca

SEQ ID NO: 30463 - DNA, 15 bp, Artificial Sequence
  dgRNA
  Bcs1l
gtggcaaggactccg

SEQ ID NO: 30464 - DNA, 15 bp, Artificial Sequence
  dgRNA
  Dcx
gcactaggacctaga

SEQ ID NO: 30465 - DNA, 15 bp, Artificial Sequence
  dgRNA
  Dcx
ggcaactatccaccc

SEQ ID NO: 30466 - DNA, 15 bp, Artificial Sequence
  dgRNA
  Dcx
actatccaccctggc

SEQ ID NO: 30467 - DNA, 15 bp, Artificial Sequence
  dgRNA
  Rad1
tttcgagctcctttt

SEQ ID NO: 30468 - DNA, 15 bp, Artificial Sequence
  dgRNA
  Rad1
cacgccgctttctct

SEQ ID NO: 30469 - DNA, 15 bp, Artificial Sequence
  dgRNA
  Rad1
ctcgcctcgccgcgt

SEQ ID NO: 30470 - DNA, 15 bp, Artificial Sequence
  dgRNA
  Rad1
cgctgcctgcacttc

SEQ ID NO: 30471 - DNA, 15 bp, Artificial Sequence
  dgRNA
  Defb6
tgtagactcctacac

SEQ ID NO: 30472 - DNA, 15 bp, Artificial Sequence
  dgRNA
  Defb6
atctctctagtgagg

SEQ ID NO: 30473 - DNA, 15 bp, Artificial Sequence
  dgRNA
  Gm7030
gggcagggcttgaat

SEQ ID NO: 30474 - DNA, 15 bp, Artificial Sequence
  dgRNA
  Gm7030
cccaggcccattgag

SEQ ID NO: 30475 - DNA, 15 bp, Artificial Sequence
  dgRNA
  Gm7030
tcctctcaatgggcc

SEQ ID NO: 30476 - DNA, 15 bp, Artificial Sequence
  dgRNA
  Ggta1
cctctttcattcgcc

SEQ ID NO: 30477 - DNA, 15 bp, Artificial Sequence
  dgRNA
  Ggta1
ctttcattcgcccgg

SEQ ID NO: 30478 - DNA, 15 bp, Artificial Sequence
  dgRNA
  Ggta1
cgcccggaggtagat

SEQ ID NO: 30479 - DNA, 15 bp, Artificial Sequence
  dgRNA
  Ggta1
taggtgtgtcttagg

SEQ ID NO: 30480 - DNA, 15 bp, Artificial Sequence
  dgRNA
  Zbtb7b
agcgaagcaaaatct

SEQ ID NO: 30481 - DNA, 15 bp, Artificial Sequence
  dgRNA
  Zbtb7b
ccatatgctccctgc

SEQ ID NO: 30482 - DNA, 15 bp, Artificial Sequence
  dgRNA
  Zbtb7b
gctggaactagctgt

SEQ ID NO: 30483 - DNA, 15 bp, Artificial Sequence
  dgRNA
  Zbtb7b
actagctgttggaag

SEQ ID NO: 30484 - DNA, 15 bp, Artificial Sequence
  dgRNA
  Disc1
aaactttctgcgctg

SEQ ID NO: 30485 - DNA, 15 bp, Artificial Sequence
  dgRNA
  Disc1
ttctgcgctgcggtc

SEQ ID NO: 30486 - DNA, 15 bp, Artificial Sequence
  dgRNA
  Disc1
tctgcgctgcggtct

SEQ ID NO: 30487 - DNA, 15 bp, Artificial Sequence
  dgRNA
  Disc1
ggtctgggagccgcg

SEQ ID NO: 30488 - DNA, 15 bp, Artificial Sequence
  dgRNA
  Peli1
caccgcctcgcgatg

SEQ ID NO: 30489 - DNA, 15 bp, Artificial Sequence
  dgRNA
  Peli1
taagcctgaaggttc

SEQ ID NO: 30490 - DNA, 15 bp, Artificial Sequence
  dgRNA
  Peli1
cgcgcaagggggttg

SEQ ID NO: 30491 - DNA, 15 bp, Artificial Sequence
  dgRNA
  Peli1
acgcgcaagggggtt

SEQ ID NO: 30492 - DNA, 15 bp, Artificial Sequence
  dgRNA
  Fgf23
accctttaaaagtcc

SEQ ID NO: 30493 - DNA, 15 bp, Artificial Sequence
  dgRNA
  Fgf23
ccctttaaaagtccc

SEQ ID NO: 30494 - DNA, 15 bp, Artificial Sequence
  dgRNA
  Fgf23
cctttaaaagtcccg

SEQ ID NO: 30495 - DNA, 15 bp, Artificial Sequence
  dgRNA
  Fgf23
agtcccggggaaaaa

SEQ ID NO: 30496 - DNA, 15 bp, Artificial Sequence
  dgRNA
  3110082I17Rik
caccaggtgttgccc

SEQ ID NO: 30497 - DNA, 15 bp, Artificial Sequence
  dgRNA
  3110082I17Rik
ccaatatcctgcgcc

SEQ ID NO: 30498 - DNA, 15 bp, Artificial Sequence
  dgRNA
  3110082I17Rik
caatatcctgcgcca

SEQ ID NO: 30499 - DNA, 15 bp, Artificial Sequence
  dgRNA
  3110082I17Rik
ctgcgccctcccatg

SEQ ID NO: 30500 - DNA, 15 bp, Artificial Sequence
  dgRNA
  Rbm22
ggtaatggatccgct

SEQ ID NO: 30501 - DNA, 15 bp, Artificial Sequence
  dgRNA
  Rbm22
gcgttacaatcccac

SEQ ID NO: 30502 - DNA, 15 bp, Artificial Sequence
  dgRNA
  Rbm22
atgcaaggacgtaca

SEQ ID NO: 30503 - DNA, 15 bp, Artificial Sequence
  dgRNA
  Rbm22
tgcaaggacgtacac

SEQ ID NO: 30504 - DNA, 15 bp, Artificial Sequence
  dgRNA
  Dscaml1
aagcctgcgagttac

SEQ ID NO: 30505 - DNA, 15 bp, Artificial Sequence
  dgRNA
  Dscaml1
tcctctctcgaccag

SEQ ID NO: 30506 - DNA, 15 bp, Artificial Sequence
  dgRNA
  Dscaml1
ctcgaccagaggagc

SEQ ID NO: 30507 - DNA, 15 bp, Artificial Sequence
  dgRNA
  Dscaml1
aggatcgagactgtc

SEQ ID NO: 30508 - DNA, 15 bp, Artificial Sequence
  dgRNA
  Olfr1100
aggatacaatagagg

SEQ ID NO: 30509 - DNA, 15 bp, Artificial Sequence
  dgRNA
  Olfr1100
accaggatacaatag

SEQ ID NO: 30510 - DNA, 15 bp, Artificial Sequence
  dgRNA
  Olfr1100
aattcatatttgacc

SEQ ID NO: 30511 - DNA, 15 bp, Artificial Sequence
  dgRNA
  Ciart
gcgtgccgtagcaaa

SEQ ID NO: 30512 - DNA, 15 bp, Artificial Sequence
  dgRNA
  Ciart
cgtgccgtagcaaat

SEQ ID NO: 30513 - DNA, 15 bp, Artificial Sequence
  dgRNA
  Ciart
agagtcacgtgttgc

SEQ ID NO: 30514 - DNA, 15 bp, Artificial Sequence
  dgRNA
  Ciart
aaggtctgtgtacgc

SEQ ID NO: 30515 - DNA, 15 bp, Artificial Sequence
  dgRNA
  Pex11b
accatcgttgtcaag

SEQ ID NO: 30516 - DNA, 15 bp, Artificial Sequence
  dgRNA
  Pex11b
taggacaaatagtct

SEQ ID NO: 30517 - DNA, 15 bp, Artificial Sequence
  dgRNA
  Pex11b
caaatagtctaggac

SEQ ID NO: 30518 - DNA, 15 bp, Artificial Sequence
  dgRNA
  Pex11b
gctgttctgggcgtt

SEQ ID NO: 30519 - DNA, 15 bp, Artificial Sequence
  dgRNA
  Slc1a3
tacttaattgtattc

SEQ ID NO: 30520 - DNA, 15 bp, Artificial Sequence
  dgRNA
  Slc1a3
gtccccaatgctaaa

SEQ ID NO: 30521 - DNA, 15 bp, Artificial Sequence
  dgRNA
  Slc1a3
tccccaatgctaaag

SEQ ID NO: 30522 - DNA, 15 bp, Artificial Sequence
  dgRNA
  Slc1a3
ccaatgctaaagggg

SEQ ID NO: 30523 - DNA, 15 bp, Artificial Sequence
  dgRNA
  Dusp9
cccccgacctgccct

SEQ ID NO: 30524 - DNA, 15 bp, Artificial Sequence
  dgRNA
  Dusp9
tgaccctgtcccgcc

SEQ ID NO: 30525 - DNA, 15 bp, Artificial Sequence
  dgRNA
  Dusp9
gaccctgtcccgcct

SEQ ID NO: 30526 - DNA, 15 bp, Artificial Sequence
  dgRNA
  Dusp9
cctgtcccgcctggg

SEQ ID NO: 30527 - DNA, 15 bp, Artificial Sequence
  dgRNA
  Vcpkmt
atgtataagcactgt

SEQ ID NO: 30528 - DNA, 15 bp, Artificial Sequence
  dgRNA
  Vcpkmt
gtcacgcatgcgcct

SEQ ID NO: 30529 - DNA, 15 bp, Artificial Sequence
  dgRNA
  Vcpkmt
tcacgcatgcgcctt

SEQ ID NO: 30530 - DNA, 15 bp, Artificial Sequence
  dgRNA
  Vcpkmt
cagccgccctgccgc

SEQ ID NO: 30531 - DNA, 15 bp, Artificial Sequence
  dgRNA
  Dennd1a
gcgcttcccgccccc

SEQ ID NO: 30532 - DNA, 15 bp, Artificial Sequence
  dgRNA
  Dennd1a
ccaccctcacgcgag

SEQ ID NO: 30533 - DNA, 15 bp, Artificial Sequence
  dgRNA
  Dennd1a
agcccccgcggtcag

SEQ ID NO: 30534 - DNA, 15 bp, Artificial Sequence
  dgRNA
  Dennd1a
ccgcggtcagcggcg

SEQ ID NO: 30535 - DNA, 15 bp, Artificial Sequence
  dgRNA
  Sqrdl
ggggaaggtgccgcg

SEQ ID NO: 30536 - DNA, 15 bp, Artificial Sequence
  dgRNA
  Sqrdl
cgcggttctgagtag

SEQ ID NO: 30537 - DNA, 15 bp, Artificial Sequence
  dgRNA
  Sqrdl
gtaagaaaagcgtct

SEQ ID NO: 30538 - DNA, 15 bp, Artificial Sequence
  dgRNA
  Sqrdl
agcgtctaggctgcg

SEQ ID NO: 30539 - DNA, 15 bp, Artificial Sequence
  dgRNA
  Lrrtm4
tgttttctccagcgg

SEQ ID NO: 30540 - DNA, 15 bp, Artificial Sequence
  dgRNA
  Lrrtm4
gttttctccagcgga

SEQ ID NO: 30541 - DNA, 15 bp, Artificial Sequence
  dgRNA
  Lrrtm4
ctgagtgccctccgc

SEQ ID NO: 30542 - DNA, 15 bp, Artificial Sequence
  dgRNA
  Lrrtm4
cttgtctaattcaga

SEQ ID NO: 30543 - DNA, 15 bp, Artificial Sequence
  dgRNA
  Klf12
gaccatctcttgccg

SEQ ID NO: 30544 - DNA, 15 bp, Artificial Sequence
  dgRNA
  Klf12
attgcctccatcgtc

SEQ ID NO: 30545 - DNA, 15 bp, Artificial Sequence
  dgRNA
  Klf12
gcctccatcgtcagg

SEQ ID NO: 30546 - DNA, 15 bp, Artificial Sequence
  dgRNA
  Klf12
ccacttttcccgata

SEQ ID NO: 30547 - DNA, 15 bp, Artificial Sequence
  dgRNA
  Ankra2
cttcaccgaacgctc

SEQ ID NO: 30548 - DNA, 15 bp, Artificial Sequence
  dgRNA
  Ankra2
ttcaccgaacgctct

SEQ ID NO: 30549 - DNA, 15 bp, Artificial Sequence
  dgRNA
  Ankra2
cagagcgttcggtga

SEQ ID NO: 30550 - DNA, 15 bp, Artificial Sequence
  dgRNA
  Ankra2
aaagcccagagcgtt

SEQ ID NO: 30551 - DNA, 15 bp, Artificial Sequence
  dgRNA
  Gzmn
tcatgcagtagaatc

SEQ ID NO: 30552 - DNA, 15 bp, Artificial Sequence
  dgRNA
  Gzmn
cgttctagttcctca

SEQ ID NO: 30553 - DNA, 15 bp, Artificial Sequence
  dgRNA
  Gzmn
acttaggtttcagat

SEQ ID NO: 30554 - DNA, 15 bp, Artificial Sequence
  dgRNA
  Gzmn
catgatgctatctta

SEQ ID NO: 30555 - DNA, 15 bp, Artificial Sequence
  dgRNA
  Mphosph6
gcagctccgagcact

SEQ ID NO: 30556 - DNA, 15 bp, Artificial Sequence
  dgRNA
  Mphosph6
cagctccgagcacta

SEQ ID NO: 30557 - DNA, 15 bp, Artificial Sequence
  dgRNA
  Mphosph6
tccgagcactagggc

SEQ ID NO: 30558 - DNA, 15 bp, Artificial Sequence
  dgRNA
  Mphosph6
ccgagcactagggcg

SEQ ID NO: 30559 - DNA, 15 bp, Artificial Sequence
  dgRNA
  Nes
tcacccgcaccggac

SEQ ID NO: 30560 - DNA, 15 bp, Artificial Sequence
  dgRNA
  Nes
gacgggatccccgcc

SEQ ID NO: 30561 - DNA, 15 bp, Artificial Sequence
  dgRNA
  Nes
acgggatccccgcca

SEQ ID NO: 30562 - DNA, 15 bp, Artificial Sequence
  dgRNA
  Nes
atccccgccagggcg

SEQ ID NO: 30563 - DNA, 15 bp, Artificial Sequence
  dgRNA
  Mrpl30
tcggaatcctgtccc

SEQ ID NO: 30564 - DNA, 15 bp, Artificial Sequence
  dgRNA
  Mrpl30
ctgcgctgtcttcta

SEQ ID NO: 30565 - DNA, 15 bp, Artificial Sequence
  dgRNA
  Mrpl30
atggcgcgttgtgaa

SEQ ID NO: 30566 - DNA, 15 bp, Artificial Sequence
  dgRNA
  Mrpl30
tggcgcgttgtgaat

SEQ ID NO: 30567 - DNA, 15 bp, Artificial Sequence
  dgRNA
  Rybp
gcgggggccaccggc

SEQ ID NO: 30568 - DNA, 15 bp, Artificial Sequence
  dgRNA
  Rybp
cccgggcacgcacgc

SEQ ID NO: 30569 - DNA, 15 bp, Artificial Sequence
  dgRNA
  Rybp
tacgccccgcccccg

SEQ ID NO: 30570 - DNA, 15 bp, Artificial Sequence
  dgRNA
  Rybp
ccgcccccgcggcgc

SEQ ID NO: 30571 - DNA, 15 bp, Artificial Sequence
  dgRNA
  Nrep
gccctacggcggcgg

SEQ ID NO: 30572 - DNA, 15 bp, Artificial Sequence
  dgRNA
  Nrep
ggagcgcgcgcaagt

SEQ ID NO: 30573 - DNA, 15 bp, Artificial Sequence
  dgRNA
  Nrep
ttggccgcgcgccca

SEQ ID NO: 30574 - DNA, 15 bp, Artificial Sequence
  dgRNA
  Nrep
tggccgcgcgcccac

SEQ ID NO: 30575 - DNA, 15 bp, Artificial Sequence
  dgRNA
  Skint10
taacttgccttggcg

SEQ ID NO: 30576 - DNA, 15 bp, Artificial Sequence
  dgRNA
  Skint10
gcagtttaaatgagt

SEQ ID NO: 30577 - DNA, 15 bp, Artificial Sequence
  dgRNA
  Skint10
atctgagccacgcca

SEQ ID NO: 30578 - DNA, 15 bp, Artificial Sequence
  dgRNA
  1700029I15Rik
tctagagtgatggac

SEQ ID NO: 30579 - DNA, 15 bp, Artificial Sequence
  dgRNA
  1700029I15Rik
tggagttggatagta

SEQ ID NO: 30580 - DNA, 15 bp, Artificial Sequence
  dgRNA
  1700029I15Rik
tggatagtatggaat

SEQ ID NO: 30581 - DNA, 15 bp, Artificial Sequence
  dgRNA
  1700029I15Rik
tagtatggaattggc

SEQ ID NO: 30582 - DNA, 15 bp, Artificial Sequence
  dgRNA
  BC031181
caggaagggccggcc

SEQ ID NO: 30583 - DNA, 15 bp, Artificial Sequence
  dgRNA
  BC031181
aggaagggccggccc

SEQ ID NO: 30584 - DNA, 15 bp, Artificial Sequence
  dgRNA
  BC031181
actacagcgcagctc

SEQ ID NO: 30585 - DNA, 15 bp, Artificial Sequence
  dgRNA
  BC031181
gcagctccggaagtg

SEQ ID NO: 30586 - DNA, 15 bp, Artificial Sequence
  dgRNA
  Ywhaz
agtgtaggccccaga

SEQ ID NO: 30587 - DNA, 15 bp, Artificial Sequence
  dgRNA
  Ywhaz
gtgtaggccccagaa

SEQ ID NO: 30588 - DNA, 15 bp, Artificial Sequence
  dgRNA
  Ywhaz
tgtaggccccagaag

SEQ ID NO: 30589 - DNA, 15 bp, Artificial Sequence
  dgRNA
  Ywhaz
tcaacttccgtctcc

SEQ ID NO: 30590 - DNA, 15 bp, Artificial Sequence
  dgRNA
  Vmn1r230
ttcaccagttcacat

SEQ ID NO: 30591 - DNA, 15 bp, Artificial Sequence
  dgRNA
  Vmn1r230
ttcaataactgtagg

SEQ ID NO: 30592 - DNA, 15 bp, Artificial Sequence
  dgRNA
  Vmn1r230
ttctgccgaccatct

SEQ ID NO: 30593 - DNA, 15 bp, Artificial Sequence
  dgRNA
  Vmn1r230
tctgccgaccatctt

SEQ ID NO: 30594 - DNA, 15 bp, Artificial Sequence
  dgRNA
  Naip1
gtagccattgtctaa

SEQ ID NO: 30595 - DNA, 15 bp, Artificial Sequence
  dgRNA
  Naip1
tagccattgtctaat

SEQ ID NO: 30596 - DNA, 15 bp, Artificial Sequence
  dgRNA
  Naip1
ggacccattagacaa

SEQ ID NO: 30597 - DNA, 15 bp, Artificial Sequence
  dgRNA
  Naip1
ttttgtggctccatc

SEQ ID NO: 30598 - DNA, 15 bp, Artificial Sequence
  dgRNA
  Ltk
gacgtgagtgtatac

SEQ ID NO: 30599 - DNA, 15 bp, Artificial Sequence
  dgRNA
  Ltk
tgtatacaggccagt

SEQ ID NO: 30600 - DNA, 15 bp, Artificial Sequence
  dgRNA
  Ltk
aggccagttggaagt

SEQ ID NO: 30601 - DNA, 15 bp, Artificial Sequence
  dgRNA
  Ltk
cagttggaagtcggc

SEQ ID NO: 30602 - DNA, 15 bp, Artificial Sequence
  dgRNA
  Efr3a
tacactcaagactat

SEQ ID NO: 30603 - DNA, 15 bp, Artificial Sequence
  dgRNA
  Efr3a
gtcctaaagtgacct

SEQ ID NO: 30604 - DNA, 15 bp, Artificial Sequence
  dgRNA
  Efr3a
caagcagtcaccgct

SEQ ID NO: 30605 - DNA, 15 bp, Artificial Sequence
  dgRNA
  Efr3a
aagcagtcaccgctt

SEQ ID NO: 30606 - DNA, 15 bp, Artificial Sequence
  dgRNA
  Usp22
ccggcaaaccaccaa

SEQ ID NO: 30607 - DNA, 15 bp, Artificial Sequence
  dgRNA
  Usp22
caatggtgtgacgcg

SEQ ID NO: 30608 - DNA, 15 bp, Artificial Sequence
  dgRNA
  Usp22
aatggtgtgacgcga

SEQ ID NO: 30609 - DNA, 15 bp, Artificial Sequence
  dgRNA
  Usp22
ggtgtgacgcgaggg

SEQ ID NO: 30610 - DNA, 15 bp, Artificial Sequence
  dgRNA
  Plxnb3
tggagcccgatctcc

SEQ ID NO: 30611 - DNA, 15 bp, Artificial Sequence
  dgRNA
  Plxnb3
agggccaccatgaat

SEQ ID NO: 30612 - DNA, 15 bp, Artificial Sequence
  dgRNA
  Plxnb3
ttgtcaatagtggcc

SEQ ID NO: 30613 - DNA, 15 bp, Artificial Sequence
  dgRNA
  Plxnb3
gctcagccccattca

SEQ ID NO: 30614 - DNA, 15 bp, Artificial Sequence
  dgRNA
  Pigg
gatcgcttaatctgc

SEQ ID NO: 30615 - DNA, 15 bp, Artificial Sequence
  dgRNA
  Pigg
tggggccataacacc

SEQ ID NO: 30616 - DNA, 15 bp, Artificial Sequence
  dgRNA
  Pigg
ggccataacaccagg

SEQ ID NO: 30617 - DNA, 15 bp, Artificial Sequence
  dgRNA
  Pigg
atactgcaccgacac

SEQ ID NO: 30618 - DNA, 15 bp, Artificial Sequence
  dgRNA
  Stfa2l1
ggtgtgccaagactc

SEQ ID NO: 30619 - DNA, 15 bp, Artificial Sequence
  dgRNA
  Asic4
cactcgcttgctcgc

SEQ ID NO: 30620 - DNA, 15 bp, Artificial Sequence
  dgRNA
  Asic4
cgcagggacacacgc

SEQ ID NO: 30621 - DNA, 15 bp, Artificial Sequence
  dgRNA
  Asic4
gtgcgggtgctgata

SEQ ID NO: 30622 - DNA, 15 bp, Artificial Sequence
  dgRNA
  Asic4
tgcgggtgctgataa

SEQ ID NO: 30623 - DNA, 15 bp, Artificial Sequence
  dgRNA
  Mamld1
cgaaactccaccttc

SEQ ID NO: 30624 - DNA, 15 bp, Artificial Sequence
  dgRNA
  Mamld1
caccttccgggcgcg

SEQ ID NO: 30625 - DNA, 15 bp, Artificial Sequence
  dgRNA
  Mamld1
tccgggcgcgcggcg

SEQ ID NO: 30626 - DNA, 15 bp, Artificial Sequence
  dgRNA
  Mamld1
gcggagccgggcggt

SEQ ID NO: 30627 - DNA, 15 bp, Artificial Sequence
  dgRNA
  Polr2j
ttagtcccattcagt

SEQ ID NO: 30628 - DNA, 15 bp, Artificial Sequence
  dgRNA
  Polr2j
ccattcagtcggtac

SEQ ID NO: 30629 - DNA, 15 bp, Artificial Sequence
  dgRNA
  Polr2j
cattcagtcggtacc

SEQ ID NO: 30630 - DNA, 15 bp, Artificial Sequence
  dgRNA
  Polr2j
attcagtcggtaccg

SEQ ID NO: 30631 - DNA, 15 bp, Artificial Sequence
  dgRNA
  Zfp867
taatcactcaaggat

SEQ ID NO: 30632 - DNA, 15 bp, Artificial Sequence
  dgRNA
  Zfp867
atcactcaaggattg

SEQ ID NO: 30633 - DNA, 15 bp, Artificial Sequence
  dgRNA
  Zfp867
tcactcaaggattgg

SEQ ID NO: 30634 - DNA, 15 bp, Artificial Sequence
  dgRNA
  Zfp867
cttcgtctatcagag

SEQ ID NO: 30635 - DNA, 15 bp, Artificial Sequence
  dgRNA
  Actr3
atgcgtagccgcttc

SEQ ID NO: 30636 - DNA, 15 bp, Artificial Sequence
  dgRNA
  Actr3
ccaaagtggactttc

SEQ ID NO: 30637 - DNA, 15 bp, Artificial Sequence
  dgRNA
  Actr3
ttctggctatccgga

SEQ ID NO: 30638 - DNA, 15 bp, Artificial Sequence
  dgRNA
  Actr3
tctggctatccggaa

SEQ ID NO: 30639 - DNA, 15 bp, Artificial Sequence
  dgRNA
  Kcna2
gcgcggagttttgtt

SEQ ID NO: 30640 - DNA, 15 bp, Artificial Sequence
  dgRNA
  Kcna2
ttgcggtgggggtcc

SEQ ID NO: 30641 - DNA, 15 bp, Artificial Sequence
  dgRNA
  Kcna2
gggggtccgggacac

SEQ ID NO: 30642 - DNA, 15 bp, Artificial Sequence
  dgRNA
  Kcna2
ggggtccgggacaca

SEQ ID NO: 30643 - DNA, 15 bp, Artificial Sequence
  dgRNA
  Kdm7a
ccgccagccccgctg

SEQ ID NO: 30644 - DNA, 15 bp, Artificial Sequence
  dgRNA
  Kdm7a
cgccagccccgctgc

SEQ ID NO: 30645 - DNA, 15 bp, Artificial Sequence
  dgRNA
  Kdm7a
tgcgggtcgccgcgc

SEQ ID NO: 30646 - DNA, 15 bp, Artificial Sequence
  dgRNA
  Kdm7a
ccgcgcaggtcgccg

SEQ ID NO: 30647 - DNA, 15 bp, Artificial Sequence
  dgRNA
  Srgap1
tcgcccgagtttgct

SEQ ID NO: 30648 - DNA, 15 bp, Artificial Sequence
  dgRNA
  Srgap1
ccgagtttgctcggc

SEQ ID NO: 30649 - DNA, 15 bp, Artificial Sequence
  dgRNA
  Srgap1
cgctcgccagcgccc

SEQ ID NO: 30650 - DNA, 15 bp, Artificial Sequence
  dgRNA
  Srgap1
gctcgccagcgccca

SEQ ID NO: 30651 - DNA, 15 bp, Artificial Sequence
  dgRNA
  Ino80c
acatagcgaagctgc

SEQ ID NO: 30652 - DNA, 15 bp, Artificial Sequence
  dgRNA
  Ino80c
agaccggatgctcac

SEQ ID NO: 30653 - DNA, 15 bp, Artificial Sequence
  dgRNA
  Ino80c
gaccggatgctcact

SEQ ID NO: 30654 - DNA, 15 bp, Artificial Sequence
  dgRNA
  Ino80c
ccaggcgcgtgcccc

SEQ ID NO: 30655 - DNA, 15 bp, Artificial Sequence
  dgRNA
  Abcd1
cttctgtagtgtacg

SEQ ID NO: 30656 - DNA, 15 bp, Artificial Sequence
  dgRNA
  Abcd1
cttcgtttctgttgt

SEQ ID NO: 30657 - DNA, 15 bp, Artificial Sequence
  dgRNA
  Abcd1
tttctgttgtcggag

SEQ ID NO: 30658 - DNA, 15 bp, Artificial Sequence
  dgRNA
  Abcd1
tctgttgtcggagag

SEQ ID NO: 30659 - DNA, 15 bp, Artificial Sequence
  dgRNA
  Htra3
ccagaccctcattct

SEQ ID NO: 30660 - DNA, 15 bp, Artificial Sequence
  dgRNA
  Htra3
accctcattctgggc

SEQ ID NO: 30661 - DNA, 15 bp, Artificial Sequence
  dgRNA
  Htra3
cacaccaggcaagcg

SEQ ID NO: 30662 - DNA, 15 bp, Artificial Sequence
  dgRNA
  Htra3
caagcggggagcagg

SEQ ID NO: 30663 - DNA, 15 bp, Artificial Sequence
  dgRNA
  Tcf25
cgaagcaccgcacca

SEQ ID NO: 30664 - DNA, 15 bp, Artificial Sequence
  dgRNA
  Tcf25
accacggccgccgct

SEQ ID NO: 30665 - DNA, 15 bp, Artificial Sequence
  dgRNA
  Tcf25
ccacggccgccgcta

SEQ ID NO: 30666 - DNA, 15 bp, Artificial Sequence
  dgRNA
  Tcf25
tcgcgagagctccct

SEQ ID NO: 30667 - DNA, 15 bp, Artificial Sequence
  dgRNA
  Tmem184b
ctggggacttcccgc

SEQ ID NO: 30668 - DNA, 15 bp, Artificial Sequence
  dgRNA
  Tmem184b
tggggacttcccgcg

SEQ ID NO: 30669 - DNA, 15 bp, Artificial Sequence
  dgRNA
  Tmem184b
ggacttcccgcgggg

SEQ ID NO: 30670 - DNA, 15 bp, Artificial Sequence
  dgRNA
  Tmem184b
ttcccgcggggaggc

SEQ ID NO: 30671 - DNA, 15 bp, Artificial Sequence
  dgRNA
  Srgap2
tctaggactgcgcct

SEQ ID NO: 30672 - DNA, 15 bp, Artificial Sequence
  dgRNA
  Srgap2
tactcctggcgtcta

SEQ ID NO: 30673 - DNA, 15 bp, Artificial Sequence
  dgRNA
  Srgap2
ccgtcagtcgctatt

SEQ ID NO: 30674 - DNA, 15 bp, Artificial Sequence
  dgRNA
  Srgap2
tcagtcgctattagg

SEQ ID NO: 30675 - DNA, 15 bp, Artificial Sequence
  dgRNA
  Lrrc28
cagccaataagcgtc

SEQ ID NO: 30676 - DNA, 15 bp, Artificial Sequence
  dgRNA
  Lrrc28
catcccgcctattgt

SEQ ID NO: 30677 - DNA, 15 bp, Artificial Sequence
  dgRNA
  Lrrc28
ggacagcgagaactg

SEQ ID NO: 30678 - DNA, 15 bp, Artificial Sequence
  dgRNA
  Lrrc28
aggcgaactatcgcg

SEQ ID NO: 30679 - DNA, 15 bp, Artificial Sequence
  dgRNA
  Tep1
gagcatgattgtatt

SEQ ID NO: 30680 - DNA, 15 bp, Artificial Sequence
  dgRNA
  Tep1
catgattgtattggg

SEQ ID NO: 30681 - DNA, 15 bp, Artificial Sequence
  dgRNA
  Tep1
ggtggaaatacaact

SEQ ID NO: 30682 - DNA, 15 bp, Artificial Sequence
  dgRNA
  Tep1
gaaatacaactcggt

SEQ ID NO: 30683 - DNA, 15 bp, Artificial Sequence
  dgRNA
  Dennd1b
tgctttcccaggccg

SEQ ID NO: 30684 - DNA, 15 bp, Artificial Sequence
  dgRNA
  Dennd1b
caggccggggatcgc

SEQ ID NO: 30685 - DNA, 15 bp, Artificial Sequence
  dgRNA
  Dennd1b
ggggatcgcaggagc

SEQ ID NO: 30686 - DNA, 15 bp, Artificial Sequence
  dgRNA
  Dennd1b
tgcccggagcccgcg

SEQ ID NO: 30687 - DNA, 15 bp, Artificial Sequence
  dgRNA
  Tnfrsf12a
gcagagggcggagta

SEQ ID NO: 30688 - DNA, 15 bp, Artificial Sequence
  dgRNA
  Tnfrsf12a
agtagggtagacact

SEQ ID NO: 30689 - DNA, 15 bp, Artificial Sequence
  dgRNA
  Tnfrsf12a
gggtagacacttggc

SEQ ID NO: 30690 - DNA, 15 bp, Artificial Sequence
  dgRNA
  Tnfrsf12a
actcgcaaagcagag

SEQ ID NO: 30691 - DNA, 15 bp, Artificial Sequence
  dgRNA
  Cd1d1
aagtggtttgcgtag

SEQ ID NO: 30692 - DNA, 15 bp, Artificial Sequence
  dgRNA
  Cd1d1
tggtctagctagcag

SEQ ID NO: 30693 - DNA, 15 bp, Artificial Sequence
  dgRNA
  Cd1d1
ttggtctagctagca

SEQ ID NO: 30694 - DNA, 15 bp, Artificial Sequence
  dgRNA
  Cd1d1
tttggtctagctagc

SEQ ID NO: 30695 - DNA, 15 bp, Artificial Sequence
  dgRNA
  Zak
cgcgaccccgagccc

SEQ ID NO: 30696 - DNA, 15 bp, Artificial Sequence
  dgRNA
  Zak
tgctgggcaccgagc

SEQ ID NO: 30697 - DNA, 15 bp, Artificial Sequence
  dgRNA
  Zak
cgagccgggcgtgcc

SEQ ID NO: 30698 - DNA, 15 bp, Artificial Sequence
  dgRNA
  Zak
gccgggcgtgcccgg

SEQ ID NO: 30699 - DNA, 15 bp, Artificial Sequence
  dgRNA
  Kcnj16
tcagcctccgttggc

SEQ ID NO: 30700 - DNA, 15 bp, Artificial Sequence
  dgRNA
  Kcnj16
gtctctaccatgagt

SEQ ID NO: 30701 - DNA, 15 bp, Artificial Sequence
  dgRNA
  Kcnj16
taccatgagtaggca

SEQ ID NO: 30702 - DNA, 15 bp, Artificial Sequence
  dgRNA
  Kcnj16
accatgagtaggcat

SEQ ID NO: 30703 - DNA, 15 bp, Artificial Sequence
  dgRNA
  Rbm4b
tcccaaggcggtgat

SEQ ID NO: 30704 - DNA, 15 bp, Artificial Sequence
  dgRNA
  Rbm4b
gtgattggctagccc

SEQ ID NO: 30705 - DNA, 15 bp, Artificial Sequence
  dgRNA
  Rbm4b
ttggctagcccgggc

SEQ ID NO: 30706 - DNA, 15 bp, Artificial Sequence
  dgRNA
  Rbm4b
tggctagcccgggct

SEQ ID NO: 30707 - DNA, 15 bp, Artificial Sequence
  dgRNA
  D10Wsu102e
tccgcccacgcagtg

SEQ ID NO: 30708 - DNA, 15 bp, Artificial Sequence
  dgRNA
  D10Wsu102e
tcctccaccccgcct

SEQ ID NO: 30709 - DNA, 15 bp, Artificial Sequence
  dgRNA
  D10Wsu102e
cgcttccggttcccg

SEQ ID NO: 30710 - DNA, 15 bp, Artificial Sequence
  dgRNA
  D10Wsu102e
gcttccggttcccgt

SEQ ID NO: 30711 - DNA, 15 bp, Artificial Sequence
  dgRNA
  Luc7l2
gactcagcctccgag

SEQ ID NO: 30712 - DNA, 15 bp, Artificial Sequence
  dgRNA
  Luc7l2
gcctccgagaggggc

SEQ ID NO: 30713 - DNA, 15 bp, Artificial Sequence
  dgRNA
  Luc7l2
agacgtgaacgcgct

SEQ ID NO: 30714 - DNA, 15 bp, Artificial Sequence
  dgRNA
  Luc7l2
gacgtgaacgcgctc

SEQ ID NO: 30715 - DNA, 15 bp, Artificial Sequence
  dgRNA
  Elavl2
caacttaccttgaaa

SEQ ID NO: 30716 - DNA, 15 bp, Artificial Sequence
  dgRNA
  Elavl2
aacttaccttgaaac

SEQ ID NO: 30717 - DNA, 15 bp, Artificial Sequence
  dgRNA
  Elavl2
tagcagagcttcgcc

SEQ ID NO: 30718 - DNA, 15 bp, Artificial Sequence
  dgRNA
  Elavl2
agcagagcttcgcct

SEQ ID NO: 30719 - DNA, 15 bp, Artificial Sequence
  dgRNA
  Ppp4r1
cgcgctccgcacgct

SEQ ID NO: 30720 - DNA, 15 bp, Artificial Sequence
  dgRNA
  Ppp4r1
cgcacgctcggcgcc

SEQ ID NO: 30721 - DNA, 15 bp, Artificial Sequence
  dgRNA
  Ppp4r1
gcacgctcggcgcca

SEQ ID NO: 30722 - DNA, 15 bp, Artificial Sequence
  dgRNA
  Ppp4r1
gggcgcctctagcca

SEQ ID NO: 30723 - DNA, 15 bp, Artificial Sequence
  dgRNA
  Rhbg
tcaccggtgcctcag

SEQ ID NO: 30724 - DNA, 15 bp, Artificial Sequence
  dgRNA
  Rhbg
caccggtgcctcagc

SEQ ID NO: 30725 - DNA, 15 bp, Artificial Sequence
  dgRNA
  Rhbg
accggtgcctcagcg

SEQ ID NO: 30726 - DNA, 15 bp, Artificial Sequence
  dgRNA
  Rhbg
gcctcagcggggcca

SEQ ID NO: 30727 - DNA, 15 bp, Artificial Sequence
  dgRNA
  Atp8a1
gaactgggcgggacc

SEQ ID NO: 30728 - DNA, 15 bp, Artificial Sequence
  dgRNA
  Atp8a1
ccgccccactccagg

SEQ ID NO: 30729 - DNA, 15 bp, Artificial Sequence
  dgRNA
  Atp8a1
actgcggggagacct

SEQ ID NO: 30730 - DNA, 15 bp, Artificial Sequence
  dgRNA
  Atp8a1
gcggggagacctagg

SEQ ID NO: 30731 - DNA, 15 bp, Artificial Sequence
  dgRNA
  Gm6890
atctcacgtgctgtt

SEQ ID NO: 30732 - DNA, 15 bp, Artificial Sequence
  dgRNA
  Vstm2a
cgctcagagagttaa

SEQ ID NO: 30733 - DNA, 15 bp, Artificial Sequence
  dgRNA
  Vstm2a
cattgcagccattag

SEQ ID NO: 30734 - DNA, 15 bp, Artificial Sequence
  dgRNA
  Vstm2a
ccgctccactcgccg

SEQ ID NO: 30735 - DNA, 15 bp, Artificial Sequence
  dgRNA
  Vstm2a
cgctccactcgccgc

SEQ ID NO: 30736 - DNA, 15 bp, Artificial Sequence
  dgRNA
  Gpr174
aggctattaatcctg

SEQ ID NO: 30737 - DNA, 15 bp, Artificial Sequence
  dgRNA
  Gpr174
gtaaaccaaccttat

SEQ ID NO: 30738 - DNA, 15 bp, Artificial Sequence
  dgRNA
  Gpr174
tagcctgtgaaagta

SEQ ID NO: 30739 - DNA, 15 bp, Artificial Sequence
  dgRNA
  Gpr174
tatccactgctccac

SEQ ID NO: 30740 - DNA, 15 bp, Artificial Sequence
  dgRNA
  Fam209
atggcctctccttag

SEQ ID NO: 30741 - DNA, 15 bp, Artificial Sequence
  dgRNA
  Fam209
gaagtcctaccaggc

SEQ ID NO: 30742 - DNA, 15 bp, Artificial Sequence
  dgRNA
  Fam209
cggtgagtgagcctc

SEQ ID NO: 30743 - DNA, 15 bp, Artificial Sequence
  dgRNA
  Fam209
ggcttcttaagctaa

SEQ ID NO: 30744 - DNA, 15 bp, Artificial Sequence
  dgRNA
  Gorasp1
cacgcaccatgagag

SEQ ID NO: 30745 - DNA, 15 bp, Artificial Sequence
  dgRNA
  Gorasp1
agtcatcgctgctca

SEQ ID NO: 30746 - DNA, 15 bp, Artificial Sequence
  dgRNA
  Gorasp1
tgatgaccggctgag

SEQ ID NO: 30747 - DNA, 15 bp, Artificial Sequence
  dgRNA
  Gorasp1
gatgaccggctgagc

SEQ ID NO: 30748 - DNA, 15 bp, Artificial Sequence
  dgRNA
  Hyou1
ccgcatcgaagcgtc

SEQ ID NO: 30749 - DNA, 15 bp, Artificial Sequence
  dgRNA
  Hyou1
gtccggcaccgatgc

SEQ ID NO: 30750 - DNA, 15 bp, Artificial Sequence
  dgRNA
  Hyou1
ggcagaagtcccgcg

SEQ ID NO: 30751 - DNA, 15 bp, Artificial Sequence
  dgRNA
  Hyou1
ccgcgaggagtaacc

SEQ ID NO: 30752 - DNA, 15 bp, Artificial Sequence
  dgRNA
  Stard8
cccgcccaccccatt

SEQ ID NO: 30753 - DNA, 15 bp, Artificial Sequence
  dgRNA
  Stard8
catttggaccgcttt

SEQ ID NO: 30754 - DNA, 15 bp, Artificial Sequence
  dgRNA
  Stard8
atttggaccgctttt

SEQ ID NO: 30755 - DNA, 15 bp, Artificial Sequence
  dgRNA
  Stard8
tttggaccgcttttg

SEQ ID NO: 30756 - DNA, 15 bp, Artificial Sequence
  dgRNA
  Wnt4
ggctccgagcgcgtc

SEQ ID NO: 30757 - DNA, 15 bp, Artificial Sequence
  dgRNA
  Wnt4
gctccgagcgcgtcc

SEQ ID NO: 30758 - DNA, 15 bp, Artificial Sequence
  dgRNA
  Wnt4
agcgcgtccgggcgc

SEQ ID NO: 30759 - DNA, 15 bp, Artificial Sequence
  dgRNA
  Wnt4
gcgcgtccgggcgcc

SEQ ID NO: 30760 - DNA, 15 bp, Artificial Sequence
  dgRNA
  Aen
accggacgttccatt

SEQ ID NO: 30761 - DNA, 15 bp, Artificial Sequence
  dgRNA
  Aen
aacgctgccctatcc

SEQ ID NO: 30762 - DNA, 15 bp, Artificial Sequence
  dgRNA
  Aen
gccctatcccggcgc

SEQ ID NO: 30763 - DNA, 15 bp, Artificial Sequence
  dgRNA
  Aen
cacgccctcttcctt

SEQ ID NO: 30764 - DNA, 15 bp, Artificial Sequence
  dgRNA
  Lhx6
tcatcttgaacggag

SEQ ID NO: 30765 - DNA, 15 bp, Artificial Sequence
  dgRNA
  Lhx6
catcttgaacggagc

SEQ ID NO: 30766 - DNA, 15 bp, Artificial Sequence
  dgRNA
  Lhx6
atcttgaacggagcg

SEQ ID NO: 30767 - DNA, 15 bp, Artificial Sequence
  dgRNA
  Lhx6
cggggctccagcggc

SEQ ID NO: 30768 - DNA, 15 bp, Artificial Sequence
  dgRNA
  Rpap1
aagattagtcgccgc

SEQ ID NO: 30769 - DNA, 15 bp, Artificial Sequence
  dgRNA
  Rpap1
aggcttcgccgcttg

SEQ ID NO: 30770 - DNA, 15 bp, Artificial Sequence
  dgRNA
  Rpap1
gacacaacgctgagc

SEQ ID NO: 30771 - DNA, 15 bp, Artificial Sequence
  dgRNA
  Rpap1
acacaacgctgagct

SEQ ID NO: 30772 - DNA, 15 bp, Artificial Sequence
  dgRNA
  Zpr1
ggtcttctctagtta

SEQ ID NO: 30773 - DNA, 15 bp, Artificial Sequence
  dgRNA
  Zpr1
acggaagtgcagtct

SEQ ID NO: 30774 - DNA, 15 bp, Artificial Sequence
  dgRNA
  Zpr1
gtagctcgctagttg

SEQ ID NO: 30775 - DNA, 15 bp, Artificial Sequence
  dgRNA
  Zpbp
ctcaatccactgcta

SEQ ID NO: 30776 - DNA, 15 bp, Artificial Sequence
  dgRNA
  Zpbp
tgctaaggtaataag

SEQ ID NO: 30777 - DNA, 15 bp, Artificial Sequence
  dgRNA
  Zpbp
ctaaggtaataagag

SEQ ID NO: 30778 - DNA, 15 bp, Artificial Sequence
  dgRNA
  Zpbp
acagacaccacggga

SEQ ID NO: 30779 - DNA, 15 bp, Artificial Sequence
  dgRNA
  Btn2a2
aaaggagcgcatgaa

SEQ ID NO: 30780 - DNA, 15 bp, Artificial Sequence
  dgRNA
  Btn2a2
aaggagcgcatgaaa

SEQ ID NO: 30781 - DNA, 15 bp, Artificial Sequence
  dgRNA
  Btn2a2
acataggaatactat

SEQ ID NO: 30782 - DNA, 15 bp, Artificial Sequence
  dgRNA
  Btn2a2
aaggcaggccaatcc

SEQ ID NO: 30783 - DNA, 15 bp, Artificial Sequence
  dgRNA
  Mllt10
aaaaaacccccttca

SEQ ID NO: 30784 - DNA, 15 bp, Artificial Sequence
  dgRNA
  Mllt10
taccctcaattctac

SEQ ID NO: 30785 - DNA, 15 bp, Artificial Sequence
  dgRNA
  Mllt10
ttaggtggacttaga

SEQ ID NO: 30786 - DNA, 15 bp, Artificial Sequence
  dgRNA
  Mllt10
gtgaccgattcacta

SEQ ID NO: 30787 - DNA, 15 bp, Artificial Sequence
  dgRNA
  Eaf1
ccgtcagtcaagccc

SEQ ID NO: 30788 - DNA, 15 bp, Artificial Sequence
  dgRNA
  Eaf1
gtcaagcccaggcgt

SEQ ID NO: 30789 - DNA, 15 bp, Artificial Sequence
  dgRNA
  Eaf1
atcttctagctgacc

SEQ ID NO: 30790 - DNA, 15 bp, Artificial Sequence
  dgRNA
  Eaf1
ccccgctatttccgt

SEQ ID NO: 30791 - DNA, 15 bp, Artificial Sequence
  dgRNA
  Spam1
tcagccagacttcat

SEQ ID NO: 30792 - DNA, 15 bp, Artificial Sequence
  dgRNA
  Gfral
gaacttttcatgaat

SEQ ID NO: 30793 - DNA, 15 bp, Artificial Sequence
  dgRNA
  Gfral
gaataggggacctca

SEQ ID NO: 30794 - DNA, 15 bp, Artificial Sequence
  dgRNA
  Gfral
gaaaggataatatcc

SEQ ID NO: 30795 - DNA, 15 bp, Artificial Sequence
  dgRNA
  Gfral
aaaggataatatcct

SEQ ID NO: 30796 - DNA, 15 bp, Artificial Sequence
  dgRNA
  Plxdc1
gtttctggggcagcg

SEQ ID NO: 30797 - DNA, 15 bp, Artificial Sequence
  dgRNA
  Plxdc1
gcagcggggttctct

SEQ ID NO: 30798 - DNA, 15 bp, Artificial Sequence
  dgRNA
  Plxdc1
agagatgtcccggcg

SEQ ID NO: 30799 - DNA, 15 bp, Artificial Sequence
  dgRNA
  Plxdc1
gtcccggcgcggtcc

SEQ ID NO: 30800 - DNA, 15 bp, Artificial Sequence
  dgRNA
  Tmem28
ccccggctgccagca

SEQ ID NO: 30801 - DNA, 15 bp, Artificial Sequence
  dgRNA
  Tmem28
ccagcaggggagcgc

SEQ ID NO: 30802 - DNA, 15 bp, Artificial Sequence
  dgRNA
  Tmem28
agcgccccgccacaa

SEQ ID NO: 30803 - DNA, 15 bp, Artificial Sequence
  dgRNA
  Tmem28
ccacaacggcctgag

SEQ ID NO: 30804 - DNA, 15 bp, Artificial Sequence
  dgRNA
  Gabbr2
cgattcccccgaacg

SEQ ID NO: 30805 - DNA, 15 bp, Artificial Sequence
  dgRNA
  Gabbr2
gattcccccgaacgt

SEQ ID NO: 30806 - DNA, 15 bp, Artificial Sequence
  dgRNA
  Gabbr2
attcccccgaacgtg

SEQ ID NO: 30807 - DNA, 15 bp, Artificial Sequence
  dgRNA
  Gabbr2
ccgaacgtggggctc

SEQ ID NO: 30808 - DNA, 15 bp, Artificial Sequence
  dgRNA
  AI467606
ggctccaccttacac

SEQ ID NO: 30809 - DNA, 15 bp, Artificial Sequence
  dgRNA
  AI467606
cagtcgcccagcaac

SEQ ID NO: 30810 - DNA, 15 bp, Artificial Sequence
  dgRNA
  AI467606
tcgcccagcaacagg

SEQ ID NO: 30811 - DNA, 15 bp, Artificial Sequence
  dgRNA
  AI467606
ctaccacctgttgct

SEQ ID NO: 30812 - DNA, 15 bp, Artificial Sequence
  dgRNA
  D6Ertd527e
aactgctcaccagat

SEQ ID NO: 30813 - DNA, 15 bp, Artificial Sequence
  dgRNA
  D6Ertd527e
actgctcaccagatt

SEQ ID NO: 30814 - DNA, 15 bp, Artificial Sequence
  dgRNA
  D6Ertd527e
ggctcatctgacccc

SEQ ID NO: 30815 - DNA, 15 bp, Artificial Sequence
  dgRNA
  D6Ertd527e
gctcatctgacccct

SEQ ID NO: 30816 - DNA, 15 bp, Artificial Sequence
  dgRNA
  Anks1b
ccacaacaaatagct

SEQ ID NO: 30817 - DNA, 15 bp, Artificial Sequence
  dgRNA
  Anks1b
gtaacgtgtataacc

SEQ ID NO: 30818 - DNA, 15 bp, Artificial Sequence
  dgRNA
  Anks1b
cttcgattccgattg

SEQ ID NO: 30819 - DNA, 15 bp, Artificial Sequence
  dgRNA
  Anks1b
ccgattgaggcgctt

SEQ ID NO: 30820 - DNA, 15 bp, Artificial Sequence
  dgRNA
  Efr3b
agtgaacgaagaacc

SEQ ID NO: 30821 - DNA, 15 bp, Artificial Sequence
  dgRNA
  Efr3b
gtgaacgaagaacct

SEQ ID NO: 30822 - DNA, 15 bp, Artificial Sequence
  dgRNA
  Efr3b
cctggggcgtcaggt

SEQ ID NO: 30823 - DNA, 15 bp, Artificial Sequence
  dgRNA
  Efr3b
gtcaggtaggtaaaa

SEQ ID NO: 30824 - DNA, 15 bp, Artificial Sequence
  dgRNA
  Pfkfb1
gctcacctcaatagc

SEQ ID NO: 30825 - DNA, 15 bp, Artificial Sequence
  dgRNA
  Pfkfb1
acggtgaacaacaca

SEQ ID NO: 30826 - DNA, 15 bp, Artificial Sequence
  dgRNA
  Pfkfb1
tgaacaacacatggt

SEQ ID NO: 30827 - DNA, 15 bp, Artificial Sequence
  dgRNA
  Pfkfb1
gctcaggaacttctt

SEQ ID NO: 30828 - DNA, 15 bp, Artificial Sequence
  dgRNA
  Tbc1d19
tgttttcgatcagac

SEQ ID NO: 30829 - DNA, 15 bp, Artificial Sequence
  dgRNA
  Tbc1d19
gttttcgatcagact

SEQ ID NO: 30830 - DNA, 15 bp, Artificial Sequence
  dgRNA
  Tbc1d19
tcgatcagactgggt

SEQ ID NO: 30831 - DNA, 15 bp, Artificial Sequence
  dgRNA
  Tbc1d19
gtctctttccgccct

SEQ ID NO: 30832 - DNA, 15 bp, Artificial Sequence
  dgRNA
  Hip1r
cagggcagggcgtac

SEQ ID NO: 30833 - DNA, 15 bp, Artificial Sequence
  dgRNA
  Hip1r
agggcagggcgtact

SEQ ID NO: 30834 - DNA, 15 bp, Artificial Sequence
  dgRNA
  Hip1r
cgtactgggtgacag

SEQ ID NO: 30835 - DNA, 15 bp, Artificial Sequence
  dgRNA
  Hip1r
agagggttgcatggc

SEQ ID NO: 30836 - DNA, 15 bp, Artificial Sequence
  dgRNA
  Dennd4b
atagactgtgcatcc

SEQ ID NO: 30837 - DNA, 15 bp, Artificial Sequence
  dgRNA
  Dennd4b
gcacaggacccttag

SEQ ID NO: 30838 - DNA, 15 bp, Artificial Sequence
  dgRNA
  Dennd4b
cacaggacccttagt

SEQ ID NO: 30839 - DNA, 15 bp, Artificial Sequence
  dgRNA
  Dennd4b
taagggtcctgtgca

SEQ ID NO: 30840 - DNA, 15 bp, Artificial Sequence
  dgRNA
  Mtss1
ctcacgcacgagccg

SEQ ID NO: 30841 - DNA, 15 bp, Artificial Sequence
  dgRNA
  Mtss1
tcacgcacgagccgc

SEQ ID NO: 30842 - DNA, 15 bp, Artificial Sequence
  dgRNA
  Mtss1
cgctcccgcgccaga

SEQ ID NO: 30843 - DNA, 15 bp, Artificial Sequence
  dgRNA
  Mtss1
tcctcgcaacatccc

SEQ ID NO: 30844 - DNA, 15 bp, Artificial Sequence
  dgRNA
  Lurap1l
caggttgtagctgtc

SEQ ID NO: 30845 - DNA, 15 bp, Artificial Sequence
  dgRNA
  Lurap1l
aggttgtagctgtca

SEQ ID NO: 30846 - DNA, 15 bp, Artificial Sequence
  dgRNA
  Lurap1l
ggttgtagctgtcag

SEQ ID NO: 30847 - DNA, 15 bp, Artificial Sequence
  dgRNA
  Lurap1l
cttagtaacctaata

SEQ ID NO: 30848 - DNA, 15 bp, Artificial Sequence
  dgRNA
  Cep152
cccaatggaggctcc

SEQ ID NO: 30849 - DNA, 15 bp, Artificial Sequence
  dgRNA
  Cep152
gcttcccgccgccac

SEQ ID NO: 30850 - DNA, 15 bp, Artificial Sequence
  dgRNA
  Cep152
gcgctcttgcaactg

SEQ ID NO: 30851 - DNA, 15 bp, Artificial Sequence
  dgRNA
  Cep152
cgctcttgcaactgc

SEQ ID NO: 30852 - DNA, 15 bp, Artificial Sequence
  dgRNA
  Wdr35
ccccatcgcccgcgc

SEQ ID NO: 30853 - DNA, 15 bp, Artificial Sequence
  dgRNA
  Wdr35
gcacgacgaccaaca

SEQ ID NO: 30854 - DNA, 15 bp, Artificial Sequence
  dgRNA
  Wdr35
cacgacgaccaacac

SEQ ID NO: 30855 - DNA, 15 bp, Artificial Sequence
  dgRNA
  Wdr35
acgacgaccaacacg

SEQ ID NO: 30856 - DNA, 15 bp, Artificial Sequence
  dgRNA
  H2-Q6
gggtgaggtgatcac

SEQ ID NO: 30857 - DNA, 15 bp, Artificial Sequence
  dgRNA
  H2-Q6
acctgaatccccgag

SEQ ID NO: 30858 - DNA, 15 bp, Artificial Sequence
  dgRNA
  Dnajc10
attctgtccggtccc

SEQ ID NO: 30859 - DNA, 15 bp, Artificial Sequence
  dgRNA
  Dnajc10
tccggtccctggcaa

SEQ ID NO: 30860 - DNA, 15 bp, Artificial Sequence
  dgRNA
  Dnajc10
ccggtccctggcaac

SEQ ID NO: 30861 - DNA, 15 bp, Artificial Sequence
  dgRNA
  Dnajc10
cggtccctggcaacg

SEQ ID NO: 30862 - DNA, 15 bp, Artificial Sequence
  dgRNA
  Kcnmb1
ttggctgcactggtg

SEQ ID NO: 30863 - DNA, 15 bp, Artificial Sequence
  dgRNA
  Kcnmb1
gtgtggatataacat

SEQ ID NO: 30864 - DNA, 15 bp, Artificial Sequence
  dgRNA
  Kcnmb1
cccctgcactacaca

SEQ ID NO: 30865 - DNA, 15 bp, Artificial Sequence
  dgRNA
  Kcnmb1
ccttgtgtagtgcag

SEQ ID NO: 30866 - DNA, 15 bp, Artificial Sequence
  dgRNA
  Plekhg2
ccagcaggcgggaac

SEQ ID NO: 30867 - DNA, 15 bp, Artificial Sequence
  dgRNA
  Plekhg2
acaggatgtgagccg

SEQ ID NO: 30868 - DNA, 15 bp, Artificial Sequence
  dgRNA
  Plekhg2
ggatgtgagccgcgg

SEQ ID NO: 30869 - DNA, 15 bp, Artificial Sequence
  dgRNA
  Plekhg2
tgtgagccgcggcgg

SEQ ID NO: 30870 - DNA, 15 bp, Artificial Sequence
  dgRNA
  Olfr1161
tactctttgctcatc

SEQ ID NO: 30871 - DNA, 15 bp, Artificial Sequence
  dgRNA
  BC005561
ccagcaaccgaagtg

SEQ ID NO: 30872 - DNA, 15 bp, Artificial Sequence
  dgRNA
  BC005561
gccgcgcgtgcgcag

SEQ ID NO: 30873 - DNA, 15 bp, Artificial Sequence
  dgRNA
  BC005561
gactgtgtgcactgg

SEQ ID NO: 30874 - DNA, 15 bp, Artificial Sequence
  dgRNA
  BC005561
ggggactgaggtcgt

SEQ ID NO: 30875 - DNA, 15 bp, Artificial Sequence
  dgRNA
  Zap70
gttcccgacaccctg

SEQ ID NO: 30876 - DNA, 15 bp, Artificial Sequence
  dgRNA
  Zap70
ccgacaccctgcggc

SEQ ID NO: 30877 - DNA, 15 bp, Artificial Sequence
  dgRNA
  Zap70
ggtactgcgtgaccc

SEQ ID NO: 30878 - DNA, 15 bp, Artificial Sequence
  dgRNA
  Zap70
cccgccaggagcatg

SEQ ID NO: 30879 - DNA, 15 bp, Artificial Sequence
  dgRNA
  Meis2
tgaaactcgacagtt

SEQ ID NO: 30880 - DNA, 15 bp, Artificial Sequence
  dgRNA
  Meis2
cagttcggttacatg

SEQ ID NO: 30881 - DNA, 15 bp, Artificial Sequence
  dgRNA
  Meis2
agttcggttacatgt

SEQ ID NO: 30882 - DNA, 15 bp, Artificial Sequence
  dgRNA
  Meis2
tcgtaaccttcagtt

SEQ ID NO: 30883 - DNA, 15 bp, Artificial Sequence
  dgRNA
  Mcmdc2
caaacagcactatat

SEQ ID NO: 30884 - DNA, 15 bp, Artificial Sequence
  dgRNA
  Mcmdc2
gaagggctgcggtcc

SEQ ID NO: 30885 - DNA, 15 bp, Artificial Sequence
  dgRNA
  Mcmdc2
cgcgcgcccgacagt

SEQ ID NO: 30886 - DNA, 15 bp, Artificial Sequence
  dgRNA
  Mcmdc2
tagcgtcgtaaactt

SEQ ID NO: 30887 - DNA, 15 bp, Artificial Sequence
  dgRNA
  Pde3a
agagaatatgctgcg

SEQ ID NO: 30888 - DNA, 15 bp, Artificial Sequence
  dgRNA
  Pde3a
gagaatatgctgcgg

SEQ ID NO: 30889 - DNA, 15 bp, Artificial Sequence
  dgRNA
  Pde3a
agaatatgctgcggg

SEQ ID NO: 30890 - DNA, 15 bp, Artificial Sequence
  dgRNA
  Pde3a
gaatatgctgcgggg

SEQ ID NO: 30891 - DNA, 15 bp, Artificial Sequence
  dgRNA
  Bmp6
ttgatctgtcgtctc

SEQ ID NO: 30892 - DNA, 15 bp, Artificial Sequence
  dgRNA
  Bmp6
gtctccggcccccct

SEQ ID NO: 30893 - DNA, 15 bp, Artificial Sequence
  dgRNA
  Bmp6
gccagccgcctctga

SEQ ID NO: 30894 - DNA, 15 bp, Artificial Sequence
  dgRNA
  Bmp6
cgcctctgagggttc

SEQ ID NO: 30895 - DNA, 15 bp, Artificial Sequence
  dgRNA
  Syncrip
cggcggccccgcccg

SEQ ID NO: 30896 - DNA, 15 bp, Artificial Sequence
  dgRNA
  Syncrip
cgcccgcggagcgag

SEQ ID NO: 30897 - DNA, 15 bp, Artificial Sequence
  dgRNA
  Syncrip
gcccgcggagcgaga

SEQ ID NO: 30898 - DNA, 15 bp, Artificial Sequence
  dgRNA
  Syncrip
gagtgtccgcacaga

SEQ ID NO: 30899 - DNA, 15 bp, Artificial Sequence
  dgRNA
  Slc44a2
agggagggctaaatc

SEQ ID NO: 30900 - DNA, 15 bp, Artificial Sequence
  dgRNA
  Slc44a2
tggcctgccaatgag

SEQ ID NO: 30901 - DNA, 15 bp, Artificial Sequence
  dgRNA
  Slc44a2
gctgccggccccacc

SEQ ID NO: 30902 - DNA, 15 bp, Artificial Sequence
  dgRNA
  Slc44a2
atcggtccctcccct

SEQ ID NO: 30903 - DNA, 15 bp, Artificial Sequence
  dgRNA
  Prol1
gggtcacagtgccat

SEQ ID NO: 30904 - DNA, 15 bp, Artificial Sequence
  dgRNA
  Prol1
ctgattcctagtaaa

SEQ ID NO: 30905 - DNA, 15 bp, Artificial Sequence
  dgRNA
  Mcpt2
gtcgacaccttatca

SEQ ID NO: 30906 - DNA, 15 bp, Artificial Sequence
  dgRNA
  Mcpt2
tcgacaccttatcat

SEQ ID NO: 30907 - DNA, 15 bp, Artificial Sequence
  dgRNA
  Mcpt2
tccaaaccagatctg

SEQ ID NO: 30908 - DNA, 15 bp, Artificial Sequence
  dgRNA
  Mcpt2
accacagatctggtt

SEQ ID NO: 30909 - DNA, 15 bp, Artificial Sequence
  dgRNA
  N4bp2
gttccgaccgcacgt

SEQ ID NO: 30910 - DNA, 15 bp, Artificial Sequence
  dgRNA
  N4bp2
ccgaccgcacgttgg

SEQ ID NO: 30911 - DNA, 15 bp, Artificial Sequence
  dgRNA
  N4bp2
cgcacgttggcggcg

SEQ ID NO: 30912 - DNA, 15 bp, Artificial Sequence
  dgRNA
  N4bp2
gcacgttggcggcgc

SEQ ID NO: 30913 - DNA, 15 bp, Artificial Sequence
  dgRNA
  Wdr78
cgaaagaccggggag

SEQ ID NO: 30914 - DNA, 15 bp, Artificial Sequence
  dgRNA
  Wdr78
cgcatgcgcgccaga

SEQ ID NO: 30915 - DNA, 15 bp, Artificial Sequence
  dgRNA
  Wdr78
ccctcccggtacact

SEQ ID NO: 30916 - DNA, 15 bp, Artificial Sequence
  dgRNA
  Wdr78
cctcccggtacactc

SEQ ID NO: 30917 - DNA, 15 bp, Artificial Sequence
  dgRNA
  Rassf5
cgccccgccggtgtt

SEQ ID NO: 30918 - DNA, 15 bp, Artificial Sequence
  dgRNA
  Rassf5
gccccgccggtgtta

SEQ ID NO: 30919 - DNA, 15 bp, Artificial Sequence
  dgRNA
  Rassf5
ggtgttagggcgccc

SEQ ID NO: 30920 - DNA, 15 bp, Artificial Sequence
  dgRNA
  Rassf5
gtgttagggcgccct

SEQ ID NO: 30921 - DNA, 15 bp, Artificial Sequence
  dgRNA
  Plb1
gaacccttgacatca

SEQ ID NO: 30922 - DNA, 15 bp, Artificial Sequence
  dgRNA
  Plb1
aacccttgacatcat

SEQ ID NO: 30923 - DNA, 15 bp, Artificial Sequence
  dgRNA
  Plb1
gtagtcttgatcttt

SEQ ID NO: 30924 - DNA, 15 bp, Artificial Sequence
  dgRNA
  Plb1
tcattcagagttggc

SEQ ID NO: 30925 - DNA, 15 bp, Artificial Sequence
  dgRNA
  Pir
gctcatacgaagcgt

SEQ ID NO: 30926 - DNA, 15 bp, Artificial Sequence
  dgRNA
  Pir
ctcatacgaagcgtt

SEQ ID NO: 30927 - DNA, 15 bp, Artificial Sequence
  dgRNA
  Pir
ccaagagattctaag

SEQ ID NO: 30928 - DNA, 15 bp, Artificial Sequence
  dgRNA
  Pir
cagcgcgcccccaag

SEQ ID NO: 30929 - DNA, 15 bp, Artificial Sequence
  dgRNA
  Scn5a
cgcctgtgcagtggt

SEQ ID NO: 30930 - DNA, 15 bp, Artificial Sequence
  dgRNA
  Scn5a
gtctttccccgccat

SEQ ID NO: 30931 - DNA, 15 bp, Artificial Sequence
  dgRNA
  Scn5a
cgccatcggcctagc

SEQ ID NO: 30932 - DNA, 15 bp, Artificial Sequence
  dgRNA
  Scn5a
gactaccctgccctc

SEQ ID NO: 30933 - DNA, 15 bp, Artificial Sequence
  dgRNA
  Uba52
ctgtccccgccgcga

SEQ ID NO: 30934 - DNA, 15 bp, Artificial Sequence
  dgRNA
  Uba52
ccgccgcgaaggcag

SEQ ID NO: 30935 - DNA, 15 bp, Artificial Sequence
  dgRNA
  Uba52
cgaaggcagcggaga

SEQ ID NO: 30936 - DNA, 15 bp, Artificial Sequence
  dgRNA
  Uba52
gtgttaagctccacc

SEQ ID NO: 30937 - DNA, 15 bp, Artificial Sequence
  dgRNA
  Kifap3
ttcctgcgctgttcc

SEQ ID NO: 30938 - DNA, 15 bp, Artificial Sequence
  dgRNA
  Kifap3
cgtcagatttgtcgc

SEQ ID NO: 30939 - DNA, 15 bp, Artificial Sequence
  dgRNA
  Kifap3
agtccttagcgtgaa

SEQ ID NO: 30940 - DNA, 15 bp, Artificial Sequence
  dgRNA
  Kifap3
ttagaggcatattcc

SEQ ID NO: 30941 - DNA, 15 bp, Artificial Sequence
  dgRNA
  Tulp2
gcttagaatctataa

SEQ ID NO: 30942 - DNA, 15 bp, Artificial Sequence
  dgRNA
  Tulp2
gctatatagctctct

SEQ ID NO: 30943 - DNA, 15 bp, Artificial Sequence
  dgRNA
  Phf3
ctttaccatgcatat

SEQ ID NO: 30944 - DNA, 15 bp, Artificial Sequence
  dgRNA
  Klk7
actcaatccttgacg

SEQ ID NO: 30945 - DNA, 15 bp, Artificial Sequence
  dgRNA
  Klk7
gtttggagccttaca

SEQ ID NO: 30946 - DNA, 15 bp, Artificial Sequence
  dgRNA
  Klk7
caggggcattcagtt

SEQ ID NO: 30947 - DNA, 15 bp, Artificial Sequence
  dgRNA
  Klk7
gattgagtcggtccc

SEQ ID NO: 30948 - DNA, 15 bp, Artificial Sequence
  dgRNA
  Cacna1e
tggatgcatctccgc

SEQ ID NO: 30949 - DNA, 15 bp, Artificial Sequence
  dgRNA
  Cacna1e
cttagatggacttgc

SEQ ID NO: 30950 - DNA, 15 bp, Artificial Sequence
  dgRNA
  Cacna1e
gcatgtcaccgtagc

SEQ ID NO: 30951 - DNA, 15 bp, Artificial Sequence
  dgRNA
  Cacna1e
gggagagcggtacta

SEQ ID NO: 30952 - DNA, 15 bp, Artificial Sequence
  dgRNA
  Xrcc5
ttgaatgggctcgtc

SEQ ID NO: 30953 - DNA, 15 bp, Artificial Sequence
  dgRNA
  Xrcc5
acaaagccttgccta

SEQ ID NO: 30954 - DNA, 15 bp, Artificial Sequence
  dgRNA
  Xrcc5
aagccttgcctaagg

SEQ ID NO: 30955 - DNA, 15 bp, Artificial Sequence
  dgRNA
  Xrcc5
cttgcctaaggaggc

SEQ ID NO: 30956 - DNA, 15 bp, Artificial Sequence
  dgRNA
  Mrpl50
actaccgaccacccc

SEQ ID NO: 30957 - DNA, 15 bp, Artificial Sequence
  dgRNA
  Mrpl50
cacccccggaccaga

SEQ ID NO: 30958 - DNA, 15 bp, Artificial Sequence
  dgRNA
  Mrpl50
ccagaaggcgttacc

SEQ ID NO: 30959 - DNA, 15 bp, Artificial Sequence
  dgRNA
  Mrpl50
tacccggagccttcg

SEQ ID NO: 30960 - DNA, 15 bp, Artificial Sequence
  dgRNA
  Nip7
agccggtttcgctcc

SEQ ID NO: 30961 - DNA, 15 bp, Artificial Sequence
  dgRNA
  Nip7
gccggtttcgctcct

SEQ ID NO: 30962 - DNA, 15 bp, Artificial Sequence
  dgRNA
  Nip7
ggaaacggaaacgat

SEQ ID NO: 30963 - DNA, 15 bp, Artificial Sequence
  dgRNA
  Nip7
gaaacggaaacgatt

SEQ ID NO: 30964 - DNA, 15 bp, Artificial Sequence
  dgRNA
  Pnma1
aaccgccagatcctc

SEQ ID NO: 30965 - DNA, 15 bp, Artificial Sequence
  dgRNA
  Pnma1
tatctcgcgtcgtca

SEQ ID NO: 30966 - DNA, 15 bp, Artificial Sequence
  dgRNA
  Pnma1
ttgtcacggtgacac

SEQ ID NO: 30967 - DNA, 15 bp, Artificial Sequence
  dgRNA
  Pnma1
tgtcacggtgacact

SEQ ID NO: 30968 - DNA, 15 bp, Artificial Sequence
  dgRNA
  Jarid2
ggaccacacgctccg

SEQ ID NO: 30969 - DNA, 15 bp, Artificial Sequence
  dgRNA
  Jarid2
gaccacacgctccgc

SEQ ID NO: 30970 - DNA, 15 bp, Artificial Sequence
  dgRNA
  Jarid2
tagcagtgtcgcacg

SEQ ID NO: 30971 - DNA, 15 bp, Artificial Sequence
  dgRNA
  Jarid2
agcagtgtcgcacgc

SEQ ID NO: 30972 - DNA, 15 bp, Artificial Sequence
  dgRNA
  Zfp619
cttcacgtgtgtact

SEQ ID NO: 30973 - DNA, 15 bp, Artificial Sequence
  dgRNA
  Zfp619
tcacgtgtgtactcg

SEQ ID NO: 30974 - DNA, 15 bp, Artificial Sequence
  dgRNA
  Zfp619
cacgtgtgtactcgg

SEQ ID NO: 30975 - DNA, 15 bp, Artificial Sequence
  dgRNA
  Zfp619
tcgggggacaagcca

SEQ ID NO: 30976 - DNA, 15 bp, Artificial Sequence
  dgRNA
  Kdm6b
cttactacctgaacc

SEQ ID NO: 30977 - DNA, 15 bp, Artificial Sequence
  dgRNA
  Kdm6b
tggtttctcaatgag

SEQ ID NO: 30978 - DNA, 15 bp, Artificial Sequence
  dgRNA
  Kdm6b
ggtttctcaatgagg

SEQ ID NO: 30979 - DNA, 15 bp, Artificial Sequence
  dgRNA
  Kdm6b
tcaatgagggggacc

SEQ ID NO: 30980 - DNA, 15 bp, Artificial Sequence
  dgRNA
  Sp2
tcccccgttgatttc

SEQ ID NO: 30981 - DNA, 15 bp, Artificial Sequence
  dgRNA
  Sp2
ccgttgatttccggt

SEQ ID NO: 30982 - DNA, 15 bp, Artificial Sequence
  dgRNA
  Sp2
atgcttcccaatgat

SEQ ID NO: 30983 - DNA, 15 bp, Artificial Sequence
  dgRNA
  Sp2
gtaccaagcgttcat

SEQ ID NO: 30984 - DNA, 15 bp, Artificial Sequence
  dgRNA
  Phf21b
cctgagcctggtcgc

SEQ ID NO: 30985 - DNA, 15 bp, Artificial Sequence
  dgRNA
  Phf21b
ctgagcctggtcgct

SEQ ID NO: 30986 - DNA, 15 bp, Artificial Sequence
  dgRNA
  Phf21b
gcaatgcgcacgcgc

SEQ ID NO: 30987 - DNA, 15 bp, Artificial Sequence
  dgRNA
  Phf21b
cacgcgcgggccggg

SEQ ID NO: 30988 - DNA, 15 bp, Artificial Sequence
  dgRNA
  Taf1b
acagaaaatcctcgt

SEQ ID NO: 30989 - DNA, 15 bp, Artificial Sequence
  dgRNA
  Taf1b
gtcttgagtcccaca

SEQ ID NO: 30990 - DNA, 15 bp, Artificial Sequence
  dgRNA
  Taf1b
ggctgtgtttccgac

SEQ ID NO: 30991 - DNA, 15 bp, Artificial Sequence
  dgRNA
  Taf1b
cccggaactcagctc

SEQ ID NO: 30992 - DNA, 15 bp, Artificial Sequence
  dgRNA
  Fgfr1
attcgggcgccctcc

SEQ ID NO: 30993 - DNA, 15 bp, Artificial Sequence
  dgRNA
  Fgfr1
agttctgctcgctcc

SEQ ID NO: 30994 - DNA, 15 bp, Artificial Sequence
  dgRNA
  Fgfr1
cgctccaggcttctc

SEQ ID NO: 30995 - DNA, 15 bp, Artificial Sequence
  dgRNA
  Fgfr1
actacaaggcccagc

SEQ ID NO: 30996 - DNA, 15 bp, Artificial Sequence
  dgRNA
  Nusap1
tcagcgccagcatat

SEQ ID NO: 30997 - DNA, 15 bp, Artificial Sequence
  dgRNA
  Nusap1
tagtttgcggaatag

SEQ ID NO: 30998 - DNA, 15 bp, Artificial Sequence
  dgRNA
  Nusap1
agccaatcacgctac

SEQ ID NO: 30999 - DNA, 15 bp, Artificial Sequence
  dgRNA
  Nusap1
gctactggcccgcat

SEQ ID NO: 31000 - DNA, 15 bp, Artificial Sequence
  dgRNA
  Prkra
agagcgggcggtagc

SEQ ID NO: 31001 - DNA, 15 bp, Artificial Sequence
  dgRNA
  Prkra
gagcgggcggtagct

SEQ ID NO: 31002 - DNA, 15 bp, Artificial Sequence
  dgRNA
  Prkra
agagggcggagcccg

SEQ ID NO: 31003 - DNA, 15 bp, Artificial Sequence
  dgRNA
  Prkra
cggagcccgaggaac

SEQ ID NO: 31004 - DNA, 15 bp, Artificial Sequence
  dgRNA
  Zbtb42
gggctagcttctagc

SEQ ID NO: 31005 - DNA, 15 bp, Artificial Sequence
  dgRNA
  Zbtb42
tctagcgggactgac

SEQ ID NO: 31006 - DNA, 15 bp, Artificial Sequence
  dgRNA
  Zbtb42
ctagcgggactgacc

SEQ ID NO: 31007 - DNA, 15 bp, Artificial Sequence
  dgRNA
  Zbtb42
gcgggactgaccggg

SEQ ID NO: 31008 - DNA, 15 bp, Artificial Sequence
  dgRNA
  Crp
gacgtttaccccaag

SEQ ID NO: 31009 - DNA, 15 bp, Artificial Sequence
  dgRNA
  Crp
tataaatctgaggat

SEQ ID NO: 31010 - DNA, 15 bp, Artificial Sequence
  dgRNA
  Crp
aaacgtcagaccact

SEQ ID NO: 31011 - DNA, 15 bp, Artificial Sequence
  dgRNA
  Crp
taaacgtcagaccac

SEQ ID NO: 31012 - DNA, 15 bp, Artificial Sequence
  dgRNA
  Nr1h4
gcttactaggcaatt

SEQ ID NO: 31013 - DNA, 15 bp, Artificial Sequence
  dgRNA
  Nr1h4
ggcaatttggcattg

SEQ ID NO: 31014 - DNA, 15 bp, Artificial Sequence
  dgRNA
  Nr1h4
tattccgctcagcga

SEQ ID NO: 31015 - DNA, 15 bp, Artificial Sequence
  dgRNA
  Nr1h4
attccgctcagcgat

SEQ ID NO: 31016 - DNA, 15 bp, Artificial Sequence
  dgRNA
  Celf3
ccctcatgacgctgc

SEQ ID NO: 31017 - DNA, 15 bp, Artificial Sequence
  dgRNA
  Celf3
cacccaaacgcccca

SEQ ID NO: 31018 - DNA, 15 bp, Artificial Sequence
  dgRNA
  Celf3
agcagcgtcatgagg

SEQ ID NO: 31019 - DNA, 15 bp, Artificial Sequence
  dgRNA
  Celf3
cagcagcgtcatgag

SEQ ID NO: 31020 - DNA, 15 bp, Artificial Sequence
  dgRNA
  Ppp2r2c
ccttattgcaacacc

SEQ ID NO: 31021 - DNA, 15 bp, Artificial Sequence
  dgRNA
  Ppp2r2c
gcctcaactctagat

SEQ ID NO: 31022 - DNA, 15 bp, Artificial Sequence
  dgRNA
  Ppp2r2c
tgtccctggttccgg

SEQ ID NO: 31023 - DNA, 15 bp, Artificial Sequence
  dgRNA
  Ppp2r2c
cggaggtgaccgctg

SEQ ID NO: 31024 - DNA, 15 bp, Artificial Sequence
  dgRNA
  Nos1
ctgacctgttgctta

SEQ ID NO: 31025 - DNA, 15 bp, Artificial Sequence
  dgRNA
  Nos1
ttcctgacgtctgcc

SEQ ID NO: 31026 - DNA, 15 bp, Artificial Sequence
  dgRNA
  Nos1
ccacccaaggccgaa

SEQ ID NO: 31027 - DNA, 15 bp, Artificial Sequence
  dgRNA
  Nos1
cgaacggcaatgagc

SEQ ID NO: 31028 - DNA, 15 bp, Artificial Sequence
  dgRNA
  Penk
gtaacctgcgccatc

SEQ ID NO: 31029 - DNA, 15 bp, Artificial Sequence
  dgRNA
  Penk
cgccatctggagcaa

SEQ ID NO: 31030 - DNA, 15 bp, Artificial Sequence
  dgRNA
  Penk
cgtcgcctgttccct

SEQ ID NO: 31031 - DNA, 15 bp, Artificial Sequence
  dgRNA
  Penk
ttcgtccaactttct

SEQ ID NO: 31032 - DNA, 15 bp, Artificial Sequence
  dgRNA
  Rhot1
gcaggcaaacctccg

SEQ ID NO: 31033 - DNA, 15 bp, Artificial Sequence
  dgRNA
  Rhot1
gatacgagagcgttg

SEQ ID NO: 31034 - DNA, 15 bp, Artificial Sequence
  dgRNA
  Rhot1
cgccgcccgcgtccg

SEQ ID NO: 31035 - DNA, 15 bp, Artificial Sequence
  dgRNA
  Rhot1
ccgcgtccgcggagc

SEQ ID NO: 31036 - DNA, 15 bp, Artificial Sequence
  dgRNA
  1600014C10Rik
gctccccatttccgc

SEQ ID NO: 31037 - DNA, 15 bp, Artificial Sequence
  dgRNA
  1600014C10Rik
cagtcaatcagacgc

SEQ ID NO: 31038 - DNA, 15 bp, Artificial Sequence
  dgRNA
  1600014C10Rik
agtcaatcagacgct

SEQ ID NO: 31039 - DNA, 15 bp, Artificial Sequence
  dgRNA
  1600014C10Rik
tcagacgctggggcg

SEQ ID NO: 31040 - DNA, 15 bp, Artificial Sequence
  dgRNA
  Arvcf
cacagcattccgggc

SEQ ID NO: 31041 - DNA, 15 bp, Artificial Sequence
  dgRNA
  Arvcf
ggagttgccccctcc

SEQ ID NO: 31042 - DNA, 15 bp, Artificial Sequence
  dgRNA
  Arvcf
ctgcccggaatgctg

SEQ ID NO: 31043 - DNA, 15 bp, Artificial Sequence
  dgRNA
  Matn4
gctgtagcccaattc

SEQ ID NO: 31044 - DNA, 15 bp, Artificial Sequence
  dgRNA
  Matn4
gggcgccgtgcttgc

SEQ ID NO: 31045 - DNA, 15 bp, Artificial Sequence
  dgRNA
  Matn4
ggcgccgtgcttgct

SEQ ID NO: 31046 - DNA, 15 bp, Artificial Sequence
  dgRNA
  Matn4
gcgccgtgcttgctg

SEQ ID NO: 31047 - DNA, 15 bp, Artificial Sequence
  dgRNA
  Zfp664
gtggaggacccggag

SEQ ID NO: 31048 - DNA, 15 bp, Artificial Sequence
  dgRNA
  Zfp664
tggaggacccggagc

SEQ ID NO: 31049 - DNA, 15 bp, Artificial Sequence
  dgRNA
  Zfp664
actttgagacgcccc

SEQ ID NO: 31050 - DNA, 15 bp, Artificial Sequence
  dgRNA
  Zfp664
cgcccctcccatggg

SEQ ID NO: 31051 - DNA, 15 bp, Artificial Sequence
  dgRNA
  Tmem253
ggctcctgtctagga

SEQ ID NO: 31052 - DNA, 15 bp, Artificial Sequence
  dgRNA
  Tmem253
actccctgaatcttt

SEQ ID NO: 31053 - DNA, 15 bp, Artificial Sequence
  dgRNA
  Tmem253
gacagactatgtgcc

SEQ ID NO: 31054 - DNA, 15 bp, Artificial Sequence
  dgRNA
  Tmem253
cttacttcatcgctc

SEQ ID NO: 31055 - DNA, 15 bp, Artificial Sequence
  dgRNA
  Trpm6
tcgtagctgaggttt

SEQ ID NO: 31056 - DNA, 15 bp, Artificial Sequence
  dgRNA
  Trpm6
gttttggcaaccgcg

SEQ ID NO: 31057 - DNA, 15 bp, Artificial Sequence
  dgRNA
  Trpm6
cgtggacccttccga

SEQ ID NO: 31058 - DNA, 15 bp, Artificial Sequence
  dgRNA
  Trpm6
gtggacccttccgaa

SEQ ID NO: 31059 - DNA, 15 bp, Artificial Sequence
  dgRNA
  Wdfy1
tccgggagaattatt

SEQ ID NO: 31060 - DNA, 15 bp, Artificial Sequence
  dgRNA
  Wdfy1
tttagggttccttcc

SEQ ID NO: 31061 - DNA, 15 bp, Artificial Sequence
  dgRNA
  Wdfy1
ttagggttccttccg

SEQ ID NO: 31062 - DNA, 15 bp, Artificial Sequence
  dgRNA
  Wdfy1
cttcaccaagtacta

SEQ ID NO: 31063 - DNA, 15 bp, Artificial Sequence
  dgRNA
  Hnrnpu
gctcaagagccggaa

SEQ ID NO: 31064 - DNA, 15 bp, Artificial Sequence
  dgRNA
  Hnrnpu
aagagccggaaaggc

SEQ ID NO: 31065 - DNA, 15 bp, Artificial Sequence
  dgRNA
  Hnrnpu
ggccggcggccactg

SEQ ID NO: 31066 - DNA, 15 bp, Artificial Sequence
  dgRNA
  Hnrnpu
cggcggccactgcgg

SEQ ID NO: 31067 - DNA, 15 bp, Artificial Sequence
  dgRNA
  Snx33
gctcccctgcagccg

SEQ ID NO: 31068 - DNA, 15 bp, Artificial Sequence
  dgRNA
  Snx33
cccctgcagccgagg

SEQ ID NO: 31069 - DNA, 15 bp, Artificial Sequence
  dgRNA
  Snx33
cgctccgcaaacttt

SEQ ID NO: 31070 - DNA, 15 bp, Artificial Sequence
  dgRNA
  Snx33
cctgcacttgcgtca

SEQ ID NO: 31071 - DNA, 15 bp, Artificial Sequence
  dgRNA
  Grk4
gaagtacacaagtcc

SEQ ID NO: 31072 - DNA, 15 bp, Artificial Sequence
  dgRNA
  Grk4
tggatgacactaaac

SEQ ID NO: 31073 - DNA, 15 bp, Artificial Sequence
  dgRNA
  Grk4
acttcctcgacttcc

SEQ ID NO: 31074 - DNA, 15 bp, Artificial Sequence
  dgRNA
  Grk4
tcgacttcctggcgc

SEQ ID NO: 31075 - DNA, 15 bp, Artificial Sequence
  dgRNA
  Pik3c2a
tccccgagaggcccc

SEQ ID NO: 31076 - DNA, 15 bp, Artificial Sequence
  dgRNA
  Pik3c2a
cgagaggcccccggc

SEQ ID NO: 31077 - DNA, 15 bp, Artificial Sequence
  dgRNA
  Pik3c2a
gacacccattccccg

SEQ ID NO: 31078 - DNA, 15 bp, Artificial Sequence
  dgRNA
  Pik3c2a
cccgcccgccatctc

SEQ ID NO: 31079 - DNA, 15 bp, Artificial Sequence
  dgRNA
  Cacng1
cccctcctccgggac

SEQ ID NO: 31080 - DNA, 15 bp, Artificial Sequence
  dgRNA
  Cacng1
tcctccgggacaggg

SEQ ID NO: 31081 - DNA, 15 bp, Artificial Sequence
  dgRNA
  Cacng1
cctccgggacagggt

SEQ ID NO: 31082 - DNA, 15 bp, Artificial Sequence
  dgRNA
  Cacng1
ctccgggacagggtg

SEQ ID NO: 31083 - DNA, 15 bp, Artificial Sequence
  dgRNA
  Zfp811
taggaggcgggtctg

SEQ ID NO: 31084 - DNA, 15 bp, Artificial Sequence
  dgRNA
  Zfp811
ggtccccgccttatt

SEQ ID NO: 31085 - DNA, 15 bp, Artificial Sequence
  dgRNA
  Zfp811
gtccccgccttattt

SEQ ID NO: 31086 - DNA, 15 bp, Artificial Sequence
  dgRNA
  Zfp811
tccccgccttatttg

SEQ ID NO: 31087 - DNA, 15 bp, Artificial Sequence
  dgRNA
  Psmb1
tccaaacgttttctt

SEQ ID NO: 31088 - DNA, 15 bp, Artificial Sequence
  dgRNA
  Psmb1
ccaaacgttttctta

SEQ ID NO: 31089 - DNA, 15 bp, Artificial Sequence
  dgRNA
  Psmb1
ttagggttataaaac

SEQ ID NO: 31090 - DNA, 15 bp, Artificial Sequence
  dgRNA
  Psmb1
aggattggcggatcc

SEQ ID NO: 31091 - DNA, 15 bp, Artificial Sequence
  dgRNA
  Gngt2
agctccgccatggct

SEQ ID NO: 31092 - DNA, 15 bp, Artificial Sequence
  dgRNA
  Gngt2
atggcttggcctcgg

SEQ ID NO: 31093 - DNA, 15 bp, Artificial Sequence
  dgRNA
  Gngt2
tggcttggcctcggt

SEQ ID NO: 31094 - DNA, 15 bp, Artificial Sequence
  dgRNA
  Gngt2
ctcggtggggttccc

SEQ ID NO: 31095 - DNA, 15 bp, Artificial Sequence
  dgRNA
  Lmntd2
gaggttcccacacct

SEQ ID NO: 31096 - DNA, 15 bp, Artificial Sequence
  dgRNA
  Lmntd2
tactcaataggacat

SEQ ID NO: 31097 - DNA, 15 bp, Artificial Sequence
  dgRNA
  Lmntd2
aggtgactactcaat

SEQ ID NO: 31098 - DNA, 15 bp, Artificial Sequence
  dgRNA
  Lmntd2
tctgaggaggcttac

SEQ ID NO: 31099 - DNA, 15 bp, Artificial Sequence
  dgRNA
  Syn3
gcaactttccctacc

SEQ ID NO: 31100 - DNA, 15 bp, Artificial Sequence
  dgRNA
  Syn3
cctacctggctggcg

SEQ ID NO: 31101 - DNA, 15 bp, Artificial Sequence
  dgRNA
  Syn3
ctacctggctggcga

SEQ ID NO: 31102 - DNA, 15 bp, Artificial Sequence
  dgRNA
  Syn3
cttgaggggcgggcc

SEQ ID NO: 31103 - DNA, 15 bp, Artificial Sequence
  dgRNA
  Pdcd1lg2
agccgcttacctgcc

SEQ ID NO: 31104 - DNA, 15 bp, Artificial Sequence
  dgRNA
  Tyrobp
tcttgttcagcccat

SEQ ID NO: 31105 - DNA, 15 bp, Artificial Sequence
  dgRNA
  Tyrobp
agcccattgggaccg

SEQ ID NO: 31106 - DNA, 15 bp, Artificial Sequence
  dgRNA
  Tyrobp
atagagggcaaatct

SEQ ID NO: 31107 - DNA, 15 bp, Artificial Sequence
  dgRNA
  Tyrobp
tgccacggtcccaat

SEQ ID NO: 31108 - DNA, 15 bp, Artificial Sequence
  dgRNA
  Olfr6
tccatggtactctca

SEQ ID NO: 31109 - DNA, 15 bp, Artificial Sequence
  dgRNA
  Olfr6
gtaccatggaacatt

SEQ ID NO: 31110 - DNA, 15 bp, Artificial Sequence
  dgRNA
  Olfr6
tccatgagagtacca

SEQ ID NO: 31111 - DNA, 15 bp, Artificial Sequence
  dgRNA
  Gpatch3
ccagcatccgagacg

SEQ ID NO: 31112 - DNA, 15 bp, Artificial Sequence
  dgRNA
  Gpatch3
gtgctctcgcgagag

SEQ ID NO: 31113 - DNA, 15 bp, Artificial Sequence
  dgRNA
  Gpatch3
ctcgtgcgatgggct

SEQ ID NO: 31114 - DNA, 15 bp, Artificial Sequence
  dgRNA
  Gpatch3
actcgtgcgatgggc

SEQ ID NO: 31115 - DNA, 15 bp, Artificial Sequence
  dgRNA
  Ctnnbl1
tctactcttggataa

SEQ ID NO: 31116 - DNA, 15 bp, Artificial Sequence
  dgRNA
  Ctnnbl1
aacggcctcgctttt

SEQ ID NO: 31117 - DNA, 15 bp, Artificial Sequence
  dgRNA
  Ctnnbl1
tttccccgccccttc

SEQ ID NO: 31118 - DNA, 15 bp, Artificial Sequence
  dgRNA
  Ctnnbl1
gccccttcaggttac

SEQ ID NO: 31119 - DNA, 15 bp, Artificial Sequence
  dgRNA
  Vsx2
caaaaccgctatcca

SEQ ID NO: 31120 - DNA, 15 bp, Artificial Sequence
  dgRNA
  Vsx2
atccacggtatctcc

SEQ ID NO: 31121 - DNA, 15 bp, Artificial Sequence
  dgRNA
  Vsx2
gaataaccccaaacc

SEQ ID NO: 31122 - DNA, 15 bp, Artificial Sequence
  dgRNA
  Vsx2
gagcccaccacactt

SEQ ID NO: 31123 - DNA, 15 bp, Artificial Sequence
  dgRNA
  Phpt1
ctaataactcggtag

SEQ ID NO: 31124 - DNA, 15 bp, Artificial Sequence
  dgRNA
  Phpt1
ataactcggtagtgg

SEQ ID NO: 31125 - DNA, 15 bp, Artificial Sequence
  dgRNA
  Phpt1
ggtcgtcgtcgtggc

SEQ ID NO: 31126 - DNA, 15 bp, Artificial Sequence
  dgRNA
  Phpt1
gtcgtcgtcgtggcc

SEQ ID NO: 31127 - DNA, 15 bp, Artificial Sequence
  dgRNA
  Rdh19
acatatcatgcccac

SEQ ID NO: 31128 - DNA, 15 bp, Artificial Sequence
  dgRNA
  Rdh19
aatgccttagatctc

SEQ ID NO: 31129 - DNA, 15 bp, Artificial Sequence
  dgRNA
  Tmem33
tggtgaatcgctatc

SEQ ID NO: 31130 - DNA, 15 bp, Artificial Sequence
  dgRNA
  Tmem33
agacgaaagttgcct

SEQ ID NO: 31131 - DNA, 15 bp, Artificial Sequence
  dgRNA
  Tmem33
cgaaagttgcctcgg

SEQ ID NO: 31132 - DNA, 15 bp, Artificial Sequence
  dgRNA
  Tmem33
aagcactagtgaaac

SEQ ID NO: 31133 - DNA, 15 bp, Artificial Sequence
  dgRNA
  Eef2k
tctaacgttagaccc

SEQ ID NO: 31134 - DNA, 15 bp, Artificial Sequence
  dgRNA
  Eef2k
taggaagcgttcaac

SEQ ID NO: 31135 - DNA, 15 bp, Artificial Sequence
  dgRNA
  Eef2k
gaagcgttcaacagg

SEQ ID NO: 31136 - DNA, 15 bp, Artificial Sequence
  dgRNA
  Eef2k
aagcgttcaacaggc

SEQ ID NO: 31137 - DNA, 15 bp, Artificial Sequence
  dgRNA
  Clca3b
cacaaagaatccgaa

SEQ ID NO: 31138 - DNA, 15 bp, Artificial Sequence
  dgRNA
  Clca3b
ccttagaaagaacga

SEQ ID NO: 31139 - DNA, 15 bp, Artificial Sequence
  dgRNA
  Clca3b
gtcaccaagaaatat

SEQ ID NO: 31140 - DNA, 15 bp, Artificial Sequence
  dgRNA
  Clca3b
ccatcgttctttcta

SEQ ID NO: 31141 - DNA, 15 bp, Artificial Sequence
  dgRNA
  Smim15
aaaggttgtatacta

SEQ ID NO: 31142 - DNA, 15 bp, Artificial Sequence
  dgRNA
  Smim15
gtgtgctaaggagcg

SEQ ID NO: 31143 - DNA, 15 bp, Artificial Sequence
  dgRNA
  Smim15
gctaaggagcgggga

SEQ ID NO: 31144 - DNA, 15 bp, Artificial Sequence
  dgRNA
  Smim15
actacagcacaatct

SEQ ID NO: 31145 - DNA, 15 bp, Artificial Sequence
  dgRNA
  Hsd3b7
cactaccaaatgggc

SEQ ID NO: 31146 - DNA, 15 bp, Artificial Sequence
  dgRNA
  Hsd3b7
gtggactggccacca

SEQ ID NO: 31147 - DNA, 15 bp, Artificial Sequence
  dgRNA
  Hsd3b7
ccttgcccgccccta

SEQ ID NO: 31148 - DNA, 15 bp, Artificial Sequence
  dgRNA
  Hsd3b7
cttgcccgcccctag

SEQ ID NO: 31149 - DNA, 15 bp, Artificial Sequence
  dgRNA
  Slc6a13
accggctgaactgcc

SEQ ID NO: 31150 - DNA, 15 bp, Artificial Sequence
  dgRNA
  Slc6a13
ccggctgaactgcca

SEQ ID NO: 31151 - DNA, 15 bp, Artificial Sequence
  dgRNA
  Slc6a13
gctgaactgccaggg

SEQ ID NO: 31152 - DNA, 15 bp, Artificial Sequence
  dgRNA
  Slc6a13
gcggacagagtcccc

SEQ ID NO: 31153 - DNA, 15 bp, Artificial Sequence
  dgRNA
  Cyp2a5
gcaatgtcccaaact

SEQ ID NO: 31154 - DNA, 15 bp, Artificial Sequence
  dgRNA
  Cyp2a5
caatagtggatagtc

SEQ ID NO: 31155 - DNA, 15 bp, Artificial Sequence
  dgRNA
  Cyp2a5
tagtggatagtctgg

SEQ ID NO: 31156 - DNA, 15 bp, Artificial Sequence
  dgRNA
  Cyp2a5
ggacattgccaacac

SEQ ID NO: 31157 - DNA, 15 bp, Artificial Sequence
  dgRNA
  Smad6
gcactgtcagcctcg

SEQ ID NO: 31158 - DNA, 15 bp, Artificial Sequence
  dgRNA
  Smad6
gtcagcctcggggcg

SEQ ID NO: 31159 - DNA, 15 bp, Artificial Sequence
  dgRNA
  Smad6
tcagcctcggggcgg

SEQ ID NO: 31160 - DNA, 15 bp, Artificial Sequence
  dgRNA
  Smad6
gcgggggcccgcgtt

SEQ ID NO: 31161 - DNA, 15 bp, Artificial Sequence
  dgRNA
  Ugt2a3
ttccttatgaatagc

SEQ ID NO: 31162 - DNA, 15 bp, Artificial Sequence
  dgRNA
  Nsun6
cactctgaagaaacg

SEQ ID NO: 31163 - DNA, 15 bp, Artificial Sequence
  dgRNA
  Nsun6
aagaaacgcggactg

SEQ ID NO: 31164 - DNA, 15 bp, Artificial Sequence
  dgRNA
  Nsun6
cagcggtcatccccg

SEQ ID NO: 31165 - DNA, 15 bp, Artificial Sequence
  dgRNA
  Nsun6
gtcatccccgaggcc

SEQ ID NO: 31166 - DNA, 15 bp, Artificial Sequence
  dgRNA
  Arhgap9
ttcttttactctcga

SEQ ID NO: 31167 - DNA, 15 bp, Artificial Sequence
  dgRNA
  Arhgap9
actctcgatggtgtg

SEQ ID NO: 31168 - DNA, 15 bp, Artificial Sequence
  dgRNA
  Arhgap9
cgatggtgtgaggac

SEQ ID NO: 31169 - DNA, 15 bp, Artificial Sequence
  dgRNA
  Arhgap9
gggcggggttgcgtg

SEQ ID NO: 31170 - DNA, 15 bp, Artificial Sequence
  dgRNA
  Neurod4
acgcagtggcaaagc

SEQ ID NO: 31171 - DNA, 15 bp, Artificial Sequence
  dgRNA
  Neurod4
gtctttaggctagga

SEQ ID NO: 31172 - DNA, 15 bp, Artificial Sequence
  dgRNA
  Neurod4
ctttaggctaggaag

SEQ ID NO: 31173 - DNA, 15 bp, Artificial Sequence
  dgRNA
  Neurod4
caacatctcccgccc

SEQ ID NO: 31174 - DNA, 15 bp, Artificial Sequence
  dgRNA
  Foxred2
ccaggcgtcccatca

SEQ ID NO: 31175 - DNA, 15 bp, Artificial Sequence
  dgRNA
  Foxred2
ccgccccaccagtcc

SEQ ID NO: 31176 - DNA, 15 bp, Artificial Sequence
  dgRNA
  Foxred2
ccggcgtgctgcgcg

SEQ ID NO: 31177 - DNA, 15 bp, Artificial Sequence
  dgRNA
  Foxred2
cccgccccctgctat

SEQ ID NO: 31178 - DNA, 15 bp, Artificial Sequence
  dgRNA
  Prss2
gctcgccatgtgaca

SEQ ID NO: 31179 - DNA, 15 bp, Artificial Sequence
  dgRNA
  Prss2
ctcgccatgtgacaa

SEQ ID NO: 31180 - DNA, 15 bp, Artificial Sequence
  dgRNA
  Prss2
gggaactataaagac

SEQ ID NO: 31181 - DNA, 15 bp, Artificial Sequence
  dgRNA
  Prss2
cacatggcgagctac

SEQ ID NO: 31182 - DNA, 15 bp, Artificial Sequence
  dgRNA
  Ddr1
gattctacctcccat

SEQ ID NO: 31183 - DNA, 15 bp, Artificial Sequence
  dgRNA
  Ddr1
catgggcccttcact

SEQ ID NO: 31184 - DNA, 15 bp, Artificial Sequence
  dgRNA
  Ddr1
tgagtcacgggcgtg

SEQ ID NO: 31185 - DNA, 15 bp, Artificial Sequence
  dgRNA
  Ddr1
gagtcacgggcgtga

SEQ ID NO: 31186 - DNA, 15 bp, Artificial Sequence
  dgRNA
  V1rd19
cgagatatatttgca

SEQ ID NO: 31187 - DNA, 15 bp, Artificial Sequence
  dgRNA
  V1rd19
cttatcacttatctt

SEQ ID NO: 31188 - DNA, 15 bp, Artificial Sequence
  dgRNA
  Gm13043
ggagctatgtaagat

SEQ ID NO: 31189 - DNA, 15 bp, Artificial Sequence
  dgRNA
  Tln1
gccccgtggaatcct

SEQ ID NO: 31190 - DNA, 15 bp, Artificial Sequence
  dgRNA
  Tln1
gagttctctccaact

SEQ ID NO: 31191 - DNA, 15 bp, Artificial Sequence
  dgRNA
  Tln1
tctccaactcggaag

SEQ ID NO: 31192 - DNA, 15 bp, Artificial Sequence
  dgRNA
  Tln1
ctcggaagtggctcc

SEQ ID NO: 31193 - DNA, 15 bp, Artificial Sequence
  dgRNA
  Rrp8
tctacccaacgctct

SEQ ID NO: 31194 - DNA, 15 bp, Artificial Sequence
  dgRNA
  Rrp8
ctacccaacgctcta

SEQ ID NO: 31195 - DNA, 15 bp, Artificial Sequence
  dgRNA
  Rrp8
gacatgagttcatag

SEQ ID NO: 31196 - DNA, 15 bp, Artificial Sequence
  dgRNA
  Rrp8
aaagttcccgggaac

SEQ ID NO: 31197 - DNA, 15 bp, Artificial Sequence
  dgRNA
  E2f6
ccgccatcctctcca

SEQ ID NO: 31198 - DNA, 15 bp, Artificial Sequence
  dgRNA
  E2f6
caaggatccatcctc

SEQ ID NO: 31199 - DNA, 15 bp, Artificial Sequence
  dgRNA
  E2f6
atcctccggaacacc

SEQ ID NO: 31200 - DNA, 15 bp, Artificial Sequence
  dgRNA
  E2f6
tcctccggaacaccc

SEQ ID NO: 31201 - DNA, 15 bp, Artificial Sequence
  dgRNA
  Dlg5
gggcagtatgtgaac

SEQ ID NO: 31202 - DNA, 15 bp, Artificial Sequence
  dgRNA
  Dlg5
taccttgtggactaa

SEQ ID NO: 31203 - DNA, 15 bp, Artificial Sequence
  dgRNA
  Dlg5
ttgtggactaagggc

SEQ ID NO: 31204 - DNA, 15 bp, Artificial Sequence
  dgRNA
  Dlg5
tggactaagggccgg

SEQ ID NO: 31205 - DNA, 15 bp, Artificial Sequence
  dgRNA
  Ppp1r16b
aaaggggtcttcatt

SEQ ID NO: 31206 - DNA, 15 bp, Artificial Sequence
  dgRNA
  Ppp1r16b
cggtgacaagcccct

SEQ ID NO: 31207 - DNA, 15 bp, Artificial Sequence
  dgRNA
  Ppp1r16b
ggtgacaagcccctt

SEQ ID NO: 31208 - DNA, 15 bp, Artificial Sequence
  dgRNA
  Ppp1r16b
gtgacaagccccttg

SEQ ID NO: 31209 - DNA, 15 bp, Artificial Sequence
  dgRNA
  Atxn1l
accaaaggggggcgc

SEQ ID NO: 31210 - DNA, 15 bp, Artificial Sequence
  dgRNA
  Atxn1l
ccaaaggggggcgct

SEQ ID NO: 31211 - DNA, 15 bp, Artificial Sequence
  dgRNA
  Atxn1l
gggcgctgggtacga

SEQ ID NO: 31212 - DNA, 15 bp, Artificial Sequence
  dgRNA
  Atxn1l
ggcgctgggtacgat

SEQ ID NO: 31213 - DNA, 15 bp, Artificial Sequence
  dgRNA
  Ints1
cctccggccgccaga

SEQ ID NO: 31214 - DNA, 15 bp, Artificial Sequence
  dgRNA
  Ints1
ccggccgccagaggg

SEQ ID NO: 31215 - DNA, 15 bp, Artificial Sequence
  dgRNA
  Ints1
ggtgcaaacactagt

SEQ ID NO: 31216 - DNA, 15 bp, Artificial Sequence
  dgRNA
  Ints1
tgagaaatcagcgct

SEQ ID NO: 31217 - DNA, 15 bp, Artificial Sequence
  dgRNA
  Gk2
ggtgagggggtaaat

SEQ ID NO: 31218 - DNA, 15 bp, Artificial Sequence
  dgRNA
  Gk2
ggctcccgaagctgt

SEQ ID NO: 31219 - DNA, 15 bp, Artificial Sequence
  dgRNA
  Gk2
ccgaagctgtgggac

SEQ ID NO: 31220 - DNA, 15 bp, Artificial Sequence
  dgRNA
  Gk2
tccaccgtacctgac

SEQ ID NO: 31221 - DNA, 15 bp, Artificial Sequence
  dgRNA
  Fam101b
cagctttgccagtcg

SEQ ID NO: 31222 - DNA, 15 bp, Artificial Sequence
  dgRNA
  Fam101b
ccagtcgcggcatgc

SEQ ID NO: 31223 - DNA, 15 bp, Artificial Sequence
  dgRNA
  Fam101b
cagtcgcggcatgcc

SEQ ID NO: 31224 - DNA, 15 bp, Artificial Sequence
  dgRNA
  Fam101b
agtcgcggcatgccg

SEQ ID NO: 31225 - DNA, 15 bp, Artificial Sequence
  dgRNA
  Ldlr
ctcaaacagcaacgc

SEQ ID NO: 31226 - DNA, 15 bp, Artificial Sequence
  dgRNA
  Ldlr
aaacagcaacgcggg

SEQ ID NO: 31227 - DNA, 15 bp, Artificial Sequence
  dgRNA
  Ldlr
gggcggctaagtgtc

SEQ ID NO: 31228 - DNA, 15 bp, Artificial Sequence
  dgRNA
  Ldlr
ggcggctaagtgtcc

SEQ ID NO: 31229 - DNA, 15 bp, Artificial Sequence
  dgRNA
  Zfp11
gttgccctcaccact

SEQ ID NO: 31230 - DNA, 15 bp, Artificial Sequence
  dgRNA
  Zfp11
ccacttggactccca

SEQ ID NO: 31231 - DNA, 15 bp, Artificial Sequence
  dgRNA
  Zfp11
tattcctagccacct

SEQ ID NO: 31232 - DNA, 15 bp, Artificial Sequence
  dgRNA
  Zfp11
ctctccgggtcaccg

SEQ ID NO: 31233 - DNA, 15 bp, Artificial Sequence
  dgRNA
  P2ry13
gcgtgcctgcagagc

SEQ ID NO: 31234 - DNA, 15 bp, Artificial Sequence
  dgRNA
  P2ry13
agccggtgacagcac

SEQ ID NO: 31235 - DNA, 15 bp, Artificial Sequence
  dgRNA
  P2ry13
gcaaccaataactac

SEQ ID NO: 31236 - DNA, 15 bp, Artificial Sequence
  dgRNA
  P2ry13
tggtaaatgctccaa

SEQ ID NO: 31237 - DNA, 15 bp, Artificial Sequence
  dgRNA
  Ftmt
gttacataacgtcag

SEQ ID NO: 31238 - DNA, 15 bp, Artificial Sequence
  dgRNA
  Ftmt
actaacacaagattc

SEQ ID NO: 31239 - DNA, 15 bp, Artificial Sequence
  dgRNA
  Ftmt
taggcccgcaggaaa

SEQ ID NO: 31240 - DNA, 15 bp, Artificial Sequence
  dgRNA
  Ftmt
ctaggcccgcaggaa

SEQ ID NO: 31241 - DNA, 15 bp, Artificial Sequence
  dgRNA
  Vps13d
agcccccagcatact

SEQ ID NO: 31242 - DNA, 15 bp, Artificial Sequence
  dgRNA
  Vps13d
acccgccgcccttac

SEQ ID NO: 31243 - DNA, 15 bp, Artificial Sequence
  dgRNA
  Vps13d
ccgcccttacaggaa

SEQ ID NO: 31244 - DNA, 15 bp, Artificial Sequence
  dgRNA
  Vps13d
ttacaggaacggctg

SEQ ID NO: 31245 - DNA, 15 bp, Artificial Sequence
  dgRNA
  Krtap4-7
gccctttctaaacat

SEQ ID NO: 31246 - DNA, 15 bp, Artificial Sequence
  dgRNA
  Krtap4-7
ccctttctaaacatt

SEQ ID NO: 31247 - DNA, 15 bp, Artificial Sequence
  dgRNA
  Krtap4-7
aagggaataccagcc

SEQ ID NO: 31248 - DNA, 15 bp, Artificial Sequence
  dgRNA
  Krtap4-7
tgattcattgaatta

SEQ ID NO: 31249 - DNA, 15 bp, Artificial Sequence
  dgRNA
  Lmbrd1
tgggcttatccggac

SEQ ID NO: 31250 - DNA, 15 bp, Artificial Sequence
  dgRNA
  Lmbrd1
gaccggaagcgaaga

SEQ ID NO: 31251 - DNA, 15 bp, Artificial Sequence
  dgRNA
  Lmbrd1
cggaagcgaagatgg

SEQ ID NO: 31252 - DNA, 15 bp, Artificial Sequence
  dgRNA
  Lmbrd1
aagcgaagatggcgg

SEQ ID NO: 31253 - DNA, 15 bp, Artificial Sequence
  dgRNA
  Usp4
cagcagtcagatcgc

SEQ ID NO: 31254 - DNA, 15 bp, Artificial Sequence
  dgRNA
  Usp4
ggagccgctcagaca

SEQ ID NO: 31255 - DNA, 15 bp, Artificial Sequence
  dgRNA
  Usp4
ccgctcagacacggg

SEQ ID NO: 31256 - DNA, 15 bp, Artificial Sequence
  dgRNA
  Usp4
agacacgggtggatg

SEQ ID NO: 31257 - DNA, 15 bp, Artificial Sequence
  dgRNA
  Celsr3
ggggccgtatgccaa

SEQ ID NO: 31258 - DNA, 15 bp, Artificial Sequence
  dgRNA
  Celsr3
gggccgtatgccaaa

SEQ ID NO: 31259 - DNA, 15 bp, Artificial Sequence
  dgRNA
  Celsr3
atgccaaaggggctc

SEQ ID NO: 31260 - DNA, 15 bp, Artificial Sequence
  dgRNA
  Celsr3
aaggggctctggccg

SEQ ID NO: 31261 - DNA, 15 bp, Artificial Sequence
  dgRNA
  Ndufs1
cgacttggtaactaa

SEQ ID NO: 31262 - DNA, 15 bp, Artificial Sequence
  dgRNA
  Ndufs1
ccacaggtcgtccgc

SEQ ID NO: 31263 - DNA, 15 bp, Artificial Sequence
  dgRNA
  Ndufs1
aatgccttcgctcca

SEQ ID NO: 31264 - DNA, 15 bp, Artificial Sequence
  dgRNA
  Ndufs1
aggactccgaaacga

SEQ ID NO: 31265 - DNA, 15 bp, Artificial Sequence
  dgRNA
  Kcne3
tgtcattggtgaagc

SEQ ID NO: 31266 - DNA, 15 bp, Artificial Sequence
  dgRNA
  Kcne3
caacgtgaactacag

SEQ ID NO: 31267 - DNA, 15 bp, Artificial Sequence
  dgRNA
  Kcne3
tacagaggattcgcc

SEQ ID NO: 31268 - DNA, 15 bp, Artificial Sequence
  dgRNA
  Kcne3
agaggattcgcctgg

SEQ ID NO: 31269 - DNA, 15 bp, Artificial Sequence
  dgRNA
  Gstm7
ccgaactgtcaccac

SEQ ID NO: 31270 - DNA, 15 bp, Artificial Sequence
  dgRNA
  Gstm7
cgaactgtcaccact

SEQ ID NO: 31271 - DNA, 15 bp, Artificial Sequence
  dgRNA
  Gstm7
tgccatctagactag

SEQ ID NO: 31272 - DNA, 15 bp, Artificial Sequence
  dgRNA
  Gstm7
gccatctagactaga

SEQ ID NO: 31273 - DNA, 15 bp, Artificial Sequence
  dgRNA
  Rab17
gtttgtgccatgtat

SEQ ID NO: 31274 - DNA, 15 bp, Artificial Sequence
  dgRNA
  Rab17
gtatgggttggcccc

SEQ ID NO: 31275 - DNA, 15 bp, Artificial Sequence
  dgRNA
  Rab17
tatgggttggcccca

SEQ ID NO: 31276 - DNA, 15 bp, Artificial Sequence
  dgRNA
  Rab17
cagggtgacccgtga

SEQ ID NO: 31277 - DNA, 15 bp, Artificial Sequence
  dgRNA
  Fibin
tacgtcttattgtac

SEQ ID NO: 31278 - DNA, 15 bp, Artificial Sequence
  dgRNA
  Fibin
acgtcttattgtaca

SEQ ID NO: 31279 - DNA, 15 bp, Artificial Sequence
  dgRNA
  Fibin
agtcctgcaatcctc

SEQ ID NO: 31280 - DNA, 15 bp, Artificial Sequence
  dgRNA
  Fibin
ggatatctttagcca

SEQ ID NO: 31281 - DNA, 15 bp, Artificial Sequence
  dgRNA
  Gpbp1
cccttcccccgcgcc

SEQ ID NO: 31282 - DNA, 15 bp, Artificial Sequence
  dgRNA
  Gpbp1
caggcgccgacgtag

SEQ ID NO: 31283 - DNA, 15 bp, Artificial Sequence
  dgRNA
  Gpbp1
aggcgccgacgtaga

SEQ ID NO: 31284 - DNA, 15 bp, Artificial Sequence
  dgRNA
  Gpbp1
cgccgacgtagaggg

SEQ ID NO: 31285 - DNA, 15 bp, Artificial Sequence
  dgRNA
  Zbtb7a
cccgccccgggcttc

SEQ ID NO: 31286 - DNA, 15 bp, Artificial Sequence
  dgRNA
  Zbtb7a
ccgccccgggcttcg

SEQ ID NO: 31287 - DNA, 15 bp, Artificial Sequence
  dgRNA
  Zbtb7a
cgccccgggcttcgg

SEQ ID NO: 31288 - DNA, 15 bp, Artificial Sequence
  dgRNA
  Zbtb7a
ccgccctgcgcgcac

SEQ ID NO: 31289 - DNA, 15 bp, Artificial Sequence
  dgRNA
  Mpnd
ttcgccaaattgcac

SEQ ID NO: 31290 - DNA, 15 bp, Artificial Sequence
  dgRNA
  Mpnd
tatcccctccgcccc

SEQ ID NO: 31291 - DNA, 15 bp, Artificial Sequence
  dgRNA
  Mpnd
cccctccgcccccgg

SEQ ID NO: 31292 - DNA, 15 bp, Artificial Sequence
  dgRNA
  Mpnd
ggaccttctcattca

SEQ ID NO: 31293 - DNA, 15 bp, Artificial Sequence
  dgRNA
  Maea
aacgtccatggcgtc

SEQ ID NO: 31294 - DNA, 15 bp, Artificial Sequence
  dgRNA
  Maea
ctaaatccgcatctg

SEQ ID NO: 31295 - DNA, 15 bp, Artificial Sequence
  dgRNA
  Maea
tgcggcctacgccag

SEQ ID NO: 31296 - DNA, 15 bp, Artificial Sequence
  dgRNA
  Maea
gcggacaattcaatg

SEQ ID NO: 31297 - DNA, 15 bp, Artificial Sequence
  dgRNA
  Msrb3
agggggctctgctac

SEQ ID NO: 31298 - DNA, 15 bp, Artificial Sequence
  dgRNA
  Msrb3
cgggttgcccacgcg

SEQ ID NO: 31299 - DNA, 15 bp, Artificial Sequence
  dgRNA
  Msrb3
agccctgttcccgca

SEQ ID NO: 31300 - DNA, 15 bp, Artificial Sequence
  dgRNA
  Msrb3
ctgttcccgcagggc

SEQ ID NO: 31301 - DNA, 15 bp, Artificial Sequence
  dgRNA
  Pitpna
ctaccaaaccagacc

SEQ ID NO: 31302 - DNA, 15 bp, Artificial Sequence
  dgRNA
  Pitpna
taccaaaccagacct

SEQ ID NO: 31303 - DNA, 15 bp, Artificial Sequence
  dgRNA
  Pitpna
atgctgacacggacc

SEQ ID NO: 31304 - DNA, 15 bp, Artificial Sequence
  dgRNA
  Pitpna
acggacccggagcca

SEQ ID NO: 31305 - DNA, 15 bp, Artificial Sequence
  dgRNA
  Ltbp1
taatctgccttgccc

SEQ ID NO: 31306 - DNA, 15 bp, Artificial Sequence
  dgRNA
  Ltbp1
actcgacttcaaatg

SEQ ID NO: 31307 - DNA, 15 bp, Artificial Sequence
  dgRNA
  Ltbp1
gatgtaatgcagagg

SEQ ID NO: 31308 - DNA, 15 bp, Artificial Sequence
  dgRNA
  Ltbp1
caacccccgacagac

SEQ ID NO: 31309 - DNA, 15 bp, Artificial Sequence
  dgRNA
  Kcnip3
gagctaagactcgga

SEQ ID NO: 31310 - DNA, 15 bp, Artificial Sequence
  dgRNA
  Kcnip3
tgcttagttaggctc

SEQ ID NO: 31311 - DNA, 15 bp, Artificial Sequence
  dgRNA
  Sema6b
ctgtagcatggggtt

SEQ ID NO: 31312 - DNA, 15 bp, Artificial Sequence
  dgRNA
  Sema6b
atggccgcagtgcag

SEQ ID NO: 31313 - DNA, 15 bp, Artificial Sequence
  dgRNA
  Sema6b
ggaatctggtgtcat

SEQ ID NO: 31314 - DNA, 15 bp, Artificial Sequence
  dgRNA
  Sema6b
gaatctggtgtcatg

SEQ ID NO: 31315 - DNA, 15 bp, Artificial Sequence
  dgRNA
  Ddx5
gaagcgagtaataaa

SEQ ID NO: 31316 - DNA, 15 bp, Artificial Sequence
  dgRNA
  Ddx5
aagcgagtaataaac

SEQ ID NO: 31317 - DNA, 15 bp, Artificial Sequence
  dgRNA
  Ddx5
gtaataaacgggcgc

SEQ ID NO: 31318 - DNA, 15 bp, Artificial Sequence
  dgRNA
  Ddx5
taataaacgggcgcc

SEQ ID NO: 31319 - DNA, 15 bp, Artificial Sequence
  dgRNA
  Gpr12
ttaataagtgtcact

SEQ ID NO: 31320 - DNA, 15 bp, Artificial Sequence
  dgRNA
  Gpr12
taataagtgtcactt

SEQ ID NO: 31321 - DNA, 15 bp, Artificial Sequence
  dgRNA
  Gpr12
ggtacttaaatgaat

SEQ ID NO: 31322 - DNA, 15 bp, Artificial Sequence
  dgRNA
  Gpr12
gtacttaaatgaatt

SEQ ID NO: 31323 - DNA, 15 bp, Artificial Sequence
  dgRNA
  Rer1
ggcctccggttgcca

SEQ ID NO: 31324 - DNA, 15 bp, Artificial Sequence
  dgRNA
  Rer1
gcctccggttgccat

SEQ ID NO: 31325 - DNA, 15 bp, Artificial Sequence
  dgRNA
  Rer1
cctccggttgccatg

SEQ ID NO: 31326 - DNA, 15 bp, Artificial Sequence
  dgRNA
  Rer1
ggttgccatggggcg

SEQ ID NO: 31327 - DNA, 15 bp, Artificial Sequence
  dgRNA
  Doxl2
catgtgtagcccttg

SEQ ID NO: 31328 - DNA, 15 bp, Artificial Sequence
  dgRNA
  Doxl2
gttataacaccaaaa

SEQ ID NO: 31329 - DNA, 15 bp, Artificial Sequence
  dgRNA
  Doxl2
taaaaggttttaccc

SEQ ID NO: 31330 - DNA, 15 bp, Artificial Sequence
  dgRNA
  Doxl2
aaggttttaccctgg

SEQ ID NO: 31331 - DNA, 15 bp, Artificial Sequence
  dgRNA
  Tktl1
agataaacttgtgac

SEQ ID NO: 31332 - DNA, 15 bp, Artificial Sequence
  dgRNA
  Tktl1
gataaacttgtgact

SEQ ID NO: 31333 - DNA, 15 bp, Artificial Sequence
  dgRNA
  Tktl1
gcgcatgtgcaagcg

SEQ ID NO: 31334 - DNA, 15 bp, Artificial Sequence
  dgRNA
  Tktl1
catgtgcaagcgcgg

SEQ ID NO: 31335 - DNA, 15 bp, Artificial Sequence
  dgRNA
  Olfr195
taactcagaattgac

SEQ ID NO: 31336 - DNA, 15 bp, Artificial Sequence
  dgRNA
  Tram1
cgacctccagcccac

SEQ ID NO: 31337 - DNA, 15 bp, Artificial Sequence
  dgRNA
  Tram1
gcgctgtgggccacc

SEQ ID NO: 31338 - DNA, 15 bp, Artificial Sequence
  dgRNA
  Tram1
caccaggtgcggcca

SEQ ID NO: 31339 - DNA, 15 bp, Artificial Sequence
  dgRNA
  Tram1
cacggcgcgagcgcg

SEQ ID NO: 31340 - DNA, 15 bp, Artificial Sequence
  dgRNA
  Kif6
tcccacggacatgcg

SEQ ID NO: 31341 - DNA, 15 bp, Artificial Sequence
  dgRNA
  Kif6
gcggcgatccctgct

SEQ ID NO: 31342 - DNA, 15 bp, Artificial Sequence
  dgRNA
  Kif6
agtccacgaccaatt

SEQ ID NO: 31343 - DNA, 15 bp, Artificial Sequence
  dgRNA
  Kif6
gtccacgaccaatta

SEQ ID NO: 31344 - DNA, 15 bp, Artificial Sequence
  dgRNA
  4930564D02Rik
gtaaaccacttctga

SEQ ID NO: 31345 - DNA, 15 bp, Artificial Sequence
  dgRNA
  4930564D02Rik
cccaccctacggcac

SEQ ID NO: 31346 - DNA, 15 bp, Artificial Sequence
  dgRNA
  4930564D02Rik
actggtttccgacgt

SEQ ID NO: 31347 - DNA, 15 bp, Artificial Sequence
  dgRNA
  4930564D02Rik
gatcgtgggaaagtt

SEQ ID NO: 31348 - DNA, 15 bp, Artificial Sequence
  dgRNA
  Xrcc6bp1
acactgcctttaatt

SEQ ID NO: 31349 - DNA, 15 bp, Artificial Sequence
  dgRNA
  Xrcc6bp1
ttaattcggtgtgag

SEQ ID NO: 31350 - DNA, 15 bp, Artificial Sequence
  dgRNA
  Xrcc6bp1
taattcggtgtgagt

SEQ ID NO: 31351 - DNA, 15 bp, Artificial Sequence
  dgRNA
  Xrcc6bp1
tatagtggccagcat

SEQ ID NO: 31352 - DNA, 15 bp, Artificial Sequence
  dgRNA
  Klhl26
ccccgcctacctctt

SEQ ID NO: 31353 - DNA, 15 bp, Artificial Sequence
  dgRNA
  Klhl26
ggcccctggtctttc

SEQ ID NO: 31354 - DNA, 15 bp, Artificial Sequence
  dgRNA
  Klhl26
cgacctgctctcctc

SEQ ID NO: 31355 - DNA, 15 bp, Artificial Sequence
  dgRNA
  Klhl26
tccgcccgctgcccc

SEQ ID NO: 31356 - DNA, 15 bp, Artificial Sequence
  dgRNA
  Dusp6
gcactggggcttatc

SEQ ID NO: 31357 - DNA, 15 bp, Artificial Sequence
  dgRNA
  Dusp6
ggggcttatccggag

SEQ ID NO: 31358 - DNA, 15 bp, Artificial Sequence
  dgRNA
  Dusp6
gccggcccgtcccca

SEQ ID NO: 31359 - DNA, 15 bp, Artificial Sequence
  dgRNA
  Dusp6
ccgcagcgcgctcat

SEQ ID NO: 31360 - DNA, 15 bp, Artificial Sequence
  dgRNA
  Bud31
ggaatccgcgttccc

SEQ ID NO: 31361 - DNA, 15 bp, Artificial Sequence
  dgRNA
  Bud31
cggtgtccctgtccg

SEQ ID NO: 31362 - DNA, 15 bp, Artificial Sequence
  dgRNA
  Bud31
agacacgtagccgtg

SEQ ID NO: 31363 - DNA, 15 bp, Artificial Sequence
  dgRNA
  Bud31
gacacgtagccgtgt

SEQ ID NO: 31364 - DNA, 15 bp, Artificial Sequence
  dgRNA
  Spsb1
ctaagcgggaaagtg

SEQ ID NO: 31365 - DNA, 15 bp, Artificial Sequence
  dgRNA
  Spsb1
agcgggaaagtgcgg

SEQ ID NO: 31366 - DNA, 15 bp, Artificial Sequence
  dgRNA
  Spsb1
gcgggaaagtgcgga

SEQ ID NO: 31367 - DNA, 15 bp, Artificial Sequence
  dgRNA
  Spsb1
cgggaaagtgcggag

SEQ ID NO: 31368 - DNA, 15 bp, Artificial Sequence
  dgRNA
  Sgsm1
gcgtatttagaaacg

SEQ ID NO: 31369 - DNA, 15 bp, Artificial Sequence
  dgRNA
  Sapcd1
ctagctaggctacac

SEQ ID NO: 31370 - DNA, 15 bp, Artificial Sequence
  dgRNA
  Sapcd1
tagctaggctacaca

SEQ ID NO: 31371 - DNA, 15 bp, Artificial Sequence
  dgRNA
  Sapcd1
ccttgggactcaatg

SEQ ID NO: 31372 - DNA, 15 bp, Artificial Sequence
  dgRNA
  Sapcd1
cctcattgagtccca

SEQ ID NO: 31373 - DNA, 15 bp, Artificial Sequence
  dgRNA
  Bfsp2
atgatccattcccac

SEQ ID NO: 31374 - DNA, 15 bp, Artificial Sequence
  dgRNA
  Bfsp2
aaaagtctggacggc

SEQ ID NO: 31375 - DNA, 15 bp, Artificial Sequence
  dgRNA
  Bfsp2
aaagtctggacggct

SEQ ID NO: 31376 - DNA, 15 bp, Artificial Sequence
  dgRNA
  Bfsp2
aatccttatgcagcc

SEQ ID NO: 31377 - DNA, 15 bp, Artificial Sequence
  dgRNA
  Thoc2
ccgccacctctttgt

SEQ ID NO: 31378 - DNA, 15 bp, Artificial Sequence
  dgRNA
  Thoc2
acctctttgtcggcc

SEQ ID NO: 31379 - DNA, 15 bp, Artificial Sequence
  dgRNA
  Thoc2
cccaggacttccgtt

SEQ ID NO: 31380 - DNA, 15 bp, Artificial Sequence
  dgRNA
  Thoc2
aggacttccgtttgg

SEQ ID NO: 31381 - DNA, 15 bp, Artificial Sequence
  dgRNA
  Cuzd1
ttgagcttcagatcc

SEQ ID NO: 31382 - DNA, 15 bp, Artificial Sequence
  dgRNA
  Cuzd1
tgacccaaggggtag

SEQ ID NO: 31383 - DNA, 15 bp, Artificial Sequence
  dgRNA
  Cuzd1
gctgacccaaggggt

SEQ ID NO: 31384 - DNA, 15 bp, Artificial Sequence
  dgRNA
  Cuzd1
tcagatgcctacagg

SEQ ID NO: 31385 - DNA, 15 bp, Artificial Sequence
  dgRNA
  Abhd14a
cggaaattgatgaac

SEQ ID NO: 31386 - DNA, 15 bp, Artificial Sequence
  dgRNA
  Abhd14a
cgggtgactttccac

SEQ ID NO: 31387 - DNA, 15 bp, Artificial Sequence
  dgRNA
  Abhd14a
acaattcctaaaatc

SEQ ID NO: 31388 - DNA, 15 bp, Artificial Sequence
  dgRNA
  Abhd14a
caattcctaaaatct

SEQ ID NO: 31389 - DNA, 15 bp, Artificial Sequence
  dgRNA
  Rap1a
taaccaccttctcaa

SEQ ID NO: 31390 - DNA, 15 bp, Artificial Sequence
  dgRNA
  Rap1a
agattccggacacag

SEQ ID NO: 31391 - DNA, 15 bp, Artificial Sequence
  dgRNA
  Rap1a
gattccggacacagc

SEQ ID NO: 31392 - DNA, 15 bp, Artificial Sequence
  dgRNA
  Rap1a
attccggacacagcg

SEQ ID NO: 31393 - DNA, 15 bp, Artificial Sequence
  dgRNA
  Olfr290
attatcgcatagcgt

SEQ ID NO: 31394 - DNA, 15 bp, Artificial Sequence
  dgRNA
  Prrt3
gcctgagcatctcgg

SEQ ID NO: 31395 - DNA, 15 bp, Artificial Sequence
  dgRNA
  Prrt3
cggaggatgcgcctc

SEQ ID NO: 31396 - DNA, 15 bp, Artificial Sequence
  dgRNA
  Prrt3
ggaggatgcgcctcc

SEQ ID NO: 31397 - DNA, 15 bp, Artificial Sequence
  dgRNA
  Prrt3
atgcgcctccgggag

SEQ ID NO: 31398 - DNA, 15 bp, Artificial Sequence
  dgRNA
  Hrg
cacaataagtgcttt

SEQ ID NO: 31399 - DNA, 15 bp, Artificial Sequence
  dgRNA
  Hrg
tgggtaactgattca

SEQ ID NO: 31400 - DNA, 15 bp, Artificial Sequence
  dgRNA
  Hrg
tatgctatatctggt

SEQ ID NO: 31401 - DNA, 15 bp, Artificial Sequence
  dgRNA
  Hrg
atatgctatatctgg

SEQ ID NO: 31402 - DNA, 15 bp, Artificial Sequence
  dgRNA
  Myo3a
actctggtgaatatt

SEQ ID NO: 31403 - DNA, 15 bp, Artificial Sequence
  dgRNA
  Myo3a
cctctaatcaaatgt

SEQ ID NO: 31404 - DNA, 15 bp, Artificial Sequence
  dgRNA
  Myo3a
ctaatcaaatgtagg

SEQ ID NO: 31405 - DNA, 15 bp, Artificial Sequence
  dgRNA
  Myo3a
catgcatacgttggt

SEQ ID NO: 31406 - DNA, 15 bp, Artificial Sequence
  dgRNA
  Rsph14
tttgcgcctgcgcct

SEQ ID NO: 31407 - DNA, 15 bp, Artificial Sequence
  dgRNA
  Rsph14
agcaaccaggtcgcc

SEQ ID NO: 31408 - DNA, 15 bp, Artificial Sequence
  dgRNA
  Rsph14
caggtcgcctggtaa

SEQ ID NO: 31409 - DNA, 15 bp, Artificial Sequence
  dgRNA
  Rsph14
aggtcgcctggtaat

SEQ ID NO: 31410 - DNA, 15 bp, Artificial Sequence
  dgRNA
  Ppil3
gctgtatgaagttgc

SEQ ID NO: 31411 - DNA, 15 bp, Artificial Sequence
  dgRNA
  Ppil3
ctgtatgaagttgct

SEQ ID NO: 31412 - DNA, 15 bp, Artificial Sequence
  dgRNA
  Ppil3
gttgctgggcgacag

SEQ ID NO: 31413 - DNA, 15 bp, Artificial Sequence
  dgRNA
  Ppil3
tacagcggcctggag

SEQ ID NO: 31414 - DNA, 15 bp, Artificial Sequence
  dgRNA
  Copb1
gacaacacacttcca

SEQ ID NO: 31415 - DNA, 15 bp, Artificial Sequence
  dgRNA
  Copb1
tccagggcgcagctc

SEQ ID NO: 31416 - DNA, 15 bp, Artificial Sequence
  dgRNA
  Copb1
tctgggtctccgtac

SEQ ID NO: 31417 - DNA, 15 bp, Artificial Sequence
  dgRNA
  Copb1
cgtcagccaaggact

SEQ ID NO: 31418 - DNA, 15 bp, Artificial Sequence
  dgRNA
  Eif1ad
ctcgacttccgcttc

SEQ ID NO: 31419 - DNA, 15 bp, Artificial Sequence
  dgRNA
  Eif1ad
tcgacttccgcttcc

SEQ ID NO: 31420 - DNA, 15 bp, Artificial Sequence
  dgRNA
  Eif1ad
actaatccccaaact

SEQ ID NO: 31421 - DNA, 15 bp, Artificial Sequence
  dgRNA
  Eif1ad
gcaggtctagctacc

SEQ ID NO: 31422 - DNA, 15 bp, Artificial Sequence
  dgRNA
  Il4
ttggtctgatttcac

SEQ ID NO: 31423 - DNA, 15 bp, Artificial Sequence
  dgRNA
  Il4
gaataactgacaatc

SEQ ID NO: 31424 - DNA, 15 bp, Artificial Sequence
  dgRNA
  Il4
gattgtcagttattc

SEQ ID NO: 31425 - DNA, 15 bp, Artificial Sequence
  dgRNA
  Spon1
gacccaagctggaac

SEQ ID NO: 31426 - DNA, 15 bp, Artificial Sequence
  dgRNA
  Spon1
tggaactggataccg

SEQ ID NO: 31427 - DNA, 15 bp, Artificial Sequence
  dgRNA
  Spon1
aggaagcagcctcgt

SEQ ID NO: 31428 - DNA, 15 bp, Artificial Sequence
  dgRNA
  Spon1
aagcagcctcgttgg

SEQ ID NO: 31429 - DNA, 15 bp, Artificial Sequence
  dgRNA
  1600012H06Rik
ccgccatccgggagc

SEQ ID NO: 31430 - DNA, 15 bp, Artificial Sequence
  dgRNA
  1600012H06Rik
ccagtcatcccctca

SEQ ID NO: 31431 - DNA, 15 bp, Artificial Sequence
  dgRNA
  1600012H06Rik
cagtcatcccctcaa

SEQ ID NO: 31432 - DNA, 15 bp, Artificial Sequence
  dgRNA
  1600012H06Rik
ccagccgcgtcgcta

SEQ ID NO: 31433 - DNA, 15 bp, Artificial Sequence
  dgRNA
  Prkar1a
atcccttcgagatgc

SEQ ID NO: 31434 - DNA, 15 bp, Artificial Sequence
  dgRNA
  Prkar1a
gattaagttcctcac

SEQ ID NO: 31435 - DNA, 15 bp, Artificial Sequence
  dgRNA
  Prkar1a
tcttcagaacacgac

SEQ ID NO: 31436 - DNA, 15 bp, Artificial Sequence
  dgRNA
  Prkar1a
cttcagaacacgacc

SEQ ID NO: 31437 - DNA, 15 bp, Artificial Sequence
  dgRNA
  Fam221a
cttggccaaggggcg

SEQ ID NO: 31438 - DNA, 15 bp, Artificial Sequence
  dgRNA
  Fam221a
aaggggcgtggcaca

SEQ ID NO: 31439 - DNA, 15 bp, Artificial Sequence
  dgRNA
  Fam221a
gaggggcgctaggac

SEQ ID NO: 31440 - DNA, 15 bp, Artificial Sequence
  dgRNA
  Fam221a
ggcgctaggacaggc

SEQ ID NO: 31441 - DNA, 15 bp, Artificial Sequence
  dgRNA
  Nek6
tggcggccgcgcgca

SEQ ID NO: 31442 - DNA, 15 bp, Artificial Sequence
  dgRNA
  Nek6
ggcggccgcgcgcac

SEQ ID NO: 31443 - DNA, 15 bp, Artificial Sequence
  dgRNA
  Nek6
cgcgcgcacgggcgc

SEQ ID NO: 31444 - DNA, 15 bp, Artificial Sequence
  dgRNA
  Nek6
gcgcgcacgggcgca

SEQ ID NO: 31445 - DNA, 15 bp, Artificial Sequence
  dgRNA
  Lancl2
cccagtggtgatgaa

SEQ ID NO: 31446 - DNA, 15 bp, Artificial Sequence
  dgRNA
  Lancl2
ccagtggtgatgaat

SEQ ID NO: 31447 - DNA, 15 bp, Artificial Sequence
  dgRNA
  Lancl2
cccacccccttcggg

SEQ ID NO: 31448 - DNA, 15 bp, Artificial Sequence
  dgRNA
  Lancl2
gattggcgcacgacc

SEQ ID NO: 31449 - DNA, 15 bp, Artificial Sequence
  dgRNA
  Pparg
atggacatcggtctg

SEQ ID NO: 31450 - DNA, 15 bp, Artificial Sequence
  dgRNA
  Pparg
tcggtctgagggaca

SEQ ID NO: 31451 - DNA, 15 bp, Artificial Sequence
  dgRNA
  Pparg
cggtctgagggacac

SEQ ID NO: 31452 - DNA, 15 bp, Artificial Sequence
  dgRNA
  Pparg
gacacgggaccttcc

SEQ ID NO: 31453 - DNA, 15 bp, Artificial Sequence
  dgRNA
  Bckdk
gcttattttatacag

SEQ ID NO: 31454 - DNA, 15 bp, Artificial Sequence
  dgRNA
  Bckdk
aactactgataactt

SEQ ID NO: 31455 - DNA, 15 bp, Artificial Sequence
  dgRNA
  Bckdk
atgctactcatttga

SEQ ID NO: 31456 - DNA, 15 bp, Artificial Sequence
  dgRNA
  Bckdk
ggcttaagggagaac

SEQ ID NO: 31457 - DNA, 15 bp, Artificial Sequence
  dgRNA
  Ubl4a
acttggtccaccagc

SEQ ID NO: 31458 - DNA, 15 bp, Artificial Sequence
  dgRNA
  Ubl4a
ggtccaccagcaggg

SEQ ID NO: 31459 - DNA, 15 bp, Artificial Sequence
  dgRNA
  Ubl4a
ggtgggaattagcac

SEQ ID NO: 31460 - DNA, 15 bp, Artificial Sequence
  dgRNA
  Ubl4a
caagcctggccccac

SEQ ID NO: 31461 - DNA, 15 bp, Artificial Sequence
  dgRNA
  Fam184b
cccatctactactac

SEQ ID NO: 31462 - DNA, 15 bp, Artificial Sequence
  dgRNA
  Fam184b
atttgccgatctgct

SEQ ID NO: 31463 - DNA, 15 bp, Artificial Sequence
  dgRNA
  Fam184b
tttgccgatctgcta

SEQ ID NO: 31464 - DNA, 15 bp, Artificial Sequence
  dgRNA
  Fam184b
tgagctatccacctc

SEQ ID NO: 31465 - DNA, 15 bp, Artificial Sequence
  dgRNA
  H1fnt
ttatgacgattacac

SEQ ID NO: 31466 - DNA, 15 bp, Artificial Sequence
  dgRNA
  H1fnt
ttattacatacttgc

SEQ ID NO: 31467 - DNA, 15 bp, Artificial Sequence
  dgRNA
  H1fnt
taatcgtcataacca

SEQ ID NO: 31468 - DNA, 15 bp, Artificial Sequence
  dgRNA
  H1fnt
tgcgtcctggtggaa

SEQ ID NO: 31469 - DNA, 15 bp, Artificial Sequence
  dgRNA
  Dynll2
gcggtccgtgtcatt

SEQ ID NO: 31470 - DNA, 15 bp, Artificial Sequence
  dgRNA
  Dynll2
gtccgtgtcatttgg

SEQ ID NO: 31471 - DNA, 15 bp, Artificial Sequence
  dgRNA
  Dynll2
ttttgtcgcaagacc

SEQ ID NO: 31472 - DNA, 15 bp, Artificial Sequence
  dgRNA
  Dynll2
tttgtcgcaagacca

SEQ ID NO: 31473 - DNA, 15 bp, Artificial Sequence
  dgRNA
  Cdk6
ggcggcgcggcgact

SEQ ID NO: 31474 - DNA, 15 bp, Artificial Sequence
  dgRNA
  Cdk6
cgcggcgactcggct

SEQ ID NO: 31475 - DNA, 15 bp, Artificial Sequence
  dgRNA
  Cdk6
ggcgactcggctagg

SEQ ID NO: 31476 - DNA, 15 bp, Artificial Sequence
  dgRNA
  Cdk6
ggcggagtttcgcag

SEQ ID NO: 31477 - DNA, 15 bp, Artificial Sequence
  dgRNA
  Tekt3
gatcccaaaggtagc

SEQ ID NO: 31478 - DNA, 15 bp, Artificial Sequence
  dgRNA
  Tekt3
gtagctggtgcgcct

SEQ ID NO: 31479 - DNA, 15 bp, Artificial Sequence
  dgRNA
  Tekt3
tggtgcgccttggaa

SEQ ID NO: 31480 - DNA, 15 bp, Artificial Sequence
  dgRNA
  Tekt3
cgccttggaatggat

SEQ ID NO: 31481 - DNA, 15 bp, Artificial Sequence
  dgRNA
  Guf1
tgcgacacccgactc

SEQ ID NO: 31482 - DNA, 15 bp, Artificial Sequence
  dgRNA
  Guf1
cggtcgcctagactg

SEQ ID NO: 31483 - DNA, 15 bp, Artificial Sequence
  dgRNA
  Guf1
ggacacgcgcttgac

SEQ ID NO: 31484 - DNA, 15 bp, Artificial Sequence
  dgRNA
  Guf1
cggcagtatcacccg

SEQ ID NO: 31485 - DNA, 15 bp, Artificial Sequence
  dgRNA
  Rbpms
gcgcccctcctctcg

SEQ ID NO: 31486 - DNA, 15 bp, Artificial Sequence
  dgRNA
  Rbpms
cgcccctcctctcgc

SEQ ID NO: 31487 - DNA, 15 bp, Artificial Sequence
  dgRNA
  Rbpms
gcccctcctctcgcg

SEQ ID NO: 31488 - DNA, 15 bp, Artificial Sequence
  dgRNA
  Rbpms
cccctcctctcgcgg

SEQ ID NO: 31489 - DNA, 15 bp, Artificial Sequence
  dgRNA
  Reep6
tcctcgctgccgccc

SEQ ID NO: 31490 - DNA, 15 bp, Artificial Sequence
  dgRNA
  Reep6
agagggccatgcggc

SEQ ID NO: 31491 - DNA, 15 bp, Artificial Sequence
  dgRNA
  Reep6
gagggccatgcggcc

SEQ ID NO: 31492 - DNA, 15 bp, Artificial Sequence
  dgRNA
  Reep6
agggccatgcggccg

SEQ ID NO: 31493 - DNA, 15 bp, Artificial Sequence
  dgRNA
  Zfp784
agtcagcccatgcgg

SEQ ID NO: 31494 - DNA, 15 bp, Artificial Sequence
  dgRNA
  Zfp784
atgcggaggaccgac

SEQ ID NO: 31495 - DNA, 15 bp, Artificial Sequence
  dgRNA
  Zfp784
ctatcctaccccgcc

SEQ ID NO: 31496 - DNA, 15 bp, Artificial Sequence
  dgRNA
  Zfp784
tatcctaccccgcca

SEQ ID NO: 31497 - DNA, 15 bp, Artificial Sequence
  dgRNA
  Akirin1
aggcccctgccgcgc

SEQ ID NO: 31498 - DNA, 15 bp, Artificial Sequence
  dgRNA
  Akirin1
tgcgaaagacctccc

SEQ ID NO: 31499 - DNA, 15 bp, Artificial Sequence
  dgRNA
  Akirin1
cggcagagagcgtga

SEQ ID NO: 31500 - DNA, 15 bp, Artificial Sequence
  dgRNA
  Akirin1
ggcagagagcgtgaa

SEQ ID NO: 31501 - DNA, 15 bp, Artificial Sequence
  dgRNA
  2310011J03Rik
caccacacgcggtga

SEQ ID NO: 31502 - DNA, 15 bp, Artificial Sequence
  dgRNA
  2310011J03Rik
cacacgcggtgaagg

SEQ ID NO: 31503 - DNA, 15 bp, Artificial Sequence
  dgRNA
  2310011J03Rik
acacgcggtgaagga

SEQ ID NO: 31504 - DNA, 15 bp, Artificial Sequence
  dgRNA
  2310011J03Rik
tactggatagcaact

SEQ ID NO: 31505 - DNA, 15 bp, Artificial Sequence
  dgRNA
  A4galt
cggaaggtttagaat

SEQ ID NO: 31506 - DNA, 15 bp, Artificial Sequence
  dgRNA
  A4galt
ggattgtgactagtg

SEQ ID NO: 31507 - DNA, 15 bp, Artificial Sequence
  dgRNA
  A4galt
tgactagtgaggtgt

SEQ ID NO: 31508 - DNA, 15 bp, Artificial Sequence
  dgRNA
  A4galt
acacctgttggctac

SEQ ID NO: 31509 - DNA, 15 bp, Artificial Sequence
  dgRNA
  Snph
tgagcaacagctagt

SEQ ID NO: 31510 - DNA, 15 bp, Artificial Sequence
  dgRNA
  Snph
gcaacagctagttgg

SEQ ID NO: 31511 - DNA, 15 bp, Artificial Sequence
  dgRNA
  Snph
actatctctttaaga

SEQ ID NO: 31512 - DNA, 15 bp, Artificial Sequence
  dgRNA
  Snph
cggcgagctgccgac

SEQ ID NO: 31513 - DNA, 15 bp, Artificial Sequence
  dgRNA
  Ap2m1
cacgtgttgcttgca

SEQ ID NO: 31514 - DNA, 15 bp, Artificial Sequence
  dgRNA
  Ap2m1
gttttgttgagccta

SEQ ID NO: 31515 - DNA, 15 bp, Artificial Sequence
  dgRNA
  Ap2m1
agcttgaaagctgcg

SEQ ID NO: 31516 - DNA, 15 bp, Artificial Sequence
  dgRNA
  Ap2m1
gctgcggggactgac

SEQ ID NO: 31517 - DNA, 15 bp, Artificial Sequence
  dgRNA
  Crtc2
ccctttcccgttcgt

SEQ ID NO: 31518 - DNA, 15 bp, Artificial Sequence
  dgRNA
  Crtc2
tcccgttcgtaggct

SEQ ID NO: 31519 - DNA, 15 bp, Artificial Sequence
  dgRNA
  Crtc2
cccgttcgtaggctc

SEQ ID NO: 31520 - DNA, 15 bp, Artificial Sequence
  dgRNA
  Crtc2
cggcttgctgtgcgc

SEQ ID NO: 31521 - DNA, 15 bp, Artificial Sequence
  dgRNA
  Ttc39a
aagagggctaggtgt

SEQ ID NO: 31522 - DNA, 15 bp, Artificial Sequence
  dgRNA
  Ttc39a
ggtgacgagtctaga

SEQ ID NO: 31523 - DNA, 15 bp, Artificial Sequence
  dgRNA
  Ttc39a
tcgtcaccttcctga

SEQ ID NO: 31524 - DNA, 15 bp, Artificial Sequence
  dgRNA
  Ttc39a
tgtcacaatgggcca

SEQ ID NO: 31525 - DNA, 15 bp, Artificial Sequence
  dgRNA
  Snx16
tagtaataaagcctg

SEQ ID NO: 31526 - DNA, 15 bp, Artificial Sequence
  dgRNA
  Snx16
cagtgtgggcctccg

SEQ ID NO: 31527 - DNA, 15 bp, Artificial Sequence
  dgRNA
  Snx16
agtgtgggcctccgg

SEQ ID NO: 31528 - DNA, 15 bp, Artificial Sequence
  dgRNA
  Snx16
gtgggcctccggggg

SEQ ID NO: 31529 - DNA, 15 bp, Artificial Sequence
  dgRNA
  Crhr2
agatcgccagcactg

SEQ ID NO: 31530 - DNA, 15 bp, Artificial Sequence
  dgRNA
  Crhr2
attctagggacttgt

SEQ ID NO: 31531 - DNA, 15 bp, Artificial Sequence
  dgRNA
  Crhr2
acttgtcgggtccag

SEQ ID NO: 31532 - DNA, 15 bp, Artificial Sequence
  dgRNA
  Crhr2
cttgtcgggtccaga

SEQ ID NO: 31533 - DNA, 15 bp, Artificial Sequence
  dgRNA
  Rag1
ggctatcatcatctg

SEQ ID NO: 31534 - DNA, 15 bp, Artificial Sequence
  dgRNA
  Rag1
gtggttagccgtctg

SEQ ID NO: 31535 - DNA, 15 bp, Artificial Sequence
  dgRNA
  Rag1
agccgtctgtggtgt

SEQ ID NO: 31536 - DNA, 15 bp, Artificial Sequence
  dgRNA
  Rag1
cagcattgtgcacta

SEQ ID NO: 31537 - DNA, 15 bp, Artificial Sequence
  dgRNA
  Ctsw
taccccagaatagtt

SEQ ID NO: 31538 - DNA, 15 bp, Artificial Sequence
  dgRNA
  Ctsw
ctggtttccccctcg

SEQ ID NO: 31539 - DNA, 15 bp, Artificial Sequence
  dgRNA
  Ctsw
ctccaaactattctg

SEQ ID NO: 31540 - DNA, 15 bp, Artificial Sequence
  dgRNA
  Ctsw
gctccaaactattct

SEQ ID NO: 31541 - DNA, 15 bp, Artificial Sequence
  dgRNA
  Pigr
aggatctacgcatga

SEQ ID NO: 31542 - DNA, 15 bp, Artificial Sequence
  dgRNA
  Pigr
ggcagtcacgtgatc

SEQ ID NO: 31543 - DNA, 15 bp, Artificial Sequence
  dgRNA
  Pigr
gtcacgtgatctggc

SEQ ID NO: 31544 - DNA, 15 bp, Artificial Sequence
  dgRNA
  Pigr
tggctaccttgacta

SEQ ID NO: 31545 - DNA, 15 bp, Artificial Sequence
  dgRNA
  Oosp3
ttaatggtatgttaa

SEQ ID NO: 31546 - DNA, 15 bp, Artificial Sequence
  dgRNA
  Oosp3
gtataaaaacacttc

SEQ ID NO: 31547 - DNA, 15 bp, Artificial Sequence
  dgRNA
  Oosp3
caatgaacccaattc

SEQ ID NO: 31548 - DNA, 15 bp, Artificial Sequence
  dgRNA
  Smg7
ccccccctccggagc

SEQ ID NO: 31549 - DNA, 15 bp, Artificial Sequence
  dgRNA
  Smg7
gtccctgcgccccac

SEQ ID NO: 31550 - DNA, 15 bp, Artificial Sequence
  dgRNA
  Smg7
accccgcgccaagcg

SEQ ID NO: 31551 - DNA, 15 bp, Artificial Sequence
  dgRNA
  Smg7
ccgcgccaagcgagg

SEQ ID NO: 31552 - DNA, 15 bp, Artificial Sequence
  dgRNA
  Cdkn1c
ggaggcccgcgcgcg

SEQ ID NO: 31553 - DNA, 15 bp, Artificial Sequence
  dgRNA
  Cdkn1c
gaggcccgcgcgcgc

SEQ ID NO: 31554 - DNA, 15 bp, Artificial Sequence
  dgRNA
  Cdkn1c
aggcccgcgcgcgcg

SEQ ID NO: 31555 - DNA, 15 bp, Artificial Sequence
  dgRNA
  Cdkn1c
ggccagcgcgtataa

SEQ ID NO: 31556 - DNA, 15 bp, Artificial Sequence
  dgRNA
  Cd164l2
aatcgcacagcagag

SEQ ID NO: 31557 - DNA, 15 bp, Artificial Sequence
  dgRNA
  Cd164l2
atcgcacagcagagc

SEQ ID NO: 31558 - DNA, 15 bp, Artificial Sequence
  dgRNA
  Cd164l2
tcgcacagcagagcg

SEQ ID NO: 31559 - DNA, 15 bp, Artificial Sequence
  dgRNA
  Cd164l2
ggggcctgaacaaaa

SEQ ID NO: 31560 - DNA, 15 bp, Artificial Sequence
  dgRNA
  Ddx19b
tggagaaggcatcta

SEQ ID NO: 31561 - DNA, 15 bp, Artificial Sequence
  dgRNA
  Ddx19b
ggagaaggcatctat

SEQ ID NO: 31562 - DNA, 15 bp, Artificial Sequence
  dgRNA
  Ddx19b
gcatctatgggtctt

SEQ ID NO: 31563 - DNA, 15 bp, Artificial Sequence
  dgRNA
  Ddx19b
cctcttatgattggc

SEQ ID NO: 31564 - DNA, 15 bp, Artificial Sequence
  dgRNA
  Zfp68
cctacagctgtgcgt

SEQ ID NO: 31565 - DNA, 15 bp, Artificial Sequence
  dgRNA
  Zfp68
tctactgtcactcaa

SEQ ID NO: 31566 - DNA, 15 bp, Artificial Sequence
  dgRNA
  Zfp68
ggagccctgtccaat

SEQ ID NO: 31567 - DNA, 15 bp, Artificial Sequence
  dgRNA
  Zfp68
gccctgtccaatcgg

SEQ ID NO: 31568 - DNA, 15 bp, Artificial Sequence
  dgRNA
  Ifit1
cctcatcgatttcag

SEQ ID NO: 31569 - DNA, 15 bp, Artificial Sequence
  dgRNA
  Ifit1
cacagtgcgtctccc

SEQ ID NO: 31570 - DNA, 15 bp, Artificial Sequence
  dgRNA
  Ifit1
cggatacagacatgt

SEQ ID NO: 31571 - DNA, 15 bp, Artificial Sequence
  dgRNA
  Ifit1
gggagacgcactgtg

SEQ ID NO: 31572 - DNA, 15 bp, Artificial Sequence
  dgRNA
  Zfp865
gaacaaactaatcgg

SEQ ID NO: 31573 - DNA, 15 bp, Artificial Sequence
  dgRNA
  Zfp865
cggaggtgcagaaaa

SEQ ID NO: 31574 - DNA, 15 bp, Artificial Sequence
  dgRNA
  Zfp865
aaaaaggaatccgac

SEQ ID NO: 31575 - DNA, 15 bp, Artificial Sequence
  dgRNA
  Zfp865
ccgaccggcctataa

SEQ ID NO: 31576 - DNA, 15 bp, Artificial Sequence
  dgRNA
  Yipf3
gccactcgctgtaaa

SEQ ID NO: 31577 - DNA, 15 bp, Artificial Sequence
  dgRNA
  Yipf3
actcgctgtaaaagg

SEQ ID NO: 31578 - DNA, 15 bp, Artificial Sequence
  dgRNA
  Yipf3
ctccgcagcaacgct

SEQ ID NO: 31579 - DNA, 15 bp, Artificial Sequence
  dgRNA
  Yipf3
tccgcagcaacgctc

SEQ ID NO: 31580 - DNA, 15 bp, Artificial Sequence
  dgRNA
  Adora2b
tccctctcccgcccg

SEQ ID NO: 31581 - DNA, 15 bp, Artificial Sequence
  dgRNA
  Adora2b
ccctctcccgcccga

SEQ ID NO: 31582 - DNA, 15 bp, Artificial Sequence
  dgRNA
  Adora2b
cgcccgagggaaatt

SEQ ID NO: 31583 - DNA, 15 bp, Artificial Sequence
  dgRNA
  Adora2b
gcccgagggaaattc

SEQ ID NO: 31584 - DNA, 15 bp, Artificial Sequence
  dgRNA
  Crispld2
tttatggtcacggct

SEQ ID NO: 31585 - DNA, 15 bp, Artificial Sequence
  dgRNA
  Crispld2
ttatggtcacggcta

SEQ ID NO: 31586 - DNA, 15 bp, Artificial Sequence
  dgRNA
  Crispld2
tatggtcacggctag

SEQ ID NO: 31587 - DNA, 15 bp, Artificial Sequence
  dgRNA
  Crispld2
gctccttgcgcatcg

SEQ ID NO: 31588 - DNA, 15 bp, Artificial Sequence
  dgRNA
  Hnrnpab
gcgcgttctaaaatg

SEQ ID NO: 31589 - DNA, 15 bp, Artificial Sequence
  dgRNA
  Hnrnpab
aggacaaagcccgcc

SEQ ID NO: 31590 - DNA, 15 bp, Artificial Sequence
  dgRNA
  Hnrnpab
gtatccgttgttacg

SEQ ID NO: 31591 - DNA, 15 bp, Artificial Sequence
  dgRNA
  Hnrnpab
tccgttgttacgagg

SEQ ID NO: 31592 - DNA, 15 bp, Artificial Sequence
  dgRNA
  Sec16a
gaagcagtgcaaaac

SEQ ID NO: 31593 - DNA, 15 bp, Artificial Sequence
  dgRNA
  Sec16a
cagtgcaaaactgga

SEQ ID NO: 31594 - DNA, 15 bp, Artificial Sequence
  dgRNA
  Sec16a
agtgcaaaactggac

SEQ ID NO: 31595 - DNA, 15 bp, Artificial Sequence
  dgRNA
  Sec16a
gggggcggagcccaa

SEQ ID NO: 31596 - DNA, 15 bp, Artificial Sequence
  dgRNA
  Kif12
tttagatctctctag

SEQ ID NO: 31597 - DNA, 15 bp, Artificial Sequence
  dgRNA
  Kif12
agaaacccccctagc

SEQ ID NO: 31598 - DNA, 15 bp, Artificial Sequence
  dgRNA
  Kif12
ctagctggaatgccc

SEQ ID NO: 31599 - DNA, 15 bp, Artificial Sequence
  dgRNA
  Kif12
ttaacttgctagctc

SEQ ID NO: 31600 - DNA, 15 bp, Artificial Sequence
  dgRNA
  Ripk4
cgcccctaggagcgc

SEQ ID NO: 31601 - DNA, 15 bp, Artificial Sequence
  dgRNA
  Ripk4
gcccctaggagcgca

SEQ ID NO: 31602 - DNA, 15 bp, Artificial Sequence
  dgRNA
  Ripk4
gattccaccgatccc

SEQ ID NO: 31603 - DNA, 15 bp, Artificial Sequence
  dgRNA
  Ripk4
tccaccgatccctgg

SEQ ID NO: 31604 - DNA, 15 bp, Artificial Sequence
  dgRNA
  Syt17
ggtggaaccacacca

SEQ ID NO: 31605 - DNA, 15 bp, Artificial Sequence
  dgRNA
  Syt17
tcccccatttgtggg

SEQ ID NO: 31606 - DNA, 15 bp, Artificial Sequence
  dgRNA
  Syt17
tttgtgggtggtcga

SEQ ID NO: 31607 - DNA, 15 bp, Artificial Sequence
  dgRNA
  Syt17
ctctaccagcaggat

SEQ ID NO: 31608 - DNA, 15 bp, Artificial Sequence
  dgRNA
  Rfx6
accgagcaagacact

SEQ ID NO: 31609 - DNA, 15 bp, Artificial Sequence
  dgRNA
  Rfx6
ccgagcaagacactt

SEQ ID NO: 31610 - DNA, 15 bp, Artificial Sequence
  dgRNA
  Rfx6
ccctctccaccatcg

SEQ ID NO: 31611 - DNA, 15 bp, Artificial Sequence
  dgRNA
  Rfx6
cctctccaccatcgg

SEQ ID NO: 31612 - DNA, 15 bp, Artificial Sequence
  dgRNA
  Spaca6
accctttaacctgtg

SEQ ID NO: 31613 - DNA, 15 bp, Artificial Sequence
  dgRNA
  Spaca6
cctgtgaggacgtcc

SEQ ID NO: 31614 - DNA, 15 bp, Artificial Sequence
  dgRNA
  Spaca6
ctgtgaggacgtcca

SEQ ID NO: 31615 - DNA, 15 bp, Artificial Sequence
  dgRNA
  Spaca6
gacgtccagggtcac

SEQ ID NO: 31616 - DNA, 15 bp, Artificial Sequence
  dgRNA
  Sh2d3c
tttggatcctacgag

SEQ ID NO: 31617 - DNA, 15 bp, Artificial Sequence
  dgRNA
  Sh2d3c
ttggatcctacgagc

SEQ ID NO: 31618 - DNA, 15 bp, Artificial Sequence
  dgRNA
  Sh2d3c
gatcctacgagcggg

SEQ ID NO: 31619 - DNA, 15 bp, Artificial Sequence
  dgRNA
  Sh2d3c
gcgggaggcgtgtct

SEQ ID NO: 31620 - DNA, 15 bp, Artificial Sequence
  dgRNA
  Diaph3
catccccggaaaagg

SEQ ID NO: 31621 - DNA, 15 bp, Artificial Sequence
  dgRNA
  Diaph3
atccccggaaaaggc

SEQ ID NO: 31622 - DNA, 15 bp, Artificial Sequence
  dgRNA
  Diaph3
tccccggaaaaggcg

SEQ ID NO: 31623 - DNA, 15 bp, Artificial Sequence
  dgRNA
  Diaph3
gggcccttgcgtcac

SEQ ID NO: 31624 - DNA, 15 bp, Artificial Sequence
  dgRNA
  Rhbdd2
ccgcacaacacccgt

SEQ ID NO: 31625 - DNA, 15 bp, Artificial Sequence
  dgRNA
  Rhbdd2
cacccgtaggtaagc

SEQ ID NO: 31626 - DNA, 15 bp, Artificial Sequence
  dgRNA
  Rhbdd2
actcccggcctcctt

SEQ ID NO: 31627 - DNA, 15 bp, Artificial Sequence
  dgRNA
  Rhbdd2
ctcccggcctccttt

SEQ ID NO: 31628 - DNA, 15 bp, Artificial Sequence
  dgRNA
  Ift20
tgcgcccgccgactc

SEQ ID NO: 31629 - DNA, 15 bp, Artificial Sequence
  dgRNA
  Ift20
cccaaccctacagat

SEQ ID NO: 31630 - DNA, 15 bp, Artificial Sequence
  dgRNA
  Ift20
ccaaccctacagatc

SEQ ID NO: 31631 - DNA, 15 bp, Artificial Sequence
  dgRNA
  Ift20
cgcgcgagctagcag

SEQ ID NO: 31632 - DNA, 15 bp, Artificial Sequence
  dgRNA
  Vwa9
ggaggcacccagaat

SEQ ID NO: 31633 - DNA, 15 bp, Artificial Sequence
  dgRNA
  Vwa9
tggggtaagacaaag

SEQ ID NO: 31634 - DNA, 15 bp, Artificial Sequence
  dgRNA
  Vwa9
ccagaaaccccccgc

SEQ ID NO: 31635 - DNA, 15 bp, Artificial Sequence
  dgRNA
  Vwa9
cagaaaccccccgca

SEQ ID NO: 31636 - DNA, 15 bp, Artificial Sequence
  dgRNA
  Dzank1
ttccagccgccgaga

SEQ ID NO: 31637 - DNA, 15 bp, Artificial Sequence
  dgRNA
  Dzank1
gagaaggcatattct

SEQ ID NO: 31638 - DNA, 15 bp, Artificial Sequence
  dgRNA
  Dzank1
gaggcgggtaccaga

SEQ ID NO: 31639 - DNA, 15 bp, Artificial Sequence
  dgRNA
  Dzank1
gcgggtaccagacgg

SEQ ID NO: 31640 - DNA, 15 bp, Artificial Sequence
  dgRNA
  Olfr1239
attgttaataagttc

SEQ ID NO: 31641 - DNA, 15 bp, Artificial Sequence
  dgRNA
  Olfr1239
attcaatggtgttac

SEQ ID NO: 31642 - DNA, 15 bp, Artificial Sequence
  dgRNA
  Acot5
agtaaaactattggt

SEQ ID NO: 31643 - DNA, 15 bp, Artificial Sequence
  dgRNA
  Acot5
gtaaaactattggtc

SEQ ID NO: 31644 - DNA, 15 bp, Artificial Sequence
  dgRNA
  Acot5
taaaactattggtcg

SEQ ID NO: 31645 - DNA, 15 bp, Artificial Sequence
  dgRNA
  Acot5
tattgcttagctcct

SEQ ID NO: 31646 - DNA, 15 bp, Artificial Sequence
  dgRNA
  Olfr1215
gtagatttccatatc

SEQ ID NO: 31647 - DNA, 15 bp, Artificial Sequence
  dgRNA
  Ppil3
tgttcttctcgctgg

SEQ ID NO: 31648 - DNA, 15 bp, Artificial Sequence
  dgRNA
  Ppil3
gtctgttcttctcgc

SEQ ID NO: 31649 - DNA, 15 bp, Artificial Sequence
  dgRNA
  Rps18
aacacaactctgttc

SEQ ID NO: 31650 - DNA, 15 bp, Artificial Sequence
  dgRNA
  Rps18
gcgcccacacaagaa

SEQ ID NO: 31651 - DNA, 15 bp, Artificial Sequence
  dgRNA
  Rps18
gtacgacgacagaga

SEQ ID NO: 31652 - DNA, 15 bp, Artificial Sequence
  dgRNA
  Rps18
cagagaaggccgaac

SEQ ID NO: 31653 - DNA, 15 bp, Artificial Sequence
  dgRNA
  Klk1
gagtacaactctgtc

SEQ ID NO: 31654 - DNA, 15 bp, Artificial Sequence
  dgRNA
  Klk1
gagctgttagtgtta

SEQ ID NO: 31655 - DNA, 15 bp, Artificial Sequence
  dgRNA
  Gemin8
cacgacgttacgtca

SEQ ID NO: 31656 - DNA, 15 bp, Artificial Sequence
  dgRNA
  Gemin8
gttacgtcacggata

SEQ ID NO: 31657 - DNA, 15 bp, Artificial Sequence
  dgRNA
  Gemin8
acgtcacggataagg

SEQ ID NO: 31658 - DNA, 15 bp, Artificial Sequence
  dgRNA
  Gemin8
cgtcacggataaggc

SEQ ID NO: 31659 - DNA, 15 bp, Artificial Sequence
  dgRNA
  Rnf187
ggtcgtgagctgcta

SEQ ID NO: 31660 - DNA, 15 bp, Artificial Sequence
  dgRNA
  Rnf187
gtcgtgagctgctac

SEQ ID NO: 31661 - DNA, 15 bp, Artificial Sequence
  dgRNA
  Rnf187
ctacgggaaccagtg

SEQ ID NO: 31662 - DNA, 15 bp, Artificial Sequence
  dgRNA
  Rnf187
cagctgctcaatcat

SEQ ID NO: 31663 - DNA, 15 bp, Artificial Sequence
  dgRNA
  Cyp27b1
acagaccacttgcaa

SEQ ID NO: 31664 - DNA, 15 bp, Artificial Sequence
  dgRNA
  Cyp27b1
attggctgaagagct

SEQ ID NO: 31665 - DNA, 15 bp, Artificial Sequence
  dgRNA
  Cyp27b1
ggcgtcttcacctcc

SEQ ID NO: 31666 - DNA, 15 bp, Artificial Sequence
  dgRNA
  Cyp27b1
gaccaagggtatata

SEQ ID NO: 31667 - DNA, 15 bp, Artificial Sequence
  dgRNA
  Troap
ctcgcgctccgtcct

SEQ ID NO: 31668 - DNA, 15 bp, Artificial Sequence
  dgRNA
  Troap
gctccgtcctcggat

SEQ ID NO: 31669 - DNA, 15 bp, Artificial Sequence
  dgRNA
  Troap
attggccgagagagc

SEQ ID NO: 31670 - DNA, 15 bp, Artificial Sequence
  dgRNA
  Troap
cgactagtccttctc

SEQ ID NO: 31671 - DNA, 15 bp, Artificial Sequence
  dgRNA
  Slc7a6os
acagctcacccgctg

SEQ ID NO: 31672 - DNA, 15 bp, Artificial Sequence
  dgRNA
  Slc7a6os
cagctcacccgctgt

SEQ ID NO: 31673 - DNA, 15 bp, Artificial Sequence
  dgRNA
  Slc7a6os
tcgccgccactcccg

SEQ ID NO: 31674 - DNA, 15 bp, Artificial Sequence
  dgRNA
  Slc7a6os
gcgtgacgttccgtg

SEQ ID NO: 31675 - DNA, 15 bp, Artificial Sequence
  dgRNA
  Stard5
actccttaagctagc

SEQ ID NO: 31676 - DNA, 15 bp, Artificial Sequence
  dgRNA
  Stard5
tgacgcttactgcgc

SEQ ID NO: 31677 - DNA, 15 bp, Artificial Sequence
  dgRNA
  Stard5
gacgcttactgcgca

SEQ ID NO: 31678 - DNA, 15 bp, Artificial Sequence
  dgRNA
  Stard5
gcttactgcgcaggg

SEQ ID NO: 31679 - DNA, 15 bp, Artificial Sequence
  dgRNA
  Apoc2
cacgcgtgcgcgccc

SEQ ID NO: 31680 - DNA, 15 bp, Artificial Sequence
  dgRNA
  Apoc2
cgcgcccaggtgtaa

SEQ ID NO: 31681 - DNA, 15 bp, Artificial Sequence
  dgRNA
  Olfr714
ctctgcttatgcact

SEQ ID NO: 31682 - DNA, 15 bp, Artificial Sequence
  dgRNA
  Olfr714
cttatgcactaggat

SEQ ID NO: 31683 - DNA, 15 bp, Artificial Sequence
  dgRNA
  Olfr714
cctgaatcagtaatc

SEQ ID NO: 31684 - DNA, 15 bp, Artificial Sequence
  dgRNA
  Olfr714
gaatcagtaatctgg

SEQ ID NO: 31685 - DNA, 15 bp, Artificial Sequence
  dgRNA
  Pitpnm2
gctgacgccttcccc

SEQ ID NO: 31686 - DNA, 15 bp, Artificial Sequence
  dgRNA
  Pitpnm2
gcttgaggcgggcgg

SEQ ID NO: 31687 - DNA, 15 bp, Artificial Sequence
  dgRNA
  Pitpnm2
cgctggcagagcttg

SEQ ID NO: 31688 - DNA, 15 bp, Artificial Sequence
  dgRNA
  Pitpnm2
tgagctaagttgcca

SEQ ID NO: 31689 - DNA, 15 bp, Artificial Sequence
  dgRNA
  Rel
gcgcactggcccgcg

SEQ ID NO: 31690 - DNA, 15 bp, Artificial Sequence
  dgRNA
  Rel
cgcactggcccgcgc

SEQ ID NO: 31691 - DNA, 15 bp, Artificial Sequence
  dgRNA
  Rel
gcactggcccgcgcg

SEQ ID NO: 31692 - DNA, 15 bp, Artificial Sequence
  dgRNA
  Rel
cgcgcgcccgccgcg

SEQ ID NO: 31693 - DNA, 15 bp, Artificial Sequence
  dgRNA
  Lyz2
ctgaagtccatagat

SEQ ID NO: 31694 - DNA, 15 bp, Artificial Sequence
  dgRNA
  Lyz2
agtccatagatcggt

SEQ ID NO: 31695 - DNA, 15 bp, Artificial Sequence
  dgRNA
  Lyz2
gttcctaccgatcta

SEQ ID NO: 31696 - DNA, 15 bp, Artificial Sequence
  dgRNA
  Rxrg
cagtcacacatcgat

SEQ ID NO: 31697 - DNA, 15 bp, Artificial Sequence
  dgRNA
  Rxrg
attgtgccacccggt

SEQ ID NO: 31698 - DNA, 15 bp, Artificial Sequence
  dgRNA
  Rxrg
cccggtaggaacctc

SEQ ID NO: 31699 - DNA, 15 bp, Artificial Sequence
  dgRNA
  Rxrg
ccggtaggaacctct

SEQ ID NO: 31700 - DNA, 15 bp, Artificial Sequence
  dgRNA
  Mrto4
agccgccgggactgg

SEQ ID NO: 31701 - DNA, 15 bp, Artificial Sequence
  dgRNA
  Mrto4
gccgccgggactgga

SEQ ID NO: 31702 - DNA, 15 bp, Artificial Sequence
  dgRNA
  Mrto4
gagggacccgggacc

SEQ ID NO: 31703 - DNA, 15 bp, Artificial Sequence
  dgRNA
  Mrto4
agggacccgggacct

SEQ ID NO: 31704 - DNA, 15 bp, Artificial Sequence
  dgRNA
  Zfp706
acgacaccgagagag

SEQ ID NO: 31705 - DNA, 15 bp, Artificial Sequence
  dgRNA
  Zfp706
cgacaccgagagagc

SEQ ID NO: 31706 - DNA, 15 bp, Artificial Sequence
  dgRNA
  Zfp706
caccgagagagcggg

SEQ ID NO: 31707 - DNA, 15 bp, Artificial Sequence
  dgRNA
  Zfp706
accgagagagcgggc

SEQ ID NO: 31708 - DNA, 15 bp, Artificial Sequence
  dgRNA
  Comt
ccagaaggccacggt

SEQ ID NO: 31709 - DNA, 15 bp, Artificial Sequence
  dgRNA
  Comt
gaaggccacggtcgg

SEQ ID NO: 31710 - DNA, 15 bp, Artificial Sequence
  dgRNA
  Comt
tacctaagcagtctg

SEQ ID NO: 31711 - DNA, 15 bp, Artificial Sequence
  dgRNA
  Comt
agcttggctacatgg

SEQ ID NO: 31712 - DNA, 15 bp, Artificial Sequence
  dgRNA
  Col6a1
tcttctatgttacac

SEQ ID NO: 31713 - DNA, 15 bp, Artificial Sequence
  dgRNA
  Col6a1
acacaccgtagcaac

SEQ ID NO: 31714 - DNA, 15 bp, Artificial Sequence
  dgRNA
  Col6a1
tgcctagtacccgag

SEQ ID NO: 31715 - DNA, 15 bp, Artificial Sequence
  dgRNA
  Col6a1
gtacccgagaggaga

SEQ ID NO: 31716 - DNA, 15 bp, Artificial Sequence
  dgRNA
  Rhox2c
gtgtaacggtgaata

SEQ ID NO: 31717 - DNA, 15 bp, Artificial Sequence
  dgRNA
  Olfr1450
gggccttatgcagtc

SEQ ID NO: 31718 - DNA, 15 bp, Artificial Sequence
  dgRNA
  Olfr1232
tcatacgctctctat

SEQ ID NO: 31719 - DNA, 15 bp, Artificial Sequence
  dgRNA
  Olfr1232
agagagcgtatgatt

SEQ ID NO: 31720 - DNA, 15 bp, Artificial Sequence
  dgRNA
  Ubxn2b
aactggcgagccctg

SEQ ID NO: 31721 - DNA, 15 bp, Artificial Sequence
  dgRNA
  Ubxn2b
gcgagccctgcggac

SEQ ID NO: 31722 - DNA, 15 bp, Artificial Sequence
  dgRNA
  Ubxn2b
acagcgagtgcgcac

SEQ ID NO: 31723 - DNA, 15 bp, Artificial Sequence
  dgRNA
  Ubxn2b
cgagtgcgcaccggc

SEQ ID NO: 31724 - DNA, 15 bp, Artificial Sequence
  dgRNA
  Rnmt
cccgggcgcactccc

SEQ ID NO: 31725 - DNA, 15 bp, Artificial Sequence
  dgRNA
  Rnmt
ggaagtgacgtaaca

SEQ ID NO: 31726 - DNA, 15 bp, Artificial Sequence
  dgRNA
  Rnmt
gtaacaaggcacgcg

SEQ ID NO: 31727 - DNA, 15 bp, Artificial Sequence
  dgRNA
  Rnmt
aggcacgcgtggctc

SEQ ID NO: 31728 - DNA, 15 bp, Artificial Sequence
  dgRNA
  Rhox2h
gaaggttatcggagc

SEQ ID NO: 31729 - DNA, 15 bp, Artificial Sequence
  dgRNA
  Rhox2h
agtccccaacaattc

SEQ ID NO: 31730 - DNA, 15 bp, Artificial Sequence
  dgRNA
  Zfp94
aaacacgcaggcacc

SEQ ID NO: 31731 - DNA, 15 bp, Artificial Sequence
  dgRNA
  Zfp94
aacacgcaggcaccc

SEQ ID NO: 31732 - DNA, 15 bp, Artificial Sequence
  dgRNA
  Zfp94
ccgggagagctgacg

SEQ ID NO: 31733 - DNA, 15 bp, Artificial Sequence
  dgRNA
  Zfp94
tgacgcggagatttc

SEQ ID NO: 31734 - DNA, 15 bp, Artificial Sequence
  dgRNA
  Rab34
gggtgtaggcggtcc

SEQ ID NO: 31735 - DNA, 15 bp, Artificial Sequence
  dgRNA
  Rab34
aggcggtcctggcgt

SEQ ID NO: 31736 - DNA, 15 bp, Artificial Sequence
  dgRNA
  Rab34
ggcggtcctggcgtt

SEQ ID NO: 31737 - DNA, 15 bp, Artificial Sequence
  dgRNA
  Rab34
gtcctggcgttgggt

SEQ ID NO: 31738 - DNA, 15 bp, Artificial Sequence
  dgRNA
  Plscr3
accctccaacaggcc

SEQ ID NO: 31739 - DNA, 15 bp, Artificial Sequence
  dgRNA
  Plscr3
cctctgcagtcggag

SEQ ID NO: 31740 - DNA, 15 bp, Artificial Sequence
  dgRNA
  Plscr3
tgcagtcggagcgga

SEQ ID NO: 31741 - DNA, 15 bp, Artificial Sequence
  dgRNA
  Plscr3
gcagtcggagcggaa

SEQ ID NO: 31742 - DNA, 15 bp, Artificial Sequence
  dgRNA
  Eif2ak2
gaagtgtccgaaacc

SEQ ID NO: 31743 - DNA, 15 bp, Artificial Sequence
  dgRNA
  Eif2ak2
ttactgcagttgcac

SEQ ID NO: 31744 - DNA, 15 bp, Artificial Sequence
  dgRNA
  Eif2ak2
ggcgggcccggacct

SEQ ID NO: 31745 - DNA, 15 bp, Artificial Sequence
  dgRNA
  Eif2ak2
ccttggctcccgcgc

SEQ ID NO: 31746 - DNA, 15 bp, Artificial Sequence
  dgRNA
  Pgc
gaaactattgatact

SEQ ID NO: 31747 - DNA, 15 bp, Artificial Sequence
  dgRNA
  Pgc
gatacttggagtcca

SEQ ID NO: 31748 - DNA, 15 bp, Artificial Sequence
  dgRNA
  Pgc
tcttggcttggggcg

SEQ ID NO: 31749 - DNA, 15 bp, Artificial Sequence
  dgRNA
  Pgc
gcggcatgcttgccc

SEQ ID NO: 31750 - DNA, 15 bp, Artificial Sequence
  dgRNA
  Ankmy2
cttaataggttatca

SEQ ID NO: 31751 - DNA, 15 bp, Artificial Sequence
  dgRNA
  Ankmy2
ttaataggttatcat

SEQ ID NO: 31752 - DNA, 15 bp, Artificial Sequence
  dgRNA
  Ankmy2
ggttatcatgggaat

SEQ ID NO: 31753 - DNA, 15 bp, Artificial Sequence
  dgRNA
  Ankmy2
tggtttggacctcgt

SEQ ID NO: 31754 - DNA, 15 bp, Artificial Sequence
  dgRNA
  Gm5916
acacttccctaagtc

SEQ ID NO: 31755 - DNA, 15 bp, Artificial Sequence
  dgRNA
  Gm5916
cttcctaaggttaaa

SEQ ID NO: 31756 - DNA, 15 bp, Artificial Sequence
  dgRNA
  Gm5916
taagtgagcttccta

SEQ ID NO: 31757 - DNA, 15 bp, Artificial Sequence
  dgRNA
  Gm5916
gagtagccagactta

SEQ ID NO: 31758 - DNA, 15 bp, Artificial Sequence
  dgRNA
  Lpar5
ctgacctgtttgcga

SEQ ID NO: 31759 - DNA, 15 bp, Artificial Sequence
  dgRNA
  Lpar5
ttgcgaaggtgtctg

SEQ ID NO: 31760 - DNA, 15 bp, Artificial Sequence
  dgRNA
  Lpar5
ggcccgcccaggagc

SEQ ID NO: 31761 - DNA, 15 bp, Artificial Sequence
  dgRNA
  Lpar5
ggagcaggtcctacc

SEQ ID NO: 31762 - DNA, 15 bp, Artificial Sequence
  dgRNA
  Ccdc88a
gaatctgggcggcgg

SEQ ID NO: 31763 - DNA, 15 bp, Artificial Sequence
  dgRNA
  Ccdc88a
aatctgggcggcggc

SEQ ID NO: 31764 - DNA, 15 bp, Artificial Sequence
  dgRNA
  Ccdc88a
ggggcgcgctcacgc

SEQ ID NO: 31765 - DNA, 15 bp, Artificial Sequence
  dgRNA
  Ccdc88a
agcgcgctcttgcag

SEQ ID NO: 31766 - DNA, 15 bp, Artificial Sequence
  dgRNA
  Vegfa
agccgagctcatgga

SEQ ID NO: 31767 - DNA, 15 bp, Artificial Sequence
  dgRNA
  Vegfa
gccgagctcatggac

SEQ ID NO: 31768 - DNA, 15 bp, Artificial Sequence
  dgRNA
  Vegfa
gctcatggacgggtg

SEQ ID NO: 31769 - DNA, 15 bp, Artificial Sequence
  dgRNA
  Vegfa
catggacgggtgagg

SEQ ID NO: 31770 - DNA, 15 bp, Artificial Sequence
  dgRNA
  Hpca
tgcttccgttctcgc

SEQ ID NO: 31771 - DNA, 15 bp, Artificial Sequence
  dgRNA
  Hpca
cgttctcgcaggtca

SEQ ID NO: 31772 - DNA, 15 bp, Artificial Sequence
  dgRNA
  Hpca
tgcctggaggagtac

SEQ ID NO: 31773 - DNA, 15 bp, Artificial Sequence
  dgRNA
  Hpca
gcctggaggagtact

SEQ ID NO: 31774 - DNA, 15 bp, Artificial Sequence
  dgRNA
  Ethe1
catatctacccttcg

SEQ ID NO: 31775 - DNA, 15 bp, Artificial Sequence
  dgRNA
  Ethe1
gcggagagatcctag

SEQ ID NO: 31776 - DNA, 15 bp, Artificial Sequence
  dgRNA
  Ethe1
agggcggtccctccc

SEQ ID NO: 31777 - DNA, 15 bp, Artificial Sequence
  dgRNA
  Ethe1
gggcggtccctcccc

SEQ ID NO: 31778 - DNA, 15 bp, Artificial Sequence
  dgRNA
  Tubb4a
atttacaagattccg

SEQ ID NO: 31779 - DNA, 15 bp, Artificial Sequence
  dgRNA
  Tubb4a
aatggtgcctgacaa

SEQ ID NO: 31780 - DNA, 15 bp, Artificial Sequence
  dgRNA
  Tubb4a
tgacaacggagcctg

SEQ ID NO: 31781 - DNA, 15 bp, Artificial Sequence
  dgRNA
  Tubb4a
gacaacggagcctga

SEQ ID NO: 31782 - DNA, 15 bp, Artificial Sequence
  dgRNA
  Hp1bp3
cctgcccctggcgcg

SEQ ID NO: 31783 - DNA, 15 bp, Artificial Sequence
  dgRNA
  Hp1bp3
ctgcccctggcgcgc

SEQ ID NO: 31784 - DNA, 15 bp, Artificial Sequence
  dgRNA
  Hp1bp3
ggcgcgcgggccact

SEQ ID NO: 31785 - DNA, 15 bp, Artificial Sequence
  dgRNA
  Hp1bp3
gccactcgggccccg

SEQ ID NO: 31786 - DNA, 15 bp, Artificial Sequence
  dgRNA
  Atpaf2
gggagcaagctcacg

SEQ ID NO: 31787 - DNA, 15 bp, Artificial Sequence
  dgRNA
  Atpaf2
ggcgcttccgcccat

SEQ ID NO: 31788 - DNA, 15 bp, Artificial Sequence
  dgRNA
  Atpaf2
gcttccgcccattgg

SEQ ID NO: 31789 - DNA, 15 bp, Artificial Sequence
  dgRNA
  Atpaf2
ggcgcagagcgcgaa

SEQ ID NO: 31790 - DNA, 15 bp, Artificial Sequence
  dgRNA
  Mrps25
gaagacaaaaacgac

SEQ ID NO: 31791 - DNA, 15 bp, Artificial Sequence
  dgRNA
  Mrps25
tgattcccaacgctg

SEQ ID NO: 31792 - DNA, 15 bp, Artificial Sequence
  dgRNA
  Mrps25
ttcccaacgctgagg

SEQ ID NO: 31793 - DNA, 15 bp, Artificial Sequence
  dgRNA
  Mrps25
aggcggctgcgagcc

SEQ ID NO: 31794 - DNA, 15 bp, Artificial Sequence
  dgRNA
  Slc12a7
gtccttgagggtaca

SEQ ID NO: 31795 - DNA, 15 bp, Artificial Sequence
  dgRNA
  Slc12a7
ggggcggagttttaa

SEQ ID NO: 31796 - DNA, 15 bp, Artificial Sequence
  dgRNA
  Slc12a7
gggcggagttttaag

SEQ ID NO: 31797 - DNA, 15 bp, Artificial Sequence
  dgRNA
  Slc12a7
cggagttttaagggg

SEQ ID NO: 31798 - DNA, 15 bp, Artificial Sequence
  dgRNA
  Dcaf17
ctacatttccgggag

SEQ ID NO: 31799 - DNA, 15 bp, Artificial Sequence
  dgRNA
  Dcaf17
tacatttccgggaga

SEQ ID NO: 31800 - DNA, 15 bp, Artificial Sequence
  dgRNA
  Dcaf17
atacggagggccgcg

SEQ ID NO: 31801 - DNA, 15 bp, Artificial Sequence
  dgRNA
  Cpt2
cttcgggcaagaagc

SEQ ID NO: 31802 - DNA, 15 bp, Artificial Sequence
  dgRNA
  Cpt2
ttcgggcaagaagct

SEQ ID NO: 31803 - DNA, 15 bp, Artificial Sequence
  dgRNA
  Cpt2
tttagagaccgcttc

SEQ ID NO: 31804 - DNA, 15 bp, Artificial Sequence
  dgRNA
  Cpt2
gaccgcttccggccc

SEQ ID NO: 31805 - DNA, 15 bp, Artificial Sequence
  dgRNA
  Nkd2
gtctagtaaagtctt

SEQ ID NO: 31806 - DNA, 15 bp, Artificial Sequence
  dgRNA
  Nkd2
gtaaaggagacgcta

SEQ ID NO: 31807 - DNA, 15 bp, Artificial Sequence
  dgRNA
  Nkd2
aggtccactgcgcta

SEQ ID NO: 31808 - DNA, 15 bp, Artificial Sequence
  dgRNA
  Nkd2
ctgcgctacggtccg

SEQ ID NO: 31809 - DNA, 15 bp, Artificial Sequence
  dgRNA
  Scaf8
tcgctcccgcggccc

SEQ ID NO: 31810 - DNA, 15 bp, Artificial Sequence
  dgRNA
  Scaf8
ccgcggcccgggatg

SEQ ID NO: 31811 - DNA, 15 bp, Artificial Sequence
  dgRNA
  Scaf8
cgactccagacgctc

SEQ ID NO: 31812 - DNA, 15 bp, Artificial Sequence
  dgRNA
  Scaf8
cccacgccatctcta

SEQ ID NO: 31813 - DNA, 15 bp, Artificial Sequence
  dgRNA
  Tm9sf3
acagcagcggcgact

SEQ ID NO: 31814 - DNA, 15 bp, Artificial Sequence
  dgRNA
  Tm9sf3
aacccttcaaccccg

SEQ ID NO: 31815 - DNA, 15 bp, Artificial Sequence
  dgRNA
  Tm9sf3
gcggcctgcgcgcgc

SEQ ID NO: 31816 - DNA, 15 bp, Artificial Sequence
  dgRNA
  Tm9sf3
cgcgccggcgcccca

SEQ ID NO: 31817 - DNA, 15 bp, Artificial Sequence
  dgRNA
  Metap2
ggtgtttgcaagttt

SEQ ID NO: 31818 - DNA, 15 bp, Artificial Sequence
  dgRNA
  Snx30
cagcgaagctgccag

SEQ ID NO: 31819 - DNA, 15 bp, Artificial Sequence
  dgRNA
  Snx30
agcgaagctgccagt

SEQ ID NO: 31820 - DNA, 15 bp, Artificial Sequence
  dgRNA
  Snx30
gggcgcacttcctgc

SEQ ID NO: 31821 - DNA, 15 bp, Artificial Sequence
  dgRNA
  Snx30
ggcgcacttcctgcc

SEQ ID NO: 31822 - DNA, 15 bp, Artificial Sequence
  dgRNA
  Lamp2
caaaaagccagggcg

SEQ ID NO: 31823 - DNA, 15 bp, Artificial Sequence
  dgRNA
  Lamp2
tctaagcatgctgat

SEQ ID NO: 31824 - DNA, 15 bp, Artificial Sequence
  dgRNA
  Lamp2
taaggctagcaggaa

SEQ ID NO: 31825 - DNA, 15 bp, Artificial Sequence
  dgRNA
  Lamp2
ttttttaaggctagc

SEQ ID NO: 31826 - DNA, 15 bp, Artificial Sequence
  dgRNA
  Hist1h2bp
cttattaaaaagcga

SEQ ID NO: 31827 - DNA, 15 bp, Artificial Sequence
  dgRNA
  Hist1h2bp
aaagcgaagggctca

SEQ ID NO: 31828 - DNA, 15 bp, Artificial Sequence
  dgRNA
  Hist1h2bp
gcgcaagttgtagcg

SEQ ID NO: 31829 - DNA, 15 bp, Artificial Sequence
  dgRNA
  Hist1h2bp
cttcgctttttaata

SEQ ID NO: 31830 - DNA, 15 bp, Artificial Sequence
  dgRNA
  Unc5d
ctgttccgctgctgt

SEQ ID NO: 31831 - DNA, 15 bp, Artificial Sequence
  dgRNA
  Unc5d
tgttccgctgctgta

SEQ ID NO: 31832 - DNA, 15 bp, Artificial Sequence
  dgRNA
  Unc5d
tgtagggagcggcgg

SEQ ID NO: 31833 - DNA, 15 bp, Artificial Sequence
  dgRNA
  Unc5d
gtagggagcggcggt

SEQ ID NO: 31834 - DNA, 15 bp, Artificial Sequence
  dgRNA
  Rdh9
tcttttgatcagaac

SEQ ID NO: 31835 - DNA, 15 bp, Artificial Sequence
  dgRNA
  Rdh9
gtcaccaatagttat

SEQ ID NO: 31836 - DNA, 15 bp, Artificial Sequence
  dgRNA
  Rdh9
tcaccaatagttata

SEQ ID NO: 31837 - DNA, 15 bp, Artificial Sequence
  dgRNA
  Rdh9
ttcctggactcacgt

SEQ ID NO: 31838 - DNA, 15 bp, Artificial Sequence
  dgRNA
  Kbtbd2
tgtctgtatctcggg

SEQ ID NO: 31839 - DNA, 15 bp, Artificial Sequence
  dgRNA
  Kbtbd2
aaacacgaacaactg

SEQ ID NO: 31840 - DNA, 15 bp, Artificial Sequence
  dgRNA
  Kbtbd2
cgctgaatagaactt

SEQ ID NO: 31841 - DNA, 15 bp, Artificial Sequence
  dgRNA
  Kbtbd2
gctgaatagaacttt

SEQ ID NO: 31842 - DNA, 15 bp, Artificial Sequence
  dgRNA
  Mllt6
cggcgcctcccccgc

SEQ ID NO: 31843 - DNA, 15 bp, Artificial Sequence
  dgRNA
  Mllt6
gccctgcttgcaccg

SEQ ID NO: 31844 - DNA, 15 bp, Artificial Sequence
  dgRNA
  Mllt6
tgcttgcaccgcggc

SEQ ID NO: 31845 - DNA, 15 bp, Artificial Sequence
  dgRNA
  Mllt6
gcttgcaccgcggcc

SEQ ID NO: 31846 - DNA, 15 bp, Artificial Sequence
  dgRNA
  Msh4
tactgggggtgtaac

SEQ ID NO: 31847 - DNA, 15 bp, Artificial Sequence
  dgRNA
  Msh4
aaatatgcaataccc

SEQ ID NO: 31848 - DNA, 15 bp, Artificial Sequence
  dgRNA
  Msh4
aactgttgacaacct

SEQ ID NO: 31849 - DNA, 15 bp, Artificial Sequence
  dgRNA
  Msh4
cacatagcatagtac

SEQ ID NO: 31850 - DNA, 15 bp, Artificial Sequence
  dgRNA
  Agap3
cagctccgaggcggc

SEQ ID NO: 31851 - DNA, 15 bp, Artificial Sequence
  dgRNA
  Agap3
ggcgggatctcagcg

SEQ ID NO: 31852 - DNA, 15 bp, Artificial Sequence
  dgRNA
  Agap3
gcgggatctcagcgc

SEQ ID NO: 31853 - DNA, 15 bp, Artificial Sequence
  dgRNA
  Agap3
agcgcgggtaaacgc

SEQ ID NO: 31854 - DNA, 15 bp, Artificial Sequence
  dgRNA
  Chst11
gtctcgggtaggggc

SEQ ID NO: 31855 - DNA, 15 bp, Artificial Sequence
  dgRNA
  Chst11
tctcgggtaggggcg

SEQ ID NO: 31856 - DNA, 15 bp, Artificial Sequence
  dgRNA
  Chst11
tcgggtaggggcggg

SEQ ID NO: 31857 - DNA, 15 bp, Artificial Sequence
  dgRNA
  Chst11
ggcgacgctccgccc

SEQ ID NO: 31858 - DNA, 15 bp, Artificial Sequence
  dgRNA
  Ambra1
agccggatttgcagc

SEQ ID NO: 31859 - DNA, 15 bp, Artificial Sequence
  dgRNA
  Ambra1
caatgtttcggcact

SEQ ID NO: 31860 - DNA, 15 bp, Artificial Sequence
  dgRNA
  Ambra1
ccttgaacgattgct

SEQ ID NO: 31861 - DNA, 15 bp, Artificial Sequence
  dgRNA
  Ambra1
cttgaacgattgctg

SEQ ID NO: 31862 - DNA, 15 bp, Artificial Sequence
  dgRNA
  H1foo
tgagtcttaccctcg

SEQ ID NO: 31863 - DNA, 15 bp, Artificial Sequence
  dgRNA
  H1foo
ccctcgaggcctgat

SEQ ID NO: 31864 - DNA, 15 bp, Artificial Sequence
  dgRNA
  H1foo
agctttcggctgctc

SEQ ID NO: 31865 - DNA, 15 bp, Artificial Sequence
  dgRNA
  H1foo
ttaaggcagaaggtc

SEQ ID NO: 31866 - DNA, 15 bp, Artificial Sequence
  dgRNA
  Cacng6
tttttgagtagtccc

SEQ ID NO: 31867 - DNA, 15 bp, Artificial Sequence
  dgRNA
  Cacng6
cccctcgaattccag

SEQ ID NO: 31868 - DNA, 15 bp, Artificial Sequence
  dgRNA
  Cacng6
ccctcgaattccagt

SEQ ID NO: 31869 - DNA, 15 bp, Artificial Sequence
  dgRNA
  Cacng6
cctcgaattccagtg

SEQ ID NO: 31870 - DNA, 15 bp, Artificial Sequence
  dgRNA
  Rtn3
gccgcccgcgcgtcc

SEQ ID NO: 31871 - DNA, 15 bp, Artificial Sequence
  dgRNA
  Rtn3
tggacgcgcgggcgg

SEQ ID NO: 31872 - DNA, 15 bp, Artificial Sequence
  dgRNA
  Rtn3
gcctggacgcgcggg

SEQ ID NO: 31873 - DNA, 15 bp, Artificial Sequence
  dgRNA
  Rtn3
agagcctggacgcgc

SEQ ID NO: 31874 - DNA, 15 bp, Artificial Sequence
  dgRNA
  Olfr1391
atccgatgaagaaaa

SEQ ID NO: 31875 - DNA, 15 bp, Artificial Sequence
  dgRNA
  Carns1
ggcggggctccgccc

SEQ ID NO: 31876 - DNA, 15 bp, Artificial Sequence
  dgRNA
  Carns1
gcggggctccgcccc

SEQ ID NO: 31877 - DNA, 15 bp, Artificial Sequence
  dgRNA
  Carns1
gctccgccccgggca

SEQ ID NO: 31878 - DNA, 15 bp, Artificial Sequence
  dgRNA
  Carns1
gccccgggcatggcc

SEQ ID NO: 31879 - DNA, 15 bp, Artificial Sequence
  dgRNA
  Lysmd2
tggagaagccggccg

SEQ ID NO: 31880 - DNA, 15 bp, Artificial Sequence
  dgRNA
  Lysmd2
agaagccggccgcgg

SEQ ID NO: 31881 - DNA, 15 bp, Artificial Sequence
  dgRNA
  Lysmd2
gaagccggccgcgga

SEQ ID NO: 31882 - DNA, 15 bp, Artificial Sequence
  dgRNA
  Lysmd2
cggcgcgcgccatgc

SEQ ID NO: 31883 - DNA, 15 bp, Artificial Sequence
  dgRNA
  Fut11
cgccgcgtgccccta

SEQ ID NO: 31884 - DNA, 15 bp, Artificial Sequence
  dgRNA
  Fut11
gtgcccctatggcgt

SEQ ID NO: 31885 - DNA, 15 bp, Artificial Sequence
  dgRNA
  Fut11
ctccccacccgccgc

SEQ ID NO: 31886 - DNA, 15 bp, Artificial Sequence
  dgRNA
  Fut11
tccccacccgccgca

SEQ ID NO: 31887 - DNA, 15 bp, Artificial Sequence
  dgRNA
  Fubp1
gggcggcacacttcc

SEQ ID NO: 31888 - DNA, 15 bp, Artificial Sequence
  dgRNA
  Fubp1
ggcggcacacttccc

SEQ ID NO: 31889 - DNA, 15 bp, Artificial Sequence
  dgRNA
  Fubp1
tcagccgccgaggcg

SEQ ID NO: 31890 - DNA, 15 bp, Artificial Sequence
  dgRNA
  Fubp1
cagccgccgaggcga

SEQ ID NO: 31891 - DNA, 15 bp, Artificial Sequence
  dgRNA
  Spata17
tttcgagctgctgat

SEQ ID NO: 31892 - DNA, 15 bp, Artificial Sequence
  dgRNA
  Spata17
atttcgagctgctga

SEQ ID NO: 31893 - DNA, 15 bp, Artificial Sequence
  dgRNA
  Efnb1
tctgtgggcgtggta

SEQ ID NO: 31894 - DNA, 15 bp, Artificial Sequence
  dgRNA
  Efnb1
ctgtgggcgtggtat

SEQ ID NO: 31895 - DNA, 15 bp, Artificial Sequence
  dgRNA
  Efnb1
gcgtggtatggggca

SEQ ID NO: 31896 - DNA, 15 bp, Artificial Sequence
  dgRNA
  Efnb1
tttctattggttcga

SEQ ID NO: 31897 - DNA, 15 bp, Artificial Sequence
  dgRNA
  Aldob
ataaacacctcctac

SEQ ID NO: 31898 - DNA, 15 bp, Artificial Sequence
  dgRNA
  Aldob
cctcctactgggtca

SEQ ID NO: 31899 - DNA, 15 bp, Artificial Sequence
  dgRNA
  Aldob
ggtgaggaaactatg

SEQ ID NO: 31900 - DNA, 15 bp, Artificial Sequence
  dgRNA
  Aldob
gactctgtacaggtg

SEQ ID NO: 31901 - DNA, 15 bp, Artificial Sequence
  dgRNA
  Commd6
ggggagccgacatcc

SEQ ID NO: 31902 - DNA, 15 bp, Artificial Sequence
  dgRNA
  Commd6
cacgagtcctccacc

SEQ ID NO: 31903 - DNA, 15 bp, Artificial Sequence
  dgRNA
  Commd6
tttcctgcacgtctc

SEQ ID NO: 31904 - DNA, 15 bp, Artificial Sequence
  dgRNA
  Commd6
gcaacctagcgtgag

SEQ ID NO: 31905 - DNA, 15 bp, Artificial Sequence
  dgRNA
  Ch25h
ccgctgcttgcgtga

SEQ ID NO: 31906 - DNA, 15 bp, Artificial Sequence
  dgRNA
  Ch25h
cgctgcttgcgtgaa

SEQ ID NO: 31907 - DNA, 15 bp, Artificial Sequence
  dgRNA
  Ch25h
gctgcttgcgtgaag

SEQ ID NO: 31908 - DNA, 15 bp, Artificial Sequence
  dgRNA
  Ch25h
atgcagctataaacc

SEQ ID NO: 31909 - DNA, 15 bp, Artificial Sequence
  dgRNA
  Dctn4
ggaaacgaggagtgt

SEQ ID NO: 31910 - DNA, 15 bp, Artificial Sequence
  dgRNA
  Dctn4
accgcaacgtcctgc

SEQ ID NO: 31911 - DNA, 15 bp, Artificial Sequence
  dgRNA
  Dctn4
ccgcaacgtcctgct

SEQ ID NO: 31912 - DNA, 15 bp, Artificial Sequence
  dgRNA
  Dctn4
aacgtcctgctgggt

SEQ ID NO: 31913 - DNA, 15 bp, Artificial Sequence
  dgRNA
  Ank1
tacaaattatccacg

SEQ ID NO: 31914 - DNA, 15 bp, Artificial Sequence
  dgRNA
  Ank1
acgctggcctgctgc

SEQ ID NO: 31915 - DNA, 15 bp, Artificial Sequence
  dgRNA
  Ank1
cctggcggccgagac

SEQ ID NO: 31916 - DNA, 15 bp, Artificial Sequence
  dgRNA
  Ank1
ctggcggccgagaca

SEQ ID NO: 31917 - DNA, 15 bp, Artificial Sequence
  dgRNA
  Pkn2
ccggcgacgcgagcc

SEQ ID NO: 31918 - DNA, 15 bp, Artificial Sequence
  dgRNA
  Pkn2
cggcgacgcgagccc

SEQ ID NO: 31919 - DNA, 15 bp, Artificial Sequence
  dgRNA
  Pkn2
ggcgacgcgagcccg

SEQ ID NO: 31920 - DNA, 15 bp, Artificial Sequence
  dgRNA
  Pkn2
cgcctccctgtcatc

SEQ ID NO: 31921 - DNA, 15 bp, Artificial Sequence
  dgRNA
  Gm13178
attggctgacttagg

SEQ ID NO: 31922 - DNA, 15 bp, Artificial Sequence
  dgRNA
  Cfap43
cagatccttctcgtc

SEQ ID NO: 31923 - DNA, 15 bp, Artificial Sequence
  dgRNA
  Cfap43
atccttctcgtcagg

SEQ ID NO: 31924 - DNA, 15 bp, Artificial Sequence
  dgRNA
  Cfap43
atccgagagacccag

SEQ ID NO: 31925 - DNA, 15 bp, Artificial Sequence
  dgRNA
  Cfap43
agaggatggtctccg

SEQ ID NO: 31926 - DNA, 15 bp, Artificial Sequence
  dgRNA
  Olfr267
actgttctagcataa

SEQ ID NO: 31927 - DNA, 15 bp, Artificial Sequence
  dgRNA
  Olfr267
ctggtggtgctcgtg

SEQ ID NO: 31928 - DNA, 15 bp, Artificial Sequence
  dgRNA
  Saa4
tactcggcaagcact

SEQ ID NO: 31929 - DNA, 15 bp, Artificial Sequence
  dgRNA
  Saa4
tctgccaaggcttgt

SEQ ID NO: 31930 - DNA, 15 bp, Artificial Sequence
  dgRNA
  Saa4
taaacagttacaggc

SEQ ID NO: 31931 - DNA, 15 bp, Artificial Sequence
  dgRNA
  Pcdhga3
ttgactgaagaagct

SEQ ID NO: 31932 - DNA, 15 bp, Artificial Sequence
  dgRNA
  Pcdhga3
gtgcagtgaatgatt

SEQ ID NO: 31933 - DNA, 15 bp, Artificial Sequence
  dgRNA
  Pcdhga3
gaatgattaggcctc

SEQ ID NO: 31934 - DNA, 15 bp, Artificial Sequence
  dgRNA
  Pcdhga3
aatgattaggcctct

SEQ ID NO: 31935 - DNA, 15 bp, Artificial Sequence
  dgRNA
  2310050C09Rik
cagtcaggcatactg

SEQ ID NO: 31936 - DNA, 15 bp, Artificial Sequence
  dgRNA
  2310050C09Rik
tgtcctcgtgatccc

SEQ ID NO: 31937 - DNA, 15 bp, Artificial Sequence
  dgRNA
  2310050C09Rik
gagctgatattgcat

SEQ ID NO: 31938 - DNA, 15 bp, Artificial Sequence
  dgRNA
  2310050C09Rik
gcacctgggatcacg

SEQ ID NO: 31939 - DNA, 15 bp, Artificial Sequence
  dgRNA
  Tdh
ggccagctacaacat

SEQ ID NO: 31940 - DNA, 15 bp, Artificial Sequence
  dgRNA
  Tdh
acattggactgccaa

SEQ ID NO: 31941 - DNA, 15 bp, Artificial Sequence
  dgRNA
  Tdh
gagatacacttacat

SEQ ID NO: 31942 - DNA, 15 bp, Artificial Sequence
  dgRNA
  Tdh
agatacacttacatc

SEQ ID NO: 31943 - DNA, 15 bp, Artificial Sequence
  dgRNA
  Rpusd4
aaaccgttggggcac

SEQ ID NO: 31944 - DNA, 15 bp, Artificial Sequence
  dgRNA
  Rpusd4
gctgcagctaccggc

SEQ ID NO: 31945 - DNA, 15 bp, Artificial Sequence
  dgRNA
  Rpusd4
ccccacgtgacccgt

SEQ ID NO: 31946 - DNA, 15 bp, Artificial Sequence
  dgRNA
  Rpusd4
gcccacgtgatcagc

SEQ ID NO: 31947 - DNA, 15 bp, Artificial Sequence
  dgRNA
  Cyp2u1
caccagccgtcccgt

SEQ ID NO: 31948 - DNA, 15 bp, Artificial Sequence
  dgRNA
  Cyp2u1
gcccccaccttatgc

SEQ ID NO: 31949 - DNA, 15 bp, Artificial Sequence
  dgRNA
  Cyp2u1
tggaggatcccgaga

SEQ ID NO: 31950 - DNA, 15 bp, Artificial Sequence
  dgRNA
  Cyp2u1
ggaggatcccgagag

SEQ ID NO: 31951 - DNA, 15 bp, Artificial Sequence
  dgRNA
  Akirin2
agcttccgtctgcac

SEQ ID NO: 31952 - DNA, 15 bp, Artificial Sequence
  dgRNA
  Akirin2
tctgcaccggcgtgt

SEQ ID NO: 31953 - DNA, 15 bp, Artificial Sequence
  dgRNA
  Akirin2
gtcggagatcgcgtc

SEQ ID NO: 31954 - DNA, 15 bp, Artificial Sequence
  dgRNA
  Akirin2
tcggagatcgcgtct

SEQ ID NO: 31955 - DNA, 15 bp, Artificial Sequence
  dgRNA
  Rint1
tgacatccaaccagc

SEQ ID NO: 31956 - DNA, 15 bp, Artificial Sequence
  dgRNA
  Rint1
gacatccaaccagca

SEQ ID NO: 31957 - DNA, 15 bp, Artificial Sequence
  dgRNA
  Rint1
acggaaccagagagt

SEQ ID NO: 31958 - DNA, 15 bp, Artificial Sequence
  dgRNA
  Rint1
aattcggccctggca

SEQ ID NO: 31959 - DNA, 15 bp, Artificial Sequence
  dgRNA
  Hirip3
cgttcatgacccgcc

SEQ ID NO: 31960 - DNA, 15 bp, Artificial Sequence
  dgRNA
  Hirip3
gttcatgacccgcca

SEQ ID NO: 31961 - DNA, 15 bp, Artificial Sequence
  dgRNA
  Hirip3
cagggagaaacgccc

SEQ ID NO: 31962 - DNA, 15 bp, Artificial Sequence
  dgRNA
  Hirip3
ctacccaagtccgcc

SEQ ID NO: 31963 - DNA, 15 bp, Artificial Sequence
  dgRNA
  R3hdm2
gttgacgcacattgc

SEQ ID NO: 31964 - DNA, 15 bp, Artificial Sequence
  dgRNA
  R3hdm2
ccctccatgcccgac

SEQ ID NO: 31965 - DNA, 15 bp, Artificial Sequence
  dgRNA
  R3hdm2
ccagtcgggcatgga

SEQ ID NO: 31966 - DNA, 15 bp, Artificial Sequence
  dgRNA
  R3hdm2
gtcaccagtcgggca

SEQ ID NO: 31967 - DNA, 15 bp, Artificial Sequence
  dgRNA
  Il24
cctgtctaagagcaa

SEQ ID NO: 31968 - DNA, 15 bp, Artificial Sequence
  dgRNA
  Il24
ttggtcatgcttccc

SEQ ID NO: 31969 - DNA, 15 bp, Artificial Sequence
  dgRNA
  Ap1s2
gcgcgcgccgcgtcc

SEQ ID NO: 31970 - DNA, 15 bp, Artificial Sequence
  dgRNA
  Ap1s2
agtacgcaagcgcgc

SEQ ID NO: 31971 - DNA, 15 bp, Artificial Sequence
  dgRNA
  Ap1s2
gcctaggccgcttcc

SEQ ID NO: 31972 - DNA, 15 bp, Artificial Sequence
  dgRNA
  Ap1s2
acgtggccagacttc

SEQ ID NO: 31973 - DNA, 15 bp, Artificial Sequence
  dgRNA
  Phax
cccggagagtccact

SEQ ID NO: 31974 - DNA, 15 bp, Artificial Sequence
  dgRNA
  Phax
gagagtccacttggc

SEQ ID NO: 31975 - DNA, 15 bp, Artificial Sequence
  dgRNA
  Phax
tctgcgagcgctcat

SEQ ID NO: 31976 - DNA, 15 bp, Artificial Sequence
  dgRNA
  Phax
ctgcgagcgctcatt

SEQ ID NO: 31977 - DNA, 15 bp, Artificial Sequence
  dgRNA
  Fnbp1l
gccgccgagggtccg

SEQ ID NO: 31978 - DNA, 15 bp, Artificial Sequence
  dgRNA
  Fnbp1l
cgaggatccccgccc

SEQ ID NO: 31979 - DNA, 15 bp, Artificial Sequence
  dgRNA
  Fnbp1l
gaggatccccgcccc

SEQ ID NO: 31980 - DNA, 15 bp, Artificial Sequence
  dgRNA
  Fnbp1l
cccgggcgagctgtt

SEQ ID NO: 31981 - DNA, 15 bp, Artificial Sequence
  dgRNA
  Hist1h2ah
aaacctcgtttccat

SEQ ID NO: 31982 - DNA, 15 bp, Artificial Sequence
  dgRNA
  Hist1h2ah
aatgctaaccaatga

SEQ ID NO: 31983 - DNA, 15 bp, Artificial Sequence
  dgRNA
  Hist1h2ah
tcctttttcgcgccc

SEQ ID NO: 31984 - DNA, 15 bp, Artificial Sequence
  dgRNA
  Hist1h2ah
tagctaacgcttacc

SEQ ID NO: 31985 - DNA, 15 bp, Artificial Sequence
  dgRNA
  H2-Ob
tttctctcccgatgc

SEQ ID NO: 31986 - DNA, 15 bp, Artificial Sequence
  dgRNA
  H2-Ob
gtcttcgctcttgat

SEQ ID NO: 31987 - DNA, 15 bp, Artificial Sequence
  dgRNA
  H2-Ob
caagaactggttacc

SEQ ID NO: 31988 - DNA, 15 bp, Artificial Sequence
  dgRNA
  Inadl
gacttgtcgtttgtt

SEQ ID NO: 31989 - DNA, 15 bp, Artificial Sequence
  dgRNA
  Inadl
acttgtcgtttgttt

SEQ ID NO: 31990 - DNA, 15 bp, Artificial Sequence
  dgRNA
  Inadl
ttggggtctcggttt

SEQ ID NO: 31991 - DNA, 15 bp, Artificial Sequence
  dgRNA
  Inadl
tggggtctcggtttt

SEQ ID NO: 31992 - DNA, 15 bp, Artificial Sequence
  dgRNA
  Whrn
tcttcgaccagtaca

SEQ ID NO: 31993 - DNA, 15 bp, Artificial Sequence
  dgRNA
  Whrn
accagtacacggccg

SEQ ID NO: 31994 - DNA, 15 bp, Artificial Sequence
  dgRNA
  Whrn
ccagtacacggccga

SEQ ID NO: 31995 - DNA, 15 bp, Artificial Sequence
  dgRNA
  Whrn
gccaccaccccctac

SEQ ID NO: 31996 - DNA, 15 bp, Artificial Sequence
  dgRNA
  Serpinb3c
caaaaggtagtacag

SEQ ID NO: 31997 - DNA, 15 bp, Artificial Sequence
  dgRNA
  Serpinb3c
actaccttttgccac

SEQ ID NO: 31998 - DNA, 15 bp, Artificial Sequence
  dgRNA
  Golim4
atccaggctccacgt

SEQ ID NO: 31999 - DNA, 15 bp, Artificial Sequence
  dgRNA
  Golim4
cacgtgggcgcaccc

SEQ ID NO: 32000 - DNA, 15 bp, Artificial Sequence
  dgRNA
  Golim4
gcgcacccaggcgcc

SEQ ID NO: 32001 - DNA, 15 bp, Artificial Sequence
  dgRNA
  Golim4
cacccaggcgccagg

SEQ ID NO: 32002 - DNA, 15 bp, Artificial Sequence
  dgRNA
  Fsip1
atacccaattcttga

SEQ ID NO: 32003 - DNA, 15 bp, Artificial Sequence
  dgRNA
  Fsip1
caattcttgaaggta

SEQ ID NO: 32004 - DNA, 15 bp, Artificial Sequence
  dgRNA
  Fsip1
aattcttgaaggtac

SEQ ID NO: 32005 - DNA, 15 bp, Artificial Sequence
  dgRNA
  Fsip1
gcgcttctagttgcc

SEQ ID NO: 32006 - DNA, 15 bp, Artificial Sequence
  dgRNA
  Tmcc3
gccctctgtgaataa

SEQ ID NO: 32007 - DNA, 15 bp, Artificial Sequence
  dgRNA
  Tmcc3
aggaagtgccggccg

SEQ ID NO: 32008 - DNA, 15 bp, Artificial Sequence
  dgRNA
  Tmcc3
agtgccggccgaggc

SEQ ID NO: 32009 - DNA, 15 bp, Artificial Sequence
  dgRNA
  Tmcc3
gtgccggccgaggct

SEQ ID NO: 32010 - DNA, 15 bp, Artificial Sequence
  dgRNA
  Taok2
caccaaggatccgcg

SEQ ID NO: 32011 - DNA, 15 bp, Artificial Sequence
  dgRNA
  Taok2
caaggatccgcgtgg

SEQ ID NO: 32012 - DNA, 15 bp, Artificial Sequence
  dgRNA
  Taok2
aaggatccgcgtggc

SEQ ID NO: 32013 - DNA, 15 bp, Artificial Sequence
  dgRNA
  Taok2
aggatccgcgtggcg

SEQ ID NO: 32014 - DNA, 15 bp, Artificial Sequence
  dgRNA
  Cyp2d9
ggctcctccctattc

SEQ ID NO: 32015 - DNA, 15 bp, Artificial Sequence
  dgRNA
  Cyp2d9
gacccctcttcaaga

SEQ ID NO: 32016 - DNA, 15 bp, Artificial Sequence
  dgRNA
  Cyp2d9
tggcccggaataggg

SEQ ID NO: 32017 - DNA, 15 bp, Artificial Sequence
  dgRNA
  Cyp2d9
ttttggcccggaata

SEQ ID NO: 32018 - DNA, 15 bp, Artificial Sequence
  dgRNA
  Nelfe
gagtaaccacggagc

SEQ ID NO: 32019 - DNA, 15 bp, Artificial Sequence
  dgRNA
  Nelfe
ggccccgccccgaga

SEQ ID NO: 32020 - DNA, 15 bp, Artificial Sequence
  dgRNA
  Nelfe
gccccgccccgagaa

SEQ ID NO: 32021 - DNA, 15 bp, Artificial Sequence
  dgRNA
  Nelfe
ccgccccgagaaggg

SEQ ID NO: 32022 - DNA, 15 bp, Artificial Sequence
  dgRNA
  Snx20
atgccagctatcgtt

SEQ ID NO: 32023 - DNA, 15 bp, Artificial Sequence
  dgRNA
  Snx20
agatatttgtctagg

SEQ ID NO: 32024 - DNA, 15 bp, Artificial Sequence
  dgRNA
  Snx20
cagcaaccaataagc

SEQ ID NO: 32025 - DNA, 15 bp, Artificial Sequence
  dgRNA
  Snx20
gcaaccaataagctg

SEQ ID NO: 32026 - DNA, 15 bp, Artificial Sequence
  dgRNA
  Olfr307
ataacgaattagaag

SEQ ID NO: 32027 - DNA, 15 bp, Artificial Sequence
  dgRNA
  Olfr307
taacgaattagaaga

SEQ ID NO: 32028 - DNA, 15 bp, Artificial Sequence
  dgRNA
  Olfr307
gcaaggaactacata

SEQ ID NO: 32029 - DNA, 15 bp, Artificial Sequence
  dgRNA
  Fam134a
ttagctacgtccctg

SEQ ID NO: 32030 - DNA, 15 bp, Artificial Sequence
  dgRNA
  Fam134a
gtggctgcggctccg

SEQ ID NO: 32031 - DNA, 15 bp, Artificial Sequence
  dgRNA
  Fam134a
ctgcggctccgcggc

SEQ ID NO: 32032 - DNA, 15 bp, Artificial Sequence
  dgRNA
  Fam134a
tgcggctccgcggct

SEQ ID NO: 32033 - DNA, 15 bp, Artificial Sequence
  dgRNA
  Gstp1
gcaccgctgcagact

SEQ ID NO: 32034 - DNA, 15 bp, Artificial Sequence
  dgRNA
  Gstp1
caccgctgcagactc

SEQ ID NO: 32035 - DNA, 15 bp, Artificial Sequence
  dgRNA
  Gstp1
acaagcgagtgtccc

SEQ ID NO: 32036 - DNA, 15 bp, Artificial Sequence
  dgRNA
  Gstp1
agtgtccccggcagg

SEQ ID NO: 32037 - DNA, 15 bp, Artificial Sequence
  dgRNA
  Dcun1d3
cgccttgcccttact

SEQ ID NO: 32038 - DNA, 15 bp, Artificial Sequence
  dgRNA
  Dcun1d3
gcccttacttggaga

SEQ ID NO: 32039 - DNA, 15 bp, Artificial Sequence
  dgRNA
  Dcun1d3
acttggagacggctt

SEQ ID NO: 32040 - DNA, 15 bp, Artificial Sequence
  dgRNA
  Dcun1d3
ccctcctcgagccag

SEQ ID NO: 32041 - DNA, 15 bp, Artificial Sequence
  dgRNA
  Dis3l
ctaccttcacacccg

SEQ ID NO: 32042 - DNA, 15 bp, Artificial Sequence
  dgRNA
  Dis3l
cacccgaggattctt

SEQ ID NO: 32043 - DNA, 15 bp, Artificial Sequence
  dgRNA
  Dis3l
acccgaggattcttc

SEQ ID NO: 32044 - DNA, 15 bp, Artificial Sequence
  dgRNA
  Dis3l
tacacttttcccgcc

SEQ ID NO: 32045 - DNA, 15 bp, Artificial Sequence
  dgRNA
  Icam2
ccctgatctgaatct

SEQ ID NO: 32046 - DNA, 15 bp, Artificial Sequence
  dgRNA
  Icam2
ctaccaggcctcggt

SEQ ID NO: 32047 - DNA, 15 bp, Artificial Sequence
  dgRNA
  Icam2
acgtgttttgtgtgt

SEQ ID NO: 32048 - DNA, 15 bp, Artificial Sequence
  dgRNA
  Cox10
ctcgccttccgcccg

SEQ ID NO: 32049 - DNA, 15 bp, Artificial Sequence
  dgRNA
  Cox10
tcgccttccgcccgc

SEQ ID NO: 32050 - DNA, 15 bp, Artificial Sequence
  dgRNA
  Cox10
acgatctgtccctcc

SEQ ID NO: 32051 - DNA, 15 bp, Artificial Sequence
  dgRNA
  Cox10
cgatctgtccctccc

SEQ ID NO: 32052 - DNA, 15 bp, Artificial Sequence
  dgRNA
  Nbl1
ccctgtcccggccgt

SEQ ID NO: 32053 - DNA, 15 bp, Artificial Sequence
  dgRNA
  Nbl1
cctgtcccggccgtc

SEQ ID NO: 32054 - DNA, 15 bp, Artificial Sequence
  dgRNA
  Nbl1
ctgtcccggccgtcg

SEQ ID NO: 32055 - DNA, 15 bp, Artificial Sequence
  dgRNA
  Nbl1
ccggccgtcggggag

SEQ ID NO: 32056 - DNA, 15 bp, Artificial Sequence
  dgRNA
  Sftpa1
gctgtgtacacacga

SEQ ID NO: 32057 - DNA, 15 bp, Artificial Sequence
  dgRNA
  Sftpa1
tgataggggctctga

SEQ ID NO: 32058 - DNA, 15 bp, Artificial Sequence
  dgRNA
  Sftpa1
tagaacccttgaggg

SEQ ID NO: 32059 - DNA, 15 bp, Artificial Sequence
  dgRNA
  Sftpa1
acttagaacccttga

SEQ ID NO: 32060 - DNA, 15 bp, Artificial Sequence
  dgRNA
  Rabgap1
tcgctgtgttagctg

SEQ ID NO: 32061 - DNA, 15 bp, Artificial Sequence
  dgRNA
  Rabgap1
ctcagccctgcgcgc

SEQ ID NO: 32062 - DNA, 15 bp, Artificial Sequence
  dgRNA
  Rabgap1
ccctgcgcgcaggcg

SEQ ID NO: 32063 - DNA, 15 bp, Artificial Sequence
  dgRNA
  Rabgap1
cgcaggcgcggatcc

SEQ ID NO: 32064 - DNA, 15 bp, Artificial Sequence
  dgRNA
  Blzf1
tcacttccgtctggc

SEQ ID NO: 32065 - DNA, 15 bp, Artificial Sequence
  dgRNA
  Zfp410
tcaggtgctcttcat

SEQ ID NO: 32066 - DNA, 15 bp, Artificial Sequence
  dgRNA
  Zfp410
ttcgggagctgtcac

SEQ ID NO: 32067 - DNA, 15 bp, Artificial Sequence
  dgRNA
  Zfp410
ccatcccagccgccg

SEQ ID NO: 32068 - DNA, 15 bp, Artificial Sequence
  dgRNA
  Zfp410
aacagctccgctcag

SEQ ID NO: 32069 - DNA, 15 bp, Artificial Sequence
  dgRNA
  Heg1
cgatactccagggtg

SEQ ID NO: 32070 - DNA, 15 bp, Artificial Sequence
  dgRNA
  Heg1
tgtaacaaaagtcgc

SEQ ID NO: 32071 - DNA, 15 bp, Artificial Sequence
  dgRNA
  Heg1
gtaacaaaagtcgca

SEQ ID NO: 32072 - DNA, 15 bp, Artificial Sequence
  dgRNA
  Heg1
taacaaaagtcgcag

SEQ ID NO: 32073 - DNA, 15 bp, Artificial Sequence
  dgRNA
  Aoah
gccaacagagtgctt

SEQ ID NO: 32074 - DNA, 15 bp, Artificial Sequence
  dgRNA
  Aoah
ccaacagagtgcttc

SEQ ID NO: 32075 - DNA, 15 bp, Artificial Sequence
  dgRNA
  Aoah
ttcgggcaaacctca

SEQ ID NO: 32076 - DNA, 15 bp, Artificial Sequence
  dgRNA
  Aoah
acctcaaggttcatg

SEQ ID NO: 32077 - DNA, 15 bp, Artificial Sequence
  dgRNA
  Celf5
cggaggcacgtggtg

SEQ ID NO: 32078 - DNA, 15 bp, Artificial Sequence
  dgRNA
  Celf5
gcacgtggtgtgggc

SEQ ID NO: 32079 - DNA, 15 bp, Artificial Sequence
  dgRNA
  Celf5
cacgtggtgtgggcg

SEQ ID NO: 32080 - DNA, 15 bp, Artificial Sequence
  dgRNA
  Celf5
ggggagggcgctccg

SEQ ID NO: 32081 - DNA, 15 bp, Artificial Sequence
  dgRNA
  Smim18
aatgatctactcctc

SEQ ID NO: 32082 - DNA, 15 bp, Artificial Sequence
  dgRNA
  Smim18
actcctcaggacggc

SEQ ID NO: 32083 - DNA, 15 bp, Artificial Sequence
  dgRNA
  Smim18
agctgcattatgcgt

SEQ ID NO: 32084 - DNA, 15 bp, Artificial Sequence
  dgRNA
  Nudt14
gcgcagcactcccgc

SEQ ID NO: 32085 - DNA, 15 bp, Artificial Sequence
  dgRNA
  Nudt14
cccgcaggtgctacc

SEQ ID NO: 32086 - DNA, 15 bp, Artificial Sequence
  dgRNA
  Nudt14
gccccgcgtgtgaac

SEQ ID NO: 32087 - DNA, 15 bp, Artificial Sequence
  dgRNA
  Nudt14
ccccgcgtgtgaact

SEQ ID NO: 32088 - DNA, 15 bp, Artificial Sequence
  dgRNA
  Ptpn23
gaagccccttcaccg

SEQ ID NO: 32089 - DNA, 15 bp, Artificial Sequence
  dgRNA
  Ptpn23
cccttcaccgtggat

SEQ ID NO: 32090 - DNA, 15 bp, Artificial Sequence
  dgRNA
  Ptpn23
ccttcaccgtggatt

SEQ ID NO: 32091 - DNA, 15 bp, Artificial Sequence
  dgRNA
  Ptpn23
cgagcatgcgcgaag

SEQ ID NO: 32092 - DNA, 15 bp, Artificial Sequence
  dgRNA
  Gpr171
gtcagttactgtttt

SEQ ID NO: 32093 - DNA, 15 bp, Artificial Sequence
  dgRNA
  Gpr171
acgtagatgaaactg

SEQ ID NO: 32094 - DNA, 15 bp, Artificial Sequence
  dgRNA
  Lig1
gttgaccaaggccgc

SEQ ID NO: 32095 - DNA, 15 bp, Artificial Sequence
  dgRNA
  Lig1
aggccgcaggagttt

SEQ ID NO: 32096 - DNA, 15 bp, Artificial Sequence
  dgRNA
  Lig1
aaactcctgcggcct

SEQ ID NO: 32097 - DNA, 15 bp, Artificial Sequence
  dgRNA
  Lig1
acaccaaaactcctg

SEQ ID NO: 32098 - DNA, 15 bp, Artificial Sequence
  dgRNA
  Lrat
gcaggatctttcgcg

SEQ ID NO: 32099 - DNA, 15 bp, Artificial Sequence
  dgRNA
  Lrat
gcgcggccacgcctc

SEQ ID NO: 32100 - DNA, 15 bp, Artificial Sequence
  dgRNA
  Lrat
gcatctctcctacgc

SEQ ID NO: 32101 - DNA, 15 bp, Artificial Sequence
  dgRNA
  Lrat
acgctggctgtttaa

SEQ ID NO: 32102 - DNA, 15 bp, Artificial Sequence
  dgRNA
  Anapc5
aggcccccgctactg

SEQ ID NO: 32103 - DNA, 15 bp, Artificial Sequence
  dgRNA
  Anapc5
ggcccccgctactgt

SEQ ID NO: 32104 - DNA, 15 bp, Artificial Sequence
  dgRNA
  Anapc5
ttcccacagtagcgg

SEQ ID NO: 32105 - DNA, 15 bp, Artificial Sequence
  dgRNA
  Anapc5
tttcccacagtagcg

SEQ ID NO: 32106 - DNA, 15 bp, Artificial Sequence
  dgRNA
  Ttll6
caccaagcgcgcatt

SEQ ID NO: 32107 - DNA, 15 bp, Artificial Sequence
  dgRNA
  Ttll6
agcgcgcatttggag

SEQ ID NO: 32108 - DNA, 15 bp, Artificial Sequence
  dgRNA
  Ttll6
gcgcgcatttggagc

SEQ ID NO: 32109 - DNA, 15 bp, Artificial Sequence
  dgRNA
  Ttll6
cgcgcatttggagcg

SEQ ID NO: 32110 - DNA, 15 bp, Artificial Sequence
  dgRNA
  Brd3
cccccacgcgcccct

SEQ ID NO: 32111 - DNA, 15 bp, Artificial Sequence
  dgRNA
  Brd3
cacgcgcccctaggc

SEQ ID NO: 32112 - DNA, 15 bp, Artificial Sequence
  dgRNA
  Brd3
acgcgcccctaggcc

SEQ ID NO: 32113 - DNA, 15 bp, Artificial Sequence
  dgRNA
  Brd3
ctaggccgggcccgc

SEQ ID NO: 32114 - DNA, 15 bp, Artificial Sequence
  dgRNA
  Itga6
gcgggtgcgccgctg

SEQ ID NO: 32115 - DNA, 15 bp, Artificial Sequence
  dgRNA
  Itga6
cgggtgcgccgctgc

SEQ ID NO: 32116 - DNA, 15 bp, Artificial Sequence
  dgRNA
  Itga6
gggtgcgccgctgcg

SEQ ID NO: 32117 - DNA, 15 bp, Artificial Sequence
  dgRNA
  Itga6
tgcgccgctgcgggg

SEQ ID NO: 32118 - DNA, 15 bp, Artificial Sequence
  dgRNA
  Gzmg
cccaacttagctcat

SEQ ID NO: 32119 - DNA, 15 bp, Artificial Sequence
  dgRNA
  Gzmg
gctaagttgggataa

SEQ ID NO: 32120 - DNA, 15 bp, Artificial Sequence
  dgRNA
  Gzmg
cctatgagctaagtt

SEQ ID NO: 32121 - DNA, 15 bp, Artificial Sequence
  dgRNA
  Gzmg
tcctatgagctaagt

SEQ ID NO: 32122 - DNA, 15 bp, Artificial Sequence
  dgRNA
  Slco6d1
cctgtagagttctag

SEQ ID NO: 32123 - DNA, 15 bp, Artificial Sequence
  dgRNA
  Slco6d1
cgttatttccagtgc

SEQ ID NO: 32124 - DNA, 15 bp, Artificial Sequence
  dgRNA
  Slco6d1
cactagaactctaca

SEQ ID NO: 32125 - DNA, 15 bp, Artificial Sequence
  dgRNA
  Slco6d1
ccactagaactctac

SEQ ID NO: 32126 - DNA, 15 bp, Artificial Sequence
  dgRNA
  Crip3
gctgaatagtgggca

SEQ ID NO: 32127 - DNA, 15 bp, Artificial Sequence
  dgRNA
  Crip3
ggcggggcatatcag

SEQ ID NO: 32128 - DNA, 15 bp, Artificial Sequence
  dgRNA
  Crip3
gcggggcatatcagc

SEQ ID NO: 32129 - DNA, 15 bp, Artificial Sequence
  dgRNA
  Crip3
cctatagttgctgct

SEQ ID NO: 32130 - DNA, 15 bp, Artificial Sequence
  dgRNA
  Fes
gcgttcgcgggaccc

SEQ ID NO: 32131 - DNA, 15 bp, Artificial Sequence
  dgRNA
  Fes
aggccactcttcgca

SEQ ID NO: 32132 - DNA, 15 bp, Artificial Sequence
  dgRNA
  Fes
atggccattctttgc

SEQ ID NO: 32133 - DNA, 15 bp, Artificial Sequence
  dgRNA
  Fes
tcccttccgtttccg

SEQ ID NO: 32134 - DNA, 15 bp, Artificial Sequence
  dgRNA
  2410002F23Rik
ccttatcacctgatc

SEQ ID NO: 32135 - DNA, 15 bp, Artificial Sequence
  dgRNA
  2410002F23Rik
atcaggaatgtccta

SEQ ID NO: 32136 - DNA, 15 bp, Artificial Sequence
  dgRNA
  2410002F23Rik
tgccaccgtgaaagc

SEQ ID NO: 32137 - DNA, 15 bp, Artificial Sequence
  dgRNA
  2410002F23Rik
gctcaggcgtaagtg

SEQ ID NO: 32138 - DNA, 15 bp, Artificial Sequence
  dgRNA
  Eif4g1
acgtgaccggcgcag

SEQ ID NO: 32139 - DNA, 15 bp, Artificial Sequence
  dgRNA
  Tmem242
aggagggccgtcttg

SEQ ID NO: 32140 - DNA, 15 bp, Artificial Sequence
  dgRNA
  Tmem242
ggagggccgtcttgt

SEQ ID NO: 32141 - DNA, 15 bp, Artificial Sequence
  dgRNA
  Tmem242
gagggccgtcttgtg

SEQ ID NO: 32142 - DNA, 15 bp, Artificial Sequence
  dgRNA
  Tmem242
gtggggcgccgccct

SEQ ID NO: 32143 - DNA, 15 bp, Artificial Sequence
  dgRNA
  Erg
cctgtttcttcgggc

SEQ ID NO: 32144 - DNA, 15 bp, Artificial Sequence
  dgRNA
  Erg
ctgtttcttcgggct

SEQ ID NO: 32145 - DNA, 15 bp, Artificial Sequence
  dgRNA
  Erg
cggggctgtcacagc

SEQ ID NO: 32146 - DNA, 15 bp, Artificial Sequence
  dgRNA
  Erg
aattggctgaggccg

SEQ ID NO: 32147 - DNA, 15 bp, Artificial Sequence
  dgRNA
  Dnase1l1
ggattcgtcgagcag

SEQ ID NO: 32148 - DNA, 15 bp, Artificial Sequence
  dgRNA
  Dnase1l1
aagttgctattcgct

SEQ ID NO: 32149 - DNA, 15 bp, Artificial Sequence
  dgRNA
  Dnase1l1
catcatgggcggggt

SEQ ID NO: 32150 - DNA, 15 bp, Artificial Sequence
  dgRNA
  Dnase1l1
tcaggcacagcctac

SEQ ID NO: 32151 - DNA, 15 bp, Artificial Sequence
  dgRNA
  Ifna9
aagcgaaaagaccag

SEQ ID NO: 32152 - DNA, 15 bp, Artificial Sequence
  dgRNA
  Ifna9
agcgaaaagaccagt

SEQ ID NO: 32153 - DNA, 15 bp, Artificial Sequence
  dgRNA
  Ifna9
ctcttgtgggctgtt

SEQ ID NO: 32154 - DNA, 15 bp, Artificial Sequence
  dgRNA
  Pomp
tttataaaaccgtaa

SEQ ID NO: 32155 - DNA, 15 bp, Artificial Sequence
  dgRNA
  Pomp
accaccgtgcgtcct

SEQ ID NO: 32156 - DNA, 15 bp, Artificial Sequence
  dgRNA
  Pomp
ccgtgcgtccttgga

SEQ ID NO: 32157 - DNA, 15 bp, Artificial Sequence
  dgRNA
  Pomp
tccttggatggcccg

SEQ ID NO: 32158 - DNA, 15 bp, Artificial Sequence
  dgRNA
  Gnai2
tgtcttccctcgttg

SEQ ID NO: 32159 - DNA, 15 bp, Artificial Sequence
  dgRNA
  Gnai2
ctcagcttgcgccta

SEQ ID NO: 32160 - DNA, 15 bp, Artificial Sequence
  dgRNA
  Gnai2
gcttgcgcctaaggc

SEQ ID NO: 32161 - DNA, 15 bp, Artificial Sequence
  dgRNA
  Gnai2
gccccggcccagtcg

SEQ ID NO: 32162 - DNA, 15 bp, Artificial Sequence
  dgRNA
  C2cd3
gggtaacggagtctg

SEQ ID NO: 32163 - DNA, 15 bp, Artificial Sequence
  dgRNA
  C2cd3
ctcgacaaccctagc

SEQ ID NO: 32164 - DNA, 15 bp, Artificial Sequence
  dgRNA
  C2cd3
gaagagacctcttga

SEQ ID NO: 32165 - DNA, 15 bp, Artificial Sequence
  dgRNA
  C2cd3
cgcttgcgcagatgc

SEQ ID NO: 32166 - DNA, 15 bp, Artificial Sequence
  dgRNA
  Pklr
gactaaaaattgacc

SEQ ID NO: 32167 - DNA, 15 bp, Artificial Sequence
  dgRNA
  Pklr
aaaacggatgaccta

SEQ ID NO: 32168 - DNA, 15 bp, Artificial Sequence
  dgRNA
  Pklr
aaacggatgacctag

SEQ ID NO: 32169 - DNA, 15 bp, Artificial Sequence
  dgRNA
  Pklr
cgacagccctccaga

SEQ ID NO: 32170 - DNA, 15 bp, Artificial Sequence
  dgRNA
  Cd7
gtggtgaagctccga

SEQ ID NO: 32171 - DNA, 15 bp, Artificial Sequence
  dgRNA
  Cd7
gttcaatgcgattgg

SEQ ID NO: 32172 - DNA, 15 bp, Artificial Sequence
  dgRNA
  Cd7
gcagttcaatgcgat

SEQ ID NO: 32173 - DNA, 15 bp, Artificial Sequence
  dgRNA
  Cd7
accaaaaaccctgag

SEQ ID NO: 32174 - DNA, 15 bp, Artificial Sequence
  dgRNA
  Polr2d
cgaccgcccccctcg

SEQ ID NO: 32175 - DNA, 15 bp, Artificial Sequence
  dgRNA
  Polr2d
gaccgcccccctcgc

SEQ ID NO: 32176 - DNA, 15 bp, Artificial Sequence
  dgRNA
  Polr2d
ccccgcccattcact

SEQ ID NO: 32177 - DNA, 15 bp, Artificial Sequence
  dgRNA
  Polr2d
gcctccgagctggat

SEQ ID NO: 32178 - DNA, 15 bp, Artificial Sequence
  dgRNA
  Pnlip
ttcccacggacacct

SEQ ID NO: 32179 - DNA, 15 bp, Artificial Sequence
  dgRNA
  Pnlip
ggaacgctcagcctc

SEQ ID NO: 32180 - DNA, 15 bp, Artificial Sequence
  dgRNA
  Pnlip
cctccggtacttctc

SEQ ID NO: 32181 - DNA, 15 bp, Artificial Sequence
  dgRNA
  Pnlip
ctccggtacttctct

SEQ ID NO: 32182 - DNA, 15 bp, Artificial Sequence
  dgRNA
  Hdac3
ctatgaatggtgcca

SEQ ID NO: 32183 - DNA, 15 bp, Artificial Sequence
  dgRNA
  Hdac3
tatgaatggtgccac

SEQ ID NO: 32184 - DNA, 15 bp, Artificial Sequence
  dgRNA
  Hdac3
cacgggtccccttcc

SEQ ID NO: 32185 - DNA, 15 bp, Artificial Sequence
  dgRNA
  Hdac3
tcaagcctcggaatc

SEQ ID NO: 32186 - DNA, 15 bp, Artificial Sequence
  dgRNA
  Dclre1b
tcgccctgagacaca

SEQ ID NO: 32187 - DNA, 15 bp, Artificial Sequence
  dgRNA
  Dclre1b
ccgagcgccgagcgc

SEQ ID NO: 32188 - DNA, 15 bp, Artificial Sequence
  dgRNA
  Dclre1b
cgccgagcgcaggtc

SEQ ID NO: 32189 - DNA, 15 bp, Artificial Sequence
  dgRNA
  Dclre1b
gccgagcgcaggtcc

SEQ ID NO: 32190 - DNA, 15 bp, Artificial Sequence
  dgRNA
  Lmna
aaccaatatgggtct

SEQ ID NO: 32191 - DNA, 15 bp, Artificial Sequence
  dgRNA
  Lmna
ggccggaagttagcc

SEQ ID NO: 32192 - DNA, 15 bp, Artificial Sequence
  dgRNA
  Lmna
ggttgcagtcccagg

SEQ ID NO: 32193 - DNA, 15 bp, Artificial Sequence
  dgRNA
  Lmna
tacctggctaacttc

SEQ ID NO: 32194 - DNA, 15 bp, Artificial Sequence
  dgRNA
  Epb41l5
ttctatagtcccatc

SEQ ID NO: 32195 - DNA, 15 bp, Artificial Sequence
  dgRNA
  Epb41l5
caggaggccgatttc

SEQ ID NO: 32196 - DNA, 15 bp, Artificial Sequence
  dgRNA
  Epb41l5
aggaggccgatttcc

SEQ ID NO: 32197 - DNA, 15 bp, Artificial Sequence
  dgRNA
  Epb41l5
ggaggccgatttccg

SEQ ID NO: 32198 - DNA, 15 bp, Artificial Sequence
  dgRNA
  Pp2d1
caacctttgtgatcc

SEQ ID NO: 32199 - DNA, 15 bp, Artificial Sequence
  dgRNA
  Pp2d1
gttgaccatctaatc

SEQ ID NO: 32200 - DNA, 15 bp, Artificial Sequence
  dgRNA
  Park2
cgtgacgagcgtttc

SEQ ID NO: 32201 - DNA, 15 bp, Artificial Sequence
  dgRNA
  Park2
gagcgtttccggaaa

SEQ ID NO: 32202 - DNA, 15 bp, Artificial Sequence
  dgRNA
  Park2
agttgcagctgccgg

SEQ ID NO: 32203 - DNA, 15 bp, Artificial Sequence
  dgRNA
  Park2
cggaggcgaatctta

SEQ ID NO: 32204 - DNA, 15 bp, Artificial Sequence
  dgRNA
  Coq2
ccatacggctcagcc

SEQ ID NO: 32205 - DNA, 15 bp, Artificial Sequence
  dgRNA
  Coq2
gcgcatgcctgcccg

SEQ ID NO: 32206 - DNA, 15 bp, Artificial Sequence
  dgRNA
  Coq2
ccgggctgagccgta

SEQ ID NO: 32207 - DNA, 15 bp, Artificial Sequence
  dgRNA
  Coq2
gcgcgctcctggaac

SEQ ID NO: 32208 - DNA, 15 bp, Artificial Sequence
  dgRNA
  2410131K14Rik
gcgccacgtgacttc

SEQ ID NO: 32209 - DNA, 15 bp, Artificial Sequence
  dgRNA
  2410131K14Rik
cacgtgacttccggc

SEQ ID NO: 32210 - DNA, 15 bp, Artificial Sequence
  dgRNA
  2410131K14Rik
caccgagaacgcgat

SEQ ID NO: 32211 - DNA, 15 bp, Artificial Sequence
  dgRNA
  2410131K14Rik
aacgcgatcggcgct

SEQ ID NO: 32212 - DNA, 15 bp, Artificial Sequence
  dgRNA
  Tonsl
cctgatggcgccagt

SEQ ID NO: 32213 - DNA, 15 bp, Artificial Sequence
  dgRNA
  Tonsl
ggagtctaccgcact

SEQ ID NO: 32214 - DNA, 15 bp, Artificial Sequence
  dgRNA
  Tonsl
gagtctaccgcactt

SEQ ID NO: 32215 - DNA, 15 bp, Artificial Sequence
  dgRNA
  Tonsl
cacttgggccaccga

SEQ ID NO: 32216 - DNA, 15 bp, Artificial Sequence
  dgRNA
  Rfc2
cactgcggcctctag

SEQ ID NO: 32217 - DNA, 15 bp, Artificial Sequence
  dgRNA
  Rfc2
cggcctctagcggcc

SEQ ID NO: 32218 - DNA, 15 bp, Artificial Sequence
  dgRNA
  Rfc2
ggcctctagcggcca

SEQ ID NO: 32219 - DNA, 15 bp, Artificial Sequence
  dgRNA
  Rfc2
ccagggatggctacg

SEQ ID NO: 32220 - DNA, 15 bp, Artificial Sequence
  dgRNA
  Fabp3
ggcgtttctccagcg

SEQ ID NO: 32221 - DNA, 15 bp, Artificial Sequence
  dgRNA
  Fabp3
cgtggcaccagctca

SEQ ID NO: 32222 - DNA, 15 bp, Artificial Sequence
  dgRNA
  Fabp3
tcctttcagtatggc

SEQ ID NO: 32223 - DNA, 15 bp, Artificial Sequence
  dgRNA
  Fabp3
cctttcagtatggcc

SEQ ID NO: 32224 - DNA, 15 bp, Artificial Sequence
  dgRNA
  Runx1t1
tggggtcaaagcgag

SEQ ID NO: 32225 - DNA, 15 bp, Artificial Sequence
  dgRNA
  Runx1t1
gaccggcttgggatg

SEQ ID NO: 32226 - DNA, 15 bp, Artificial Sequence
  dgRNA
  Runx1t1
ggaccggcttgggat

SEQ ID NO: 32227 - DNA, 15 bp, Artificial Sequence
  dgRNA
  Runx1t1
gggaccggcttggga

SEQ ID NO: 32228 - DNA, 15 bp, Artificial Sequence
  dgRNA
  Foxp3
attattagaagagcg

SEQ ID NO: 32229 - DNA, 15 bp, Artificial Sequence
  dgRNA
  Foxp3
gcggcttccacgccg

SEQ ID NO: 32230 - DNA, 15 bp, Artificial Sequence
  dgRNA
  Foxp3
ctgataattgcaggg

SEQ ID NO: 32231 - DNA, 15 bp, Artificial Sequence
  dgRNA
  Foxp3
gtgctgataattgca

SEQ ID NO: 32232 - DNA, 15 bp, Artificial Sequence
  dgRNA
  P2rx2
tgctatgagaaacct

SEQ ID NO: 32233 - DNA, 15 bp, Artificial Sequence
  dgRNA
  P2rx2
cttgggctcctcccg

SEQ ID NO: 32234 - DNA, 15 bp, Artificial Sequence
  dgRNA
  P2rx2
ctcccggggctctcc

SEQ ID NO: 32235 - DNA, 15 bp, Artificial Sequence
  dgRNA
  P2rx2
cggggctctccgggc

SEQ ID NO: 32236 - DNA, 15 bp, Artificial Sequence
  dgRNA
  Chn2
ttgctaagaatgagt

SEQ ID NO: 32237 - DNA, 15 bp, Artificial Sequence
  dgRNA
  Chn2
gtagtgatttaccat

SEQ ID NO: 32238 - DNA, 15 bp, Artificial Sequence
  dgRNA
  Chn2
cgtttatgagatcac

SEQ ID NO: 32239 - DNA, 15 bp, Artificial Sequence
  dgRNA
  Chn2
tgaggaccagccatt

SEQ ID NO: 32240 - DNA, 15 bp, Artificial Sequence
  dgRNA
  Piezo2
aactataggcacact

SEQ ID NO: 32241 - DNA, 15 bp, Artificial Sequence
  dgRNA
  Piezo2
tataggcacacttgg

SEQ ID NO: 32242 - DNA, 15 bp, Artificial Sequence
  dgRNA
  Piezo2
ataggcacacttggc

SEQ ID NO: 32243 - DNA, 15 bp, Artificial Sequence
  dgRNA
  Piezo2
taggcacacttggcg

SEQ ID NO: 32244 - DNA, 15 bp, Artificial Sequence
  dgRNA
  Hist1h2be
ttcgtacgtcccgat

SEQ ID NO: 32245 - DNA, 15 bp, Artificial Sequence
  dgRNA
  Hist1h2be
tcgctttcaccaatc

SEQ ID NO: 32246 - DNA, 15 bp, Artificial Sequence
  dgRNA
  Hist1h2be
ttcgctttcaccaat

SEQ ID NO: 32247 - DNA, 15 bp, Artificial Sequence
  dgRNA
  Hist1h2be
ggtctactgtctcat

SEQ ID NO: 32248 - DNA, 15 bp, Artificial Sequence
  dgRNA
  Oaf
gcctagaccacaaag

SEQ ID NO: 32249 - DNA, 15 bp, Artificial Sequence
  dgRNA
  Oaf
agcggctgagccccg

SEQ ID NO: 32250 - DNA, 15 bp, Artificial Sequence
  dgRNA
  Oaf
cctttaagggccaag

SEQ ID NO: 32251 - DNA, 15 bp, Artificial Sequence
  dgRNA
  Oaf
tgcgcggtctcttta

SEQ ID NO: 32252 - DNA, 15 bp, Artificial Sequence
  dgRNA
  Smndc1
ccgctccgccttccg

SEQ ID NO: 32253 - DNA, 15 bp, Artificial Sequence
  dgRNA
  Smndc1
cgaggctgcaatcgc

SEQ ID NO: 32254 - DNA, 15 bp, Artificial Sequence
  dgRNA
  Smndc1
gctgagagggcggcg

SEQ ID NO: 32255 - DNA, 15 bp, Artificial Sequence
  dgRNA
  Smndc1
ctgagagggcggcga

SEQ ID NO: 32256 - DNA, 15 bp, Artificial Sequence
  dgRNA
  Ranbp6
caggagcacatcggt

SEQ ID NO: 32257 - DNA, 15 bp, Artificial Sequence
  dgRNA
  Ranbp6
catcggtcggagaac

SEQ ID NO: 32258 - DNA, 15 bp, Artificial Sequence
  dgRNA
  Ranbp6
ttcaccccgccgcag

SEQ ID NO: 32259 - DNA, 15 bp, Artificial Sequence
  dgRNA
  Ranbp6
cgccgcagcggagag

SEQ ID NO: 32260 - DNA, 15 bp, Artificial Sequence
  dgRNA
  Rilpl1
gagctcctaggtgcg

SEQ ID NO: 32261 - DNA, 15 bp, Artificial Sequence
  dgRNA
  Rilpl1
agctcctaggtgcga

SEQ ID NO: 32262 - DNA, 15 bp, Artificial Sequence
  dgRNA
  Rilpl1
tcctcctgcactatc

SEQ ID NO: 32263 - DNA, 15 bp, Artificial Sequence
  dgRNA
  Rilpl1
cactatctggatcgc

SEQ ID NO: 32264 - DNA, 15 bp, Artificial Sequence
  dgRNA
  Sulf2
cctctggtggcttcg

SEQ ID NO: 32265 - DNA, 15 bp, Artificial Sequence
  dgRNA
  Sulf2
gttctccctttacca

SEQ ID NO: 32266 - DNA, 15 bp, Artificial Sequence
  dgRNA
  Sulf2
ctttaccaagggaac

SEQ ID NO: 32267 - DNA, 15 bp, Artificial Sequence
  dgRNA
  Sulf2
gaacggggcgggcct

SEQ ID NO: 32268 - DNA, 15 bp, Artificial Sequence
  dgRNA
  Flrt2
cagccacacgcccac

SEQ ID NO: 32269 - DNA, 15 bp, Artificial Sequence
  dgRNA
  Flrt2
gaaagccagcgtctg

SEQ ID NO: 32270 - DNA, 15 bp, Artificial Sequence
  dgRNA
  Flrt2
aatctagcttctatc

SEQ ID NO: 32271 - DNA, 15 bp, Artificial Sequence
  dgRNA
  Flrt2
ttctatccggagtgt

SEQ ID NO: 32272 - DNA, 15 bp, Artificial Sequence
  dgRNA
  Slmo2
aaagtcccgccgcca

SEQ ID NO: 32273 - DNA, 15 bp, Artificial Sequence
  dgRNA
  Slmo2
cgcgcatgcgtagtg

SEQ ID NO: 32274 - DNA, 15 bp, Artificial Sequence
  dgRNA
  Slmo2
tgcgtagtgcggcgc

SEQ ID NO: 32275 - DNA, 15 bp, Artificial Sequence
  dgRNA
  Slmo2
tagtgcggcgccggc

SEQ ID NO: 32276 - DNA, 15 bp, Artificial Sequence
  dgRNA
  Hdac9
caggctgcaatcact

SEQ ID NO: 32277 - DNA, 15 bp, Artificial Sequence
  dgRNA
  Hdac9
tgcttgacctatttt

SEQ ID NO: 32278 - DNA, 15 bp, Artificial Sequence
  dgRNA
  Hdac9
acctatttttggctc

SEQ ID NO: 32279 - DNA, 15 bp, Artificial Sequence
  dgRNA
  Hdac9
tctctcagctcaagt

SEQ ID NO: 32280 - DNA, 15 bp, Artificial Sequence
  dgRNA
  Brwd1
tccgccgccgcacaa

SEQ ID NO: 32281 - DNA, 15 bp, Artificial Sequence
  dgRNA
  Brwd1
ccgccgcacaaaggc

SEQ ID NO: 32282 - DNA, 15 bp, Artificial Sequence
  dgRNA
  Brwd1
ccgcacaaaggccgg

SEQ ID NO: 32283 - DNA, 15 bp, Artificial Sequence
  dgRNA
  Brwd1
cgcctcaccgcgcgc

SEQ ID NO: 32284 - DNA, 15 bp, Artificial Sequence
  dgRNA
  1110008F13Rik
tcgctcaccgtcccc

SEQ ID NO: 32285 - DNA, 15 bp, Artificial Sequence
  dgRNA
  1110008F13Rik
tcccctggcgtccgc

SEQ ID NO: 32286 - DNA, 15 bp, Artificial Sequence
  dgRNA
  1110008F13Rik
gtcacttccgcccac

SEQ ID NO: 32287 - DNA, 15 bp, Artificial Sequence
  dgRNA
  1110008F13Rik
acttccgcccaccgg

SEQ ID NO: 32288 - DNA, 15 bp, Artificial Sequence
  dgRNA
  Git2
ttcaagatggcgata

SEQ ID NO: 32289 - DNA, 15 bp, Artificial Sequence
  dgRNA
  Git2
gaagcgtgccctttc

SEQ ID NO: 32290 - DNA, 15 bp, Artificial Sequence
  dgRNA
  Git2
gcgtgcgcagtgtgc

SEQ ID NO: 32291 - DNA, 15 bp, Artificial Sequence
  dgRNA
  Git2
cgtgcgcagtgtgcc

SEQ ID NO: 32292 - DNA, 15 bp, Artificial Sequence
  dgRNA
  Cox6a1
cggacatcctcacct

SEQ ID NO: 32293 - DNA, 15 bp, Artificial Sequence
  dgRNA
  Cox6a1
taggcgctgacaagc

SEQ ID NO: 32294 - DNA, 15 bp, Artificial Sequence
  dgRNA
  Cox6a1
aggcgctgacaagca

SEQ ID NO: 32295 - DNA, 15 bp, Artificial Sequence
  dgRNA
  Cox6a1
gctccagccgcccca

SEQ ID NO: 32296 - DNA, 15 bp, Artificial Sequence
  dgRNA
  Vat1
atcaagtcttagact

SEQ ID NO: 32297 - DNA, 15 bp, Artificial Sequence
  dgRNA
  Vat1
cgcgccctcgcagct

SEQ ID NO: 32298 - DNA, 15 bp, Artificial Sequence
  dgRNA
  Vat1
cagctcggtcagcag

SEQ ID NO: 32299 - DNA, 15 bp, Artificial Sequence
  dgRNA
  Vat1
agctcggtcagcaga

SEQ ID NO: 32300 - DNA, 15 bp, Artificial Sequence
  dgRNA
  Ap2b1
gtccgtctgtagtcc

SEQ ID NO: 32301 - DNA, 15 bp, Artificial Sequence
  dgRNA
  Ap2b1
tacattgaacaagac

SEQ ID NO: 32302 - DNA, 15 bp, Artificial Sequence
  dgRNA
  Ap2b1
acggcgactcaaaga

SEQ ID NO: 32303 - DNA, 15 bp, Artificial Sequence
  dgRNA
  Ap2b1
acggacggatgaact

SEQ ID NO: 32304 - DNA, 15 bp, Artificial Sequence
  dgRNA
  Fan1
agtgtaaagctcttg

SEQ ID NO: 32305 - DNA, 15 bp, Artificial Sequence
  dgRNA
  Fan1
ccactagctgagcct

SEQ ID NO: 32306 - DNA, 15 bp, Artificial Sequence
  dgRNA
  Fan1
cttggagcgaagacg

SEQ ID NO: 32307 - DNA, 15 bp, Artificial Sequence
  dgRNA
  Fan1
ttggagcgaagacgc

SEQ ID NO: 32308 - DNA, 15 bp, Artificial Sequence
  dgRNA
  Cadps2
cgtgtccggaaagcc

SEQ ID NO: 32309 - DNA, 15 bp, Artificial Sequence
  dgRNA
  Cadps2
gtgtccggaaagccc

SEQ ID NO: 32310 - DNA, 15 bp, Artificial Sequence
  dgRNA
  Cadps2
ttcgttctgcggccg

SEQ ID NO: 32311 - DNA, 15 bp, Artificial Sequence
  dgRNA
  Cadps2
gtggcccgggctttc

SEQ ID NO: 32312 - DNA, 15 bp, Artificial Sequence
  dgRNA
  Ndufv2
cgggccggcctttta

SEQ ID NO: 32313 - DNA, 15 bp, Artificial Sequence
  dgRNA
  Ndufv2
cggccttttagggac

SEQ ID NO: 32314 - DNA, 15 bp, Artificial Sequence
  dgRNA
  Ndufv2
ggccttttagggact

SEQ ID NO: 32315 - DNA, 15 bp, Artificial Sequence
  dgRNA
  Ndufv2
ttcgggcccgcccac

SEQ ID NO: 32316 - DNA, 15 bp, Artificial Sequence
  dgRNA
  4931423N10Rik
cgcattaacctttat

SEQ ID NO: 32317 - DNA, 15 bp, Artificial Sequence
  dgRNA
  4931423N10Rik
acctttattggcttc

SEQ ID NO: 32318 - DNA, 15 bp, Artificial Sequence
  dgRNA
  4931423N10Rik
ggcttcaggtagtcg

SEQ ID NO: 32319 - DNA, 15 bp, Artificial Sequence
  dgRNA
  4931423N10Rik
gcttcaggtagtcga

SEQ ID NO: 32320 - DNA, 15 bp, Artificial Sequence
  dgRNA
  Nr1h5
acaatcctccccctt

SEQ ID NO: 32321 - DNA, 15 bp, Artificial Sequence
  dgRNA
  Nr1h5
gtttagcattgctga

SEQ ID NO: 32322 - DNA, 15 bp, Artificial Sequence
  dgRNA
  Ehd3
cctgcgctttcccac

SEQ ID NO: 32323 - DNA, 15 bp, Artificial Sequence
  dgRNA
  Ehd3
cagatagagtccgcg

SEQ ID NO: 32324 - DNA, 15 bp, Artificial Sequence
  dgRNA
  Ehd3
tgcccatagacatgg

SEQ ID NO: 32325 - DNA, 15 bp, Artificial Sequence
  dgRNA
  Ehd3
tggcggcgccctcct

SEQ ID NO: 32326 - DNA, 15 bp, Artificial Sequence
  dgRNA
  Hic1
ggtctcaggtagtag

SEQ ID NO: 32327 - DNA, 15 bp, Artificial Sequence
  dgRNA
  Hic1
ttcggagcaggagcg

SEQ ID NO: 32328 - DNA, 15 bp, Artificial Sequence
  dgRNA
  Hic1
gttcggagcaggagc

SEQ ID NO: 32329 - DNA, 15 bp, Artificial Sequence
  dgRNA
  Hic1
acatacgttcggagc

SEQ ID NO: 32330 - DNA, 15 bp, Artificial Sequence
  dgRNA
  Dram2
agcaactccgactcc

SEQ ID NO: 32331 - DNA, 15 bp, Artificial Sequence
  dgRNA
  Dram2
acgattgccgtaaag

SEQ ID NO: 32332 - DNA, 15 bp, Artificial Sequence
  dgRNA
  Dram2
cgattgccgtaaaga

SEQ ID NO: 32333 - DNA, 15 bp, Artificial Sequence
  dgRNA
  Dram2
gattgccgtaaagag

SEQ ID NO: 32334 - DNA, 15 bp, Artificial Sequence
  dgRNA
  Vgll4
cggcctctggctccg

SEQ ID NO: 32335 - DNA, 15 bp, Artificial Sequence
  dgRNA
  Vgll4
taattctgcagcgcc

SEQ ID NO: 32336 - DNA, 15 bp, Artificial Sequence
  dgRNA
  Vgll4
cgctgcagaattagc

SEQ ID NO: 32337 - DNA, 15 bp, Artificial Sequence
  dgRNA
  Cox7b2
ctgtggcggtaaatg

SEQ ID NO: 32338 - DNA, 15 bp, Artificial Sequence
  dgRNA
  Cox7b2
tttgattggtcagat

SEQ ID NO: 32339 - DNA, 15 bp, Artificial Sequence
  dgRNA
  Cox7b2
gtcagattggaacat

SEQ ID NO: 32340 - DNA, 15 bp, Artificial Sequence
  dgRNA
  Cox7b2
gattggaacattgga

SEQ ID NO: 32341 - DNA, 15 bp, Artificial Sequence
  dgRNA
  Ccdc94
cggaacctttatttc

SEQ ID NO: 32342 - DNA, 15 bp, Artificial Sequence
  dgRNA
  Ccdc94
tcgggtttcaactac

SEQ ID NO: 32343 - DNA, 15 bp, Artificial Sequence
  dgRNA
  Ccdc94
tcaactaccggcacc

SEQ ID NO: 32344 - DNA, 15 bp, Artificial Sequence
  dgRNA
  Ccdc94
ctaccggcacccgga

SEQ ID NO: 32345 - DNA, 15 bp, Artificial Sequence
  dgRNA
  Ubr3
aagttgggagtcaac

SEQ ID NO: 32346 - DNA, 15 bp, Artificial Sequence
  dgRNA
  Ubr3
gtggggagcccgacg

SEQ ID NO: 32347 - DNA, 15 bp, Artificial Sequence
  dgRNA
  Ubr3
tggggagcccgacga

SEQ ID NO: 32348 - DNA, 15 bp, Artificial Sequence
  dgRNA
  Ubr3
ggggagcccgacgag

SEQ ID NO: 32349 - DNA, 15 bp, Artificial Sequence
  dgRNA
  Tsc22d2
tccacgcgaagccgc

SEQ ID NO: 32350 - DNA, 15 bp, Artificial Sequence
  dgRNA
  Tsc22d2
gaagccgcaggaaac

SEQ ID NO: 32351 - DNA, 15 bp, Artificial Sequence
  dgRNA
  Tsc22d2
gccgcaggaaaccgg

SEQ ID NO: 32352 - DNA, 15 bp, Artificial Sequence
  dgRNA
  Tsc22d2
ccgcaggaaaccgga

SEQ ID NO: 32353 - DNA, 15 bp, Artificial Sequence
  dgRNA
  Zfp160
cccactagcacgcag

SEQ ID NO: 32354 - DNA, 15 bp, Artificial Sequence
  dgRNA
  Zfp160
cgccttattttaccc

SEQ ID NO: 32355 - DNA, 15 bp, Artificial Sequence
  dgRNA
  Zfp160
ccactgcgtgctagt

SEQ ID NO: 32356 - DNA, 15 bp, Artificial Sequence
  dgRNA
  Zfp160
gccactgcgtgctag

SEQ ID NO: 32357 - DNA, 15 bp, Artificial Sequence
  dgRNA
  Tnks
ggactccacccactt

SEQ ID NO: 32358 - DNA, 15 bp, Artificial Sequence
  dgRNA
  Tnks
tccacccacttcggc

SEQ ID NO: 32359 - DNA, 15 bp, Artificial Sequence
  dgRNA
  Tnks
catttccgggtatgt

SEQ ID NO: 32360 - DNA, 15 bp, Artificial Sequence
  dgRNA
  Tnks
atgttggatcccgat

SEQ ID NO: 32361 - DNA, 15 bp, Artificial Sequence
  dgRNA
  Mageh1
cattctcttgcgcgc

SEQ ID NO: 32362 - DNA, 15 bp, Artificial Sequence
  dgRNA
  Mageh1
tcttaactaccattg

SEQ ID NO: 32363 - DNA, 15 bp, Artificial Sequence
  dgRNA
  Mageh1
cgctccttttccttt

SEQ ID NO: 32364 - DNA, 15 bp, Artificial Sequence
  dgRNA
  Mageh1
tttcctttcggctag

SEQ ID NO: 32365 - DNA, 15 bp, Artificial Sequence
  dgRNA
  Fktn
tgtactgccatactt

SEQ ID NO: 32366 - DNA, 15 bp, Artificial Sequence
  dgRNA
  Fktn
tttatcgtcagcatt

SEQ ID NO: 32367 - DNA, 15 bp, Artificial Sequence
  dgRNA
  Mns1
cccttcggatgtaaa

SEQ ID NO: 32368 - DNA, 15 bp, Artificial Sequence
  dgRNA
  Mns1
taaacggctcccgct

SEQ ID NO: 32369 - DNA, 15 bp, Artificial Sequence
  dgRNA
  Mns1
aaacggctcccgcta

SEQ ID NO: 32370 - DNA, 15 bp, Artificial Sequence
  dgRNA
  Mns1
cgaacttcgcgcttt

SEQ ID NO: 32371 - DNA, 15 bp, Artificial Sequence
  dgRNA
  Nfasc
ttgatccttagcgcg

SEQ ID NO: 32372 - DNA, 15 bp, Artificial Sequence
  dgRNA
  Nfasc
tgatccttagcgcgt

SEQ ID NO: 32373 - DNA, 15 bp, Artificial Sequence
  dgRNA
  Nfasc
gatccttagcgcgtg

SEQ ID NO: 32374 - DNA, 15 bp, Artificial Sequence
  dgRNA
  Nfasc
ccttagcgcgtgggg

SEQ ID NO: 32375 - DNA, 15 bp, Artificial Sequence
  dgRNA
  Mtch2
acttccggcttgcgc

SEQ ID NO: 32376 - DNA, 15 bp, Artificial Sequence
  dgRNA
  Mtch2
aatcgcctttcctag

SEQ ID NO: 32377 - DNA, 15 bp, Artificial Sequence
  dgRNA
  Mtch2
tttcctagaggcgcg

SEQ ID NO: 32378 - DNA, 15 bp, Artificial Sequence
  dgRNA
  Mtch2
aagccccgccccagg

SEQ ID NO: 32379 - DNA, 15 bp, Artificial Sequence
  dgRNA
  Tmigd3
cttcacggtgctaca

SEQ ID NO: 32380 - DNA, 15 bp, Artificial Sequence
  dgRNA
  Tmigd3
gctacatggactttt

SEQ ID NO: 32381 - DNA, 15 bp, Artificial Sequence
  dgRNA
  Tmigd3
agcccgcatcaccgg

SEQ ID NO: 32382 - DNA, 15 bp, Artificial Sequence
  dgRNA
  Tmigd3
tcaccggaggatgcc

SEQ ID NO: 32383 - DNA, 15 bp, Artificial Sequence
  dgRNA
  Tmem261
taacacaccgggatg

SEQ ID NO: 32384 - DNA, 15 bp, Artificial Sequence
  dgRNA
  Tmem261
ccgccctgttccgcc

SEQ ID NO: 32385 - DNA, 15 bp, Artificial Sequence
  dgRNA
  Tmem261
catttcccagaagcg

SEQ ID NO: 32386 - DNA, 15 bp, Artificial Sequence
  dgRNA
  Tmem261
ttcccagaagcgcgg

SEQ ID NO: 32387 - DNA, 15 bp, Artificial Sequence
  dgRNA
  Sharpin
gtccactttaaccac

SEQ ID NO: 32388 - DNA, 15 bp, Artificial Sequence
  dgRNA
  Sharpin
cacgagaaaccttat

SEQ ID NO: 32389 - DNA, 15 bp, Artificial Sequence
  dgRNA
  Sharpin
gactcctccgccact

SEQ ID NO: 32390 - DNA, 15 bp, Artificial Sequence
  dgRNA
  Sharpin
acccgcctcccctct

SEQ ID NO: 32391 - DNA, 15 bp, Artificial Sequence
  dgRNA
  Pmp2
ggattatttcaccca

SEQ ID NO: 32392 - DNA, 15 bp, Artificial Sequence
  dgRNA
  Pmp2
atttcacccatggat

SEQ ID NO: 32393 - DNA, 15 bp, Artificial Sequence
  dgRNA
  Pmp2
gccgcctttcctcat

SEQ ID NO: 32394 - DNA, 15 bp, Artificial Sequence
  dgRNA
  Pmp2
acactgcctatccat

SEQ ID NO: 32395 - DNA, 15 bp, Artificial Sequence
  dgRNA
  Ier2
tgtcttaaggtgcag

SEQ ID NO: 32396 - DNA, 15 bp, Artificial Sequence
  dgRNA
  Ier2
gtcttaaggtgcagt

SEQ ID NO: 32397 - DNA, 15 bp, Artificial Sequence
  dgRNA
  Ier2
gtcctttttccttcg

SEQ ID NO: 32398 - DNA, 15 bp, Artificial Sequence
  dgRNA
  Ier2
atccctattgcttta

SEQ ID NO: 32399 - DNA, 15 bp, Artificial Sequence
  dgRNA
  Necap1
ttaccgtttgaaggt

SEQ ID NO: 32400 - DNA, 15 bp, Artificial Sequence
  dgRNA
  Necap1
aaagagcccaacccg

SEQ ID NO: 32401 - DNA, 15 bp, Artificial Sequence
  dgRNA
  Necap1
cccaacccgaggcct

SEQ ID NO: 32402 - DNA, 15 bp, Artificial Sequence
  dgRNA
  Necap1
acccgaggccttggc

SEQ ID NO: 32403 - DNA, 15 bp, Artificial Sequence
  dgRNA
  Olfr1188
tcatgccataccaaa

SEQ ID NO: 32404 - DNA, 15 bp, Artificial Sequence
  dgRNA
  Olfr1188
ttcatgccataccaa

SEQ ID NO: 32405 - DNA, 15 bp, Artificial Sequence
  dgRNA
  Kpna1
ccgccgccttttccc

SEQ ID NO: 32406 - DNA, 15 bp, Artificial Sequence
  dgRNA
  Kpna1
ggccgccgctagcct

SEQ ID NO: 32407 - DNA, 15 bp, Artificial Sequence
  dgRNA
  Kpna1
gccgccgctagccta

SEQ ID NO: 32408 - DNA, 15 bp, Artificial Sequence
  dgRNA
  Kpna1
tagggcgtccacgct

SEQ ID NO: 32409 - DNA, 15 bp, Artificial Sequence
  dgRNA
  Pgam5
cacccactaaagggc

SEQ ID NO: 32410 - DNA, 15 bp, Artificial Sequence
  dgRNA
  Pgam5
ctaccctgcgaccac

SEQ ID NO: 32411 - DNA, 15 bp, Artificial Sequence
  dgRNA
  Pgam5
cctgcgaccaccggc

SEQ ID NO: 32412 - DNA, 15 bp, Artificial Sequence
  dgRNA
  Pgam5
gcgaccaccggcagg

SEQ ID NO: 32413 - DNA, 15 bp, Artificial Sequence
  dgRNA
  Gm684
ctcactgcgctctgc

SEQ ID NO: 32414 - DNA, 15 bp, Artificial Sequence
  dgRNA
  Gm684
tcactgcgctctgcc

SEQ ID NO: 32415 - DNA, 15 bp, Artificial Sequence
  dgRNA
  Gm684
tgccgggaccccagg

SEQ ID NO: 32416 - DNA, 15 bp, Artificial Sequence
  dgRNA
  Gm684
accccaggcggtcac

SEQ ID NO: 32417 - DNA, 15 bp, Artificial Sequence
  dgRNA
  Sirt7
tctttgaaatcccga

SEQ ID NO: 32418 - DNA, 15 bp, Artificial Sequence
  dgRNA
  Sirt7
aatcccgaaggagca

SEQ ID NO: 32419 - DNA, 15 bp, Artificial Sequence
  dgRNA
  Sirt7
atcccgaaggagcaa

SEQ ID NO: 32420 - DNA, 15 bp, Artificial Sequence
  dgRNA
  Sirt7
ccgaaggagcaaggg

SEQ ID NO: 32421 - DNA, 15 bp, Artificial Sequence
  dgRNA
  Rap1gds1
tggctgcgggagacg

SEQ ID NO: 32422 - DNA, 15 bp, Artificial Sequence
  dgRNA
  Rap1gds1
ctgcgggagacgcgg

SEQ ID NO: 32423 - DNA, 15 bp, Artificial Sequence
  dgRNA
  Rap1gds1
gagacgcggaggtag

SEQ ID NO: 32424 - DNA, 15 bp, Artificial Sequence
  dgRNA
  Rap1gds1
agacgcggaggtaga

SEQ ID NO: 32425 - DNA, 15 bp, Artificial Sequence
  dgRNA
  Rftn1
ggacgttcccacctg

SEQ ID NO: 32426 - DNA, 15 bp, Artificial Sequence
  dgRNA
  Rftn1
caatcagcacgttga

SEQ ID NO: 32427 - DNA, 15 bp, Artificial Sequence
  dgRNA
  Rftn1
ggtgggaacgtcccc

SEQ ID NO: 32428 - DNA, 15 bp, Artificial Sequence
  dgRNA
  Rftn1
gaaagagatccattc

SEQ ID NO: 32429 - DNA, 15 bp, Artificial Sequence
  dgRNA
  Lynx1
gtgtatactctcctc

SEQ ID NO: 32430 - DNA, 15 bp, Artificial Sequence
  dgRNA
  Lynx1
cctctgggtcgctac

SEQ ID NO: 32431 - DNA, 15 bp, Artificial Sequence
  dgRNA
  Lynx1
ctctgggtcgctact

SEQ ID NO: 32432 - DNA, 15 bp, Artificial Sequence
  dgRNA
  Lynx1
aatcttcacatgagt

SEQ ID NO: 32433 - DNA, 15 bp, Artificial Sequence
  dgRNA
  Slc9a7
agctcggtggcgcag

SEQ ID NO: 32434 - DNA, 15 bp, Artificial Sequence
  dgRNA
  Slc9a7
cggtggcgcagtgga

SEQ ID NO: 32435 - DNA, 15 bp, Artificial Sequence
  dgRNA
  Slc9a7
ggtggcgcagtggaa

SEQ ID NO: 32436 - DNA, 15 bp, Artificial Sequence
  dgRNA
  Slc9a7
ggctagccgccctcc

SEQ ID NO: 32437 - DNA, 15 bp, Artificial Sequence
  dgRNA
  Egfl7
ttagagccctcagtg

SEQ ID NO: 32438 - DNA, 15 bp, Artificial Sequence
  dgRNA
  Egfl7
aggcgcatcctttga

SEQ ID NO: 32439 - DNA, 15 bp, Artificial Sequence
  dgRNA
  Egfl7
ggcgcatcctttgat

SEQ ID NO: 32440 - DNA, 15 bp, Artificial Sequence
  dgRNA
  Egfl7
ggccaaccaccaagc

SEQ ID NO: 32441 - DNA, 15 bp, Artificial Sequence
  dgRNA
  Chst9
gtacatggtaaagta

SEQ ID NO: 32442 - DNA, 15 bp, Artificial Sequence
  dgRNA
  Chst9
attgtaatggctaat

SEQ ID NO: 32443 - DNA, 15 bp, Artificial Sequence
  dgRNA
  Chst9
cattgtaatggctaa

SEQ ID NO: 32444 - DNA, 15 bp, Artificial Sequence
  dgRNA
  Megf9
tgcgccgttacaaag

SEQ ID NO: 32445 - DNA, 15 bp, Artificial Sequence
  dgRNA
  Megf9
ccgttacaaagaggc

SEQ ID NO: 32446 - DNA, 15 bp, Artificial Sequence
  dgRNA
  Megf9
cgttacaaagaggcc

SEQ ID NO: 32447 - DNA, 15 bp, Artificial Sequence
  dgRNA
  Megf9
gttacaaagaggccg

SEQ ID NO: 32448 - DNA, 15 bp, Artificial Sequence
  dgRNA
  Fam122b
cggcgccagggttcc

SEQ ID NO: 32449 - DNA, 15 bp, Artificial Sequence
  dgRNA
  Fam122b
ggaccaatgccacgc

SEQ ID NO: 32450 - DNA, 15 bp, Artificial Sequence
  dgRNA
  Fam122b
cacgcaggaagattt

SEQ ID NO: 32451 - DNA, 15 bp, Artificial Sequence
  dgRNA
  Fam122b
acgcaggaagatttt

SEQ ID NO: 32452 - DNA, 15 bp, Artificial Sequence
  dgRNA
  Zfand2b
ctttacacccgctcc

SEQ ID NO: 32453 - DNA, 15 bp, Artificial Sequence
  dgRNA
  Zfand2b
tttacacccgctccc

SEQ ID NO: 32454 - DNA, 15 bp, Artificial Sequence
  dgRNA
  Zfand2b
acccgctcccgggcg

SEQ ID NO: 32455 - DNA, 15 bp, Artificial Sequence
  dgRNA
  Zfand2b
gtggctcaactcttc

SEQ ID NO: 32456 - DNA, 15 bp, Artificial Sequence
  dgRNA
  Hgf
gtttcttaccgtaag

SEQ ID NO: 32457 - DNA, 15 bp, Artificial Sequence
  dgRNA
  Hgf
tttcttaccgtaaga

SEQ ID NO: 32458 - DNA, 15 bp, Artificial Sequence
  dgRNA
  Hgf
cagctcagaaccgac

SEQ ID NO: 32459 - DNA, 15 bp, Artificial Sequence
  dgRNA
  Hgf
cgaccggtttgcaac

SEQ ID NO: 32460 - DNA, 15 bp, Artificial Sequence
  dgRNA
  Sspo
gaacagctggtaccc

SEQ ID NO: 32461 - DNA, 15 bp, Artificial Sequence
  dgRNA
  Sspo
ccttatgaagagcct

SEQ ID NO: 32462 - DNA, 15 bp, Artificial Sequence
  dgRNA
  Sspo
attcagacctcattg

SEQ ID NO: 32463 - DNA, 15 bp, Artificial Sequence
  dgRNA
  Sspo
ttcagacctcattgt

SEQ ID NO: 32464 - DNA, 15 bp, Artificial Sequence
  dgRNA
  Olfr684
caggttcaagcggga

SEQ ID NO: 32465 - DNA, 15 bp, Artificial Sequence
  dgRNA
  Qrsl1
agcaattcctaggtc

SEQ ID NO: 32466 - DNA, 15 bp, Artificial Sequence
  dgRNA
  Qrsl1
ttcctgacacgaccc

SEQ ID NO: 32467 - DNA, 15 bp, Artificial Sequence
  dgRNA
  Qrsl1
acacgaccccggccg

SEQ ID NO: 32468 - DNA, 15 bp, Artificial Sequence
  dgRNA
  Qrsl1
ctgtccgcgcgcctc

SEQ ID NO: 32469 - DNA, 15 bp, Artificial Sequence
  dgRNA
  Atp2a2
ctgcctcgcggttcc

SEQ ID NO: 32470 - DNA, 15 bp, Artificial Sequence
  dgRNA
  Atp2a2
ggttcccggcgccga

SEQ ID NO: 32471 - DNA, 15 bp, Artificial Sequence
  dgRNA
  Atp2a2
ccggcgccgagggct

SEQ ID NO: 32472 - DNA, 15 bp, Artificial Sequence
  dgRNA
  Atp2a2
gccgagggctcggcc

SEQ ID NO: 32473 - DNA, 15 bp, Artificial Sequence
  dgRNA
  Adgrf5
agtctttccacttgg

SEQ ID NO: 32474 - DNA, 15 bp, Artificial Sequence
  dgRNA
  Adgrf5
aggcttctccataag

SEQ ID NO: 32475 - DNA, 15 bp, Artificial Sequence
  dgRNA
  Adgrf5
cataagaggacctga

SEQ ID NO: 32476 - DNA, 15 bp, Artificial Sequence
  dgRNA
  Adgrf5
cttcccatgggcgtg

SEQ ID NO: 32477 - DNA, 15 bp, Artificial Sequence
  dgRNA
  Prkce
catttcctgcattag

SEQ ID NO: 32478 - DNA, 15 bp, Artificial Sequence
  dgRNA
  Prkce
ctcgcacagcgatcg

SEQ ID NO: 32479 - DNA, 15 bp, Artificial Sequence
  dgRNA
  Prkce
tcgcacagcgatcga

SEQ ID NO: 32480 - DNA, 15 bp, Artificial Sequence
  dgRNA
  Prkce
gagcgctctggcggg

SEQ ID NO: 32481 - DNA, 15 bp, Artificial Sequence
  dgRNA
  Tspan32
aaactgccccccttc

SEQ ID NO: 32482 - DNA, 15 bp, Artificial Sequence
  dgRNA
  Tspan32
agccactaggttaca

SEQ ID NO: 32483 - DNA, 15 bp, Artificial Sequence
  dgRNA
  Tspan32
gccactaggttacaa

SEQ ID NO: 32484 - DNA, 15 bp, Artificial Sequence
  dgRNA
  Tspan32
gggttgctgacagat

SEQ ID NO: 32485 - DNA, 15 bp, Artificial Sequence
  dgRNA
  Fgf16
caaatggatacgaga

SEQ ID NO: 32486 - DNA, 15 bp, Artificial Sequence
  dgRNA
  Fgf16
aaatggatacgagaa

SEQ ID NO: 32487 - DNA, 15 bp, Artificial Sequence
  dgRNA
  Fgf16
aatggatacgagaag

SEQ ID NO: 32488 - DNA, 15 bp, Artificial Sequence
  dgRNA
  Fgf16
atggatacgagaagg

SEQ ID NO: 32489 - DNA, 15 bp, Artificial Sequence
  dgRNA
  Atp5g3
tcactggccgccagc

SEQ ID NO: 32490 - DNA, 15 bp, Artificial Sequence
  dgRNA
  Atp5g3
gccgccagccggtca

SEQ ID NO: 32491 - DNA, 15 bp, Artificial Sequence
  dgRNA
  Atp5g3
gccagccggtcacgg

SEQ ID NO: 32492 - DNA, 15 bp, Artificial Sequence
  dgRNA
  Atp5g3
ccagccggtcacgga

SEQ ID NO: 32493 - DNA, 15 bp, Artificial Sequence
  dgRNA
  Nrf1
taaataccctacggc

SEQ ID NO: 32494 - DNA, 15 bp, Artificial Sequence
  dgRNA
  Olfr1230
catggaattctaaac

SEQ ID NO: 32495 - DNA, 15 bp, Artificial Sequence
  dgRNA
  Ctc1
gtaattcccgccttt

SEQ ID NO: 32496 - DNA, 15 bp, Artificial Sequence
  dgRNA
  Ctc1
gtcgctgcaaattta

SEQ ID NO: 32497 - DNA, 15 bp, Artificial Sequence
  dgRNA
  Ctc1
ccagtaggctcctta

SEQ ID NO: 32498 - DNA, 15 bp, Artificial Sequence
  dgRNA
  Ctc1
caagttcaccgcaaa

SEQ ID NO: 32499 - DNA, 15 bp, Artificial Sequence
  dgRNA
  Hps6
cgaggttcagaaaga

SEQ ID NO: 32500 - DNA, 15 bp, Artificial Sequence
  dgRNA
  Hps6
attctcacggtgcct

SEQ ID NO: 32501 - DNA, 15 bp, Artificial Sequence
  dgRNA
  Hps6
cttgaatccagagcg

SEQ ID NO: 32502 - DNA, 15 bp, Artificial Sequence
  dgRNA
  Hps6
agagcggggaccctt

SEQ ID NO: 32503 - DNA, 15 bp, Artificial Sequence
  dgRNA
  Csf1r
agttgctgctatagg

SEQ ID NO: 32504 - DNA, 15 bp, Artificial Sequence
  dgRNA
  Csf1r
ggccttctgccttaa

SEQ ID NO: 32505 - DNA, 15 bp, Artificial Sequence
  dgRNA
  Csf1r
tcctatagcagcaac

SEQ ID NO: 32506 - DNA, 15 bp, Artificial Sequence
  dgRNA
  Azgp1
cccaacctgtttgtg

SEQ ID NO: 32507 - DNA, 15 bp, Artificial Sequence
  dgRNA
  Azgp1
tcacctcccccgggc

SEQ ID NO: 32508 - DNA, 15 bp, Artificial Sequence
  dgRNA
  Azgp1
gccacacaaacaggt

SEQ ID NO: 32509 - DNA, 15 bp, Artificial Sequence
  dgRNA
  Azgp1
tggcatcctgcccgg

SEQ ID NO: 32510 - DNA, 15 bp, Artificial Sequence
  dgRNA
  Per3
ccgccctctgaccaa

SEQ ID NO: 32511 - DNA, 15 bp, Artificial Sequence
  dgRNA
  Per3
cgccctctgaccaat

SEQ ID NO: 32512 - DNA, 15 bp, Artificial Sequence
  dgRNA
  Per3
gggagctcgtgttgc

SEQ ID NO: 32513 - DNA, 15 bp, Artificial Sequence
  dgRNA
  Per3
cagcgaccaatcgcg

SEQ ID NO: 32514 - DNA, 15 bp, Artificial Sequence
  dgRNA
  Fbxo4
aatatctaacgctta

SEQ ID NO: 32515 - DNA, 15 bp, Artificial Sequence
  dgRNA
  Fbxo4
atatctaacgcttaa

SEQ ID NO: 32516 - DNA, 15 bp, Artificial Sequence
  dgRNA
  Fbxo4
tatctaacgcttaag

SEQ ID NO: 32517 - DNA, 15 bp, Artificial Sequence
  dgRNA
  Fbxo4
gtgacgcacagaggc

SEQ ID NO: 32518 - DNA, 15 bp, Artificial Sequence
  dgRNA
  Il12rb1
ggcttactcacccca

SEQ ID NO: 32519 - DNA, 15 bp, Artificial Sequence
  dgRNA
  Il12rb1
ttactcaccccaagg

SEQ ID NO: 32520 - DNA, 15 bp, Artificial Sequence
  dgRNA
  Il12rb1
ggtttgtagtgcaga

SEQ ID NO: 32521 - DNA, 15 bp, Artificial Sequence
  dgRNA
  Il12rb1
gtttgtagtgcagag

SEQ ID NO: 32522 - DNA, 15 bp, Artificial Sequence
  dgRNA
  Mpg
tggcaatcgggccat

SEQ ID NO: 32523 - DNA, 15 bp, Artificial Sequence
  dgRNA
  Mpg
ggcaatcgggccatt

SEQ ID NO: 32524 - DNA, 15 bp, Artificial Sequence
  dgRNA
  Mpg
gggttccaatcctac

SEQ ID NO: 32525 - DNA, 15 bp, Artificial Sequence
  dgRNA
  Mpg
aatcctactggtgaa

SEQ ID NO: 32526 - DNA, 15 bp, Artificial Sequence
  dgRNA
  Tmem107
gactcctagcgccca

SEQ ID NO: 32527 - DNA, 15 bp, Artificial Sequence
  dgRNA
  Tmem107
tcttgggtccatcaa

SEQ ID NO: 32528 - DNA, 15 bp, Artificial Sequence
  dgRNA
  Tmem107
cgcgcctatagacgt

SEQ ID NO: 32529 - DNA, 15 bp, Artificial Sequence
  dgRNA
  Tmem107
tatagacgttggtag

SEQ ID NO: 32530 - DNA, 15 bp, Artificial Sequence
  dgRNA
  Nxpe5
tttttagcacagtcc

SEQ ID NO: 32531 - DNA, 15 bp, Artificial Sequence
  dgRNA
  Nxpe5
atgtgattgtaggcg

SEQ ID NO: 32532 - DNA, 15 bp, Artificial Sequence
  dgRNA
  Nxpe5
tgtgattgtaggcgt

SEQ ID NO: 32533 - DNA, 15 bp, Artificial Sequence
  dgRNA
  Nxpe5
tacctatgcagtcct

SEQ ID NO: 32534 - DNA, 15 bp, Artificial Sequence
  dgRNA
  Rdx
caccgaactgcaccc

SEQ ID NO: 32535 - DNA, 15 bp, Artificial Sequence
  dgRNA
  Rdx
ctggagcggctgccg

SEQ ID NO: 32536 - DNA, 15 bp, Artificial Sequence
  dgRNA
  Rdx
tggagcggctgccga

SEQ ID NO: 32537 - DNA, 15 bp, Artificial Sequence
  dgRNA
  Rdx
ggagcggctgccgag

SEQ ID NO: 32538 - DNA, 15 bp, Artificial Sequence
  dgRNA
  Shroom3
gagcagggttgcccg

SEQ ID NO: 32539 - DNA, 15 bp, Artificial Sequence
  dgRNA
  Shroom3
agcagggttgcccgc

SEQ ID NO: 32540 - DNA, 15 bp, Artificial Sequence
  dgRNA
  Shroom3
ggttgcccgcgggca

SEQ ID NO: 32541 - DNA, 15 bp, Artificial Sequence
  dgRNA
  Shroom3
gggcacggtagaaac

SEQ ID NO: 32542 - DNA, 15 bp, Artificial Sequence
  dgRNA
  Csnk2b
caaagcggaacgctg

SEQ ID NO: 32543 - DNA, 15 bp, Artificial Sequence
  dgRNA
  Csnk2b
aaagcggaacgctga

SEQ ID NO: 32544 - DNA, 15 bp, Artificial Sequence
  dgRNA
  Csnk2b
ctgagggagcaccgc

SEQ ID NO: 32545 - DNA, 15 bp, Artificial Sequence
  dgRNA
  Csnk2b
tgagggagcaccgca

SEQ ID NO: 32546 - DNA, 15 bp, Artificial Sequence
  dgRNA
  1700034J05Rik
agcacatacaatagt

SEQ ID NO: 32547 - DNA, 15 bp, Artificial Sequence
  dgRNA
  1700034J05Rik
attatgtaaagggac

SEQ ID NO: 32548 - DNA, 15 bp, Artificial Sequence
  dgRNA
  1700034J05Rik
gactgttggttacca

SEQ ID NO: 32549 - DNA, 15 bp, Artificial Sequence
  dgRNA
  Slc4a2
cccggagcttcgccg

SEQ ID NO: 32550 - DNA, 15 bp, Artificial Sequence
  dgRNA
  Slc4a2
ccggagcttcgccgc

SEQ ID NO: 32551 - DNA, 15 bp, Artificial Sequence
  dgRNA
  Slc4a2
gagcttcgccgcggg

SEQ ID NO: 32552 - DNA, 15 bp, Artificial Sequence
  dgRNA
  Slc4a2
cttcgccgcgggtgg

SEQ ID NO: 32553 - DNA, 15 bp, Artificial Sequence
  dgRNA
  Olfr1257
tttaagtcggttttt

SEQ ID NO: 32554 - DNA, 15 bp, Artificial Sequence
  dgRNA
  Olfr1257
ctcaattctttaagt

SEQ ID NO: 32555 - DNA, 15 bp, Artificial Sequence
  dgRNA
  Olfr1257
attccacaatttaat

SEQ ID NO: 32556 - DNA, 15 bp, Artificial Sequence
  dgRNA
  Ccdc18
tcgcagagccccgcg

SEQ ID NO: 32557 - DNA, 15 bp, Artificial Sequence
  dgRNA
  Ccdc18
agagccccgcgtggt

SEQ ID NO: 32558 - DNA, 15 bp, Artificial Sequence
  dgRNA
  Ccdc18
gccccgcgtggtggg

SEQ ID NO: 32559 - DNA, 15 bp, Artificial Sequence
  dgRNA
  Ccdc18
ccccgcgtggtgggc

SEQ ID NO: 32560 - DNA, 15 bp, Artificial Sequence
  dgRNA
  Oxct1
tgtactcattccaga

SEQ ID NO: 32561 - DNA, 15 bp, Artificial Sequence
  dgRNA
  Oxct1
ttccagagggcgatt

SEQ ID NO: 32562 - DNA, 15 bp, Artificial Sequence
  dgRNA
  Oxct1
agtaagagaccctcc

SEQ ID NO: 32563 - DNA, 15 bp, Artificial Sequence
  dgRNA
  Oxct1
ggcaacccgaaaccc

SEQ ID NO: 32564 - DNA, 15 bp, Artificial Sequence
  dgRNA
  Tspyl2
gatgatgtgtagtgt

SEQ ID NO: 32565 - DNA, 15 bp, Artificial Sequence
  dgRNA
  Tspyl2
ggattgcgtgagaga

SEQ ID NO: 32566 - DNA, 15 bp, Artificial Sequence
  dgRNA
  Tspyl2
ctaccgccagctccg

SEQ ID NO: 32567 - DNA, 15 bp, Artificial Sequence
  dgRNA
  Tspyl2
agcagacgccatgcc

SEQ ID NO: 32568 - DNA, 15 bp, Artificial Sequence
  dgRNA
  Gls
cagcgggactgcgta

SEQ ID NO: 32569 - DNA, 15 bp, Artificial Sequence
  dgRNA
  Gls
agcgggactgcgtac

SEQ ID NO: 32570 - DNA, 15 bp, Artificial Sequence
  dgRNA
  Gls
gactgcgtacgggcg

SEQ ID NO: 32571 - DNA, 15 bp, Artificial Sequence
  dgRNA
  Gls
aatggaagagcttgc

SEQ ID NO: 32572 - DNA, 15 bp, Artificial Sequence
  dgRNA
  Prkci
agagcgtctgttagt

SEQ ID NO: 32573 - DNA, 15 bp, Artificial Sequence
  dgRNA
  Prkci
cgtctgttagtaggc

SEQ ID NO: 32574 - DNA, 15 bp, Artificial Sequence
  dgRNA
  Prkci
ctgttagtaggctgg

SEQ ID NO: 32575 - DNA, 15 bp, Artificial Sequence
  dgRNA
  Prkci
cttctcccccccgtg

SEQ ID NO: 32576 - DNA, 15 bp, Artificial Sequence
  dgRNA
  Lrguk
ccactgaacgtaaag

SEQ ID NO: 32577 - DNA, 15 bp, Artificial Sequence
  dgRNA
  Lrguk
aaaagtgaacgccaa

SEQ ID NO: 32578 - DNA, 15 bp, Artificial Sequence
  dgRNA
  Lrguk
gcaagtacggaagct

SEQ ID NO: 32579 - DNA, 15 bp, Artificial Sequence
  dgRNA
  Lrguk
ttccttgcagcgccg

SEQ ID NO: 32580 - DNA, 15 bp, Artificial Sequence
  dgRNA
  Ipo9
agcgcgtgcgacttc

SEQ ID NO: 32581 - DNA, 15 bp, Artificial Sequence
  dgRNA
  Ipo9
cgcccaaagctttcc

SEQ ID NO: 32582 - DNA, 15 bp, Artificial Sequence
  dgRNA
  Ipo9
ctggcccgcgaatcg

SEQ ID NO: 32583 - DNA, 15 bp, Artificial Sequence
  dgRNA
  Ipo9
ccgcgaatcgcggtt

SEQ ID NO: 32584 - DNA, 15 bp, Artificial Sequence
  dgRNA
  Psmb10
ggtggcacgcccaca

SEQ ID NO: 32585 - DNA, 15 bp, Artificial Sequence
  dgRNA
  Psmb10
ggcacgcccacatgg

SEQ ID NO: 32586 - DNA, 15 bp, Artificial Sequence
  dgRNA
  Psmb10
ggcgtgccaccacgt

SEQ ID NO: 32587 - DNA, 15 bp, Artificial Sequence
  dgRNA
  Psmb10
gggcgtgccaccacg

SEQ ID NO: 32588 - DNA, 15 bp, Artificial Sequence
  dgRNA
  Siglec15
catgactaaggcgca

SEQ ID NO: 32589 - DNA, 15 bp, Artificial Sequence
  dgRNA
  Siglec15
atgactaaggcgcac

SEQ ID NO: 32590 - DNA, 15 bp, Artificial Sequence
  dgRNA
  Siglec15
gccaactcacaccgc

SEQ ID NO: 32591 - DNA, 15 bp, Artificial Sequence
  dgRNA
  Siglec15
acaccgctggctact

SEQ ID NO: 32592 - DNA, 15 bp, Artificial Sequence
  dgRNA
  Ccdc12
tcacaaattaagtgt

SEQ ID NO: 32593 - DNA, 15 bp, Artificial Sequence
  dgRNA
  Ccdc12
gctcactcgctgtac

SEQ ID NO: 32594 - DNA, 15 bp, Artificial Sequence
  dgRNA
  Ccdc12
ccagatcaaggggcg

SEQ ID NO: 32595 - DNA, 15 bp, Artificial Sequence
  dgRNA
  Ccdc12
caactcagcattgat

SEQ ID NO: 32596 - DNA, 15 bp, Artificial Sequence
  dgRNA
  Fn3krp
cagcacaccagagcg

SEQ ID NO: 32597 - DNA, 15 bp, Artificial Sequence
  dgRNA
  Fn3krp
cacaccagagcgggg

SEQ ID NO: 32598 - DNA, 15 bp, Artificial Sequence
  dgRNA
  Fn3krp
cacccacttaccacc

SEQ ID NO: 32599 - DNA, 15 bp, Artificial Sequence
  dgRNA
  Fn3krp
caatcctaaccagtc

SEQ ID NO: 32600 - DNA, 15 bp, Artificial Sequence
  dgRNA
  Sirt3
cttcgggttatcgtg

SEQ ID NO: 32601 - DNA, 15 bp, Artificial Sequence
  dgRNA
  Sirt3
ttcgggttatcgtgc

SEQ ID NO: 32602 - DNA, 15 bp, Artificial Sequence
  dgRNA
  Sirt3
tcgggttatcgtgcg

SEQ ID NO: 32603 - DNA, 15 bp, Artificial Sequence
  dgRNA
  Sirt3
cgggttatcgtgcgg

SEQ ID NO: 32604 - DNA, 15 bp, Artificial Sequence
  dgRNA
  Selenbp2
gtaatttgaacagcc

SEQ ID NO: 32605 - DNA, 15 bp, Artificial Sequence
  dgRNA
  Selenbp2
gctgttcaaattaca

SEQ ID NO: 32606 - DNA, 15 bp, Artificial Sequence
  dgRNA
  Selenbp2
ggctgttcaaattac

SEQ ID NO: 32607 - DNA, 15 bp, Artificial Sequence
  dgRNA
  Selenbp2
aaagggcagctaacc

SEQ ID NO: 32608 - DNA, 15 bp, Artificial Sequence
  dgRNA
  Wfikkn1
agtggtcagttgctc

SEQ ID NO: 32609 - DNA, 15 bp, Artificial Sequence
  dgRNA
  Wfikkn1
gtggtcagttgctct

SEQ ID NO: 32610 - DNA, 15 bp, Artificial Sequence
  dgRNA
  Wfikkn1
ccagctcaatcaggg

SEQ ID NO: 32611 - DNA, 15 bp, Artificial Sequence
  dgRNA
  Wfikkn1
gggccagctcaatca

SEQ ID NO: 32612 - DNA, 15 bp, Artificial Sequence
  dgRNA
  Rorc
tttacctacaaggcc

SEQ ID NO: 32613 - DNA, 15 bp, Artificial Sequence
  dgRNA
  Rorc
cccgtcagcaggcag

SEQ ID NO: 32614 - DNA, 15 bp, Artificial Sequence
  dgRNA
  Rorc
gcccgtcagcaggca

SEQ ID NO: 32615 - DNA, 15 bp, Artificial Sequence
  dgRNA
  Rorc
ggcccgtcagcaggc

SEQ ID NO: 32616 - DNA, 15 bp, Artificial Sequence
  dgRNA
  Cracr2a
gctggctgcttatca

SEQ ID NO: 32617 - DNA, 15 bp, Artificial Sequence
  dgRNA
  Cracr2a
ggctgcttatcaagg

SEQ ID NO: 32618 - DNA, 15 bp, Artificial Sequence
  dgRNA
  Afap1l1
ggcaggtcagccacg

SEQ ID NO: 32619 - DNA, 15 bp, Artificial Sequence
  dgRNA
  Afap1l1
gcaggtcagccacgg

SEQ ID NO: 32620 - DNA, 15 bp, Artificial Sequence
  dgRNA
  Afap1l1
ctgaaccgaagcgtg

SEQ ID NO: 32621 - DNA, 15 bp, Artificial Sequence
  dgRNA
  Afap1l1
tgaaccgaagcgtgt

SEQ ID NO: 32622 - DNA, 15 bp, Artificial Sequence
  dgRNA
  Otc
ttatgaaaaacgaag

SEQ ID NO: 32623 - DNA, 15 bp, Artificial Sequence
  dgRNA
  Otc
aaggctgatctgata

SEQ ID NO: 32624 - DNA, 15 bp, Artificial Sequence
  dgRNA
  Otc
ttaagcctaactcca

SEQ ID NO: 32625 - DNA, 15 bp, Artificial Sequence
  dgRNA
  Otc
tttaagcctaactcc

SEQ ID NO: 32626 - DNA, 15 bp, Artificial Sequence
  dgRNA
  Mcm3
tgctcaatttccagg

SEQ ID NO: 32627 - DNA, 15 bp, Artificial Sequence
  dgRNA
  Mcm3
tcaatttccaggggg

SEQ ID NO: 32628 - DNA, 15 bp, Artificial Sequence
  dgRNA
  Mcm3
gtcagacttcctatt

SEQ ID NO: 32629 - DNA, 15 bp, Artificial Sequence
  dgRNA
  Mcm3
tcagacttcctatta

SEQ ID NO: 32630 - DNA, 15 bp, Artificial Sequence
  dgRNA
  Znrf2
ctttcccgttgcaag

SEQ ID NO: 32631 - DNA, 15 bp, Artificial Sequence
  dgRNA
  Znrf2
cccgttgcaagcggc

SEQ ID NO: 32632 - DNA, 15 bp, Artificial Sequence
  dgRNA
  Znrf2
aagcggctggcgcgc

SEQ ID NO: 32633 - DNA, 15 bp, Artificial Sequence
  dgRNA
  Znrf2
agcggctggcgcgca

SEQ ID NO: 32634 - DNA, 15 bp, Artificial Sequence
  dgRNA
  Mettl7a2
agtcagggcattacc

SEQ ID NO: 32635 - DNA, 15 bp, Artificial Sequence
  dgRNA
  Mettl7a2
agaaatcgcagagcc

SEQ ID NO: 32636 - DNA, 15 bp, Artificial Sequence
  dgRNA
  Msx2
gtttgagctcatagt

SEQ ID NO: 32637 - DNA, 15 bp, Artificial Sequence
  dgRNA
  Msx2
tcaggcgggagcgtg

SEQ ID NO: 32638 - DNA, 15 bp, Artificial Sequence
  dgRNA
  Msx2
caggcgggagcgtgt

SEQ ID NO: 32639 - DNA, 15 bp, Artificial Sequence
  dgRNA
  Msx2
aatctgcggagggca

SEQ ID NO: 32640 - DNA, 15 bp, Artificial Sequence
  dgRNA
  Rep15
cacccagttgacaaa

SEQ ID NO: 32641 - DNA, 15 bp, Artificial Sequence
  dgRNA
  Rep15
cccagttgacaaacg

SEQ ID NO: 32642 - DNA, 15 bp, Artificial Sequence
  dgRNA
  Rep15
atgtttgtctagcct

SEQ ID NO: 32643 - DNA, 15 bp, Artificial Sequence
  dgRNA
  Rep15
agcctcgggtctata

SEQ ID NO: 32644 - DNA, 15 bp, Artificial Sequence
  dgRNA
  Gm609
aggttattcattaac

SEQ ID NO: 32645 - DNA, 15 bp, Artificial Sequence
  dgRNA
  Gm609
aagttttccgttaaa

SEQ ID NO: 32646 - DNA, 15 bp, Artificial Sequence
  dgRNA
  Elmsan1
cgggcagccgccccg

SEQ ID NO: 32647 - DNA, 15 bp, Artificial Sequence
  dgRNA
  Elmsan1
cctcccagccttatt

SEQ ID NO: 32648 - DNA, 15 bp, Artificial Sequence
  dgRNA
  Elmsan1
gccttatttggtcgc

SEQ ID NO: 32649 - DNA, 15 bp, Artificial Sequence
  dgRNA
  Elmsan1
ttggtcgcaggaagt

SEQ ID NO: 32650 - DNA, 15 bp, Artificial Sequence
  dgRNA
  Zfp658
gtatcattgtattgt

SEQ ID NO: 32651 - DNA, 15 bp, Artificial Sequence
  dgRNA
  Zfp658
atccaagtgaagtat

SEQ ID NO: 32652 - DNA, 15 bp, Artificial Sequence
  dgRNA
  Zfp658
cgccagcctccacaa

SEQ ID NO: 32653 - DNA, 15 bp, Artificial Sequence
  dgRNA
  Zfp658
gccagcctccacaag

SEQ ID NO: 32654 - DNA, 15 bp, Artificial Sequence
  dgRNA
  Olfr1499
gataatcctcaggtt

SEQ ID NO: 32655 - DNA, 15 bp, Artificial Sequence
  dgRNA
  Fam49a
gtattaacattagct

SEQ ID NO: 32656 - DNA, 15 bp, Artificial Sequence
  dgRNA
  Fam49a
tcctagtgcctagcc

SEQ ID NO: 32657 - DNA, 15 bp, Artificial Sequence
  dgRNA
  Fam49a
tggctagaagtgaac

SEQ ID NO: 32658 - DNA, 15 bp, Artificial Sequence
  dgRNA
  Fam49a
agtgaaccggccctc

SEQ ID NO: 32659 - DNA, 15 bp, Artificial Sequence
  dgRNA
  Nfam1
cttccgctatttcag

SEQ ID NO: 32660 - DNA, 15 bp, Artificial Sequence
  dgRNA
  Nfam1
ttccgctatttcaga

SEQ ID NO: 32661 - DNA, 15 bp, Artificial Sequence
  dgRNA
  Nfam1
cgctatttcagaggg

SEQ ID NO: 32662 - DNA, 15 bp, Artificial Sequence
  dgRNA
  Nfam1
agaggaaccgccttg

SEQ ID NO: 32663 - DNA, 15 bp, Artificial Sequence
  dgRNA
  Tox
cccaggcctctaacg

SEQ ID NO: 32664 - DNA, 15 bp, Artificial Sequence
  dgRNA
  Tox
cccgagcgcgagtgc

SEQ ID NO: 32665 - DNA, 15 bp, Artificial Sequence
  dgRNA
  Tox
ccgagcgcgagtgcc

SEQ ID NO: 32666 - DNA, 15 bp, Artificial Sequence
  dgRNA
  Tox
gtgccgggcggcgaa

SEQ ID NO: 32667 - DNA, 15 bp, Artificial Sequence
  dgRNA
  Ascc1
cgcagcacctagctg

SEQ ID NO: 32668 - DNA, 15 bp, Artificial Sequence
  dgRNA
  Ascc1
gcggtagctctttct

SEQ ID NO: 32669 - DNA, 15 bp, Artificial Sequence
  dgRNA
  Ascc1
tagctctttctaggt

SEQ ID NO: 32670 - DNA, 15 bp, Artificial Sequence
  dgRNA
  Ascc1
ggatgaagaagctcg

SEQ ID NO: 32671 - DNA, 15 bp, Artificial Sequence
  dgRNA
  Rnf145
cttggaatagtctgc

SEQ ID NO: 32672 - DNA, 15 bp, Artificial Sequence
  dgRNA
  Rnf145
gagaagccggcgttt

SEQ ID NO: 32673 - DNA, 15 bp, Artificial Sequence
  dgRNA
  Rnf145
agaagccggcgtttc

SEQ ID NO: 32674 - DNA, 15 bp, Artificial Sequence
  dgRNA
  Rnf145
gggcccactcaacgg

SEQ ID NO: 32675 - DNA, 15 bp, Artificial Sequence
  dgRNA
  Fbxo46
tcccagataccctcg

SEQ ID NO: 32676 - DNA, 15 bp, Artificial Sequence
  dgRNA
  Fbxo46
cccagataccctcgc

SEQ ID NO: 32677 - DNA, 15 bp, Artificial Sequence
  dgRNA
  Fbxo46
taccgtattgcatct

SEQ ID NO: 32678 - DNA, 15 bp, Artificial Sequence
  dgRNA
  Fbxo46
accgtattgcatctt

SEQ ID NO: 32679 - DNA, 15 bp, Artificial Sequence
  dgRNA
  Gm527
tcctacacttgattc

SEQ ID NO: 32680 - DNA, 15 bp, Artificial Sequence
  dgRNA
  Gm527
cacttgattctggct

SEQ ID NO: 32681 - DNA, 15 bp, Artificial Sequence
  dgRNA
  Gm527
gattctggctcggat

SEQ ID NO: 32682 - DNA, 15 bp, Artificial Sequence
  dgRNA
  Gm527
attctggctcggatt

SEQ ID NO: 32683 - DNA, 15 bp, Artificial Sequence
  dgRNA
  Phax
agccacgcgcgccaa

SEQ ID NO: 32684 - DNA, 15 bp, Artificial Sequence
  dgRNA
  Phax
gccacgcgcgccaac

SEQ ID NO: 32685 - DNA, 15 bp, Artificial Sequence
  dgRNA
  Phax
ccacgcgcgccaacg

SEQ ID NO: 32686 - DNA, 15 bp, Artificial Sequence
  dgRNA
  Phax
cgccaacggggagag

SEQ ID NO: 32687 - DNA, 15 bp, Artificial Sequence
  dgRNA
  Rbp2
agggacacgcagacc

SEQ ID NO: 32688 - DNA, 15 bp, Artificial Sequence
  dgRNA
  Rbp2
acgcagacctggcaa

SEQ ID NO: 32689 - DNA, 15 bp, Artificial Sequence
  dgRNA
  Rbp2
agacctggcaacggc

SEQ ID NO: 32690 - DNA, 15 bp, Artificial Sequence
  dgRNA
  Rbp2
tcattttaggctgac

SEQ ID NO: 32691 - DNA, 15 bp, Artificial Sequence
  dgRNA
  Dpm1
aacgaagacgcttcc

SEQ ID NO: 32692 - DNA, 15 bp, Artificial Sequence
  dgRNA
  Dpm1
atgggtttttatccg

SEQ ID NO: 32693 - DNA, 15 bp, Artificial Sequence
  dgRNA
  Dpm1
ggaagccgtcacgat

SEQ ID NO: 32694 - DNA, 15 bp, Artificial Sequence
  dgRNA
  Dpm1
acgattggcttgaaa

SEQ ID NO: 32695 - DNA, 15 bp, Artificial Sequence
  dgRNA
  Tgif2
ggaaggaggtgccgc

SEQ ID NO: 32696 - DNA, 15 bp, Artificial Sequence
  dgRNA
  Tgif2
gccccctccgacgcg

SEQ ID NO: 32697 - DNA, 15 bp, Artificial Sequence
  dgRNA
  Tgif2
ccccctccgacgcgt

SEQ ID NO: 32698 - DNA, 15 bp, Artificial Sequence
  dgRNA
  Tgif2
cctccgacgcgtggg

SEQ ID NO: 32699 - DNA, 15 bp, Artificial Sequence
  dgRNA
  Tnf
cctctgcccccgcga

SEQ ID NO: 32700 - DNA, 15 bp, Artificial Sequence
  dgRNA
  Tnf
ccgagacagaggtgt

SEQ ID NO: 32701 - DNA, 15 bp, Artificial Sequence
  dgRNA
  Tnf
cgagacagaggtgta

SEQ ID NO: 32702 - DNA, 15 bp, Artificial Sequence
  dgRNA
  Tnf
caaggaagttttccg

SEQ ID NO: 32703 - DNA, 15 bp, Artificial Sequence
  dgRNA
  Slc25a14
ccgacctttttgcac

SEQ ID NO: 32704 - DNA, 15 bp, Artificial Sequence
  dgRNA
  Slc25a14
gagtgggcggagttt

SEQ ID NO: 32705 - DNA, 15 bp, Artificial Sequence
  dgRNA
  Slc25a14
gggcggagtttagga

SEQ ID NO: 32706 - DNA, 15 bp, Artificial Sequence
  dgRNA
  Slc25a14
gcgccactgttgccg

SEQ ID NO: 32707 - DNA, 15 bp, Artificial Sequence
  dgRNA
  Stoml3
aggcttcttgcacca

SEQ ID NO: 32708 - DNA, 15 bp, Artificial Sequence
  dgRNA
  Stoml3
gggttactactcctc

SEQ ID NO: 32709 - DNA, 15 bp, Artificial Sequence
  dgRNA
  Stoml3
ggttactactcctca

SEQ ID NO: 32710 - DNA, 15 bp, Artificial Sequence
  dgRNA
  Stoml3
tcagggtgtacgcca

SEQ ID NO: 32711 - DNA, 15 bp, Artificial Sequence
  dgRNA
  Oprl1
agccctaggcatttc

SEQ ID NO: 32712 - DNA, 15 bp, Artificial Sequence
  dgRNA
  Oprl1
gccctaggcatttct

SEQ ID NO: 32713 - DNA, 15 bp, Artificial Sequence
  dgRNA
  Gsta2
aaccttatcaggaac

SEQ ID NO: 32714 - DNA, 15 bp, Artificial Sequence
  dgRNA
  Gsta2
aactggctatattag

SEQ ID NO: 32715 - DNA, 15 bp, Artificial Sequence
  dgRNA
  Gsta2
ggactctaaattttc

SEQ ID NO: 32716 - DNA, 15 bp, Artificial Sequence
  dgRNA
  Gsta2
ggggctgatccctat

SEQ ID NO: 32717 - DNA, 15 bp, Artificial Sequence
  dgRNA
  Cpn1
taagatctttgagcc

SEQ ID NO: 32718 - DNA, 15 bp, Artificial Sequence
  dgRNA
  Cpn1
tgcttcagaacgagg

SEQ ID NO: 32719 - DNA, 15 bp, Artificial Sequence
  dgRNA
  Cpn1
gcttcagaacgaggt

SEQ ID NO: 32720 - DNA, 15 bp, Artificial Sequence
  dgRNA
  Cpn1
cttcagaacgaggtg

SEQ ID NO: 32721 - DNA, 15 bp, Artificial Sequence
  dgRNA
  Dcst1
aggtactacggacca

SEQ ID NO: 32722 - DNA, 15 bp, Artificial Sequence
  dgRNA
  Dcst1
cggcccgtgccgtgc

SEQ ID NO: 32723 - DNA, 15 bp, Artificial Sequence
  dgRNA
  Dcst1
catcagcgttgacta

SEQ ID NO: 32724 - DNA, 15 bp, Artificial Sequence
  dgRNA
  Dcst1
gttgactatggctgc

SEQ ID NO: 32725 - DNA, 15 bp, Artificial Sequence
  dgRNA
  Gabra1
tttgcgaagcctgtc

SEQ ID NO: 32726 - DNA, 15 bp, Artificial Sequence
  dgRNA
  Gabra1
gggatgcaaagcact

SEQ ID NO: 32727 - DNA, 15 bp, Artificial Sequence
  dgRNA
  Gabra1
cgttccctagcaaac

SEQ ID NO: 32728 - DNA, 15 bp, Artificial Sequence
  dgRNA
  Gabra1
gttccctagcaaaca

SEQ ID NO: 32729 - DNA, 15 bp, Artificial Sequence
  dgRNA
  Wdr46
atagttaacaagatt

SEQ ID NO: 32730 - DNA, 15 bp, Artificial Sequence
  dgRNA
  Wdr46
tagttaacaagattc

SEQ ID NO: 32731 - DNA, 15 bp, Artificial Sequence
  dgRNA
  Wdr46
agttaacaagattcg

SEQ ID NO: 32732 - DNA, 15 bp, Artificial Sequence
  dgRNA
  Wdr46
ctcgggcgatcctcc

SEQ ID NO: 32733 - DNA, 15 bp, Artificial Sequence
  dgRNA
  Serpina7
ggttaatttgtaacc

SEQ ID NO: 32734 - DNA, 15 bp, Artificial Sequence
  dgRNA
  Serpina7
ctagttttgcaatag

SEQ ID NO: 32735 - DNA, 15 bp, Artificial Sequence
  dgRNA
  Serpina7
taaggtttgtactct

SEQ ID NO: 32736 - DNA, 15 bp, Artificial Sequence
  dgRNA
  Serpina7
ttaaggtttgtactc

SEQ ID NO: 32737 - DNA, 15 bp, Artificial Sequence
  dgRNA
  Rab5b
ttctcgtgtaggtat

SEQ ID NO: 32738 - DNA, 15 bp, Artificial Sequence
  dgRNA
  Rab5b
gtaggtattggcttg

SEQ ID NO: 32739 - DNA, 15 bp, Artificial Sequence
  dgRNA
  Rab5b
ctcacttgtgctagt

SEQ ID NO: 32740 - DNA, 15 bp, Artificial Sequence
  dgRNA
  Rab5b
cagaagattggcggg

SEQ ID NO: 32741 - DNA, 15 bp, Artificial Sequence
  dgRNA
  A830018L16Rik
atcccagcctagtga

SEQ ID NO: 32742 - DNA, 15 bp, Artificial Sequence
  dgRNA
  A830018L16Rik
tgaaggcagagcgct

SEQ ID NO: 32743 - DNA, 15 bp, Artificial Sequence
  dgRNA
  A830018L16Rik
tcaagctgagtggtt

SEQ ID NO: 32744 - DNA, 15 bp, Artificial Sequence
  dgRNA
  A830018L16Rik
agcggctctgtcgct

SEQ ID NO: 32745 - DNA, 15 bp, Artificial Sequence
  dgRNA
  Krt12
gtgtcagatatctag

SEQ ID NO: 32746 - DNA, 15 bp, Artificial Sequence
  dgRNA
  Krt12
gatatctagtggtaa

SEQ ID NO: 32747 - DNA, 15 bp, Artificial Sequence
  dgRNA
  Krt12
tggccaactgggtgt

SEQ ID NO: 32748 - DNA, 15 bp, Artificial Sequence
  dgRNA
  Krt12
tgggcatgcgagagt

SEQ ID NO: 32749 - DNA, 15 bp, Artificial Sequence
  dgRNA
  Serpinc1
gcagtctgtttcagc

SEQ ID NO: 32750 - DNA, 15 bp, Artificial Sequence
  dgRNA
  Serpinc1
ctgtttcagcgggtc

SEQ ID NO: 32751 - DNA, 15 bp, Artificial Sequence
  dgRNA
  Serpinc1
tgtttcagcgggtct

SEQ ID NO: 32752 - DNA, 15 bp, Artificial Sequence
  dgRNA
  Serpinc1
gtttcagcgggtctg

SEQ ID NO: 32753 - DNA, 15 bp, Artificial Sequence
  dgRNA
  Lrrc39
agcaagagtcacgtg

SEQ ID NO: 32754 - DNA, 15 bp, Artificial Sequence
  dgRNA
  Lrrc39
tagcaagagtcacgt

SEQ ID NO: 32755 - DNA, 15 bp, Artificial Sequence
  dgRNA
  Lrrc39
atagcaagagtcacg

SEQ ID NO: 32756 - DNA, 15 bp, Artificial Sequence
  dgRNA
  Plppr4
cggaccctgacaacc

SEQ ID NO: 32757 - DNA, 15 bp, Artificial Sequence
  dgRNA
  Plppr4
ggaccctgacaacca

SEQ ID NO: 32758 - DNA, 15 bp, Artificial Sequence
  dgRNA
  Plppr4
atgcttccatagtta

SEQ ID NO: 32759 - DNA, 15 bp, Artificial Sequence
  dgRNA
  Plppr4
tcacagccgtaacta

SEQ ID NO: 32760 - DNA, 15 bp, Artificial Sequence
  dgRNA
  Stat3
gcgtgtcttggccag

SEQ ID NO: 32761 - DNA, 15 bp, Artificial Sequence
  dgRNA
  Stat3
ttggccagtggcggc

SEQ ID NO: 32762 - DNA, 15 bp, Artificial Sequence
  dgRNA
  Stat3
tggccagtggcggct

SEQ ID NO: 32763 - DNA, 15 bp, Artificial Sequence
  dgRNA
  Stat3
taattcagcggtttc

SEQ ID NO: 32764 - DNA, 15 bp, Artificial Sequence
  dgRNA
  G6pd2
caatgttgagccctt

SEQ ID NO: 32765 - DNA, 15 bp, Artificial Sequence
  dgRNA
  G6pd2
agccctttgggcatt

SEQ ID NO: 32766 - DNA, 15 bp, Artificial Sequence
  dgRNA
  G6pd2
ccactcatcccattc

SEQ ID NO: 32767 - DNA, 15 bp, Artificial Sequence
  dgRNA
  2310022A10Rik
gagtgttagctgtga

SEQ ID NO: 32768 - DNA, 15 bp, Artificial Sequence
  dgRNA
  2310022A10Rik
gcttcgggctattct

SEQ ID NO: 32769 - DNA, 15 bp, Artificial Sequence
  dgRNA
  2310022A10Rik
cttcgggctattctt

SEQ ID NO: 32770 - DNA, 15 bp, Artificial Sequence
  dgRNA
  2310022A10Rik
ctgaccccctagttc

SEQ ID NO: 32771 - DNA, 15 bp, Artificial Sequence
  dgRNA
  Mark1
ggcggcgctcacctg

SEQ ID NO: 32772 - DNA, 15 bp, Artificial Sequence
  dgRNA
  Mark1
ggcgctcacctgagg

SEQ ID NO: 32773 - DNA, 15 bp, Artificial Sequence
  dgRNA
  Mark1
acctgaggcggcgtg

SEQ ID NO: 32774 - DNA, 15 bp, Artificial Sequence
  dgRNA
  Mark1
cctgaggcggcgtgc

SEQ ID NO: 32775 - DNA, 15 bp, Artificial Sequence
  dgRNA
  Rabgap1l
gtactccgcgctttc

SEQ ID NO: 32776 - DNA, 15 bp, Artificial Sequence
  dgRNA
  Rabgap1l
tactccgcgctttca

SEQ ID NO: 32777 - DNA, 15 bp, Artificial Sequence
  dgRNA
  Rabgap1l
ccgcgctttcagggt

SEQ ID NO: 32778 - DNA, 15 bp, Artificial Sequence
  dgRNA
  Rabgap1l
cgcgctttcagggtt

SEQ ID NO: 32779 - DNA, 15 bp, Artificial Sequence
  dgRNA
  Rassf1
actggacggaaagat

SEQ ID NO: 32780 - DNA, 15 bp, Artificial Sequence
  dgRNA
  Rassf1
ctggacggaaagatt

SEQ ID NO: 32781 - DNA, 15 bp, Artificial Sequence
  dgRNA
  Rassf1
acggaaagattggga

SEQ ID NO: 32782 - DNA, 15 bp, Artificial Sequence
  dgRNA
  Rassf1
aaggggctctttgaa

SEQ ID NO: 32783 - DNA, 15 bp, Artificial Sequence
  dgRNA
  Camta1
gccaatcactttagt

SEQ ID NO: 32784 - DNA, 15 bp, Artificial Sequence
  dgRNA
  Camta1
tcactttagtcggtg

SEQ ID NO: 32785 - DNA, 15 bp, Artificial Sequence
  dgRNA
  Camta1
ctttagtcggtgcgg

SEQ ID NO: 32786 - DNA, 15 bp, Artificial Sequence
  dgRNA
  Camta1
gtggtgatcagccaa

SEQ ID NO: 32787 - DNA, 15 bp, Artificial Sequence
  dgRNA
  Tor1aip2
ttctaggaagtctag

SEQ ID NO: 32788 - DNA, 15 bp, Artificial Sequence
  dgRNA
  Tor1aip2
gcgggttcctccctg

SEQ ID NO: 32789 - DNA, 15 bp, Artificial Sequence
  dgRNA
  Tor1aip2
ggagctcacgtcacg

SEQ ID NO: 32790 - DNA, 15 bp, Artificial Sequence
  dgRNA
  Tor1aip2
gagctcacgtcacgt

SEQ ID NO: 32791 - DNA, 15 bp, Artificial Sequence
  dgRNA
  Spdya
gctggagcggaataa

SEQ ID NO: 32792 - DNA, 15 bp, Artificial Sequence
  dgRNA
  Spdya
cggaataacggcaga

SEQ ID NO: 32793 - DNA, 15 bp, Artificial Sequence
  dgRNA
  Spdya
aataacggcagaagg

SEQ ID NO: 32794 - DNA, 15 bp, Artificial Sequence
  dgRNA
  Spdya
aacggcagaaggcgg

SEQ ID NO: 32795 - DNA, 15 bp, Artificial Sequence
  dgRNA
  Slc25a19
ccgcgcagacttcag

SEQ ID NO: 32796 - DNA, 15 bp, Artificial Sequence
  dgRNA
  Slc25a19
gatcgcgccaatgag

SEQ ID NO: 32797 - DNA, 15 bp, Artificial Sequence
  dgRNA
  Slc25a19
gagaggccctctaga

SEQ ID NO: 32798 - DNA, 15 bp, Artificial Sequence
  dgRNA
  Slc25a19
ccatccgctctttta

SEQ ID NO: 32799 - DNA, 15 bp, Artificial Sequence
  dgRNA
  Slc22a29
gtcaactatggacat

SEQ ID NO: 32800 - DNA, 15 bp, Artificial Sequence
  dgRNA
  Slc22a29
tcccatggtcaacta

SEQ ID NO: 32801 - DNA, 15 bp, Artificial Sequence
  dgRNA
  Nphp4
gaagtcagcgtgtgt

SEQ ID NO: 32802 - DNA, 15 bp, Artificial Sequence
  dgRNA
  Nphp4
cgtgtgttggagtcg

SEQ ID NO: 32803 - DNA, 15 bp, Artificial Sequence
  dgRNA
  Nphp4
gtgtgttggagtcgc

SEQ ID NO: 32804 - DNA, 15 bp, Artificial Sequence
  dgRNA
  Nphp4
tgttggagtcgcggg

SEQ ID NO: 32805 - DNA, 15 bp, Artificial Sequence
  dgRNA
  Efcab14
ggcgcgtgtgagttg

SEQ ID NO: 32806 - DNA, 15 bp, Artificial Sequence
  dgRNA
  Efcab14
agttgcggaagtcgc

SEQ ID NO: 32807 - DNA, 15 bp, Artificial Sequence
  dgRNA
  Efcab14
tgcggaagtcgctgg

SEQ ID NO: 32808 - DNA, 15 bp, Artificial Sequence
  dgRNA
  Efcab14
ggaagtcgctggtgg

SEQ ID NO: 32809 - DNA, 15 bp, Artificial Sequence
  dgRNA
  Paqr6
aatgggcggagctag

SEQ ID NO: 32810 - DNA, 15 bp, Artificial Sequence
  dgRNA
  Paqr6
gggtcctatcggtcc

SEQ ID NO: 32811 - DNA, 15 bp, Artificial Sequence
  dgRNA
  Paqr6
atcggtccaggtcag

SEQ ID NO: 32812 - DNA, 15 bp, Artificial Sequence
  dgRNA
  Paqr6
cctccgccggtgcca

SEQ ID NO: 32813 - DNA, 15 bp, Artificial Sequence
  dgRNA
  Terf2ip
agaacttccaggtcg

SEQ ID NO: 32814 - DNA, 15 bp, Artificial Sequence
  dgRNA
  Terf2ip
ccgatgggaagtgcc

SEQ ID NO: 32815 - DNA, 15 bp, Artificial Sequence
  dgRNA
  Terf2ip
ttgcagtgttccgat

SEQ ID NO: 32816 - DNA, 15 bp, Artificial Sequence
  dgRNA
  Terf2ip
gttgcagtgttccga

SEQ ID NO: 32817 - DNA, 15 bp, Artificial Sequence
  dgRNA
  Zc4h2
gagttgtagttctag

SEQ ID NO: 32818 - DNA, 15 bp, Artificial Sequence
  dgRNA
  Zc4h2
agttctagaggcacc

SEQ ID NO: 32819 - DNA, 15 bp, Artificial Sequence
  dgRNA
  Zc4h2
gttctagaggcaccc

SEQ ID NO: 32820 - DNA, 15 bp, Artificial Sequence
  dgRNA
  Zc4h2
ggcacccgggttgcc

SEQ ID NO: 32821 - DNA, 15 bp, Artificial Sequence
  dgRNA
  Trappc12
agccggatatgcgcc

SEQ ID NO: 32822 - DNA, 15 bp, Artificial Sequence
  dgRNA
  Trappc12
gcgcccggcttccag

SEQ ID NO: 32823 - DNA, 15 bp, Artificial Sequence
  dgRNA
  Trappc12
agcatgtgcggaagt

SEQ ID NO: 32824 - DNA, 15 bp, Artificial Sequence
  dgRNA
  Trappc12
gaagtcgggtctccg

SEQ ID NO: 32825 - DNA, 15 bp, Artificial Sequence
  dgRNA
  Otos
gagcatggcgccccc

SEQ ID NO: 32826 - DNA, 15 bp, Artificial Sequence
  dgRNA
  Otos
cggctgtctcacccc

SEQ ID NO: 32827 - DNA, 15 bp, Artificial Sequence
  dgRNA
  Otos
gggcgccatgctcac

SEQ ID NO: 32828 - DNA, 15 bp, Artificial Sequence
  dgRNA
  Otos
gagacagccggtccc

SEQ ID NO: 32829 - DNA, 15 bp, Artificial Sequence
  dgRNA
  Tmub2
cgtaggggtcagggg

SEQ ID NO: 32830 - DNA, 15 bp, Artificial Sequence
  dgRNA
  Tmub2
ttccgtaggggtcag

SEQ ID NO: 32831 - DNA, 15 bp, Artificial Sequence
  dgRNA
  Tmub2
ctttccgtaggggtc

SEQ ID NO: 32832 - DNA, 15 bp, Artificial Sequence
  dgRNA
  Tmub2
gttctctttccgtag

SEQ ID NO: 32833 - DNA, 15 bp, Artificial Sequence
  dgRNA
  Hspa14
tgatgaacggcgctc

SEQ ID NO: 32834 - DNA, 15 bp, Artificial Sequence
  dgRNA
  Hspa14
aacggcgctcaggag

SEQ ID NO: 32835 - DNA, 15 bp, Artificial Sequence
  dgRNA
  Hspa14
acggcgctcaggaga

SEQ ID NO: 32836 - DNA, 15 bp, Artificial Sequence
  dgRNA
  Hspa14
gaccggcgtttacgc

SEQ ID NO: 32837 - DNA, 15 bp, Artificial Sequence
  dgRNA
  Tubb1
gactgagcacagcgc

SEQ ID NO: 32838 - DNA, 15 bp, Artificial Sequence
  dgRNA
  Tubb1
cacccctgggccaat

SEQ ID NO: 32839 - DNA, 15 bp, Artificial Sequence
  dgRNA
  Tubb1
acccctgggccaatt

SEQ ID NO: 32840 - DNA, 15 bp, Artificial Sequence
  dgRNA
  Tubb1
ctcagtcagggtaag

SEQ ID NO: 32841 - DNA, 15 bp, Artificial Sequence
  dgRNA
  Dbndd2
gcgagcgcgtgcgcg

SEQ ID NO: 32842 - DNA, 15 bp, Artificial Sequence
  dgRNA
  Dbndd2
cgcgtggtcgttgcg

SEQ ID NO: 32843 - DNA, 15 bp, Artificial Sequence
  dgRNA
  Dbndd2
gcgtggtcgttgcgt

SEQ ID NO: 32844 - DNA, 15 bp, Artificial Sequence
  dgRNA
  Dbndd2
gcgtgggcgctgctc

SEQ ID NO: 32845 - DNA, 15 bp, Artificial Sequence
  dgRNA
  Olfr994
caccccttagactct

SEQ ID NO: 32846 - DNA, 15 bp, Artificial Sequence
  dgRNA
  Olfr994
taccaagagtctaag

SEQ ID NO: 32847 - DNA, 15 bp, Artificial Sequence
  dgRNA
  Olfr994
ctaccaagagtctaa

SEQ ID NO: 32848 - DNA, 15 bp, Artificial Sequence
  dgRNA
  Plekhs1
gttacctggaacatc

SEQ ID NO: 32849 - DNA, 15 bp, Artificial Sequence
  dgRNA
  Plekhs1
ccaggacttcccctt

SEQ ID NO: 32850 - DNA, 15 bp, Artificial Sequence
  dgRNA
  Plekhs1
gatgttccaggtaac

SEQ ID NO: 32851 - DNA, 15 bp, Artificial Sequence
  dgRNA
  Plekhs1
tacacctgatgttcc

SEQ ID NO: 32852 - DNA, 15 bp, Artificial Sequence
  dgRNA
  Syn2
ccacgaaggtgatga

SEQ ID NO: 32853 - DNA, 15 bp, Artificial Sequence
  dgRNA
  Syn2
cactgcgagagctcc

SEQ ID NO: 32854 - DNA, 15 bp, Artificial Sequence
  dgRNA
  Syn2
cacacagtcacgctc

SEQ ID NO: 32855 - DNA, 15 bp, Artificial Sequence
  dgRNA
  Syn2
acagtcacgctcagg

SEQ ID NO: 32856 - DNA, 15 bp, Artificial Sequence
  dgRNA
  Fig4
aggtcaacataagtc

SEQ ID NO: 32857 - DNA, 15 bp, Artificial Sequence
  dgRNA
  Fig4
cccgcccctccggtt

SEQ ID NO: 32858 - DNA, 15 bp, Artificial Sequence
  dgRNA
  Fig4
ccgcccctccggttt

SEQ ID NO: 32859 - DNA, 15 bp, Artificial Sequence
  dgRNA
  Fig4
ccctccggtttgggc

SEQ ID NO: 32860 - DNA, 15 bp, Artificial Sequence
  dgRNA
  Ghsr
cctagcgcccaagag

SEQ ID NO: 32861 - DNA, 15 bp, Artificial Sequence
  dgRNA
  Ghsr
gagtgttcccctcgg

SEQ ID NO: 32862 - DNA, 15 bp, Artificial Sequence
  dgRNA
  Ghsr
agcgagtgttcccct

SEQ ID NO: 32863 - DNA, 15 bp, Artificial Sequence
  dgRNA
  Ghsr
gtggccgggaaggat

SEQ ID NO: 32864 - DNA, 15 bp, Artificial Sequence
  dgRNA
  Zmym3
accccaacagtcgcc

SEQ ID NO: 32865 - DNA, 15 bp, Artificial Sequence
  dgRNA
  Zmym3
ccccaacagtcgccc

SEQ ID NO: 32866 - DNA, 15 bp, Artificial Sequence
  dgRNA
  Zmym3
cccaacagtcgcccg

SEQ ID NO: 32867 - DNA, 15 bp, Artificial Sequence
  dgRNA
  Zmym3
ccaacagtcgcccgg

SEQ ID NO: 32868 - DNA, 15 bp, Artificial Sequence
  dgRNA
  Hk3
ctccgcttctttcca

SEQ ID NO: 32869 - DNA, 15 bp, Artificial Sequence
  dgRNA
  Gatsl3
gggcgtccagcggaa

SEQ ID NO: 32870 - DNA, 15 bp, Artificial Sequence
  dgRNA
  Gatsl3
ggcgtccagcggaaa

SEQ ID NO: 32871 - DNA, 15 bp, Artificial Sequence
  dgRNA
  Gatsl3
cggaaagggcgtgtc

SEQ ID NO: 32872 - DNA, 15 bp, Artificial Sequence
  dgRNA
  Gatsl3
gaaagggcgtgtctg

SEQ ID NO: 32873 - DNA, 15 bp, Artificial Sequence
  dgRNA
  Chn1
aaaatcttgcatgag

SEQ ID NO: 32874 - DNA, 15 bp, Artificial Sequence
  dgRNA
  Chn1
ggaaagagcgagttg

SEQ ID NO: 32875 - DNA, 15 bp, Artificial Sequence
  dgRNA
  Chn1
cttaaatactgctac

SEQ ID NO: 32876 - DNA, 15 bp, Artificial Sequence
  dgRNA
  Chn1
gactagactggccac

SEQ ID NO: 32877 - DNA, 15 bp, Artificial Sequence
  dgRNA
  Med8
ctcacctctggctcg

SEQ ID NO: 32878 - DNA, 15 bp, Artificial Sequence
  dgRNA
  Med8
gctcggggcgctccg

SEQ ID NO: 32879 - DNA, 15 bp, Artificial Sequence
  dgRNA
  Med8
acagccctcccgcgc

SEQ ID NO: 32880 - DNA, 15 bp, Artificial Sequence
  dgRNA
  Med8
cctcccgcgccggcc

SEQ ID NO: 32881 - DNA, 15 bp, Artificial Sequence
  dgRNA
  Iqcf5
atttgagtggtataa

SEQ ID NO: 32882 - DNA, 15 bp, Artificial Sequence
  dgRNA
  Iqcf5
agtggtataaaggtg

SEQ ID NO: 32883 - DNA, 15 bp, Artificial Sequence
  dgRNA
  Iqcf5
gtggtataaaggtgt

SEQ ID NO: 32884 - DNA, 15 bp, Artificial Sequence
  dgRNA
  Iqcf5
gtgtattggaccctc

SEQ ID NO: 32885 - DNA, 15 bp, Artificial Sequence
  dgRNA
  Enthd2
gaacgcgtgaacatc

SEQ ID NO: 32886 - DNA, 15 bp, Artificial Sequence
  dgRNA
  Enthd2
gcctatcctattttc

SEQ ID NO: 32887 - DNA, 15 bp, Artificial Sequence
  dgRNA
  Enthd2
atcctattttctggt

SEQ ID NO: 32888 - DNA, 15 bp, Artificial Sequence
  dgRNA
  Enthd2
ccccttgcgagcgat

SEQ ID NO: 32889 - DNA, 15 bp, Artificial Sequence
  dgRNA
  C2cd2
aaggcgcgccaagcg

SEQ ID NO: 32890 - DNA, 15 bp, Artificial Sequence
  dgRNA
  C2cd2
actcaaggtagtggc

SEQ ID NO: 32891 - DNA, 15 bp, Artificial Sequence
  dgRNA
  C2cd2
cttaacgccgccgtg

SEQ ID NO: 32892 - DNA, 15 bp, Artificial Sequence
  dgRNA
  C2cd2
ttaacgccgccgtga

SEQ ID NO: 32893 - DNA, 15 bp, Artificial Sequence
  dgRNA
  Neurl2
ctggggaccccttac

SEQ ID NO: 32894 - DNA, 15 bp, Artificial Sequence
  dgRNA
  Neurl2
tgacaagcgagaaag

SEQ ID NO: 32895 - DNA, 15 bp, Artificial Sequence
  dgRNA
  Neurl2
cgagaaagcggcgct

SEQ ID NO: 32896 - DNA, 15 bp, Artificial Sequence
  dgRNA
  Neurl2
ggcgctaggaccccc

SEQ ID NO: 32897 - DNA, 15 bp, Artificial Sequence
  dgRNA
  Mcpt4
gtcgacaccttatta

SEQ ID NO: 32898 - DNA, 15 bp, Artificial Sequence
  dgRNA
  Mcpt4
tcgacaccttattat

SEQ ID NO: 32899 - DNA, 15 bp, Artificial Sequence
  dgRNA
  Mcpt4
cttattatgggatgc

SEQ ID NO: 32900 - DNA, 15 bp, Artificial Sequence
  dgRNA
  Mcpt4
ctgcatcccataata

SEQ ID NO: 32901 - DNA, 15 bp, Artificial Sequence
  dgRNA
  Slc26a1
accaaggccatcacg

SEQ ID NO: 32902 - DNA, 15 bp, Artificial Sequence
  dgRNA
  Slc26a1
caattgtgcttggcc

SEQ ID NO: 32903 - DNA, 15 bp, Artificial Sequence
  dgRNA
  Slc26a1
ggagccaattgtgct

SEQ ID NO: 32904 - DNA, 15 bp, Artificial Sequence
  dgRNA
  Slc26a1
cttggtcctgtttac

SEQ ID NO: 32905 - DNA, 15 bp, Artificial Sequence
  dgRNA
  Fto
cggcgggtcgcgtag

SEQ ID NO: 32906 - DNA, 15 bp, Artificial Sequence
  dgRNA
  Fto
gccctgctagctgac

SEQ ID NO: 32907 - DNA, 15 bp, Artificial Sequence
  dgRNA
  Fto
agcccaaggagtact

SEQ ID NO: 32908 - DNA, 15 bp, Artificial Sequence
  dgRNA
  Fto
gcccaaggagtactc

SEQ ID NO: 32909 - DNA, 15 bp, Artificial Sequence
  dgRNA
  Hadh
cccaccagattgtga

SEQ ID NO: 32910 - DNA, 15 bp, Artificial Sequence
  dgRNA
  Hadh
gggtccctgctttgc

SEQ ID NO: 32911 - DNA, 15 bp, Artificial Sequence
  dgRNA
  Hadh
tgccggagtccatgc

SEQ ID NO: 32912 - DNA, 15 bp, Artificial Sequence
  dgRNA
  Hadh
ctggcaccgccctct

SEQ ID NO: 32913 - DNA, 15 bp, Artificial Sequence
  dgRNA
  Ikbip
gcgcacccgcgagct

SEQ ID NO: 32914 - DNA, 15 bp, Artificial Sequence
  dgRNA
  Ikbip
cgcacccgcgagctt

SEQ ID NO: 32915 - DNA, 15 bp, Artificial Sequence
  dgRNA
  Ikbip
tcccgcagactcagt

SEQ ID NO: 32916 - DNA, 15 bp, Artificial Sequence
  dgRNA
  Ikbip
cccgcagactcagtc

SEQ ID NO: 32917 - DNA, 15 bp, Artificial Sequence
  dgRNA
  Jrkl
tcccgattatccgcg

SEQ ID NO: 32918 - DNA, 15 bp, Artificial Sequence
  dgRNA
  Jrkl
atccgcgaggatgtg

SEQ ID NO: 32919 - DNA, 15 bp, Artificial Sequence
  dgRNA
  Jrkl
taatactgctgtgac

SEQ ID NO: 32920 - DNA, 15 bp, Artificial Sequence
  dgRNA
  Jrkl
tcctcgcggataatc

SEQ ID NO: 32921 - DNA, 15 bp, Artificial Sequence
  dgRNA
  B3galnt2
cgggcttacaatctc

SEQ ID NO: 32922 - DNA, 15 bp, Artificial Sequence
  dgRNA
  B3galnt2
ggcacgcctccctcc

SEQ ID NO: 32923 - DNA, 15 bp, Artificial Sequence
  dgRNA
  B3galnt2
gcacgcctccctcct

SEQ ID NO: 32924 - DNA, 15 bp, Artificial Sequence
  dgRNA
  B3galnt2
ccgctcccgcccttc

SEQ ID NO: 32925 - DNA, 15 bp, Artificial Sequence
  dgRNA
  Supt20
cgggctagcgggtgt

SEQ ID NO: 32926 - DNA, 15 bp, Artificial Sequence
  dgRNA
  Supt20
gtcggtctagtgtcg

SEQ ID NO: 32927 - DNA, 15 bp, Artificial Sequence
  dgRNA
  Supt20
tctagtgtcgtggag

SEQ ID NO: 32928 - DNA, 15 bp, Artificial Sequence
  dgRNA
  Supt20
gtgtcgtggagcggc

SEQ ID NO: 32929 - DNA, 15 bp, Artificial Sequence
  dgRNA
  Ly96
tactgtcgagtccga

SEQ ID NO: 32930 - DNA, 15 bp, Artificial Sequence
  dgRNA
  Ly96
gtccgatggtcttcc

SEQ ID NO: 32931 - DNA, 15 bp, Artificial Sequence
  dgRNA
  Ly96
gcgagtttaaagtat

SEQ ID NO: 32932 - DNA, 15 bp, Artificial Sequence
  dgRNA
  Ly96
agcagtcatgtgatt

SEQ ID NO: 32933 - DNA, 15 bp, Artificial Sequence
  dgRNA
  Acsl6
tcccgtgaccttgtg

SEQ ID NO: 32934 - DNA, 15 bp, Artificial Sequence
  dgRNA
  Acsl6
cattcttattaagtg

SEQ ID NO: 32935 - DNA, 15 bp, Artificial Sequence
  dgRNA
  Fam47e
acgcaggctttagag

SEQ ID NO: 32936 - DNA, 15 bp, Artificial Sequence
  dgRNA
  Fam47e
ctctgagtgacacgc

SEQ ID NO: 32937 - DNA, 15 bp, Artificial Sequence
  dgRNA
  Fam47e
atgagcagatcggtg

SEQ ID NO: 32938 - DNA, 15 bp, Artificial Sequence
  dgRNA
  Fam47e
tcaaactagactgca

SEQ ID NO: 32939 - DNA, 15 bp, Artificial Sequence
  dgRNA
  Gnb2
ccctagttccgcctc

SEQ ID NO: 32940 - DNA, 15 bp, Artificial Sequence
  dgRNA
  Gnb2
cctagttccgcctcc

SEQ ID NO: 32941 - DNA, 15 bp, Artificial Sequence
  dgRNA
  Gnb2
gttccgcctccggga

SEQ ID NO: 32942 - DNA, 15 bp, Artificial Sequence
  dgRNA
  Gnb2
ttccgcctccgggaa

SEQ ID NO: 32943 - DNA, 15 bp, Artificial Sequence
  dgRNA
  Hdgfrp3
ggcggcgggcgtctt

SEQ ID NO: 32944 - DNA, 15 bp, Artificial Sequence
  dgRNA
  Hdgfrp3
gggcgtctttggagt

SEQ ID NO: 32945 - DNA, 15 bp, Artificial Sequence
  dgRNA
  Hdgfrp3
aggcgctcccacccg

SEQ ID NO: 32946 - DNA, 15 bp, Artificial Sequence
  dgRNA
  Hdgfrp3
ggcgctcccacccgc

SEQ ID NO: 32947 - DNA, 15 bp, Artificial Sequence
  dgRNA
  Shf
tcctcctacgggctc

SEQ ID NO: 32948 - DNA, 15 bp, Artificial Sequence
  dgRNA
  Shf
ctacgggctccggcc

SEQ ID NO: 32949 - DNA, 15 bp, Artificial Sequence
  dgRNA
  Shf
tacgggctccggccc

SEQ ID NO: 32950 - DNA, 15 bp, Artificial Sequence
  dgRNA
  Shf
acgggctccggcccg

SEQ ID NO: 32951 - DNA, 15 bp, Artificial Sequence
  dgRNA
  Nup107
cacgcagtcactccc

SEQ ID NO: 32952 - DNA, 15 bp, Artificial Sequence
  dgRNA
  Nup107
cactgagcctgcggc

SEQ ID NO: 32953 - DNA, 15 bp, Artificial Sequence
  dgRNA
  Nup107
gcgcatgcgccgagc

SEQ ID NO: 32954 - DNA, 15 bp, Artificial Sequence
  dgRNA
  Nup107
gccaggccgcgcttc

SEQ ID NO: 32955 - DNA, 15 bp, Artificial Sequence
  dgRNA
  Cnih4
ttcatatgataggca

SEQ ID NO: 32956 - DNA, 15 bp, Artificial Sequence
  dgRNA
  Cnih4
agtggatactaaatg

SEQ ID NO: 32957 - DNA, 15 bp, Artificial Sequence
  dgRNA
  Cnih4
gtggatactaaatga

SEQ ID NO: 32958 - DNA, 15 bp, Artificial Sequence
  dgRNA
  Cnih4
acctgctatgctccc

SEQ ID NO: 32959 - DNA, 15 bp, Artificial Sequence
  dgRNA
  Cep44
aagaagctgcgcgaa

SEQ ID NO: 32960 - DNA, 15 bp, Artificial Sequence
  dgRNA
  Cep44
tgcgcgaacggagtg

SEQ ID NO: 32961 - DNA, 15 bp, Artificial Sequence
  dgRNA
  Cep44
tggcgaatctgaatg

SEQ ID NO: 32962 - DNA, 15 bp, Artificial Sequence
  dgRNA
  Cep44
tcgcgcagcttcttc

SEQ ID NO: 32963 - DNA, 15 bp, Artificial Sequence
  dgRNA
  Krba1
tgctaaagagaacgg

SEQ ID NO: 32964 - DNA, 15 bp, Artificial Sequence
  dgRNA
  Krba1
agccgcaagctcgac

SEQ ID NO: 32965 - DNA, 15 bp, Artificial Sequence
  dgRNA
  Krba1
ctaaccagtgccagg

SEQ ID NO: 32966 - DNA, 15 bp, Artificial Sequence
  dgRNA
  Krba1
gggacggagcagtaa

SEQ ID NO: 32967 - DNA, 15 bp, Artificial Sequence
  dgRNA
  Prkar1b
gtggcaagaggtatc

SEQ ID NO: 32968 - DNA, 15 bp, Artificial Sequence
  dgRNA
  Prkar1b
gtacccctgaacgat

SEQ ID NO: 32969 - DNA, 15 bp, Artificial Sequence
  dgRNA
  Prkar1b
tacccctgaacgata

SEQ ID NO: 32970 - DNA, 15 bp, Artificial Sequence
  dgRNA
  Prkar1b
gaacgatagggaatg

SEQ ID NO: 32971 - DNA, 15 bp, Artificial Sequence
  dgRNA
  Ercc6l
tagcgccagtgctcg

SEQ ID NO: 32972 - DNA, 15 bp, Artificial Sequence
  dgRNA
  Ercc6l
agcgccagtgctcga

SEQ ID NO: 32973 - DNA, 15 bp, Artificial Sequence
  dgRNA
  Ercc6l
agtgctcgagggcgc

SEQ ID NO: 32974 - DNA, 15 bp, Artificial Sequence
  dgRNA
  Ercc6l
gcgcaagaccttcct

SEQ ID NO: 32975 - DNA, 15 bp, Artificial Sequence
  dgRNA
  Rfpl4b
atgatttactcttag

SEQ ID NO: 32976 - DNA, 15 bp, Artificial Sequence
  dgRNA
  Rfpl4b
tgatttactcttaga

SEQ ID NO: 32977 - DNA, 15 bp, Artificial Sequence
  dgRNA
  Rfpl4b
ttttgactcacattg

SEQ ID NO: 32978 - DNA, 15 bp, Artificial Sequence
  dgRNA
  Rfpl4b
tttgactcacattgt

SEQ ID NO: 32979 - DNA, 15 bp, Artificial Sequence
  dgRNA
  Tsc22d1
ttgaaatcgagacgc

SEQ ID NO: 32980 - DNA, 15 bp, Artificial Sequence
  dgRNA
  Tsc22d1
gcccagtagctcggc

SEQ ID NO: 32981 - DNA, 15 bp, Artificial Sequence
  dgRNA
  Tsc22d1
cccagtagctcggct

SEQ ID NO: 32982 - DNA, 15 bp, Artificial Sequence
  dgRNA
  Tsc22d1
taataatcctgctgc

SEQ ID NO: 32983 - DNA, 15 bp, Artificial Sequence
  dgRNA
  Olfr859
tgtcttatgaatagc

SEQ ID NO: 32984 - DNA, 15 bp, Artificial Sequence
  dgRNA
  Zglp1
gtgacctgcgccgcc

SEQ ID NO: 32985 - DNA, 15 bp, Artificial Sequence
  dgRNA
  Zglp1
gctccgttttatccc

SEQ ID NO: 32986 - DNA, 15 bp, Artificial Sequence
  dgRNA
  Zglp1
ctccgttttatccct

SEQ ID NO: 32987 - DNA, 15 bp, Artificial Sequence
  dgRNA
  Zglp1
ccgttttatccctgg

SEQ ID NO: 32988 - DNA, 15 bp, Artificial Sequence
  dgRNA
  Rabgef1
atacgccaaaagcac

SEQ ID NO: 32989 - DNA, 15 bp, Artificial Sequence
  dgRNA
  Upf2
attgaacacatagcg

SEQ ID NO: 32990 - DNA, 15 bp, Artificial Sequence
  dgRNA
  Upf2
ttgaacacatagcga

SEQ ID NO: 32991 - DNA, 15 bp, Artificial Sequence
  dgRNA
  Upf2
cacatagcgagggac

SEQ ID NO: 32992 - DNA, 15 bp, Artificial Sequence
  dgRNA
  Upf2
agggaccggagacga

SEQ ID NO: 32993 - DNA, 15 bp, Artificial Sequence
  dgRNA
  Adck1
ccgcgcacagagtcc

SEQ ID NO: 32994 - DNA, 15 bp, Artificial Sequence
  dgRNA
  Adck1
cgctgccagattgtg

SEQ ID NO: 32995 - DNA, 15 bp, Artificial Sequence
  dgRNA
  Adck1
gctgccagattgtgc

SEQ ID NO: 32996 - DNA, 15 bp, Artificial Sequence
  dgRNA
  Adck1
agattgtgcgggacg

SEQ ID NO: 32997 - DNA, 15 bp, Artificial Sequence
  dgRNA
  Slc25a22
gcctttgatcaaggg

SEQ ID NO: 32998 - DNA, 15 bp, Artificial Sequence
  dgRNA
  Slc25a22
cctttgatcaagggt

SEQ ID NO: 32999 - DNA, 15 bp, Artificial Sequence
  dgRNA
  Slc25a22
gcattaaaaggcatc

SEQ ID NO: 33000 - DNA, 15 bp, Artificial Sequence
  dgRNA
  Slc25a22
tgccgttttttcagt

SEQ ID NO: 33001 - DNA, 15 bp, Artificial Sequence
  dgRNA
  A830018L16Rik
ctcggggagcagctt

SEQ ID NO: 33002 - DNA, 15 bp, Artificial Sequence
  dgRNA
  A830018L16Rik
gctgggcgcacaccg

SEQ ID NO: 33003 - DNA, 15 bp, Artificial Sequence
  dgRNA
  A830018L16Rik
caccgtggcgcgctc

SEQ ID NO: 33004 - DNA, 15 bp, Artificial Sequence
  dgRNA
  A830018L16Rik
accgtggcgcgctct

SEQ ID NO: 33005 - DNA, 15 bp, Artificial Sequence
  dgRNA
  Il11ra1
cctccttgctagtcc

SEQ ID NO: 33006 - DNA, 15 bp, Artificial Sequence
  dgRNA
  Gm11596
caaacctaacacact

SEQ ID NO: 33007 - DNA, 15 bp, Artificial Sequence
  dgRNA
  Gm11596
ctgtctcgtgctaca

SEQ ID NO: 33008 - DNA, 15 bp, Artificial Sequence
  dgRNA
  Xpo6
ctggcctcttgggcg

SEQ ID NO: 33009 - DNA, 15 bp, Artificial Sequence
  dgRNA
  Xpo6
tcttgggcggggacg

SEQ ID NO: 33010 - DNA, 15 bp, Artificial Sequence
  dgRNA
  Xpo6
gccctcacttgattc

SEQ ID NO: 33011 - DNA, 15 bp, Artificial Sequence
  dgRNA
  Xpo6
cacttgattccggat

SEQ ID NO: 33012 - DNA, 15 bp, Artificial Sequence
  dgRNA
  Papolb
cctgcttggggatag

SEQ ID NO: 33013 - DNA, 15 bp, Artificial Sequence
  dgRNA
  Papolb
gagacttctcagaac

SEQ ID NO: 33014 - DNA, 15 bp, Artificial Sequence
  dgRNA
  Papolb
ttctcagaaccgggc

SEQ ID NO: 33015 - DNA, 15 bp, Artificial Sequence
  dgRNA
  Papolb
cagaaccgggcaggc

SEQ ID NO: 33016 - DNA, 15 bp, Artificial Sequence
  dgRNA
  Slc38a8
tggggtcggtttctg

SEQ ID NO: 33017 - DNA, 15 bp, Artificial Sequence
  dgRNA
  Slc38a8
ggggtcggtttctga

SEQ ID NO: 33018 - DNA, 15 bp, Artificial Sequence
  dgRNA
  Slc38a8
gcttttgccgatcac

SEQ ID NO: 33019 - DNA, 15 bp, Artificial Sequence
  dgRNA
  Slc38a8
ccaccgcagaccccg

SEQ ID NO: 33020 - DNA, 15 bp, Artificial Sequence
  dgRNA
  Ablim1
cggcaatcatttatc

SEQ ID NO: 33021 - DNA, 15 bp, Artificial Sequence
  dgRNA
  Ablim1
tcatttatcaggccc

SEQ ID NO: 33022 - DNA, 15 bp, Artificial Sequence
  dgRNA
  Ablim1
ttatcaggccctggg

SEQ ID NO: 33023 - DNA, 15 bp, Artificial Sequence
  dgRNA
  Ablim1
attttcccgggcgtc

SEQ ID NO: 33024 - DNA, 15 bp, Artificial Sequence
  dgRNA
  Ngfrap1
cctcccactatagcc

SEQ ID NO: 33025 - DNA, 15 bp, Artificial Sequence
  dgRNA
  Asrgl1
catgcgataatttca

SEQ ID NO: 33026 - DNA, 15 bp, Artificial Sequence
  dgRNA
  Asrgl1
gtcccgcgtgctact

SEQ ID NO: 33027 - DNA, 15 bp, Artificial Sequence
  dgRNA
  Asrgl1
tcccgcgtgctacta

SEQ ID NO: 33028 - DNA, 15 bp, Artificial Sequence
  dgRNA
  Asrgl1
atgttattctagatc

SEQ ID NO: 33029 - DNA, 15 bp, Artificial Sequence
  dgRNA
  Snrnp48
ttccgccctgcccgt

SEQ ID NO: 33030 - DNA, 15 bp, Artificial Sequence
  dgRNA
  Snrnp48
tcggctcttcccgat

SEQ ID NO: 33031 - DNA, 15 bp, Artificial Sequence
  dgRNA
  Snrnp48
ctcttcccgataggc

SEQ ID NO: 33032 - DNA, 15 bp, Artificial Sequence
  dgRNA
  Snrnp48
aggctggcgccatcc

SEQ ID NO: 33033 - DNA, 15 bp, Artificial Sequence
  dgRNA
  Oas1h
tagccccgcccttct

SEQ ID NO: 33034 - DNA, 15 bp, Artificial Sequence
  dgRNA
  Npsr1
caggcaagcccggac

SEQ ID NO: 33035 - DNA, 15 bp, Artificial Sequence
  dgRNA
  Npsr1
caggcaagcccatcc

SEQ ID NO: 33036 - DNA, 15 bp, Artificial Sequence
  dgRNA
  Npsr1
acgtgagcacggcct

SEQ ID NO: 33037 - DNA, 15 bp, Artificial Sequence
  dgRNA
  Npsr1
cgtgagcacggcctt

SEQ ID NO: 33038 - DNA, 15 bp, Artificial Sequence
  dgRNA
  Golga7b
ggccttccgtattgc

SEQ ID NO: 33039 - DNA, 15 bp, Artificial Sequence
  dgRNA
  Golga7b
ttccgtattgcaggc

SEQ ID NO: 33040 - DNA, 15 bp, Artificial Sequence
  dgRNA
  Golga7b
tccgtattgcaggcc

SEQ ID NO: 33041 - DNA, 15 bp, Artificial Sequence
  dgRNA
  Golga7b
tctggaagtccccgg

SEQ ID NO: 33042 - DNA, 15 bp, Artificial Sequence
  dgRNA
  Pcyt1b
tagttaattcaccaa

SEQ ID NO: 33043 - DNA, 15 bp, Artificial Sequence
  dgRNA
  Pcyt1b
gttgccatagctcca

SEQ ID NO: 33044 - DNA, 15 bp, Artificial Sequence
  dgRNA
  Pcyt1b
gggtagatcaaacaa

SEQ ID NO: 33045 - DNA, 15 bp, Artificial Sequence
  dgRNA
  Pcyt1b
gactgattatgctcc

SEQ ID NO: 33046 - DNA, 15 bp, Artificial Sequence
  dgRNA
  Ythdc1
gaaccagagcacggg

SEQ ID NO: 33047 - DNA, 15 bp, Artificial Sequence
  dgRNA
  Ythdc1
ggaagggttgcgcgt

SEQ ID NO: 33048 - DNA, 15 bp, Artificial Sequence
  dgRNA
  Ythdc1
gcgtaggaagctgag

SEQ ID NO: 33049 - DNA, 15 bp, Artificial Sequence
  dgRNA
  Ythdc1
gcgcggcccgccgga

SEQ ID NO: 33050 - DNA, 15 bp, Artificial Sequence
  dgRNA
  Laptm4a
tggctccctctaagt

SEQ ID NO: 33051 - DNA, 15 bp, Artificial Sequence
  dgRNA
  Laptm4a
gcgagccctcctttc

SEQ ID NO: 33052 - DNA, 15 bp, Artificial Sequence
  dgRNA
  Laptm4a
agggccacgccagaa

SEQ ID NO: 33053 - DNA, 15 bp, Artificial Sequence
  dgRNA
  Laptm4a
caggcacgccccgac

SEQ ID NO: 33054 - DNA, 15 bp, Artificial Sequence
  dgRNA
  Nrp2
ccgctcgcacactcg

SEQ ID NO: 33055 - DNA, 15 bp, Artificial Sequence
  dgRNA
  Nrp2
cgctcgcacactcgc

SEQ ID NO: 33056 - DNA, 15 bp, Artificial Sequence
  dgRNA
  Nrp2
gcgggtgtaaccgcc

SEQ ID NO: 33057 - DNA, 15 bp, Artificial Sequence
  dgRNA
  Nrp2
cgggtgtaaccgccg

SEQ ID NO: 33058 - DNA, 15 bp, Artificial Sequence
  dgRNA
  Sars
tcacgatttcagtgg

SEQ ID NO: 33059 - DNA, 15 bp, Artificial Sequence
  dgRNA
  Sars
cacgatttcagtggg

SEQ ID NO: 33060 - DNA, 15 bp, Artificial Sequence
  dgRNA
  Sars
tggggggcgatcaga

SEQ ID NO: 33061 - DNA, 15 bp, Artificial Sequence
  dgRNA
  Sars
gaaacaacccgcata

SEQ ID NO: 33062 - DNA, 15 bp, Artificial Sequence
  dgRNA
  Cxcr3
ggattggagtctcac

SEQ ID NO: 33063 - DNA, 15 bp, Artificial Sequence
  dgRNA
  Cxcr3
ctccttagcaagtac

SEQ ID NO: 33064 - DNA, 15 bp, Artificial Sequence
  dgRNA
  Cxcr3
caactaagtgagtct

SEQ ID NO: 33065 - DNA, 15 bp, Artificial Sequence
  dgRNA
  Cxcr3
tagaaggggctagcc

SEQ ID NO: 33066 - DNA, 15 bp, Artificial Sequence
  dgRNA
  Tas2r120
gcaatgtgttgtaat

SEQ ID NO: 33067 - DNA, 15 bp, Artificial Sequence
  dgRNA
  Tial1
cggcgcgaggcactc

SEQ ID NO: 33068 - DNA, 15 bp, Artificial Sequence
  dgRNA
  Tial1
ggcgcgaggcactct

SEQ ID NO: 33069 - DNA, 15 bp, Artificial Sequence
  dgRNA
  Tial1
ttcctcgctctatcc

SEQ ID NO: 33070 - DNA, 15 bp, Artificial Sequence
  dgRNA
  Tial1
ccgactacttagtcg

SEQ ID NO: 33071 - DNA, 15 bp, Artificial Sequence
  dgRNA
  Klf2
agggacggtcggggg

SEQ ID NO: 33072 - DNA, 15 bp, Artificial Sequence
  dgRNA
  Klf2
gggacggtcgggggc

SEQ ID NO: 33073 - DNA, 15 bp, Artificial Sequence
  dgRNA
  Klf2
ggacggtcgggggcg

SEQ ID NO: 33074 - DNA, 15 bp, Artificial Sequence
  dgRNA
  Klf2
ggggcccggccgcgg

SEQ ID NO: 33075 - DNA, 15 bp, Artificial Sequence
  dgRNA
  AI182371
tgatccccgaatttc

SEQ ID NO: 33076 - DNA, 15 bp, Artificial Sequence
  dgRNA
  AI182371
aattaacgcagaatg

SEQ ID NO: 33077 - DNA, 15 bp, Artificial Sequence
  dgRNA
  AI182371
gtaggatttcgcatc

SEQ ID NO: 33078 - DNA, 15 bp, Artificial Sequence
  dgRNA
  AI182371
aaccatttcaagccc

SEQ ID NO: 33079 - DNA, 15 bp, Artificial Sequence
  dgRNA
  Galnt9
gggcggtctgaagct

SEQ ID NO: 33080 - DNA, 15 bp, Artificial Sequence
  dgRNA
  Galnt9
gtctgaagctcggag

SEQ ID NO: 33081 - DNA, 15 bp, Artificial Sequence
  dgRNA
  Galnt9
agtggtgccgcgccc

SEQ ID NO: 33082 - DNA, 15 bp, Artificial Sequence
  dgRNA
  Galnt9
gtggtgccgcgccct

SEQ ID NO: 33083 - DNA, 15 bp, Artificial Sequence
  dgRNA
  Pxn
attgggcgtgctggg

SEQ ID NO: 33084 - DNA, 15 bp, Artificial Sequence
  dgRNA
  Pxn
tggccagcgtgcacg

SEQ ID NO: 33085 - DNA, 15 bp, Artificial Sequence
  dgRNA
  Pxn
ggccagcgtgcacgc

SEQ ID NO: 33086 - DNA, 15 bp, Artificial Sequence
  dgRNA
  Pxn
gccagcgtgcacgcg

SEQ ID NO: 33087 - DNA, 15 bp, Artificial Sequence
  dgRNA
  Olfr1275
agttagtccatattt

SEQ ID NO: 33088 - DNA, 15 bp, Artificial Sequence
  dgRNA
  Olfr1275
taataacctaacagt

SEQ ID NO: 33089 - DNA, 15 bp, Artificial Sequence
  dgRNA
  Pik3c3
cgtctcaatcaaagt

SEQ ID NO: 33090 - DNA, 15 bp, Artificial Sequence
  dgRNA
  Pik3c3
gtaataacgttcaca

SEQ ID NO: 33091 - DNA, 15 bp, Artificial Sequence
  dgRNA
  Pik3c3
ctactttgattgaga

SEQ ID NO: 33092 - DNA, 15 bp, Artificial Sequence
  dgRNA
  Caln1
agtgcgcgcgcaccg

SEQ ID NO: 33093 - DNA, 15 bp, Artificial Sequence
  dgRNA
  Caln1
accgaggcgttcctc

SEQ ID NO: 33094 - DNA, 15 bp, Artificial Sequence
  dgRNA
  Caln1
tcaggttgcgctgcc

SEQ ID NO: 33095 - DNA, 15 bp, Artificial Sequence
  dgRNA
  Caln1
aacggagggagccat

SEQ ID NO: 33096 - DNA, 15 bp, Artificial Sequence
  dgRNA
  Ermn
actggagctgcgagg

SEQ ID NO: 33097 - DNA, 15 bp, Artificial Sequence
  dgRNA
  Ermn
atgttgctgattggc

SEQ ID NO: 33098 - DNA, 15 bp, Artificial Sequence
  dgRNA
  Ermn
gttttgctcccgggc

SEQ ID NO: 33099 - DNA, 15 bp, Artificial Sequence
  dgRNA
  Ermn
tgtcagtccccctct

SEQ ID NO: 33100 - DNA, 15 bp, Artificial Sequence
  dgRNA
  Lamb2
ttgtctgcagcgggc

SEQ ID NO: 33101 - DNA, 15 bp, Artificial Sequence
  dgRNA
  Lamb2
gttcgaggaactaaa

SEQ ID NO: 33102 - DNA, 15 bp, Artificial Sequence
  dgRNA
  Lamb2
gagtggatctaaaat

SEQ ID NO: 33103 - DNA, 15 bp, Artificial Sequence
  dgRNA
  Lamb2
aagtaaaacacggag

SEQ ID NO: 33104 - DNA, 15 bp, Artificial Sequence
  dgRNA
  Decr1
gtgacggaattccca

SEQ ID NO: 33105 - DNA, 15 bp, Artificial Sequence
  dgRNA
  Decr1
aattcccatggatca

SEQ ID NO: 33106 - DNA, 15 bp, Artificial Sequence
  dgRNA
  Decr1
cacggcttttcatca

SEQ ID NO: 33107 - DNA, 15 bp, Artificial Sequence
  dgRNA
  Decr1
acgcgaccgatcgaa

SEQ ID NO: 33108 - DNA, 15 bp, Artificial Sequence
  dgRNA
  Pus10
ccgccagctccgctc

SEQ ID NO: 33109 - DNA, 15 bp, Artificial Sequence
  dgRNA
  Pus10
ctccgctccggctca

SEQ ID NO: 33110 - DNA, 15 bp, Artificial Sequence
  dgRNA
  Pus10
gggaagcgactgcga

SEQ ID NO: 33111 - DNA, 15 bp, Artificial Sequence
  dgRNA
  Pus10
agcgactgcgacggc

SEQ ID NO: 33112 - DNA, 15 bp, Artificial Sequence
  dgRNA
  Smim17
gggcgcactccacct

SEQ ID NO: 33113 - DNA, 15 bp, Artificial Sequence
  dgRNA
  Smim17
actgtactacaccac

SEQ ID NO: 33114 - DNA, 15 bp, Artificial Sequence
  dgRNA
  Smim17
ctgtactacaccaca

SEQ ID NO: 33115 - DNA, 15 bp, Artificial Sequence
  dgRNA
  Smim17
cgcatcctccctgca

SEQ ID NO: 33116 - DNA, 15 bp, Artificial Sequence
  dgRNA
  Ldoc1l
gagaggctccgcgag

SEQ ID NO: 33117 - DNA, 15 bp, Artificial Sequence
  dgRNA
  Ldoc1l
gctccgcgagcggcc

SEQ ID NO: 33118 - DNA, 15 bp, Artificial Sequence
  dgRNA
  Ldoc1l
ctccgcgagcggcct

SEQ ID NO: 33119 - DNA, 15 bp, Artificial Sequence
  dgRNA
  Ldoc1l
gcgagcggcctgggt

SEQ ID NO: 33120 - DNA, 15 bp, Artificial Sequence
  dgRNA
  Tmigd1
gtgtaccgttataac

SEQ ID NO: 33121 - DNA, 15 bp, Artificial Sequence
  dgRNA
  Tmigd1
tgtaccgttataact

SEQ ID NO: 33122 - DNA, 15 bp, Artificial Sequence
  dgRNA
  Tmigd1
gtaccgttataactg

SEQ ID NO: 33123 - DNA, 15 bp, Artificial Sequence
  dgRNA
  Klf14
ttgagctgtgagcgg

SEQ ID NO: 33124 - DNA, 15 bp, Artificial Sequence
  dgRNA
  Klf14
cgctcacagctcaaa

SEQ ID NO: 33125 - DNA, 15 bp, Artificial Sequence
  dgRNA
  Klf14
gatcgctggcgaagt

SEQ ID NO: 33126 - DNA, 15 bp, Artificial Sequence
  dgRNA
  Klf14
cgatcgctggcgaag

SEQ ID NO: 33127 - DNA, 15 bp, Artificial Sequence
  dgRNA
  Cd36
tgacttgtggcaaac

SEQ ID NO: 33128 - DNA, 15 bp, Artificial Sequence
  dgRNA
  Cd36
gacttgtggcaaaca

SEQ ID NO: 33129 - DNA, 15 bp, Artificial Sequence
  dgRNA
  Tatdn2
caagttaccctccat

SEQ ID NO: 33130 - DNA, 15 bp, Artificial Sequence
  dgRNA
  Tatdn2
ctccatcggtatttt

SEQ ID NO: 33131 - DNA, 15 bp, Artificial Sequence
  dgRNA
  Tatdn2
ggtattttcggctcc

SEQ ID NO: 33132 - DNA, 15 bp, Artificial Sequence
  dgRNA
  Tatdn2
gtattttcggctccc

SEQ ID NO: 33133 - DNA, 15 bp, Artificial Sequence
  dgRNA
  Olfr726
ataatgccttaatca

SEQ ID NO: 33134 - DNA, 15 bp, Artificial Sequence
  dgRNA
  Olfr726
tataatgccttaatc

SEQ ID NO: 33135 - DNA, 15 bp, Artificial Sequence
  dgRNA
  Olfr726
tcagttaggtaagtt

SEQ ID NO: 33136 - DNA, 15 bp, Artificial Sequence
  dgRNA
  Olfr726
cgtaatcaatcagtt

SEQ ID NO: 33137 - DNA, 15 bp, Artificial Sequence
  dgRNA
  Babam1
atagcgtgattaaac

SEQ ID NO: 33138 - DNA, 15 bp, Artificial Sequence
  dgRNA
  Babam1
agcttccatgtcccg

SEQ ID NO: 33139 - DNA, 15 bp, Artificial Sequence
  dgRNA
  Babam1
gcttccatgtcccga

SEQ ID NO: 33140 - DNA, 15 bp, Artificial Sequence
  dgRNA
  Babam1
acgctatggttctca

SEQ ID NO: 33141 - DNA, 15 bp, Artificial Sequence
  dgRNA
  Zkscan17
catgccacgaagccg

SEQ ID NO: 33142 - DNA, 15 bp, Artificial Sequence
  dgRNA
  Zkscan17
atgccacgaagccgc

SEQ ID NO: 33143 - DNA, 15 bp, Artificial Sequence
  dgRNA
  Zkscan17
cgcgggccgctgctt

SEQ ID NO: 33144 - DNA, 15 bp, Artificial Sequence
  dgRNA
  Zkscan17
cttcggcgagcaccg

SEQ ID NO: 33145 - DNA, 15 bp, Artificial Sequence
  dgRNA
  1500015O10Rik
tgagcctgacgccaa

SEQ ID NO: 33146 - DNA, 15 bp, Artificial Sequence
  dgRNA
  1500015O10Rik
ctgacgccaagggcc

SEQ ID NO: 33147 - DNA, 15 bp, Artificial Sequence
  dgRNA
  1500015O10Rik
tgacgccaagggcct

SEQ ID NO: 33148 - DNA, 15 bp, Artificial Sequence
  dgRNA
  1500015O10Rik
gcagaggaacggctc

SEQ ID NO: 33149 - DNA, 15 bp, Artificial Sequence
  dgRNA
  Zfp334
gccctagcgcctcag

SEQ ID NO: 33150 - DNA, 15 bp, Artificial Sequence
  dgRNA
  Zfp334
tcagaggctatcggc

SEQ ID NO: 33151 - DNA, 15 bp, Artificial Sequence
  dgRNA
  Zfp334
cagaggctatcggct

SEQ ID NO: 33152 - DNA, 15 bp, Artificial Sequence
  dgRNA
  Zfp334
aggctatcggctggg

SEQ ID NO: 33153 - DNA, 15 bp, Artificial Sequence
  dgRNA
  Fam102a
tcgtgttcgtacagt

SEQ ID NO: 33154 - DNA, 15 bp, Artificial Sequence
  dgRNA
  Fam102a
ggcctgtccaatcgc

SEQ ID NO: 33155 - DNA, 15 bp, Artificial Sequence
  dgRNA
  Fam102a
tgtccaatcgcaggt

SEQ ID NO: 33156 - DNA, 15 bp, Artificial Sequence
  dgRNA
  Fam102a
cgcccctgctgctct

SEQ ID NO: 33157 - DNA, 15 bp, Artificial Sequence
  dgRNA
  Vmn1r10
aattaacaagtagta

SEQ ID NO: 33158 - DNA, 15 bp, Artificial Sequence
  dgRNA
  Acadsb
gcgtgagcgtgctgc

SEQ ID NO: 33159 - DNA, 15 bp, Artificial Sequence
  dgRNA
  Acadsb
cgtgagcgtgctgca

SEQ ID NO: 33160 - DNA, 15 bp, Artificial Sequence
  dgRNA
  Acadsb
gaattatgtctctcc

SEQ ID NO: 33161 - DNA, 15 bp, Artificial Sequence
  dgRNA
  Acadsb
ggtgcggttgtcagg

SEQ ID NO: 33162 - DNA, 15 bp, Artificial Sequence
  dgRNA
  Tsc22d3
aatgaagggggcgga

SEQ ID NO: 33163 - DNA, 15 bp, Artificial Sequence
  dgRNA
  Tsc22d3
gttcacaatattcag

SEQ ID NO: 33164 - DNA, 15 bp, Artificial Sequence
  dgRNA
  Tsc22d3
cgttcacaatattca

SEQ ID NO: 33165 - DNA, 15 bp, Artificial Sequence
  dgRNA
  Tsc22d3
ccgttcacaatattc

SEQ ID NO: 33166 - DNA, 15 bp, Artificial Sequence
  dgRNA
  Grifin
caaggcccctagagg

SEQ ID NO: 33167 - DNA, 15 bp, Artificial Sequence
  dgRNA
  Grifin
aaggcccctagaggt

SEQ ID NO: 33168 - DNA, 15 bp, Artificial Sequence
  dgRNA
  Grifin
catgccccgccccag

SEQ ID NO: 33169 - DNA, 15 bp, Artificial Sequence
  dgRNA
  Grifin
cagcgctcttgccct

SEQ ID NO: 33170 - DNA, 15 bp, Artificial Sequence
  dgRNA
  Olfr617
gtgaatacttgcagt

SEQ ID NO: 33171 - DNA, 15 bp, Artificial Sequence
  dgRNA
  Sry
gtttaagatatcatg

SEQ ID NO: 33172 - DNA, 15 bp, Artificial Sequence
  dgRNA
  Gm15284
ttcactgtcctataa

SEQ ID NO: 33173 - DNA, 15 bp, Artificial Sequence
  dgRNA
  Gm15284
ccctcccactgataa

SEQ ID NO: 33174 - DNA, 15 bp, Artificial Sequence
  dgRNA
  Gm15284
ctgggaagttcgaaa

SEQ ID NO: 33175 - DNA, 15 bp, Artificial Sequence
  dgRNA
  Gm15284
gctgggaagttcgaa

SEQ ID NO: 33176 - DNA, 15 bp, Artificial Sequence
  dgRNA
  Ccdc169
aagctagtcaactac

SEQ ID NO: 33177 - DNA, 15 bp, Artificial Sequence
  dgRNA
  Tns2
cagcagggtagatcc

SEQ ID NO: 33178 - DNA, 15 bp, Artificial Sequence
  dgRNA
  Tns2
tcagcctaagatctc

SEQ ID NO: 33179 - DNA, 15 bp, Artificial Sequence
  dgRNA
  Tns2
aggatctaccctgct

SEQ ID NO: 33180 - DNA, 15 bp, Artificial Sequence
  dgRNA
  Tns2
caggatctaccctgc

SEQ ID NO: 33181 - DNA, 15 bp, Artificial Sequence
  dgRNA
  Gid8
gaacactcataccca

SEQ ID NO: 33182 - DNA, 15 bp, Artificial Sequence
  dgRNA
  Gid8
aacactcatacccaa

SEQ ID NO: 33183 - DNA, 15 bp, Artificial Sequence
  dgRNA
  Gid8
cgagctcctttattc

SEQ ID NO: 33184 - DNA, 15 bp, Artificial Sequence
  dgRNA
  Gid8
ttgagtgaacttctt

SEQ ID NO: 33185 - DNA, 15 bp, Artificial Sequence
  dgRNA
  Plagl1
tcccccaccgacccc

SEQ ID NO: 33186 - DNA, 15 bp, Artificial Sequence
  dgRNA
  Plagl1
cccccggagccccaa

SEQ ID NO: 33187 - DNA, 15 bp, Artificial Sequence
  dgRNA
  Plagl1
ccccggagccccaac

SEQ ID NO: 33188 - DNA, 15 bp, Artificial Sequence
  dgRNA
  Plagl1
cccggagccccaacg

SEQ ID NO: 33189 - DNA, 15 bp, Artificial Sequence
  dgRNA
  Camk2a
gggctaaaattagag

SEQ ID NO: 33190 - DNA, 15 bp, Artificial Sequence
  dgRNA
  Camk2a
aattagagaggccca

SEQ ID NO: 33191 - DNA, 15 bp, Artificial Sequence
  dgRNA
  Camk2a
tctcaatcgggctgc

SEQ ID NO: 33192 - DNA, 15 bp, Artificial Sequence
  dgRNA
  Camk2a
cggactgcattttgc

SEQ ID NO: 33193 - DNA, 15 bp, Artificial Sequence
  dgRNA
  Plekho2
gcccaggatccgccc

SEQ ID NO: 33194 - DNA, 15 bp, Artificial Sequence
  dgRNA
  Plekho2
cctgaaccccccacc

SEQ ID NO: 33195 - DNA, 15 bp, Artificial Sequence
  dgRNA
  Plekho2
tcacccagctgcggg

SEQ ID NO: 33196 - DNA, 15 bp, Artificial Sequence
  dgRNA
  Plekho2
cacccagctgcgggc

SEQ ID NO: 33197 - DNA, 15 bp, Artificial Sequence
  dgRNA
  Mbp
ctctaggcctcgtac

SEQ ID NO: 33198 - DNA, 15 bp, Artificial Sequence
  dgRNA
  Mbp
ctcattgttgttgca

SEQ ID NO: 33199 - DNA, 15 bp, Artificial Sequence
  dgRNA
  Mbp
tgcgatccagaacaa

SEQ ID NO: 33200 - DNA, 15 bp, Artificial Sequence
  dgRNA
  Mbp
gcgatccagaacaat

SEQ ID NO: 33201 - DNA, 15 bp, Artificial Sequence
  dgRNA
  Rbm42
aaaagactcctaccc

SEQ ID NO: 33202 - DNA, 15 bp, Artificial Sequence
  dgRNA
  Rbm42
ttccggcttccacag

SEQ ID NO: 33203 - DNA, 15 bp, Artificial Sequence
  dgRNA
  Rbm42
tccggcttccacagc

SEQ ID NO: 33204 - DNA, 15 bp, Artificial Sequence
  dgRNA
  Rbm42
ccggcttccacagcg

SEQ ID NO: 33205 - DNA, 15 bp, Artificial Sequence
  dgRNA
  Inhbc
gtctggcagctcatt

SEQ ID NO: 33206 - DNA, 15 bp, Artificial Sequence
  dgRNA
  Inhbc
aagttccacctgaac

SEQ ID NO: 33207 - DNA, 15 bp, Artificial Sequence
  dgRNA
  Inhbc
ttcacgccagatgtt

SEQ ID NO: 33208 - DNA, 15 bp, Artificial Sequence
  dgRNA
  Krt80
ggcagagcccctgta

SEQ ID NO: 33209 - DNA, 15 bp, Artificial Sequence
  dgRNA
  Krt80
gctgtggtacgggga

SEQ ID NO: 33210 - DNA, 15 bp, Artificial Sequence
  dgRNA
  Krt80
tggtacggggagggc

SEQ ID NO: 33211 - DNA, 15 bp, Artificial Sequence
  dgRNA
  Krt80
catcatctaactaac

SEQ ID NO: 33212 - DNA, 15 bp, Artificial Sequence
  dgRNA
  Pitx2
accatccctctgccg

SEQ ID NO: 33213 - DNA, 15 bp, Artificial Sequence
  dgRNA
  Pitx2
ccctctgccgcggct

SEQ ID NO: 33214 - DNA, 15 bp, Artificial Sequence
  dgRNA
  Pitx2
cctctgccgcggctc

SEQ ID NO: 33215 - DNA, 15 bp, Artificial Sequence
  dgRNA
  Pitx2
ctctgccgcggctcg

SEQ ID NO: 33216 - DNA, 15 bp, Artificial Sequence
  dgRNA
  10-Sep
ccatggccggacgcc

SEQ ID NO: 33217 - DNA, 15 bp, Artificial Sequence
  dgRNA
  10-Sep
tggccggacgcctgg

SEQ ID NO: 33218 - DNA, 15 bp, Artificial Sequence
  dgRNA
  10-Sep
gacgcctggaggacc

SEQ ID NO: 33219 - DNA, 15 bp, Artificial Sequence
  dgRNA
  10-Sep
acccggagagcggct

SEQ ID NO: 33220 - DNA, 15 bp, Artificial Sequence
  dgRNA
  Ccl7
caatagtagctgagc

SEQ ID NO: 33221 - DNA, 15 bp, Artificial Sequence
  dgRNA
  Ccl7
gtacagtgttttatc

SEQ ID NO: 33222 - DNA, 15 bp, Artificial Sequence
  dgRNA
  Ccl7
cagctcagctactat

SEQ ID NO: 33223 - DNA, 15 bp, Artificial Sequence
  dgRNA
  Ccl7
agtgtaatgtgaggc

SEQ ID NO: 33224 - DNA, 15 bp, Artificial Sequence
  dgRNA
  Dxo
ttgcgattcataacc

SEQ ID NO: 33225 - DNA, 15 bp, Artificial Sequence
  dgRNA
  Dxo
cataacccggatttc

SEQ ID NO: 33226 - DNA, 15 bp, Artificial Sequence
  dgRNA
  Dxo
cggatttcaggattc

SEQ ID NO: 33227 - DNA, 15 bp, Artificial Sequence
  dgRNA
  Dxo
tcaggattccgggaa

SEQ ID NO: 33228 - DNA, 15 bp, Artificial Sequence
  dgRNA
  Fubp3
tcgcttcccttccgc

SEQ ID NO: 33229 - DNA, 15 bp, Artificial Sequence
  dgRNA
  Fubp3
cccttccgccggaag

SEQ ID NO: 33230 - DNA, 15 bp, Artificial Sequence
  dgRNA
  Fubp3
ccttccgccggaagt

SEQ ID NO: 33231 - DNA, 15 bp, Artificial Sequence
  dgRNA
  Fubp3
cttccgccggaagtg

SEQ ID NO: 33232 - DNA, 15 bp, Artificial Sequence
  dgRNA
  Bud31
ggcggggccccgcga

SEQ ID NO: 33233 - DNA, 15 bp, Artificial Sequence
  dgRNA
  Bud31
tgaagagtttgtcgc

SEQ ID NO: 33234 - DNA, 15 bp, Artificial Sequence
  dgRNA
  Bud31
agtttgtcgccggag

SEQ ID NO: 33235 - DNA, 15 bp, Artificial Sequence
  dgRNA
  Bud31
aataaggccctcgcg

SEQ ID NO: 33236 - DNA, 15 bp, Artificial Sequence
  dgRNA
  Rft1
atggtctacagggat

SEQ ID NO: 33237 - DNA, 15 bp, Artificial Sequence
  dgRNA
  Rft1
gcctcaaaagttgtt

SEQ ID NO: 33238 - DNA, 15 bp, Artificial Sequence
  dgRNA
  Rft1
gtcaaagacccaatc

SEQ ID NO: 33239 - DNA, 15 bp, Artificial Sequence
  dgRNA
  Rft1
agaactcgcagtctc

SEQ ID NO: 33240 - DNA, 15 bp, Artificial Sequence
  dgRNA
  Timm22
tttaaagaggcgttg

SEQ ID NO: 33241 - DNA, 15 bp, Artificial Sequence
  dgRNA
  Timm22
tcgacgctgatgcat

SEQ ID NO: 33242 - DNA, 15 bp, Artificial Sequence
  dgRNA
  Timm22
ccgttgtcgtcactc

SEQ ID NO: 33243 - DNA, 15 bp, Artificial Sequence
  dgRNA
  Timm22
tgtcgtcactctggc

SEQ ID NO: 33244 - DNA, 15 bp, Artificial Sequence
  dgRNA
  Entpd1
agctttcgagtaact

SEQ ID NO: 33245 - DNA, 15 bp, Artificial Sequence
  dgRNA
  Entpd1
gctttcgagtaacta

SEQ ID NO: 33246 - DNA, 15 bp, Artificial Sequence
  dgRNA
  Entpd1
ctttcgagtaactag

SEQ ID NO: 33247 - DNA, 15 bp, Artificial Sequence
  dgRNA
  Entpd1
aagacatcgggcttg

SEQ ID NO: 33248 - DNA, 15 bp, Artificial Sequence
  dgRNA
  Lingo4
tctacgctatgagga

SEQ ID NO: 33249 - DNA, 15 bp, Artificial Sequence
  dgRNA
  Lingo4
cgctatgaggaagga

SEQ ID NO: 33250 - DNA, 15 bp, Artificial Sequence
  dgRNA
  Lingo4
gcagactctcctagg

SEQ ID NO: 33251 - DNA, 15 bp, Artificial Sequence
  dgRNA
  Lrriq4
gagctaggctgtatc

SEQ ID NO: 33252 - DNA, 15 bp, Artificial Sequence
  dgRNA
  Lrriq4
cccactcttgacaca

SEQ ID NO: 33253 - DNA, 15 bp, Artificial Sequence
  dgRNA
  Lrriq4
gttattccactattg

SEQ ID NO: 33254 - DNA, 15 bp, Artificial Sequence
  dgRNA
  Lrriq4
agcctagctccattt

SEQ ID NO: 33255 - DNA, 15 bp, Artificial Sequence
  dgRNA
  Acbd5
aacaagctatgtcag

SEQ ID NO: 33256 - DNA, 15 bp, Artificial Sequence
  dgRNA
  Acbd5
gccccaaacgcaatc

SEQ ID NO: 33257 - DNA, 15 bp, Artificial Sequence
  dgRNA
  Acbd5
cgcaatccggaagaa

SEQ ID NO: 33258 - DNA, 15 bp, Artificial Sequence
  dgRNA
  Acbd5
acttccgccacacac

SEQ ID NO: 33259 - DNA, 15 bp, Artificial Sequence
  dgRNA
  Rgs8
aagcagatctcaccc

SEQ ID NO: 33260 - DNA, 15 bp, Artificial Sequence
  dgRNA
  Rgs8
caccagccgctccgg

SEQ ID NO: 33261 - DNA, 15 bp, Artificial Sequence
  dgRNA
  Rgs8
tccggaggtagcgct

SEQ ID NO: 33262 - DNA, 15 bp, Artificial Sequence
  dgRNA
  Rgs8
tgcggtcatcaacct

SEQ ID NO: 33263 - DNA, 15 bp, Artificial Sequence
  dgRNA
  Sh3pxd2a
ctgcgcccacagcgc

SEQ ID NO: 33264 - DNA, 15 bp, Artificial Sequence
  dgRNA
  Sh3pxd2a
cagcgccgagccccc

SEQ ID NO: 33265 - DNA, 15 bp, Artificial Sequence
  dgRNA
  Sh3pxd2a
ccaggagcccgagcg

SEQ ID NO: 33266 - DNA, 15 bp, Artificial Sequence
  dgRNA
  Sh3pxd2a
gcccgagcgcggccc

SEQ ID NO: 33267 - DNA, 15 bp, Artificial Sequence
  dgRNA
  Cox7a2l
ggtcttgagaaagcg

SEQ ID NO: 33268 - DNA, 15 bp, Artificial Sequence
  dgRNA
  Cox7a2l
cccccgacgttgcgt

SEQ ID NO: 33269 - DNA, 15 bp, Artificial Sequence
  dgRNA
  Cox7a2l
ccgacgttgcgtagg

SEQ ID NO: 33270 - DNA, 15 bp, Artificial Sequence
  dgRNA
  Cox7a2l
gctatgttttaagtc

SEQ ID NO: 33271 - DNA, 15 bp, Artificial Sequence
  dgRNA
  Zdhhc21
agcgagcactgctta

SEQ ID NO: 33272 - DNA, 15 bp, Artificial Sequence
  dgRNA
  Zdhhc21
ggggacacgcgtgtg

SEQ ID NO: 33273 - DNA, 15 bp, Artificial Sequence
  dgRNA
  Zdhhc21
gcgtgtgcggccgcc

SEQ ID NO: 33274 - DNA, 15 bp, Artificial Sequence
  dgRNA
  Zdhhc21
tgcggccgcctgggc

SEQ ID NO: 33275 - DNA, 15 bp, Artificial Sequence
  dgRNA
  Vps4b
cccccacatgccttt

SEQ ID NO: 33276 - DNA, 15 bp, Artificial Sequence
  dgRNA
  Vps4b
ctgacttccgcatct

SEQ ID NO: 33277 - DNA, 15 bp, Artificial Sequence
  dgRNA
  Vps4b
gcgagagttcatttg

SEQ ID NO: 33278 - DNA, 15 bp, Artificial Sequence
  dgRNA
  Vps4b
gctcagctaatgtat

SEQ ID NO: 33279 - DNA, 15 bp, Artificial Sequence
  dgRNA
  Clca3a1
tcatagctgcagcta

SEQ ID NO: 33280 - DNA, 15 bp, Artificial Sequence
  dgRNA
  Clca3a1
ctgttcaggccgata

SEQ ID NO: 33281 - DNA, 15 bp, Artificial Sequence
  dgRNA
  Clca3a1
atatcctgcctatca

SEQ ID NO: 33282 - DNA, 15 bp, Artificial Sequence
  dgRNA
  Clca3a1
cctgcattgctattc

SEQ ID NO: 33283 - DNA, 15 bp, Artificial Sequence
  dgRNA
  Pklr
ggggatccggcagca

SEQ ID NO: 33284 - DNA, 15 bp, Artificial Sequence
  dgRNA
  Pklr
gcagcatggacgcca

SEQ ID NO: 33285 - DNA, 15 bp, Artificial Sequence
  dgRNA
  Pklr
cagcatggacgccac

SEQ ID NO: 33286 - DNA, 15 bp, Artificial Sequence
  dgRNA
  Pklr
cacggggcactcccg

SEQ ID NO: 33287 - DNA, 15 bp, Artificial Sequence
  dgRNA
  Reep4
agaagactattcgac

SEQ ID NO: 33288 - DNA, 15 bp, Artificial Sequence
  dgRNA
  Reep4
agactattcgaccgg

SEQ ID NO: 33289 - DNA, 15 bp, Artificial Sequence
  dgRNA
  Reep4
cgccgctttaagaga

SEQ ID NO: 33290 - DNA, 15 bp, Artificial Sequence
  dgRNA
  Reep4
cgtcccgcccctctg

SEQ ID NO: 33291 - DNA, 15 bp, Artificial Sequence
  dgRNA
  Tril
ttctcacttggcgtc

SEQ ID NO: 33292 - DNA, 15 bp, Artificial Sequence
  dgRNA
  Tril
tctcacttggcgtcc

SEQ ID NO: 33293 - DNA, 15 bp, Artificial Sequence
  dgRNA
  Tril
cttggcgtccgggct

SEQ ID NO: 33294 - DNA, 15 bp, Artificial Sequence
  dgRNA
  Tril
ttggcgtccgggcta

SEQ ID NO: 33295 - DNA, 15 bp, Artificial Sequence
  dgRNA
  Gpx4
accctgctccgctgc

SEQ ID NO: 33296 - DNA, 15 bp, Artificial Sequence
  dgRNA
  Gpx4
tcgtccgcgagaacg

SEQ ID NO: 33297 - DNA, 15 bp, Artificial Sequence
  dgRNA
  Gpx4
ccgcgtccctatcac

SEQ ID NO: 33298 - DNA, 15 bp, Artificial Sequence
  dgRNA
  Gpx4
cgcgtccctatcact

SEQ ID NO: 33299 - DNA, 15 bp, Artificial Sequence
  dgRNA
  Rnf144b
tataaataaacgctc

SEQ ID NO: 33300 - DNA, 15 bp, Artificial Sequence
  dgRNA
  Rnf144b
cgcgccccgagctgc

SEQ ID NO: 33301 - DNA, 15 bp, Artificial Sequence
  dgRNA
  Rnf144b
cccgagctgtaggtc

SEQ ID NO: 33302 - DNA, 15 bp, Artificial Sequence
  dgRNA
  Rnf144b
ccgagctgtaggtct

SEQ ID NO: 33303 - DNA, 15 bp, Artificial Sequence
  dgRNA
  Cul1
caggcccggcgatgg

SEQ ID NO: 33304 - DNA, 15 bp, Artificial Sequence
  dgRNA
  Cul1
gcggcgacggtttct

SEQ ID NO: 33305 - DNA, 15 bp, Artificial Sequence
  dgRNA
  Cul1
ttggctcccccgccc

SEQ ID NO: 33306 - DNA, 15 bp, Artificial Sequence
  dgRNA
  Cul1
cgccccggacgccga

SEQ ID NO: 33307 - DNA, 15 bp, Artificial Sequence
  dgRNA
  Il17re
tgtgaccaagcctgc

SEQ ID NO: 33308 - DNA, 15 bp, Artificial Sequence
  dgRNA
  Il17re
tggttaggatcaagg

SEQ ID NO: 33309 - DNA, 15 bp, Artificial Sequence
  dgRNA
  Il17re
caaggaggagcttcg

SEQ ID NO: 33310 - DNA, 15 bp, Artificial Sequence
  dgRNA
  Il17re
aggagcttcggggca

SEQ ID NO: 33311 - DNA, 15 bp, Artificial Sequence
  dgRNA
  Foxe1
gctgggccgagctcc

SEQ ID NO: 33312 - DNA, 15 bp, Artificial Sequence
  dgRNA
  Foxe1
tctcagtctcccgct

SEQ ID NO: 33313 - DNA, 15 bp, Artificial Sequence
  dgRNA
  Foxe1
ccgcttggcgcgcag

SEQ ID NO: 33314 - DNA, 15 bp, Artificial Sequence
  dgRNA
  Foxe1
cgcttggcgcgcaga

SEQ ID NO: 33315 - DNA, 15 bp, Artificial Sequence
  dgRNA
  Ociad1
cgtcatttcccgtca

SEQ ID NO: 33316 - DNA, 15 bp, Artificial Sequence
  dgRNA
  Ociad1
caagggtactgcttc

SEQ ID NO: 33317 - DNA, 15 bp, Artificial Sequence
  dgRNA
  Ociad1
cgggtgtcggcctgc

SEQ ID NO: 33318 - DNA, 15 bp, Artificial Sequence
  dgRNA
  Ociad1
gctggcgctcgtgtg

SEQ ID NO: 33319 - DNA, 15 bp, Artificial Sequence
  dgRNA
  Ak5
tctgtctatcgtctg

SEQ ID NO: 33320 - DNA, 15 bp, Artificial Sequence
  dgRNA
  Egfl7
gcatctagatcacct

SEQ ID NO: 33321 - DNA, 15 bp, Artificial Sequence
  dgRNA
  Egfl7
actcgctataatact

SEQ ID NO: 33322 - DNA, 15 bp, Artificial Sequence
  dgRNA
  Egfl7
ctcgctataatacta

SEQ ID NO: 33323 - DNA, 15 bp, Artificial Sequence
  dgRNA
  Egfl7
ttgccatccgcgaaa

SEQ ID NO: 33324 - DNA, 15 bp, Artificial Sequence
  dgRNA
  Rbm38
cagacaagctgatac

SEQ ID NO: 33325 - DNA, 15 bp, Artificial Sequence
  dgRNA
  Rbm38
taccggcgagcacct

SEQ ID NO: 33326 - DNA, 15 bp, Artificial Sequence
  dgRNA
  Rbm38
accggcgagcaccta

SEQ ID NO: 33327 - DNA, 15 bp, Artificial Sequence
  dgRNA
  Rbm38
ccggcgagcacctag

SEQ ID NO: 33328 - DNA, 15 bp, Artificial Sequence
  dgRNA
  Pcgf1
acgaccaccgattgt

SEQ ID NO: 33329 - DNA, 15 bp, Artificial Sequence
  dgRNA
  Pcgf1
cgaccaccgattgtt

SEQ ID NO: 33330 - DNA, 15 bp, Artificial Sequence
  dgRNA
  Pcgf1
gaccaccgattgttg

SEQ ID NO: 33331 - DNA, 15 bp, Artificial Sequence
  dgRNA
  Pcgf1
accaccgattgttgg

SEQ ID NO: 33332 - DNA, 15 bp, Artificial Sequence
  dgRNA
  Mroh6
ctgtaggcccgcctg

SEQ ID NO: 33333 - DNA, 15 bp, Artificial Sequence
  dgRNA
  Mroh6
tgtaggcccgcctgt

SEQ ID NO: 33334 - DNA, 15 bp, Artificial Sequence
  dgRNA
  Mroh6
gcctgtgggcccgcc

SEQ ID NO: 33335 - DNA, 15 bp, Artificial Sequence
  dgRNA
  Mroh6
cctgtgggcccgccc

SEQ ID NO: 33336 - DNA, 15 bp, Artificial Sequence
  dgRNA
  BC024978
gaagtcgagtaagac

SEQ ID NO: 33337 - DNA, 15 bp, Artificial Sequence
  dgRNA
  BC024978
gagtaagaccggaat

SEQ ID NO: 33338 - DNA, 15 bp, Artificial Sequence
  dgRNA
  BC024978
gaccggaattggaag

SEQ ID NO: 33339 - DNA, 15 bp, Artificial Sequence
  dgRNA
  BC024978
ccaacccgcgtgcta

SEQ ID NO: 33340 - DNA, 15 bp, Artificial Sequence
  dgRNA
  Rcc1
cagggtcgcggccgg

SEQ ID NO: 33341 - DNA, 15 bp, Artificial Sequence
  dgRNA
  Rcc1
cgaccctggccagaa

SEQ ID NO: 33342 - DNA, 15 bp, Artificial Sequence
  dgRNA
  Rcc1
gcgaccctggccaga

SEQ ID NO: 33343 - DNA, 15 bp, Artificial Sequence
  dgRNA
  Rcc1
ctccggccgcgaccc

SEQ ID NO: 33344 - DNA, 15 bp, Artificial Sequence
  dgRNA
  Jade3
ggagcgcacagtgtc

SEQ ID NO: 33345 - DNA, 15 bp, Artificial Sequence
  dgRNA
  Jade3
tgctccgcgccgcct

SEQ ID NO: 33346 - DNA, 15 bp, Artificial Sequence
  dgRNA
  Jade3
aagggccaggcggcc

SEQ ID NO: 33347 - DNA, 15 bp, Artificial Sequence
  dgRNA
  Jade3
cgggagcagagcgct

SEQ ID NO: 33348 - DNA, 15 bp, Artificial Sequence
  dgRNA
  Zc3h6
cagcgagcgtattaa

SEQ ID NO: 33349 - DNA, 15 bp, Artificial Sequence
  dgRNA
  Zc3h6
ttaaaggcccgcccc

SEQ ID NO: 33350 - DNA, 15 bp, Artificial Sequence
  dgRNA
  Zc3h6
aatggctagtgcgct

SEQ ID NO: 33351 - DNA, 15 bp, Artificial Sequence
  dgRNA
  Zc3h6
tagtgcgctcggcac

SEQ ID NO: 33352 - DNA, 15 bp, Artificial Sequence
  dgRNA
  BC021785
gaggactgtccgtgg

SEQ ID NO: 33353 - DNA, 15 bp, Artificial Sequence
  dgRNA
  Mdk
ggactaggggggtct

SEQ ID NO: 33354 - DNA, 15 bp, Artificial Sequence
  dgRNA
  Mdk
gactaggggggtctg

SEQ ID NO: 33355 - DNA, 15 bp, Artificial Sequence
  dgRNA
  Mdk
gggaggtgcgggttt

SEQ ID NO: 33356 - DNA, 15 bp, Artificial Sequence
  dgRNA
  Mdk
gggcgggtccttcca

SEQ ID NO: 33357 - DNA, 15 bp, Artificial Sequence
  dgRNA
  B930041F14Rik
gccagcaccggatag

SEQ ID NO: 33358 - DNA, 15 bp, Artificial Sequence
  dgRNA
  B930041F14Rik
ccagcaccggataga

SEQ ID NO: 33359 - DNA, 15 bp, Artificial Sequence
  dgRNA
  B930041F14Rik
gatagagggaccgtc

SEQ ID NO: 33360 - DNA, 15 bp, Artificial Sequence
  dgRNA
  B930041F14Rik
agttctcatcaattg

SEQ ID NO: 33361 - DNA, 15 bp, Artificial Sequence
  dgRNA
  Chrac1
gcccgagcaagcact

SEQ ID NO: 33362 - DNA, 15 bp, Artificial Sequence
  dgRNA
  Chrac1
tgagagcgcttcttc

SEQ ID NO: 33363 - DNA, 15 bp, Artificial Sequence
  dgRNA
  Chrac1
gagagcgcttcttcc

SEQ ID NO: 33364 - DNA, 15 bp, Artificial Sequence
  dgRNA
  Chrac1
tccgggagactgccc

SEQ ID NO: 33365 - DNA, 15 bp, Artificial Sequence
  dgRNA
  Safb2
gctgcgagaggcaaa

SEQ ID NO: 33366 - DNA, 15 bp, Artificial Sequence
  dgRNA
  Safb2
ctgcgagaggcaaac

SEQ ID NO: 33367 - DNA, 15 bp, Artificial Sequence
  dgRNA
  Safb2
tgcgagaggcaaacg

SEQ ID NO: 33368 - DNA, 15 bp, Artificial Sequence
  dgRNA
  Safb2
tcagtgagcgtagcg

SEQ ID NO: 33369 - DNA, 15 bp, Artificial Sequence
  dgRNA
  Stra6l
aagtgttgtgaaacc

SEQ ID NO: 33370 - DNA, 15 bp, Artificial Sequence
  dgRNA
  Stra6l
tcaatccacaagcgg

SEQ ID NO: 33371 - DNA, 15 bp, Artificial Sequence
  dgRNA
  Stra6l
ttctcaatccacaag

SEQ ID NO: 33372 - DNA, 15 bp, Artificial Sequence
  dgRNA
  Stra6l
gtttcacaacacttt

SEQ ID NO: 33373 - DNA, 15 bp, Artificial Sequence
  dgRNA
  Agpat3
ccatgcctgatttcg

SEQ ID NO: 33374 - DNA, 15 bp, Artificial Sequence
  dgRNA
  Agpat3
gatttcggggccctg

SEQ ID NO: 33375 - DNA, 15 bp, Artificial Sequence
  dgRNA
  Agpat3
atttcggggccctgt

SEQ ID NO: 33376 - DNA, 15 bp, Artificial Sequence
  dgRNA
  Agpat3
tttgcttgctcaacg

SEQ ID NO: 33377 - DNA, 15 bp, Artificial Sequence
  dgRNA
  Znhit1
aaagtgaccatttgc

SEQ ID NO: 33378 - DNA, 15 bp, Artificial Sequence
  dgRNA
  Znhit1
gtgaccatttgcagg

SEQ ID NO: 33379 - DNA, 15 bp, Artificial Sequence
  dgRNA
  Znhit1
taaccacaatgcgac

SEQ ID NO: 33380 - DNA, 15 bp, Artificial Sequence
  dgRNA
  Znhit1
aatgcgaccggaatt

SEQ ID NO: 33381 - DNA, 15 bp, Artificial Sequence
  dgRNA
  Akap2
ttcggattttctaga

SEQ ID NO: 33382 - DNA, 15 bp, Artificial Sequence
  dgRNA
  Akap2
ccttatgaaggtaca

SEQ ID NO: 33383 - DNA, 15 bp, Artificial Sequence
  dgRNA
  Akap2
aaaggtagcccatgt

SEQ ID NO: 33384 - DNA, 15 bp, Artificial Sequence
  dgRNA
  Akap2
atctaaatttagacc

SEQ ID NO: 33385 - DNA, 15 bp, Artificial Sequence
  dgRNA
  Plcl2
ctccccgaccccggc

SEQ ID NO: 33386 - DNA, 15 bp, Artificial Sequence
  dgRNA
  Plcl2
cgacgtccttcgcgc

SEQ ID NO: 33387 - DNA, 15 bp, Artificial Sequence
  dgRNA
  Plcl2
cgtccttcgcgccgg

SEQ ID NO: 33388 - DNA, 15 bp, Artificial Sequence
  dgRNA
  Plcl2
cggaagaagcggccg

SEQ ID NO: 33389 - DNA, 15 bp, Artificial Sequence
  dgRNA
  Rora
gacggaaagcttctt

SEQ ID NO: 33390 - DNA, 15 bp, Artificial Sequence
  dgRNA
  Rora
cggaaagcttctttg

SEQ ID NO: 33391 - DNA, 15 bp, Artificial Sequence
  dgRNA
  Rora
cttccgggccgccac

SEQ ID NO: 33392 - DNA, 15 bp, Artificial Sequence
  dgRNA
  Rora
gccgccacaggtgat

SEQ ID NO: 33393 - DNA, 15 bp, Artificial Sequence
  dgRNA
  Fam150b
atccgcgccccagag

SEQ ID NO: 33394 - DNA, 15 bp, Artificial Sequence
  dgRNA
  Fam150b
aattaaagcggcgct

SEQ ID NO: 33395 - DNA, 15 bp, Artificial Sequence
  dgRNA
  Fam150b
gcggcgctcggaacc

SEQ ID NO: 33396 - DNA, 15 bp, Artificial Sequence
  dgRNA
  Fam150b
cggcgctcggaaccc

SEQ ID NO: 33397 - DNA, 15 bp, Artificial Sequence
  dgRNA
  Eci2
cattctcaactctga

SEQ ID NO: 33398 - DNA, 15 bp, Artificial Sequence
  dgRNA
  Eci2
tcgcacccctgccca

SEQ ID NO: 33399 - DNA, 15 bp, Artificial Sequence
  dgRNA
  Eci2
cccgggtcctttcac

SEQ ID NO: 33400 - DNA, 15 bp, Artificial Sequence
  dgRNA
  Eci2
gccgagctcacatcc

SEQ ID NO: 33401 - DNA, 15 bp, Artificial Sequence
  dgRNA
  Pgk1
cagctcgcgtcgtgc

SEQ ID NO: 33402 - DNA, 15 bp, Artificial Sequence
  dgRNA
  Pgk1
gcaggacgtgacaaa

SEQ ID NO: 33403 - DNA, 15 bp, Artificial Sequence
  dgRNA
  Pgk1
ctagtctcgtgcaga

SEQ ID NO: 33404 - DNA, 15 bp, Artificial Sequence
  dgRNA
  Pgk1
gcaatggaagcgggt

SEQ ID NO: 33405 - DNA, 15 bp, Artificial Sequence
  dgRNA
  Ptpn5
gtgtacagccctagt

SEQ ID NO: 33406 - DNA, 15 bp, Artificial Sequence
  dgRNA
  Ptpn5
tgtacagccctagtg

SEQ ID NO: 33407 - DNA, 15 bp, Artificial Sequence
  dgRNA
  Ptpn5
ctagtggggtccctc

SEQ ID NO: 33408 - DNA, 15 bp, Artificial Sequence
  dgRNA
  Ptpn5
cgcgcagccccgacc

SEQ ID NO: 33409 - DNA, 15 bp, Artificial Sequence
  dgRNA
  Pfkp
cgtgggcggctcctg

SEQ ID NO: 33410 - DNA, 15 bp, Artificial Sequence
  dgRNA
  Pfkp
gtgggcggctcctgc

SEQ ID NO: 33411 - DNA, 15 bp, Artificial Sequence
  dgRNA
  Pfkp
tcctgcgggtgcagg

SEQ ID NO: 33412 - DNA, 15 bp, Artificial Sequence
  dgRNA
  Pfkp
cctgcgggtgcaggc

SEQ ID NO: 33413 - DNA, 15 bp, Artificial Sequence
  dgRNA
  Naa60
tccgggctgcgccgc

SEQ ID NO: 33414 - DNA, 15 bp, Artificial Sequence
  dgRNA
  Naa60
cgccgccggcagcac

SEQ ID NO: 33415 - DNA, 15 bp, Artificial Sequence
  dgRNA
  Naa60
ccggcagcacaggag

SEQ ID NO: 33416 - DNA, 15 bp, Artificial Sequence
  dgRNA
  Naa60
agcccggaagatcat

SEQ ID NO: 33417 - DNA, 15 bp, Artificial Sequence
  dgRNA
  Sult2a8
ttgatcaaacagagc

SEQ ID NO: 33418 - DNA, 15 bp, Artificial Sequence
  dgRNA
  Grp
gatggtttcccagcc

SEQ ID NO: 33419 - DNA, 15 bp, Artificial Sequence
  dgRNA
  Grp
gacgtcagtgcgctc

SEQ ID NO: 33420 - DNA, 15 bp, Artificial Sequence
  dgRNA
  Grp
agtgcgctcaggtcc

SEQ ID NO: 33421 - DNA, 15 bp, Artificial Sequence
  dgRNA
  Grp
gtgcgctcaggtccc

SEQ ID NO: 33422 - DNA, 15 bp, Artificial Sequence
  dgRNA
  Fam219b
tggccagttcctgac

SEQ ID NO: 33423 - DNA, 15 bp, Artificial Sequence
  dgRNA
  Fam219b
cagttcctgacgggt

SEQ ID NO: 33424 - DNA, 15 bp, Artificial Sequence
  dgRNA
  Fam219b
agttcctgacgggta

SEQ ID NO: 33425 - DNA, 15 bp, Artificial Sequence
  dgRNA
  Fam219b
tcctgacgggtaggg

SEQ ID NO: 33426 - DNA, 15 bp, Artificial Sequence
  dgRNA
  Phactr1
gttagggggagcccc

SEQ ID NO: 33427 - DNA, 15 bp, Artificial Sequence
  dgRNA
  Phactr1
ccccgggtacagatc

SEQ ID NO: 33428 - DNA, 15 bp, Artificial Sequence
  dgRNA
  Phactr1
cccgggtacagatca

SEQ ID NO: 33429 - DNA, 15 bp, Artificial Sequence
  dgRNA
  Phactr1
tccgccaatccttaa

SEQ ID NO: 33430 - DNA, 15 bp, Artificial Sequence
  dgRNA
  Pappa
ctcattcaattggga

SEQ ID NO: 33431 - DNA, 15 bp, Artificial Sequence
  dgRNA
  Pappa
attcaattgggaagg

SEQ ID NO: 33432 - DNA, 15 bp, Artificial Sequence
  dgRNA
  Pappa
ttactcgtcttctaa

SEQ ID NO: 33433 - DNA, 15 bp, Artificial Sequence
  dgRNA
  Pappa
ttcatttcgtgaaga

SEQ ID NO: 33434 - DNA, 15 bp, Artificial Sequence
  dgRNA
  Bad
tcctgcacacgccct

SEQ ID NO: 33435 - DNA, 15 bp, Artificial Sequence
  dgRNA
  Bad
cacgccctaggcttg

SEQ ID NO: 33436 - DNA, 15 bp, Artificial Sequence
  dgRNA
  Bad
gaggaagtccgatcc

SEQ ID NO: 33437 - DNA, 15 bp, Artificial Sequence
  dgRNA
  Bad
tccgatcccggaatc

SEQ ID NO: 33438 - DNA, 15 bp, Artificial Sequence
  dgRNA
  Prkar2b
gcgtgggattcgctc

SEQ ID NO: 33439 - DNA, 15 bp, Artificial Sequence
  dgRNA
  Prkar2b
cgtgggattcgctca

SEQ ID NO: 33440 - DNA, 15 bp, Artificial Sequence
  dgRNA
  Prkar2b
tcgctcagggagctc

SEQ ID NO: 33441 - DNA, 15 bp, Artificial Sequence
  dgRNA
  Prkar2b
ctcaggtggagcgcg

SEQ ID NO: 33442 - DNA, 15 bp, Artificial Sequence
  dgRNA
  Armc3
gccatggcacgattg

SEQ ID NO: 33443 - DNA, 15 bp, Artificial Sequence
  dgRNA
  Armc3
gattgtggttcctgc

SEQ ID NO: 33444 - DNA, 15 bp, Artificial Sequence
  dgRNA
  Armc3
attgatcgatcactt

SEQ ID NO: 33445 - DNA, 15 bp, Artificial Sequence
  dgRNA
  Armc3
cgatcactttggagc

SEQ ID NO: 33446 - DNA, 15 bp, Artificial Sequence
  dgRNA
  4930548H24Rik
ttgacccccaatctg

SEQ ID NO: 33447 - DNA, 15 bp, Artificial Sequence
  dgRNA
  4930548H24Rik
tgacccccaatctga

SEQ ID NO: 33448 - DNA, 15 bp, Artificial Sequence
  dgRNA
  4930548H24Rik
agacatgataccttg

SEQ ID NO: 33449 - DNA, 15 bp, Artificial Sequence
  dgRNA
  4930548H24Rik
gtttttgcggagtct

SEQ ID NO: 33450 - DNA, 15 bp, Artificial Sequence
  dgRNA
  Wdr12
tactcaacctcgtct

SEQ ID NO: 33451 - DNA, 15 bp, Artificial Sequence
  dgRNA
  Wdr12
ctcgtcttggctccg

SEQ ID NO: 33452 - DNA, 15 bp, Artificial Sequence
  dgRNA
  Wdr12
accagcacaatgcgc

SEQ ID NO: 33453 - DNA, 15 bp, Artificial Sequence
  dgRNA
  Wdr12
caggcgcacccctcc

SEQ ID NO: 33454 - DNA, 15 bp, Artificial Sequence
  dgRNA
  Ccdc180
cctcctactagcttt

SEQ ID NO: 33455 - DNA, 15 bp, Artificial Sequence
  dgRNA
  Ccdc180
ttaaagggcgctcca

SEQ ID NO: 33456 - DNA, 15 bp, Artificial Sequence
  dgRNA
  Ccdc180
ttcactactccacgt

SEQ ID NO: 33457 - DNA, 15 bp, Artificial Sequence
  dgRNA
  Ccdc180
tgttgctgagtgacc

SEQ ID NO: 33458 - DNA, 15 bp, Artificial Sequence
  dgRNA
  Olfr1490
gatgcaagtcatata

SEQ ID NO: 33459 - DNA, 15 bp, Artificial Sequence
  dgRNA
  Csde1
cgcagagattgcttc

SEQ ID NO: 33460 - DNA, 15 bp, Artificial Sequence
  dgRNA
  Csde1
cttctggcactaccc

SEQ ID NO: 33461 - DNA, 15 bp, Artificial Sequence
  dgRNA
  Csde1
tctggcactacccag

SEQ ID NO: 33462 - DNA, 15 bp, Artificial Sequence
  dgRNA
  Csde1
tcaccggcttgcgtg

SEQ ID NO: 33463 - DNA, 15 bp, Artificial Sequence
  dgRNA
  Sirpa
gcttttgctatacct

SEQ ID NO: 33464 - DNA, 15 bp, Artificial Sequence
  dgRNA
  Sirpa
ttttgctatacctcg

SEQ ID NO: 33465 - DNA, 15 bp, Artificial Sequence
  dgRNA
  Sirpa
aagatttgggcccct

SEQ ID NO: 33466 - DNA, 15 bp, Artificial Sequence
  dgRNA
  Sirpa
ggactcacgcccacc

SEQ ID NO: 33467 - DNA, 15 bp, Artificial Sequence
  dgRNA
  Tnfrsf10b
gttttcatattaggt

SEQ ID NO: 33468 - DNA, 15 bp, Artificial Sequence
  dgRNA
  Tnfrsf10b
catattaggtaggat

SEQ ID NO: 33469 - DNA, 15 bp, Artificial Sequence
  dgRNA
  Tnfrsf10b
atattaggtaggatc

SEQ ID NO: 33470 - DNA, 15 bp, Artificial Sequence
  dgRNA
  Tnfrsf10b
tattaggtaggatcg

SEQ ID NO: 33471 - DNA, 15 bp, Artificial Sequence
  dgRNA
  Ubqln1
acgggagacgcgaag

SEQ ID NO: 33472 - DNA, 15 bp, Artificial Sequence
  dgRNA
  Ubqln1
cgggagacgcgaagt

SEQ ID NO: 33473 - DNA, 15 bp, Artificial Sequence
  dgRNA
  Ubqln1
actccatcgaccttg

SEQ ID NO: 33474 - DNA, 15 bp, Artificial Sequence
  dgRNA
  Ubqln1
ccgcgcttcgtccgc

SEQ ID NO: 33475 - DNA, 15 bp, Artificial Sequence
  dgRNA
  Nudt13
aaggttacaagctcc

SEQ ID NO: 33476 - DNA, 15 bp, Artificial Sequence
  dgRNA
  Nudt13
ggagcttgtaacctt

SEQ ID NO: 33477 - DNA, 15 bp, Artificial Sequence
  dgRNA
  Nudt13
gttcaacttttaggc

SEQ ID NO: 33478 - DNA, 15 bp, Artificial Sequence
  dgRNA
  Nudt13
ttaccgatgcactct

SEQ ID NO: 33479 - DNA, 15 bp, Artificial Sequence
  dgRNA
  Slc11a2
aaggtttgaactgcg

SEQ ID NO: 33480 - DNA, 15 bp, Artificial Sequence
  dgRNA
  Slc11a2
gaactgcgaggaccg

SEQ ID NO: 33481 - DNA, 15 bp, Artificial Sequence
  dgRNA
  Slc11a2
ggaccgtggcgcgcc

SEQ ID NO: 33482 - DNA, 15 bp, Artificial Sequence
  dgRNA
  Slc11a2
ccgtggcgcgcccgg

SEQ ID NO: 33483 - DNA, 15 bp, Artificial Sequence
  dgRNA
  Dixdc1
ttgcgagcacccgtg

SEQ ID NO: 33484 - DNA, 15 bp, Artificial Sequence
  dgRNA
  Dixdc1
cttccccgcactccc

SEQ ID NO: 33485 - DNA, 15 bp, Artificial Sequence
  dgRNA
  Dixdc1
agcgccgggcccctc

SEQ ID NO: 33486 - DNA, 15 bp, Artificial Sequence
  dgRNA
  Dixdc1
tgcaagccgctagtt

SEQ ID NO: 33487 - DNA, 15 bp, Artificial Sequence
  dgRNA
  Tnp2
tctgacctgacccac

SEQ ID NO: 33488 - DNA, 15 bp, Artificial Sequence
  dgRNA
  Tnp2
aagctgccccgccct

SEQ ID NO: 33489 - DNA, 15 bp, Artificial Sequence
  dgRNA
  Tnp2
ccagctatataacta

SEQ ID NO: 33490 - DNA, 15 bp, Artificial Sequence
  dgRNA
  Tnp2
cagctatataactag

SEQ ID NO: 33491 - DNA, 15 bp, Artificial Sequence
  dgRNA
  Tnfrsf25
ggaacaaagcctccg

SEQ ID NO: 33492 - DNA, 15 bp, Artificial Sequence
  dgRNA
  Tnfrsf25
acaaagcctccgggg

SEQ ID NO: 33493 - DNA, 15 bp, Artificial Sequence
  dgRNA
  Tnfrsf25
caaagcctccgggga

SEQ ID NO: 33494 - DNA, 15 bp, Artificial Sequence
  dgRNA
  Tnfrsf25
actccgacctccctg

SEQ ID NO: 33495 - DNA, 15 bp, Artificial Sequence
  dgRNA
  Rnf32
taaccgcaccagcgc

SEQ ID NO: 33496 - DNA, 15 bp, Artificial Sequence
  dgRNA
  Rnf32
cgctgacgatacgcg

SEQ ID NO: 33497 - DNA, 15 bp, Artificial Sequence
  dgRNA
  Rnf32
gctgacgatacgcga

SEQ ID NO: 33498 - DNA, 15 bp, Artificial Sequence
  dgRNA
  Rnf32
ctgacgatacgcgag

SEQ ID NO: 33499 - DNA, 15 bp, Artificial Sequence
  dgRNA
  Arhgap18
aaccacggtttcctc

SEQ ID NO: 33500 - DNA, 15 bp, Artificial Sequence
  dgRNA
  Arhgap18
ctccctgtgaatcgc

SEQ ID NO: 33501 - DNA, 15 bp, Artificial Sequence
  dgRNA
  Arhgap18
ggcctgaggaaaccg

SEQ ID NO: 33502 - DNA, 15 bp, Artificial Sequence
  dgRNA
  Arhgap18
aaacccggcaatccc

SEQ ID NO: 33503 - DNA, 15 bp, Artificial Sequence
  dgRNA
  Htra3
cgctccaatgttgcc

SEQ ID NO: 33504 - DNA, 15 bp, Artificial Sequence
  dgRNA
  Htra3
tccaatgttgcccgg

SEQ ID NO: 33505 - DNA, 15 bp, Artificial Sequence
  dgRNA
  Htra3
ggaggggtctaggtt

SEQ ID NO: 33506 - DNA, 15 bp, Artificial Sequence
  dgRNA
  Htra3
gaggggtctaggttt

SEQ ID NO: 33507 - DNA, 15 bp, Artificial Sequence
  dgRNA
  Cux1
gcgccccctcgaggc

SEQ ID NO: 33508 - DNA, 15 bp, Artificial Sequence
  dgRNA
  Cux1
aggccgggccgccgt

SEQ ID NO: 33509 - DNA, 15 bp, Artificial Sequence
  dgRNA
  Cux1
ggccgggccgccgta

SEQ ID NO: 33510 - DNA, 15 bp, Artificial Sequence
  dgRNA
  Cux1
cgtagggtcgcagcg

SEQ ID NO: 33511 - DNA, 15 bp, Artificial Sequence
  dgRNA
  Galnt14
gcacaaccctagccc

SEQ ID NO: 33512 - DNA, 15 bp, Artificial Sequence
  dgRNA
  Galnt14
aggtccctcaaccgc

SEQ ID NO: 33513 - DNA, 15 bp, Artificial Sequence
  dgRNA
  Galnt14
ggtccctcaaccgca

SEQ ID NO: 33514 - DNA, 15 bp, Artificial Sequence
  dgRNA
  Galnt14
ccgcagggtgctcca

SEQ ID NO: 33515 - DNA, 15 bp, Artificial Sequence
  dgRNA
  Mepe
ttaccataccccctg

SEQ ID NO: 33516 - DNA, 15 bp, Artificial Sequence
  dgRNA
  Mepe
tgacagactccgtgc

SEQ ID NO: 33517 - DNA, 15 bp, Artificial Sequence
  dgRNA
  Mepe
gtgaaccatgctgat

SEQ ID NO: 33518 - DNA, 15 bp, Artificial Sequence
  dgRNA
  Mepe
atgctgattggacat

SEQ ID NO: 33519 - DNA, 15 bp, Artificial Sequence
  dgRNA
  Mfap3l
gtagacggcaactga

SEQ ID NO: 33520 - DNA, 15 bp, Artificial Sequence
  dgRNA
  Mfap3l
ggtttatttagaacc

SEQ ID NO: 33521 - DNA, 15 bp, Artificial Sequence
  dgRNA
  Mfap3l
tggctagaagtatag

SEQ ID NO: 33522 - DNA, 15 bp, Artificial Sequence
  dgRNA
  Mfap3l
gtatagtggatgaaa

SEQ ID NO: 33523 - DNA, 15 bp, Artificial Sequence
  dgRNA
  Tppp3
ttcagcagtcccttg

SEQ ID NO: 33524 - DNA, 15 bp, Artificial Sequence
  dgRNA
  Tppp3
gggacaatggaattt

SEQ ID NO: 33525 - DNA, 15 bp, Artificial Sequence
  dgRNA
  Tppp3
tatcttaggacatcc

SEQ ID NO: 33526 - DNA, 15 bp, Artificial Sequence
  dgRNA
  Tppp3
agctctgaccgcttg

SEQ ID NO: 33527 - DNA, 15 bp, Artificial Sequence
  dgRNA
  Wrb
agcgtgcgtgcaccg

SEQ ID NO: 33528 - DNA, 15 bp, Artificial Sequence
  dgRNA
  Wrb
gtgtagccctagccg

SEQ ID NO: 33529 - DNA, 15 bp, Artificial Sequence
  dgRNA
  Wrb
ctagccgtggcgcgc

SEQ ID NO: 33530 - DNA, 15 bp, Artificial Sequence
  dgRNA
  Wrb
gtggcgcgccggcgc

SEQ ID NO: 33531 - DNA, 15 bp, Artificial Sequence
  dgRNA
  Cand1
gccattccgcccgaa

SEQ ID NO: 33532 - DNA, 15 bp, Artificial Sequence
  dgRNA
  Cand1
attccgcccgaaagg

SEQ ID NO: 33533 - DNA, 15 bp, Artificial Sequence
  dgRNA
  Cand1
gcgaagacagacagc

SEQ ID NO: 33534 - DNA, 15 bp, Artificial Sequence
  dgRNA
  Cand1
gacagacagccggcc

SEQ ID NO: 33535 - DNA, 15 bp, Artificial Sequence
  dgRNA
  F12
cagcgctgttctgct

SEQ ID NO: 33536 - DNA, 15 bp, Artificial Sequence
  dgRNA
  F12
attgatcctcactcc

SEQ ID NO: 33537 - DNA, 15 bp, Artificial Sequence
  dgRNA
  F12
ctgactttactagga

SEQ ID NO: 33538 - DNA, 15 bp, Artificial Sequence
  dgRNA
  F12
gcggactgaagagtt

SEQ ID NO: 33539 - DNA, 15 bp, Artificial Sequence
  dgRNA
  Higd2a
ccacccgtgcgcgca

SEQ ID NO: 33540 - DNA, 15 bp, Artificial Sequence
  dgRNA
  Higd2a
gcgcgcaaggattct

SEQ ID NO: 33541 - DNA, 15 bp, Artificial Sequence
  dgRNA
  Higd2a
cgcgcaaggattctt

SEQ ID NO: 33542 - DNA, 15 bp, Artificial Sequence
  dgRNA
  Higd2a
gaaagcaacgggcaa

SEQ ID NO: 33543 - DNA, 15 bp, Artificial Sequence
  dgRNA
  Tmem243
ccgccaattgccaag

SEQ ID NO: 33544 - DNA, 15 bp, Artificial Sequence
  dgRNA
  Tmem243
ccaattgccaagagg

SEQ ID NO: 33545 - DNA, 15 bp, Artificial Sequence
  dgRNA
  Tmem243
aggcggagaaacgct

SEQ ID NO: 33546 - DNA, 15 bp, Artificial Sequence
  dgRNA
  Tmem243
agaaacgcttggcag

SEQ ID NO: 33547 - DNA, 15 bp, Artificial Sequence
  dgRNA
  Ptpn13
ggacagcgccgcgcg

SEQ ID NO: 33548 - DNA, 15 bp, Artificial Sequence
  dgRNA
  Ptpn13
gacagcgccgcgcgc

SEQ ID NO: 33549 - DNA, 15 bp, Artificial Sequence
  dgRNA
  Ptpn13
agcgccgcgcgcggg

SEQ ID NO: 33550 - DNA, 15 bp, Artificial Sequence
  dgRNA
  Ptpn13
gggcggccgtcgttg

SEQ ID NO: 33551 - DNA, 15 bp, Artificial Sequence
  dgRNA
  Nudt1
ccgtgtcccgctccc

SEQ ID NO: 33552 - DNA, 15 bp, Artificial Sequence
  dgRNA
  Nudt1
cgtgtcccgctcccc

SEQ ID NO: 33553 - DNA, 15 bp, Artificial Sequence
  dgRNA
  Nudt1
tcccgctccccggga

SEQ ID NO: 33554 - DNA, 15 bp, Artificial Sequence
  dgRNA
  Nudt1
cgctccccgggacgg

SEQ ID NO: 33555 - DNA, 15 bp, Artificial Sequence
  dgRNA
  Caprin2
gtacgcgccaagcgc

SEQ ID NO: 33556 - DNA, 15 bp, Artificial Sequence
  dgRNA
  Caprin2
ggacctgtccctcgc

SEQ ID NO: 33557 - DNA, 15 bp, Artificial Sequence
  dgRNA
  Caprin2
gtccctcgcaggtcc

SEQ ID NO: 33558 - DNA, 15 bp, Artificial Sequence
  dgRNA
  Caprin2
tccctcgcaggtccc

SEQ ID NO: 33559 - DNA, 15 bp, Artificial Sequence
  dgRNA
  Pcdh11x
ggggtacccatcagt

SEQ ID NO: 33560 - DNA, 15 bp, Artificial Sequence
  dgRNA
  Pcdh11x
tcccagcaggcggct

SEQ ID NO: 33561 - DNA, 15 bp, Artificial Sequence
  dgRNA
  Pcdh11x
cccagcaggcggcta

SEQ ID NO: 33562 - DNA, 15 bp, Artificial Sequence
  dgRNA
  Pcdh11x
ccctcgccattgaaa

SEQ ID NO: 33563 - DNA, 15 bp, Artificial Sequence
  dgRNA
  Rnf19b
ctgcgcagttgcccg

SEQ ID NO: 33564 - DNA, 15 bp, Artificial Sequence
  dgRNA
  Rnf19b
gttgcccgcggcgcg

SEQ ID NO: 33565 - DNA, 15 bp, Artificial Sequence
  dgRNA
  Rnf19b
ttgcccgcggcgcgc

SEQ ID NO: 33566 - DNA, 15 bp, Artificial Sequence
  dgRNA
  Rnf19b
tgcccgcggcgcgcg

SEQ ID NO: 33567 - DNA, 15 bp, Artificial Sequence
  dgRNA
  Fam189b
gatccttaactgctc

SEQ ID NO: 33568 - DNA, 15 bp, Artificial Sequence
  dgRNA
  Fam189b
tcaggcttcagggcg

SEQ ID NO: 33569 - DNA, 15 bp, Artificial Sequence
  dgRNA
  Fam189b
cttcagggcgaggct

SEQ ID NO: 33570 - DNA, 15 bp, Artificial Sequence
  dgRNA
  Fam189b
ttcagggcgaggcta

SEQ ID NO: 33571 - DNA, 15 bp, Artificial Sequence
  dgRNA
  Kri1
ggcctttccccgcag

SEQ ID NO: 33572 - DNA, 15 bp, Artificial Sequence
  dgRNA
  Kri1
cgcagaggcttgtcc

SEQ ID NO: 33573 - DNA, 15 bp, Artificial Sequence
  dgRNA
  Kri1
agaggcttgtcccgg

SEQ ID NO: 33574 - DNA, 15 bp, Artificial Sequence
  dgRNA
  Kri1
gaggcttgtcccggt

SEQ ID NO: 33575 - DNA, 15 bp, Artificial Sequence
  dgRNA
  Mylk
ttccctggtacgtgc

SEQ ID NO: 33576 - DNA, 15 bp, Artificial Sequence
  dgRNA
  Mylk
tccctggtacgtgca

SEQ ID NO: 33577 - DNA, 15 bp, Artificial Sequence
  dgRNA
  Mylk
cggaagcagttctcc

SEQ ID NO: 33578 - DNA, 15 bp, Artificial Sequence
  dgRNA
  Mylk
agccgaccacagaga

SEQ ID NO: 33579 - DNA, 15 bp, Artificial Sequence
  dgRNA
  Noc2l
tttcccgggtgcgag

SEQ ID NO: 33580 - DNA, 15 bp, Artificial Sequence
  dgRNA
  Noc2l
gcgagcggtcgttcc

SEQ ID NO: 33581 - DNA, 15 bp, Artificial Sequence
  dgRNA
  Noc2l
agcggtcgttccagg

SEQ ID NO: 33582 - DNA, 15 bp, Artificial Sequence
  dgRNA
  Noc2l
gcggtcgttccaggc

SEQ ID NO: 33583 - DNA, 15 bp, Artificial Sequence
  dgRNA
  Tmc3
tctttgagccctgtc

SEQ ID NO: 33584 - DNA, 15 bp, Artificial Sequence
  dgRNA
  Tmc3
acagccctaggctac

SEQ ID NO: 33585 - DNA, 15 bp, Artificial Sequence
  dgRNA
  Tmc3
cagccctaggctact

SEQ ID NO: 33586 - DNA, 15 bp, Artificial Sequence
  dgRNA
  Tmc3
acatatgtatgaccc

SEQ ID NO: 33587 - DNA, 15 bp, Artificial Sequence
  dgRNA
  Prg4
ctaagtctagtcgtc

SEQ ID NO: 33588 - DNA, 15 bp, Artificial Sequence
  dgRNA
  Prg4
taagtctagtcgtct

SEQ ID NO: 33589 - DNA, 15 bp, Artificial Sequence
  dgRNA
  Prg4
ctcatccaacaaatg

SEQ ID NO: 33590 - DNA, 15 bp, Artificial Sequence
  dgRNA
  Prg4
attttgcctaacctt

SEQ ID NO: 33591 - DNA, 15 bp, Artificial Sequence
  dgRNA
  Il6
tgtgcaatcttaata

SEQ ID NO: 33592 - DNA, 15 bp, Artificial Sequence
  dgRNA
  Il6
cttaagtcatccttg

SEQ ID NO: 33593 - DNA, 15 bp, Artificial Sequence
  dgRNA
  Il6
gaatcacaactagga

SEQ ID NO: 33594 - DNA, 15 bp, Artificial Sequence
  dgRNA
  Pate2
taggagtctatcctg

SEQ ID NO: 33595 - DNA, 15 bp, Artificial Sequence
  dgRNA
  Pate2
acaatgtcttgatcc

SEQ ID NO: 33596 - DNA, 15 bp, Artificial Sequence
  dgRNA
  Pate2
aagtactgtcagtcc

SEQ ID NO: 33597 - DNA, 15 bp, Artificial Sequence
  dgRNA
  Pate2
tagatgaacagccca

SEQ ID NO: 33598 - DNA, 15 bp, Artificial Sequence
  dgRNA
  Caly
tgaaatgtatttcgt

SEQ ID NO: 33599 - DNA, 15 bp, Artificial Sequence
  dgRNA
  Caly
gcagagatctgccgt

SEQ ID NO: 33600 - DNA, 15 bp, Artificial Sequence
  dgRNA
  Caly
agatctgccgtggga

SEQ ID NO: 33601 - DNA, 15 bp, Artificial Sequence
  dgRNA
  Caly
gatctgccgtgggag

SEQ ID NO: 33602 - DNA, 15 bp, Artificial Sequence
  dgRNA
  Lrcol1
ttcaaccttgagttg

SEQ ID NO: 33603 - DNA, 15 bp, Artificial Sequence
  dgRNA
  Lrcol1
tcaaccttgagttga

SEQ ID NO: 33604 - DNA, 15 bp, Artificial Sequence
  dgRNA
  Lrcol1
caaccttgagttgag

SEQ ID NO: 33605 - DNA, 15 bp, Artificial Sequence
  dgRNA
  Lrcol1
aaagcaaggacgtcc

SEQ ID NO: 33606 - DNA, 15 bp, Artificial Sequence
  dgRNA
  Mdh2
gagtccttctagtac

SEQ ID NO: 33607 - DNA, 15 bp, Artificial Sequence
  dgRNA
  Mdh2
agtccttctagtacc

SEQ ID NO: 33608 - DNA, 15 bp, Artificial Sequence
  dgRNA
  Mdh2
tagtaccgggttgct

SEQ ID NO: 33609 - DNA, 15 bp, Artificial Sequence
  dgRNA
  Mdh2
agtaccgggttgcta

SEQ ID NO: 33610 - DNA, 15 bp, Artificial Sequence
  dgRNA
  1110032A03Rik
ccaccactcaatgca

SEQ ID NO: 33611 - DNA, 15 bp, Artificial Sequence
  dgRNA
  1110032A03Rik
actcaatgcatggtt

SEQ ID NO: 33612 - DNA, 15 bp, Artificial Sequence
  dgRNA
  1110032A03Rik
cgcctgagcgccccc

SEQ ID NO: 33613 - DNA, 15 bp, Artificial Sequence
  dgRNA
  1110032A03Rik
cacacccttacgctc

SEQ ID NO: 33614 - DNA, 15 bp, Artificial Sequence
  dgRNA
  Ly6k
aactaatctgaacac

SEQ ID NO: 33615 - DNA, 15 bp, Artificial Sequence
  dgRNA
  Ly6k
cacatcttgtcagag

SEQ ID NO: 33616 - DNA, 15 bp, Artificial Sequence
  dgRNA
  Ly6k
catcttgtcagagtg

SEQ ID NO: 33617 - DNA, 15 bp, Artificial Sequence
  dgRNA
  Ly6k
tgtgagtaactatcg

SEQ ID NO: 33618 - DNA, 15 bp, Artificial Sequence
  dgRNA
  Vmn2r118
gagtttggtacaaac

SEQ ID NO: 33619 - DNA, 15 bp, Artificial Sequence
  dgRNA
  Vmn2r118
gttcttgcacaactc

SEQ ID NO: 33620 - DNA, 15 bp, Artificial Sequence
  dgRNA
  Vmn2r118
accaaactctcaaga

SEQ ID NO: 33621 - DNA, 15 bp, Artificial Sequence
  dgRNA
  Cpt1a
tcctaggtctgccgt

SEQ ID NO: 33622 - DNA, 15 bp, Artificial Sequence
  dgRNA
  Cpt1a
tgccgttggcaagct

SEQ ID NO: 33623 - DNA, 15 bp, Artificial Sequence
  dgRNA
  Cpt1a
gccgttggcaagctc

SEQ ID NO: 33624 - DNA, 15 bp, Artificial Sequence
  dgRNA
  Cpt1a
tcagccaatcacccg

SEQ ID NO: 33625 - DNA, 15 bp, Artificial Sequence
  dgRNA
  Rxra
actcacacctagggc

SEQ ID NO: 33626 - DNA, 15 bp, Artificial Sequence
  dgRNA
  Rxra
agttataggctgaat

SEQ ID NO: 33627 - DNA, 15 bp, Artificial Sequence
  dgRNA
  Rxra
ataggcctccagtct

SEQ ID NO: 33628 - DNA, 15 bp, Artificial Sequence
  dgRNA
  Rxra
gctgctaccctgccg

SEQ ID NO: 33629 - DNA, 15 bp, Artificial Sequence
  dgRNA
  Itpk1
gcgcacgtccctgcg

SEQ ID NO: 33630 - DNA, 15 bp, Artificial Sequence
  dgRNA
  Itpk1
cgcacgtccctgcgc

SEQ ID NO: 33631 - DNA, 15 bp, Artificial Sequence
  dgRNA
  Itpk1
cgcgggcgagccccg

SEQ ID NO: 33632 - DNA, 15 bp, Artificial Sequence
  dgRNA
  Itpk1
gcgggcgagccccgc

SEQ ID NO: 33633 - DNA, 15 bp, Artificial Sequence
  dgRNA
  Calcoco1
gcctgccctttctta

SEQ ID NO: 33634 - DNA, 15 bp, Artificial Sequence
  dgRNA
  Calcoco1
ggccgtgaagtcctt

SEQ ID NO: 33635 - DNA, 15 bp, Artificial Sequence
  dgRNA
  Calcoco1
tcgcgcgcagcctcc

SEQ ID NO: 33636 - DNA, 15 bp, Artificial Sequence
  dgRNA
  Calcoco1
cgcgcgcagcctcct

SEQ ID NO: 33637 - DNA, 15 bp, Artificial Sequence
  dgRNA
  Crtc3
gagaagtcccgaagc

SEQ ID NO: 33638 - DNA, 15 bp, Artificial Sequence
  dgRNA
  Crtc3
agtcccgaagcaggc

SEQ ID NO: 33639 - DNA, 15 bp, Artificial Sequence
  dgRNA
  Crtc3
gtcccgaagcaggct

SEQ ID NO: 33640 - DNA, 15 bp, Artificial Sequence
  dgRNA
  Crtc3
tcccgaagcaggctg

SEQ ID NO: 33641 - DNA, 15 bp, Artificial Sequence
  dgRNA
  Agbl1
ccacgcctgtgccga

SEQ ID NO: 33642 - DNA, 15 bp, Artificial Sequence
  dgRNA
  Agbl1
ctgtgccgaaggcta

SEQ ID NO: 33643 - DNA, 15 bp, Artificial Sequence
  dgRNA
  Agbl1
aggctaaggttgcac

SEQ ID NO: 33644 - DNA, 15 bp, Artificial Sequence
  dgRNA
  Agbl1
ggctaaggttgcaca

SEQ ID NO: 33645 - DNA, 15 bp, Artificial Sequence
  dgRNA
  Pml
tcacttcctctcggg

SEQ ID NO: 33646 - DNA, 15 bp, Artificial Sequence
  dgRNA
  Pml
cttcctctcgggagg

SEQ ID NO: 33647 - DNA, 15 bp, Artificial Sequence
  dgRNA
  Pml
gaggcgggctctcct

SEQ ID NO: 33648 - DNA, 15 bp, Artificial Sequence
  dgRNA
  Pml
tctcgctcagttttc

SEQ ID NO: 33649 - DNA, 15 bp, Artificial Sequence
  dgRNA
  Cacng5
gggggataaagctta

SEQ ID NO: 33650 - DNA, 15 bp, Artificial Sequence
  dgRNA
  Cacng5
ggataaagcttaagg

SEQ ID NO: 33651 - DNA, 15 bp, Artificial Sequence
  dgRNA
  Cacng5
gtagggacaggttgc

SEQ ID NO: 33652 - DNA, 15 bp, Artificial Sequence
  dgRNA
  Cacng5
atgcaaagtcctatg

SEQ ID NO: 33653 - DNA, 15 bp, Artificial Sequence
  dgRNA
  Capg
tgactcacttctccg

SEQ ID NO: 33654 - DNA, 15 bp, Artificial Sequence
  dgRNA
  Capg
gactcacttctccga

SEQ ID NO: 33655 - DNA, 15 bp, Artificial Sequence
  dgRNA
  Capg
actcacttctccgag

SEQ ID NO: 33656 - DNA, 15 bp, Artificial Sequence
  dgRNA
  Capg
ctcacttctccgagg

SEQ ID NO: 33657 - DNA, 15 bp, Artificial Sequence
  dgRNA
  Chrna5
atcaattatgagcag

SEQ ID NO: 33658 - DNA, 15 bp, Artificial Sequence
  dgRNA
  Chrna5
cagtgtagagtctac

SEQ ID NO: 33659 - DNA, 15 bp, Artificial Sequence
  dgRNA
  Chrna5
agtgtagagtctaca

SEQ ID NO: 33660 - DNA, 15 bp, Artificial Sequence
  dgRNA
  Chrna5
ttagaacgcttcatt

SEQ ID NO: 33661 - DNA, 15 bp, Artificial Sequence
  dgRNA
  Snx10
aaagacccgctagct

SEQ ID NO: 33662 - DNA, 15 bp, Artificial Sequence
  dgRNA
  Snx10
gcctttcctacgtta

SEQ ID NO: 33663 - DNA, 15 bp, Artificial Sequence
  dgRNA
  Snx10
ttcctacgttaaggc

SEQ ID NO: 33664 - DNA, 15 bp, Artificial Sequence
  dgRNA
  Snx10
cgttaaggctggcag

SEQ ID NO: 33665 - DNA, 15 bp, Artificial Sequence
  dgRNA
  Ddo
cgaaacttcccctgc

SEQ ID NO: 33666 - DNA, 15 bp, Artificial Sequence
  dgRNA
  Ddo
cacgtgcctctctcc

SEQ ID NO: 33667 - DNA, 15 bp, Artificial Sequence
  dgRNA
  Ddo
acgtgcctctctcct

SEQ ID NO: 33668 - DNA, 15 bp, Artificial Sequence
  dgRNA
  Ddo
tgtggcatggaccaa

SEQ ID NO: 33669 - DNA, 15 bp, Artificial Sequence
  dgRNA
  Atraid
accgcgagcaagcgc

SEQ ID NO: 33670 - DNA, 15 bp, Artificial Sequence
  dgRNA
  Atraid
gagcaagcgcaggac

SEQ ID NO: 33671 - DNA, 15 bp, Artificial Sequence
  dgRNA
  Atraid
agcagcccgaacctg

SEQ ID NO: 33672 - DNA, 15 bp, Artificial Sequence
  dgRNA
  Atraid
gcagcccgaacctgc

SEQ ID NO: 33673 - DNA, 15 bp, Artificial Sequence
  dgRNA
  Crocc2
ggcttgtttggcgtg

SEQ ID NO: 33674 - DNA, 15 bp, Artificial Sequence
  dgRNA
  Crocc2
ctccacaatcaaggt

SEQ ID NO: 33675 - DNA, 15 bp, Artificial Sequence
  dgRNA
  Crocc2
tccacaatcaaggtg

SEQ ID NO: 33676 - DNA, 15 bp, Artificial Sequence
  dgRNA
  Crocc2
tcaaggtggggcatc

SEQ ID NO: 33677 - DNA, 15 bp, Artificial Sequence
  dgRNA
  Nt5c3
ccttccgggtccttg

SEQ ID NO: 33678 - DNA, 15 bp, Artificial Sequence
  dgRNA
  Nt5c3
gcgtttcctgaagtc

SEQ ID NO: 33679 - DNA, 15 bp, Artificial Sequence
  dgRNA
  Nt5c3
cgtttcctgaagtca

SEQ ID NO: 33680 - DNA, 15 bp, Artificial Sequence
  dgRNA
  Nt5c3
ccgcccccactataa

SEQ ID NO: 33681 - DNA, 15 bp, Artificial Sequence
  dgRNA
  Csrnp2
cgccgcgaatgttcc

SEQ ID NO: 33682 - DNA, 15 bp, Artificial Sequence
  dgRNA
  Csrnp2
gccgcgaatgttcca

SEQ ID NO: 33683 - DNA, 15 bp, Artificial Sequence
  dgRNA
  Csrnp2
gcgaatgttccaggg

SEQ ID NO: 33684 - DNA, 15 bp, Artificial Sequence
  dgRNA
  Csrnp2
cgaatgttccagggt

SEQ ID NO: 33685 - DNA, 15 bp, Artificial Sequence
  dgRNA
  Spn
ctaagaattcccgtc

SEQ ID NO: 33686 - DNA, 15 bp, Artificial Sequence
  dgRNA
  Spn
ccccacaagcaacta

SEQ ID NO: 33687 - DNA, 15 bp, Artificial Sequence
  dgRNA
  Spn
cccacaagcaactat

SEQ ID NO: 33688 - DNA, 15 bp, Artificial Sequence
  dgRNA
  Spn
cagacgggaattctt

SEQ ID NO: 33689 - DNA, 15 bp, Artificial Sequence
  dgRNA
  Defa24
gcctacaactagaga

SEQ ID NO: 33690 - DNA, 15 bp, Artificial Sequence
  dgRNA
  Hist1h4a
cgggtcttggctgag

SEQ ID NO: 33691 - DNA, 15 bp, Artificial Sequence
  dgRNA
  Hist1h4a
atgtcattttcccgc

SEQ ID NO: 33692 - DNA, 15 bp, Artificial Sequence
  dgRNA
  Hist1h4a
gccggcgcgctttcg

SEQ ID NO: 33693 - DNA, 15 bp, Artificial Sequence
  dgRNA
  Hist1h4a
cgcgctttcggggca

SEQ ID NO: 33694 - DNA, 15 bp, Artificial Sequence
  dgRNA
  Hsph1
cgaaaactgcccctc

SEQ ID NO: 33695 - DNA, 15 bp, Artificial Sequence
  dgRNA
  Hsph1
gaggccgggcaagct

SEQ ID NO: 33696 - DNA, 15 bp, Artificial Sequence
  dgRNA
  Hsph1
aactcaggccgcccg

SEQ ID NO: 33697 - DNA, 15 bp, Artificial Sequence
  dgRNA
  Hsph1
tcaggccgcccgcgg

SEQ ID NO: 33698 - DNA, 15 bp, Artificial Sequence
  dgRNA
  Cltb
tcggttcaatgcacc

SEQ ID NO: 33699 - DNA, 15 bp, Artificial Sequence
  dgRNA
  Cltb
gctgctggcacgctc

SEQ ID NO: 33700 - DNA, 15 bp, Artificial Sequence
  dgRNA
  Cltb
acgctctggagccga

SEQ ID NO: 33701 - DNA, 15 bp, Artificial Sequence
  dgRNA
  Cltb
ccgaaggtgggcttc

SEQ ID NO: 33702 - DNA, 15 bp, Artificial Sequence
  dgRNA
  Fam69b
tgccgtagcgggtcc

SEQ ID NO: 33703 - DNA, 15 bp, Artificial Sequence
  dgRNA
  Fam69b
gggtcccggagctct

SEQ ID NO: 33704 - DNA, 15 bp, Artificial Sequence
  dgRNA
  Fam69b
cccggagctctcggg

SEQ ID NO: 33705 - DNA, 15 bp, Artificial Sequence
  dgRNA
  Fam69b
ggcgtaggtccccag

SEQ ID NO: 33706 - DNA, 15 bp, Artificial Sequence
  dgRNA
  Etaa1
cagttcctgctaagt

SEQ ID NO: 33707 - DNA, 15 bp, Artificial Sequence
  dgRNA
  Etaa1
gttggacgagtctga

SEQ ID NO: 33708 - DNA, 15 bp, Artificial Sequence
  dgRNA
  Etaa1
taacccgcccctaga

SEQ ID NO: 33709 - DNA, 15 bp, Artificial Sequence
  dgRNA
  Etaa1
cccgcccctagacgg

SEQ ID NO: 33710 - DNA, 15 bp, Artificial Sequence
  dgRNA
  Il33
cgataacagtaacat

SEQ ID NO: 33711 - DNA, 15 bp, Artificial Sequence
  dgRNA
  Il33
aacagtaacattggc

SEQ ID NO: 33712 - DNA, 15 bp, Artificial Sequence
  dgRNA
  Il33
ctcgcagagcgcctt

SEQ ID NO: 33713 - DNA, 15 bp, Artificial Sequence
  dgRNA
  Il33
cctcgcagagcgcct

SEQ ID NO: 33714 - DNA, 15 bp, Artificial Sequence
  dgRNA
  BC052040
cgcggaggtgaagcc

SEQ ID NO: 33715 - DNA, 15 bp, Artificial Sequence
  dgRNA
  BC052040
gcggaggtgaagcct

SEQ ID NO: 33716 - DNA, 15 bp, Artificial Sequence
  dgRNA
  BC052040
caggcttcacctccg

SEQ ID NO: 33717 - DNA, 15 bp, Artificial Sequence
  dgRNA
  BC052040
gacacgcagcgtccc

SEQ ID NO: 33718 - DNA, 15 bp, Artificial Sequence
  dgRNA
  Tifa
ccgctccccacgcct

SEQ ID NO: 33719 - DNA, 15 bp, Artificial Sequence
  dgRNA
  Tifa
cgctccccacgcctc

SEQ ID NO: 33720 - DNA, 15 bp, Artificial Sequence
  dgRNA
  Tifa
ccaaggcccgagatc

SEQ ID NO: 33721 - DNA, 15 bp, Artificial Sequence
  dgRNA
  Tifa
caggcgcacattctt

SEQ ID NO: 33722 - DNA, 15 bp, Artificial Sequence
  dgRNA
  Olfr311
gaatgaattaagccc

SEQ ID NO: 33723 - DNA, 15 bp, Artificial Sequence
  dgRNA
  Olfr311
ctatgtgagtggaat

SEQ ID NO: 33724 - DNA, 15 bp, Artificial Sequence
  dgRNA
  Olfr311
ataataggcaggctc

SEQ ID NO: 33725 - DNA, 15 bp, Artificial Sequence
  dgRNA
  Olfr311
gccgcacacagctga

SEQ ID NO: 33726 - DNA, 15 bp, Artificial Sequence
  dgRNA
  Tinagl1
acaagagatccctca

SEQ ID NO: 33727 - DNA, 15 bp, Artificial Sequence
  dgRNA
  Tinagl1
cttaagccgttccct

SEQ ID NO: 33728 - DNA, 15 bp, Artificial Sequence
  dgRNA
  Tinagl1
gttccctcggagcta

SEQ ID NO: 33729 - DNA, 15 bp, Artificial Sequence
  dgRNA
  Tinagl1
gctaagggctactcc

SEQ ID NO: 33730 - DNA, 15 bp, Artificial Sequence
  dgRNA
  Prrc2b
ctccctcccgggaca

SEQ ID NO: 33731 - DNA, 15 bp, Artificial Sequence
  dgRNA
  Prrc2b
tccctcccgggacag

SEQ ID NO: 33732 - DNA, 15 bp, Artificial Sequence
  dgRNA
  Prrc2b
caggggcgacgcagc

SEQ ID NO: 33733 - DNA, 15 bp, Artificial Sequence
  dgRNA
  Prrc2b
aggggcgacgcagca

SEQ ID NO: 33734 - DNA, 15 bp, Artificial Sequence
  dgRNA
  Abcc3
ctgtgttgcaatcgc

SEQ ID NO: 33735 - DNA, 15 bp, Artificial Sequence
  dgRNA
  Abcc3
tgtgttgcaatcgct

SEQ ID NO: 33736 - DNA, 15 bp, Artificial Sequence
  dgRNA
  Abcc3
gtgttgcaatcgctg

SEQ ID NO: 33737 - DNA, 15 bp, Artificial Sequence
  dgRNA
  Abcc3
gcaatcgctggggac

SEQ ID NO: 33738 - DNA, 15 bp, Artificial Sequence
  dgRNA
  Tdpoz2
tttacaccacggaga

SEQ ID NO: 33739 - DNA, 15 bp, Artificial Sequence
  dgRNA
  Tdpoz2
ttacaccacggagag

SEQ ID NO: 33740 - DNA, 15 bp, Artificial Sequence
  dgRNA
  Tdpoz2
atacttatatccaac

SEQ ID NO: 33741 - DNA, 15 bp, Artificial Sequence
  dgRNA
  Tdpoz2
caactcccctctccg

SEQ ID NO: 33742 - DNA, 15 bp, Artificial Sequence
  dgRNA
  Gm4763
atctgcccacaatcc

SEQ ID NO: 33743 - DNA, 15 bp, Artificial Sequence
  dgRNA
  Gm4763
atctaagctaattag

SEQ ID NO: 33744 - DNA, 15 bp, Artificial Sequence
  dgRNA
  Gm4763
tctaagctaattagc

SEQ ID NO: 33745 - DNA, 15 bp, Artificial Sequence
  dgRNA
  Gm4763
ggcttgacctggtat

SEQ ID NO: 33746 - DNA, 15 bp, Artificial Sequence
  dgRNA
  Olfr1477
ttagatcaaccttga

SEQ ID NO: 33747 - DNA, 15 bp, Artificial Sequence
  dgRNA
  Olfr1477
ataatgagctcatat

SEQ ID NO: 33748 - DNA, 15 bp, Artificial Sequence
  dgRNA
  Kalrn
tcgtttgtgtcactg

SEQ ID NO: 33749 - DNA, 15 bp, Artificial Sequence
  dgRNA
  Kalrn
cagtccatctatttc

SEQ ID NO: 33750 - DNA, 15 bp, Artificial Sequence
  dgRNA
  Kalrn
aacctagagggtggc

SEQ ID NO: 33751 - DNA, 15 bp, Artificial Sequence
  dgRNA
  Kalrn
aataaacctagaggg

SEQ ID NO: 33752 - DNA, 15 bp, Artificial Sequence
  dgRNA
  Gtf3c3
ctagctggtagttta

SEQ ID NO: 33753 - DNA, 15 bp, Artificial Sequence
  dgRNA
  Gtf3c3
tagtttaagggagtc

SEQ ID NO: 33754 - DNA, 15 bp, Artificial Sequence
  dgRNA
  Gtf3c3
acactcccttgcctg

SEQ ID NO: 33755 - DNA, 15 bp, Artificial Sequence
  dgRNA
  Gtf3c3
tggggcctagagcgc

SEQ ID NO: 33756 - DNA, 15 bp, Artificial Sequence
  dgRNA
  Fbxl16
cgcaccgggagcgcg

SEQ ID NO: 33757 - DNA, 15 bp, Artificial Sequence
  dgRNA
  Fbxl16
gcgcgcggagaggag

SEQ ID NO: 33758 - DNA, 15 bp, Artificial Sequence
  dgRNA
  Fbxl16
cgcgcggagaggagc

SEQ ID NO: 33759 - DNA, 15 bp, Artificial Sequence
  dgRNA
  Fbxl16
gcgcggagaggagcg

SEQ ID NO: 33760 - DNA, 15 bp, Artificial Sequence
  dgRNA
  Nox3
tgaagcatgtcagct

SEQ ID NO: 33761 - DNA, 15 bp, Artificial Sequence
  dgRNA
  Nox3
ttggtgatacgctct

SEQ ID NO: 33762 - DNA, 15 bp, Artificial Sequence
  dgRNA
  Nox3
tacatcactttgtct

SEQ ID NO: 33763 - DNA, 15 bp, Artificial Sequence
  dgRNA
  Pcdhga5
aataactaaacgaag

SEQ ID NO: 33764 - DNA, 15 bp, Artificial Sequence
  dgRNA
  Pcdhga5
ataactaaacgaaga

SEQ ID NO: 33765 - DNA, 15 bp, Artificial Sequence
  dgRNA
  Pcdhga5
aattggtgtagtaac

SEQ ID NO: 33766 - DNA, 15 bp, Artificial Sequence
  dgRNA
  Pcdhga5
gtgtagtaactggtt

SEQ ID NO: 33767 - DNA, 15 bp, Artificial Sequence
  dgRNA
  Galr1
accagagtggcagcg

SEQ ID NO: 33768 - DNA, 15 bp, Artificial Sequence
  dgRNA
  Galr1
gggcagcacgtagag

SEQ ID NO: 33769 - DNA, 15 bp, Artificial Sequence
  dgRNA
  Galr1
gggctgccacctatc

SEQ ID NO: 33770 - DNA, 15 bp, Artificial Sequence
  dgRNA
  Galr1
cctatccggctgaga

SEQ ID NO: 33771 - DNA, 15 bp, Artificial Sequence
  dgRNA
  Ghr
cctggatccccgagg

SEQ ID NO: 33772 - DNA, 15 bp, Artificial Sequence
  dgRNA
  Ghr
ggatccccgaggcgg

SEQ ID NO: 33773 - DNA, 15 bp, Artificial Sequence
  dgRNA
  Ghr
tccccgaggcggcgg

SEQ ID NO: 33774 - DNA, 15 bp, Artificial Sequence
  dgRNA
  Ghr
cacgagctgccaagc

SEQ ID NO: 33775 - DNA, 15 bp, Artificial Sequence
  dgRNA
  Tmem87b
gtcccgccccaatta

SEQ ID NO: 33776 - DNA, 15 bp, Artificial Sequence
  dgRNA
  Tmem87b
ccccaattaaggtct

SEQ ID NO: 33777 - DNA, 15 bp, Artificial Sequence
  dgRNA
  Tmem87b
cgccccctccgtggg

SEQ ID NO: 33778 - DNA, 15 bp, Artificial Sequence
  dgRNA
  Tmem87b
gccccctccgtgggc

SEQ ID NO: 33779 - DNA, 15 bp, Artificial Sequence
  dgRNA
  Usp6nl
atacgctgaagtctc

SEQ ID NO: 33780 - DNA, 15 bp, Artificial Sequence
  dgRNA
  Usp6nl
ctgttagctgccccc

SEQ ID NO: 33781 - DNA, 15 bp, Artificial Sequence
  dgRNA
  Usp6nl
gaactgtgcttgtgc

SEQ ID NO: 33782 - DNA, 15 bp, Artificial Sequence
  dgRNA
  Usp6nl
ttacacaccaaactg

SEQ ID NO: 33783 - DNA, 15 bp, Artificial Sequence
  dgRNA
  Brs3
agcctaattatccaa

SEQ ID NO: 33784 - DNA, 15 bp, Artificial Sequence
  dgRNA
  Brs3
acccaccctccaaag

SEQ ID NO: 33785 - DNA, 15 bp, Artificial Sequence
  dgRNA
  Brs3
gggtgggtagtcctt

SEQ ID NO: 33786 - DNA, 15 bp, Artificial Sequence
  dgRNA
  Brs3
tcccctttggagggt

SEQ ID NO: 33787 - DNA, 15 bp, Artificial Sequence
  dgRNA
  Ran
cctttcccgcccacg

SEQ ID NO: 33788 - DNA, 15 bp, Artificial Sequence
  dgRNA
  Ran
cgcccacgaggcccc

SEQ ID NO: 33789 - DNA, 15 bp, Artificial Sequence
  dgRNA
  Ran
acgaggcccctggct

SEQ ID NO: 33790 - DNA, 15 bp, Artificial Sequence
  dgRNA
  Ran
cgcccgcgtaacgcg

SEQ ID NO: 33791 - DNA, 15 bp, Artificial Sequence
  dgRNA
  Letm2
ttgttgccttccgcg

SEQ ID NO: 33792 - DNA, 15 bp, Artificial Sequence
  dgRNA
  Letm2
gcgcggctgccgtga

SEQ ID NO: 33793 - DNA, 15 bp, Artificial Sequence
  dgRNA
  Letm2
acgcgagccagtccc

SEQ ID NO: 33794 - DNA, 15 bp, Artificial Sequence
  dgRNA
  Letm2
ctcattggatggtag

SEQ ID NO: 33795 - DNA, 15 bp, Artificial Sequence
  dgRNA
  Cd34
tttgaccctgccgag

SEQ ID NO: 33796 - DNA, 15 bp, Artificial Sequence
  dgRNA
  Cd34
agtaggaactacgag

SEQ ID NO: 33797 - DNA, 15 bp, Artificial Sequence
  dgRNA
  Cd34
gtaggaactacgaga

SEQ ID NO: 33798 - DNA, 15 bp, Artificial Sequence
  dgRNA
  Cd34
taggaactacgagag

SEQ ID NO: 33799 - DNA, 15 bp, Artificial Sequence
  dgRNA
  Nrsn1
caatccctaatcttt

SEQ ID NO: 33800 - DNA, 15 bp, Artificial Sequence
  dgRNA
  Nrsn1
aaacagtgagcgagc

SEQ ID NO: 33801 - DNA, 15 bp, Artificial Sequence
  dgRNA
  Nrsn1
cgagctggtgcccaa

SEQ ID NO: 33802 - DNA, 15 bp, Artificial Sequence
  dgRNA
  Nrsn1
gtgcccaacggtgcc

SEQ ID NO: 33803 - DNA, 15 bp, Artificial Sequence
  dgRNA
  Olfr948
aaaagtgactctaac

SEQ ID NO: 33804 - DNA, 15 bp, Artificial Sequence
  dgRNA
  Olfr948
gtctctaagttgaga

SEQ ID NO: 33805 - DNA, 15 bp, Artificial Sequence
  dgRNA
  Olfr948
ccaattagatcctga

SEQ ID NO: 33806 - DNA, 15 bp, Artificial Sequence
  dgRNA
  Pqlc3
acagaaccaccgccc

SEQ ID NO: 33807 - DNA, 15 bp, Artificial Sequence
  dgRNA
  Pqlc3
caccgccctggagtc

SEQ ID NO: 33808 - DNA, 15 bp, Artificial Sequence
  dgRNA
  Pqlc3
aagccaactccgagc

SEQ ID NO: 33809 - DNA, 15 bp, Artificial Sequence
  dgRNA
  Pqlc3
agccaactccgagct

SEQ ID NO: 33810 - DNA, 15 bp, Artificial Sequence
  dgRNA
  Zcchc6
ggcgacggatctcgc

SEQ ID NO: 33811 - DNA, 15 bp, Artificial Sequence
  dgRNA
  Zcchc6
atctcgcaggtagct

SEQ ID NO: 33812 - DNA, 15 bp, Artificial Sequence
  dgRNA
  Zcchc6
tctcgcaggtagcta

SEQ ID NO: 33813 - DNA, 15 bp, Artificial Sequence
  dgRNA
  Zcchc6
ctgcgcccgcacccg

SEQ ID NO: 33814 - DNA, 15 bp, Artificial Sequence
  dgRNA
  Frmd4a
gctgtaggcagatta

SEQ ID NO: 33815 - DNA, 15 bp, Artificial Sequence
  dgRNA
  Defb11
agcaatacatgcttg

SEQ ID NO: 33816 - DNA, 15 bp, Artificial Sequence
  dgRNA
  Rpa1
actaggcctcgaacc

SEQ ID NO: 33817 - DNA, 15 bp, Artificial Sequence
  dgRNA
  Rpa1
cctcgaacccggcct

SEQ ID NO: 33818 - DNA, 15 bp, Artificial Sequence
  dgRNA
  Rpa1
gctctgcctgccgcg

SEQ ID NO: 33819 - DNA, 15 bp, Artificial Sequence
  dgRNA
  Rpa1
gcgcggtagccaatg

SEQ ID NO: 33820 - DNA, 15 bp, Artificial Sequence
  dgRNA
  Ahi1
gcagtaacgaacact

SEQ ID NO: 33821 - DNA, 15 bp, Artificial Sequence
  dgRNA
  Ahi1
tccacatgcgataaa

SEQ ID NO: 33822 - DNA, 15 bp, Artificial Sequence
  dgRNA
  Ahi1
caagattagccctca

SEQ ID NO: 33823 - DNA, 15 bp, Artificial Sequence
  dgRNA
  Ahi1
cacagtaggatccat

SEQ ID NO: 33824 - DNA, 15 bp, Artificial Sequence
  dgRNA
  Olfr649
gctcttaatggtaat

SEQ ID NO: 33825 - DNA, 15 bp, Artificial Sequence
  dgRNA
  Olfr649
tacacgcttgatttt

SEQ ID NO: 33826 - DNA, 15 bp, Artificial Sequence
  dgRNA
  Olfr649
gcaatactcatgggc

SEQ ID NO: 33827 - DNA, 15 bp, Artificial Sequence
  dgRNA
  Olfr649
aaaatcaagcgtgta

SEQ ID NO: 33828 - DNA, 15 bp, Artificial Sequence
  dgRNA
  Kcnk13
ggtcgagagcctcga

SEQ ID NO: 33829 - DNA, 15 bp, Artificial Sequence
  dgRNA
  Kcnk13
ggttgcttaacagat

SEQ ID NO: 33830 - DNA, 15 bp, Artificial Sequence
  dgRNA
  Atp6v0a4
gacactagtctacgt

SEQ ID NO: 33831 - DNA, 15 bp, Artificial Sequence
  dgRNA
  Atp6v0a4
ctagtctacgttggc

SEQ ID NO: 33832 - DNA, 15 bp, Artificial Sequence
  dgRNA
  Atp6v0a4
agttaatcattcctt

SEQ ID NO: 33833 - DNA, 15 bp, Artificial Sequence
  dgRNA
  Atp6v0a4
attactggttttggc

SEQ ID NO: 33834 - DNA, 15 bp, Artificial Sequence
  dgRNA
  Mtus2
taggtcagcgacctc

SEQ ID NO: 33835 - DNA, 15 bp, Artificial Sequence
  dgRNA
  Mtus2
tgctccggaccactg

SEQ ID NO: 33836 - DNA, 15 bp, Artificial Sequence
  dgRNA
  Mtus2
ggtcccgtgagctgc

SEQ ID NO: 33837 - DNA, 15 bp, Artificial Sequence
  dgRNA
  Mtus2
gtcccgtgagctgcc

SEQ ID NO: 33838 - DNA, 15 bp, Artificial Sequence
  dgRNA
  Gtf2h3
ccagtgcggaggccg

SEQ ID NO: 33839 - DNA, 15 bp, Artificial Sequence
  dgRNA
  Gtf2h3
gagcgacttcccgca

SEQ ID NO: 33840 - DNA, 15 bp, Artificial Sequence
  dgRNA
  Gtf2h3
cagttccgtcgtctc

SEQ ID NO: 33841 - DNA, 15 bp, Artificial Sequence
  dgRNA
  Gtf2h3
cgtctccggcgtgcg

SEQ ID NO: 33842 - DNA, 15 bp, Artificial Sequence
  dgRNA
  Awat1
gtcatccagtctaag

SEQ ID NO: 33843 - DNA, 15 bp, Artificial Sequence
  dgRNA
  Awat1
gactatgaggacatc

SEQ ID NO: 33844 - DNA, 15 bp, Artificial Sequence
  dgRNA
  Gm20604
tcccactccacccat

SEQ ID NO: 33845 - DNA, 15 bp, Artificial Sequence
  dgRNA
  Gm20604
actctctcgttcaaa

SEQ ID NO: 33846 - DNA, 15 bp, Artificial Sequence
  dgRNA
  Gm20604
gctaactatgcccat

SEQ ID NO: 33847 - DNA, 15 bp, Artificial Sequence
  dgRNA
  Gm20604
ggctaactatgccca

SEQ ID NO: 33848 - DNA, 15 bp, Artificial Sequence
  dgRNA
  Bloc1s3
ctgctcccgagtctt

SEQ ID NO: 33849 - DNA, 15 bp, Artificial Sequence
  dgRNA
  Bloc1s3
cttcggacatccaat

SEQ ID NO: 33850 - DNA, 15 bp, Artificial Sequence
  dgRNA
  Bloc1s3
aatttacgcgtcaaa

SEQ ID NO: 33851 - DNA, 15 bp, Artificial Sequence
  dgRNA
  Bloc1s3
taaccgctttcctat

SEQ ID NO: 33852 - DNA, 15 bp, Artificial Sequence
  dgRNA
  B3gntl1
tgctcccgccgagaa

SEQ ID NO: 33853 - DNA, 15 bp, Artificial Sequence
  dgRNA
  B3gntl1
tcccgccgagaacgg

SEQ ID NO: 33854 - DNA, 15 bp, Artificial Sequence
  dgRNA
  B3gntl1
ccagagaacaccgac

SEQ ID NO: 33855 - DNA, 15 bp, Artificial Sequence
  dgRNA
  B3gntl1
gagcattctgctcga

SEQ ID NO: 33856 - DNA, 15 bp, Artificial Sequence
  dgRNA
  Rragc
ctgccgctgctagtc

SEQ ID NO: 33857 - DNA, 15 bp, Artificial Sequence
  dgRNA
  Rragc
tagtcaggtgattcc

SEQ ID NO: 33858 - DNA, 15 bp, Artificial Sequence
  dgRNA
  Rragc
taataaaccgaagct

SEQ ID NO: 33859 - DNA, 15 bp, Artificial Sequence
  dgRNA
  Rragc
taaaccgaagcttgg

SEQ ID NO: 33860 - DNA, 15 bp, Artificial Sequence
  dgRNA
  Tpd52
ccgcccgagccgacg

SEQ ID NO: 33861 - DNA, 15 bp, Artificial Sequence
  dgRNA
  Tpd52
cccgagccgacgtgg

SEQ ID NO: 33862 - DNA, 15 bp, Artificial Sequence
  dgRNA
  Tpd52
cgtggcggagcgcac

SEQ ID NO: 33863 - DNA, 15 bp, Artificial Sequence
  dgRNA
  Tpd52
ggagcgcacaggtcg

SEQ ID NO: 33864 - DNA, 15 bp, Artificial Sequence
  dgRNA
  Cnbd2
tggtagcgaaactgc

SEQ ID NO: 33865 - DNA, 15 bp, Artificial Sequence
  dgRNA
  Cnbd2
aactgccggaagcgc

SEQ ID NO: 33866 - DNA, 15 bp, Artificial Sequence
  dgRNA
  Cnbd2
ggaagcgctggcgaa

SEQ ID NO: 33867 - DNA, 15 bp, Artificial Sequence
  dgRNA
  Cnbd2
gctggcgaaaggtct

SEQ ID NO: 33868 - DNA, 15 bp, Artificial Sequence
  dgRNA
  Alg1
acctcgccttatcca

SEQ ID NO: 33869 - DNA, 15 bp, Artificial Sequence
  dgRNA
  Alg1
tcctccttcgtaaag

SEQ ID NO: 33870 - DNA, 15 bp, Artificial Sequence
  dgRNA
  Alg1
ataatcacctccccc

SEQ ID NO: 33871 - DNA, 15 bp, Artificial Sequence
  dgRNA
  Alg1
taatcacctccccct

SEQ ID NO: 33872 - DNA, 15 bp, Artificial Sequence
  dgRNA
  Ctage5
agcggttgcaatctt

SEQ ID NO: 33873 - DNA, 15 bp, Artificial Sequence
  dgRNA
  Ctage5
tttcctttccgattg

SEQ ID NO: 33874 - DNA, 15 bp, Artificial Sequence
  dgRNA
  Ctage5
ctgaaattggattac

SEQ ID NO: 33875 - DNA, 15 bp, Artificial Sequence
  dgRNA
  Ctage5
aattggattacgggt

SEQ ID NO: 33876 - DNA, 15 bp, Artificial Sequence
  dgRNA
  Aldh16a1
ccagcatccgcccat

SEQ ID NO: 33877 - DNA, 15 bp, Artificial Sequence
  dgRNA
  Aldh16a1
ataggccgcatcgcg

SEQ ID NO: 33878 - DNA, 15 bp, Artificial Sequence
  dgRNA
  Aldh16a1
gcgcggctctaaagt

SEQ ID NO: 33879 - DNA, 15 bp, Artificial Sequence
  dgRNA
  Aldh16a1
cggctctaaagtagg

SEQ ID NO: 33880 - DNA, 15 bp, Artificial Sequence
  dgRNA
  Lmnb1
gccacgcccagctcg

SEQ ID NO: 33881 - DNA, 15 bp, Artificial Sequence
  dgRNA
  Lmnb1
ggggctcgaggccga

SEQ ID NO: 33882 - DNA, 15 bp, Artificial Sequence
  dgRNA
  Lmnb1
gccgacggttgcccg

SEQ ID NO: 33883 - DNA, 15 bp, Artificial Sequence
  dgRNA
  Lmnb1
ccgacggttgcccga

SEQ ID NO: 33884 - DNA, 15 bp, Artificial Sequence
  dgRNA
  Susd3
agcgctgctgaacat

SEQ ID NO: 33885 - DNA, 15 bp, Artificial Sequence
  dgRNA
  Susd3
gcgctgctgaacatt

SEQ ID NO: 33886 - DNA, 15 bp, Artificial Sequence
  dgRNA
  Susd3
cgctgctgaacattg

SEQ ID NO: 33887 - DNA, 15 bp, Artificial Sequence
  dgRNA
  Susd3
cactgagccacacga

SEQ ID NO: 33888 - DNA, 15 bp, Artificial Sequence
  dgRNA
  Cd33
gtgtagcccaacatg

SEQ ID NO: 33889 - DNA, 15 bp, Artificial Sequence
  dgRNA
  Cd33
ccaatagcatatgtg

SEQ ID NO: 33890 - DNA, 15 bp, Artificial Sequence
  dgRNA
  Cd33
gcctgactttattac

SEQ ID NO: 33891 - DNA, 15 bp, Artificial Sequence
  dgRNA
  Cd33
cactttccacatgtt

SEQ ID NO: 33892 - DNA, 15 bp, Artificial Sequence
  dgRNA
  Olfr1469
attgtccatacccac

SEQ ID NO: 33893 - DNA, 15 bp, Artificial Sequence
  dgRNA
  Mybpc3
gatacctcagctgga

SEQ ID NO: 33894 - DNA, 15 bp, Artificial Sequence
  dgRNA
  Mybpc3
tctatatttagcagg

SEQ ID NO: 33895 - DNA, 15 bp, Artificial Sequence
  dgRNA
  Ceacam2
tctagaacaatgaac

SEQ ID NO: 33896 - DNA, 15 bp, Artificial Sequence
  dgRNA
  Ceacam2
caccccacgtgaatc

SEQ ID NO: 33897 - DNA, 15 bp, Artificial Sequence
  dgRNA
  Ceacam2
accccacgtgaatct

SEQ ID NO: 33898 - DNA, 15 bp, Artificial Sequence
  dgRNA
  Ceacam2
gattcacgtggggtg

SEQ ID NO: 33899 - DNA, 15 bp, Artificial Sequence
  dgRNA
  Foxred2
tgactcgcgccacag

SEQ ID NO: 33900 - DNA, 15 bp, Artificial Sequence
  dgRNA
  Coq3
gtaggtaggtcttcg

SEQ ID NO: 33901 - DNA, 15 bp, Artificial Sequence
  dgRNA
  Coq3
tcgtggccttttatt

SEQ ID NO: 33902 - DNA, 15 bp, Artificial Sequence
  dgRNA
  Coq3
gacataatttgatag

SEQ ID NO: 33903 - DNA, 15 bp, Artificial Sequence
  dgRNA
  Coq3
ggcatccgcgagtgt

SEQ ID NO: 33904 - DNA, 15 bp, Artificial Sequence
  dgRNA
  Hist1h2bb
ttgcccaattgtaga

SEQ ID NO: 33905 - DNA, 15 bp, Artificial Sequence
  dgRNA
  Hist1h2bb
tgcccaattgtagat

SEQ ID NO: 33906 - DNA, 15 bp, Artificial Sequence
  dgRNA
  Hist1h2bb
aatcccatctacaat

SEQ ID NO: 33907 - DNA, 15 bp, Artificial Sequence
  dgRNA
  Hist1h2bb
gaataatggcctcaa

SEQ ID NO: 33908 - DNA, 15 bp, Artificial Sequence
  dgRNA
  Ramp1
ccctccaagcccatc

SEQ ID NO: 33909 - DNA, 15 bp, Artificial Sequence
  dgRNA
  Ramp1
cgccctcgacagccg

SEQ ID NO: 33910 - DNA, 15 bp, Artificial Sequence
  dgRNA
  Ramp1
gccctcgacagccgc

SEQ ID NO: 33911 - DNA, 15 bp, Artificial Sequence
  dgRNA
  Ramp1
cgacagccgcgggcg

SEQ ID NO: 33912 - DNA, 15 bp, Artificial Sequence
  dgRNA
  Nat1
atctgtcactcgaca

SEQ ID NO: 33913 - DNA, 15 bp, Artificial Sequence
  dgRNA
  Nat1
caatagagaacatag

SEQ ID NO: 33914 - DNA, 15 bp, Artificial Sequence
  dgRNA
  Fam129c
ggggagtttaggcca

SEQ ID NO: 33915 - DNA, 15 bp, Artificial Sequence
  dgRNA
  Fam129c
acgccctggcacaga

SEQ ID NO: 33916 - DNA, 15 bp, Artificial Sequence
  dgRNA
  Fam129c
tctgtcaggggtagt

SEQ ID NO: 33917 - DNA, 15 bp, Artificial Sequence
  dgRNA
  Mllt4
gaggactcacgcctc

SEQ ID NO: 33918 - DNA, 15 bp, Artificial Sequence
  dgRNA
  Mllt4
gcgcgcgcgaccacg

SEQ ID NO: 33919 - DNA, 15 bp, Artificial Sequence
  dgRNA
  Mllt4
cgcggcagcacctag

SEQ ID NO: 33920 - DNA, 15 bp, Artificial Sequence
  dgRNA
  Mllt4
cagcacctagcggcg

SEQ ID NO: 33921 - DNA, 15 bp, Artificial Sequence
  dgRNA
  Ear10
cgtggaagtgagtgc

SEQ ID NO: 33922 - DNA, 15 bp, Artificial Sequence
  dgRNA
  Ear10
gctttgttgctcccg

SEQ ID NO: 33923 - DNA, 15 bp, Artificial Sequence
  dgRNA
  Ear10
cctatgtctacctga

SEQ ID NO: 33924 - DNA, 15 bp, Artificial Sequence
  dgRNA
  Traip
actgttttacgccac

SEQ ID NO: 33925 - DNA, 15 bp, Artificial Sequence
  dgRNA
  Traip
ctgttttacgccaca

SEQ ID NO: 33926 - DNA, 15 bp, Artificial Sequence
  dgRNA
  Traip
tgttttacgccacag

SEQ ID NO: 33927 - DNA, 15 bp, Artificial Sequence
  dgRNA
  Traip
gccacaggggatcgc

SEQ ID NO: 33928 - DNA, 15 bp, Artificial Sequence
  dgRNA
  Ces2b
actattccaggccat

SEQ ID NO: 33929 - DNA, 15 bp, Artificial Sequence
  dgRNA
  Ces2b
tccaacaactttgac

SEQ ID NO: 33930 - DNA, 15 bp, Artificial Sequence
  dgRNA
  Ces2b
ctcaactgggatacc

SEQ ID NO: 33931 - DNA, 15 bp, Artificial Sequence
  dgRNA
  Ces2b
tagttaacaagtgac

SEQ ID NO: 33932 - DNA, 15 bp, Artificial Sequence
  dgRNA
  Vmn1r32
gtactcctggaagta

SEQ ID NO: 33933 - DNA, 15 bp, Artificial Sequence
  dgRNA
  Vmn1r32
tgacaccatagctat

SEQ ID NO: 33934 - DNA, 15 bp, Artificial Sequence
  dgRNA
  Vmn1r32
tagctatgggtctag

SEQ ID NO: 33935 - DNA, 15 bp, Artificial Sequence
  dgRNA
  Vmn1r32
tatgggtctagaggg

SEQ ID NO: 33936 - DNA, 15 bp, Artificial Sequence
  dgRNA
  Rnf125
gtttccaaacttgga

SEQ ID NO: 33937 - DNA, 15 bp, Artificial Sequence
  dgRNA
  Rnf125
cgccccctacttcac

SEQ ID NO: 33938 - DNA, 15 bp, Artificial Sequence
  dgRNA
  Rnf125
cggtactgatcatct

SEQ ID NO: 33939 - DNA, 15 bp, Artificial Sequence
  dgRNA
  Rnf125
atttcggaactcggg

SEQ ID NO: 33940 - DNA, 15 bp, Artificial Sequence
  dgRNA
  Dsel
cccactggcagtgcg

SEQ ID NO: 33941 - DNA, 15 bp, Artificial Sequence
  dgRNA
  Dsel
ccactggcagtgcgc

SEQ ID NO: 33942 - DNA, 15 bp, Artificial Sequence
  dgRNA
  Dsel
ctggcagtgcgcggg

SEQ ID NO: 33943 - DNA, 15 bp, Artificial Sequence
  dgRNA
  Dsel
gtgcgcgggcggctc

SEQ ID NO: 33944 - DNA, 15 bp, Artificial Sequence
  dgRNA
  Ddr1
gctgtaccccagcat

SEQ ID NO: 33945 - DNA, 15 bp, Artificial Sequence
  dgRNA
  Ddr1
cagcatcggggtggc

SEQ ID NO: 33946 - DNA, 15 bp, Artificial Sequence
  dgRNA
  Ddr1
agcatcggggtggcg

SEQ ID NO: 33947 - DNA, 15 bp, Artificial Sequence
  dgRNA
  Ddr1
gcatcggggtggcgg

SEQ ID NO: 33948 - DNA, 15 bp, Artificial Sequence
  dgRNA
  Marcksl1
atctcccggaccgac

SEQ ID NO: 33949 - DNA, 15 bp, Artificial Sequence
  dgRNA
  Marcksl1
tctcccggaccgacc

SEQ ID NO: 33950 - DNA, 15 bp, Artificial Sequence
  dgRNA
  Marcksl1
aaccctacttgcccc

SEQ ID NO: 33951 - DNA, 15 bp, Artificial Sequence
  dgRNA
  Marcksl1
ggtcgtcccaagtga

SEQ ID NO: 33952 - DNA, 15 bp, Artificial Sequence
  dgRNA
  Tnfrsf18
cgagtttgctggagt

SEQ ID NO: 33953 - DNA, 15 bp, Artificial Sequence
  dgRNA
  Tnfrsf18
atgtctgccggaaac

SEQ ID NO: 33954 - DNA, 15 bp, Artificial Sequence
  dgRNA
  Tnfrsf18
tctgccggaaactgg

SEQ ID NO: 33955 - DNA, 15 bp, Artificial Sequence
  dgRNA
  Tnfrsf18
gagctatcccctttc

SEQ ID NO: 33956 - DNA, 15 bp, Artificial Sequence
  dgRNA
  Mfsd3
aacctgcttaacatt

SEQ ID NO: 33957 - DNA, 15 bp, Artificial Sequence
  dgRNA
  Mfsd3
acctgcttaacattt

SEQ ID NO: 33958 - DNA, 15 bp, Artificial Sequence
  dgRNA
  Mfsd3
gttttaggccaattg

SEQ ID NO: 33959 - DNA, 15 bp, Artificial Sequence
  dgRNA
  Mfsd3
caattgaggactagt

SEQ ID NO: 33960 - DNA, 15 bp, Artificial Sequence
  dgRNA
  Akr1a1
gtcaaactttgtatc

SEQ ID NO: 33961 - DNA, 15 bp, Artificial Sequence
  dgRNA
  Akr1a1
tgtatcaggcccgct

SEQ ID NO: 33962 - DNA, 15 bp, Artificial Sequence
  dgRNA
  Akr1a1
gtatcaggcccgctc

SEQ ID NO: 33963 - DNA, 15 bp, Artificial Sequence
  dgRNA
  Akr1a1
tatcaggcccgctcg

SEQ ID NO: 33964 - DNA, 15 bp, Artificial Sequence
  dgRNA
  Vmn1r217
gaaaaacttgtttcg

SEQ ID NO: 33965 - DNA, 15 bp, Artificial Sequence
  dgRNA
  Ak7
tgggctctcacgctg

SEQ ID NO: 33966 - DNA, 15 bp, Artificial Sequence
  dgRNA
  Ak7
agcagagcgtcctac

SEQ ID NO: 33967 - DNA, 15 bp, Artificial Sequence
  dgRNA
  Ak7
caggagatgtgccga

SEQ ID NO: 33968 - DNA, 15 bp, Artificial Sequence
  dgRNA
  Ak7
tcagccccgcccttt

SEQ ID NO: 33969 - DNA, 15 bp, Artificial Sequence
  dgRNA
  Tnfsfm13
ctgcctgcacgcgcc

SEQ ID NO: 33970 - DNA, 15 bp, Artificial Sequence
  dgRNA
  Tnfsfm13
tgcctgcacgcgccc

SEQ ID NO: 33971 - DNA, 15 bp, Artificial Sequence
  dgRNA
  Tnfsfm13
cacgcgcccgggcgc

SEQ ID NO: 33972 - DNA, 15 bp, Artificial Sequence
  dgRNA
  Tnfsfm13
cttgcacagcactcc

SEQ ID NO: 33973 - DNA, 15 bp, Artificial Sequence
  dgRNA
  4933434E20Rik
tcggcttcctcttac

SEQ ID NO: 33974 - DNA, 15 bp, Artificial Sequence
  dgRNA
  4933434E20Rik
cgtctccgcactccc

SEQ ID NO: 33975 - DNA, 15 bp, Artificial Sequence
  dgRNA
  4933434E20Rik
gcacgctgacgtgcg

SEQ ID NO: 33976 - DNA, 15 bp, Artificial Sequence
  dgRNA
  4933434E20Rik
tgtttcgtggcgggg

SEQ ID NO: 33977 - DNA, 15 bp, Artificial Sequence
  dgRNA
  Fxyd5
cctcagatcctcgag

SEQ ID NO: 33978 - DNA, 15 bp, Artificial Sequence
  dgRNA
  Fxyd5
cagatcctcgagtgg

SEQ ID NO: 33979 - DNA, 15 bp, Artificial Sequence
  dgRNA
  Fxyd5
atgactgggacgctc

SEQ ID NO: 33980 - DNA, 15 bp, Artificial Sequence
  dgRNA
  Fxyd5
gtccgcgcccgcccg

SEQ ID NO: 33981 - DNA, 15 bp, Artificial Sequence
  dgRNA
  Themis
ccaacctcattactt

SEQ ID NO: 33982 - DNA, 15 bp, Artificial Sequence
  dgRNA
  Themis
caacctcattacttt

SEQ ID NO: 33983 - DNA, 15 bp, Artificial Sequence
  dgRNA
  Themis
aggttggcaagttgc

SEQ ID NO: 33984 - DNA, 15 bp, Artificial Sequence
  dgRNA
  Themis
ctacccaaagtaatg

SEQ ID NO: 33985 - DNA, 15 bp, Artificial Sequence
  dgRNA
  Pigq
agttactgcgttgtt

SEQ ID NO: 33986 - DNA, 15 bp, Artificial Sequence
  dgRNA
  Pigq
gttactgcgttgtta

SEQ ID NO: 33987 - DNA, 15 bp, Artificial Sequence
  dgRNA
  Pigq
ttactgcgttgttag

SEQ ID NO: 33988 - DNA, 15 bp, Artificial Sequence
  dgRNA
  Pigq
actatgcggcccaca

SEQ ID NO: 33989 - DNA, 15 bp, Artificial Sequence
  dgRNA
  Abca5
cgcgctcacctccgc

SEQ ID NO: 33990 - DNA, 15 bp, Artificial Sequence
  dgRNA
  Abca5
cccgtctcgagctcc

SEQ ID NO: 33991 - DNA, 15 bp, Artificial Sequence
  dgRNA
  Abca5
gcacgccccgccctc

SEQ ID NO: 33992 - DNA, 15 bp, Artificial Sequence
  dgRNA
  Abca5
cctcaggtgcattca

SEQ ID NO: 33993 - DNA, 15 bp, Artificial Sequence
  dgRNA
  Camk2d
cactctgtcgccccg

SEQ ID NO: 33994 - DNA, 15 bp, Artificial Sequence
  dgRNA
  Camk2d
actctgtcgccccgc

SEQ ID NO: 33995 - DNA, 15 bp, Artificial Sequence
  dgRNA
  Camk2d
agccttgcggccccg

SEQ ID NO: 33996 - DNA, 15 bp, Artificial Sequence
  dgRNA
  Camk2d
tgcggccccgtggag

SEQ ID NO: 33997 - DNA, 15 bp, Artificial Sequence
  dgRNA
  Oacyl
atctgtccgctttgc

SEQ ID NO: 33998 - DNA, 15 bp, Artificial Sequence
  dgRNA
  Oacyl
tgtccgctttgcagg

SEQ ID NO: 33999 - DNA, 15 bp, Artificial Sequence
  dgRNA
  Oacyl
tcttggcttgttaag

SEQ ID NO: 34000 - DNA, 15 bp, Artificial Sequence
  dgRNA
  Oacyl
tggatgtggcgccac

SEQ ID NO: 34001 - DNA, 15 bp, Artificial Sequence
  dgRNA
  Msmp
gatctggggaccacc

SEQ ID NO: 34002 - DNA, 15 bp, Artificial Sequence
  dgRNA
  Msmp
gttgaaggccccagg

SEQ ID NO: 34003 - DNA, 15 bp, Artificial Sequence
  dgRNA
  Msmp
aaggggcgctggact

SEQ ID NO: 34004 - DNA, 15 bp, Artificial Sequence
  dgRNA
  Msmp
gaaggggcgctggac

SEQ ID NO: 34005 - DNA, 15 bp, Artificial Sequence
  dgRNA
  Ndufs8
gggcccgcctcctac

SEQ ID NO: 34006 - DNA, 15 bp, Artificial Sequence
  dgRNA
  Ndufs8
gagaagctcgcccaa

SEQ ID NO: 34007 - DNA, 15 bp, Artificial Sequence
  dgRNA
  Ndufs8
ttaggctccgccttc

SEQ ID NO: 34008 - DNA, 15 bp, Artificial Sequence
  dgRNA
  Ndufs8
cggttgaaccgcatc

SEQ ID NO: 34009 - DNA, 15 bp, Artificial Sequence
  dgRNA
  Elmsan1
cagcaccgggaaccg

SEQ ID NO: 34010 - DNA, 15 bp, Artificial Sequence
  dgRNA
  Elmsan1
agcaccgggaaccga

SEQ ID NO: 34011 - DNA, 15 bp, Artificial Sequence
  dgRNA
  Elmsan1
cgggaaccgagggtc

SEQ ID NO: 34012 - DNA, 15 bp, Artificial Sequence
  dgRNA
  Elmsan1
aaccgagggtctggc

SEQ ID NO: 34013 - DNA, 15 bp, Artificial Sequence
  dgRNA
  Sh3glb1
tggctcgcagctgct

SEQ ID NO: 34014 - DNA, 15 bp, Artificial Sequence
  dgRNA
  Sh3glb1
gctcggcgacgcgac

SEQ ID NO: 34015 - DNA, 15 bp, Artificial Sequence
  dgRNA
  Sh3glb1
ggcccagcgtgtgag

SEQ ID NO: 34016 - DNA, 15 bp, Artificial Sequence
  dgRNA
  Sh3glb1
agcgtgtgagcggag

SEQ ID NO: 34017 - DNA, 15 bp, Artificial Sequence
  dgRNA
  Rps6ka3
cctgggtgcgcgcgg

SEQ ID NO: 34018 - DNA, 15 bp, Artificial Sequence
  dgRNA
  Rps6ka3
gggtgcgcgcggtgg

SEQ ID NO: 34019 - DNA, 15 bp, Artificial Sequence
  dgRNA
  Rps6ka3
tgcgcgcggtggtgg

SEQ ID NO: 34020 - DNA, 15 bp, Artificial Sequence
  dgRNA
  Rps6ka3
tcgctctagagagac

SEQ ID NO: 34021 - DNA, 15 bp, Artificial Sequence
  dgRNA
  Trim13
ggcaaagtggtgtga

SEQ ID NO: 34022 - DNA, 15 bp, Artificial Sequence
  dgRNA
  Trim13
tccaaactcggcgcg

SEQ ID NO: 34023 - DNA, 15 bp, Artificial Sequence
  dgRNA
  Trim13
ccaaactcggcgcgt

SEQ ID NO: 34024 - DNA, 15 bp, Artificial Sequence
  dgRNA
  Trim13
agagcacttatccag

SEQ ID NO: 34025 - DNA, 15 bp, Artificial Sequence
  dgRNA
  Smyd1
gaccacactagcttg

SEQ ID NO: 34026 - DNA, 15 bp, Artificial Sequence
  dgRNA
  Smyd1
aacgagacctttgta

SEQ ID NO: 34027 - DNA, 15 bp, Artificial Sequence
  dgRNA
  Smyd1
tatagtcctgctctt

SEQ ID NO: 34028 - DNA, 15 bp, Artificial Sequence
  dgRNA
  Smyd1
atagtcctgctcttt

SEQ ID NO: 34029 - DNA, 15 bp, Artificial Sequence
  dgRNA
  Timd4
acacatcccagattg

SEQ ID NO: 34030 - DNA, 15 bp, Artificial Sequence
  dgRNA
  Timd4
aacgggaagattgtg

SEQ ID NO: 34031 - DNA, 15 bp, Artificial Sequence
  dgRNA
  Timd4
gattgtgcggcagaa

SEQ ID NO: 34032 - DNA, 15 bp, Artificial Sequence
  dgRNA
  Timd4
attgtgcggcagaaa

SEQ ID NO: 34033 - DNA, 15 bp, Artificial Sequence
  dgRNA
  Olfr441
gtgcatcacataggg

SEQ ID NO: 34034 - DNA, 15 bp, Artificial Sequence
  dgRNA
  Olfr441
gtagtgcatcacata

SEQ ID NO: 34035 - DNA, 15 bp, Artificial Sequence
  dgRNA
  Olfr441
tgtagtgcatcacat

SEQ ID NO: 34036 - DNA, 15 bp, Artificial Sequence
  dgRNA
  Mpv17l2
cgtgttcggcgtgag

SEQ ID NO: 34037 - DNA, 15 bp, Artificial Sequence
  dgRNA
  Mpv17l2
ctgccgcaacgcttg

SEQ ID NO: 34038 - DNA, 15 bp, Artificial Sequence
  dgRNA
  Mpv17l2
acgcttgaggacgat

SEQ ID NO: 34039 - DNA, 15 bp, Artificial Sequence
  dgRNA
  Mpv17l2
tggtccgttctgaat

SEQ ID NO: 34040 - DNA, 15 bp, Artificial Sequence
  dgRNA
  Ephb6
gcccgccaggacctg

SEQ ID NO: 34041 - DNA, 15 bp, Artificial Sequence
  dgRNA
  Ephb6
gccaggacctgcggg

SEQ ID NO: 34042 - DNA, 15 bp, Artificial Sequence
  dgRNA
  Ephb6
gaggccgaccctcct

SEQ ID NO: 34043 - DNA, 15 bp, Artificial Sequence
  dgRNA
  Ephb6
accctcctcggcaca

SEQ ID NO: 34044 - DNA, 15 bp, Artificial Sequence
  dgRNA
  Tex10
cctgactcggcttgc

SEQ ID NO: 34045 - DNA, 15 bp, Artificial Sequence
  dgRNA
  Tex10
cgcagcccctcttag

SEQ ID NO: 34046 - DNA, 15 bp, Artificial Sequence
  dgRNA
  Tex10
cgtggcgtgcaaatc

SEQ ID NO: 34047 - DNA, 15 bp, Artificial Sequence
  dgRNA
  Tex10
tctggacccgccctc

SEQ ID NO: 34048 - DNA, 15 bp, Artificial Sequence
  dgRNA
  Uggt2
gtagattggcatgga

SEQ ID NO: 34049 - DNA, 15 bp, Artificial Sequence
  dgRNA
  Uggt2
gttccccagacccgg

SEQ ID NO: 34050 - DNA, 15 bp, Artificial Sequence
  dgRNA
  Uggt2
ccccagacccggcgg

SEQ ID NO: 34051 - DNA, 15 bp, Artificial Sequence
  dgRNA
  Uggt2
ctccgaaaatcctcg

SEQ ID NO: 34052 - DNA, 15 bp, Artificial Sequence
  dgRNA
  Fetub
tactgggcggctcct

SEQ ID NO: 34053 - DNA, 15 bp, Artificial Sequence
  dgRNA
  Fetub
ctctaattcatagtt

SEQ ID NO: 34054 - DNA, 15 bp, Artificial Sequence
  dgRNA
  Fetub
gcagggtattattcc

SEQ ID NO: 34055 - DNA, 15 bp, Artificial Sequence
  dgRNA
  Fetub
ttccgtgtctttcca

SEQ ID NO: 34056 - DNA, 15 bp, Artificial Sequence
  dgRNA
  Tnfaip8
ccacttctcccgcgc

SEQ ID NO: 34057 - DNA, 15 bp, Artificial Sequence
  dgRNA
  Tnfaip8
cacttctcccgcgct

SEQ ID NO: 34058 - DNA, 15 bp, Artificial Sequence
  dgRNA
  Tnfaip8
acttctcccgcgctg

SEQ ID NO: 34059 - DNA, 15 bp, Artificial Sequence
  dgRNA
  Tnfaip8
gcgctggggcccgcc

SEQ ID NO: 34060 - DNA, 15 bp, Artificial Sequence
  dgRNA
  Slit2
agtctgggcgcgagc

SEQ ID NO: 34061 - DNA, 15 bp, Artificial Sequence
  dgRNA
  Slit2
tctgggcgcgagcag

SEQ ID NO: 34062 - DNA, 15 bp, Artificial Sequence
  dgRNA
  Slit2
gcgagcaggggcgta

SEQ ID NO: 34063 - DNA, 15 bp, Artificial Sequence
  dgRNA
  Slit2
cgagcaggggcgtac

SEQ ID NO: 34064 - DNA, 15 bp, Artificial Sequence
  dgRNA
  Otx2
ttctggtagtgtcgg

SEQ ID NO: 34065 - DNA, 15 bp, Artificial Sequence
  dgRNA
  Otx2
gtagtgtcggaggcc

SEQ ID NO: 34066 - DNA, 15 bp, Artificial Sequence
  dgRNA
  Otx2
ccccccgtgcagcag

SEQ ID NO: 34067 - DNA, 15 bp, Artificial Sequence
  dgRNA
  Otx2
cgttctttaaaacac

SEQ ID NO: 34068 - DNA, 15 bp, Artificial Sequence
  dgRNA
  Svil
acttgctagcagagt

SEQ ID NO: 34069 - DNA, 15 bp, Artificial Sequence
  dgRNA
  Svil
agctgaaaacaaacg

SEQ ID NO: 34070 - DNA, 15 bp, Artificial Sequence
  dgRNA
  Svil
gctgaaaacaaacga

SEQ ID NO: 34071 - DNA, 15 bp, Artificial Sequence
  dgRNA
  Svil
cattgctggagcgaa

SEQ ID NO: 34072 - DNA, 15 bp, Artificial Sequence
  dgRNA
  Tex24
gatagtaggtagaag

SEQ ID NO: 34073 - DNA, 15 bp, Artificial Sequence
  dgRNA
  Tff3
tccccaacttaggac

SEQ ID NO: 34074 - DNA, 15 bp, Artificial Sequence
  dgRNA
  Tff3
ccccaacttaggact

SEQ ID NO: 34075 - DNA, 15 bp, Artificial Sequence
  dgRNA
  Tff3
cccaacttaggactg

SEQ ID NO: 34076 - DNA, 15 bp, Artificial Sequence
  dgRNA
  Tff3
cccagtcctaagttg

SEQ ID NO: 34077 - DNA, 15 bp, Artificial Sequence
  dgRNA
  Vmn1r172
tcttacaggataatt

SEQ ID NO: 34078 - DNA, 15 bp, Artificial Sequence
  dgRNA
  Vmn1r172
ttactgaacgcgacc

SEQ ID NO: 34079 - DNA, 15 bp, Artificial Sequence
  dgRNA
  C8b
ctaaccctgagcatt

SEQ ID NO: 34080 - DNA, 15 bp, Artificial Sequence
  dgRNA
  C8b
ctttccgaagtactc

SEQ ID NO: 34081 - DNA, 15 bp, Artificial Sequence
  dgRNA
  C8b
cgaagtactcaggta

SEQ ID NO: 34082 - DNA, 15 bp, Artificial Sequence
  dgRNA
  C8b
gtaaggctgcttcca

SEQ ID NO: 34083 - DNA, 15 bp, Artificial Sequence
  dgRNA
  Ccdc63
ggtcaccatattttc

SEQ ID NO: 34084 - DNA, 15 bp, Artificial Sequence
  dgRNA
  Ccdc63
ctgtagaaccccagg

SEQ ID NO: 34085 - DNA, 15 bp, Artificial Sequence
  dgRNA
  Ccdc63
gtcaacagagtcttc

SEQ ID NO: 34086 - DNA, 15 bp, Artificial Sequence
  dgRNA
  Ccdc63
gtgacaagtggaacc

SEQ ID NO: 34087 - DNA, 15 bp, Artificial Sequence
  dgRNA
  Trim32
ttagactctgaaacg

SEQ ID NO: 34088 - DNA, 15 bp, Artificial Sequence
  dgRNA
  Trim32
cctatctattcagct

SEQ ID NO: 34089 - DNA, 15 bp, Artificial Sequence
  dgRNA
  Trim32
tattcagctgggccg

SEQ ID NO: 34090 - DNA, 15 bp, Artificial Sequence
  dgRNA
  Trim32
attcagctgggccgc

SEQ ID NO: 34091 - DNA, 15 bp, Artificial Sequence
  dgRNA
  Zbtb11
ttgacgtcacaccgc

SEQ ID NO: 34092 - DNA, 15 bp, Artificial Sequence
  dgRNA
  Zbtb11
acaccgccggctccc

SEQ ID NO: 34093 - DNA, 15 bp, Artificial Sequence
  dgRNA
  Zbtb11
gtagcgcgctccaat

SEQ ID NO: 34094 - DNA, 15 bp, Artificial Sequence
  dgRNA
  Zbtb11
tagcgcgctccaatc

SEQ ID NO: 34095 - DNA, 15 bp, Artificial Sequence
  dgRNA
  Rufy4
ggtccagcccccttc

SEQ ID NO: 34096 - DNA, 15 bp, Artificial Sequence
  dgRNA
  Rufy4
tggcatgaggccagt

SEQ ID NO: 34097 - DNA, 15 bp, Artificial Sequence
  dgRNA
  Rnf4
caaagtggtaataga

SEQ ID NO: 34098 - DNA, 15 bp, Artificial Sequence
  dgRNA
  Rnf4
taaaccggtagagca

SEQ ID NO: 34099 - DNA, 15 bp, Artificial Sequence
  dgRNA
  Rnf4
aaaccggtagagcac

SEQ ID NO: 34100 - DNA, 15 bp, Artificial Sequence
  dgRNA
  Rnf4
ctctaccggtttagg

SEQ ID NO: 34101 - DNA, 15 bp, Artificial Sequence
  dgRNA
  2010107G12Rik
aggagattaatctcg

SEQ ID NO: 34102 - DNA, 15 bp, Artificial Sequence
  dgRNA
  2010107G12Rik
ggagattaatctcga

SEQ ID NO: 34103 - DNA, 15 bp, Artificial Sequence
  dgRNA
  2010107G12Rik
gattaatctcgaggg

SEQ ID NO: 34104 - DNA, 15 bp, Artificial Sequence
  dgRNA
  2010107G12Rik
attaatctcgagggc

SEQ ID NO: 34105 - DNA, 15 bp, Artificial Sequence
  dgRNA
  Got2
cttggggaaactagt

SEQ ID NO: 34106 - DNA, 15 bp, Artificial Sequence
  dgRNA
  Got2
aactagtgggttgaa

SEQ ID NO: 34107 - DNA, 15 bp, Artificial Sequence
  dgRNA
  Got2
tcaaactggcacgct

SEQ ID NO: 34108 - DNA, 15 bp, Artificial Sequence
  dgRNA
  Got2
ctgcctctagcgtag

SEQ ID NO: 34109 - DNA, 15 bp, Artificial Sequence
  dgRNA
  Trappc9
tatctaagagtcaac

SEQ ID NO: 34110 - DNA, 15 bp, Artificial Sequence
  dgRNA
  Trappc9
atctaagagtcaaca

SEQ ID NO: 34111 - DNA, 15 bp, Artificial Sequence
  dgRNA
  Trappc9
aatgttaatccagcc

SEQ ID NO: 34112 - DNA, 15 bp, Artificial Sequence
  dgRNA
  Trappc9
cctggagtcggtgac

SEQ ID NO: 34113 - DNA, 15 bp, Artificial Sequence
  dgRNA
  Ano10
ccacccctctcccga

SEQ ID NO: 34114 - DNA, 15 bp, Artificial Sequence
  dgRNA
  Ano10
tccgccccccttcct

SEQ ID NO: 34115 - DNA, 15 bp, Artificial Sequence
  dgRNA
  Ano10
gacttacaactgtta

SEQ ID NO: 34116 - DNA, 15 bp, Artificial Sequence
  dgRNA
  Ano10
acgccgagtgacagc

SEQ ID NO: 34117 - DNA, 15 bp, Artificial Sequence
  dgRNA
  Polr2m
acccagacgccttgg

SEQ ID NO: 34118 - DNA, 15 bp, Artificial Sequence
  dgRNA
  Polr2m
ccctgcacgcttcct

SEQ ID NO: 34119 - DNA, 15 bp, Artificial Sequence
  dgRNA
  Polr2m
ggcgtcccctcgtcc

SEQ ID NO: 34120 - DNA, 15 bp, Artificial Sequence
  dgRNA
  Polr2m
tggcctgtccgtttc

SEQ ID NO: 34121 - DNA, 15 bp, Artificial Sequence
  dgRNA
  Ier3ip1
cttcggtcccctccc

SEQ ID NO: 34122 - DNA, 15 bp, Artificial Sequence
  dgRNA
  Ier3ip1
acaaactactaagcg

SEQ ID NO: 34123 - DNA, 15 bp, Artificial Sequence
  dgRNA
  Ier3ip1
caaactactaagcgc

SEQ ID NO: 34124 - DNA, 15 bp, Artificial Sequence
  dgRNA
  Ier3ip1
aaactactaagcgcg

SEQ ID NO: 34125 - DNA, 15 bp, Artificial Sequence
  dgRNA
  Prg3
ctggggcaatcaccc

SEQ ID NO: 34126 - DNA, 15 bp, Artificial Sequence
  dgRNA
  Prg3
tataagagctgattg

SEQ ID NO: 34127 - DNA, 15 bp, Artificial Sequence
  dgRNA
  Prg3
cacagccactgagcg

SEQ ID NO: 34128 - DNA, 15 bp, Artificial Sequence
  dgRNA
  Prg3
acctgtggccctaaa

SEQ ID NO: 34129 - DNA, 15 bp, Artificial Sequence
  dgRNA
  Surf4
ttccatggtatctcg

SEQ ID NO: 34130 - DNA, 15 bp, Artificial Sequence
  dgRNA
  Surf4
tcactgtcctactac

SEQ ID NO: 34131 - DNA, 15 bp, Artificial Sequence
  dgRNA
  Surf4
cactgtcctactacc

SEQ ID NO: 34132 - DNA, 15 bp, Artificial Sequence
  dgRNA
  Surf4
caaagccctcgagcc

SEQ ID NO: 34133 - DNA, 15 bp, Artificial Sequence
  dgRNA
  Tmem126a
catgcaacctacgcc

SEQ ID NO: 34134 - DNA, 15 bp, Artificial Sequence
  dgRNA
  Tmem126a
aacctacgccaggat

SEQ ID NO: 34135 - DNA, 15 bp, Artificial Sequence
  dgRNA
  Tmem126a
acctacgccaggatc

SEQ ID NO: 34136 - DNA, 15 bp, Artificial Sequence
  dgRNA
  Tmem126a
cctacgccaggatcg

SEQ ID NO: 34137 - DNA, 15 bp, Artificial Sequence
  dgRNA
  Cdh13
tgccgcctccttgct

SEQ ID NO: 34138 - DNA, 15 bp, Artificial Sequence
  dgRNA
  Cdh13
cgcctccttgctcgg

SEQ ID NO: 34139 - DNA, 15 bp, Artificial Sequence
  dgRNA
  Cdh13
gcctccttgctcgga

SEQ ID NO: 34140 - DNA, 15 bp, Artificial Sequence
  dgRNA
  Cdh13
cctccttgctcggag

SEQ ID NO: 34141 - DNA, 15 bp, Artificial Sequence
  dgRNA
  Lrsam1
ccgcccctcccctaa

SEQ ID NO: 34142 - DNA, 15 bp, Artificial Sequence
  dgRNA
  Lrsam1
ctcctaacctgtttg

SEQ ID NO: 34143 - DNA, 15 bp, Artificial Sequence
  dgRNA
  Lrsam1
tcaccgtcaagagaa

SEQ ID NO: 34144 - DNA, 15 bp, Artificial Sequence
  dgRNA
  Lrsam1
gtcaccgtcaagaga

SEQ ID NO: 34145 - DNA, 15 bp, Artificial Sequence
  dgRNA
  Chac1
gtctgccacgggagg

SEQ ID NO: 34146 - DNA, 15 bp, Artificial Sequence
  dgRNA
  Chac1
aatcagcacgcgcgt

SEQ ID NO: 34147 - DNA, 15 bp, Artificial Sequence
  dgRNA
  Chac1
cacgcgcgttggccc

SEQ ID NO: 34148 - DNA, 15 bp, Artificial Sequence
  dgRNA
  Chac1
acgcgcgttggccct

SEQ ID NO: 34149 - DNA, 15 bp, Artificial Sequence
  dgRNA
  Got1
aaaagcctcagcgat

SEQ ID NO: 34150 - DNA, 15 bp, Artificial Sequence
  dgRNA
  Got1
cggtgtacattgcat

SEQ ID NO: 34151 - DNA, 15 bp, Artificial Sequence
  dgRNA
  Got1
atcctcttctcgaat

SEQ ID NO: 34152 - DNA, 15 bp, Artificial Sequence
  dgRNA
  Got1
cgaattggctagtag

SEQ ID NO: 34153 - DNA, 15 bp, Artificial Sequence
  dgRNA
  Tgif1
cgagtgttccagtcg

SEQ ID NO: 34154 - DNA, 15 bp, Artificial Sequence
  dgRNA
  Tgif1
gttccagtcgtggac

SEQ ID NO: 34155 - DNA, 15 bp, Artificial Sequence
  dgRNA
  Tgif1
cagaagttaatcgct

SEQ ID NO: 34156 - DNA, 15 bp, Artificial Sequence
  dgRNA
  Tgif1
aatcgcttggagaag

SEQ ID NO: 34157 - DNA, 15 bp, Artificial Sequence
  dgRNA
  Sesn1
cggacactgctcccc

SEQ ID NO: 34158 - DNA, 15 bp, Artificial Sequence
  dgRNA
  Sesn1
gctcccccggagcac

SEQ ID NO: 34159 - DNA, 15 bp, Artificial Sequence
  dgRNA
  Sesn1
ggagcaccggagcct

SEQ ID NO: 34160 - DNA, 15 bp, Artificial Sequence
  dgRNA
  Sesn1
gagcaccggagcctc

SEQ ID NO: 34161 - DNA, 15 bp, Artificial Sequence
  dgRNA
  Pex11a
aaccaagacgggaga

SEQ ID NO: 34162 - DNA, 15 bp, Artificial Sequence
  dgRNA
  Pex11a
agtaactaccacttc

SEQ ID NO: 34163 - DNA, 15 bp, Artificial Sequence
  dgRNA
  Pex11a
acttccggtactaac

SEQ ID NO: 34164 - DNA, 15 bp, Artificial Sequence
  dgRNA
  Pex11a
aagccgcgtttccga

SEQ ID NO: 34165 - DNA, 15 bp, Artificial Sequence
  dgRNA
  0610011F06Rik
gtcaccgctaaatcc

SEQ ID NO: 34166 - DNA, 15 bp, Artificial Sequence
  dgRNA
  0610011F06Rik
ctaaatcccggccgc

SEQ ID NO: 34167 - DNA, 15 bp, Artificial Sequence
  dgRNA
  0610011F06Rik
ttatactgttgcaag

SEQ ID NO: 34168 - DNA, 15 bp, Artificial Sequence
  dgRNA
  0610011F06Rik
actgttgcaagcggc

SEQ ID NO: 34169 - DNA, 15 bp, Artificial Sequence
  dgRNA
  Tbl2
cacagcgcccgctaa

SEQ ID NO: 34170 - DNA, 15 bp, Artificial Sequence
  dgRNA
  Tbl2
cgcccgctaacggcc

SEQ ID NO: 34171 - DNA, 15 bp, Artificial Sequence
  dgRNA
  Tbl2
tgcagagcgctccaa

SEQ ID NO: 34172 - DNA, 15 bp, Artificial Sequence
  dgRNA
  Tbl2
agcgctccaacggcc

SEQ ID NO: 34173 - DNA, 15 bp, Artificial Sequence
  dgRNA
  Defb50
acgtgtccacagtat

SEQ ID NO: 34174 - DNA, 15 bp, Artificial Sequence
  dgRNA
  Defb50
gattagctcctccct

SEQ ID NO: 34175 - DNA, 15 bp, Artificial Sequence
  dgRNA
  Defb50
agatctccaatactg

SEQ ID NO: 34176 - DNA, 15 bp, Artificial Sequence
  dgRNA
  Defb50
gctaatctagattga

SEQ ID NO: 34177 - DNA, 15 bp, Artificial Sequence
  dgRNA
  Fam53b
tccccgggagtcgct

SEQ ID NO: 34178 - DNA, 15 bp, Artificial Sequence
  dgRNA
  Fam53b
tcggtacaaagcgct

SEQ ID NO: 34179 - DNA, 15 bp, Artificial Sequence
  dgRNA
  Fam53b
caaagcgctcggcgc

SEQ ID NO: 34180 - DNA, 15 bp, Artificial Sequence
  dgRNA
  Fam53b
cggagagcgtgcgca

SEQ ID NO: 34181 - DNA, 15 bp, Artificial Sequence
  dgRNA
  Krtap4-1
atgaggtgttcagcg

SEQ ID NO: 34182 - DNA, 15 bp, Artificial Sequence
  dgRNA
  Krtap4-1
tcagcgaggtataaa

SEQ ID NO: 34183 - DNA, 15 bp, Artificial Sequence
  dgRNA
  Krtap4-1
cagcgaggtataaaa

SEQ ID NO: 34184 - DNA, 15 bp, Artificial Sequence
  dgRNA
  Krtap4-1
agcgaggtataaaag

SEQ ID NO: 34185 - DNA, 15 bp, Artificial Sequence
  dgRNA
  Eif2b4
agtcgcggcctggcc

SEQ ID NO: 34186 - DNA, 15 bp, Artificial Sequence
  dgRNA
  Eif2b4
gtcgcggcctggccg

SEQ ID NO: 34187 - DNA, 15 bp, Artificial Sequence
  dgRNA
  Eif2b4
gaacctattggagct

SEQ ID NO: 34188 - DNA, 15 bp, Artificial Sequence
  dgRNA
  Eif2b4
aacctattggagctt

SEQ ID NO: 34189 - DNA, 15 bp, Artificial Sequence
  dgRNA
  Hk3
tcctatggctaatgg

SEQ ID NO: 34190 - DNA, 15 bp, Artificial Sequence
  dgRNA
  Hk3
ctttcgacttgtttc

SEQ ID NO: 34191 - DNA, 15 bp, Artificial Sequence
  dgRNA
  Hk3
cataggataagccga

SEQ ID NO: 34192 - DNA, 15 bp, Artificial Sequence
  dgRNA
  Hk3
ccataggataagccg

SEQ ID NO: 34193 - DNA, 15 bp, Artificial Sequence
  dgRNA
  Mmgt2
ctccttcccgccgcg

SEQ ID NO: 34194 - DNA, 15 bp, Artificial Sequence
  dgRNA
  Mmgt2
cccgccgcgcggctc

SEQ ID NO: 34195 - DNA, 15 bp, Artificial Sequence
  dgRNA
  Mmgt2
ccgccgcgcggctct

SEQ ID NO: 34196 - DNA, 15 bp, Artificial Sequence
  dgRNA
  Mmgt2
gcgcggctctgggct

SEQ ID NO: 34197 - DNA, 15 bp, Artificial Sequence
  dgRNA
  Gulp1
cgtctgaaataagaa

SEQ ID NO: 34198 - DNA, 15 bp, Artificial Sequence
  dgRNA
  Gulp1
gcataaatataagtg

SEQ ID NO: 34199 - DNA, 15 bp, Artificial Sequence
  dgRNA
  Olfr183
accctcaaagtctag

SEQ ID NO: 34200 - DNA, 15 bp, Artificial Sequence
  dgRNA
  Olfr183
acatttactgatacc

SEQ ID NO: 34201 - DNA, 15 bp, Artificial Sequence
  dgRNA
  Olfr183
agggtataagagtat

SEQ ID NO: 34202 - DNA, 15 bp, Artificial Sequence
  dgRNA
  Olfr183
tccactagactttga

SEQ ID NO: 34203 - DNA, 15 bp, Artificial Sequence
  dgRNA
  Sdr9c7
tcctgaaaggtctag

SEQ ID NO: 34204 - DNA, 15 bp, Artificial Sequence
  dgRNA
  Sdr9c7
gatattcatagtcat

SEQ ID NO: 34205 - DNA, 15 bp, Artificial Sequence
  dgRNA
  Sdr9c7
ggatattcatagtca

SEQ ID NO: 34206 - DNA, 15 bp, Artificial Sequence
  dgRNA
  Sdr9c7
agggatccaaaaatg

SEQ ID NO: 34207 - DNA, 15 bp, Artificial Sequence
  dgRNA
  Cldnd2
cgtgggtggctttcc

SEQ ID NO: 34208 - DNA, 15 bp, Artificial Sequence
  dgRNA
  Snx9
ccgccgctccagcca

SEQ ID NO: 34209 - DNA, 15 bp, Artificial Sequence
  dgRNA
  Snx9
ctgcgctcggagccg

SEQ ID NO: 34210 - DNA, 15 bp, Artificial Sequence
  dgRNA
  Snx9
tgcgctcggagccgc

SEQ ID NO: 34211 - DNA, 15 bp, Artificial Sequence
  dgRNA
  Snx9
gctcggagccgcggg

SEQ ID NO: 34212 - DNA, 15 bp, Artificial Sequence
  dgRNA
  Skap1
cccaggcgacagccg

SEQ ID NO: 34213 - DNA, 15 bp, Artificial Sequence
  dgRNA
  Skap1
cgacagccgaggtac

SEQ ID NO: 34214 - DNA, 15 bp, Artificial Sequence
  dgRNA
  Skap1
cgaggtacaggtgcc

SEQ ID NO: 34215 - DNA, 15 bp, Artificial Sequence
  dgRNA
  Skap1
ggctgtcgcctgggg

SEQ ID NO: 34216 - DNA, 15 bp, Artificial Sequence
  dgRNA
  F8a
gctacagcagagcgc

SEQ ID NO: 34217 - DNA, 15 bp, Artificial Sequence
  dgRNA
  F8a
ctacagcagagcgct

SEQ ID NO: 34218 - DNA, 15 bp, Artificial Sequence
  dgRNA
  F8a
gcgctggggcgcctg

SEQ ID NO: 34219 - DNA, 15 bp, Artificial Sequence
  dgRNA
  F8a
ctggggcgcctgagg

SEQ ID NO: 34220 - DNA, 15 bp, Artificial Sequence
  dgRNA
  Pkig
gcagtcgcgtcgcct

SEQ ID NO: 34221 - DNA, 15 bp, Artificial Sequence
  dgRNA
  Pkig
gcgtcgcctaggcaa

SEQ ID NO: 34222 - DNA, 15 bp, Artificial Sequence
  dgRNA
  Pkig
gcctaggcaacggct

SEQ ID NO: 34223 - DNA, 15 bp, Artificial Sequence
  dgRNA
  Pkig
gccgagccgttgcct

SEQ ID NO: 34224 - DNA, 15 bp, Artificial Sequence
  dgRNA
  Mageb3
tgagcttagggcccg

SEQ ID NO: 34225 - DNA, 15 bp, Artificial Sequence
  dgRNA
  Mageb3
cccgaggagttagac

SEQ ID NO: 34226 - DNA, 15 bp, Artificial Sequence
  dgRNA
  Mageb3
gactcagcctccgat

SEQ ID NO: 34227 - DNA, 15 bp, Artificial Sequence
  dgRNA
  Mageb3
actcagcctccgatg

SEQ ID NO: 34228 - DNA, 15 bp, Artificial Sequence
  dgRNA
  Zfp446
cctaggccttctccg

SEQ ID NO: 34229 - DNA, 15 bp, Artificial Sequence
  dgRNA
  Zfp446
ggccttctccgaggc

SEQ ID NO: 34230 - DNA, 15 bp, Artificial Sequence
  dgRNA
  Zfp446
gccttctccgaggca

SEQ ID NO: 34231 - DNA, 15 bp, Artificial Sequence
  dgRNA
  Zfp446
cgctagctgttacct

SEQ ID NO: 34232 - DNA, 15 bp, Artificial Sequence
  dgRNA
  Cracr2b
cctagccaacaataa

SEQ ID NO: 34233 - DNA, 15 bp, Artificial Sequence
  dgRNA
  Cracr2b
caataacggttgttc

SEQ ID NO: 34234 - DNA, 15 bp, Artificial Sequence
  dgRNA
  Cracr2b
cggttgttctggtta

SEQ ID NO: 34235 - DNA, 15 bp, Artificial Sequence
  dgRNA
  Cracr2b
ctgggcgagccggcc

SEQ ID NO: 34236 - DNA, 15 bp, Artificial Sequence
  dgRNA
  Rab3c
cgctctttgaagaaa

SEQ ID NO: 34237 - DNA, 15 bp, Artificial Sequence
  dgRNA
  Rab3c
aacaaccggtgtaac

SEQ ID NO: 34238 - DNA, 15 bp, Artificial Sequence
  dgRNA
  Rab3c
accgcccagtgcagc

SEQ ID NO: 34239 - DNA, 15 bp, Artificial Sequence
  dgRNA
  Rab3c
ggaggggctagcccg

SEQ ID NO: 34240 - DNA, 15 bp, Artificial Sequence
  dgRNA
  Maged1
attgcggagaaaggt

SEQ ID NO: 34241 - DNA, 15 bp, Artificial Sequence
  dgRNA
  Maged1
ttgcggagaaaggta

SEQ ID NO: 34242 - DNA, 15 bp, Artificial Sequence
  dgRNA
  Maged1
tgcggagaaaggtag

SEQ ID NO: 34243 - DNA, 15 bp, Artificial Sequence
  dgRNA
  Maged1
ctggtgtgtcgggcc

SEQ ID NO: 34244 - DNA, 15 bp, Artificial Sequence
  dgRNA
  1810013L24Rik
catcagttcgacagg

SEQ ID NO: 34245 - DNA, 15 bp, Artificial Sequence
  dgRNA
  1810013L24Rik
atcagttcgacaggc

SEQ ID NO: 34246 - DNA, 15 bp, Artificial Sequence
  dgRNA
  1810013L24Rik
cagaacgctgcgttc

SEQ ID NO: 34247 - DNA, 15 bp, Artificial Sequence
  dgRNA
  1810013L24Rik
agaacgctgcgttca

SEQ ID NO: 34248 - DNA, 15 bp, Artificial Sequence
  dgRNA
  Atp7a
ccctttcacgtgacg

SEQ ID NO: 34249 - DNA, 15 bp, Artificial Sequence
  dgRNA
  Atp7a
gaccatttccctagt

SEQ ID NO: 34250 - DNA, 15 bp, Artificial Sequence
  dgRNA
  Atp7a
agtcggcccagcttc

SEQ ID NO: 34251 - DNA, 15 bp, Artificial Sequence
  dgRNA
  Atp7a
gtcggcccagcttcc

SEQ ID NO: 34252 - DNA, 15 bp, Artificial Sequence
  dgRNA
  Cxxc5
ggagggaatccgagg

SEQ ID NO: 34253 - DNA, 15 bp, Artificial Sequence
  dgRNA
  Cxxc5
gaatccgaggtggag

SEQ ID NO: 34254 - DNA, 15 bp, Artificial Sequence
  dgRNA
  Cxxc5
aatccgaggtggaga

SEQ ID NO: 34255 - DNA, 15 bp, Artificial Sequence
  dgRNA
  Cxxc5
agggagccgctagtc

SEQ ID NO: 34256 - DNA, 15 bp, Artificial Sequence
  dgRNA
  Gjd3
cctccgagattgttg

SEQ ID NO: 34257 - DNA, 15 bp, Artificial Sequence
  dgRNA
  Gjd3
ctccgagattgttga

SEQ ID NO: 34258 - DNA, 15 bp, Artificial Sequence
  dgRNA
  Gjd3
agattgttgagggac

SEQ ID NO: 34259 - DNA, 15 bp, Artificial Sequence
  dgRNA
  Gjd3
gattgttgagggacg

SEQ ID NO: 34260 - DNA, 15 bp, Artificial Sequence
  dgRNA
  Fam193a
cccgccccacacgcc

SEQ ID NO: 34261 - DNA, 15 bp, Artificial Sequence
  dgRNA
  Fam193a
ccccacacgcccggg

SEQ ID NO: 34262 - DNA, 15 bp, Artificial Sequence
  dgRNA
  Fam193a
gcccgggcggagccg

SEQ ID NO: 34263 - DNA, 15 bp, Artificial Sequence
  dgRNA
  Fam193a
cccgggcggagccgc

SEQ ID NO: 34264 - DNA, 15 bp, Artificial Sequence
  dgRNA
  Olfr330
aggttgcatcatccc

SEQ ID NO: 34265 - DNA, 15 bp, Artificial Sequence
  dgRNA
  Evi5l
cagagaaccgtagcc

SEQ ID NO: 34266 - DNA, 15 bp, Artificial Sequence
  dgRNA
  Evi5l
agagaaccgtagcca

SEQ ID NO: 34267 - DNA, 15 bp, Artificial Sequence
  dgRNA
  Evi5l
ccagggtccgcctca

SEQ ID NO: 34268 - DNA, 15 bp, Artificial Sequence
  dgRNA
  Evi5l
cagggtccgcctcac

SEQ ID NO: 34269 - DNA, 15 bp, Artificial Sequence
  dgRNA
  Prmt2
aaggcccaatgcgac

SEQ ID NO: 34270 - DNA, 15 bp, Artificial Sequence
  dgRNA
  Prmt2
cccaatgcgaccggc

SEQ ID NO: 34271 - DNA, 15 bp, Artificial Sequence
  dgRNA
  Prmt2
cgaccggccggaagc

SEQ ID NO: 34272 - DNA, 15 bp, Artificial Sequence
  dgRNA
  Prmt2
gaccggccggaagca

SEQ ID NO: 34273 - DNA, 15 bp, Artificial Sequence
  dgRNA
  Pard3b
tcccgttacaattcc

SEQ ID NO: 34274 - DNA, 15 bp, Artificial Sequence
  dgRNA
  Pard3b
gcaacaagctaccca

SEQ ID NO: 34275 - DNA, 15 bp, Artificial Sequence
  dgRNA
  Pard3b
ccaaggtctagttac

SEQ ID NO: 34276 - DNA, 15 bp, Artificial Sequence
  dgRNA
  Pard3b
caaggtctagttact

SEQ ID NO: 34277 - DNA, 15 bp, Artificial Sequence
  dgRNA
  Ak6
cctgacccgaaacgc

SEQ ID NO: 34278 - DNA, 15 bp, Artificial Sequence
  dgRNA
  Ak6
gacccgaaacgcagg

SEQ ID NO: 34279 - DNA, 15 bp, Artificial Sequence
  dgRNA
  Ak6
acccgaaacgcaggc

SEQ ID NO: 34280 - DNA, 15 bp, Artificial Sequence
  dgRNA
  Ak6
aacgcaggcgggtct

SEQ ID NO: 34281 - DNA, 15 bp, Artificial Sequence
  dgRNA
  Trim67
gttgctctggcaagc

SEQ ID NO: 34282 - DNA, 15 bp, Artificial Sequence
  dgRNA
  Trim67
agtctccatccgtaa

SEQ ID NO: 34283 - DNA, 15 bp, Artificial Sequence
  dgRNA
  Trim67
actgccagccgcgag

SEQ ID NO: 34284 - DNA, 15 bp, Artificial Sequence
  dgRNA
  Trim67
cgctgagctgacgcc

SEQ ID NO: 34285 - DNA, 15 bp, Artificial Sequence
  dgRNA
  Olfr836
ataggacatcctaga

SEQ ID NO: 34286 - DNA, 15 bp, Artificial Sequence
  dgRNA
  Pnck
cccactctggactag

SEQ ID NO: 34287 - DNA, 15 bp, Artificial Sequence
  dgRNA
  Pnck
ggactaggggcaagc

SEQ ID NO: 34288 - DNA, 15 bp, Artificial Sequence
  dgRNA
  Pnck
gcaagcaggcgagcg

SEQ ID NO: 34289 - DNA, 15 bp, Artificial Sequence
  dgRNA
  Pnck
cgagcgggggcgggt

SEQ ID NO: 34290 - DNA, 15 bp, Artificial Sequence
  dgRNA
  4933405O20Rik
taagcatgctagata

SEQ ID NO: 34291 - DNA, 15 bp, Artificial Sequence
  dgRNA
  2-Mar
gcggtgcccggacgc

SEQ ID NO: 34292 - DNA, 15 bp, Artificial Sequence
  dgRNA
  2-Mar
cgagcacctgcgtcc

SEQ ID NO: 34293 - DNA, 15 bp, Artificial Sequence
  dgRNA
  2-Mar
gcgagcacctgcgtc

SEQ ID NO: 34294 - DNA, 15 bp, Artificial Sequence
  dgRNA
  Slc44a3
cgcctggaagagaac

SEQ ID NO: 34295 - DNA, 15 bp, Artificial Sequence
  dgRNA
  Slc44a3
actggtgaacctttc

SEQ ID NO: 34296 - DNA, 15 bp, Artificial Sequence
  dgRNA
  Slc44a3
ctggtgaacctttca

SEQ ID NO: 34297 - DNA, 15 bp, Artificial Sequence
  dgRNA
  Slc44a3
tccaggcgctggcaa

SEQ ID NO: 34298 - DNA, 15 bp, Artificial Sequence
  dgRNA
  Vmn2r68
tagtatcacatggat

SEQ ID NO: 34299 - DNA, 15 bp, Artificial Sequence
  dgRNA
  Mfsd5
ttccggacgaccccg

SEQ ID NO: 34300 - DNA, 15 bp, Artificial Sequence
  dgRNA
  Mfsd5
cgaccccgcggatat

SEQ ID NO: 34301 - DNA, 15 bp, Artificial Sequence
  dgRNA
  Mfsd5
cggatattggccagc

SEQ ID NO: 34302 - DNA, 15 bp, Artificial Sequence
  dgRNA
  Mfsd5
atattggccagctgg

SEQ ID NO: 34303 - DNA, 15 bp, Artificial Sequence
  dgRNA
  Phactr2
gcacgtttgggggga

SEQ ID NO: 34304 - DNA, 15 bp, Artificial Sequence
  dgRNA
  Phactr2
tgctgcacgtttggg

SEQ ID NO: 34305 - DNA, 15 bp, Artificial Sequence
  dgRNA
  Phactr2
gtgctgcacgtttgg

SEQ ID NO: 34306 - DNA, 15 bp, Artificial Sequence
  dgRNA
  Phactr2
tgtgctgcacgtttg

SEQ ID NO: 34307 - DNA, 15 bp, Artificial Sequence
  dgRNA
  Ifrd1
cagcccaggcaccga

SEQ ID NO: 34308 - DNA, 15 bp, Artificial Sequence
  dgRNA
  Ifrd1
accgagggcagactg

SEQ ID NO: 34309 - DNA, 15 bp, Artificial Sequence
  dgRNA
  Ifrd1
tgggagtccgaatgc

SEQ ID NO: 34310 - DNA, 15 bp, Artificial Sequence
  dgRNA
  Ifrd1
cagtggacgccgcgg

SEQ ID NO: 34311 - DNA, 15 bp, Artificial Sequence
  dgRNA
  Clca2
gcttagccacaaacc

SEQ ID NO: 34312 - DNA, 15 bp, Artificial Sequence
  dgRNA
  Clca2
tgagtactattgcct

SEQ ID NO: 34313 - DNA, 15 bp, Artificial Sequence
  dgRNA
  Clca2
actattgccttggag

SEQ ID NO: 34314 - DNA, 15 bp, Artificial Sequence
  dgRNA
  Clca2
tactcacctggtttg

SEQ ID NO: 34315 - DNA, 15 bp, Artificial Sequence
  dgRNA
  Mbp
tttcccgagatgccc

SEQ ID NO: 34316 - DNA, 15 bp, Artificial Sequence
  dgRNA
  Mbp
ttcccgagatgcccc

SEQ ID NO: 34317 - DNA, 15 bp, Artificial Sequence
  dgRNA
  Mbp
cgagatgccccggga

SEQ ID NO: 34318 - DNA, 15 bp, Artificial Sequence
  dgRNA
  Mbp
agaggcggatcaagt

SEQ ID NO: 34319 - DNA, 15 bp, Artificial Sequence
  dgRNA
  Olfr541
tctgtaccacaccat

SEQ ID NO: 34320 - DNA, 15 bp, Artificial Sequence
  dgRNA
  Olfr1310
tgatggattctcccc

SEQ ID NO: 34321 - DNA, 15 bp, Artificial Sequence
  dgRNA
  Olfr1310
ttaaactatctccaa

SEQ ID NO: 34322 - DNA, 15 bp, Artificial Sequence
  dgRNA
  Olfr1310
agactatcatgcctt

SEQ ID NO: 34323 - DNA, 15 bp, Artificial Sequence
  dgRNA
  Fam134b
ccgcaccctctttcc

SEQ ID NO: 34324 - DNA, 15 bp, Artificial Sequence
  dgRNA
  Fam134b
ccctctttcccggcg

SEQ ID NO: 34325 - DNA, 15 bp, Artificial Sequence
  dgRNA
  Fam134b
tttcccggcgcggcc

SEQ ID NO: 34326 - DNA, 15 bp, Artificial Sequence
  dgRNA
  Fam134b
aggcctgacgtcaca

SEQ ID NO: 34327 - DNA, 15 bp, Artificial Sequence
  dgRNA
  Prpf3
ggcgcgtgcgccccg

SEQ ID NO: 34328 - DNA, 15 bp, Artificial Sequence
  dgRNA
  Prpf3
ggcaccttgataccg

SEQ ID NO: 34329 - DNA, 15 bp, Artificial Sequence
  dgRNA
  Prpf3
gcggctgcgcagctg

SEQ ID NO: 34330 - DNA, 15 bp, Artificial Sequence
  dgRNA
  Prpf3
gtagtcacgtgccgt

SEQ ID NO: 34331 - DNA, 15 bp, Artificial Sequence
  dgRNA
  Ercc8
cagagcgccacacac

SEQ ID NO: 34332 - DNA, 15 bp, Artificial Sequence
  dgRNA
  Ercc8
cctgcgccgaactca

SEQ ID NO: 34333 - DNA, 15 bp, Artificial Sequence
  dgRNA
  Ercc8
cgaactcaaggtctg

SEQ ID NO: 34334 - DNA, 15 bp, Artificial Sequence
  dgRNA
  Ercc8
tcaacccgccaccgg

SEQ ID NO: 34335 - DNA, 15 bp, Artificial Sequence
  dgRNA
  Ubtf
cgtgcagcccccgag

SEQ ID NO: 34336 - DNA, 15 bp, Artificial Sequence
  dgRNA
  Ubtf
cagcccccgagcggt

SEQ ID NO: 34337 - DNA, 15 bp, Artificial Sequence
  dgRNA
  Ubtf
cccccgagcggtggg

SEQ ID NO: 34338 - DNA, 15 bp, Artificial Sequence
  dgRNA
  Ubtf
ccccgagcggtggga

SEQ ID NO: 34339 - DNA, 15 bp, Artificial Sequence
  dgRNA
  Olfr456
ctcccctaaccacca

SEQ ID NO: 34340 - DNA, 15 bp, Artificial Sequence
  dgRNA
  Olfr456
gaggggggttcgatg

SEQ ID NO: 34341 - DNA, 15 bp, Artificial Sequence
  dgRNA
  Olfr456
ggaggggggttcgat

SEQ ID NO: 34342 - DNA, 15 bp, Artificial Sequence
  dgRNA
  Olfr456
tggaggggggttcga

SEQ ID NO: 34343 - DNA, 15 bp, Artificial Sequence
  dgRNA
  Fstl5
cttgttaacatggtt

SEQ ID NO: 34344 - DNA, 15 bp, Artificial Sequence
  dgRNA
  Fstl5
gttaacatggtttgg

SEQ ID NO: 34345 - DNA, 15 bp, Artificial Sequence
  dgRNA
  Fstl5
ttaacatggtttgga

SEQ ID NO: 34346 - DNA, 15 bp, Artificial Sequence
  dgRNA
  Fstl5
taacatggtttggag

SEQ ID NO: 34347 - DNA, 15 bp, Artificial Sequence
  dgRNA
  Prkar1a
ctagctagatgacga

SEQ ID NO: 34348 - DNA, 15 bp, Artificial Sequence
  dgRNA
  Prkar1a
tagctagatgacgac

SEQ ID NO: 34349 - DNA, 15 bp, Artificial Sequence
  dgRNA
  Prkar1a
gatgacgacgggcta

SEQ ID NO: 34350 - DNA, 15 bp, Artificial Sequence
  dgRNA
  Prkar1a
atgacgacgggctaa

SEQ ID NO: 34351 - DNA, 15 bp, Artificial Sequence
  dgRNA
  Tmem9
cagtaagatagtata

SEQ ID NO: 34352 - DNA, 15 bp, Artificial Sequence
  dgRNA
  Tmem9
agatagtataaggcg

SEQ ID NO: 34353 - DNA, 15 bp, Artificial Sequence
  dgRNA
  Tmem9
acaaagcactctagg

SEQ ID NO: 34354 - DNA, 15 bp, Artificial Sequence
  dgRNA
  Tmem9
gttgaacggacccac

SEQ ID NO: 34355 - DNA, 15 bp, Artificial Sequence
  dgRNA
  Prss54
tctctagcacaacca

SEQ ID NO: 34356 - DNA, 15 bp, Artificial Sequence
  dgRNA
  Prss54
acaaccagggccccc

SEQ ID NO: 34357 - DNA, 15 bp, Artificial Sequence
  dgRNA
  Nfkbib
tgctctgtcccgtga

SEQ ID NO: 34358 - DNA, 15 bp, Artificial Sequence
  dgRNA
  Nfkbib
gtcccgtgacggcag

SEQ ID NO: 34359 - DNA, 15 bp, Artificial Sequence
  dgRNA
  Nfkbib
caaaaagcctggcgc

SEQ ID NO: 34360 - DNA, 15 bp, Artificial Sequence
  dgRNA
  Nfkbib
aaagcctggcgccgg

SEQ ID NO: 34361 - DNA, 15 bp, Artificial Sequence
  dgRNA
  Gpr62
gtaaactgtaccctc

SEQ ID NO: 34362 - DNA, 15 bp, Artificial Sequence
  dgRNA
  Gpr62
gctgttagagccaag

SEQ ID NO: 34363 - DNA, 15 bp, Artificial Sequence
  dgRNA
  Gpr62
aagggggctggcacc

SEQ ID NO: 34364 - DNA, 15 bp, Artificial Sequence
  dgRNA
  Gpr62
tgtgaaactgcccga

SEQ ID NO: 34365 - DNA, 15 bp, Artificial Sequence
  dgRNA
  Vangl2
gatccagagggcgca

SEQ ID NO: 34366 - DNA, 15 bp, Artificial Sequence
  dgRNA
  Vangl2
gcgcagggcatggcc

SEQ ID NO: 34367 - DNA, 15 bp, Artificial Sequence
  dgRNA
  Vangl2
ggcatggccaggcgc

SEQ ID NO: 34368 - DNA, 15 bp, Artificial Sequence
  dgRNA
  Vangl2
gcatggccaggcgca

SEQ ID NO: 34369 - DNA, 15 bp, Artificial Sequence
  dgRNA
  Ccdc42
agttagtgggttcat

SEQ ID NO: 34370 - DNA, 15 bp, Artificial Sequence
  dgRNA
  Ccdc42
gggttcataggttag

SEQ ID NO: 34371 - DNA, 15 bp, Artificial Sequence
  dgRNA
  Ccdc42
ggttcataggttaga

SEQ ID NO: 34372 - DNA, 15 bp, Artificial Sequence
  dgRNA
  Ccdc42
ttagagggcaaaccg

SEQ ID NO: 34373 - DNA, 15 bp, Artificial Sequence
  dgRNA
  Bglap2
ggcagtctccgattg

SEQ ID NO: 34374 - DNA, 15 bp, Artificial Sequence
  dgRNA
  Bglap2
cgatataaatgctac

SEQ ID NO: 34375 - DNA, 15 bp, Artificial Sequence
  dgRNA
  Bglap2
caatcggagactgcc

SEQ ID NO: 34376 - DNA, 15 bp, Artificial Sequence
  dgRNA
  Bglap2
cagtagcatttatat

SEQ ID NO: 34377 - DNA, 15 bp, Artificial Sequence
  dgRNA
  Tpst1
ctccagttaggccac

SEQ ID NO: 34378 - DNA, 15 bp, Artificial Sequence
  dgRNA
  Tpst1
acaaactgcccgtgt

SEQ ID NO: 34379 - DNA, 15 bp, Artificial Sequence
  dgRNA
  Tpst1
cgtgtaggcagcagc

SEQ ID NO: 34380 - DNA, 15 bp, Artificial Sequence
  dgRNA
  Tpst1
gagttcgacaaacgc

SEQ ID NO: 34381 - DNA, 15 bp, Artificial Sequence
  dgRNA
  Armcx1
tagaccagaattagg

SEQ ID NO: 34382 - DNA, 15 bp, Artificial Sequence
  dgRNA
  Alx4
aaccttaagagggtt

SEQ ID NO: 34383 - DNA, 15 bp, Artificial Sequence
  dgRNA
  Alx4
accttaagagggttt

SEQ ID NO: 34384 - DNA, 15 bp, Artificial Sequence
  dgRNA
  Alx4
atccgaatcttttta

SEQ ID NO: 34385 - DNA, 15 bp, Artificial Sequence
  dgRNA
  Alx4
tttttacggagcttt

SEQ ID NO: 34386 - DNA, 15 bp, Artificial Sequence
  dgRNA
  Tmprss3
ttgcgacaaacccac

SEQ ID NO: 34387 - DNA, 15 bp, Artificial Sequence
  dgRNA
  Tmprss3
tgcgacaaacccaca

SEQ ID NO: 34388 - DNA, 15 bp, Artificial Sequence
  dgRNA
  Tmprss3
gcgacaaacccacag

SEQ ID NO: 34389 - DNA, 15 bp, Artificial Sequence
  dgRNA
  Tmprss3
ggtgtgggcttcgtg

SEQ ID NO: 34390 - DNA, 15 bp, Artificial Sequence
  dgRNA
  Cd40lg
cgtaactttttttgc

SEQ ID NO: 34391 - DNA, 15 bp, Artificial Sequence
  dgRNA
  Cd40lg
cgaagcacattttcc

SEQ ID NO: 34392 - DNA, 15 bp, Artificial Sequence
  dgRNA
  Cd40lg
aaaaaagttacgtaa

SEQ ID NO: 34393 - DNA, 15 bp, Artificial Sequence
  dgRNA
  Cd40lg
gtggccgccttactc

SEQ ID NO: 34394 - DNA, 15 bp, Artificial Sequence
  dgRNA
  Apoa1bp
cgaagcacatctgtt

SEQ ID NO: 34395 - DNA, 15 bp, Artificial Sequence
  dgRNA
  Apoa1bp
ggaactctgcgacgc

SEQ ID NO: 34396 - DNA, 15 bp, Artificial Sequence
  dgRNA
  Apoa1bp
gaactctgcgacgcc

SEQ ID NO: 34397 - DNA, 15 bp, Artificial Sequence
  dgRNA
  Apoa1bp
aactctgcgacgccg

SEQ ID NO: 34398 - DNA, 15 bp, Artificial Sequence
  dgRNA
  Dpf1
acgccatactcccaa

SEQ ID NO: 34399 - DNA, 15 bp, Artificial Sequence
  dgRNA
  Dpf1
actcccaacggcccc

SEQ ID NO: 34400 - DNA, 15 bp, Artificial Sequence
  dgRNA
  Dpf1
ctcccaacggcccct

SEQ ID NO: 34401 - DNA, 15 bp, Artificial Sequence
  dgRNA
  Dpf1
acgtgtagtccctac

SEQ ID NO: 34402 - DNA, 15 bp, Artificial Sequence
  dgRNA
  Pacsin3
tctcagggtgcctag

SEQ ID NO: 34403 - DNA, 15 bp, Artificial Sequence
  dgRNA
  Pacsin3
gcgccactatctgta

SEQ ID NO: 34404 - DNA, 15 bp, Artificial Sequence
  dgRNA
  Pacsin3
atggctaaccctagt

SEQ ID NO: 34405 - DNA, 15 bp, Artificial Sequence
  dgRNA
  Pacsin3
acgccccatttcccc

SEQ ID NO: 34406 - DNA, 15 bp, Artificial Sequence
  dgRNA
  Naa40
tgcgcgcctcagcga

SEQ ID NO: 34407 - DNA, 15 bp, Artificial Sequence
  dgRNA
  Naa40
caccaagtggctccg

SEQ ID NO: 34408 - DNA, 15 bp, Artificial Sequence
  dgRNA
  Naa40
cccttccgctccgcg

SEQ ID NO: 34409 - DNA, 15 bp, Artificial Sequence
  dgRNA
  Naa40
ccatagttacagacg

SEQ ID NO: 34410 - DNA, 15 bp, Artificial Sequence
  dgRNA
  Atf2
cgtccgagtgttctt

SEQ ID NO: 34411 - DNA, 15 bp, Artificial Sequence
  dgRNA
  Atf2
cccgccctttttccg

SEQ ID NO: 34412 - DNA, 15 bp, Artificial Sequence
  dgRNA
  Atf2
ttttccgaggcacga

SEQ ID NO: 34413 - DNA, 15 bp, Artificial Sequence
  dgRNA
  Atf2
gagtcacctgacccg

SEQ ID NO: 34414 - DNA, 15 bp, Artificial Sequence
  dgRNA
  Camk1d
cccggcgcccaagca

SEQ ID NO: 34415 - DNA, 15 bp, Artificial Sequence
  dgRNA
  Camk1d
caagcacggagctcc

SEQ ID NO: 34416 - DNA, 15 bp, Artificial Sequence
  dgRNA
  Camk1d
aagcacggagctcct

SEQ ID NO: 34417 - DNA, 15 bp, Artificial Sequence
  dgRNA
  Camk1d
agcacggagctcctg

SEQ ID NO: 34418 - DNA, 15 bp, Artificial Sequence
  dgRNA
  Hectd2
tccccgcgcgtgacg

SEQ ID NO: 34419 - DNA, 15 bp, Artificial Sequence
  dgRNA
  Hectd2
ccccgcgcgtgacgc

SEQ ID NO: 34420 - DNA, 15 bp, Artificial Sequence
  dgRNA
  Hectd2
cccgcgcgtgacgcg

SEQ ID NO: 34421 - DNA, 15 bp, Artificial Sequence
  dgRNA
  Hectd2
cgtgacgcggggccg

SEQ ID NO: 34422 - DNA, 15 bp, Artificial Sequence
  dgRNA
  Zrsr1
gtcaactgggctgaa

SEQ ID NO: 34423 - DNA, 15 bp, Artificial Sequence
  dgRNA
  Zrsr1
gaacaacttagcagc

SEQ ID NO: 34424 - DNA, 15 bp, Artificial Sequence
  dgRNA
  Zrsr1
gattatcgcgagatc

SEQ ID NO: 34425 - DNA, 15 bp, Artificial Sequence
  dgRNA
  Zrsr1
attatcgcgagatcc

SEQ ID NO: 34426 - DNA, 15 bp, Artificial Sequence
  dgRNA
  Itgad
gaagcaagcttctag

SEQ ID NO: 34427 - DNA, 15 bp, Artificial Sequence
  dgRNA
  Itgad
ctagtgggcaacgag

SEQ ID NO: 34428 - DNA, 15 bp, Artificial Sequence
  dgRNA
  Itgad
tagtgggcaacgaga

SEQ ID NO: 34429 - DNA, 15 bp, Artificial Sequence
  dgRNA
  Itgad
cgagagggaaagcat

SEQ ID NO: 34430 - DNA, 15 bp, Artificial Sequence
  dgRNA
  Tmem181a
ggggtccgtaccctt

SEQ ID NO: 34431 - DNA, 15 bp, Artificial Sequence
  dgRNA
  Tmem181a
gtccgtacccttcgg

SEQ ID NO: 34432 - DNA, 15 bp, Artificial Sequence
  dgRNA
  Tmem181a
gtacccttcggtggt

SEQ ID NO: 34433 - DNA, 15 bp, Artificial Sequence
  dgRNA
  Tmem181a
cccttcggtggtcgg

SEQ ID NO: 34434 - DNA, 15 bp, Artificial Sequence
  dgRNA
  Frrs1l
atgttgtagatcagc

SEQ ID NO: 34435 - DNA, 15 bp, Artificial Sequence
  dgRNA
  Frrs1l
aaaggtcaaatctgg

SEQ ID NO: 34436 - DNA, 15 bp, Artificial Sequence
  dgRNA
  Frrs1l
aaatctggaggcgac

SEQ ID NO: 34437 - DNA, 15 bp, Artificial Sequence
  dgRNA
  Frrs1l
aatctggaggcgact

SEQ ID NO: 34438 - DNA, 15 bp, Artificial Sequence
  dgRNA
  Klra5
ttgagtatcactagg

SEQ ID NO: 34439 - DNA, 15 bp, Artificial Sequence
  dgRNA
  Klra5
tatctaagcaaaagg

SEQ ID NO: 34440 - DNA, 15 bp, Artificial Sequence
  dgRNA
  Dyrk1b
actttgtgtgcttcg

SEQ ID NO: 34441 - DNA, 15 bp, Artificial Sequence
  dgRNA
  Dyrk1b
ctttgtgtgcttcgg

SEQ ID NO: 34442 - DNA, 15 bp, Artificial Sequence
  dgRNA
  Dyrk1b
tttgtgtgcttcggg

SEQ ID NO: 34443 - DNA, 15 bp, Artificial Sequence
  dgRNA
  Dyrk1b
ctggaaagtttcatc

SEQ ID NO: 34444 - DNA, 15 bp, Artificial Sequence
  dgRNA
  Tmco1
ctccaacggcgtccc

SEQ ID NO: 34445 - DNA, 15 bp, Artificial Sequence
  dgRNA
  Tmco1
tccccggcatcataa

SEQ ID NO: 34446 - DNA, 15 bp, Artificial Sequence
  dgRNA
  Tmco1
cggcatcataaaggc

SEQ ID NO: 34447 - DNA, 15 bp, Artificial Sequence
  dgRNA
  Tmco1
tttaaccagcgcccg

SEQ ID NO: 34448 - DNA, 15 bp, Artificial Sequence
  dgRNA
  Creb3l4
tcctacaatataagt

SEQ ID NO: 34449 - DNA, 15 bp, Artificial Sequence
  dgRNA
  Creb3l4
cctacaatataagta

SEQ ID NO: 34450 - DNA, 15 bp, Artificial Sequence
  dgRNA
  Creb3l4
ctacaatataagtag

SEQ ID NO: 34451 - DNA, 15 bp, Artificial Sequence
  dgRNA
  Creb3l4
ataagtaggggcctc

SEQ ID NO: 34452 - DNA, 15 bp, Artificial Sequence
  dgRNA
  Pcdhgb5
gggaccaaacagcag

SEQ ID NO: 34453 - DNA, 15 bp, Artificial Sequence
  dgRNA
  Pcdhgb5
tcatagtgcgaactc

SEQ ID NO: 34454 - DNA, 15 bp, Artificial Sequence
  dgRNA
  Pcdhgb5
catagtgcgaactct

SEQ ID NO: 34455 - DNA, 15 bp, Artificial Sequence
  dgRNA
  Pcdhgb5
cagtcaggccaacag

SEQ ID NO: 34456 - DNA, 15 bp, Artificial Sequence
  dgRNA
  Ttc19
ggagcgcgaccgcca

SEQ ID NO: 34457 - DNA, 15 bp, Artificial Sequence
  dgRNA
  Ttc19
cttcacgcgccctgc

SEQ ID NO: 34458 - DNA, 15 bp, Artificial Sequence
  dgRNA
  Ttc19
acgcgccctgcaggc

SEQ ID NO: 34459 - DNA, 15 bp, Artificial Sequence
  dgRNA
  Ttc19
gcgccctgcaggccg

SEQ ID NO: 34460 - DNA, 15 bp, Artificial Sequence
  dgRNA
  Gemin7
cctggtcgcgtgccc

SEQ ID NO: 34461 - DNA, 15 bp, Artificial Sequence
  dgRNA
  Gemin7
tcgcgtgccctggag

SEQ ID NO: 34462 - DNA, 15 bp, Artificial Sequence
  dgRNA
  Gemin7
aggccgatgaacatg

SEQ ID NO: 34463 - DNA, 15 bp, Artificial Sequence
  dgRNA
  Gemin7
ggccgatgaacatgt

SEQ ID NO: 34464 - DNA, 15 bp, Artificial Sequence
  dgRNA
  Fam217b
gcctcgagcagcggg

SEQ ID NO: 34465 - DNA, 15 bp, Artificial Sequence
  dgRNA
  Fam217b
tggcgctatccaagg

SEQ ID NO: 34466 - DNA, 15 bp, Artificial Sequence
  dgRNA
  Fam217b
tccaaggcggcttcc

SEQ ID NO: 34467 - DNA, 15 bp, Artificial Sequence
  dgRNA
  Fam217b
ccaaggcggcttccc

SEQ ID NO: 34468 - DNA, 15 bp, Artificial Sequence
  dgRNA
  Apip
gcaagtcaactagat

SEQ ID NO: 34469 - DNA, 15 bp, Artificial Sequence
  dgRNA
  Apip
agtcaactagattgg

SEQ ID NO: 34470 - DNA, 15 bp, Artificial Sequence
  dgRNA
  Apip
cctcaaggcccgtcc

SEQ ID NO: 34471 - DNA, 15 bp, Artificial Sequence
  dgRNA
  Apip
aggccccgccttgca

SEQ ID NO: 34472 - DNA, 15 bp, Artificial Sequence
  dgRNA
  1700009N14Rik
cccctatacgaagaa

SEQ ID NO: 34473 - DNA, 15 bp, Artificial Sequence
  dgRNA
  1700009N14Rik
taaggactgcttggt

SEQ ID NO: 34474 - DNA, 15 bp, Artificial Sequence
  dgRNA
  1700009N14Rik
atgttaaggactgct

SEQ ID NO: 34475 - DNA, 15 bp, Artificial Sequence
  dgRNA
  1700009N14Rik
ttcttcgtatagggg

SEQ ID NO: 34476 - DNA, 15 bp, Artificial Sequence
  dgRNA
  Adcy10
tagaccactcagtgt

SEQ ID NO: 34477 - DNA, 15 bp, Artificial Sequence
  dgRNA
  Adcy10
gcttggctcaatctc

SEQ ID NO: 34478 - DNA, 15 bp, Artificial Sequence
  dgRNA
  Adcy10
ttgtttcacgcgcac

SEQ ID NO: 34479 - DNA, 15 bp, Artificial Sequence
  dgRNA
  Adcy10
aaaaagccgttttcc

SEQ ID NO: 34480 - DNA, 15 bp, Artificial Sequence
  dgRNA
  Fgfrl1
cgccgtttatccgcg

SEQ ID NO: 34481 - DNA, 15 bp, Artificial Sequence
  dgRNA
  Fgfrl1
cagccgccagcgccc

SEQ ID NO: 34482 - DNA, 15 bp, Artificial Sequence
  dgRNA
  Fgfrl1
gcgggatgcggcgcc

SEQ ID NO: 34483 - DNA, 15 bp, Artificial Sequence
  dgRNA
  Fgfrl1
cgggatgcggcgccc

SEQ ID NO: 34484 - DNA, 15 bp, Artificial Sequence
  dgRNA
  Ppp1r8
ttcagacccgccaaa

SEQ ID NO: 34485 - DNA, 15 bp, Artificial Sequence
  dgRNA
  Ppp1r8
tcagacccgccaaat

SEQ ID NO: 34486 - DNA, 15 bp, Artificial Sequence
  dgRNA
  Ppp1r8
actaagagctcggga

SEQ ID NO: 34487 - DNA, 15 bp, Artificial Sequence
  dgRNA
  Ppp1r8
aactaagagctcggg

SEQ ID NO: 34488 - DNA, 15 bp, Artificial Sequence
  dgRNA
  Alpk1
gggaaactccttatt

SEQ ID NO: 34489 - DNA, 15 bp, Artificial Sequence
  dgRNA
  Alpk1
gtcatccaagagtga

SEQ ID NO: 34490 - DNA, 15 bp, Artificial Sequence
  dgRNA
  Alpk1
aacttgtctgataac

SEQ ID NO: 34491 - DNA, 15 bp, Artificial Sequence
  dgRNA
  Alpk1
gccctactccaaata

SEQ ID NO: 34492 - DNA, 15 bp, Artificial Sequence
  dgRNA
  Cul4b
gtgctgctgtaggac

SEQ ID NO: 34493 - DNA, 15 bp, Artificial Sequence
  dgRNA
  Cul4b
gaaaggcgttacagt

SEQ ID NO: 34494 - DNA, 15 bp, Artificial Sequence
  dgRNA
  Cul4b
aggcgttacagttgg

SEQ ID NO: 34495 - DNA, 15 bp, Artificial Sequence
  dgRNA
  Cul4b
ggcgttacagttggt

SEQ ID NO: 34496 - DNA, 15 bp, Artificial Sequence
  dgRNA
  Hdac11
gcagggatgcaccgc

SEQ ID NO: 34497 - DNA, 15 bp, Artificial Sequence
  dgRNA
  Hdac11
ccctgggaatgcggg

SEQ ID NO: 34498 - DNA, 15 bp, Artificial Sequence
  dgRNA
  Hdac11
atgaccacgccctcc

SEQ ID NO: 34499 - DNA, 15 bp, Artificial Sequence
  dgRNA
  Hdac11
ccgcccgcattccca

SEQ ID NO: 34500 - DNA, 15 bp, Artificial Sequence
  dgRNA
  Etf1
gagagccgggccgga

SEQ ID NO: 34501 - DNA, 15 bp, Artificial Sequence
  dgRNA
  Etf1
gcagccaggccgccg

SEQ ID NO: 34502 - DNA, 15 bp, Artificial Sequence
  dgRNA
  Etf1
attgcctcttgtaag

SEQ ID NO: 34503 - DNA, 15 bp, Artificial Sequence
  dgRNA
  Etf1
gcctcttgtaagcgg

SEQ ID NO: 34504 - DNA, 15 bp, Artificial Sequence
  dgRNA
  Hist2h2bb
gctcgcaaccagaat

SEQ ID NO: 34505 - DNA, 15 bp, Artificial Sequence
  dgRNA
  Hist2h2bb
agaatcggtttgagt

SEQ ID NO: 34506 - DNA, 15 bp, Artificial Sequence
  dgRNA
  Hist2h2bb
cagttcgtagttgcc

SEQ ID NO: 34507 - DNA, 15 bp, Artificial Sequence
  dgRNA
  Hist2h2bb
ttgcatctttagacg

SEQ ID NO: 34508 - DNA, 15 bp, Artificial Sequence
  dgRNA
  Gm17252
agttttcctaggatc

SEQ ID NO: 34509 - DNA, 15 bp, Artificial Sequence
  dgRNA
  Gm17252
ccactgtataaatag

SEQ ID NO: 34510 - DNA, 15 bp, Artificial Sequence
  dgRNA
  Gm17252
cactgtataaatagt

SEQ ID NO: 34511 - DNA, 15 bp, Artificial Sequence
  dgRNA
  Gm17252
gcgtaccctgatcct

SEQ ID NO: 34512 - DNA, 15 bp, Artificial Sequence
  dgRNA
  Isg20
catagctgcccaaac

SEQ ID NO: 34513 - DNA, 15 bp, Artificial Sequence
  dgRNA
  Isg20
atagctgcccaaact

SEQ ID NO: 34514 - DNA, 15 bp, Artificial Sequence
  dgRNA
  Isg20
agggggcttcgaggt

SEQ ID NO: 34515 - DNA, 15 bp, Artificial Sequence
  dgRNA
  Isg20
ggcactggagataat

SEQ ID NO: 34516 - DNA, 15 bp, Artificial Sequence
  dgRNA
  Dvl2
cgggttgtacacgtt

SEQ ID NO: 34517 - DNA, 15 bp, Artificial Sequence
  dgRNA
  Dvl2
gggttgtacacgttt

SEQ ID NO: 34518 - DNA, 15 bp, Artificial Sequence
  dgRNA
  Dvl2
gttgtacacgtttgg

SEQ ID NO: 34519 - DNA, 15 bp, Artificial Sequence
  dgRNA
  Dvl2
gtacacgtttggggg

SEQ ID NO: 34520 - DNA, 15 bp, Artificial Sequence
  dgRNA
  Ppm1b
aagatactaggggcc

SEQ ID NO: 34521 - DNA, 15 bp, Artificial Sequence
  dgRNA
  Ppm1b
actaggggccaggtt

SEQ ID NO: 34522 - DNA, 15 bp, Artificial Sequence
  dgRNA
  Ppm1b
agaacgtagattgac

SEQ ID NO: 34523 - DNA, 15 bp, Artificial Sequence
  dgRNA
  Ppm1b
cttctcagcaaaccg

SEQ ID NO: 34524 - DNA, 15 bp, Artificial Sequence
  dgRNA
  Wnt5a
cgaaagtgagggagc

SEQ ID NO: 34525 - DNA, 15 bp, Artificial Sequence
  dgRNA
  Wnt5a
tggtcaggagggccg

SEQ ID NO: 34526 - DNA, 15 bp, Artificial Sequence
  dgRNA
  Wnt5a
acgcggtcccctcgc

SEQ ID NO: 34527 - DNA, 15 bp, Artificial Sequence
  dgRNA
  Wnt5a
cgcggtcccctcgct

SEQ ID NO: 34528 - DNA, 15 bp, Artificial Sequence
  dgRNA
  Trappc8
ggatgcaaagcctct

SEQ ID NO: 34529 - DNA, 15 bp, Artificial Sequence
  dgRNA
  Trappc8
gcgctgagcggaggc

SEQ ID NO: 34530 - DNA, 15 bp, Artificial Sequence
  dgRNA
  Trappc8
cgctgagcggaggca

SEQ ID NO: 34531 - DNA, 15 bp, Artificial Sequence
  dgRNA
  Trappc8
ccgaaagccgaagcc

SEQ ID NO: 34532 - DNA, 15 bp, Artificial Sequence
  dgRNA
  Kirrel2
gattcctagatctta

SEQ ID NO: 34533 - DNA, 15 bp, Artificial Sequence
  dgRNA
  Kirrel2
cttaaggtacgtgta

SEQ ID NO: 34534 - DNA, 15 bp, Artificial Sequence
  dgRNA
  Kirrel2
cgtgtatggcttgca

SEQ ID NO: 34535 - DNA, 15 bp, Artificial Sequence
  dgRNA
  Kirrel2
cgtaccttaagatct

SEQ ID NO: 34536 - DNA, 15 bp, Artificial Sequence
  dgRNA
  Ep300
cgcctccctgtttct

SEQ ID NO: 34537 - DNA, 15 bp, Artificial Sequence
  dgRNA
  Ep300
taccgctatcctgta

SEQ ID NO: 34538 - DNA, 15 bp, Artificial Sequence
  dgRNA
  Ep300
cgctatcctgtaagg

SEQ ID NO: 34539 - DNA, 15 bp, Artificial Sequence
  dgRNA
  Ep300
cctgtaaggaggatt

SEQ ID NO: 34540 - DNA, 15 bp, Artificial Sequence
  dgRNA
  Ppp1r1c
tagcattcatcgatg

SEQ ID NO: 34541 - DNA, 15 bp, Artificial Sequence
  dgRNA
  Ppp1r1c
cattcatcgatgagg

SEQ ID NO: 34542 - DNA, 15 bp, Artificial Sequence
  dgRNA
  Ppp1r1c
tcatcgatgaggtgg

SEQ ID NO: 34543 - DNA, 15 bp, Artificial Sequence
  dgRNA
  Ppp1r1c
agcgtgtaacagcaa

SEQ ID NO: 34544 - DNA, 15 bp, Artificial Sequence
  dgRNA
  Rnf14
gagcccaccctccgc

SEQ ID NO: 34545 - DNA, 15 bp, Artificial Sequence
  dgRNA
  Rnf14
ctgcggctggtctgc

SEQ ID NO: 34546 - DNA, 15 bp, Artificial Sequence
  dgRNA
  Rnf14
ggcaagcgtctgccg

SEQ ID NO: 34547 - DNA, 15 bp, Artificial Sequence
  dgRNA
  Rnf14
gccgaggcccagtca

SEQ ID NO: 34548 - DNA, 15 bp, Artificial Sequence
  dgRNA
  Thra
ctgccggaggagccg

SEQ ID NO: 34549 - DNA, 15 bp, Artificial Sequence
  dgRNA
  Thra
tgccggaggagccgc

SEQ ID NO: 34550 - DNA, 15 bp, Artificial Sequence
  dgRNA
  Thra
gccggaggagccgcg

SEQ ID NO: 34551 - DNA, 15 bp, Artificial Sequence
  dgRNA
  Thra
aggcggcggccgctc

SEQ ID NO: 34552 - DNA, 15 bp, Artificial Sequence
  dgRNA
  Itgb2
cctcgatgctatcaa

SEQ ID NO: 34553 - DNA, 15 bp, Artificial Sequence
  dgRNA
  Itgb2
gattcatggaccagc

SEQ ID NO: 34554 - DNA, 15 bp, Artificial Sequence
  dgRNA
  Itgb2
attgatagcatcgag

SEQ ID NO: 34555 - DNA, 15 bp, Artificial Sequence
  dgRNA
  Itgb2
cattgatagcatcga

SEQ ID NO: 34556 - DNA, 15 bp, Artificial Sequence
  dgRNA
  Plod3
tgagcacaccccttc

SEQ ID NO: 34557 - DNA, 15 bp, Artificial Sequence
  dgRNA
  Plod3
gcacaccccttccgg

SEQ ID NO: 34558 - DNA, 15 bp, Artificial Sequence
  dgRNA
  Plod3
tacgtgatgttccct

SEQ ID NO: 34559 - DNA, 15 bp, Artificial Sequence
  dgRNA
  Plod3
ggagaagaaacccgc

SEQ ID NO: 34560 - DNA, 15 bp, Artificial Sequence
  dgRNA
  Celf6
tgggcttggcgcgcc

SEQ ID NO: 34561 - DNA, 15 bp, Artificial Sequence
  dgRNA
  Celf6
gggcttggcgcgcca

SEQ ID NO: 34562 - DNA, 15 bp, Artificial Sequence
  dgRNA
  Celf6
gagggggactccagc

SEQ ID NO: 34563 - DNA, 15 bp, Artificial Sequence
  dgRNA
  Celf6
cccctcgctctcggc

SEQ ID NO: 34564 - DNA, 15 bp, Artificial Sequence
  dgRNA
  Sult2a6
agtaaccgttgacta

SEQ ID NO: 34565 - DNA, 15 bp, Artificial Sequence
  dgRNA
  Sult2a6
aatatgctgaactgg

SEQ ID NO: 34566 - DNA, 15 bp, Artificial Sequence
  dgRNA
  Sult2a6
aaactagctactgat

SEQ ID NO: 34567 - DNA, 15 bp, Artificial Sequence
  dgRNA
  Drp2
ggtatgtgcaagtcg

SEQ ID NO: 34568 - DNA, 15 bp, Artificial Sequence
  dgRNA
  Drp2
tatgtgcaagtcggg

SEQ ID NO: 34569 - DNA, 15 bp, Artificial Sequence
  dgRNA
  Drp2
ttgtattgatctccg

SEQ ID NO: 34570 - DNA, 15 bp, Artificial Sequence
  dgRNA
  Drp2
ctccgcgagccgcca

SEQ ID NO: 34571 - DNA, 15 bp, Artificial Sequence
  dgRNA
  Dynlrb2
gcagggcggaaaagc

SEQ ID NO: 34572 - DNA, 15 bp, Artificial Sequence
  dgRNA
  Dynlrb2
gcctaaccgttgcgc

SEQ ID NO: 34573 - DNA, 15 bp, Artificial Sequence
  dgRNA
  Dynlrb2
gttgcctagcaacgg

SEQ ID NO: 34574 - DNA, 15 bp, Artificial Sequence
  dgRNA
  Dynlrb2
aacctcaaggcgatg

SEQ ID NO: 34575 - DNA, 15 bp, Artificial Sequence
  dgRNA
  Dgkb
ggactaccagaggac

SEQ ID NO: 34576 - DNA, 15 bp, Artificial Sequence
  dgRNA
  Dgkb
gaggtggcctcggca

SEQ ID NO: 34577 - DNA, 15 bp, Artificial Sequence
  dgRNA
  Dgkb
aggtggcctcggcag

SEQ ID NO: 34578 - DNA, 15 bp, Artificial Sequence
  dgRNA
  Dgkb
gagttgcaaatgatc

SEQ ID NO: 34579 - DNA, 15 bp, Artificial Sequence
  dgRNA
  Gps1
accgcggccagcgcg

SEQ ID NO: 34580 - DNA, 15 bp, Artificial Sequence
  dgRNA
  Gps1
cggccagcgcgaggc

SEQ ID NO: 34581 - DNA, 15 bp, Artificial Sequence
  dgRNA
  Gps1
agcgcgaggcaggcc

SEQ ID NO: 34582 - DNA, 15 bp, Artificial Sequence
  dgRNA
  Gps1
aacacccgccgcgca

SEQ ID NO: 34583 - DNA, 15 bp, Artificial Sequence
  dgRNA
  Derl3
ccacgtgctctaccg

SEQ ID NO: 34584 - DNA, 15 bp, Artificial Sequence
  dgRNA
  Derl3
cacgtgctctaccgt

SEQ ID NO: 34585 - DNA, 15 bp, Artificial Sequence
  dgRNA
  Derl3
attggctagccgcct

SEQ ID NO: 34586 - DNA, 15 bp, Artificial Sequence
  dgRNA
  Derl3
cgcctcggatacacc

SEQ ID NO: 34587 - DNA, 15 bp, Artificial Sequence
  dgRNA
  Sftpb
agggtactaagcagt

SEQ ID NO: 34588 - DNA, 15 bp, Artificial Sequence
  dgRNA
  Cdh11
gtttggcatctctcg

SEQ ID NO: 34589 - DNA, 15 bp, Artificial Sequence
  dgRNA
  Cdh11
atctctcggggcccc

SEQ ID NO: 34590 - DNA, 15 bp, Artificial Sequence
  dgRNA
  Cdh11
tctctcggggcccca

SEQ ID NO: 34591 - DNA, 15 bp, Artificial Sequence
  dgRNA
  Cdh11
tctcggggccccagg

SEQ ID NO: 34592 - DNA, 15 bp, Artificial Sequence
  dgRNA
  4921506M07Rik
cctactggtttatag

SEQ ID NO: 34593 - DNA, 15 bp, Artificial Sequence
  dgRNA
  4921506M07Rik
gtttatagaggatca

SEQ ID NO: 34594 - DNA, 15 bp, Artificial Sequence
  dgRNA
  4921506M07Rik
gtgtgcgtattttac

SEQ ID NO: 34595 - DNA, 15 bp, Artificial Sequence
  dgRNA
  4921506M07Rik
cctctataaaccagt

SEQ ID NO: 34596 - DNA, 15 bp, Artificial Sequence
  dgRNA
  Foxd2
ggttttctagtcccg

SEQ ID NO: 34597 - DNA, 15 bp, Artificial Sequence
  dgRNA
  Foxd2
ggggcagcaccggtt

SEQ ID NO: 34598 - DNA, 15 bp, Artificial Sequence
  dgRNA
  Foxd2
tgggtgcgccctgca

SEQ ID NO: 34599 - DNA, 15 bp, Artificial Sequence
  dgRNA
  Foxd2
tagagtttcaacacc

SEQ ID NO: 34600 - DNA, 15 bp, Artificial Sequence
  dgRNA
  Inip
ctgccaatcagcgtt

SEQ ID NO: 34601 - DNA, 15 bp, Artificial Sequence
  dgRNA
  Inip
ccgcccccaattgta

SEQ ID NO: 34602 - DNA, 15 bp, Artificial Sequence
  dgRNA
  Inip
tcgactgtcattctt

SEQ ID NO: 34603 - DNA, 15 bp, Artificial Sequence
  dgRNA
  Inip
ctgtcattcttcgga

SEQ ID NO: 34604 - DNA, 15 bp, Artificial Sequence
  dgRNA
  Osr2
gagtggaccattagc

SEQ ID NO: 34605 - DNA, 15 bp, Artificial Sequence
  dgRNA
  Osr2
accattagcgggcgc

SEQ ID NO: 34606 - DNA, 15 bp, Artificial Sequence
  dgRNA
  Osr2
ccattagcgggcgcc

SEQ ID NO: 34607 - DNA, 15 bp, Artificial Sequence
  dgRNA
  Osr2
agcgggcgccgggct

SEQ ID NO: 34608 - DNA, 15 bp, Artificial Sequence
  dgRNA
  Rpl10
gctctgtgcttcgtt

SEQ ID NO: 34609 - DNA, 15 bp, Artificial Sequence
  dgRNA
  Rpl10
tcgttcggtcccgcc

SEQ ID NO: 34610 - DNA, 15 bp, Artificial Sequence
  dgRNA
  Rpl10
gtcgacaccaccccc

SEQ ID NO: 34611 - DNA, 15 bp, Artificial Sequence
  dgRNA
  Rpl10
aaaccagcttccgcc

SEQ ID NO: 34612 - DNA, 15 bp, Artificial Sequence
  dgRNA
  Ncln
ggggctccgcgcata

SEQ ID NO: 34613 - DNA, 15 bp, Artificial Sequence
  dgRNA
  Ncln
gtcacagcttccgag

SEQ ID NO: 34614 - DNA, 15 bp, Artificial Sequence
  dgRNA
  Ncln
gggttccacagcgcg

SEQ ID NO: 34615 - DNA, 15 bp, Artificial Sequence
  dgRNA
  Ncln
gagccgtttaaaacg

SEQ ID NO: 34616 - DNA, 15 bp, Artificial Sequence
  dgRNA
  Igbp1b
atggtaaccattgct

SEQ ID NO: 34617 - DNA, 15 bp, Artificial Sequence
  dgRNA
  Igbp1b
ccccttgtgatggtg

SEQ ID NO: 34618 - DNA, 15 bp, Artificial Sequence
  dgRNA
  Igbp1b
gggcaagattgcaga

SEQ ID NO: 34619 - DNA, 15 bp, Artificial Sequence
  dgRNA
  Gtpbp3
taacccgaagttaac

SEQ ID NO: 34620 - DNA, 15 bp, Artificial Sequence
  dgRNA
  Gtpbp3
cccgaagttaactgg

SEQ ID NO: 34621 - DNA, 15 bp, Artificial Sequence
  dgRNA
  Gtpbp3
ccaggatgcctatcc

SEQ ID NO: 34622 - DNA, 15 bp, Artificial Sequence
  dgRNA
  Gtpbp3
tcccggaacacacat

SEQ ID NO: 34623 - DNA, 15 bp, Artificial Sequence
  dgRNA
  Mob2
atggtcttcagatac

SEQ ID NO: 34624 - DNA, 15 bp, Artificial Sequence
  dgRNA
  Mob2
ggtctcgaagccccg

SEQ ID NO: 34625 - DNA, 15 bp, Artificial Sequence
  dgRNA
  Mob2
tcgaagccccgaggt

SEQ ID NO: 34626 - DNA, 15 bp, Artificial Sequence
  dgRNA
  Mob2
ccccgaggttggcga

SEQ ID NO: 34627 - DNA, 15 bp, Artificial Sequence
  dgRNA
  Cpt1b
aggcgctcccccaaa

SEQ ID NO: 34628 - DNA, 15 bp, Artificial Sequence
  dgRNA
  Cpt1b
cgctcccccaaaagg

SEQ ID NO: 34629 - DNA, 15 bp, Artificial Sequence
  dgRNA
  Cpt1b
ccccaatttgggagt

SEQ ID NO: 34630 - DNA, 15 bp, Artificial Sequence
  dgRNA
  Cpt1b
ggtctcacgtgagca

SEQ ID NO: 34631 - DNA, 15 bp, Artificial Sequence
  dgRNA
  Wdr37
gctaggccatagttt

SEQ ID NO: 34632 - DNA, 15 bp, Artificial Sequence
  dgRNA
  Wdr37
atagtttaggtctcc

SEQ ID NO: 34633 - DNA, 15 bp, Artificial Sequence
  dgRNA
  Wdr37
gccgaaagccaaaac

SEQ ID NO: 34634 - DNA, 15 bp, Artificial Sequence
  dgRNA
  Wdr37
caggagactatcccg

SEQ ID NO: 34635 - DNA, 15 bp, Artificial Sequence
  dgRNA
  Epo
aacatccccgacccc

SEQ ID NO: 34636 - DNA, 15 bp, Artificial Sequence
  dgRNA
  Epo
tcccgggaccaaccc

SEQ ID NO: 34637 - DNA, 15 bp, Artificial Sequence
  dgRNA
  Epo
accaaccctggccgg

SEQ ID NO: 34638 - DNA, 15 bp, Artificial Sequence
  dgRNA
  Epo
cactgtgttcccgaa

SEQ ID NO: 34639 - DNA, 15 bp, Artificial Sequence
  dgRNA
  Fam222b
ggcaagatattctag

SEQ ID NO: 34640 - DNA, 15 bp, Artificial Sequence
  dgRNA
  Fam222b
gacctaaaatatcca

SEQ ID NO: 34641 - DNA, 15 bp, Artificial Sequence
  dgRNA
  Fam222b
tccaaggccagcgag

SEQ ID NO: 34642 - DNA, 15 bp, Artificial Sequence
  dgRNA
  Fam222b
tgataaagacgtccc

SEQ ID NO: 34643 - DNA, 15 bp, Artificial Sequence
  dgRNA
  Obscn
tcggaggcacttgag

SEQ ID NO: 34644 - DNA, 15 bp, Artificial Sequence
  dgRNA
  Obscn
cggaggcacttgagt

SEQ ID NO: 34645 - DNA, 15 bp, Artificial Sequence
  dgRNA
  Obscn
gcacttgagtgggtt

SEQ ID NO: 34646 - DNA, 15 bp, Artificial Sequence
  dgRNA
  Obscn
gaggaggtgcctact

SEQ ID NO: 34647 - DNA, 15 bp, Artificial Sequence
  dgRNA
  Col6a3
tttgggtctgtccta

SEQ ID NO: 34648 - DNA, 15 bp, Artificial Sequence
  dgRNA
  Col6a3
ggtctgtcctatggc

SEQ ID NO: 34649 - DNA, 15 bp, Artificial Sequence
  dgRNA
  Col6a3
gtctgtcctatggca

SEQ ID NO: 34650 - DNA, 15 bp, Artificial Sequence
  dgRNA
  Col6a3
ccctgactgtacccc

SEQ ID NO: 34651 - DNA, 15 bp, Artificial Sequence
  dgRNA
  Flot1
cctatatccggtcac

SEQ ID NO: 34652 - DNA, 15 bp, Artificial Sequence
  dgRNA
  Flot1
gcagtcatacattgc

SEQ ID NO: 34653 - DNA, 15 bp, Artificial Sequence
  dgRNA
  Flot1
actcatggcaggcgg

SEQ ID NO: 34654 - DNA, 15 bp, Artificial Sequence
  dgRNA
  Flot1
aggcggcgggtattc

SEQ ID NO: 34655 - DNA, 15 bp, Artificial Sequence
  dgRNA
  Tpcn2
tgacattcctagagc

SEQ ID NO: 34656 - DNA, 15 bp, Artificial Sequence
  dgRNA
  Tpcn2
cggagcgccacccat

SEQ ID NO: 34657 - DNA, 15 bp, Artificial Sequence
  dgRNA
  Tpcn2
ggagcgccacccatt

SEQ ID NO: 34658 - DNA, 15 bp, Artificial Sequence
  dgRNA
  Tpcn2
gagcgccacccattg

SEQ ID NO: 34659 - DNA, 15 bp, Artificial Sequence
  dgRNA
  Prrg4
tagacaacccagacc

SEQ ID NO: 34660 - DNA, 15 bp, Artificial Sequence
  dgRNA
  Prrg4
agaacagctgaccga

SEQ ID NO: 34661 - DNA, 15 bp, Artificial Sequence
  dgRNA
  Prrg4
accgaaggtaacctc

SEQ ID NO: 34662 - DNA, 15 bp, Artificial Sequence
  dgRNA
  Prrg4
gaaggtaacctcggg

SEQ ID NO: 34663 - DNA, 15 bp, Artificial Sequence
  dgRNA
  Zfp229
gtgtctgccgcccag

SEQ ID NO: 34664 - DNA, 15 bp, Artificial Sequence
  dgRNA
  Zfp229
tgtctgccgcccagt

SEQ ID NO: 34665 - DNA, 15 bp, Artificial Sequence
  dgRNA
  Zfp229
ccgcccagtgggcgt

SEQ ID NO: 34666 - DNA, 15 bp, Artificial Sequence
  dgRNA
  Zfp229
atagctgggaccctt

SEQ ID NO: 34667 - DNA, 15 bp, Artificial Sequence
  dgRNA
  Zfp608
ctagaggacgcctgt

SEQ ID NO: 34668 - DNA, 15 bp, Artificial Sequence
  dgRNA
  Zfp608
aggacgcctgtaggt

SEQ ID NO: 34669 - DNA, 15 bp, Artificial Sequence
  dgRNA
  Zfp608
attacttactgatca

SEQ ID NO: 34670 - DNA, 15 bp, Artificial Sequence
  dgRNA
  Zfp608
gcggaatgagaagtt

SEQ ID NO: 34671 - DNA, 15 bp, Artificial Sequence
  dgRNA
  Phospho2
ccgcgagtccagagc

SEQ ID NO: 34672 - DNA, 15 bp, Artificial Sequence
  dgRNA
  Phospho2
gataactaaaccatt

SEQ ID NO: 34673 - DNA, 15 bp, Artificial Sequence
  dgRNA
  Phospho2
gtttagcaaccacgc

SEQ ID NO: 34674 - DNA, 15 bp, Artificial Sequence
  dgRNA
  Phospho2
aaggagccctgtccg

SEQ ID NO: 34675 - DNA, 15 bp, Artificial Sequence
  dgRNA
  Ssbp1
cgtaaaactacccac

SEQ ID NO: 34676 - DNA, 15 bp, Artificial Sequence
  dgRNA
  Ssbp1
aaaactacccacagg

SEQ ID NO: 34677 - DNA, 15 bp, Artificial Sequence
  dgRNA
  Ssbp1
ccgcccacttccgcc

SEQ ID NO: 34678 - DNA, 15 bp, Artificial Sequence
  dgRNA
  Ssbp1
ggcacttctaaattg

SEQ ID NO: 34679 - DNA, 15 bp, Artificial Sequence
  dgRNA
  Smim20
tctcggcctccacga

SEQ ID NO: 34680 - DNA, 15 bp, Artificial Sequence
  dgRNA
  Smim20
ctccacgatggcagc

SEQ ID NO: 34681 - DNA, 15 bp, Artificial Sequence
  dgRNA
  Smim20
acgatggcagccgga

SEQ ID NO: 34682 - DNA, 15 bp, Artificial Sequence
  dgRNA
  Smim20
ggcagccggagggcg

SEQ ID NO: 34683 - DNA, 15 bp, Artificial Sequence
  dgRNA
  Atp2b4
gtaccttgcagatcc

SEQ ID NO: 34684 - DNA, 15 bp, Artificial Sequence
  dgRNA
  Atp2b4
agtatccaggctcat

SEQ ID NO: 34685 - DNA, 15 bp, Artificial Sequence
  dgRNA
  Atp2b4
cagtatccaggctca

SEQ ID NO: 34686 - DNA, 15 bp, Artificial Sequence
  dgRNA
  Atp2b4
cggaactgagaactg

SEQ ID NO: 34687 - DNA, 15 bp, Artificial Sequence
  dgRNA
  Acaa1b
gagtcgccctctgat

SEQ ID NO: 34688 - DNA, 15 bp, Artificial Sequence
  dgRNA
  Acaa1b
tactgcgcaagttca

SEQ ID NO: 34689 - DNA, 15 bp, Artificial Sequence
  dgRNA
  Luzp2
gagagacgcctgctc

SEQ ID NO: 34690 - DNA, 15 bp, Artificial Sequence
  dgRNA
  Luzp2
ggaccctaaagagtc

SEQ ID NO: 34691 - DNA, 15 bp, Artificial Sequence
  dgRNA
  Luzp2
cgccagctcaattac

SEQ ID NO: 34692 - DNA, 15 bp, Artificial Sequence
  dgRNA
  Luzp2
tgattagaggcataa

SEQ ID NO: 34693 - DNA, 15 bp, Artificial Sequence
  dgRNA
  Uvrag
gagaagttacgcccc

SEQ ID NO: 34694 - DNA, 15 bp, Artificial Sequence
  dgRNA
  Uvrag
gccccaggtttagcc

SEQ ID NO: 34695 - DNA, 15 bp, Artificial Sequence
  dgRNA
  Uvrag
ccccaggtttagccc

SEQ ID NO: 34696 - DNA, 15 bp, Artificial Sequence
  dgRNA
  Uvrag
tgacagacgcaattg

SEQ ID NO: 34697 - DNA, 15 bp, Artificial Sequence
  dgRNA
  Hacd1
cgctcgcgtctctct

SEQ ID NO: 34698 - DNA, 15 bp, Artificial Sequence
  dgRNA
  Hacd1
cgtctctctaggaag

SEQ ID NO: 34699 - DNA, 15 bp, Artificial Sequence
  dgRNA
  Hacd1
aggtcgcagccagtg

SEQ ID NO: 34700 - DNA, 15 bp, Artificial Sequence
  dgRNA
  Hacd1
cggacagctctcccg

SEQ ID NO: 34701 - DNA, 15 bp, Artificial Sequence
  dgRNA
  Muc6
ggcggtggtgatcac

SEQ ID NO: 34702 - DNA, 15 bp, Artificial Sequence
  dgRNA
  Muc6
acaggcctagagtat

SEQ ID NO: 34703 - DNA, 15 bp, Artificial Sequence
  dgRNA
  Muc6
caggcctagagtatg

SEQ ID NO: 34704 - DNA, 15 bp, Artificial Sequence
  dgRNA
  Muc6
agtatggggcacaag

SEQ ID NO: 34705 - DNA, 15 bp, Artificial Sequence
  dgRNA
  Tceal7
tgcagtagtgctgat

SEQ ID NO: 34706 - DNA, 15 bp, Artificial Sequence
  dgRNA
  Tceal7
agtagtgctgatggg

SEQ ID NO: 34707 - DNA, 15 bp, Artificial Sequence
  dgRNA
  Tceal7
aggcgttatatatcc

SEQ ID NO: 34708 - DNA, 15 bp, Artificial Sequence
  dgRNA
  Tceal7
gcttctaatcacgtg

SEQ ID NO: 34709 - DNA, 15 bp, Artificial Sequence
  dgRNA
  Ube2ql1
tgcgtgtgtcgccgc

SEQ ID NO: 34710 - DNA, 15 bp, Artificial Sequence
  dgRNA
  Ube2ql1
gtcgccgcaggaacc

SEQ ID NO: 34711 - DNA, 15 bp, Artificial Sequence
  dgRNA
  Ube2ql1
gtgcagtcaagcccg

SEQ ID NO: 34712 - DNA, 15 bp, Artificial Sequence
  dgRNA
  Ube2ql1
ctgagcgtgctaata

SEQ ID NO: 34713 - DNA, 15 bp, Artificial Sequence
  dgRNA
  Cst11
caaaaagattgatag

SEQ ID NO: 34714 - DNA, 15 bp, Artificial Sequence
  dgRNA
  Cst11
ctacctgcctactct

SEQ ID NO: 34715 - DNA, 15 bp, Artificial Sequence
  dgRNA
  Pelp1
ctacagcgctcagcc

SEQ ID NO: 34716 - DNA, 15 bp, Artificial Sequence
  dgRNA
  Pelp1
tacagcgctcagccc

SEQ ID NO: 34717 - DNA, 15 bp, Artificial Sequence
  dgRNA
  Pelp1
aagccgccccaacgc

SEQ ID NO: 34718 - DNA, 15 bp, Artificial Sequence
  dgRNA
  Pelp1
ccccctcctgccgca

SEQ ID NO: 34719 - DNA, 15 bp, Artificial Sequence
  dgRNA
  Rarres2
agttcccacccgctc

SEQ ID NO: 34720 - DNA, 15 bp, Artificial Sequence
  dgRNA
  Rarres2
ctcatttggtgctcc

SEQ ID NO: 34721 - DNA, 15 bp, Artificial Sequence
  dgRNA
  Rarres2
ttggctcaatgcaag

SEQ ID NO: 34722 - DNA, 15 bp, Artificial Sequence
  dgRNA
  Rarres2
agatccagagcgggt

SEQ ID NO: 34723 - DNA, 15 bp, Artificial Sequence
  dgRNA
  Prr3
cgggacaaggacttt

SEQ ID NO: 34724 - DNA, 15 bp, Artificial Sequence
  dgRNA
  Prr3
ggatgtggcgacctt

SEQ ID NO: 34725 - DNA, 15 bp, Artificial Sequence
  dgRNA
  Prr3
accttaggatgcgac

SEQ ID NO: 34726 - DNA, 15 bp, Artificial Sequence
  dgRNA
  Prr3
gtcccgaagcctgtc

SEQ ID NO: 34727 - DNA, 15 bp, Artificial Sequence
  dgRNA
  Mtfr1
ttggtaggcttactc

SEQ ID NO: 34728 - DNA, 15 bp, Artificial Sequence
  dgRNA
  Mtfr1
tggtaggcttactca

SEQ ID NO: 34729 - DNA, 15 bp, Artificial Sequence
  dgRNA
  Mtfr1
ggcttactcagggtg

SEQ ID NO: 34730 - DNA, 15 bp, Artificial Sequence
  dgRNA
  Mtfr1
ttgtactgtcataat

SEQ ID NO: 34731 - DNA, 15 bp, Artificial Sequence
  dgRNA
  Nckap1l
aagcaaccggaagct

SEQ ID NO: 34732 - DNA, 15 bp, Artificial Sequence
  dgRNA
  Nckap1l
ctcggtgcaccaacc

SEQ ID NO: 34733 - DNA, 15 bp, Artificial Sequence
  dgRNA
  Nckap1l
tcggtgcaccaacca

SEQ ID NO: 34734 - DNA, 15 bp, Artificial Sequence
  dgRNA
  Nckap1l
gtgcaccaaccaggg

SEQ ID NO: 34735 - DNA, 15 bp, Artificial Sequence
  dgRNA
  Espl1
tgtacccgcccctcc

SEQ ID NO: 34736 - DNA, 15 bp, Artificial Sequence
  dgRNA
  Espl1
acgtgacagacagcg

SEQ ID NO: 34737 - DNA, 15 bp, Artificial Sequence
  dgRNA
  Espl1
tcccagagcgccacg

SEQ ID NO: 34738 - DNA, 15 bp, Artificial Sequence
  dgRNA
  Espl1
agagcgccacgcggc

SEQ ID NO: 34739 - DNA, 15 bp, Artificial Sequence
  dgRNA
  Mrpl57
tctcgctgtccagcg

SEQ ID NO: 34740 - DNA, 15 bp, Artificial Sequence
  dgRNA
  Mrpl57
cgctgtccagcgtgg

SEQ ID NO: 34741 - DNA, 15 bp, Artificial Sequence
  dgRNA
  Mrpl57
ccccgcagcttacag

SEQ ID NO: 34742 - DNA, 15 bp, Artificial Sequence
  dgRNA
  Mrpl57
atttgaatcctgcgc

SEQ ID NO: 34743 - DNA, 15 bp, Artificial Sequence
  dgRNA
  Glrb
ctaacagtctcccgc

SEQ ID NO: 34744 - DNA, 15 bp, Artificial Sequence
  dgRNA
  Glrb
taacagtctcccgct

SEQ ID NO: 34745 - DNA, 15 bp, Artificial Sequence
  dgRNA
  Glrb
aacagtctcccgctg

SEQ ID NO: 34746 - DNA, 15 bp, Artificial Sequence
  dgRNA
  Glrb
gcgtctcgtccctct

SEQ ID NO: 34747 - DNA, 15 bp, Artificial Sequence
  dgRNA
  Hyal3
gcccatggcccacaa

SEQ ID NO: 34748 - DNA, 15 bp, Artificial Sequence
  dgRNA
  Hyal3
tcgctccacttacag

SEQ ID NO: 34749 - DNA, 15 bp, Artificial Sequence
  dgRNA
  Hyal3
tccacttacagtggt

SEQ ID NO: 34750 - DNA, 15 bp, Artificial Sequence
  dgRNA
  Hyal3
ccacttacagtggtg

SEQ ID NO: 34751 - DNA, 15 bp, Artificial Sequence
  dgRNA
  Prokr2
tacaaaacccttgga

SEQ ID NO: 34752 - DNA, 15 bp, Artificial Sequence
  dgRNA
  Prokr2
ttcagtagatctagg

SEQ ID NO: 34753 - DNA, 15 bp, Artificial Sequence
  dgRNA
  Prokr2
gtagatctaggaggc

SEQ ID NO: 34754 - DNA, 15 bp, Artificial Sequence
  dgRNA
  Prokr2
ggcaggcgggtctcg

SEQ ID NO: 34755 - DNA, 15 bp, Artificial Sequence
  dgRNA
  Smpd4
tcatcaagctgcgcc

SEQ ID NO: 34756 - DNA, 15 bp, Artificial Sequence
  dgRNA
  Smpd4
gtcatcaagctgcgc

SEQ ID NO: 34757 - DNA, 15 bp, Artificial Sequence
  dgRNA
  Egfl8
tttcctcagccgatc

SEQ ID NO: 34758 - DNA, 15 bp, Artificial Sequence
  dgRNA
  Egfl8
ccgatctggcctact

SEQ ID NO: 34759 - DNA, 15 bp, Artificial Sequence
  dgRNA
  Egfl8
tcttaggctgaaagg

SEQ ID NO: 34760 - DNA, 15 bp, Artificial Sequence
  dgRNA
  Egfl8
ggttgctattagagc

SEQ ID NO: 34761 - DNA, 15 bp, Artificial Sequence
  dgRNA
  C2cd4d
atggtgattccacgc

SEQ ID NO: 34762 - DNA, 15 bp, Artificial Sequence
  dgRNA
  C2cd4d
tggtgattccacgca

SEQ ID NO: 34763 - DNA, 15 bp, Artificial Sequence
  dgRNA
  C2cd4d
cagtgcacccctgcg

SEQ ID NO: 34764 - DNA, 15 bp, Artificial Sequence
  dgRNA
  Il21
aacctgtgcacagtc

SEQ ID NO: 34765 - DNA, 15 bp, Artificial Sequence
  dgRNA
  Il21
gaaatctttgtatag

SEQ ID NO: 34766 - DNA, 15 bp, Artificial Sequence
  dgRNA
  Il21
cacaggttgtcgcta

SEQ ID NO: 34767 - DNA, 15 bp, Artificial Sequence
  dgRNA
  Znhit2
gcaaacctgttcctt

SEQ ID NO: 34768 - DNA, 15 bp, Artificial Sequence
  dgRNA
  Znhit2
gttaccgagaagttt

SEQ ID NO: 34769 - DNA, 15 bp, Artificial Sequence
  dgRNA
  Znhit2
agtttcggaaatgtg

SEQ ID NO: 34770 - DNA, 15 bp, Artificial Sequence
  dgRNA
  Znhit2
cggaaatgtgcggaa

SEQ ID NO: 34771 - DNA, 15 bp, Artificial Sequence
  dgRNA
  Raver2
gcgcagtggcgcctg

SEQ ID NO: 34772 - DNA, 15 bp, Artificial Sequence
  dgRNA
  Raver2
ggcgcctgaggccct

SEQ ID NO: 34773 - DNA, 15 bp, Artificial Sequence
  dgRNA
  Raver2
gccctcggatttgag

SEQ ID NO: 34774 - DNA, 15 bp, Artificial Sequence
  dgRNA
  Raver2
cggatttgagaggcg

SEQ ID NO: 34775 - DNA, 15 bp, Artificial Sequence
  dgRNA
  Pcdha3
gcaacaattcaaatt

SEQ ID NO: 34776 - DNA, 15 bp, Artificial Sequence
  dgRNA
  Pcdha3
gtgaatgtgtaatac

SEQ ID NO: 34777 - DNA, 15 bp, Artificial Sequence
  dgRNA
  Elp3
ccagatccacctttc

SEQ ID NO: 34778 - DNA, 15 bp, Artificial Sequence
  dgRNA
  Elp3
gccacctagacaggg

SEQ ID NO: 34779 - DNA, 15 bp, Artificial Sequence
  dgRNA
  Elp3
ccacctagacagggc

SEQ ID NO: 34780 - DNA, 15 bp, Artificial Sequence
  dgRNA
  Elp3
cacctagacagggcg

SEQ ID NO: 34781 - DNA, 15 bp, Artificial Sequence
  dgRNA
  Ccr7
caaggcactactacc

SEQ ID NO: 34782 - DNA, 15 bp, Artificial Sequence
  dgRNA
  Ccr7
aaggcactactacca

SEQ ID NO: 34783 - DNA, 15 bp, Artificial Sequence
  dgRNA
  Ccr7
aggcactactaccag

SEQ ID NO: 34784 - DNA, 15 bp, Artificial Sequence
  dgRNA
  Ccr7
acgactcagtgattc

SEQ ID NO: 34785 - DNA, 15 bp, Artificial Sequence
  dgRNA
  Lmbr1l
ctcacatctcagccg

SEQ ID NO: 34786 - DNA, 15 bp, Artificial Sequence
  dgRNA
  Lmbr1l
cagccgtggaccaca

SEQ ID NO: 34787 - DNA, 15 bp, Artificial Sequence
  dgRNA
  Lmbr1l
tagaacagcttcgac

SEQ ID NO: 34788 - DNA, 15 bp, Artificial Sequence
  dgRNA
  Lmbr1l
gaccgacagtctacg

SEQ ID NO: 34789 - DNA, 15 bp, Artificial Sequence
  dgRNA
  Pih1d1
gattggttggctagg

SEQ ID NO: 34790 - DNA, 15 bp, Artificial Sequence
  dgRNA
  Pih1d1
ttggctaggagggcg

SEQ ID NO: 34791 - DNA, 15 bp, Artificial Sequence
  dgRNA
  Pih1d1
gctctttcatacaag

SEQ ID NO: 34792 - DNA, 15 bp, Artificial Sequence
  dgRNA
  Pih1d1
acaagtggtccctgt

SEQ ID NO: 34793 - DNA, 15 bp, Artificial Sequence
  dgRNA
  Zfp369
actccctcctagtct

SEQ ID NO: 34794 - DNA, 15 bp, Artificial Sequence
  dgRNA
  Zfp369
agtagcctccttcaa

SEQ ID NO: 34795 - DNA, 15 bp, Artificial Sequence
  dgRNA
  Zfp369
agtagcagacgctta

SEQ ID NO: 34796 - DNA, 15 bp, Artificial Sequence
  dgRNA
  Zfp369
gacgcttacggactt

SEQ ID NO: 34797 - DNA, 15 bp, Artificial Sequence
  dgRNA
  Arhgef5
ggccacgccggacac

SEQ ID NO: 34798 - DNA, 15 bp, Artificial Sequence
  dgRNA
  Arhgef5
ttggtgactcctgcc

SEQ ID NO: 34799 - DNA, 15 bp, Artificial Sequence
  dgRNA
  Arhgef5
gcccctggacggcca

SEQ ID NO: 34800 - DNA, 15 bp, Artificial Sequence
  dgRNA
  Arhgef5
acggccacggcctgc

SEQ ID NO: 34801 - DNA, 15 bp, Artificial Sequence
  dgRNA
  Defb22
gctagtgcaggcctc

SEQ ID NO: 34802 - DNA, 15 bp, Artificial Sequence
  dgRNA
  Defb22
ctagtgcaggcctct

SEQ ID NO: 34803 - DNA, 15 bp, Artificial Sequence
  dgRNA
  Defb22
attcttctgctctac

SEQ ID NO: 34804 - DNA, 15 bp, Artificial Sequence
  dgRNA
  Defb22
actagccatgccttc

SEQ ID NO: 34805 - DNA, 15 bp, Artificial Sequence
  dgRNA
  Svip
gctgttaaaccctat

SEQ ID NO: 34806 - DNA, 15 bp, Artificial Sequence
  dgRNA
  Svip
ctgttaaaccctatt

SEQ ID NO: 34807 - DNA, 15 bp, Artificial Sequence
  dgRNA
  Svip
ttaaaccctattggg

SEQ ID NO: 34808 - DNA, 15 bp, Artificial Sequence
  dgRNA
  Svip
taaaccctattgggt

SEQ ID NO: 34809 - DNA, 15 bp, Artificial Sequence
  dgRNA
  Dcpp1
gctgtagtgccaagt

SEQ ID NO: 34810 - DNA, 15 bp, Artificial Sequence
  dgRNA
  Dcpp1
cagcctacgtcaaca

SEQ ID NO: 34811 - DNA, 15 bp, Artificial Sequence
  dgRNA
  Dcpp1
acagcctacgtcaac

SEQ ID NO: 34812 - DNA, 15 bp, Artificial Sequence
  dgRNA
  Olfr490
attggggtgctagat

SEQ ID NO: 34813 - DNA, 15 bp, Artificial Sequence
  dgRNA
  Olfr107
caatttatgccatga

SEQ ID NO: 34814 - DNA, 15 bp, Artificial Sequence
  dgRNA
  Olfr107
ggagaccgttttcca

SEQ ID NO: 34815 - DNA, 15 bp, Artificial Sequence
  dgRNA
  Olfr107
tccaagggatcagat

SEQ ID NO: 34816 - DNA, 15 bp, Artificial Sequence
  dgRNA
  Olfr107
gcgagggacaagtct

SEQ ID NO: 34817 - DNA, 15 bp, Artificial Sequence
  dgRNA
  Esp36
cagcttattgattgt

SEQ ID NO: 34818 - DNA, 15 bp, Artificial Sequence
  dgRNA
  Esp36
gtggttatcctgcat

SEQ ID NO: 34819 - DNA, 15 bp, Artificial Sequence
  dgRNA
  Esp36
ttttgaagcaagacg

SEQ ID NO: 34820 - DNA, 15 bp, Artificial Sequence
  dgRNA
  Gm15091
ggaggacgcctttag

SEQ ID NO: 34821 - DNA, 15 bp, Artificial Sequence
  dgRNA
  Slc29a2
gtgcccaacaaccac

SEQ ID NO: 34822 - DNA, 15 bp, Artificial Sequence
  dgRNA
  Slc29a2
ccggacccgtgccta

SEQ ID NO: 34823 - DNA, 15 bp, Artificial Sequence
  dgRNA
  Slc29a2
gagaagacgggtgcg

SEQ ID NO: 34824 - DNA, 15 bp, Artificial Sequence
  dgRNA
  Slc29a2
acgggtgcgaggcga

SEQ ID NO: 34825 - DNA, 15 bp, Artificial Sequence
  dgRNA
  Dleu7
tgagcccattctgcc

SEQ ID NO: 34826 - DNA, 15 bp, Artificial Sequence
  dgRNA
  Dleu7
gcgggtcaccacctg

SEQ ID NO: 34827 - DNA, 15 bp, Artificial Sequence
  dgRNA
  Dleu7
cgggtcaccacctgc

SEQ ID NO: 34828 - DNA, 15 bp, Artificial Sequence
  dgRNA
  Dleu7
tcaccacctgcgggc

SEQ ID NO: 34829 - DNA, 15 bp, Artificial Sequence
  dgRNA
  Scmh1
ccagtattagtactt

SEQ ID NO: 34830 - DNA, 15 bp, Artificial Sequence
  dgRNA
  Scmh1
acttaggtctcacca

SEQ ID NO: 34831 - DNA, 15 bp, Artificial Sequence
  dgRNA
  Scmh1
ggtgtaggtggatcc

SEQ ID NO: 34832 - DNA, 15 bp, Artificial Sequence
  dgRNA
  Scmh1
cctaagtactaatac

SEQ ID NO: 34833 - DNA, 15 bp, Artificial Sequence
  dgRNA
  Socs5
cccttcagagaggcg

SEQ ID NO: 34834 - DNA, 15 bp, Artificial Sequence
  dgRNA
  Socs5
tattttccattccgg

SEQ ID NO: 34835 - DNA, 15 bp, Artificial Sequence
  dgRNA
  Socs5
attttccattccggt

SEQ ID NO: 34836 - DNA, 15 bp, Artificial Sequence
  dgRNA
  Socs5
tttccattccggtgg

SEQ ID NO: 34837 - DNA, 15 bp, Artificial Sequence
  dgRNA
  Rab25
ccagcaatgtacact

SEQ ID NO: 34838 - DNA, 15 bp, Artificial Sequence
  dgRNA
  Rab25
cagcaatgtacactc

SEQ ID NO: 34839 - DNA, 15 bp, Artificial Sequence
  dgRNA
  Rab25
ccaggccctcttatt

SEQ ID NO: 34840 - DNA, 15 bp, Artificial Sequence
  dgRNA
  Rab25
caggccctcttattt

SEQ ID NO: 34841 - DNA, 15 bp, Artificial Sequence
  dgRNA
  Atoh8
ggcgcgcccccaact

SEQ ID NO: 34842 - DNA, 15 bp, Artificial Sequence
  dgRNA
  Atoh8
gcgcgcccccaactt

SEQ ID NO: 34843 - DNA, 15 bp, Artificial Sequence
  dgRNA
  Atoh8
gcccccaacttgggt

SEQ ID NO: 34844 - DNA, 15 bp, Artificial Sequence
  dgRNA
  Atoh8
cccccaacttgggta

SEQ ID NO: 34845 - DNA, 15 bp, Artificial Sequence
  dgRNA
  Sstr2
tcctgggccacccgc

SEQ ID NO: 34846 - DNA, 15 bp, Artificial Sequence
  dgRNA
  Sstr2
ctcaccgggtccaac

SEQ ID NO: 34847 - DNA, 15 bp, Artificial Sequence
  dgRNA
  Sstr2
acctgcgggtggccc

SEQ ID NO: 34848 - DNA, 15 bp, Artificial Sequence
  dgRNA
  Sstr2
gagaaaacctgcggg

SEQ ID NO: 34849 - DNA, 15 bp, Artificial Sequence
  dgRNA
  Cebpg
accaccgacagccta

SEQ ID NO: 34850 - DNA, 15 bp, Artificial Sequence
  dgRNA
  Cebpg
ccaccgacagcctaa

SEQ ID NO: 34851 - DNA, 15 bp, Artificial Sequence
  dgRNA
  Cebpg
caccgacagcctaag

SEQ ID NO: 34852 - DNA, 15 bp, Artificial Sequence
  dgRNA
  Cebpg
accgacagcctaagg

SEQ ID NO: 34853 - DNA, 15 bp, Artificial Sequence
  dgRNA
  G3bp2
ggggccccgagctcg

SEQ ID NO: 34854 - DNA, 15 bp, Artificial Sequence
  dgRNA
  G3bp2
gagctcgcggctctc

SEQ ID NO: 34855 - DNA, 15 bp, Artificial Sequence
  dgRNA
  G3bp2
cggattccgaagcct

SEQ ID NO: 34856 - DNA, 15 bp, Artificial Sequence
  dgRNA
  G3bp2
ggattccgaagcctc

SEQ ID NO: 34857 - DNA, 15 bp, Artificial Sequence
  dgRNA
  Icam1
gtcattacttcagtt

SEQ ID NO: 34858 - DNA, 15 bp, Artificial Sequence
  dgRNA
  Icam1
aaattcctagatcgc

SEQ ID NO: 34859 - DNA, 15 bp, Artificial Sequence
  dgRNA
  Icam1
aattcctagatcgca

SEQ ID NO: 34860 - DNA, 15 bp, Artificial Sequence
  dgRNA
  Icam1
attcctagatcgcag

SEQ ID NO: 34861 - DNA, 15 bp, Artificial Sequence
  dgRNA
  Arhgef12
acctcccgctcctcg

SEQ ID NO: 34862 - DNA, 15 bp, Artificial Sequence
  dgRNA
  Arhgef12
cgcctaccagagcgt

SEQ ID NO: 34863 - DNA, 15 bp, Artificial Sequence
  dgRNA
  Arhgef12
cctaccagagcgtcg

SEQ ID NO: 34864 - DNA, 15 bp, Artificial Sequence
  dgRNA
  Arhgef12
accagagcgtcgggg

SEQ ID NO: 34865 - DNA, 15 bp, Artificial Sequence
  dgRNA
  Rhob
aggcgaacccgcctt

SEQ ID NO: 34866 - DNA, 15 bp, Artificial Sequence
  dgRNA
  Rhob
gccttcggactgcag

SEQ ID NO: 34867 - DNA, 15 bp, Artificial Sequence
  dgRNA
  Rhob
ccttcggactgcagc

SEQ ID NO: 34868 - DNA, 15 bp, Artificial Sequence
  dgRNA
  Rhob
cagcgggcgaccaat

SEQ ID NO: 34869 - DNA, 15 bp, Artificial Sequence
  dgRNA
  Lmo4
cgtgcgtcctcgtac

SEQ ID NO: 34870 - DNA, 15 bp, Artificial Sequence
  dgRNA
  Lmo4
tcctcgtaccggccg

SEQ ID NO: 34871 - DNA, 15 bp, Artificial Sequence
  dgRNA
  Lmo4
cctcgtaccggccgc

SEQ ID NO: 34872 - DNA, 15 bp, Artificial Sequence
  dgRNA
  Lmo4
ctgcaccgccgctcc

SEQ ID NO: 34873 - DNA, 15 bp, Artificial Sequence
  dgRNA
  Tgfb3
accacgtcgaaccag

SEQ ID NO: 34874 - DNA, 15 bp, Artificial Sequence
  dgRNA
  Tgfb3
accgtgcagcgagag

SEQ ID NO: 34875 - DNA, 15 bp, Artificial Sequence
  dgRNA
  Tgfb3
gaggcttgtgtgcgc

SEQ ID NO: 34876 - DNA, 15 bp, Artificial Sequence
  dgRNA
  Tgfb3
caggccgatacgtca

SEQ ID NO: 34877 - DNA, 15 bp, Artificial Sequence
  dgRNA
  Dohh
tgcgctatgcacggc

SEQ ID NO: 34878 - DNA, 15 bp, Artificial Sequence
  dgRNA
  Dohh
tatgcacggccggcc

SEQ ID NO: 34879 - DNA, 15 bp, Artificial Sequence
  dgRNA
  Dohh
cggttgtgctgtgaa

SEQ ID NO: 34880 - DNA, 15 bp, Artificial Sequence
  dgRNA
  Dohh
tatgggagagacggt

SEQ ID NO: 34881 - DNA, 15 bp, Artificial Sequence
  dgRNA
  Ppox
gattaggacacgaac

SEQ ID NO: 34882 - DNA, 15 bp, Artificial Sequence
  dgRNA
  Ppox
ggttaacccgctcca

SEQ ID NO: 34883 - DNA, 15 bp, Artificial Sequence
  dgRNA
  Ppox
aactgactccgaaag

SEQ ID NO: 34884 - DNA, 15 bp, Artificial Sequence
  dgRNA
  Ppox
cggctgttgctcctc

SEQ ID NO: 34885 - DNA, 15 bp, Artificial Sequence
  dgRNA
  Lrrc75a
tagcccagagccgcg

SEQ ID NO: 34886 - DNA, 15 bp, Artificial Sequence
  dgRNA
  Lrrc75a
cccagagccgcgcgg

SEQ ID NO: 34887 - DNA, 15 bp, Artificial Sequence
  dgRNA
  Lrrc75a
ccagagccgcgcggc

SEQ ID NO: 34888 - DNA, 15 bp, Artificial Sequence
  dgRNA
  Lrrc75a
agccgcgcggcggga

SEQ ID NO: 34889 - DNA, 15 bp, Artificial Sequence
  dgRNA
  Bsnd
ggtgcaaagcctgtc

SEQ ID NO: 34890 - DNA, 15 bp, Artificial Sequence
  dgRNA
  Bsnd
caatcaccaaacagc

SEQ ID NO: 34891 - DNA, 15 bp, Artificial Sequence
  dgRNA
  Bsnd
cgggggaagtcacag

SEQ ID NO: 34892 - DNA, 15 bp, Artificial Sequence
  dgRNA
  Bsnd
gcgggggaagtcaca

SEQ ID NO: 34893 - DNA, 15 bp, Artificial Sequence
  dgRNA
  Ddx17
cattatgtctgcaca

SEQ ID NO: 34894 - DNA, 15 bp, Artificial Sequence
  dgRNA
  Ddx17
gccggcctcaagcgc

SEQ ID NO: 34895 - DNA, 15 bp, Artificial Sequence
  dgRNA
  Ddx17
ccggcctcaagcgcc

SEQ ID NO: 34896 - DNA, 15 bp, Artificial Sequence
  dgRNA
  Ddx17
gcgccgggttgagct

SEQ ID NO: 34897 - DNA, 15 bp, Artificial Sequence
  dgRNA
  Epc1
gcccggagaagggcc

SEQ ID NO: 34898 - DNA, 15 bp, Artificial Sequence
  dgRNA
  Epc1
cccggagaagggccc

SEQ ID NO: 34899 - DNA, 15 bp, Artificial Sequence
  dgRNA
  Epc1
gagcccggtgtaaaa

SEQ ID NO: 34900 - DNA, 15 bp, Artificial Sequence
  dgRNA
  Epc1
attctttccgagctg

SEQ ID NO: 34901 - DNA, 15 bp, Artificial Sequence
  dgRNA
  Dysf
ttggccaccgccctg

SEQ ID NO: 34902 - DNA, 15 bp, Artificial Sequence
  dgRNA
  Dysf
tggccaccgccctga

SEQ ID NO: 34903 - DNA, 15 bp, Artificial Sequence
  dgRNA
  Dysf
cctgagggcggaccc

SEQ ID NO: 34904 - DNA, 15 bp, Artificial Sequence
  dgRNA
  Dysf
agggcggacccaggc

SEQ ID NO: 34905 - DNA, 15 bp, Artificial Sequence
  dgRNA
  Mst1
atgagacagcactcg

SEQ ID NO: 34906 - DNA, 15 bp, Artificial Sequence
  dgRNA
  Mst1
tgagacagcactcga

SEQ ID NO: 34907 - DNA, 15 bp, Artificial Sequence
  dgRNA
  Mst1
gtgtcagtcaagtcc

SEQ ID NO: 34908 - DNA, 15 bp, Artificial Sequence
  dgRNA
  Mst1
gtcacccaatcctga

SEQ ID NO: 34909 - DNA, 15 bp, Artificial Sequence
  dgRNA
  Gnb4
aggccaagcgcgttc

SEQ ID NO: 34910 - DNA, 15 bp, Artificial Sequence
  dgRNA
  Gnb4
ggccaagcgcgttct

SEQ ID NO: 34911 - DNA, 15 bp, Artificial Sequence
  dgRNA
  Gnb4
cgcgcgccgctctct

SEQ ID NO: 34912 - DNA, 15 bp, Artificial Sequence
  dgRNA
  Gnb4
gcgcatgcagggcca

SEQ ID NO: 34913 - DNA, 15 bp, Artificial Sequence
  dgRNA
  Sugp2
ggcgccgcctcgcct

SEQ ID NO: 34914 - DNA, 15 bp, Artificial Sequence
  dgRNA
  Sugp2
gacgccgaggcgagg

SEQ ID NO: 34915 - DNA, 15 bp, Artificial Sequence
  dgRNA
  Trappc3l
gatgaagcataagta

SEQ ID NO: 34916 - DNA, 15 bp, Artificial Sequence
  dgRNA
  Trappc3l
cggtggtctgaatcc

SEQ ID NO: 34917 - DNA, 15 bp, Artificial Sequence
  dgRNA
  Palb2
gattccagctacttc

SEQ ID NO: 34918 - DNA, 15 bp, Artificial Sequence
  dgRNA
  Palb2
ctacttccggttgat

SEQ ID NO: 34919 - DNA, 15 bp, Artificial Sequence
  dgRNA
  Palb2
ccgctatccccgccc

SEQ ID NO: 34920 - DNA, 15 bp, Artificial Sequence
  dgRNA
  Palb2
gcctgctcgatcgct

SEQ ID NO: 34921 - DNA, 15 bp, Artificial Sequence
  dgRNA
  Capza3
ctctgtgacgtcacc

SEQ ID NO: 34922 - DNA, 15 bp, Artificial Sequence
  dgRNA
  Capza3
agttttcttcgaaag

SEQ ID NO: 34923 - DNA, 15 bp, Artificial Sequence
  dgRNA
  A530099J19Rik
aaaccatggaattcg

SEQ ID NO: 34924 - DNA, 15 bp, Artificial Sequence
  dgRNA
  A530099J19Rik
ttgctaataagtcgt

SEQ ID NO: 34925 - DNA, 15 bp, Artificial Sequence
  dgRNA
  A530099J19Rik
tgctaataagtcgtt

SEQ ID NO: 34926 - DNA, 15 bp, Artificial Sequence
  dgRNA
  A530099J19Rik
aattccatggtttac

SEQ ID NO: 34927 - DNA, 15 bp, Artificial Sequence
  dgRNA
  B3gat3
gagcttgtgctcaat

SEQ ID NO: 34928 - DNA, 15 bp, Artificial Sequence
  dgRNA
  B3gat3
agcttgtgctcaatt

SEQ ID NO: 34929 - DNA, 15 bp, Artificial Sequence
  dgRNA
  B3gat3
gaccgcttgacccag

SEQ ID NO: 34930 - DNA, 15 bp, Artificial Sequence
  dgRNA
  B3gat3
cgtcaacgccctgaa

SEQ ID NO: 34931 - DNA, 15 bp, Artificial Sequence
  dgRNA
  Mybbp1a
actcctccaggttaa

SEQ ID NO: 34932 - DNA, 15 bp, Artificial Sequence
  dgRNA
  Mybbp1a
aaaggcaaggccgta

SEQ ID NO: 34933 - DNA, 15 bp, Artificial Sequence
  dgRNA
  Mybbp1a
ggccccgccctcact

SEQ ID NO: 34934 - DNA, 15 bp, Artificial Sequence
  dgRNA
  Mybbp1a
gacgtcccagtgcgc

SEQ ID NO: 34935 - DNA, 15 bp, Artificial Sequence
  dgRNA
  Ankrd1
gattcgcatacgccg

SEQ ID NO: 34936 - DNA, 15 bp, Artificial Sequence
  dgRNA
  Ankrd1
ctctgaattggccac

SEQ ID NO: 34937 - DNA, 15 bp, Artificial Sequence
  dgRNA
  Ankrd1
tgaattggccactgg

SEQ ID NO: 34938 - DNA, 15 bp, Artificial Sequence
  dgRNA
  Ankrd1
gaattggccactggt

SEQ ID NO: 34939 - DNA, 15 bp, Artificial Sequence
  dgRNA
  Olfr1510
tgaccagtggctagc

SEQ ID NO: 34940 - DNA, 15 bp, Artificial Sequence
  dgRNA
  Olfr1510
ttgtttgatgaccag

SEQ ID NO: 34941 - DNA, 15 bp, Artificial Sequence
  dgRNA
  Dnajb14
gcaatcactccctaa

SEQ ID NO: 34942 - DNA, 15 bp, Artificial Sequence
  dgRNA
  Dnajb14
atcactccctaacgg

SEQ ID NO: 34943 - DNA, 15 bp, Artificial Sequence
  dgRNA
  Dnajb14
cctaacggaggccca

SEQ ID NO: 34944 - DNA, 15 bp, Artificial Sequence
  dgRNA
  Dnajb14
caagacctaagggcc

SEQ ID NO: 34945 - DNA, 15 bp, Artificial Sequence
  dgRNA
  Kng2
caagaatctaaatag

SEQ ID NO: 34946 - DNA, 15 bp, Artificial Sequence
  dgRNA
  Arhgap25
acatggcgagagcct

SEQ ID NO: 34947 - DNA, 15 bp, Artificial Sequence
  dgRNA
  Arhgap25
catggcgagagcctt

SEQ ID NO: 34948 - DNA, 15 bp, Artificial Sequence
  dgRNA
  Arhgap25
ctctcgccatgtgcc

SEQ ID NO: 34949 - DNA, 15 bp, Artificial Sequence
  dgRNA
  Arhgap25
tgcgttttgaggaag

SEQ ID NO: 34950 - DNA, 15 bp, Artificial Sequence
  dgRNA
  Atp11a
ggagtgaacggggcg

SEQ ID NO: 34951 - DNA, 15 bp, Artificial Sequence
  dgRNA
  Atp11a
gagtgaacggggcgg

SEQ ID NO: 34952 - DNA, 15 bp, Artificial Sequence
  dgRNA
  Atp11a
acccgacgagccacg

SEQ ID NO: 34953 - DNA, 15 bp, Artificial Sequence
  dgRNA
  Atp11a
cccgacgagccacgc

SEQ ID NO: 34954 - DNA, 15 bp, Artificial Sequence
  dgRNA
  Pmaip1
cgtaggtcggcgccg

SEQ ID NO: 34955 - DNA, 15 bp, Artificial Sequence
  dgRNA
  Pmaip1
cgccgcggcgatctg

SEQ ID NO: 34956 - DNA, 15 bp, Artificial Sequence
  dgRNA
  Pmaip1
ccggcaagttgcgct

SEQ ID NO: 34957 - DNA, 15 bp, Artificial Sequence
  dgRNA
  Pmaip1
cggcaagttgcgctc

SEQ ID NO: 34958 - DNA, 15 bp, Artificial Sequence
  dgRNA
  Rps6kb1
ttcccggcttggctt

SEQ ID NO: 34959 - DNA, 15 bp, Artificial Sequence
  dgRNA
  Rps6kb1
cggcttggcttcgga

SEQ ID NO: 34960 - DNA, 15 bp, Artificial Sequence
  dgRNA
  Rps6kb1
tttgtacgcatgcgc

SEQ ID NO: 34961 - DNA, 15 bp, Artificial Sequence
  dgRNA
  Rps6kb1
ccggagctgaacttg

SEQ ID NO: 34962 - DNA, 15 bp, Artificial Sequence
  dgRNA
  Lrig1
caatgagcaacgggc

SEQ ID NO: 34963 - DNA, 15 bp, Artificial Sequence
  dgRNA
  Lrig1
aatgagcaacgggca

SEQ ID NO: 34964 - DNA, 15 bp, Artificial Sequence
  dgRNA
  Lrig1
gcaacgggcagggcg

SEQ ID NO: 34965 - DNA, 15 bp, Artificial Sequence
  dgRNA
  Lrig1
gccctgcagccaacg

SEQ ID NO: 34966 - DNA, 15 bp, Artificial Sequence
  dgRNA
  Trim58
ttggctgctggatcc

SEQ ID NO: 34967 - DNA, 15 bp, Artificial Sequence
  dgRNA
  Trim58
gatccgggccagccc

SEQ ID NO: 34968 - DNA, 15 bp, Artificial Sequence
  dgRNA
  Trim58
ggcgataaaaccctc

SEQ ID NO: 34969 - DNA, 15 bp, Artificial Sequence
  dgRNA
  Trim58
gcgataaaaccctca

SEQ ID NO: 34970 - DNA, 15 bp, Artificial Sequence
  dgRNA
  Rhox2d
tgaagatggggcccg

SEQ ID NO: 34971 - DNA, 15 bp, Artificial Sequence
  dgRNA
  Rhox2d
gtggcagcagacgat

SEQ ID NO: 34972 - DNA, 15 bp, Artificial Sequence
  dgRNA
  Rhox2d
gcagcagacgattgg

SEQ ID NO: 34973 - DNA, 15 bp, Artificial Sequence
  dgRNA
  Zcchc10
tgtattacagacccc

SEQ ID NO: 34974 - DNA, 15 bp, Artificial Sequence
  dgRNA
  Zcchc10
tgaattgagcccgtc

SEQ ID NO: 34975 - DNA, 15 bp, Artificial Sequence
  dgRNA
  Zcchc10
cgtctggccccgccc

SEQ ID NO: 34976 - DNA, 15 bp, Artificial Sequence
  dgRNA
  Zcchc10
cgcccaggaccgcag

SEQ ID NO: 34977 - DNA, 15 bp, Artificial Sequence
  dgRNA
  Tbc1d1
accgctcacttttct

SEQ ID NO: 34978 - DNA, 15 bp, Artificial Sequence
  dgRNA
  Tbc1d1
gcctctttaacttgc

SEQ ID NO: 34979 - DNA, 15 bp, Artificial Sequence
  dgRNA
  Tbc1d1
tttaacttgcgggaa

SEQ ID NO: 34980 - DNA, 15 bp, Artificial Sequence
  dgRNA
  Tbc1d1
gctccgcacgcagag

SEQ ID NO: 34981 - DNA, 15 bp, Artificial Sequence
  dgRNA
  Rims1
cagtgtaattgtata

SEQ ID NO: 34982 - DNA, 15 bp, Artificial Sequence
  dgRNA
  Rims1
agtgtaattgtatat

SEQ ID NO: 34983 - DNA, 15 bp, Artificial Sequence
  dgRNA
  Rims1
atgtcgtaaaccgag

SEQ ID NO: 34984 - DNA, 15 bp, Artificial Sequence
  dgRNA
  Rims1
cgagtggacacacag

SEQ ID NO: 34985 - DNA, 15 bp, Artificial Sequence
  dgRNA
  Slc11a1
gggccagacttatta

SEQ ID NO: 34986 - DNA, 15 bp, Artificial Sequence
  dgRNA
  Slc11a1
cttattatggaacat

SEQ ID NO: 34987 - DNA, 15 bp, Artificial Sequence
  dgRNA
  Slc11a1
gaacatagggtatcc

SEQ ID NO: 34988 - DNA, 15 bp, Artificial Sequence
  dgRNA
  Slc11a1
cgaaggtcaaaactg

SEQ ID NO: 34989 - DNA, 15 bp, Artificial Sequence
  dgRNA
  Rbms3
aatactgcagccttc

SEQ ID NO: 34990 - DNA, 15 bp, Artificial Sequence
  dgRNA
  Rbms3
tctggactgcgtgcc

SEQ ID NO: 34991 - DNA, 15 bp, Artificial Sequence
  dgRNA
  Rbms3
gcgtgcccggctccc

SEQ ID NO: 34992 - DNA, 15 bp, Artificial Sequence
  dgRNA
  Rbms3
gttccacccactggc

SEQ ID NO: 34993 - DNA, 15 bp, Artificial Sequence
  dgRNA
  Nrxn2
tggacgtccgggcaa

SEQ ID NO: 34994 - DNA, 15 bp, Artificial Sequence
  dgRNA
  Nrxn2
agggctcggatgccc

SEQ ID NO: 34995 - DNA, 15 bp, Artificial Sequence
  dgRNA
  Nrxn2
gggctcggatgccct

SEQ ID NO: 34996 - DNA, 15 bp, Artificial Sequence
  dgRNA
  Nrxn2
ggctcggatgccctg

SEQ ID NO: 34997 - DNA, 15 bp, Artificial Sequence
  dgRNA
  Cdk2ap2
aggacgaagtgtgtt

SEQ ID NO: 34998 - DNA, 15 bp, Artificial Sequence
  dgRNA
  Cdk2ap2
acgaagtgtgttcgg

SEQ ID NO: 34999 - DNA, 15 bp, Artificial Sequence
  dgRNA
  Cdk2ap2
cccgccacacaccac

SEQ ID NO: 35000 - DNA, 15 bp, Artificial Sequence
  dgRNA
  Cdk2ap2
caccggagcaaaccg

SEQ ID NO: 35001 - DNA, 15 bp, Artificial Sequence
  dgRNA
  Vmn1r81
gtacacttaatttcc

SEQ ID NO: 35002 - DNA, 15 bp, Artificial Sequence
  dgRNA
  Vmn1r81
atagtcaatagaccc

SEQ ID NO: 35003 - DNA, 15 bp, Artificial Sequence
  dgRNA
  Cypt3
cttttacactatacc

SEQ ID NO: 35004 - DNA, 15 bp, Artificial Sequence
  dgRNA
  Cypt3
atacctggctggcat

SEQ ID NO: 35005 - DNA, 15 bp, Artificial Sequence
  dgRNA
  Cypt3
taacctatgccagcc

SEQ ID NO: 35006 - DNA, 15 bp, Artificial Sequence
  dgRNA
  Vps36
tgtcaacacttattt

SEQ ID NO: 35007 - DNA, 15 bp, Artificial Sequence
  dgRNA
  Vps36
gcatgtcaacaagtt

SEQ ID NO: 35008 - DNA, 15 bp, Artificial Sequence
  dgRNA
  Vps36
aagtttggcagtgac

SEQ ID NO: 35009 - DNA, 15 bp, Artificial Sequence
  dgRNA
  Vps36
aaatgtgcacgcgag

SEQ ID NO: 35010 - DNA, 15 bp, Artificial Sequence
  dgRNA
  Olfr599
cggtgtcagcatcag

SEQ ID NO: 35011 - DNA, 15 bp, Artificial Sequence
  dgRNA
  Olfr599
atcagcggtgagtag

SEQ ID NO: 35012 - DNA, 15 bp, Artificial Sequence
  dgRNA
  Olfr599
tgaagtacgaccaca

SEQ ID NO: 35013 - DNA, 15 bp, Artificial Sequence
  dgRNA
  6030468B19Rik
ccacgccagtgcccc

SEQ ID NO: 35014 - DNA, 15 bp, Artificial Sequence
  dgRNA
  6030468B19Rik
ggaaccagccctgta

SEQ ID NO: 35015 - DNA, 15 bp, Artificial Sequence
  dgRNA
  6030468B19Rik
gccctgtaaggtatt

SEQ ID NO: 35016 - DNA, 15 bp, Artificial Sequence
  dgRNA
  6030468B19Rik
ccctgtaaggtattg

SEQ ID NO: 35017 - DNA, 15 bp, Artificial Sequence
  dgRNA
  Ndufa4l2
tgacccctccctgat

SEQ ID NO: 35018 - DNA, 15 bp, Artificial Sequence
  dgRNA
  Ndufa4l2
cccctccctgatggg

SEQ ID NO: 35019 - DNA, 15 bp, Artificial Sequence
  dgRNA
  Ndufa4l2
ggggggcgggacccc

SEQ ID NO: 35020 - DNA, 15 bp, Artificial Sequence
  dgRNA
  Ndufa4l2
gggggcgggacccca

SEQ ID NO: 35021 - DNA, 15 bp, Artificial Sequence
  dgRNA
  Car9
accgcaccaatgtcc

SEQ ID NO: 35022 - DNA, 15 bp, Artificial Sequence
  dgRNA
  Car9
caggctttgatatcg

SEQ ID NO: 35023 - DNA, 15 bp, Artificial Sequence
  dgRNA
  Car9
gctttgatatcgggg

SEQ ID NO: 35024 - DNA, 15 bp, Artificial Sequence
  dgRNA
  Car9
ctttgatatcgggga

SEQ ID NO: 35025 - DNA, 15 bp, Artificial Sequence
  dgRNA
  Vamp1
aggccatttctcacg

SEQ ID NO: 35026 - DNA, 15 bp, Artificial Sequence
  dgRNA
  Vamp1
atttctcacgaggat

SEQ ID NO: 35027 - DNA, 15 bp, Artificial Sequence
  dgRNA
  Vamp1
cacgaggattggacc

SEQ ID NO: 35028 - DNA, 15 bp, Artificial Sequence
  dgRNA
  Vamp1
ttgacatcatccgag

SEQ ID NO: 35029 - DNA, 15 bp, Artificial Sequence
  dgRNA
  Sema4c
gtccgaatctttgcc

SEQ ID NO: 35030 - DNA, 15 bp, Artificial Sequence
  dgRNA
  Sema4c
ggctcgcgaactgct

SEQ ID NO: 35031 - DNA, 15 bp, Artificial Sequence
  dgRNA
  Sema4c
gctcgcgaactgctc

SEQ ID NO: 35032 - DNA, 15 bp, Artificial Sequence
  dgRNA
  Sema4c
ttccccccacctcga

SEQ ID NO: 35033 - DNA, 15 bp, Artificial Sequence
  dgRNA
  Olfr1377
aatcgtcctgcatgt

SEQ ID NO: 35034 - DNA, 15 bp, Artificial Sequence
  dgRNA
  Olfr1377
atcgtcctgcatgtg

SEQ ID NO: 35035 - DNA, 15 bp, Artificial Sequence
  dgRNA
  Olfr1377
tgctttactggttga

SEQ ID NO: 35036 - DNA, 15 bp, Artificial Sequence
  dgRNA
  Sez6l2
ctcccctaggggcct

SEQ ID NO: 35037 - DNA, 15 bp, Artificial Sequence
  dgRNA
  Sez6l2
cgggaagtgcagtcc

SEQ ID NO: 35038 - DNA, 15 bp, Artificial Sequence
  dgRNA
  Sez6l2
aattaggttccctcc

SEQ ID NO: 35039 - DNA, 15 bp, Artificial Sequence
  dgRNA
  Sez6l2
gtcccagtagtaatt

SEQ ID NO: 35040 - DNA, 15 bp, Artificial Sequence
  dgRNA
  BC024978
ggatgagagatattc

SEQ ID NO: 35041 - DNA, 15 bp, Artificial Sequence
  dgRNA
  BC024978
tcatttggggtctac

SEQ ID NO: 35042 - DNA, 15 bp, Artificial Sequence
  dgRNA
  BC024978
ggtctcatgaattat

SEQ ID NO: 35043 - DNA, 15 bp, Artificial Sequence
  dgRNA
  BC024978
gtccgggggatttag

SEQ ID NO: 35044 - DNA, 15 bp, Artificial Sequence
  dgRNA
  Cnksr2
cgagcagcccacacc

SEQ ID NO: 35045 - DNA, 15 bp, Artificial Sequence
  dgRNA
  Cnksr2
ctgctagaagtcggg

SEQ ID NO: 35046 - DNA, 15 bp, Artificial Sequence
  dgRNA
  Cnksr2
cccacgcacgcgcac

SEQ ID NO: 35047 - DNA, 15 bp, Artificial Sequence
  dgRNA
  Cnksr2
ccacgcacgcgcaca

SEQ ID NO: 35048 - DNA, 15 bp, Artificial Sequence
  dgRNA
  Cdon
tttttcagtaagcgg

SEQ ID NO: 35049 - DNA, 15 bp, Artificial Sequence
  dgRNA
  Cdon
cagtaagcggaggcc

SEQ ID NO: 35050 - DNA, 15 bp, Artificial Sequence
  dgRNA
  Cdon
aggatattccactac

SEQ ID NO: 35051 - DNA, 15 bp, Artificial Sequence
  dgRNA
  Plekhg1
tcccgcagggccccg

SEQ ID NO: 35052 - DNA, 15 bp, Artificial Sequence
  dgRNA
  Plekhg1
cgcagggccccgtgg

SEQ ID NO: 35053 - DNA, 15 bp, Artificial Sequence
  dgRNA
  Plekhg1
ccccgtggaggcggg

SEQ ID NO: 35054 - DNA, 15 bp, Artificial Sequence
  dgRNA
  Plekhg1
cccgtggaggcgggc

SEQ ID NO: 35055 - DNA, 15 bp, Artificial Sequence
  dgRNA
  Mroh4
ttgagactgtcagat

SEQ ID NO: 35056 - DNA, 15 bp, Artificial Sequence
  dgRNA
  Mroh4
ccttagagctcctct

SEQ ID NO: 35057 - DNA, 15 bp, Artificial Sequence
  dgRNA
  Mroh4
ccctcagtgtcggtt

SEQ ID NO: 35058 - DNA, 15 bp, Artificial Sequence
  dgRNA
  Mroh4
cagtgtcggttagga

SEQ ID NO: 35059 - DNA, 15 bp, Artificial Sequence
  dgRNA
  Cpox
ccgcgtgcgagcagc

SEQ ID NO: 35060 - DNA, 15 bp, Artificial Sequence
  dgRNA
  Cpox
cccacctctgtgcgc

SEQ ID NO: 35061 - DNA, 15 bp, Artificial Sequence
  dgRNA
  Cpox
ccacctctgtgcgca

SEQ ID NO: 35062 - DNA, 15 bp, Artificial Sequence
  dgRNA
  Cpox
aggctgacgacaaac

SEQ ID NO: 35063 - DNA, 15 bp, Artificial Sequence
  dgRNA
  Ppfibp2
gctcttgggtcctcg

SEQ ID NO: 35064 - DNA, 15 bp, Artificial Sequence
  dgRNA
  Ppfibp2
ctcttgggtcctcgc

SEQ ID NO: 35065 - DNA, 15 bp, Artificial Sequence
  dgRNA
  Ppfibp2
cctcgcgggccactg

SEQ ID NO: 35066 - DNA, 15 bp, Artificial Sequence
  dgRNA
  Ppfibp2
cgggccactgcggtg

SEQ ID NO: 35067 - DNA, 15 bp, Artificial Sequence
  dgRNA
  Farsb
tattcggctggaaaa

SEQ ID NO: 35068 - DNA, 15 bp, Artificial Sequence
  dgRNA
  Farsb
aaacggatgtgcaaa

SEQ ID NO: 35069 - DNA, 15 bp, Artificial Sequence
  dgRNA
  Farsb
tggttgaatttagac

SEQ ID NO: 35070 - DNA, 15 bp, Artificial Sequence
  dgRNA
  Farsb
ccaagagcggagcgt

SEQ ID NO: 35071 - DNA, 15 bp, Artificial Sequence
  dgRNA
  Pla2g2f
aggaattttaccagc

SEQ ID NO: 35072 - DNA, 15 bp, Artificial Sequence
  dgRNA
  Pla2g2f
ggaattttaccagcc

SEQ ID NO: 35073 - DNA, 15 bp, Artificial Sequence
  dgRNA
  Pla2g2f
ttaccagccgggtgt

SEQ ID NO: 35074 - DNA, 15 bp, Artificial Sequence
  dgRNA
  Pla2g2f
cttcccacacccggc

SEQ ID NO: 35075 - DNA, 15 bp, Artificial Sequence
  dgRNA
  Rab11fip3
gtacaaactgctatc

SEQ ID NO: 35076 - DNA, 15 bp, Artificial Sequence
  dgRNA
  Rab11fip3
cctgcctgtttgtta

SEQ ID NO: 35077 - DNA, 15 bp, Artificial Sequence
  dgRNA
  Rab11fip3
ttaacagagcgtgtc

SEQ ID NO: 35078 - DNA, 15 bp, Artificial Sequence
  dgRNA
  Rab11fip3
taacagagcgtgtct

SEQ ID NO: 35079 - DNA, 15 bp, Artificial Sequence
  dgRNA
  Sbf1
gcttcacccgcccaa

SEQ ID NO: 35080 - DNA, 15 bp, Artificial Sequence
  dgRNA
  Sbf1
cggtccttgagcatg

SEQ ID NO: 35081 - DNA, 15 bp, Artificial Sequence
  dgRNA
  Sbf1
gcatgaggtagtagg

SEQ ID NO: 35082 - DNA, 15 bp, Artificial Sequence
  dgRNA
  Sbf1
catgaggtagtaggc

SEQ ID NO: 35083 - DNA, 15 bp, Artificial Sequence
  dgRNA
  Clec7a
ccatgaacctcgcaa

SEQ ID NO: 35084 - DNA, 15 bp, Artificial Sequence
  dgRNA
  Clec7a
catgaacctcgcaaa

SEQ ID NO: 35085 - DNA, 15 bp, Artificial Sequence
  dgRNA
  Clec7a
gaaatgaaaacgcgt

SEQ ID NO: 35086 - DNA, 15 bp, Artificial Sequence
  dgRNA
  Clec7a
gccagtgcccaaagc

SEQ ID NO: 35087 - DNA, 15 bp, Artificial Sequence
  dgRNA
  Olfr124
taagcaacattccct

SEQ ID NO: 35088 - DNA, 15 bp, Artificial Sequence
  dgRNA
  Olfr124
atggctggttaattc

SEQ ID NO: 35089 - DNA, 15 bp, Artificial Sequence
  dgRNA
  Olfr124
tgcttaattaatggc

SEQ ID NO: 35090 - DNA, 15 bp, Artificial Sequence
  dgRNA
  Olfr124
atgttgcttaattaa

SEQ ID NO: 35091 - DNA, 15 bp, Artificial Sequence
  dgRNA
  Fahd2a
gaagtacctaacagc

SEQ ID NO: 35092 - DNA, 15 bp, Artificial Sequence
  dgRNA
  Fahd2a
aggagggcggacttc

SEQ ID NO: 35093 - DNA, 15 bp, Artificial Sequence
  dgRNA
  Fahd2a
ggagggcggacttcc

SEQ ID NO: 35094 - DNA, 15 bp, Artificial Sequence
  dgRNA
  Fahd2a
gggcggacttccggg

SEQ ID NO: 35095 - DNA, 15 bp, Artificial Sequence
  dgRNA
  Lama5
ccccttccaggacgc

SEQ ID NO: 35096 - DNA, 15 bp, Artificial Sequence
  dgRNA
  Lama5
ggacgctggtctggc

SEQ ID NO: 35097 - DNA, 15 bp, Artificial Sequence
  dgRNA
  Lama5
acgctggtctggccg

SEQ ID NO: 35098 - DNA, 15 bp, Artificial Sequence
  dgRNA
  Lama5
ctggccggggtcgga

SEQ ID NO: 35099 - DNA, 15 bp, Artificial Sequence
  dgRNA
  Fam169a
cgcggccccgaggcg

SEQ ID NO: 35100 - DNA, 15 bp, Artificial Sequence
  dgRNA
  Fam169a
aggcggggcggctcc

SEQ ID NO: 35101 - DNA, 15 bp, Artificial Sequence
  dgRNA
  Fam169a
cggctcccggcgagg

SEQ ID NO: 35102 - DNA, 15 bp, Artificial Sequence
  dgRNA
  Fam169a
gcgccgcggcgcacg

SEQ ID NO: 35103 - DNA, 15 bp, Artificial Sequence
  dgRNA
  Klhl8
aatagctataaaatc

SEQ ID NO: 35104 - DNA, 15 bp, Artificial Sequence
  dgRNA
  Klhl8
ggatattccccacgc

SEQ ID NO: 35105 - DNA, 15 bp, Artificial Sequence
  dgRNA
  Klhl8
gatattccccacgca

SEQ ID NO: 35106 - DNA, 15 bp, Artificial Sequence
  dgRNA
  Klhl8
atattccccacgcag

SEQ ID NO: 35107 - DNA, 15 bp, Artificial Sequence
  dgRNA
  Amhr2
cgggataggacagag

SEQ ID NO: 35108 - DNA, 15 bp, Artificial Sequence
  dgRNA
  Amhr2
ggataggacagagcg

SEQ ID NO: 35109 - DNA, 15 bp, Artificial Sequence
  dgRNA
  Amhr2
taggacagagcgggg

SEQ ID NO: 35110 - DNA, 15 bp, Artificial Sequence
  dgRNA
  Amhr2
agagcggggcggagt

SEQ ID NO: 35111 - DNA, 15 bp, Artificial Sequence
  dgRNA
  Slc25a35
acatctccccgcctc

SEQ ID NO: 35112 - DNA, 15 bp, Artificial Sequence
  dgRNA
  Slc25a35
aacccgttttagttg

SEQ ID NO: 35113 - DNA, 15 bp, Artificial Sequence
  dgRNA
  Slc25a35
ttttagttgaggccg

SEQ ID NO: 35114 - DNA, 15 bp, Artificial Sequence
  dgRNA
  Slc25a35
tttagttgaggccga

SEQ ID NO: 35115 - DNA, 15 bp, Artificial Sequence
  dgRNA
  Pbx1
gcctgccgccacggc

SEQ ID NO: 35116 - DNA, 15 bp, Artificial Sequence
  dgRNA
  Pbx1
cctgccgccacggct

SEQ ID NO: 35117 - DNA, 15 bp, Artificial Sequence
  dgRNA
  Pbx1
ctgccgccacggctg

SEQ ID NO: 35118 - DNA, 15 bp, Artificial Sequence
  dgRNA
  Pbx1
tgccgccacggctgg

SEQ ID NO: 35119 - DNA, 15 bp, Artificial Sequence
  dgRNA
  Rnf2
caagtcagcaggcgt

SEQ ID NO: 35120 - DNA, 15 bp, Artificial Sequence
  dgRNA
  Rnf2
tcagcaggcgttggc

SEQ ID NO: 35121 - DNA, 15 bp, Artificial Sequence
  dgRNA
  Rnf2
cagcaggcgttggct

SEQ ID NO: 35122 - DNA, 15 bp, Artificial Sequence
  dgRNA
  Rnf2
gcaggcgttggctgg

SEQ ID NO: 35123 - DNA, 15 bp, Artificial Sequence
  dgRNA
  Rpl19
attttgcccgacgaa

SEQ ID NO: 35124 - DNA, 15 bp, Artificial Sequence
  dgRNA
  Rpl19
ttttgcccgacgaaa

SEQ ID NO: 35125 - DNA, 15 bp, Artificial Sequence
  dgRNA
  Rpl19
tttgcccgacgaaag

SEQ ID NO: 35126 - DNA, 15 bp, Artificial Sequence
  dgRNA
  Rpl19
cccgacgaaaggggt

SEQ ID NO: 35127 - DNA, 15 bp, Artificial Sequence
  dgRNA
  Rps25
agtttagccaagacg

SEQ ID NO: 35128 - DNA, 15 bp, Artificial Sequence
  dgRNA
  Rps25
ggaagtactctctcg

SEQ ID NO: 35129 - DNA, 15 bp, Artificial Sequence
  dgRNA
  Rps25
gattgttgggccacc

SEQ ID NO: 35130 - DNA, 15 bp, Artificial Sequence
  dgRNA
  Rps25
cgcctcttgtgggat

SEQ ID NO: 35131 - DNA, 15 bp, Artificial Sequence
  dgRNA
  Zpbp2
cccctcgtgccaagc

SEQ ID NO: 35132 - DNA, 15 bp, Artificial Sequence
  dgRNA
  Zpbp2
caagccggaacacgc

SEQ ID NO: 35133 - DNA, 15 bp, Artificial Sequence
  dgRNA
  Zpbp2
acacgcaggcgctct

SEQ ID NO: 35134 - DNA, 15 bp, Artificial Sequence
  dgRNA
  Zpbp2
cacgcaggcgctctc

SEQ ID NO: 35135 - DNA, 15 bp, Artificial Sequence
  dgRNA
  Ebp
gagtctatgatggcg

SEQ ID NO: 35136 - DNA, 15 bp, Artificial Sequence
  dgRNA
  Ebp
atgatggcggggtcc

SEQ ID NO: 35137 - DNA, 15 bp, Artificial Sequence
  dgRNA
  Ebp
tgcttgcgtagagca

SEQ ID NO: 35138 - DNA, 15 bp, Artificial Sequence
  dgRNA
  Ebp
tacttcatggaaaac

SEQ ID NO: 35139 - DNA, 15 bp, Artificial Sequence
  dgRNA
  Skint2
tgtggccagactttc

SEQ ID NO: 35140 - DNA, 15 bp, Artificial Sequence
  dgRNA
  Skint2
ttcaggttaggagta

SEQ ID NO: 35141 - DNA, 15 bp, Artificial Sequence
  dgRNA
  Skint2
tcaggttaggagtag

SEQ ID NO: 35142 - DNA, 15 bp, Artificial Sequence
  dgRNA
  Skint2
actctgacatgttta

SEQ ID NO: 35143 - DNA, 15 bp, Artificial Sequence
  dgRNA
  Olfr738
cttaaatcctcatgc

SEQ ID NO: 35144 - DNA, 15 bp, Artificial Sequence
  dgRNA
  Slc13a4
cttcagatgcgatat

SEQ ID NO: 35145 - DNA, 15 bp, Artificial Sequence
  dgRNA
  Slc13a4
tttcaacttgctgat

SEQ ID NO: 35146 - DNA, 15 bp, Artificial Sequence
  dgRNA
  Slc13a4
gattggtctcagcag

SEQ ID NO: 35147 - DNA, 15 bp, Artificial Sequence
  dgRNA
  Slc13a4
tatcgcatctgaagg

SEQ ID NO: 35148 - DNA, 15 bp, Artificial Sequence
  dgRNA
  Optc
ggcacttgaaagaat

SEQ ID NO: 35149 - DNA, 15 bp, Artificial Sequence
  dgRNA
  Optc
cactcgtcctctccc

SEQ ID NO: 35150 - DNA, 15 bp, Artificial Sequence
  dgRNA
  Optc
cctggccaatagatg

SEQ ID NO: 35151 - DNA, 15 bp, Artificial Sequence
  dgRNA
  Optc
ctggccaatagatga

SEQ ID NO: 35152 - DNA, 15 bp, Artificial Sequence
  dgRNA
  Sfxn3
taatccgaatccctc

SEQ ID NO: 35153 - DNA, 15 bp, Artificial Sequence
  dgRNA
  Sfxn3
aatccgaatccctcc

SEQ ID NO: 35154 - DNA, 15 bp, Artificial Sequence
  dgRNA
  Sfxn3
gcgttgcaccctcag

SEQ ID NO: 35155 - DNA, 15 bp, Artificial Sequence
  dgRNA
  Sfxn3
ccagtgcacctagac

SEQ ID NO: 35156 - DNA, 15 bp, Artificial Sequence
  dgRNA
  Sf3b2
actactgctgcatac

SEQ ID NO: 35157 - DNA, 15 bp, Artificial Sequence
  dgRNA
  Sf3b2
cgttcgtcctctaga

SEQ ID NO: 35158 - DNA, 15 bp, Artificial Sequence
  dgRNA
  Sf3b2
ctctgcaacctccgt

SEQ ID NO: 35159 - DNA, 15 bp, Artificial Sequence
  dgRNA
  Sf3b2
tgcaacctccgttgg

SEQ ID NO: 35160 - DNA, 15 bp, Artificial Sequence
  dgRNA
  Acss3
gacttccaaacttcg

SEQ ID NO: 35161 - DNA, 15 bp, Artificial Sequence
  dgRNA
  Acss3
caaacttcggggcta

SEQ ID NO: 35162 - DNA, 15 bp, Artificial Sequence
  dgRNA
  Acss3
aaacttcggggctag

SEQ ID NO: 35163 - DNA, 15 bp, Artificial Sequence
  dgRNA
  Acss3
gccaggagtttatag

SEQ ID NO: 35164 - DNA, 15 bp, Artificial Sequence
  dgRNA
  Cyth1
ctgcagtgggctaat

SEQ ID NO: 35165 - DNA, 15 bp, Artificial Sequence
  dgRNA
  Cyth1
agctgtcctagtggc

SEQ ID NO: 35166 - DNA, 15 bp, Artificial Sequence
  dgRNA
  Cyth1
ggactgtttccccgt

SEQ ID NO: 35167 - DNA, 15 bp, Artificial Sequence
  dgRNA
  Cyth1
aagggctagtggcac

SEQ ID NO: 35168 - DNA, 15 bp, Artificial Sequence
  dgRNA
  Zc3h11a
cgctttgcgtcgtgc

SEQ ID NO: 35169 - DNA, 15 bp, Artificial Sequence
  dgRNA
  Zc3h11a
aggcgagcctgtagc

SEQ ID NO: 35170 - DNA, 15 bp, Artificial Sequence
  dgRNA
  Zc3h11a
ggcgagcctgtagcc

SEQ ID NO: 35171 - DNA, 15 bp, Artificial Sequence
  dgRNA
  Zc3h11a
cggaatttctttctg

SEQ ID NO: 35172 - DNA, 15 bp, Artificial Sequence
  dgRNA
  Nipal3
gcctacttgtccggc

SEQ ID NO: 35173 - DNA, 15 bp, Artificial Sequence
  dgRNA
  Nipal3
tacttgtccggcagg

SEQ ID NO: 35174 - DNA, 15 bp, Artificial Sequence
  dgRNA
  Nipal3
ttgtccggcaggtgg

SEQ ID NO: 35175 - DNA, 15 bp, Artificial Sequence
  dgRNA
  Nipal3
gagcagccataactt

SEQ ID NO: 35176 - DNA, 15 bp, Artificial Sequence
  dgRNA
  Nfix
ccgacacgtgctggc

SEQ ID NO: 35177 - DNA, 15 bp, Artificial Sequence
  dgRNA
  Nfix
cgccccgacacgtgc

SEQ ID NO: 35178 - DNA, 15 bp, Artificial Sequence
  dgRNA
  Nfix
ggacgcacaccgacg

SEQ ID NO: 35179 - DNA, 15 bp, Artificial Sequence
  dgRNA
  Nfix
gcgggtgagcgcggc

SEQ ID NO: 35180 - DNA, 15 bp, Artificial Sequence
  dgRNA
  Stmn3
gacaagcccatactc

SEQ ID NO: 35181 - DNA, 15 bp, Artificial Sequence
  dgRNA
  Stmn3
tccgtgcctattctg

SEQ ID NO: 35182 - DNA, 15 bp, Artificial Sequence
  dgRNA
  Stmn3
cggcagatgaaatat

SEQ ID NO: 35183 - DNA, 15 bp, Artificial Sequence
  dgRNA
  Stmn3
gtctcatagtcaggg

SEQ ID NO: 35184 - DNA, 15 bp, Artificial Sequence
  dgRNA
  Tmem201
gcgtgcgcaggctgc

SEQ ID NO: 35185 - DNA, 15 bp, Artificial Sequence
  dgRNA
  Tmem201
tgcaactgtggacgc

SEQ ID NO: 35186 - DNA, 15 bp, Artificial Sequence
  dgRNA
  Tmem201
gcaactgtggacgct

SEQ ID NO: 35187 - DNA, 15 bp, Artificial Sequence
  dgRNA
  Tmem201
caactgtggacgctg

SEQ ID NO: 35188 - DNA, 15 bp, Artificial Sequence
  dgRNA
  Desi1
ttcgacccttcaagc

SEQ ID NO: 35189 - DNA, 15 bp, Artificial Sequence
  dgRNA
  Desi1
ccctgttccctaaac

SEQ ID NO: 35190 - DNA, 15 bp, Artificial Sequence
  dgRNA
  Desi1
aaactggaacgcttg

SEQ ID NO: 35191 - DNA, 15 bp, Artificial Sequence
  dgRNA
  Desi1
gccccctgttccgtg

SEQ ID NO: 35192 - DNA, 15 bp, Artificial Sequence
  dgRNA
  Arhgef10l
ccctggctaactccc

SEQ ID NO: 35193 - DNA, 15 bp, Artificial Sequence
  dgRNA
  Arhgef10l
cctggctaactccct

SEQ ID NO: 35194 - DNA, 15 bp, Artificial Sequence
  dgRNA
  Arhgef10l
tatgcccagccaggt

SEQ ID NO: 35195 - DNA, 15 bp, Artificial Sequence
  dgRNA
  Arhgef10l
cagcctaacccttcc

SEQ ID NO: 35196 - DNA, 15 bp, Artificial Sequence
  dgRNA
  Gabarapl2
cccaggagcgctcct

SEQ ID NO: 35197 - DNA, 15 bp, Artificial Sequence
  dgRNA
  Gabarapl2
cctaggtctccgctt

SEQ ID NO: 35198 - DNA, 15 bp, Artificial Sequence
  dgRNA
  Gabarapl2
tcttaccaggcccgc

SEQ ID NO: 35199 - DNA, 15 bp, Artificial Sequence
  dgRNA
  Gabarapl2
aagccccgccccggg

SEQ ID NO: 35200 - DNA, 15 bp, Artificial Sequence
  dgRNA
  Rbm25
agctcgagcctctct

SEQ ID NO: 35201 - DNA, 15 bp, Artificial Sequence
  dgRNA
  Rbm25
gacaatcccactcta

SEQ ID NO: 35202 - DNA, 15 bp, Artificial Sequence
  dgRNA
  Rbm25
tacttaatgagtcag

SEQ ID NO: 35203 - DNA, 15 bp, Artificial Sequence
  dgRNA
  Rbm25
cggcggagactatct

SEQ ID NO: 35204 - DNA, 15 bp, Artificial Sequence
  dgRNA
  Sp4
gcggccccagcgccc

SEQ ID NO: 35205 - DNA, 15 bp, Artificial Sequence
  dgRNA
  Sp4
ccggccccggcaggt

SEQ ID NO: 35206 - DNA, 15 bp, Artificial Sequence
  dgRNA
  Sp4
gccccggcaggtcgg

SEQ ID NO: 35207 - DNA, 15 bp, Artificial Sequence
  dgRNA
  Sp4
cggcggccaatccgc

SEQ ID NO: 35208 - DNA, 15 bp, Artificial Sequence
  dgRNA
  Acnat2
tacaattaactacca

SEQ ID NO: 35209 - DNA, 15 bp, Artificial Sequence
  dgRNA
  Orc5
cggtgaggtgccccc

SEQ ID NO: 35210 - DNA, 15 bp, Artificial Sequence
  dgRNA
  Orc5
ccttcagcttgtgta

SEQ ID NO: 35211 - DNA, 15 bp, Artificial Sequence
  dgRNA
  Orc5
ctgagcaccgccgcc

SEQ ID NO: 35212 - DNA, 15 bp, Artificial Sequence
  dgRNA
  Orc5
gcccacgttgtcgcg

SEQ ID NO: 35213 - DNA, 15 bp, Artificial Sequence
  dgRNA
  Hsbp1l1
cacaagcaagctagg

SEQ ID NO: 35214 - DNA, 15 bp, Artificial Sequence
  dgRNA
  Sde2
agctccagcgctccg

SEQ ID NO: 35215 - DNA, 15 bp, Artificial Sequence
  dgRNA
  Sde2
gctccgcggtcttat

SEQ ID NO: 35216 - DNA, 15 bp, Artificial Sequence
  dgRNA
  Sde2
ggtcttatcggcctc

SEQ ID NO: 35217 - DNA, 15 bp, Artificial Sequence
  dgRNA
  Sde2
ttatcggcctcaggc

SEQ ID NO: 35218 - DNA, 15 bp, Artificial Sequence
  dgRNA
  Idh3a
gatgaaggcggtgat

SEQ ID NO: 35219 - DNA, 15 bp, Artificial Sequence
  dgRNA
  Idh3a
tgattggtcagctag

SEQ ID NO: 35220 - DNA, 15 bp, Artificial Sequence
  dgRNA
  Idh3a
cggcagctgtgcagc

SEQ ID NO: 35221 - DNA, 15 bp, Artificial Sequence
  dgRNA
  Idh3a
ctgtgcagcggggtc

SEQ ID NO: 35222 - DNA, 15 bp, Artificial Sequence
  dgRNA
  Cyp4a14
tctagtatctagtct

SEQ ID NO: 35223 - DNA, 15 bp, Artificial Sequence
  dgRNA
  Cyp4a14
acctacttgtgggag

SEQ ID NO: 35224 - DNA, 15 bp, Artificial Sequence
  dgRNA
  Cyp4a14
cacctacttgtggga

SEQ ID NO: 35225 - DNA, 15 bp, Artificial Sequence
  dgRNA
  Cyp4a14
acacctacttgtggg

SEQ ID NO: 35226 - DNA, 15 bp, Artificial Sequence
  dgRNA
  Myrip
tgccacccgcgcacc

SEQ ID NO: 35227 - DNA, 15 bp, Artificial Sequence
  dgRNA
  Myrip
gccacccgcgcaccc

SEQ ID NO: 35228 - DNA, 15 bp, Artificial Sequence
  dgRNA
  Myrip
ccacccgcgcacccg

SEQ ID NO: 35229 - DNA, 15 bp, Artificial Sequence
  dgRNA
  Myrip
cccggggagctcgcg

SEQ ID NO: 35230 - DNA, 15 bp, Artificial Sequence
  dgRNA
  Fam103a1
atatcctctccccga

SEQ ID NO: 35231 - DNA, 15 bp, Artificial Sequence
  dgRNA
  Fam103a1
tccccgacggtcacc

SEQ ID NO: 35232 - DNA, 15 bp, Artificial Sequence
  dgRNA
  Fam103a1
acggtcaccaggcac

SEQ ID NO: 35233 - DNA, 15 bp, Artificial Sequence
  dgRNA
  Fam103a1
ctttgctcgaccctg

SEQ ID NO: 35234 - DNA, 15 bp, Artificial Sequence
  dgRNA
  Olfr536
gttgcaaggccactt

SEQ ID NO: 35235 - DNA, 15 bp, Artificial Sequence
  dgRNA
  Rbm39
caccctcgcgagact

SEQ ID NO: 35236 - DNA, 15 bp, Artificial Sequence
  dgRNA
  Rbm39
accctcgcgagactt

SEQ ID NO: 35237 - DNA, 15 bp, Artificial Sequence
  dgRNA
  Rbm39
tcgggcaaagacagt

SEQ ID NO: 35238 - DNA, 15 bp, Artificial Sequence
  dgRNA
  Rbm39
ggtgcgtcctctatc

SEQ ID NO: 35239 - DNA, 15 bp, Artificial Sequence
  dgRNA
  Pde12
acacctcgaaagacc

SEQ ID NO: 35240 - DNA, 15 bp, Artificial Sequence
  dgRNA
  Pde12
cacctcgaaagacca

SEQ ID NO: 35241 - DNA, 15 bp, Artificial Sequence
  dgRNA
  Pde12
cggacgttgcaatcc

SEQ ID NO: 35242 - DNA, 15 bp, Artificial Sequence
  dgRNA
  Pde12
ggacgttgcaatcct

SEQ ID NO: 35243 - DNA, 15 bp, Artificial Sequence
  dgRNA
  Pum2
gcgcgtgaccagccc

SEQ ID NO: 35244 - DNA, 15 bp, Artificial Sequence
  dgRNA
  Pum2
cgcgtgaccagcccc

SEQ ID NO: 35245 - DNA, 15 bp, Artificial Sequence
  dgRNA
  Pum2
ggagcagagcgccag

SEQ ID NO: 35246 - DNA, 15 bp, Artificial Sequence
  dgRNA
  Pum2
agaggtccggcgtgc

SEQ ID NO: 35247 - DNA, 15 bp, Artificial Sequence
  dgRNA
  Sox3
gggctcggtgttgat

SEQ ID NO: 35248 - DNA, 15 bp, Artificial Sequence
  dgRNA
  Sox3
cggtgttgattggcc

SEQ ID NO: 35249 - DNA, 15 bp, Artificial Sequence
  dgRNA
  Sox3
caatcacgaggccca

SEQ ID NO: 35250 - DNA, 15 bp, Artificial Sequence
  dgRNA
  Sox3
aatcacgaggcccac

SEQ ID NO: 35251 - DNA, 15 bp, Artificial Sequence
  dgRNA
  Dazap1
ccgcgcgccttctga

SEQ ID NO: 35252 - DNA, 15 bp, Artificial Sequence
  dgRNA
  Dazap1
cagaaggcgcgcgga

SEQ ID NO: 35253 - DNA, 15 bp, Artificial Sequence
  dgRNA
  Dazap1
ccttcagaaggcgcg

SEQ ID NO: 35254 - DNA, 15 bp, Artificial Sequence
  dgRNA
  Dazap1
gtcctctgcattatc

SEQ ID NO: 35255 - DNA, 15 bp, Artificial Sequence
  dgRNA
  Zfp36l1
tccctcttgaccgca

SEQ ID NO: 35256 - DNA, 15 bp, Artificial Sequence
  dgRNA
  Zfp36l1
tgcggtcaagaggga

SEQ ID NO: 35257 - DNA, 15 bp, Artificial Sequence
  dgRNA
  Zfp36l1
atgcggtcaagaggg

SEQ ID NO: 35258 - DNA, 15 bp, Artificial Sequence
  dgRNA
  Zfp36l1
gccatgcggtcaaga

SEQ ID NO: 35259 - DNA, 15 bp, Artificial Sequence
  dgRNA
  Cdk15
gagcgctagctgctg

SEQ ID NO: 35260 - DNA, 15 bp, Artificial Sequence
  dgRNA
  Cdk15
tcatgagactgctcc

SEQ ID NO: 35261 - DNA, 15 bp, Artificial Sequence
  dgRNA
  Cdk15
cgagagaatacaact

SEQ ID NO: 35262 - DNA, 15 bp, Artificial Sequence
  dgRNA
  Cdk15
ccgagagaatacaac

SEQ ID NO: 35263 - DNA, 15 bp, Artificial Sequence
  dgRNA
  Mrpl23
acactatacaccgag

SEQ ID NO: 35264 - DNA, 15 bp, Artificial Sequence
  dgRNA
  Mrpl23
caccgagaggtatgc

SEQ ID NO: 35265 - DNA, 15 bp, Artificial Sequence
  dgRNA
  Mrpl23
tatgccggctttttg

SEQ ID NO: 35266 - DNA, 15 bp, Artificial Sequence
  dgRNA
  Mrpl23
atgccggctttttgc

SEQ ID NO: 35267 - DNA, 15 bp, Artificial Sequence
  dgRNA
  Zfp467
aggtgacaaccccga

SEQ ID NO: 35268 - DNA, 15 bp, Artificial Sequence
  dgRNA
  Zfp467
gacaaccccgaggga

SEQ ID NO: 35269 - DNA, 15 bp, Artificial Sequence
  dgRNA
  Zfp467
acaaccccgagggaa

SEQ ID NO: 35270 - DNA, 15 bp, Artificial Sequence
  dgRNA
  Zfp467
caaccccgagggaag

SEQ ID NO: 35271 - DNA, 15 bp, Artificial Sequence
  dgRNA
  Acaca
tttccaagccacttg

SEQ ID NO: 35272 - DNA, 15 bp, Artificial Sequence
  dgRNA
  Acaca
ttggctactcttttt

SEQ ID NO: 35273 - DNA, 15 bp, Artificial Sequence
  dgRNA
  Gpx6
ctgacgatcctcaaa

SEQ ID NO: 35274 - DNA, 15 bp, Artificial Sequence
  dgRNA
  Gpx6
tgacgatcctcaaaa

SEQ ID NO: 35275 - DNA, 15 bp, Artificial Sequence
  dgRNA
  Gpx6
ttgaggatcgtcagc

SEQ ID NO: 35276 - DNA, 15 bp, Artificial Sequence
  dgRNA
  Tnfrsf25
gagctagacccagcg

SEQ ID NO: 35277 - DNA, 15 bp, Artificial Sequence
  dgRNA
  Tnfrsf25
cccagcgtgggatca

SEQ ID NO: 35278 - DNA, 15 bp, Artificial Sequence
  dgRNA
  Tnfrsf25
cagggtgcaacctac

SEQ ID NO: 35279 - DNA, 15 bp, Artificial Sequence
  dgRNA
  Tnfrsf25
agggtgcaacctact

SEQ ID NO: 35280 - DNA, 15 bp, Artificial Sequence
  dgRNA
  Aars2
ctctatgcaaagtta

SEQ ID NO: 35281 - DNA, 15 bp, Artificial Sequence
  dgRNA
  Aars2
gctgagccgctcgcc

SEQ ID NO: 35282 - DNA, 15 bp, Artificial Sequence
  dgRNA
  Aars2
ctgagccgctcgcca

SEQ ID NO: 35283 - DNA, 15 bp, Artificial Sequence
  dgRNA
  Aars2
tgagccgctcgccag

SEQ ID NO: 35284 - DNA, 15 bp, Artificial Sequence
  dgRNA
  Denr
cacgccccactgcgc

SEQ ID NO: 35285 - DNA, 15 bp, Artificial Sequence
  dgRNA
  Denr
acgccccactgcgca

SEQ ID NO: 35286 - DNA, 15 bp, Artificial Sequence
  dgRNA
  Denr
gcgccccctaccgtc

SEQ ID NO: 35287 - DNA, 15 bp, Artificial Sequence
  dgRNA
  Denr
cgcctctacgcaact

SEQ ID NO: 35288 - DNA, 15 bp, Artificial Sequence
  dgRNA
  Plekha3
ggatgccccgggagt

SEQ ID NO: 35289 - DNA, 15 bp, Artificial Sequence
  dgRNA
  Plekha3
tggtctgctgcggac

SEQ ID NO: 35290 - DNA, 15 bp, Artificial Sequence
  dgRNA
  Plekha3
cggactggagatgtc

SEQ ID NO: 35291 - DNA, 15 bp, Artificial Sequence
  dgRNA
  Plekha3
ggagatgtccggatg

SEQ ID NO: 35292 - DNA, 15 bp, Artificial Sequence
  dgRNA
  Srebf2
gcttcgcgcgccgat

SEQ ID NO: 35293 - DNA, 15 bp, Artificial Sequence
  dgRNA
  Srebf2
gggtgcggaggctcg

SEQ ID NO: 35294 - DNA, 15 bp, Artificial Sequence
  dgRNA
  Srebf2
tgcggaggctcgggg

SEQ ID NO: 35295 - DNA, 15 bp, Artificial Sequence
  dgRNA
  Srebf2
agtgggcgcggcccg

SEQ ID NO: 35296 - DNA, 15 bp, Artificial Sequence
  dgRNA
  Rxfp4
acacccagattccaa

SEQ ID NO: 35297 - DNA, 15 bp, Artificial Sequence
  dgRNA
  Rxfp4
ctgagacaacagcgg

SEQ ID NO: 35298 - DNA, 15 bp, Artificial Sequence
  dgRNA
  Rxfp4
agacaacagcggcgg

SEQ ID NO: 35299 - DNA, 15 bp, Artificial Sequence
  dgRNA
  Rxfp4
gacaacagcggcggc

SEQ ID NO: 35300 - DNA, 15 bp, Artificial Sequence
  dgRNA
  Kcnt2
ccagacttttgctcc

SEQ ID NO: 35301 - DNA, 15 bp, Artificial Sequence
  dgRNA
  Kcnt2
ccccatcacaccctt

SEQ ID NO: 35302 - DNA, 15 bp, Artificial Sequence
  dgRNA
  Kcnt2
aaccgcccccaggct

SEQ ID NO: 35303 - DNA, 15 bp, Artificial Sequence
  dgRNA
  Kcnt2
caaggaaccgccccc

SEQ ID NO: 35304 - DNA, 15 bp, Artificial Sequence
  dgRNA
  Cdkn1b
gtcctggcggcgcta

SEQ ID NO: 35305 - DNA, 15 bp, Artificial Sequence
  dgRNA
  Cdkn1b
tcctggcggcgctac

SEQ ID NO: 35306 - DNA, 15 bp, Artificial Sequence
  dgRNA
  Cdkn1b
cctggcggcgctacg

SEQ ID NO: 35307 - DNA, 15 bp, Artificial Sequence
  dgRNA
  Cdkn1b
ggcggcgctacgggg

SEQ ID NO: 35308 - DNA, 15 bp, Artificial Sequence
  dgRNA
  Vmn2r108
tttacaatggcaagg

SEQ ID NO: 35309 - DNA, 15 bp, Artificial Sequence
  dgRNA
  Vmn2r108
tgaggccctctatac

SEQ ID NO: 35310 - DNA, 15 bp, Artificial Sequence
  dgRNA
  Cyp1b1
gcgcggatttcccac

SEQ ID NO: 35311 - DNA, 15 bp, Artificial Sequence
  dgRNA
  Cyp1b1
cccactggaccaccc

SEQ ID NO: 35312 - DNA, 15 bp, Artificial Sequence
  dgRNA
  Cyp1b1
ccactggaccaccct

SEQ ID NO: 35313 - DNA, 15 bp, Artificial Sequence
  dgRNA
  Cyp1b1
aaaaccccggagtag

SEQ ID NO: 35314 - DNA, 15 bp, Artificial Sequence
  dgRNA
  Tas2r107
ctatcacatgacaat

SEQ ID NO: 35315 - DNA, 15 bp, Artificial Sequence
  dgRNA
  Tas2r107
gattcagaactttat

SEQ ID NO: 35316 - DNA, 15 bp, Artificial Sequence
  dgRNA
  Olfr215
aggaacaccgacttc

SEQ ID NO: 35317 - DNA, 15 bp, Artificial Sequence
  dgRNA
  Olfr215
aacaccgacttcagg

SEQ ID NO: 35318 - DNA, 15 bp, Artificial Sequence
  dgRNA
  Olfr215
ttcaggtggccagta

SEQ ID NO: 35319 - DNA, 15 bp, Artificial Sequence
  dgRNA
  Olfr215
gtatggtagtataag

SEQ ID NO: 35320 - DNA, 15 bp, Artificial Sequence
  dgRNA
  Cts8
cacactcaacccttc

SEQ ID NO: 35321 - DNA, 15 bp, Artificial Sequence
  dgRNA
  Cts8
acccttcaggataga

SEQ ID NO: 35322 - DNA, 15 bp, Artificial Sequence
  dgRNA
  Cts8
cccttcaggatagat

SEQ ID NO: 35323 - DNA, 15 bp, Artificial Sequence
  dgRNA
  Cts8
acaattgcaaatcag

SEQ ID NO: 35324 - DNA, 15 bp, Artificial Sequence
  dgRNA
  Tap2
tgtaggcctgcttta

SEQ ID NO: 35325 - DNA, 15 bp, Artificial Sequence
  dgRNA
  Tap2
accagcatgtctaag

SEQ ID NO: 35326 - DNA, 15 bp, Artificial Sequence
  dgRNA
  Tap2
gagaaggctcccatc

SEQ ID NO: 35327 - DNA, 15 bp, Artificial Sequence
  dgRNA
  Tap2
tagggctaccccagg

SEQ ID NO: 35328 - DNA, 15 bp, Artificial Sequence
  dgRNA
  Zfp839
cgaagacctccactg

SEQ ID NO: 35329 - DNA, 15 bp, Artificial Sequence
  dgRNA
  Zfp839
actgaggatccgatc

SEQ ID NO: 35330 - DNA, 15 bp, Artificial Sequence
  dgRNA
  Zfp839
ctgaggatccgatcc

SEQ ID NO: 35331 - DNA, 15 bp, Artificial Sequence
  dgRNA
  Zfp839
tccgggacatcagca

SEQ ID NO: 35332 - DNA, 15 bp, Artificial Sequence
  dgRNA
  Vdac3
cacaccaccccgcgc

SEQ ID NO: 35333 - DNA, 15 bp, Artificial Sequence
  dgRNA
  Vdac3
cggtcacccgccagc

SEQ ID NO: 35334 - DNA, 15 bp, Artificial Sequence
  dgRNA
  Vdac3
ggtcacccgccagca

SEQ ID NO: 35335 - DNA, 15 bp, Artificial Sequence
  dgRNA
  Vdac3
ccgcgcacgcgcagc

SEQ ID NO: 35336 - DNA, 15 bp, Artificial Sequence
  dgRNA
  Iqcc
gaggggggccgcacc

SEQ ID NO: 35337 - DNA, 15 bp, Artificial Sequence
  dgRNA
  Iqcc
gatgcgtgcgtctga

SEQ ID NO: 35338 - DNA, 15 bp, Artificial Sequence
  dgRNA
  Iqcc
cccagcgtgtgtccc

SEQ ID NO: 35339 - DNA, 15 bp, Artificial Sequence
  dgRNA
  Iqcc
ccctggagacgcggg

SEQ ID NO: 35340 - DNA, 15 bp, Artificial Sequence
  dgRNA
  Zfp112
catggcacttccgct

SEQ ID NO: 35341 - DNA, 15 bp, Artificial Sequence
  dgRNA
  Zfp112
atggcacttccgctc

SEQ ID NO: 35342 - DNA, 15 bp, Artificial Sequence
  dgRNA
  Zfp112
tggcacttccgctcg

SEQ ID NO: 35343 - DNA, 15 bp, Artificial Sequence
  dgRNA
  Zfp112
cgctcggggaaggca

SEQ ID NO: 35344 - DNA, 15 bp, Artificial Sequence
  dgRNA
  Ap5z1
tttgcgcgggggagt

SEQ ID NO: 35345 - DNA, 15 bp, Artificial Sequence
  dgRNA
  Ap5z1
gatggccctcccacg

SEQ ID NO: 35346 - DNA, 15 bp, Artificial Sequence
  dgRNA
  Ap5z1
ccacgtgatccagcc

SEQ ID NO: 35347 - DNA, 15 bp, Artificial Sequence
  dgRNA
  Ap5z1
gatccagccaggacg

SEQ ID NO: 35348 - DNA, 15 bp, Artificial Sequence
  dgRNA
  Pipox
acctcgccacccacc

SEQ ID NO: 35349 - DNA, 15 bp, Artificial Sequence
  dgRNA
  Pipox
cgccacccaccaggg

SEQ ID NO: 35350 - DNA, 15 bp, Artificial Sequence
  dgRNA
  Pipox
ggagggccataccct

SEQ ID NO: 35351 - DNA, 15 bp, Artificial Sequence
  dgRNA
  Pipox
ggccgggtagctctc

SEQ ID NO: 35352 - DNA, 15 bp, Artificial Sequence
  dgRNA
  Ppp3cc
catctgccccacgcg

SEQ ID NO: 35353 - DNA, 15 bp, Artificial Sequence
  dgRNA
  Ppp3cc
ctgccccacgcgagg

SEQ ID NO: 35354 - DNA, 15 bp, Artificial Sequence
  dgRNA
  Ppp3cc
cccacgcgaggcgga

SEQ ID NO: 35355 - DNA, 15 bp, Artificial Sequence
  dgRNA
  Ppp3cc
acgcgaggcggacgg

SEQ ID NO: 35356 - DNA, 15 bp, Artificial Sequence
  dgRNA
  Kl
acgcggggacatctc

SEQ ID NO: 35357 - DNA, 15 bp, Artificial Sequence
  dgRNA
  Kl
caggattgtgcgatg

SEQ ID NO: 35358 - DNA, 15 bp, Artificial Sequence
  dgRNA
  Kl
tcccgcccccgtgcc

SEQ ID NO: 35359 - DNA, 15 bp, Artificial Sequence
  dgRNA
  Kl
gcccccgtgccaggc

SEQ ID NO: 35360 - DNA, 15 bp, Artificial Sequence
  dgRNA
  Gabrb2
cttcaggataaaacg

SEQ ID NO: 35361 - DNA, 15 bp, Artificial Sequence
  dgRNA
  Gabrb2
gaggaacacgactct

SEQ ID NO: 35362 - DNA, 15 bp, Artificial Sequence
  dgRNA
  Gabrb2
aggaacacgactcta

SEQ ID NO: 35363 - DNA, 15 bp, Artificial Sequence
  dgRNA
  Gabrb2
cagtcccggtgctct

SEQ ID NO: 35364 - DNA, 15 bp, Artificial Sequence
  dgRNA
  Med17
ctgagcccggtcagc

SEQ ID NO: 35365 - DNA, 15 bp, Artificial Sequence
  dgRNA
  Med17
tcagccggaagttcc

SEQ ID NO: 35366 - DNA, 15 bp, Artificial Sequence
  dgRNA
  Med17
tcacgtgcaacctac

SEQ ID NO: 35367 - DNA, 15 bp, Artificial Sequence
  dgRNA
  Med17
aaatgtccgggcagc

SEQ ID NO: 35368 - DNA, 15 bp, Artificial Sequence
  dgRNA
  Serpinb11
accacaggatagttc

SEQ ID NO: 35369 - DNA, 15 bp, Artificial Sequence
  dgRNA
  Serpinb11
ccaccagtggtgatc

SEQ ID NO: 35370 - DNA, 15 bp, Artificial Sequence
  dgRNA
  Serpinb11
ctgaccgcttcttca

SEQ ID NO: 35371 - DNA, 15 bp, Artificial Sequence
  dgRNA
  Serpinf1
ccggtatggagatgc

SEQ ID NO: 35372 - DNA, 15 bp, Artificial Sequence
  dgRNA
  Serpinf1
gtgagccagccggta

SEQ ID NO: 35373 - DNA, 15 bp, Artificial Sequence
  dgRNA
  Serpinf1
gatggctaacttcag

SEQ ID NO: 35374 - DNA, 15 bp, Artificial Sequence
  dgRNA
  Serpinf1
tgatggctaacttca

SEQ ID NO: 35375 - DNA, 15 bp, Artificial Sequence
  dgRNA
  Snx32
gtaggggtccacctg

SEQ ID NO: 35376 - DNA, 15 bp, Artificial Sequence
  dgRNA
  Snx32
tggcctatcctggtc

SEQ ID NO: 35377 - DNA, 15 bp, Artificial Sequence
  dgRNA
  Snx32
cctggtccggctttc

SEQ ID NO: 35378 - DNA, 15 bp, Artificial Sequence
  dgRNA
  Snx32
ccacgtaagattgat

SEQ ID NO: 35379 - DNA, 15 bp, Artificial Sequence
  dgRNA
  H2-M10.6
ctaaatcactacctt

SEQ ID NO: 35380 - DNA, 15 bp, Artificial Sequence
  dgRNA
  H2-M10.6
ttagacctgatgggg

SEQ ID NO: 35381 - DNA, 15 bp, Artificial Sequence
  dgRNA
  H2-M10.6
gatttagacctgatg

SEQ ID NO: 35382 - DNA, 15 bp, Artificial Sequence
  dgRNA
  H2-M10.6
tgatttagacctgat

SEQ ID NO: 35383 - DNA, 15 bp, Artificial Sequence
  dgRNA
  Gm15292
gttccccaatccccc

SEQ ID NO: 35384 - DNA, 15 bp, Artificial Sequence
  dgRNA
  Olfr911-ps1
ttgtgatagcctgaa

SEQ ID NO: 35385 - DNA, 15 bp, Artificial Sequence
  dgRNA
  Olfr911-ps1
atagtggtacattta

SEQ ID NO: 35386 - DNA, 15 bp, Artificial Sequence
  dgRNA
  Olfr911-ps1
gatatttccccatag

SEQ ID NO: 35387 - DNA, 15 bp, Artificial Sequence
  dgRNA
  Mark2
cggtcttcggaatct

SEQ ID NO: 35388 - DNA, 15 bp, Artificial Sequence
  dgRNA
  Mark2
tcttcggaatctagg

SEQ ID NO: 35389 - DNA, 15 bp, Artificial Sequence
  dgRNA
  Mark2
aggtgcgcgcgtccc

SEQ ID NO: 35390 - DNA, 15 bp, Artificial Sequence
  dgRNA
  Mark2
ggtgcgcgcgtcccc

SEQ ID NO: 35391 - DNA, 15 bp, Artificial Sequence
  dgRNA
  Gtf2h4
aggcgcggaatcaaa

SEQ ID NO: 35392 - DNA, 15 bp, Artificial Sequence
  dgRNA
  Gtf2h4
acttcggatgtttct

SEQ ID NO: 35393 - DNA, 15 bp, Artificial Sequence
  dgRNA
  Gtf2h4
ccaccttttctcggc

SEQ ID NO: 35394 - DNA, 15 bp, Artificial Sequence
  dgRNA
  Gtf2h4
cggccggccttcttg

SEQ ID NO: 35395 - DNA, 15 bp, Artificial Sequence
  dgRNA
  Col8a1
ccactcctaaaaact

SEQ ID NO: 35396 - DNA, 15 bp, Artificial Sequence
  dgRNA
  Col8a1
cactcctaaaaactc

SEQ ID NO: 35397 - DNA, 15 bp, Artificial Sequence
  dgRNA
  Col8a1
agtggagacgaatga

SEQ ID NO: 35398 - DNA, 15 bp, Artificial Sequence
  dgRNA
  Col8a1
gagtggagacgaatg

SEQ ID NO: 35399 - DNA, 15 bp, Artificial Sequence
  dgRNA
  Spidr
tccctaaagagcgag

SEQ ID NO: 35400 - DNA, 15 bp, Artificial Sequence
  dgRNA
  Spidr
ctcagtttgagcccg

SEQ ID NO: 35401 - DNA, 15 bp, Artificial Sequence
  dgRNA
  Spidr
acgacggctttcgca

SEQ ID NO: 35402 - DNA, 15 bp, Artificial Sequence
  dgRNA
  Spidr
cgacggctttcgcaa

SEQ ID NO: 35403 - DNA, 15 bp, Artificial Sequence
  dgRNA
  Crbn
ggtcatggataactt

SEQ ID NO: 35404 - DNA, 15 bp, Artificial Sequence
  dgRNA
  Crbn
gtcatggataacttt

SEQ ID NO: 35405 - DNA, 15 bp, Artificial Sequence
  dgRNA
  Crbn
atggtcctcttcatt

SEQ ID NO: 35406 - DNA, 15 bp, Artificial Sequence
  dgRNA
  Crbn
ccgctgtgccgctct

SEQ ID NO: 35407 - DNA, 15 bp, Artificial Sequence
  dgRNA
  Hnrnpul1
cgcggccagagtgga

SEQ ID NO: 35408 - DNA, 15 bp, Artificial Sequence
  dgRNA
  Hnrnpul1
tcgcggccagagtgg

SEQ ID NO: 35409 - DNA, 15 bp, Artificial Sequence
  dgRNA
  Hnrnpul1
aagtcgcggccagag

SEQ ID NO: 35410 - DNA, 15 bp, Artificial Sequence
  dgRNA
  Vmn2r18
atcatgggtgaaatc

SEQ ID NO: 35411 - DNA, 15 bp, Artificial Sequence
  dgRNA
  Vmn2r18
ccatttagactacaa

SEQ ID NO: 35412 - DNA, 15 bp, Artificial Sequence
  dgRNA
  Vmn2r18
gtagtctaaatggga

SEQ ID NO: 35413 - DNA, 15 bp, Artificial Sequence
  dgRNA
  Vmn2r18
tgtagtctaaatggg

SEQ ID NO: 35414 - DNA, 15 bp, Artificial Sequence
  dgRNA
  Arl10
tctaccacactggtc

SEQ ID NO: 35415 - DNA, 15 bp, Artificial Sequence
  dgRNA
  Arl10
gtggaagatccatcc

SEQ ID NO: 35416 - DNA, 15 bp, Artificial Sequence
  dgRNA
  Arl10
gaccgaacccctact

SEQ ID NO: 35417 - DNA, 15 bp, Artificial Sequence
  dgRNA
  Arl10
aagcgcagccttcgc

SEQ ID NO: 35418 - DNA, 15 bp, Artificial Sequence
  dgRNA
  Slco5a1
agtaggagtaccaga

SEQ ID NO: 35419 - DNA, 15 bp, Artificial Sequence
  dgRNA
  Slco5a1
caaacgcactgttta

SEQ ID NO: 35420 - DNA, 15 bp, Artificial Sequence
  dgRNA
  Slco5a1
aatgagcgagagtct

SEQ ID NO: 35421 - DNA, 15 bp, Artificial Sequence
  dgRNA
  Slco5a1
gagcgagagtcttgg

SEQ ID NO: 35422 - DNA, 15 bp, Artificial Sequence
  dgRNA
  Gimap9
cgccaggaatgtctc

SEQ ID NO: 35423 - DNA, 15 bp, Artificial Sequence
  dgRNA
  Gimap9
acctccgaggcaaca

SEQ ID NO: 35424 - DNA, 15 bp, Artificial Sequence
  dgRNA
  Gimap9
gggggaagctacaat

SEQ ID NO: 35425 - DNA, 15 bp, Artificial Sequence
  dgRNA
  Gimap9
cgcgtgctgacagaa

SEQ ID NO: 35426 - DNA, 15 bp, Artificial Sequence
  dgRNA
  Pitpnm2
ccctcctcccgcgcg

SEQ ID NO: 35427 - DNA, 15 bp, Artificial Sequence
  dgRNA
  Pitpnm2
cctcctcccgcgcgc

SEQ ID NO: 35428 - DNA, 15 bp, Artificial Sequence
  dgRNA
  Pitpnm2
tcccgcgcgcgggct

SEQ ID NO: 35429 - DNA, 15 bp, Artificial Sequence
  dgRNA
  Pitpnm2
gcgggctcggcagtg

SEQ ID NO: 35430 - DNA, 15 bp, Artificial Sequence
  dgRNA
  Ldb3
agatatcagtgtcga

SEQ ID NO: 35431 - DNA, 15 bp, Artificial Sequence
  dgRNA
  Ldb3
tcttaggagcctccc

SEQ ID NO: 35432 - DNA, 15 bp, Artificial Sequence
  dgRNA
  Gm5111
tgtcaaactgattaa

SEQ ID NO: 35433 - DNA, 15 bp, Artificial Sequence
  dgRNA
  Gm5111
ggtagcagagcctcg

SEQ ID NO: 35434 - DNA, 15 bp, Artificial Sequence
  dgRNA
  Gm5111
acctgaggtacctgc

SEQ ID NO: 35435 - DNA, 15 bp, Artificial Sequence
  dgRNA
  Gm5111
cttgagagcagtaaa

SEQ ID NO: 35436 - DNA, 15 bp, Artificial Sequence
  dgRNA
  Krt19
gtgtcaaattcctgg

SEQ ID NO: 35437 - DNA, 15 bp, Artificial Sequence
  dgRNA
  Krt19
gtgatatcgtcactc

SEQ ID NO: 35438 - DNA, 15 bp, Artificial Sequence
  dgRNA
  Krt19
taagcctgtgtagta

SEQ ID NO: 35439 - DNA, 15 bp, Artificial Sequence
  dgRNA
  Krt19
tagtaaggggctgaa

SEQ ID NO: 35440 - DNA, 15 bp, Artificial Sequence
  dgRNA
  Naaa
aagtacaaccactcc

SEQ ID NO: 35441 - DNA, 15 bp, Artificial Sequence
  dgRNA
  Naaa
caggcttaatcccgc

SEQ ID NO: 35442 - DNA, 15 bp, Artificial Sequence
  dgRNA
  Naaa
aggcttaatcccgct

SEQ ID NO: 35443 - DNA, 15 bp, Artificial Sequence
  dgRNA
  Naaa
ggcttaatcccgctg

SEQ ID NO: 35444 - DNA, 15 bp, Artificial Sequence
  dgRNA
  Cd300lf
gctttatatgccagc

SEQ ID NO: 35445 - DNA, 15 bp, Artificial Sequence
  dgRNA
  Cd300lf
tatgccagcgggaag

SEQ ID NO: 35446 - DNA, 15 bp, Artificial Sequence
  dgRNA
  Cd300lf
caggctcggtgcttc

SEQ ID NO: 35447 - DNA, 15 bp, Artificial Sequence
  dgRNA
  Cd300lf
ttagccacttcccgc

SEQ ID NO: 35448 - DNA, 15 bp, Artificial Sequence
  dgRNA
  Enkd1
ggcggcgaacccctc

SEQ ID NO: 35449 - DNA, 15 bp, Artificial Sequence
  dgRNA
  Enkd1
gcggcgaacccctct

SEQ ID NO: 35450 - DNA, 15 bp, Artificial Sequence
  dgRNA
  Enkd1
acccctctgggcagt

SEQ ID NO: 35451 - DNA, 15 bp, Artificial Sequence
  dgRNA
  Enkd1
gcagtgggctagtcg

SEQ ID NO: 35452 - DNA, 15 bp, Artificial Sequence
  dgRNA
  1700015E13Rik
aactcctaacctaac

SEQ ID NO: 35453 - DNA, 15 bp, Artificial Sequence
  dgRNA
  1700015E13Rik
aacctaactggctaa

SEQ ID NO: 35454 - DNA, 15 bp, Artificial Sequence
  dgRNA
  1700015E13Rik
ttagccagttaggtt

SEQ ID NO: 35455 - DNA, 15 bp, Artificial Sequence
  dgRNA
  1700015E13Rik
ttccattagccagtt

SEQ ID NO: 35456 - DNA, 15 bp, Artificial Sequence
  dgRNA
  Gm5082
tggtgagtccacagt

SEQ ID NO: 35457 - DNA, 15 bp, Artificial Sequence
  dgRNA
  Gm5082
tgagaagacaaacgt

SEQ ID NO: 35458 - DNA, 15 bp, Artificial Sequence
  dgRNA
  Gm5082
atgattccctgcagg

SEQ ID NO: 35459 - DNA, 15 bp, Artificial Sequence
  dgRNA
  Gm5082
ggggccttcgagtca

SEQ ID NO: 35460 - DNA, 15 bp, Artificial Sequence
  dgRNA
  BC035044
ggccaaatgtcccaa

SEQ ID NO: 35461 - DNA, 15 bp, Artificial Sequence
  dgRNA
  BC035044
agtaagctcatgcaa

SEQ ID NO: 35462 - DNA, 15 bp, Artificial Sequence
  dgRNA
  BC035044
tttggcctgttaaag

SEQ ID NO: 35463 - DNA, 15 bp, Artificial Sequence
  dgRNA
  BC035044
tttcgggttagttta

SEQ ID NO: 35464 - DNA, 15 bp, Artificial Sequence
  dgRNA
  Larp4b
gggtgggacttccgc

SEQ ID NO: 35465 - DNA, 15 bp, Artificial Sequence
  dgRNA
  Larp4b
ggtgggacttccgca

SEQ ID NO: 35466 - DNA, 15 bp, Artificial Sequence
  dgRNA
  Larp4b
acttccgcagggccc

SEQ ID NO: 35467 - DNA, 15 bp, Artificial Sequence
  dgRNA
  Larp4b
gcagggccccggaag

SEQ ID NO: 35468 - DNA, 15 bp, Artificial Sequence
  dgRNA
  Cd40
gcgggactcctagca

SEQ ID NO: 35469 - DNA, 15 bp, Artificial Sequence
  dgRNA
  Cd40
ctaggagtcccgccc

SEQ ID NO: 35470 - DNA, 15 bp, Artificial Sequence
  dgRNA
  Ctdspl2
gtcaggaattcgctc

SEQ ID NO: 35471 - DNA, 15 bp, Artificial Sequence
  dgRNA
  Ctdspl2
gtgagttccctaagg

SEQ ID NO: 35472 - DNA, 15 bp, Artificial Sequence
  dgRNA
  Ctdspl2
cacggtagtaaaagt

SEQ ID NO: 35473 - DNA, 15 bp, Artificial Sequence
  dgRNA
  Ctdspl2
cccgcctctccggat

SEQ ID NO: 35474 - DNA, 15 bp, Artificial Sequence
  dgRNA
  Gfod1
caggcgagacaggcg

SEQ ID NO: 35475 - DNA, 15 bp, Artificial Sequence
  dgRNA
  Gfod1
cgagacaggcggggc

SEQ ID NO: 35476 - DNA, 15 bp, Artificial Sequence
  dgRNA
  Gfod1
agacaggcggggccg

SEQ ID NO: 35477 - DNA, 15 bp, Artificial Sequence
  dgRNA
  Gfod1
gtcaaagcgggttcc

SEQ ID NO: 35478 - DNA, 15 bp, Artificial Sequence
  dgRNA
  Psmb4
gaattgtcagaatac

SEQ ID NO: 35479 - DNA, 15 bp, Artificial Sequence
  dgRNA
  Psmb4
aattgtcagaatact

SEQ ID NO: 35480 - DNA, 15 bp, Artificial Sequence
  dgRNA
  Psmb4
catccctactgcagt

SEQ ID NO: 35481 - DNA, 15 bp, Artificial Sequence
  dgRNA
  Psmb4
tactgcagtgggata

SEQ ID NO: 35482 - DNA, 15 bp, Artificial Sequence
  dgRNA
  Eef1g
agataccagccttcg

SEQ ID NO: 35483 - DNA, 15 bp, Artificial Sequence
  dgRNA
  Eef1g
gataccagccttcga

SEQ ID NO: 35484 - DNA, 15 bp, Artificial Sequence
  dgRNA
  Eef1g
ccagccttcgagggg

SEQ ID NO: 35485 - DNA, 15 bp, Artificial Sequence
  dgRNA
  Eef1g
gggcggtgcttccgc

SEQ ID NO: 35486 - DNA, 15 bp, Artificial Sequence
  dgRNA
  mt-Nd5
ataatagtaatccat

SEQ ID NO: 35487 - DNA, 15 bp, Artificial Sequence
  dgRNA
  mt-Nd5
tttggatttgcacca

SEQ ID NO: 35488 - DNA, 15 bp, Artificial Sequence
  dgRNA
  Spata2l
cgcccagcttcgccc

SEQ ID NO: 35489 - DNA, 15 bp, Artificial Sequence
  dgRNA
  Spata2l
tcctacttagccgaa

SEQ ID NO: 35490 - DNA, 15 bp, Artificial Sequence
  dgRNA
  Spata2l
cctacttagccgaaa

SEQ ID NO: 35491 - DNA, 15 bp, Artificial Sequence
  dgRNA
  Spata2l
ccaacgtcacgacca

SEQ ID NO: 35492 - DNA, 15 bp, Artificial Sequence
  dgRNA
  Rph3al
ccagtacaatagtgc

SEQ ID NO: 35493 - DNA, 15 bp, Artificial Sequence
  dgRNA
  Rph3al
cagtacaatagtgct

SEQ ID NO: 35494 - DNA, 15 bp, Artificial Sequence
  dgRNA
  Rph3al
agtacaatagtgctg

SEQ ID NO: 35495 - DNA, 15 bp, Artificial Sequence
  dgRNA
  Rph3al
cggcttccctgcact

SEQ ID NO: 35496 - DNA, 15 bp, Artificial Sequence
  dgRNA
  Ssrp1
aagaattcagccgcg

SEQ ID NO: 35497 - DNA, 15 bp, Artificial Sequence
  dgRNA
  Ssrp1
agaattcagccgcgt

SEQ ID NO: 35498 - DNA, 15 bp, Artificial Sequence
  dgRNA
  Ssrp1
tcgctttagccgacc

SEQ ID NO: 35499 - DNA, 15 bp, Artificial Sequence
  dgRNA
  Ssrp1
cgctttagccgacca

SEQ ID NO: 35500 - DNA, 15 bp, Artificial Sequence
  dgRNA
  Cetn4
cctcctcaccacgcg

SEQ ID NO: 35501 - DNA, 15 bp, Artificial Sequence
  dgRNA
  Cetn4
ccgcctgcttgagcg

SEQ ID NO: 35502 - DNA, 15 bp, Artificial Sequence
  dgRNA
  Cetn4
ttccattgggcgcaa

SEQ ID NO: 35503 - DNA, 15 bp, Artificial Sequence
  dgRNA
  Cetn4
aatggtcgtcaatca

SEQ ID NO: 35504 - DNA, 15 bp, Artificial Sequence
  dgRNA
  Lypd3
gggccgctctccctg

SEQ ID NO: 35505 - DNA, 15 bp, Artificial Sequence
  dgRNA
  Lypd3
ggccgctctccctgt

SEQ ID NO: 35506 - DNA, 15 bp, Artificial Sequence
  dgRNA
  Lypd3
gggtgacgcacctag

SEQ ID NO: 35507 - DNA, 15 bp, Artificial Sequence
  dgRNA
  Lypd3
tgacgcacctagagg

SEQ ID NO: 35508 - DNA, 15 bp, Artificial Sequence
  dgRNA
  Fam183b
gtggtgctccgagcc

SEQ ID NO: 35509 - DNA, 15 bp, Artificial Sequence
  dgRNA
  Fam183b
tggtgctccgagcct

SEQ ID NO: 35510 - DNA, 15 bp, Artificial Sequence
  dgRNA
  Fam183b
tggcctgaacacaag

SEQ ID NO: 35511 - DNA, 15 bp, Artificial Sequence
  dgRNA
  Fam183b
ggaacatccgttgcc

SEQ ID NO: 35512 - DNA, 15 bp, Artificial Sequence
  dgRNA
  St8sia5
cgtcacctcggcggg

SEQ ID NO: 35513 - DNA, 15 bp, Artificial Sequence
  dgRNA
  St8sia5
gtcacctcggcggga

SEQ ID NO: 35514 - DNA, 15 bp, Artificial Sequence
  dgRNA
  St8sia5
acctcggcgggaggg

SEQ ID NO: 35515 - DNA, 15 bp, Artificial Sequence
  dgRNA
  St8sia5
gccgtcgcccctcca

SEQ ID NO: 35516 - DNA, 15 bp, Artificial Sequence
  dgRNA
  Nhlh1
taatattgatgaggg

SEQ ID NO: 35517 - DNA, 15 bp, Artificial Sequence
  dgRNA
  Nhlh1
gatgaggggggtgcc

SEQ ID NO: 35518 - DNA, 15 bp, Artificial Sequence
  dgRNA
  Nhlh1
atgaggggggtgcct

SEQ ID NO: 35519 - DNA, 15 bp, Artificial Sequence
  dgRNA
  Nhlh1
gaaccccttgggagc

SEQ ID NO: 35520 - DNA, 15 bp, Artificial Sequence
  dgRNA
  Trappc13
aacgaatcagaataa

SEQ ID NO: 35521 - DNA, 15 bp, Artificial Sequence
  dgRNA
  Trappc13
tgtacgcggggcagg

SEQ ID NO: 35522 - DNA, 15 bp, Artificial Sequence
  dgRNA
  Trappc13
cagtgtacgcggggc

SEQ ID NO: 35523 - DNA, 15 bp, Artificial Sequence
  dgRNA
  Trappc13
ttcgcagtgtacgcg

SEQ ID NO: 35524 - DNA, 15 bp, Artificial Sequence
  dgRNA
  Zfpm2
cactccacgcgaccg

SEQ ID NO: 35525 - DNA, 15 bp, Artificial Sequence
  dgRNA
  Zfpm2
ccacgcgaccgaggc

SEQ ID NO: 35526 - DNA, 15 bp, Artificial Sequence
  dgRNA
  Zfpm2
cacgcgaccgaggcc

SEQ ID NO: 35527 - DNA, 15 bp, Artificial Sequence
  dgRNA
  Zfpm2
agtttgcatccggac

SEQ ID NO: 35528 - DNA, 15 bp, Artificial Sequence
  dgRNA
  Slc24a3
tttgttgggctcaat

SEQ ID NO: 35529 - DNA, 15 bp, Artificial Sequence
  dgRNA
  Slc24a3
ggattcaacagtcag

SEQ ID NO: 35530 - DNA, 15 bp, Artificial Sequence
  dgRNA
  Slc24a3
aatgttagctgatta

SEQ ID NO: 35531 - DNA, 15 bp, Artificial Sequence
  dgRNA
  Slc24a3
agctgattaaggcac

SEQ ID NO: 35532 - DNA, 15 bp, Artificial Sequence
  dgRNA
  Oprm1
gagagtggcgctttg

SEQ ID NO: 35533 - DNA, 15 bp, Artificial Sequence
  dgRNA
  Oprm1
ctccgtgtacttcta

SEQ ID NO: 35534 - DNA, 15 bp, Artificial Sequence
  dgRNA
  Oprm1
cgtgtacttctaagg

SEQ ID NO: 35535 - DNA, 15 bp, Artificial Sequence
  dgRNA
  Oprm1
gtgtacttctaaggt

SEQ ID NO: 35536 - DNA, 15 bp, Artificial Sequence
  dgRNA
  Slc3a2
tacttaccccgaaca

SEQ ID NO: 35537 - DNA, 15 bp, Artificial Sequence
  dgRNA
  Slc3a2
gacaagaacaacgtg

SEQ ID NO: 35538 - DNA, 15 bp, Artificial Sequence
  dgRNA
  Slc3a2
aatagcatctcgcaa

SEQ ID NO: 35539 - DNA, 15 bp, Artificial Sequence
  dgRNA
  Slc3a2
tctcgcaaaggccca

SEQ ID NO: 35540 - DNA, 15 bp, Artificial Sequence
  dgRNA
  Zfp428
gcgctttatttttcc

SEQ ID NO: 35541 - DNA, 15 bp, Artificial Sequence
  dgRNA
  Zfp428
atcctccagtgcggg

SEQ ID NO: 35542 - DNA, 15 bp, Artificial Sequence
  dgRNA
  Zfp428
cctttgtcccgcgct

SEQ ID NO: 35543 - DNA, 15 bp, Artificial Sequence
  dgRNA
  Zfp428
cgagcctccagcccg

SEQ ID NO: 35544 - DNA, 15 bp, Artificial Sequence
  dgRNA
  Crygb
aaccccaatgagcag

SEQ ID NO: 35545 - DNA, 15 bp, Artificial Sequence
  dgRNA
  Crygb
accccaatgagcaga

SEQ ID NO: 35546 - DNA, 15 bp, Artificial Sequence
  dgRNA
  Crygb
ccttactcaccgaaa

SEQ ID NO: 35547 - DNA, 15 bp, Artificial Sequence
  dgRNA
  Crygb
cttactcaccgaaat

SEQ ID NO: 35548 - DNA, 15 bp, Artificial Sequence
  dgRNA
  Tle6
gctcgcagcccacgt

SEQ ID NO: 35549 - DNA, 15 bp, Artificial Sequence
  dgRNA
  Tle6
tcgccgccttctgat

SEQ ID NO: 35550 - DNA, 15 bp, Artificial Sequence
  dgRNA
  Tle6
gcggttcgctgagtc

SEQ ID NO: 35551 - DNA, 15 bp, Artificial Sequence
  dgRNA
  Tle6
cggttcgctgagtcc

SEQ ID NO: 35552 - DNA, 15 bp, Artificial Sequence
  dgRNA
  Rap1gap
aggcttcccgcgcgc

SEQ ID NO: 35553 - DNA, 15 bp, Artificial Sequence
  dgRNA
  Rap1gap
cggccgccccgcgag

SEQ ID NO: 35554 - DNA, 15 bp, Artificial Sequence
  dgRNA
  Rap1gap
ggccgccccgcgagt

SEQ ID NO: 35555 - DNA, 15 bp, Artificial Sequence
  dgRNA
  Rap1gap
ccccgcgagtgggcg

SEQ ID NO: 35556 - DNA, 15 bp, Artificial Sequence
  dgRNA
  Lrfn5
tgcccctccgtgccc

SEQ ID NO: 35557 - DNA, 15 bp, Artificial Sequence
  dgRNA
  Lrfn5
tcaaatgcatctgat

SEQ ID NO: 35558 - DNA, 15 bp, Artificial Sequence
  dgRNA
  Lrfn5
aacacgtttgcttct

SEQ ID NO: 35559 - DNA, 15 bp, Artificial Sequence
  dgRNA
  Lrfn5
taacacgtttgcttc

SEQ ID NO: 35560 - DNA, 15 bp, Artificial Sequence
  dgRNA
  Olfr781
atttttcagccagat

SEQ ID NO: 35561 - DNA, 15 bp, Artificial Sequence
  dgRNA
  Olfr781
tttttcagccagatt

SEQ ID NO: 35562 - DNA, 15 bp, Artificial Sequence
  dgRNA
  Olfr781
tcgctgtattaccat

SEQ ID NO: 35563 - DNA, 15 bp, Artificial Sequence
  dgRNA
  Olfr781
gtctcttgcccaatc

SEQ ID NO: 35564 - DNA, 15 bp, Artificial Sequence
  dgRNA
  Wfdc15a
aaaagagttaggcgt

SEQ ID NO: 35565 - DNA, 15 bp, Artificial Sequence
  dgRNA
  Wfdc15a
aaagagttaggcgtg

SEQ ID NO: 35566 - DNA, 15 bp, Artificial Sequence
  dgRNA
  Wfdc15a
ggcgtggggcttgaa

SEQ ID NO: 35567 - DNA, 15 bp, Artificial Sequence
  dgRNA
  Wfdc15a
agagaccgtgtgtcc

SEQ ID NO: 35568 - DNA, 15 bp, Artificial Sequence
  dgRNA
  Dcun1d4
tgactgacagccgtt

SEQ ID NO: 35569 - DNA, 15 bp, Artificial Sequence
  dgRNA
  Dcun1d4
gttgggtccaacctg

SEQ ID NO: 35570 - DNA, 15 bp, Artificial Sequence
  dgRNA
  Dcun1d4
tgcggctccgaacag

SEQ ID NO: 35571 - DNA, 15 bp, Artificial Sequence
  dgRNA
  Dcun1d4
ggcctccaccagggg

SEQ ID NO: 35572 - DNA, 15 bp, Artificial Sequence
  dgRNA
  Trim24
cagcgagccaatcag

SEQ ID NO: 35573 - DNA, 15 bp, Artificial Sequence
  dgRNA
  Trim24
cgcggtcctcgcgtc

SEQ ID NO: 35574 - DNA, 15 bp, Artificial Sequence
  dgRNA
  Trim24
ggtcctcgcgtccgg

SEQ ID NO: 35575 - DNA, 15 bp, Artificial Sequence
  dgRNA
  Trim24
gtcctcgcgtccggc

SEQ ID NO: 35576 - DNA, 15 bp, Artificial Sequence
  dgRNA
  Synpo2
cttttagctgaaaag

SEQ ID NO: 35577 - DNA, 15 bp, Artificial Sequence
  dgRNA
  Synpo2
agcgtgacgcaagag

SEQ ID NO: 35578 - DNA, 15 bp, Artificial Sequence
  dgRNA
  Synpo2
gcgtgacgcaagaga

SEQ ID NO: 35579 - DNA, 15 bp, Artificial Sequence
  dgRNA
  Synpo2
tgacgcaagagaggg

SEQ ID NO: 35580 - DNA, 15 bp, Artificial Sequence
  dgRNA
  Panx2
tggtcaatatgaact

SEQ ID NO: 35581 - DNA, 15 bp, Artificial Sequence
  dgRNA
  Panx2
aacgccgcagctacg

SEQ ID NO: 35582 - DNA, 15 bp, Artificial Sequence
  dgRNA
  Panx2
gccgcagctacgtgg

SEQ ID NO: 35583 - DNA, 15 bp, Artificial Sequence
  dgRNA
  Panx2
ccgcagctacgtgga

SEQ ID NO: 35584 - DNA, 15 bp, Artificial Sequence
  dgRNA
  Dpyd
accaaactcaacctt

SEQ ID NO: 35585 - DNA, 15 bp, Artificial Sequence
  dgRNA
  Dpyd
agagcccggcagctt

SEQ ID NO: 35586 - DNA, 15 bp, Artificial Sequence
  dgRNA
  Dpyd
accagtggaacggtg

SEQ ID NO: 35587 - DNA, 15 bp, Artificial Sequence
  dgRNA
  Dpyd
gttgccccgccccag

SEQ ID NO: 35588 - DNA, 15 bp, Artificial Sequence
  dgRNA
  Cars
tgcccggaagacgac

SEQ ID NO: 35589 - DNA, 15 bp, Artificial Sequence
  dgRNA
  Cars
ccggaagacgactgg

SEQ ID NO: 35590 - DNA, 15 bp, Artificial Sequence
  dgRNA
  Cars
cggaagacgactggt

SEQ ID NO: 35591 - DNA, 15 bp, Artificial Sequence
  dgRNA
  Cars
ggaagacgactggtg

SEQ ID NO: 35592 - DNA, 15 bp, Artificial Sequence
  dgRNA
  Ccdc136
ccttgcaagccacct

SEQ ID NO: 35593 - DNA, 15 bp, Artificial Sequence
  dgRNA
  Pstpip1
aagaacctaacctct

SEQ ID NO: 35594 - DNA, 15 bp, Artificial Sequence
  dgRNA
  Pstpip1
agaacctaacctctt

SEQ ID NO: 35595 - DNA, 15 bp, Artificial Sequence
  dgRNA
  Pstpip1
gaacctaacctcttg

SEQ ID NO: 35596 - DNA, 15 bp, Artificial Sequence
  dgRNA
  Pstpip1
aagctaaactgggcc

SEQ ID NO: 35597 - DNA, 15 bp, Artificial Sequence
  dgRNA
  Eif3a
actctgtgtccgcgg

SEQ ID NO: 35598 - DNA, 15 bp, Artificial Sequence
  dgRNA
  Eif3a
ctctgtgtccgcggg

SEQ ID NO: 35599 - DNA, 15 bp, Artificial Sequence
  dgRNA
  Eif3a
gtccgcggggggcag

SEQ ID NO: 35600 - DNA, 15 bp, Artificial Sequence
  dgRNA
  Eif3a
ggtggtcggagaaaa

SEQ ID NO: 35601 - DNA, 15 bp, Artificial Sequence
  dgRNA
  Polr2f
ccttaggcgatgacc

SEQ ID NO: 35602 - DNA, 15 bp, Artificial Sequence
  dgRNA
  Polr2f
cttaggcgatgacct

SEQ ID NO: 35603 - DNA, 15 bp, Artificial Sequence
  dgRNA
  Polr2f
acagagccctccgca

SEQ ID NO: 35604 - DNA, 15 bp, Artificial Sequence
  dgRNA
  Polr2f
cacggagaaactcca

SEQ ID NO: 35605 - DNA, 15 bp, Artificial Sequence
  dgRNA
  Rpl4
gatgcggaagacgag

SEQ ID NO: 35606 - DNA, 15 bp, Artificial Sequence
  dgRNA
  Rpl4
cggaagacgagtgga

SEQ ID NO: 35607 - DNA, 15 bp, Artificial Sequence
  dgRNA
  Xcr1
tcgaaaccaaacata

SEQ ID NO: 35608 - DNA, 15 bp, Artificial Sequence
  dgRNA
  Xcr1
acctttatcaagcat

SEQ ID NO: 35609 - DNA, 15 bp, Artificial Sequence
  dgRNA
  Xcr1
cctttatcaagcata

SEQ ID NO: 35610 - DNA, 15 bp, Artificial Sequence
  dgRNA
  Xcr1
ttagctatggattgg

SEQ ID NO: 35611 - DNA, 15 bp, Artificial Sequence
  dgRNA
  Elmod1
ctgcacagttaaact

SEQ ID NO: 35612 - DNA, 15 bp, Artificial Sequence
  dgRNA
  Elmod1
taaactaggccactg

SEQ ID NO: 35613 - DNA, 15 bp, Artificial Sequence
  dgRNA
  Elmod1
tcccacattctggcg

SEQ ID NO: 35614 - DNA, 15 bp, Artificial Sequence
  dgRNA
  Elmod1
cccacattctggcgc

SEQ ID NO: 35615 - DNA, 15 bp, Artificial Sequence
  dgRNA
  Baiap2l1
atcgaccctcccacc

SEQ ID NO: 35616 - DNA, 15 bp, Artificial Sequence
  dgRNA
  Baiap2l1
ggctgtctccgcgcg

SEQ ID NO: 35617 - DNA, 15 bp, Artificial Sequence
  dgRNA
  Baiap2l1
cccgcccacctcagg

SEQ ID NO: 35618 - DNA, 15 bp, Artificial Sequence
  dgRNA
  Baiap2l1
ccgcccacctcaggt

SEQ ID NO: 35619 - DNA, 15 bp, Artificial Sequence
  dgRNA
  Eif3e
ccacccagaaggcgt

SEQ ID NO: 35620 - DNA, 15 bp, Artificial Sequence
  dgRNA
  Eif3e
cacccagaaggcgtg

SEQ ID NO: 35621 - DNA, 15 bp, Artificial Sequence
  dgRNA
  Eif3e
tgtcatcagcacgct

SEQ ID NO: 35622 - DNA, 15 bp, Artificial Sequence
  dgRNA
  Eif3e
gtcatcagcacgctt

SEQ ID NO: 35623 - DNA, 15 bp, Artificial Sequence
  dgRNA
  Lsm8
tccccgccttggtct

SEQ ID NO: 35624 - DNA, 15 bp, Artificial Sequence
  dgRNA
  Lsm8
ctagtcagccccgcc

SEQ ID NO: 35625 - DNA, 15 bp, Artificial Sequence
  dgRNA
  Lsm8
tactaaaggtagtgt

SEQ ID NO: 35626 - DNA, 15 bp, Artificial Sequence
  dgRNA
  Lsm8
ttactaaaggtagtg

SEQ ID NO: 35627 - DNA, 15 bp, Artificial Sequence
  dgRNA
  Psme4
agaggatactgagcg

SEQ ID NO: 35628 - DNA, 15 bp, Artificial Sequence
  dgRNA
  Psme4
atactgagcgtggag

SEQ ID NO: 35629 - DNA, 15 bp, Artificial Sequence
  dgRNA
  Psme4
gcgtggagaggtagt

SEQ ID NO: 35630 - DNA, 15 bp, Artificial Sequence
  dgRNA
  Psme4
cggattccgtgtctc

SEQ ID NO: 35631 - DNA, 15 bp, Artificial Sequence
  dgRNA
  Rabggta
ataccagtcccttca

SEQ ID NO: 35632 - DNA, 15 bp, Artificial Sequence
  dgRNA
  Rabggta
agtttgagttgcgaa

SEQ ID NO: 35633 - DNA, 15 bp, Artificial Sequence
  dgRNA
  Rabggta
gtttgagttgcgaat

SEQ ID NO: 35634 - DNA, 15 bp, Artificial Sequence
  dgRNA
  Rabggta
cgaatgggaagagcc

SEQ ID NO: 35635 - DNA, 15 bp, Artificial Sequence
  dgRNA
  Csf2ra
catggcgtcacacag

SEQ ID NO: 35636 - DNA, 15 bp, Artificial Sequence
  dgRNA
  Csf2ra
atggcgtcacacagc

SEQ ID NO: 35637 - DNA, 15 bp, Artificial Sequence
  dgRNA
  Csf2ra
agcgggccaaccgcc

SEQ ID NO: 35638 - DNA, 15 bp, Artificial Sequence
  dgRNA
  Csf2ra
cctgcacgggacact

SEQ ID NO: 35639 - DNA, 15 bp, Artificial Sequence
  dgRNA
  Rnf224
gagtacaagaacggg

SEQ ID NO: 35640 - DNA, 15 bp, Artificial Sequence
  dgRNA
  Rnf224
agaacgggaggactt

SEQ ID NO: 35641 - DNA, 15 bp, Artificial Sequence
  dgRNA
  Rnf224
ctttaggagttacag

SEQ ID NO: 35642 - DNA, 15 bp, Artificial Sequence
  dgRNA
  Rnf224
catccggtcatgcag

SEQ ID NO: 35643 - DNA, 15 bp, Artificial Sequence
  dgRNA
  Zp2
gcccccaattgtgaa

SEQ ID NO: 35644 - DNA, 15 bp, Artificial Sequence
  dgRNA
  Zp2
cccccaattgtgaaa

SEQ ID NO: 35645 - DNA, 15 bp, Artificial Sequence
  dgRNA
  Zp2
ccaattgtgaaaggg

SEQ ID NO: 35646 - DNA, 15 bp, Artificial Sequence
  dgRNA
  Zp2
gtcacaccctacctg

SEQ ID NO: 35647 - DNA, 15 bp, Artificial Sequence
  dgRNA
  V1ra8
ggcaatatgtaacat

SEQ ID NO: 35648 - DNA, 15 bp, Artificial Sequence
  dgRNA
  Slc25a26
tcgtagatcccatcc

SEQ ID NO: 35649 - DNA, 15 bp, Artificial Sequence
  dgRNA
  Slc25a26
cgtagatcccatccg

SEQ ID NO: 35650 - DNA, 15 bp, Artificial Sequence
  dgRNA
  Slc25a26
cccatccggggccac

SEQ ID NO: 35651 - DNA, 15 bp, Artificial Sequence
  dgRNA
  Slc25a26
ccacaggcttgtgcg

SEQ ID NO: 35652 - DNA, 15 bp, Artificial Sequence
  dgRNA
  Pth
ggcaccaccccatga

SEQ ID NO: 35653 - DNA, 15 bp, Artificial Sequence
  dgRNA
  Pth
ccccatgagggtatg

SEQ ID NO: 35654 - DNA, 15 bp, Artificial Sequence
  dgRNA
  Pth
cataccctcatgggg

SEQ ID NO: 35655 - DNA, 15 bp, Artificial Sequence
  dgRNA
  Pth
ccacataccctcatg

SEQ ID NO: 35656 - DNA, 15 bp, Artificial Sequence
  dgRNA
  Amh
acctttggtgttgat

SEQ ID NO: 35657 - DNA, 15 bp, Artificial Sequence
  dgRNA
  Amh
cctttggtgttgata

SEQ ID NO: 35658 - DNA, 15 bp, Artificial Sequence
  dgRNA
  Amh
ctttggtgttgatag

SEQ ID NO: 35659 - DNA, 15 bp, Artificial Sequence
  dgRNA
  Amh
gccatacatataagc

SEQ ID NO: 35660 - DNA, 15 bp, Artificial Sequence
  dgRNA
  Incenp
caaccacttcctcgc

SEQ ID NO: 35661 - DNA, 15 bp, Artificial Sequence
  dgRNA
  Incenp
aaccacttcctcgcc

SEQ ID NO: 35662 - DNA, 15 bp, Artificial Sequence
  dgRNA
  Incenp
gattgccgcagcttc

SEQ ID NO: 35663 - DNA, 15 bp, Artificial Sequence
  dgRNA
  Incenp
gcagcttccggaagt

SEQ ID NO: 35664 - DNA, 15 bp, Artificial Sequence
  dgRNA
  Ppp6r1
cgcactgggccctct

SEQ ID NO: 35665 - DNA, 15 bp, Artificial Sequence
  dgRNA
  Ppp6r1
cctctaggtttattc

SEQ ID NO: 35666 - DNA, 15 bp, Artificial Sequence
  dgRNA
  Ppp6r1
ctctaggtttattca

SEQ ID NO: 35667 - DNA, 15 bp, Artificial Sequence
  dgRNA
  Ppp6r1
aacattggcaaccgt

SEQ ID NO: 35668 - DNA, 15 bp, Artificial Sequence
  dgRNA
  Muc15
ccctctagttttcat

SEQ ID NO: 35669 - DNA, 15 bp, Artificial Sequence
  dgRNA
  Muc15
tcagctgtaagcaat

SEQ ID NO: 35670 - DNA, 15 bp, Artificial Sequence
  dgRNA
  Pnrc1
gtgcgctctttgtga

SEQ ID NO: 35671 - DNA, 15 bp, Artificial Sequence
  dgRNA
  Pnrc1
tgcgctctttgtgaa

SEQ ID NO: 35672 - DNA, 15 bp, Artificial Sequence
  dgRNA
  Pnrc1
ttgtgtcttgcctcg

SEQ ID NO: 35673 - DNA, 15 bp, Artificial Sequence
  dgRNA
  Pnrc1
tcttgcctcggggcg

SEQ ID NO: 35674 - DNA, 15 bp, Artificial Sequence
  dgRNA
  Enpp2
aatgctctgctttcg

SEQ ID NO: 35675 - DNA, 15 bp, Artificial Sequence
  dgRNA
  Olfr1016
actttcatgattacc

SEQ ID NO: 35676 - DNA, 15 bp, Artificial Sequence
  dgRNA
  2610507B11Rik
ctccgcgcaagccgc

SEQ ID NO: 35677 - DNA, 15 bp, Artificial Sequence
  dgRNA
  2610507B11Rik
gcgcaagccgctggt

SEQ ID NO: 35678 - DNA, 15 bp, Artificial Sequence
  dgRNA
  2610507B11Rik
cgctggtcggccctc

SEQ ID NO: 35679 - DNA, 15 bp, Artificial Sequence
  dgRNA
  2610507B11Rik
gctggtcggccctca

SEQ ID NO: 35680 - DNA, 15 bp, Artificial Sequence
  dgRNA
  Rpl36
caactcctaacctaa

SEQ ID NO: 35681 - DNA, 15 bp, Artificial Sequence
  dgRNA
  Rpl36
caagccgaggtctca

SEQ ID NO: 35682 - DNA, 15 bp, Artificial Sequence
  dgRNA
  Rpl36
aagccgaggtctcac

SEQ ID NO: 35683 - DNA, 15 bp, Artificial Sequence
  dgRNA
  Rpl36
gtgccgtagaacctc

SEQ ID NO: 35684 - DNA, 15 bp, Artificial Sequence
  dgRNA
  Cfap69
tcctccgccccacac

SEQ ID NO: 35685 - DNA, 15 bp, Artificial Sequence
  dgRNA
  Cfap69
ggcacttattaagca

SEQ ID NO: 35686 - DNA, 15 bp, Artificial Sequence
  dgRNA
  Cfap69
gcacttattaagcaa

SEQ ID NO: 35687 - DNA, 15 bp, Artificial Sequence
  dgRNA
  Cfap69
cgcgatctcagtcac

SEQ ID NO: 35688 - DNA, 15 bp, Artificial Sequence
  dgRNA
  Nacad
gcccaagagattgtc

SEQ ID NO: 35689 - DNA, 15 bp, Artificial Sequence
  dgRNA
  Nacad
cgttgccacagagac

SEQ ID NO: 35690 - DNA, 15 bp, Artificial Sequence
  dgRNA
  Nacad
gttttcgctcatctt

SEQ ID NO: 35691 - DNA, 15 bp, Artificial Sequence
  dgRNA
  Nacad
ttttcgctcatcttg

SEQ ID NO: 35692 - DNA, 15 bp, Artificial Sequence
  dgRNA
  Smim11
agattcctgcgcaac

SEQ ID NO: 35693 - DNA, 15 bp, Artificial Sequence
  dgRNA
  Smim11
catagcgcctgcgct

SEQ ID NO: 35694 - DNA, 15 bp, Artificial Sequence
  dgRNA
  Smim11
atactagcgaatctg

SEQ ID NO: 35695 - DNA, 15 bp, Artificial Sequence
  dgRNA
  Smim11
tactagcgaatctgc

SEQ ID NO: 35696 - DNA, 15 bp, Artificial Sequence
  dgRNA
  Immp2l
acgtaaacccaattc

SEQ ID NO: 35697 - DNA, 15 bp, Artificial Sequence
  dgRNA
  Immp2l
ccttgagccgcgttt

SEQ ID NO: 35698 - DNA, 15 bp, Artificial Sequence
  dgRNA
  Immp2l
cttgagccgcgtttc

SEQ ID NO: 35699 - DNA, 15 bp, Artificial Sequence
  dgRNA
  Immp2l
ttgagccgcgtttcg

SEQ ID NO: 35700 - DNA, 15 bp, Artificial Sequence
  dgRNA
  Deaf1
gccggccagctctat

SEQ ID NO: 35701 - DNA, 15 bp, Artificial Sequence
  dgRNA
  Deaf1
gccagctctatcggt

SEQ ID NO: 35702 - DNA, 15 bp, Artificial Sequence
  dgRNA
  Deaf1
acgctcgtaagcttt

SEQ ID NO: 35703 - DNA, 15 bp, Artificial Sequence
  dgRNA
  Deaf1
cgctcgtaagctttc

SEQ ID NO: 35704 - DNA, 15 bp, Artificial Sequence
  dgRNA
  Myh3
ggcgaaaaatacgtg

SEQ ID NO: 35705 - DNA, 15 bp, Artificial Sequence
  dgRNA
  Myh3
gaaaaatacgtgtgg

SEQ ID NO: 35706 - DNA, 15 bp, Artificial Sequence
  dgRNA
  Myh3
aaaaatacgtgtgga

SEQ ID NO: 35707 - DNA, 15 bp, Artificial Sequence
  dgRNA
  Myh3
aaaatacgtgtggag

SEQ ID NO: 35708 - DNA, 15 bp, Artificial Sequence
  dgRNA
  Mzt1
cagccaatggcgtcg

SEQ ID NO: 35709 - DNA, 15 bp, Artificial Sequence
  dgRNA
  Mzt1
ccaatggcgtcgagg

SEQ ID NO: 35710 - DNA, 15 bp, Artificial Sequence
  dgRNA
  Mzt1
tggcgtcgaggcggc

SEQ ID NO: 35711 - DNA, 15 bp, Artificial Sequence
  dgRNA
  Mzt1
ggcgtcgaggcggcc

SEQ ID NO: 35712 - DNA, 15 bp, Artificial Sequence
  dgRNA
  Hmgcr
aggcgcccctcggct

SEQ ID NO: 35713 - DNA, 15 bp, Artificial Sequence
  dgRNA
  Hmgcr
ggctcggagaccaat

SEQ ID NO: 35714 - DNA, 15 bp, Artificial Sequence
  dgRNA
  Hmgcr
cggagaccaatagga

SEQ ID NO: 35715 - DNA, 15 bp, Artificial Sequence
  dgRNA
  Hmgcr
ggaaggccgcgatgc

SEQ ID NO: 35716 - DNA, 15 bp, Artificial Sequence
  dgRNA
  Nxnl2
ggcggaacagaactc

SEQ ID NO: 35717 - DNA, 15 bp, Artificial Sequence
  dgRNA
  Nxnl2
tccgcagaacagagc

SEQ ID NO: 35718 - DNA, 15 bp, Artificial Sequence
  dgRNA
  Nxnl2
gtggaactgggcccg

SEQ ID NO: 35719 - DNA, 15 bp, Artificial Sequence
  dgRNA
  Nxnl2
tggaactgggcccgt

SEQ ID NO: 35720 - DNA, 15 bp, Artificial Sequence
  dgRNA
  Dtnb
aaggtgcagtcacgt

SEQ ID NO: 35721 - DNA, 15 bp, Artificial Sequence
  dgRNA
  Dtnb
cccggcagctacctg

SEQ ID NO: 35722 - DNA, 15 bp, Artificial Sequence
  dgRNA
  Dtnb
ctccacctccgcggc

SEQ ID NO: 35723 - DNA, 15 bp, Artificial Sequence
  dgRNA
  Dtnb
gccggcgcacagcag

SEQ ID NO: 35724 - DNA, 15 bp, Artificial Sequence
  dgRNA
  Cdk2
accagttccggcctg

SEQ ID NO: 35725 - DNA, 15 bp, Artificial Sequence
  dgRNA
  Cdk2
tgcggagcctaaacc

SEQ ID NO: 35726 - DNA, 15 bp, Artificial Sequence
  dgRNA
  Cdk2
gcggctcgcccgccc

SEQ ID NO: 35727 - DNA, 15 bp, Artificial Sequence
  dgRNA
  Cdk2
cggctcgcccgccca

SEQ ID NO: 35728 - DNA, 15 bp, Artificial Sequence
  dgRNA
  BC021614
ggtacactgaacacc

SEQ ID NO: 35729 - DNA, 15 bp, Artificial Sequence
  dgRNA
  BC021614
ggtgcaatatgctac

SEQ ID NO: 35730 - DNA, 15 bp, Artificial Sequence
  dgRNA
  BC021614
cctggcagacgtggt

SEQ ID NO: 35731 - DNA, 15 bp, Artificial Sequence
  dgRNA
  BC021614
agtgtaccagcttcc

SEQ ID NO: 35732 - DNA, 15 bp, Artificial Sequence
  dgRNA
  Nlrp9c
tgatatcaataactt

SEQ ID NO: 35733 - DNA, 15 bp, Artificial Sequence
  dgRNA
  Nlrp9c
aataagtgacactcg

SEQ ID NO: 35734 - DNA, 15 bp, Artificial Sequence
  dgRNA
  Nlrp9c
gatctcagactctag

SEQ ID NO: 35735 - DNA, 15 bp, Artificial Sequence
  dgRNA
  Acad8
gccaggctaatcttc

SEQ ID NO: 35736 - DNA, 15 bp, Artificial Sequence
  dgRNA
  Acad8
ccaggctaatcttct

SEQ ID NO: 35737 - DNA, 15 bp, Artificial Sequence
  dgRNA
  Acad8
gagccttgaggcgac

SEQ ID NO: 35738 - DNA, 15 bp, Artificial Sequence
  dgRNA
  Acad8
ggcgactggcgtgcc

SEQ ID NO: 35739 - DNA, 15 bp, Artificial Sequence
  dgRNA
  Tmem40
cccctcttaggatgc

SEQ ID NO: 35740 - DNA, 15 bp, Artificial Sequence
  dgRNA
  Tmem40
gccagcgggggccca

SEQ ID NO: 35741 - DNA, 15 bp, Artificial Sequence
  dgRNA
  Tmem40
ccagcgggggcccag

SEQ ID NO: 35742 - DNA, 15 bp, Artificial Sequence
  dgRNA
  Tmem40
ccaggggcaacgtca

SEQ ID NO: 35743 - DNA, 15 bp, Artificial Sequence
  dgRNA
  Tal1
agttttagagcggtc

SEQ ID NO: 35744 - DNA, 15 bp, Artificial Sequence
  dgRNA
  Tal1
gttttagagcggtca

SEQ ID NO: 35745 - DNA, 15 bp, Artificial Sequence
  dgRNA
  Tal1
ttttagagcggtcag

SEQ ID NO: 35746 - DNA, 15 bp, Artificial Sequence
  dgRNA
  Tal1
tgatgagggtcagcg

SEQ ID NO: 35747 - DNA, 15 bp, Artificial Sequence
  dgRNA
  Dcaf15
tgaagggcgggaata

SEQ ID NO: 35748 - DNA, 15 bp, Artificial Sequence
  dgRNA
  Dcaf15
agggcgggaataagg

SEQ ID NO: 35749 - DNA, 15 bp, Artificial Sequence
  dgRNA
  Dcaf15
gggcgggaataaggc

SEQ ID NO: 35750 - DNA, 15 bp, Artificial Sequence
  dgRNA
  Dcaf15
ccaagatagctttga

SEQ ID NO: 35751 - DNA, 15 bp, Artificial Sequence
  dgRNA
  Commd2
atattacacttttgc

SEQ ID NO: 35752 - DNA, 15 bp, Artificial Sequence
  dgRNA
  Commd2
tacacttttgcagga

SEQ ID NO: 35753 - DNA, 15 bp, Artificial Sequence
  dgRNA
  Commd2
tggctcatgaatgag

SEQ ID NO: 35754 - DNA, 15 bp, Artificial Sequence
  dgRNA
  Commd2
tcctatagagtgaac

SEQ ID NO: 35755 - DNA, 15 bp, Artificial Sequence
  dgRNA
  Dok1
caccgcttccctgag

SEQ ID NO: 35756 - DNA, 15 bp, Artificial Sequence
  dgRNA
  Dok1
ccccatcaccgccgc

SEQ ID NO: 35757 - DNA, 15 bp, Artificial Sequence
  dgRNA
  Dok1
cccatcaccgccgca

SEQ ID NO: 35758 - DNA, 15 bp, Artificial Sequence
  dgRNA
  Dok1
ccatcaccgccgcag

SEQ ID NO: 35759 - DNA, 15 bp, Artificial Sequence
  dgRNA
  Fam174b
gttaggattcctcca

SEQ ID NO: 35760 - DNA, 15 bp, Artificial Sequence
  dgRNA
  Fam174b
ttaggattcctccat

SEQ ID NO: 35761 - DNA, 15 bp, Artificial Sequence
  dgRNA
  Fam174b
taggattcctccatg

SEQ ID NO: 35762 - DNA, 15 bp, Artificial Sequence
  dgRNA
  Fam174b
gtcttaggtcctgat

SEQ ID NO: 35763 - DNA, 15 bp, Artificial Sequence
  dgRNA
  Slc25a10
atggcagagcgcctt

SEQ ID NO: 35764 - DNA, 15 bp, Artificial Sequence
  dgRNA
  Slc25a10
accaaagccatgatc

SEQ ID NO: 35765 - DNA, 15 bp, Artificial Sequence
  dgRNA
  Slc25a10
cattgctcctcgttg

SEQ ID NO: 35766 - DNA, 15 bp, Artificial Sequence
  dgRNA
  Slc25a10
aggcggagtctccca

SEQ ID NO: 35767 - DNA, 15 bp, Artificial Sequence
  dgRNA
  Runx1
caccgagtcccgggc

SEQ ID NO: 35768 - DNA, 15 bp, Artificial Sequence
  dgRNA
  Runx1
accgagtcccgggcc

SEQ ID NO: 35769 - DNA, 15 bp, Artificial Sequence
  dgRNA
  Runx1
gcgtacagtagcgcg

SEQ ID NO: 35770 - DNA, 15 bp, Artificial Sequence
  dgRNA
  Runx1
cgtacagtagcgcgc

SEQ ID NO: 35771 - DNA, 15 bp, Artificial Sequence
  dgRNA
  Map3k5
cgtccgcccgccaag

SEQ ID NO: 35772 - DNA, 15 bp, Artificial Sequence
  dgRNA
  Map3k5
ccgcccgccaagagg

SEQ ID NO: 35773 - DNA, 15 bp, Artificial Sequence
  dgRNA
  Map3k5
ccttcccgctcgccg

SEQ ID NO: 35774 - DNA, 15 bp, Artificial Sequence
  dgRNA
  Map3k5
cccgctcgccgcggc

SEQ ID NO: 35775 - DNA, 15 bp, Artificial Sequence
  dgRNA
  Olfr1404
atggccccagttaaa

SEQ ID NO: 35776 - DNA, 15 bp, Artificial Sequence
  dgRNA
  Olfr1404
tctctagcctcgcgc

SEQ ID NO: 35777 - DNA, 15 bp, Artificial Sequence
  dgRNA
  Olfr1404
ctctagcctcgcgca

SEQ ID NO: 35778 - DNA, 15 bp, Artificial Sequence
  dgRNA
  Olfr1404
cgtcatcaaacacct

SEQ ID NO: 35779 - DNA, 15 bp, Artificial Sequence
  dgRNA
  Ncoa2
cgggcccacgctcgg

SEQ ID NO: 35780 - DNA, 15 bp, Artificial Sequence
  dgRNA
  Ncoa2
ccacgctcgggggcg

SEQ ID NO: 35781 - DNA, 15 bp, Artificial Sequence
  dgRNA
  Ncoa2
cacgctcgggggcgc

SEQ ID NO: 35782 - DNA, 15 bp, Artificial Sequence
  dgRNA
  Ncoa2
acgcaagtttccgcc

SEQ ID NO: 35783 - DNA, 15 bp, Artificial Sequence
  dgRNA
  Phlpp2
cccacaattctactc

SEQ ID NO: 35784 - DNA, 15 bp, Artificial Sequence
  dgRNA
  Phlpp2
tactccggcctcgcc

SEQ ID NO: 35785 - DNA, 15 bp, Artificial Sequence
  dgRNA
  Phlpp2
ggctgacgactacgc

SEQ ID NO: 35786 - DNA, 15 bp, Artificial Sequence
  dgRNA
  Phlpp2
actacgcaggtccag

SEQ ID NO: 35787 - DNA, 15 bp, Artificial Sequence
  dgRNA
  Rb1
ggctggcgccgccca

SEQ ID NO: 35788 - DNA, 15 bp, Artificial Sequence
  dgRNA
  Rb1
gctggcgccgcccac

SEQ ID NO: 35789 - DNA, 15 bp, Artificial Sequence
  dgRNA
  Rb1
ctggcgccgcccacg

SEQ ID NO: 35790 - DNA, 15 bp, Artificial Sequence
  dgRNA
  Rb1
cccacggggacgacg

SEQ ID NO: 35791 - DNA, 15 bp, Artificial Sequence
  dgRNA
  Rnf214
ccctacggaaactct

SEQ ID NO: 35792 - DNA, 15 bp, Artificial Sequence
  dgRNA
  Rnf214
aactctcggcttccc

SEQ ID NO: 35793 - DNA, 15 bp, Artificial Sequence
  dgRNA
  Rnf214
cttccccggagccgg

SEQ ID NO: 35794 - DNA, 15 bp, Artificial Sequence
  dgRNA
  Rnf214
gacatcacttccgcc

SEQ ID NO: 35795 - DNA, 15 bp, Artificial Sequence
  dgRNA
  Ecel1
ctcccgggacagatc

SEQ ID NO: 35796 - DNA, 15 bp, Artificial Sequence
  dgRNA
  Ecel1
tggactccggagtcc

SEQ ID NO: 35797 - DNA, 15 bp, Artificial Sequence
  dgRNA
  Ecel1
ggagcgttatctccg

SEQ ID NO: 35798 - DNA, 15 bp, Artificial Sequence
  dgRNA
  Ecel1
atctgtcccgggagg

SEQ ID NO: 35799 - DNA, 15 bp, Artificial Sequence
  dgRNA
  P2ry12
ccttagcgcagtcta

SEQ ID NO: 35800 - DNA, 15 bp, Artificial Sequence
  dgRNA
  P2ry12
ggaacagctgcaaat

SEQ ID NO: 35801 - DNA, 15 bp, Artificial Sequence
  dgRNA
  P2ry12
agctgcaaattggac

SEQ ID NO: 35802 - DNA, 15 bp, Artificial Sequence
  dgRNA
  Prr11
cgcctcagttccgat

SEQ ID NO: 35803 - DNA, 15 bp, Artificial Sequence
  dgRNA
  Prr11
gaccacgtctacgat

SEQ ID NO: 35804 - DNA, 15 bp, Artificial Sequence
  dgRNA
  Prr11
cgattggtcgctcgt

SEQ ID NO: 35805 - DNA, 15 bp, Artificial Sequence
  dgRNA
  Prr11
aaggcgggcgagaag

SEQ ID NO: 35806 - DNA, 15 bp, Artificial Sequence
  dgRNA
  Tbx4
cggtccagaacctga

SEQ ID NO: 35807 - DNA, 15 bp, Artificial Sequence
  dgRNA
  Tbx4
gggtccacgtgtgca

SEQ ID NO: 35808 - DNA, 15 bp, Artificial Sequence
  dgRNA
  Tbx4
ggtccacgtgtgcag

SEQ ID NO: 35809 - DNA, 15 bp, Artificial Sequence
  dgRNA
  Tbx4
tagccagtgtggatc

SEQ ID NO: 35810 - DNA, 15 bp, Artificial Sequence
  dgRNA
  Dync1li1
cgcgcatgcgcgacc

SEQ ID NO: 35811 - DNA, 15 bp, Artificial Sequence
  dgRNA
  Dync1li1
ccgcccccgcaggcg

SEQ ID NO: 35812 - DNA, 15 bp, Artificial Sequence
  dgRNA
  Dync1li1
ccccgcaggcgcggt

SEQ ID NO: 35813 - DNA, 15 bp, Artificial Sequence
  dgRNA
  Dync1li1
ggactgtggtaatgc

SEQ ID NO: 35814 - DNA, 15 bp, Artificial Sequence
  dgRNA
  Nkx1-2
cccaggatagtctcg

SEQ ID NO: 35815 - DNA, 15 bp, Artificial Sequence
  dgRNA
  Nkx1-2
aggatagtctcgtgg

SEQ ID NO: 35816 - DNA, 15 bp, Artificial Sequence
  dgRNA
  Nkx1-2
agcgctcactgcacg

SEQ ID NO: 35817 - DNA, 15 bp, Artificial Sequence
  dgRNA
  Nkx1-2
ctcactgcacgtgga

SEQ ID NO: 35818 - DNA, 15 bp, Artificial Sequence
  dgRNA
  Zfp566
gtggaagctgatata

SEQ ID NO: 35819 - DNA, 15 bp, Artificial Sequence
  dgRNA
  Zfp566
ggatgcgtttctatt

SEQ ID NO: 35820 - DNA, 15 bp, Artificial Sequence
  dgRNA
  Zfp566
gatgcgtttctattt

SEQ ID NO: 35821 - DNA, 15 bp, Artificial Sequence
  dgRNA
  Zfp566
atgcgtttctatttg

SEQ ID NO: 35822 - DNA, 15 bp, Artificial Sequence
  dgRNA
  Olfr514
gctcattaatgcaag

SEQ ID NO: 35823 - DNA, 15 bp, Artificial Sequence
  dgRNA
  Olfr514
ctagagctatttgac

SEQ ID NO: 35824 - DNA, 15 bp, Artificial Sequence
  dgRNA
  Olfr514
cccttgaaatagaag

SEQ ID NO: 35825 - DNA, 15 bp, Artificial Sequence
  dgRNA
  Hsp90ab1
gctaccatgacgtca

SEQ ID NO: 35826 - DNA, 15 bp, Artificial Sequence
  dgRNA
  Hsp90ab1
ccatgacgtcaaggt

SEQ ID NO: 35827 - DNA, 15 bp, Artificial Sequence
  dgRNA
  Hsp90ab1
tgacgtcaaggtggg

SEQ ID NO: 35828 - DNA, 15 bp, Artificial Sequence
  dgRNA
  Hsp90ab1
gacgtcaaggtgggc

SEQ ID NO: 35829 - DNA, 15 bp, Artificial Sequence
  dgRNA
  Osbpl10
tccatcccccatagg

SEQ ID NO: 35830 - DNA, 15 bp, Artificial Sequence
  dgRNA
  Osbpl10
tagccgctgactcga

SEQ ID NO: 35831 - DNA, 15 bp, Artificial Sequence
  dgRNA
  Osbpl10
gtcgtccacctatgg

SEQ ID NO: 35832 - DNA, 15 bp, Artificial Sequence
  dgRNA
  Osbpl10
tggtcgtccacctat

SEQ ID NO: 35833 - DNA, 15 bp, Artificial Sequence
  dgRNA
  Tsc22d3
tacagtccctgacta

SEQ ID NO: 35834 - DNA, 15 bp, Artificial Sequence
  dgRNA
  Tsc22d3
ccctgactaaggttc

SEQ ID NO: 35835 - DNA, 15 bp, Artificial Sequence
  dgRNA
  Tsc22d3
cctgactaaggttca

SEQ ID NO: 35836 - DNA, 15 bp, Artificial Sequence
  dgRNA
  Tsc22d3
gactaaggttcaggg

SEQ ID NO: 35837 - DNA, 15 bp, Artificial Sequence
  dgRNA
  Smarca4
ccgggcagcggaagc

SEQ ID NO: 35838 - DNA, 15 bp, Artificial Sequence
  dgRNA
  Smarca4
cgggcagcggaagca

SEQ ID NO: 35839 - DNA, 15 bp, Artificial Sequence
  dgRNA
  Smarca4
gtggagcgggtagac

SEQ ID NO: 35840 - DNA, 15 bp, Artificial Sequence
  dgRNA
  Smarca4
tggagcgggtagaca

SEQ ID NO: 35841 - DNA, 15 bp, Artificial Sequence
  dgRNA
  Emp2
agcgatgatcccagc

SEQ ID NO: 35842 - DNA, 15 bp, Artificial Sequence
  dgRNA
  Emp2
ctggacggcccagca

SEQ ID NO: 35843 - DNA, 15 bp, Artificial Sequence
  dgRNA
  Emp2
tggacggcccagcaa

SEQ ID NO: 35844 - DNA, 15 bp, Artificial Sequence
  dgRNA
  Emp2
ggacggcccagcaag

SEQ ID NO: 35845 - DNA, 15 bp, Artificial Sequence
  dgRNA
  9430016H08Rik
gctccccaaaaatgt

SEQ ID NO: 35846 - DNA, 15 bp, Artificial Sequence
  dgRNA
  9430016H08Rik
ggggccgtttctctc

SEQ ID NO: 35847 - DNA, 15 bp, Artificial Sequence
  dgRNA
  9430016H08Rik
gggccgtttctctcc

SEQ ID NO: 35848 - DNA, 15 bp, Artificial Sequence
  dgRNA
  9430016H08Rik
ggccgtttctctccg

SEQ ID NO: 35849 - DNA, 15 bp, Artificial Sequence
  dgRNA
  Trpm3
cataaggaagcgggc

SEQ ID NO: 35850 - DNA, 15 bp, Artificial Sequence
  dgRNA
  Trpm3
gcaagcgcagcctgc

SEQ ID NO: 35851 - DNA, 15 bp, Artificial Sequence
  dgRNA
  Trpm3
cggagctcccgactc

SEQ ID NO: 35852 - DNA, 15 bp, Artificial Sequence
  dgRNA
  Trpm3
agctcccgactcagg

SEQ ID NO: 35853 - DNA, 15 bp, Artificial Sequence
  dgRNA
  Stoml2
tcctaaggtaaagtt

SEQ ID NO: 35854 - DNA, 15 bp, Artificial Sequence
  dgRNA
  Stoml2
ccatgacaacgggaa

SEQ ID NO: 35855 - DNA, 15 bp, Artificial Sequence
  dgRNA
  Stoml2
ccaagaatgtcacta

SEQ ID NO: 35856 - DNA, 15 bp, Artificial Sequence
  dgRNA
  Stoml2
aatccattgtcgtta

SEQ ID NO: 35857 - DNA, 15 bp, Artificial Sequence
  dgRNA
  Dph5
gtcagcgagtcctgg

SEQ ID NO: 35858 - DNA, 15 bp, Artificial Sequence
  dgRNA
  Dph5
ctggagggccttgcg

SEQ ID NO: 35859 - DNA, 15 bp, Artificial Sequence
  dgRNA
  Dph5
tggagggccttgcgg

SEQ ID NO: 35860 - DNA, 15 bp, Artificial Sequence
  dgRNA
  Dph5
tctatagctcgttcc

SEQ ID NO: 35861 - DNA, 15 bp, Artificial Sequence
  dgRNA
  Topbp1
ctccgcttcccagag

SEQ ID NO: 35862 - DNA, 15 bp, Artificial Sequence
  dgRNA
  Topbp1
ccgcttcccagagcg

SEQ ID NO: 35863 - DNA, 15 bp, Artificial Sequence
  dgRNA
  Topbp1
cgcttcccagagcgg

SEQ ID NO: 35864 - DNA, 15 bp, Artificial Sequence
  dgRNA
  Topbp1
tgacgccacttcctc

SEQ ID NO: 35865 - DNA, 15 bp, Artificial Sequence
  dgRNA
  Sec22b
aatgtgggcgggact

SEQ ID NO: 35866 - DNA, 15 bp, Artificial Sequence
  dgRNA
  Sec22b
gcgggacttggtcgg

SEQ ID NO: 35867 - DNA, 15 bp, Artificial Sequence
  dgRNA
  Sec22b
tcggaggaatgactg

SEQ ID NO: 35868 - DNA, 15 bp, Artificial Sequence
  dgRNA
  Sec22b
cggaactaaagttcc

SEQ ID NO: 35869 - DNA, 15 bp, Artificial Sequence
  dgRNA
  AC109138.1
ggcggggctccgccc

SEQ ID NO: 35870 - DNA, 15 bp, Artificial Sequence
  dgRNA
  AC109138.1
gcggggctccgcccc

SEQ ID NO: 35871 - DNA, 15 bp, Artificial Sequence
  dgRNA
  AC109138.1
gctccgccccgggca

SEQ ID NO: 35872 - DNA, 15 bp, Artificial Sequence
  dgRNA
  AC109138.1
gccccgggcatggcc

SEQ ID NO: 35873 - DNA, 15 bp, Artificial Sequence
  dgRNA
  Itgb3
gcacacaggaccccg

SEQ ID NO: 35874 - DNA, 15 bp, Artificial Sequence
  dgRNA
  Itgb3
cacacaggaccccgg

SEQ ID NO: 35875 - DNA, 15 bp, Artificial Sequence
  dgRNA
  Itgb3
acacaggaccccggg

SEQ ID NO: 35876 - DNA, 15 bp, Artificial Sequence
  dgRNA
  Itgb3
ctcctctagtgaacg

SEQ ID NO: 35877 - DNA, 15 bp, Artificial Sequence
  dgRNA
  Cdk12
ctccctcaggcacga

SEQ ID NO: 35878 - DNA, 15 bp, Artificial Sequence
  dgRNA
  Cdk12
ggcacgagggacaaa

SEQ ID NO: 35879 - DNA, 15 bp, Artificial Sequence
  dgRNA
  Cdk12
aggcaacctaggccg

SEQ ID NO: 35880 - DNA, 15 bp, Artificial Sequence
  dgRNA
  Cdk12
caacctaggccgcgg

SEQ ID NO: 35881 - DNA, 15 bp, Artificial Sequence
  dgRNA
  Spred2
aggggcacgctcagt

SEQ ID NO: 35882 - DNA, 15 bp, Artificial Sequence
  dgRNA
  Spred2
ggcacgctcagtagg

SEQ ID NO: 35883 - DNA, 15 bp, Artificial Sequence
  dgRNA
  Spred2
gcacgctcagtaggc

SEQ ID NO: 35884 - DNA, 15 bp, Artificial Sequence
  dgRNA
  Spred2
attttggtcgcaagt

SEQ ID NO: 35885 - DNA, 15 bp, Artificial Sequence
  dgRNA
  2210013O21Rik
cagtccctcacaaac

SEQ ID NO: 35886 - DNA, 15 bp, Artificial Sequence
  dgRNA
  2210013O21Rik
tttacaaacgcacca

SEQ ID NO: 35887 - DNA, 15 bp, Artificial Sequence
  dgRNA
  Ints2
tcgctctgaccgttt

SEQ ID NO: 35888 - DNA, 15 bp, Artificial Sequence
  dgRNA
  Ints2
ggaactcatctgaca

SEQ ID NO: 35889 - DNA, 15 bp, Artificial Sequence
  dgRNA
  Ints2
aacactccacgcttt

SEQ ID NO: 35890 - DNA, 15 bp, Artificial Sequence
  dgRNA
  Ints2
ccacgctttcggaag

SEQ ID NO: 35891 - DNA, 15 bp, Artificial Sequence
  dgRNA
  Eif2b4
cccagctcgccattt

SEQ ID NO: 35892 - DNA, 15 bp, Artificial Sequence
  dgRNA
  Eif2b4
agctcgccattttgg

SEQ ID NO: 35893 - DNA, 15 bp, Artificial Sequence
  dgRNA
  Eif2b4
gctcgccattttggt

SEQ ID NO: 35894 - DNA, 15 bp, Artificial Sequence
  dgRNA
  Eif2b4
tgggcctgaactccg

SEQ ID NO: 35895 - DNA, 15 bp, Artificial Sequence
  dgRNA
  Ifit3b
taagagggcagtcgg

SEQ ID NO: 35896 - DNA, 15 bp, Artificial Sequence
  dgRNA
  Ifit3b
ataagagggcagtcg

SEQ ID NO: 35897 - DNA, 15 bp, Artificial Sequence
  dgRNA
  Ifit3b
tataagagggcagtc

SEQ ID NO: 35898 - DNA, 15 bp, Artificial Sequence
  dgRNA
  Ifit3b
atataagagggcagt

SEQ ID NO: 35899 - DNA, 15 bp, Artificial Sequence
  dgRNA
  Sema4d
gcggggctagcgtgc

SEQ ID NO: 35900 - DNA, 15 bp, Artificial Sequence
  dgRNA
  Rac1
tttagcgtgccaaga

SEQ ID NO: 35901 - DNA, 15 bp, Artificial Sequence
  dgRNA
  Rac1
agcgtgccaagatgg

SEQ ID NO: 35902 - DNA, 15 bp, Artificial Sequence
  dgRNA
  Rac1
gccgagcccgttctc

SEQ ID NO: 35903 - DNA, 15 bp, Artificial Sequence
  dgRNA
  Rac1
agcccgttctccggc

SEQ ID NO: 35904 - DNA, 15 bp, Artificial Sequence
  dgRNA
  Yipf1
tttaagaccaccgag

SEQ ID NO: 35905 - DNA, 15 bp, Artificial Sequence
  dgRNA
  Yipf1
ttaagaccaccgaga

SEQ ID NO: 35906 - DNA, 15 bp, Artificial Sequence
  dgRNA
  Yipf1
agaccaccgagaggg

SEQ ID NO: 35907 - DNA, 15 bp, Artificial Sequence
  dgRNA
  Yipf1
gaccaccgagagggc

SEQ ID NO: 35908 - DNA, 15 bp, Artificial Sequence
  dgRNA
  Ptk2
gccacctcgtcatcc

SEQ ID NO: 35909 - DNA, 15 bp, Artificial Sequence
  dgRNA
  Ptk2
gaacagcgctatccg

SEQ ID NO: 35910 - DNA, 15 bp, Artificial Sequence
  dgRNA
  Ptk2
ccacgcccgcacagc

SEQ ID NO: 35911 - DNA, 15 bp, Artificial Sequence
  dgRNA
  Ptk2
cacgcccgcacagct

SEQ ID NO: 35912 - DNA, 15 bp, Artificial Sequence
  dgRNA
  Rcbtb2
gatcactagccccac

SEQ ID NO: 35913 - DNA, 15 bp, Artificial Sequence
  dgRNA
  Rcbtb2
caaatttcagttagg

SEQ ID NO: 35914 - DNA, 15 bp, Artificial Sequence
  dgRNA
  Usp53
gcgccacccccgcgt

SEQ ID NO: 35915 - DNA, 15 bp, Artificial Sequence
  dgRNA
  Usp53
cgccacccccgcgtc

SEQ ID NO: 35916 - DNA, 15 bp, Artificial Sequence
  dgRNA
  Usp53
gccacccccgcgtcg

SEQ ID NO: 35917 - DNA, 15 bp, Artificial Sequence
  dgRNA
  Usp53
cgagccctgctctcg

SEQ ID NO: 35918 - DNA, 15 bp, Artificial Sequence
  dgRNA
  1700029H14Rik
agaataccgaagtac

SEQ ID NO: 35919 - DNA, 15 bp, Artificial Sequence
  dgRNA
  1700029H14Rik
cgaagtacaggaaag

SEQ ID NO: 35920 - DNA, 15 bp, Artificial Sequence
  dgRNA
  1700029H14Rik
cgaggggcttctaga

SEQ ID NO: 35921 - DNA, 15 bp, Artificial Sequence
  dgRNA
  1700029H14Rik
attctttaacagcga

SEQ ID NO: 35922 - DNA, 15 bp, Artificial Sequence
  dgRNA
  Srsf10
agggcccgggtctca

SEQ ID NO: 35923 - DNA, 15 bp, Artificial Sequence
  dgRNA
  Srsf10
gggcccgggtctcac

SEQ ID NO: 35924 - DNA, 15 bp, Artificial Sequence
  dgRNA
  Srsf10
ggcccgggtctcacg

SEQ ID NO: 35925 - DNA, 15 bp, Artificial Sequence
  dgRNA
  Srsf10
gggaattgcgtgcct

SEQ ID NO: 35926 - DNA, 15 bp, Artificial Sequence
  dgRNA
  Trpv1
tgggaatcggagccg

SEQ ID NO: 35927 - DNA, 15 bp, Artificial Sequence
  dgRNA
  Trpv1
tccctgccgtacacc

SEQ ID NO: 35928 - DNA, 15 bp, Artificial Sequence
  dgRNA
  Trpv1
ccctgccgtacacca

SEQ ID NO: 35929 - DNA, 15 bp, Artificial Sequence
  dgRNA
  Trpv1
cctgccgtacaccag

SEQ ID NO: 35930 - DNA, 15 bp, Artificial Sequence
  dgRNA
  Mocs3
tccgacgtcccagtg

SEQ ID NO: 35931 - DNA, 15 bp, Artificial Sequence
  dgRNA
  Mocs3
tcaagccaatcgtga

SEQ ID NO: 35932 - DNA, 15 bp, Artificial Sequence
  dgRNA
  Mocs3
tcgtgacggcttccc

SEQ ID NO: 35933 - DNA, 15 bp, Artificial Sequence
  dgRNA
  Mocs3
tcgtttcactttcaa

SEQ ID NO: 35934 - DNA, 15 bp, Artificial Sequence
  dgRNA
  Efcab3
gattatgctgagcca

SEQ ID NO: 35935 - DNA, 15 bp, Artificial Sequence
  dgRNA
  Efcab3
attatgctgagccat

SEQ ID NO: 35936 - DNA, 15 bp, Artificial Sequence
  dgRNA
  Efcab3
ttgttgagcgtctcc

SEQ ID NO: 35937 - DNA, 15 bp, Artificial Sequence
  dgRNA
  Efcab3
tgttgagcgtctcca

SEQ ID NO: 35938 - DNA, 15 bp, Artificial Sequence
  dgRNA
  Taar4
tatgcacacgaagtg

SEQ ID NO: 35939 - DNA, 15 bp, Artificial Sequence
  dgRNA
  Taar4
atgcacacgaagtgt

SEQ ID NO: 35940 - DNA, 15 bp, Artificial Sequence
  dgRNA
  Taar4
tgcacacgaagtgtg

SEQ ID NO: 35941 - DNA, 15 bp, Artificial Sequence
  dgRNA
  Taar4
gcacacgaagtgtgg

SEQ ID NO: 35942 - DNA, 15 bp, Artificial Sequence
  dgRNA
  Snrpb
aacgcggtgggtagg

SEQ ID NO: 35943 - DNA, 15 bp, Artificial Sequence
  dgRNA
  Snrpb
cttagtaccagatgc

SEQ ID NO: 35944 - DNA, 15 bp, Artificial Sequence
  dgRNA
  Snrpb
tagaccgggtctcac

SEQ ID NO: 35945 - DNA, 15 bp, Artificial Sequence
  dgRNA
  Snrpb
tgacggattgtgtgg

SEQ ID NO: 35946 - DNA, 15 bp, Artificial Sequence
  dgRNA
  Olfr178
tgtgcaatctatgta

SEQ ID NO: 35947 - DNA, 15 bp, Artificial Sequence
  dgRNA
  Olfr178
accatgacatatttc

SEQ ID NO: 35948 - DNA, 15 bp, Artificial Sequence
  dgRNA
  Ripk3
gtggttggcaagcgg

SEQ ID NO: 35949 - DNA, 15 bp, Artificial Sequence
  dgRNA
  Ripk3
caagcggtggagcta

SEQ ID NO: 35950 - DNA, 15 bp, Artificial Sequence
  dgRNA
  Ripk3
aagcggtggagctaa

SEQ ID NO: 35951 - DNA, 15 bp, Artificial Sequence
  dgRNA
  Ripk3
agcggtggagctaag

SEQ ID NO: 35952 - DNA, 15 bp, Artificial Sequence
  dgRNA
  Mycl
agcgtacaatttatt

SEQ ID NO: 35953 - DNA, 15 bp, Artificial Sequence
  dgRNA
  Mycl
gcgtacaatttatta

SEQ ID NO: 35954 - DNA, 15 bp, Artificial Sequence
  dgRNA
  Mycl
attagggagcttcaa

SEQ ID NO: 35955 - DNA, 15 bp, Artificial Sequence
  dgRNA
  Mycl
acgaccagttcagcc

SEQ ID NO: 35956 - DNA, 15 bp, Artificial Sequence
  dgRNA
  Chn2
ccctcggcctgcaca

SEQ ID NO: 35957 - DNA, 15 bp, Artificial Sequence
  dgRNA
  Chn2
cttgtagtttagctt

SEQ ID NO: 35958 - DNA, 15 bp, Artificial Sequence
  dgRNA
  Chn2
catcataatccctaa

SEQ ID NO: 35959 - DNA, 15 bp, Artificial Sequence
  dgRNA
  Chn2
tttaagaagcttcga

SEQ ID NO: 35960 - DNA, 15 bp, Artificial Sequence
  dgRNA
  Unc45b
gactgcccctgagcg

SEQ ID NO: 35961 - DNA, 15 bp, Artificial Sequence
  dgRNA
  Unc45b
tgagcgaggtgttcg

SEQ ID NO: 35962 - DNA, 15 bp, Artificial Sequence
  dgRNA
  Unc45b
gagcgaggtgttcga

SEQ ID NO: 35963 - DNA, 15 bp, Artificial Sequence
  dgRNA
  Unc45b
gtgttcgagggccag

SEQ ID NO: 35964 - DNA, 15 bp, Artificial Sequence
  dgRNA
  Cnot3
tcgctaggaaccaat

SEQ ID NO: 35965 - DNA, 15 bp, Artificial Sequence
  dgRNA
  Cnot3
cgctaggaaccaatg

SEQ ID NO: 35966 - DNA, 15 bp, Artificial Sequence
  dgRNA
  Cnot3
atggggcgcgcctaa

SEQ ID NO: 35967 - DNA, 15 bp, Artificial Sequence
  dgRNA
  Cnot3
cagagcgacgtactg

SEQ ID NO: 35968 - DNA, 15 bp, Artificial Sequence
  dgRNA
  Actg2
catccacgccccgaa

SEQ ID NO: 35969 - DNA, 15 bp, Artificial Sequence
  dgRNA
  Actg2
cacgccccgaaaggc

SEQ ID NO: 35970 - DNA, 15 bp, Artificial Sequence
  dgRNA
  Actg2
taccacaccgtcagc

SEQ ID NO: 35971 - DNA, 15 bp, Artificial Sequence
  dgRNA
  Actg2
tcagctggccttttt

SEQ ID NO: 35972 - DNA, 15 bp, Artificial Sequence
  dgRNA
  Idi1
tcaagaccaacccac

SEQ ID NO: 35973 - DNA, 15 bp, Artificial Sequence
  dgRNA
  Idi1
agagcgcgcttctca

SEQ ID NO: 35974 - DNA, 15 bp, Artificial Sequence
  dgRNA
  Idi1
ctcaacatgttattc

SEQ ID NO: 35975 - DNA, 15 bp, Artificial Sequence
  dgRNA
  Idi1
gctaatgggttagtt

SEQ ID NO: 35976 - DNA, 15 bp, Artificial Sequence
  dgRNA
  Mmp28
ggttgactgacccac

SEQ ID NO: 35977 - DNA, 15 bp, Artificial Sequence
  dgRNA
  Mmp28
aggcatcgcgggtgc

SEQ ID NO: 35978 - DNA, 15 bp, Artificial Sequence
  dgRNA
  Mmp28
ggtgccggacaacct

SEQ ID NO: 35979 - DNA, 15 bp, Artificial Sequence
  dgRNA
  Mmp28
gtgccggacaacctc

SEQ ID NO: 35980 - DNA, 15 bp, Artificial Sequence
  dgRNA
  Cfdp1
tccattaaggacgca

SEQ ID NO: 35981 - DNA, 15 bp, Artificial Sequence
  dgRNA
  Cfdp1
tgcatcgcttctgag

SEQ ID NO: 35982 - DNA, 15 bp, Artificial Sequence
  dgRNA
  Cfdp1
atcgcttctgagagg

SEQ ID NO: 35983 - DNA, 15 bp, Artificial Sequence
  dgRNA
  Cfdp1
gtccggaatcccaca

SEQ ID NO: 35984 - DNA, 15 bp, Artificial Sequence
  dgRNA
  Ank1
gaaaaaacggagttc

SEQ ID NO: 35985 - DNA, 15 bp, Artificial Sequence
  dgRNA
  Ank1
gacccggcctttgag

SEQ ID NO: 35986 - DNA, 15 bp, Artificial Sequence
  dgRNA
  Ank1
acccggcctttgaga

SEQ ID NO: 35987 - DNA, 15 bp, Artificial Sequence
  dgRNA
  Ank1
tttgtaggacagcac

SEQ ID NO: 35988 - DNA, 15 bp, Artificial Sequence
  dgRNA
  Atp1a2
gttgtagctgcccat

SEQ ID NO: 35989 - DNA, 15 bp, Artificial Sequence
  dgRNA
  Atp1a2
gagggggacagaccg

SEQ ID NO: 35990 - DNA, 15 bp, Artificial Sequence
  dgRNA
  Atp1a2
gaccggggacaaaac

SEQ ID NO: 35991 - DNA, 15 bp, Artificial Sequence
  dgRNA
  Atp1a2
tgctaaagaggcggg

SEQ ID NO: 35992 - DNA, 15 bp, Artificial Sequence
  dgRNA
  Tnfaip2
agcggtaacaacact

SEQ ID NO: 35993 - DNA, 15 bp, Artificial Sequence
  dgRNA
  Tnfaip2
gcgttgagatggaag

SEQ ID NO: 35994 - DNA, 15 bp, Artificial Sequence
  dgRNA
  Tnfaip2
cgttgagatggaaga

SEQ ID NO: 35995 - DNA, 15 bp, Artificial Sequence
  dgRNA
  Tnfaip2
gctgactgtgtgacg

SEQ ID NO: 35996 - DNA, 15 bp, Artificial Sequence
  dgRNA
  Tox4
tcggtaaactgaagg

SEQ ID NO: 35997 - DNA, 15 bp, Artificial Sequence
  dgRNA
  Tox4
acacctgcgaaagaa

SEQ ID NO: 35998 - DNA, 15 bp, Artificial Sequence
  dgRNA
  Tox4
tagacgcacgtcacc

SEQ ID NO: 35999 - DNA, 15 bp, Artificial Sequence
  dgRNA
  Tox4
agacgcacgtcaccc

SEQ ID NO: 36000 - DNA, 15 bp, Artificial Sequence
  dgRNA
  Rsrp1
aatcctcaaaatacc

SEQ ID NO: 36001 - DNA, 15 bp, Artificial Sequence
  dgRNA
  Rsrp1
atacccggatgtaga

SEQ ID NO: 36002 - DNA, 15 bp, Artificial Sequence
  dgRNA
  Rsrp1
cccggatgtagaagg

SEQ ID NO: 36003 - DNA, 15 bp, Artificial Sequence
  dgRNA
  Rsrp1
ccggatgtagaaggc

SEQ ID NO: 36004 - DNA, 15 bp, Artificial Sequence
  dgRNA
  Wdr6
agctaagcgcccgct

SEQ ID NO: 36005 - DNA, 15 bp, Artificial Sequence
  dgRNA
  Wdr6
gctaagcgcccgctt

SEQ ID NO: 36006 - DNA, 15 bp, Artificial Sequence
  dgRNA
  Wdr6
ctaagcgcccgcttg

SEQ ID NO: 36007 - DNA, 15 bp, Artificial Sequence
  dgRNA
  Wdr6
taagcgcccgcttgg

SEQ ID NO: 36008 - DNA, 15 bp, Artificial Sequence
  dgRNA
  Olfr347
tgactaatacacttc

SEQ ID NO: 36009 - DNA, 15 bp, Artificial Sequence
  dgRNA
  Bgn
ccgtcccctccctgt

SEQ ID NO: 36010 - DNA, 15 bp, Artificial Sequence
  dgRNA
  Bgn
gacggctggtctatg

SEQ ID NO: 36011 - DNA, 15 bp, Artificial Sequence
  dgRNA
  Bgn
tttcttgtagacggc

SEQ ID NO: 36012 - DNA, 15 bp, Artificial Sequence
  dgRNA
  Bgn
cgggccgacagggag

SEQ ID NO: 36013 - DNA, 15 bp, Artificial Sequence
  dgRNA
  Nudt12
acctcgttatcataa

SEQ ID NO: 36014 - DNA, 15 bp, Artificial Sequence
  dgRNA
  Nudt12
gccattatgataacg

SEQ ID NO: 36015 - DNA, 15 bp, Artificial Sequence
  dgRNA
  Nudt12
cggacttcaggtgct

SEQ ID NO: 36016 - DNA, 15 bp, Artificial Sequence
  dgRNA
  Nudt12
ccggacttcaggtgc

SEQ ID NO: 36017 - DNA, 15 bp, Artificial Sequence
  dgRNA
  Cxcl2
gggtcccatagtgga

SEQ ID NO: 36018 - DNA, 15 bp, Artificial Sequence
  dgRNA
  Cxcl2
ggtcccatagtggaa

SEQ ID NO: 36019 - DNA, 15 bp, Artificial Sequence
  dgRNA
  Cxcl2
ccatagtggaagggc

SEQ ID NO: 36020 - DNA, 15 bp, Artificial Sequence
  dgRNA
  Cxcl2
caacccactcagctt

SEQ ID NO: 36021 - DNA, 15 bp, Artificial Sequence
  dgRNA
  Fam26e
gcaaccaccagtagg

SEQ ID NO: 36022 - DNA, 15 bp, Artificial Sequence
  dgRNA
  Fam26e
tatctgaacgttgtt

SEQ ID NO: 36023 - DNA, 15 bp, Artificial Sequence
  dgRNA
  Fam26e
cgatgcagactgagc

SEQ ID NO: 36024 - DNA, 15 bp, Artificial Sequence
  dgRNA
  Fam26e
gataatgcctcctac

SEQ ID NO: 36025 - DNA, 15 bp, Artificial Sequence
  dgRNA
  Fezf2
tttgaggtagcgcgt

SEQ ID NO: 36026 - DNA, 15 bp, Artificial Sequence
  dgRNA
  Fezf2
ttgaggtagcgcgtc

SEQ ID NO: 36027 - DNA, 15 bp, Artificial Sequence
  dgRNA
  Fezf2
tgaggtagcgcgtcg

SEQ ID NO: 36028 - DNA, 15 bp, Artificial Sequence
  dgRNA
  Fezf2
gtaccctaaaactgt

SEQ ID NO: 36029 - DNA, 15 bp, Artificial Sequence
  dgRNA
  Phyhd1
cttagatcctgcgac

SEQ ID NO: 36030 - DNA, 15 bp, Artificial Sequence
  dgRNA
  Phyhd1
ttagatcctgcgact

SEQ ID NO: 36031 - DNA, 15 bp, Artificial Sequence
  dgRNA
  Phyhd1
tagatcctgcgactg

SEQ ID NO: 36032 - DNA, 15 bp, Artificial Sequence
  dgRNA
  Phyhd1
catctgttagactgc

SEQ ID NO: 36033 - DNA, 15 bp, Artificial Sequence
  dgRNA
  Olfml2b
ccttcccacgccagc

SEQ ID NO: 36034 - DNA, 15 bp, Artificial Sequence
  dgRNA
  Olfml2b
cccgcttaagcgcag

SEQ ID NO: 36035 - DNA, 15 bp, Artificial Sequence
  dgRNA
  Olfml2b
gtggctgaaccctag

SEQ ID NO: 36036 - DNA, 15 bp, Artificial Sequence
  dgRNA
  Olfml2b
gctgaaccctagagg

SEQ ID NO: 36037 - DNA, 15 bp, Artificial Sequence
  dgRNA
  Fam217a
agagctaagtaaggc

SEQ ID NO: 36038 - DNA, 15 bp, Artificial Sequence
  dgRNA
  Fam217a
atcccacagcagcgc

SEQ ID NO: 36039 - DNA, 15 bp, Artificial Sequence
  dgRNA
  Fam217a
gcgcagggcagcacc

SEQ ID NO: 36040 - DNA, 15 bp, Artificial Sequence
  dgRNA
  Fam217a
atgcttacggctctt

SEQ ID NO: 36041 - DNA, 15 bp, Artificial Sequence
  dgRNA
  Hspe1
tgcatgcggcgcgcg

SEQ ID NO: 36042 - DNA, 15 bp, Artificial Sequence
  dgRNA
  Hspe1
cccgccgccctacgc

SEQ ID NO: 36043 - DNA, 15 bp, Artificial Sequence
  dgRNA
  Hspe1
ccctacgctggttcc

SEQ ID NO: 36044 - DNA, 15 bp, Artificial Sequence
  dgRNA
  Hspe1
ctagaaccttccgga

SEQ ID NO: 36045 - DNA, 15 bp, Artificial Sequence
  dgRNA
  Cc2d2a
tggcctgttgggtca

SEQ ID NO: 36046 - DNA, 15 bp, Artificial Sequence
  dgRNA
  Cc2d2a
gttgcatggcctgtt

SEQ ID NO: 36047 - DNA, 15 bp, Artificial Sequence
  dgRNA
  Cc2d2a
ggttgcatggcctgt

SEQ ID NO: 36048 - DNA, 15 bp, Artificial Sequence
  dgRNA
  Cc2d2a
gaatatgagcttgct

SEQ ID NO: 36049 - DNA, 15 bp, Artificial Sequence
  dgRNA
  Sdf4
actcggagactggcg

SEQ ID NO: 36050 - DNA, 15 bp, Artificial Sequence
  dgRNA
  Sdf4
ggagactggcgcggc

SEQ ID NO: 36051 - DNA, 15 bp, Artificial Sequence
  dgRNA
  Sdf4
ctggcgcggccggtt

SEQ ID NO: 36052 - DNA, 15 bp, Artificial Sequence
  dgRNA
  Sdf4
gcggccggttaggcc

SEQ ID NO: 36053 - DNA, 15 bp, Artificial Sequence
  dgRNA
  Supt3
acaactcccgctctg

SEQ ID NO: 36054 - DNA, 15 bp, Artificial Sequence
  dgRNA
  Supt3
tgaggctccgccgcg

SEQ ID NO: 36055 - DNA, 15 bp, Artificial Sequence
  dgRNA
  Supt3
tccgccgcgtggctg

SEQ ID NO: 36056 - DNA, 15 bp, Artificial Sequence
  dgRNA
  Supt3
ccgctccgtacgccg

SEQ ID NO: 36057 - DNA, 15 bp, Artificial Sequence
  dgRNA
  Krtap19-3
gcaaacagattaatg

SEQ ID NO: 36058 - DNA, 15 bp, Artificial Sequence
  dgRNA
  Krtap19-3
tgaataacttggaat

SEQ ID NO: 36059 - DNA, 15 bp, Artificial Sequence
  dgRNA
  Krtap19-3
acgggtttgatcaca

SEQ ID NO: 36060 - DNA, 15 bp, Artificial Sequence
  dgRNA
  Krtap19-3
tgctaacacaaggat

SEQ ID NO: 36061 - DNA, 15 bp, Artificial Sequence
  dgRNA
  Ptpn7
gccgcttgctcttag

SEQ ID NO: 36062 - DNA, 15 bp, Artificial Sequence
  dgRNA
  Ptpn7
ccgcttgctcttaga

SEQ ID NO: 36063 - DNA, 15 bp, Artificial Sequence
  dgRNA
  Ptpn7
gctcttagagggcac

SEQ ID NO: 36064 - DNA, 15 bp, Artificial Sequence
  dgRNA
  Ptpn7
gcacccgacccctgg

SEQ ID NO: 36065 - DNA, 15 bp, Artificial Sequence
  dgRNA
  Oxr1
ccggactcccccgac

SEQ ID NO: 36066 - DNA, 15 bp, Artificial Sequence
  dgRNA
  Oxr1
cggactcccccgaca

SEQ ID NO: 36067 - DNA, 15 bp, Artificial Sequence
  dgRNA
  Oxr1
actcccccgacaggg

SEQ ID NO: 36068 - DNA, 15 bp, Artificial Sequence
  dgRNA
  Oxr1
cgacagggcggccga

SEQ ID NO: 36069 - DNA, 15 bp, Artificial Sequence
  dgRNA
  Nrp2
cgcagccccgcacga

SEQ ID NO: 36070 - DNA, 15 bp, Artificial Sequence
  dgRNA
  Nrp2
ccgcacgaaggtgcg

SEQ ID NO: 36071 - DNA, 15 bp, Artificial Sequence
  dgRNA
  Nrp2
cgcacgaaggtgcgt

SEQ ID NO: 36072 - DNA, 15 bp, Artificial Sequence
  dgRNA
  Nrp2
gcacgaaggtgcgtg

SEQ ID NO: 36073 - DNA, 15 bp, Artificial Sequence
  dgRNA
  Zfp217
gttaggccggatggc

SEQ ID NO: 36074 - DNA, 15 bp, Artificial Sequence
  dgRNA
  Zfp217
ccggatggcgggaca

SEQ ID NO: 36075 - DNA, 15 bp, Artificial Sequence
  dgRNA
  Zfp217
tggcgggacacggcg

SEQ ID NO: 36076 - DNA, 15 bp, Artificial Sequence
  dgRNA
  Zfp217
ggcgggacacggcgc

SEQ ID NO: 36077 - DNA, 15 bp, Artificial Sequence
  dgRNA
  Hoga1
tttaggccgtaattg

SEQ ID NO: 36078 - DNA, 15 bp, Artificial Sequence
  dgRNA
  Hoga1
gtggcgtttctccag

SEQ ID NO: 36079 - DNA, 15 bp, Artificial Sequence
  dgRNA
  Hoga1
cagcggctttccagc

SEQ ID NO: 36080 - DNA, 15 bp, Artificial Sequence
  dgRNA
  Hoga1
agcggctttccagca

SEQ ID NO: 36081 - DNA, 15 bp, Artificial Sequence
  dgRNA
  Ctsh
agcaacgcaaatgcc

SEQ ID NO: 36082 - DNA, 15 bp, Artificial Sequence
  dgRNA
  Ctsh
ccaaatgcctgttgg

SEQ ID NO: 36083 - DNA, 15 bp, Artificial Sequence
  dgRNA
  Ctsh
ccccaacaggcattt

SEQ ID NO: 36084 - DNA, 15 bp, Artificial Sequence
  dgRNA
  Ctsh
cccccaacaggcatt

SEQ ID NO: 36085 - DNA, 15 bp, Artificial Sequence
  dgRNA
  B4galt2
aacgcacctccccgc

SEQ ID NO: 36086 - DNA, 15 bp, Artificial Sequence
  dgRNA
  B4galt2
acctccccgctggct

SEQ ID NO: 36087 - DNA, 15 bp, Artificial Sequence
  dgRNA
  B4galt2
ctggctgggccgcgc

SEQ ID NO: 36088 - DNA, 15 bp, Artificial Sequence
  dgRNA
  B4galt2
tggctgggccgcgca

SEQ ID NO: 36089 - DNA, 15 bp, Artificial Sequence
  dgRNA
  Exoc3l
gggctgatcaagact

SEQ ID NO: 36090 - DNA, 15 bp, Artificial Sequence
  dgRNA
  Exoc3l
gacttggtgctcacc

SEQ ID NO: 36091 - DNA, 15 bp, Artificial Sequence
  dgRNA
  Exoc3l
acttggtgctcaccg

SEQ ID NO: 36092 - DNA, 15 bp, Artificial Sequence
  dgRNA
  Exoc3l
cttggtgctcaccgg

SEQ ID NO: 36093 - DNA, 15 bp, Artificial Sequence
  dgRNA
  Ube2v2
ggggcaaagcttgcc

SEQ ID NO: 36094 - DNA, 15 bp, Artificial Sequence
  dgRNA
  Ube2v2
tcggtccctctatga

SEQ ID NO: 36095 - DNA, 15 bp, Artificial Sequence
  dgRNA
  Ube2v2
gaactgttggttcat

SEQ ID NO: 36096 - DNA, 15 bp, Artificial Sequence
  dgRNA
  Ube2v2
aagctttgcccctga

SEQ ID NO: 36097 - DNA, 15 bp, Artificial Sequence
  dgRNA
  Acer2
ccccggtcctaccct

SEQ ID NO: 36098 - DNA, 15 bp, Artificial Sequence
  dgRNA
  Acer2
cccggtcctaccctt

SEQ ID NO: 36099 - DNA, 15 bp, Artificial Sequence
  dgRNA
  Acer2
ccggtcctacccttg

SEQ ID NO: 36100 - DNA, 15 bp, Artificial Sequence
  dgRNA
  Acer2
cggtcctacccttgg

SEQ ID NO: 36101 - DNA, 15 bp, Artificial Sequence
  dgRNA
  Wdr38
gaggcgagcactttt

SEQ ID NO: 36102 - DNA, 15 bp, Artificial Sequence
  dgRNA
  Wdr38
cgcctccatggaagg

SEQ ID NO: 36103 - DNA, 15 bp, Artificial Sequence
  dgRNA
  Wdr38
agccgcctccatgga

SEQ ID NO: 36104 - DNA, 15 bp, Artificial Sequence
  dgRNA
  Wdr38
tctgagccgcctcca

SEQ ID NO: 36105 - DNA, 15 bp, Artificial Sequence
  dgRNA
  Rnf114
cgcccaccgcgggcc

SEQ ID NO: 36106 - DNA, 15 bp, Artificial Sequence
  dgRNA
  Rnf114
caccgcgggcccgga

SEQ ID NO: 36107 - DNA, 15 bp, Artificial Sequence
  dgRNA
  Rnf114
tagaccgggagacca

SEQ ID NO: 36108 - DNA, 15 bp, Artificial Sequence
  dgRNA
  Rnf114
agagcgactcagcca

SEQ ID NO: 36109 - DNA, 15 bp, Artificial Sequence
  dgRNA
  Hip1
atgcggaccgccctg

SEQ ID NO: 36110 - DNA, 15 bp, Artificial Sequence
  dgRNA
  Hip1
cggaccgccctgagg

SEQ ID NO: 36111 - DNA, 15 bp, Artificial Sequence
  dgRNA
  Hip1
ggaccgccctgaggc

SEQ ID NO: 36112 - DNA, 15 bp, Artificial Sequence
  dgRNA
  Hip1
agcgggtgaagtgag

SEQ ID NO: 36113 - DNA, 15 bp, Artificial Sequence
  dgRNA
  Nucb2
ggcttcctcacgctt

SEQ ID NO: 36114 - DNA, 15 bp, Artificial Sequence
  dgRNA
  Nucb2
gcgccacgtccctct

SEQ ID NO: 36115 - DNA, 15 bp, Artificial Sequence
  dgRNA
  Nucb2
gaagcgccttcgcgt

SEQ ID NO: 36116 - DNA, 15 bp, Artificial Sequence
  dgRNA
  Nucb2
gcgtaggcgcgtccc

SEQ ID NO: 36117 - DNA, 15 bp, Artificial Sequence
  dgRNA
  Gm13271
atccattgctgcacc

SEQ ID NO: 36118 - DNA, 15 bp, Artificial Sequence
  dgRNA
  Gm13271
ctttgcaccaaaacc

SEQ ID NO: 36119 - DNA, 15 bp, Artificial Sequence
  dgRNA
  Gm13271
agctcctctatgatc

SEQ ID NO: 36120 - DNA, 15 bp, Artificial Sequence
  dgRNA
  Gm13271
ttacttagagctcct

SEQ ID NO: 36121 - DNA, 15 bp, Artificial Sequence
  dgRNA
  Tcaim
aagatccggttcctc

SEQ ID NO: 36122 - DNA, 15 bp, Artificial Sequence
  dgRNA
  Tcaim
agccgttggtagtct

SEQ ID NO: 36123 - DNA, 15 bp, Artificial Sequence
  dgRNA
  Tcaim
ctatgcaaggcgctc

SEQ ID NO: 36124 - DNA, 15 bp, Artificial Sequence
  dgRNA
  Tcaim
gggcggagctatgca

SEQ ID NO: 36125 - DNA, 15 bp, Artificial Sequence
  dgRNA
  Cela3a
ctgtagattagggag

SEQ ID NO: 36126 - DNA, 15 bp, Artificial Sequence
  dgRNA
  Cela3a
aaccactgtagatta

SEQ ID NO: 36127 - DNA, 15 bp, Artificial Sequence
  dgRNA
  Cela3a
caaccactgtagatt

SEQ ID NO: 36128 - DNA, 15 bp, Artificial Sequence
  dgRNA
  Cela3a
ctaatatagtgccgg

SEQ ID NO: 36129 - DNA, 15 bp, Artificial Sequence
  dgRNA
  Ttc14
tggccttggcgacct

SEQ ID NO: 36130 - DNA, 15 bp, Artificial Sequence
  dgRNA
  Ttc14
gtacgtgctaagctc

SEQ ID NO: 36131 - DNA, 15 bp, Artificial Sequence
  dgRNA
  Ttc14
gccttactccgccct

SEQ ID NO: 36132 - DNA, 15 bp, Artificial Sequence
  dgRNA
  Ttc14
gcttcgcgcttcctg

SEQ ID NO: 36133 - DNA, 15 bp, Artificial Sequence
  dgRNA
  Chaf1a
ttcatccgcctcccg

SEQ ID NO: 36134 - DNA, 15 bp, Artificial Sequence
  dgRNA
  Chaf1a
tcatccgcctcccgc

SEQ ID NO: 36135 - DNA, 15 bp, Artificial Sequence
  dgRNA
  Chaf1a
accgaagttctcgcg

SEQ ID NO: 36136 - DNA, 15 bp, Artificial Sequence
  dgRNA
  Chaf1a
gtgcacctctttttc

SEQ ID NO: 36137 - DNA, 15 bp, Artificial Sequence
  dgRNA
  Tacr3
caacccgcgacgtca

SEQ ID NO: 36138 - DNA, 15 bp, Artificial Sequence
  dgRNA
  Tacr3
cgacgtcacggaagc

SEQ ID NO: 36139 - DNA, 15 bp, Artificial Sequence
  dgRNA
  Tacr3
gacgtcacggaagct

SEQ ID NO: 36140 - DNA, 15 bp, Artificial Sequence
  dgRNA
  Tacr3
acgtcacggaagctg

SEQ ID NO: 36141 - DNA, 15 bp, Artificial Sequence
  dgRNA
  Ccdc50
gcgcggcaggcacat

SEQ ID NO: 36142 - DNA, 15 bp, Artificial Sequence
  dgRNA
  Ccdc50
gcaggcacataggcg

SEQ ID NO: 36143 - DNA, 15 bp, Artificial Sequence
  dgRNA
  Ccdc50
caggcacataggcga

SEQ ID NO: 36144 - DNA, 15 bp, Artificial Sequence
  dgRNA
  Ccdc50
aggcacataggcgag

SEQ ID NO: 36145 - DNA, 15 bp, Artificial Sequence
  dgRNA
  Uap1l1
gtacaccttgaatgc

SEQ ID NO: 36146 - DNA, 15 bp, Artificial Sequence
  dgRNA
  Uap1l1
accttgaatgctggg

SEQ ID NO: 36147 - DNA, 15 bp, Artificial Sequence
  dgRNA
  Uap1l1
cctaggattcaagtc

SEQ ID NO: 36148 - DNA, 15 bp, Artificial Sequence
  dgRNA
  Uap1l1
agtccggaaacgcgc

SEQ ID NO: 36149 - DNA, 15 bp, Artificial Sequence
  dgRNA
  Cldn34b4
agcatactaaaagct

SEQ ID NO: 36150 - DNA, 15 bp, Artificial Sequence
  dgRNA
  Cldn34b4
ctaaaagctcggaaa

SEQ ID NO: 36151 - DNA, 15 bp, Artificial Sequence
  dgRNA
  Rinl
accaagctatgcccc

SEQ ID NO: 36152 - DNA, 15 bp, Artificial Sequence
  dgRNA
  Rinl
gctatgcccctggag

SEQ ID NO: 36153 - DNA, 15 bp, Artificial Sequence
  dgRNA
  Rinl
ggtgactttttaccc

SEQ ID NO: 36154 - DNA, 15 bp, Artificial Sequence
  dgRNA
  Rinl
ccctaatactgaccc

SEQ ID NO: 36155 - DNA, 15 bp, Artificial Sequence
  dgRNA
  Alg2
ttagcgtgcttaata

SEQ ID NO: 36156 - DNA, 15 bp, Artificial Sequence
  dgRNA
  Alg2
ccaaattgcaagctt

SEQ ID NO: 36157 - DNA, 15 bp, Artificial Sequence
  dgRNA
  Alg2
ttgcaagctttggac

SEQ ID NO: 36158 - DNA, 15 bp, Artificial Sequence
  dgRNA
  Alg2
agcttatcgctgatg

SEQ ID NO: 36159 - DNA, 15 bp, Artificial Sequence
  dgRNA
  Dnajc18
ccaactaaatctgac

SEQ ID NO: 36160 - DNA, 15 bp, Artificial Sequence
  dgRNA
  Dnajc18
tgacaggcctcgctc

SEQ ID NO: 36161 - DNA, 15 bp, Artificial Sequence
  dgRNA
  Dnajc18
gacaggcctcgctct

SEQ ID NO: 36162 - DNA, 15 bp, Artificial Sequence
  dgRNA
  Dnajc18
acaggcctcgctctg

SEQ ID NO: 36163 - DNA, 15 bp, Artificial Sequence
  dgRNA
  Cmtm6
ggtgtggcgaacaag

SEQ ID NO: 36164 - DNA, 15 bp, Artificial Sequence
  dgRNA
  Cmtm6
aggcgcggcaaacca

SEQ ID NO: 36165 - DNA, 15 bp, Artificial Sequence
  dgRNA
  Cmtm6
ggcgcggcaaaccat

SEQ ID NO: 36166 - DNA, 15 bp, Artificial Sequence
  dgRNA
  Cmtm6
gcgcggcaaaccatg

SEQ ID NO: 36167 - DNA, 15 bp, Artificial Sequence
  dgRNA
  Star
cctacctgcagagtc

SEQ ID NO: 36168 - DNA, 15 bp, Artificial Sequence
  dgRNA
  Star
cttggccagcactgc

SEQ ID NO: 36169 - DNA, 15 bp, Artificial Sequence
  dgRNA
  Star
aggggtcacggagat

SEQ ID NO: 36170 - DNA, 15 bp, Artificial Sequence
  dgRNA
  Cramp1l
ttctcccacccgaaa

SEQ ID NO: 36171 - DNA, 15 bp, Artificial Sequence
  dgRNA
  Cramp1l
tctcccacccgaaat

SEQ ID NO: 36172 - DNA, 15 bp, Artificial Sequence
  dgRNA
  Cramp1l
cccgaaatgggacaa

SEQ ID NO: 36173 - DNA, 15 bp, Artificial Sequence
  dgRNA
  Cramp1l
ccgaaatgggacaaa

SEQ ID NO: 36174 - DNA, 15 bp, Artificial Sequence
  dgRNA
  9930021J03Rik
cggcgtcggagacga

SEQ ID NO: 36175 - DNA, 15 bp, Artificial Sequence
  dgRNA
  9930021J03Rik
cgtcggagacgacgg

SEQ ID NO: 36176 - DNA, 15 bp, Artificial Sequence
  dgRNA
  9930021J03Rik
gacgacggtggtcgc

SEQ ID NO: 36177 - DNA, 15 bp, Artificial Sequence
  dgRNA
  9930021J03Rik
gacggtggtcgcagg

SEQ ID NO: 36178 - DNA, 15 bp, Artificial Sequence
  dgRNA
  Slc19a1
atctccaagtgtaga

SEQ ID NO: 36179 - DNA, 15 bp, Artificial Sequence
  dgRNA
  Slc19a1
tgcatgaaccccctg

SEQ ID NO: 36180 - DNA, 15 bp, Artificial Sequence
  dgRNA
  Slc19a1
gctgcgggtgtagcc

SEQ ID NO: 36181 - DNA, 15 bp, Artificial Sequence
  dgRNA
  Slc19a1
gtttgccccgcctcc

SEQ ID NO: 36182 - DNA, 15 bp, Artificial Sequence
  dgRNA
  Brdt
ggcccacgccctcct

SEQ ID NO: 36183 - DNA, 15 bp, Artificial Sequence
  dgRNA
  Brdt
gcccacgccctccta

SEQ ID NO: 36184 - DNA, 15 bp, Artificial Sequence
  dgRNA
  Brdt
cgccctcctagggag

SEQ ID NO: 36185 - DNA, 15 bp, Artificial Sequence
  dgRNA
  Brdt
tagggagtggcggca

SEQ ID NO: 36186 - DNA, 15 bp, Artificial Sequence
  dgRNA
  Gm12886
gtataaagtccctaa

SEQ ID NO: 36187 - DNA, 15 bp, Artificial Sequence
  dgRNA
  Gm12886
ttccggtctgttcta

SEQ ID NO: 36188 - DNA, 15 bp, Artificial Sequence
  dgRNA
  Gm12886
atatacctgtcaagt

SEQ ID NO: 36189 - DNA, 15 bp, Artificial Sequence
  dgRNA
  Hspb1
cctaaacccgacagt

SEQ ID NO: 36190 - DNA, 15 bp, Artificial Sequence
  dgRNA
  Hspb1
aatcgctccagctac

SEQ ID NO: 36191 - DNA, 15 bp, Artificial Sequence
  dgRNA
  Hspb1
cccctttgcaagctt

SEQ ID NO: 36192 - DNA, 15 bp, Artificial Sequence
  dgRNA
  Hspb1
ccctttgcaagctta

SEQ ID NO: 36193 - DNA, 15 bp, Artificial Sequence
  dgRNA
  Pnma3
tagaagtgtctttgc

SEQ ID NO: 36194 - DNA, 15 bp, Artificial Sequence
  dgRNA
  Pnma3
ggtagggagccgagc

SEQ ID NO: 36195 - DNA, 15 bp, Artificial Sequence
  dgRNA
  Pnma3
cgcattaatttcctt

SEQ ID NO: 36196 - DNA, 15 bp, Artificial Sequence
  dgRNA
  Pnma3
tgtaaatagggccaa

SEQ ID NO: 36197 - DNA, 15 bp, Artificial Sequence
  dgRNA
  Egfem1
gaccgctggtctcac

SEQ ID NO: 36198 - DNA, 15 bp, Artificial Sequence
  dgRNA
  Egfem1
gtctccagtcgccgc

SEQ ID NO: 36199 - DNA, 15 bp, Artificial Sequence
  dgRNA
  Egfem1
cgccgccggcagtgc

SEQ ID NO: 36200 - DNA, 15 bp, Artificial Sequence
  dgRNA
  Egfem1
gccgccggcagtgca

SEQ ID NO: 36201 - DNA, 15 bp, Artificial Sequence
  dgRNA
  Ccdc112
gttcagtaccctcac

SEQ ID NO: 36202 - DNA, 15 bp, Artificial Sequence
  dgRNA
  Ccdc112
agtaccctcaccggt

SEQ ID NO: 36203 - DNA, 15 bp, Artificial Sequence
  dgRNA
  Ccdc112
tagccacgccccgtg

SEQ ID NO: 36204 - DNA, 15 bp, Artificial Sequence
  dgRNA
  Ccdc112
ggcaaggtggacacg

SEQ ID NO: 36205 - DNA, 15 bp, Artificial Sequence
  dgRNA
  Diaph2
gtaggaagcggcttt

SEQ ID NO: 36206 - DNA, 15 bp, Artificial Sequence
  dgRNA
  Diaph2
ctttcggagcccgcc

SEQ ID NO: 36207 - DNA, 15 bp, Artificial Sequence
  dgRNA
  Diaph2
tttcggagcccgccc

SEQ ID NO: 36208 - DNA, 15 bp, Artificial Sequence
  dgRNA
  Diaph2
ccgggcgaccgacag

SEQ ID NO: 36209 - DNA, 15 bp, Artificial Sequence
  dgRNA
  Ccdc150
gtgcgcctagtaatt

SEQ ID NO: 36210 - DNA, 15 bp, Artificial Sequence
  dgRNA
  Ccdc150
tgcgcctagtaatta

SEQ ID NO: 36211 - DNA, 15 bp, Artificial Sequence
  dgRNA
  Ccdc150
aagccgacccaatcg

SEQ ID NO: 36212 - DNA, 15 bp, Artificial Sequence
  dgRNA
  Ccdc150
gacccaatcgaggag

SEQ ID NO: 36213 - DNA, 15 bp, Artificial Sequence
  dgRNA
  Rab35
ccctgctaaacggtt

SEQ ID NO: 36214 - DNA, 15 bp, Artificial Sequence
  dgRNA
  Rab35
acggttcggttctcc

SEQ ID NO: 36215 - DNA, 15 bp, Artificial Sequence
  dgRNA
  Rab35
cggttcggttctccc

SEQ ID NO: 36216 - DNA, 15 bp, Artificial Sequence
  dgRNA
  Rab35
ggttcggttctcccg

SEQ ID NO: 36217 - DNA, 15 bp, Artificial Sequence
  dgRNA
  Gpm6a
aaagacgtgaaataa

SEQ ID NO: 36218 - DNA, 15 bp, Artificial Sequence
  dgRNA
  Gpm6a
aattaactagacact

SEQ ID NO: 36219 - DNA, 15 bp, Artificial Sequence
  dgRNA
  Gpm6a
actagacacttggtg

SEQ ID NO: 36220 - DNA, 15 bp, Artificial Sequence
  dgRNA
  Gpm6a
tgtaatgaatctgac

SEQ ID NO: 36221 - DNA, 15 bp, Artificial Sequence
  dgRNA
  Triap1
cctgtggattcgctt

SEQ ID NO: 36222 - DNA, 15 bp, Artificial Sequence
  dgRNA
  Triap1
tcggcccgcgtccag

SEQ ID NO: 36223 - DNA, 15 bp, Artificial Sequence
  dgRNA
  Triap1
cggcccgcgtccagc

SEQ ID NO: 36224 - DNA, 15 bp, Artificial Sequence
  dgRNA
  Triap1
ggcccgcgtccagcg

SEQ ID NO: 36225 - DNA, 15 bp, Artificial Sequence
  dgRNA
  Snx16
tccccctcccactcg

SEQ ID NO: 36226 - DNA, 15 bp, Artificial Sequence
  dgRNA
  Snx16
cggcctcgagtggga

SEQ ID NO: 36227 - DNA, 15 bp, Artificial Sequence
  dgRNA
  Snx16
acggcctcgagtggg

SEQ ID NO: 36228 - DNA, 15 bp, Artificial Sequence
  dgRNA
  Snx16
gggacggcctcgagt

SEQ ID NO: 36229 - DNA, 15 bp, Artificial Sequence
  dgRNA
  Gpr15
atcaagacgctccct

SEQ ID NO: 36230 - DNA, 15 bp, Artificial Sequence
  dgRNA
  Gpr15
agttcgtaagacgca

SEQ ID NO: 36231 - DNA, 15 bp, Artificial Sequence
  dgRNA
  Gpr15
gtaagacgcaaggta

SEQ ID NO: 36232 - DNA, 15 bp, Artificial Sequence
  dgRNA
  Gpr15
gttcgacgctgaatc

SEQ ID NO: 36233 - DNA, 15 bp, Artificial Sequence
  dgRNA
  Phkg2
atggtggagaccttt

SEQ ID NO: 36234 - DNA, 15 bp, Artificial Sequence
  dgRNA
  Phkg2
ggtggagaccttttg

SEQ ID NO: 36235 - DNA, 15 bp, Artificial Sequence
  dgRNA
  Phkg2
gacttctagcgccaa

SEQ ID NO: 36236 - DNA, 15 bp, Artificial Sequence
  dgRNA
  Phkg2
cggccttgtccgccc

SEQ ID NO: 36237 - DNA, 15 bp, Artificial Sequence
  dgRNA
  Pccb
actgctaccagcttt

SEQ ID NO: 36238 - DNA, 15 bp, Artificial Sequence
  dgRNA
  Pccb
ctgctaccagcttta

SEQ ID NO: 36239 - DNA, 15 bp, Artificial Sequence
  dgRNA
  Pccb
ccagcgacgacgcgc

SEQ ID NO: 36240 - DNA, 15 bp, Artificial Sequence
  dgRNA
  Pccb
cagtgtgtgtcacgc

SEQ ID NO: 36241 - DNA, 15 bp, Artificial Sequence
  dgRNA
  Tmem194b
tctgagaaccctgcg

SEQ ID NO: 36242 - DNA, 15 bp, Artificial Sequence
  dgRNA
  Tmem194b
ctgagaaccctgcgc

SEQ ID NO: 36243 - DNA, 15 bp, Artificial Sequence
  dgRNA
  Tmem194b
tgagaaccctgcgcg

SEQ ID NO: 36244 - DNA, 15 bp, Artificial Sequence
  dgRNA
  Tmem194b
aagaatcgggaaggc

SEQ ID NO: 36245 - DNA, 15 bp, Artificial Sequence
  dgRNA
  Cdc42ep3
tcgcctccagtcctg

SEQ ID NO: 36246 - DNA, 15 bp, Artificial Sequence
  dgRNA
  Cdc42ep3
cgcctccagtcctgc

SEQ ID NO: 36247 - DNA, 15 bp, Artificial Sequence
  dgRNA
  Cdc42ep3
ccagtcctgcgggtc

SEQ ID NO: 36248 - DNA, 15 bp, Artificial Sequence
  dgRNA
  Cdc42ep3
cagtcctgcgggtct

SEQ ID NO: 36249 - DNA, 15 bp, Artificial Sequence
  dgRNA
  Slc30a7
atctttcgtgagttc

SEQ ID NO: 36250 - DNA, 15 bp, Artificial Sequence
  dgRNA
  Slc30a7
ctctagctgagctag

SEQ ID NO: 36251 - DNA, 15 bp, Artificial Sequence
  dgRNA
  Slc30a7
tctctagctgagcta

SEQ ID NO: 36252 - DNA, 15 bp, Artificial Sequence
  dgRNA
  Slc30a7
cgagctgaaagcttg

SEQ ID NO: 36253 - DNA, 15 bp, Artificial Sequence
  dgRNA
  Inf2
gatgccagacccggg

SEQ ID NO: 36254 - DNA, 15 bp, Artificial Sequence
  dgRNA
  Inf2
atgccagacccgggt

SEQ ID NO: 36255 - DNA, 15 bp, Artificial Sequence
  dgRNA
  Inf2
cagacccgggtgggc

SEQ ID NO: 36256 - DNA, 15 bp, Artificial Sequence
  dgRNA
  Inf2
agacccgggtgggca

SEQ ID NO: 36257 - DNA, 15 bp, Artificial Sequence
  dgRNA
  Adamts4
accactaaggtcttt

SEQ ID NO: 36258 - DNA, 15 bp, Artificial Sequence
  dgRNA
  Adamts4
cacagagggcggttc

SEQ ID NO: 36259 - DNA, 15 bp, Artificial Sequence
  dgRNA
  Adamts4
gatgcttaaaagagc

SEQ ID NO: 36260 - DNA, 15 bp, Artificial Sequence
  dgRNA
  Adamts4
tcccaaagaccttag

SEQ ID NO: 36261 - DNA, 15 bp, Artificial Sequence
  dgRNA
  Pcgf5
actttgggttagttc

SEQ ID NO: 36262 - DNA, 15 bp, Artificial Sequence
  dgRNA
  Pcgf5
gggttagttctggct

SEQ ID NO: 36263 - DNA, 15 bp, Artificial Sequence
  dgRNA
  Pcgf5
tggctcggtgctttg

SEQ ID NO: 36264 - DNA, 15 bp, Artificial Sequence
  dgRNA
  Pcgf5
gtgctctccggattt

SEQ ID NO: 36265 - DNA, 15 bp, Artificial Sequence
  dgRNA
  Ugt1a10
agacctttttttgtc

SEQ ID NO: 36266 - DNA, 15 bp, Artificial Sequence
  dgRNA
  Ugt1a10
tctaatactttgcct

SEQ ID NO: 36267 - DNA, 15 bp, Artificial Sequence
  dgRNA
  Katnal2
agcctcttgattgac

SEQ ID NO: 36268 - DNA, 15 bp, Artificial Sequence
  dgRNA
  Katnal2
gcctcttgattgact

SEQ ID NO: 36269 - DNA, 15 bp, Artificial Sequence
  dgRNA
  Katnal2
attgcgcagactctc

SEQ ID NO: 36270 - DNA, 15 bp, Artificial Sequence
  dgRNA
  Katnal2
taaagaatccgtctg

SEQ ID NO: 36271 - DNA, 15 bp, Artificial Sequence
  dgRNA
  Bhlha9
gcctggccacgccct

SEQ ID NO: 36272 - DNA, 15 bp, Artificial Sequence
  dgRNA
  Bhlha9
tacacaggaccagct

SEQ ID NO: 36273 - DNA, 15 bp, Artificial Sequence
  dgRNA
  Bhlha9
gtacacaggaccagc

SEQ ID NO: 36274 - DNA, 15 bp, Artificial Sequence
  dgRNA
  Bhlha9
cagattcttgtacac

SEQ ID NO: 36275 - DNA, 15 bp, Artificial Sequence
  dgRNA
  Sidt2
gggccaccgccgcct

SEQ ID NO: 36276 - DNA, 15 bp, Artificial Sequence
  dgRNA
  Sidt2
ccgcctcggctctcc

SEQ ID NO: 36277 - DNA, 15 bp, Artificial Sequence
  dgRNA
  Sidt2
ctctccgggcgcgag

SEQ ID NO: 36278 - DNA, 15 bp, Artificial Sequence
  dgRNA
  Sidt2
ggcgcgagcggacgc

SEQ ID NO: 36279 - DNA, 15 bp, Artificial Sequence
  dgRNA
  1700109H08Rik
ccgtgctagctgttg

SEQ ID NO: 36280 - DNA, 15 bp, Artificial Sequence
  dgRNA
  1700109H08Rik
tatgtactgaatggc

SEQ ID NO: 36281 - DNA, 15 bp, Artificial Sequence
  dgRNA
  1700109H08Rik
atgtactgaatggca

SEQ ID NO: 36282 - DNA, 15 bp, Artificial Sequence
  dgRNA
  1700109H08Rik
atgttcatcgctttc

SEQ ID NO: 36283 - DNA, 15 bp, Artificial Sequence
  dgRNA
  Wwc1
cacgcgccaagagcc

SEQ ID NO: 36284 - DNA, 15 bp, Artificial Sequence
  dgRNA
  Wwc1
agagcccggacactc

SEQ ID NO: 36285 - DNA, 15 bp, Artificial Sequence
  dgRNA
  Wwc1
gggtggtcggcgatt

SEQ ID NO: 36286 - DNA, 15 bp, Artificial Sequence
  dgRNA
  Wwc1
tgggactgtcccacg

SEQ ID NO: 36287 - DNA, 15 bp, Artificial Sequence
  dgRNA
  Prrc1
gtcacctcagctacg

SEQ ID NO: 36288 - DNA, 15 bp, Artificial Sequence
  dgRNA
  Prrc1
ggggacagaacgacg

SEQ ID NO: 36289 - DNA, 15 bp, Artificial Sequence
  dgRNA
  Prrc1
gggacagaacgacga

SEQ ID NO: 36290 - DNA, 15 bp, Artificial Sequence
  dgRNA
  Prrc1
acagaacgacgaggg

SEQ ID NO: 36291 - DNA, 15 bp, Artificial Sequence
  dgRNA
  Pthlh
ctgtttgtagggacc

SEQ ID NO: 36292 - DNA, 15 bp, Artificial Sequence
  dgRNA
  Pthlh
acagcaggccggttc

SEQ ID NO: 36293 - DNA, 15 bp, Artificial Sequence
  dgRNA
  Pthlh
gcaggccggttcagg

SEQ ID NO: 36294 - DNA, 15 bp, Artificial Sequence
  dgRNA
  Pthlh
ggccggttcaggagg

SEQ ID NO: 36295 - DNA, 15 bp, Artificial Sequence
  dgRNA
  Egln2
gtgtctgctttcgcg

SEQ ID NO: 36296 - DNA, 15 bp, Artificial Sequence
  dgRNA
  Egln2
ctgctttcgcgtgga

SEQ ID NO: 36297 - DNA, 15 bp, Artificial Sequence
  dgRNA
  Egln2
tgctttcgcgtggaa

SEQ ID NO: 36298 - DNA, 15 bp, Artificial Sequence
  dgRNA
  Egln2
gctttcgcgtggaag

SEQ ID NO: 36299 - DNA, 15 bp, Artificial Sequence
  dgRNA
  Pld5
gagaggcgcgcgcag

SEQ ID NO: 36300 - DNA, 15 bp, Artificial Sequence
  dgRNA
  Pld5
agaggcgcgcgcaga

SEQ ID NO: 36301 - DNA, 15 bp, Artificial Sequence
  dgRNA
  Pld5
ggcgcgcgcagaggg

SEQ ID NO: 36302 - DNA, 15 bp, Artificial Sequence
  dgRNA
  Pld5
gcgcgcagagggcgg

SEQ ID NO: 36303 - DNA, 15 bp, Artificial Sequence
  dgRNA
  5430419D17Rik
tgggatgtatctaat

SEQ ID NO: 36304 - DNA, 15 bp, Artificial Sequence
  dgRNA
  5430419D17Rik
ccaaggcaaacgcat

SEQ ID NO: 36305 - DNA, 15 bp, Artificial Sequence
  dgRNA
  5430419D17Rik
cttgccaattcgagc

SEQ ID NO: 36306 - DNA, 15 bp, Artificial Sequence
  dgRNA
  5430419D17Rik
gagcatcgagttgcc

SEQ ID NO: 36307 - DNA, 15 bp, Artificial Sequence
  dgRNA
  Cdrt4
gtctaggtcaaggat

SEQ ID NO: 36308 - DNA, 15 bp, Artificial Sequence
  dgRNA
  Cdrt4
accgtgacagatgcc

SEQ ID NO: 36309 - DNA, 15 bp, Artificial Sequence
  dgRNA
  Cdrt4
aaatgacctcattcg

SEQ ID NO: 36310 - DNA, 15 bp, Artificial Sequence
  dgRNA
  Rev3l
gaatcatcgattcct

SEQ ID NO: 36311 - DNA, 15 bp, Artificial Sequence
  dgRNA
  Rev3l
cgattcctcggcgcg

SEQ ID NO: 36312 - DNA, 15 bp, Artificial Sequence
  dgRNA
  Rev3l
cctcggcgcgcggcc

SEQ ID NO: 36313 - DNA, 15 bp, Artificial Sequence
  dgRNA
  Rev3l
gccgcgcgctccgag

SEQ ID NO: 36314 - DNA, 15 bp, Artificial Sequence
  dgRNA
  Rdh14
tctaaataaatccgc

SEQ ID NO: 36315 - DNA, 15 bp, Artificial Sequence
  dgRNA
  Rdh14
ctaaataaatccgct

SEQ ID NO: 36316 - DNA, 15 bp, Artificial Sequence
  dgRNA
  Rdh14
taaataaatccgctg

SEQ ID NO: 36317 - DNA, 15 bp, Artificial Sequence
  dgRNA
  Rdh14
cgcgcgcagtagccc

SEQ ID NO: 36318 - DNA, 15 bp, Artificial Sequence
  dgRNA
  Hmbox1
ctgtgggaaggcgta

SEQ ID NO: 36319 - DNA, 15 bp, Artificial Sequence
  dgRNA
  Hmbox1
tgtgggaaggcgtat

SEQ ID NO: 36320 - DNA, 15 bp, Artificial Sequence
  dgRNA
  Hmbox1
agctgtagttcccta

SEQ ID NO: 36321 - DNA, 15 bp, Artificial Sequence
  dgRNA
  Hmbox1
atgcccagcggcagc

SEQ ID NO: 36322 - DNA, 15 bp, Artificial Sequence
  dgRNA
  Hrc
gaataacttaggctc

SEQ ID NO: 36323 - DNA, 15 bp, Artificial Sequence
  dgRNA
  Hrc
ggggacagaccccat

SEQ ID NO: 36324 - DNA, 15 bp, Artificial Sequence
  dgRNA
  Hrc
cttcatggcgggggc

SEQ ID NO: 36325 - DNA, 15 bp, Artificial Sequence
  dgRNA
  Hrc
gggtcttcatggcgg

SEQ ID NO: 36326 - DNA, 15 bp, Artificial Sequence
  dgRNA
  Pnpt1
tatttttcaccgata

SEQ ID NO: 36327 - DNA, 15 bp, Artificial Sequence
  dgRNA
  Pnpt1
atttttcaccgataa

SEQ ID NO: 36328 - DNA, 15 bp, Artificial Sequence
  dgRNA
  Pnpt1
tttcaccgataaggg

SEQ ID NO: 36329 - DNA, 15 bp, Artificial Sequence
  dgRNA
  Pnpt1
ttcaccgataagggt

SEQ ID NO: 36330 - DNA, 15 bp, Artificial Sequence
  dgRNA
  Foxb1
cggtctcccagtctt

SEQ ID NO: 36331 - DNA, 15 bp, Artificial Sequence
  dgRNA
  Foxb1
ctcccagtcttcggc

SEQ ID NO: 36332 - DNA, 15 bp, Artificial Sequence
  dgRNA
  Foxb1
ggaagtgattcctat

SEQ ID NO: 36333 - DNA, 15 bp, Artificial Sequence
  dgRNA
  Foxb1
ggtgtccatgtaaat

SEQ ID NO: 36334 - DNA, 15 bp, Artificial Sequence
  dgRNA
  Gchfr
gcatccgccggactt

SEQ ID NO: 36335 - DNA, 15 bp, Artificial Sequence
  dgRNA
  Gchfr
gcatggaggtattgc

SEQ ID NO: 36336 - DNA, 15 bp, Artificial Sequence
  dgRNA
  Gchfr
gggcaaaggggcgac

SEQ ID NO: 36337 - DNA, 15 bp, Artificial Sequence
  dgRNA
  Gchfr
gcaccctgtacgcca

SEQ ID NO: 36338 - DNA, 15 bp, Artificial Sequence
  dgRNA
  Shc3
atgggcccggcagcc

SEQ ID NO: 36339 - DNA, 15 bp, Artificial Sequence
  dgRNA
  Shc3
tgggcccggcagcct

SEQ ID NO: 36340 - DNA, 15 bp, Artificial Sequence
  dgRNA
  Shc3
cagctccggcctgcg

SEQ ID NO: 36341 - DNA, 15 bp, Artificial Sequence
  dgRNA
  Shc3
tgcgtggcctgtcgt

SEQ ID NO: 36342 - DNA, 15 bp, Artificial Sequence
  dgRNA
  Olfr434
taagtatttaagcac

SEQ ID NO: 36343 - DNA, 15 bp, Artificial Sequence
  dgRNA
  Olfr434
tagaataactgacac

SEQ ID NO: 36344 - DNA, 15 bp, Artificial Sequence
  dgRNA
  Slc35d2
gctaaggcagttttt

SEQ ID NO: 36345 - DNA, 15 bp, Artificial Sequence
  dgRNA
  Slc35d2
gtttttcggctttcc

SEQ ID NO: 36346 - DNA, 15 bp, Artificial Sequence
  dgRNA
  Slc35d2
tttttcggctttccc

SEQ ID NO: 36347 - DNA, 15 bp, Artificial Sequence
  dgRNA
  Slc35d2
ttcggctttcccggg

SEQ ID NO: 36348 - DNA, 15 bp, Artificial Sequence
  dgRNA
  Prorsd1
gaagccacattgccg

SEQ ID NO: 36349 - DNA, 15 bp, Artificial Sequence
  dgRNA
  Prorsd1
gccgcggccgagcaa

SEQ ID NO: 36350 - DNA, 15 bp, Artificial Sequence
  dgRNA
  Prorsd1
ccgagcaatggaacc

SEQ ID NO: 36351 - DNA, 15 bp, Artificial Sequence
  dgRNA
  Prorsd1
cgaccccggcactgg

SEQ ID NO: 36352 - DNA, 15 bp, Artificial Sequence
  dgRNA
  Lce3d
atcacacatctacca

SEQ ID NO: 36353 - DNA, 15 bp, Artificial Sequence
  dgRNA
  Dtx3l
cgctccacccttgag

SEQ ID NO: 36354 - DNA, 15 bp, Artificial Sequence
  dgRNA
  Dtx3l
ggattttctgctcga

SEQ ID NO: 36355 - DNA, 15 bp, Artificial Sequence
  dgRNA
  Dtx3l
gggattttctgctcg

SEQ ID NO: 36356 - DNA, 15 bp, Artificial Sequence
  dgRNA
  Dtx3l
tagctgggcacctta

SEQ ID NO: 36357 - DNA, 15 bp, Artificial Sequence
  dgRNA
  Mrpl10
tctcgcgtcgttgct

SEQ ID NO: 36358 - DNA, 15 bp, Artificial Sequence
  dgRNA
  Mrpl10
tcgttgctaggagac

SEQ ID NO: 36359 - DNA, 15 bp, Artificial Sequence
  dgRNA
  Mrpl10
aggagactggacgcc

SEQ ID NO: 36360 - DNA, 15 bp, Artificial Sequence
  dgRNA
  Mrpl10
ggacgccaggtctga

SEQ ID NO: 36361 - DNA, 15 bp, Artificial Sequence
  dgRNA
  A930018P22Rik
gggctattttggggc

SEQ ID NO: 36362 - DNA, 15 bp, Artificial Sequence
  dgRNA
  A930018P22Rik
tggggcgggtagtgc

SEQ ID NO: 36363 - DNA, 15 bp, Artificial Sequence
  dgRNA
  A930018P22Rik
ggggcgggtagtgca

SEQ ID NO: 36364 - DNA, 15 bp, Artificial Sequence
  dgRNA
  A930018P22Rik
cccgaagctgactcg

SEQ ID NO: 36365 - DNA, 15 bp, Artificial Sequence
  dgRNA
  Tspan1
catacaccccttttc

SEQ ID NO: 36366 - DNA, 15 bp, Artificial Sequence
  dgRNA
  Tspan1
tatctccaggcagta

SEQ ID NO: 36367 - DNA, 15 bp, Artificial Sequence
  dgRNA
  Tspan1
aaggctaatcagcct

SEQ ID NO: 36368 - DNA, 15 bp, Artificial Sequence
  dgRNA
  Tspan1
aggctaatcagcctt

SEQ ID NO: 36369 - DNA, 15 bp, Artificial Sequence
  dgRNA
  Fbxo9
tgccttctattgacg

SEQ ID NO: 36370 - DNA, 15 bp, Artificial Sequence
  dgRNA
  Fbxo9
ctattgacgtggaat

SEQ ID NO: 36371 - DNA, 15 bp, Artificial Sequence
  dgRNA
  Fbxo9
gtggaatcggatgtt

SEQ ID NO: 36372 - DNA, 15 bp, Artificial Sequence
  dgRNA
  Fbxo9
gtaagaagtggcacc

SEQ ID NO: 36373 - DNA, 15 bp, Artificial Sequence
  dgRNA
  Cfap70
tgaaattaatcgtaa

SEQ ID NO: 36374 - DNA, 15 bp, Artificial Sequence
  dgRNA
  Cfap70
aacacccaaggggcg

SEQ ID NO: 36375 - DNA, 15 bp, Artificial Sequence
  dgRNA
  Cfap70
ctcgcgagagctagc

SEQ ID NO: 36376 - DNA, 15 bp, Artificial Sequence
  dgRNA
  Cfap70
ctcctttgcaagttt

SEQ ID NO: 36377 - DNA, 15 bp, Artificial Sequence
  dgRNA
  Tacc3
actccctgcgcaaga

SEQ ID NO: 36378 - DNA, 15 bp, Artificial Sequence
  dgRNA
  Tacc3
ctccctgcgcaagaa

SEQ ID NO: 36379 - DNA, 15 bp, Artificial Sequence
  dgRNA
  Tacc3
cctgcgcaagaaggg

SEQ ID NO: 36380 - DNA, 15 bp, Artificial Sequence
  dgRNA
  Tacc3
ctgcgcaagaagggc

SEQ ID NO: 36381 - DNA, 15 bp, Artificial Sequence
  dgRNA
  Nkx2-1
aacgcttaaattcca

SEQ ID NO: 36382 - DNA, 15 bp, Artificial Sequence
  dgRNA
  Nkx2-1
aaatctgtgccatgc

SEQ ID NO: 36383 - DNA, 15 bp, Artificial Sequence
  dgRNA
  Nkx2-1
gcttcctggcccggc

SEQ ID NO: 36384 - DNA, 15 bp, Artificial Sequence
  dgRNA
  Nkx2-1
gggcggagtgcttcc

SEQ ID NO: 36385 - DNA, 15 bp, Artificial Sequence
  dgRNA
  Hspa12b
taggggactagactc

SEQ ID NO: 36386 - DNA, 15 bp, Artificial Sequence
  dgRNA
  Hspa12b
aggggactagactct

SEQ ID NO: 36387 - DNA, 15 bp, Artificial Sequence
  dgRNA
  Hspa12b
caggggaggcaccgc

SEQ ID NO: 36388 - DNA, 15 bp, Artificial Sequence
  dgRNA
  Hspa12b
gcaccgctggcccgc

SEQ ID NO: 36389 - DNA, 15 bp, Artificial Sequence
  dgRNA
  Xpo5
ggccgtcacccgaag

SEQ ID NO: 36390 - DNA, 15 bp, Artificial Sequence
  dgRNA
  Xpo5
cgcgcgcatgcgccg

SEQ ID NO: 36391 - DNA, 15 bp, Artificial Sequence
  dgRNA
  Xpo5
gcgcatgcgccgtgg

SEQ ID NO: 36392 - DNA, 15 bp, Artificial Sequence
  dgRNA
  Xpo5
gcgccgtggcggctc

SEQ ID NO: 36393 - DNA, 15 bp, Artificial Sequence
  dgRNA
  Cyp2d26
ctggataagcaccac

SEQ ID NO: 36394 - DNA, 15 bp, Artificial Sequence
  dgRNA
  Cyp2d26
gcttatccaggggag

SEQ ID NO: 36395 - DNA, 15 bp, Artificial Sequence
  dgRNA
  Cyp2d26
tgtggtgcttatcca

SEQ ID NO: 36396 - DNA, 15 bp, Artificial Sequence
  dgRNA
  Cyp2d26
ctgtggtgcttatcc

SEQ ID NO: 36397 - DNA, 15 bp, Artificial Sequence
  dgRNA
  Olfr644
ctctttctaggatag

SEQ ID NO: 36398 - DNA, 15 bp, Artificial Sequence
  dgRNA
  Mdk
gtaaaaccgaactcc

SEQ ID NO: 36399 - DNA, 15 bp, Artificial Sequence
  dgRNA
  Mdk
gtgcgcttctggctc

SEQ ID NO: 36400 - DNA, 15 bp, Artificial Sequence
  dgRNA
  Mdk
ttaccagtgcgcttc

SEQ ID NO: 36401 - DNA, 15 bp, Artificial Sequence
  dgRNA
  Prss50
aaattagctgaggcg

SEQ ID NO: 36402 - DNA, 15 bp, Artificial Sequence
  dgRNA
  Prss50
gctgaggcgaggcat

SEQ ID NO: 36403 - DNA, 15 bp, Artificial Sequence
  dgRNA
  Prss50
ctgaggcgaggcata

SEQ ID NO: 36404 - DNA, 15 bp, Artificial Sequence
  dgRNA
  Prss50
cttgcgcgcctttag

SEQ ID NO: 36405 - DNA, 15 bp, Artificial Sequence
  dgRNA
  Paxip1
gaggctccgcctcct

SEQ ID NO: 36406 - DNA, 15 bp, Artificial Sequence
  dgRNA
  Paxip1
ggcgcatgcgctgtc

SEQ ID NO: 36407 - DNA, 15 bp, Artificial Sequence
  dgRNA
  Paxip1
gcatgcgctgtcagg

SEQ ID NO: 36408 - DNA, 15 bp, Artificial Sequence
  dgRNA
  Paxip1
tgtcaggtggccgca

SEQ ID NO: 36409 - DNA, 15 bp, Artificial Sequence
  dgRNA
  Tub
ccttccggcagagag

SEQ ID NO: 36410 - DNA, 15 bp, Artificial Sequence
  dgRNA
  Tub
cttccggcagagagt

SEQ ID NO: 36411 - DNA, 15 bp, Artificial Sequence
  dgRNA
  Tub
agtgggcatcccgcg

SEQ ID NO: 36412 - DNA, 15 bp, Artificial Sequence
  dgRNA
  Tub
ctgcatccaccggcc

SEQ ID NO: 36413 - DNA, 15 bp, Artificial Sequence
  dgRNA
  Actn1
ggtggcgtgcgcgcc

SEQ ID NO: 36414 - DNA, 15 bp, Artificial Sequence
  dgRNA
  Actn1
ggcgtgcgcgcccgg

SEQ ID NO: 36415 - DNA, 15 bp, Artificial Sequence
  dgRNA
  Actn1
gcgtgcgcgcccgga

SEQ ID NO: 36416 - DNA, 15 bp, Artificial Sequence
  dgRNA
  Actn1
gtgcgcgcccggagg

SEQ ID NO: 36417 - DNA, 15 bp, Artificial Sequence
  dgRNA
  Fam46d
gtattagccagcatg

SEQ ID NO: 36418 - DNA, 15 bp, Artificial Sequence
  dgRNA
  Fam46d
attccaaaccatact

SEQ ID NO: 36419 - DNA, 15 bp, Artificial Sequence
  dgRNA
  Fam46d
accatactcggtgct

SEQ ID NO: 36420 - DNA, 15 bp, Artificial Sequence
  dgRNA
  Fam46d
taggtgcataatatt

SEQ ID NO: 36421 - DNA, 15 bp, Artificial Sequence
  dgRNA
  Inpp4b
gaggagaccgctccg

SEQ ID NO: 36422 - DNA, 15 bp, Artificial Sequence
  dgRNA
  Inpp4b
aggagaccgctccga

SEQ ID NO: 36423 - DNA, 15 bp, Artificial Sequence
  dgRNA
  Inpp4b
agtgagcctaagacg

SEQ ID NO: 36424 - DNA, 15 bp, Artificial Sequence
  dgRNA
  Inpp4b
gagcctaagacgagg

SEQ ID NO: 36425 - DNA, 15 bp, Artificial Sequence
  dgRNA
  Ip6k1
ccgaaacgattgcgc

SEQ ID NO: 36426 - DNA, 15 bp, Artificial Sequence
  dgRNA
  Ip6k1
acagtcacgtgcccc

SEQ ID NO: 36427 - DNA, 15 bp, Artificial Sequence
  dgRNA
  Ip6k1
ggcattctgcacgag

SEQ ID NO: 36428 - DNA, 15 bp, Artificial Sequence
  dgRNA
  Ip6k1
gcacgccctgactga

SEQ ID NO: 36429 - DNA, 15 bp, Artificial Sequence
  dgRNA
  4930578I06Rik
tacacggacatccaa

SEQ ID NO: 36430 - DNA, 15 bp, Artificial Sequence
  dgRNA
  4930578I06Rik
atgtcatggggtccc

SEQ ID NO: 36431 - DNA, 15 bp, Artificial Sequence
  dgRNA
  4930578I06Rik
ctttgttatgtcatg

SEQ ID NO: 36432 - DNA, 15 bp, Artificial Sequence
  dgRNA
  4930578I06Rik
gggttcccggaaccc

SEQ ID NO: 36433 - DNA, 15 bp, Artificial Sequence
  dgRNA
  Aoc1
aataagctaccagaa

SEQ ID NO: 36434 - DNA, 15 bp, Artificial Sequence
  dgRNA
  Aoc1
cgttttcctcaacca

SEQ ID NO: 36435 - DNA, 15 bp, Artificial Sequence
  dgRNA
  Aoc1
acgttttcctcaacc

SEQ ID NO: 36436 - DNA, 15 bp, Artificial Sequence
  dgRNA
  Lman1
tggcccccagtagcg

SEQ ID NO: 36437 - DNA, 15 bp, Artificial Sequence
  dgRNA
  Lman1
cccccagtagcgagg

SEQ ID NO: 36438 - DNA, 15 bp, Artificial Sequence
  dgRNA
  Lman1
agtagcgaggaggcc

SEQ ID NO: 36439 - DNA, 15 bp, Artificial Sequence
  dgRNA
  Lman1
gtagcgaggaggcca

SEQ ID NO: 36440 - DNA, 15 bp, Artificial Sequence
  dgRNA
  Msrb1
ctagaggcggaagta

SEQ ID NO: 36441 - DNA, 15 bp, Artificial Sequence
  dgRNA
  Msrb1
taaggacgtgatctc

SEQ ID NO: 36442 - DNA, 15 bp, Artificial Sequence
  dgRNA
  Msrb1
ggggtttagggccta

SEQ ID NO: 36443 - DNA, 15 bp, Artificial Sequence
  dgRNA
  Msrb1
gggtttagggcctat

SEQ ID NO: 36444 - DNA, 15 bp, Artificial Sequence
  dgRNA
  Ube2k
gaagccgcaccctcc

SEQ ID NO: 36445 - DNA, 15 bp, Artificial Sequence
  dgRNA
  Ube2k
gccccagccgccggc

SEQ ID NO: 36446 - DNA, 15 bp, Artificial Sequence
  dgRNA
  Ube2k
cagccgccggcaggg

SEQ ID NO: 36447 - DNA, 15 bp, Artificial Sequence
  dgRNA
  Ube2k
cagggcggagccacg

SEQ ID NO: 36448 - DNA, 15 bp, Artificial Sequence
  dgRNA
  Tex11
ccgcatccaagaacg

SEQ ID NO: 36449 - DNA, 15 bp, Artificial Sequence
  dgRNA
  Tex11
cgcatccaagaacga

SEQ ID NO: 36450 - DNA, 15 bp, Artificial Sequence
  dgRNA
  Tex11
gcatccaagaacgag

SEQ ID NO: 36451 - DNA, 15 bp, Artificial Sequence
  dgRNA
  Tex11
agaacgaggggccga

SEQ ID NO: 36452 - DNA, 15 bp, Artificial Sequence
  dgRNA
  Gm13762
aatgttcaaaacccc

SEQ ID NO: 36453 - DNA, 15 bp, Artificial Sequence
  dgRNA
  Gm13762
attatgaataccctg

SEQ ID NO: 36454 - DNA, 15 bp, Artificial Sequence
  dgRNA
  Gm13762
gattatgaataccct

SEQ ID NO: 36455 - DNA, 15 bp, Artificial Sequence
  dgRNA
  Gm13762
tgattatgaataccc

SEQ ID NO: 36456 - DNA, 15 bp, Artificial Sequence
  dgRNA
  Crk
cccatcctccgcggt

SEQ ID NO: 36457 - DNA, 15 bp, Artificial Sequence
  dgRNA
  Crk
ccatcctccgcggtt

SEQ ID NO: 36458 - DNA, 15 bp, Artificial Sequence
  dgRNA
  Crk
catcctccgcggttg

SEQ ID NO: 36459 - DNA, 15 bp, Artificial Sequence
  dgRNA
  Crk
tccgcggttggggtc

SEQ ID NO: 36460 - DNA, 15 bp, Artificial Sequence
  dgRNA
  Aktip
atttagggtctgcat

SEQ ID NO: 36461 - DNA, 15 bp, Artificial Sequence
  dgRNA
  Aktip
gggtctgcattggaa

SEQ ID NO: 36462 - DNA, 15 bp, Artificial Sequence
  dgRNA
  Aktip
ccagccctcttaagt

SEQ ID NO: 36463 - DNA, 15 bp, Artificial Sequence
  dgRNA
  Aktip
agccctcttaagttg

SEQ ID NO: 36464 - DNA, 15 bp, Artificial Sequence
  dgRNA
  Aip
tgaagtgccgataat

SEQ ID NO: 36465 - DNA, 15 bp, Artificial Sequence
  dgRNA
  Aip
gaagtgccgataata

SEQ ID NO: 36466 - DNA, 15 bp, Artificial Sequence
  dgRNA
  Aip
ccaactaagcacaac

SEQ ID NO: 36467 - DNA, 15 bp, Artificial Sequence
  dgRNA
  Aip
taagcacaactggca

SEQ ID NO: 36468 - DNA, 15 bp, Artificial Sequence
  dgRNA
  Apoc3
gcccagctacggcag

SEQ ID NO: 36469 - DNA, 15 bp, Artificial Sequence
  dgRNA
  Apoc3
tccgttgctccacag

SEQ ID NO: 36470 - DNA, 15 bp, Artificial Sequence
  dgRNA
  Apoc3
tgccgtagctgggca

SEQ ID NO: 36471 - DNA, 15 bp, Artificial Sequence
  dgRNA
  Apoc3
ctgccgtagctgggc

SEQ ID NO: 36472 - DNA, 15 bp, Artificial Sequence
  dgRNA
  Podxl
gcccgccgcgctcca

SEQ ID NO: 36473 - DNA, 15 bp, Artificial Sequence
  dgRNA
  Podxl
cgccgcgctccaggg

SEQ ID NO: 36474 - DNA, 15 bp, Artificial Sequence
  dgRNA
  Podxl
cctgcgcgcgcgcca

SEQ ID NO: 36475 - DNA, 15 bp, Artificial Sequence
  dgRNA
  Podxl
gcctgcgcgcgcgcc

SEQ ID NO: 36476 - DNA, 15 bp, Artificial Sequence
  dgRNA
  Fancb
cccctacagctcagc

SEQ ID NO: 36477 - DNA, 15 bp, Artificial Sequence
  dgRNA
  Fancb
gcttccagccctcgg

SEQ ID NO: 36478 - DNA, 15 bp, Artificial Sequence
  dgRNA
  Fancb
ccgcctgagttgttc

SEQ ID NO: 36479 - DNA, 15 bp, Artificial Sequence
  dgRNA
  Fancb
tgttcaggcaactat

SEQ ID NO: 36480 - DNA, 15 bp, Artificial Sequence
  dgRNA
  Pggt1b
tacgagttgcgagaa

SEQ ID NO: 36481 - DNA, 15 bp, Artificial Sequence
  dgRNA
  Pggt1b
gtccaaactagggag

SEQ ID NO: 36482 - DNA, 15 bp, Artificial Sequence
  dgRNA
  Pggt1b
cactgagggtttcgg

SEQ ID NO: 36483 - DNA, 15 bp, Artificial Sequence
  dgRNA
  Pggt1b
gtttcggtggtcgac

SEQ ID NO: 36484 - DNA, 15 bp, Artificial Sequence
  dgRNA
  Lrp11
tgaatgaggcctgat

SEQ ID NO: 36485 - DNA, 15 bp, Artificial Sequence
  dgRNA
  Lrp11
acacccacgctgctt

SEQ ID NO: 36486 - DNA, 15 bp, Artificial Sequence
  dgRNA
  Lrp11
cacccacgctgctta

SEQ ID NO: 36487 - DNA, 15 bp, Artificial Sequence
  dgRNA
  Lrp11
ggtgtgatcaagccg

SEQ ID NO: 36488 - DNA, 15 bp, Artificial Sequence
  dgRNA
  She
cgggggccccggcgc

SEQ ID NO: 36489 - DNA, 15 bp, Artificial Sequence
  dgRNA
  She
ccccggcgccggcga

SEQ ID NO: 36490 - DNA, 15 bp, Artificial Sequence
  dgRNA
  She
ggcgccggcgaggga

SEQ ID NO: 36491 - DNA, 15 bp, Artificial Sequence
  dgRNA
  She
gcgccggcgagggag

SEQ ID NO: 36492 - DNA, 15 bp, Artificial Sequence
  dgRNA
  Prss48
agtcccgcagccgct

SEQ ID NO: 36493 - DNA, 15 bp, Artificial Sequence
  dgRNA
  Prss48
aaatcccttgcagtc

SEQ ID NO: 36494 - DNA, 15 bp, Artificial Sequence
  dgRNA
  Prss48
cttgcagtccggccc

SEQ ID NO: 36495 - DNA, 15 bp, Artificial Sequence
  dgRNA
  Prss48
gtccggcccaggcga

SEQ ID NO: 36496 - DNA, 15 bp, Artificial Sequence
  dgRNA
  Srsf7
atcccggcgttccca

SEQ ID NO: 36497 - DNA, 15 bp, Artificial Sequence
  dgRNA
  Srsf7
ctccgccccgcctct

SEQ ID NO: 36498 - DNA, 15 bp, Artificial Sequence
  dgRNA
  Srsf7
atataagcgcgactc

SEQ ID NO: 36499 - DNA, 15 bp, Artificial Sequence
  dgRNA
  Srsf7
ttgcccataaacctg

SEQ ID NO: 36500 - DNA, 15 bp, Artificial Sequence
  dgRNA
  Ocel1
cggggctctcagggt

SEQ ID NO: 36501 - DNA, 15 bp, Artificial Sequence
  dgRNA
  Ocel1
tcggccgctagggcg

SEQ ID NO: 36502 - DNA, 15 bp, Artificial Sequence
  dgRNA
  Ocel1
ctcggccgctagggc

SEQ ID NO: 36503 - DNA, 15 bp, Artificial Sequence
  dgRNA
  Ocel1
gctcggccgctaggg

SEQ ID NO: 36504 - DNA, 15 bp, Artificial Sequence
  dgRNA
  Ppp1r27
gagtagtagccagga

SEQ ID NO: 36505 - DNA, 15 bp, Artificial Sequence
  dgRNA
  Ppp1r27
gccggacatagtgac

SEQ ID NO: 36506 - DNA, 15 bp, Artificial Sequence
  dgRNA
  Ppp1r27
gcaagcatgactgcg

SEQ ID NO: 36507 - DNA, 15 bp, Artificial Sequence
  dgRNA
  Ppp1r27
aagccctttataagc

SEQ ID NO: 36508 - DNA, 15 bp, Artificial Sequence
  dgRNA
  Cst9
ccactaaatatgatc

SEQ ID NO: 36509 - DNA, 15 bp, Artificial Sequence
  dgRNA
  Cst9
ttccttagggacgtt

SEQ ID NO: 36510 - DNA, 15 bp, Artificial Sequence
  dgRNA
  Cst9
cgtttggaagatgct

SEQ ID NO: 36511 - DNA, 15 bp, Artificial Sequence
  dgRNA
  Cst9
tgatcatatttagtg

SEQ ID NO: 36512 - DNA, 15 bp, Artificial Sequence
  dgRNA
  Epc2
gggaccgagcgcacc

SEQ ID NO: 36513 - DNA, 15 bp, Artificial Sequence
  dgRNA
  Epc2
ccgagcgtcccgccg

SEQ ID NO: 36514 - DNA, 15 bp, Artificial Sequence
  dgRNA
  Epc2
agcgtcccgccgagg

SEQ ID NO: 36515 - DNA, 15 bp, Artificial Sequence
  dgRNA
  Epc2
gcgtcccgccgagga

SEQ ID NO: 36516 - DNA, 15 bp, Artificial Sequence
  dgRNA
  Fam98b
ctattgttgcaaaca

SEQ ID NO: 36517 - DNA, 15 bp, Artificial Sequence
  dgRNA
  Fam98b
tacgttgcaccaagc

SEQ ID NO: 36518 - DNA, 15 bp, Artificial Sequence
  dgRNA
  Fam98b
acgttgcaccaagca

SEQ ID NO: 36519 - DNA, 15 bp, Artificial Sequence
  dgRNA
  Fam98b
cacggctacaagtcc

SEQ ID NO: 36520 - DNA, 15 bp, Artificial Sequence
  dgRNA
  Ms4a18
atcctattctagaca

SEQ ID NO: 36521 - DNA, 15 bp, Artificial Sequence
  dgRNA
  Ms4a18
gtcataaatactccg

SEQ ID NO: 36522 - DNA, 15 bp, Artificial Sequence
  dgRNA
  Ms4a18
gaccgtgtctagaat

SEQ ID NO: 36523 - DNA, 15 bp, Artificial Sequence
  dgRNA
  Isoc2a
tacagggcgcagccg

SEQ ID NO: 36524 - DNA, 15 bp, Artificial Sequence
  dgRNA
  Isoc2a
gaggcgcgagctgat

SEQ ID NO: 36525 - DNA, 15 bp, Artificial Sequence
  dgRNA
  Isoc2a
attggcctgctcggg

SEQ ID NO: 36526 - DNA, 15 bp, Artificial Sequence
  dgRNA
  Isoc2a
ttggcctgctcggga

SEQ ID NO: 36527 - DNA, 15 bp, Artificial Sequence
  dgRNA
  Fer1l4
ccaaccgtgacctcc

SEQ ID NO: 36528 - DNA, 15 bp, Artificial Sequence
  dgRNA
  Fer1l4
gattgctgaacctgc

SEQ ID NO: 36529 - DNA, 15 bp, Artificial Sequence
  dgRNA
  Fer1l4
agtcacgggcaacac

SEQ ID NO: 36530 - DNA, 15 bp, Artificial Sequence
  dgRNA
  Fer1l4
cacgggcaacactgg

SEQ ID NO: 36531 - DNA, 15 bp, Artificial Sequence
  dgRNA
  Cyp2s1
ggtcacaggcgcgcg

SEQ ID NO: 36532 - DNA, 15 bp, Artificial Sequence
  dgRNA
  Cyp2s1
caggcgcgcgaggtg

SEQ ID NO: 36533 - DNA, 15 bp, Artificial Sequence
  dgRNA
  Cyp2s1
aggtctcccgctccc

SEQ ID NO: 36534 - DNA, 15 bp, Artificial Sequence
  dgRNA
  Cyp2s1
tactatgccccacct

SEQ ID NO: 36535 - DNA, 15 bp, Artificial Sequence
  dgRNA
  Tnfsf18
acctcctacacccac

SEQ ID NO: 36536 - DNA, 15 bp, Artificial Sequence
  dgRNA
  Tnfsf18
cctcctacacccacg

SEQ ID NO: 36537 - DNA, 15 bp, Artificial Sequence
  dgRNA
  Tnfsf18
tgtcatcgtggcacc

SEQ ID NO: 36538 - DNA, 15 bp, Artificial Sequence
  dgRNA
  Tnfsf18
cactcgctgtcatcg

SEQ ID NO: 36539 - DNA, 15 bp, Artificial Sequence
  dgRNA
  Rchy1
ccaccccttacacca

SEQ ID NO: 36540 - DNA, 15 bp, Artificial Sequence
  dgRNA
  Rchy1
ccttacaccagggac

SEQ ID NO: 36541 - DNA, 15 bp, Artificial Sequence
  dgRNA
  Rchy1
cagggaccggaaatc

SEQ ID NO: 36542 - DNA, 15 bp, Artificial Sequence
  dgRNA
  Rchy1
tgcagatcacgtgat

SEQ ID NO: 36543 - DNA, 15 bp, Artificial Sequence
  dgRNA
  Zyg11b
gctggcgtttgagaa

SEQ ID NO: 36544 - DNA, 15 bp, Artificial Sequence
  dgRNA
  Zyg11b
gaatggagtctacgc

SEQ ID NO: 36545 - DNA, 15 bp, Artificial Sequence
  dgRNA
  Zyg11b
aatggagtctacgcc

SEQ ID NO: 36546 - DNA, 15 bp, Artificial Sequence
  dgRNA
  Zyg11b
gagtctacgccggga

SEQ ID NO: 36547 - DNA, 15 bp, Artificial Sequence
  dgRNA
  Adgrg3
ccactcatacagtgg

SEQ ID NO: 36548 - DNA, 15 bp, Artificial Sequence
  dgRNA
  Adgrg3
gatggcgccattcat

SEQ ID NO: 36549 - DNA, 15 bp, Artificial Sequence
  dgRNA
  Adgrg3
cgccattcattggtc

SEQ ID NO: 36550 - DNA, 15 bp, Artificial Sequence
  dgRNA
  Adgrg3
ccaccactgtatgag

SEQ ID NO: 36551 - DNA, 15 bp, Artificial Sequence
  dgRNA
  Pnp
aagcggttgctgggc

SEQ ID NO: 36552 - DNA, 15 bp, Artificial Sequence
  dgRNA
  Pnp
tcgggaatagggaag

SEQ ID NO: 36553 - DNA, 15 bp, Artificial Sequence
  dgRNA
  Pnp
ctgctttcgggaata

SEQ ID NO: 36554 - DNA, 15 bp, Artificial Sequence
  dgRNA
  Aaed1
ccttggtattcaaac

SEQ ID NO: 36555 - DNA, 15 bp, Artificial Sequence
  dgRNA
  Aaed1
ccgtagcgtcccttg

SEQ ID NO: 36556 - DNA, 15 bp, Artificial Sequence
  dgRNA
  Aaed1
tggccacgcctccga

SEQ ID NO: 36557 - DNA, 15 bp, Artificial Sequence
  dgRNA
  Aaed1
acgcctccgaagggt

SEQ ID NO: 36558 - DNA, 15 bp, Artificial Sequence
  dgRNA
  Tcf12
accaatgctaggatt

SEQ ID NO: 36559 - DNA, 15 bp, Artificial Sequence
  dgRNA
  Tcf12
gaacttatgcaaaat

SEQ ID NO: 36560 - DNA, 15 bp, Artificial Sequence
  dgRNA
  Cnga1
aggcagtattccttt

SEQ ID NO: 36561 - DNA, 15 bp, Artificial Sequence
  dgRNA
  Cnga1
ggcttactttcagac

SEQ ID NO: 36562 - DNA, 15 bp, Artificial Sequence
  dgRNA
  Cnga1
gacaggttaggcgac

SEQ ID NO: 36563 - DNA, 15 bp, Artificial Sequence
  dgRNA
  Cnga1
gaccggctttgagaa

SEQ ID NO: 36564 - DNA, 15 bp, Artificial Sequence
  dgRNA
  Eif4a2
aaccctattctgttc

SEQ ID NO: 36565 - DNA, 15 bp, Artificial Sequence
  dgRNA
  Eif4a2
tattctgttccggca

SEQ ID NO: 36566 - DNA, 15 bp, Artificial Sequence
  dgRNA
  Eif4a2
ttccggcacggaacg

SEQ ID NO: 36567 - DNA, 15 bp, Artificial Sequence
  dgRNA
  Eif4a2
cggcacggaacgcgg

SEQ ID NO: 36568 - DNA, 15 bp, Artificial Sequence
  dgRNA
  Mettl20
cagaattcgcagaca

SEQ ID NO: 36569 - DNA, 15 bp, Artificial Sequence
  dgRNA
  Mettl20
aattgcgcttcattc

SEQ ID NO: 36570 - DNA, 15 bp, Artificial Sequence
  dgRNA
  Mettl20
ttcattcaggtctat

SEQ ID NO: 36571 - DNA, 15 bp, Artificial Sequence
  dgRNA
  Mettl20
tcattcaggtctata

SEQ ID NO: 36572 - DNA, 15 bp, Artificial Sequence
  dgRNA
  Jmjd6
ggtgcccaaggagcg

SEQ ID NO: 36573 - DNA, 15 bp, Artificial Sequence
  dgRNA
  Jmjd6
gccggacactgtcca

SEQ ID NO: 36574 - DNA, 15 bp, Artificial Sequence
  dgRNA
  Jmjd6
gccggaggccgcagc

SEQ ID NO: 36575 - DNA, 15 bp, Artificial Sequence
  dgRNA
  Jmjd6
aggccgcagcgggcc

SEQ ID NO: 36576 - DNA, 15 bp, Artificial Sequence
  dgRNA
  Wbp1l
aaatcacctagcacg

SEQ ID NO: 36577 - DNA, 15 bp, Artificial Sequence
  dgRNA
  Wbp1l
aatcacctagcacga

SEQ ID NO: 36578 - DNA, 15 bp, Artificial Sequence
  dgRNA
  Wbp1l
cacctagcacgaggg

SEQ ID NO: 36579 - DNA, 15 bp, Artificial Sequence
  dgRNA
  Wbp1l
tagcacgagggtggc

SEQ ID NO: 36580 - DNA, 15 bp, Artificial Sequence
  dgRNA
  Usp18
gtatccaggagttac

SEQ ID NO: 36581 - DNA, 15 bp, Artificial Sequence
  dgRNA
  Usp18
tatccaggagttacc

SEQ ID NO: 36582 - DNA, 15 bp, Artificial Sequence
  dgRNA
  Usp18
aggagttaccgggcc

SEQ ID NO: 36583 - DNA, 15 bp, Artificial Sequence
  dgRNA
  Usp18
ttaccgggccaggtc

SEQ ID NO: 36584 - DNA, 15 bp, Artificial Sequence
  dgRNA
  Tyw5
caggccgaagccctc

SEQ ID NO: 36585 - DNA, 15 bp, Artificial Sequence
  dgRNA
  Tyw5
ccagccgccgccctc

SEQ ID NO: 36586 - DNA, 15 bp, Artificial Sequence
  dgRNA
  Tyw5
cagccgccgccctct

SEQ ID NO: 36587 - DNA, 15 bp, Artificial Sequence
  dgRNA
  Tyw5
agccgccgccctctg

SEQ ID NO: 36588 - DNA, 15 bp, Artificial Sequence
  dgRNA
  Rad51c
atccgaaacgtgact

SEQ ID NO: 36589 - DNA, 15 bp, Artificial Sequence
  dgRNA
  Rad51c
aggcctcgtgagtct

SEQ ID NO: 36590 - DNA, 15 bp, Artificial Sequence
  dgRNA
  Rad51c
ccggagacgcggaga

SEQ ID NO: 36591 - DNA, 15 bp, Artificial Sequence
  dgRNA
  Rad51c
aagaggccggagacg

SEQ ID NO: 36592 - DNA, 15 bp, Artificial Sequence
  dgRNA
  Cfap100
gtactccgcgcccgc

SEQ ID NO: 36593 - DNA, 15 bp, Artificial Sequence
  dgRNA
  Cfap100
ccgcccagtgtgccc

SEQ ID NO: 36594 - DNA, 15 bp, Artificial Sequence
  dgRNA
  Cfap100
gcccgggcccgcctc

SEQ ID NO: 36595 - DNA, 15 bp, Artificial Sequence
  dgRNA
  Cfap100
ccgggcccgcctccg

SEQ ID NO: 36596 - DNA, 15 bp, Artificial Sequence
  dgRNA
  Nubp1
ctcgccctgttttag

SEQ ID NO: 36597 - DNA, 15 bp, Artificial Sequence
  dgRNA
  Nubp1
tcgccctgttttagc

SEQ ID NO: 36598 - DNA, 15 bp, Artificial Sequence
  dgRNA
  Nubp1
tgttttagcgggaag

SEQ ID NO: 36599 - DNA, 15 bp, Artificial Sequence
  dgRNA
  Nubp1
gcgcgtgcgcagtcc

SEQ ID NO: 36600 - DNA, 15 bp, Artificial Sequence
  dgRNA
  Nuf2
gcaaagttccagtct

SEQ ID NO: 36601 - DNA, 15 bp, Artificial Sequence
  dgRNA
  Nuf2
ccggtaaacacatcc

SEQ ID NO: 36602 - DNA, 15 bp, Artificial Sequence
  dgRNA
  Nuf2
aactgctgcgcttcc

SEQ ID NO: 36603 - DNA, 15 bp, Artificial Sequence
  dgRNA
  Nuf2
cgcttcctggtctgg

SEQ ID NO: 36604 - DNA, 15 bp, Artificial Sequence
  dgRNA
  Vmn2r73
ttgtactttagtagt

SEQ ID NO: 36605 - DNA, 15 bp, Artificial Sequence
  dgRNA
  Vmn2r73
atattttgtgaaccc

SEQ ID NO: 36606 - DNA, 15 bp, Artificial Sequence
  dgRNA
  Arfgap1
gccctagaatcccgc

SEQ ID NO: 36607 - DNA, 15 bp, Artificial Sequence
  dgRNA
  Arfgap1
ggagatagcgcagcc

SEQ ID NO: 36608 - DNA, 15 bp, Artificial Sequence
  dgRNA
  Arfgap1
ctggcgctcagccga

SEQ ID NO: 36609 - DNA, 15 bp, Artificial Sequence
  dgRNA
  Arfgap1
aaggtttagacagac

SEQ ID NO: 36610 - DNA, 15 bp, Artificial Sequence
  dgRNA
  CAAA01000182.1
atggctggcagtatt

SEQ ID NO: 36611 - DNA, 15 bp, Artificial Sequence
  dgRNA
  CAAA01000182.1
catggctggcagtat

SEQ ID NO: 36612 - DNA, 15 bp, Artificial Sequence
  dgRNA
  CAAA01000182.1
gggaccatttctgca

SEQ ID NO: 36613 - DNA, 15 bp, Artificial Sequence
  dgRNA
  Ctnna1
ctgggggtcccggcc

SEQ ID NO: 36614 - DNA, 15 bp, Artificial Sequence
  dgRNA
  Ctnna1
cggcctggagttgcc

SEQ ID NO: 36615 - DNA, 15 bp, Artificial Sequence
  dgRNA
  Ctnna1
aggctaccttccggg

SEQ ID NO: 36616 - DNA, 15 bp, Artificial Sequence
  dgRNA
  Ctnna1
ggctaccttccgggt

SEQ ID NO: 36617 - DNA, 15 bp, Artificial Sequence
  dgRNA
  Cyp2w1
ggccccctgccacag

SEQ ID NO: 36618 - DNA, 15 bp, Artificial Sequence
  dgRNA
  Cyp2w1
tttaagcctcctgtt

SEQ ID NO: 36619 - DNA, 15 bp, Artificial Sequence
  dgRNA
  Cyp2w1
cattccacattctcg

SEQ ID NO: 36620 - DNA, 15 bp, Artificial Sequence
  dgRNA
  Cyp2w1
tccacattctcgggg

SEQ ID NO: 36621 - DNA, 15 bp, Artificial Sequence
  dgRNA
  Krt76
gccattttggcccag

SEQ ID NO: 36622 - DNA, 15 bp, Artificial Sequence
  dgRNA
  Krt76
cccgagatgactctc

SEQ ID NO: 36623 - DNA, 15 bp, Artificial Sequence
  dgRNA
  Krt76
caacaagttacttct

SEQ ID NO: 36624 - DNA, 15 bp, Artificial Sequence
  dgRNA
  Ccno
ctgaaggcgggtgag

SEQ ID NO: 36625 - DNA, 15 bp, Artificial Sequence
  dgRNA
  Ccno
cccctgcaaccagcg

SEQ ID NO: 36626 - DNA, 15 bp, Artificial Sequence
  dgRNA
  Ccno
ccctgcaaccagcgc

SEQ ID NO: 36627 - DNA, 15 bp, Artificial Sequence
  dgRNA
  Ccno
cctgcaaccagcgcg

SEQ ID NO: 36628 - DNA, 15 bp, Artificial Sequence
  dgRNA
  Setd1a
atgcggcccatcttc

SEQ ID NO: 36629 - DNA, 15 bp, Artificial Sequence
  dgRNA
  Setd1a
actcccgagcctcgc

SEQ ID NO: 36630 - DNA, 15 bp, Artificial Sequence
  dgRNA
  Setd1a
ctcccgagcctcgca

SEQ ID NO: 36631 - DNA, 15 bp, Artificial Sequence
  dgRNA
  Setd1a
agcctcgcagggcgc

SEQ ID NO: 36632 - DNA, 15 bp, Artificial Sequence
  dgRNA
  Arap1
agactcaaggatccg

SEQ ID NO: 36633 - DNA, 15 bp, Artificial Sequence
  dgRNA
  Arap1
gcaagctaaggataa

SEQ ID NO: 36634 - DNA, 15 bp, Artificial Sequence
  dgRNA
  Arap1
acaaacccggcggtc

SEQ ID NO: 36635 - DNA, 15 bp, Artificial Sequence
  dgRNA
  Arap1
cggtccggtctgcct

SEQ ID NO: 36636 - DNA, 15 bp, Artificial Sequence
  dgRNA
  Pkn1
ggcctctgaggctcg

SEQ ID NO: 36637 - DNA, 15 bp, Artificial Sequence
  dgRNA
  Pkn1
ggctcgcggtcgctt

SEQ ID NO: 36638 - DNA, 15 bp, Artificial Sequence
  dgRNA
  Pkn1
gtcccctacgctaca

SEQ ID NO: 36639 - DNA, 15 bp, Artificial Sequence
  dgRNA
  Pkn1
cccgctgcaagcccc

SEQ ID NO: 36640 - DNA, 15 bp, Artificial Sequence
  dgRNA
  Baz2b
taggtcatttattat

SEQ ID NO: 36641 - DNA, 15 bp, Artificial Sequence
  dgRNA
  Baz2b
tgacgtcaaccaaca

SEQ ID NO: 36642 - DNA, 15 bp, Artificial Sequence
  dgRNA
  Baz2b
ttcacttctaggcga

SEQ ID NO: 36643 - DNA, 15 bp, Artificial Sequence
  dgRNA
  Lpar2
gcacgtgagatgtgc

SEQ ID NO: 36644 - DNA, 15 bp, Artificial Sequence
  dgRNA
  Lpar2
cacgtgagatgtgcg

SEQ ID NO: 36645 - DNA, 15 bp, Artificial Sequence
  dgRNA
  Lpar2
acgtgagatgtgcgg

SEQ ID NO: 36646 - DNA, 15 bp, Artificial Sequence
  dgRNA
  Lpar2
cgtgagatgtgcggg

SEQ ID NO: 36647 - DNA, 15 bp, Artificial Sequence
  dgRNA
  Ikzf3
tgggtgcggaacccg

SEQ ID NO: 36648 - DNA, 15 bp, Artificial Sequence
  dgRNA
  Ikzf3
ggaacccgcggcact

SEQ ID NO: 36649 - DNA, 15 bp, Artificial Sequence
  dgRNA
  Ikzf3
gagcgtgctttaaag

SEQ ID NO: 36650 - DNA, 15 bp, Artificial Sequence
  dgRNA
  Ikzf3
tctaacctcgcgccc

SEQ ID NO: 36651 - DNA, 15 bp, Artificial Sequence
  dgRNA
  Cdh10
atgcatgtgccgctt

SEQ ID NO: 36652 - DNA, 15 bp, Artificial Sequence
  dgRNA
  Kctd19
agggtcagcgccccc

SEQ ID NO: 36653 - DNA, 15 bp, Artificial Sequence
  dgRNA
  Kctd19
gtcagcgcccccagg

SEQ ID NO: 36654 - DNA, 15 bp, Artificial Sequence
  dgRNA
  Kctd19
gcccccaggcggcgg

SEQ ID NO: 36655 - DNA, 15 bp, Artificial Sequence
  dgRNA
  Kctd19
gccgctcacctgccg

SEQ ID NO: 36656 - DNA, 15 bp, Artificial Sequence
  dgRNA
  Tbc1d10a
gcgggcccttggtga

SEQ ID NO: 36657 - DNA, 15 bp, Artificial Sequence
  dgRNA
  Tbc1d10a
cccgccccctcacgt

SEQ ID NO: 36658 - DNA, 15 bp, Artificial Sequence
  dgRNA
  Tbc1d10a
tcacgtcggtccact

SEQ ID NO: 36659 - DNA, 15 bp, Artificial Sequence
  dgRNA
  Tbc1d10a
ggtccacttggcgcc

SEQ ID NO: 36660 - DNA, 15 bp, Artificial Sequence
  dgRNA
  Nudcd2
gatgtcaacatctct

SEQ ID NO: 36661 - DNA, 15 bp, Artificial Sequence
  dgRNA
  Nudcd2
tcggtcgatttcacc

SEQ ID NO: 36662 - DNA, 15 bp, Artificial Sequence
  dgRNA
  Nudcd2
cggtcgatttcacca

SEQ ID NO: 36663 - DNA, 15 bp, Artificial Sequence
  dgRNA
  Nudcd2
tcggacacgccagtt

SEQ ID NO: 36664 - DNA, 15 bp, Artificial Sequence
  dgRNA
  Fam184a
gacgtcgccaagccg

SEQ ID NO: 36665 - DNA, 15 bp, Artificial Sequence
  dgRNA
  Fam184a
cgccaagccgaggca

SEQ ID NO: 36666 - DNA, 15 bp, Artificial Sequence
  dgRNA
  Fam184a
gggacgcggctgttg

SEQ ID NO: 36667 - DNA, 15 bp, Artificial Sequence
  dgRNA
  Fam184a
ggacgcggctgttgc

SEQ ID NO: 36668 - DNA, 15 bp, Artificial Sequence
  dgRNA
  Sf3b6
ctaaatcgcaggctc

SEQ ID NO: 36669 - DNA, 15 bp, Artificial Sequence
  dgRNA
  Sf3b6
taaatcgcaggctct

SEQ ID NO: 36670 - DNA, 15 bp, Artificial Sequence
  dgRNA
  Sf3b6
ttccggtccgcaatc

SEQ ID NO: 36671 - DNA, 15 bp, Artificial Sequence
  dgRNA
  Sf3b6
aatccggaagcgttc

SEQ ID NO: 36672 - DNA, 15 bp, Artificial Sequence
  dgRNA
  Gtf2ird1
gagggtggtgttgcg

SEQ ID NO: 36673 - DNA, 15 bp, Artificial Sequence
  dgRNA
  Gtf2ird1
agggtggtgttgcgc

SEQ ID NO: 36674 - DNA, 15 bp, Artificial Sequence
  dgRNA
  Gtf2ird1
gggtggtgttgcgcg

SEQ ID NO: 36675 - DNA, 15 bp, Artificial Sequence
  dgRNA
  Gtf2ird1
ggtgttgcgcggggc

SEQ ID NO: 36676 - DNA, 15 bp, Artificial Sequence
  dgRNA
  Mast4
gagctcccgcgggat

SEQ ID NO: 36677 - DNA, 15 bp, Artificial Sequence
  dgRNA
  Mast4
agctcccgcgggatc

SEQ ID NO: 36678 - DNA, 15 bp, Artificial Sequence
  dgRNA
  Mast4
tcccgcgggatcggg

SEQ ID NO: 36679 - DNA, 15 bp, Artificial Sequence
  dgRNA
  Mast4
cgggtggcccgctcc

SEQ ID NO: 36680 - DNA, 15 bp, Artificial Sequence
  dgRNA
  Fras1
ccccacgtgactctc

SEQ ID NO: 36681 - DNA, 15 bp, Artificial Sequence
  dgRNA
  Fras1
cgtgctttaaatgcg

SEQ ID NO: 36682 - DNA, 15 bp, Artificial Sequence
  dgRNA
  Fras1
atgcgaggatccact

SEQ ID NO: 36683 - DNA, 15 bp, Artificial Sequence
  dgRNA
  Fras1
tgcgaggatccactc

SEQ ID NO: 36684 - DNA, 15 bp, Artificial Sequence
  dgRNA
  Klhl13
tgagcagacctattc

SEQ ID NO: 36685 - DNA, 15 bp, Artificial Sequence
  dgRNA
  Ptprr
agttccatttaagga

SEQ ID NO: 36686 - DNA, 15 bp, Artificial Sequence
  dgRNA
  Ptprr
cagggaacacccgca

SEQ ID NO: 36687 - DNA, 15 bp, Artificial Sequence
  dgRNA
  Ptprr
acagggaacacccgc

SEQ ID NO: 36688 - DNA, 15 bp, Artificial Sequence
  dgRNA
  Ptprr
catgtagaaattgcc

SEQ ID NO: 36689 - DNA, 15 bp, Artificial Sequence
  dgRNA
  Polk
ccgggcccctcccgg

SEQ ID NO: 36690 - DNA, 15 bp, Artificial Sequence
  dgRNA
  Polk
gacgctccctacctc

SEQ ID NO: 36691 - DNA, 15 bp, Artificial Sequence
  dgRNA
  Polk
tacctccggccctcc

SEQ ID NO: 36692 - DNA, 15 bp, Artificial Sequence
  dgRNA
  Polk
acctccggccctccc

SEQ ID NO: 36693 - DNA, 15 bp, Artificial Sequence
  dgRNA
  Slc6a18
ggtctatattaagtg

SEQ ID NO: 36694 - DNA, 15 bp, Artificial Sequence
  dgRNA
  Slc6a18
ataggccagtagatg

SEQ ID NO: 36695 - DNA, 15 bp, Artificial Sequence
  dgRNA
  Slc6a18
taggccagtagatgc

SEQ ID NO: 36696 - DNA, 15 bp, Artificial Sequence
  dgRNA
  Slc6a18
tgcgggtgttgaaga

SEQ ID NO: 36697 - DNA, 15 bp, Artificial Sequence
  dgRNA
  Ncam1
aacgcagctcggcag

SEQ ID NO: 36698 - DNA, 15 bp, Artificial Sequence
  dgRNA
  Tmem160
gccgcacccttctgc

SEQ ID NO: 36699 - DNA, 15 bp, Artificial Sequence
  dgRNA
  Tmem160
ccgtacattgatctc

SEQ ID NO: 36700 - DNA, 15 bp, Artificial Sequence
  dgRNA
  Tmem160
cgtacattgatctct

SEQ ID NO: 36701 - DNA, 15 bp, Artificial Sequence
  dgRNA
  Tmem160
ctagttgcaaaactg

SEQ ID NO: 36702 - DNA, 15 bp, Artificial Sequence
  dgRNA
  Gdpd4
acttggtcctaaaat

SEQ ID NO: 36703 - DNA, 15 bp, Artificial Sequence
  dgRNA
  Gdpd4
cttggtcctaaaatt

SEQ ID NO: 36704 - DNA, 15 bp, Artificial Sequence
  dgRNA
  Gdpd4
ttggtcctaaaattg

SEQ ID NO: 36705 - DNA, 15 bp, Artificial Sequence
  dgRNA
  Gdpd4
tggtcctaaaattgg

SEQ ID NO: 36706 - DNA, 15 bp, Artificial Sequence
  dgRNA
  Kars
acgacaccactaaga

SEQ ID NO: 36707 - DNA, 15 bp, Artificial Sequence
  dgRNA
  Kars
agacggactctccgc

SEQ ID NO: 36708 - DNA, 15 bp, Artificial Sequence
  dgRNA
  Kars
cggactctccgccgg

SEQ ID NO: 36709 - DNA, 15 bp, Artificial Sequence
  dgRNA
  Kars
tgcgcagcgagagtc

SEQ ID NO: 36710 - DNA, 15 bp, Artificial Sequence
  dgRNA
  Rnf220
gagtttaaacctagc

SEQ ID NO: 36711 - DNA, 15 bp, Artificial Sequence
  dgRNA
  Phc1
acgagcttgaaaaga

SEQ ID NO: 36712 - DNA, 15 bp, Artificial Sequence
  dgRNA
  Phc1
cgtcactgtttcaaa

SEQ ID NO: 36713 - DNA, 15 bp, Artificial Sequence
  dgRNA
  Slc47a2
ctacacagtggcgtt

SEQ ID NO: 36714 - DNA, 15 bp, Artificial Sequence
  dgRNA
  Slc47a2
acagtggcgtttgga

SEQ ID NO: 36715 - DNA, 15 bp, Artificial Sequence
  dgRNA
  Slc47a2
cagtggcgtttggat

SEQ ID NO: 36716 - DNA, 15 bp, Artificial Sequence
  dgRNA
  Slc47a2
taagcacccaggccg

SEQ ID NO: 36717 - DNA, 15 bp, Artificial Sequence
  dgRNA
  Olfr250
gtcactctttgtggg

SEQ ID NO: 36718 - DNA, 15 bp, Artificial Sequence
  dgRNA
  Olfr250
ctcggtttaagatgc

SEQ ID NO: 36719 - DNA, 15 bp, Artificial Sequence
  dgRNA
  Olfr250
aaccagatgactttc

SEQ ID NO: 36720 - DNA, 15 bp, Artificial Sequence
  dgRNA
  Acsl6
cagaacgttgcgggg

SEQ ID NO: 36721 - DNA, 15 bp, Artificial Sequence
  dgRNA
  Acsl6
agaacgttgcggggc

SEQ ID NO: 36722 - DNA, 15 bp, Artificial Sequence
  dgRNA
  Acsl6
acgttgcggggcggg

SEQ ID NO: 36723 - DNA, 15 bp, Artificial Sequence
  dgRNA
  Acsl6
tcccccagtcgggct

SEQ ID NO: 36724 - DNA, 15 bp, Artificial Sequence
  dgRNA
  Bpifa3
aagttctattccaat

SEQ ID NO: 36725 - DNA, 15 bp, Artificial Sequence
  dgRNA
  Bpifa3
ctgtagcttatgccc

SEQ ID NO: 36726 - DNA, 15 bp, Artificial Sequence
  dgRNA
  Bpifa3
acccaacagtagctc

SEQ ID NO: 36727 - DNA, 15 bp, Artificial Sequence
  dgRNA
  Bpifa3
ctgggcataagctac

SEQ ID NO: 36728 - DNA, 15 bp, Artificial Sequence
  dgRNA
  Ascl3
tcatagctccatagt

SEQ ID NO: 36729 - DNA, 15 bp, Artificial Sequence
  dgRNA
  Ascl3
gaccacctataaatc

SEQ ID NO: 36730 - DNA, 15 bp, Artificial Sequence
  dgRNA
  Ascl3
ttcatccggtttata

SEQ ID NO: 36731 - DNA, 15 bp, Artificial Sequence
  dgRNA
  Ascl3
gtactcccattcatc

SEQ ID NO: 36732 - DNA, 15 bp, Artificial Sequence
  dgRNA
  Lrch2
catagccactggccc

SEQ ID NO: 36733 - DNA, 15 bp, Artificial Sequence
  dgRNA
  Lrch2
atagccactggcccg

SEQ ID NO: 36734 - DNA, 15 bp, Artificial Sequence
  dgRNA
  Lrch2
aaccccctccactcg

SEQ ID NO: 36735 - DNA, 15 bp, Artificial Sequence
  dgRNA
  Lrch2
ggctccgagtattgt

SEQ ID NO: 36736 - DNA, 15 bp, Artificial Sequence
  dgRNA
  Rhag
agcatttccattggg

SEQ ID NO: 36737 - DNA, 15 bp, Artificial Sequence
  dgRNA
  Rhag
aaacgctccacccaa

SEQ ID NO: 36738 - DNA, 15 bp, Artificial Sequence
  dgRNA
  4931408C20Rik
gcagcaagatttcaa

SEQ ID NO: 36739 - DNA, 15 bp, Artificial Sequence
  dgRNA
  4931408C20Rik
ggagtatggaaagcc

SEQ ID NO: 36740 - DNA, 15 bp, Artificial Sequence
  dgRNA
  4931408C20Rik
aagggagggttgcac

SEQ ID NO: 36741 - DNA, 15 bp, Artificial Sequence
  dgRNA
  4931408C20Rik
gggctataagcagaa

SEQ ID NO: 36742 - DNA, 15 bp, Artificial Sequence
  dgRNA
  Svopl
acaagggatccggtg

SEQ ID NO: 36743 - DNA, 15 bp, Artificial Sequence
  dgRNA
  Svopl
caagggatccggtga

SEQ ID NO: 36744 - DNA, 15 bp, Artificial Sequence
  dgRNA
  Svopl
cggtgagggctgttt

SEQ ID NO: 36745 - DNA, 15 bp, Artificial Sequence
  dgRNA
  Svopl
tgacctcagaacgcc

SEQ ID NO: 36746 - DNA, 15 bp, Artificial Sequence
  dgRNA
  Usp13
gggattacatccccg

SEQ ID NO: 36747 - DNA, 15 bp, Artificial Sequence
  dgRNA
  Usp13
ggattacatccccga

SEQ ID NO: 36748 - DNA, 15 bp, Artificial Sequence
  dgRNA
  Usp13
gattacatccccgag

SEQ ID NO: 36749 - DNA, 15 bp, Artificial Sequence
  dgRNA
  Usp13
atccccgaggggcca

SEQ ID NO: 36750 - DNA, 15 bp, Artificial Sequence
  dgRNA
  Tex29
gctcaccacgctttc

SEQ ID NO: 36751 - DNA, 15 bp, Artificial Sequence
  dgRNA
  Tex29
ttggattctaacttg

SEQ ID NO: 36752 - DNA, 15 bp, Artificial Sequence
  dgRNA
  Tex29
acagtaccttacaca

SEQ ID NO: 36753 - DNA, 15 bp, Artificial Sequence
  dgRNA
  Tex29
cagtaccttacacag

SEQ ID NO: 36754 - DNA, 15 bp, Artificial Sequence
  dgRNA
  Anxa9
tttgcaggttacctg

SEQ ID NO: 36755 - DNA, 15 bp, Artificial Sequence
  dgRNA
  Anxa9
tagcagctgtcatgc

SEQ ID NO: 36756 - DNA, 15 bp, Artificial Sequence
  dgRNA
  Anxa9
cagcaggtgtaatct

SEQ ID NO: 36757 - DNA, 15 bp, Artificial Sequence
  dgRNA
  Anxa9
tcagcaggtgtaatc

SEQ ID NO: 36758 - DNA, 15 bp, Artificial Sequence
  dgRNA
  1700056E22Rik
tagcccgggcccgct

SEQ ID NO: 36759 - DNA, 15 bp, Artificial Sequence
  dgRNA
  1700056E22Rik
gcccgcttggagcag

SEQ ID NO: 36760 - DNA, 15 bp, Artificial Sequence
  dgRNA
  1700056E22Rik
gtaaacctaggcagc

SEQ ID NO: 36761 - DNA, 15 bp, Artificial Sequence
  dgRNA
  1700056E22Rik
ctaggcagcaggacg

SEQ ID NO: 36762 - DNA, 15 bp, Artificial Sequence
  dgRNA
  Tcf12
ttagaccatgccaga

SEQ ID NO: 36763 - DNA, 15 bp, Artificial Sequence
  dgRNA
  Tcf12
tggtaaagtaactag

SEQ ID NO: 36764 - DNA, 15 bp, Artificial Sequence
  dgRNA
  Tcf12
tcataggggacaagg

SEQ ID NO: 36765 - DNA, 15 bp, Artificial Sequence
  dgRNA
  Tcf12
catgatcaagcaatc

SEQ ID NO: 36766 - DNA, 15 bp, Artificial Sequence
  dgRNA
  Flrt3
tgtaggcagcaactc

SEQ ID NO: 36767 - DNA, 15 bp, Artificial Sequence
  dgRNA
  Olfr920
aatcactctagttag

SEQ ID NO: 36768 - DNA, 15 bp, Artificial Sequence
  dgRNA
  Olfr920
gggttccacaacagt

SEQ ID NO: 36769 - DNA, 15 bp, Artificial Sequence
  dgRNA
  Olfr920
agagtgattataggc

SEQ ID NO: 36770 - DNA, 15 bp, Artificial Sequence
  dgRNA
  Olfr920
aactagagtgattat

SEQ ID NO: 36771 - DNA, 15 bp, Artificial Sequence
  dgRNA
  Dgkd
cgaaacaacccagca

SEQ ID NO: 36772 - DNA, 15 bp, Artificial Sequence
  dgRNA
  Dgkd
gcgcccactgcctat

SEQ ID NO: 36773 - DNA, 15 bp, Artificial Sequence
  dgRNA
  Dgkd
cgcccactgcctatg

SEQ ID NO: 36774 - DNA, 15 bp, Artificial Sequence
  dgRNA
  Dgkd
ctgcctatgggggcg

SEQ ID NO: 36775 - DNA, 15 bp, Artificial Sequence
  dgRNA
  Med19
cagtctctcaggcga

SEQ ID NO: 36776 - DNA, 15 bp, Artificial Sequence
  dgRNA
  Med19
acggaagtaagttgc

SEQ ID NO: 36777 - DNA, 15 bp, Artificial Sequence
  dgRNA
  Med19
taagttgccggaaga

SEQ ID NO: 36778 - DNA, 15 bp, Artificial Sequence
  dgRNA
  Med19
ttgccggaagatggt

SEQ ID NO: 36779 - DNA, 15 bp, Artificial Sequence
  dgRNA
  Tmem260
ttgtggcttactaca

SEQ ID NO: 36780 - DNA, 15 bp, Artificial Sequence
  dgRNA
  Tmem260
ggcttactacatggt

SEQ ID NO: 36781 - DNA, 15 bp, Artificial Sequence
  dgRNA
  Tmem260
tccaccccacgccac

SEQ ID NO: 36782 - DNA, 15 bp, Artificial Sequence
  dgRNA
  Tmem260
caccccacgccacag

SEQ ID NO: 36783 - DNA, 15 bp, Artificial Sequence
  dgRNA
  Tstd1
ggtcaacctttgagt

SEQ ID NO: 36784 - DNA, 15 bp, Artificial Sequence
  dgRNA
  Tstd1
gtcaacctttgagtg

SEQ ID NO: 36785 - DNA, 15 bp, Artificial Sequence
  dgRNA
  Tstd1
cattacccagagtcc

SEQ ID NO: 36786 - DNA, 15 bp, Artificial Sequence
  dgRNA
  Tstd1
tgcctgtgccaaacc

SEQ ID NO: 36787 - DNA, 15 bp, Artificial Sequence
  dgRNA
  Samd3
ggggttaaggcatcc

SEQ ID NO: 36788 - DNA, 15 bp, Artificial Sequence
  dgRNA
  Samd3
agacgtaagtaaacc

SEQ ID NO: 36789 - DNA, 15 bp, Artificial Sequence
  dgRNA
  Samd3
ggttgacatttacag

SEQ ID NO: 36790 - DNA, 15 bp, Artificial Sequence
  dgRNA
  Atp8a2
ctcacaggtccacgg

SEQ ID NO: 36791 - DNA, 15 bp, Artificial Sequence
  dgRNA
  Atp8a2
tcacaggtccacggc

SEQ ID NO: 36792 - DNA, 15 bp, Artificial Sequence
  dgRNA
  Atp8a2
cacaggtccacggcg

SEQ ID NO: 36793 - DNA, 15 bp, Artificial Sequence
  dgRNA
  Atp8a2
ggtccacggcggggc

SEQ ID NO: 36794 - DNA, 15 bp, Artificial Sequence
  dgRNA
  Vmn1r237
tgaataatgactacg

SEQ ID NO: 36795 - DNA, 15 bp, Artificial Sequence
  dgRNA
  Vmn1r237
ttaggcttatgcaga

SEQ ID NO: 36796 - DNA, 15 bp, Artificial Sequence
  dgRNA
  Hsd17b6
tgtataatatgcctc

SEQ ID NO: 36797 - DNA, 15 bp, Artificial Sequence
  dgRNA
  Hsd17b6
gtataatatgcctct

SEQ ID NO: 36798 - DNA, 15 bp, Artificial Sequence
  dgRNA
  Hsd17b6
aatatgcctctgggc

SEQ ID NO: 36799 - DNA, 15 bp, Artificial Sequence
  dgRNA
  Hsd17b6
tctgtaagggattag

SEQ ID NO: 36800 - DNA, 15 bp, Artificial Sequence
  dgRNA
  Sec14l5
tcccgggtcctggag

SEQ ID NO: 36801 - DNA, 15 bp, Artificial Sequence
  dgRNA
  Sec14l5
tggagcggtccaggc

SEQ ID NO: 36802 - DNA, 15 bp, Artificial Sequence
  dgRNA
  Sec14l5
tgtctgtcaccgctc

SEQ ID NO: 36803 - DNA, 15 bp, Artificial Sequence
  dgRNA
  Sec14l5
tgtaggattgacaag

SEQ ID NO: 36804 - DNA, 15 bp, Artificial Sequence
  dgRNA
  Phf6
ggtccgcgcgcgagc

SEQ ID NO: 36805 - DNA, 15 bp, Artificial Sequence
  dgRNA
  Phf6
ccgcgcgcgagcagg

SEQ ID NO: 36806 - DNA, 15 bp, Artificial Sequence
  dgRNA
  Phf6
cgcgcgagcaggagg

SEQ ID NO: 36807 - DNA, 15 bp, Artificial Sequence
  dgRNA
  Phf6
cgcgagcaggaggcg

SEQ ID NO: 36808 - DNA, 15 bp, Artificial Sequence
  dgRNA
  Tmem52
gagggacgcatacca

SEQ ID NO: 36809 - DNA, 15 bp, Artificial Sequence
  dgRNA
  Tmem52
ggacgcataccaagg

SEQ ID NO: 36810 - DNA, 15 bp, Artificial Sequence
  dgRNA
  Tmem52
gacgcataccaaggt

SEQ ID NO: 36811 - DNA, 15 bp, Artificial Sequence
  dgRNA
  Tmem52
aggtgggcgtgaccc

SEQ ID NO: 36812 - DNA, 15 bp, Artificial Sequence
  dgRNA
  Mrgprf
aggaatgcccagttc

SEQ ID NO: 36813 - DNA, 15 bp, Artificial Sequence
  dgRNA
  Gm13090
aagattcgagaaagg

SEQ ID NO: 36814 - DNA, 15 bp, Artificial Sequence
  dgRNA
  Gm13090
agtcctacctaacaa

SEQ ID NO: 36815 - DNA, 15 bp, Artificial Sequence
  dgRNA
  Gm13090
acaagccatcgccac

SEQ ID NO: 36816 - DNA, 15 bp, Artificial Sequence
  dgRNA
  Gm13090
gtgttaaactctata

SEQ ID NO: 36817 - DNA, 15 bp, Artificial Sequence
  dgRNA
  Kif5a
aaagtggggtgtaat

SEQ ID NO: 36818 - DNA, 15 bp, Artificial Sequence
  dgRNA
  Kif5a
cgggggtgtgtgttc

SEQ ID NO: 36819 - DNA, 15 bp, Artificial Sequence
  dgRNA
  Kif5a
tcccaggcaggcgac

SEQ ID NO: 36820 - DNA, 15 bp, Artificial Sequence
  dgRNA
  Kif5a
ggaaagagcacctac

SEQ ID NO: 36821 - DNA, 15 bp, Artificial Sequence
  dgRNA
  Gnl1
ccgcgctcgcacgtg

SEQ ID NO: 36822 - DNA, 15 bp, Artificial Sequence
  dgRNA
  Gnl1
gagtcctgttgccgc

SEQ ID NO: 36823 - DNA, 15 bp, Artificial Sequence
  dgRNA
  Gnl1
ccgcaggccagtcca

SEQ ID NO: 36824 - DNA, 15 bp, Artificial Sequence
  dgRNA
  Gnl1
cgcaggccagtccac

SEQ ID NO: 36825 - DNA, 15 bp, Artificial Sequence
  dgRNA
  Prrt2
gggtgccccaccagg

SEQ ID NO: 36826 - DNA, 15 bp, Artificial Sequence
  dgRNA
  Prrt2
aggtgcgcgtgagaa

SEQ ID NO: 36827 - DNA, 15 bp, Artificial Sequence
  dgRNA
  Prrt2
cgcgtgagaaaggac

SEQ ID NO: 36828 - DNA, 15 bp, Artificial Sequence
  dgRNA
  Prrt2
gcacgagtggtcccc

SEQ ID NO: 36829 - DNA, 15 bp, Artificial Sequence
  dgRNA
  Eif3h
tgggttgagcagtac

SEQ ID NO: 36830 - DNA, 15 bp, Artificial Sequence
  dgRNA
  Eif3h
tccgcgcgtgcgcag

SEQ ID NO: 36831 - DNA, 15 bp, Artificial Sequence
  dgRNA
  Eif3h
cccacaatctcaggg

SEQ ID NO: 36832 - DNA, 15 bp, Artificial Sequence
  dgRNA
  Eif3h
ggagaaacaccaccg

SEQ ID NO: 36833 - DNA, 15 bp, Artificial Sequence
  dgRNA
  Ikbke
cagcatagtactcag

SEQ ID NO: 36834 - DNA, 15 bp, Artificial Sequence
  dgRNA
  Ikbke
caggcgatggcccta

SEQ ID NO: 36835 - DNA, 15 bp, Artificial Sequence
  dgRNA
  Ikbke
ccctttaagagcgag

SEQ ID NO: 36836 - DNA, 15 bp, Artificial Sequence
  dgRNA
  Ikbke
cactgagtactatgc

SEQ ID NO: 36837 - DNA, 15 bp, Artificial Sequence
  dgRNA
  Exoc1
agagagacacgtgac

SEQ ID NO: 36838 - DNA, 15 bp, Artificial Sequence
  dgRNA
  Exoc1
acacgtgaccggata

SEQ ID NO: 36839 - DNA, 15 bp, Artificial Sequence
  dgRNA
  Exoc1
cacgtgaccggatac

SEQ ID NO: 36840 - DNA, 15 bp, Artificial Sequence
  dgRNA
  Exoc1
accggatacgggaag

SEQ ID NO: 36841 - DNA, 15 bp, Artificial Sequence
  dgRNA
  Mobp
attcctcgtgtactg

SEQ ID NO: 36842 - DNA, 15 bp, Artificial Sequence
  dgRNA
  Mobp
caaaggcccgcacaa

SEQ ID NO: 36843 - DNA, 15 bp, Artificial Sequence
  dgRNA
  Mobp
cacgaggaatatata

SEQ ID NO: 36844 - DNA, 15 bp, Artificial Sequence
  dgRNA
  Mobp
acacgaggaatatat

SEQ ID NO: 36845 - DNA, 15 bp, Artificial Sequence
  dgRNA
  Tssk1
aagttcaatcggccc

SEQ ID NO: 36846 - DNA, 15 bp, Artificial Sequence
  dgRNA
  Tssk1
gctacatttccccca

SEQ ID NO: 36847 - DNA, 15 bp, Artificial Sequence
  dgRNA
  Tssk1
actgtacacgaaaca

SEQ ID NO: 36848 - DNA, 15 bp, Artificial Sequence
  dgRNA
  Tssk1
gactgtacacgaaac

SEQ ID NO: 36849 - DNA, 15 bp, Artificial Sequence
  dgRNA
  Atg4c
gtagttacagttacg

SEQ ID NO: 36850 - DNA, 15 bp, Artificial Sequence
  dgRNA
  Atg4c
tagttacagttacga

SEQ ID NO: 36851 - DNA, 15 bp, Artificial Sequence
  dgRNA
  Atg4c
gctgtaaatctaact

SEQ ID NO: 36852 - DNA, 15 bp, Artificial Sequence
  dgRNA
  Atg4c
gcagcccgggagctt

SEQ ID NO: 36853 - DNA, 15 bp, Artificial Sequence
  dgRNA
  Olfr303
tacatacaatacacc

SEQ ID NO: 36854 - DNA, 15 bp, Artificial Sequence
  dgRNA
  Olfr303
tatccgtttctattg

SEQ ID NO: 36855 - DNA, 15 bp, Artificial Sequence
  dgRNA
  Olfr303
agtggcaatcagaac

SEQ ID NO: 36856 - DNA, 15 bp, Artificial Sequence
  dgRNA
  Asnsd1
tacataggatccact

SEQ ID NO: 36857 - DNA, 15 bp, Artificial Sequence
  dgRNA
  Asnsd1
acataggatccacta

SEQ ID NO: 36858 - DNA, 15 bp, Artificial Sequence
  dgRNA
  Asnsd1
cataggatccactag

SEQ ID NO: 36859 - DNA, 15 bp, Artificial Sequence
  dgRNA
  Asnsd1
ataggatccactagg

SEQ ID NO: 36860 - DNA, 15 bp, Artificial Sequence
  dgRNA
  Ccdc121
gttctgacacctgtc

SEQ ID NO: 36861 - DNA, 15 bp, Artificial Sequence
  dgRNA
  Ccdc121
aggctgagtgtcgct

SEQ ID NO: 36862 - DNA, 15 bp, Artificial Sequence
  dgRNA
  Ccdc121
cgccttgaccaccag

SEQ ID NO: 36863 - DNA, 15 bp, Artificial Sequence
  dgRNA
  Ccdc121
gtccaaaccagtgcc

SEQ ID NO: 36864 - DNA, 15 bp, Artificial Sequence
  dgRNA
  Olfr320
ccctagagctattca

SEQ ID NO: 36865 - DNA, 15 bp, Artificial Sequence
  dgRNA
  Olfr320
ggactgtcattgagt

SEQ ID NO: 36866 - DNA, 15 bp, Artificial Sequence
  dgRNA
  Sgpp1
acgattccggtttcg

SEQ ID NO: 36867 - DNA, 15 bp, Artificial Sequence
  dgRNA
  Sgpp1
attccggtttcgcgg

SEQ ID NO: 36868 - DNA, 15 bp, Artificial Sequence
  dgRNA
  Sgpp1
ggctaataaaagccg

SEQ ID NO: 36869 - DNA, 15 bp, Artificial Sequence
  dgRNA
  Sgpp1
gctaataaaagccgc

SEQ ID NO: 36870 - DNA, 15 bp, Artificial Sequence
  dgRNA
  Rnf185
tcccacgtcttcacg

SEQ ID NO: 36871 - DNA, 15 bp, Artificial Sequence
  dgRNA
  Rnf185
gtcttcacgcgggcg

SEQ ID NO: 36872 - DNA, 15 bp, Artificial Sequence
  dgRNA
  Rnf185
cgctaggaaacccta

SEQ ID NO: 36873 - DNA, 15 bp, Artificial Sequence
  dgRNA
  Rnf185
gcggaacttaccagc

SEQ ID NO: 36874 - DNA, 15 bp, Artificial Sequence
  dgRNA
  Vwc2l
gtccgcggaagcagc

SEQ ID NO: 36875 - DNA, 15 bp, Artificial Sequence
  dgRNA
  Vwc2l
tccgcggaagcagct

SEQ ID NO: 36876 - DNA, 15 bp, Artificial Sequence
  dgRNA
  Vwc2l
ccgcggaagcagctg

SEQ ID NO: 36877 - DNA, 15 bp, Artificial Sequence
  dgRNA
  Vwc2l
cgcggaagcagctgg

SEQ ID NO: 36878 - DNA, 15 bp, Artificial Sequence
  dgRNA
  Zc3h12c
cggctccgacccccg

SEQ ID NO: 36879 - DNA, 15 bp, Artificial Sequence
  dgRNA
  Zc3h12c
acccccgaggtcgag

SEQ ID NO: 36880 - DNA, 15 bp, Artificial Sequence
  dgRNA
  Zc3h12c
gccccgaacactgag

SEQ ID NO: 36881 - DNA, 15 bp, Artificial Sequence
  dgRNA
  Zc3h12c
ccccgaacactgagc

SEQ ID NO: 36882 - DNA, 15 bp, Artificial Sequence
  dgRNA
  Fgd6
ttccgacctgcttat

SEQ ID NO: 36883 - DNA, 15 bp, Artificial Sequence
  dgRNA
  Fgd6
ggtgagcgtgtaggc

SEQ ID NO: 36884 - DNA, 15 bp, Artificial Sequence
  dgRNA
  Fgd6
gagcgtgtaggctgg

SEQ ID NO: 36885 - DNA, 15 bp, Artificial Sequence
  dgRNA
  Fgd6
agcgtgtaggctgga

SEQ ID NO: 36886 - DNA, 15 bp, Artificial Sequence
  dgRNA
  Cts3
aagagttgttggccc

SEQ ID NO: 36887 - DNA, 15 bp, Artificial Sequence
  dgRNA
  Cts3
tggtacttgtcccaa

SEQ ID NO: 36888 - DNA, 15 bp, Artificial Sequence
  dgRNA
  Cts3
atgtgattaggcttc

SEQ ID NO: 36889 - DNA, 15 bp, Artificial Sequence
  dgRNA
  Cts3
tgcaatgatgtgatt

SEQ ID NO: 36890 - DNA, 15 bp, Artificial Sequence
  dgRNA
  Ptprb
aagactttgcggccc

SEQ ID NO: 36891 - DNA, 15 bp, Artificial Sequence
  dgRNA
  Ptprb
ctttgcggcccagga

SEQ ID NO: 36892 - DNA, 15 bp, Artificial Sequence
  dgRNA
  Ptprb
gaagggattcttggc

SEQ ID NO: 36893 - DNA, 15 bp, Artificial Sequence
  dgRNA
  Ptprb
ggcagcctcaggcgt

SEQ ID NO: 36894 - DNA, 15 bp, Artificial Sequence
  dgRNA
  Olfr45
ggctttccaatggtg

SEQ ID NO: 36895 - DNA, 15 bp, Artificial Sequence
  dgRNA
  Olfr45
tatgtaccacaccat

SEQ ID NO: 36896 - DNA, 15 bp, Artificial Sequence
  dgRNA
  Olfr45
tacctcttcaaaatc

SEQ ID NO: 36897 - DNA, 15 bp, Artificial Sequence
  dgRNA
  Hist1h3d
gcaaatctaccaata

SEQ ID NO: 36898 - DNA, 15 bp, Artificial Sequence
  dgRNA
  Hist1h3d
ccaataaggtcgctg

SEQ ID NO: 36899 - DNA, 15 bp, Artificial Sequence
  dgRNA
  Hist1h3d
cgtccaatcagaacg

SEQ ID NO: 36900 - DNA, 15 bp, Artificial Sequence
  dgRNA
  Hist1h3d
ccacagcgaccttat

SEQ ID NO: 36901 - DNA, 15 bp, Artificial Sequence
  dgRNA
  Uba1y
taaatgattcatgat

SEQ ID NO: 36902 - DNA, 15 bp, Artificial Sequence
  dgRNA
  Uba1y
gattcatgattggcg

SEQ ID NO: 36903 - DNA, 15 bp, Artificial Sequence
  dgRNA
  Uba1y
ccttccgcttccgac

SEQ ID NO: 36904 - DNA, 15 bp, Artificial Sequence
  dgRNA
  Uba1y
cttccgcttccgact

SEQ ID NO: 36905 - DNA, 15 bp, Artificial Sequence
  dgRNA
  Psme2
ctctcggatcctact

SEQ ID NO: 36906 - DNA, 15 bp, Artificial Sequence
  dgRNA
  Psme2
ctcagtctagcgtca

SEQ ID NO: 36907 - DNA, 15 bp, Artificial Sequence
  dgRNA
  Psme2
gtccagtacttcccc

SEQ ID NO: 36908 - DNA, 15 bp, Artificial Sequence
  dgRNA
  Psme2
agtacttcccctgga

SEQ ID NO: 36909 - DNA, 15 bp, Artificial Sequence
  dgRNA
  Fam117a
tggaccaatcatcct

SEQ ID NO: 36910 - DNA, 15 bp, Artificial Sequence
  dgRNA
  Fam117a
agaagagccccgcca

SEQ ID NO: 36911 - DNA, 15 bp, Artificial Sequence
  dgRNA
  Fam117a
agccccgccatggat

SEQ ID NO: 36912 - DNA, 15 bp, Artificial Sequence
  dgRNA
  Fam117a
gccatggattggttg

SEQ ID NO: 36913 - DNA, 15 bp, Artificial Sequence
  dgRNA
  Ttyh3
agactgccctggtat

SEQ ID NO: 36914 - DNA, 15 bp, Artificial Sequence
  dgRNA
  Ttyh3
accaatagcattgtg

SEQ ID NO: 36915 - DNA, 15 bp, Artificial Sequence
  dgRNA
  Ttyh3
ccaatagcattgtgt

SEQ ID NO: 36916 - DNA, 15 bp, Artificial Sequence
  dgRNA
  Ttyh3
gcggggccgaatgtc

SEQ ID NO: 36917 - DNA, 15 bp, Artificial Sequence
  dgRNA
  Slc26a8
gtatggagaactact

SEQ ID NO: 36918 - DNA, 15 bp, Artificial Sequence
  dgRNA
  Slc26a8
gaccgcatctcattt

SEQ ID NO: 36919 - DNA, 15 bp, Artificial Sequence
  dgRNA
  Slc26a8
tgcattcccacctag

SEQ ID NO: 36920 - DNA, 15 bp, Artificial Sequence
  dgRNA
  Slc26a8
tacctaaatgagatg

SEQ ID NO: 36921 - DNA, 15 bp, Artificial Sequence
  dgRNA
  Rab14
taacggcgacaattc

SEQ ID NO: 36922 - DNA, 15 bp, Artificial Sequence
  dgRNA
  Rab14
gcgcagtaactccgc

SEQ ID NO: 36923 - DNA, 15 bp, Artificial Sequence
  dgRNA
  Rab14
agtaactccgccggg

SEQ ID NO: 36924 - DNA, 15 bp, Artificial Sequence
  dgRNA
  Rab14
ctccgccgggaggcg

SEQ ID NO: 36925 - DNA, 15 bp, Artificial Sequence
  dgRNA
  Tbc1d5
ccgcggctcacccgc

SEQ ID NO: 36926 - DNA, 15 bp, Artificial Sequence
  dgRNA
  Tbc1d5
ccgctggctcgtccc

SEQ ID NO: 36927 - DNA, 15 bp, Artificial Sequence
  dgRNA
  Tbc1d5
ggctcgtcccaggcc

SEQ ID NO: 36928 - DNA, 15 bp, Artificial Sequence
  dgRNA
  Tbc1d5
gcgcgcgcctgcgca

SEQ ID NO: 36929 - DNA, 15 bp, Artificial Sequence
  dgRNA
  Ctxn3
ttgatatcccttaac

SEQ ID NO: 36930 - DNA, 15 bp, Artificial Sequence
  dgRNA
  Ctxn3
gtcagcaatcaatag

SEQ ID NO: 36931 - DNA, 15 bp, Artificial Sequence
  dgRNA
  Ctxn3
gaggagacgcagcat

SEQ ID NO: 36932 - DNA, 15 bp, Artificial Sequence
  dgRNA
  Ctxn3
gaatgcccgaatgcc

SEQ ID NO: 36933 - DNA, 15 bp, Artificial Sequence
  dgRNA
  Picalm
ccgaggctgaggcgc

SEQ ID NO: 36934 - DNA, 15 bp, Artificial Sequence
  dgRNA
  Picalm
ctgaggcgcgggacc

SEQ ID NO: 36935 - DNA, 15 bp, Artificial Sequence
  dgRNA
  Picalm
tgaggcgcgggaccc

SEQ ID NO: 36936 - DNA, 15 bp, Artificial Sequence
  dgRNA
  Picalm
cgcgggacccgggag

SEQ ID NO: 36937 - DNA, 15 bp, Artificial Sequence
  dgRNA
  Ncoa7
caacaccaggacaat

SEQ ID NO: 36938 - DNA, 15 bp, Artificial Sequence
  dgRNA
  Ncoa7
gttttattgtatggc

SEQ ID NO: 36939 - DNA, 15 bp, Artificial Sequence
  dgRNA
  Ncoa7
atggctgggtttcaa

SEQ ID NO: 36940 - DNA, 15 bp, Artificial Sequence
  dgRNA
  Ncoa7
ctctaaatcctaatt

SEQ ID NO: 36941 - DNA, 15 bp, Artificial Sequence
  dgRNA
  Spsb3
cttatatttgtccaa

SEQ ID NO: 36942 - DNA, 15 bp, Artificial Sequence
  dgRNA
  Spsb3
ttgaccgctctagcg

SEQ ID NO: 36943 - DNA, 15 bp, Artificial Sequence
  dgRNA
  Spsb3
tgaccgctctagcga

SEQ ID NO: 36944 - DNA, 15 bp, Artificial Sequence
  dgRNA
  Spsb3
catagagcccgcctt

SEQ ID NO: 36945 - DNA, 15 bp, Artificial Sequence
  dgRNA
  Dnajc16
aaacgctgacgctct

SEQ ID NO: 36946 - DNA, 15 bp, Artificial Sequence
  dgRNA
  Dnajc16
aggattctatgaata

SEQ ID NO: 36947 - DNA, 15 bp, Artificial Sequence
  dgRNA
  Dnajc16
gggtcaaagtgaact

SEQ ID NO: 36948 - DNA, 15 bp, Artificial Sequence
  dgRNA
  Dnajc16
acagttgctagatgt

SEQ ID NO: 36949 - DNA, 15 bp, Artificial Sequence
  dgRNA
  Angel1
gttgaaacgccagcc

SEQ ID NO: 36950 - DNA, 15 bp, Artificial Sequence
  dgRNA
  Angel1
ttgaaacgccagcct

SEQ ID NO: 36951 - DNA, 15 bp, Artificial Sequence
  dgRNA
  Angel1
cgccagcctggggcg

SEQ ID NO: 36952 - DNA, 15 bp, Artificial Sequence
  dgRNA
  Angel1
agcctaggcggctca

SEQ ID NO: 36953 - DNA, 15 bp, Artificial Sequence
  dgRNA
  Arf2
gaggcggcggatgat

SEQ ID NO: 36954 - DNA, 15 bp, Artificial Sequence
  dgRNA
  Arf2
cggcggatgattggt

SEQ ID NO: 36955 - DNA, 15 bp, Artificial Sequence
  dgRNA
  Arf2
gtcgccattttattg

SEQ ID NO: 36956 - DNA, 15 bp, Artificial Sequence
  dgRNA
  Arf2
ccgaattcctcacag

SEQ ID NO: 36957 - DNA, 15 bp, Artificial Sequence
  dgRNA
  Lrrc4
cgtggagaaagctta

SEQ ID NO: 36958 - DNA, 15 bp, Artificial Sequence
  dgRNA
  Lrrc4
ctttccttccgaggt

SEQ ID NO: 36959 - DNA, 15 bp, Artificial Sequence
  dgRNA
  Lrrc4
tccgaggtaggtgac

SEQ ID NO: 36960 - DNA, 15 bp, Artificial Sequence
  dgRNA
  Lrrc4
ccgaggtaggtgaca

SEQ ID NO: 36961 - DNA, 15 bp, Artificial Sequence
  dgRNA
  N6amt1
gagtacgcacgcgtc

SEQ ID NO: 36962 - DNA, 15 bp, Artificial Sequence
  dgRNA
  Olfr776
attggaaattcctac

SEQ ID NO: 36963 - DNA, 15 bp, Artificial Sequence
  dgRNA
  Syngr3
ctctaaaccccataa

SEQ ID NO: 36964 - DNA, 15 bp, Artificial Sequence
  dgRNA
  Syngr3
tccaactctgtcata

SEQ ID NO: 36965 - DNA, 15 bp, Artificial Sequence
  dgRNA
  Syngr3
caactctgtcatacg

SEQ ID NO: 36966 - DNA, 15 bp, Artificial Sequence
  dgRNA
  Syngr3
aactctgtcatacgg

SEQ ID NO: 36967 - DNA, 15 bp, Artificial Sequence
  dgRNA
  Arnt2
gtgtccctgatacct

SEQ ID NO: 36968 - DNA, 15 bp, Artificial Sequence
  dgRNA
  Arnt2
ctggggaccctacta

SEQ ID NO: 36969 - DNA, 15 bp, Artificial Sequence
  dgRNA
  Arnt2
gggaccctactaggg

SEQ ID NO: 36970 - DNA, 15 bp, Artificial Sequence
  dgRNA
  Arnt2
cctactagggcggat

SEQ ID NO: 36971 - DNA, 15 bp, Artificial Sequence
  dgRNA
  Synj2
tgcctcagcaccgct

SEQ ID NO: 36972 - DNA, 15 bp, Artificial Sequence
  dgRNA
  Synj2
gcctcagcaccgcta

SEQ ID NO: 36973 - DNA, 15 bp, Artificial Sequence
  dgRNA
  Synj2
ccccactccgtaccc

SEQ ID NO: 36974 - DNA, 15 bp, Artificial Sequence
  dgRNA
  Synj2
gagccagcgttctgt

SEQ ID NO: 36975 - DNA, 15 bp, Artificial Sequence
  dgRNA
  Hipk2
atccattatgcgtcc

SEQ ID NO: 36976 - DNA, 15 bp, Artificial Sequence
  dgRNA
  Hipk2
ggatacggtagagaa

SEQ ID NO: 36977 - DNA, 15 bp, Artificial Sequence
  dgRNA
  Hipk2
tggatacggtagaga

SEQ ID NO: 36978 - DNA, 15 bp, Artificial Sequence
  dgRNA
  Hipk2
gacgcataatggata

SEQ ID NO: 36979 - DNA, 15 bp, Artificial Sequence
  dgRNA
  1810046K07Rik
attggggatgcaaat

SEQ ID NO: 36980 - DNA, 15 bp, Artificial Sequence
  dgRNA
  1810046K07Rik
caacgagtttccatt

SEQ ID NO: 36981 - DNA, 15 bp, Artificial Sequence
  dgRNA
  1700019D03Rik
ggaacccaatgctgt

SEQ ID NO: 36982 - DNA, 15 bp, Artificial Sequence
  dgRNA
  1700019D03Rik
gaacccaatgctgtt

SEQ ID NO: 36983 - DNA, 15 bp, Artificial Sequence
  dgRNA
  1700019D03Rik
gcggtgccaacactg

SEQ ID NO: 36984 - DNA, 15 bp, Artificial Sequence
  dgRNA
  1700019D03Rik
cggtgccaacactga

SEQ ID NO: 36985 - DNA, 15 bp, Artificial Sequence
  dgRNA
  Csn2
ttaaagccccccact

SEQ ID NO: 36986 - DNA, 15 bp, Artificial Sequence
  dgRNA
  Csn2
agccccccactaggc

SEQ ID NO: 36987 - DNA, 15 bp, Artificial Sequence
  dgRNA
  Csn2
cccggtcctctcact

SEQ ID NO: 36988 - DNA, 15 bp, Artificial Sequence
  dgRNA
  Csn2
gtcctctcacttggc

SEQ ID NO: 36989 - DNA, 15 bp, Artificial Sequence
  dgRNA
  Alg8
cagctactatctgaa

SEQ ID NO: 36990 - DNA, 15 bp, Artificial Sequence
  dgRNA
  Alg8
actatctgaatggac

SEQ ID NO: 36991 - DNA, 15 bp, Artificial Sequence
  dgRNA
  Alg8
ctatctgaatggaca

SEQ ID NO: 36992 - DNA, 15 bp, Artificial Sequence
  dgRNA
  Alg8
gacaggggtcggagc

SEQ ID NO: 36993 - DNA, 15 bp, Artificial Sequence
  dgRNA
  Gstm4
gcttattacgctttc

SEQ ID NO: 36994 - DNA, 15 bp, Artificial Sequence
  dgRNA
  Gstm4
cgctttccggtctgt

SEQ ID NO: 36995 - DNA, 15 bp, Artificial Sequence
  dgRNA
  Gstm4
gctttccggtctgtt

SEQ ID NO: 36996 - DNA, 15 bp, Artificial Sequence
  dgRNA
  Gstm4
ccggtctgttggggg

SEQ ID NO: 36997 - DNA, 15 bp, Artificial Sequence
  dgRNA
  Serpina3j
gtatggactagagat

SEQ ID NO: 36998 - DNA, 15 bp, Artificial Sequence
  dgRNA
  Serpina3j
ctagagattggtgat

SEQ ID NO: 36999 - DNA, 15 bp, Artificial Sequence
  dgRNA
  Serpina3j
tatgccaatccagaa

SEQ ID NO: 37000 - DNA, 15 bp, Artificial Sequence
  dgRNA
  Serpina3j
cataaggctattagg

SEQ ID NO: 37001 - DNA, 15 bp, Artificial Sequence
  dgRNA
  A430005L14Rik
acatggcggccaaaa

SEQ ID NO: 37002 - DNA, 15 bp, Artificial Sequence
  dgRNA
  A430005L14Rik
catggcggccaaaac

SEQ ID NO: 37003 - DNA, 15 bp, Artificial Sequence
  dgRNA
  A430005L14Rik
ggcggccaaaacggg

SEQ ID NO: 37004 - DNA, 15 bp, Artificial Sequence
  dgRNA
  A430005L14Rik
gcggccaaaacgggc

SEQ ID NO: 37005 - DNA, 15 bp, Artificial Sequence
  dgRNA
  Gck
aaacctgatcccacg

SEQ ID NO: 37006 - DNA, 15 bp, Artificial Sequence
  dgRNA
  Gck
cgtggttctttgtcc

SEQ ID NO: 37007 - DNA, 15 bp, Artificial Sequence
  dgRNA
  Gck
cccgtggcagtaggc

SEQ ID NO: 37008 - DNA, 15 bp, Artificial Sequence
  dgRNA
  Gck
taggcagggtatttt

SEQ ID NO: 37009 - DNA, 15 bp, Artificial Sequence
  dgRNA
  Dad1
ggcgtcaacaaacgc

SEQ ID NO: 37010 - DNA, 15 bp, Artificial Sequence
  dgRNA
  Dad1
gcgtcaacaaacgca

SEQ ID NO: 37011 - DNA, 15 bp, Artificial Sequence
  dgRNA
  Dad1
tcaacaaacgcaggg

SEQ ID NO: 37012 - DNA, 15 bp, Artificial Sequence
  dgRNA
  Dad1
cgcagggcggaaata

SEQ ID NO: 37013 - DNA, 15 bp, Artificial Sequence
  dgRNA
  Tctex1d2
aagttaggtctggtt

SEQ ID NO: 37014 - DNA, 15 bp, Artificial Sequence
  dgRNA
  Tctex1d2
gtcctggtctcggtt

SEQ ID NO: 37015 - DNA, 15 bp, Artificial Sequence
  dgRNA
  Tctex1d2
ttcccagcgggctca

SEQ ID NO: 37016 - DNA, 15 bp, Artificial Sequence
  dgRNA
  Tctex1d2
ctccagccagtgcgc

SEQ ID NO: 37017 - DNA, 15 bp, Artificial Sequence
  dgRNA
  Ggcx
gtcctcatacccacc

SEQ ID NO: 37018 - DNA, 15 bp, Artificial Sequence
  dgRNA
  Ggcx
ccggtctctgagctc

SEQ ID NO: 37019 - DNA, 15 bp, Artificial Sequence
  dgRNA
  Ggcx
ctcagggctcggctc

SEQ ID NO: 37020 - DNA, 15 bp, Artificial Sequence
  dgRNA
  Ggcx
ctatgcttcagtgcg

SEQ ID NO: 37021 - DNA, 15 bp, Artificial Sequence
  dgRNA
  Defb15
acccactgaggcggg

SEQ ID NO: 37022 - DNA, 15 bp, Artificial Sequence
  dgRNA
  Defb15
cccactgaggcgggt

SEQ ID NO: 37023 - DNA, 15 bp, Artificial Sequence
  dgRNA
  Defb15
cgggtgggctccatg

SEQ ID NO: 37024 - DNA, 15 bp, Artificial Sequence
  dgRNA
  Defb15
acacttcactgatca

SEQ ID NO: 37025 - DNA, 15 bp, Artificial Sequence
  dgRNA
  Krtap24-1
ttcgttgtaatcacc

SEQ ID NO: 37026 - DNA, 15 bp, Artificial Sequence
  dgRNA
  Krtap24-1
tcgttgtaatcacca

SEQ ID NO: 37027 - DNA, 15 bp, Artificial Sequence
  dgRNA
  Krtap24-1
ggctgctcgtgtctc

SEQ ID NO: 37028 - DNA, 15 bp, Artificial Sequence
  dgRNA
  Krtap24-1
tgcattgtttagcta

SEQ ID NO: 37029 - DNA, 15 bp, Artificial Sequence
  dgRNA
  Wnt8b
ctgcgtttgtccgtc

SEQ ID NO: 37030 - DNA, 15 bp, Artificial Sequence
  dgRNA
  Wnt8b
tgcgtttgtccgtcc

SEQ ID NO: 37031 - DNA, 15 bp, Artificial Sequence
  dgRNA
  Wnt8b
gtttgtccgtccggg

SEQ ID NO: 37032 - DNA, 15 bp, Artificial Sequence
  dgRNA
  Wnt8b
cgtccgggaggaccc

SEQ ID NO: 37033 - DNA, 15 bp, Artificial Sequence
  dgRNA
  Gtf2h2
tattggtgaactgga

SEQ ID NO: 37034 - DNA, 15 bp, Artificial Sequence
  dgRNA
  Gtf2h2
aggcagttacgctct

SEQ ID NO: 37035 - DNA, 15 bp, Artificial Sequence
  dgRNA
  Gtf2h2
ggctccagcgcgctg

SEQ ID NO: 37036 - DNA, 15 bp, Artificial Sequence
  dgRNA
  Gtf2h2
gcggaagaattttgg

SEQ ID NO: 37037 - DNA, 15 bp, Artificial Sequence
  dgRNA
  4833439L19Rik
atcaaggagtgtggt

SEQ ID NO: 37038 - DNA, 15 bp, Artificial Sequence
  dgRNA
  4833439L19Rik
gcattgcctgaatca

SEQ ID NO: 37039 - DNA, 15 bp, Artificial Sequence
  dgRNA
  Tbl1xr1
cgggcgcaggccgct

SEQ ID NO: 37040 - DNA, 15 bp, Artificial Sequence
  dgRNA
  Tbl1xr1
cggccgtcgccgccg

SEQ ID NO: 37041 - DNA, 15 bp, Artificial Sequence
  dgRNA
  Tbl1xr1
tcgccgccgcgggcc

SEQ ID NO: 37042 - DNA, 15 bp, Artificial Sequence
  dgRNA
  Tbl1xr1
gtggggcgcgcccgg

SEQ ID NO: 37043 - DNA, 15 bp, Artificial Sequence
  dgRNA
  Snx8
gctagcactcagtct

SEQ ID NO: 37044 - DNA, 15 bp, Artificial Sequence
  dgRNA
  Snx8
tgctgaacgctgccc

SEQ ID NO: 37045 - DNA, 15 bp, Artificial Sequence
  dgRNA
  Snx8
acgctgccccggccg

SEQ ID NO: 37046 - DNA, 15 bp, Artificial Sequence
  dgRNA
  Snx8
ccgcggccacgtggt

SEQ ID NO: 37047 - DNA, 15 bp, Artificial Sequence
  dgRNA
  Synm
atggcccgatctgtc

SEQ ID NO: 37048 - DNA, 15 bp, Artificial Sequence
  dgRNA
  Synm
cccgatctgtccggc

SEQ ID NO: 37049 - DNA, 15 bp, Artificial Sequence
  dgRNA
  Synm
ccgatctgtccggca

SEQ ID NO: 37050 - DNA, 15 bp, Artificial Sequence
  dgRNA
  Synm
cgatctgtccggcag

SEQ ID NO: 37051 - DNA, 15 bp, Artificial Sequence
  dgRNA
  Kat5
gtcacgtgacagact

SEQ ID NO: 37052 - DNA, 15 bp, Artificial Sequence
  dgRNA
  Kat5
tccaatcgctgtgcg

SEQ ID NO: 37053 - DNA, 15 bp, Artificial Sequence
  dgRNA
  Kat5
tcgctgtgcgaggag

SEQ ID NO: 37054 - DNA, 15 bp, Artificial Sequence
  dgRNA
  Kat5
cgctgtgcgaggagc

SEQ ID NO: 37055 - DNA, 15 bp, Artificial Sequence
  dgRNA
  Ezh1
ctgacagcgccacct

SEQ ID NO: 37056 - DNA, 15 bp, Artificial Sequence
  dgRNA
  Ezh1
cgaagaccgcagccc

SEQ ID NO: 37057 - DNA, 15 bp, Artificial Sequence
  dgRNA
  Ezh1
tgcgcacgcgcacgg

SEQ ID NO: 37058 - DNA, 15 bp, Artificial Sequence
  dgRNA
  Ezh1
gcgcacgcgcacgga

SEQ ID NO: 37059 - DNA, 15 bp, Artificial Sequence
  dgRNA
  Gatc
gagccgtcccctttg

SEQ ID NO: 37060 - DNA, 15 bp, Artificial Sequence
  dgRNA
  Gatc
cagcggttgaagcac

SEQ ID NO: 37061 - DNA, 15 bp, Artificial Sequence
  dgRNA
  Gatc
ccccgacgctgttca

SEQ ID NO: 37062 - DNA, 15 bp, Artificial Sequence
  dgRNA
  Gatc
cgacgctgttcatgg

SEQ ID NO: 37063 - DNA, 15 bp, Artificial Sequence
  dgRNA
  Cidec
cttcttccccgtttc

SEQ ID NO: 37064 - DNA, 15 bp, Artificial Sequence
  dgRNA
  Cidec
ttcttccccgtttca

SEQ ID NO: 37065 - DNA, 15 bp, Artificial Sequence
  dgRNA
  Cidec
cgtttcagggccttc

SEQ ID NO: 37066 - DNA, 15 bp, Artificial Sequence
  dgRNA
  Cidec
gacttaaaatcccta

SEQ ID NO: 37067 - DNA, 15 bp, Artificial Sequence
  dgRNA
  Usp42
cgccccgccgccctt

SEQ ID NO: 37068 - DNA, 15 bp, Artificial Sequence
  dgRNA
  Usp42
gccgcccttgggcga

SEQ ID NO: 37069 - DNA, 15 bp, Artificial Sequence
  dgRNA
  Usp42
gcgcctcttgcgcga

SEQ ID NO: 37070 - DNA, 15 bp, Artificial Sequence
  dgRNA
  Usp42
ttgcgcgacggcccc

SEQ ID NO: 37071 - DNA, 15 bp, Artificial Sequence
  dgRNA
  Mbd2
gagcaggtggtcacg

SEQ ID NO: 37072 - DNA, 15 bp, Artificial Sequence
  dgRNA
  Mbd2
agcaggtggtcacgg

SEQ ID NO: 37073 - DNA, 15 bp, Artificial Sequence
  dgRNA
  Mbd2
tggtcacggggggcg

SEQ ID NO: 37074 - DNA, 15 bp, Artificial Sequence
  dgRNA
  Mbd2
gaggcggagacaata

SEQ ID NO: 37075 - DNA, 15 bp, Artificial Sequence
  dgRNA
  Cpa3
ggactgttcatcccc

SEQ ID NO: 37076 - DNA, 15 bp, Artificial Sequence
  dgRNA
  Cpa3
tcgagataaaagctg

SEQ ID NO: 37077 - DNA, 15 bp, Artificial Sequence
  dgRNA
  Cpa3
gtataaaacccgtat

SEQ ID NO: 37078 - DNA, 15 bp, Artificial Sequence
  dgRNA
  Cpa3
tataaaacccgtata

SEQ ID NO: 37079 - DNA, 15 bp, Artificial Sequence
  dgRNA
  Fam13b
ccctccgctcgctcc

SEQ ID NO: 37080 - DNA, 15 bp, Artificial Sequence
  dgRNA
  Fam13b
gctcgctcccggcac

SEQ ID NO: 37081 - DNA, 15 bp, Artificial Sequence
  dgRNA
  Fam13b
ctccgcacccacaag

SEQ ID NO: 37082 - DNA, 15 bp, Artificial Sequence
  dgRNA
  Fam13b
tccgcacccacaagt

SEQ ID NO: 37083 - DNA, 15 bp, Artificial Sequence
  dgRNA
  Serpina6
ataagcgccatggca

SEQ ID NO: 37084 - DNA, 15 bp, Artificial Sequence
  dgRNA
  Serpina6
cattgataagcgcca

SEQ ID NO: 37085 - DNA, 15 bp, Artificial Sequence
  dgRNA
  Serpina6
ttgcgtcagggttca

SEQ ID NO: 37086 - DNA, 15 bp, Artificial Sequence
  dgRNA
  Serpina6
gctagagttgcgtca

SEQ ID NO: 37087 - DNA, 15 bp, Artificial Sequence
  dgRNA
  Cst7
cccgtgtgtggtgaa

SEQ ID NO: 37088 - DNA, 15 bp, Artificial Sequence
  dgRNA
  Cst7
agggtgctgcgctcg

SEQ ID NO: 37089 - DNA, 15 bp, Artificial Sequence
  dgRNA
  Cst7
gggtgctgcgctcgt

SEQ ID NO: 37090 - DNA, 15 bp, Artificial Sequence
  dgRNA
  Cst7
attcaccacacacgg

SEQ ID NO: 37091 - DNA, 15 bp, Artificial Sequence
  dgRNA
  Dhrs7b
cccgagtattgtgat

SEQ ID NO: 37092 - DNA, 15 bp, Artificial Sequence
  dgRNA
  Dhrs7b
ccaatcacaatactc

SEQ ID NO: 37093 - DNA, 15 bp, Artificial Sequence
  dgRNA
  Dixdc1
aatagtatgtagaac

SEQ ID NO: 37094 - DNA, 15 bp, Artificial Sequence
  dgRNA
  Dixdc1
agcccacactattga

SEQ ID NO: 37095 - DNA, 15 bp, Artificial Sequence
  dgRNA
  Dixdc1
actattgaaggtcaa

SEQ ID NO: 37096 - DNA, 15 bp, Artificial Sequence
  dgRNA
  Dixdc1
acggcaagctcccat

SEQ ID NO: 37097 - DNA, 15 bp, Artificial Sequence
  dgRNA
  Tex33
tggatagcctgacct

SEQ ID NO: 37098 - DNA, 15 bp, Artificial Sequence
  dgRNA
  Tex33
ttggtggccgctcaa

SEQ ID NO: 37099 - DNA, 15 bp, Artificial Sequence
  dgRNA
  Tex33
ggcatagtgtcgcca

SEQ ID NO: 37100 - DNA, 15 bp, Artificial Sequence
  dgRNA
  Tex33
cttcaatgcacatct

SEQ ID NO: 37101 - DNA, 15 bp, Artificial Sequence
  dgRNA
  Olfr1123
ataggtcttattact

SEQ ID NO: 37102 - DNA, 15 bp, Artificial Sequence
  dgRNA
  Olfr1123
ggcaatgttaattgt

SEQ ID NO: 37103 - DNA, 15 bp, Artificial Sequence
  dgRNA
  Olfr1123
gtagatattgagtgg

SEQ ID NO: 37104 - DNA, 15 bp, Artificial Sequence
  dgRNA
  Nav2
tttccagtcccgggg

SEQ ID NO: 37105 - DNA, 15 bp, Artificial Sequence
  dgRNA
  Nav2
ccagtcccggggcgg

SEQ ID NO: 37106 - DNA, 15 bp, Artificial Sequence
  dgRNA
  Nav2
cggggggagagactc

SEQ ID NO: 37107 - DNA, 15 bp, Artificial Sequence
  dgRNA
  Nav2
actccggaccctgaa

SEQ ID NO: 37108 - DNA, 15 bp, Artificial Sequence
  dgRNA
  Kifc1
gccgcgctcggcgct

SEQ ID NO: 37109 - DNA, 15 bp, Artificial Sequence
  dgRNA
  Kifc1
ccgcgctcggcgctc

SEQ ID NO: 37110 - DNA, 15 bp, Artificial Sequence
  dgRNA
  Kifc1
cgctcggcgctcggg

SEQ ID NO: 37111 - DNA, 15 bp, Artificial Sequence
  dgRNA
  Kifc1
gctcggcgctcggga

SEQ ID NO: 37112 - DNA, 15 bp, Artificial Sequence
  dgRNA
  Naa16
acagtccagagatta

SEQ ID NO: 37113 - DNA, 15 bp, Artificial Sequence
  dgRNA
  Naa16
ggcgagtaaatgact

SEQ ID NO: 37114 - DNA, 15 bp, Artificial Sequence
  dgRNA
  Naa16
cgcttaagacgtgac

SEQ ID NO: 37115 - DNA, 15 bp, Artificial Sequence
  dgRNA
  Naa16
agccctgcaccgacc

SEQ ID NO: 37116 - DNA, 15 bp, Artificial Sequence
  dgRNA
  Tctex1d1
aagatagcctttact

SEQ ID NO: 37117 - DNA, 15 bp, Artificial Sequence
  dgRNA
  Omp
gctttaccagttagg

SEQ ID NO: 37118 - DNA, 15 bp, Artificial Sequence
  dgRNA
  Omp
aggcgggccttcagg

SEQ ID NO: 37119 - DNA, 15 bp, Artificial Sequence
  dgRNA
  Omp
tgatatcaactgctg

SEQ ID NO: 37120 - DNA, 15 bp, Artificial Sequence
  dgRNA
  Omp
caactgcctcctaac

SEQ ID NO: 37121 - DNA, 15 bp, Artificial Sequence
  dgRNA
  Mrpl36
catgggcaccggtct

SEQ ID NO: 37122 - DNA, 15 bp, Artificial Sequence
  dgRNA
  Mrpl36
tagagtgcaggattc

SEQ ID NO: 37123 - DNA, 15 bp, Artificial Sequence
  dgRNA
  Mrpl36
aagaccggtgcccat

SEQ ID NO: 37124 - DNA, 15 bp, Artificial Sequence
  dgRNA
  Mrpl36
caagaccggtgccca

SEQ ID NO: 37125 - DNA, 15 bp, Artificial Sequence
  dgRNA
  Sin3a
tctcccctcccagcg

SEQ ID NO: 37126 - DNA, 15 bp, Artificial Sequence
  dgRNA
  Sin3a
taaaccattgacgga

SEQ ID NO: 37127 - DNA, 15 bp, Artificial Sequence
  dgRNA
  Sin3a
aaaccattgacggat

SEQ ID NO: 37128 - DNA, 15 bp, Artificial Sequence
  dgRNA
  Sin3a
gggtaatatatcccg

SEQ ID NO: 37129 - DNA, 15 bp, Artificial Sequence
  dgRNA
  Hbb-bs
aatcaactactgaat

SEQ ID NO: 37130 - DNA, 15 bp, Artificial Sequence
  dgRNA
  Rtkn2
cccgcccaccagttg

SEQ ID NO: 37131 - DNA, 15 bp, Artificial Sequence
  dgRNA
  Rtkn2
tagccgacaaaaccc

SEQ ID NO: 37132 - DNA, 15 bp, Artificial Sequence
  dgRNA
  Rtkn2
ccgacaaaacccagg

SEQ ID NO: 37133 - DNA, 15 bp, Artificial Sequence
  dgRNA
  Rtkn2
ttgctcttcgtattt

SEQ ID NO: 37134 - DNA, 15 bp, Artificial Sequence
  dgRNA
  Cdkn2aipnl
ctgcagagtcccaat

SEQ ID NO: 37135 - DNA, 15 bp, Artificial Sequence
  dgRNA
  Cdkn2aipnl
agttgccacacacgc

SEQ ID NO: 37136 - DNA, 15 bp, Artificial Sequence
  dgRNA
  Cdkn2aipnl
gttgccacacacgct

SEQ ID NO: 37137 - DNA, 15 bp, Artificial Sequence
  dgRNA
  Cdkn2aipnl
cctccgtgccccgcg

SEQ ID NO: 37138 - DNA, 15 bp, Artificial Sequence
  dgRNA
  Btbd6
cgaagaaaagctagc

SEQ ID NO: 37139 - DNA, 15 bp, Artificial Sequence
  dgRNA
  Btbd6
tgagtctctaacgca

SEQ ID NO: 37140 - DNA, 15 bp, Artificial Sequence
  dgRNA
  Btbd6
gctagcttttcttcg

SEQ ID NO: 37141 - DNA, 15 bp, Artificial Sequence
  dgRNA
  Trim9
ctccaggaaggctcg

SEQ ID NO: 37142 - DNA, 15 bp, Artificial Sequence
  dgRNA
  Trim9
tccaggaaggctcgg

SEQ ID NO: 37143 - DNA, 15 bp, Artificial Sequence
  dgRNA
  Trim9
gctctacgccagcag

SEQ ID NO: 37144 - DNA, 15 bp, Artificial Sequence
  dgRNA
  Trim9
tacgccagcagcgga

SEQ ID NO: 37145 - DNA, 15 bp, Artificial Sequence
  dgRNA
  Fgfrl1
gcagaagcactgcga

SEQ ID NO: 37146 - DNA, 15 bp, Artificial Sequence
  dgRNA
  Fgfrl1
gttaagcagcgagcc

SEQ ID NO: 37147 - DNA, 15 bp, Artificial Sequence
  dgRNA
  Fgfrl1
tggcgggcacgtgtg

SEQ ID NO: 37148 - DNA, 15 bp, Artificial Sequence
  dgRNA
  Fgfrl1
ggcacgtgtgcggat

SEQ ID NO: 37149 - DNA, 15 bp, Artificial Sequence
  dgRNA
  Oplah
gatcgctctgggcga

SEQ ID NO: 37150 - DNA, 15 bp, Artificial Sequence
  dgRNA
  Oplah
cgctctgggcgaagg

SEQ ID NO: 37151 - DNA, 15 bp, Artificial Sequence
  dgRNA
  Oplah
tctgggcgaaggagg

SEQ ID NO: 37152 - DNA, 15 bp, Artificial Sequence
  dgRNA
  Oplah
cgcaattacgtaatc

SEQ ID NO: 37153 - DNA, 15 bp, Artificial Sequence
  dgRNA
  Slc25a17
gccccttgaccgatc

SEQ ID NO: 37154 - DNA, 15 bp, Artificial Sequence
  dgRNA
  Slc25a17
gaccaatcgatgttc

SEQ ID NO: 37155 - DNA, 15 bp, Artificial Sequence
  dgRNA
  Slc25a17
accaatcgatgttca

SEQ ID NO: 37156 - DNA, 15 bp, Artificial Sequence
  dgRNA
  Slc25a17
ccaatcgatgttcag

SEQ ID NO: 37157 - DNA, 15 bp, Artificial Sequence
  dgRNA
  Entpd2
gggcattccctatgc

SEQ ID NO: 37158 - DNA, 15 bp, Artificial Sequence
  dgRNA
  Entpd2
attccctatgctggg

SEQ ID NO: 37159 - DNA, 15 bp, Artificial Sequence
  dgRNA
  Entpd2
cgtgactgatagctg

SEQ ID NO: 37160 - DNA, 15 bp, Artificial Sequence
  dgRNA
  Entpd2
ccaagaacctgcgga

SEQ ID NO: 37161 - DNA, 15 bp, Artificial Sequence
  dgRNA
  Map6
gacttgaacctatca

SEQ ID NO: 37162 - DNA, 15 bp, Artificial Sequence
  dgRNA
  Map6
cgccctgacgacagc

SEQ ID NO: 37163 - DNA, 15 bp, Artificial Sequence
  dgRNA
  Map6
aactgggtccttgat

SEQ ID NO: 37164 - DNA, 15 bp, Artificial Sequence
  dgRNA
  Map6
cacctgctgtcgtca

SEQ ID NO: 37165 - DNA, 15 bp, Artificial Sequence
  dgRNA
  Ghitm
agcgtttgccagtgt

SEQ ID NO: 37166 - DNA, 15 bp, Artificial Sequence
  dgRNA
  Ghitm
tactcggacccagaa

SEQ ID NO: 37167 - DNA, 15 bp, Artificial Sequence
  dgRNA
  Ghitm
aaacttccattggtc

SEQ ID NO: 37168 - DNA, 15 bp, Artificial Sequence
  dgRNA
  Ghitm
gcactcgctgccaat

SEQ ID NO: 37169 - DNA, 15 bp, Artificial Sequence
  dgRNA
  Lrit1
gggttgatgctatag

SEQ ID NO: 37170 - DNA, 15 bp, Artificial Sequence
  dgRNA
  Lrit1
ggttgatgctataga

SEQ ID NO: 37171 - DNA, 15 bp, Artificial Sequence
  dgRNA
  Lrit1
aagactgggtgattc

SEQ ID NO: 37172 - DNA, 15 bp, Artificial Sequence
  dgRNA
  Lrit1
tatagcatcaacccc

SEQ ID NO: 37173 - DNA, 15 bp, Artificial Sequence
  dgRNA
  Vldlr
ggtccccgcgccgct

SEQ ID NO: 37174 - DNA, 15 bp, Artificial Sequence
  dgRNA
  Vldlr
tcggccgcgctcctg

SEQ ID NO: 37175 - DNA, 15 bp, Artificial Sequence
  dgRNA
  Vldlr
ctcctgcggccgccc

SEQ ID NO: 37176 - DNA, 15 bp, Artificial Sequence
  dgRNA
  Vldlr
ctgcggccgcccggg

SEQ ID NO: 37177 - DNA, 15 bp, Artificial Sequence
  dgRNA
  Klhl29
gccaagcgctgagcc

SEQ ID NO: 37178 - DNA, 15 bp, Artificial Sequence
  dgRNA
  Klhl29
agcgctgagccgggc

SEQ ID NO: 37179 - DNA, 15 bp, Artificial Sequence
  dgRNA
  Klhl29
gcgctgagccgggcc

SEQ ID NO: 37180 - DNA, 15 bp, Artificial Sequence
  dgRNA
  Klhl29
cgctgagccgggccg

SEQ ID NO: 37181 - DNA, 15 bp, Artificial Sequence
  dgRNA
  Cyth3
cccaaggtgatggtt

SEQ ID NO: 37182 - DNA, 15 bp, Artificial Sequence
  dgRNA
  Cyth3
gattaggtcatgaat

SEQ ID NO: 37183 - DNA, 15 bp, Artificial Sequence
  dgRNA
  Cyth3
atcttccaccccatg

SEQ ID NO: 37184 - DNA, 15 bp, Artificial Sequence
  dgRNA
  Cyth3
ctaaccatcaccttg

SEQ ID NO: 37185 - DNA, 15 bp, Artificial Sequence
  dgRNA
  Rbp7
gttgccaaggtaggg

SEQ ID NO: 37186 - DNA, 15 bp, Artificial Sequence
  dgRNA
  Rbp7
ggagccaggagtacg

SEQ ID NO: 37187 - DNA, 15 bp, Artificial Sequence
  dgRNA
  Rbp7
gagccaggagtacgt

SEQ ID NO: 37188 - DNA, 15 bp, Artificial Sequence
  dgRNA
  Rbp7
ccccattgacaatat

SEQ ID NO: 37189 - DNA, 15 bp, Artificial Sequence
  dgRNA
  Svs3a
tacccccattgcccc

SEQ ID NO: 37190 - DNA, 15 bp, Artificial Sequence
  dgRNA
  Rdh12
gaaaatagcgtgttg

SEQ ID NO: 37191 - DNA, 15 bp, Artificial Sequence
  dgRNA
  Rdh12
aatagcgtgttgagg

SEQ ID NO: 37192 - DNA, 15 bp, Artificial Sequence
  dgRNA
  Rdh12
ctcactgccaatata

SEQ ID NO: 37193 - DNA, 15 bp, Artificial Sequence
  dgRNA
  Rdh12
ggcttcaccttatat

SEQ ID NO: 37194 - DNA, 15 bp, Artificial Sequence
  dgRNA
  Pla2g12a
tcgtgtgccagccgt

SEQ ID NO: 37195 - DNA, 15 bp, Artificial Sequence
  dgRNA
  Pla2g12a
gtgccagccgttgga

SEQ ID NO: 37196 - DNA, 15 bp, Artificial Sequence
  dgRNA
  Pla2g12a
cagccgttggaaggt

SEQ ID NO: 37197 - DNA, 15 bp, Artificial Sequence
  dgRNA
  Pla2g12a
agccgttggaaggtg

SEQ ID NO: 37198 - DNA, 15 bp, Artificial Sequence
  dgRNA
  Dhrs7
tctattgcaacaccc

SEQ ID NO: 37199 - DNA, 15 bp, Artificial Sequence
  dgRNA
  Dhrs7
agtcttgcacgcagt

SEQ ID NO: 37200 - DNA, 15 bp, Artificial Sequence
  dgRNA
  Dhrs7
gtcttgcacgcagta

SEQ ID NO: 37201 - DNA, 15 bp, Artificial Sequence
  dgRNA
  Dhrs7
cgcgcagagacgccg

SEQ ID NO: 37202 - DNA, 15 bp, Artificial Sequence
  dgRNA
  Rp2
caccgggtcaggaaa

SEQ ID NO: 37203 - DNA, 15 bp, Artificial Sequence
  dgRNA
  Rp2
agcctagttcactag

SEQ ID NO: 37204 - DNA, 15 bp, Artificial Sequence
  dgRNA
  Rp2
gcctagttcactaga

SEQ ID NO: 37205 - DNA, 15 bp, Artificial Sequence
  dgRNA
  Rp2
cctagttcactagag

SEQ ID NO: 37206 - DNA, 15 bp, Artificial Sequence
  dgRNA
  Lama4
tatagatcagacatc

SEQ ID NO: 37207 - DNA, 15 bp, Artificial Sequence
  dgRNA
  Lama4
agacatccggcgcct

SEQ ID NO: 37208 - DNA, 15 bp, Artificial Sequence
  dgRNA
  Lama4
ttggctgcgtaaata

SEQ ID NO: 37209 - DNA, 15 bp, Artificial Sequence
  dgRNA
  Lama4
cgtaaataagggatg

SEQ ID NO: 37210 - DNA, 15 bp, Artificial Sequence
  dgRNA
  Cacng8
tgacctcttagtata

SEQ ID NO: 37211 - DNA, 15 bp, Artificial Sequence
  dgRNA
  Cacng8
gtatatggctagtga

SEQ ID NO: 37212 - DNA, 15 bp, Artificial Sequence
  dgRNA
  Cacng8
tcagtagaatttagc

SEQ ID NO: 37213 - DNA, 15 bp, Artificial Sequence
  dgRNA
  Cacng8
gcccccggccccctc

SEQ ID NO: 37214 - DNA, 15 bp, Artificial Sequence
  dgRNA
  Smim22
aggtggtgcggatcc

SEQ ID NO: 37215 - DNA, 15 bp, Artificial Sequence
  dgRNA
  Smim22
tgcggatcctggatc

SEQ ID NO: 37216 - DNA, 15 bp, Artificial Sequence
  dgRNA
  Smim22
cctggatccggaagc

SEQ ID NO: 37217 - DNA, 15 bp, Artificial Sequence
  dgRNA
  Map2k6
taaatcagagacgcg

SEQ ID NO: 37218 - DNA, 15 bp, Artificial Sequence
  dgRNA
  Map2k6
acgcgtggactctac

SEQ ID NO: 37219 - DNA, 15 bp, Artificial Sequence
  dgRNA
  Map2k6
actacactacccagc

SEQ ID NO: 37220 - DNA, 15 bp, Artificial Sequence
  dgRNA
  Map2k6
gcgcctttcgcagga

SEQ ID NO: 37221 - DNA, 15 bp, Artificial Sequence
  dgRNA
  Ccdc30
tccccattggtgagt

SEQ ID NO: 37222 - DNA, 15 bp, Artificial Sequence
  dgRNA
  Ccdc30
atctgtgaccgggag

SEQ ID NO: 37223 - DNA, 15 bp, Artificial Sequence
  dgRNA
  Ccdc30
agcccactcaccaat

SEQ ID NO: 37224 - DNA, 15 bp, Artificial Sequence
  dgRNA
  Ccdc30
tctcccggtcacaga

SEQ ID NO: 37225 - DNA, 15 bp, Artificial Sequence
  dgRNA
  Ptprs
gtcccacgtgctccc

SEQ ID NO: 37226 - DNA, 15 bp, Artificial Sequence
  dgRNA
  Ptprs
tcccacgtgctcccc

SEQ ID NO: 37227 - DNA, 15 bp, Artificial Sequence
  dgRNA
  Ptprs
ccccgggccttctac

SEQ ID NO: 37228 - DNA, 15 bp, Artificial Sequence
  dgRNA
  Ptprs
gcagcgcctcctcac

SEQ ID NO: 37229 - DNA, 15 bp, Artificial Sequence
  dgRNA
  Ctcf
gaaagttggcgcccg

SEQ ID NO: 37230 - DNA, 15 bp, Artificial Sequence
  dgRNA
  Ctcf
cgccctcgtcgccgc

SEQ ID NO: 37231 - DNA, 15 bp, Artificial Sequence
  dgRNA
  Ctcf
ctcgtcgccgccggc

SEQ ID NO: 37232 - DNA, 15 bp, Artificial Sequence
  dgRNA
  Ctcf
ccttatcagcacccg

SEQ ID NO: 37233 - DNA, 15 bp, Artificial Sequence
  dgRNA
  Arhgap39
cctcggagctcccga

SEQ ID NO: 37234 - DNA, 15 bp, Artificial Sequence
  dgRNA
  Arhgap39
ctcggagctcccgag

SEQ ID NO: 37235 - DNA, 15 bp, Artificial Sequence
  dgRNA
  Arhgap39
tcccgaggggctgcg

SEQ ID NO: 37236 - DNA, 15 bp, Artificial Sequence
  dgRNA
  Arhgap39
gctgcgcggtggcgc

SEQ ID NO: 37237 - DNA, 15 bp, Artificial Sequence
  dgRNA
  Ssbp3
gccgcgctcctgccg

SEQ ID NO: 37238 - DNA, 15 bp, Artificial Sequence
  dgRNA
  Ssbp3
cggggcagccacgtt

SEQ ID NO: 37239 - DNA, 15 bp, Artificial Sequence
  dgRNA
  Ssbp3
ctccaagtagaccag

SEQ ID NO: 37240 - DNA, 15 bp, Artificial Sequence
  dgRNA
  Ssbp3
caagtagaccagcgg

SEQ ID NO: 37241 - DNA, 15 bp, Artificial Sequence
  dgRNA
  Fance
tggacgctctcttac

SEQ ID NO: 37242 - DNA, 15 bp, Artificial Sequence
  dgRNA
  Fance
ggtctggttagttga

SEQ ID NO: 37243 - DNA, 15 bp, Artificial Sequence
  dgRNA
  Fance
tgatcacgtcccttc

SEQ ID NO: 37244 - DNA, 15 bp, Artificial Sequence
  dgRNA
  Fance
cccttcaggctctac

SEQ ID NO: 37245 - DNA, 15 bp, Artificial Sequence
  dgRNA
  Capn8
caaatagtgaacagc

SEQ ID NO: 37246 - DNA, 15 bp, Artificial Sequence
  dgRNA
  Capn8
gagttgcctgcacct

SEQ ID NO: 37247 - DNA, 15 bp, Artificial Sequence
  dgRNA
  Capn8
tgactcatgtccctt

SEQ ID NO: 37248 - DNA, 15 bp, Artificial Sequence
  dgRNA
  Capn8
aggtgcaaagtttac

SEQ ID NO: 37249 - DNA, 15 bp, Artificial Sequence
  dgRNA
  Csf2
aaagcagcccgcagg

SEQ ID NO: 37250 - DNA, 15 bp, Artificial Sequence
  dgRNA
  Csf2
aagcagcccgcaggt

SEQ ID NO: 37251 - DNA, 15 bp, Artificial Sequence
  dgRNA
  Csf2
catgtatagctgata

SEQ ID NO: 37252 - DNA, 15 bp, Artificial Sequence
  dgRNA
  Csf2
atgtatagctgataa

SEQ ID NO: 37253 - DNA, 15 bp, Artificial Sequence
  dgRNA
  Myo18a
gatagagagtgtcct

SEQ ID NO: 37254 - DNA, 15 bp, Artificial Sequence
  dgRNA
  Mtif3
gctttattccattag

SEQ ID NO: 37255 - DNA, 15 bp, Artificial Sequence
  dgRNA
  Mtif3
attagtggaatccgc

SEQ ID NO: 37256 - DNA, 15 bp, Artificial Sequence
  dgRNA
  Mtif3
tgcaccctcccttta

SEQ ID NO: 37257 - DNA, 15 bp, Artificial Sequence
  dgRNA
  Mtif3
aagttccgcctgcta

SEQ ID NO: 37258 - DNA, 15 bp, Artificial Sequence
  dgRNA
  Cntf
atactagactacatt

SEQ ID NO: 37259 - DNA, 15 bp, Artificial Sequence
  dgRNA
  Cntf
tagactacattaggc

SEQ ID NO: 37260 - DNA, 15 bp, Artificial Sequence
  dgRNA
  Cntf
agactacattaggca

SEQ ID NO: 37261 - DNA, 15 bp, Artificial Sequence
  dgRNA
  Cntf
gactacattaggcag

SEQ ID NO: 37262 - DNA, 15 bp, Artificial Sequence
  dgRNA
  Vmn2r22
tactcgcaggaactg

SEQ ID NO: 37263 - DNA, 15 bp, Artificial Sequence
  dgRNA
  Vmn2r22
gtttggtcctgatac

SEQ ID NO: 37264 - DNA, 15 bp, Artificial Sequence
  dgRNA
  Ptprc
taacttcctgcaaag

SEQ ID NO: 37265 - DNA, 15 bp, Artificial Sequence
  dgRNA
  Ptprc
taattatgctgttag

SEQ ID NO: 37266 - DNA, 15 bp, Artificial Sequence
  dgRNA
  Olfr160
tgcatctatcataac

SEQ ID NO: 37267 - DNA, 15 bp, Artificial Sequence
  dgRNA
  Olfr160
gcatctatcataact

SEQ ID NO: 37268 - DNA, 15 bp, Artificial Sequence
  dgRNA
  Olfr160
gttgcactttgctgt

SEQ ID NO: 37269 - DNA, 15 bp, Artificial Sequence
  dgRNA
  Hmgb4
acaccaaccactaag

SEQ ID NO: 37270 - DNA, 15 bp, Artificial Sequence
  dgRNA
  Hmgb4
caccaaccactaaga

SEQ ID NO: 37271 - DNA, 15 bp, Artificial Sequence
  dgRNA
  Hmgb4
gagtttggttggcat

SEQ ID NO: 37272 - DNA, 15 bp, Artificial Sequence
  dgRNA
  Hmgb4
gcattggtcagctcg

SEQ ID NO: 37273 - DNA, 15 bp, Artificial Sequence
  dgRNA
  Pin4
gcgctttctcgtctc

SEQ ID NO: 37274 - DNA, 15 bp, Artificial Sequence
  dgRNA
  Pin4
cgctttctcgtctct

SEQ ID NO: 37275 - DNA, 15 bp, Artificial Sequence
  dgRNA
  Pin4
tcccgcctccccgta

SEQ ID NO: 37276 - DNA, 15 bp, Artificial Sequence
  dgRNA
  Pin4
ctccccgtaaggctt

SEQ ID NO: 37277 - DNA, 15 bp, Artificial Sequence
  dgRNA
  Vmn1r177
ggtcacccctctagt

SEQ ID NO: 37278 - DNA, 15 bp, Artificial Sequence
  dgRNA
  Vmn1r177
ctgtgccaactagag

SEQ ID NO: 37279 - DNA, 15 bp, Artificial Sequence
  dgRNA
  Vmn1r177
tctgtgccaactaga

SEQ ID NO: 37280 - DNA, 15 bp, Artificial Sequence
  dgRNA
  Vmn1r177
ttctgtgccaactag

SEQ ID NO: 37281 - DNA, 15 bp, Artificial Sequence
  dgRNA
  Gpr65
ttttaagcgatgttt

SEQ ID NO: 37282 - DNA, 15 bp, Artificial Sequence
  dgRNA
  Gpr65
cttttaagcgatgtt

SEQ ID NO: 37283 - DNA, 15 bp, Artificial Sequence
  dgRNA
  Gpr65
tgtcataagccaatg

SEQ ID NO: 37284 - DNA, 15 bp, Artificial Sequence
  dgRNA
  Cinp
cgaactcacctcccg

SEQ ID NO: 37285 - DNA, 15 bp, Artificial Sequence
  dgRNA
  Cinp
ccgcggcagcccctc

SEQ ID NO: 37286 - DNA, 15 bp, Artificial Sequence
  dgRNA
  Cinp
tcagccccgccaacc

SEQ ID NO: 37287 - DNA, 15 bp, Artificial Sequence
  dgRNA
  Cinp
gccccgccaacccgg

SEQ ID NO: 37288 - DNA, 15 bp, Artificial Sequence
  dgRNA
  Sirt1
cgccagaggccgctg

SEQ ID NO: 37289 - DNA, 15 bp, Artificial Sequence
  dgRNA
  Sirt1
gccagaggccgctga

SEQ ID NO: 37290 - DNA, 15 bp, Artificial Sequence
  dgRNA
  Sirt1
ccagaggccgctgag

SEQ ID NO: 37291 - DNA, 15 bp, Artificial Sequence
  dgRNA
  Sirt1
gagccgagccgccct

SEQ ID NO: 37292 - DNA, 15 bp, Artificial Sequence
  dgRNA
  Armcx6
agaaaccgtaacttc

SEQ ID NO: 37293 - DNA, 15 bp, Artificial Sequence
  dgRNA
  Armcx6
agggccccaagtatt

SEQ ID NO: 37294 - DNA, 15 bp, Artificial Sequence
  dgRNA
  Armcx6
gggccccaagtattg

SEQ ID NO: 37295 - DNA, 15 bp, Artificial Sequence
  dgRNA
  Armcx6
ggccccaagtattgg

SEQ ID NO: 37296 - DNA, 15 bp, Artificial Sequence
  dgRNA
  Polr3e
caccgctgccaaggc

SEQ ID NO: 37297 - DNA, 15 bp, Artificial Sequence
  dgRNA
  Polr3e
agcgtctttcgctct

SEQ ID NO: 37298 - DNA, 15 bp, Artificial Sequence
  dgRNA
  Polr3e
cttctgcgagcgcag

SEQ ID NO: 37299 - DNA, 15 bp, Artificial Sequence
  dgRNA
  Polr3e
cgagcagctcgccga

SEQ ID NO: 37300 - DNA, 15 bp, Artificial Sequence
  dgRNA
  Glod4
cctccacctgtcccg

SEQ ID NO: 37301 - DNA, 15 bp, Artificial Sequence
  dgRNA
  Glod4
ctccacctgtcccga

SEQ ID NO: 37302 - DNA, 15 bp, Artificial Sequence
  dgRNA
  Glod4
ctacgccgcagcgcc

SEQ ID NO: 37303 - DNA, 15 bp, Artificial Sequence
  dgRNA
  Glod4
cagcgccgagcgttg

SEQ ID NO: 37304 - DNA, 15 bp, Artificial Sequence
  dgRNA
  Rdh1
tacctatgctcagat

SEQ ID NO: 37305 - DNA, 15 bp, Artificial Sequence
  dgRNA
  Rdh1
acctatgctcagatg

SEQ ID NO: 37306 - DNA, 15 bp, Artificial Sequence
  dgRNA
  Rdh1
ctcagatggggccat

SEQ ID NO: 37307 - DNA, 15 bp, Artificial Sequence
  dgRNA
  Rdh1
gggccttgacggatg

SEQ ID NO: 37308 - DNA, 15 bp, Artificial Sequence
  dgRNA
  Tfrc
actccaaagacacgg

SEQ ID NO: 37309 - DNA, 15 bp, Artificial Sequence
  dgRNA
  Tfrc
ctccaaagacacggc

SEQ ID NO: 37310 - DNA, 15 bp, Artificial Sequence
  dgRNA
  Tfrc
tccaaagacacggcg

SEQ ID NO: 37311 - DNA, 15 bp, Artificial Sequence
  dgRNA
  Tfrc
ccaaagacacggcgg

SEQ ID NO: 37312 - DNA, 15 bp, Artificial Sequence
  dgRNA
  Cd177
gcatccgaggaacgc

SEQ ID NO: 37313 - DNA, 15 bp, Artificial Sequence
  dgRNA
  Cd177
catccgaggaacgct

SEQ ID NO: 37314 - DNA, 15 bp, Artificial Sequence
  dgRNA
  Cd177
atccgaggaacgctg

SEQ ID NO: 37315 - DNA, 15 bp, Artificial Sequence
  dgRNA
  Cd177
acagtagattaaggg

SEQ ID NO: 37316 - DNA, 15 bp, Artificial Sequence
  dgRNA
  H2afv
tccgcgcaaggagag

SEQ ID NO: 37317 - DNA, 15 bp, Artificial Sequence
  dgRNA
  H2afv
gcgcaaggagagcgg

SEQ ID NO: 37318 - DNA, 15 bp, Artificial Sequence
  dgRNA
  H2afv
gagagtgtcaatgtt

SEQ ID NO: 37319 - DNA, 15 bp, Artificial Sequence
  dgRNA
  H2afv
tcaatgtttggtcgg

SEQ ID NO: 37320 - DNA, 15 bp, Artificial Sequence
  dgRNA
  Fgl2
cttgaatacaatgcg

SEQ ID NO: 37321 - DNA, 15 bp, Artificial Sequence
  dgRNA
  Fgl2
aatgcgtggcaccca

SEQ ID NO: 37322 - DNA, 15 bp, Artificial Sequence
  dgRNA
  Fgl2
cgtggcacccacggc

SEQ ID NO: 37323 - DNA, 15 bp, Artificial Sequence
  dgRNA
  Fgl2
atagttttgactgac

SEQ ID NO: 37324 - DNA, 15 bp, Artificial Sequence
  dgRNA
  Fbxw7
atctcgtcaaaaatg

SEQ ID NO: 37325 - DNA, 15 bp, Artificial Sequence
  dgRNA
  Fbxw7
tctcgtcaaaaatgt

SEQ ID NO: 37326 - DNA, 15 bp, Artificial Sequence
  dgRNA
  Fbxw7
cccttccaaactttc

SEQ ID NO: 37327 - DNA, 15 bp, Artificial Sequence
  dgRNA
  Fbxw7
acagagggcggacgt

SEQ ID NO: 37328 - DNA, 15 bp, Artificial Sequence
  dgRNA
  Vcan
gctacggagctcttc

SEQ ID NO: 37329 - DNA, 15 bp, Artificial Sequence
  dgRNA
  Vcan
cctcctcggctctga

SEQ ID NO: 37330 - DNA, 15 bp, Artificial Sequence
  dgRNA
  Vcan
tgatataatgacggt

SEQ ID NO: 37331 - DNA, 15 bp, Artificial Sequence
  dgRNA
  Vcan
cgcatttgaacttgc

SEQ ID NO: 37332 - DNA, 15 bp, Artificial Sequence
  dgRNA
  Borcs5
tgtaggacccatact

SEQ ID NO: 37333 - DNA, 15 bp, Artificial Sequence
  dgRNA
  Borcs5
tatgggtcctacatg

SEQ ID NO: 37334 - DNA, 15 bp, Artificial Sequence
  dgRNA
  Tmem14c
atccttgtatcaaac

SEQ ID NO: 37335 - DNA, 15 bp, Artificial Sequence
  dgRNA
  Tmem14c
ctcaccctcggagta

SEQ ID NO: 37336 - DNA, 15 bp, Artificial Sequence
  dgRNA
  Tmem14c
ccactactcccaagc

SEQ ID NO: 37337 - DNA, 15 bp, Artificial Sequence
  dgRNA
  Tmem14c
acccgaagaccgcct

SEQ ID NO: 37338 - DNA, 15 bp, Artificial Sequence
  dgRNA
  Rab36
cagatggtaggcgtg

SEQ ID NO: 37339 - DNA, 15 bp, Artificial Sequence
  dgRNA
  Rab36
taactccttctcggg

SEQ ID NO: 37340 - DNA, 15 bp, Artificial Sequence
  dgRNA
  Rab36
gccaaccgcacgctc

SEQ ID NO: 37341 - DNA, 15 bp, Artificial Sequence
  dgRNA
  Rab36
tgctcatctacgctt

SEQ ID NO: 37342 - DNA, 15 bp, Artificial Sequence
  dgRNA
  Kdm5b
aacatcccaggcgga

SEQ ID NO: 37343 - DNA, 15 bp, Artificial Sequence
  dgRNA
  Kdm5b
tgcccctcccggcta

SEQ ID NO: 37344 - DNA, 15 bp, Artificial Sequence
  dgRNA
  Kdm5b
gcccctcccggctag

SEQ ID NO: 37345 - DNA, 15 bp, Artificial Sequence
  dgRNA
  Kdm5b
cccctcccggctagg

SEQ ID NO: 37346 - DNA, 15 bp, Artificial Sequence
  dgRNA
  Rab1a
cagttcctggttcgc

SEQ ID NO: 37347 - DNA, 15 bp, Artificial Sequence
  dgRNA
  Rab1a
ttcctggttcgccgg

SEQ ID NO: 37348 - DNA, 15 bp, Artificial Sequence
  dgRNA
  Rab1a
cgccggcggccattt

SEQ ID NO: 37349 - DNA, 15 bp, Artificial Sequence
  dgRNA
  Rab1a
gccggcggccatttt

SEQ ID NO: 37350 - DNA, 15 bp, Artificial Sequence
  dgRNA
  Ikzf4
gatgcgcttggggag

SEQ ID NO: 37351 - DNA, 15 bp, Artificial Sequence
  dgRNA
  Ikzf4
ggatgcgcttgggga

SEQ ID NO: 37352 - DNA, 15 bp, Artificial Sequence
  dgRNA
  Ikzf4
tggatgcgcttgggg

SEQ ID NO: 37353 - DNA, 15 bp, Artificial Sequence
  dgRNA
  Ikzf4
gcgtggatgcgcttg

SEQ ID NO: 37354 - DNA, 15 bp, Artificial Sequence
  dgRNA
  Gpr149
gcttgatgtgaactg

SEQ ID NO: 37355 - DNA, 15 bp, Artificial Sequence
  dgRNA
  Cntrl
ggtgtgattggccct

SEQ ID NO: 37356 - DNA, 15 bp, Artificial Sequence
  dgRNA
  Cntrl
gtgtgattggccctc

SEQ ID NO: 37357 - DNA, 15 bp, Artificial Sequence
  dgRNA
  Cntrl
ttgatttaaagttgc

SEQ ID NO: 37358 - DNA, 15 bp, Artificial Sequence
  dgRNA
  Cntrl
ttaaagttgcaggcg

SEQ ID NO: 37359 - DNA, 15 bp, Artificial Sequence
  dgRNA
  Gpr182
aaccgagacttaagg

SEQ ID NO: 37360 - DNA, 15 bp, Artificial Sequence
  dgRNA
  Gpr182
tacggctactgagtc

SEQ ID NO: 37361 - DNA, 15 bp, Artificial Sequence
  dgRNA
  Gpr182
acggctactgagtct

SEQ ID NO: 37362 - DNA, 15 bp, Artificial Sequence
  dgRNA
  Gpr182
tcaatgctcgcagct

SEQ ID NO: 37363 - DNA, 15 bp, Artificial Sequence
  dgRNA
  Cables1
agaaccggtgtgtcc

SEQ ID NO: 37364 - DNA, 15 bp, Artificial Sequence
  dgRNA
  Cables1
gggtaacaccaaatt

SEQ ID NO: 37365 - DNA, 15 bp, Artificial Sequence
  dgRNA
  Cables1
accaaatttggttac

SEQ ID NO: 37366 - DNA, 15 bp, Artificial Sequence
  dgRNA
  Cables1
ccaaatttggttact

SEQ ID NO: 37367 - DNA, 15 bp, Artificial Sequence
  dgRNA
  Rnf144a
accccccaactgatc

SEQ ID NO: 37368 - DNA, 15 bp, Artificial Sequence
  dgRNA
  Rnf144a
ccccccaactgatct

SEQ ID NO: 37369 - DNA, 15 bp, Artificial Sequence
  dgRNA
  Rnf144a
tccctttggcattgc

SEQ ID NO: 37370 - DNA, 15 bp, Artificial Sequence
  dgRNA
  Rnf144a
tgggggctgctcgcc

SEQ ID NO: 37371 - DNA, 15 bp, Artificial Sequence
  dgRNA
  Krt33b
taaaggactcatgcg

SEQ ID NO: 37372 - DNA, 15 bp, Artificial Sequence
  dgRNA
  Krt33b
aggactcatgcgagg

SEQ ID NO: 37373 - DNA, 15 bp, Artificial Sequence
  dgRNA
  Krt33b
ggtaatatgagcaaa

SEQ ID NO: 37374 - DNA, 15 bp, Artificial Sequence
  dgRNA
  Krt33b
acacccaccactgac

SEQ ID NO: 37375 - DNA, 15 bp, Artificial Sequence
  dgRNA
  C1ql1
accttgaggcttccg

SEQ ID NO: 37376 - DNA, 15 bp, Artificial Sequence
  dgRNA
  C1ql1
ttccgcggcccaatt

SEQ ID NO: 37377 - DNA, 15 bp, Artificial Sequence
  dgRNA
  C1ql1
ccgagccccgcggag

SEQ ID NO: 37378 - DNA, 15 bp, Artificial Sequence
  dgRNA
  C1ql1
gccccgcggagcggg

SEQ ID NO: 37379 - DNA, 15 bp, Artificial Sequence
  dgRNA
  Ogt
agggagcccttaacc

SEQ ID NO: 37380 - DNA, 15 bp, Artificial Sequence
  dgRNA
  Ogt
cggagttgcctagac

SEQ ID NO: 37381 - DNA, 15 bp, Artificial Sequence
  dgRNA
  Ogt
ggagttgcctagaca

SEQ ID NO: 37382 - DNA, 15 bp, Artificial Sequence
  dgRNA
  Ogt
tcatgtttgtcgcaa

SEQ ID NO: 37383 - DNA, 15 bp, Artificial Sequence
  dgRNA
  Tmem60
cgcgcagagtcgcga

SEQ ID NO: 37384 - DNA, 15 bp, Artificial Sequence
  dgRNA
  Tmem60
ggctagtgccgccgc

SEQ ID NO: 37385 - DNA, 15 bp, Artificial Sequence
  dgRNA
  Tmem60
ctacagccccgccgc

SEQ ID NO: 37386 - DNA, 15 bp, Artificial Sequence
  dgRNA
  Tmem60
cagccccgccgccgg

SEQ ID NO: 37387 - DNA, 15 bp, Artificial Sequence
  dgRNA
  Odf2
gacggggcggtggac

SEQ ID NO: 37388 - DNA, 15 bp, Artificial Sequence
  dgRNA
  Odf2
ctcgtgacccagaag

SEQ ID NO: 37389 - DNA, 15 bp, Artificial Sequence
  dgRNA
  Odf2
tcgtgacccagaagt

SEQ ID NO: 37390 - DNA, 15 bp, Artificial Sequence
  dgRNA
  Odf2
cggagcgtccccgtg

SEQ ID NO: 37391 - DNA, 15 bp, Artificial Sequence
  dgRNA
  Hoxc11
tttggatcacgtgct

SEQ ID NO: 37392 - DNA, 15 bp, Artificial Sequence
  dgRNA
  Hoxc11
ttggatcacgtgctc

SEQ ID NO: 37393 - DNA, 15 bp, Artificial Sequence
  dgRNA
  Hoxc11
tggatcacgtgctcg

SEQ ID NO: 37394 - DNA, 15 bp, Artificial Sequence
  dgRNA
  Hoxc11
ggacgttcaggcgat

SEQ ID NO: 37395 - DNA, 15 bp, Artificial Sequence
  dgRNA
  Sarnp
ctgcgctctccctat

SEQ ID NO: 37396 - DNA, 15 bp, Artificial Sequence
  dgRNA
  Sarnp
cgctctccctattgg

SEQ ID NO: 37397 - DNA, 15 bp, Artificial Sequence
  dgRNA
  Sarnp
gctgtccccaatcat

SEQ ID NO: 37398 - DNA, 15 bp, Artificial Sequence
  dgRNA
  Sarnp
tccccaatcattggt

SEQ ID NO: 37399 - DNA, 15 bp, Artificial Sequence
  dgRNA
  Alkbh1
aatgaatcgaaaccc

SEQ ID NO: 37400 - DNA, 15 bp, Artificial Sequence
  dgRNA
  Alkbh1
ctggagtcgtgaccc

SEQ ID NO: 37401 - DNA, 15 bp, Artificial Sequence
  dgRNA
  Alkbh1
ttcgagttctgcttc

SEQ ID NO: 37402 - DNA, 15 bp, Artificial Sequence
  dgRNA
  Alkbh1
tcgagttctgcttcc

SEQ ID NO: 37403 - DNA, 15 bp, Artificial Sequence
  dgRNA
  Slfnl1
ttcgtgagatcacag

SEQ ID NO: 37404 - DNA, 15 bp, Artificial Sequence
  dgRNA
  Slfnl1
aacaaccatcatgtc

SEQ ID NO: 37405 - DNA, 15 bp, Artificial Sequence
  dgRNA
  Slfnl1
gccaacaatgccttc

SEQ ID NO: 37406 - DNA, 15 bp, Artificial Sequence
  dgRNA
  Slfnl1
tctgtgatctcacga

SEQ ID NO: 37407 - DNA, 15 bp, Artificial Sequence
  dgRNA
  Selo
gggagcttcggacct

SEQ ID NO: 37408 - DNA, 15 bp, Artificial Sequence
  dgRNA
  Selo
gcttcggacctcggc

SEQ ID NO: 37409 - DNA, 15 bp, Artificial Sequence
  dgRNA
  Selo
gtccaccctctgcga

SEQ ID NO: 37410 - DNA, 15 bp, Artificial Sequence
  dgRNA
  Selo
cgacggctcgtagcc

SEQ ID NO: 37411 - DNA, 15 bp, Artificial Sequence
  dgRNA
  Hrk
cctgccggcgtctcg

SEQ ID NO: 37412 - DNA, 15 bp, Artificial Sequence
  dgRNA
  Hrk
ctgccggcgtctcga

SEQ ID NO: 37413 - DNA, 15 bp, Artificial Sequence
  dgRNA
  Hrk
agcacaacaaacgcg

SEQ ID NO: 37414 - DNA, 15 bp, Artificial Sequence
  dgRNA
  Hrk
acaaacgcgcggtga

SEQ ID NO: 37415 - DNA, 15 bp, Artificial Sequence
  dgRNA
  Mdp1
ttgtggcccgcgcct

SEQ ID NO: 37416 - DNA, 15 bp, Artificial Sequence
  dgRNA
  Mdp1
tggcccgcgccttgg

SEQ ID NO: 37417 - DNA, 15 bp, Artificial Sequence
  dgRNA
  Mdp1
ggcccgcgccttgga

SEQ ID NO: 37418 - DNA, 15 bp, Artificial Sequence
  dgRNA
  Mdp1
ccgcgccttggaggg

SEQ ID NO: 37419 - DNA, 15 bp, Artificial Sequence
  dgRNA
  Pole
cgccctcagcgagcc

SEQ ID NO: 37420 - DNA, 15 bp, Artificial Sequence
  dgRNA
  Pole
gtcccgccacgcgcg

SEQ ID NO: 37421 - DNA, 15 bp, Artificial Sequence
  dgRNA
  Pole
accctctgcgctcgc

SEQ ID NO: 37422 - DNA, 15 bp, Artificial Sequence
  dgRNA
  Pole
ctctgcgctcgccgg

SEQ ID NO: 37423 - DNA, 15 bp, Artificial Sequence
  dgRNA
  Gprc5b
agatgtcctcgaatt

SEQ ID NO: 37424 - DNA, 15 bp, Artificial Sequence
  dgRNA
  Gprc5b
gatgtcctcgaattt

SEQ ID NO: 37425 - DNA, 15 bp, Artificial Sequence
  dgRNA
  Gprc5b
atgtcctcgaatttg

SEQ ID NO: 37426 - DNA, 15 bp, Artificial Sequence
  dgRNA
  Gprc5b
cgaatttggggcacc

SEQ ID NO: 37427 - DNA, 15 bp, Artificial Sequence
  dgRNA
  Gdi2
cccttctctcgcgag

SEQ ID NO: 37428 - DNA, 15 bp, Artificial Sequence
  dgRNA
  Gdi2
ccttctctcgcgaga

SEQ ID NO: 37429 - DNA, 15 bp, Artificial Sequence
  dgRNA
  Gdi2
cttctctcgcgagag

SEQ ID NO: 37430 - DNA, 15 bp, Artificial Sequence
  dgRNA
  Gdi2
cgcgagaggggaacg

SEQ ID NO: 37431 - DNA, 15 bp, Artificial Sequence
  dgRNA
  Pgam2
ttaccaggtgccagc

SEQ ID NO: 37432 - DNA, 15 bp, Artificial Sequence
  dgRNA
  Pgam2
ggtgccagctggtta

SEQ ID NO: 37433 - DNA, 15 bp, Artificial Sequence
  dgRNA
  Pgam2
gtgccagctggttat

SEQ ID NO: 37434 - DNA, 15 bp, Artificial Sequence
  dgRNA
  Pgam2
tgccagctggttatg

SEQ ID NO: 37435 - DNA, 15 bp, Artificial Sequence
  dgRNA
  Smyd1
tctttgggacgatga

SEQ ID NO: 37436 - DNA, 15 bp, Artificial Sequence
  dgRNA
  Clns1a
tatacatcctctctc

SEQ ID NO: 37437 - DNA, 15 bp, Artificial Sequence
  dgRNA
  Clns1a
atacatcctctctcg

SEQ ID NO: 37438 - DNA, 15 bp, Artificial Sequence
  dgRNA
  Clns1a
tctaagcatccttag

SEQ ID NO: 37439 - DNA, 15 bp, Artificial Sequence
  dgRNA
  Clns1a
ccagccggctcgctg

SEQ ID NO: 37440 - DNA, 15 bp, Artificial Sequence
  dgRNA
  Olfr716
gcagtggttataaga

SEQ ID NO: 37441 - DNA, 15 bp, Artificial Sequence
  dgRNA
  Olfr716
aattaagaccactgc

SEQ ID NO: 37442 - DNA, 15 bp, Artificial Sequence
  dgRNA
  Olfr716
taattgggtagttct

SEQ ID NO: 37443 - DNA, 15 bp, Artificial Sequence
  dgRNA
  Tsnax
actgagagagagcgc

SEQ ID NO: 37444 - DNA, 15 bp, Artificial Sequence
  dgRNA
  Tsnax
ctgagagagagcgcc

SEQ ID NO: 37445 - DNA, 15 bp, Artificial Sequence
  dgRNA
  Tsnax
gagagagcgccgggt

SEQ ID NO: 37446 - DNA, 15 bp, Artificial Sequence
  dgRNA
  Tsnax
cgccgggtaggcact

SEQ ID NO: 37447 - DNA, 15 bp, Artificial Sequence
  dgRNA
  Nup160
gggagtcttatttat

SEQ ID NO: 37448 - DNA, 15 bp, Artificial Sequence
  dgRNA
  Nup160
cactgactttaccta

SEQ ID NO: 37449 - DNA, 15 bp, Artificial Sequence
  dgRNA
  Nup160
ttacctacggctcct

SEQ ID NO: 37450 - DNA, 15 bp, Artificial Sequence
  dgRNA
  Nup160
acctacggctcctcg

SEQ ID NO: 37451 - DNA, 15 bp, Artificial Sequence
  dgRNA
  Zfp941
tttattgccatccta

SEQ ID NO: 37452 - DNA, 15 bp, Artificial Sequence
  dgRNA
  Zfp941
tagaggaattgggcc

SEQ ID NO: 37453 - DNA, 15 bp, Artificial Sequence
  dgRNA
  Zfp941
gataactgtccaatt

SEQ ID NO: 37454 - DNA, 15 bp, Artificial Sequence
  dgRNA
  Zfp941
gtccaattaggaacg

SEQ ID NO: 37455 - DNA, 15 bp, Artificial Sequence
  dgRNA
  Pcdhgb6
cctgggcgccgctgt

SEQ ID NO: 37456 - DNA, 15 bp, Artificial Sequence
  dgRNA
  Pcdhgb6
acggtggggttacag

SEQ ID NO: 37457 - DNA, 15 bp, Artificial Sequence
  dgRNA
  Pcdhgb6
tttaatctcacggtg

SEQ ID NO: 37458 - DNA, 15 bp, Artificial Sequence
  dgRNA
  Pcdhgb6
ttttaatctcacggt

SEQ ID NO: 37459 - DNA, 15 bp, Artificial Sequence
  dgRNA
  Zfp60
tattctgtccggggg

SEQ ID NO: 37460 - DNA, 15 bp, Artificial Sequence
  dgRNA
  Zfp60
attctgtccgggggt

SEQ ID NO: 37461 - DNA, 15 bp, Artificial Sequence
  dgRNA
  Zfp60
ggcatagctctcaga

SEQ ID NO: 37462 - DNA, 15 bp, Artificial Sequence
  dgRNA
  Zfp60
gaactacagaccgct

SEQ ID NO: 37463 - DNA, 15 bp, Artificial Sequence
  dgRNA
  Nfe2
tcagcccgaacaaac

SEQ ID NO: 37464 - DNA, 15 bp, Artificial Sequence
  dgRNA
  Nfe2
cagcccgaacaaaca

SEQ ID NO: 37465 - DNA, 15 bp, Artificial Sequence
  dgRNA
  Nfe2
gggaatgaactgtcc

SEQ ID NO: 37466 - DNA, 15 bp, Artificial Sequence
  dgRNA
  Nfe2
cccgctgccacagag

SEQ ID NO: 37467 - DNA, 15 bp, Artificial Sequence
  dgRNA
  Foxj3
cgcaccgcccaccgc

SEQ ID NO: 37468 - DNA, 15 bp, Artificial Sequence
  dgRNA
  Foxj3
accgccggttcccgc

SEQ ID NO: 37469 - DNA, 15 bp, Artificial Sequence
  dgRNA
  Foxj3
ccgctggccgcaagc

SEQ ID NO: 37470 - DNA, 15 bp, Artificial Sequence
  dgRNA
  Foxj3
gccgcgggagctcag

SEQ ID NO: 37471 - DNA, 15 bp, Artificial Sequence
  dgRNA
  Prickle1
ctgcagaccgcagcc

SEQ ID NO: 37472 - DNA, 15 bp, Artificial Sequence
  dgRNA
  Prickle1
agaccgcagcccggc

SEQ ID NO: 37473 - DNA, 15 bp, Artificial Sequence
  dgRNA
  Prickle1
gccggtgctgcctcg

SEQ ID NO: 37474 - DNA, 15 bp, Artificial Sequence
  dgRNA
  Prickle1
ccggtgctgcctcgc

SEQ ID NO: 37475 - DNA, 15 bp, Artificial Sequence
  dgRNA
  Mical3
agacaggttgtcatc

SEQ ID NO: 37476 - DNA, 15 bp, Artificial Sequence
  dgRNA
  Mical3
gatgtcctcagttgg

SEQ ID NO: 37477 - DNA, 15 bp, Artificial Sequence
  dgRNA
  Mical3
gcttggccacatgtt

SEQ ID NO: 37478 - DNA, 15 bp, Artificial Sequence
  dgRNA
  Mical3
ggcgtgagtctggct

SEQ ID NO: 37479 - DNA, 15 bp, Artificial Sequence
  dgRNA
  Kcnn4
cagagtgcaaacggt

SEQ ID NO: 37480 - DNA, 15 bp, Artificial Sequence
  dgRNA
  Kcnn4
gtgtctttgcccacg

SEQ ID NO: 37481 - DNA, 15 bp, Artificial Sequence
  dgRNA
  Kcnn4
ctccttagtcttaga

SEQ ID NO: 37482 - DNA, 15 bp, Artificial Sequence
  dgRNA
  Kcnn4
accgtttgcactctg

SEQ ID NO: 37483 - DNA, 15 bp, Artificial Sequence
  dgRNA
  Pbsn
acatgggataggcac

SEQ ID NO: 37484 - DNA, 15 bp, Artificial Sequence
  dgRNA
  Pbsn
ctagtaaagttctcc

SEQ ID NO: 37485 - DNA, 15 bp, Artificial Sequence
  dgRNA
  Pbsn
taactggaatggtag

SEQ ID NO: 37486 - DNA, 15 bp, Artificial Sequence
  dgRNA
  Pbsn
ttatcttaactggaa

SEQ ID NO: 37487 - DNA, 15 bp, Artificial Sequence
  dgRNA
  Zfp628
tccttcccagcacga

SEQ ID NO: 37488 - DNA, 15 bp, Artificial Sequence
  dgRNA
  Zfp628
ccagcacgagggaac

SEQ ID NO: 37489 - DNA, 15 bp, Artificial Sequence
  dgRNA
  Zfp628
cagcacgagggaaca

SEQ ID NO: 37490 - DNA, 15 bp, Artificial Sequence
  dgRNA
  Zfp628
tctgcgtgtacacca

SEQ ID NO: 37491 - DNA, 15 bp, Artificial Sequence
  dgRNA
  Foxk1
agcacccttcgggac

SEQ ID NO: 37492 - DNA, 15 bp, Artificial Sequence
  dgRNA
  Foxk1
acccttcgggactgg

SEQ ID NO: 37493 - DNA, 15 bp, Artificial Sequence
  dgRNA
  Foxk1
cccgcccacctcgag

SEQ ID NO: 37494 - DNA, 15 bp, Artificial Sequence
  dgRNA
  Foxk1
tgcgcgcgcagcgcg

SEQ ID NO: 37495 - DNA, 15 bp, Artificial Sequence
  dgRNA
  Crygc
catctaggacagcgt

SEQ ID NO: 37496 - DNA, 15 bp, Artificial Sequence
  dgRNA
  Crygc
aattccctcagcccg

SEQ ID NO: 37497 - DNA, 15 bp, Artificial Sequence
  dgRNA
  Crygc
attccctcagcccga

SEQ ID NO: 37498 - DNA, 15 bp, Artificial Sequence
  dgRNA
  Crygc
gactgtagattcgcc

SEQ ID NO: 37499 - DNA, 15 bp, Artificial Sequence
  dgRNA
  Slc38a9
cagcgaccccgcctc

SEQ ID NO: 37500 - DNA, 15 bp, Artificial Sequence
  dgRNA
  Slc38a9
ccccgcctccggagc

SEQ ID NO: 37501 - DNA, 15 bp, Artificial Sequence
  dgRNA
  Slc38a9
cgcctccggagctgg

SEQ ID NO: 37502 - DNA, 15 bp, Artificial Sequence
  dgRNA
  Slc38a9
gcctccggagctgga

SEQ ID NO: 37503 - DNA, 15 bp, Artificial Sequence
  dgRNA
  Cyp39a1
agcgacttctctgat

SEQ ID NO: 37504 - DNA, 15 bp, Artificial Sequence
  dgRNA
  Cyp39a1
acttctctgattggc

SEQ ID NO: 37505 - DNA, 15 bp, Artificial Sequence
  dgRNA
  Cyp39a1
gattggctggtagct

SEQ ID NO: 37506 - DNA, 15 bp, Artificial Sequence
  dgRNA
  Cyp39a1
gagctccgccgcctc

SEQ ID NO: 37507 - DNA, 15 bp, Artificial Sequence
  dgRNA
  Tonsl
tctctgcgaaaaggg

SEQ ID NO: 37508 - DNA, 15 bp, Artificial Sequence
  dgRNA
  Tonsl
ctctgcgaaaagggt

SEQ ID NO: 37509 - DNA, 15 bp, Artificial Sequence
  dgRNA
  Tonsl
tgtaaaagccttgac

SEQ ID NO: 37510 - DNA, 15 bp, Artificial Sequence
  dgRNA
  Tonsl
ccgagtgccgatcaa

SEQ ID NO: 37511 - DNA, 15 bp, Artificial Sequence
  dgRNA
  Gm5538
taatatgtcctctaa

SEQ ID NO: 37512 - DNA, 15 bp, Artificial Sequence
  dgRNA
  Gm5538
aacactgacctttag

SEQ ID NO: 37513 - DNA, 15 bp, Artificial Sequence
  dgRNA
  Smoc2
acgcttgcctagtcc

SEQ ID NO: 37514 - DNA, 15 bp, Artificial Sequence
  dgRNA
  Smoc2
cacagccctgcgcgc

SEQ ID NO: 37515 - DNA, 15 bp, Artificial Sequence
  dgRNA
  Smoc2
acagccctgcgcgcc

SEQ ID NO: 37516 - DNA, 15 bp, Artificial Sequence
  dgRNA
  Smoc2
gccctgcgcgccggg

SEQ ID NO: 37517 - DNA, 15 bp, Artificial Sequence
  dgRNA
  Mapk8ip2
caccgctgtaaccag

SEQ ID NO: 37518 - DNA, 15 bp, Artificial Sequence
  dgRNA
  Mapk8ip2
agaggcgcgcattcc

SEQ ID NO: 37519 - DNA, 15 bp, Artificial Sequence
  dgRNA
  Mapk8ip2
gaggcgcgcattccc

SEQ ID NO: 37520 - DNA, 15 bp, Artificial Sequence
  dgRNA
  Mapk8ip2
attcccgggccgcgt

SEQ ID NO: 37521 - DNA, 15 bp, Artificial Sequence
  dgRNA
  Il15ra
gagcccgagtgcacc

SEQ ID NO: 37522 - DNA, 15 bp, Artificial Sequence
  dgRNA
  Il15ra
cccagaacttcccgt

SEQ ID NO: 37523 - DNA, 15 bp, Artificial Sequence
  dgRNA
  Il15ra
tcccgttggctgcac

SEQ ID NO: 37524 - DNA, 15 bp, Artificial Sequence
  dgRNA
  Il15ra
cccgttggctgcact

SEQ ID NO: 37525 - DNA, 15 bp, Artificial Sequence
  dgRNA
  Fancl
taatcctgaaccgtc

SEQ ID NO: 37526 - DNA, 15 bp, Artificial Sequence
  dgRNA
  Fancl
gaaccgtcaggcctg

SEQ ID NO: 37527 - DNA, 15 bp, Artificial Sequence
  dgRNA
  Fancl
actaagcagaccagt

SEQ ID NO: 37528 - DNA, 15 bp, Artificial Sequence
  dgRNA
  Fancl
tttttcccgccgaag

SEQ ID NO: 37529 - DNA, 15 bp, Artificial Sequence
  dgRNA
  Hdgf
ggcgccagctccttt

SEQ ID NO: 37530 - DNA, 15 bp, Artificial Sequence
  dgRNA
  Hdgf
gcgccagctcctttt

SEQ ID NO: 37531 - DNA, 15 bp, Artificial Sequence
  dgRNA
  Hdgf
cccgctcggcgcgct

SEQ ID NO: 37532 - DNA, 15 bp, Artificial Sequence
  dgRNA
  Hdgf
ggcgcgctcggcact

SEQ ID NO: 37533 - DNA, 15 bp, Artificial Sequence
  dgRNA
  Ankrd36
gtaggccttaagcat

SEQ ID NO: 37534 - DNA, 15 bp, Artificial Sequence
  dgRNA
  Ankrd36
taggccttaagcatc

SEQ ID NO: 37535 - DNA, 15 bp, Artificial Sequence
  dgRNA
  Ankrd36
acgtttgatgcttga

SEQ ID NO: 37536 - DNA, 15 bp, Artificial Sequence
  dgRNA
  Ankrd36
gctacgtgctttgat

SEQ ID NO: 37537 - DNA, 15 bp, Artificial Sequence
  dgRNA
  Klra7
tggtcagtccatgtc

SEQ ID NO: 37538 - DNA, 15 bp, Artificial Sequence
  dgRNA
  Klra7
ggtcagtccatgtca

SEQ ID NO: 37539 - DNA, 15 bp, Artificial Sequence
  dgRNA
  Klra7
taaagtcgtttataa

SEQ ID NO: 37540 - DNA, 15 bp, Artificial Sequence
  dgRNA
  Dfna5
gttcagccccgcccc

SEQ ID NO: 37541 - DNA, 15 bp, Artificial Sequence
  dgRNA
  Dfna5
ccttagcttgtggac

SEQ ID NO: 37542 - DNA, 15 bp, Artificial Sequence
  dgRNA
  Dfna5
cttgtggaccggctg

SEQ ID NO: 37543 - DNA, 15 bp, Artificial Sequence
  dgRNA
  Dfna5
ccggctgaggcatcc

SEQ ID NO: 37544 - DNA, 15 bp, Artificial Sequence
  dgRNA
  Lix1l
atcatttgcctaagg

SEQ ID NO: 37545 - DNA, 15 bp, Artificial Sequence
  dgRNA
  Lix1l
ctctccaccagtgat

SEQ ID NO: 37546 - DNA, 15 bp, Artificial Sequence
  dgRNA
  Lix1l
gattggcatggcatc

SEQ ID NO: 37547 - DNA, 15 bp, Artificial Sequence
  dgRNA
  Lix1l
ccgccctcaatcccc

SEQ ID NO: 37548 - DNA, 15 bp, Artificial Sequence
  dgRNA
  Jam3
taagttcatcgacag

SEQ ID NO: 37549 - DNA, 15 bp, Artificial Sequence
  dgRNA
  Jam3
ctttctcggtcacta

SEQ ID NO: 37550 - DNA, 15 bp, Artificial Sequence
  dgRNA
  Jam3
cggtcactatggtgc

SEQ ID NO: 37551 - DNA, 15 bp, Artificial Sequence
  dgRNA
  Jam3
actatggtgccggct

SEQ ID NO: 37552 - DNA, 15 bp, Artificial Sequence
  dgRNA
  Ctbs
tcagccccgccttct

SEQ ID NO: 37553 - DNA, 15 bp, Artificial Sequence
  dgRNA
  Ctbs
tctccgtttagcatc

SEQ ID NO: 37554 - DNA, 15 bp, Artificial Sequence
  dgRNA
  Ctbs
gccccgcctgcccat

SEQ ID NO: 37555 - DNA, 15 bp, Artificial Sequence
  dgRNA
  Ctbs
tgcccataggacatc

SEQ ID NO: 37556 - DNA, 15 bp, Artificial Sequence
  dgRNA
  Dcaf7
gtagccaatgatctt

SEQ ID NO: 37557 - DNA, 15 bp, Artificial Sequence
  dgRNA
  Dcaf7
aaagagcccgcctcc

SEQ ID NO: 37558 - DNA, 15 bp, Artificial Sequence
  dgRNA
  Dcaf7
ttttcaccaatagta

SEQ ID NO: 37559 - DNA, 15 bp, Artificial Sequence
  dgRNA
  Dcaf7
tcaccaatagtaagg

SEQ ID NO: 37560 - DNA, 15 bp, Artificial Sequence
  dgRNA
  Hnrnpc
cctctgttacgcatg

SEQ ID NO: 37561 - DNA, 15 bp, Artificial Sequence
  dgRNA
  Hnrnpc
tagcccaacccacct

SEQ ID NO: 37562 - DNA, 15 bp, Artificial Sequence
  dgRNA
  Hnrnpc
acctcggattatgat

SEQ ID NO: 37563 - DNA, 15 bp, Artificial Sequence
  dgRNA
  Hnrnpc
cggattatgattgga

SEQ ID NO: 37564 - DNA, 15 bp, Artificial Sequence
  dgRNA
  Atxn10
tgtcctcttcgcctg

SEQ ID NO: 37565 - DNA, 15 bp, Artificial Sequence
  dgRNA
  Atxn10
cagcaccacgggatc

SEQ ID NO: 37566 - DNA, 15 bp, Artificial Sequence
  dgRNA
  Atxn10
agcaccacgggatct

SEQ ID NO: 37567 - DNA, 15 bp, Artificial Sequence
  dgRNA
  Atxn10
gggatctgggtgacg

SEQ ID NO: 37568 - DNA, 15 bp, Artificial Sequence
  dgRNA
  Olfr1209
tcacattaacaattt

SEQ ID NO: 37569 - DNA, 15 bp, Artificial Sequence
  dgRNA
  Olfr1209
gtcccagaaatggtt

SEQ ID NO: 37570 - DNA, 15 bp, Artificial Sequence
  dgRNA
  Olfr1209
gtgaaacactttgtc

SEQ ID NO: 37571 - DNA, 15 bp, Artificial Sequence
  dgRNA
  Herc1
cccacctcccgcgcg

SEQ ID NO: 37572 - DNA, 15 bp, Artificial Sequence
  dgRNA
  Herc1
ctcccgcgcgaggcc

SEQ ID NO: 37573 - DNA, 15 bp, Artificial Sequence
  dgRNA
  Herc1
ccgcgcgaggcccgg

SEQ ID NO: 37574 - DNA, 15 bp, Artificial Sequence
  dgRNA
  Herc1
cgcgaggcccggagg

SEQ ID NO: 37575 - DNA, 15 bp, Artificial Sequence
  dgRNA
  Cnih3
cgcctccgcgcgcgc

SEQ ID NO: 37576 - DNA, 15 bp, Artificial Sequence
  dgRNA
  Cnih3
gcctccgcgcgcgcg

SEQ ID NO: 37577 - DNA, 15 bp, Artificial Sequence
  dgRNA
  Cnih3
caagtttcctacgag

SEQ ID NO: 37578 - DNA, 15 bp, Artificial Sequence
  dgRNA
  Cnih3
gtttcctacgagagg

SEQ ID NO: 37579 - DNA, 15 bp, Artificial Sequence
  dgRNA
  Laptm4b
tagcacagcattcac

SEQ ID NO: 37580 - DNA, 15 bp, Artificial Sequence
  dgRNA
  Laptm4b
tgcaagctagatgtg

SEQ ID NO: 37581 - DNA, 15 bp, Artificial Sequence
  dgRNA
  Laptm4b
ctgaatcctaaccaa

SEQ ID NO: 37582 - DNA, 15 bp, Artificial Sequence
  dgRNA
  Laptm4b
ggtgcaccccatttc

SEQ ID NO: 37583 - DNA, 15 bp, Artificial Sequence
  dgRNA
  Cdh7
tgccctagacctctt

SEQ ID NO: 37584 - DNA, 15 bp, Artificial Sequence
  dgRNA
  Cdh7
ggccttatgtgaatg

SEQ ID NO: 37585 - DNA, 15 bp, Artificial Sequence
  dgRNA
  Cdh7
tgtggaactcaagta

SEQ ID NO: 37586 - DNA, 15 bp, Artificial Sequence
  dgRNA
  Cdh7
taattagtattccgt

SEQ ID NO: 37587 - DNA, 15 bp, Artificial Sequence
  dgRNA
  Ndc80
tcgggccgctccgcc

SEQ ID NO: 37588 - DNA, 15 bp, Artificial Sequence
  dgRNA
  Ndc80
gccagcttcccggac

SEQ ID NO: 37589 - DNA, 15 bp, Artificial Sequence
  dgRNA
  Ndc80
gcttcccggacaggg

SEQ ID NO: 37590 - DNA, 15 bp, Artificial Sequence
  dgRNA
  Ndc80
cttcccggacagggc

SEQ ID NO: 37591 - DNA, 15 bp, Artificial Sequence
  dgRNA
  B3gnt8
cagccctaactcgcc

SEQ ID NO: 37592 - DNA, 15 bp, Artificial Sequence
  dgRNA
  B3gnt8
agccctaactcgcca

SEQ ID NO: 37593 - DNA, 15 bp, Artificial Sequence
  dgRNA
  B3gnt8
cgccccggctcctcc

SEQ ID NO: 37594 - DNA, 15 bp, Artificial Sequence
  dgRNA
  B3gnt8
tcctcccggccccaa

SEQ ID NO: 37595 - DNA, 15 bp, Artificial Sequence
  dgRNA
  Sh3bgrl
cccccttcccggaga

SEQ ID NO: 37596 - DNA, 15 bp, Artificial Sequence
  dgRNA
  Sh3bgrl
tttcaacagatctcg

SEQ ID NO: 37597 - DNA, 15 bp, Artificial Sequence
  dgRNA
  Sh3bgrl
attcgattagaataa

SEQ ID NO: 37598 - DNA, 15 bp, Artificial Sequence
  dgRNA
  Sh3bgrl
ccctctccgggaagg

SEQ ID NO: 37599 - DNA, 15 bp, Artificial Sequence
  dgRNA
  Olfr789
gctcaacctgttgac

SEQ ID NO: 37600 - DNA, 15 bp, Artificial Sequence
  dgRNA
  Mok
ggtcgcctactcact

SEQ ID NO: 37601 - DNA, 15 bp, Artificial Sequence
  dgRNA
  Mok
gtagcgaccgaaccg

SEQ ID NO: 37602 - DNA, 15 bp, Artificial Sequence
  dgRNA
  Mok
gcgaccgaaccgagg

SEQ ID NO: 37603 - DNA, 15 bp, Artificial Sequence
  dgRNA
  Mok
ccgaaccgaggcggc

SEQ ID NO: 37604 - DNA, 15 bp, Artificial Sequence
  dgRNA
  Olfr1037
attagaatccactag

SEQ ID NO: 37605 - DNA, 15 bp, Artificial Sequence
  dgRNA
  Olfr1037
ttttcactcctctag

SEQ ID NO: 37606 - DNA, 15 bp, Artificial Sequence
  dgRNA
  Lrch1
accgacaaaataccc

SEQ ID NO: 37607 - DNA, 15 bp, Artificial Sequence
  dgRNA
  Lrch1
taaactacaaggggt

SEQ ID NO: 37608 - DNA, 15 bp, Artificial Sequence
  dgRNA
  Lrch1
aaactacaaggggtc

SEQ ID NO: 37609 - DNA, 15 bp, Artificial Sequence
  dgRNA
  Lrch1
tacaaggggtcgggc

SEQ ID NO: 37610 - DNA, 15 bp, Artificial Sequence
  dgRNA
  Ddn
aggtcccattaggct

SEQ ID NO: 37611 - DNA, 15 bp, Artificial Sequence
  dgRNA
  Ddn
ggtcccattaggctt

SEQ ID NO: 37612 - DNA, 15 bp, Artificial Sequence
  dgRNA
  Ddn
gtcccattaggcttg

SEQ ID NO: 37613 - DNA, 15 bp, Artificial Sequence
  dgRNA
  Ddn
tcccattaggcttgg

SEQ ID NO: 37614 - DNA, 15 bp, Artificial Sequence
  dgRNA
  Timm23
ccgcttgcctccgct

SEQ ID NO: 37615 - DNA, 15 bp, Artificial Sequence
  dgRNA
  Timm23
cctccgctcggcagc

SEQ ID NO: 37616 - DNA, 15 bp, Artificial Sequence
  dgRNA
  Timm23
ctccgctcggcagca

SEQ ID NO: 37617 - DNA, 15 bp, Artificial Sequence
  dgRNA
  Timm23
cgcgccgcttccact

SEQ ID NO: 37618 - DNA, 15 bp, Artificial Sequence
  dgRNA
  Pkm
ccgatctaaagcaac

SEQ ID NO: 37619 - DNA, 15 bp, Artificial Sequence
  dgRNA
  Pkm
agcaacaggtggcgg

SEQ ID NO: 37620 - DNA, 15 bp, Artificial Sequence
  dgRNA
  Pkm
gtggcggtggcgccc

SEQ ID NO: 37621 - DNA, 15 bp, Artificial Sequence
  dgRNA
  Pkm
ggcgcccgggaacct

SEQ ID NO: 37622 - DNA, 15 bp, Artificial Sequence
  dgRNA
  Mdfic
aaccttggtgggcct

SEQ ID NO: 37623 - DNA, 15 bp, Artificial Sequence
  dgRNA
  Mdfic
tagggagcctgcatc

SEQ ID NO: 37624 - DNA, 15 bp, Artificial Sequence
  dgRNA
  Mdfic
gacagctccctcgca

SEQ ID NO: 37625 - DNA, 15 bp, Artificial Sequence
  dgRNA
  Mdfic
ctcgcaagggagctc

SEQ ID NO: 37626 - DNA, 15 bp, Artificial Sequence
  dgRNA
  Olfr706
caatggtattgctgt

SEQ ID NO: 37627 - DNA, 15 bp, Artificial Sequence
  dgRNA
  Olfr706
tctgaaaattaatgc

SEQ ID NO: 37628 - DNA, 15 bp, Artificial Sequence
  dgRNA
  Gldc
gcaacccattcccat

SEQ ID NO: 37629 - DNA, 15 bp, Artificial Sequence
  dgRNA
  Gldc
cctactgcccgcctt

SEQ ID NO: 37630 - DNA, 15 bp, Artificial Sequence
  dgRNA
  Gldc
ctactgcccgccttc

SEQ ID NO: 37631 - DNA, 15 bp, Artificial Sequence
  dgRNA
  Gldc
gccgcttaaagtgtg

SEQ ID NO: 37632 - DNA, 15 bp, Artificial Sequence
  dgRNA
  Igsf10
agtgaagacccctag

SEQ ID NO: 37633 - DNA, 15 bp, Artificial Sequence
  dgRNA
  Igsf10
gcggtgcaattccat

SEQ ID NO: 37634 - DNA, 15 bp, Artificial Sequence
  dgRNA
  Igsf10
aattccattggccca

SEQ ID NO: 37635 - DNA, 15 bp, Artificial Sequence
  dgRNA
  Igsf10
ggctgctaatcccct

SEQ ID NO: 37636 - DNA, 15 bp, Artificial Sequence
  dgRNA
  Crem
acaagaacattcggg

SEQ ID NO: 37637 - DNA, 15 bp, Artificial Sequence
  dgRNA
  Crem
cgggtggtttattac

SEQ ID NO: 37638 - DNA, 15 bp, Artificial Sequence
  dgRNA
  Crem
atatgcttgctagtt

SEQ ID NO: 37639 - DNA, 15 bp, Artificial Sequence
  dgRNA
  Crem
atatgtaagataagt

SEQ ID NO: 37640 - DNA, 15 bp, Artificial Sequence
  dgRNA
  Muc5ac
cccacgtgaagtcac

SEQ ID NO: 37641 - DNA, 15 bp, Artificial Sequence
  dgRNA
  Muc5ac
ccacgtgaagtcact

SEQ ID NO: 37642 - DNA, 15 bp, Artificial Sequence
  dgRNA
  Muc5ac
cacgtgaagtcactg

SEQ ID NO: 37643 - DNA, 15 bp, Artificial Sequence
  dgRNA
  Muc5ac
actacaaaaggtagc

SEQ ID NO: 37644 - DNA, 15 bp, Artificial Sequence
  dgRNA
  Adar
gggctcaaacaaaag

SEQ ID NO: 37645 - DNA, 15 bp, Artificial Sequence
  dgRNA
  Adar
agggatgcatcacat

SEQ ID NO: 37646 - DNA, 15 bp, Artificial Sequence
  dgRNA
  Adar
caggtctccataatg

SEQ ID NO: 37647 - DNA, 15 bp, Artificial Sequence
  dgRNA
  Adar
ttgattctactcccc

SEQ ID NO: 37648 - DNA, 15 bp, Artificial Sequence
  dgRNA
  Mgst1
gactcataatttcgc

SEQ ID NO: 37649 - DNA, 15 bp, Artificial Sequence
  dgRNA
  Mgst1
ggggcagggtcgtta

SEQ ID NO: 37650 - DNA, 15 bp, Artificial Sequence
  dgRNA
  Mgst1
gggggcagggtcgtt

SEQ ID NO: 37651 - DNA, 15 bp, Artificial Sequence
  dgRNA
  Mgst1
gaaagtgttgcaagg

SEQ ID NO: 37652 - DNA, 15 bp, Artificial Sequence
  dgRNA
  Capn3
gaaatacctccagct

SEQ ID NO: 37653 - DNA, 15 bp, Artificial Sequence
  dgRNA
  Capn3
ccacgcaccagtctg

SEQ ID NO: 37654 - DNA, 15 bp, Artificial Sequence
  dgRNA
  Capn3
cgcgaaggacctagc

SEQ ID NO: 37655 - DNA, 15 bp, Artificial Sequence
  dgRNA
  Capn3
actgagtggtcgcga

SEQ ID NO: 37656 - DNA, 15 bp, Artificial Sequence
  dgRNA
  Cib4
tgagggttcttagcc

SEQ ID NO: 37657 - DNA, 15 bp, Artificial Sequence
  dgRNA
  Cib4
gagggttcttagcca

SEQ ID NO: 37658 - DNA, 15 bp, Artificial Sequence
  dgRNA
  Cib4
tgtttgccaactcag

SEQ ID NO: 37659 - DNA, 15 bp, Artificial Sequence
  dgRNA
  Cib4
tcacgatgcctggga

SEQ ID NO: 37660 - DNA, 15 bp, Artificial Sequence
  dgRNA
  Tnfaip8l3
tctaccctcgcgtgc

SEQ ID NO: 37661 - DNA, 15 bp, Artificial Sequence
  dgRNA
  Tnfaip8l3
ctcgcgtgcaggcac

SEQ ID NO: 37662 - DNA, 15 bp, Artificial Sequence
  dgRNA
  Tnfaip8l3
gcgtgcaggcactgg

SEQ ID NO: 37663 - DNA, 15 bp, Artificial Sequence
  dgRNA
  Tnfaip8l3
cgtgcaggcactggc

SEQ ID NO: 37664 - DNA, 15 bp, Artificial Sequence
  dgRNA
  Rap1gds1
cgctcggccgcgcgt

SEQ ID NO: 37665 - DNA, 15 bp, Artificial Sequence
  dgRNA
  Rap1gds1
gctcggccgcgcgtc

SEQ ID NO: 37666 - DNA, 15 bp, Artificial Sequence
  dgRNA
  Pgls
aggcgtgtctcgccc

SEQ ID NO: 37667 - DNA, 15 bp, Artificial Sequence
  dgRNA
  Pgls
ggcgtgtctcgccca

SEQ ID NO: 37668 - DNA, 15 bp, Artificial Sequence
  dgRNA
  Pgls
cgcccagggaagcgc

SEQ ID NO: 37669 - DNA, 15 bp, Artificial Sequence
  dgRNA
  Pgls
cccagggaagcgccg

SEQ ID NO: 37670 - DNA, 15 bp, Artificial Sequence
  dgRNA
  Thsd1
gaagatgcgctgccc

SEQ ID NO: 37671 - DNA, 15 bp, Artificial Sequence
  dgRNA
  Thsd1
tctgagagcccgcct

SEQ ID NO: 37672 - DNA, 15 bp, Artificial Sequence
  dgRNA
  Thsd1
ctgagagcccgcctc

SEQ ID NO: 37673 - DNA, 15 bp, Artificial Sequence
  dgRNA
  Thsd1
tgagagcccgcctcg

SEQ ID NO: 37674 - DNA, 15 bp, Artificial Sequence
  dgRNA
  Bmp10
aacctgacttttggt

SEQ ID NO: 37675 - DNA, 15 bp, Artificial Sequence
  dgRNA
  Bmp10
gccagttacagccca

SEQ ID NO: 37676 - DNA, 15 bp, Artificial Sequence
  dgRNA
  Bmp10
gcaaaatcccctata

SEQ ID NO: 37677 - DNA, 15 bp, Artificial Sequence
  dgRNA
  Bmp10
agcaaaatcccctat

SEQ ID NO: 37678 - DNA, 15 bp, Artificial Sequence
  dgRNA
  BC051665
acctaaaccaattcc

SEQ ID NO: 37679 - DNA, 15 bp, Artificial Sequence
  dgRNA
  BC051665
cctaaaccaattcca

SEQ ID NO: 37680 - DNA, 15 bp, Artificial Sequence
  dgRNA
  BC051665
ccttggtggattgtg

SEQ ID NO: 37681 - DNA, 15 bp, Artificial Sequence
  dgRNA
  BC051665
gccttggtggattgt

SEQ ID NO: 37682 - DNA, 15 bp, Artificial Sequence
  dgRNA
  Htatsf1
gccatgcatttcggc

SEQ ID NO: 37683 - DNA, 15 bp, Artificial Sequence
  dgRNA
  Htatsf1
aggctgcgtccctaa

SEQ ID NO: 37684 - DNA, 15 bp, Artificial Sequence
  dgRNA
  Htatsf1
ataagtacagacacg

SEQ ID NO: 37685 - DNA, 15 bp, Artificial Sequence
  dgRNA
  Htatsf1
agtacagacacgcgg

SEQ ID NO: 37686 - DNA, 15 bp, Artificial Sequence
  dgRNA
  Ceacam20
tattagtgttgccgt

SEQ ID NO: 37687 - DNA, 15 bp, Artificial Sequence
  dgRNA
  Ceacam20
gaactaagactgtta

SEQ ID NO: 37688 - DNA, 15 bp, Artificial Sequence
  dgRNA
  Ceacam20
ggaactaagactgtt

SEQ ID NO: 37689 - DNA, 15 bp, Artificial Sequence
  dgRNA
  Zbtb5
tggtcagagcgctca

SEQ ID NO: 37690 - DNA, 15 bp, Artificial Sequence
  dgRNA
  Zbtb5
cgctcacggatgctg

SEQ ID NO: 37691 - DNA, 15 bp, Artificial Sequence
  dgRNA
  Zbtb5
ggtagtaaacacagc

SEQ ID NO: 37692 - DNA, 15 bp, Artificial Sequence
  dgRNA
  Zbtb5
tagtaaacacagccg

SEQ ID NO: 37693 - DNA, 15 bp, Artificial Sequence
  dgRNA
  Pmfbp1
caacctagccttacc

SEQ ID NO: 37694 - DNA, 15 bp, Artificial Sequence
  dgRNA
  Pmfbp1
ccttaccaggtaaga

SEQ ID NO: 37695 - DNA, 15 bp, Artificial Sequence
  dgRNA
  Pmfbp1
tggtaaggctaggtt

SEQ ID NO: 37696 - DNA, 15 bp, Artificial Sequence
  dgRNA
  Pmfbp1
ctggtaaggctaggt

SEQ ID NO: 37697 - DNA, 15 bp, Artificial Sequence
  dgRNA
  Trdn
tttttggcactctgg

SEQ ID NO: 37698 - DNA, 15 bp, Artificial Sequence
  dgRNA
  Ctage5
ttacagcgtcaaaac

SEQ ID NO: 37699 - DNA, 15 bp, Artificial Sequence
  dgRNA
  Wfdc21
aagatggcactaccc

SEQ ID NO: 37700 - DNA, 15 bp, Artificial Sequence
  dgRNA
  Wfdc21
ttccaggcggggctt

SEQ ID NO: 37701 - DNA, 15 bp, Artificial Sequence
  dgRNA
  Wfdc21
tagtcctcctaaagt

SEQ ID NO: 37702 - DNA, 15 bp, Artificial Sequence
  dgRNA
  Wfdc21
acactatgtatgtcc

SEQ ID NO: 37703 - DNA, 15 bp, Artificial Sequence
  dgRNA
  Grin3a
tgtgtcgctcctcca

SEQ ID NO: 37704 - DNA, 15 bp, Artificial Sequence
  dgRNA
  Grin3a
aggaagccgcggaag

SEQ ID NO: 37705 - DNA, 15 bp, Artificial Sequence
  dgRNA
  Grin3a
cgcggaagtggcgcc

SEQ ID NO: 37706 - DNA, 15 bp, Artificial Sequence
  dgRNA
  Grin3a
gcggaagtggcgcct

SEQ ID NO: 37707 - DNA, 15 bp, Artificial Sequence
  dgRNA
  Ppm1l
gccgctcaccccccg

SEQ ID NO: 37708 - DNA, 15 bp, Artificial Sequence
  dgRNA
  Ppm1l
cacgtgcgtccgccc

SEQ ID NO: 37709 - DNA, 15 bp, Artificial Sequence
  dgRNA
  Ppm1l
cccggcgagctcctt

SEQ ID NO: 37710 - DNA, 15 bp, Artificial Sequence
  dgRNA
  Ppm1l
ccggcgagctccttc

SEQ ID NO: 37711 - DNA, 15 bp, Artificial Sequence
  dgRNA
  Gata3
ggggcggcggtgtgc

SEQ ID NO: 37712 - DNA, 15 bp, Artificial Sequence
  dgRNA
  Gata3
gggcggcggtgtgcc

SEQ ID NO: 37713 - DNA, 15 bp, Artificial Sequence
  dgRNA
  Gata3
ggcggcggtgtgccg

SEQ ID NO: 37714 - DNA, 15 bp, Artificial Sequence
  dgRNA
  Gata3
ggcggtgtgccgggg

SEQ ID NO: 37715 - DNA, 15 bp, Artificial Sequence
  dgRNA
  Kcnh8
ctacggagagaccct

SEQ ID NO: 37716 - DNA, 15 bp, Artificial Sequence
  dgRNA
  Kcnh8
tacggagagacccta

SEQ ID NO: 37717 - DNA, 15 bp, Artificial Sequence
  dgRNA
  Kcnh8
acggagagaccctag

SEQ ID NO: 37718 - DNA, 15 bp, Artificial Sequence
  dgRNA
  Kcnh8
acggcggaggacgcc

SEQ ID NO: 37719 - DNA, 15 bp, Artificial Sequence
  dgRNA
  Cnksr3
ctcttcggagccaag

SEQ ID NO: 37720 - DNA, 15 bp, Artificial Sequence
  dgRNA
  Cnksr3
gccaagcggctctcc

SEQ ID NO: 37721 - DNA, 15 bp, Artificial Sequence
  dgRNA
  Cnksr3
gcccaccccttgaag

SEQ ID NO: 37722 - DNA, 15 bp, Artificial Sequence
  dgRNA
  Cnksr3
tagatccctggcgtc

SEQ ID NO: 37723 - DNA, 15 bp, Artificial Sequence
  dgRNA
  Ube2w
tcaggagcgaaaaca

SEQ ID NO: 37724 - DNA, 15 bp, Artificial Sequence
  dgRNA
  Ube2w
gagcgaaaacacggt

SEQ ID NO: 37725 - DNA, 15 bp, Artificial Sequence
  dgRNA
  Ube2w
tcttacacttgtagc

SEQ ID NO: 37726 - DNA, 15 bp, Artificial Sequence
  dgRNA
  Ube2w
agatacaacttcgcc

SEQ ID NO: 37727 - DNA, 15 bp, Artificial Sequence
  dgRNA
  Pard3
ggggacggcgaggca

SEQ ID NO: 37728 - DNA, 15 bp, Artificial Sequence
  dgRNA
  Pard3
aggggacggcgaggc

SEQ ID NO: 37729 - DNA, 15 bp, Artificial Sequence
  dgRNA
  Phactr4
gaaggtctcgggact

SEQ ID NO: 37730 - DNA, 15 bp, Artificial Sequence
  dgRNA
  Dirc2
accctttccactcgt

SEQ ID NO: 37731 - DNA, 15 bp, Artificial Sequence
  dgRNA
  Dirc2
ccctttccactcgta

SEQ ID NO: 37732 - DNA, 15 bp, Artificial Sequence
  dgRNA
  Dirc2
ccactcgtagggtcc

SEQ ID NO: 37733 - DNA, 15 bp, Artificial Sequence
  dgRNA
  Dirc2
cactcgtagggtccc

SEQ ID NO: 37734 - DNA, 15 bp, Artificial Sequence
  dgRNA
  Serpina1d
tacctcagtgcccaa

SEQ ID NO: 37735 - DNA, 15 bp, Artificial Sequence
  dgRNA
  Serpina1d
cccgcatatccccct

SEQ ID NO: 37736 - DNA, 15 bp, Artificial Sequence
  dgRNA
  Serpina1d
gagagtccatccatt

SEQ ID NO: 37737 - DNA, 15 bp, Artificial Sequence
  dgRNA
  Serpina1d
ccaagggggatatgc

SEQ ID NO: 37738 - DNA, 15 bp, Artificial Sequence
  dgRNA
  Cldn14
cagggacccattaga

SEQ ID NO: 37739 - DNA, 15 bp, Artificial Sequence
  dgRNA
  Cldn14
gttccaaacgcagat

SEQ ID NO: 37740 - DNA, 15 bp, Artificial Sequence
  dgRNA
  Cldn14
cagataggacatttc

SEQ ID NO: 37741 - DNA, 15 bp, Artificial Sequence
  dgRNA
  Cldn14
taggacatttccggt

SEQ ID NO: 37742 - DNA, 15 bp, Artificial Sequence
  dgRNA
  Dnajc5g
tgatcgggatggtca

SEQ ID NO: 37743 - DNA, 15 bp, Artificial Sequence
  dgRNA
  Dnajc5g
ctgtgccttcggccc

SEQ ID NO: 37744 - DNA, 15 bp, Artificial Sequence
  dgRNA
  Dnajc5g
tgtgccttcggccct

SEQ ID NO: 37745 - DNA, 15 bp, Artificial Sequence
  dgRNA
  Dnajc5g
gtgccttcggccctg

SEQ ID NO: 37746 - DNA, 15 bp, Artificial Sequence
  dgRNA
  Amt
tctaacccccaattc

SEQ ID NO: 37747 - DNA, 15 bp, Artificial Sequence
  dgRNA
  Amt
gcttcccgccccctg

SEQ ID NO: 37748 - DNA, 15 bp, Artificial Sequence
  dgRNA
  Amt
gcctagaaccagaat

SEQ ID NO: 37749 - DNA, 15 bp, Artificial Sequence
  dgRNA
  Amt
gaggctgactcccga

SEQ ID NO: 37750 - DNA, 15 bp, Artificial Sequence
  dgRNA
  Nrg3
ccgccgcccgcctct

SEQ ID NO: 37751 - DNA, 15 bp, Artificial Sequence
  dgRNA
  Nrg3
ccgcccgcctctcgg

SEQ ID NO: 37752 - DNA, 15 bp, Artificial Sequence
  dgRNA
  Nrg3
ccgcctctcgggggg

SEQ ID NO: 37753 - DNA, 15 bp, Artificial Sequence
  dgRNA
  Nrg3
cgcctctcgggggga

SEQ ID NO: 37754 - DNA, 15 bp, Artificial Sequence
  dgRNA
  Isl2
tcccgagcaagcccc

SEQ ID NO: 37755 - DNA, 15 bp, Artificial Sequence
  dgRNA
  Isl2
cccgagcaagcccca

SEQ ID NO: 37756 - DNA, 15 bp, Artificial Sequence
  dgRNA
  Isl2
caagccccagggcgg

SEQ ID NO: 37757 - DNA, 15 bp, Artificial Sequence
  dgRNA
  Isl2
aagccccagggcggt

SEQ ID NO: 37758 - DNA, 15 bp, Artificial Sequence
  dgRNA
  Vax1
tgcgctgaccctccg

SEQ ID NO: 37759 - DNA, 15 bp, Artificial Sequence
  dgRNA
  Vax1
gccgaagccaccccg

SEQ ID NO: 37760 - DNA, 15 bp, Artificial Sequence
  dgRNA
  Vax1
ccgaagccaccccgc

SEQ ID NO: 37761 - DNA, 15 bp, Artificial Sequence
  dgRNA
  Vax1
cgaagccaccccgcg

SEQ ID NO: 37762 - DNA, 15 bp, Artificial Sequence
  dgRNA
  Kat6b
cccgccctcccctga

SEQ ID NO: 37763 - DNA, 15 bp, Artificial Sequence
  dgRNA
  Kat6b
cctgagggcggtgag

SEQ ID NO: 37764 - DNA, 15 bp, Artificial Sequence
  dgRNA
  Kat6b
acgcctgggctgttt

SEQ ID NO: 37765 - DNA, 15 bp, Artificial Sequence
  dgRNA
  Kat6b
aggatggggacgcct

SEQ ID NO: 37766 - DNA, 15 bp, Artificial Sequence
  dgRNA
  Fam71f1
cccttggagcattca

SEQ ID NO: 37767 - DNA, 15 bp, Artificial Sequence
  dgRNA
  Fam105a
gaggtgcagccctag

SEQ ID NO: 37768 - DNA, 15 bp, Artificial Sequence
  dgRNA
  Fam105a
cacgcctacctcgcg

SEQ ID NO: 37769 - DNA, 15 bp, Artificial Sequence
  dgRNA
  Fam105a
gcctacctcgcgcgg

SEQ ID NO: 37770 - DNA, 15 bp, Artificial Sequence
  dgRNA
  Fam105a
gccctagcttctgag

SEQ ID NO: 37771 - DNA, 15 bp, Artificial Sequence
  dgRNA
  Scgb2b26
gttctaacccctctt

SEQ ID NO: 37772 - DNA, 15 bp, Artificial Sequence
  dgRNA
  Scgb2b26
ttgcccaaaggtgtt

SEQ ID NO: 37773 - DNA, 15 bp, Artificial Sequence
  dgRNA
  Scgb2b26
tcccttgcatacagg

SEQ ID NO: 37774 - DNA, 15 bp, Artificial Sequence
  dgRNA
  Aldh3b1
tgtgcgactctgacc

SEQ ID NO: 37775 - DNA, 15 bp, Artificial Sequence
  dgRNA
  Aldh3b1
gtgcgactctgacct

SEQ ID NO: 37776 - DNA, 15 bp, Artificial Sequence
  dgRNA
  Aldh3b1
ctaacagcttccacc

SEQ ID NO: 37777 - DNA, 15 bp, Artificial Sequence
  dgRNA
  Aldh3b1
gtcaggcactaggcc

SEQ ID NO: 37778 - DNA, 15 bp, Artificial Sequence
  dgRNA
  Ctrb1
tgggttgggcaatgc

SEQ ID NO: 37779 - DNA, 15 bp, Artificial Sequence
  dgRNA
  Ctrb1
aacaagacagtgata

SEQ ID NO: 37780 - DNA, 15 bp, Artificial Sequence
  dgRNA
  Ctrb1
aggtctctggataac

SEQ ID NO: 37781 - DNA, 15 bp, Artificial Sequence
  dgRNA
  Ctrb1
ttggacctttctggt

SEQ ID NO: 37782 - DNA, 15 bp, Artificial Sequence
  dgRNA
  Thap4
cgcggcagccaagcg

SEQ ID NO: 37783 - DNA, 15 bp, Artificial Sequence
  dgRNA
  Thap4
ccaagcgcggcgcag

SEQ ID NO: 37784 - DNA, 15 bp, Artificial Sequence
  dgRNA
  Thap4
ggcgcagcggaagcg

SEQ ID NO: 37785 - DNA, 15 bp, Artificial Sequence
  dgRNA
  Thap4
gcgcagcggaagcgc

SEQ ID NO: 37786 - DNA, 15 bp, Artificial Sequence
  dgRNA
  Tsc22d1
ttagacgtaagcgtg

SEQ ID NO: 37787 - DNA, 15 bp, Artificial Sequence
  dgRNA
  Tsc22d1
tagacgtaagcgtgc

SEQ ID NO: 37788 - DNA, 15 bp, Artificial Sequence
  dgRNA
  Tsc22d1
taagcgtgcgggcac

SEQ ID NO: 37789 - DNA, 15 bp, Artificial Sequence
  dgRNA
  Tsc22d1
aagcgtgcgggcacc

SEQ ID NO: 37790 - DNA, 15 bp, Artificial Sequence
  dgRNA
  Lcn12
caggatgaccccagt

SEQ ID NO: 37791 - DNA, 15 bp, Artificial Sequence
  dgRNA
  Lcn12
aggatgaccccagtt

SEQ ID NO: 37792 - DNA, 15 bp, Artificial Sequence
  dgRNA
  Lcn12
gggccctggccacgt

SEQ ID NO: 37793 - DNA, 15 bp, Artificial Sequence
  dgRNA
  Lcn12
tactggacccaactg

SEQ ID NO: 37794 - DNA, 15 bp, Artificial Sequence
  dgRNA
  Tmpo
tctcgccctgcgccg

SEQ ID NO: 37795 - DNA, 15 bp, Artificial Sequence
  dgRNA
  Tmpo
cgccctgcgccgcgg

SEQ ID NO: 37796 - DNA, 15 bp, Artificial Sequence
  dgRNA
  Tmpo
ctgcgccgcggcggc

SEQ ID NO: 37797 - DNA, 15 bp, Artificial Sequence
  dgRNA
  Tmpo
gagccgcccagccaa

SEQ ID NO: 37798 - DNA, 15 bp, Artificial Sequence
  dgRNA
  Il1b
accccttgacttcca

SEQ ID NO: 37799 - DNA, 15 bp, Artificial Sequence
  dgRNA
  Il1b
aatcagttaacccaa

SEQ ID NO: 37800 - DNA, 15 bp, Artificial Sequence
  dgRNA
  Il1b
gatgggaattcttag

SEQ ID NO: 37801 - DNA, 15 bp, Artificial Sequence
  dgRNA
  Cnih1
aaatcctttcaatac

SEQ ID NO: 37802 - DNA, 15 bp, Artificial Sequence
  dgRNA
  Cnih1
aaactccgaccatca

SEQ ID NO: 37803 - DNA, 15 bp, Artificial Sequence
  dgRNA
  Cnih1
aactccgaccatcag

SEQ ID NO: 37804 - DNA, 15 bp, Artificial Sequence
  dgRNA
  Cnih1
agtgcctgtattgaa

SEQ ID NO: 37805 - DNA, 15 bp, Artificial Sequence
  dgRNA
  Il23a
tgaagcggcatacct

SEQ ID NO: 37806 - DNA, 15 bp, Artificial Sequence
  dgRNA
  Il23a
tgggctctccaaaga

SEQ ID NO: 37807 - DNA, 15 bp, Artificial Sequence
  dgRNA
  Il23a
acctgctagtgtgaa

SEQ ID NO: 37808 - DNA, 15 bp, Artificial Sequence
  dgRNA
  Il23a
cgggccttacagtgc

SEQ ID NO: 37809 - DNA, 15 bp, Artificial Sequence
  dgRNA
  Zfand3
gccagcgccgccgca

SEQ ID NO: 37810 - DNA, 15 bp, Artificial Sequence
  dgRNA
  Zfand3
ccagcgccgccgcac

SEQ ID NO: 37811 - DNA, 15 bp, Artificial Sequence
  dgRNA
  Zfand3
cacgggacagcgccg

SEQ ID NO: 37812 - DNA, 15 bp, Artificial Sequence
  dgRNA
  Zfand3
ggacagcgccgtggc

SEQ ID NO: 37813 - DNA, 15 bp, Artificial Sequence
  dgRNA
  Msln
gcccctccctatagg

SEQ ID NO: 37814 - DNA, 15 bp, Artificial Sequence
  dgRNA
  Msln
tccctataggagggc

SEQ ID NO: 37815 - DNA, 15 bp, Artificial Sequence
  dgRNA
  Msln
ggttttcctaggggc

SEQ ID NO: 37816 - DNA, 15 bp, Artificial Sequence
  dgRNA
  Msln
tcctaggggcgggcc

SEQ ID NO: 37817 - DNA, 15 bp, Artificial Sequence
  dgRNA
  Dad1
ggcaggttaagtccc

SEQ ID NO: 37818 - DNA, 15 bp, Artificial Sequence
  dgRNA
  Dad1
cctggaccgccagct

SEQ ID NO: 37819 - DNA, 15 bp, Artificial Sequence
  dgRNA
  Dad1
agctagaccactgag

SEQ ID NO: 37820 - DNA, 15 bp, Artificial Sequence
  dgRNA
  Dad1
agagccggaactctc

SEQ ID NO: 37821 - DNA, 15 bp, Artificial Sequence
  dgRNA
  Habp4
taccaccacgcccac

SEQ ID NO: 37822 - DNA, 15 bp, Artificial Sequence
  dgRNA
  Habp4
ccacaggctatagag

SEQ ID NO: 37823 - DNA, 15 bp, Artificial Sequence
  dgRNA
  Habp4
cacaggctatagagt

SEQ ID NO: 37824 - DNA, 15 bp, Artificial Sequence
  dgRNA
  Habp4
tgacgtcacagacac

SEQ ID NO: 37825 - DNA, 15 bp, Artificial Sequence
  dgRNA
  Fgf12
ggggaagtttacatc

SEQ ID NO: 37826 - DNA, 15 bp, Artificial Sequence
  dgRNA
  Fgf12
ctctgactaaccttg

SEQ ID NO: 37827 - DNA, 15 bp, Artificial Sequence
  dgRNA
  Fgf12
tctgactaaccttgt

SEQ ID NO: 37828 - DNA, 15 bp, Artificial Sequence
  dgRNA
  Fgf12
ctgccctcatcccgg

SEQ ID NO: 37829 - DNA, 15 bp, Artificial Sequence
  dgRNA
  Ppargc1a
ccttggagtgacgtc

SEQ ID NO: 37830 - DNA, 15 bp, Artificial Sequence
  dgRNA
  Ppargc1a
cctgacgtcactcca

SEQ ID NO: 37831 - DNA, 15 bp, Artificial Sequence
  dgRNA
  Olfr213
taaacagggcatcca

SEQ ID NO: 37832 - DNA, 15 bp, Artificial Sequence
  dgRNA
  Olfr213
tcagacttggtaaac

SEQ ID NO: 37833 - DNA, 15 bp, Artificial Sequence
  dgRNA
  Olfr213
acctgtaaatgacat

SEQ ID NO: 37834 - DNA, 15 bp, Artificial Sequence
  dgRNA
  Fmnl1
tgcagcccgcccccc

SEQ ID NO: 37835 - DNA, 15 bp, Artificial Sequence
  dgRNA
  Fmnl1
gcagcccgcccccct

SEQ ID NO: 37836 - DNA, 15 bp, Artificial Sequence
  dgRNA
  Fmnl1
cagcccgcccccctg

SEQ ID NO: 37837 - DNA, 15 bp, Artificial Sequence
  dgRNA
  Fmnl1
cgcccccctggggcc

SEQ ID NO: 37838 - DNA, 15 bp, Artificial Sequence
  dgRNA
  Arpc3
tattaaccacttgcg

SEQ ID NO: 37839 - DNA, 15 bp, Artificial Sequence
  dgRNA
  Arpc3
attaaccacttgcga

SEQ ID NO: 37840 - DNA, 15 bp, Artificial Sequence
  dgRNA
  Arpc3
tttatgcatgcgcca

SEQ ID NO: 37841 - DNA, 15 bp, Artificial Sequence
  dgRNA
  Arpc3
cgctgacgcgccccc

SEQ ID NO: 37842 - DNA, 15 bp, Artificial Sequence
  dgRNA
  Grk6
aaatcggcgacgcaa

SEQ ID NO: 37843 - DNA, 15 bp, Artificial Sequence
  dgRNA
  Grk6
aatcggcgacgcaac

SEQ ID NO: 37844 - DNA, 15 bp, Artificial Sequence
  dgRNA
  Grk6
atcggcgacgcaacg

SEQ ID NO: 37845 - DNA, 15 bp, Artificial Sequence
  dgRNA
  Grk6
cagggagcgagttcc

SEQ ID NO: 37846 - DNA, 15 bp, Artificial Sequence
  dgRNA
  Zfp729b
tgttgctgccacgtg

SEQ ID NO: 37847 - DNA, 15 bp, Artificial Sequence
  dgRNA
  Zfp729b
ccacgtgcggcagcc

SEQ ID NO: 37848 - DNA, 15 bp, Artificial Sequence
  dgRNA
  Zfp729b
tgcacaagacctctt

SEQ ID NO: 37849 - DNA, 15 bp, Artificial Sequence
  dgRNA
  Zfp729b
gcacaagacctcttg

SEQ ID NO: 37850 - DNA, 15 bp, Artificial Sequence
  dgRNA
  Smu1
cgttcgcgaaaccga

SEQ ID NO: 37851 - DNA, 15 bp, Artificial Sequence
  dgRNA
  Smu1
gttcgcgaaaccgat

SEQ ID NO: 37852 - DNA, 15 bp, Artificial Sequence
  dgRNA
  Smu1
tgccacgctttcgcg

SEQ ID NO: 37853 - DNA, 15 bp, Artificial Sequence
  dgRNA
  Smu1
acgccccgcccacct

SEQ ID NO: 37854 - DNA, 15 bp, Artificial Sequence
  dgRNA
  Mrps31
cggtctgcatcttta

SEQ ID NO: 37855 - DNA, 15 bp, Artificial Sequence
  dgRNA
  Mrps31
gtctccgtttcctac

SEQ ID NO: 37856 - DNA, 15 bp, Artificial Sequence
  dgRNA
  Mrps31
cttccgtgagtgacg

SEQ ID NO: 37857 - DNA, 15 bp, Artificial Sequence
  dgRNA
  Mrps31
ccttccgtgagtgac

SEQ ID NO: 37858 - DNA, 15 bp, Artificial Sequence
  dgRNA
  Ces2a
gtacaaattcctgct

SEQ ID NO: 37859 - DNA, 15 bp, Artificial Sequence
  dgRNA
  Ces2a
cggcctggtccaagc

SEQ ID NO: 37860 - DNA, 15 bp, Artificial Sequence
  dgRNA
  Ces2a
aaaaacagatcggcc

SEQ ID NO: 37861 - DNA, 15 bp, Artificial Sequence
  dgRNA
  Rnf34
ttctgcctcgggccg

SEQ ID NO: 37862 - DNA, 15 bp, Artificial Sequence
  dgRNA
  Rnf34
tctgcctcgggccga

SEQ ID NO: 37863 - DNA, 15 bp, Artificial Sequence
  dgRNA
  Rnf34
ccaattcagcctgag

SEQ ID NO: 37864 - DNA, 15 bp, Artificial Sequence
  dgRNA
  Rnf34
ttctctccgacagac

SEQ ID NO: 37865 - DNA, 15 bp, Artificial Sequence
  dgRNA
  Nrxn3
tacttcatacagggc

SEQ ID NO: 37866 - DNA, 15 bp, Artificial Sequence
  dgRNA
  Nrxn3
ggaggtacttcatac

SEQ ID NO: 37867 - DNA, 15 bp, Artificial Sequence
  dgRNA
  Nrxn3
gagtactgatacccc

SEQ ID NO: 37868 - DNA, 15 bp, Artificial Sequence
  dgRNA
  Nrxn3
accaactattaactc

SEQ ID NO: 37869 - DNA, 15 bp, Artificial Sequence
  dgRNA
  Oxr1
gggcgcgcaggtgtg

SEQ ID NO: 37870 - DNA, 15 bp, Artificial Sequence
  dgRNA
  Oxr1
ggcgcgcaggtgtgc

SEQ ID NO: 37871 - DNA, 15 bp, Artificial Sequence
  dgRNA
  Oxr1
gcgcgcaggtgtgcg

SEQ ID NO: 37872 - DNA, 15 bp, Artificial Sequence
  dgRNA
  Oxr1
cgcgcaggtgtgcgg

SEQ ID NO: 37873 - DNA, 15 bp, Artificial Sequence
  dgRNA
  Lrrc75b
gatccacttgcttgc

SEQ ID NO: 37874 - DNA, 15 bp, Artificial Sequence
  dgRNA
  Lrrc75b
ggcgattcctgaaac

SEQ ID NO: 37875 - DNA, 15 bp, Artificial Sequence
  dgRNA
  Lrrc75b
gcgattcctgaaaca

SEQ ID NO: 37876 - DNA, 15 bp, Artificial Sequence
  dgRNA
  Lrrc75b
cctgaaacagggtgc

SEQ ID NO: 37877 - DNA, 15 bp, Artificial Sequence
  dgRNA
  Tpbpb
aacattagtacttat

SEQ ID NO: 37878 - DNA, 15 bp, Artificial Sequence
  dgRNA
  Tpbpb
acaccattgggcccc

SEQ ID NO: 37879 - DNA, 15 bp, Artificial Sequence
  dgRNA
  Tpbpb
gttgatgacaccatt

SEQ ID NO: 37880 - DNA, 15 bp, Artificial Sequence
  dgRNA
  Tspan31
aactaagggcaagac

SEQ ID NO: 37881 - DNA, 15 bp, Artificial Sequence
  dgRNA
  Tspan31
actaagggcaagact

SEQ ID NO: 37882 - DNA, 15 bp, Artificial Sequence
  dgRNA
  Tspan31
gtaatgcagattgat

SEQ ID NO: 37883 - DNA, 15 bp, Artificial Sequence
  dgRNA
  Tspan31
gcaggcgcagagaat

SEQ ID NO: 37884 - DNA, 15 bp, Artificial Sequence
  dgRNA
  Arf2
gtggtaccgtcgcct

SEQ ID NO: 37885 - DNA, 15 bp, Artificial Sequence
  dgRNA
  Arf2
ccgtcgcctaggtcg

SEQ ID NO: 37886 - DNA, 15 bp, Artificial Sequence
  dgRNA
  Arf2
cgtcgcctaggtcgc

SEQ ID NO: 37887 - DNA, 15 bp, Artificial Sequence
  dgRNA
  Arf2
gtcgcctaggtcgcg

SEQ ID NO: 37888 - DNA, 15 bp, Artificial Sequence
  dgRNA
  Epb42
ccttaagaaccaagg

SEQ ID NO: 37889 - DNA, 15 bp, Artificial Sequence
  dgRNA
  Epb42
catctccaaagagcg

SEQ ID NO: 37890 - DNA, 15 bp, Artificial Sequence
  dgRNA
  Epb42
atctccaaagagcgt

SEQ ID NO: 37891 - DNA, 15 bp, Artificial Sequence
  dgRNA
  Epb42
aaagagcgtgggccc

SEQ ID NO: 37892 - DNA, 15 bp, Artificial Sequence
  dgRNA
  Gpr142
catatgagcaacttt

SEQ ID NO: 37893 - DNA, 15 bp, Artificial Sequence
  dgRNA
  Gpr142
tgatcaggggtgaac

SEQ ID NO: 37894 - DNA, 15 bp, Artificial Sequence
  dgRNA
  Gpr142
ggaagggcgtgatca

SEQ ID NO: 37895 - DNA, 15 bp, Artificial Sequence
  dgRNA
  Gpr142
gggaagggcgtgatc

SEQ ID NO: 37896 - DNA, 15 bp, Artificial Sequence
  dgRNA
  Sort1
ggtgtggcgcagcgc

SEQ ID NO: 37897 - DNA, 15 bp, Artificial Sequence
  dgRNA
  Sort1
gtggcgcagcgccgg

SEQ ID NO: 37898 - DNA, 15 bp, Artificial Sequence
  dgRNA
  Sort1
tggcgcagcgccggc

SEQ ID NO: 37899 - DNA, 15 bp, Artificial Sequence
  dgRNA
  Sort1
ggcgcagcgccggcg

SEQ ID NO: 37900 - DNA, 15 bp, Artificial Sequence
  dgRNA
  Syne1
tgagcgggtgctcag

SEQ ID NO: 37901 - DNA, 15 bp, Artificial Sequence
  dgRNA
  Syne1
tggggcgacctccgc

SEQ ID NO: 37902 - DNA, 15 bp, Artificial Sequence
  dgRNA
  Syne1
ggcgacctccgctgg

SEQ ID NO: 37903 - DNA, 15 bp, Artificial Sequence
  dgRNA
  Syne1
acctccgctggcggc

SEQ ID NO: 37904 - DNA, 15 bp, Artificial Sequence
  dgRNA
  Sarm1
ccgcccctctaggcc

SEQ ID NO: 37905 - DNA, 15 bp, Artificial Sequence
  dgRNA
  Sarm1
tcagcgacttaggaa

SEQ ID NO: 37906 - DNA, 15 bp, Artificial Sequence
  dgRNA
  Sarm1
ctcagcgacttagga

SEQ ID NO: 37907 - DNA, 15 bp, Artificial Sequence
  dgRNA
  Sarm1
gggactcagcgactt

SEQ ID NO: 37908 - DNA, 15 bp, Artificial Sequence
  dgRNA
  Mcee
atgtaacgaaaaaga

SEQ ID NO: 37909 - DNA, 15 bp, Artificial Sequence
  dgRNA
  Mcee
tcgtgaccccgcccc

SEQ ID NO: 37910 - DNA, 15 bp, Artificial Sequence
  dgRNA
  Mcee
cacgcgacaccactg

SEQ ID NO: 37911 - DNA, 15 bp, Artificial Sequence
  dgRNA
  Mcee
cggcgggacgagcgg

SEQ ID NO: 37912 - DNA, 15 bp, Artificial Sequence
  dgRNA
  Gm1661
tgctgtaatccagct

SEQ ID NO: 37913 - DNA, 15 bp, Artificial Sequence
  dgRNA
  Gm1661
aatccagctcggccg

SEQ ID NO: 37914 - DNA, 15 bp, Artificial Sequence
  dgRNA
  Gm1661
gctcggccgaggcca

SEQ ID NO: 37915 - DNA, 15 bp, Artificial Sequence
  dgRNA
  Gm1661
gcgggtcttcagcac

SEQ ID NO: 37916 - DNA, 15 bp, Artificial Sequence
  dgRNA
  Col4a3bp
cagaatgcagcgcag

SEQ ID NO: 37917 - DNA, 15 bp, Artificial Sequence
  dgRNA
  Col4a3bp
ctacccgtcgtcacc

SEQ ID NO: 37918 - DNA, 15 bp, Artificial Sequence
  dgRNA
  Col4a3bp
tacccgtcgtcaccc

SEQ ID NO: 37919 - DNA, 15 bp, Artificial Sequence
  dgRNA
  Col4a3bp
ccgtcgtcacccggg

SEQ ID NO: 37920 - DNA, 15 bp, Artificial Sequence
  dgRNA
  Rhot2
gctgtatgccgagcc

SEQ ID NO: 37921 - DNA, 15 bp, Artificial Sequence
  dgRNA
  Rhot2
tatgccgagccagga

SEQ ID NO: 37922 - DNA, 15 bp, Artificial Sequence
  dgRNA
  Rhot2
ccgagccaggatggc

SEQ ID NO: 37923 - DNA, 15 bp, Artificial Sequence
  dgRNA
  Rhot2
cgagccaggatggct

SEQ ID NO: 37924 - DNA, 15 bp, Artificial Sequence
  dgRNA
  Zfp459
catcctgactccccg

SEQ ID NO: 37925 - DNA, 15 bp, Artificial Sequence
  dgRNA
  Zfp459
ccccgtggttgtcat

SEQ ID NO: 37926 - DNA, 15 bp, Artificial Sequence
  dgRNA
  Zfp459
tccacactctactgc

SEQ ID NO: 37927 - DNA, 15 bp, Artificial Sequence
  dgRNA
  Zfp459
agaagttgccctacc

SEQ ID NO: 37928 - DNA, 15 bp, Artificial Sequence
  dgRNA
  Coro6
accagcctccaactt

SEQ ID NO: 37929 - DNA, 15 bp, Artificial Sequence
  dgRNA
  Coro6
ccttccacagctcgc

SEQ ID NO: 37930 - DNA, 15 bp, Artificial Sequence
  dgRNA
  Coro6
cagctcgcaggatta

SEQ ID NO: 37931 - DNA, 15 bp, Artificial Sequence
  dgRNA
  Coro6
gtgagtaggattatc

SEQ ID NO: 37932 - DNA, 15 bp, Artificial Sequence
  dgRNA
  Gbp2b
tttttgctaatgctc

SEQ ID NO: 37933 - DNA, 15 bp, Artificial Sequence
  dgRNA
  Gbp2b
gaccgccccagaaat

SEQ ID NO: 37934 - DNA, 15 bp, Artificial Sequence
  dgRNA
  Gbp2b
cgccccagaaattgg

SEQ ID NO: 37935 - DNA, 15 bp, Artificial Sequence
  dgRNA
  Gbp2b
ggacaataaaacacc

SEQ ID NO: 37936 - DNA, 15 bp, Artificial Sequence
  dgRNA
  Uqcrh
gtagatcaacacatt

SEQ ID NO: 37937 - DNA, 15 bp, Artificial Sequence
  dgRNA
  Uqcrh
gtgttcgggactacg

SEQ ID NO: 37938 - DNA, 15 bp, Artificial Sequence
  dgRNA
  Uqcrh
agtatgccgcacttc

SEQ ID NO: 37939 - DNA, 15 bp, Artificial Sequence
  dgRNA
  Uqcrh
gctacgagacgtagg

SEQ ID NO: 37940 - DNA, 15 bp, Artificial Sequence
  dgRNA
  Phlpp1
ttcatgaggcgagct

SEQ ID NO: 37941 - DNA, 15 bp, Artificial Sequence
  dgRNA
  Phlpp1
tcatgaggcgagctc

SEQ ID NO: 37942 - DNA, 15 bp, Artificial Sequence
  dgRNA
  Phlpp1
cgggccgcagctccc

SEQ ID NO: 37943 - DNA, 15 bp, Artificial Sequence
  dgRNA
  Phlpp1
tgtccagcagcgggc

SEQ ID NO: 37944 - DNA, 15 bp, Artificial Sequence
  dgRNA
  Tacr2
gcacagtggacttat

SEQ ID NO: 37945 - DNA, 15 bp, Artificial Sequence
  dgRNA
  Tacr2
tgcacatctctcatc

SEQ ID NO: 37946 - DNA, 15 bp, Artificial Sequence
  dgRNA
  Tacr2
tcttaaggctactca

SEQ ID NO: 37947 - DNA, 15 bp, Artificial Sequence
  dgRNA
  Tacr2
ctcttaaggctactc

SEQ ID NO: 37948 - DNA, 15 bp, Artificial Sequence
  dgRNA
  Ppp2r1b
atgcaggggttccat

SEQ ID NO: 37949 - DNA, 15 bp, Artificial Sequence
  dgRNA
  Ppp2r1b
ggcccgcccttcttc

SEQ ID NO: 37950 - DNA, 15 bp, Artificial Sequence
  dgRNA
  Ppp2r1b
caatgggggtcaggc

SEQ ID NO: 37951 - DNA, 15 bp, Artificial Sequence
  dgRNA
  Ppp2r1b
ggagcctccacgcgc

SEQ ID NO: 37952 - DNA, 15 bp, Artificial Sequence
  dgRNA
  Scn1a
tggcactgtaacgtt

SEQ ID NO: 37953 - DNA, 15 bp, Artificial Sequence
  dgRNA
  Scn1a
aggtaccatagagtg

SEQ ID NO: 37954 - DNA, 15 bp, Artificial Sequence
  dgRNA
  Scn1a
ccatagagtgaggcg

SEQ ID NO: 37955 - DNA, 15 bp, Artificial Sequence
  dgRNA
  Scn1a
tcaaccgcttccttc

SEQ ID NO: 37956 - DNA, 15 bp, Artificial Sequence
  dgRNA
  Prr15
aacggaacgcgagca

SEQ ID NO: 37957 - DNA, 15 bp, Artificial Sequence
  dgRNA
  Prr15
ggaacgcgagcaggg

SEQ ID NO: 37958 - DNA, 15 bp, Artificial Sequence
  dgRNA
  Prr15
ccaatcagagtccgc

SEQ ID NO: 37959 - DNA, 15 bp, Artificial Sequence
  dgRNA
  Prr15
caatcagagtccgca

SEQ ID NO: 37960 - DNA, 15 bp, Artificial Sequence
  dgRNA
  Ghrl
cccacccttgaaaga

SEQ ID NO: 37961 - DNA, 15 bp, Artificial Sequence
  dgRNA
  Ghrl
ctaaggcacataaca

SEQ ID NO: 37962 - DNA, 15 bp, Artificial Sequence
  dgRNA
  Ghrl
accatctttcaaggg

SEQ ID NO: 37963 - DNA, 15 bp, Artificial Sequence
  dgRNA
  Ghrl
ctgctggacgaagca

SEQ ID NO: 37964 - DNA, 15 bp, Artificial Sequence
  dgRNA
  Olfr1080
ccgatttctaacatt

SEQ ID NO: 37965 - DNA, 15 bp, Artificial Sequence
  dgRNA
  Olfr1080
gaaatcggggaacag

SEQ ID NO: 37966 - DNA, 15 bp, Artificial Sequence
  dgRNA
  Olfr1080
caatgttagaaatcg

SEQ ID NO: 37967 - DNA, 15 bp, Artificial Sequence
  dgRNA
  Olfr1080
cccaatgttagaaat

SEQ ID NO: 37968 - DNA, 15 bp, Artificial Sequence
  dgRNA
  Hcfc2
tccaagtggacctaa

SEQ ID NO: 37969 - DNA, 15 bp, Artificial Sequence
  dgRNA
  Hcfc2
cttggcggagccccg

SEQ ID NO: 37970 - DNA, 15 bp, Artificial Sequence
  dgRNA
  Hcfc2
ttggcggagccccga

SEQ ID NO: 37971 - DNA, 15 bp, Artificial Sequence
  dgRNA
  Hcfc2
aggagcgtcacgccc

SEQ ID NO: 37972 - DNA, 15 bp, Artificial Sequence
  dgRNA
  Tulp4
tactcagtgacccgc

SEQ ID NO: 37973 - DNA, 15 bp, Artificial Sequence
  dgRNA
  Tulp4
gtagtttcctcagtt

SEQ ID NO: 37974 - DNA, 15 bp, Artificial Sequence
  dgRNA
  Zmynd8
ggattctagcagtcg

SEQ ID NO: 37975 - DNA, 15 bp, Artificial Sequence
  dgRNA
  Zmynd8
tagcagtcggggcag

SEQ ID NO: 37976 - DNA, 15 bp, Artificial Sequence
  dgRNA
  Zmynd8
agcagtcggggcaga

SEQ ID NO: 37977 - DNA, 15 bp, Artificial Sequence
  dgRNA
  Olfr1009
taaggttcgtctcta

SEQ ID NO: 37978 - DNA, 15 bp, Artificial Sequence
  dgRNA
  Lats2
ggcgtttagggaaac

SEQ ID NO: 37979 - DNA, 15 bp, Artificial Sequence
  dgRNA
  Lats2
ggaaaccggcgctcc

SEQ ID NO: 37980 - DNA, 15 bp, Artificial Sequence
  dgRNA
  Lats2
gaaaccggcgctccc

SEQ ID NO: 37981 - DNA, 15 bp, Artificial Sequence
  dgRNA
  Lats2
cggcgctcccgggct

SEQ ID NO: 37982 - DNA, 15 bp, Artificial Sequence
  dgRNA
  Tpd52
cgcggagaggcgcgg

SEQ ID NO: 37983 - DNA, 15 bp, Artificial Sequence
  dgRNA
  Tpd52
cggcaggccgagcgc

SEQ ID NO: 37984 - DNA, 15 bp, Artificial Sequence
  dgRNA
  Tpd52
tccgcgctccgcccg

SEQ ID NO: 37985 - DNA, 15 bp, Artificial Sequence
  dgRNA
  Ddx27
aacaaaatggtagtc

SEQ ID NO: 37986 - DNA, 15 bp, Artificial Sequence
  dgRNA
  Crls1
tcttgacgtaacaga

SEQ ID NO: 37987 - DNA, 15 bp, Artificial Sequence
  dgRNA
  Crls1
gataacttcccaagc

SEQ ID NO: 37988 - DNA, 15 bp, Artificial Sequence
  dgRNA
  Crls1
acatcttcaattgtt

SEQ ID NO: 37989 - DNA, 15 bp, Artificial Sequence
  dgRNA
  Crls1
ggaagttatcttacc

SEQ ID NO: 37990 - DNA, 15 bp, Artificial Sequence
  dgRNA
  Snx29
ctttttcttggctcg

SEQ ID NO: 37991 - DNA, 15 bp, Artificial Sequence
  dgRNA
  Snx29
tcttggctcggggat

SEQ ID NO: 37992 - DNA, 15 bp, Artificial Sequence
  dgRNA
  Snx29
cttggctcggggatt

SEQ ID NO: 37993 - DNA, 15 bp, Artificial Sequence
  dgRNA
  Snx29
ggcattgattttgtg

SEQ ID NO: 37994 - DNA, 15 bp, Artificial Sequence
  dgRNA
  Atxn7l2
gcgcagagagtgaac

SEQ ID NO: 37995 - DNA, 15 bp, Artificial Sequence
  dgRNA
  Atxn7l2
tgaactggcaaggta

SEQ ID NO: 37996 - DNA, 15 bp, Artificial Sequence
  dgRNA
  Atxn7l2
agggaggcgtgcccc

SEQ ID NO: 37997 - DNA, 15 bp, Artificial Sequence
  dgRNA
  Atxn7l2
aggcgtgcccccggt

SEQ ID NO: 37998 - DNA, 15 bp, Artificial Sequence
  dgRNA
  Rtkn
gctaatccagccgaa

SEQ ID NO: 37999 - DNA, 15 bp, Artificial Sequence
  dgRNA
  Rtkn
atccagccgaaagga

SEQ ID NO: 38000 - DNA, 15 bp, Artificial Sequence
  dgRNA
  Rtkn
actgtcgacccaaac

SEQ ID NO: 38001 - DNA, 15 bp, Artificial Sequence
  dgRNA
  Rtkn
cgacccaaactggct

SEQ ID NO: 38002 - DNA, 15 bp, Artificial Sequence
  dgRNA
  Ptgr1
aaatcctaccacctc

SEQ ID NO: 38003 - DNA, 15 bp, Artificial Sequence
  dgRNA
  Ptgr1
ggcggggcttctcca

SEQ ID NO: 38004 - DNA, 15 bp, Artificial Sequence
  dgRNA
  Atp13a4
aataaaacagcgacc

SEQ ID NO: 38005 - DNA, 15 bp, Artificial Sequence
  dgRNA
  Atp13a4
ataaaacagcgacct

SEQ ID NO: 38006 - DNA, 15 bp, Artificial Sequence
  dgRNA
  Atp13a4
agcccgcttctgcag

SEQ ID NO: 38007 - DNA, 15 bp, Artificial Sequence
  dgRNA
  Atp13a4
gcccgcttctgcaga

SEQ ID NO: 38008 - DNA, 15 bp, Artificial Sequence
  dgRNA
  Foxg1
ccgcgatctttttaa

SEQ ID NO: 38009 - DNA, 15 bp, Artificial Sequence
  dgRNA
  Foxg1
gattggaatttagtg

SEQ ID NO: 38010 - DNA, 15 bp, Artificial Sequence
  dgRNA
  Foxg1
tcgcggccagggcca

SEQ ID NO: 38011 - DNA, 15 bp, Artificial Sequence
  dgRNA
  Foxg1
atcgcggccagggcc

SEQ ID NO: 38012 - DNA, 15 bp, Artificial Sequence
  dgRNA
  Znhit3
gcctgatctaatcag

SEQ ID NO: 38013 - DNA, 15 bp, Artificial Sequence
  dgRNA
  Znhit3
gtatcgacactctac

SEQ ID NO: 38014 - DNA, 15 bp, Artificial Sequence
  dgRNA
  Znhit3
gactgccaatgagtg

SEQ ID NO: 38015 - DNA, 15 bp, Artificial Sequence
  dgRNA
  Znhit3
gcggagcgctgtgat

SEQ ID NO: 38016 - DNA, 15 bp, Artificial Sequence
  dgRNA
  Rfng
ccaccaggcccgctc

SEQ ID NO: 38017 - DNA, 15 bp, Artificial Sequence
  dgRNA
  Rfng
ccgctccggaccgaa

SEQ ID NO: 38018 - DNA, 15 bp, Artificial Sequence
  dgRNA
  Rfng
gaccgaacggccacg

SEQ ID NO: 38019 - DNA, 15 bp, Artificial Sequence
  dgRNA
  Rfng
ggcgacgttcgcttc

SEQ ID NO: 38020 - DNA, 15 bp, Artificial Sequence
  dgRNA
  Tmem245
ccctgtgggaccatt

SEQ ID NO: 38021 - DNA, 15 bp, Artificial Sequence
  dgRNA
  Tmem245
ggaccattgggccca

SEQ ID NO: 38022 - DNA, 15 bp, Artificial Sequence
  dgRNA
  Tmem245
tgggcccaagggcgg

SEQ ID NO: 38023 - DNA, 15 bp, Artificial Sequence
  dgRNA
  Tmem245
gctccaccgcacgct

SEQ ID NO: 38024 - DNA, 15 bp, Artificial Sequence
  dgRNA
  Ica1
cctttacacaaaccg

SEQ ID NO: 38025 - DNA, 15 bp, Artificial Sequence
  dgRNA
  Ica1
gtgacgcgaacgcta

SEQ ID NO: 38026 - DNA, 15 bp, Artificial Sequence
  dgRNA
  Ica1
aacgctatggacacg

SEQ ID NO: 38027 - DNA, 15 bp, Artificial Sequence
  dgRNA
  Ica1
cgtggaacacctgct

SEQ ID NO: 38028 - DNA, 15 bp, Artificial Sequence
  dgRNA
  Plekhg1
taaagtcggtaagcc

SEQ ID NO: 38029 - DNA, 15 bp, Artificial Sequence
  dgRNA
  Plekhg1
tatataagtcagtgc

SEQ ID NO: 38030 - DNA, 15 bp, Artificial Sequence
  dgRNA
  Plekhg1
caggacaagacgaac

SEQ ID NO: 38031 - DNA, 15 bp, Artificial Sequence
  dgRNA
  Plekhg1
aaaggctctgcggtc

SEQ ID NO: 38032 - DNA, 15 bp, Artificial Sequence
  dgRNA
  Naa15
gcacacggcactggc

SEQ ID NO: 38033 - DNA, 15 bp, Artificial Sequence
  dgRNA
  Naa15
cggcactggcaggac

SEQ ID NO: 38034 - DNA, 15 bp, Artificial Sequence
  dgRNA
  Naa15
aatccgcggctccgc

SEQ ID NO: 38035 - DNA, 15 bp, Artificial Sequence
  dgRNA
  Naa15
ctccgcaggccggcc

SEQ ID NO: 38036 - DNA, 15 bp, Artificial Sequence
  dgRNA
  Rnf8
ccccagccaccatat

SEQ ID NO: 38037 - DNA, 15 bp, Artificial Sequence
  dgRNA
  Rnf8
cgctcgtccttcttc

SEQ ID NO: 38038 - DNA, 15 bp, Artificial Sequence
  dgRNA
  Rnf8
acctatatggtggct

SEQ ID NO: 38039 - DNA, 15 bp, Artificial Sequence
  dgRNA
  Rnf8
gcttcacctatatgg

SEQ ID NO: 38040 - DNA, 15 bp, Artificial Sequence
  dgRNA
  Dpp3
ctcgcggtccttgca

SEQ ID NO: 38041 - DNA, 15 bp, Artificial Sequence
  dgRNA
  Dpp3
cggtccttgcaaggc

SEQ ID NO: 38042 - DNA, 15 bp, Artificial Sequence
  dgRNA
  Dpp3
accacccgtagcgct

SEQ ID NO: 38043 - DNA, 15 bp, Artificial Sequence
  dgRNA
  Dpp3
ccacccgtagcgctt

SEQ ID NO: 38044 - DNA, 15 bp, Artificial Sequence
  dgRNA
  Chst13
gctttcattggccta

SEQ ID NO: 38045 - DNA, 15 bp, Artificial Sequence
  dgRNA
  Chst13
cccattaagtcagtc

SEQ ID NO: 38046 - DNA, 15 bp, Artificial Sequence
  dgRNA
  Chst13
cgtctatctctagcc

SEQ ID NO: 38047 - DNA, 15 bp, Artificial Sequence
  dgRNA
  Chst13
actggacgctgcttc

SEQ ID NO: 38048 - DNA, 15 bp, Artificial Sequence
  dgRNA
  Ncapd2
ctggactgctttagg

SEQ ID NO: 38049 - DNA, 15 bp, Artificial Sequence
  dgRNA
  Ncapd2
gctttaggcggcccg

SEQ ID NO: 38050 - DNA, 15 bp, Artificial Sequence
  dgRNA
  Ncapd2
cccgcggagagacaa

SEQ ID NO: 38051 - DNA, 15 bp, Artificial Sequence
  dgRNA
  Ncapd2
ccgcggagagacaac

SEQ ID NO: 38052 - DNA, 15 bp, Artificial Sequence
  dgRNA
  Pdia2
cctagacctcccagt

SEQ ID NO: 38053 - DNA, 15 bp, Artificial Sequence
  dgRNA
  Pdia2
ctatctccgcccctg

SEQ ID NO: 38054 - DNA, 15 bp, Artificial Sequence
  dgRNA
  Pdia2
tatctccgcccctga

SEQ ID NO: 38055 - DNA, 15 bp, Artificial Sequence
  dgRNA
  Pdia2
atctccgcccctgag

SEQ ID NO: 38056 - DNA, 15 bp, Artificial Sequence
  dgRNA
  Sec63
cctggaatccgggaa

SEQ ID NO: 38057 - DNA, 15 bp, Artificial Sequence
  dgRNA
  Sec63
atccgggaagggtgc

SEQ ID NO: 38058 - DNA, 15 bp, Artificial Sequence
  dgRNA
  Sec63
tccgggaagggtgct

SEQ ID NO: 38059 - DNA, 15 bp, Artificial Sequence
  dgRNA
  Sec63
gaaagcctggtaagc

SEQ ID NO: 38060 - DNA, 15 bp, Artificial Sequence
  dgRNA
  Ggact
ttgcttgcatttcgg

SEQ ID NO: 38061 - DNA, 15 bp, Artificial Sequence
  dgRNA
  Ggact
catttcggaggaatg

SEQ ID NO: 38062 - DNA, 15 bp, Artificial Sequence
  dgRNA
  Ggact
gggttcttacctgcg

SEQ ID NO: 38063 - DNA, 15 bp, Artificial Sequence
  dgRNA
  Ggact
ttacctgcgcggttc

SEQ ID NO: 38064 - DNA, 15 bp, Artificial Sequence
  dgRNA
  Med7
tttcccgagagaagc

SEQ ID NO: 38065 - DNA, 15 bp, Artificial Sequence
  dgRNA
  Med7
gcaacatctttaggg

SEQ ID NO: 38066 - DNA, 15 bp, Artificial Sequence
  dgRNA
  Med7
caacatctttagggc

SEQ ID NO: 38067 - DNA, 15 bp, Artificial Sequence
  dgRNA
  Med7
ctttagggcgggagt

SEQ ID NO: 38068 - DNA, 15 bp, Artificial Sequence
  dgRNA
  Rerg
tctggaaattcacgc

SEQ ID NO: 38069 - DNA, 15 bp, Artificial Sequence
  dgRNA
  Rerg
aattcacgctggatg

SEQ ID NO: 38070 - DNA, 15 bp, Artificial Sequence
  dgRNA
  Rerg
gatgtggtgtgttaa

SEQ ID NO: 38071 - DNA, 15 bp, Artificial Sequence
  dgRNA
  Rerg
tctcagtgagttatc

SEQ ID NO: 38072 - DNA, 15 bp, Artificial Sequence
  dgRNA
  Gsk3b
gagatggcactttat

SEQ ID NO: 38073 - DNA, 15 bp, Artificial Sequence
  dgRNA
  Gsk3b
ctccccgcctcaaag

SEQ ID NO: 38074 - DNA, 15 bp, Artificial Sequence
  dgRNA
  Gsk3b
tccccgcctcaaaga

SEQ ID NO: 38075 - DNA, 15 bp, Artificial Sequence
  dgRNA
  Gsk3b
ccgcctcaaagaggg

SEQ ID NO: 38076 - DNA, 15 bp, Artificial Sequence
  dgRNA
  Pth1r
tgttgcccactgccg

SEQ ID NO: 38077 - DNA, 15 bp, Artificial Sequence
  dgRNA
  Pth1r
ctcccccactgggcg

SEQ ID NO: 38078 - DNA, 15 bp, Artificial Sequence
  dgRNA
  Pth1r
cgtggagcgaagcca

SEQ ID NO: 38079 - DNA, 15 bp, Artificial Sequence
  dgRNA
  Pth1r
ggggcgtgcaactag

SEQ ID NO: 38080 - DNA, 15 bp, Artificial Sequence
  dgRNA
  Svop
caaagatcacaacgc

SEQ ID NO: 38081 - DNA, 15 bp, Artificial Sequence
  dgRNA
  Svop
ccttcagtacccaac

SEQ ID NO: 38082 - DNA, 15 bp, Artificial Sequence
  dgRNA
  Svop
ctggtggcacctaat

SEQ ID NO: 38083 - DNA, 15 bp, Artificial Sequence
  dgRNA
  Svop
gtgcagtgtaatacg

SEQ ID NO: 38084 - DNA, 15 bp, Artificial Sequence
  dgRNA
  Pomk
tggccttcaccagtt

SEQ ID NO: 38085 - DNA, 15 bp, Artificial Sequence
  dgRNA
  Pomk
caccagtttggctag

SEQ ID NO: 38086 - DNA, 15 bp, Artificial Sequence
  dgRNA
  Pomk
tgaccgcgcctacgc

SEQ ID NO: 38087 - DNA, 15 bp, Artificial Sequence
  dgRNA
  Pomk
gcgcctacgctggcg

SEQ ID NO: 38088 - DNA, 15 bp, Artificial Sequence
  dgRNA
  Oprl1
tgcgcaggttggaga

SEQ ID NO: 38089 - DNA, 15 bp, Artificial Sequence
  dgRNA
  Oprl1
aggggctgcgcaggt

SEQ ID NO: 38090 - DNA, 15 bp, Artificial Sequence
  dgRNA
  Mfap3l
gggagcaccgcccag

SEQ ID NO: 38091 - DNA, 15 bp, Artificial Sequence
  dgRNA
  Mfap3l
cgcccagtggccgcc

SEQ ID NO: 38092 - DNA, 15 bp, Artificial Sequence
  dgRNA
  Mfap3l
cccggtcccgcccag

SEQ ID NO: 38093 - DNA, 15 bp, Artificial Sequence
  dgRNA
  Mfap3l
gtcccgcccagaggc

SEQ ID NO: 38094 - DNA, 15 bp, Artificial Sequence
  dgRNA
  Mettl14
tggcaggcggacaat

SEQ ID NO: 38095 - DNA, 15 bp, Artificial Sequence
  dgRNA
  Mettl14
cggacaattggttaa

SEQ ID NO: 38096 - DNA, 15 bp, Artificial Sequence
  dgRNA
  Mettl14
ggacaattggttaac

SEQ ID NO: 38097 - DNA, 15 bp, Artificial Sequence
  dgRNA
  Mettl14
cgagcctaacccttc

SEQ ID NO: 38098 - DNA, 15 bp, Artificial Sequence
  dgRNA
  Apela
caactccgtaagctc

SEQ ID NO: 38099 - DNA, 15 bp, Artificial Sequence
  dgRNA
  Apela
tccgtaagctctgga

SEQ ID NO: 38100 - DNA, 15 bp, Artificial Sequence
  dgRNA
  Apela
tactttcgtttagaa

SEQ ID NO: 38101 - DNA, 15 bp, Artificial Sequence
  dgRNA
  Apela
tgggtttgatttcga

SEQ ID NO: 38102 - DNA, 15 bp, Artificial Sequence
  dgRNA
  Klhdc2
gcaccctgaggcggg

SEQ ID NO: 38103 - DNA, 15 bp, Artificial Sequence
  dgRNA
  Klhdc2
cgggaggacggatgt

SEQ ID NO: 38104 - DNA, 15 bp, Artificial Sequence
  dgRNA
  Klhdc2
gggaggacggatgtt

SEQ ID NO: 38105 - DNA, 15 bp, Artificial Sequence
  dgRNA
  Klhdc2
aggacggatgttggg

SEQ ID NO: 38106 - DNA, 15 bp, Artificial Sequence
  dgRNA
  Nr2f2
acggtcctctcaccc

SEQ ID NO: 38107 - DNA, 15 bp, Artificial Sequence
  dgRNA
  Ism2
acccctgctcaccgg

SEQ ID NO: 38108 - DNA, 15 bp, Artificial Sequence
  dgRNA
  Ism2
ccgccgctcctcgcg

SEQ ID NO: 38109 - DNA, 15 bp, Artificial Sequence
  dgRNA
  Ism2
aggtccccgcgcgac

SEQ ID NO: 38110 - DNA, 15 bp, Artificial Sequence
  dgRNA
  Ism2
ccccgcgcgactgga

SEQ ID NO: 38111 - DNA, 15 bp, Artificial Sequence
  dgRNA
  Prrxl1
agcttggtgagggcg

SEQ ID NO: 38112 - DNA, 15 bp, Artificial Sequence
  dgRNA
  Prrxl1
cggttgtccagcagc

SEQ ID NO: 38113 - DNA, 15 bp, Artificial Sequence
  dgRNA
  Prrxl1
caggacctatgccga

SEQ ID NO: 38114 - DNA, 15 bp, Artificial Sequence
  dgRNA
  Prrxl1
ccgaaggctgaccgt

SEQ ID NO: 38115 - DNA, 15 bp, Artificial Sequence
  dgRNA
  Mrps34
tgccgacctccctag

SEQ ID NO: 38116 - DNA, 15 bp, Artificial Sequence
  dgRNA
  Mrps34
gccgacctccctagc

SEQ ID NO: 38117 - DNA, 15 bp, Artificial Sequence
  dgRNA
  Mrps34
ccgacctccctagcg

SEQ ID NO: 38118 - DNA, 15 bp, Artificial Sequence
  dgRNA
  Mrps34
cttcaccgtctgagt

SEQ ID NO: 38119 - DNA, 15 bp, Artificial Sequence
  dgRNA
  Ccdc71l
cacccaatggttgac

SEQ ID NO: 38120 - DNA, 15 bp, Artificial Sequence
  dgRNA
  Ccdc71l
gttgactggccttcc

SEQ ID NO: 38121 - DNA, 15 bp, Artificial Sequence
  dgRNA
  Ccdc71l
ccatgttccacgaac

SEQ ID NO: 38122 - DNA, 15 bp, Artificial Sequence
  dgRNA
  Ccdc71l
tcggagagcacccaa

SEQ ID NO: 38123 - DNA, 15 bp, Artificial Sequence
  dgRNA
  Mvd
attccactccctgag

SEQ ID NO: 38124 - DNA, 15 bp, Artificial Sequence
  dgRNA
  Mvd
cagccacgagcttgc

SEQ ID NO: 38125 - DNA, 15 bp, Artificial Sequence
  dgRNA
  Mvd
cgagcttgcaggcac

SEQ ID NO: 38126 - DNA, 15 bp, Artificial Sequence
  dgRNA
  Mvd
ttcgatcctgtccat

SEQ ID NO: 38127 - DNA, 15 bp, Artificial Sequence
  dgRNA
  Pde10a
cacccttttagtaga

SEQ ID NO: 38128 - DNA, 15 bp, Artificial Sequence
  dgRNA
  Pde10a
tcctgctaaggtggg

SEQ ID NO: 38129 - DNA, 15 bp, Artificial Sequence
  dgRNA
  Pde10a
gtctcctgctaaggt

SEQ ID NO: 38130 - DNA, 15 bp, Artificial Sequence
  dgRNA
  Pde10a
agaggtctcctgcta

SEQ ID NO: 38131 - DNA, 15 bp, Artificial Sequence
  dgRNA
  Ppp1r3e
taacccttcttatat

SEQ ID NO: 38132 - DNA, 15 bp, Artificial Sequence
  dgRNA
  Ppp1r3e
taggagtaactcatc

SEQ ID NO: 38133 - DNA, 15 bp, Artificial Sequence
  dgRNA
  Ppp1r3e
aggagtaactcatct

SEQ ID NO: 38134 - DNA, 15 bp, Artificial Sequence
  dgRNA
  Ppp1r3e
agcagtcacgccccc

SEQ ID NO: 38135 - DNA, 15 bp, Artificial Sequence
  dgRNA
  Ncor2
ccaggagcggagccg

SEQ ID NO: 38136 - DNA, 15 bp, Artificial Sequence
  dgRNA
  Ncor2
caggagcggagccgc

SEQ ID NO: 38137 - DNA, 15 bp, Artificial Sequence
  dgRNA
  Ncor2
agccgcgggcagcgc

SEQ ID NO: 38138 - DNA, 15 bp, Artificial Sequence
  dgRNA
  Ncor2
cggctccgctcctgg

SEQ ID NO: 38139 - DNA, 15 bp, Artificial Sequence
  dgRNA
  Rps6ka4
ctgcacggctctcac

SEQ ID NO: 38140 - DNA, 15 bp, Artificial Sequence
  dgRNA
  Rps6ka4
actggtcccggggcc

SEQ ID NO: 38141 - DNA, 15 bp, Artificial Sequence
  dgRNA
  Rps6ka4
ccagccgcctgactc

SEQ ID NO: 38142 - DNA, 15 bp, Artificial Sequence
  dgRNA
  Rps6ka4
ctgactcaggccgca

SEQ ID NO: 38143 - DNA, 15 bp, Artificial Sequence
  dgRNA
  Ednrb
aagcttagctaaaat

SEQ ID NO: 38144 - DNA, 15 bp, Artificial Sequence
  dgRNA
  Ednrb
agcttagctaaaatt

SEQ ID NO: 38145 - DNA, 15 bp, Artificial Sequence
  dgRNA
  Ednrb
cgagtgttctttcat

SEQ ID NO: 38146 - DNA, 15 bp, Artificial Sequence
  dgRNA
  Ednrb
ctcctccccaccgac

SEQ ID NO: 38147 - DNA, 15 bp, Artificial Sequence
  dgRNA
  Tmem91
gtgccttattctaag

SEQ ID NO: 38148 - DNA, 15 bp, Artificial Sequence
  dgRNA
  Mbd3
gttaagcacagaacg

SEQ ID NO: 38149 - DNA, 15 bp, Artificial Sequence
  dgRNA
  Mbd3
gttctgagcgctgat

SEQ ID NO: 38150 - DNA, 15 bp, Artificial Sequence
  dgRNA
  Mbd3
tgggcgtctcccgca

SEQ ID NO: 38151 - DNA, 15 bp, Artificial Sequence
  dgRNA
  Mbd3
gcgtctcccgcaagg

SEQ ID NO: 38152 - DNA, 15 bp, Artificial Sequence
  dgRNA
  Cpa1
gcttgccaaccgcca

SEQ ID NO: 38153 - DNA, 15 bp, Artificial Sequence
  dgRNA
  Cpa1
gcggttggcaagcac

SEQ ID NO: 38154 - DNA, 15 bp, Artificial Sequence
  dgRNA
  Cpa1
gctatccatggcggt

SEQ ID NO: 38155 - DNA, 15 bp, Artificial Sequence
  dgRNA
  Cpa1
agtgtaaggattcat

SEQ ID NO: 38156 - DNA, 15 bp, Artificial Sequence
  dgRNA
  Csrnp1
tactactgtgttgat

SEQ ID NO: 38157 - DNA, 15 bp, Artificial Sequence
  dgRNA
  Csrnp1
accatgaacctgctc

SEQ ID NO: 38158 - DNA, 15 bp, Artificial Sequence
  dgRNA
  Csrnp1
gtagtgtctccagta

SEQ ID NO: 38159 - DNA, 15 bp, Artificial Sequence
  dgRNA
  Csrnp1
ggtagtgtctccagt

SEQ ID NO: 38160 - DNA, 15 bp, Artificial Sequence
  dgRNA
  Oas2
gctctaagtttaagc

SEQ ID NO: 38161 - DNA, 15 bp, Artificial Sequence
  dgRNA
  Oas2
ctctaagtttaagct

SEQ ID NO: 38162 - DNA, 15 bp, Artificial Sequence
  dgRNA
  Oas2
tctaagtttaagctg

SEQ ID NO: 38163 - DNA, 15 bp, Artificial Sequence
  dgRNA
  Oas2
ggcttggctgtgtta

SEQ ID NO: 38164 - DNA, 15 bp, Artificial Sequence
  dgRNA
  Trp73
ttagaagggtccgag

SEQ ID NO: 38165 - DNA, 15 bp, Artificial Sequence
  dgRNA
  Trp73
tagaagggtccgagt

SEQ ID NO: 38166 - DNA, 15 bp, Artificial Sequence
  dgRNA
  Trp73
ggtccaacacatctc

SEQ ID NO: 38167 - DNA, 15 bp, Artificial Sequence
  dgRNA
  Trp73
gtccaacacatctcc

SEQ ID NO: 38168 - DNA, 15 bp, Artificial Sequence
  dgRNA
  Fancf
agcgccaatgtgccc

SEQ ID NO: 38169 - DNA, 15 bp, Artificial Sequence
  dgRNA
  Fancf
gtgccccggaaacca

SEQ ID NO: 38170 - DNA, 15 bp, Artificial Sequence
  dgRNA
  Fancf
ggtgcgagactgaca

SEQ ID NO: 38171 - DNA, 15 bp, Artificial Sequence
  dgRNA
  Fancf
acggccgtcgtccaa

SEQ ID NO: 38172 - DNA, 15 bp, Artificial Sequence
  dgRNA
  Blm
cagaggccacggtat

SEQ ID NO: 38173 - DNA, 15 bp, Artificial Sequence
  dgRNA
  Blm
ttggttagatccttc

SEQ ID NO: 38174 - DNA, 15 bp, Artificial Sequence
  dgRNA
  Blm
gccgcgcagagcgtg

SEQ ID NO: 38175 - DNA, 15 bp, Artificial Sequence
  dgRNA
  Blm
gcagagcgtgcggcg

SEQ ID NO: 38176 - DNA, 15 bp, Artificial Sequence
  dgRNA
  Iqch
gagcgggttccgcgc

SEQ ID NO: 38177 - DNA, 15 bp, Artificial Sequence
  dgRNA
  Iqch
gcgctgcttccgcct

SEQ ID NO: 38178 - DNA, 15 bp, Artificial Sequence
  dgRNA
  Iqch
cgctgcttccgcctt

SEQ ID NO: 38179 - DNA, 15 bp, Artificial Sequence
  dgRNA
  Iqch
gccgtaccactgcag

SEQ ID NO: 38180 - DNA, 15 bp, Artificial Sequence
  dgRNA
  Vmn1r203
cgtctacaattgaag

SEQ ID NO: 38181 - DNA, 15 bp, Artificial Sequence
  dgRNA
  Vmn1r203
atactgttgcagatt

SEQ ID NO: 38182 - DNA, 15 bp, Artificial Sequence
  dgRNA
  Vmn1r203
tggagttagcaaaac

SEQ ID NO: 38183 - DNA, 15 bp, Artificial Sequence
  dgRNA
  Vmn1r203
ttgtagacgtgggtc

SEQ ID NO: 38184 - DNA, 15 bp, Artificial Sequence
  dgRNA
  Aox2
agcaggtttaagctt

SEQ ID NO: 38185 - DNA, 15 bp, Artificial Sequence
  dgRNA
  Aox2
ggctttttaagtcta

SEQ ID NO: 38186 - DNA, 15 bp, Artificial Sequence
  dgRNA
  Lrfn1
ccccccaccatggcg

SEQ ID NO: 38187 - DNA, 15 bp, Artificial Sequence
  dgRNA
  Lrfn1
ccatggcgcggcgcg

SEQ ID NO: 38188 - DNA, 15 bp, Artificial Sequence
  dgRNA
  Lrfn1
cgcggcgcgaggcgg

SEQ ID NO: 38189 - DNA, 15 bp, Artificial Sequence
  dgRNA
  Lrfn1
cgggctgggtgagcg

SEQ ID NO: 38190 - DNA, 15 bp, Artificial Sequence
  dgRNA
  Pdcd7
gtgttaaggtcgatt

SEQ ID NO: 38191 - DNA, 15 bp, Artificial Sequence
  dgRNA
  Pdcd7
ttaaggtcgatttgg

SEQ ID NO: 38192 - DNA, 15 bp, Artificial Sequence
  dgRNA
  Pdcd7
aataaaccctaacat

SEQ ID NO: 38193 - DNA, 15 bp, Artificial Sequence
  dgRNA
  Pdcd7
ccctaacatcggaga

SEQ ID NO: 38194 - DNA, 15 bp, Artificial Sequence
  dgRNA
  Catip
acaacctcttaagct

SEQ ID NO: 38195 - DNA, 15 bp, Artificial Sequence
  dgRNA
  Catip
caacctcttaagctt

SEQ ID NO: 38196 - DNA, 15 bp, Artificial Sequence
  dgRNA
  Catip
aagcttgacaaatct

SEQ ID NO: 38197 - DNA, 15 bp, Artificial Sequence
  dgRNA
  Catip
agcggttgaaagcag

SEQ ID NO: 38198 - DNA, 15 bp, Artificial Sequence
  dgRNA
  Serpinh1
tgcttttccacgtcc

SEQ ID NO: 38199 - DNA, 15 bp, Artificial Sequence
  dgRNA
  Serpinh1
ccacgtccaggaccg

SEQ ID NO: 38200 - DNA, 15 bp, Artificial Sequence
  dgRNA
  Serpinh1
tctagctggtgcggg

SEQ ID NO: 38201 - DNA, 15 bp, Artificial Sequence
  dgRNA
  Serpinh1
tcgagagtgaactga

SEQ ID NO: 38202 - DNA, 15 bp, Artificial Sequence
  dgRNA
  Saa1
gagttttcccaaggg

SEQ ID NO: 38203 - DNA, 15 bp, Artificial Sequence
  dgRNA
  Ido2
tgttgacttactact

SEQ ID NO: 38204 - DNA, 15 bp, Artificial Sequence
  dgRNA
  Ido2
ggttgaactccagga

SEQ ID NO: 38205 - DNA, 15 bp, Artificial Sequence
  dgRNA
  Ido2
gtgcttcagcggtag

SEQ ID NO: 38206 - DNA, 15 bp, Artificial Sequence
  dgRNA
  Esp8
gtggttgtgcttcac

SEQ ID NO: 38207 - DNA, 15 bp, Artificial Sequence
  dgRNA
  Esp8
ggcttgtaatgaatg

SEQ ID NO: 38208 - DNA, 15 bp, Artificial Sequence
  dgRNA
  Esp8
attgcgtggagggcg

SEQ ID NO: 38209 - DNA, 15 bp, Artificial Sequence
  dgRNA
  Esp8
cattgcgtggagggc

SEQ ID NO: 38210 - DNA, 15 bp, Artificial Sequence
  dgRNA
  1600012H06Rik
cacttccggtccctt

SEQ ID NO: 38211 - DNA, 15 bp, Artificial Sequence
  dgRNA
  1600012H06Rik
tccggtcccttaggc

SEQ ID NO: 38212 - DNA, 15 bp, Artificial Sequence
  dgRNA
  1600012H06Rik
cccttaggccggagt

SEQ ID NO: 38213 - DNA, 15 bp, Artificial Sequence
  dgRNA
  1600012H06Rik
aaaagccctcgcttc

SEQ ID NO: 38214 - DNA, 15 bp, Artificial Sequence
  dgRNA
  Birc3
taaggcggaactcac

SEQ ID NO: 38215 - DNA, 15 bp, Artificial Sequence
  dgRNA
  Birc3
gtaaatgacacgaag

SEQ ID NO: 38216 - DNA, 15 bp, Artificial Sequence
  dgRNA
  Birc3
acacgaagaggagct

SEQ ID NO: 38217 - DNA, 15 bp, Artificial Sequence
  dgRNA
  Birc3
gagttccgccttaag

SEQ ID NO: 38218 - DNA, 15 bp, Artificial Sequence
  dgRNA
  Slc22a17
ttttttaaaccgcaa

SEQ ID NO: 38219 - DNA, 15 bp, Artificial Sequence
  dgRNA
  Slc22a17
gcccatccttcaacg

SEQ ID NO: 38220 - DNA, 15 bp, Artificial Sequence
  dgRNA
  Slc22a17
ttcaacggggggcct

SEQ ID NO: 38221 - DNA, 15 bp, Artificial Sequence
  dgRNA
  Slc22a17
ctctgacgaacagtc

SEQ ID NO: 38222 - DNA, 15 bp, Artificial Sequence
  dgRNA
  Cetn2
ttgattggtctagct

SEQ ID NO: 38223 - DNA, 15 bp, Artificial Sequence
  dgRNA
  Cetn2
ggtctagcttggctc

SEQ ID NO: 38224 - DNA, 15 bp, Artificial Sequence
  dgRNA
  Cetn2
tgggcgagttttgcc

SEQ ID NO: 38225 - DNA, 15 bp, Artificial Sequence
  dgRNA
  Cetn2
gctgtgagcgtcaat

SEQ ID NO: 38226 - DNA, 15 bp, Artificial Sequence
  dgRNA
  Ocstamp
gtcacgggcactgct

SEQ ID NO: 38227 - DNA, 15 bp, Artificial Sequence
  dgRNA
  Ocstamp
ggagggtttgattga

SEQ ID NO: 38228 - DNA, 15 bp, Artificial Sequence
  dgRNA
  Ocstamp
gagggtttgattgaa

SEQ ID NO: 38229 - DNA, 15 bp, Artificial Sequence
  dgRNA
  Ocstamp
tgcccgtgaccctga

SEQ ID NO: 38230 - DNA, 15 bp, Artificial Sequence
  dgRNA
  Mlxip
tcgtctctctactcc

SEQ ID NO: 38231 - DNA, 15 bp, Artificial Sequence
  dgRNA
  Mlxip
cgtctctctactcca

SEQ ID NO: 38232 - DNA, 15 bp, Artificial Sequence
  dgRNA
  Mlxip
ccgggcgtggaggcg

SEQ ID NO: 38233 - DNA, 15 bp, Artificial Sequence
  dgRNA
  Mlxip
ttttttttgtccgcc

SEQ ID NO: 38234 - DNA, 15 bp, Artificial Sequence
  dgRNA
  Rrm1
tgcccacacccaata

SEQ ID NO: 38235 - DNA, 15 bp, Artificial Sequence
  dgRNA
  Rrm1
acccaatatggcggc

SEQ ID NO: 38236 - DNA, 15 bp, Artificial Sequence
  dgRNA
  Rrm1
gaactcgttcccgcc

SEQ ID NO: 38237 - DNA, 15 bp, Artificial Sequence
  dgRNA
  Rrm1
cgctttcacccaatg

SEQ ID NO: 38238 - DNA, 15 bp, Artificial Sequence
  dgRNA
  Ilvbl
gaacgtgccgcgaga

SEQ ID NO: 38239 - DNA, 15 bp, Artificial Sequence
  dgRNA
  Ilvbl
gcgagatggttctcg

SEQ ID NO: 38240 - DNA, 15 bp, Artificial Sequence
  dgRNA
  Ilvbl
cgagatggttctcgc

SEQ ID NO: 38241 - DNA, 15 bp, Artificial Sequence
  dgRNA
  Ilvbl
tggttctcgcgggtg

SEQ ID NO: 38242 - DNA, 15 bp, Artificial Sequence
  dgRNA
  Olfr127
atctatcatgctttc

SEQ ID NO: 38243 - DNA, 15 bp, Artificial Sequence
  dgRNA
  Kcnj8
tacactctctctatc

SEQ ID NO: 38244 - DNA, 15 bp, Artificial Sequence
  dgRNA
  Kcnj8
ttgcgtcagtgaact

SEQ ID NO: 38245 - DNA, 15 bp, Artificial Sequence
  dgRNA
  Kcnj8
tgcgtcagtgaactt

SEQ ID NO: 38246 - DNA, 15 bp, Artificial Sequence
  dgRNA
  Kcnj8
atgtgtgtgccggtc

SEQ ID NO: 38247 - DNA, 15 bp, Artificial Sequence
  dgRNA
  Pigw
ccagcccaggccgat

SEQ ID NO: 38248 - DNA, 15 bp, Artificial Sequence
  dgRNA
  Pigw
cccaggccgattgga

SEQ ID NO: 38249 - DNA, 15 bp, Artificial Sequence
  dgRNA
  Pigw
ccaggccgattggaa

SEQ ID NO: 38250 - DNA, 15 bp, Artificial Sequence
  dgRNA
  Pigw
ggccgattggaaggg

SEQ ID NO: 38251 - DNA, 15 bp, Artificial Sequence
  dgRNA
  Pkp3
ggacctagcgcatgc

SEQ ID NO: 38252 - DNA, 15 bp, Artificial Sequence
  dgRNA
  Pkp3
gacctagcgcatgca

SEQ ID NO: 38253 - DNA, 15 bp, Artificial Sequence
  dgRNA
  Pkp3
ctagcgcatgcaggg

SEQ ID NO: 38254 - DNA, 15 bp, Artificial Sequence
  dgRNA
  Pkp3
tagcgcatgcagggc

SEQ ID NO: 38255 - DNA, 15 bp, Artificial Sequence
  dgRNA
  Zbtb22
gtcctcagccgcaga

SEQ ID NO: 38256 - DNA, 15 bp, Artificial Sequence
  dgRNA
  Zbtb22
gccgcagacgggacc

SEQ ID NO: 38257 - DNA, 15 bp, Artificial Sequence
  dgRNA
  Zbtb22
gacctggtaccttta

SEQ ID NO: 38258 - DNA, 15 bp, Artificial Sequence
  dgRNA
  Zbtb22
ctggtacctttaagg

SEQ ID NO: 38259 - DNA, 15 bp, Artificial Sequence
  dgRNA
  Nfkbil1
tcttccgcttgcagg

SEQ ID NO: 38260 - DNA, 15 bp, Artificial Sequence
  dgRNA
  Nfkbil1
gtcttatttcccctc

SEQ ID NO: 38261 - DNA, 15 bp, Artificial Sequence
  dgRNA
  Nfkbil1
cccagtccgagcgtt

SEQ ID NO: 38262 - DNA, 15 bp, Artificial Sequence
  dgRNA
  Nfkbil1
gttcggtacgatttc

SEQ ID NO: 38263 - DNA, 15 bp, Artificial Sequence
  dgRNA
  Maml1
cacgccctcgggcag

SEQ ID NO: 38264 - DNA, 15 bp, Artificial Sequence
  dgRNA
  Maml1
acgccctcgggcagc

SEQ ID NO: 38265 - DNA, 15 bp, Artificial Sequence
  dgRNA
  Maml1
cgggtttcctttgat

SEQ ID NO: 38266 - DNA, 15 bp, Artificial Sequence
  dgRNA
  Maml1
tgacgcagagttcgc

SEQ ID NO: 38267 - DNA, 15 bp, Artificial Sequence
  dgRNA
  Ap1s2
cggttggcgccccct

SEQ ID NO: 38268 - DNA, 15 bp, Artificial Sequence
  dgRNA
  Ap1s2
gccccctcggcagct

SEQ ID NO: 38269 - DNA, 15 bp, Artificial Sequence
  dgRNA
  Ap1s2
cggcagcttggcgcg

SEQ ID NO: 38270 - DNA, 15 bp, Artificial Sequence
  dgRNA
  Ap1s2
ttggcgcgcggtctc

SEQ ID NO: 38271 - DNA, 15 bp, Artificial Sequence
  dgRNA
  Cd5l
cacccacattttttc

SEQ ID NO: 38272 - DNA, 15 bp, Artificial Sequence
  dgRNA
  Cd5l
gatcctgaaaaaatg

SEQ ID NO: 38273 - DNA, 15 bp, Artificial Sequence
  dgRNA
  P2rx2
caatttcggtttgca

SEQ ID NO: 38274 - DNA, 15 bp, Artificial Sequence
  dgRNA
  P2rx2
aatttcggtttgcaa

SEQ ID NO: 38275 - DNA, 15 bp, Artificial Sequence
  dgRNA
  P2rx2
atttcggtttgcaag

SEQ ID NO: 38276 - DNA, 15 bp, Artificial Sequence
  dgRNA
  P2rx2
accgaaattgtttgc

SEQ ID NO: 38277 - DNA, 15 bp, Artificial Sequence
  dgRNA
  Gm44
tattcagttgagtaa

SEQ ID NO: 38278 - DNA, 15 bp, Artificial Sequence
  dgRNA
  Gm44
gatctaggaacatag

SEQ ID NO: 38279 - DNA, 15 bp, Artificial Sequence
  dgRNA
  Gm44
aactttaccaggagg

SEQ ID NO: 38280 - DNA, 15 bp, Artificial Sequence
  dgRNA
  Gm44
atgagcaactttacc

SEQ ID NO: 38281 - DNA, 15 bp, Artificial Sequence
  dgRNA
  Npas1
tgaagatggcgatcg

SEQ ID NO: 38282 - DNA, 15 bp, Artificial Sequence
  dgRNA
  Npas1
agatggcgatcgtgg

SEQ ID NO: 38283 - DNA, 15 bp, Artificial Sequence
  dgRNA
  Npas1
gatggcgatcgtggt

SEQ ID NO: 38284 - DNA, 15 bp, Artificial Sequence
  dgRNA
  Npas1
tcgtggtgggactcc

SEQ ID NO: 38285 - DNA, 15 bp, Artificial Sequence
  dgRNA
  Serpinb9d
tcgaacaaggaatca

SEQ ID NO: 38286 - DNA, 15 bp, Artificial Sequence
  dgRNA
  Serpinb9d
gttctctgtcgaaca

SEQ ID NO: 38287 - DNA, 15 bp, Artificial Sequence
  dgRNA
  Serpinb9d
atacttcagccctgg

SEQ ID NO: 38288 - DNA, 15 bp, Artificial Sequence
  dgRNA
  Serpinb9d
tagaggggggtggcc

SEQ ID NO: 38289 - DNA, 15 bp, Artificial Sequence
  dgRNA
  Slc1a2
caaatggtcccgatg

SEQ ID NO: 38290 - DNA, 15 bp, Artificial Sequence
  dgRNA
  Slc1a2
aacacctagcaacct

SEQ ID NO: 38291 - DNA, 15 bp, Artificial Sequence
  dgRNA
  Slc1a2
acacctagcaacctt

SEQ ID NO: 38292 - DNA, 15 bp, Artificial Sequence
  dgRNA
  Slc1a2
cacctagcaaccttg

SEQ ID NO: 38293 - DNA, 15 bp, Artificial Sequence
  dgRNA
  D17H6S53E
gtgagcagccgaacc

SEQ ID NO: 38294 - DNA, 15 bp, Artificial Sequence
  dgRNA
  D17H6S53E
tgagcagccgaaccc

SEQ ID NO: 38295 - DNA, 15 bp, Artificial Sequence
  dgRNA
  D17H6S53E
cccgggttcgtgctc

SEQ ID NO: 38296 - DNA, 15 bp, Artificial Sequence
  dgRNA
  D17H6S53E
ccgggttcgtgctca

SEQ ID NO: 38297 - DNA, 15 bp, Artificial Sequence
  dgRNA
  Krt78
acgtacccattcccc

SEQ ID NO: 38298 - DNA, 15 bp, Artificial Sequence
  dgRNA
  Krt78
gtcagccgcagcaag

SEQ ID NO: 38299 - DNA, 15 bp, Artificial Sequence
  dgRNA
  Krt78
gcccaaggacgggag

SEQ ID NO: 38300 - DNA, 15 bp, Artificial Sequence
  dgRNA
  Krt78
taaaagtctcgtgcc

SEQ ID NO: 38301 - DNA, 15 bp, Artificial Sequence
  dgRNA
  Tmed3
cgtccgggatttctc

SEQ ID NO: 38302 - DNA, 15 bp, Artificial Sequence
  dgRNA
  Tmed3
atttctccggagacg

SEQ ID NO: 38303 - DNA, 15 bp, Artificial Sequence
  dgRNA
  Tmed3
cggtttccgagttga

SEQ ID NO: 38304 - DNA, 15 bp, Artificial Sequence
  dgRNA
  Tmed3
gatgcgcttgcgcag

SEQ ID NO: 38305 - DNA, 15 bp, Artificial Sequence
  dgRNA
  Smpd5
ctcggatttctttta

SEQ ID NO: 38306 - DNA, 15 bp, Artificial Sequence
  dgRNA
  Smpd5
tcggatttcttttac

SEQ ID NO: 38307 - DNA, 15 bp, Artificial Sequence
  dgRNA
  Smpd5
agcactcaggctcgc

SEQ ID NO: 38308 - DNA, 15 bp, Artificial Sequence
  dgRNA
  Smpd5
ggctcgcgggacgtc

SEQ ID NO: 38309 - DNA, 15 bp, Artificial Sequence
  dgRNA
  Slc30a3
tctcacaatttggcg

SEQ ID NO: 38310 - DNA, 15 bp, Artificial Sequence
  dgRNA
  Slc30a3
ctcacaatttggcgc

SEQ ID NO: 38311 - DNA, 15 bp, Artificial Sequence
  dgRNA
  Slc30a3
tcacaatttggcgcg

SEQ ID NO: 38312 - DNA, 15 bp, Artificial Sequence
  dgRNA
  Slc30a3
cacaatttggcgcgg

SEQ ID NO: 38313 - DNA, 15 bp, Artificial Sequence
  dgRNA
  Timm10
acactgcaaacgctc

SEQ ID NO: 38314 - DNA, 15 bp, Artificial Sequence
  dgRNA
  Timm10
cgctcaggcgtctcc

SEQ ID NO: 38315 - DNA, 15 bp, Artificial Sequence
  dgRNA
  Timm10
cgtctcccggacaac

SEQ ID NO: 38316 - DNA, 15 bp, Artificial Sequence
  dgRNA
  Timm10
ctcccggacaaccgg

SEQ ID NO: 38317 - DNA, 15 bp, Artificial Sequence
  dgRNA
  Hopx
ttgccctgcgctccc

SEQ ID NO: 38318 - DNA, 15 bp, Artificial Sequence
  dgRNA
  Hopx
ctgcgctccctggca

SEQ ID NO: 38319 - DNA, 15 bp, Artificial Sequence
  dgRNA
  Hopx
ccacgtgctagcccg

SEQ ID NO: 38320 - DNA, 15 bp, Artificial Sequence
  dgRNA
  Hopx
cgtgctagcccgcgg

SEQ ID NO: 38321 - DNA, 15 bp, Artificial Sequence
  dgRNA
  Aldh8a1
agaaccatccgagtt

SEQ ID NO: 38322 - DNA, 15 bp, Artificial Sequence
  dgRNA
  Aldh8a1
tccgagtttggaatc

SEQ ID NO: 38323 - DNA, 15 bp, Artificial Sequence
  dgRNA
  Aldh8a1
gttctgaagcgcagc

SEQ ID NO: 38324 - DNA, 15 bp, Artificial Sequence
  dgRNA
  Aldh8a1
tcggatatgcaaatg

SEQ ID NO: 38325 - DNA, 15 bp, Artificial Sequence
  dgRNA
  Gm6034
catgacgtgggagaa

SEQ ID NO: 38326 - DNA, 15 bp, Artificial Sequence
  dgRNA
  Gm6034
aggaagtcatgacgt

SEQ ID NO: 38327 - DNA, 15 bp, Artificial Sequence
  dgRNA
  BC048502
agtctggttgcatgt

SEQ ID NO: 38328 - DNA, 15 bp, Artificial Sequence
  dgRNA
  BC048502
cagtctggttgcatg

SEQ ID NO: 38329 - DNA, 15 bp, Artificial Sequence
  dgRNA
  Ccdc93
aaaaagtaccttagg

SEQ ID NO: 38330 - DNA, 15 bp, Artificial Sequence
  dgRNA
  Ccdc93
acctcctctgagggg

SEQ ID NO: 38331 - DNA, 15 bp, Artificial Sequence
  dgRNA
  Ccdc93
ggaggatcggttact

SEQ ID NO: 38332 - DNA, 15 bp, Artificial Sequence
  dgRNA
  Ccdc93
gaggatcggttactc

SEQ ID NO: 38333 - DNA, 15 bp, Artificial Sequence
  dgRNA
  Card9
agagcacttttgggt

SEQ ID NO: 38334 - DNA, 15 bp, Artificial Sequence
  dgRNA
  Card9
gagcacttttgggta

SEQ ID NO: 38335 - DNA, 15 bp, Artificial Sequence
  dgRNA
  Card9
ctcttagaccccaac

SEQ ID NO: 38336 - DNA, 15 bp, Artificial Sequence
  dgRNA
  Card9
gccgggcagctgctt

SEQ ID NO: 38337 - DNA, 15 bp, Artificial Sequence
  dgRNA
  Tmem86a
tggctatccaacctt

SEQ ID NO: 38338 - DNA, 15 bp, Artificial Sequence
  dgRNA
  Tmem86a
ggctatccaaccttg

SEQ ID NO: 38339 - DNA, 15 bp, Artificial Sequence
  dgRNA
  Tmem86a
gctatccaaccttgg

SEQ ID NO: 38340 - DNA, 15 bp, Artificial Sequence
  dgRNA
  Tmem86a
gtcgccgtcacgttc

SEQ ID NO: 38341 - DNA, 15 bp, Artificial Sequence
  dgRNA
  Jrk
cagcatcgtctaaat

SEQ ID NO: 38342 - DNA, 15 bp, Artificial Sequence
  dgRNA
  Jrk
ggtcctggcaaccgg

SEQ ID NO: 38343 - DNA, 15 bp, Artificial Sequence
  dgRNA
  Jrk
gtcctggcaaccggc

SEQ ID NO: 38344 - DNA, 15 bp, Artificial Sequence
  dgRNA
  Jrk
gcaaccggcgggcct

SEQ ID NO: 38345 - DNA, 15 bp, Artificial Sequence
  dgRNA
  Izumo1
gctagggcaggttac

SEQ ID NO: 38346 - DNA, 15 bp, Artificial Sequence
  dgRNA
  Izumo1
ggctttcgttcaggt

SEQ ID NO: 38347 - DNA, 15 bp, Artificial Sequence
  dgRNA
  Izumo1
cgttcaggtcggtgc

SEQ ID NO: 38348 - DNA, 15 bp, Artificial Sequence
  dgRNA
  Izumo1
gttcaggtcggtgct

SEQ ID NO: 38349 - DNA, 15 bp, Artificial Sequence
  dgRNA
  Zfp207
cagctctcaccgcgg

SEQ ID NO: 38350 - DNA, 15 bp, Artificial Sequence
  dgRNA
  Zfp207
caccgcggtggctga

SEQ ID NO: 38351 - DNA, 15 bp, Artificial Sequence
  dgRNA
  Zfp207
accgcggtggctgat

SEQ ID NO: 38352 - DNA, 15 bp, Artificial Sequence
  dgRNA
  Zfp207
gcggtggctgatggg

SEQ ID NO: 38353 - DNA, 15 bp, Artificial Sequence
  dgRNA
  Enam
cactaactcttgtga

SEQ ID NO: 38354 - DNA, 15 bp, Artificial Sequence
  dgRNA
  Enam
catcacaagagttag

SEQ ID NO: 38355 - DNA, 15 bp, Artificial Sequence
  dgRNA
  Enam
aggaggcttgatagc

SEQ ID NO: 38356 - DNA, 15 bp, Artificial Sequence
  dgRNA
  Tas2r131
atatcaacctaatgg

SEQ ID NO: 38357 - DNA, 15 bp, Artificial Sequence
  dgRNA
  Olfr1184
attgattaccttcta

SEQ ID NO: 38358 - DNA, 15 bp, Artificial Sequence
  dgRNA
  Olfr1184
ctaacaaaccataga

SEQ ID NO: 38359 - DNA, 15 bp, Artificial Sequence
  dgRNA
  Cetn1
gtattaactgccagt

SEQ ID NO: 38360 - DNA, 15 bp, Artificial Sequence
  dgRNA
  Cetn1
actgccagtaggcgc

SEQ ID NO: 38361 - DNA, 15 bp, Artificial Sequence
  dgRNA
  Cetn1
taggcgcaggcgcat

SEQ ID NO: 38362 - DNA, 15 bp, Artificial Sequence
  dgRNA
  Cetn1
aggcgcaggcgcata

SEQ ID NO: 38363 - DNA, 15 bp, Artificial Sequence
  dgRNA
  Nrde2
gttcagtgaagccgg

SEQ ID NO: 38364 - DNA, 15 bp, Artificial Sequence
  dgRNA
  Nrde2
ttcagtgaagccgga

SEQ ID NO: 38365 - DNA, 15 bp, Artificial Sequence
  dgRNA
  Nrde2
agggcactaactaca

SEQ ID NO: 38366 - DNA, 15 bp, Artificial Sequence
  dgRNA
  Nrde2
cgcaccgccttgccc

SEQ ID NO: 38367 - DNA, 15 bp, Artificial Sequence
  dgRNA
  Usp16
ttactgtctccgctg

SEQ ID NO: 38368 - DNA, 15 bp, Artificial Sequence
  dgRNA
  Usp16
ctgaggtccgcttaa

SEQ ID NO: 38369 - DNA, 15 bp, Artificial Sequence
  dgRNA
  Usp16
tgaggtccgcttaac

SEQ ID NO: 38370 - DNA, 15 bp, Artificial Sequence
  dgRNA
  Usp16
gcaactcaaatcttc

SEQ ID NO: 38371 - DNA, 15 bp, Artificial Sequence
  dgRNA
  Olfr1364
tgacgttttttccca

SEQ ID NO: 38372 - DNA, 15 bp, Artificial Sequence
  dgRNA
  Olfr1364
cgtcaaattcgtgag

SEQ ID NO: 38373 - DNA, 15 bp, Artificial Sequence
  dgRNA
  Trib3
taaagtactacaata

SEQ ID NO: 38374 - DNA, 15 bp, Artificial Sequence
  dgRNA
  Trib3
tacaatacggagagt

SEQ ID NO: 38375 - DNA, 15 bp, Artificial Sequence
  dgRNA
  Trib3
aatacggagagtcgg

SEQ ID NO: 38376 - DNA, 15 bp, Artificial Sequence
  dgRNA
  Trib3
tgctacttcaggagc

SEQ ID NO: 38377 - DNA, 15 bp, Artificial Sequence
  dgRNA
  Snx17
aggctcctcccgccg

SEQ ID NO: 38378 - DNA, 15 bp, Artificial Sequence
  dgRNA
  Snx17
cactacagcgccacc

SEQ ID NO: 38379 - DNA, 15 bp, Artificial Sequence
  dgRNA
  Snx17
actacagcgccacct

SEQ ID NO: 38380 - DNA, 15 bp, Artificial Sequence
  dgRNA
  Snx17
cgccacctgggctgc

SEQ ID NO: 38381 - DNA, 15 bp, Artificial Sequence
  dgRNA
  Slc2a9
gctttggcatgcccc

SEQ ID NO: 38382 - DNA, 15 bp, Artificial Sequence
  dgRNA
  Slc2a9
cccatgtttccgtgt

SEQ ID NO: 38383 - DNA, 15 bp, Artificial Sequence
  dgRNA
  Slc2a9
ccatgtttccgtgtt

SEQ ID NO: 38384 - DNA, 15 bp, Artificial Sequence
  dgRNA
  Slc2a9
cttatgcaagcagac

SEQ ID NO: 38385 - DNA, 15 bp, Artificial Sequence
  dgRNA
  Htr1b
aggagctagcagacg

SEQ ID NO: 38386 - DNA, 15 bp, Artificial Sequence
  dgRNA
  Htr1b
cgcggcagcagcgcc

SEQ ID NO: 38387 - DNA, 15 bp, Artificial Sequence
  dgRNA
  Htr1b
cagcgcctggcgcac

SEQ ID NO: 38388 - DNA, 15 bp, Artificial Sequence
  dgRNA
  Htr1b
gcgcactggaagtgc

SEQ ID NO: 38389 - DNA, 15 bp, Artificial Sequence
  dgRNA
  Kcnj10
gcaccctagtccgtc

SEQ ID NO: 38390 - DNA, 15 bp, Artificial Sequence
  dgRNA
  Kcnj10
caccctagtccgtct

SEQ ID NO: 38391 - DNA, 15 bp, Artificial Sequence
  dgRNA
  Kcnj10
ccccaggcgctgatc

SEQ ID NO: 38392 - DNA, 15 bp, Artificial Sequence
  dgRNA
  Kcnj10
gctccgatctgccat

SEQ ID NO: 38393 - DNA, 15 bp, Artificial Sequence
  dgRNA
  Ly6e
ccaaaaccggatgcc

SEQ ID NO: 38394 - DNA, 15 bp, Artificial Sequence
  dgRNA
  Ly6e
caaaaccggatgcct

SEQ ID NO: 38395 - DNA, 15 bp, Artificial Sequence
  dgRNA
  Ly6e
ttcatactcaaggag

SEQ ID NO: 38396 - DNA, 15 bp, Artificial Sequence
  dgRNA
  Ly6e
caaggagcggagtgt

SEQ ID NO: 38397 - DNA, 15 bp, Artificial Sequence
  dgRNA
  Bin3
caaagtgttaacgcg

SEQ ID NO: 38398 - DNA, 15 bp, Artificial Sequence
  dgRNA
  Bin3
aaagtgttaacgcgt

SEQ ID NO: 38399 - DNA, 15 bp, Artificial Sequence
  dgRNA
  Bin3
cctcttccgggcata

SEQ ID NO: 38400 - DNA, 15 bp, Artificial Sequence
  dgRNA
  Bin3
ctcttccgggcataa

SEQ ID NO: 38401 - DNA, 15 bp, Artificial Sequence
  dgRNA
  Bag6
gttaagtcgtgttgc

SEQ ID NO: 38402 - DNA, 15 bp, Artificial Sequence
  dgRNA
  Bag6
gttgctggaataccg

SEQ ID NO: 38403 - DNA, 15 bp, Artificial Sequence
  dgRNA
  Bag6
tggaataccgaggag

SEQ ID NO: 38404 - DNA, 15 bp, Artificial Sequence
  dgRNA
  Bag6
aataccgaggagagg

SEQ ID NO: 38405 - DNA, 15 bp, Artificial Sequence
  dgRNA
  Ubxn2a
tctccgcgcctccta

SEQ ID NO: 38406 - DNA, 15 bp, Artificial Sequence
  dgRNA
  Ubxn2a
ttagtgcgcgccttg

SEQ ID NO: 38407 - DNA, 15 bp, Artificial Sequence
  dgRNA
  Ubxn2a
gccttgcggcagcct

SEQ ID NO: 38408 - DNA, 15 bp, Artificial Sequence
  dgRNA
  Ubxn2a
ttcctcacggccgcg

SEQ ID NO: 38409 - DNA, 15 bp, Artificial Sequence
  dgRNA
  Ablim2
tgtgcgccgagccgc

SEQ ID NO: 38410 - DNA, 15 bp, Artificial Sequence
  dgRNA
  Ablim2
tgcccgcccggtcct

SEQ ID NO: 38411 - DNA, 15 bp, Artificial Sequence
  dgRNA
  Ablim2
cgggctgtcgcagcg

SEQ ID NO: 38412 - DNA, 15 bp, Artificial Sequence
  dgRNA
  Ablim2
gggctgtcgcagcgc

SEQ ID NO: 38413 - DNA, 15 bp, Artificial Sequence
  dgRNA
  1110025L11Rik
tcacattaaggactc

SEQ ID NO: 38414 - DNA, 15 bp, Artificial Sequence
  dgRNA
  1110025L11Rik
cattaaggactcagg

SEQ ID NO: 38415 - DNA, 15 bp, Artificial Sequence
  dgRNA
  1110025L11Rik
ggtgggactaaccac

SEQ ID NO: 38416 - DNA, 15 bp, Artificial Sequence
  dgRNA
  Sh3bgrl2
agcttgtcccgcttc

SEQ ID NO: 38417 - DNA, 15 bp, Artificial Sequence
  dgRNA
  Sh3bgrl2
gcttgtcccgcttcc

SEQ ID NO: 38418 - DNA, 15 bp, Artificial Sequence
  dgRNA
  Sh3bgrl2
taattcccgtgaagc

SEQ ID NO: 38419 - DNA, 15 bp, Artificial Sequence
  dgRNA
  Sh3bgrl2
ccgtgaagcaggcgc

SEQ ID NO: 38420 - DNA, 15 bp, Artificial Sequence
  dgRNA
  Cyp2e1
acctatgaattggtg

SEQ ID NO: 38421 - DNA, 15 bp, Artificial Sequence
  dgRNA
  Cyp2e1
aaccagaggattggc

SEQ ID NO: 38422 - DNA, 15 bp, Artificial Sequence
  dgRNA
  Cyp2e1
accagaggattggca

SEQ ID NO: 38423 - DNA, 15 bp, Artificial Sequence
  dgRNA
  Cyp2e1
aggcaatggctccaa

SEQ ID NO: 38424 - DNA, 15 bp, Artificial Sequence
  dgRNA
  Dmap1
ccgcatcgcctcgcg

SEQ ID NO: 38425 - DNA, 15 bp, Artificial Sequence
  dgRNA
  Dmap1
cctcgcgcggattcc

SEQ ID NO: 38426 - DNA, 15 bp, Artificial Sequence
  dgRNA
  Dmap1
ctcgcgcggattcct

SEQ ID NO: 38427 - DNA, 15 bp, Artificial Sequence
  dgRNA
  Dmap1
gcgactcagcctgcc

SEQ ID NO: 38428 - DNA, 15 bp, Artificial Sequence
  dgRNA
  Ramp3
aattctaggcaacgg

SEQ ID NO: 38429 - DNA, 15 bp, Artificial Sequence
  dgRNA
  Ramp3
attctaggcaacgga

SEQ ID NO: 38430 - DNA, 15 bp, Artificial Sequence
  dgRNA
  Ramp3
gcaacggagggagtc

SEQ ID NO: 38431 - DNA, 15 bp, Artificial Sequence
  dgRNA
  Ramp3
caacggagggagtca

SEQ ID NO: 38432 - DNA, 15 bp, Artificial Sequence
  dgRNA
  Olfr822
aagtttatagcttag

SEQ ID NO: 38433 - DNA, 15 bp, Artificial Sequence
  dgRNA
  Olfr822
aactgtactagtgat

SEQ ID NO: 38434 - DNA, 15 bp, Artificial Sequence
  dgRNA
  Prpf4
tcctcttctcccgcg

SEQ ID NO: 38435 - DNA, 15 bp, Artificial Sequence
  dgRNA
  Prpf4
actccagccgacctt

SEQ ID NO: 38436 - DNA, 15 bp, Artificial Sequence
  dgRNA
  Prpf4
tttctgatacgtttc

SEQ ID NO: 38437 - DNA, 15 bp, Artificial Sequence
  dgRNA
  Prpf4
acctcgcgggagaag

SEQ ID NO: 38438 - DNA, 15 bp, Artificial Sequence
  dgRNA
  Mtmr9
taccaacttccggtc

SEQ ID NO: 38439 - DNA, 15 bp, Artificial Sequence
  dgRNA
  Mtmr9
tccctctaattgtgc

SEQ ID NO: 38440 - DNA, 15 bp, Artificial Sequence
  dgRNA
  Mtmr9
tttatggtcctacaa

SEQ ID NO: 38441 - DNA, 15 bp, Artificial Sequence
  dgRNA
  Mtmr9
gtactttgctagatc

SEQ ID NO: 38442 - DNA, 15 bp, Artificial Sequence
  dgRNA
  Trim11
ttgtcaccgcaagag

SEQ ID NO: 38443 - DNA, 15 bp, Artificial Sequence
  dgRNA
  Trim11
agccccgatacacag

SEQ ID NO: 38444 - DNA, 15 bp, Artificial Sequence
  dgRNA
  Trim11
acaagtctccgcagg

SEQ ID NO: 38445 - DNA, 15 bp, Artificial Sequence
  dgRNA
  Trim11
gtgacaagtctccgc

SEQ ID NO: 38446 - DNA, 15 bp, Artificial Sequence
  dgRNA
  Zfyve27
aaacgagtcatctct

SEQ ID NO: 38447 - DNA, 15 bp, Artificial Sequence
  dgRNA
  Zfyve27
aacgagtcatctctt

SEQ ID NO: 38448 - DNA, 15 bp, Artificial Sequence
  dgRNA
  Zfyve27
gagggaagagtgcgc

SEQ ID NO: 38449 - DNA, 15 bp, Artificial Sequence
  dgRNA
  Zfyve27
ttgctcacctgcgct

SEQ ID NO: 38450 - DNA, 15 bp, Artificial Sequence
  dgRNA
  Asb15
atgcatactcataag

SEQ ID NO: 38451 - DNA, 15 bp, Artificial Sequence
  dgRNA
  Asb15
atccgttttctcttg

SEQ ID NO: 38452 - DNA, 15 bp, Artificial Sequence
  dgRNA
  Asb15
attcacacacgtgga

SEQ ID NO: 38453 - DNA, 15 bp, Artificial Sequence
  dgRNA
  Asb15
cattcacacacgtgg

SEQ ID NO: 38454 - DNA, 15 bp, Artificial Sequence
  dgRNA
  4931429I11Rik
cagcatcaccgatgc

SEQ ID NO: 38455 - DNA, 15 bp, Artificial Sequence
  dgRNA
  4931429I11Rik
agcatcaccgatgct

SEQ ID NO: 38456 - DNA, 15 bp, Artificial Sequence
  dgRNA
  4931429I11Rik
cctcctccgcagagt

SEQ ID NO: 38457 - DNA, 15 bp, Artificial Sequence
  dgRNA
  4931429I11Rik
ctcctccgcagagtt

SEQ ID NO: 38458 - DNA, 15 bp, Artificial Sequence
  dgRNA
  Clk3
tggctgcgcgacgcg

SEQ ID NO: 38459 - DNA, 15 bp, Artificial Sequence
  dgRNA
  Clk3
ggctgcgcgacgcgc

SEQ ID NO: 38460 - DNA, 15 bp, Artificial Sequence
  dgRNA
  Clk3
gctgcgcgacgcgcg

SEQ ID NO: 38461 - DNA, 15 bp, Artificial Sequence
  dgRNA
  Clk3
ctgcgcgacgcgcgg

SEQ ID NO: 38462 - DNA, 15 bp, Artificial Sequence
  dgRNA
  Hsd17b13
tttcatgtcgaaaca

SEQ ID NO: 38463 - DNA, 15 bp, Artificial Sequence
  dgRNA
  Hsd17b13
gcttttcagataacc

SEQ ID NO: 38464 - DNA, 15 bp, Artificial Sequence
  dgRNA
  Hsd17b13
gataaccaggtccaa

SEQ ID NO: 38465 - DNA, 15 bp, Artificial Sequence
  dgRNA
  Hsd17b13
agggcacatcccact

SEQ ID NO: 38466 - DNA, 15 bp, Artificial Sequence
  dgRNA
  Faap100
caggactgcattatt

SEQ ID NO: 38467 - DNA, 15 bp, Artificial Sequence
  dgRNA
  Faap100
tatttggctaccctc

SEQ ID NO: 38468 - DNA, 15 bp, Artificial Sequence
  dgRNA
  Faap100
ttgtgcctcccgttg

SEQ ID NO: 38469 - DNA, 15 bp, Artificial Sequence
  dgRNA
  Faap100
taagccacggtgttt

SEQ ID NO: 38470 - DNA, 15 bp, Artificial Sequence
  dgRNA
  Efemp1
gaatcagggtaccaa

SEQ ID NO: 38471 - DNA, 15 bp, Artificial Sequence
  dgRNA
  Efemp1
aatcagggtaccaag

SEQ ID NO: 38472 - DNA, 15 bp, Artificial Sequence
  dgRNA
  Efemp1
aggggcctaatgcag

SEQ ID NO: 38473 - DNA, 15 bp, Artificial Sequence
  dgRNA
  Efemp1
gaccccaacgccaaa

SEQ ID NO: 38474 - DNA, 15 bp, Artificial Sequence
  dgRNA
  Ager
gcttctagtacctga

SEQ ID NO: 38475 - DNA, 15 bp, Artificial Sequence
  dgRNA
  Ager
tctgacagaacgaga

SEQ ID NO: 38476 - DNA, 15 bp, Artificial Sequence
  dgRNA
  Ager
ctgacagaacgagat

SEQ ID NO: 38477 - DNA, 15 bp, Artificial Sequence
  dgRNA
  Ager
gtgcaagccccacct

SEQ ID NO: 38478 - DNA, 15 bp, Artificial Sequence
  dgRNA
  Tnfaip3
cattactgaaaacgt

SEQ ID NO: 38479 - DNA, 15 bp, Artificial Sequence
  dgRNA
  Tnfaip3
agcgtggtactgagg

SEQ ID NO: 38480 - DNA, 15 bp, Artificial Sequence
  dgRNA
  Tnfaip3
cggagcgtggtactg

SEQ ID NO: 38481 - DNA, 15 bp, Artificial Sequence
  dgRNA
  Cep83
cggtgctgatgacgt

SEQ ID NO: 38482 - DNA, 15 bp, Artificial Sequence
  dgRNA
  Cep83
gctgatgacgtagga

SEQ ID NO: 38483 - DNA, 15 bp, Artificial Sequence
  dgRNA
  Cep83
tgatgacgtaggacg

SEQ ID NO: 38484 - DNA, 15 bp, Artificial Sequence
  dgRNA
  Cep83
tgacgtaggacgggg

SEQ ID NO: 38485 - DNA, 15 bp, Artificial Sequence
  dgRNA
  Dct
catgtgctaacaaag

SEQ ID NO: 38486 - DNA, 15 bp, Artificial Sequence
  dgRNA
  Dct
taatccccttaatga

SEQ ID NO: 38487 - DNA, 15 bp, Artificial Sequence
  dgRNA
  Dct
ccccgtgccccacca

SEQ ID NO: 38488 - DNA, 15 bp, Artificial Sequence
  dgRNA
  Dct
aggcaacacggtgct

SEQ ID NO: 38489 - DNA, 15 bp, Artificial Sequence
  dgRNA
  Crmp1
acggtcctttgtagc

SEQ ID NO: 38490 - DNA, 15 bp, Artificial Sequence
  dgRNA
  Crmp1
cagtggcgctggtct

SEQ ID NO: 38491 - DNA, 15 bp, Artificial Sequence
  dgRNA
  Crmp1
ggtcttggtcaccgt

SEQ ID NO: 38492 - DNA, 15 bp, Artificial Sequence
  dgRNA
  Crmp1
tcgcgggccacgccc

SEQ ID NO: 38493 - DNA, 15 bp, Artificial Sequence
  dgRNA
  Nrip3
gctagctttttcctc

SEQ ID NO: 38494 - DNA, 15 bp, Artificial Sequence
  dgRNA
  Nrip3
gaacctgcgccagag

SEQ ID NO: 38495 - DNA, 15 bp, Artificial Sequence
  dgRNA
  Nrip3
cctgcgccagagggg

SEQ ID NO: 38496 - DNA, 15 bp, Artificial Sequence
  dgRNA
  Nrip3
ctgcgccagaggggc

SEQ ID NO: 38497 - DNA, 15 bp, Artificial Sequence
  dgRNA
  Olfr689
tatatcactacctta

SEQ ID NO: 38498 - DNA, 15 bp, Artificial Sequence
  dgRNA
  Olfr689
tcacccataatcttg

SEQ ID NO: 38499 - DNA, 15 bp, Artificial Sequence
  dgRNA
  Olfr689
ttaaggtagtgatat

SEQ ID NO: 38500 - DNA, 15 bp, Artificial Sequence
  dgRNA
  Olfr689
ttttatctagcctta

SEQ ID NO: 38501 - DNA, 15 bp, Artificial Sequence
  dgRNA
  Depdc5
ggcgggaaacgccaa

SEQ ID NO: 38502 - DNA, 15 bp, Artificial Sequence
  dgRNA
  Depdc5
gcgggaaacgccaac

SEQ ID NO: 38503 - DNA, 15 bp, Artificial Sequence
  dgRNA
  Depdc5
acgccaacgggaact

SEQ ID NO: 38504 - DNA, 15 bp, Artificial Sequence
  dgRNA
  Depdc5
aactcggtttgaagt

SEQ ID NO: 38505 - DNA, 15 bp, Artificial Sequence
  dgRNA
  Ric1
cctgtcgcctcatcc

SEQ ID NO: 38506 - DNA, 15 bp, Artificial Sequence
  dgRNA
  Ric1
ccagctccacgcgcc

SEQ ID NO: 38507 - DNA, 15 bp, Artificial Sequence
  dgRNA
  Ric1
ggtcgccagccagca

SEQ ID NO: 38508 - DNA, 15 bp, Artificial Sequence
  dgRNA
  Ric1
cgacgtcctgccccg

SEQ ID NO: 38509 - DNA, 15 bp, Artificial Sequence
  dgRNA
  Tas2r119
cttggtctagttgaa

SEQ ID NO: 38510 - DNA, 15 bp, Artificial Sequence
  dgRNA
  Slc17a8
gagagctcattcata

SEQ ID NO: 38511 - DNA, 15 bp, Artificial Sequence
  dgRNA
  Slc17a8
ctcattcataaggcc

SEQ ID NO: 38512 - DNA, 15 bp, Artificial Sequence
  dgRNA
  Slc17a8
ccgggctgcagaaag

SEQ ID NO: 38513 - DNA, 15 bp, Artificial Sequence
  dgRNA
  Slc17a8
ctatagcatcgcccc

SEQ ID NO: 38514 - DNA, 15 bp, Artificial Sequence
  dgRNA
  Pld4
cgatctgtcttgacg

SEQ ID NO: 38515 - DNA, 15 bp, Artificial Sequence
  dgRNA
  Pld4
gatctgtcttgacgt

SEQ ID NO: 38516 - DNA, 15 bp, Artificial Sequence
  dgRNA
  Pld4
atctgtcttgacgtg

SEQ ID NO: 38517 - DNA, 15 bp, Artificial Sequence
  dgRNA
  Pld4
tctgtcttgacgtgg

SEQ ID NO: 38518 - DNA, 15 bp, Artificial Sequence
  dgRNA
  Gpr108
aatctgtttagcgat

SEQ ID NO: 38519 - DNA, 15 bp, Artificial Sequence
  dgRNA
  Gpr108
agagtatgaaagccg

SEQ ID NO: 38520 - DNA, 15 bp, Artificial Sequence
  dgRNA
  Gpr108
ataagcacgcccatt

SEQ ID NO: 38521 - DNA, 15 bp, Artificial Sequence
  dgRNA
  Gpr108
taagcacgcccattt

SEQ ID NO: 38522 - DNA, 15 bp, Artificial Sequence
  dgRNA
  Lrrn2
ctcaaactacagcat

SEQ ID NO: 38523 - DNA, 15 bp, Artificial Sequence
  dgRNA
  Lrrn2
agcgcttgggggtca

SEQ ID NO: 38524 - DNA, 15 bp, Artificial Sequence
  dgRNA
  Lrrn2
tagcgcttgggggtc

SEQ ID NO: 38525 - DNA, 15 bp, Artificial Sequence
  dgRNA
  Lrrn2
gggcatagcgcttgg

SEQ ID NO: 38526 - DNA, 15 bp, Artificial Sequence
  dgRNA
  Piga
ccttccgcagctctt

SEQ ID NO: 38527 - DNA, 15 bp, Artificial Sequence
  dgRNA
  Piga
cccgcgctagagact

SEQ ID NO: 38528 - DNA, 15 bp, Artificial Sequence
  dgRNA
  Piga
ccgcgctagagactt

SEQ ID NO: 38529 - DNA, 15 bp, Artificial Sequence
  dgRNA
  Piga
agacttgggcccgac

SEQ ID NO: 38530 - DNA, 15 bp, Artificial Sequence
  dgRNA
  Rfk
aaaggcgacaattag

SEQ ID NO: 38531 - DNA, 15 bp, Artificial Sequence
  dgRNA
  Rfk
gcgacaattagaggc

SEQ ID NO: 38532 - DNA, 15 bp, Artificial Sequence
  dgRNA
  Rfk
cgacaattagaggct

SEQ ID NO: 38533 - DNA, 15 bp, Artificial Sequence
  dgRNA
  Rfk
ctatgggtgagggcg

SEQ ID NO: 38534 - DNA, 15 bp, Artificial Sequence
  dgRNA
  Ppp3cb
acgcgcgatgcatga

SEQ ID NO: 38535 - DNA, 15 bp, Artificial Sequence
  dgRNA
  Ppp3cb
gtccgccatgttccc

SEQ ID NO: 38536 - DNA, 15 bp, Artificial Sequence
  dgRNA
  Ppp3cb
cgccatgttccccgg

SEQ ID NO: 38537 - DNA, 15 bp, Artificial Sequence
  dgRNA
  Ppp3cb
acagtccaagggatc

SEQ ID NO: 38538 - DNA, 15 bp, Artificial Sequence
  dgRNA
  Rbm47
gtaaatcctccgcat

SEQ ID NO: 38539 - DNA, 15 bp, Artificial Sequence
  dgRNA
  Rbm47
taaatcctccgcatc

SEQ ID NO: 38540 - DNA, 15 bp, Artificial Sequence
  dgRNA
  Rbm47
aaatcctccgcatcg

SEQ ID NO: 38541 - DNA, 15 bp, Artificial Sequence
  dgRNA
  Rbm47
ttaaaccttcagcta

SEQ ID NO: 38542 - DNA, 15 bp, Artificial Sequence
  dgRNA
  Nfx1
caggacttgacaaaa

SEQ ID NO: 38543 - DNA, 15 bp, Artificial Sequence
  dgRNA
  Nfx1
agcaattacgcaagt

SEQ ID NO: 38544 - DNA, 15 bp, Artificial Sequence
  dgRNA
  Nfx1
gcaattacgcaagtt

SEQ ID NO: 38545 - DNA, 15 bp, Artificial Sequence
  dgRNA
  Nfx1
caattacgcaagttg

SEQ ID NO: 38546 - DNA, 15 bp, Artificial Sequence
  dgRNA
  Scn2b
agaggctaaattttc

SEQ ID NO: 38547 - DNA, 15 bp, Artificial Sequence
  dgRNA
  Casp3
gcctgcgctacgaga

SEQ ID NO: 38548 - DNA, 15 bp, Artificial Sequence
  dgRNA
  Casp3
cctgcgctacgagac

SEQ ID NO: 38549 - DNA, 15 bp, Artificial Sequence
  dgRNA
  Casp3
ctgcgctacgagacg

SEQ ID NO: 38550 - DNA, 15 bp, Artificial Sequence
  dgRNA
  Casp3
agacggggctcagtc

SEQ ID NO: 38551 - DNA, 15 bp, Artificial Sequence
  dgRNA
  Erlin2
aaaacccgcaagcct

SEQ ID NO: 38552 - DNA, 15 bp, Artificial Sequence
  dgRNA
  Erlin2
ctcgcgagcgtcccc

SEQ ID NO: 38553 - DNA, 15 bp, Artificial Sequence
  dgRNA
  Erlin2
caccgccgaacactg

SEQ ID NO: 38554 - DNA, 15 bp, Artificial Sequence
  dgRNA
  Erlin2
gcggctcgcagcgcg

SEQ ID NO: 38555 - DNA, 15 bp, Artificial Sequence
  dgRNA
  Pgpep1l
gagcgatttcagtgg

SEQ ID NO: 38556 - DNA, 15 bp, Artificial Sequence
  dgRNA
  Pgpep1l
agcgatttcagtggt

SEQ ID NO: 38557 - DNA, 15 bp, Artificial Sequence
  dgRNA
  Pgpep1l
gtaaccccacagtct

SEQ ID NO: 38558 - DNA, 15 bp, Artificial Sequence
  dgRNA
  Pgpep1l
acagttggttgctat

SEQ ID NO: 38559 - DNA, 15 bp, Artificial Sequence
  dgRNA
  Olfr1442
agcattaagaatcat

SEQ ID NO: 38560 - DNA, 15 bp, Artificial Sequence
  dgRNA
  Olfr1442
ctttgtaccactatc

SEQ ID NO: 38561 - DNA, 15 bp, Artificial Sequence
  dgRNA
  Psg26
tgacagacttatgcc

SEQ ID NO: 38562 - DNA, 15 bp, Artificial Sequence
  dgRNA
  Psg26
gaacaactcatccat

SEQ ID NO: 38563 - DNA, 15 bp, Artificial Sequence
  dgRNA
  Olfr63
acttgtaagctcacc

SEQ ID NO: 38564 - DNA, 15 bp, Artificial Sequence
  dgRNA
  Heatr3
cttacgtttgtacga

SEQ ID NO: 38565 - DNA, 15 bp, Artificial Sequence
  dgRNA
  Heatr3
acgatggaaatgaga

SEQ ID NO: 38566 - DNA, 15 bp, Artificial Sequence
  dgRNA
  Heatr3
cgatggaaatgagat

SEQ ID NO: 38567 - DNA, 15 bp, Artificial Sequence
  dgRNA
  Heatr3
attcaactgtacgaa

SEQ ID NO: 38568 - DNA, 15 bp, Artificial Sequence
  dgRNA
  Gsx1
aaaaaccctattgag

SEQ ID NO: 38569 - DNA, 15 bp, Artificial Sequence
  dgRNA
  Gsx1
ggccccggccgctcc

SEQ ID NO: 38570 - DNA, 15 bp, Artificial Sequence
  dgRNA
  Gsx1
gcgtagcccatcaca

SEQ ID NO: 38571 - DNA, 15 bp, Artificial Sequence
  dgRNA
  Gsx1
atagtcctatttaag

SEQ ID NO: 38572 - DNA, 15 bp, Artificial Sequence
  dgRNA
  H3f3b
gaacaccggccaatc

SEQ ID NO: 38573 - DNA, 15 bp, Artificial Sequence
  dgRNA
  H3f3b
aacggccccgaagta

SEQ ID NO: 38574 - DNA, 15 bp, Artificial Sequence
  dgRNA
  H3f3b
tacggcctttgtgtc

SEQ ID NO: 38575 - DNA, 15 bp, Artificial Sequence
  dgRNA
  H3f3b
gagatgtcagcgcgt

SEQ ID NO: 38576 - DNA, 15 bp, Artificial Sequence
  dgRNA
  Tmtc1
gcagttgggcgtacc

SEQ ID NO: 38577 - DNA, 15 bp, Artificial Sequence
  dgRNA
  Tmtc1
gttgggcgtacccgg

SEQ ID NO: 38578 - DNA, 15 bp, Artificial Sequence
  dgRNA
  Tmtc1
ttgggcgtacccggt

SEQ ID NO: 38579 - DNA, 15 bp, Artificial Sequence
  dgRNA
  Tmtc1
tacccggtgggaccc

SEQ ID NO: 38580 - DNA, 15 bp, Artificial Sequence
  dgRNA
  Gm13212
aaaaggtccctaagt

SEQ ID NO: 38581 - DNA, 15 bp, Artificial Sequence
  dgRNA
  Gm13212
aggtccctaagtagg

SEQ ID NO: 38582 - DNA, 15 bp, Artificial Sequence
  dgRNA
  Gm13212
ggtccctaagtaggt

SEQ ID NO: 38583 - DNA, 15 bp, Artificial Sequence
  dgRNA
  Kcna10
actaactaagcttcc

SEQ ID NO: 38584 - DNA, 15 bp, Artificial Sequence
  dgRNA
  Kcna10
gccacccaacagagc

SEQ ID NO: 38585 - DNA, 15 bp, Artificial Sequence
  dgRNA
  Kcna10
gtgacatgtgggtaa

SEQ ID NO: 38586 - DNA, 15 bp, Artificial Sequence
  dgRNA
  Kcna10
gccagtgtgacatgt

SEQ ID NO: 38587 - DNA, 15 bp, Artificial Sequence
  dgRNA
  Acvr1
tgcgccccggccccg

SEQ ID NO: 38588 - DNA, 15 bp, Artificial Sequence
  dgRNA
  Acvr1
cgggccacccgcccg

SEQ ID NO: 38589 - DNA, 15 bp, Artificial Sequence
  dgRNA
  Acvr1
cggcccgcggagttc

SEQ ID NO: 38590 - DNA, 15 bp, Artificial Sequence
  dgRNA
  Acvr1
ggcccgcggagttcc

SEQ ID NO: 38591 - DNA, 15 bp, Artificial Sequence
  dgRNA
  Fam43b
gtccaccagtgaagc

SEQ ID NO: 38592 - DNA, 15 bp, Artificial Sequence
  dgRNA
  Fam43b
cctccgcaatatttt

SEQ ID NO: 38593 - DNA, 15 bp, Artificial Sequence
  dgRNA
  Fam43b
ctccgcaatatttta

SEQ ID NO: 38594 - DNA, 15 bp, Artificial Sequence
  dgRNA
  Fam43b
tccgcaatattttag

SEQ ID NO: 38595 - DNA, 15 bp, Artificial Sequence
  dgRNA
  Ube2j2
cctttgcgcagtagc

SEQ ID NO: 38596 - DNA, 15 bp, Artificial Sequence
  dgRNA
  Ube2j2
gagcgcttccacccg

SEQ ID NO: 38597 - DNA, 15 bp, Artificial Sequence
  dgRNA
  Ube2j2
ccgcggacagcgcac

SEQ ID NO: 38598 - DNA, 15 bp, Artificial Sequence
  dgRNA
  Ube2j2
acagcgcaccggaag

SEQ ID NO: 38599 - DNA, 15 bp, Artificial Sequence
  dgRNA
  Cd28
cctgtaaagtggccc

SEQ ID NO: 38600 - DNA, 15 bp, Artificial Sequence
  dgRNA
  Cd28
ccagggccactttac

SEQ ID NO: 38601 - DNA, 15 bp, Artificial Sequence
  dgRNA
  2300009A05Rik
acgcgccgcacctca

SEQ ID NO: 38602 - DNA, 15 bp, Artificial Sequence
  dgRNA
  2300009A05Rik
ccgcgcgctgcccgc

SEQ ID NO: 38603 - DNA, 15 bp, Artificial Sequence
  dgRNA
  2300009A05Rik
cgcgcgctgcccgct

SEQ ID NO: 38604 - DNA, 15 bp, Artificial Sequence
  dgRNA
  2300009A05Rik
gggtgtcccccgccc

SEQ ID NO: 38605 - DNA, 15 bp, Artificial Sequence
  dgRNA
  5430427O19Rik
gtgatactaagaagg

SEQ ID NO: 38606 - DNA, 15 bp, Artificial Sequence
  dgRNA
  5430427O19Rik
gtatcactgatccta

SEQ ID NO: 38607 - DNA, 15 bp, Artificial Sequence
  dgRNA
  Uros
cctcccgctggcccg

SEQ ID NO: 38608 - DNA, 15 bp, Artificial Sequence
  dgRNA
  Uros
tagatgccatgtcgc

SEQ ID NO: 38609 - DNA, 15 bp, Artificial Sequence
  dgRNA
  Uros
ccgcccccgtccttc

SEQ ID NO: 38610 - DNA, 15 bp, Artificial Sequence
  dgRNA
  Uros
ccccgggccagcggg

SEQ ID NO: 38611 - DNA, 15 bp, Artificial Sequence
  dgRNA
  Olfr1462
tcacaaaggggtagc

SEQ ID NO: 38612 - DNA, 15 bp, Artificial Sequence
  dgRNA
  Gab1
gtggcgctgcgttcc

SEQ ID NO: 38613 - DNA, 15 bp, Artificial Sequence
  dgRNA
  Gab1
gccttccatagcgcg

SEQ ID NO: 38614 - DNA, 15 bp, Artificial Sequence
  dgRNA
  Gab1
ccttccatagcgcgc

SEQ ID NO: 38615 - DNA, 15 bp, Artificial Sequence
  dgRNA
  Gab1
catagcgcgcgggcc

SEQ ID NO: 38616 - DNA, 15 bp, Artificial Sequence
  dgRNA
  Gss
gggaactaagctaac

SEQ ID NO: 38617 - DNA, 15 bp, Artificial Sequence
  dgRNA
  Gss
ttgtagccacaacca

SEQ ID NO: 38618 - DNA, 15 bp, Artificial Sequence
  dgRNA
  Gss
tattccttaaagccc

SEQ ID NO: 38619 - DNA, 15 bp, Artificial Sequence
  dgRNA
  Gss
gcacgctgtgagatg

SEQ ID NO: 38620 - DNA, 15 bp, Artificial Sequence
  dgRNA
  Gpr4
gggggaggacgcggt

SEQ ID NO: 38621 - DNA, 15 bp, Artificial Sequence
  dgRNA
  Gpr4
ggggaggacgcggtg

SEQ ID NO: 38622 - DNA, 15 bp, Artificial Sequence
  dgRNA
  Gpr4
gacgcggtggggtgc

SEQ ID NO: 38623 - DNA, 15 bp, Artificial Sequence
  dgRNA
  Gpr4
acgcggtggggtgca

SEQ ID NO: 38624 - DNA, 15 bp, Artificial Sequence
  dgRNA
  Tnpo2
cggggcctggtaggt

SEQ ID NO: 38625 - DNA, 15 bp, Artificial Sequence
  dgRNA
  Tnpo2
taggtgggcctcgct

SEQ ID NO: 38626 - DNA, 15 bp, Artificial Sequence
  dgRNA
  Tnpo2
tgggcctcgctcggc

SEQ ID NO: 38627 - DNA, 15 bp, Artificial Sequence
  dgRNA
  Tnpo2
gggcctcgctcggcc

SEQ ID NO: 38628 - DNA, 15 bp, Artificial Sequence
  dgRNA
  Psme1
gggagtatattaggc

SEQ ID NO: 38629 - DNA, 15 bp, Artificial Sequence
  dgRNA
  Psme1
ggagtatattaggca

SEQ ID NO: 38630 - DNA, 15 bp, Artificial Sequence
  dgRNA
  Psme1
gagtatattaggcag

SEQ ID NO: 38631 - DNA, 15 bp, Artificial Sequence
  dgRNA
  Psme1
gcaggggaccacgct

SEQ ID NO: 38632 - DNA, 15 bp, Artificial Sequence
  dgRNA
  Kat2a
tgtcactatctcgga

SEQ ID NO: 38633 - DNA, 15 bp, Artificial Sequence
  dgRNA
  Kat2a
gtaatggtcaaatct

SEQ ID NO: 38634 - DNA, 15 bp, Artificial Sequence
  dgRNA
  Kat2a
caaccaagcgacatt

SEQ ID NO: 38635 - DNA, 15 bp, Artificial Sequence
  dgRNA
  Kat2a
cgacatttggttgtc

SEQ ID NO: 38636 - DNA, 15 bp, Artificial Sequence
  dgRNA
  C77080
gccggacctcgccct

SEQ ID NO: 38637 - DNA, 15 bp, Artificial Sequence
  dgRNA
  C77080
ccggacctcgccctc

SEQ ID NO: 38638 - DNA, 15 bp, Artificial Sequence
  dgRNA
  C77080
cggacctcgccctcg

SEQ ID NO: 38639 - DNA, 15 bp, Artificial Sequence
  dgRNA
  C77080
ctcgccctcggggca

SEQ ID NO: 38640 - DNA, 15 bp, Artificial Sequence
  dgRNA
  Olfr934
atattagtattactg

SEQ ID NO: 38641 - DNA, 15 bp, Artificial Sequence
  dgRNA
  Olfr934
acactcttatgttac

SEQ ID NO: 38642 - DNA, 15 bp, Artificial Sequence
  dgRNA
  Arsi
tctggagtccgggcc

SEQ ID NO: 38643 - DNA, 15 bp, Artificial Sequence
  dgRNA
  Arsi
aggccttagaactag

SEQ ID NO: 38644 - DNA, 15 bp, Artificial Sequence
  dgRNA
  Arsi
aactagcggccacag

SEQ ID NO: 38645 - DNA, 15 bp, Artificial Sequence
  dgRNA
  Arsi
actagcggccacagc

SEQ ID NO: 38646 - DNA, 15 bp, Artificial Sequence
  dgRNA
  Prima1
cgcgcgcagccgcca

SEQ ID NO: 38647 - DNA, 15 bp, Artificial Sequence
  dgRNA
  Prima1
agaggccccgcctag

SEQ ID NO: 38648 - DNA, 15 bp, Artificial Sequence
  dgRNA
  Prima1
gaggccccgcctaga

SEQ ID NO: 38649 - DNA, 15 bp, Artificial Sequence
  dgRNA
  Prima1
gccccgcctagaggg

SEQ ID NO: 38650 - DNA, 15 bp, Artificial Sequence
  dgRNA
  Cpne2
gcaacgcggggagct

SEQ ID NO: 38651 - DNA, 15 bp, Artificial Sequence
  dgRNA
  Cpne2
acgcggggagctcgg

SEQ ID NO: 38652 - DNA, 15 bp, Artificial Sequence
  dgRNA
  Cpne2
tgacgcccagagcgg

SEQ ID NO: 38653 - DNA, 15 bp, Artificial Sequence
  dgRNA
  Cpne2
gacgcccagagcggc

SEQ ID NO: 38654 - DNA, 15 bp, Artificial Sequence
  dgRNA
  Gabrd
aggacacagtgtgcg

SEQ ID NO: 38655 - DNA, 15 bp, Artificial Sequence
  dgRNA
  Gabrd
ctctccggagcgcag

SEQ ID NO: 38656 - DNA, 15 bp, Artificial Sequence
  dgRNA
  Gabrd
cagcggagcgaccac

SEQ ID NO: 38657 - DNA, 15 bp, Artificial Sequence
  dgRNA
  Gabrd
ccaccgggtgctatg

SEQ ID NO: 38658 - DNA, 15 bp, Artificial Sequence
  dgRNA
  Rims3
cccacagctaggacg

SEQ ID NO: 38659 - DNA, 15 bp, Artificial Sequence
  dgRNA
  Rims3
acagctaggacgcgg

SEQ ID NO: 38660 - DNA, 15 bp, Artificial Sequence
  dgRNA
  Rims3
cagctaggacgcggt

SEQ ID NO: 38661 - DNA, 15 bp, Artificial Sequence
  dgRNA
  Rims3
agctaggacgcggtg

SEQ ID NO: 38662 - DNA, 15 bp, Artificial Sequence
  dgRNA
  Aurka
gcctgcgcccagcta

SEQ ID NO: 38663 - DNA, 15 bp, Artificial Sequence
  dgRNA
  Aurka
gcgcccagctacggc

SEQ ID NO: 38664 - DNA, 15 bp, Artificial Sequence
  dgRNA
  Aurka
cgcccagctacggca

SEQ ID NO: 38665 - DNA, 15 bp, Artificial Sequence
  dgRNA
  Aurka
ccatagtcgcgttta

SEQ ID NO: 38666 - DNA, 15 bp, Artificial Sequence
  dgRNA
  Adck1
gtggcctctagtcta

SEQ ID NO: 38667 - DNA, 15 bp, Artificial Sequence
  dgRNA
  Adck1
tcccggcaggcctcg

SEQ ID NO: 38668 - DNA, 15 bp, Artificial Sequence
  dgRNA
  Adck1
ggcaccggcttctgt

SEQ ID NO: 38669 - DNA, 15 bp, Artificial Sequence
  dgRNA
  Adck1
cttctgtaggcgctc

SEQ ID NO: 38670 - DNA, 15 bp, Artificial Sequence
  dgRNA
  Ncbp3
ctagatgatagatcg

SEQ ID NO: 38671 - DNA, 15 bp, Artificial Sequence
  dgRNA
  Ncbp3
agtcccgccccaagc

SEQ ID NO: 38672 - DNA, 15 bp, Artificial Sequence
  dgRNA
  Ncbp3
ccccaagccggcccc

SEQ ID NO: 38673 - DNA, 15 bp, Artificial Sequence
  dgRNA
  Ncbp3
cggccccaggttcct

SEQ ID NO: 38674 - DNA, 15 bp, Artificial Sequence
  dgRNA
  Trim33
ggtatgtagcaacgt

SEQ ID NO: 38675 - DNA, 15 bp, Artificial Sequence
  dgRNA
  Trim33
cttctgtctcaccgc

SEQ ID NO: 38676 - DNA, 15 bp, Artificial Sequence
  dgRNA
  Trim33
gcaggagcctatatc

SEQ ID NO: 38677 - DNA, 15 bp, Artificial Sequence
  dgRNA
  Trim33
gccctctagagaacg

SEQ ID NO: 38678 - DNA, 15 bp, Artificial Sequence
  dgRNA
  Msi1
gcccgagcccgcacc

SEQ ID NO: 38679 - DNA, 15 bp, Artificial Sequence
  dgRNA
  Msi1
cccgcaccaggaatc

SEQ ID NO: 38680 - DNA, 15 bp, Artificial Sequence
  dgRNA
  Msi1
ccgcaccaggaatca

SEQ ID NO: 38681 - DNA, 15 bp, Artificial Sequence
  dgRNA
  Msi1
cgcaccaggaatcag

SEQ ID NO: 38682 - DNA, 15 bp, Artificial Sequence
  dgRNA
  C2
aataaaacgttttgc

SEQ ID NO: 38683 - DNA, 15 bp, Artificial Sequence
  dgRNA
  C2
ataaaacgttttgca

SEQ ID NO: 38684 - DNA, 15 bp, Artificial Sequence
  dgRNA
  C2
atatttggccttgtg

SEQ ID NO: 38685 - DNA, 15 bp, Artificial Sequence
  dgRNA
  C2
agagagaaacccgcc

SEQ ID NO: 38686 - DNA, 15 bp, Artificial Sequence
  dgRNA
  Chrd
cctagggcactaaag

SEQ ID NO: 38687 - DNA, 15 bp, Artificial Sequence
  dgRNA
  Chrd
cactaaagtggagta

SEQ ID NO: 38688 - DNA, 15 bp, Artificial Sequence
  dgRNA
  Chrd
aagtggagtacggcc

SEQ ID NO: 38689 - DNA, 15 bp, Artificial Sequence
  dgRNA
  Chrd
agtggagtacggccc

SEQ ID NO: 38690 - DNA, 15 bp, Artificial Sequence
  dgRNA
  Slc22a21
ccagcccgactcgct

SEQ ID NO: 38691 - DNA, 15 bp, Artificial Sequence
  dgRNA
  Slc22a21
agcccgactcgctcg

SEQ ID NO: 38692 - DNA, 15 bp, Artificial Sequence
  dgRNA
  Slc22a21
gcccgactcgctcgg

SEQ ID NO: 38693 - DNA, 15 bp, Artificial Sequence
  dgRNA
  Slc22a21
cccgactcgctcggg

SEQ ID NO: 38694 - DNA, 15 bp, Artificial Sequence
  dgRNA
  Depdc1a
gctatacaatcgctt

SEQ ID NO: 38695 - DNA, 15 bp, Artificial Sequence
  dgRNA
  Depdc1a
catcatgtgactcaa

SEQ ID NO: 38696 - DNA, 15 bp, Artificial Sequence
  dgRNA
  Depdc1a
ccaatcagcttcgct

SEQ ID NO: 38697 - DNA, 15 bp, Artificial Sequence
  dgRNA
  Depdc1a
ccttcttgattctag

SEQ ID NO: 38698 - DNA, 15 bp, Artificial Sequence
  dgRNA
  Pax6
gagggagtctcccgc

SEQ ID NO: 38699 - DNA, 15 bp, Artificial Sequence
  dgRNA
  Pax6
agggagtctcccgcc

SEQ ID NO: 38700 - DNA, 15 bp, Artificial Sequence
  dgRNA
  Pax6
agctgaacccaactc

SEQ ID NO: 38701 - DNA, 15 bp, Artificial Sequence
  dgRNA
  Pax6
gacgtcatccgcgcc

SEQ ID NO: 38702 - DNA, 15 bp, Artificial Sequence
  dgRNA
  Clcn3
ctcccggccacgccc

SEQ ID NO: 38703 - DNA, 15 bp, Artificial Sequence
  dgRNA
  Clcn3
tccattccgaccaat

SEQ ID NO: 38704 - DNA, 15 bp, Artificial Sequence
  dgRNA
  Clcn3
gaccaataggcgcag

SEQ ID NO: 38705 - DNA, 15 bp, Artificial Sequence
  dgRNA
  Clcn3
ctcccagtgcggccg

SEQ ID NO: 38706 - DNA, 15 bp, Artificial Sequence
  dgRNA
  Cldn20
caaaattaggattgg

SEQ ID NO: 38707 - DNA, 15 bp, Artificial Sequence
  dgRNA
  Cldn20
ggtaattgtggtgtg

SEQ ID NO: 38708 - DNA, 15 bp, Artificial Sequence
  dgRNA
  Cldn20
ctcagtgggtaattg

SEQ ID NO: 38709 - DNA, 15 bp, Artificial Sequence
  dgRNA
  Cldn20
cctagaagatctcag

SEQ ID NO: 38710 - DNA, 15 bp, Artificial Sequence
  dgRNA
  Lrrc4b
aagggcttgctcgtg

SEQ ID NO: 38711 - DNA, 15 bp, Artificial Sequence
  dgRNA
  Lrrc4b
gccaggctcccctag

SEQ ID NO: 38712 - DNA, 15 bp, Artificial Sequence
  dgRNA
  Lrrc4b
ggctcccctagaggg

SEQ ID NO: 38713 - DNA, 15 bp, Artificial Sequence
  dgRNA
  Lrrc4b
gctcccctagagggt

SEQ ID NO: 38714 - DNA, 15 bp, Artificial Sequence
  dgRNA
  Ldhb
gaataagtgcctcag

SEQ ID NO: 38715 - DNA, 15 bp, Artificial Sequence
  dgRNA
  Ldhb
aagtgcctcagcgga

SEQ ID NO: 38716 - DNA, 15 bp, Artificial Sequence
  dgRNA
  Ldhb
taactttagagagcg

SEQ ID NO: 38717 - DNA, 15 bp, Artificial Sequence
  dgRNA
  Ldhb
aactttagagagcgg

SEQ ID NO: 38718 - DNA, 15 bp, Artificial Sequence
  dgRNA
  Ndufv3
gttaagggcgagatc

SEQ ID NO: 38719 - DNA, 15 bp, Artificial Sequence
  dgRNA
  Ndufv3
ttaagggcgagatca

SEQ ID NO: 38720 - DNA, 15 bp, Artificial Sequence
  dgRNA
  Ndufv3
ggcgagatcagggca

SEQ ID NO: 38721 - DNA, 15 bp, Artificial Sequence
  dgRNA
  Ndufv3
tgggcaggcccaaat

SEQ ID NO: 38722 - DNA, 15 bp, Artificial Sequence
  dgRNA
  Oraov1
aaagcagggttcgtc

SEQ ID NO: 38723 - DNA, 15 bp, Artificial Sequence
  dgRNA
  Oraov1
ccaccacggagcgag

SEQ ID NO: 38724 - DNA, 15 bp, Artificial Sequence
  dgRNA
  Oraov1
gagcgagcggtacca

SEQ ID NO: 38725 - DNA, 15 bp, Artificial Sequence
  dgRNA
  Oraov1
cgagcggtaccaagg

SEQ ID NO: 38726 - DNA, 15 bp, Artificial Sequence
  dgRNA
  Arhgdib
attacttctgtttag

SEQ ID NO: 38727 - DNA, 15 bp, Artificial Sequence
  dgRNA
  Arhgdib
ctctccccgagatta

SEQ ID NO: 38728 - DNA, 15 bp, Artificial Sequence
  dgRNA
  Arhgdib
gcatctatgtcacat

SEQ ID NO: 38729 - DNA, 15 bp, Artificial Sequence
  dgRNA
  Arhgdib
ctatgtcacatgggc

SEQ ID NO: 38730 - DNA, 15 bp, Artificial Sequence
  dgRNA
  Snta1
ctaactgtggccgtg

SEQ ID NO: 38731 - DNA, 15 bp, Artificial Sequence
  dgRNA
  Snta1
ggccgtgagggaacg

SEQ ID NO: 38732 - DNA, 15 bp, Artificial Sequence
  dgRNA
  Snta1
cggattctatggatg

SEQ ID NO: 38733 - DNA, 15 bp, Artificial Sequence
  dgRNA
  Snta1
ccggattctatggat

SEQ ID NO: 38734 - DNA, 15 bp, Artificial Sequence
  dgRNA
  Bhlhe41
gcgcgggtgtgcgag

SEQ ID NO: 38735 - DNA, 15 bp, Artificial Sequence
  dgRNA
  Bhlhe41
cgagcgagcacgggg

SEQ ID NO: 38736 - DNA, 15 bp, Artificial Sequence
  dgRNA
  Bhlhe41
gcgagcacggggcgg

SEQ ID NO: 38737 - DNA, 15 bp, Artificial Sequence
  dgRNA
  Bhlhe41
cgagcacggggcgga

SEQ ID NO: 38738 - DNA, 15 bp, Artificial Sequence
  dgRNA
  Slc35g2
tccgccccagggcgt

SEQ ID NO: 38739 - DNA, 15 bp, Artificial Sequence
  dgRNA
  Slc35g2
gcagcttccattgcc

SEQ ID NO: 38740 - DNA, 15 bp, Artificial Sequence
  dgRNA
  Slc35g2
gacgctcacgcctct

SEQ ID NO: 38741 - DNA, 15 bp, Artificial Sequence
  dgRNA
  Slc35g2
acgctcacgcctctc

SEQ ID NO: 38742 - DNA, 15 bp, Artificial Sequence
  dgRNA
  Sumo2
ccaggcgcgcccccg

SEQ ID NO: 38743 - DNA, 15 bp, Artificial Sequence
  dgRNA
  Sumo2
ggcgcgcccccgcgg

SEQ ID NO: 38744 - DNA, 15 bp, Artificial Sequence
  dgRNA
  Sumo2
cccccgcggcgggac

SEQ ID NO: 38745 - DNA, 15 bp, Artificial Sequence
  dgRNA
  Sumo2
ctcttcccgccgacc

SEQ ID NO: 38746 - DNA, 15 bp, Artificial Sequence
  dgRNA
  Hist1h3a
caaaaataagtaccg

SEQ ID NO: 38747 - DNA, 15 bp, Artificial Sequence
  dgRNA
  Hist1h3a
taaggtagtctgccg

SEQ ID NO: 38748 - DNA, 15 bp, Artificial Sequence
  dgRNA
  Hist1h3a
taagaactgcagttg

SEQ ID NO: 38749 - DNA, 15 bp, Artificial Sequence
  dgRNA
  Hist1h3a
gcaaaggatagtgat

SEQ ID NO: 38750 - DNA, 15 bp, Artificial Sequence
  dgRNA
  Anks1
agggggtggcgtccc

SEQ ID NO: 38751 - DNA, 15 bp, Artificial Sequence
  dgRNA
  Anks1
ggtggcgtccccggc

SEQ ID NO: 38752 - DNA, 15 bp, Artificial Sequence
  dgRNA
  Tmcc2
agatgtcttgccgtt

SEQ ID NO: 38753 - DNA, 15 bp, Artificial Sequence
  dgRNA
  Tmcc2
tgtcttgccgttagg

SEQ ID NO: 38754 - DNA, 15 bp, Artificial Sequence
  dgRNA
  Tmcc2
ggttaagctagtgct

SEQ ID NO: 38755 - DNA, 15 bp, Artificial Sequence
  dgRNA
  Tmcc2
aaccaacccccaggg

SEQ ID NO: 38756 - DNA, 15 bp, Artificial Sequence
  dgRNA
  Cdc25b
cgcgtcaatgggagc

SEQ ID NO: 38757 - DNA, 15 bp, Artificial Sequence
  dgRNA
  Cdc25b
gtcaatgggagcggg

SEQ ID NO: 38758 - DNA, 15 bp, Artificial Sequence
  dgRNA
  Cdc25b
tcaatgggagcgggc

SEQ ID NO: 38759 - DNA, 15 bp, Artificial Sequence
  dgRNA
  Cdc25b
caatgggagcgggcg

SEQ ID NO: 38760 - DNA, 15 bp, Artificial Sequence
  dgRNA
  Nmi
cactgccgttcttga

SEQ ID NO: 38761 - DNA, 15 bp, Artificial Sequence
  dgRNA
  Nmi
ggcttccgtcaagaa

SEQ ID NO: 38762 - DNA, 15 bp, Artificial Sequence
  dgRNA
  Tpm1
atgcggtcgcccccc

SEQ ID NO: 38763 - DNA, 15 bp, Artificial Sequence
  dgRNA
  Tpm1
tgcggtcgcccccct

SEQ ID NO: 38764 - DNA, 15 bp, Artificial Sequence
  dgRNA
  Tpm1
gggaaagtacatatc

SEQ ID NO: 38765 - DNA, 15 bp, Artificial Sequence
  dgRNA
  Tpm1
atatcagggagcagc

SEQ ID NO: 38766 - DNA, 15 bp, Artificial Sequence
  dgRNA
  Arrdc3
cccatgcaccgaagt

SEQ ID NO: 38767 - DNA, 15 bp, Artificial Sequence
  dgRNA
  Arrdc3
atgcaccgaagtcgg

SEQ ID NO: 38768 - DNA, 15 bp, Artificial Sequence
  dgRNA
  Arrdc3
cacacctactgtacc

SEQ ID NO: 38769 - DNA, 15 bp, Artificial Sequence
  dgRNA
  Arrdc3
tgtaccgggagcgtg

SEQ ID NO: 38770 - DNA, 15 bp, Artificial Sequence
  dgRNA
  Tmem168
ttatcccactctagc

SEQ ID NO: 38771 - DNA, 15 bp, Artificial Sequence
  dgRNA
  Tmem168
cggtccaactctaag

SEQ ID NO: 38772 - DNA, 15 bp, Artificial Sequence
  dgRNA
  Tmem168
gtgacctcgctgctt

SEQ ID NO: 38773 - DNA, 15 bp, Artificial Sequence
  dgRNA
  Tmem168
tgacctcgctgcttt

SEQ ID NO: 38774 - DNA, 15 bp, Artificial Sequence
  dgRNA
  Nlrp12
tgtgggtcatgctta

SEQ ID NO: 38775 - DNA, 15 bp, Artificial Sequence
  dgRNA
  Nlrp12
ggtcatgcttacggt

SEQ ID NO: 38776 - DNA, 15 bp, Artificial Sequence
  dgRNA
  Nlrp12
aacactattgttgac

SEQ ID NO: 38777 - DNA, 15 bp, Artificial Sequence
  dgRNA
  Nlrp12
ataagattgggacag

SEQ ID NO: 38778 - DNA, 15 bp, Artificial Sequence
  dgRNA
  Olfr291
ccacgggctattata

SEQ ID NO: 38779 - DNA, 15 bp, Artificial Sequence
  dgRNA
  Olfr291
tccctaaggatagaa

SEQ ID NO: 38780 - DNA, 15 bp, Artificial Sequence
  dgRNA
  Olfr291
ccctaaggatagaat

SEQ ID NO: 38781 - DNA, 15 bp, Artificial Sequence
  dgRNA
  Olfr291
tggacatggcccacc

SEQ ID NO: 38782 - DNA, 15 bp, Artificial Sequence
  dgRNA
  Prkcsh
ttccgatctgttcta

SEQ ID NO: 38783 - DNA, 15 bp, Artificial Sequence
  dgRNA
  Prkcsh
tgttcctactcaaga

SEQ ID NO: 38784 - DNA, 15 bp, Artificial Sequence
  dgRNA
  Prkcsh
ttgccactcctaaca

SEQ ID NO: 38785 - DNA, 15 bp, Artificial Sequence
  dgRNA
  Prkcsh
cctaacatggcgtcc

SEQ ID NO: 38786 - DNA, 15 bp, Artificial Sequence
  dgRNA
  Pomt2
ctgtctacccgaagc

SEQ ID NO: 38787 - DNA, 15 bp, Artificial Sequence
  dgRNA
  Pomt2
tgtctacccgaagca

SEQ ID NO: 38788 - DNA, 15 bp, Artificial Sequence
  dgRNA
  Pomt2
agggaaaagcgcgat

SEQ ID NO: 38789 - DNA, 15 bp, Artificial Sequence
  dgRNA
  Pomt2
caccataaggttcag

SEQ ID NO: 38790 - DNA, 15 bp, Artificial Sequence
  dgRNA
  Dars2
tcgtcattttaactg

SEQ ID NO: 38791 - DNA, 15 bp, Artificial Sequence
  dgRNA
  Dars2
cgtcattttaactga

SEQ ID NO: 38792 - DNA, 15 bp, Artificial Sequence
  dgRNA
  Dars2
ttttaactgagggca

SEQ ID NO: 38793 - DNA, 15 bp, Artificial Sequence
  dgRNA
  Dars2
cttccgttttccaac

SEQ ID NO: 38794 - DNA, 15 bp, Artificial Sequence
  dgRNA
  Klhdc8b
caggcaacgagacca

SEQ ID NO: 38795 - DNA, 15 bp, Artificial Sequence
  dgRNA
  Klhdc8b
aaggtttgacgacaa

SEQ ID NO: 38796 - DNA, 15 bp, Artificial Sequence
  dgRNA
  Klhdc8b
ttgacgacaaaggac

SEQ ID NO: 38797 - DNA, 15 bp, Artificial Sequence
  dgRNA
  Klhdc8b
tccaactaggaaggt

SEQ ID NO: 38798 - DNA, 15 bp, Artificial Sequence
  dgRNA
  Bfar
ttggctcggacgaaa

SEQ ID NO: 38799 - DNA, 15 bp, Artificial Sequence
  dgRNA
  Bfar
ctcggacgaaaagga

SEQ ID NO: 38800 - DNA, 15 bp, Artificial Sequence
  dgRNA
  Bfar
tcggacgaaaaggaa

SEQ ID NO: 38801 - DNA, 15 bp, Artificial Sequence
  dgRNA
  Bfar
aggggcgggtcgcgt

SEQ ID NO: 38802 - DNA, 15 bp, Artificial Sequence
  dgRNA
  Plekhm2
tgggtctatgcgatc

SEQ ID NO: 38803 - DNA, 15 bp, Artificial Sequence
  dgRNA
  Plekhm2
gggtctatgcgatcc

SEQ ID NO: 38804 - DNA, 15 bp, Artificial Sequence
  dgRNA
  Plekhm2
aggtccccggggctc

SEQ ID NO: 38805 - DNA, 15 bp, Artificial Sequence
  dgRNA
  Plekhm2
aggtctccatcgccc

SEQ ID NO: 38806 - DNA, 15 bp, Artificial Sequence
  dgRNA
  Tmem127
aaaatatgtcgccct

SEQ ID NO: 38807 - DNA, 15 bp, Artificial Sequence
  dgRNA
  Tmem127
cgccgcgtgaccttc

SEQ ID NO: 38808 - DNA, 15 bp, Artificial Sequence
  dgRNA
  Tmem127
gccgcgtgaccttct

SEQ ID NO: 38809 - DNA, 15 bp, Artificial Sequence
  dgRNA
  Tmem127
ctcatcctccgtaac

SEQ ID NO: 38810 - DNA, 15 bp, Artificial Sequence
  dgRNA
  Olfr1321
ggaacccggtgctgc

SEQ ID NO: 38811 - DNA, 15 bp, Artificial Sequence
  dgRNA
  Olfr1321
gaacccggtgctgct

SEQ ID NO: 38812 - DNA, 15 bp, Artificial Sequence
  dgRNA
  Olfr1321
accccatatacagaa

SEQ ID NO: 38813 - DNA, 15 bp, Artificial Sequence
  dgRNA
  Olfr1321
agaatggcccctagc

SEQ ID NO: 38814 - DNA, 15 bp, Artificial Sequence
  dgRNA
  Tmod2
cctcctctttgccgc

SEQ ID NO: 38815 - DNA, 15 bp, Artificial Sequence
  dgRNA
  Tmod2
tgttggtcaaacaga

SEQ ID NO: 38816 - DNA, 15 bp, Artificial Sequence
  dgRNA
  Tmod2
cacatagtactcctg

SEQ ID NO: 38817 - DNA, 15 bp, Artificial Sequence
  dgRNA
  Tmod2
ctagaacagttaccc

SEQ ID NO: 38818 - DNA, 15 bp, Artificial Sequence
  dgRNA
  Olfr922
gaatgtagtgagtta

SEQ ID NO: 38819 - DNA, 15 bp, Artificial Sequence
  dgRNA
  Olfr922
agcgagacgtgtgga

SEQ ID NO: 38820 - DNA, 15 bp, Artificial Sequence
  dgRNA
  Olfr922
tatgagcgagacgtg

SEQ ID NO: 38821 - DNA, 15 bp, Artificial Sequence
  dgRNA
  Ebag9
ggtggccgcgcttcc

SEQ ID NO: 38822 - DNA, 15 bp, Artificial Sequence
  dgRNA
  Ebag9
ttcccggtcaccctc

SEQ ID NO: 38823 - DNA, 15 bp, Artificial Sequence
  dgRNA
  Ebag9
cgagccaccactctg

SEQ ID NO: 38824 - DNA, 15 bp, Artificial Sequence
  dgRNA
  Ebag9
ctggggtactgtttc

SEQ ID NO: 38825 - DNA, 15 bp, Artificial Sequence
  dgRNA
  Rilpl2
ccgcccccgtttcca

SEQ ID NO: 38826 - DNA, 15 bp, Artificial Sequence
  dgRNA
  Rilpl2
acgcgtccgtcacca

SEQ ID NO: 38827 - DNA, 15 bp, Artificial Sequence
  dgRNA
  Rilpl2
cgcgtccgtcaccaa

SEQ ID NO: 38828 - DNA, 15 bp, Artificial Sequence
  dgRNA
  Rilpl2
ggcggacttcccaag

SEQ ID NO: 38829 - DNA, 15 bp, Artificial Sequence
  dgRNA
  Cngb3
gattaaacagctaat

SEQ ID NO: 38830 - DNA, 15 bp, Artificial Sequence
  dgRNA
  Cngb3
ataatttaagacgag

SEQ ID NO: 38831 - DNA, 15 bp, Artificial Sequence
  dgRNA
  Cngb3
ctccctagctaagca

SEQ ID NO: 38832 - DNA, 15 bp, Artificial Sequence
  dgRNA
  Cngb3
actccctagctaagc

SEQ ID NO: 38833 - DNA, 15 bp, Artificial Sequence
  dgRNA
  Rbm3
tccaaccgtttgaga

SEQ ID NO: 38834 - DNA, 15 bp, Artificial Sequence
  dgRNA
  Rbm3
ccgtttgagatggaa

SEQ ID NO: 38835 - DNA, 15 bp, Artificial Sequence
  dgRNA
  Rbm3
cgtttgagatggaaa

SEQ ID NO: 38836 - DNA, 15 bp, Artificial Sequence
  dgRNA
  Rbm3
tccatctcaaacggt

SEQ ID NO: 38837 - DNA, 15 bp, Artificial Sequence
  dgRNA
  Fam185a
aacgggaaagcaacg

SEQ ID NO: 38838 - DNA, 15 bp, Artificial Sequence
  dgRNA
  Fam185a
acgggaaagcaacga

SEQ ID NO: 38839 - DNA, 15 bp, Artificial Sequence
  dgRNA
  Fam185a
cgggaaagcaacgag

SEQ ID NO: 38840 - DNA, 15 bp, Artificial Sequence
  dgRNA
  Fam185a
gggaaagcaacgagg

SEQ ID NO: 38841 - DNA, 15 bp, Artificial Sequence
  dgRNA
  Lrrc16a
ggtctcggcctcctg

SEQ ID NO: 38842 - DNA, 15 bp, Artificial Sequence
  dgRNA
  Lrrc16a
ccgcctggctggtct

SEQ ID NO: 38843 - DNA, 15 bp, Artificial Sequence
  dgRNA
  Lrrc16a
gagggttgggccgcc

SEQ ID NO: 38844 - DNA, 15 bp, Artificial Sequence
  dgRNA
  Lrrc16a
cggaaggcgagggtt

SEQ ID NO: 38845 - DNA, 15 bp, Artificial Sequence
  dgRNA
  Slc38a4
cagctagactccacc

SEQ ID NO: 38846 - DNA, 15 bp, Artificial Sequence
  dgRNA
  Slc38a4
tattggtggctaggc

SEQ ID NO: 38847 - DNA, 15 bp, Artificial Sequence
  dgRNA
  Slc38a4
gagggtcctcaagaa

SEQ ID NO: 38848 - DNA, 15 bp, Artificial Sequence
  dgRNA
  Slc38a4
gctgccccctatcac

SEQ ID NO: 38849 - DNA, 15 bp, Artificial Sequence
  dgRNA
  1700020L24Rik
cctggggtaaggtag

SEQ ID NO: 38850 - DNA, 15 bp, Artificial Sequence
  dgRNA
  1700020L24Rik
gggtttgtttgaatc

SEQ ID NO: 38851 - DNA, 15 bp, Artificial Sequence
  dgRNA
  1700020L24Rik
ttggccccagtaggc

SEQ ID NO: 38852 - DNA, 15 bp, Artificial Sequence
  dgRNA
  1700020L24Rik
cccctaccttacccc

SEQ ID NO: 38853 - DNA, 15 bp, Artificial Sequence
  dgRNA
  Gpr158
ggtttccgagtcatc

SEQ ID NO: 38854 - DNA, 15 bp, Artificial Sequence
  dgRNA
  Gpr158
gtttccgagtcatca

SEQ ID NO: 38855 - DNA, 15 bp, Artificial Sequence
  dgRNA
  Gpr158
atcagggaacacgag

SEQ ID NO: 38856 - DNA, 15 bp, Artificial Sequence
  dgRNA
  Gpr158
tcagggaacacgagt

SEQ ID NO: 38857 - DNA, 15 bp, Artificial Sequence
  dgRNA
  Otof
ttcagcatgcgttcc

SEQ ID NO: 38858 - DNA, 15 bp, Artificial Sequence
  dgRNA
  Otof
tcagcatgcgttcct

SEQ ID NO: 38859 - DNA, 15 bp, Artificial Sequence
  dgRNA
  Otof
gcgctacacacatgc

SEQ ID NO: 38860 - DNA, 15 bp, Artificial Sequence
  dgRNA
  Otof
cgctacacacatgct

SEQ ID NO: 38861 - DNA, 15 bp, Artificial Sequence
  dgRNA
  Ptprh
tcgaagcttgtttac

SEQ ID NO: 38862 - DNA, 15 bp, Artificial Sequence
  dgRNA
  Ptprh
gaccatttttcatag

SEQ ID NO: 38863 - DNA, 15 bp, Artificial Sequence
  dgRNA
  Ptprh
aaacgccccgtgaca

SEQ ID NO: 38864 - DNA, 15 bp, Artificial Sequence
  dgRNA
  Ptprh
aacgccccgtgacaa

SEQ ID NO: 38865 - DNA, 15 bp, Artificial Sequence
  dgRNA
  Ghdc
acgatcttgccaccc

SEQ ID NO: 38866 - DNA, 15 bp, Artificial Sequence
  dgRNA
  Ghdc
aacaagttacctttt

SEQ ID NO: 38867 - DNA, 15 bp, Artificial Sequence
  dgRNA
  Ghdc
attccgccccacccc

SEQ ID NO: 38868 - DNA, 15 bp, Artificial Sequence
  dgRNA
  Ghdc
cgggtcctcccagtc

SEQ ID NO: 38869 - DNA, 15 bp, Artificial Sequence
  dgRNA
  Katna1
gtactgaagtaggcg

SEQ ID NO: 38870 - DNA, 15 bp, Artificial Sequence
  dgRNA
  Katna1
gccacgcccctccgc

SEQ ID NO: 38871 - DNA, 15 bp, Artificial Sequence
  dgRNA
  Katna1
gcggggcgaaggact

SEQ ID NO: 38872 - DNA, 15 bp, Artificial Sequence
  dgRNA
  Katna1
aagtaggcggggcga

SEQ ID NO: 38873 - DNA, 15 bp, Artificial Sequence
  dgRNA
  Tmem199
gaccgagaccaccag

SEQ ID NO: 38874 - DNA, 15 bp, Artificial Sequence
  dgRNA
  Tmem199
actgctagggcccgt

SEQ ID NO: 38875 - DNA, 15 bp, Artificial Sequence
  dgRNA
  Tmem199
ctgctagggcccgtc

SEQ ID NO: 38876 - DNA, 15 bp, Artificial Sequence
  dgRNA
  Tmem199
gcccgagcgcccgct

SEQ ID NO: 38877 - DNA, 15 bp, Artificial Sequence
  dgRNA
  Trpm2
tcctacactttgtgg

SEQ ID NO: 38878 - DNA, 15 bp, Artificial Sequence
  dgRNA
  Trpm2
ggaggatctgattcc

SEQ ID NO: 38879 - DNA, 15 bp, Artificial Sequence
  dgRNA
  Trpm2
aggatctgattcccg

SEQ ID NO: 38880 - DNA, 15 bp, Artificial Sequence
  dgRNA
  Trpm2
cgcaagtgcctttct

SEQ ID NO: 38881 - DNA, 15 bp, Artificial Sequence
  dgRNA
  Pikfyve
tagaacgatactctc

SEQ ID NO: 38882 - DNA, 15 bp, Artificial Sequence
  dgRNA
  Pikfyve
agaacgatactctct

SEQ ID NO: 38883 - DNA, 15 bp, Artificial Sequence
  dgRNA
  Pikfyve
cgatactctctgggt

SEQ ID NO: 38884 - DNA, 15 bp, Artificial Sequence
  dgRNA
  Pikfyve
gcctgaacatctgat

SEQ ID NO: 38885 - DNA, 15 bp, Artificial Sequence
  dgRNA
  Ralgapa1
gaaccgctgtttaca

SEQ ID NO: 38886 - DNA, 15 bp, Artificial Sequence
  dgRNA
  Ralgapa1
accaagaggctatag

SEQ ID NO: 38887 - DNA, 15 bp, Artificial Sequence
  dgRNA
  Ralgapa1
gcacttgacgtcaga

SEQ ID NO: 38888 - DNA, 15 bp, Artificial Sequence
  dgRNA
  Ralgapa1
cttgacgtcagaagg

SEQ ID NO: 38889 - DNA, 15 bp, Artificial Sequence
  dgRNA
  Socs2
ccggctctctccacc

SEQ ID NO: 38890 - DNA, 15 bp, Artificial Sequence
  dgRNA
  Socs2
aagcctgcgcattag

SEQ ID NO: 38891 - DNA, 15 bp, Artificial Sequence
  dgRNA
  Socs2
ctgcgcattagcggc

SEQ ID NO: 38892 - DNA, 15 bp, Artificial Sequence
  dgRNA
  Socs2
tgcgcattagcggcc

SEQ ID NO: 38893 - DNA, 15 bp, Artificial Sequence
  dgRNA
  Olfr272
acaatggactgcacc

SEQ ID NO: 38894 - DNA, 15 bp, Artificial Sequence
  dgRNA
  Itga4
gatcctaggagcacc

SEQ ID NO: 38895 - DNA, 15 bp, Artificial Sequence
  dgRNA
  Itga4
ggagcacccggcccc

SEQ ID NO: 38896 - DNA, 15 bp, Artificial Sequence
  dgRNA
  Itga4
cggcccctggctccg

SEQ ID NO: 38897 - DNA, 15 bp, Artificial Sequence
  dgRNA
  Itga4
cggggccacagaaac

SEQ ID NO: 38898 - DNA, 15 bp, Artificial Sequence
  dgRNA
  Gsto2
tgcctgcgacaacca

SEQ ID NO: 38899 - DNA, 15 bp, Artificial Sequence
  dgRNA
  Gsto2
gcctgcgacaaccac

SEQ ID NO: 38900 - DNA, 15 bp, Artificial Sequence
  dgRNA
  Gsto2
cctgcgacaaccacg

SEQ ID NO: 38901 - DNA, 15 bp, Artificial Sequence
  dgRNA
  Gsto2
ctgcgacaaccacgg

SEQ ID NO: 38902 - DNA, 15 bp, Artificial Sequence
  dgRNA
  Tpbpa
aatttcgtaaatgcc

SEQ ID NO: 38903 - DNA, 15 bp, Artificial Sequence
  dgRNA
  Tpbpa
gagtcctatagccca

SEQ ID NO: 38904 - DNA, 15 bp, Artificial Sequence
  dgRNA
  Tpbpa
agcattagtacttat

SEQ ID NO: 38905 - DNA, 15 bp, Artificial Sequence
  dgRNA
  Tpbpa
catttacgaaattga

SEQ ID NO: 38906 - DNA, 15 bp, Artificial Sequence
  dgRNA
  Slc9a2
agacccattctactt

SEQ ID NO: 38907 - DNA, 15 bp, Artificial Sequence
  dgRNA
  Slc9a2
gacccattctacttc

SEQ ID NO: 38908 - DNA, 15 bp, Artificial Sequence
  dgRNA
  Slc9a2
tacttcgggctagaa

SEQ ID NO: 38909 - DNA, 15 bp, Artificial Sequence
  dgRNA
  Slc9a2
gggttgatacagaat

SEQ ID NO: 38910 - DNA, 15 bp, Artificial Sequence
  dgRNA
  Tmco3
cgcaggcgattgccg

SEQ ID NO: 38911 - DNA, 15 bp, Artificial Sequence
  dgRNA
  Tmco3
aggcgattgccgcgg

SEQ ID NO: 38912 - DNA, 15 bp, Artificial Sequence
  dgRNA
  Tmco3
gcggcggctagcagc

SEQ ID NO: 38913 - DNA, 15 bp, Artificial Sequence
  dgRNA
  Tmco3
gcaggcgctctgcgc

SEQ ID NO: 38914 - DNA, 15 bp, Artificial Sequence
  dgRNA
  Cenpk
aatcgctcccactct

SEQ ID NO: 38915 - DNA, 15 bp, Artificial Sequence
  dgRNA
  Cenpk
tcgccatgtcgtccg

SEQ ID NO: 38916 - DNA, 15 bp, Artificial Sequence
  dgRNA
  Cenpk
acgaccgagtgaact

SEQ ID NO: 38917 - DNA, 15 bp, Artificial Sequence
  dgRNA
  Cenpk
ggtttccccgagccg

SEQ ID NO: 38918 - DNA, 15 bp, Artificial Sequence
  dgRNA
  Ankle1
gtacgcaccaaaccc

SEQ ID NO: 38919 - DNA, 15 bp, Artificial Sequence
  dgRNA
  Ankle1
gcttgctccggacgt

SEQ ID NO: 38920 - DNA, 15 bp, Artificial Sequence
  dgRNA
  Ankle1
cttgctccggacgta

SEQ ID NO: 38921 - DNA, 15 bp, Artificial Sequence
  dgRNA
  Ankle1
ctagtcaatcccgat

SEQ ID NO: 38922 - DNA, 15 bp, Artificial Sequence
  dgRNA
  Odf3
gtaatgtctgaagag

SEQ ID NO: 38923 - DNA, 15 bp, Artificial Sequence
  dgRNA
  Odf3
gtggacttctccttt

SEQ ID NO: 38924 - DNA, 15 bp, Artificial Sequence
  dgRNA
  Odf3
aactaaccctctcca

SEQ ID NO: 38925 - DNA, 15 bp, Artificial Sequence
  dgRNA
  Lrrc71
agagtacagaccatt

SEQ ID NO: 38926 - DNA, 15 bp, Artificial Sequence
  dgRNA
  Lrrc71
gagtacagaccatta

SEQ ID NO: 38927 - DNA, 15 bp, Artificial Sequence
  dgRNA
  Lrrc71
cctagccacgcccac

SEQ ID NO: 38928 - DNA, 15 bp, Artificial Sequence
  dgRNA
  Lrrc71
cacgcccactggctc

SEQ ID NO: 38929 - DNA, 15 bp, Artificial Sequence
  dgRNA
  Lsm4
ctaggagcgcaaaat

SEQ ID NO: 38930 - DNA, 15 bp, Artificial Sequence
  dgRNA
  Lsm4
gcttcgcccacagtg

SEQ ID NO: 38931 - DNA, 15 bp, Artificial Sequence
  dgRNA
  Lsm4
gtgtggcgccgaatt

SEQ ID NO: 38932 - DNA, 15 bp, Artificial Sequence
  dgRNA
  Lsm4
cgccgaaccagatcc

SEQ ID NO: 38933 - DNA, 15 bp, Artificial Sequence
  dgRNA
  Sptbn1
ggacctgaccgtgcg

SEQ ID NO: 38934 - DNA, 15 bp, Artificial Sequence
  dgRNA
  Sptbn1
gacctgaccgtgcgc

SEQ ID NO: 38935 - DNA, 15 bp, Artificial Sequence
  dgRNA
  Sptbn1
gaccgtgcgcgggtt

SEQ ID NO: 38936 - DNA, 15 bp, Artificial Sequence
  dgRNA
  Sptbn1
accgtgcgcgggtta

SEQ ID NO: 38937 - DNA, 15 bp, Artificial Sequence
  dgRNA
  Aebp2
cttccctagctgtaa

SEQ ID NO: 38938 - DNA, 15 bp, Artificial Sequence
  dgRNA
  Aebp2
ttccctagctgtaaa

SEQ ID NO: 38939 - DNA, 15 bp, Artificial Sequence
  dgRNA
  Aebp2
ggtttgactcttgcc

SEQ ID NO: 38940 - DNA, 15 bp, Artificial Sequence
  dgRNA
  Aebp2
tgaacttctcggtaa

SEQ ID NO: 38941 - DNA, 15 bp, Artificial Sequence
  dgRNA
  2310009B15Rik
gtcggtctaggggcg

SEQ ID NO: 38942 - DNA, 15 bp, Artificial Sequence
  dgRNA
  2310009B15Rik
ggtcggtctaggggc

SEQ ID NO: 38943 - DNA, 15 bp, Artificial Sequence
  dgRNA
  2310009B15Rik
gggtcggtctagggg

SEQ ID NO: 38944 - DNA, 15 bp, Artificial Sequence
  dgRNA
  2310009B15Rik
gcggggtcggtctag

SEQ ID NO: 38945 - DNA, 15 bp, Artificial Sequence
  dgRNA
  Nup43
gttgccaaagggttt

SEQ ID NO: 38946 - DNA, 15 bp, Artificial Sequence
  dgRNA
  Nup43
attctttcagcccaa

SEQ ID NO: 38947 - DNA, 15 bp, Artificial Sequence
  dgRNA
  Nup43
cctgctgacgagaat

SEQ ID NO: 38948 - DNA, 15 bp, Artificial Sequence
  dgRNA
  Nup43
gccaccgtctccttc

SEQ ID NO: 38949 - DNA, 15 bp, Artificial Sequence
  dgRNA
  Dmd
atatgtagtgtccat

SEQ ID NO: 38950 - DNA, 15 bp, Artificial Sequence
  dgRNA
  Dmd
tgggcagtcctatta

SEQ ID NO: 38951 - DNA, 15 bp, Artificial Sequence
  dgRNA
  Dmd
gggcagtcctattat

SEQ ID NO: 38952 - DNA, 15 bp, Artificial Sequence
  dgRNA
  Dmd
cacttgcttgtgcgc

SEQ ID NO: 38953 - DNA, 15 bp, Artificial Sequence
  dgRNA
  Ripply2
actcgctccagcagc

SEQ ID NO: 38954 - DNA, 15 bp, Artificial Sequence
  dgRNA
  Ripply2
ggttcccgggccatt

SEQ ID NO: 38955 - DNA, 15 bp, Artificial Sequence
  dgRNA
  Ripply2
gttcccgggccattt

SEQ ID NO: 38956 - DNA, 15 bp, Artificial Sequence
  dgRNA
  Ripply2
gttcacacccgcgcg

SEQ ID NO: 38957 - DNA, 15 bp, Artificial Sequence
  dgRNA
  Glcci1
attccgagtgagaag

SEQ ID NO: 38958 - DNA, 15 bp, Artificial Sequence
  dgRNA
  Glcci1
ttccgagtgagaagc

SEQ ID NO: 38959 - DNA, 15 bp, Artificial Sequence
  dgRNA
  Glcci1
gtgagaagcgggtcg

SEQ ID NO: 38960 - DNA, 15 bp, Artificial Sequence
  dgRNA
  Glcci1
agaagcgggtcgagg

SEQ ID NO: 38961 - DNA, 15 bp, Artificial Sequence
  dgRNA
  Ice1
gtgctgtcgtcgctt

SEQ ID NO: 38962 - DNA, 15 bp, Artificial Sequence
  dgRNA
  Ice1
tgctgtcgtcgcttt

SEQ ID NO: 38963 - DNA, 15 bp, Artificial Sequence
  dgRNA
  Ice1
gtcgctttgggccct

SEQ ID NO: 38964 - DNA, 15 bp, Artificial Sequence
  dgRNA
  Ice1
tcgctttgggccctc

SEQ ID NO: 38965 - DNA, 15 bp, Artificial Sequence
  dgRNA
  Olfr1015
cacatcatgttattc

SEQ ID NO: 38966 - DNA, 15 bp, Artificial Sequence
  dgRNA
  Olfr1015
ctgaataacatgatg

SEQ ID NO: 38967 - DNA, 15 bp, Artificial Sequence
  dgRNA
  Olfr1015
gcaatcaacaaatac

SEQ ID NO: 38968 - DNA, 15 bp, Artificial Sequence
  dgRNA
  Adgrg5
tagccgacagctcag

SEQ ID NO: 38969 - DNA, 15 bp, Artificial Sequence
  dgRNA
  Adgrg5
ggagcatagggtgaa

SEQ ID NO: 38970 - DNA, 15 bp, Artificial Sequence
  dgRNA
  Adgrg5
ggagtaagtaggccg

SEQ ID NO: 38971 - DNA, 15 bp, Artificial Sequence
  dgRNA
  Adgrg5
ttggtcacactctgg

SEQ ID NO: 38972 - DNA, 15 bp, Artificial Sequence
  dgRNA
  Tbxas1
gacaggcgggcctca

SEQ ID NO: 38973 - DNA, 15 bp, Artificial Sequence
  dgRNA
  Map3k7cl
gaatagacgcagaca

SEQ ID NO: 38974 - DNA, 15 bp, Artificial Sequence
  dgRNA
  Map3k7cl
acgcagacacggatt

SEQ ID NO: 38975 - DNA, 15 bp, Artificial Sequence
  dgRNA
  Map3k7cl
tctattccagcgaac

SEQ ID NO: 38976 - DNA, 15 bp, Artificial Sequence
  dgRNA
  Map3k7cl
acaggaatgtcttcg

SEQ ID NO: 38977 - DNA, 15 bp, Artificial Sequence
  dgRNA
  Pml
cgcagcatgcacacc

SEQ ID NO: 38978 - DNA, 15 bp, Artificial Sequence
  dgRNA
  Ctps
tctagacctcgggcg

SEQ ID NO: 38979 - DNA, 15 bp, Artificial Sequence
  dgRNA
  Ctps
taaccggaaccctga

SEQ ID NO: 38980 - DNA, 15 bp, Artificial Sequence
  dgRNA
  Ctps
ctaaccggaaccctg

SEQ ID NO: 38981 - DNA, 15 bp, Artificial Sequence
  dgRNA
  Ctps
tgactcgcatctaac

SEQ ID NO: 38982 - DNA, 15 bp, Artificial Sequence
  dgRNA
  Utp6
tttttccggtctccg

SEQ ID NO: 38983 - DNA, 15 bp, Artificial Sequence
  dgRNA
  Utp6
ggtctccgaggcgcg

SEQ ID NO: 38984 - DNA, 15 bp, Artificial Sequence
  dgRNA
  Utp6
ttcccagaccggaaa

SEQ ID NO: 38985 - DNA, 15 bp, Artificial Sequence
  dgRNA
  Utp6
cctatagtcaaccac

SEQ ID NO: 38986 - DNA, 15 bp, Artificial Sequence
  dgRNA
  Slc6a4
acgcaaaaattcttg

SEQ ID NO: 38987 - DNA, 15 bp, Artificial Sequence
  dgRNA
  Slc6a4
tcttgcggagctctt

SEQ ID NO: 38988 - DNA, 15 bp, Artificial Sequence
  dgRNA
  Slc6a4
tgcggagctctttgg

SEQ ID NO: 38989 - DNA, 15 bp, Artificial Sequence
  dgRNA
  Slc6a4
ggagctctttggcgg

SEQ ID NO: 38990 - DNA, 15 bp, Artificial Sequence
  dgRNA
  Esyt3
tttatgccagacagt

SEQ ID NO: 38991 - DNA, 15 bp, Artificial Sequence
  dgRNA
  Esyt3
cctcaaggcctcatc

SEQ ID NO: 38992 - DNA, 15 bp, Artificial Sequence
  dgRNA
  Esyt3
ccgccccttttcacc

SEQ ID NO: 38993 - DNA, 15 bp, Artificial Sequence
  dgRNA
  Esyt3
cgccccttttcacct

SEQ ID NO: 38994 - DNA, 15 bp, Artificial Sequence
  dgRNA
  Phf23
gctcttcgcccgtcc

SEQ ID NO: 38995 - DNA, 15 bp, Artificial Sequence
  dgRNA
  Phf23
gacgcgaagtagcgt

SEQ ID NO: 38996 - DNA, 15 bp, Artificial Sequence
  dgRNA
  Phf23
acgcgaagtagcgtt

SEQ ID NO: 38997 - DNA, 15 bp, Artificial Sequence
  dgRNA
  Phf23
cgcgaagtagcgttg

SEQ ID NO: 38998 - DNA, 15 bp, Artificial Sequence
  dgRNA
  Pex12
atggcaaccggcgtc

SEQ ID NO: 38999 - DNA, 15 bp, Artificial Sequence
  dgRNA
  Pex12
caaccggcgtcaggc

SEQ ID NO: 39000 - DNA, 15 bp, Artificial Sequence
  dgRNA
  Pex12
aaccggcgtcaggca

SEQ ID NO: 39001 - DNA, 15 bp, Artificial Sequence
  dgRNA
  Pex12
cccagctcggcacag

SEQ ID NO: 39002 - DNA, 15 bp, Artificial Sequence
  dgRNA
  Six2
gggtgggagccgccc

SEQ ID NO: 39003 - DNA, 15 bp, Artificial Sequence
  dgRNA
  Six2
cgggccgccggggct

SEQ ID NO: 39004 - DNA, 15 bp, Artificial Sequence
  dgRNA
  Six2
cggggctcgggttac

SEQ ID NO: 39005 - DNA, 15 bp, Artificial Sequence
  dgRNA
  Six2
gactcgactattgtc

SEQ ID NO: 39006 - DNA, 15 bp, Artificial Sequence
  dgRNA
  Samd4b
aatgctggcgcacag

SEQ ID NO: 39007 - DNA, 15 bp, Artificial Sequence
  dgRNA
  Samd4b
cgcacagtggccctc

SEQ ID NO: 39008 - DNA, 15 bp, Artificial Sequence
  dgRNA
  Samd4b
cacagtggccctccg

SEQ ID NO: 39009 - DNA, 15 bp, Artificial Sequence
  dgRNA
  Samd4b
gtggccctccggggc

SEQ ID NO: 39010 - DNA, 15 bp, Artificial Sequence
  dgRNA
  Arid2
gccctgcgctccccc

SEQ ID NO: 39011 - DNA, 15 bp, Artificial Sequence
  dgRNA
  Arid2
acgggcggccgggcg

SEQ ID NO: 39012 - DNA, 15 bp, Artificial Sequence
  dgRNA
  Arid2
aggcgacgggcggcc

SEQ ID NO: 39013 - DNA, 15 bp, Artificial Sequence
  dgRNA
  Arid2
caggcgacgggcggc

SEQ ID NO: 39014 - DNA, 15 bp, Artificial Sequence
  dgRNA
  Usb1
agacccgcagacctg

SEQ ID NO: 39015 - DNA, 15 bp, Artificial Sequence
  dgRNA
  Usb1
cccacactggggcga

SEQ ID NO: 39016 - DNA, 15 bp, Artificial Sequence
  dgRNA
  Usb1
ggcgacggagtgatc

SEQ ID NO: 39017 - DNA, 15 bp, Artificial Sequence
  dgRNA
  Usb1
acggagtgatccgga

SEQ ID NO: 39018 - DNA, 15 bp, Artificial Sequence
  dgRNA
  Fam69c
gctgcgactcctacg

SEQ ID NO: 39019 - DNA, 15 bp, Artificial Sequence
  dgRNA
  Fam69c
cctacgcggtgcccc

SEQ ID NO: 39020 - DNA, 15 bp, Artificial Sequence
  dgRNA
  Fam69c
ggcgaccggagctca

SEQ ID NO: 39021 - DNA, 15 bp, Artificial Sequence
  dgRNA
  Fam69c
gggctggcaatggcg

SEQ ID NO: 39022 - DNA, 15 bp, Artificial Sequence
  dgRNA
  Ptpn20
aggaaacttaactgc

SEQ ID NO: 39023 - DNA, 15 bp, Artificial Sequence
  dgRNA
  Ptpn20
gcgctgaagttcctc

SEQ ID NO: 39024 - DNA, 15 bp, Artificial Sequence
  dgRNA
  Ptpn20
cggtcctctctgacc

SEQ ID NO: 39025 - DNA, 15 bp, Artificial Sequence
  dgRNA
  Ptpn20
ggtttacaccagctc

SEQ ID NO: 39026 - DNA, 15 bp, Artificial Sequence
  dgRNA
  Tex2
cctccaggcccgtcg

SEQ ID NO: 39027 - DNA, 15 bp, Artificial Sequence
  dgRNA
  Tex2
ctccaggcccgtcgc

SEQ ID NO: 39028 - DNA, 15 bp, Artificial Sequence
  dgRNA
  Tex2
cccgtcgcgggcgcg

SEQ ID NO: 39029 - DNA, 15 bp, Artificial Sequence
  dgRNA
  Tex2
gcgggcgcgcggcac

SEQ ID NO: 39030 - DNA, 15 bp, Artificial Sequence
  dgRNA
  Sez6
cccgcgcggcgatcc

SEQ ID NO: 39031 - DNA, 15 bp, Artificial Sequence
  dgRNA
  Sez6
ccgcgcggcgatccc

SEQ ID NO: 39032 - DNA, 15 bp, Artificial Sequence
  dgRNA
  Sez6
ccgggcgccgacgcc

SEQ ID NO: 39033 - DNA, 15 bp, Artificial Sequence
  dgRNA
  Sez6
gccgacgccaggcgc

SEQ ID NO: 39034 - DNA, 15 bp, Artificial Sequence
  dgRNA
  Rest
ggtaagtttcccccg

SEQ ID NO: 39035 - DNA, 15 bp, Artificial Sequence
  dgRNA
  Rest
ccgaggcgcgccccc

SEQ ID NO: 39036 - DNA, 15 bp, Artificial Sequence
  dgRNA
  Rest
ggcgcgcccccaggc

SEQ ID NO: 39037 - DNA, 15 bp, Artificial Sequence
  dgRNA
  Rest
gtccacttcgagcct

SEQ ID NO: 39038 - DNA, 15 bp, Artificial Sequence
  dgRNA
  Olfr659
aatgagccctattaa

SEQ ID NO: 39039 - DNA, 15 bp, Artificial Sequence
  dgRNA
  Olfr659
tatcctaattaatct

SEQ ID NO: 39040 - DNA, 15 bp, Artificial Sequence
  dgRNA
  Olfr659
ttaatcttggaaggt

SEQ ID NO: 39041 - DNA, 15 bp, Artificial Sequence
  dgRNA
  Olfr659
aatagggctcattga

SEQ ID NO: 39042 - DNA, 15 bp, Artificial Sequence
  dgRNA
  Dlec1
tgtccagccctcggg

SEQ ID NO: 39043 - DNA, 15 bp, Artificial Sequence
  dgRNA
  Dlec1
gctagattacctagc

SEQ ID NO: 39044 - DNA, 15 bp, Artificial Sequence
  dgRNA
  Dlec1
acctagctggacgtt

SEQ ID NO: 39045 - DNA, 15 bp, Artificial Sequence
  dgRNA
  Dlec1
tttagatgacgacag

SEQ ID NO: 39046 - DNA, 15 bp, Artificial Sequence
  dgRNA
  S100z
gaacaccgtctttaa

SEQ ID NO: 39047 - DNA, 15 bp, Artificial Sequence
  dgRNA
  S100z
tttaagaactgtcgc

SEQ ID NO: 39048 - DNA, 15 bp, Artificial Sequence
  dgRNA
  S100z
tcacggaagagctga

SEQ ID NO: 39049 - DNA, 15 bp, Artificial Sequence
  dgRNA
  S100z
gccttccccctggtt

SEQ ID NO: 39050 - DNA, 15 bp, Artificial Sequence
  dgRNA
  Irs3
gcccctgtgaaagtt

SEQ ID NO: 39051 - DNA, 15 bp, Artificial Sequence
  dgRNA
  Irs3
aaagtttggtcccag

SEQ ID NO: 39052 - DNA, 15 bp, Artificial Sequence
  dgRNA
  Irs3
ggtcccagcggtgca

SEQ ID NO: 39053 - DNA, 15 bp, Artificial Sequence
  dgRNA
  Irs3
tcctgcactcgggcg

SEQ ID NO: 39054 - DNA, 15 bp, Artificial Sequence
  dgRNA
  Hells
cgatcggggccacta

SEQ ID NO: 39055 - DNA, 15 bp, Artificial Sequence
  dgRNA
  Hells
ggccactacggtctg

SEQ ID NO: 39056 - DNA, 15 bp, Artificial Sequence
  dgRNA
  Hells
gcgcctctgtgacca

SEQ ID NO: 39057 - DNA, 15 bp, Artificial Sequence
  dgRNA
  Hells
cacgggcgacattca

SEQ ID NO: 39058 - DNA, 15 bp, Artificial Sequence
  dgRNA
  Ktn1
gtatagttgaggtgc

SEQ ID NO: 39059 - DNA, 15 bp, Artificial Sequence
  dgRNA
  Ktn1
tgttctgagtaagat

SEQ ID NO: 39060 - DNA, 15 bp, Artificial Sequence
  dgRNA
  Ktn1
aagtgctaactgtca

SEQ ID NO: 39061 - DNA, 15 bp, Artificial Sequence
  dgRNA
  Ktn1
gctaactgtcagggc

SEQ ID NO: 39062 - DNA, 15 bp, Artificial Sequence
  dgRNA
  Slc25a46
agcatccctgctagc

SEQ ID NO: 39063 - DNA, 15 bp, Artificial Sequence
  dgRNA
  Slc25a46
acaccttgcatctcc

SEQ ID NO: 39064 - DNA, 15 bp, Artificial Sequence
  dgRNA
  Slc25a46
cctagcaaccaactc

SEQ ID NO: 39065 - DNA, 15 bp, Artificial Sequence
  dgRNA
  Slc25a46
ctagcaaccaactca

SEQ ID NO: 39066 - DNA, 15 bp, Artificial Sequence
  dgRNA
  Satb1
gttctagtgtcatgc

SEQ ID NO: 39067 - DNA, 15 bp, Artificial Sequence
  dgRNA
  Cacna1i
cgaccctaaattgtt

SEQ ID NO: 39068 - DNA, 15 bp, Artificial Sequence
  dgRNA
  Cacna1i
ccctaaattgttagg

SEQ ID NO: 39069 - DNA, 15 bp, Artificial Sequence
  dgRNA
  Cacna1i
aggtggctgcactcc

SEQ ID NO: 39070 - DNA, 15 bp, Artificial Sequence
  dgRNA
  Cacna1i
gtggctgcactcccg

SEQ ID NO: 39071 - DNA, 15 bp, Artificial Sequence
  dgRNA
  Gcat
tcagcttccccatcg

SEQ ID NO: 39072 - DNA, 15 bp, Artificial Sequence
  dgRNA
  Gcat
ccatcgcggacctcc

SEQ ID NO: 39073 - DNA, 15 bp, Artificial Sequence
  dgRNA
  Gcat
catcgcggacctccc

SEQ ID NO: 39074 - DNA, 15 bp, Artificial Sequence
  dgRNA
  Gcat
tcaatcctttcttgg

SEQ ID NO: 39075 - DNA, 15 bp, Artificial Sequence
  dgRNA
  Mybpc2
tttagagcatgcaag

SEQ ID NO: 39076 - DNA, 15 bp, Artificial Sequence
  dgRNA
  Mybpc2
tgcaagaggaatgcg

SEQ ID NO: 39077 - DNA, 15 bp, Artificial Sequence
  dgRNA
  Mybpc2
ctcgagactccataa

SEQ ID NO: 39078 - DNA, 15 bp, Artificial Sequence
  dgRNA
  Mybpc2
ataaagggctcctcc

SEQ ID NO: 39079 - DNA, 15 bp, Artificial Sequence
  dgRNA
  Ank3
cccgtgacagcagcc

SEQ ID NO: 39080 - DNA, 15 bp, Artificial Sequence
  dgRNA
  Ank3
gcagccgctctgcct

SEQ ID NO: 39081 - DNA, 15 bp, Artificial Sequence
  dgRNA
  Ank3
ggggagttccctaaa

SEQ ID NO: 39082 - DNA, 15 bp, Artificial Sequence
  dgRNA
  Ank3
tccctaaatggactt

SEQ ID NO: 39083 - DNA, 15 bp, Artificial Sequence
  dgRNA
  Rnf215
ccatcgcagctcctc

SEQ ID NO: 39084 - DNA, 15 bp, Artificial Sequence
  dgRNA
  Rnf215
caggcctcctacatt

SEQ ID NO: 39085 - DNA, 15 bp, Artificial Sequence
  dgRNA
  Rnf215
tacattaggtttctc

SEQ ID NO: 39086 - DNA, 15 bp, Artificial Sequence
  dgRNA
  Rnf215
gagccccgccctgtc

SEQ ID NO: 39087 - DNA, 15 bp, Artificial Sequence
  dgRNA
  Fam83a
ccgacatggatccta

SEQ ID NO: 39088 - DNA, 15 bp, Artificial Sequence
  dgRNA
  Fam83a
cgacatggatcctat

SEQ ID NO: 39089 - DNA, 15 bp, Artificial Sequence
  dgRNA
  Fam83a
atcctatgggttccc

SEQ ID NO: 39090 - DNA, 15 bp, Artificial Sequence
  dgRNA
  Fam83a
gccatactccccaaa

SEQ ID NO: 39091 - DNA, 15 bp, Artificial Sequence
  dgRNA
  Hemk1
gtacttccccttagg

SEQ ID NO: 39092 - DNA, 15 bp, Artificial Sequence
  dgRNA
  Hemk1
tacttccccttaggg

SEQ ID NO: 39093 - DNA, 15 bp, Artificial Sequence
  dgRNA
  Hemk1
aaatccggccacttt

SEQ ID NO: 39094 - DNA, 15 bp, Artificial Sequence
  dgRNA
  Hemk1
aggaaccctagacca

SEQ ID NO: 39095 - DNA, 15 bp, Artificial Sequence
  dgRNA
  Adgrl4
catctgtaatctgac

SEQ ID NO: 39096 - DNA, 15 bp, Artificial Sequence
  dgRNA
  Adgrl4
ggcctggctgccgga

SEQ ID NO: 39097 - DNA, 15 bp, Artificial Sequence
  dgRNA
  Adgrl4
gctgccggacggacg

SEQ ID NO: 39098 - DNA, 15 bp, Artificial Sequence
  dgRNA
  Adgrl4
aggccggaaagtgac

SEQ ID NO: 39099 - DNA, 15 bp, Artificial Sequence
  dgRNA
  Ddx1
tcgtaactctgaaga

SEQ ID NO: 39100 - DNA, 15 bp, Artificial Sequence
  dgRNA
  Ddx1
atggatatcaataac

SEQ ID NO: 39101 - DNA, 15 bp, Artificial Sequence
  dgRNA
  Ddx1
cagggcttggctatt

SEQ ID NO: 39102 - DNA, 15 bp, Artificial Sequence
  dgRNA
  Ddx1
agggcttggctatta

SEQ ID NO: 39103 - DNA, 15 bp, Artificial Sequence
  dgRNA
  Olfr1106
gtacctgctaatgac

SEQ ID NO: 39104 - DNA, 15 bp, Artificial Sequence
  dgRNA
  Smap1
atcgtcagatgaaca

SEQ ID NO: 39105 - DNA, 15 bp, Artificial Sequence
  dgRNA
  Smap1
gtgaatcagcttatg

SEQ ID NO: 39106 - DNA, 15 bp, Artificial Sequence
  dgRNA
  Smap1
tgaatcagcttatga

SEQ ID NO: 39107 - DNA, 15 bp, Artificial Sequence
  dgRNA
  Smap1
ccaataccgagctgt

SEQ ID NO: 39108 - DNA, 15 bp, Artificial Sequence
  dgRNA
  Pabpn1l
tagcctagcccaagc

SEQ ID NO: 39109 - DNA, 15 bp, Artificial Sequence
  dgRNA
  Pabpn1l
gggggagcacttaaa

SEQ ID NO: 39110 - DNA, 15 bp, Artificial Sequence
  dgRNA
  Pabpn1l
ggggagcacttaaaa

SEQ ID NO: 39111 - DNA, 15 bp, Artificial Sequence
  dgRNA
  Pabpn1l
gagcacttaaaaggg

SEQ ID NO: 39112 - DNA, 15 bp, Artificial Sequence
  dgRNA
  Taf11
tctgccctgaagcgg

SEQ ID NO: 39113 - DNA, 15 bp, Artificial Sequence
  dgRNA
  Taf11
tttatatgaatcccc

SEQ ID NO: 39114 - DNA, 15 bp, Artificial Sequence
  dgRNA
  Taf11
ttatatgaatcccct

SEQ ID NO: 39115 - DNA, 15 bp, Artificial Sequence
  dgRNA
  Taf11
caaccaacgcgcttc

SEQ ID NO: 39116 - DNA, 15 bp, Artificial Sequence
  dgRNA
  Urod
actgcgtcgcaacag

SEQ ID NO: 39117 - DNA, 15 bp, Artificial Sequence
  dgRNA
  Urod
cggtaaaaaattgtt

SEQ ID NO: 39118 - DNA, 15 bp, Artificial Sequence
  dgRNA
  Urod
ttgtttgggtcctac

SEQ ID NO: 39119 - DNA, 15 bp, Artificial Sequence
  dgRNA
  Urod
ggtcctacgggcagc

SEQ ID NO: 39120 - DNA, 15 bp, Artificial Sequence
  dgRNA
  Lcp2
cccacagttcactag

SEQ ID NO: 39121 - DNA, 15 bp, Artificial Sequence
  dgRNA
  Lcp2
gtctgtaatactaat

SEQ ID NO: 39122 - DNA, 15 bp, Artificial Sequence
  dgRNA
  Lcp2
tacttgaactgacac

SEQ ID NO: 39123 - DNA, 15 bp, Artificial Sequence
  dgRNA
  Lcp2
ccactagtgaactgt

SEQ ID NO: 39124 - DNA, 15 bp, Artificial Sequence
  dgRNA
  Fam46a
agacgcgagtgtgcg

SEQ ID NO: 39125 - DNA, 15 bp, Artificial Sequence
  dgRNA
  Fam46a
cgcgagtgtgcgcgg

SEQ ID NO: 39126 - DNA, 15 bp, Artificial Sequence
  dgRNA
  Fam46a
tgtgcgcggtggcat

SEQ ID NO: 39127 - DNA, 15 bp, Artificial Sequence
  dgRNA
  Fam46a
gcgcggtggcatcgg

SEQ ID NO: 39128 - DNA, 15 bp, Artificial Sequence
  dgRNA
  Fam207a
cgtaacgtgcacccg

SEQ ID NO: 39129 - DNA, 15 bp, Artificial Sequence
  dgRNA
  Fam207a
cgtctaacgcgctag

SEQ ID NO: 39130 - DNA, 15 bp, Artificial Sequence
  dgRNA
  Fam207a
gtctaacgcgctagc

SEQ ID NO: 39131 - DNA, 15 bp, Artificial Sequence
  dgRNA
  Fam207a
actgcgcacgcgcta

SEQ ID NO: 39132 - DNA, 15 bp, Artificial Sequence
  dgRNA
  Pih1d1
taaacgaaaaccgcg

SEQ ID NO: 39133 - DNA, 15 bp, Artificial Sequence
  dgRNA
  Pih1d1
aggcttccgcactgt

SEQ ID NO: 39134 - DNA, 15 bp, Artificial Sequence
  dgRNA
  Pih1d1
gcttccgcactgtag

SEQ ID NO: 39135 - DNA, 15 bp, Artificial Sequence
  dgRNA
  Pih1d1
aaatcacgcgctcag

SEQ ID NO: 39136 - DNA, 15 bp, Artificial Sequence
  dgRNA
  Efcc1
agcgatggggagtgc

SEQ ID NO: 39137 - DNA, 15 bp, Artificial Sequence
  dgRNA
  Efcc1
tccagcgcctcccat

SEQ ID NO: 39138 - DNA, 15 bp, Artificial Sequence
  dgRNA
  Efcc1
gtccacgcagctgcc

SEQ ID NO: 39139 - DNA, 15 bp, Artificial Sequence
  dgRNA
  Efcc1
ggtcccgtgcctctc

SEQ ID NO: 39140 - DNA, 15 bp, Artificial Sequence
  dgRNA
  1190005I06Rik
actgcagcgacgagc

SEQ ID NO: 39141 - DNA, 15 bp, Artificial Sequence
  dgRNA
  1190005I06Rik
ctgcagcgacgagcc

SEQ ID NO: 39142 - DNA, 15 bp, Artificial Sequence
  dgRNA
  1190005I06Rik
tgcagcgacgagccg

SEQ ID NO: 39143 - DNA, 15 bp, Artificial Sequence
  dgRNA
  1190005I06Rik
tctgcgtctctgcac

SEQ ID NO: 39144 - DNA, 15 bp, Artificial Sequence
  dgRNA
  AI429214
cgtatgctcaacacc

SEQ ID NO: 39145 - DNA, 15 bp, Artificial Sequence
  dgRNA
  AI429214
aaaggggcgggatac

SEQ ID NO: 39146 - DNA, 15 bp, Artificial Sequence
  dgRNA
  AI429214
ctcactgcgcatgac

SEQ ID NO: 39147 - DNA, 15 bp, Artificial Sequence
  dgRNA
  AI429214
catacgtaagtccca

SEQ ID NO: 39148 - DNA, 15 bp, Artificial Sequence
  dgRNA
  Lrp5
gtacagagacttggc

SEQ ID NO: 39149 - DNA, 15 bp, Artificial Sequence
  dgRNA
  Lrp5
cggcctctcctgtcg

SEQ ID NO: 39150 - DNA, 15 bp, Artificial Sequence
  dgRNA
  Lrp5
ggcctctcctgtcgc

SEQ ID NO: 39151 - DNA, 15 bp, Artificial Sequence
  dgRNA
  Lrp5
ctcctgtcgcgggcc

SEQ ID NO: 39152 - DNA, 15 bp, Artificial Sequence
  dgRNA
  Epha4
ccttgagccctgcgg

SEQ ID NO: 39153 - DNA, 15 bp, Artificial Sequence
  dgRNA
  Epha4
gcgggacctcggggg

SEQ ID NO: 39154 - DNA, 15 bp, Artificial Sequence
  dgRNA
  Epha4
cgggacctcgggggt

SEQ ID NO: 39155 - DNA, 15 bp, Artificial Sequence
  dgRNA
  Epha4
gtgggctctgcaccg

SEQ ID NO: 39156 - DNA, 15 bp, Artificial Sequence
  dgRNA
  Trim69
aaactctgattggat

SEQ ID NO: 39157 - DNA, 15 bp, Artificial Sequence
  dgRNA
  Smpd2
ccgcacgtgacatgc

SEQ ID NO: 39158 - DNA, 15 bp, Artificial Sequence
  dgRNA
  Smpd2
cgcacgtgacatgct

SEQ ID NO: 39159 - DNA, 15 bp, Artificial Sequence
  dgRNA
  Smpd2
gcacgtgacatgctg

SEQ ID NO: 39160 - DNA, 15 bp, Artificial Sequence
  dgRNA
  Smpd2
cacgtgacatgctgg

SEQ ID NO: 39161 - DNA, 15 bp, Artificial Sequence
  dgRNA
  Tas2r108
gactagtggatgttg

SEQ ID NO: 39162 - DNA, 15 bp, Artificial Sequence
  dgRNA
  Tas2r108
aagcttaattgaatc

SEQ ID NO: 39163 - DNA, 15 bp, Artificial Sequence
  dgRNA
  Olfr346
aaaagtcctcatact

SEQ ID NO: 39164 - DNA, 15 bp, Artificial Sequence
  dgRNA
  Olfr346
cataaaatgttcccg

SEQ ID NO: 39165 - DNA, 15 bp, Artificial Sequence
  dgRNA
  Olfr346
tgtctaatacaccac

SEQ ID NO: 39166 - DNA, 15 bp, Artificial Sequence
  dgRNA
  Mrfap1
atcggaataagatac

SEQ ID NO: 39167 - DNA, 15 bp, Artificial Sequence
  dgRNA
  Mrfap1
tgcaaaagctgcgaa

SEQ ID NO: 39168 - DNA, 15 bp, Artificial Sequence
  dgRNA
  Mrfap1
gcaaaagctgcgaaa

SEQ ID NO: 39169 - DNA, 15 bp, Artificial Sequence
  dgRNA
  Mrfap1
aaagctgcgaaaggg

SEQ ID NO: 39170 - DNA, 15 bp, Artificial Sequence
  dgRNA
  Tmprss11a
ttccgtatttcttcc

SEQ ID NO: 39171 - DNA, 15 bp, Artificial Sequence
  dgRNA
  Tmprss11a
tgtcatagagctgat

SEQ ID NO: 39172 - DNA, 15 bp, Artificial Sequence
  dgRNA
  Tmprss11a
gaacgtcaagttcag

SEQ ID NO: 39173 - DNA, 15 bp, Artificial Sequence
  dgRNA
  Tmprss11a
gtgatgtatctgcat

SEQ ID NO: 39174 - DNA, 15 bp, Artificial Sequence
  dgRNA
  H13
gcacggaaaggcaag

SEQ ID NO: 39175 - DNA, 15 bp, Artificial Sequence
  dgRNA
  Themis2
ccccattcaagagtt

SEQ ID NO: 39176 - DNA, 15 bp, Artificial Sequence
  dgRNA
  Themis2
ccattcaagagttcg

SEQ ID NO: 39177 - DNA, 15 bp, Artificial Sequence
  dgRNA
  Themis2
agggctcccgacctg

SEQ ID NO: 39178 - DNA, 15 bp, Artificial Sequence
  dgRNA
  Themis2
gggctcccgacctga

SEQ ID NO: 39179 - DNA, 15 bp, Artificial Sequence
  dgRNA
  Folr2
ctcgtctgaccatca

SEQ ID NO: 39180 - DNA, 15 bp, Artificial Sequence
  dgRNA
  Folr2
cgtgatggtcagacg

SEQ ID NO: 39181 - DNA, 15 bp, Artificial Sequence
  dgRNA
  Folr2
atacagtgtccgtga

SEQ ID NO: 39182 - DNA, 15 bp, Artificial Sequence
  dgRNA
  Folr2
gactccaccctgttc

SEQ ID NO: 39183 - DNA, 15 bp, Artificial Sequence
  dgRNA
  4933402J07Rik
gtgttacatagcatc

SEQ ID NO: 39184 - DNA, 15 bp, Artificial Sequence
  dgRNA
  4933402J07Rik
gagaccatagaacgt

SEQ ID NO: 39185 - DNA, 15 bp, Artificial Sequence
  dgRNA
  4933402J07Rik
agaccatagaacgta

SEQ ID NO: 39186 - DNA, 15 bp, Artificial Sequence
  dgRNA
  4933402J07Rik
gaccatagaacgtag

SEQ ID NO: 39187 - DNA, 15 bp, Artificial Sequence
  dgRNA
  Zfp109
tttgctgacgcattc

SEQ ID NO: 39188 - DNA, 15 bp, Artificial Sequence
  dgRNA
  Zfp109
ttgctgacgcattct

SEQ ID NO: 39189 - DNA, 15 bp, Artificial Sequence
  dgRNA
  Zfp109
ttccggcgcctgtgt

SEQ ID NO: 39190 - DNA, 15 bp, Artificial Sequence
  dgRNA
  Zfp109
cgcctgtgtaggtcg

SEQ ID NO: 39191 - DNA, 15 bp, Artificial Sequence
  dgRNA
  Ccdc166
aatgggatgaggtcg

SEQ ID NO: 39192 - DNA, 15 bp, Artificial Sequence
  dgRNA
  Ccdc166
agaggttgttcaagc

SEQ ID NO: 39193 - DNA, 15 bp, Artificial Sequence
  dgRNA
  Ccdc166
acagtgtcgcaggtc

SEQ ID NO: 39194 - DNA, 15 bp, Artificial Sequence
  dgRNA
  Ccdc166
cagttacagtgtcgc

SEQ ID NO: 39195 - DNA, 15 bp, Artificial Sequence
  dgRNA
  Sec24a
caccagcggtagccg

SEQ ID NO: 39196 - DNA, 15 bp, Artificial Sequence
  dgRNA
  Sec24a
ggtagccgaggacat

SEQ ID NO: 39197 - DNA, 15 bp, Artificial Sequence
  dgRNA
  Sec24a
gacatcggtcgtctc

SEQ ID NO: 39198 - DNA, 15 bp, Artificial Sequence
  dgRNA
  Sec24a
agagaatcccggaag

SEQ ID NO: 39199 - DNA, 15 bp, Artificial Sequence
  dgRNA
  Hoxd12
tcgccctccctcaac

SEQ ID NO: 39200 - DNA, 15 bp, Artificial Sequence
  dgRNA
  Hoxd12
tccctcaacaggctt

SEQ ID NO: 39201 - DNA, 15 bp, Artificial Sequence
  dgRNA
  Hoxd12
tcataataccctgaa

SEQ ID NO: 39202 - DNA, 15 bp, Artificial Sequence
  dgRNA
  Hoxd12
cataataccctgaaa

SEQ ID NO: 39203 - DNA, 15 bp, Artificial Sequence
  dgRNA
  Hebp2
attttgcagaggcgc

SEQ ID NO: 39204 - DNA, 15 bp, Artificial Sequence
  dgRNA
  Hebp2
cagcgttttcaatgt

SEQ ID NO: 39205 - DNA, 15 bp, Artificial Sequence
  dgRNA
  Hebp2
agcgttttcaatgta

SEQ ID NO: 39206 - DNA, 15 bp, Artificial Sequence
  dgRNA
  Hebp2
aatgggtgcccggac

SEQ ID NO: 39207 - DNA, 15 bp, Artificial Sequence
  dgRNA
  Parm1
aagcgacctaacggc

SEQ ID NO: 39208 - DNA, 15 bp, Artificial Sequence
  dgRNA
  Parm1
agcgacctaacggca

SEQ ID NO: 39209 - DNA, 15 bp, Artificial Sequence
  dgRNA
  Parm1
cccgctgtccagcag

SEQ ID NO: 39210 - DNA, 15 bp, Artificial Sequence
  dgRNA
  Parm1
tgggccgggactcct

SEQ ID NO: 39211 - DNA, 15 bp, Artificial Sequence
  dgRNA
  Catsperg2
gccttgggcccgtgc

SEQ ID NO: 39212 - DNA, 15 bp, Artificial Sequence
  dgRNA
  Catsperg2
ccttgggcccgtgct

SEQ ID NO: 39213 - DNA, 15 bp, Artificial Sequence
  dgRNA
  Catsperg2
gggctctagcaagtc

SEQ ID NO: 39214 - DNA, 15 bp, Artificial Sequence
  dgRNA
  Gpx2
cccacttgaccttta

SEQ ID NO: 39215 - DNA, 15 bp, Artificial Sequence
  dgRNA
  Gpx2
tgacctttatggctc

SEQ ID NO: 39216 - DNA, 15 bp, Artificial Sequence
  dgRNA
  Gpx2
ttccaggttgccagt

SEQ ID NO: 39217 - DNA, 15 bp, Artificial Sequence
  dgRNA
  Gpx2
ttcagtggcagtaag

SEQ ID NO: 39218 - DNA, 15 bp, Artificial Sequence
  dgRNA
  AU040320
ccgggcgcgatgctc

SEQ ID NO: 39219 - DNA, 15 bp, Artificial Sequence
  dgRNA
  AU040320
cgggcgcgatgctcc

SEQ ID NO: 39220 - DNA, 15 bp, Artificial Sequence
  dgRNA
  AU040320
gatgctccgggagcc

SEQ ID NO: 39221 - DNA, 15 bp, Artificial Sequence
  dgRNA
  AU040320
atgctccgggagcct

SEQ ID NO: 39222 - DNA, 15 bp, Artificial Sequence
  dgRNA
  Glipr1l2
cctcgatccgtagat

SEQ ID NO: 39223 - DNA, 15 bp, Artificial Sequence
  dgRNA
  Glipr1l2
gatccgtagattggc

SEQ ID NO: 39224 - DNA, 15 bp, Artificial Sequence
  dgRNA
  Glipr1l2
gacttgtgacaccaa

SEQ ID NO: 39225 - DNA, 15 bp, Artificial Sequence
  dgRNA
  Glipr1l2
ctacggatcgaggga

SEQ ID NO: 39226 - DNA, 15 bp, Artificial Sequence
  dgRNA
  Klk1b9
tacagtgggtgcaac

SEQ ID NO: 39227 - DNA, 15 bp, Artificial Sequence
  dgRNA
  Klk1b9
acagtgggtgcaaca

SEQ ID NO: 39228 - DNA, 15 bp, Artificial Sequence
  dgRNA
  Bco2
ggacttagcggcagg

SEQ ID NO: 39229 - DNA, 15 bp, Artificial Sequence
  dgRNA
  Bco2
gacttagcggcaggt

SEQ ID NO: 39230 - DNA, 15 bp, Artificial Sequence
  dgRNA
  Bco2
acttagcggcaggtg

SEQ ID NO: 39231 - DNA, 15 bp, Artificial Sequence
  dgRNA
  Bco2
cttagcggcaggtgg

SEQ ID NO: 39232 - DNA, 15 bp, Artificial Sequence
  dgRNA
  Thoc1
ttgccgtgcccaggg

SEQ ID NO: 39233 - DNA, 15 bp, Artificial Sequence
  dgRNA
  Thoc1
aacacgaaacaccct

SEQ ID NO: 39234 - DNA, 15 bp, Artificial Sequence
  dgRNA
  Thoc1
ccgctccactgctag

SEQ ID NO: 39235 - DNA, 15 bp, Artificial Sequence
  dgRNA
  Thoc1
ggcctacgcgccaca

SEQ ID NO: 39236 - DNA, 15 bp, Artificial Sequence
  dgRNA
  Dscc1
tgcaagagccgtgct

SEQ ID NO: 39237 - DNA, 15 bp, Artificial Sequence
  dgRNA
  Dscc1
ccgtgcttggccccg

SEQ ID NO: 39238 - DNA, 15 bp, Artificial Sequence
  dgRNA
  Dscc1
cgtgcttggccccgt

SEQ ID NO: 39239 - DNA, 15 bp, Artificial Sequence
  dgRNA
  Dscc1
gtgcttggccccgtg

SEQ ID NO: 39240 - DNA, 15 bp, Artificial Sequence
  dgRNA
  Gm17296
tcccaacaaagttga

SEQ ID NO: 39241 - DNA, 15 bp, Artificial Sequence
  dgRNA
  Gm17296
tgaaggaaccttatg

SEQ ID NO: 39242 - DNA, 15 bp, Artificial Sequence
  dgRNA
  Gm17296
tatgcggtcctatgc

SEQ ID NO: 39243 - DNA, 15 bp, Artificial Sequence
  dgRNA
  Gm17296
atgcggtcctatgcc

SEQ ID NO: 39244 - DNA, 15 bp, Artificial Sequence
  dgRNA
  Gfra1
gctactcgctgcagc

SEQ ID NO: 39245 - DNA, 15 bp, Artificial Sequence
  dgRNA
  Gfra1
tggacaccggtcaat

SEQ ID NO: 39246 - DNA, 15 bp, Artificial Sequence
  dgRNA
  Gfra1
ggacaccggtcaatt

SEQ ID NO: 39247 - DNA, 15 bp, Artificial Sequence
  dgRNA
  Gfra1
cggtcaattgggttc

SEQ ID NO: 39248 - DNA, 15 bp, Artificial Sequence
  dgRNA
  Inadl
agtccctaagtatgc

SEQ ID NO: 39249 - DNA, 15 bp, Artificial Sequence
  dgRNA
  Inadl
gtccctaagtatgca

SEQ ID NO: 39250 - DNA, 15 bp, Artificial Sequence
  dgRNA
  Inadl
gggtgaccgagcgtc

SEQ ID NO: 39251 - DNA, 15 bp, Artificial Sequence
  dgRNA
  Inadl
ggtgaccgagcgtca

SEQ ID NO: 39252 - DNA, 15 bp, Artificial Sequence
  dgRNA
  Hbq1b
aaatgtaaggcgtgg

SEQ ID NO: 39253 - DNA, 15 bp, Artificial Sequence
  dgRNA
  Hbq1b
aatgtaaggcgtgga

SEQ ID NO: 39254 - DNA, 15 bp, Artificial Sequence
  dgRNA
  Hbq1b
atgtaaggcgtggag

SEQ ID NO: 39255 - DNA, 15 bp, Artificial Sequence
  dgRNA
  Hbq1b
tgtaaggcgtggagg

SEQ ID NO: 39256 - DNA, 15 bp, Artificial Sequence
  dgRNA
  Nus1
gcccaatcattccat

SEQ ID NO: 39257 - DNA, 15 bp, Artificial Sequence
  dgRNA
  Nus1
aaaggctagaggcgt

SEQ ID NO: 39258 - DNA, 15 bp, Artificial Sequence
  dgRNA
  Nus1
cccagggggcgccag

SEQ ID NO: 39259 - DNA, 15 bp, Artificial Sequence
  dgRNA
  Nus1
ggggcgccagcggcc

SEQ ID NO: 39260 - DNA, 15 bp, Artificial Sequence
  dgRNA
  Edc4
aagtttagccactac

SEQ ID NO: 39261 - DNA, 15 bp, Artificial Sequence
  dgRNA
  Edc4
agtttagccactact

SEQ ID NO: 39262 - DNA, 15 bp, Artificial Sequence
  dgRNA
  Edc4
gcaagcagcctacgg

SEQ ID NO: 39263 - DNA, 15 bp, Artificial Sequence
  dgRNA
  Edc4
gcctctgataggaac

SEQ ID NO: 39264 - DNA, 15 bp, Artificial Sequence
  dgRNA
  Cd248
ccccggggagctagc

SEQ ID NO: 39265 - DNA, 15 bp, Artificial Sequence
  dgRNA
  Cd248
cccggggagctagca

SEQ ID NO: 39266 - DNA, 15 bp, Artificial Sequence
  dgRNA
  Cd248
ccggggagctagcag

SEQ ID NO: 39267 - DNA, 15 bp, Artificial Sequence
  dgRNA
  Cd248
agcccactccttaca

SEQ ID NO: 39268 - DNA, 15 bp, Artificial Sequence
  dgRNA
  Cbs
gcgtccagccgagct

SEQ ID NO: 39269 - DNA, 15 bp, Artificial Sequence
  dgRNA
  Cbs
tggcggagccagagt

SEQ ID NO: 39270 - DNA, 15 bp, Artificial Sequence
  dgRNA
  Cbs
gccgttctgcggccc

SEQ ID NO: 39271 - DNA, 15 bp, Artificial Sequence
  dgRNA
  Cbs
gcggcccaggattgg

SEQ ID NO: 39272 - DNA, 15 bp, Artificial Sequence
  dgRNA
  Slc35f4
cgtccttccctcaag

SEQ ID NO: 39273 - DNA, 15 bp, Artificial Sequence
  dgRNA
  Slc35f4
gtccttccctcaagt

SEQ ID NO: 39274 - DNA, 15 bp, Artificial Sequence
  dgRNA
  Slc35f4
tccctcaagtgggct

SEQ ID NO: 39275 - DNA, 15 bp, Artificial Sequence
  dgRNA
  Slc35f4
ccctcaagtgggctt

SEQ ID NO: 39276 - DNA, 15 bp, Artificial Sequence
  dgRNA
  Shox2
atctgaactctccgc

SEQ ID NO: 39277 - DNA, 15 bp, Artificial Sequence
  dgRNA
  Shox2
tgaacacgcgcactc

SEQ ID NO: 39278 - DNA, 15 bp, Artificial Sequence
  dgRNA
  Shox2
cacgcgcactccggc

SEQ ID NO: 39279 - DNA, 15 bp, Artificial Sequence
  dgRNA
  Shox2
acgcgcactccggca

SEQ ID NO: 39280 - DNA, 15 bp, Artificial Sequence
  dgRNA
  Med1
taatctcgcgatctt

SEQ ID NO: 39281 - DNA, 15 bp, Artificial Sequence
  dgRNA
  Med1
aatctcgcgatcttt

SEQ ID NO: 39282 - DNA, 15 bp, Artificial Sequence
  dgRNA
  Med1
tttgggaagttccgt

SEQ ID NO: 39283 - DNA, 15 bp, Artificial Sequence
  dgRNA
  Med1
tgggaagttccgttg

SEQ ID NO: 39284 - DNA, 15 bp, Artificial Sequence
  dgRNA
  Catsper3
ggtactcaccctctc

SEQ ID NO: 39285 - DNA, 15 bp, Artificial Sequence
  dgRNA
  Catsper3
gaaccacaagtgaat

SEQ ID NO: 39286 - DNA, 15 bp, Artificial Sequence
  dgRNA
  Catsper3
gaataggccttagcc

SEQ ID NO: 39287 - DNA, 15 bp, Artificial Sequence
  dgRNA
  Catsper3
tacctagcaaccctg

SEQ ID NO: 39288 - DNA, 15 bp, Artificial Sequence
  dgRNA
  Cyp2a4
gtaatgtcccaaact

SEQ ID NO: 39289 - DNA, 15 bp, Artificial Sequence
  dgRNA
  Cyp2a4
ttggtgcacaatagt

SEQ ID NO: 39290 - DNA, 15 bp, Artificial Sequence
  dgRNA
  Cyp2a4
caatagtgggtagtc

SEQ ID NO: 39291 - DNA, 15 bp, Artificial Sequence
  dgRNA
  Cyp2a4
tagtgggtagtctgg

SEQ ID NO: 39292 - DNA, 15 bp, Artificial Sequence
  dgRNA
  Adcy8
gctcgctcgacccac

SEQ ID NO: 39293 - DNA, 15 bp, Artificial Sequence
  dgRNA
  Adcy8
ctcgacccaccggtg

SEQ ID NO: 39294 - DNA, 15 bp, Artificial Sequence
  dgRNA
  Adcy8
cggcccttcaagacc

SEQ ID NO: 39295 - DNA, 15 bp, Artificial Sequence
  dgRNA
  Adcy8
ggcccttcaagacct

SEQ ID NO: 39296 - DNA, 15 bp, Artificial Sequence
  dgRNA
  Hfe
attacaggacggctt

SEQ ID NO: 39297 - DNA, 15 bp, Artificial Sequence
  dgRNA
  Hfe
aattacaggacggct

SEQ ID NO: 39298 - DNA, 15 bp, Artificial Sequence
  dgRNA
  Hfe
gtgattgcaagtcta

SEQ ID NO: 39299 - DNA, 15 bp, Artificial Sequence
  dgRNA
  Mep1b
gttggcacagtaaag

SEQ ID NO: 39300 - DNA, 15 bp, Artificial Sequence
  dgRNA
  Olfr95
aacaaatatccatcc

SEQ ID NO: 39301 - DNA, 15 bp, Artificial Sequence
  dgRNA
  Olfr95
gttcctaggatgacc

SEQ ID NO: 39302 - DNA, 15 bp, Artificial Sequence
  dgRNA
  Olfr95
gacctgggtataaca

SEQ ID NO: 39303 - DNA, 15 bp, Artificial Sequence
  dgRNA
  Olfr95
acctgggtataacat

SEQ ID NO: 39304 - DNA, 15 bp, Artificial Sequence
  dgRNA
  Hoxa9
gttaatttgtagcac

SEQ ID NO: 39305 - DNA, 15 bp, Artificial Sequence
  dgRNA
  Hoxa9
gctgtagtttgacta

SEQ ID NO: 39306 - DNA, 15 bp, Artificial Sequence
  dgRNA
  Hoxa9
ccaaggcaggggcgc

SEQ ID NO: 39307 - DNA, 15 bp, Artificial Sequence
  dgRNA
  Hoxa9
caggggcgctggaga

SEQ ID NO: 39308 - DNA, 15 bp, Artificial Sequence
  dgRNA
  Ercc1
cgccccaaaccacag

SEQ ID NO: 39309 - DNA, 15 bp, Artificial Sequence
  dgRNA
  Ercc1
ccacagcggtcctcc

SEQ ID NO: 39310 - DNA, 15 bp, Artificial Sequence
  dgRNA
  Ercc1
gctctaactcctccg

SEQ ID NO: 39311 - DNA, 15 bp, Artificial Sequence
  dgRNA
  Ercc1
agcgagacgagcgaa

SEQ ID NO: 39312 - DNA, 15 bp, Artificial Sequence
  dgRNA
  Pdp1
acgcgtggaaccaat

SEQ ID NO: 39313 - DNA, 15 bp, Artificial Sequence
  dgRNA
  Pdp1
gctagccgcgccaaa

SEQ ID NO: 39314 - DNA, 15 bp, Artificial Sequence
  dgRNA
  Pdp1
gccgcgccaaatgga

SEQ ID NO: 39315 - DNA, 15 bp, Artificial Sequence
  dgRNA
  Pdp1
ccgcgccaaatggaa

SEQ ID NO: 39316 - DNA, 15 bp, Artificial Sequence
  dgRNA
  Psma7
acgcgactgcctccc

SEQ ID NO: 39317 - DNA, 15 bp, Artificial Sequence
  dgRNA
  Psma7
ggtcaggataccgcg

SEQ ID NO: 39318 - DNA, 15 bp, Artificial Sequence
  dgRNA
  Psma7
caggataccgcgcgg

SEQ ID NO: 39319 - DNA, 15 bp, Artificial Sequence
  dgRNA
  Psma7
cgctcttcgtccagc

SEQ ID NO: 39320 - DNA, 15 bp, Artificial Sequence
  dgRNA
  Vsx2
gctctgaccccactt

SEQ ID NO: 39321 - DNA, 15 bp, Artificial Sequence
  dgRNA
  Vsx2
acttgggctgccgcc

SEQ ID NO: 39322 - DNA, 15 bp, Artificial Sequence
  dgRNA
  Vsx2
gggctgccgcctggt

SEQ ID NO: 39323 - DNA, 15 bp, Artificial Sequence
  dgRNA
  Vsx2
cctggttggataaaa

SEQ ID NO: 39324 - DNA, 15 bp, Artificial Sequence
  dgRNA
  Abca13
ccgaggcagagcacc

SEQ ID NO: 39325 - DNA, 15 bp, Artificial Sequence
  dgRNA
  Abca13
cacctttgttagaat

SEQ ID NO: 39326 - DNA, 15 bp, Artificial Sequence
  dgRNA
  Abca13
tggctaataggccac

SEQ ID NO: 39327 - DNA, 15 bp, Artificial Sequence
  dgRNA
  Abca13
aggctggtatataag

SEQ ID NO: 39328 - DNA, 15 bp, Artificial Sequence
  dgRNA
  Fam65b
ttcagctacgagacc

SEQ ID NO: 39329 - DNA, 15 bp, Artificial Sequence
  dgRNA
  Fam65b
agctacgagaccagg

SEQ ID NO: 39330 - DNA, 15 bp, Artificial Sequence
  dgRNA
  Fam65b
ttccagcaattatgc

SEQ ID NO: 39331 - DNA, 15 bp, Artificial Sequence
  dgRNA
  Fam65b
agcaattatgcagga

SEQ ID NO: 39332 - DNA, 15 bp, Artificial Sequence
  dgRNA
  Eed
cccgagctccgcatc

SEQ ID NO: 39333 - DNA, 15 bp, Artificial Sequence
  dgRNA
  Eed
ccgagctccgcatca

SEQ ID NO: 39334 - DNA, 15 bp, Artificial Sequence
  dgRNA
  Eed
cctcgggagcagtgg

SEQ ID NO: 39335 - DNA, 15 bp, Artificial Sequence
  dgRNA
  Eed
gtggtgggccgatcc

SEQ ID NO: 39336 - DNA, 15 bp, Artificial Sequence
  dgRNA
  Clec14a
gcccctagagatcag

SEQ ID NO: 39337 - DNA, 15 bp, Artificial Sequence
  dgRNA
  Clec14a
gtggttttactagtg

SEQ ID NO: 39338 - DNA, 15 bp, Artificial Sequence
  dgRNA
  Clec14a
ataaacacaataggc

SEQ ID NO: 39339 - DNA, 15 bp, Artificial Sequence
  dgRNA
  Clec14a
cacaataggcgggtg

SEQ ID NO: 39340 - DNA, 15 bp, Artificial Sequence
  dgRNA
  Pde6b
atatttcaggcgagc

SEQ ID NO: 39341 - DNA, 15 bp, Artificial Sequence
  dgRNA
  Pde6b
tatttcaggcgagct

SEQ ID NO: 39342 - DNA, 15 bp, Artificial Sequence
  dgRNA
  Pde6b
gactttgctgacaac

SEQ ID NO: 39343 - DNA, 15 bp, Artificial Sequence
  dgRNA
  Pde6b
ggggtaaagctaggt

SEQ ID NO: 39344 - DNA, 15 bp, Artificial Sequence
  dgRNA
  Rhbdd1
tctccaccgtccact

SEQ ID NO: 39345 - DNA, 15 bp, Artificial Sequence
  dgRNA
  Rhbdd1
agactacactgcacc

SEQ ID NO: 39346 - DNA, 15 bp, Artificial Sequence
  dgRNA
  Rhbdd1
accgggaagaaactt

SEQ ID NO: 39347 - DNA, 15 bp, Artificial Sequence
  dgRNA
  Rhbdd1
catgcgctgtgcgcg

SEQ ID NO: 39348 - DNA, 15 bp, Artificial Sequence
  dgRNA
  Mmp17
ggcgcgtccagagga

SEQ ID NO: 39349 - DNA, 15 bp, Artificial Sequence
  dgRNA
  Mmp17
cgcagcccgatccgc

SEQ ID NO: 39350 - DNA, 15 bp, Artificial Sequence
  dgRNA
  Mmp17
gtgctccagccttcg

SEQ ID NO: 39351 - DNA, 15 bp, Artificial Sequence
  dgRNA
  Mmp17
tccagccttcggggt

SEQ ID NO: 39352 - DNA, 15 bp, Artificial Sequence
  dgRNA
  Iqsec1
ttgcgcttacaagtg

SEQ ID NO: 39353 - DNA, 15 bp, Artificial Sequence
  dgRNA
  Iqsec1
gggattctgatgtta

SEQ ID NO: 39354 - DNA, 15 bp, Artificial Sequence
  dgRNA
  Iqsec1
ggattctgatgttat

SEQ ID NO: 39355 - DNA, 15 bp, Artificial Sequence
  dgRNA
  Iqsec1
aatctgcgcttctcc

SEQ ID NO: 39356 - DNA, 15 bp, Artificial Sequence
  dgRNA
  Il17rc
ttttggtgagatccg

SEQ ID NO: 39357 - DNA, 15 bp, Artificial Sequence
  dgRNA
  Il17rc
ggtgagatccggggt

SEQ ID NO: 39358 - DNA, 15 bp, Artificial Sequence
  dgRNA
  Il17rc
agattctgatcgatc

SEQ ID NO: 39359 - DNA, 15 bp, Artificial Sequence
  dgRNA
  Il17rc
aaggaactcctaccc

SEQ ID NO: 39360 - DNA, 15 bp, Artificial Sequence
  dgRNA
  Dlst
aacccgggggcgctc

SEQ ID NO: 39361 - DNA, 15 bp, Artificial Sequence
  dgRNA
  Dlst
ccgggggcgctccgg

SEQ ID NO: 39362 - DNA, 15 bp, Artificial Sequence
  dgRNA
  Dlst
gggcgctccggtggc

SEQ ID NO: 39363 - DNA, 15 bp, Artificial Sequence
  dgRNA
  Dlst
gctccggtggccgga

SEQ ID NO: 39364 - DNA, 15 bp, Artificial Sequence
  dgRNA
  Irx3
cgctctgtactcgcg

SEQ ID NO: 39365 - DNA, 15 bp, Artificial Sequence
  dgRNA
  Irx3
gctctgtactcgcgg

SEQ ID NO: 39366 - DNA, 15 bp, Artificial Sequence
  dgRNA
  Irx3
ctgtactcgcggggg

SEQ ID NO: 39367 - DNA, 15 bp, Artificial Sequence
  dgRNA
  Irx3
tgtactcgcggggga

SEQ ID NO: 39368 - DNA, 15 bp, Artificial Sequence
  dgRNA
  Pramel3
taagactatcttggc

SEQ ID NO: 39369 - DNA, 15 bp, Artificial Sequence
  dgRNA
  Pramel3
gactatcttggcagg

SEQ ID NO: 39370 - DNA, 15 bp, Artificial Sequence
  dgRNA
  Gm694
tagcatctgcttgat

SEQ ID NO: 39371 - DNA, 15 bp, Artificial Sequence
  dgRNA
  Gm694
tcctaatgactacta

SEQ ID NO: 39372 - DNA, 15 bp, Artificial Sequence
  dgRNA
  Gm694
atgactactaagggt

SEQ ID NO: 39373 - DNA, 15 bp, Artificial Sequence
  dgRNA
  Gm694
aagggttgggctcca

SEQ ID NO: 39374 - DNA, 15 bp, Artificial Sequence
  dgRNA
  Hspbap1
ccaaggcgaagatgg

SEQ ID NO: 39375 - DNA, 15 bp, Artificial Sequence
  dgRNA
  Hspbap1
ggatccgactagaga

SEQ ID NO: 39376 - DNA, 15 bp, Artificial Sequence
  dgRNA
  Hspbap1
aaacagcagacgcta

SEQ ID NO: 39377 - DNA, 15 bp, Artificial Sequence
  dgRNA
  Hspbap1
aacagcagacgctaa

SEQ ID NO: 39378 - DNA, 15 bp, Artificial Sequence
  dgRNA
  Aqp6
tgggggcaccttagc

SEQ ID NO: 39379 - DNA, 15 bp, Artificial Sequence
  dgRNA
  Aqp6
ggcaccttagctggc

SEQ ID NO: 39380 - DNA, 15 bp, Artificial Sequence
  dgRNA
  Aqp6
ggtcaagagacctga

SEQ ID NO: 39381 - DNA, 15 bp, Artificial Sequence
  dgRNA
  Aqp6
ggaacagaacgaatc

SEQ ID NO: 39382 - DNA, 15 bp, Artificial Sequence
  dgRNA
  Acad9
acttcctagcctgtt

SEQ ID NO: 39383 - DNA, 15 bp, Artificial Sequence
  dgRNA
  Acad9
agcaatgcttggcgt

SEQ ID NO: 39384 - DNA, 15 bp, Artificial Sequence
  dgRNA
  Acad9
caatagcctcgctca

SEQ ID NO: 39385 - DNA, 15 bp, Artificial Sequence
  dgRNA
  Acad9
tagcctcgctcaagg

SEQ ID NO: 39386 - DNA, 15 bp, Artificial Sequence
  dgRNA
  Toe1
tgcgcagtctccgac

SEQ ID NO: 39387 - DNA, 15 bp, Artificial Sequence
  dgRNA
  Toe1
cccaagaaaccccga

SEQ ID NO: 39388 - DNA, 15 bp, Artificial Sequence
  dgRNA
  Toe1
ccaagaaaccccgaa

SEQ ID NO: 39389 - DNA, 15 bp, Artificial Sequence
  dgRNA
  Toe1
caagaaaccccgaag

SEQ ID NO: 39390 - DNA, 15 bp, Artificial Sequence
  dgRNA
  Ltc4s
gagttccgccaccac

SEQ ID NO: 39391 - DNA, 15 bp, Artificial Sequence
  dgRNA
  Ltc4s
ggactaagcacggaa

SEQ ID NO: 39392 - DNA, 15 bp, Artificial Sequence
  dgRNA
  Ltc4s
aagcacggaaaggcc

SEQ ID NO: 39393 - DNA, 15 bp, Artificial Sequence
  dgRNA
  Ltc4s
ccgcctctactgcaa

SEQ ID NO: 39394 - DNA, 15 bp, Artificial Sequence
  dgRNA
  Mmp7
tggattcagcatggt

SEQ ID NO: 39395 - DNA, 15 bp, Artificial Sequence
  dgRNA
  Strip2
gagcagtaaaaatgc

SEQ ID NO: 39396 - DNA, 15 bp, Artificial Sequence
  dgRNA
  Strip2
gcagtaaaaatgccg

SEQ ID NO: 39397 - DNA, 15 bp, Artificial Sequence
  dgRNA
  Strip2
cagtaaaaatgccgg

SEQ ID NO: 39398 - DNA, 15 bp, Artificial Sequence
  dgRNA
  Strip2
aatgccgggggtcca

SEQ ID NO: 39399 - DNA, 15 bp, Artificial Sequence
  dgRNA
  Arhgap6
gaactgagtgctagg

SEQ ID NO: 39400 - DNA, 15 bp, Artificial Sequence
  dgRNA
  Arhgap6
taggtggcgggacat

SEQ ID NO: 39401 - DNA, 15 bp, Artificial Sequence
  dgRNA
  Arhgap6
ggggcccgccaggag

SEQ ID NO: 39402 - DNA, 15 bp, Artificial Sequence
  dgRNA
  Arhgap6
cccgccaggagcgga

SEQ ID NO: 39403 - DNA, 15 bp, Artificial Sequence
  dgRNA
  Gsdmc4
cttaggcccatgcca

SEQ ID NO: 39404 - DNA, 15 bp, Artificial Sequence
  dgRNA
  Gsdmc4
aagaggttaggtcca

SEQ ID NO: 39405 - DNA, 15 bp, Artificial Sequence
  dgRNA
  Gsdmc4
agaggttaggtccag

SEQ ID NO: 39406 - DNA, 15 bp, Artificial Sequence
  dgRNA
  Gsdmc4
tgggaggcctatata

SEQ ID NO: 39407 - DNA, 15 bp, Artificial Sequence
  dgRNA
  Crem
tagatcatttaccag

SEQ ID NO: 39408 - DNA, 15 bp, Artificial Sequence
  dgRNA
  Crem
agatcatttaccagt

SEQ ID NO: 39409 - DNA, 15 bp, Artificial Sequence
  dgRNA
  Tcf7l2
aatgccgcagctgaa

SEQ ID NO: 39410 - DNA, 15 bp, Artificial Sequence
  dgRNA
  Tcf7l2
gccgcagctgaacgg

SEQ ID NO: 39411 - DNA, 15 bp, Artificial Sequence
  dgRNA
  Tcf7l2
aaaaagacgagtcca

SEQ ID NO: 39412 - DNA, 15 bp, Artificial Sequence
  dgRNA
  Tcf7l2
accgccgttcagctg

SEQ ID NO: 39413 - DNA, 15 bp, Artificial Sequence
  dgRNA
  Pias3
cccgcaagggatcaa

SEQ ID NO: 39414 - DNA, 15 bp, Artificial Sequence
  dgRNA
  Pias3
ttaataactcccgcc

SEQ ID NO: 39415 - DNA, 15 bp, Artificial Sequence
  dgRNA
  Pias3
ctcccgcccggctcc

SEQ ID NO: 39416 - DNA, 15 bp, Artificial Sequence
  dgRNA
  Pias3
tcccgcccggctcct

SEQ ID NO: 39417 - DNA, 15 bp, Artificial Sequence
  dgRNA
  Gjc3
atacatcccgtgacc

SEQ ID NO: 39418 - DNA, 15 bp, Artificial Sequence
  dgRNA
  Gjc3
tcaattggttgtctt

SEQ ID NO: 39419 - DNA, 15 bp, Artificial Sequence
  dgRNA
  Gjc3
tggcgtccgggtcac

SEQ ID NO: 39420 - DNA, 15 bp, Artificial Sequence
  dgRNA
  Gjc3
ctggcgtccgggtca

SEQ ID NO: 39421 - DNA, 15 bp, Artificial Sequence
  dgRNA
  Bdkrb1
cctcttttaacctag

SEQ ID NO: 39422 - DNA, 15 bp, Artificial Sequence
  dgRNA
  Bdkrb1
gtgctgtgcccgttc

SEQ ID NO: 39423 - DNA, 15 bp, Artificial Sequence
  dgRNA
  Bdkrb1
ggagaaagcgcttat

SEQ ID NO: 39424 - DNA, 15 bp, Artificial Sequence
  dgRNA
  Bdkrb1
cctctaggttaaaag

SEQ ID NO: 39425 - DNA, 15 bp, Artificial Sequence
  dgRNA
  Gtsf1l
cgacgctgatgaata

SEQ ID NO: 39426 - DNA, 15 bp, Artificial Sequence
  dgRNA
  Gtsf1l
gacgctgatgaataa

SEQ ID NO: 39427 - DNA, 15 bp, Artificial Sequence
  dgRNA
  Gtsf1l
acgctgatgaataag

SEQ ID NO: 39428 - DNA, 15 bp, Artificial Sequence
  dgRNA
  Gtsf1l
agcccgaaactgcca

SEQ ID NO: 39429 - DNA, 15 bp, Artificial Sequence
  dgRNA
  Syn1
tgccgtgagtccagt

SEQ ID NO: 39430 - DNA, 15 bp, Artificial Sequence
  dgRNA
  Syn1
ggaccgcaccacgag

SEQ ID NO: 39431 - DNA, 15 bp, Artificial Sequence
  dgRNA
  Syn1
cgagaggtgcaagat

SEQ ID NO: 39432 - DNA, 15 bp, Artificial Sequence
  dgRNA
  Syn1
gagaggtgcaagata

SEQ ID NO: 39433 - DNA, 15 bp, Artificial Sequence
  dgRNA
  Myo19
ggtcttgagctgggt

SEQ ID NO: 39434 - DNA, 15 bp, Artificial Sequence
  dgRNA
  Myo19
gtcttgagctgggtt

SEQ ID NO: 39435 - DNA, 15 bp, Artificial Sequence
  dgRNA
  Myo19
ccagacctagccgcg

SEQ ID NO: 39436 - DNA, 15 bp, Artificial Sequence
  dgRNA
  Myo19
gacctagccgcgcgg

SEQ ID NO: 39437 - DNA, 15 bp, Artificial Sequence
  dgRNA
  2410004P03Rik
tctcgtcccttcgtc

SEQ ID NO: 39438 - DNA, 15 bp, Artificial Sequence
  dgRNA
  2410004P03Rik
ctcgtcccttcgtct

SEQ ID NO: 39439 - DNA, 15 bp, Artificial Sequence
  dgRNA
  2410004P03Rik
gagttctccaccagg

SEQ ID NO: 39440 - DNA, 15 bp, Artificial Sequence
  dgRNA
  2410004P03Rik
cagctctgcggaaca

SEQ ID NO: 39441 - DNA, 15 bp, Artificial Sequence
  dgRNA
  Rabepk
aaacctagcatccta

SEQ ID NO: 39442 - DNA, 15 bp, Artificial Sequence
  dgRNA
  Rabepk
catcctatggcatgc

SEQ ID NO: 39443 - DNA, 15 bp, Artificial Sequence
  dgRNA
  Rabepk
tgtaacaaactccgt

SEQ ID NO: 39444 - DNA, 15 bp, Artificial Sequence
  dgRNA
  Rabepk
gtaacaaactccgtc

SEQ ID NO: 39445 - DNA, 15 bp, Artificial Sequence
  dgRNA
  Uso1
gcaagcagcgcaagg

SEQ ID NO: 39446 - DNA, 15 bp, Artificial Sequence
  dgRNA
  Uso1
gggggcgtgcccaag

SEQ ID NO: 39447 - DNA, 15 bp, Artificial Sequence
  dgRNA
  Uso1
ggcgtgcccaagtgg

SEQ ID NO: 39448 - DNA, 15 bp, Artificial Sequence
  dgRNA
  Uso1
gcgtgcccaagtggt

SEQ ID NO: 39449 - DNA, 15 bp, Artificial Sequence
  dgRNA
  Morc3
cattaccagcggcca

SEQ ID NO: 39450 - DNA, 15 bp, Artificial Sequence
  dgRNA
  Morc3
caatcttcaatctca

SEQ ID NO: 39451 - DNA, 15 bp, Artificial Sequence
  dgRNA
  Morc3
aggtccagctacgcg

SEQ ID NO: 39452 - DNA, 15 bp, Artificial Sequence
  dgRNA
  Morc3
cagctacgcgaggcg

SEQ ID NO: 39453 - DNA, 15 bp, Artificial Sequence
  dgRNA
  Asb6
ggcttatatgtaccg

SEQ ID NO: 39454 - DNA, 15 bp, Artificial Sequence
  dgRNA
  Asb6
tatatgtaccgaggt

SEQ ID NO: 39455 - DNA, 15 bp, Artificial Sequence
  dgRNA
  Asb6
cgaggtcggatagac

SEQ ID NO: 39456 - DNA, 15 bp, Artificial Sequence
  dgRNA
  Asb6
atcctcttaatctaa

SEQ ID NO: 39457 - DNA, 15 bp, Artificial Sequence
  dgRNA
  4921501E09Rik
gtccctcctaatttt

SEQ ID NO: 39458 - DNA, 15 bp, Artificial Sequence
  dgRNA
  4921501E09Rik
gaccaaaaattagga

SEQ ID NO: 39459 - DNA, 15 bp, Artificial Sequence
  dgRNA
  Tmem132e
tcggcacgcggccct

SEQ ID NO: 39460 - DNA, 15 bp, Artificial Sequence
  dgRNA
  Tmem132e
gccctcggcagccac

SEQ ID NO: 39461 - DNA, 15 bp, Artificial Sequence
  dgRNA
  Tmem132e
cagccaccgggacgt

SEQ ID NO: 39462 - DNA, 15 bp, Artificial Sequence
  dgRNA
  Tmem132e
ccaccgggacgttgg

SEQ ID NO: 39463 - DNA, 15 bp, Artificial Sequence
  dgRNA
  Elmo1
cgcgtgtccgcgcgc

SEQ ID NO: 39464 - DNA, 15 bp, Artificial Sequence
  dgRNA
  Elmo1
tccgcgcgcaggtgc

SEQ ID NO: 39465 - DNA, 15 bp, Artificial Sequence
  dgRNA
  Elmo1
ccgcgcgcaggtgcc

SEQ ID NO: 39466 - DNA, 15 bp, Artificial Sequence
  dgRNA
  Elmo1
gcgcgcaggtgccgg

SEQ ID NO: 39467 - DNA, 15 bp, Artificial Sequence
  dgRNA
  Trmt6
acgcgcttctgctta

SEQ ID NO: 39468 - DNA, 15 bp, Artificial Sequence
  dgRNA
  Trmt6
ggaagccacgcgact

SEQ ID NO: 39469 - DNA, 15 bp, Artificial Sequence
  dgRNA
  Trmt6
gaagccacgcgacta

SEQ ID NO: 39470 - DNA, 15 bp, Artificial Sequence
  dgRNA
  Trmt6
aagccacgcgactag

SEQ ID NO: 39471 - DNA, 15 bp, Artificial Sequence
  dgRNA
  Sftpd
gaccatgcatagcta

SEQ ID NO: 39472 - DNA, 15 bp, Artificial Sequence
  dgRNA
  Sftpd
ggtgcacatagtgtc

SEQ ID NO: 39473 - DNA, 15 bp, Artificial Sequence
  dgRNA
  Sftpd
ggtagctccacttac

SEQ ID NO: 39474 - DNA, 15 bp, Artificial Sequence
  dgRNA
  Sftpd
actccacctacactc

SEQ ID NO: 39475 - DNA, 15 bp, Artificial Sequence
  dgRNA
  Olfr736
cagcaacaatgctat

SEQ ID NO: 39476 - DNA, 15 bp, Artificial Sequence
  dgRNA
  Olfr736
gatcagtcaatataa

SEQ ID NO: 39477 - DNA, 15 bp, Artificial Sequence
  dgRNA
  Olfr736
tacattccagggtat

SEQ ID NO: 39478 - DNA, 15 bp, Artificial Sequence
  dgRNA
  BC030500
cagcaccaatctgca

SEQ ID NO: 39479 - DNA, 15 bp, Artificial Sequence
  dgRNA
  BC030500
agaaaactatgacga

SEQ ID NO: 39480 - DNA, 15 bp, Artificial Sequence
  dgRNA
  BC030500
gacggcattatctat

SEQ ID NO: 39481 - DNA, 15 bp, Artificial Sequence
  dgRNA
  BC030500
taaacgagtcaactg

SEQ ID NO: 39482 - DNA, 15 bp, Artificial Sequence
  dgRNA
  Eid2b
tgatgccgcccctgc

SEQ ID NO: 39483 - DNA, 15 bp, Artificial Sequence
  dgRNA
  Eid2b
aacttgaggcggccg

SEQ ID NO: 39484 - DNA, 15 bp, Artificial Sequence
  dgRNA
  Eid2b
ttgaggcggccgtgg

SEQ ID NO: 39485 - DNA, 15 bp, Artificial Sequence
  dgRNA
  Eid2b
cggccgtggcggtaa

SEQ ID NO: 39486 - DNA, 15 bp, Artificial Sequence
  dgRNA
  Zfp831
gtcccttgaatagct

SEQ ID NO: 39487 - DNA, 15 bp, Artificial Sequence
  dgRNA
  Zfp831
gctaggcttacagtt

SEQ ID NO: 39488 - DNA, 15 bp, Artificial Sequence
  dgRNA
  Zfp831
tccttaactgagtgg

SEQ ID NO: 39489 - DNA, 15 bp, Artificial Sequence
  dgRNA
  Zfp831
ccttaactgagtggt

SEQ ID NO: 39490 - DNA, 15 bp, Artificial Sequence
  dgRNA
  Nin
tacccgctcctccct

SEQ ID NO: 39491 - DNA, 15 bp, Artificial Sequence
  dgRNA
  Nin
ctccctcggctgcgg

SEQ ID NO: 39492 - DNA, 15 bp, Artificial Sequence
  dgRNA
  Nin
tccctcggctgcggc

SEQ ID NO: 39493 - DNA, 15 bp, Artificial Sequence
  dgRNA
  Nin
ctcggctgcggcggg

SEQ ID NO: 39494 - DNA, 15 bp, Artificial Sequence
  dgRNA
  Efhd2
aggggaacgatgatg

SEQ ID NO: 39495 - DNA, 15 bp, Artificial Sequence
  dgRNA
  Efhd2
ccctacccccctccg

SEQ ID NO: 39496 - DNA, 15 bp, Artificial Sequence
  dgRNA
  Efhd2
gaaggacccggcacg

SEQ ID NO: 39497 - DNA, 15 bp, Artificial Sequence
  dgRNA
  Efhd2
cccggcacgcggcaa

SEQ ID NO: 39498 - DNA, 15 bp, Artificial Sequence
  dgRNA
  Cyp4f39
caaagtgaaggtcgt

SEQ ID NO: 39499 - DNA, 15 bp, Artificial Sequence
  dgRNA
  Cyp4f39
aggtcgtaggtcagc

SEQ ID NO: 39500 - DNA, 15 bp, Artificial Sequence
  dgRNA
  Cyp4f39
agtaagctagagcct

SEQ ID NO: 39501 - DNA, 15 bp, Artificial Sequence
  dgRNA
  Cyp4f39
cctagcctcgctgat

SEQ ID NO: 39502 - DNA, 15 bp, Artificial Sequence
  dgRNA
  Rapgef3
ctcttggccacgtgg

SEQ ID NO: 39503 - DNA, 15 bp, Artificial Sequence
  dgRNA
  Rapgef3
ttggccacgtggcgg

SEQ ID NO: 39504 - DNA, 15 bp, Artificial Sequence
  dgRNA
  Rapgef3
tggccacgtggcggc

SEQ ID NO: 39505 - DNA, 15 bp, Artificial Sequence
  dgRNA
  Rapgef3
tcaccgcccctaacc

SEQ ID NO: 39506 - DNA, 15 bp, Artificial Sequence
  dgRNA
  Kcnab2
cgtccacgtacccag

SEQ ID NO: 39507 - DNA, 15 bp, Artificial Sequence
  dgRNA
  Kcnab2
gtccacgtacccaga

SEQ ID NO: 39508 - DNA, 15 bp, Artificial Sequence
  dgRNA
  Kcnab2
cgtacccagaggggc

SEQ ID NO: 39509 - DNA, 15 bp, Artificial Sequence
  dgRNA
  Kcnab2
gtgccttaggggccc

SEQ ID NO: 39510 - DNA, 15 bp, Artificial Sequence
  dgRNA
  Cldn10
aactttcaagctaac

SEQ ID NO: 39511 - DNA, 15 bp, Artificial Sequence
  dgRNA
  Cyp2r1
agctggctaacccaa

SEQ ID NO: 39512 - DNA, 15 bp, Artificial Sequence
  dgRNA
  Cyp2r1
atggccgtagagata

SEQ ID NO: 39513 - DNA, 15 bp, Artificial Sequence
  dgRNA
  Cyp2r1
gccgtagagataagg

SEQ ID NO: 39514 - DNA, 15 bp, Artificial Sequence
  dgRNA
  Cyp2r1
ccgtagagataaggc

SEQ ID NO: 39515 - DNA, 15 bp, Artificial Sequence
  dgRNA
  Rnf5
agctttggttatgac

SEQ ID NO: 39516 - DNA, 15 bp, Artificial Sequence
  dgRNA
  Rnf5
ttatgaccaatccct

SEQ ID NO: 39517 - DNA, 15 bp, Artificial Sequence
  dgRNA
  Rnf5
aatcatcatcgtgca

SEQ ID NO: 39518 - DNA, 15 bp, Artificial Sequence
  dgRNA
  Rnf5
atcatcatcgtgcaa

SEQ ID NO: 39519 - DNA, 15 bp, Artificial Sequence
  dgRNA
  Gnb1
ggctgccaacgtccc

SEQ ID NO: 39520 - DNA, 15 bp, Artificial Sequence
  dgRNA
  Gnb1
cctggaagacccttg

SEQ ID NO: 39521 - DNA, 15 bp, Artificial Sequence
  dgRNA
  Gnb1
tggaagacccttgcg

SEQ ID NO: 39522 - DNA, 15 bp, Artificial Sequence
  dgRNA
  Gnb1
cccttgcggggtgtg

SEQ ID NO: 39523 - DNA, 15 bp, Artificial Sequence
  dgRNA
  Tmem252
tataaggctgtgacc

SEQ ID NO: 39524 - DNA, 15 bp, Artificial Sequence
  dgRNA
  Tmem252
attgtgtcctcgggg

SEQ ID NO: 39525 - DNA, 15 bp, Artificial Sequence
  dgRNA
  Tmem252
cattgtgtcctcggg

SEQ ID NO: 39526 - DNA, 15 bp, Artificial Sequence
  dgRNA
  Tmem252
acattgtgtcctcgg

SEQ ID NO: 39527 - DNA, 15 bp, Artificial Sequence
  dgRNA
  Meig1
tttctcgatccacag

SEQ ID NO: 39528 - DNA, 15 bp, Artificial Sequence
  dgRNA
  Meig1
tccacagtggttaca

SEQ ID NO: 39529 - DNA, 15 bp, Artificial Sequence
  dgRNA
  Meig1
tcatgggatgatgcc

SEQ ID NO: 39530 - DNA, 15 bp, Artificial Sequence
  dgRNA
  Meig1
aggggtcggaatgcc

SEQ ID NO: 39531 - DNA, 15 bp, Artificial Sequence
  dgRNA
  Fam186a
atctgtcttcgaata

SEQ ID NO: 39532 - DNA, 15 bp, Artificial Sequence
  dgRNA
  Fam186a
cgggagtcagttgtt

SEQ ID NO: 39533 - DNA, 15 bp, Artificial Sequence
  dgRNA
  Fam186a
gggagtcagttgttt

SEQ ID NO: 39534 - DNA, 15 bp, Artificial Sequence
  dgRNA
  Fam186a
gaatcttttcccgtg

SEQ ID NO: 39535 - DNA, 15 bp, Artificial Sequence
  dgRNA
  Tjp2
tgggtggcgccggtg

SEQ ID NO: 39536 - DNA, 15 bp, Artificial Sequence
  dgRNA
  Tjp2
caggacgacccaaag

SEQ ID NO: 39537 - DNA, 15 bp, Artificial Sequence
  dgRNA
  Tjp2
tttttccgggtctgg

SEQ ID NO: 39538 - DNA, 15 bp, Artificial Sequence
  dgRNA
  Tjp2
acccagcggtggggc

SEQ ID NO: 39539 - DNA, 15 bp, Artificial Sequence
  dgRNA
  Nr4a1
ttcgccccgccccct

SEQ ID NO: 39540 - DNA, 15 bp, Artificial Sequence
  dgRNA
  Nr4a1
ctggccgcctcccgc

SEQ ID NO: 39541 - DNA, 15 bp, Artificial Sequence
  dgRNA
  Nr4a1
ccccgcgcccttgta

SEQ ID NO: 39542 - DNA, 15 bp, Artificial Sequence
  dgRNA
  Nr4a1
atggccaaagctcgc

SEQ ID NO: 39543 - DNA, 15 bp, Artificial Sequence
  dgRNA
  Bhlhe22
gcgggggctttccac

SEQ ID NO: 39544 - DNA, 15 bp, Artificial Sequence
  dgRNA
  Bhlhe22
tcccagtctttaccg

SEQ ID NO: 39545 - DNA, 15 bp, Artificial Sequence
  dgRNA
  Bhlhe22
tcctcggctctaagt

SEQ ID NO: 39546 - DNA, 15 bp, Artificial Sequence
  dgRNA
  Bhlhe22
cctcggctctaagta

SEQ ID NO: 39547 - DNA, 15 bp, Artificial Sequence
  dgRNA
  Gas2l2
agccgcagagcccct

SEQ ID NO: 39548 - DNA, 15 bp, Artificial Sequence
  dgRNA
  Gas2l2
ggacccattgaatca

SEQ ID NO: 39549 - DNA, 15 bp, Artificial Sequence
  dgRNA
  Gas2l2
aggaccttgactagc

SEQ ID NO: 39550 - DNA, 15 bp, Artificial Sequence
  dgRNA
  Gas2l2
tctgcggcttgctat

SEQ ID NO: 39551 - DNA, 15 bp, Artificial Sequence
  dgRNA
  Kcnj14
cacccccctctgttc

SEQ ID NO: 39552 - DNA, 15 bp, Artificial Sequence
  dgRNA
  Kcnj14
caggccctgatccgc

SEQ ID NO: 39553 - DNA, 15 bp, Artificial Sequence
  dgRNA
  Kcnj14
gtgcagataatgggt

SEQ ID NO: 39554 - DNA, 15 bp, Artificial Sequence
  dgRNA
  Kcnj14
agctccagcggatca

SEQ ID NO: 39555 - DNA, 15 bp, Artificial Sequence
  dgRNA
  1110034G24Rik
gcctttgcctgatca

SEQ ID NO: 39556 - DNA, 15 bp, Artificial Sequence
  dgRNA
  1110034G24Rik
gctgagcgcattcac

SEQ ID NO: 39557 - DNA, 15 bp, Artificial Sequence
  dgRNA
  1110034G24Rik
ctgagcgcattcact

SEQ ID NO: 39558 - DNA, 15 bp, Artificial Sequence
  dgRNA
  1110034G24Rik
ctacggtgtaatgat

SEQ ID NO: 39559 - DNA, 15 bp, Artificial Sequence
  dgRNA
  Polr3a
ccccactgatctgcg

SEQ ID NO: 39560 - DNA, 15 bp, Artificial Sequence
  dgRNA
  Polr3a
tgatctgcgcggcct

SEQ ID NO: 39561 - DNA, 15 bp, Artificial Sequence
  dgRNA
  Polr3a
ggtgcattttcgtga

SEQ ID NO: 39562 - DNA, 15 bp, Artificial Sequence
  dgRNA
  Polr3a
gaaggagccgctaga

SEQ ID NO: 39563 - DNA, 15 bp, Artificial Sequence
  dgRNA
  Rorb
attaatgcagtctgt

SEQ ID NO: 39564 - DNA, 15 bp, Artificial Sequence
  dgRNA
  Rorb
ttgggattctggttg

SEQ ID NO: 39565 - DNA, 15 bp, Artificial Sequence
  dgRNA
  Rorb
cgtttcattaagtaa

SEQ ID NO: 39566 - DNA, 15 bp, Artificial Sequence
  dgRNA
  Rorb
tcgtttcattaagta

SEQ ID NO: 39567 - DNA, 15 bp, Artificial Sequence
  dgRNA
  Defb26
actgagtcatgcaaa

SEQ ID NO: 39568 - DNA, 15 bp, Artificial Sequence
  dgRNA
  Defb26
agtcatgcaaatggt

SEQ ID NO: 39569 - DNA, 15 bp, Artificial Sequence
  dgRNA
  Defb26
aatggttggcctgac

SEQ ID NO: 39570 - DNA, 15 bp, Artificial Sequence
  dgRNA
  Defb26
acctagatcacctgc

SEQ ID NO: 39571 - DNA, 15 bp, Artificial Sequence
  dgRNA
  Slco4c1
attgtggttgtcgct

SEQ ID NO: 39572 - DNA, 15 bp, Artificial Sequence
  dgRNA
  Slco4c1
ttgtggttgtcgctt

SEQ ID NO: 39573 - DNA, 15 bp, Artificial Sequence
  dgRNA
  Slco4c1
tgtggttgtcgcttg

SEQ ID NO: 39574 - DNA, 15 bp, Artificial Sequence
  dgRNA
  Slco4c1
gtcgcttggggcgac

SEQ ID NO: 39575 - DNA, 15 bp, Artificial Sequence
  dgRNA
  Ifi205
gctaagaggtttccc

SEQ ID NO: 39576 - DNA, 15 bp, Artificial Sequence
  dgRNA
  Tspan33
gtctcccccgcctct

SEQ ID NO: 39577 - DNA, 15 bp, Artificial Sequence
  dgRNA
  Tspan33
tcccccgcctctcgg

SEQ ID NO: 39578 - DNA, 15 bp, Artificial Sequence
  dgRNA
  Tspan33
cgcctctcggaggag

SEQ ID NO: 39579 - DNA, 15 bp, Artificial Sequence
  dgRNA
  Tspan33
ggctgcttagtgaca

SEQ ID NO: 39580 - DNA, 15 bp, Artificial Sequence
  dgRNA
  Ampd1
ttgaaattcgatttc

SEQ ID NO: 39581 - DNA, 15 bp, Artificial Sequence
  dgRNA
  Ampd1
cctaaagctataaat

SEQ ID NO: 39582 - DNA, 15 bp, Artificial Sequence
  dgRNA
  Ampd1
atctccccttttagc

SEQ ID NO: 39583 - DNA, 15 bp, Artificial Sequence
  dgRNA
  Ampd1
cccttttagcaggga

SEQ ID NO: 39584 - DNA, 15 bp, Artificial Sequence
  dgRNA
  Pym1
gggagggaccggacc

SEQ ID NO: 39585 - DNA, 15 bp, Artificial Sequence
  dgRNA
  Pym1
gaccggaccgggctt

SEQ ID NO: 39586 - DNA, 15 bp, Artificial Sequence
  dgRNA
  Pym1
ggcacaacctaacaa

SEQ ID NO: 39587 - DNA, 15 bp, Artificial Sequence
  dgRNA
  Pym1
gcacaacctaacaaa

SEQ ID NO: 39588 - DNA, 15 bp, Artificial Sequence
  dgRNA
  Rabgap1
gagctgcggcccctc

SEQ ID NO: 39589 - DNA, 15 bp, Artificial Sequence
  dgRNA
  Rabgap1
agctgcggcccctcg

SEQ ID NO: 39590 - DNA, 15 bp, Artificial Sequence
  dgRNA
  Rabgap1
ggcccctcggggctc

SEQ ID NO: 39591 - DNA, 15 bp, Artificial Sequence
  dgRNA
  Rabgap1
gcccctcggggctcc

SEQ ID NO: 39592 - DNA, 15 bp, Artificial Sequence
  dgRNA
  Rlim
gacccgccgcccgtc

SEQ ID NO: 39593 - DNA, 15 bp, Artificial Sequence
  dgRNA
  Rlim
acccgccgcccgtct

SEQ ID NO: 39594 - DNA, 15 bp, Artificial Sequence
  dgRNA
  Rlim
cgccgcccgtctggg

SEQ ID NO: 39595 - DNA, 15 bp, Artificial Sequence
  dgRNA
  Rlim
gccgcccgtctgggc

SEQ ID NO: 39596 - DNA, 15 bp, Artificial Sequence
  dgRNA
  Zfp735
cacctttgcttgcga

SEQ ID NO: 39597 - DNA, 15 bp, Artificial Sequence
  dgRNA
  Dync1li2
atcttcgttcatgtt

SEQ ID NO: 39598 - DNA, 15 bp, Artificial Sequence
  dgRNA
  Dync1li2
atcgctttataaata

SEQ ID NO: 39599 - DNA, 15 bp, Artificial Sequence
  dgRNA
  Dync1li2
gttcattccaaagct

SEQ ID NO: 39600 - DNA, 15 bp, Artificial Sequence
  dgRNA
  Dync1li2
gacttgccgcatcag

SEQ ID NO: 39601 - DNA, 15 bp, Artificial Sequence
  dgRNA
  Rbm3
aggacggcagttcgc

SEQ ID NO: 39602 - DNA, 15 bp, Artificial Sequence
  dgRNA
  Rbm3
gacctactgtcagtt

SEQ ID NO: 39603 - DNA, 15 bp, Artificial Sequence
  dgRNA
  Rbm3
taactgacagtaggt

SEQ ID NO: 39604 - DNA, 15 bp, Artificial Sequence
  dgRNA
  Rbm3
gtcctaactgacagt

SEQ ID NO: 39605 - DNA, 15 bp, Artificial Sequence
  dgRNA
  Sgsm3
aaaatatcttcgagg

SEQ ID NO: 39606 - DNA, 15 bp, Artificial Sequence
  dgRNA
  Sgsm3
aaatatcttcgagga

SEQ ID NO: 39607 - DNA, 15 bp, Artificial Sequence
  dgRNA
  Sgsm3
aatatcttcgaggag

SEQ ID NO: 39608 - DNA, 15 bp, Artificial Sequence
  dgRNA
  Sgsm3
acaagcggtcatcat

SEQ ID NO: 39609 - DNA, 15 bp, Artificial Sequence
  dgRNA
  Syna
aaggctacacctagg

SEQ ID NO: 39610 - DNA, 15 bp, Artificial Sequence
  dgRNA
  Syna
gtcaaagctcaaaag

SEQ ID NO: 39611 - DNA, 15 bp, Artificial Sequence
  dgRNA
  Syna
tccataagcacaacc

SEQ ID NO: 39612 - DNA, 15 bp, Artificial Sequence
  dgRNA
  Syna
cttttccgtcactcc

SEQ ID NO: 39613 - DNA, 15 bp, Artificial Sequence
  dgRNA
  Coa4
tctcagaacgatcca

SEQ ID NO: 39614 - DNA, 15 bp, Artificial Sequence
  dgRNA
  Coa4
gccttccctaggatc

SEQ ID NO: 39615 - DNA, 15 bp, Artificial Sequence
  dgRNA
  Coa4
ggatccggtctccat

SEQ ID NO: 39616 - DNA, 15 bp, Artificial Sequence
  dgRNA
  Coa4
ccttccgccctttcc

SEQ ID NO: 39617 - DNA, 15 bp, Artificial Sequence
  dgRNA
  Cacna2d4
tccccccaagttcag

SEQ ID NO: 39618 - DNA, 15 bp, Artificial Sequence
  dgRNA
  Cacna2d4
aggccagtggattag

SEQ ID NO: 39619 - DNA, 15 bp, Artificial Sequence
  dgRNA
  Cacna2d4
gccagtggattagag

SEQ ID NO: 39620 - DNA, 15 bp, Artificial Sequence
  dgRNA
  Cacna2d4
ccagtggattagagg

SEQ ID NO: 39621 - DNA, 15 bp, Artificial Sequence
  dgRNA
  Hs3st3a1
agcggatccccgcgt

SEQ ID NO: 39622 - DNA, 15 bp, Artificial Sequence
  dgRNA
  Hs3st3a1
cgcgttggtctggcc

SEQ ID NO: 39623 - DNA, 15 bp, Artificial Sequence
  dgRNA
  Hs3st3a1
gcgttggtctggcct

SEQ ID NO: 39624 - DNA, 15 bp, Artificial Sequence
  dgRNA
  Hs3st3a1
ttcgcgtcccacgtg

SEQ ID NO: 39625 - DNA, 15 bp, Artificial Sequence
  dgRNA
  Tomt
atgtcctgatcccaa

SEQ ID NO: 39626 - DNA, 15 bp, Artificial Sequence
  dgRNA
  Tomt
ggtaacctgaactgc

SEQ ID NO: 39627 - DNA, 15 bp, Artificial Sequence
  dgRNA
  Tomt
tcaataattgaaatc

SEQ ID NO: 39628 - DNA, 15 bp, Artificial Sequence
  dgRNA
  Tomt
tcaggacatgcggca

SEQ ID NO: 39629 - DNA, 15 bp, Artificial Sequence
  dgRNA
  Hint1
cgtgcagcaccaagc

SEQ ID NO: 39630 - DNA, 15 bp, Artificial Sequence
  dgRNA
  Hint1
agccgggctcgtgag

SEQ ID NO: 39631 - DNA, 15 bp, Artificial Sequence
  dgRNA
  Hint1
gggctcgtgagagga

SEQ ID NO: 39632 - DNA, 15 bp, Artificial Sequence
  dgRNA
  Hint1
ggctcgtgagaggaa

SEQ ID NO: 39633 - DNA, 15 bp, Artificial Sequence
  dgRNA
  Apoe
tagccgggaagaaag

SEQ ID NO: 39634 - DNA, 15 bp, Artificial Sequence
  dgRNA
  Apoe
agctggaccacccgc

SEQ ID NO: 39635 - DNA, 15 bp, Artificial Sequence
  dgRNA
  Apoe
tttgaaccctaggag

SEQ ID NO: 39636 - DNA, 15 bp, Artificial Sequence
  dgRNA
  Apoe
ttgaaccctaggaga

SEQ ID NO: 39637 - DNA, 15 bp, Artificial Sequence
  dgRNA
  Csf3
accctgcagcgattc

SEQ ID NO: 39638 - DNA, 15 bp, Artificial Sequence
  dgRNA
  Csf3
gcagcgattcaggcc

SEQ ID NO: 39639 - DNA, 15 bp, Artificial Sequence
  dgRNA
  Csf3
cagcgattcaggcct

SEQ ID NO: 39640 - DNA, 15 bp, Artificial Sequence
  dgRNA
  Csf3
ggggacaagacgtca

SEQ ID NO: 39641 - DNA, 15 bp, Artificial Sequence
  dgRNA
  Olfr1491
actagacacatgtac

SEQ ID NO: 39642 - DNA, 15 bp, Artificial Sequence
  dgRNA
  Olfr1491
catttccatcgttca

SEQ ID NO: 39643 - DNA, 15 bp, Artificial Sequence
  dgRNA
  Olfr1491
aatatccatgaacga

SEQ ID NO: 39644 - DNA, 15 bp, Artificial Sequence
  dgRNA
  Tbc1d14
tagttagcaccccca

SEQ ID NO: 39645 - DNA, 15 bp, Artificial Sequence
  dgRNA
  Tbc1d14
tgggagctacacaat

SEQ ID NO: 39646 - DNA, 15 bp, Artificial Sequence
  dgRNA
  Tbc1d14
acacaattggcaggg

SEQ ID NO: 39647 - DNA, 15 bp, Artificial Sequence
  dgRNA
  Tbc1d14
ccgccccgtctgttg

SEQ ID NO: 39648 - DNA, 15 bp, Artificial Sequence
  dgRNA
  Ehd4
ggactacaccctctc

SEQ ID NO: 39649 - DNA, 15 bp, Artificial Sequence
  dgRNA
  Ehd4
gtcatcaataattca

SEQ ID NO: 39650 - DNA, 15 bp, Artificial Sequence
  dgRNA
  Ehd4
ggatcgcctttccat

SEQ ID NO: 39651 - DNA, 15 bp, Artificial Sequence
  dgRNA
  Ehd4
cttccacccagtcgc

SEQ ID NO: 39652 - DNA, 15 bp, Artificial Sequence
  dgRNA
  Timm8a2
aaggtaagcggagcc

SEQ ID NO: 39653 - DNA, 15 bp, Artificial Sequence
  dgRNA
  Timm8a2
agcctgcagactaaa

SEQ ID NO: 39654 - DNA, 15 bp, Artificial Sequence
  dgRNA
  Timm8a2
gcctgcagactaaaa

SEQ ID NO: 39655 - DNA, 15 bp, Artificial Sequence
  dgRNA
  Timm8a2
gccaagcttcctagg

SEQ ID NO: 39656 - DNA, 15 bp, Artificial Sequence
  dgRNA
  Lmbrd1
gatcaagtggcacgc

SEQ ID NO: 39657 - DNA, 15 bp, Artificial Sequence
  dgRNA
  Lmbrd1
cacgcaggccgcgcg

SEQ ID NO: 39658 - DNA, 15 bp, Artificial Sequence
  dgRNA
  Lmbrd1
acgcaggccgcgcgt

SEQ ID NO: 39659 - DNA, 15 bp, Artificial Sequence
  dgRNA
  Lmbrd1
caggccgcgcgtggg

SEQ ID NO: 39660 - DNA, 15 bp, Artificial Sequence
  dgRNA
  Crem
tgacgtcaatgtgct

SEQ ID NO: 39661 - DNA, 15 bp, Artificial Sequence
  dgRNA
  Crem
aatcacaacatgact

SEQ ID NO: 39662 - DNA, 15 bp, Artificial Sequence
  dgRNA
  Irf9
ccaacttaactgttg

SEQ ID NO: 39663 - DNA, 15 bp, Artificial Sequence
  dgRNA
  Irf9
cttaactgttgagga

SEQ ID NO: 39664 - DNA, 15 bp, Artificial Sequence
  dgRNA
  Irf9
acccctctagcaaag

SEQ ID NO: 39665 - DNA, 15 bp, Artificial Sequence
  dgRNA
  Irf9
cccctctagcaaaga

SEQ ID NO: 39666 - DNA, 15 bp, Artificial Sequence
  dgRNA
  Kcng3
ggggagcccgaggtc

SEQ ID NO: 39667 - DNA, 15 bp, Artificial Sequence
  dgRNA
  Kcng3
ggagcccgaggtccg

SEQ ID NO: 39668 - DNA, 15 bp, Artificial Sequence
  dgRNA
  Kcng3
gcccgaggtccgggg

SEQ ID NO: 39669 - DNA, 15 bp, Artificial Sequence
  dgRNA
  Kcng3
cccgaggtccggggc

SEQ ID NO: 39670 - DNA, 15 bp, Artificial Sequence
  dgRNA
  Gnl3
gccccgtggccgcca

SEQ ID NO: 39671 - DNA, 15 bp, Artificial Sequence
  dgRNA
  Gnl3
ctgctagcgctcctc

SEQ ID NO: 39672 - DNA, 15 bp, Artificial Sequence
  dgRNA
  Gnl3
gcgctcctctggccg

SEQ ID NO: 39673 - DNA, 15 bp, Artificial Sequence
  dgRNA
  Gnl3
ccgcggccgtctctc

SEQ ID NO: 39674 - DNA, 15 bp, Artificial Sequence
  dgRNA
  Actr8
ttaactgtattacac

SEQ ID NO: 39675 - DNA, 15 bp, Artificial Sequence
  dgRNA
  Actr8
atgctcactattcaa

SEQ ID NO: 39676 - DNA, 15 bp, Artificial Sequence
  dgRNA
  Actr8
cgtggagggcatgac

SEQ ID NO: 39677 - DNA, 15 bp, Artificial Sequence
  dgRNA
  Actr8
cccctagagaattct

SEQ ID NO: 39678 - DNA, 15 bp, Artificial Sequence
  dgRNA
  2810428I15Rik
atttagagttccacc

SEQ ID NO: 39679 - DNA, 15 bp, Artificial Sequence
  dgRNA
  2810428I15Rik
tagagttccaccagg

SEQ ID NO: 39680 - DNA, 15 bp, Artificial Sequence
  dgRNA
  2810428I15Rik
agttccaccaggcgg

SEQ ID NO: 39681 - DNA, 15 bp, Artificial Sequence
  dgRNA
  2810428I15Rik
gaattcaaaggcgcg

SEQ ID NO: 39682 - DNA, 15 bp, Artificial Sequence
  dgRNA
  Car5b
ggcttaagttagaag

SEQ ID NO: 39683 - DNA, 15 bp, Artificial Sequence
  dgRNA
  Car5b
gagcagaggcacgcc

SEQ ID NO: 39684 - DNA, 15 bp, Artificial Sequence
  dgRNA
  Car5b
cacgccaggtctaaa

SEQ ID NO: 39685 - DNA, 15 bp, Artificial Sequence
  dgRNA
  Car5b
acgccaggtctaaat

SEQ ID NO: 39686 - DNA, 15 bp, Artificial Sequence
  dgRNA
  Arl13a
gttctaacatgtcta

SEQ ID NO: 39687 - DNA, 15 bp, Artificial Sequence
  dgRNA
  Gm6040
ttcgtaatcacattc

SEQ ID NO: 39688 - DNA, 15 bp, Artificial Sequence
  dgRNA
  Gm6040
gatttattccccttc

SEQ ID NO: 39689 - DNA, 15 bp, Artificial Sequence
  dgRNA
  Gm6040
tcatgcattaagcac

SEQ ID NO: 39690 - DNA, 15 bp, Artificial Sequence
  dgRNA
  Tomm70a
gtctgcagtcacgca

SEQ ID NO: 39691 - DNA, 15 bp, Artificial Sequence
  dgRNA
  Tomm70a
ctcccgagcgattct

SEQ ID NO: 39692 - DNA, 15 bp, Artificial Sequence
  dgRNA
  Tomm70a
gcaaccgcctgcaag

SEQ ID NO: 39693 - DNA, 15 bp, Artificial Sequence
  dgRNA
  Tomm70a
cgcctgcaagaggaa

SEQ ID NO: 39694 - DNA, 15 bp, Artificial Sequence
  dgRNA
  Rbbp8
gccgctgcagcacgt

SEQ ID NO: 39695 - DNA, 15 bp, Artificial Sequence
  dgRNA
  Rbbp8
ccgctgcagcacgtt

SEQ ID NO: 39696 - DNA, 15 bp, Artificial Sequence
  dgRNA
  Rbbp8
tgcagcacgttgggc

SEQ ID NO: 39697 - DNA, 15 bp, Artificial Sequence
  dgRNA
  Rbbp8
gcctttgatgcagac

SEQ ID NO: 39698 - DNA, 15 bp, Artificial Sequence
  dgRNA
  A530016L24Rik
gaacaaattgtgcca

SEQ ID NO: 39699 - DNA, 15 bp, Artificial Sequence
  dgRNA
  A530016L24Rik
caaattgtgccaagg

SEQ ID NO: 39700 - DNA, 15 bp, Artificial Sequence
  dgRNA
  A530016L24Rik
acccatgcgcagacc

SEQ ID NO: 39701 - DNA, 15 bp, Artificial Sequence
  dgRNA
  A530016L24Rik
agtacctcccaaatc

SEQ ID NO: 39702 - DNA, 15 bp, Artificial Sequence
  dgRNA
  Eif3c
cttgcagcctagtcc

SEQ ID NO: 39703 - DNA, 15 bp, Artificial Sequence
  dgRNA
  Eif3c
gcagcctagtccggg

SEQ ID NO: 39704 - DNA, 15 bp, Artificial Sequence
  dgRNA
  Eif3c
ctactaattcgtccc

SEQ ID NO: 39705 - DNA, 15 bp, Artificial Sequence
  dgRNA
  Eif3c
ccgtgtatagcgcaa

SEQ ID NO: 39706 - DNA, 15 bp, Artificial Sequence
  dgRNA
  Hsdl2
cgatgcgccgaacct

SEQ ID NO: 39707 - DNA, 15 bp, Artificial Sequence
  dgRNA
  Hsdl2
gccgaacctaggctg

SEQ ID NO: 39708 - DNA, 15 bp, Artificial Sequence
  dgRNA
  Hsdl2
gaacctaggctgagg

SEQ ID NO: 39709 - DNA, 15 bp, Artificial Sequence
  dgRNA
  Hsdl2
ggttcggcgcatcga

SEQ ID NO: 39710 - DNA, 15 bp, Artificial Sequence
  dgRNA
  Lamb1
aacaaaagaggcgcc

SEQ ID NO: 39711 - DNA, 15 bp, Artificial Sequence
  dgRNA
  Lamb1
acaaaagaggcgcct

SEQ ID NO: 39712 - DNA, 15 bp, Artificial Sequence
  dgRNA
  Lamb1
caaaagaggcgcctg

SEQ ID NO: 39713 - DNA, 15 bp, Artificial Sequence
  dgRNA
  Lamb1
aagaggcgcctgggg

SEQ ID NO: 39714 - DNA, 15 bp, Artificial Sequence
  dgRNA
  Slc2a10
aatatgggtgagacc

SEQ ID NO: 39715 - DNA, 15 bp, Artificial Sequence
  dgRNA
  Zfp473
gacgtcacaggctgc

SEQ ID NO: 39716 - DNA, 15 bp, Artificial Sequence
  dgRNA
  Zfp473
acgtcacaggctgcc

SEQ ID NO: 39717 - DNA, 15 bp, Artificial Sequence
  dgRNA
  Zfp473
aggctgccgggcgag

SEQ ID NO: 39718 - DNA, 15 bp, Artificial Sequence
  dgRNA
  Zfp473
cttgtgaaaaagccg

SEQ ID NO: 39719 - DNA, 15 bp, Artificial Sequence
  dgRNA
  Ndufb4
ttaccaccagacaag

SEQ ID NO: 39720 - DNA, 15 bp, Artificial Sequence
  dgRNA
  Ndufb4
cacgcgcagaatacg

SEQ ID NO: 39721 - DNA, 15 bp, Artificial Sequence
  dgRNA
  Ndufb4
acgcgcagaatacgc

SEQ ID NO: 39722 - DNA, 15 bp, Artificial Sequence
  dgRNA
  Ndufb4
agaatacgcgggacg

SEQ ID NO: 39723 - DNA, 15 bp, Artificial Sequence
  dgRNA
  Defb1
aaatccagctgatgc

SEQ ID NO: 39724 - DNA, 15 bp, Artificial Sequence
  dgRNA
  Defb1
cagcgaatagcatga

SEQ ID NO: 39725 - DNA, 15 bp, Artificial Sequence
  dgRNA
  Tob2
tgagcagccccgctg

SEQ ID NO: 39726 - DNA, 15 bp, Artificial Sequence
  dgRNA
  Tob2
cgctgaggacgtggc

SEQ ID NO: 39727 - DNA, 15 bp, Artificial Sequence
  dgRNA
  Tob2
gctgaggacgtggca

SEQ ID NO: 39728 - DNA, 15 bp, Artificial Sequence
  dgRNA
  Tob2
acttcccgcagaacc

SEQ ID NO: 39729 - DNA, 15 bp, Artificial Sequence
  dgRNA
  Tc2n
gacccggcttcccca

SEQ ID NO: 39730 - DNA, 15 bp, Artificial Sequence
  dgRNA
  Tc2n
cggcttccccaagga

SEQ ID NO: 39731 - DNA, 15 bp, Artificial Sequence
  dgRNA
  Tc2n
ccccaaggagggccg

SEQ ID NO: 39732 - DNA, 15 bp, Artificial Sequence
  dgRNA
  Tc2n
ggagaccggtacctc

SEQ ID NO: 39733 - DNA, 15 bp, Artificial Sequence
  dgRNA
  Tuba4a
catcggctcaaaact

SEQ ID NO: 39734 - DNA, 15 bp, Artificial Sequence
  dgRNA
  Tuba4a
aactaggaacgaata

SEQ ID NO: 39735 - DNA, 15 bp, Artificial Sequence
  dgRNA
  Tuba4a
actaggaacgaatat

SEQ ID NO: 39736 - DNA, 15 bp, Artificial Sequence
  dgRNA
  Tuba4a
taagccaaacccgac

SEQ ID NO: 39737 - DNA, 15 bp, Artificial Sequence
  dgRNA
  Dmd
cctccgcagtgcttt

SEQ ID NO: 39738 - DNA, 15 bp, Artificial Sequence
  dgRNA
  Dmd
tttcggctgcgagcc

SEQ ID NO: 39739 - DNA, 15 bp, Artificial Sequence
  dgRNA
  Dmd
ttcggctgcgagcct

SEQ ID NO: 39740 - DNA, 15 bp, Artificial Sequence
  dgRNA
  Dmd
tgcgagcctgggcgg

SEQ ID NO: 39741 - DNA, 15 bp, Artificial Sequence
  dgRNA
  Sycn
gtgagcgccaaggac

SEQ ID NO: 39742 - DNA, 15 bp, Artificial Sequence
  dgRNA
  Sycn
tgagcgccaaggaca

SEQ ID NO: 39743 - DNA, 15 bp, Artificial Sequence
  dgRNA
  Sycn
gagcgccaaggacag

SEQ ID NO: 39744 - DNA, 15 bp, Artificial Sequence
  dgRNA
  Sycn
agcgccaaggacagg

SEQ ID NO: 39745 - DNA, 15 bp, Artificial Sequence
  dgRNA
  Chmp3
ctagctgacaggttt

SEQ ID NO: 39746 - DNA, 15 bp, Artificial Sequence
  dgRNA
  Chmp3
ctcccttatgagcaa

SEQ ID NO: 39747 - DNA, 15 bp, Artificial Sequence
  dgRNA
  Fbxw11
gtcgcggcgctcgcg

SEQ ID NO: 39748 - DNA, 15 bp, Artificial Sequence
  dgRNA
  Fbxw11
ccagctctgcacgtc

SEQ ID NO: 39749 - DNA, 15 bp, Artificial Sequence
  dgRNA
  Fbxw11
gccctgcgctcccct

SEQ ID NO: 39750 - DNA, 15 bp, Artificial Sequence
  dgRNA
  Fbxw11
cctaggtgctctctc

SEQ ID NO: 39751 - DNA, 15 bp, Artificial Sequence
  dgRNA
  Angpt2
ctagtgaccccctac

SEQ ID NO: 39752 - DNA, 15 bp, Artificial Sequence
  dgRNA
  Angpt2
gatagtgggtgagcc

SEQ ID NO: 39753 - DNA, 15 bp, Artificial Sequence
  dgRNA
  Angpt2
tcaacttatcatata

SEQ ID NO: 39754 - DNA, 15 bp, Artificial Sequence
  dgRNA
  Angpt2
caacttatcatataa

SEQ ID NO: 39755 - DNA, 15 bp, Artificial Sequence
  dgRNA
  Csnk2b
ctacttcgtctgctg

SEQ ID NO: 39756 - DNA, 15 bp, Artificial Sequence
  dgRNA
  Csnk2b
ttcgtctgctgcggc

SEQ ID NO: 39757 - DNA, 15 bp, Artificial Sequence
  dgRNA
  Csnk2b
tcgtctgctgcggcc

SEQ ID NO: 39758 - DNA, 15 bp, Artificial Sequence
  dgRNA
  Csnk2b
ctgctgcggccgggt

SEQ ID NO: 39759 - DNA, 15 bp, Artificial Sequence
  dgRNA
  Hpgd
ggggaaaattcctgc

SEQ ID NO: 39760 - DNA, 15 bp, Artificial Sequence
  dgRNA
  Hpgd
gggaaaattcctgct

SEQ ID NO: 39761 - DNA, 15 bp, Artificial Sequence
  dgRNA
  Hpgd
gcgccgaccctaccc

SEQ ID NO: 39762 - DNA, 15 bp, Artificial Sequence
  dgRNA
  Hpgd
caatgtcggtttcct

SEQ ID NO: 39763 - DNA, 15 bp, Artificial Sequence
  dgRNA
  Mbd1
caggcaaccgagacc

SEQ ID NO: 39764 - DNA, 15 bp, Artificial Sequence
  dgRNA
  Mbd1
gcaaccgagacccgg

SEQ ID NO: 39765 - DNA, 15 bp, Artificial Sequence
  dgRNA
  Mbd1
caaccgagacccggc

SEQ ID NO: 39766 - DNA, 15 bp, Artificial Sequence
  dgRNA
  Mbd1
gtgttgtcagtgcgc

SEQ ID NO: 39767 - DNA, 15 bp, Artificial Sequence
  dgRNA
  Ubfd1
cccacgcggtgcccg

SEQ ID NO: 39768 - DNA, 15 bp, Artificial Sequence
  dgRNA
  Ubfd1
ccacgcggtgcccga

SEQ ID NO: 39769 - DNA, 15 bp, Artificial Sequence
  dgRNA
  Ubfd1
gagggccaccacgtg

SEQ ID NO: 39770 - DNA, 15 bp, Artificial Sequence
  dgRNA
  Ubfd1
aggggcgccgccatg

SEQ ID NO: 39771 - DNA, 15 bp, Artificial Sequence
  dgRNA
  Nuak2
cgcattcctgggcct

SEQ ID NO: 39772 - DNA, 15 bp, Artificial Sequence
  dgRNA
  Nuak2
ggcctcgggtccaag

SEQ ID NO: 39773 - DNA, 15 bp, Artificial Sequence
  dgRNA
  Nuak2
gcctcgggtccaagt

SEQ ID NO: 39774 - DNA, 15 bp, Artificial Sequence
  dgRNA
  Nuak2
tcgggtccaagtggg

SEQ ID NO: 39775 - DNA, 15 bp, Artificial Sequence
  dgRNA
  Lalba
gtattgactggatgc

SEQ ID NO: 39776 - DNA, 15 bp, Artificial Sequence
  dgRNA
  Lalba
agaaggcccggtgcc

SEQ ID NO: 39777 - DNA, 15 bp, Artificial Sequence
  dgRNA
  Lalba
ggtgtctgcattaca

SEQ ID NO: 39778 - DNA, 15 bp, Artificial Sequence
  dgRNA
  Stim1
agaccccgccagttg

SEQ ID NO: 39779 - DNA, 15 bp, Artificial Sequence
  dgRNA
  Stim1
gaccccgccagttgc

SEQ ID NO: 39780 - DNA, 15 bp, Artificial Sequence
  dgRNA
  Stim1
accccgccagttgcg

SEQ ID NO: 39781 - DNA, 15 bp, Artificial Sequence
  dgRNA
  Stim1
ccccgccagttgcgg

SEQ ID NO: 39782 - DNA, 15 bp, Artificial Sequence
  dgRNA
  Fhl5
tcatgacataacaat

SEQ ID NO: 39783 - DNA, 15 bp, Artificial Sequence
  dgRNA
  Fhl5
gacctatatgacaaa

SEQ ID NO: 39784 - DNA, 15 bp, Artificial Sequence
  dgRNA
  Trap1
cacacgcacaatgca

SEQ ID NO: 39785 - DNA, 15 bp, Artificial Sequence
  dgRNA
  Trap1
acacgcacaatgcaa

SEQ ID NO: 39786 - DNA, 15 bp, Artificial Sequence
  dgRNA
  Trap1
agggcccccgcgctg

SEQ ID NO: 39787 - DNA, 15 bp, Artificial Sequence
  dgRNA
  Trap1
ttcccgttctcgcac

SEQ ID NO: 39788 - DNA, 15 bp, Artificial Sequence
  dgRNA
  Rec8
ttgtcagctgtcgcc

SEQ ID NO: 39789 - DNA, 15 bp, Artificial Sequence
  dgRNA
  Rec8
tgtcagctgtcgcca

SEQ ID NO: 39790 - DNA, 15 bp, Artificial Sequence
  dgRNA
  Rec8
gtcagctttgcacct

SEQ ID NO: 39791 - DNA, 15 bp, Artificial Sequence
  dgRNA
  Rec8
ctacccgagaacgag

SEQ ID NO: 39792 - DNA, 15 bp, Artificial Sequence
  dgRNA
  Decr2
gcagcccggccagct

SEQ ID NO: 39793 - DNA, 15 bp, Artificial Sequence
  dgRNA
  Decr2
cagcccggccagctt

SEQ ID NO: 39794 - DNA, 15 bp, Artificial Sequence
  dgRNA
  Decr2
gccagcttgggtata

SEQ ID NO: 39795 - DNA, 15 bp, Artificial Sequence
  dgRNA
  Decr2
ggtatatggactaag

SEQ ID NO: 39796 - DNA, 15 bp, Artificial Sequence
  dgRNA
  Dnm3
aacaacaattcctgt

SEQ ID NO: 39797 - DNA, 15 bp, Artificial Sequence
  dgRNA
  Dnm3
aggcagtccaaccgt

SEQ ID NO: 39798 - DNA, 15 bp, Artificial Sequence
  dgRNA
  Dnm3
caaccgtaggccagt

SEQ ID NO: 39799 - DNA, 15 bp, Artificial Sequence
  dgRNA
  Dnm3
gtaggccagtaggat

SEQ ID NO: 39800 - DNA, 15 bp, Artificial Sequence
  dgRNA
  Ambn
ataatgagagcctgc

SEQ ID NO: 39801 - DNA, 15 bp, Artificial Sequence
  dgRNA
  Ambn
gtgtggactaattgc

SEQ ID NO: 39802 - DNA, 15 bp, Artificial Sequence
  dgRNA
  Ambn
ttgcctcactttgat

SEQ ID NO: 39803 - DNA, 15 bp, Artificial Sequence
  dgRNA
  Ambn
cctcactttgattgg

SEQ ID NO: 39804 - DNA, 15 bp, Artificial Sequence
  dgRNA
  Alkbh4
acgccatcttagggc

SEQ ID NO: 39805 - DNA, 15 bp, Artificial Sequence
  dgRNA
  Alkbh4
tagaaacgccatctt

SEQ ID NO: 39806 - DNA, 15 bp, Artificial Sequence
  dgRNA
  Alkbh4
ctggccaatgcttat

SEQ ID NO: 39807 - DNA, 15 bp, Artificial Sequence
  dgRNA
  Alkbh4
cgtaaggctgtggtc

SEQ ID NO: 39808 - DNA, 15 bp, Artificial Sequence
  dgRNA
  Zfp82
acttaatcagagttg

SEQ ID NO: 39809 - DNA, 15 bp, Artificial Sequence
  dgRNA
  Zfp82
cgcacgcggtgcgtg

SEQ ID NO: 39810 - DNA, 15 bp, Artificial Sequence
  dgRNA
  Zfp82
aatcggattttcgtt

SEQ ID NO: 39811 - DNA, 15 bp, Artificial Sequence
  dgRNA
  Zfp82
gctccgtttgggacc

SEQ ID NO: 39812 - DNA, 15 bp, Artificial Sequence
  dgRNA
  Mtus1
ctcccccccgcaacc

SEQ ID NO: 39813 - DNA, 15 bp, Artificial Sequence
  dgRNA
  Mtus1
ctctaggagccgccg

SEQ ID NO: 39814 - DNA, 15 bp, Artificial Sequence
  dgRNA
  Mtus1
tctaggagccgccgc

SEQ ID NO: 39815 - DNA, 15 bp, Artificial Sequence
  dgRNA
  Mtus1
gagccgccgcgggcg

SEQ ID NO: 39816 - DNA, 15 bp, Artificial Sequence
  dgRNA
  Fgfr3
ggctctgcggcaacc

SEQ ID NO: 39817 - DNA, 15 bp, Artificial Sequence
  dgRNA
  Fgfr3
gctctgcggcaacca

SEQ ID NO: 39818 - DNA, 15 bp, Artificial Sequence
  dgRNA
  Fgfr3
ctgcggcaaccaggg

SEQ ID NO: 39819 - DNA, 15 bp, Artificial Sequence
  dgRNA
  Fgfr3
tgcggcaaccaggga

SEQ ID NO: 39820 - DNA, 15 bp, Artificial Sequence
  dgRNA
  Xpo1
gctccgaccaataag

SEQ ID NO: 39821 - DNA, 15 bp, Artificial Sequence
  dgRNA
  Xpo1
cgaccaataagaggt

SEQ ID NO: 39822 - DNA, 15 bp, Artificial Sequence
  dgRNA
  Xpo1
ggtaggctgatggcg

SEQ ID NO: 39823 - DNA, 15 bp, Artificial Sequence
  dgRNA
  Xpo1
ctgatggcgcggctg

SEQ ID NO: 39824 - DNA, 15 bp, Artificial Sequence
  dgRNA
  Rgl3
attgacccgcacttc

SEQ ID NO: 39825 - DNA, 15 bp, Artificial Sequence
  dgRNA
  Rgl3
ttgacccgcacttct

SEQ ID NO: 39826 - DNA, 15 bp, Artificial Sequence
  dgRNA
  Rgl3
cccgcacttctggga

SEQ ID NO: 39827 - DNA, 15 bp, Artificial Sequence
  dgRNA
  Rgl3
aggaacgggacttct

SEQ ID NO: 39828 - DNA, 15 bp, Artificial Sequence
  dgRNA
  Brd7
cagggaagagcgtcg

SEQ ID NO: 39829 - DNA, 15 bp, Artificial Sequence
  dgRNA
  Brd7
ctgcagcgccgcctc

SEQ ID NO: 39830 - DNA, 15 bp, Artificial Sequence
  dgRNA
  Brd7
cgcctccggccgcca

SEQ ID NO: 39831 - DNA, 15 bp, Artificial Sequence
  dgRNA
  Brd7
cgcatcccgtccgct

SEQ ID NO: 39832 - DNA, 15 bp, Artificial Sequence
  dgRNA
  Nup35
cgcagagagcatgac

SEQ ID NO: 39833 - DNA, 15 bp, Artificial Sequence
  dgRNA
  Nup35
gttgcgcaacccata

SEQ ID NO: 39834 - DNA, 15 bp, Artificial Sequence
  dgRNA
  Nup35
actagtaaaccacag

SEQ ID NO: 39835 - DNA, 15 bp, Artificial Sequence
  dgRNA
  Nup35
gcgcttcagccattt

SEQ ID NO: 39836 - DNA, 15 bp, Artificial Sequence
  dgRNA
  Rnf150
cgaagcctgaatttg

SEQ ID NO: 39837 - DNA, 15 bp, Artificial Sequence
  dgRNA
  Rnf150
aggtcgctgacgccc

SEQ ID NO: 39838 - DNA, 15 bp, Artificial Sequence
  dgRNA
  Rnf150
agagtgagcgttgca

SEQ ID NO: 39839 - DNA, 15 bp, Artificial Sequence
  dgRNA
  Rnf150
gagtgagcgttgcaa

SEQ ID NO: 39840 - DNA, 15 bp, Artificial Sequence
  dgRNA
  Plekha2
gaaacgaaattaacc

SEQ ID NO: 39841 - DNA, 15 bp, Artificial Sequence
  dgRNA
  Plekha2
gtcgagagacggcct

SEQ ID NO: 39842 - DNA, 15 bp, Artificial Sequence
  dgRNA
  Plekha2
ggagaagtgtgccgc

SEQ ID NO: 39843 - DNA, 15 bp, Artificial Sequence
  dgRNA
  Plekha2
agtgtgccgcaggac

SEQ ID NO: 39844 - DNA, 15 bp, Artificial Sequence
  dgRNA
  Tmem177
gaaatccgggccagc

SEQ ID NO: 39845 - DNA, 15 bp, Artificial Sequence
  dgRNA
  Tmem177
agcaggtctctatct

SEQ ID NO: 39846 - DNA, 15 bp, Artificial Sequence
  dgRNA
  Tmem177
ctatcttggctccga

SEQ ID NO: 39847 - DNA, 15 bp, Artificial Sequence
  dgRNA
  Tmem177
tatcttggctccgaa

SEQ ID NO: 39848 - DNA, 15 bp, Artificial Sequence
  dgRNA
  Cluh
gacgcgttgccttta

SEQ ID NO: 39849 - DNA, 15 bp, Artificial Sequence
  dgRNA
  Cluh
tctgtgaactgacta

SEQ ID NO: 39850 - DNA, 15 bp, Artificial Sequence
  dgRNA
  Cluh
cctcgtcgtctgccg

SEQ ID NO: 39851 - DNA, 15 bp, Artificial Sequence
  dgRNA
  Cluh
ctcgtcgtctgccgt

SEQ ID NO: 39852 - DNA, 15 bp, Artificial Sequence
  dgRNA
  4933402E13Rik
aatgtgaacgatgtt

SEQ ID NO: 39853 - DNA, 15 bp, Artificial Sequence
  dgRNA
  4933402E13Rik
attttgaacctgatt

SEQ ID NO: 39854 - DNA, 15 bp, Artificial Sequence
  dgRNA
  4933402E13Rik
tgactagatagccat

SEQ ID NO: 39855 - DNA, 15 bp, Artificial Sequence
  dgRNA
  4933402E13Rik
gactagatagccatt

SEQ ID NO: 39856 - DNA, 15 bp, Artificial Sequence
  dgRNA
  Smarcc1
tagacaaacggggcc

SEQ ID NO: 39857 - DNA, 15 bp, Artificial Sequence
  dgRNA
  Smarcc1
gtctaccaacagcag

SEQ ID NO: 39858 - DNA, 15 bp, Artificial Sequence
  dgRNA
  Smarcc1
gttccgagagaccag

SEQ ID NO: 39859 - DNA, 15 bp, Artificial Sequence
  dgRNA
  Smarcc1
gcagcctcagtccgt

SEQ ID NO: 39860 - DNA, 15 bp, Artificial Sequence
  dgRNA
  Ar
aactgtgtaagtagc

SEQ ID NO: 39861 - DNA, 15 bp, Artificial Sequence
  dgRNA
  Ar
actgtgtaagtagca

SEQ ID NO: 39862 - DNA, 15 bp, Artificial Sequence
  dgRNA
  Ar
cgtgccttcctttac

SEQ ID NO: 39863 - DNA, 15 bp, Artificial Sequence
  dgRNA
  Ar
cccggagcttcccgc

SEQ ID NO: 39864 - DNA, 15 bp, Artificial Sequence
  dgRNA
  Cdca7l
gaaaacttgggtgat

SEQ ID NO: 39865 - DNA, 15 bp, Artificial Sequence
  dgRNA
  Cdca7l
gggcagccacttttt

SEQ ID NO: 39866 - DNA, 15 bp, Artificial Sequence
  dgRNA
  Cdca7l
cagccactttttcgg

SEQ ID NO: 39867 - DNA, 15 bp, Artificial Sequence
  dgRNA
  Cdca7l
tctacgcaacactcc

SEQ ID NO: 39868 - DNA, 15 bp, Artificial Sequence
  dgRNA
  Cyp2c65
ctttaatcacgatgt

SEQ ID NO: 39869 - DNA, 15 bp, Artificial Sequence
  dgRNA
  Cyp2c65
acaaagtccactggg

SEQ ID NO: 39870 - DNA, 15 bp, Artificial Sequence
  dgRNA
  Cyp2c65
tacttataatgggtt

SEQ ID NO: 39871 - DNA, 15 bp, Artificial Sequence
  dgRNA
  Cyp2c65
ttacttataatgggt

SEQ ID NO: 39872 - DNA, 15 bp, Artificial Sequence
  dgRNA
  Plec
gacattggagctatg

SEQ ID NO: 39873 - DNA, 15 bp, Artificial Sequence
  dgRNA
  Plec
tggagctatgtggcc

SEQ ID NO: 39874 - DNA, 15 bp, Artificial Sequence
  dgRNA
  Plec
gctatgtggcccggg

SEQ ID NO: 39875 - DNA, 15 bp, Artificial Sequence
  dgRNA
  Plec
ccccccactcttcaa

SEQ ID NO: 39876 - DNA, 15 bp, Artificial Sequence
  dgRNA
  Fggy
aatccaggcagcgaa

SEQ ID NO: 39877 - DNA, 15 bp, Artificial Sequence
  dgRNA
  Fggy
gacttacagtacagt

SEQ ID NO: 39878 - DNA, 15 bp, Artificial Sequence
  dgRNA
  Fggy
acttacagtacagtg

SEQ ID NO: 39879 - DNA, 15 bp, Artificial Sequence
  dgRNA
  Fggy
cggtgcccgtttcaa

SEQ ID NO: 39880 - DNA, 15 bp, Artificial Sequence
  dgRNA
  Itgae
cagataagggaccac

SEQ ID NO: 39881 - DNA, 15 bp, Artificial Sequence
  dgRNA
  Cenpo
tagcagggtctgcgt

SEQ ID NO: 39882 - DNA, 15 bp, Artificial Sequence
  dgRNA
  Cenpo
tgccacacgtacttc

SEQ ID NO: 39883 - DNA, 15 bp, Artificial Sequence
  dgRNA
  Cenpo
tacttccggaagcta

SEQ ID NO: 39884 - DNA, 15 bp, Artificial Sequence
  dgRNA
  Cenpo
acttccggaagctaa

SEQ ID NO: 39885 - DNA, 15 bp, Artificial Sequence
  dgRNA
  Vmn1r61
aatcgaatatgaatg

SEQ ID NO: 39886 - DNA, 15 bp, Artificial Sequence
  dgRNA
  Fbxw21
tcatcagcctttgac

SEQ ID NO: 39887 - DNA, 15 bp, Artificial Sequence
  dgRNA
  Olfr398
atgagtaggctattc

SEQ ID NO: 39888 - DNA, 15 bp, Artificial Sequence
  dgRNA
  Olfr398
ctattcaggcatgcg

SEQ ID NO: 39889 - DNA, 15 bp, Artificial Sequence
  dgRNA
  Olfr398
caggaaatctacttg

SEQ ID NO: 39890 - DNA, 15 bp, Artificial Sequence
  dgRNA
  Olfr398
cccaagtagatttcc

SEQ ID NO: 39891 - DNA, 15 bp, Artificial Sequence
  dgRNA
  Mink1
cgggttgcaggcgcg

SEQ ID NO: 39892 - DNA, 15 bp, Artificial Sequence
  dgRNA
  Mink1
gggttgcaggcgcgc

SEQ ID NO: 39893 - DNA, 15 bp, Artificial Sequence
  dgRNA
  Mink1
gcgcctgtcagccgc

SEQ ID NO: 39894 - DNA, 15 bp, Artificial Sequence
  dgRNA
  Mink1
cgcctgtcagccgct

SEQ ID NO: 39895 - DNA, 15 bp, Artificial Sequence
  dgRNA
  Tsta3
cccgcccacaggact

SEQ ID NO: 39896 - DNA, 15 bp, Artificial Sequence
  dgRNA
  Tsta3
actcggtttcccaga

SEQ ID NO: 39897 - DNA, 15 bp, Artificial Sequence
  dgRNA
  Tsta3
tcccagatggccgtg

SEQ ID NO: 39898 - DNA, 15 bp, Artificial Sequence
  dgRNA
  Tsta3
gggcccgcgcctcac

SEQ ID NO: 39899 - DNA, 15 bp, Artificial Sequence
  dgRNA
  Olfr1508
ttctaactagtgacc

SEQ ID NO: 39900 - DNA, 15 bp, Artificial Sequence
  dgRNA
  Olfr1508
aagccttgataatcg

SEQ ID NO: 39901 - DNA, 15 bp, Artificial Sequence
  dgRNA
  Olfr1508
gcacctcgattatca

SEQ ID NO: 39902 - DNA, 15 bp, Artificial Sequence
  dgRNA
  Cotl1
tggggcccacggagt

SEQ ID NO: 39903 - DNA, 15 bp, Artificial Sequence
  dgRNA
  Cotl1
ggggcccacggagtg

SEQ ID NO: 39904 - DNA, 15 bp, Artificial Sequence
  dgRNA
  Cotl1
gcaatccgcacagac

SEQ ID NO: 39905 - DNA, 15 bp, Artificial Sequence
  dgRNA
  Cotl1
caatccgcacagact

SEQ ID NO: 39906 - DNA, 15 bp, Artificial Sequence
  dgRNA
  Olfr1457
tggttgaacaataat

SEQ ID NO: 39907 - DNA, 15 bp, Artificial Sequence
  dgRNA
  Olfr1457
tgtggaactatgact

SEQ ID NO: 39908 - DNA, 15 bp, Artificial Sequence
  dgRNA
  1700030K09Rik
gtccgtaccgcttga

SEQ ID NO: 39909 - DNA, 15 bp, Artificial Sequence
  dgRNA
  1700030K09Rik
tccgtaccgcttgac

SEQ ID NO: 39910 - DNA, 15 bp, Artificial Sequence
  dgRNA
  1700030K09Rik
cttgggattatgacc

SEQ ID NO: 39911 - DNA, 15 bp, Artificial Sequence
  dgRNA
  1700030K09Rik
ttgggattatgacct

SEQ ID NO: 39912 - DNA, 15 bp, Artificial Sequence
  dgRNA
  Zbbx
ttggagtagcagcta

SEQ ID NO: 39913 - DNA, 15 bp, Artificial Sequence
  dgRNA
  Zbbx
aacggatggctgaga

SEQ ID NO: 39914 - DNA, 15 bp, Artificial Sequence
  dgRNA
  Zbbx
aggcctatgtaccct

SEQ ID NO: 39915 - DNA, 15 bp, Artificial Sequence
  dgRNA
  Zbbx
ggcctatgtaccctt

SEQ ID NO: 39916 - DNA, 15 bp, Artificial Sequence
  dgRNA
  Cacfd1
tccaatcttgcaaag

SEQ ID NO: 39917 - DNA, 15 bp, Artificial Sequence
  dgRNA
  Cacfd1
atccagcgcacctgc

SEQ ID NO: 39918 - DNA, 15 bp, Artificial Sequence
  dgRNA
  Cacfd1
tccagcgcacctgct

SEQ ID NO: 39919 - DNA, 15 bp, Artificial Sequence
  dgRNA
  Cacfd1
agcgcacctgctggg

SEQ ID NO: 39920 - DNA, 15 bp, Artificial Sequence
  dgRNA
  Ncmap
gtccagcgctcaccg

SEQ ID NO: 39921 - DNA, 15 bp, Artificial Sequence
  dgRNA
  Ncmap
tccagcgctcaccgc

SEQ ID NO: 39922 - DNA, 15 bp, Artificial Sequence
  dgRNA
  Ncmap
ggtcctgacttgggc

SEQ ID NO: 39923 - DNA, 15 bp, Artificial Sequence
  dgRNA
  Ncmap
ggggtgtactctctc

SEQ ID NO: 39924 - DNA, 15 bp, Artificial Sequence
  dgRNA
  Lct
cactttcccccttga

SEQ ID NO: 39925 - DNA, 15 bp, Artificial Sequence
  dgRNA
  Lct
gtataaccttcaagg

SEQ ID NO: 39926 - DNA, 15 bp, Artificial Sequence
  dgRNA
  Lct
ggtataaccttcaag

SEQ ID NO: 39927 - DNA, 15 bp, Artificial Sequence
  dgRNA
  Arf3
gagctcgctctgctc

SEQ ID NO: 39928 - DNA, 15 bp, Artificial Sequence
  dgRNA
  Arf3
cacaggcccccgcct

SEQ ID NO: 39929 - DNA, 15 bp, Artificial Sequence
  dgRNA
  Arf3
ccgctgccatggtga

SEQ ID NO: 39930 - DNA, 15 bp, Artificial Sequence
  dgRNA
  Arf3
cacggcgtgtagagg

SEQ ID NO: 39931 - DNA, 15 bp, Artificial Sequence
  dgRNA
  Rfx2
cctccccgaggccgt

SEQ ID NO: 39932 - DNA, 15 bp, Artificial Sequence
  dgRNA
  Rfx2
ccccgaggccgttgg

SEQ ID NO: 39933 - DNA, 15 bp, Artificial Sequence
  dgRNA
  Rfx2
cgaggccgttggagg

SEQ ID NO: 39934 - DNA, 15 bp, Artificial Sequence
  dgRNA
  Rfx2
gaggccgttggaggc

SEQ ID NO: 39935 - DNA, 15 bp, Artificial Sequence
  dgRNA
  Orc4
taagcagggggtagc

SEQ ID NO: 39936 - DNA, 15 bp, Artificial Sequence
  dgRNA
  Orc4
cagggggtagccggg

SEQ ID NO: 39937 - DNA, 15 bp, Artificial Sequence
  dgRNA
  Orc4
agggggtagccgggc

SEQ ID NO: 39938 - DNA, 15 bp, Artificial Sequence
  dgRNA
  Orc4
tagccgggcgggggc

SEQ ID NO: 39939 - DNA, 15 bp, Artificial Sequence
  dgRNA
  Fam78a
cggggatcgagacac

SEQ ID NO: 39940 - DNA, 15 bp, Artificial Sequence
  dgRNA
  Fam78a
gacactggagcgaga

SEQ ID NO: 39941 - DNA, 15 bp, Artificial Sequence
  dgRNA
  Fam78a
aggggcgtttcacgc

SEQ ID NO: 39942 - DNA, 15 bp, Artificial Sequence
  dgRNA
  Fam78a
ggcgtttcacgctgg

SEQ ID NO: 39943 - DNA, 15 bp, Artificial Sequence
  dgRNA
  Mprip
ctccccgagtgcgcg

SEQ ID NO: 39944 - DNA, 15 bp, Artificial Sequence
  dgRNA
  Mprip
cgcgcgcactcgggg

SEQ ID NO: 39945 - DNA, 15 bp, Artificial Sequence
  dgRNA
  Mprip
cgccgcgcgcactcg

SEQ ID NO: 39946 - DNA, 15 bp, Artificial Sequence
  dgRNA
  Mprip
gcgccgcgcgcactc

SEQ ID NO: 39947 - DNA, 15 bp, Artificial Sequence
  dgRNA
  Ttll11
cggggccccgtcccg

SEQ ID NO: 39948 - DNA, 15 bp, Artificial Sequence
  dgRNA
  Ttll11
ggccccgtcccgagg

SEQ ID NO: 39949 - DNA, 15 bp, Artificial Sequence
  dgRNA
  Ttll11
actatccctgtcaac

SEQ ID NO: 39950 - DNA, 15 bp, Artificial Sequence
  dgRNA
  Ttll11
ctatccctgtcaacc

SEQ ID NO: 39951 - DNA, 15 bp, Artificial Sequence
  dgRNA
  Rph3a
ttagttaacccttca

SEQ ID NO: 39952 - DNA, 15 bp, Artificial Sequence
  dgRNA
  Rph3a
ccttcatggcctgta

SEQ ID NO: 39953 - DNA, 15 bp, Artificial Sequence
  dgRNA
  Rph3a
ggcctgtatggcaca

SEQ ID NO: 39954 - DNA, 15 bp, Artificial Sequence
  dgRNA
  Rph3a
gcctgtatggcacac

SEQ ID NO: 39955 - DNA, 15 bp, Artificial Sequence
  dgRNA
  Cyp2c39
accagatagtcaaat

SEQ ID NO: 39956 - DNA, 15 bp, Artificial Sequence
  dgRNA
  Cyp2c39
tctggttaacagtac

SEQ ID NO: 39957 - DNA, 15 bp, Artificial Sequence
  dgRNA
  Cyp2c39
gcccatttgactatc

SEQ ID NO: 39958 - DNA, 15 bp, Artificial Sequence
  dgRNA
  Cyp2c39
gtgatcaggcatcac

SEQ ID NO: 39959 - DNA, 15 bp, Artificial Sequence
  dgRNA
  Rbck1
ccgcccaaccaagtg

SEQ ID NO: 39960 - DNA, 15 bp, Artificial Sequence
  dgRNA
  Rbck1
tggcgcgaaagtgcc

SEQ ID NO: 39961 - DNA, 15 bp, Artificial Sequence
  dgRNA
  Rbck1
ccaggagcagtctag

SEQ ID NO: 39962 - DNA, 15 bp, Artificial Sequence
  dgRNA
  Rbck1
gcagagtctcgggtg

SEQ ID NO: 39963 - DNA, 15 bp, Artificial Sequence
  dgRNA
  Efcab5
aaagtacagctgccg

SEQ ID NO: 39964 - DNA, 15 bp, Artificial Sequence
  dgRNA
  Efcab5
acgataaactgaaga

SEQ ID NO: 39965 - DNA, 15 bp, Artificial Sequence
  dgRNA
  Efcab5
caaaaaagctcccta

SEQ ID NO: 39966 - DNA, 15 bp, Artificial Sequence
  dgRNA
  Efcab5
tccctagggatgact

SEQ ID NO: 39967 - DNA, 15 bp, Artificial Sequence
  dgRNA
  Grin2d
tgtttccctccgtgt

SEQ ID NO: 39968 - DNA, 15 bp, Artificial Sequence
  dgRNA
  Grin2d
gcggcagaagcatag

SEQ ID NO: 39969 - DNA, 15 bp, Artificial Sequence
  dgRNA
  Grin2d
tgagagaaggcgcgg

SEQ ID NO: 39970 - DNA, 15 bp, Artificial Sequence
  dgRNA
  Ate1
ccctcgccctcccta

SEQ ID NO: 39971 - DNA, 15 bp, Artificial Sequence
  dgRNA
  Ate1
cctcgccctccctag

SEQ ID NO: 39972 - DNA, 15 bp, Artificial Sequence
  dgRNA
  Ate1
ctcgccctccctagg

SEQ ID NO: 39973 - DNA, 15 bp, Artificial Sequence
  dgRNA
  Ate1
agccgcccctcacag

SEQ ID NO: 39974 - DNA, 15 bp, Artificial Sequence
  dgRNA
  Gm8909
aggtctcgtctccat

SEQ ID NO: 39975 - DNA, 15 bp, Artificial Sequence
  dgRNA
  Gm8909
ggtctcgtctccatt

SEQ ID NO: 39976 - DNA, 15 bp, Artificial Sequence
  dgRNA
  Gm8909
ctcgtctccattggg

SEQ ID NO: 39977 - DNA, 15 bp, Artificial Sequence
  dgRNA
  Olfr293
cttagttttaatacg

SEQ ID NO: 39978 - DNA, 15 bp, Artificial Sequence
  dgRNA
  Hist1h2ai
aaaccagggcgccat

SEQ ID NO: 39979 - DNA, 15 bp, Artificial Sequence
  dgRNA
  Hist1h2ai
tgcttcttactgcgg

SEQ ID NO: 39980 - DNA, 15 bp, Artificial Sequence
  dgRNA
  Hist1h2ai
atggtgattcaggtt

SEQ ID NO: 39981 - DNA, 15 bp, Artificial Sequence
  dgRNA
  Hist1h2ai
gacgtatggtgattc

SEQ ID NO: 39982 - DNA, 15 bp, Artificial Sequence
  dgRNA
  Olfr57
gccatttgcagttgg

SEQ ID NO: 39983 - DNA, 15 bp, Artificial Sequence
  dgRNA
  Olfr57
atgggtaacacttaa

SEQ ID NO: 39984 - DNA, 15 bp, Artificial Sequence
  dgRNA
  Olfr57
acacttaaaggatac

SEQ ID NO: 39985 - DNA, 15 bp, Artificial Sequence
  dgRNA
  Tnfsf11
tcagagggccctgat

SEQ ID NO: 39986 - DNA, 15 bp, Artificial Sequence
  dgRNA
  Tnfsf11
gaggcaccctcctgg

SEQ ID NO: 39987 - DNA, 15 bp, Artificial Sequence
  dgRNA
  Tnfsf11
agagttagggctgcc

SEQ ID NO: 39988 - DNA, 15 bp, Artificial Sequence
  dgRNA
  Tnfsf11
gttgggtccagtggt

SEQ ID NO: 39989 - DNA, 15 bp, Artificial Sequence
  dgRNA
  Nanog
gcattacaatgtcca

SEQ ID NO: 39990 - DNA, 15 bp, Artificial Sequence
  dgRNA
  Nanog
catggtggaccctgc

SEQ ID NO: 39991 - DNA, 15 bp, Artificial Sequence
  dgRNA
  Nanog
ggtggaccctgcagg

SEQ ID NO: 39992 - DNA, 15 bp, Artificial Sequence
  dgRNA
  Nanog
ggcgtgggtgccgcc

SEQ ID NO: 39993 - DNA, 15 bp, Artificial Sequence
  dgRNA
  Ptrf
gtatagatagacgat

SEQ ID NO: 39994 - DNA, 15 bp, Artificial Sequence
  dgRNA
  Ptrf
tatagatagacgatg

SEQ ID NO: 39995 - DNA, 15 bp, Artificial Sequence
  dgRNA
  Ptrf
ggcaaggatcctcca

SEQ ID NO: 39996 - DNA, 15 bp, Artificial Sequence
  dgRNA
  Ptrf
aattcacgcgccatt

SEQ ID NO: 39997 - DNA, 15 bp, Artificial Sequence
  dgRNA
  Utp14b
aacgagcgccagccc

SEQ ID NO: 39998 - DNA, 15 bp, Artificial Sequence
  dgRNA
  Utp14b
acgagcgccagcccg

SEQ ID NO: 39999 - DNA, 15 bp, Artificial Sequence
  dgRNA
  Utp14b
ccggggtgcgcgtcc

SEQ ID NO: 40000 - DNA, 15 bp, Artificial Sequence
  dgRNA
  Utp14b
gcgcgtccaggactg

SEQ ID NO: 40001 - DNA, 15 bp, Artificial Sequence
  dgRNA
  Acsl4
cgacctgcgaccctt

SEQ ID NO: 40002 - DNA, 15 bp, Artificial Sequence
  dgRNA
  Acsl4
agctgcaagcccgat

SEQ ID NO: 40003 - DNA, 15 bp, Artificial Sequence
  dgRNA
  Acsl4
gctgcaagcccgatc

SEQ ID NO: 40004 - DNA, 15 bp, Artificial Sequence
  dgRNA
  Acsl4
cgggctccgcctttt

SEQ ID NO: 40005 - DNA, 15 bp, Artificial Sequence
  dgRNA
  Shoc2
ttcatccggcctggc

SEQ ID NO: 40006 - DNA, 15 bp, Artificial Sequence
  dgRNA
  Shoc2
ggccggccctgctgt

SEQ ID NO: 40007 - DNA, 15 bp, Artificial Sequence
  dgRNA
  Shoc2
gccggccctgctgta

SEQ ID NO: 40008 - DNA, 15 bp, Artificial Sequence
  dgRNA
  Shoc2
ctgctgtagggcgtc

SEQ ID NO: 40009 - DNA, 15 bp, Artificial Sequence
  dgRNA
  Tlcd2
acgccatccgttcca

SEQ ID NO: 40010 - DNA, 15 bp, Artificial Sequence
  dgRNA
  Tlcd2
ccatggcttcacccg

SEQ ID NO: 40011 - DNA, 15 bp, Artificial Sequence
  dgRNA
  Tlcd2
cccgaggtggcccca

SEQ ID NO: 40012 - DNA, 15 bp, Artificial Sequence
  dgRNA
  Tlcd2
gagcagccgagagat

SEQ ID NO: 40013 - DNA, 15 bp, Artificial Sequence
  dgRNA
  Stkld1
taagcagacacgccc

SEQ ID NO: 40014 - DNA, 15 bp, Artificial Sequence
  dgRNA
  Stkld1
aagcagacacgcccc

SEQ ID NO: 40015 - DNA, 15 bp, Artificial Sequence
  dgRNA
  Stkld1
acacgccccgggttg

SEQ ID NO: 40016 - DNA, 15 bp, Artificial Sequence
  dgRNA
  Stkld1
cacgccccgggttga

SEQ ID NO: 40017 - DNA, 15 bp, Artificial Sequence
  dgRNA
  Yif1a
ccgccccctatctgt

SEQ ID NO: 40018 - DNA, 15 bp, Artificial Sequence
  dgRNA
  Yif1a
atgacaaaacccgat

SEQ ID NO: 40019 - DNA, 15 bp, Artificial Sequence
  dgRNA
  Yif1a
agccaataggtgaga

SEQ ID NO: 40020 - DNA, 15 bp, Artificial Sequence
  dgRNA
  Yif1a
gcgctaccagccaat

SEQ ID NO: 40021 - DNA, 15 bp, Artificial Sequence
  dgRNA
  Slc38a2
cagtgccccgagccg

SEQ ID NO: 40022 - DNA, 15 bp, Artificial Sequence
  dgRNA
  Slc38a2
agtgccccgagccgc

SEQ ID NO: 40023 - DNA, 15 bp, Artificial Sequence
  dgRNA
  Slc38a2
gtgccccgagccgcg

SEQ ID NO: 40024 - DNA, 15 bp, Artificial Sequence
  dgRNA
  Slc38a2
cgagccgcggggaag

SEQ ID NO: 40025 - DNA, 15 bp, Artificial Sequence
  dgRNA
  Mid1
ctctttccctcgaga

SEQ ID NO: 40026 - DNA, 15 bp, Artificial Sequence
  dgRNA
  Mid1
cctctcgagggaaag

SEQ ID NO: 40027 - DNA, 15 bp, Artificial Sequence
  dgRNA
  Mid1
tagcggccctctcga

SEQ ID NO: 40028 - DNA, 15 bp, Artificial Sequence
  dgRNA
  Mid1
gtagcggccctctcg

SEQ ID NO: 40029 - DNA, 15 bp, Artificial Sequence
  dgRNA
  Cyba
agtgacttacgcctc

SEQ ID NO: 40030 - DNA, 15 bp, Artificial Sequence
  dgRNA
  Cyba
ttacgcctctggccc

SEQ ID NO: 40031 - DNA, 15 bp, Artificial Sequence
  dgRNA
  Cyba
tacgcctctggccct

SEQ ID NO: 40032 - DNA, 15 bp, Artificial Sequence
  dgRNA
  Cyba
ggggcacagcccgac

SEQ ID NO: 40033 - DNA, 15 bp, Artificial Sequence
  dgRNA
  Chpf
acgcaccaaccacgc

SEQ ID NO: 40034 - DNA, 15 bp, Artificial Sequence
  dgRNA
  Chpf
gcaccaaccacgcag

SEQ ID NO: 40035 - DNA, 15 bp, Artificial Sequence
  dgRNA
  Chpf
caccaaccacgcagg

SEQ ID NO: 40036 - DNA, 15 bp, Artificial Sequence
  dgRNA
  Chpf
accaaccacgcaggg

SEQ ID NO: 40037 - DNA, 15 bp, Artificial Sequence
  dgRNA
  Epor
cccctacactggttt

SEQ ID NO: 40038 - DNA, 15 bp, Artificial Sequence
  dgRNA
  Epor
cactggtttaggcag

SEQ ID NO: 40039 - DNA, 15 bp, Artificial Sequence
  dgRNA
  Epor
gtctaggtctagtcc

SEQ ID NO: 40040 - DNA, 15 bp, Artificial Sequence
  dgRNA
  Epor
cgtctaggtctagtc

SEQ ID NO: 40041 - DNA, 15 bp, Artificial Sequence
  dgRNA
  Pcdhga7
tttaaagtgtatccg

SEQ ID NO: 40042 - DNA, 15 bp, Artificial Sequence
  dgRNA
  Pcdhga7
tgtatccgtggtgtc

SEQ ID NO: 40043 - DNA, 15 bp, Artificial Sequence
  dgRNA
  Pcdhga7
gtatccgtggtgtct

SEQ ID NO: 40044 - DNA, 15 bp, Artificial Sequence
  dgRNA
  Pcdhga7
tgcagtaacttagta

SEQ ID NO: 40045 - DNA, 15 bp, Artificial Sequence
  dgRNA
  Txndc12
cagccctcaccaatt

SEQ ID NO: 40046 - DNA, 15 bp, Artificial Sequence
  dgRNA
  Txndc12
agccctcaccaattc

SEQ ID NO: 40047 - DNA, 15 bp, Artificial Sequence
  dgRNA
  Txndc12
tcgggccacctcatc

SEQ ID NO: 40048 - DNA, 15 bp, Artificial Sequence
  dgRNA
  Txndc12
taagcctggatatca

SEQ ID NO: 40049 - DNA, 15 bp, Artificial Sequence
  dgRNA
  Cdv3
gccataacgaaggtg

SEQ ID NO: 40050 - DNA, 15 bp, Artificial Sequence
  dgRNA
  Cdv3
ccataacgaaggtga

SEQ ID NO: 40051 - DNA, 15 bp, Artificial Sequence
  dgRNA
  Cdv3
aacgaaggtgagggt

SEQ ID NO: 40052 - DNA, 15 bp, Artificial Sequence
  dgRNA
  Cdv3
acgaaggtgagggtc

SEQ ID NO: 40053 - DNA, 15 bp, Artificial Sequence
  dgRNA
  Vmn2r76
gttaaacttctgctc

SEQ ID NO: 40054 - DNA, 15 bp, Artificial Sequence
  dgRNA
  Vmn2r76
gcattatcttgcctg

SEQ ID NO: 40055 - DNA, 15 bp, Artificial Sequence
  dgRNA
  Vmn2r76
agcattatcttgcct

SEQ ID NO: 40056 - DNA, 15 bp, Artificial Sequence
  dgRNA
  Vmn2r76
aagcattatcttgcc

SEQ ID NO: 40057 - DNA, 15 bp, Artificial Sequence
  dgRNA
  Snap23
gaagaactcctcccg

SEQ ID NO: 40058 - DNA, 15 bp, Artificial Sequence
  dgRNA
  Snap23
ccggggagaatctgt

SEQ ID NO: 40059 - DNA, 15 bp, Artificial Sequence
  dgRNA
  Snap23
cggggagaatctgta

SEQ ID NO: 40060 - DNA, 15 bp, Artificial Sequence
  dgRNA
  Snap23
atctgtagggttaac

SEQ ID NO: 40061 - DNA, 15 bp, Artificial Sequence
  dgRNA
  Apoc1
gttaaacctctgtgc

SEQ ID NO: 40062 - DNA, 15 bp, Artificial Sequence
  dgRNA
  Apoc1
ctctagtgagttgct

SEQ ID NO: 40063 - DNA, 15 bp, Artificial Sequence
  dgRNA
  Apoc1
cataggctttttggc

SEQ ID NO: 40064 - DNA, 15 bp, Artificial Sequence
  dgRNA
  Apoc1
taaccggttggggag

SEQ ID NO: 40065 - DNA, 15 bp, Artificial Sequence
  dgRNA
  Olfr620
ctgtatcgagaaaac

SEQ ID NO: 40066 - DNA, 15 bp, Artificial Sequence
  dgRNA
  Olfr620
tgtatcgagaaaaca

SEQ ID NO: 40067 - DNA, 15 bp, Artificial Sequence
  dgRNA
  Olfr620
gacctttcagtacta

SEQ ID NO: 40068 - DNA, 15 bp, Artificial Sequence
  dgRNA
  Olfr620
ctaataatgtctact

SEQ ID NO: 40069 - DNA, 15 bp, Artificial Sequence
  dgRNA
  Trpc6
tttcgatccctttaa

SEQ ID NO: 40070 - DNA, 15 bp, Artificial Sequence
  dgRNA
  Trpc6
cgatccctttaaagg

SEQ ID NO: 40071 - DNA, 15 bp, Artificial Sequence
  dgRNA
  Trpc6
aggtggggatcgtga

SEQ ID NO: 40072 - DNA, 15 bp, Artificial Sequence
  dgRNA
  Trpc6
tggggatcgtgacgg

SEQ ID NO: 40073 - DNA, 15 bp, Artificial Sequence
  dgRNA
  Mms19
ccgttaggtccctga

SEQ ID NO: 40074 - DNA, 15 bp, Artificial Sequence
  dgRNA
  Mms19
cgttaggtccctgaa

SEQ ID NO: 40075 - DNA, 15 bp, Artificial Sequence
  dgRNA
  Mms19
tggcccagagccggc

SEQ ID NO: 40076 - DNA, 15 bp, Artificial Sequence
  dgRNA
  Mms19
ggcaggcacgtgacc

SEQ ID NO: 40077 - DNA, 15 bp, Artificial Sequence
  dgRNA
  Neurod2
gtgacagatggcggc

SEQ ID NO: 40078 - DNA, 15 bp, Artificial Sequence
  dgRNA
  Neurod2
gatggcggcgggtcc

SEQ ID NO: 40079 - DNA, 15 bp, Artificial Sequence
  dgRNA
  Neurod2
atggcggcgggtccc

SEQ ID NO: 40080 - DNA, 15 bp, Artificial Sequence
  dgRNA
  Neurod2
tggcggcgggtcccg

SEQ ID NO: 40081 - DNA, 15 bp, Artificial Sequence
  dgRNA
  Cml1
agaagatcgtcccct

SEQ ID NO: 40082 - DNA, 15 bp, Artificial Sequence
  dgRNA
  Cml1
ttagctctctacttc

SEQ ID NO: 40083 - DNA, 15 bp, Artificial Sequence
  dgRNA
  Cml1
cgggcgtaggatgca

SEQ ID NO: 40084 - DNA, 15 bp, Artificial Sequence
  dgRNA
  Cml1
gcgggcgtaggatgc

SEQ ID NO: 40085 - DNA, 15 bp, Artificial Sequence
  dgRNA
  Thyn1
cgaatctcagacccc

SEQ ID NO: 40086 - DNA, 15 bp, Artificial Sequence
  dgRNA
  Thyn1
gcccccctgatactc

SEQ ID NO: 40087 - DNA, 15 bp, Artificial Sequence
  dgRNA
  Thyn1
cccccctgatactct

SEQ ID NO: 40088 - DNA, 15 bp, Artificial Sequence
  dgRNA
  Thyn1
taagcccttgaagcg

SEQ ID NO: 40089 - DNA, 15 bp, Artificial Sequence
  dgRNA
  Emcn
gacccttcttgagaa

SEQ ID NO: 40090 - DNA, 15 bp, Artificial Sequence
  dgRNA
  Parp1
caggcgcagtcgcgc

SEQ ID NO: 40091 - DNA, 15 bp, Artificial Sequence
  dgRNA
  Parp1
aggcgcagtcgcgct

SEQ ID NO: 40092 - DNA, 15 bp, Artificial Sequence
  dgRNA
  Parp1
ccgccctatgagctg

SEQ ID NO: 40093 - DNA, 15 bp, Artificial Sequence
  dgRNA
  Parp1
ctccgcgcgcgagct

SEQ ID NO: 40094 - DNA, 15 bp, Artificial Sequence
  dgRNA
  Tgtp1
agcccccctctttga

SEQ ID NO: 40095 - DNA, 15 bp, Artificial Sequence
  dgRNA
  Tgtp1
gatggcttctacccc

SEQ ID NO: 40096 - DNA, 15 bp, Artificial Sequence
  dgRNA
  Tgtp1
aggggggctgtagtc

SEQ ID NO: 40097 - DNA, 15 bp, Artificial Sequence
  dgRNA
  9130019O22Rik
gcagggtgtctcacg

SEQ ID NO: 40098 - DNA, 15 bp, Artificial Sequence
  dgRNA
  9130019O22Rik
cagggtgtctcacgt

SEQ ID NO: 40099 - DNA, 15 bp, Artificial Sequence
  dgRNA
  9130019O22Rik
aacttgttcttagac

SEQ ID NO: 40100 - DNA, 15 bp, Artificial Sequence
  dgRNA
  9130019O22Rik
gtgcaggaagtcacg

SEQ ID NO: 40101 - DNA, 15 bp, Artificial Sequence
  dgRNA
  Mcf2l
cacacgcatgactcc

SEQ ID NO: 40102 - DNA, 15 bp, Artificial Sequence
  dgRNA
  Mcf2l
tgactccaggtgcgg

SEQ ID NO: 40103 - DNA, 15 bp, Artificial Sequence
  dgRNA
  Mcf2l
cggtggtgacacgcc

SEQ ID NO: 40104 - DNA, 15 bp, Artificial Sequence
  dgRNA
  Mcf2l
ggtgacacgcccggc

SEQ ID NO: 40105 - DNA, 15 bp, Artificial Sequence
  dgRNA
  Pla2g4d
cttagctcgggagcc

SEQ ID NO: 40106 - DNA, 15 bp, Artificial Sequence
  dgRNA
  Pla2g4d
tggtattgacctaca

SEQ ID NO: 40107 - DNA, 15 bp, Artificial Sequence
  dgRNA
  Pla2g4d
ggtattgacctacaa

SEQ ID NO: 40108 - DNA, 15 bp, Artificial Sequence
  dgRNA
  Pla2g4d
gatgctccacccacg

SEQ ID NO: 40109 - DNA, 15 bp, Artificial Sequence
  dgRNA
  Bnip1
acttttccgtttagt

SEQ ID NO: 40110 - DNA, 15 bp, Artificial Sequence
  dgRNA
  Bnip1
tctggactcttgacc

SEQ ID NO: 40111 - DNA, 15 bp, Artificial Sequence
  dgRNA
  Bnip1
tggtttgatccacac

SEQ ID NO: 40112 - DNA, 15 bp, Artificial Sequence
  dgRNA
  Bnip1
ggtttgatccacacg

SEQ ID NO: 40113 - DNA, 15 bp, Artificial Sequence
  dgRNA
  Zfp454
atcgctttttgctcc

SEQ ID NO: 40114 - DNA, 15 bp, Artificial Sequence
  dgRNA
  Zfp454
cctggacaaacgcgc

SEQ ID NO: 40115 - DNA, 15 bp, Artificial Sequence
  dgRNA
  Zfp454
acaaacgcgcaggcg

SEQ ID NO: 40116 - DNA, 15 bp, Artificial Sequence
  dgRNA
  Zfp454
tccgcgtcaagcagc

SEQ ID NO: 40117 - DNA, 15 bp, Artificial Sequence
  dgRNA
  Ankrd16
gcatgttgtcgcctg

SEQ ID NO: 40118 - DNA, 15 bp, Artificial Sequence
  dgRNA
  Ankrd16
catgttgtcgcctga

SEQ ID NO: 40119 - DNA, 15 bp, Artificial Sequence
  dgRNA
  Ankrd16
cattaaagacgctag

SEQ ID NO: 40120 - DNA, 15 bp, Artificial Sequence
  dgRNA
  Ankrd16
ctagcggagagaatc

SEQ ID NO: 40121 - DNA, 15 bp, Artificial Sequence
  dgRNA
  Fam8a1
taaaacgtaccacag

SEQ ID NO: 40122 - DNA, 15 bp, Artificial Sequence
  dgRNA
  Fam8a1
aacatcgcgtagccc

SEQ ID NO: 40123 - DNA, 15 bp, Artificial Sequence
  dgRNA
  Fam8a1
caccaaccgcccgcc

SEQ ID NO: 40124 - DNA, 15 bp, Artificial Sequence
  dgRNA
  Fam8a1
ccggctccccaagcc

SEQ ID NO: 40125 - DNA, 15 bp, Artificial Sequence
  dgRNA
  Alox15
gagccccgccttttt

SEQ ID NO: 40126 - DNA, 15 bp, Artificial Sequence
  dgRNA
  Alox15
agccccgcctttttt

SEQ ID NO: 40127 - DNA, 15 bp, Artificial Sequence
  dgRNA
  Alox15
ccgccttttttgggc

SEQ ID NO: 40128 - DNA, 15 bp, Artificial Sequence
  dgRNA
  Alox15
ttttgggctggaacg

SEQ ID NO: 40129 - DNA, 15 bp, Artificial Sequence
  dgRNA
  Vars2
ttttgtttacacacc

SEQ ID NO: 40130 - DNA, 15 bp, Artificial Sequence
  dgRNA
  Vars2
gcttcagacgtctgc

SEQ ID NO: 40131 - DNA, 15 bp, Artificial Sequence
  dgRNA
  Vars2
tagccagaaagccgg

SEQ ID NO: 40132 - DNA, 15 bp, Artificial Sequence
  dgRNA
  Vars2
tgggtagggaaacgc

SEQ ID NO: 40133 - DNA, 15 bp, Artificial Sequence
  dgRNA
  Ube2f
acatggcccaccctc

SEQ ID NO: 40134 - DNA, 15 bp, Artificial Sequence
  dgRNA
  Ube2f
cttcaccaatgaacg

SEQ ID NO: 40135 - DNA, 15 bp, Artificial Sequence
  dgRNA
  Ube2f
ttcaccaatgaacga

SEQ ID NO: 40136 - DNA, 15 bp, Artificial Sequence
  dgRNA
  Ube2f
gtgactgtccacgag

SEQ ID NO: 40137 - DNA, 15 bp, Artificial Sequence
  dgRNA
  Bcl7c
tccactcgcagcgtc

SEQ ID NO: 40138 - DNA, 15 bp, Artificial Sequence
  dgRNA
  Bcl7c
cgtctggcgcgtact

SEQ ID NO: 40139 - DNA, 15 bp, Artificial Sequence
  dgRNA
  Bcl7c
gacgcccacccgccg

SEQ ID NO: 40140 - DNA, 15 bp, Artificial Sequence
  dgRNA
  Bcl7c
ccgcggacgcacacc

SEQ ID NO: 40141 - DNA, 15 bp, Artificial Sequence
  dgRNA
  Rag2
aaggttaaacttgag

SEQ ID NO: 40142 - DNA, 15 bp, Artificial Sequence
  dgRNA
  Rag2
ttgagaggaacaccc

SEQ ID NO: 40143 - DNA, 15 bp, Artificial Sequence
  dgRNA
  Rag2
tccctcaaccatcac

SEQ ID NO: 40144 - DNA, 15 bp, Artificial Sequence
  dgRNA
  Rag2
ccctcaaccatcaca

SEQ ID NO: 40145 - DNA, 15 bp, Artificial Sequence
  dgRNA
  Trim45
gccaaaccacaaatc

SEQ ID NO: 40146 - DNA, 15 bp, Artificial Sequence
  dgRNA
  Trim45
aaatccggagatctg

SEQ ID NO: 40147 - DNA, 15 bp, Artificial Sequence
  dgRNA
  Trim45
ccggagatctgtgga

SEQ ID NO: 40148 - DNA, 15 bp, Artificial Sequence
  dgRNA
  Trim45
gaggcgttctctttc

SEQ ID NO: 40149 - DNA, 15 bp, Artificial Sequence
  dgRNA
  BC147527
tttttgggacctgat

SEQ ID NO: 40150 - DNA, 15 bp, Artificial Sequence
  dgRNA
  BC147527
ttttgggacctgatt

SEQ ID NO: 40151 - DNA, 15 bp, Artificial Sequence
  dgRNA
  BC147527
aggtcccaaaaatcc

SEQ ID NO: 40152 - DNA, 15 bp, Artificial Sequence
  dgRNA
  Sgk1
ccagggcggctcgcc

SEQ ID NO: 40153 - DNA, 15 bp, Artificial Sequence
  dgRNA
  Sgk1
tcgcctggctcactc

SEQ ID NO: 40154 - DNA, 15 bp, Artificial Sequence
  dgRNA
  Sgk1
agcctgctaggcggc

SEQ ID NO: 40155 - DNA, 15 bp, Artificial Sequence
  dgRNA
  Sgk1
gcctgctaggcggct

SEQ ID NO: 40156 - DNA, 15 bp, Artificial Sequence
  dgRNA
  Rsph6a
acagctgcgggagtt

SEQ ID NO: 40157 - DNA, 15 bp, Artificial Sequence
  dgRNA
  Rsph6a
cagctgcgggagttt

SEQ ID NO: 40158 - DNA, 15 bp, Artificial Sequence
  dgRNA
  Rsph6a
gctgcgggagtttgg

SEQ ID NO: 40159 - DNA, 15 bp, Artificial Sequence
  dgRNA
  Rsph6a
ctgcgggagtttggg

SEQ ID NO: 40160 - DNA, 15 bp, Artificial Sequence
  dgRNA
  Ewsr1
ttgtttcaggccggc

SEQ ID NO: 40161 - DNA, 15 bp, Artificial Sequence
  dgRNA
  Ewsr1
ccgcgcctcgcgcca

SEQ ID NO: 40162 - DNA, 15 bp, Artificial Sequence
  dgRNA
  Ewsr1
cgccaaggagctctc

SEQ ID NO: 40163 - DNA, 15 bp, Artificial Sequence
  dgRNA
  Ewsr1
gagctctcgggttcg

SEQ ID NO: 40164 - DNA, 15 bp, Artificial Sequence
  dgRNA
  Ticam1
ctgcctagttccacg

SEQ ID NO: 40165 - DNA, 15 bp, Artificial Sequence
  dgRNA
  Ticam1
gttccacgtggcgcc

SEQ ID NO: 40166 - DNA, 15 bp, Artificial Sequence
  dgRNA
  Ticam1
ccccccagacccgga

SEQ ID NO: 40167 - DNA, 15 bp, Artificial Sequence
  dgRNA
  Ticam1
cccccagacccggaa

SEQ ID NO: 40168 - DNA, 15 bp, Artificial Sequence
  dgRNA
  D2hgdh
gttgggaaaagtgcg

SEQ ID NO: 40169 - DNA, 15 bp, Artificial Sequence
  dgRNA
  D2hgdh
aaaagtgcgtggagt

SEQ ID NO: 40170 - DNA, 15 bp, Artificial Sequence
  dgRNA
  D2hgdh
cgtggagtcggattt

SEQ ID NO: 40171 - DNA, 15 bp, Artificial Sequence
  dgRNA
  D2hgdh
ggatactcgccactt

SEQ ID NO: 40172 - DNA, 15 bp, Artificial Sequence
  dgRNA
  Tmem266
tccggaacgcgcgag

SEQ ID NO: 40173 - DNA, 15 bp, Artificial Sequence
  dgRNA
  Tmem266
ccggaacgcgcgagc

SEQ ID NO: 40174 - DNA, 15 bp, Artificial Sequence
  dgRNA
  Tmem266
acgcgcgagcgggag

SEQ ID NO: 40175 - DNA, 15 bp, Artificial Sequence
  dgRNA
  Tmem266
cgcgcgagcgggagc

SEQ ID NO: 40176 - DNA, 15 bp, Artificial Sequence
  dgRNA
  D430042O09Rik
ctcgccgccgaggcc

SEQ ID NO: 40177 - DNA, 15 bp, Artificial Sequence
  dgRNA
  D430042O09Rik
tcgccgccgaggcca

SEQ ID NO: 40178 - DNA, 15 bp, Artificial Sequence
  dgRNA
  D430042O09Rik
gcgtacagcgatccg

SEQ ID NO: 40179 - DNA, 15 bp, Artificial Sequence
  dgRNA
  D430042O09Rik
agcgatccgaggcct

SEQ ID NO: 40180 - DNA, 15 bp, Artificial Sequence
  dgRNA
  Atp5e
ctcagagcgggctcg

SEQ ID NO: 40181 - DNA, 15 bp, Artificial Sequence
  dgRNA
  Atp5e
agagcgggctcgagg

SEQ ID NO: 40182 - DNA, 15 bp, Artificial Sequence
  dgRNA
  Atp5e
cccgcagcacctgga

SEQ ID NO: 40183 - DNA, 15 bp, Artificial Sequence
  dgRNA
  Atp5e
gtgaccggcatgcag

SEQ ID NO: 40184 - DNA, 15 bp, Artificial Sequence
  dgRNA
  Rxfp3
ttactattgtgtaag

SEQ ID NO: 40185 - DNA, 15 bp, Artificial Sequence
  dgRNA
  Rxfp3
tactattgtgtaagt

SEQ ID NO: 40186 - DNA, 15 bp, Artificial Sequence
  dgRNA
  Rxfp3
caaactattgtgtta

SEQ ID NO: 40187 - DNA, 15 bp, Artificial Sequence
  dgRNA
  Rxfp3
actattgtgttaagg

SEQ ID NO: 40188 - DNA, 15 bp, Artificial Sequence
  dgRNA
  Mrgpra3
tgagaaggaaatcgc

SEQ ID NO: 40189 - DNA, 15 bp, Artificial Sequence
  dgRNA
  Mrgpra3
aatcgcaggtctgtc

SEQ ID NO: 40190 - DNA, 15 bp, Artificial Sequence
  dgRNA
  Mrgpra3
atcgcaggtctgtct

SEQ ID NO: 40191 - DNA, 15 bp, Artificial Sequence
  dgRNA
  Mrgpra3
tcgcaggtctgtctg

SEQ ID NO: 40192 - DNA, 15 bp, Artificial Sequence
  dgRNA
  Rrp15
tcggaacccagcttc

SEQ ID NO: 40193 - DNA, 15 bp, Artificial Sequence
  dgRNA
  Rrp15
gcagccgcccagaag

SEQ ID NO: 40194 - DNA, 15 bp, Artificial Sequence
  dgRNA
  Rrp15
cgcccagaaggggcc

SEQ ID NO: 40195 - DNA, 15 bp, Artificial Sequence
  dgRNA
  Rrp15
gcccagaaggggccg

SEQ ID NO: 40196 - DNA, 15 bp, Artificial Sequence
  dgRNA
  Gna12
agatcccgccttttt

SEQ ID NO: 40197 - DNA, 15 bp, Artificial Sequence
  dgRNA
  Gna12
cgcctttttcggcac

SEQ ID NO: 40198 - DNA, 15 bp, Artificial Sequence
  dgRNA
  Gna12
accggctccgcccca

SEQ ID NO: 40199 - DNA, 15 bp, Artificial Sequence
  dgRNA
  Gna12
cgccccaaggaccac

SEQ ID NO: 40200 - DNA, 15 bp, Artificial Sequence
  dgRNA
  Lenep
gaagttgagctttcc

SEQ ID NO: 40201 - DNA, 15 bp, Artificial Sequence
  dgRNA
  Lenep
actcctggacccccg

SEQ ID NO: 40202 - DNA, 15 bp, Artificial Sequence
  dgRNA
  Lenep
gttctatgttactcc

SEQ ID NO: 40203 - DNA, 15 bp, Artificial Sequence
  dgRNA
  Lenep
acttcccgtccatgc

SEQ ID NO: 40204 - DNA, 15 bp, Artificial Sequence
  dgRNA
  Dusp28
cacccgtctagacca

SEQ ID NO: 40205 - DNA, 15 bp, Artificial Sequence
  dgRNA
  Dusp28
agaccaaggcatgac

SEQ ID NO: 40206 - DNA, 15 bp, Artificial Sequence
  dgRNA
  Dusp28
gaccaaggcatgaca

SEQ ID NO: 40207 - DNA, 15 bp, Artificial Sequence
  dgRNA
  Dusp28
gccaatcctgagccg

SEQ ID NO: 40208 - DNA, 15 bp, Artificial Sequence
  dgRNA
  Vmp1
aaccgaaatcccgcg

SEQ ID NO: 40209 - DNA, 15 bp, Artificial Sequence
  dgRNA
  Vmp1
ccgcgaggaacctcc

SEQ ID NO: 40210 - DNA, 15 bp, Artificial Sequence
  dgRNA
  Vmp1
cgaggaacctcccgg

SEQ ID NO: 40211 - DNA, 15 bp, Artificial Sequence
  dgRNA
  Vmp1
ctcccggtggccgaa

SEQ ID NO: 40212 - DNA, 15 bp, Artificial Sequence
  dgRNA
  Sox5
tgacttctaccattc

SEQ ID NO: 40213 - DNA, 15 bp, Artificial Sequence
  dgRNA
  Sox5
cattcagggatgtcc

SEQ ID NO: 40214 - DNA, 15 bp, Artificial Sequence
  dgRNA
  Sox5
gaaagaactggcgcc

SEQ ID NO: 40215 - DNA, 15 bp, Artificial Sequence
  dgRNA
  Sox5
agaactggcgcctgg

SEQ ID NO: 40216 - DNA, 15 bp, Artificial Sequence
  dgRNA
  Mrpl12
ggctatgagttccgt

SEQ ID NO: 40217 - DNA, 15 bp, Artificial Sequence
  dgRNA
  Mrpl12
gagttccgtaggtaa

SEQ ID NO: 40218 - DNA, 15 bp, Artificial Sequence
  dgRNA
  Mrpl12
agttccgtaggtaaa

SEQ ID NO: 40219 - DNA, 15 bp, Artificial Sequence
  dgRNA
  Mrpl12
gttccgtaggtaaag

SEQ ID NO: 40220 - DNA, 15 bp, Artificial Sequence
  dgRNA
  Aga
cactgggccaataga

SEQ ID NO: 40221 - DNA, 15 bp, Artificial Sequence
  dgRNA
  Aga
tctcgcgagacaacg

SEQ ID NO: 40222 - DNA, 15 bp, Artificial Sequence
  dgRNA
  Abl1
ttccaccgaccttcc

SEQ ID NO: 40223 - DNA, 15 bp, Artificial Sequence
  dgRNA
  Abl1
accttcccggacacg

SEQ ID NO: 40224 - DNA, 15 bp, Artificial Sequence
  dgRNA
  Abl1
tcccggacacgcggc

SEQ ID NO: 40225 - DNA, 15 bp, Artificial Sequence
  dgRNA
  Abl1
cccggacacgcggca

SEQ ID NO: 40226 - DNA, 15 bp, Artificial Sequence
  dgRNA
  Anapc1
ttagctcaattgaga

SEQ ID NO: 40227 - DNA, 15 bp, Artificial Sequence
  dgRNA
  Anapc1
gaccgccttcgctat

SEQ ID NO: 40228 - DNA, 15 bp, Artificial Sequence
  dgRNA
  Anapc1
ctttttcaactgcgc

SEQ ID NO: 40229 - DNA, 15 bp, Artificial Sequence
  dgRNA
  Anapc1
aactgcgcaggcgct

SEQ ID NO: 40230 - DNA, 15 bp, Artificial Sequence
  dgRNA
  Thumpd3
tagcctcggtttctc

SEQ ID NO: 40231 - DNA, 15 bp, Artificial Sequence
  dgRNA
  Thumpd3
agtgctcgacactga

SEQ ID NO: 40232 - DNA, 15 bp, Artificial Sequence
  dgRNA
  Thumpd3
cgacactgagggcag

SEQ ID NO: 40233 - DNA, 15 bp, Artificial Sequence
  dgRNA
  Thumpd3
gagcatccgctcgct

SEQ ID NO: 40234 - DNA, 15 bp, Artificial Sequence
  dgRNA
  Grm8
caagccaactttatg

SEQ ID NO: 40235 - DNA, 15 bp, Artificial Sequence
  dgRNA
  Grm8
gggaataaacttgaa

SEQ ID NO: 40236 - DNA, 15 bp, Artificial Sequence
  dgRNA
  Grm8
aataaacttgaacgg

SEQ ID NO: 40237 - DNA, 15 bp, Artificial Sequence
  dgRNA
  Grm8
gaacggaggatctgt

SEQ ID NO: 40238 - DNA, 15 bp, Artificial Sequence
  dgRNA
  Shroom4
cactgacttacacct

SEQ ID NO: 40239 - DNA, 15 bp, Artificial Sequence
  dgRNA
  Shroom4
acacctcggttcgct

SEQ ID NO: 40240 - DNA, 15 bp, Artificial Sequence
  dgRNA
  Shroom4
cacctcggttcgctc

SEQ ID NO: 40241 - DNA, 15 bp, Artificial Sequence
  dgRNA
  Shroom4
gttcgctcgggctga

SEQ ID NO: 40242 - DNA, 15 bp, Artificial Sequence
  dgRNA
  Krtap11-1
taaatgtcctttacg

SEQ ID NO: 40243 - DNA, 15 bp, Artificial Sequence
  dgRNA
  Krtap11-1
aaatgtcctttacga

SEQ ID NO: 40244 - DNA, 15 bp, Artificial Sequence
  dgRNA
  Krtap11-1
cctttacgagggaga

SEQ ID NO: 40245 - DNA, 15 bp, Artificial Sequence
  dgRNA
  Krtap11-1
cagggacaattaact

SEQ ID NO: 40246 - DNA, 15 bp, Artificial Sequence
  dgRNA
  Pno1
ggctgcgagcgtatg

SEQ ID NO: 40247 - DNA, 15 bp, Artificial Sequence
  dgRNA
  Pno1
gctgcgagcgtatga

SEQ ID NO: 40248 - DNA, 15 bp, Artificial Sequence
  dgRNA
  Pno1
gagcgtatgagggca

SEQ ID NO: 40249 - DNA, 15 bp, Artificial Sequence
  dgRNA
  Pno1
agcaattccgaaacg

SEQ ID NO: 40250 - DNA, 15 bp, Artificial Sequence
  dgRNA
  Sdad1
acctgctccagagtt

SEQ ID NO: 40251 - DNA, 15 bp, Artificial Sequence
  dgRNA
  Sdad1
gtagcggttgtccac

SEQ ID NO: 40252 - DNA, 15 bp, Artificial Sequence
  dgRNA
  Sdad1
cggttgtccaccggc

SEQ ID NO: 40253 - DNA, 15 bp, Artificial Sequence
  dgRNA
  Sdad1
ggttgtccaccggca

SEQ ID NO: 40254 - DNA, 15 bp, Artificial Sequence
  dgRNA
  Syt14
agctgcctggccccg

SEQ ID NO: 40255 - DNA, 15 bp, Artificial Sequence
  dgRNA
  Syt14
gaacgccccggggcc

SEQ ID NO: 40256 - DNA, 15 bp, Artificial Sequence
  dgRNA
  Syt14
ggcgggaacgccccg

SEQ ID NO: 40257 - DNA, 15 bp, Artificial Sequence
  dgRNA
  Syt14
gggcgggaacgcccc

SEQ ID NO: 40258 - DNA, 15 bp, Artificial Sequence
  dgRNA
  Coa7
accgacgcagaaacc

SEQ ID NO: 40259 - DNA, 15 bp, Artificial Sequence
  dgRNA
  Coa7
ccgacgcagaaacct

SEQ ID NO: 40260 - DNA, 15 bp, Artificial Sequence
  dgRNA
  Coa7
gagctaccaccgcaa

SEQ ID NO: 40261 - DNA, 15 bp, Artificial Sequence
  dgRNA
  Coa7
accgcaaaggatgat

SEQ ID NO: 40262 - DNA, 15 bp, Artificial Sequence
  dgRNA
  Pglyrp2
tctacggacttcttt

SEQ ID NO: 40263 - DNA, 15 bp, Artificial Sequence
  dgRNA
  Pglyrp2
cggacttcttttggc

SEQ ID NO: 40264 - DNA, 15 bp, Artificial Sequence
  dgRNA
  Pglyrp2
ggacttcttttggca

SEQ ID NO: 40265 - DNA, 15 bp, Artificial Sequence
  dgRNA
  Pglyrp2
cccatcacgtcactc

SEQ ID NO: 40266 - DNA, 15 bp, Artificial Sequence
  dgRNA
  Tmem229b
tagaacgagctaaca

SEQ ID NO: 40267 - DNA, 15 bp, Artificial Sequence
  dgRNA
  Tmem229b
ctaacaaggttgagt

SEQ ID NO: 40268 - DNA, 15 bp, Artificial Sequence
  dgRNA
  Tmem229b
ggttgagtcggcctc

SEQ ID NO: 40269 - DNA, 15 bp, Artificial Sequence
  dgRNA
  Tmem229b
ctattgaagttctta

SEQ ID NO: 40270 - DNA, 15 bp, Artificial Sequence
  dgRNA
  Scgb1b3
atcttgtcaataacc

SEQ ID NO: 40271 - DNA, 15 bp, Artificial Sequence
  dgRNA
  Tac4
caagctgtaacctcc

SEQ ID NO: 40272 - DNA, 15 bp, Artificial Sequence
  dgRNA
  Tac4
atcagtgttaagcct

SEQ ID NO: 40273 - DNA, 15 bp, Artificial Sequence
  dgRNA
  Tac4
tcagtgttaagcctt

SEQ ID NO: 40274 - DNA, 15 bp, Artificial Sequence
  dgRNA
  Tac4
tgttggggtggcaat

SEQ ID NO: 40275 - DNA, 15 bp, Artificial Sequence
  dgRNA
  Cyp4f15
cccccatgatgtgag

SEQ ID NO: 40276 - DNA, 15 bp, Artificial Sequence
  dgRNA
  Cyp4f15
caagttctaaggctc

SEQ ID NO: 40277 - DNA, 15 bp, Artificial Sequence
  dgRNA
  Cyp4f15
gggcctgtgaaggat

SEQ ID NO: 40278 - DNA, 15 bp, Artificial Sequence
  dgRNA
  Cyp4f15
ccctctcacatcatg

SEQ ID NO: 40279 - DNA, 15 bp, Artificial Sequence
  dgRNA
  Olfr1045
aaccaacctcacctg

SEQ ID NO: 40280 - DNA, 15 bp, Artificial Sequence
  dgRNA
  Olfr1045
gcaccttgtatcaaa

SEQ ID NO: 40281 - DNA, 15 bp, Artificial Sequence
  dgRNA
  Olfr1045
ctgaagtaacgtgag

SEQ ID NO: 40282 - DNA, 15 bp, Artificial Sequence
  dgRNA
  Olfr1045
cctgaagtaacgtga

SEQ ID NO: 40283 - DNA, 15 bp, Artificial Sequence
  dgRNA
  Galnt3
gctcaccaacctaac

SEQ ID NO: 40284 - DNA, 15 bp, Artificial Sequence
  dgRNA
  Galnt3
gcagcacggtctccc

SEQ ID NO: 40285 - DNA, 15 bp, Artificial Sequence
  dgRNA
  Galnt3
cagcacggtctccca

SEQ ID NO: 40286 - DNA, 15 bp, Artificial Sequence
  dgRNA
  Galnt3
agcacggtctcccag

SEQ ID NO: 40287 - DNA, 15 bp, Artificial Sequence
  dgRNA
  Rassf6
ataattaactgccgc

SEQ ID NO: 40288 - DNA, 15 bp, Artificial Sequence
  dgRNA
  Rassf6
taattaactgccgct

SEQ ID NO: 40289 - DNA, 15 bp, Artificial Sequence
  dgRNA
  Rassf6
aattaactgccgctg

SEQ ID NO: 40290 - DNA, 15 bp, Artificial Sequence
  dgRNA
  Rassf6
ctgcgaaactctgcc

SEQ ID NO: 40291 - DNA, 15 bp, Artificial Sequence
  dgRNA
  Olfr582
gtaacttcaccacac

SEQ ID NO: 40292 - DNA, 15 bp, Artificial Sequence
  dgRNA
  Mylk2
cccatgtcaggccgt

SEQ ID NO: 40293 - DNA, 15 bp, Artificial Sequence
  dgRNA
  Mylk2
ccgtgtcctctgaac

SEQ ID NO: 40294 - DNA, 15 bp, Artificial Sequence
  dgRNA
  Mylk2
cgtgtcctctgaacg

SEQ ID NO: 40295 - DNA, 15 bp, Artificial Sequence
  dgRNA
  Mylk2
gtgtcctctgaacgg

SEQ ID NO: 40296 - DNA, 15 bp, Artificial Sequence
  dgRNA
  Olfr135
ttcttaaccagaact

SEQ ID NO: 40297 - DNA, 15 bp, Artificial Sequence
  dgRNA
  Olfr135
gtagaatgccaaccc

SEQ ID NO: 40298 - DNA, 15 bp, Artificial Sequence
  dgRNA
  Olfr135
attactatagaatcc

SEQ ID NO: 40299 - DNA, 15 bp, Artificial Sequence
  dgRNA
  Pcbp2
acgcagtcgactcgc

SEQ ID NO: 40300 - DNA, 15 bp, Artificial Sequence
  dgRNA
  Pcbp2
cgactcgccggcccc

SEQ ID NO: 40301 - DNA, 15 bp, Artificial Sequence
  dgRNA
  Pcbp2
gactcgccggccccc

SEQ ID NO: 40302 - DNA, 15 bp, Artificial Sequence
  dgRNA
  Pcbp2
actcgccggcccccg

SEQ ID NO: 40303 - DNA, 15 bp, Artificial Sequence
  dgRNA
  Hist4h4
gagagggaaccgaaa

SEQ ID NO: 40304 - DNA, 15 bp, Artificial Sequence
  dgRNA
  Hist4h4
accgaaagggtttta

SEQ ID NO: 40305 - DNA, 15 bp, Artificial Sequence
  dgRNA
  Hist4h4
atcaggtccgctccc

SEQ ID NO: 40306 - DNA, 15 bp, Artificial Sequence
  dgRNA
  Hist4h4
taagctcttgctcgg

SEQ ID NO: 40307 - DNA, 15 bp, Artificial Sequence
  dgRNA
  Sdk2
ggctccggggagatt

SEQ ID NO: 40308 - DNA, 15 bp, Artificial Sequence
  dgRNA
  Sdk2
cttacatcaagtccc

SEQ ID NO: 40309 - DNA, 15 bp, Artificial Sequence
  dgRNA
  Sdk2
ttacatcaagtccca

SEQ ID NO: 40310 - DNA, 15 bp, Artificial Sequence
  dgRNA
  Sdk2
caggggcccggcgcc

SEQ ID NO: 40311 - DNA, 15 bp, Artificial Sequence
  dgRNA
  Olfr1086
tgcgtacatatcaca

SEQ ID NO: 40312 - DNA, 15 bp, Artificial Sequence
  dgRNA
  Apitd1
tgtgggtggtgcgtc

SEQ ID NO: 40313 - DNA, 15 bp, Artificial Sequence
  dgRNA
  Apitd1
ggtggtgcgtctggc

SEQ ID NO: 40314 - DNA, 15 bp, Artificial Sequence
  dgRNA
  Apitd1
ccgcgagctgtcgcc

SEQ ID NO: 40315 - DNA, 15 bp, Artificial Sequence
  dgRNA
  Apitd1
cgcgagctgtcgcca

SEQ ID NO: 40316 - DNA, 15 bp, Artificial Sequence
  dgRNA
  Ube2i
cctcccccacggcgc

SEQ ID NO: 40317 - DNA, 15 bp, Artificial Sequence
  dgRNA
  Ube2i
agggggctaactcgt

SEQ ID NO: 40318 - DNA, 15 bp, Artificial Sequence
  dgRNA
  Ube2i
gctaactcgtaggtt

SEQ ID NO: 40319 - DNA, 15 bp, Artificial Sequence
  dgRNA
  Ube2i
ctaactcgtaggtta

SEQ ID NO: 40320 - DNA, 15 bp, Artificial Sequence
  dgRNA
  Camp
gtgaacactaaatct

SEQ ID NO: 40321 - DNA, 15 bp, Artificial Sequence
  dgRNA
  Camp
ctaggctcactccta

SEQ ID NO: 40322 - DNA, 15 bp, Artificial Sequence
  dgRNA
  Camp
cccgttgagcaatac

SEQ ID NO: 40323 - DNA, 15 bp, Artificial Sequence
  dgRNA
  Camp
atatgatagtccctc

SEQ ID NO: 40324 - DNA, 15 bp, Artificial Sequence
  dgRNA
  4921511H03Rik
ggacaagatccattg

SEQ ID NO: 40325 - DNA, 15 bp, Artificial Sequence
  dgRNA
  4921511H03Rik
cccctttcatgacta

SEQ ID NO: 40326 - DNA, 15 bp, Artificial Sequence
  dgRNA
  4921511H03Rik
aatggatcttgtcct

SEQ ID NO: 40327 - DNA, 15 bp, Artificial Sequence
  dgRNA
  4921511H03Rik
gggatagaatattcc

SEQ ID NO: 40328 - DNA, 15 bp, Artificial Sequence
  dgRNA
  Slc6a20a
ctgaagtccacacgc

SEQ ID NO: 40329 - DNA, 15 bp, Artificial Sequence
  dgRNA
  Slc6a20a
tgaagtccacacgca

SEQ ID NO: 40330 - DNA, 15 bp, Artificial Sequence
  dgRNA
  Slc6a20a
cacgcagggccaagg

SEQ ID NO: 40331 - DNA, 15 bp, Artificial Sequence
  dgRNA
  Slc6a20a
acgcagggccaagga

SEQ ID NO: 40332 - DNA, 15 bp, Artificial Sequence
  dgRNA
  Efcab10
attaaaacctcattc

SEQ ID NO: 40333 - DNA, 15 bp, Artificial Sequence
  dgRNA
  Efcab10
tatggatattgagct

SEQ ID NO: 40334 - DNA, 15 bp, Artificial Sequence
  dgRNA
  Glipr1l1
agggttctgacaatg

SEQ ID NO: 40335 - DNA, 15 bp, Artificial Sequence
  dgRNA
  Glipr1l1
gagagtgcttggact

SEQ ID NO: 40336 - DNA, 15 bp, Artificial Sequence
  dgRNA
  Glipr1l1
gcctgaggcgccctc

SEQ ID NO: 40337 - DNA, 15 bp, Artificial Sequence
  dgRNA
  Nrxn1
acccccgcccaatca

SEQ ID NO: 40338 - DNA, 15 bp, Artificial Sequence
  dgRNA
  Nrxn1
atcacggctaaatcc

SEQ ID NO: 40339 - DNA, 15 bp, Artificial Sequence
  dgRNA
  Nrxn1
taaatcccggagaag

SEQ ID NO: 40340 - DNA, 15 bp, Artificial Sequence
  dgRNA
  Nrxn1
tccacaagattttcg

SEQ ID NO: 40341 - DNA, 15 bp, Artificial Sequence
  dgRNA
  Cbwd1
agcgtgcttcacacc

SEQ ID NO: 40342 - DNA, 15 bp, Artificial Sequence
  dgRNA
  Cbwd1
gcgtgcttcacaccc

SEQ ID NO: 40343 - DNA, 15 bp, Artificial Sequence
  dgRNA
  Cbwd1
cgtgcttcacacccg

SEQ ID NO: 40344 - DNA, 15 bp, Artificial Sequence
  dgRNA
  Cbwd1
gtgcttcacacccgg

SEQ ID NO: 40345 - DNA, 15 bp, Artificial Sequence
  dgRNA
  Sned1
gagcctcgacacaga

SEQ ID NO: 40346 - DNA, 15 bp, Artificial Sequence
  dgRNA
  Sned1
agcctcgacacagaa

SEQ ID NO: 40347 - DNA, 15 bp, Artificial Sequence
  dgRNA
  Sned1
cgacacagaagggcc

SEQ ID NO: 40348 - DNA, 15 bp, Artificial Sequence
  dgRNA
  Sned1
caccctcccactccg

SEQ ID NO: 40349 - DNA, 15 bp, Artificial Sequence
  dgRNA
  Cxcl14
ggtgtgcaagcgtaa

SEQ ID NO: 40350 - DNA, 15 bp, Artificial Sequence
  dgRNA
  Cxcl14
gtgcaagcgtaaagg

SEQ ID NO: 40351 - DNA, 15 bp, Artificial Sequence
  dgRNA
  Cxcl14
tgcaagcgtaaaggc

SEQ ID NO: 40352 - DNA, 15 bp, Artificial Sequence
  dgRNA
  Cxcl14
aaggcgggcgtgctg

SEQ ID NO: 40353 - DNA, 15 bp, Artificial Sequence
  dgRNA
  Nans
ccaaattgtgtctag

SEQ ID NO: 40354 - DNA, 15 bp, Artificial Sequence
  dgRNA
  Nans
tgtgtctagaggcgt

SEQ ID NO: 40355 - DNA, 15 bp, Artificial Sequence
  dgRNA
  Nans
aggcgtaggcagcgc

SEQ ID NO: 40356 - DNA, 15 bp, Artificial Sequence
  dgRNA
  Nans
cgtaggcagcgctgg

SEQ ID NO: 40357 - DNA, 15 bp, Artificial Sequence
  dgRNA
  H2-Q4
ctcctaacttgggtc

SEQ ID NO: 40358 - DNA, 15 bp, Artificial Sequence
  dgRNA
  H2-Q4
gttctcacccccatt

SEQ ID NO: 40359 - DNA, 15 bp, Artificial Sequence
  dgRNA
  H2-Q4
gggtgacgtgatcac

SEQ ID NO: 40360 - DNA, 15 bp, Artificial Sequence
  dgRNA
  H2-Q4
caatcatcgtcgccg

SEQ ID NO: 40361 - DNA, 15 bp, Artificial Sequence
  dgRNA
  Sox10
agcagtgcgggtcac

SEQ ID NO: 40362 - DNA, 15 bp, Artificial Sequence
  dgRNA
  Sox10
gcagtgcgggtcaca

SEQ ID NO: 40363 - DNA, 15 bp, Artificial Sequence
  dgRNA
  Sox10
tgcgggtcacagggc

SEQ ID NO: 40364 - DNA, 15 bp, Artificial Sequence
  dgRNA
  Sox10
gcgggtcacagggct

SEQ ID NO: 40365 - DNA, 15 bp, Artificial Sequence
  dgRNA
  Lrig3
ctttctcccgggcgc

SEQ ID NO: 40366 - DNA, 15 bp, Artificial Sequence
  dgRNA
  Lrig3
tcccgggcgccggct

SEQ ID NO: 40367 - DNA, 15 bp, Artificial Sequence
  dgRNA
  Lrig3
cccgggcgccggctc

SEQ ID NO: 40368 - DNA, 15 bp, Artificial Sequence
  dgRNA
  Lrig3
cttgttattgtcacg

SEQ ID NO: 40369 - DNA, 15 bp, Artificial Sequence
  dgRNA
  Ucn2
agtacgaggtgagct

SEQ ID NO: 40370 - DNA, 15 bp, Artificial Sequence
  dgRNA
  Olfr305
atgtagacgtaattt

SEQ ID NO: 40371 - DNA, 15 bp, Artificial Sequence
  dgRNA
  Adgrb2
tctgcacccgccgct

SEQ ID NO: 40372 - DNA, 15 bp, Artificial Sequence
  dgRNA
  Adgrb2
gcacccgccgctcgg

SEQ ID NO: 40373 - DNA, 15 bp, Artificial Sequence
  dgRNA
  Adgrb2
cgccgctcggcggag

SEQ ID NO: 40374 - DNA, 15 bp, Artificial Sequence
  dgRNA
  Adgrb2
gccgctcggcggagc

SEQ ID NO: 40375 - DNA, 15 bp, Artificial Sequence
  dgRNA
  Ampd3
gtggactgtaatctc

SEQ ID NO: 40376 - DNA, 15 bp, Artificial Sequence
  dgRNA
  Ampd3
acgtgacccactgct

SEQ ID NO: 40377 - DNA, 15 bp, Artificial Sequence
  dgRNA
  Ampd3
cacgtgacccactgc

SEQ ID NO: 40378 - DNA, 15 bp, Artificial Sequence
  dgRNA
  Olfr543
gttgagttaaacaag

SEQ ID NO: 40379 - DNA, 15 bp, Artificial Sequence
  dgRNA
  Olfr543
atgggaatctacctg

SEQ ID NO: 40380 - DNA, 15 bp, Artificial Sequence
  dgRNA
  Olfr543
gatgggaatctacct

SEQ ID NO: 40381 - DNA, 15 bp, Artificial Sequence
  dgRNA
  Olfr543
tgatgggaatctacc

SEQ ID NO: 40382 - DNA, 15 bp, Artificial Sequence
  dgRNA
  Fscn2
tcgcttttgtcctgc

SEQ ID NO: 40383 - DNA, 15 bp, Artificial Sequence
  dgRNA
  Fscn2
cattgactctggact

SEQ ID NO: 40384 - DNA, 15 bp, Artificial Sequence
  dgRNA
  Fscn2
ggacttggtgcatcc

SEQ ID NO: 40385 - DNA, 15 bp, Artificial Sequence
  dgRNA
  Fscn2
tccaagctggggcta

SEQ ID NO: 40386 - DNA, 15 bp, Artificial Sequence
  dgRNA
  Aktip
atgcacatcaatccc

SEQ ID NO: 40387 - DNA, 15 bp, Artificial Sequence
  dgRNA
  Aktip
tgcacatcaatcccc

SEQ ID NO: 40388 - DNA, 15 bp, Artificial Sequence
  dgRNA
  Aktip
ggattgatgtgcatt

SEQ ID NO: 40389 - DNA, 15 bp, Artificial Sequence
  dgRNA
  Ppp1r9a
gggggccccgcacgt

SEQ ID NO: 40390 - DNA, 15 bp, Artificial Sequence
  dgRNA
  Ppp1r9a
cgcacgtgggccgag

SEQ ID NO: 40391 - DNA, 15 bp, Artificial Sequence
  dgRNA
  Ppp1r9a
ggcgtccccgatccc

SEQ ID NO: 40392 - DNA, 15 bp, Artificial Sequence
  dgRNA
  Ppp1r9a
ccgatcccaggccgc

SEQ ID NO: 40393 - DNA, 15 bp, Artificial Sequence
  dgRNA
  Fam199x
caagcatcccagaat

SEQ ID NO: 40394 - DNA, 15 bp, Artificial Sequence
  dgRNA
  Fam199x
gaccgcgtagagcac

SEQ ID NO: 40395 - DNA, 15 bp, Artificial Sequence
  dgRNA
  Fam199x
accgcgtagagcacc

SEQ ID NO: 40396 - DNA, 15 bp, Artificial Sequence
  dgRNA
  Fam199x
cgtagagcaccgggc

SEQ ID NO: 40397 - DNA, 15 bp, Artificial Sequence
  dgRNA
  Ncf4
cttgatggactaccc

SEQ ID NO: 40398 - DNA, 15 bp, Artificial Sequence
  dgRNA
  Ncf4
ttgatggactaccca

SEQ ID NO: 40399 - DNA, 15 bp, Artificial Sequence
  dgRNA
  Ncf4
gctaaaactgctcta

SEQ ID NO: 40400 - DNA, 15 bp, Artificial Sequence
  dgRNA
  Ncf4
aaaactgctctatgg

SEQ ID NO: 40401 - DNA, 15 bp, Artificial Sequence
  dgRNA
  Olfr1495
ctgcccaattaatga

SEQ ID NO: 40402 - DNA, 15 bp, Artificial Sequence
  dgRNA
  Olfr1495
atacaacctatcatg

SEQ ID NO: 40403 - DNA, 15 bp, Artificial Sequence
  dgRNA
  Olfr1495
tcattaattgggcag

SEQ ID NO: 40404 - DNA, 15 bp, Artificial Sequence
  dgRNA
  Olfr1495
acgccttcattaatt

SEQ ID NO: 40405 - DNA, 15 bp, Artificial Sequence
  dgRNA
  Nfe2l3
ccaggtcactaccac

SEQ ID NO: 40406 - DNA, 15 bp, Artificial Sequence
  dgRNA
  Nfe2l3
caggtcactaccaca

SEQ ID NO: 40407 - DNA, 15 bp, Artificial Sequence
  dgRNA
  Nfe2l3
actcctcctataaag

SEQ ID NO: 40408 - DNA, 15 bp, Artificial Sequence
  dgRNA
  Nfe2l3
tcctataaagaggcc

SEQ ID NO: 40409 - DNA, 15 bp, Artificial Sequence
  dgRNA
  Myd88
atccaccttgatcgg

SEQ ID NO: 40410 - DNA, 15 bp, Artificial Sequence
  dgRNA
  Myd88
tccaccttgatcggt

SEQ ID NO: 40411 - DNA, 15 bp, Artificial Sequence
  dgRNA
  Myd88
ttgatcggtgggcca

SEQ ID NO: 40412 - DNA, 15 bp, Artificial Sequence
  dgRNA
  Myd88
attctcacaccttcg

SEQ ID NO: 40413 - DNA, 15 bp, Artificial Sequence
  dgRNA
  Mtor
ccgccctcgagaagc

SEQ ID NO: 40414 - DNA, 15 bp, Artificial Sequence
  dgRNA
  Mtor
ccccatcttcgagct

SEQ ID NO: 40415 - DNA, 15 bp, Artificial Sequence
  dgRNA
  Mtor
gctcggcccgctgat

SEQ ID NO: 40416 - DNA, 15 bp, Artificial Sequence
  dgRNA
  Mtor
gcctagaagacagcg

SEQ ID NO: 40417 - DNA, 15 bp, Artificial Sequence
  dgRNA
  Murc
gtatgagtaacatag

SEQ ID NO: 40418 - DNA, 15 bp, Artificial Sequence
  dgRNA
  Murc
aggtccttagtcagt

SEQ ID NO: 40419 - DNA, 15 bp, Artificial Sequence
  dgRNA
  Murc
gtcggcaagcatgtt

SEQ ID NO: 40420 - DNA, 15 bp, Artificial Sequence
  dgRNA
  Murc
gtttggaaccggccc

SEQ ID NO: 40421 - DNA, 15 bp, Artificial Sequence
  dgRNA
  Yap1
ggtgcgcacgcagcg

SEQ ID NO: 40422 - DNA, 15 bp, Artificial Sequence
  dgRNA
  Yap1
cagcgcggtcgcccc

SEQ ID NO: 40423 - DNA, 15 bp, Artificial Sequence
  dgRNA
  Yap1
agcgcggtcgccccc

SEQ ID NO: 40424 - DNA, 15 bp, Artificial Sequence
  dgRNA
  Yap1
cccccgggtcacgtg

SEQ ID NO: 40425 - DNA, 15 bp, Artificial Sequence
  dgRNA
  Plekha8
gactagcctcatccg

SEQ ID NO: 40426 - DNA, 15 bp, Artificial Sequence
  dgRNA
  Plekha8
ctcatccgaggattc

SEQ ID NO: 40427 - DNA, 15 bp, Artificial Sequence
  dgRNA
  Plekha8
tcatccgaggattcc

SEQ ID NO: 40428 - DNA, 15 bp, Artificial Sequence
  dgRNA
  Plekha8
gagcctagaccccca

SEQ ID NO: 40429 - DNA, 15 bp, Artificial Sequence
  dgRNA
  Abr
gagcacgtttgtagc

SEQ ID NO: 40430 - DNA, 15 bp, Artificial Sequence
  dgRNA
  Abr
ggaccaaaagcttgc

SEQ ID NO: 40431 - DNA, 15 bp, Artificial Sequence
  dgRNA
  Esp23
ccaacaaacatgtgt

SEQ ID NO: 40432 - DNA, 15 bp, Artificial Sequence
  dgRNA
  Esp23
gtgggtaaattacac

SEQ ID NO: 40433 - DNA, 15 bp, Artificial Sequence
  dgRNA
  Esp23
tgggtaaattacact

SEQ ID NO: 40434 - DNA, 15 bp, Artificial Sequence
  dgRNA
  Esp23
caacagtctactatt

SEQ ID NO: 40435 - DNA, 15 bp, Artificial Sequence
  dgRNA
  Zyx
gcccggggcaggacc

SEQ ID NO: 40436 - DNA, 15 bp, Artificial Sequence
  dgRNA
  Zyx
cgggtcctccctccc

SEQ ID NO: 40437 - DNA, 15 bp, Artificial Sequence
  dgRNA
  Zyx
gggccgctccttgta

SEQ ID NO: 40438 - DNA, 15 bp, Artificial Sequence
  dgRNA
  Zyx
gctccttgtatggtc

SEQ ID NO: 40439 - DNA, 15 bp, Artificial Sequence
  dgRNA
  Socs4
tgcaagcacgggcag

SEQ ID NO: 40440 - DNA, 15 bp, Artificial Sequence
  dgRNA
  Socs4
caagcacgggcagcg

SEQ ID NO: 40441 - DNA, 15 bp, Artificial Sequence
  dgRNA
  Socs4
aagcacgggcagcgg

SEQ ID NO: 40442 - DNA, 15 bp, Artificial Sequence
  dgRNA
  Socs4
ccgcttcccgcgctc

SEQ ID NO: 40443 - DNA, 15 bp, Artificial Sequence
  dgRNA
  Mdm1
tgaacaaagctcccg

SEQ ID NO: 40444 - DNA, 15 bp, Artificial Sequence
  dgRNA
  Mdm1
gaacaaagctcccgc

SEQ ID NO: 40445 - DNA, 15 bp, Artificial Sequence
  dgRNA
  Mdm1
ctccggtatcctcat

SEQ ID NO: 40446 - DNA, 15 bp, Artificial Sequence
  dgRNA
  Mdm1
tcttcgcccgccatt

SEQ ID NO: 40447 - DNA, 15 bp, Artificial Sequence
  dgRNA
  Gclc
ccccgcggacaccct

SEQ ID NO: 40448 - DNA, 15 bp, Artificial Sequence
  dgRNA
  Gclc
gcagcctataaaatc

SEQ ID NO: 40449 - DNA, 15 bp, Artificial Sequence
  dgRNA
  Gclc
ataaaatctggagcg

SEQ ID NO: 40450 - DNA, 15 bp, Artificial Sequence
  dgRNA
  Gclc
ctggagcgcggcgca

SEQ ID NO: 40451 - DNA, 15 bp, Artificial Sequence
  dgRNA
  Gdf10
cgggagcgcacaccc

SEQ ID NO: 40452 - DNA, 15 bp, Artificial Sequence
  dgRNA
  Gdf10
cgcacgcccgcacac

SEQ ID NO: 40453 - DNA, 15 bp, Artificial Sequence
  dgRNA
  Gdf10
gcacgcccgcacacc

SEQ ID NO: 40454 - DNA, 15 bp, Artificial Sequence
  dgRNA
  Gdf10
gcacgcacagcacac

SEQ ID NO: 40455 - DNA, 15 bp, Artificial Sequence
  dgRNA
  Ctsk
tatcatatgccagtg

SEQ ID NO: 40456 - DNA, 15 bp, Artificial Sequence
  dgRNA
  Ctsk
aatctggataaggga

SEQ ID NO: 40457 - DNA, 15 bp, Artificial Sequence
  dgRNA
  Ctsk
attcggtaaggattg

SEQ ID NO: 40458 - DNA, 15 bp, Artificial Sequence
  dgRNA
  Cyp2j13
gggctgtctaattag

SEQ ID NO: 40459 - DNA, 15 bp, Artificial Sequence
  dgRNA
  Cyp2j13
tgtctaattagaggt

SEQ ID NO: 40460 - DNA, 15 bp, Artificial Sequence
  dgRNA
  Cyp2j13
gtctaattagaggta

SEQ ID NO: 40461 - DNA, 15 bp, Artificial Sequence
  dgRNA
  Cyp2j13
gggtcctgtgctaac

SEQ ID NO: 40462 - DNA, 15 bp, Artificial Sequence
  dgRNA
  Mvk
gcactcgcaccaggg

SEQ ID NO: 40463 - DNA, 15 bp, Artificial Sequence
  dgRNA
  Mvk
cactcgcaccagggc

SEQ ID NO: 40464 - DNA, 15 bp, Artificial Sequence
  dgRNA
  Mvk
actcgcaccagggcg

SEQ ID NO: 40465 - DNA, 15 bp, Artificial Sequence
  dgRNA
  Mvk
gctcttgattcccat

SEQ ID NO: 40466 - DNA, 15 bp, Artificial Sequence
  dgRNA
  Gsdmd
gcgctgcgaacttgg

SEQ ID NO: 40467 - DNA, 15 bp, Artificial Sequence
  dgRNA
  Gsdmd
agaaagcgaagctcc

SEQ ID NO: 40468 - DNA, 15 bp, Artificial Sequence
  dgRNA
  Gsdmd
aagctcccggatcgc

SEQ ID NO: 40469 - DNA, 15 bp, Artificial Sequence
  dgRNA
  Gsdmd
agctcccggatcgca

SEQ ID NO: 40470 - DNA, 15 bp, Artificial Sequence
  dgRNA
  Xrcc6
cccagagactccgca

SEQ ID NO: 40471 - DNA, 15 bp, Artificial Sequence
  dgRNA
  Xrcc6
gactccgcacggaac

SEQ ID NO: 40472 - DNA, 15 bp, Artificial Sequence
  dgRNA
  Xrcc6
actccgcacggaaca

SEQ ID NO: 40473 - DNA, 15 bp, Artificial Sequence
  dgRNA
  Xrcc6
ctccgcacggaacag

SEQ ID NO: 40474 - DNA, 15 bp, Artificial Sequence
  dgRNA
  Imp3
gaaaagtgtattcgc

SEQ ID NO: 40475 - DNA, 15 bp, Artificial Sequence
  dgRNA
  Imp3
tgtattcgcaggaca

SEQ ID NO: 40476 - DNA, 15 bp, Artificial Sequence
  dgRNA
  Imp3
ggacgaatgaaaaac

SEQ ID NO: 40477 - DNA, 15 bp, Artificial Sequence
  dgRNA
  Imp3
gacgaatgaaaaacc

SEQ ID NO: 40478 - DNA, 15 bp, Artificial Sequence
  dgRNA
  Henmt1
ttggaggcggcagcc

SEQ ID NO: 40479 - DNA, 15 bp, Artificial Sequence
  dgRNA
  Henmt1
gaggcggcagccggg

SEQ ID NO: 40480 - DNA, 15 bp, Artificial Sequence
  dgRNA
  Henmt1
cagccgggaggcatg

SEQ ID NO: 40481 - DNA, 15 bp, Artificial Sequence
  dgRNA
  Henmt1
gggccggagcatggc

SEQ ID NO: 40482 - DNA, 15 bp, Artificial Sequence
  dgRNA
  Pcyt1a
gagaccggcggcagg

SEQ ID NO: 40483 - DNA, 15 bp, Artificial Sequence
  dgRNA
  Pcyt1a
gaggcgccacacatc

SEQ ID NO: 40484 - DNA, 15 bp, Artificial Sequence
  dgRNA
  Pcyt1a
ctgccgccggtctcc

SEQ ID NO: 40485 - DNA, 15 bp, Artificial Sequence
  dgRNA
  Pcyt1a
ggcgcctcctgccgc

SEQ ID NO: 40486 - DNA, 15 bp, Artificial Sequence
  dgRNA
  Ctsll3
cacccagtcaaatgc

SEQ ID NO: 40487 - DNA, 15 bp, Artificial Sequence
  dgRNA
  Ctsll3
acccagtcaaatgca

SEQ ID NO: 40488 - DNA, 15 bp, Artificial Sequence
  dgRNA
  Ctsll3
gcaggcacactatcc

SEQ ID NO: 40489 - DNA, 15 bp, Artificial Sequence
  dgRNA
  Ctsll3
ttggactgcacctgc

SEQ ID NO: 40490 - DNA, 15 bp, Artificial Sequence
  dgRNA
  Olfr968
gggagttctatagaa

SEQ ID NO: 40491 - DNA, 15 bp, Artificial Sequence
  dgRNA
  Ccdc130
ctccgggtgtgcttc

SEQ ID NO: 40492 - DNA, 15 bp, Artificial Sequence
  dgRNA
  Ccdc130
tccgggtgtgcttcc

SEQ ID NO: 40493 - DNA, 15 bp, Artificial Sequence
  dgRNA
  Ccdc130
gtgcttccgggctgg

SEQ ID NO: 40494 - DNA, 15 bp, Artificial Sequence
  dgRNA
  Ccdc130
tggaggcgtgacgtc

SEQ ID NO: 40495 - DNA, 15 bp, Artificial Sequence
  dgRNA
  Fam109a
ttgagccgtctcgcc

SEQ ID NO: 40496 - DNA, 15 bp, Artificial Sequence
  dgRNA
  Fam109a
tcgccaggttgctcc

SEQ ID NO: 40497 - DNA, 15 bp, Artificial Sequence
  dgRNA
  Fam109a
tccgggaccgaattc

SEQ ID NO: 40498 - DNA, 15 bp, Artificial Sequence
  dgRNA
  Fam109a
ccgggaccgaattct

SEQ ID NO: 40499 - DNA, 15 bp, Artificial Sequence
  dgRNA
  Syt16
gagggatgatgctac

SEQ ID NO: 40500 - DNA, 15 bp, Artificial Sequence
  dgRNA
  Syt16
gatgatgctacgggc

SEQ ID NO: 40501 - DNA, 15 bp, Artificial Sequence
  dgRNA
  Syt16
atgatgctacgggct

SEQ ID NO: 40502 - DNA, 15 bp, Artificial Sequence
  dgRNA
  Syt16
gctacgggctgggca

SEQ ID NO: 40503 - DNA, 15 bp, Artificial Sequence
  dgRNA
  Mtl5
tgctcggcgacttcc

SEQ ID NO: 40504 - DNA, 15 bp, Artificial Sequence
  dgRNA
  Mtl5
gctcggcgacttccc

SEQ ID NO: 40505 - DNA, 15 bp, Artificial Sequence
  dgRNA
  Mtl5
ctcggcgacttcccg

SEQ ID NO: 40506 - DNA, 15 bp, Artificial Sequence
  dgRNA
  Mtl5
atcgtcgttacttcc

SEQ ID NO: 40507 - DNA, 15 bp, Artificial Sequence
  dgRNA
  Kmt2e
gaaagacggagtgtc

SEQ ID NO: 40508 - DNA, 15 bp, Artificial Sequence
  dgRNA
  Kmt2e
tgtctggccagctcg

SEQ ID NO: 40509 - DNA, 15 bp, Artificial Sequence
  dgRNA
  Kmt2e
gacgtctccacgcct

SEQ ID NO: 40510 - DNA, 15 bp, Artificial Sequence
  dgRNA
  Kmt2e
gtctccacgcctcgg

SEQ ID NO: 40511 - DNA, 15 bp, Artificial Sequence
  dgRNA
  Ahcyl2
tagtcgcgtgcaacc

SEQ ID NO: 40512 - DNA, 15 bp, Artificial Sequence
  dgRNA
  Ahcyl2
gagcaagcgcactac

SEQ ID NO: 40513 - DNA, 15 bp, Artificial Sequence
  dgRNA
  Ahcyl2
gcactacaggttctg

SEQ ID NO: 40514 - DNA, 15 bp, Artificial Sequence
  dgRNA
  Ahcyl2
gcgcgtgagtcagac

SEQ ID NO: 40515 - DNA, 15 bp, Artificial Sequence
  dgRNA
  1700007B14Rik
tgtacagtttggccc

SEQ ID NO: 40516 - DNA, 15 bp, Artificial Sequence
  dgRNA
  1700007B14Rik
agaatctcccattct

SEQ ID NO: 40517 - DNA, 15 bp, Artificial Sequence
  dgRNA
  1700007B14Rik
gctcctcaacgtcac

SEQ ID NO: 40518 - DNA, 15 bp, Artificial Sequence
  dgRNA
  1700007B14Rik
ctcctcaacgtcaca

SEQ ID NO: 40519 - DNA, 15 bp, Artificial Sequence
  dgRNA
  AU041133
cagcctcagtcgcta

SEQ ID NO: 40520 - DNA, 15 bp, Artificial Sequence
  dgRNA
  AU041133
agcctcagtcgctaa

SEQ ID NO: 40521 - DNA, 15 bp, Artificial Sequence
  dgRNA
  AU041133
cctcaccagctaatc

SEQ ID NO: 40522 - DNA, 15 bp, Artificial Sequence
  dgRNA
  AU041133
ctcaccagctaatca

SEQ ID NO: 40523 - DNA, 15 bp, Artificial Sequence
  dgRNA
  Crocc
gttccctaccattca

SEQ ID NO: 40524 - DNA, 15 bp, Artificial Sequence
  dgRNA
  Crocc
ccctgcgtagtcacg

SEQ ID NO: 40525 - DNA, 15 bp, Artificial Sequence
  dgRNA
  Crocc
cctgcgtagtcacgt

SEQ ID NO: 40526 - DNA, 15 bp, Artificial Sequence
  dgRNA
  Crocc
ctgcgtagtcacgtg

SEQ ID NO: 40527 - DNA, 15 bp, Artificial Sequence
  dgRNA
  Cpeb1
gggacgaggccgggc

SEQ ID NO: 40528 - DNA, 15 bp, Artificial Sequence
  dgRNA
  Cpeb1
ggacgaggccgggcg

SEQ ID NO: 40529 - DNA, 15 bp, Artificial Sequence
  dgRNA
  Cpeb1
gggcggggccgacac

SEQ ID NO: 40530 - DNA, 15 bp, Artificial Sequence
  dgRNA
  Cpeb1
caggtgctcctcgtc

SEQ ID NO: 40531 - DNA, 15 bp, Artificial Sequence
  dgRNA
  Them7
ggctatcagggtaga

SEQ ID NO: 40532 - DNA, 15 bp, Artificial Sequence
  dgRNA
  Them7
ataacctgaagttag

SEQ ID NO: 40533 - DNA, 15 bp, Artificial Sequence
  dgRNA
  Them7
agggcaaggccgccc

SEQ ID NO: 40534 - DNA, 15 bp, Artificial Sequence
  dgRNA
  Them7
tctcaatggtgggct

SEQ ID NO: 40535 - DNA, 15 bp, Artificial Sequence
  dgRNA
  Angpt4
gccttgagcacgcca

SEQ ID NO: 40536 - DNA, 15 bp, Artificial Sequence
  dgRNA
  Angpt4
cacgccagggaagac

SEQ ID NO: 40537 - DNA, 15 bp, Artificial Sequence
  dgRNA
  Angpt4
ggcgaggcctcagag

SEQ ID NO: 40538 - DNA, 15 bp, Artificial Sequence
  dgRNA
  Angpt4
gtataaatagcccag

SEQ ID NO: 40539 - DNA, 15 bp, Artificial Sequence
  dgRNA
  Zswim2
atccagttacagtgt

SEQ ID NO: 40540 - DNA, 15 bp, Artificial Sequence
  dgRNA
  Zswim2
gatccagttacagtg

SEQ ID NO: 40541 - DNA, 15 bp, Artificial Sequence
  dgRNA
  Zswim2
taccctgcagtagtt

SEQ ID NO: 40542 - DNA, 15 bp, Artificial Sequence
  dgRNA
  Zswim2
ctaccctgcagtagt

SEQ ID NO: 40543 - DNA, 15 bp, Artificial Sequence
  dgRNA
  Col14a1
gctgccacgcgcacc

SEQ ID NO: 40544 - DNA, 15 bp, Artificial Sequence
  dgRNA
  Col14a1
ctgccacgcgcacct

SEQ ID NO: 40545 - DNA, 15 bp, Artificial Sequence
  dgRNA
  Col14a1
cacgcgcacctgggt

SEQ ID NO: 40546 - DNA, 15 bp, Artificial Sequence
  dgRNA
  Col14a1
tcggctgccagtcct

SEQ ID NO: 40547 - DNA, 15 bp, Artificial Sequence
  dgRNA
  Olfr259
ttagtatcatagata

SEQ ID NO: 40548 - DNA, 15 bp, Artificial Sequence
  dgRNA
  Olfr259
accactcagtgtatg

SEQ ID NO: 40549 - DNA, 15 bp, Artificial Sequence
  dgRNA
  Olfr259
aagattatcagattc

SEQ ID NO: 40550 - DNA, 15 bp, Artificial Sequence
  dgRNA
  Olfr259
attatcagattctgg

SEQ ID NO: 40551 - DNA, 15 bp, Artificial Sequence
  dgRNA
  Smim3
agaggaccatacagc

SEQ ID NO: 40552 - DNA, 15 bp, Artificial Sequence
  dgRNA
  Smim3
catacagcgggcagc

SEQ ID NO: 40553 - DNA, 15 bp, Artificial Sequence
  dgRNA
  Smim3
atacagcgggcagca

SEQ ID NO: 40554 - DNA, 15 bp, Artificial Sequence
  dgRNA
  Smim3
gtgggtcattaatag

SEQ ID NO: 40555 - DNA, 15 bp, Artificial Sequence
  dgRNA
  Mpped2
cccacgctttgtcag

SEQ ID NO: 40556 - DNA, 15 bp, Artificial Sequence
  dgRNA
  Mpped2
acagctcccgttgcc

SEQ ID NO: 40557 - DNA, 15 bp, Artificial Sequence
  dgRNA
  Mpped2
gttttaaatctaggg

SEQ ID NO: 40558 - DNA, 15 bp, Artificial Sequence
  dgRNA
  Mpped2
atatggtggggcgag

SEQ ID NO: 40559 - DNA, 15 bp, Artificial Sequence
  dgRNA
  Phb2
gagggcgctcgaaaa

SEQ ID NO: 40560 - DNA, 15 bp, Artificial Sequence
  dgRNA
  Phb2
atggcgatgcccgta

SEQ ID NO: 40561 - DNA, 15 bp, Artificial Sequence
  dgRNA
  Phb2
gtacggaagcctctc

SEQ ID NO: 40562 - DNA, 15 bp, Artificial Sequence
  dgRNA
  Phb2
tacggaagcctctcc

SEQ ID NO: 40563 - DNA, 15 bp, Artificial Sequence
  dgRNA
  Fem1b
agccccgctcgccag

SEQ ID NO: 40564 - DNA, 15 bp, Artificial Sequence
  dgRNA
  Fem1b
gaccctttcgatcgc

SEQ ID NO: 40565 - DNA, 15 bp, Artificial Sequence
  dgRNA
  Fem1b
cctttcgatcgccgg

SEQ ID NO: 40566 - DNA, 15 bp, Artificial Sequence
  dgRNA
  Fem1b
ctttcgatcgccggt

SEQ ID NO: 40567 - DNA, 15 bp, Artificial Sequence
  dgRNA
  Fmr1
ggggccgcgcctgag

SEQ ID NO: 40568 - DNA, 15 bp, Artificial Sequence
  dgRNA
  Fmr1
gggccgcgcctgaga

SEQ ID NO: 40569 - DNA, 15 bp, Artificial Sequence
  dgRNA
  Fmr1
ccgcgcctgagaggg

SEQ ID NO: 40570 - DNA, 15 bp, Artificial Sequence
  dgRNA
  Fmr1
cgcgcctgagagggc

SEQ ID NO: 40571 - DNA, 15 bp, Artificial Sequence
  dgRNA
  Itpripl1
atcactgtaatacta

SEQ ID NO: 40572 - DNA, 15 bp, Artificial Sequence
  dgRNA
  Itpripl1
gtaatactaaggagt

SEQ ID NO: 40573 - DNA, 15 bp, Artificial Sequence
  dgRNA
  Itpripl1
agtggtgaggttaag

SEQ ID NO: 40574 - DNA, 15 bp, Artificial Sequence
  dgRNA
  Itpripl1
tggtctaatgacaca

SEQ ID NO: 40575 - DNA, 15 bp, Artificial Sequence
  dgRNA
  Atp8b1
tcgtgtcactgaagc

SEQ ID NO: 40576 - DNA, 15 bp, Artificial Sequence
  dgRNA
  Atp8b1
ccgtacaacaacccc

SEQ ID NO: 40577 - DNA, 15 bp, Artificial Sequence
  dgRNA
  Atp8b1
gcctctctccacccg

SEQ ID NO: 40578 - DNA, 15 bp, Artificial Sequence
  dgRNA
  Atp8b1
cctctctccacccgg

SEQ ID NO: 40579 - DNA, 15 bp, Artificial Sequence
  dgRNA
  Col4a4
gtgggcgcagctcca

SEQ ID NO: 40580 - DNA, 15 bp, Artificial Sequence
  dgRNA
  Col4a4
tgggcgcagctccag

SEQ ID NO: 40581 - DNA, 15 bp, Artificial Sequence
  dgRNA
  Col4a4
gacttcggtgcctag

SEQ ID NO: 40582 - DNA, 15 bp, Artificial Sequence
  dgRNA
  Col4a4
acttcggtgcctagc

SEQ ID NO: 40583 - DNA, 15 bp, Artificial Sequence
  dgRNA
  Adam15
cgggattgggtgagc

SEQ ID NO: 40584 - DNA, 15 bp, Artificial Sequence
  dgRNA
  Adam15
gtgagccggaagaac

SEQ ID NO: 40585 - DNA, 15 bp, Artificial Sequence
  dgRNA
  Adam15
caatctccacgaagc

SEQ ID NO: 40586 - DNA, 15 bp, Artificial Sequence
  dgRNA
  Adam15
aatctccacgaagcc

SEQ ID NO: 40587 - DNA, 15 bp, Artificial Sequence
  dgRNA
  Krtap9-3
ctgtcgcagagtgac

SEQ ID NO: 40588 - DNA, 15 bp, Artificial Sequence
  dgRNA
  Krtap9-3
taaaaggctcttggt

SEQ ID NO: 40589 - DNA, 15 bp, Artificial Sequence
  dgRNA
  Krtap9-3
acatatgctcatctg

SEQ ID NO: 40590 - DNA, 15 bp, Artificial Sequence
  dgRNA
  Krtap9-3
cagtcactctgcgac

SEQ ID NO: 40591 - DNA, 15 bp, Artificial Sequence
  dgRNA
  Enpp7
tcgtgtgcaaagtct

SEQ ID NO: 40592 - DNA, 15 bp, Artificial Sequence
  dgRNA
  Enpp7
gtgcaaagtctaggc

SEQ ID NO: 40593 - DNA, 15 bp, Artificial Sequence
  dgRNA
  Enpp7
tctaacggagatccc

SEQ ID NO: 40594 - DNA, 15 bp, Artificial Sequence
  dgRNA
  Enpp7
tagactttgcacacg

SEQ ID NO: 40595 - DNA, 15 bp, Artificial Sequence
  dgRNA
  Xpnpep2
ctgagttacaattgg

SEQ ID NO: 40596 - DNA, 15 bp, Artificial Sequence
  dgRNA
  Xpnpep2
ttactgtcttacaac

SEQ ID NO: 40597 - DNA, 15 bp, Artificial Sequence
  dgRNA
  Xpnpep2
atgttgattgcaact

SEQ ID NO: 40598 - DNA, 15 bp, Artificial Sequence
  dgRNA
  Xpnpep2
aatgttgattgcaac

SEQ ID NO: 40599 - DNA, 15 bp, Artificial Sequence
  dgRNA
  Add3
attaaccccaatatt

SEQ ID NO: 40600 - DNA, 15 bp, Artificial Sequence
  dgRNA
  Add3
ctactcctaatattg

SEQ ID NO: 40601 - DNA, 15 bp, Artificial Sequence
  dgRNA
  Add3
tctactcctaatatt

SEQ ID NO: 40602 - DNA, 15 bp, Artificial Sequence
  dgRNA
  Add3
ctctactcctaatat

SEQ ID NO: 40603 - DNA, 15 bp, Artificial Sequence
  dgRNA
  Ifna1
ttctctgcttgcgtc

SEQ ID NO: 40604 - DNA, 15 bp, Artificial Sequence
  dgRNA
  Ifna1
aaatagggcaaacac

SEQ ID NO: 40605 - DNA, 15 bp, Artificial Sequence
  dgRNA
  Hsp90b1
gcggagccatctgat

SEQ ID NO: 40606 - DNA, 15 bp, Artificial Sequence
  dgRNA
  Hsp90b1
ttggaggaaagccgc

SEQ ID NO: 40607 - DNA, 15 bp, Artificial Sequence
  dgRNA
  Hsp90b1
acaagcccaatcgca

SEQ ID NO: 40608 - DNA, 15 bp, Artificial Sequence
  dgRNA
  Hsp90b1
caaggagccacgctt

SEQ ID NO: 40609 - DNA, 15 bp, Artificial Sequence
  dgRNA
  Heatr5a
tgtggccggaatctc

SEQ ID NO: 40610 - DNA, 15 bp, Artificial Sequence
  dgRNA
  Heatr5a
ccggaatctccggac

SEQ ID NO: 40611 - DNA, 15 bp, Artificial Sequence
  dgRNA
  Heatr5a
gaatctccggactgg

SEQ ID NO: 40612 - DNA, 15 bp, Artificial Sequence
  dgRNA
  Heatr5a
ctcccatcgctctct

SEQ ID NO: 40613 - DNA, 15 bp, Artificial Sequence
  dgRNA
  Dusp21
ggggattgtgacatc

SEQ ID NO: 40614 - DNA, 15 bp, Artificial Sequence
  dgRNA
  Dusp21
catgggtagtagaag

SEQ ID NO: 40615 - DNA, 15 bp, Artificial Sequence
  dgRNA
  Dusp21
acccatgtgtcacaa

SEQ ID NO: 40616 - DNA, 15 bp, Artificial Sequence
  dgRNA
  Dlg3
catagtcgctgaaga

SEQ ID NO: 40617 - DNA, 15 bp, Artificial Sequence
  dgRNA
  Dlg3
ggccttttagctgac

SEQ ID NO: 40618 - DNA, 15 bp, Artificial Sequence
  dgRNA
  Dlg3
tttagctgacggggt

SEQ ID NO: 40619 - DNA, 15 bp, Artificial Sequence
  dgRNA
  Dlg3
gctgacggggttggc

SEQ ID NO: 40620 - DNA, 15 bp, Artificial Sequence
  dgRNA
  Dio2
agggactggcacgcc

SEQ ID NO: 40621 - DNA, 15 bp, Artificial Sequence
  dgRNA
  Dio2
gggactggcacgcca

SEQ ID NO: 40622 - DNA, 15 bp, Artificial Sequence
  dgRNA
  Dio2
gtacactccaactgc

SEQ ID NO: 40623 - DNA, 15 bp, Artificial Sequence
  dgRNA
  Fxyd4
tagcttgaaggagcc

SEQ ID NO: 40624 - DNA, 15 bp, Artificial Sequence
  dgRNA
  Fxyd4
gcactggctctaccc

SEQ ID NO: 40625 - DNA, 15 bp, Artificial Sequence
  dgRNA
  Fxyd4
cactggctctaccct

SEQ ID NO: 40626 - DNA, 15 bp, Artificial Sequence
  dgRNA
  Fxyd4
gtggtaagtgagcta

SEQ ID NO: 40627 - DNA, 15 bp, Artificial Sequence
  dgRNA
  Vav1
tgtagttgtccccac

SEQ ID NO: 40628 - DNA, 15 bp, Artificial Sequence
  dgRNA
  Vav1
gtagttgtccccact

SEQ ID NO: 40629 - DNA, 15 bp, Artificial Sequence
  dgRNA
  2310057M21Rik
cgcggcacctgcccc

SEQ ID NO: 40630 - DNA, 15 bp, Artificial Sequence
  dgRNA
  2310057M21Rik
gcacgagccaacccc

SEQ ID NO: 40631 - DNA, 15 bp, Artificial Sequence
  dgRNA
  2310057M21Rik
cctggctcttttccg

SEQ ID NO: 40632 - DNA, 15 bp, Artificial Sequence
  dgRNA
  2310057M21Rik
acgcatgcgcacgtg

SEQ ID NO: 40633 - DNA, 15 bp, Artificial Sequence
  dgRNA
  Slc35a2
gcctctggcccttag

SEQ ID NO: 40634 - DNA, 15 bp, Artificial Sequence
  dgRNA
  Slc35a2
ctggcccttagaggg

SEQ ID NO: 40635 - DNA, 15 bp, Artificial Sequence
  dgRNA
  Slc35a2
ttagagggcggcacc

SEQ ID NO: 40636 - DNA, 15 bp, Artificial Sequence
  dgRNA
  Slc35a2
agggcggcacctggc

SEQ ID NO: 40637 - DNA, 15 bp, Artificial Sequence
  dgRNA
  Mapk8ip1
gcttggaatgtccct

SEQ ID NO: 40638 - DNA, 15 bp, Artificial Sequence
  dgRNA
  Mapk8ip1
gtgtagggaggccga

SEQ ID NO: 40639 - DNA, 15 bp, Artificial Sequence
  dgRNA
  Mapk8ip1
tgtagggaggccgag

SEQ ID NO: 40640 - DNA, 15 bp, Artificial Sequence
  dgRNA
  Mapk8ip1
ggccgaggggaccca

SEQ ID NO: 40641 - DNA, 15 bp, Artificial Sequence
  dgRNA
  Mad2l2
cagcccagcgcctac

SEQ ID NO: 40642 - DNA, 15 bp, Artificial Sequence
  dgRNA
  Mad2l2
gacacttagttctct

SEQ ID NO: 40643 - DNA, 15 bp, Artificial Sequence
  dgRNA
  Mad2l2
cttagttctctaggg

SEQ ID NO: 40644 - DNA, 15 bp, Artificial Sequence
  dgRNA
  Mad2l2
acttgagtttcgggt

SEQ ID NO: 40645 - DNA, 15 bp, Artificial Sequence
  dgRNA
  Apba3
ccgttcttgtagtct

SEQ ID NO: 40646 - DNA, 15 bp, Artificial Sequence
  dgRNA
  Apba3
cgttcttgtagtctc

SEQ ID NO: 40647 - DNA, 15 bp, Artificial Sequence
  dgRNA
  Apba3
tctatactgcaacac

SEQ ID NO: 40648 - DNA, 15 bp, Artificial Sequence
  dgRNA
  Apba3
acactggcgagtccc

SEQ ID NO: 40649 - DNA, 15 bp, Artificial Sequence
  dgRNA
  2610020H08Rik
gccatccccggaccc

SEQ ID NO: 40650 - DNA, 15 bp, Artificial Sequence
  dgRNA
  2610020H08Rik
ccatccccggaccct

SEQ ID NO: 40651 - DNA, 15 bp, Artificial Sequence
  dgRNA
  2610020H08Rik
tttcgcagagttcaa

SEQ ID NO: 40652 - DNA, 15 bp, Artificial Sequence
  dgRNA
  2610020H08Rik
gcagagttcaacggc

SEQ ID NO: 40653 - DNA, 15 bp, Artificial Sequence
  dgRNA
  Met
agtttcaccttgccg

SEQ ID NO: 40654 - DNA, 15 bp, Artificial Sequence
  dgRNA
  Met
gtttcaccttgccga

SEQ ID NO: 40655 - DNA, 15 bp, Artificial Sequence
  dgRNA
  Met
tcaccttgccgaggg

SEQ ID NO: 40656 - DNA, 15 bp, Artificial Sequence
  dgRNA
  Met
caccttgccgagggc

SEQ ID NO: 40657 - DNA, 15 bp, Artificial Sequence
  dgRNA
  Slc16a6
gagggcgtcgggcca

SEQ ID NO: 40658 - DNA, 15 bp, Artificial Sequence
  dgRNA
  Slc16a6
ggaccccagaggcgt

SEQ ID NO: 40659 - DNA, 15 bp, Artificial Sequence
  dgRNA
  Slc16a6
ccccagaggcgtcgg

SEQ ID NO: 40660 - DNA, 15 bp, Artificial Sequence
  dgRNA
  Slc16a6
cccagaggcgtcggc

SEQ ID NO: 40661 - DNA, 15 bp, Artificial Sequence
  dgRNA
  Lcorl
cgctcagggttttcg

SEQ ID NO: 40662 - DNA, 15 bp, Artificial Sequence
  dgRNA
  Lcorl
cagggttttcgtgga

SEQ ID NO: 40663 - DNA, 15 bp, Artificial Sequence
  dgRNA
  Lcorl
ggttttcgtggacgg

SEQ ID NO: 40664 - DNA, 15 bp, Artificial Sequence
  dgRNA
  Lcorl
gttttcgtggacggc

SEQ ID NO: 40665 - DNA, 15 bp, Artificial Sequence
  dgRNA
  Doc2a
gtcttcttccgaatg

SEQ ID NO: 40666 - DNA, 15 bp, Artificial Sequence
  dgRNA
  Doc2a
gttccccagagcggc

SEQ ID NO: 40667 - DNA, 15 bp, Artificial Sequence
  dgRNA
  Doc2a
tctctcctctttcgc

SEQ ID NO: 40668 - DNA, 15 bp, Artificial Sequence
  dgRNA
  Doc2a
ctcctctttcgccgg

SEQ ID NO: 40669 - DNA, 15 bp, Artificial Sequence
  dgRNA
  Vegfa
ataattttgaggccg

SEQ ID NO: 40670 - DNA, 15 bp, Artificial Sequence
  dgRNA
  Vegfa
tgaggccgtggaccc

SEQ ID NO: 40671 - DNA, 15 bp, Artificial Sequence
  dgRNA
  Vegfa
ccgtggaccctggta

SEQ ID NO: 40672 - DNA, 15 bp, Artificial Sequence
  dgRNA
  Vegfa
cgtggaccctggtaa

SEQ ID NO: 40673 - DNA, 15 bp, Artificial Sequence
  dgRNA
  Trim27
gccacgaccgactcc

SEQ ID NO: 40674 - DNA, 15 bp, Artificial Sequence
  dgRNA
  Trim27
ccacgaccgactccc

SEQ ID NO: 40675 - DNA, 15 bp, Artificial Sequence
  dgRNA
  Trim27
gaccgactcccgggc

SEQ ID NO: 40676 - DNA, 15 bp, Artificial Sequence
  dgRNA
  Trim27
accgactcccgggct

SEQ ID NO: 40677 - DNA, 15 bp, Artificial Sequence
  dgRNA
  Fam171a1
gagtagaatgactta

SEQ ID NO: 40678 - DNA, 15 bp, Artificial Sequence
  dgRNA
  Fam171a1
cgaacaatgggtgtt

SEQ ID NO: 40679 - DNA, 15 bp, Artificial Sequence
  dgRNA
  Fam171a1
ccgaacaatgggtgt

SEQ ID NO: 40680 - DNA, 15 bp, Artificial Sequence
  dgRNA
  Fam171a1
tgtttgccgaacaat

SEQ ID NO: 40681 - DNA, 15 bp, Artificial Sequence
  dgRNA
  Art3
tcgcaagtgacaaac

SEQ ID NO: 40682 - DNA, 15 bp, Artificial Sequence
  dgRNA
  Art3
cgcaagtgacaaaca

SEQ ID NO: 40683 - DNA, 15 bp, Artificial Sequence
  dgRNA
  Art3
gactagagcccagat

SEQ ID NO: 40684 - DNA, 15 bp, Artificial Sequence
  dgRNA
  Art3
ccagatgggcagatt

SEQ ID NO: 40685 - DNA, 15 bp, Artificial Sequence
  dgRNA
  Mvb12b
ggacatgtgctaaac

SEQ ID NO: 40686 - DNA, 15 bp, Artificial Sequence
  dgRNA
  Mvb12b
gggacatgtgctaaa

SEQ ID NO: 40687 - DNA, 15 bp, Artificial Sequence
  dgRNA
  Zfp953
acaacccagttctgt

SEQ ID NO: 40688 - DNA, 15 bp, Artificial Sequence
  dgRNA
  Zfp953
cttcgcactgatttg

SEQ ID NO: 40689 - DNA, 15 bp, Artificial Sequence
  dgRNA
  Zfp953
ttcgcactgatttgt

SEQ ID NO: 40690 - DNA, 15 bp, Artificial Sequence
  dgRNA
  Zfp953
gggttgttcacctgc

SEQ ID NO: 40691 - DNA, 15 bp, Artificial Sequence
  dgRNA
  Tmem98
cctctgtaatgaccc

SEQ ID NO: 40692 - DNA, 15 bp, Artificial Sequence
  dgRNA
  Tmem98
tgcagattgattgta

SEQ ID NO: 40693 - DNA, 15 bp, Artificial Sequence
  dgRNA
  Klhl17
tctacccccgtgcta

SEQ ID NO: 40694 - DNA, 15 bp, Artificial Sequence
  dgRNA
  Klhl17
ctagcaggtgagaac

SEQ ID NO: 40695 - DNA, 15 bp, Artificial Sequence
  dgRNA
  Klhl17
tgagaaccggggcgc

SEQ ID NO: 40696 - DNA, 15 bp, Artificial Sequence
  dgRNA
  Klhl17
gagaaccggggcgct

SEQ ID NO: 40697 - DNA, 15 bp, Artificial Sequence
  dgRNA
  Muc13
caagtcataaatagt

SEQ ID NO: 40698 - DNA, 15 bp, Artificial Sequence
  dgRNA
  Muc13
tgcagtcaaatggtg

SEQ ID NO: 40699 - DNA, 15 bp, Artificial Sequence
  dgRNA
  Inca1
tcaggcccggccttc

SEQ ID NO: 40700 - DNA, 15 bp, Artificial Sequence
  dgRNA
  Inca1
gccttcaggcgagcc

SEQ ID NO: 40701 - DNA, 15 bp, Artificial Sequence
  dgRNA
  Inca1
ggcgagccaggcaag

SEQ ID NO: 40702 - DNA, 15 bp, Artificial Sequence
  dgRNA
  Inca1
gcgagccaggcaagt

SEQ ID NO: 40703 - DNA, 15 bp, Artificial Sequence
  dgRNA
  4-Sep
tgactcgagttccta

SEQ ID NO: 40704 - DNA, 15 bp, Artificial Sequence
  dgRNA
  4-Sep
cggtgcaacactgcc

SEQ ID NO: 40705 - DNA, 15 bp, Artificial Sequence
  dgRNA
  4-Sep
gcccggtgcagccct

SEQ ID NO: 40706 - DNA, 15 bp, Artificial Sequence
  dgRNA
  4-Sep
aggagaagctcacgc

SEQ ID NO: 40707 - DNA, 15 bp, Artificial Sequence
  dgRNA
  Nek3
aactcaaattactgg

SEQ ID NO: 40708 - DNA, 15 bp, Artificial Sequence
  dgRNA
  Nek3
aattactgggggcac

SEQ ID NO: 40709 - DNA, 15 bp, Artificial Sequence
  dgRNA
  Nek3
caatatcctaccgca

SEQ ID NO: 40710 - DNA, 15 bp, Artificial Sequence
  dgRNA
  Nek3
tatcctaccgcaagg

SEQ ID NO: 40711 - DNA, 15 bp, Artificial Sequence
  dgRNA
  Chn2
catccccttctaatt

SEQ ID NO: 40712 - DNA, 15 bp, Artificial Sequence
  dgRNA
  Chn2
atccccttctaattc

SEQ ID NO: 40713 - DNA, 15 bp, Artificial Sequence
  dgRNA
  Chn2
cccgcctcgcgtccc

SEQ ID NO: 40714 - DNA, 15 bp, Artificial Sequence
  dgRNA
  Chn2
gcctcgcgtccctgg

SEQ ID NO: 40715 - DNA, 15 bp, Artificial Sequence
  dgRNA
  Glod5
tgccccttgatctcc

SEQ ID NO: 40716 - DNA, 15 bp, Artificial Sequence
  dgRNA
  Glod5
cggggtacagcttag

SEQ ID NO: 40717 - DNA, 15 bp, Artificial Sequence
  dgRNA
  Glod5
actaactgaaactcg

SEQ ID NO: 40718 - DNA, 15 bp, Artificial Sequence
  dgRNA
  Glod5
gactaactgaaactc

SEQ ID NO: 40719 - DNA, 15 bp, Artificial Sequence
  dgRNA
  Flrt1
caaagcggagcacac

SEQ ID NO: 40720 - DNA, 15 bp, Artificial Sequence
  dgRNA
  Flrt1
ccactttagggggca

SEQ ID NO: 40721 - DNA, 15 bp, Artificial Sequence
  dgRNA
  Flrt1
gccactttagggggc

SEQ ID NO: 40722 - DNA, 15 bp, Artificial Sequence
  dgRNA
  Flrt1
tgtgtgctccgcttt

SEQ ID NO: 40723 - DNA, 15 bp, Artificial Sequence
  dgRNA
  Ints8
cgcttcattttctct

SEQ ID NO: 40724 - DNA, 15 bp, Artificial Sequence
  dgRNA
  Ints8
gaatctagcttctga

SEQ ID NO: 40725 - DNA, 15 bp, Artificial Sequence
  dgRNA
  Ints8
tccatggcagctaag

SEQ ID NO: 40726 - DNA, 15 bp, Artificial Sequence
  dgRNA
  Ints8
cctccgaagtctaac

SEQ ID NO: 40727 - DNA, 15 bp, Artificial Sequence
  dgRNA
  Map6
gctgagccgcaaaaa

SEQ ID NO: 40728 - DNA, 15 bp, Artificial Sequence
  dgRNA
  Map6
ctgagccgcaaaaaa

SEQ ID NO: 40729 - DNA, 15 bp, Artificial Sequence
  dgRNA
  Map6
gccgcaaaaaagggt

SEQ ID NO: 40730 - DNA, 15 bp, Artificial Sequence
  dgRNA
  Map6
ccgcaaaaaagggtg

SEQ ID NO: 40731 - DNA, 15 bp, Artificial Sequence
  dgRNA
  Cnn1
ggccagagtatgtgt

SEQ ID NO: 40732 - DNA, 15 bp, Artificial Sequence
  dgRNA
  Cnn1
gggtgccacgcctct

SEQ ID NO: 40733 - DNA, 15 bp, Artificial Sequence
  dgRNA
  Cnn1
agcccccgtggccaa

SEQ ID NO: 40734 - DNA, 15 bp, Artificial Sequence
  dgRNA
  Cnn1
gcccccgtggccaat

SEQ ID NO: 40735 - DNA, 15 bp, Artificial Sequence
  dgRNA
  Slc25a4
gaaacgccctgacaa

SEQ ID NO: 40736 - DNA, 15 bp, Artificial Sequence
  dgRNA
  Slc25a4
aaacgccctgacaac

SEQ ID NO: 40737 - DNA, 15 bp, Artificial Sequence
  dgRNA
  Slc25a4
gccctgacaacggga

SEQ ID NO: 40738 - DNA, 15 bp, Artificial Sequence
  dgRNA
  Slc25a4
ccctgacaacgggaa

SEQ ID NO: 40739 - DNA, 15 bp, Artificial Sequence
  dgRNA
  B630005N14Rik
ctccgcacagcatcc

SEQ ID NO: 40740 - DNA, 15 bp, Artificial Sequence
  dgRNA
  B630005N14Rik
tccgcacagcatccg

SEQ ID NO: 40741 - DNA, 15 bp, Artificial Sequence
  dgRNA
  B630005N14Rik
acagcatccggggcg

SEQ ID NO: 40742 - DNA, 15 bp, Artificial Sequence
  dgRNA
  B630005N14Rik
atccggggcgtggcc

SEQ ID NO: 40743 - DNA, 15 bp, Artificial Sequence
  dgRNA
  Helz2
gaccgggaaagggcc

SEQ ID NO: 40744 - DNA, 15 bp, Artificial Sequence
  dgRNA
  Helz2
tgtgttgacctcaag

SEQ ID NO: 40745 - DNA, 15 bp, Artificial Sequence
  dgRNA
  Helz2
ggggaaatcttccta

SEQ ID NO: 40746 - DNA, 15 bp, Artificial Sequence
  dgRNA
  Helz2
ccagggagctccgcc

SEQ ID NO: 40747 - DNA, 15 bp, Artificial Sequence
  dgRNA
  Rai14
gaggggggttaagta

SEQ ID NO: 40748 - DNA, 15 bp, Artificial Sequence
  dgRNA
  Rai14
gggttaagtatggaa

SEQ ID NO: 40749 - DNA, 15 bp, Artificial Sequence
  dgRNA
  Ccdc91
tttttgaggatggtc

SEQ ID NO: 40750 - DNA, 15 bp, Artificial Sequence
  dgRNA
  Ccdc91
aggccagtgtatatc

SEQ ID NO: 40751 - DNA, 15 bp, Artificial Sequence
  dgRNA
  Ccdc91
gtcaatccacttcac

SEQ ID NO: 40752 - DNA, 15 bp, Artificial Sequence
  dgRNA
  Ccdc91
catgtgatgcgcccg

SEQ ID NO: 40753 - DNA, 15 bp, Artificial Sequence
  dgRNA
  Spata25
ccccacctgtctagg

SEQ ID NO: 40754 - DNA, 15 bp, Artificial Sequence
  dgRNA
  Spata25
cccacctgtctaggt

SEQ ID NO: 40755 - DNA, 15 bp, Artificial Sequence
  dgRNA
  Spata25
ataacgacaaaatcc

SEQ ID NO: 40756 - DNA, 15 bp, Artificial Sequence
  dgRNA
  Spata25
ggaacttccagatcc

SEQ ID NO: 40757 - DNA, 15 bp, Artificial Sequence
  dgRNA
  Otog
gaagggtagttacaa

SEQ ID NO: 40758 - DNA, 15 bp, Artificial Sequence
  dgRNA
  Otog
cttatggtaatgagc

SEQ ID NO: 40759 - DNA, 15 bp, Artificial Sequence
  dgRNA
  Otog
ttatggtaatgagct

SEQ ID NO: 40760 - DNA, 15 bp, Artificial Sequence
  dgRNA
  Otog
agggcaagattgccc

SEQ ID NO: 40761 - DNA, 15 bp, Artificial Sequence
  dgRNA
  Racgap1
aatgtgagtcctaca

SEQ ID NO: 40762 - DNA, 15 bp, Artificial Sequence
  dgRNA
  Racgap1
atgtgagtcctacac

SEQ ID NO: 40763 - DNA, 15 bp, Artificial Sequence
  dgRNA
  Racgap1
aaaatggccgccttt

SEQ ID NO: 40764 - DNA, 15 bp, Artificial Sequence
  dgRNA
  Racgap1
aaatggccgcctttc

SEQ ID NO: 40765 - DNA, 15 bp, Artificial Sequence
  dgRNA
  Rnf25
aggtgtttccggttc

SEQ ID NO: 40766 - DNA, 15 bp, Artificial Sequence
  dgRNA
  Rnf25
ccggaaacacctttt

SEQ ID NO: 40767 - DNA, 15 bp, Artificial Sequence
  dgRNA
  Rnf25
accggaaacaccttt

SEQ ID NO: 40768 - DNA, 15 bp, Artificial Sequence
  dgRNA
  Sncaip
gaggaaagagcgcgc

SEQ ID NO: 40769 - DNA, 15 bp, Artificial Sequence
  dgRNA
  Sncaip
aggaaagagcgcgcg

SEQ ID NO: 40770 - DNA, 15 bp, Artificial Sequence
  dgRNA
  Sncaip
ggaaagagcgcgcgg

SEQ ID NO: 40771 - DNA, 15 bp, Artificial Sequence
  dgRNA
  Sncaip
gaaggggccaaaagt

SEQ ID NO: 40772 - DNA, 15 bp, Artificial Sequence
  dgRNA
  Dnph1
actacttgaatagct

SEQ ID NO: 40773 - DNA, 15 bp, Artificial Sequence
  dgRNA
  Dnph1
gaggggcaggtcacg

SEQ ID NO: 40774 - DNA, 15 bp, Artificial Sequence
  dgRNA
  Dnph1
gtcagaactaatgag

SEQ ID NO: 40775 - DNA, 15 bp, Artificial Sequence
  dgRNA
  Dnph1
aactaatgagcgggt

SEQ ID NO: 40776 - DNA, 15 bp, Artificial Sequence
  dgRNA
  Xlr3a
ctctgacacacgttt

SEQ ID NO: 40777 - DNA, 15 bp, Artificial Sequence
  dgRNA
  Xlr3a
acttacataaggtgc

SEQ ID NO: 40778 - DNA, 15 bp, Artificial Sequence
  dgRNA
  Xlr3a
acgtgtgtcagagag

SEQ ID NO: 40779 - DNA, 15 bp, Artificial Sequence
  dgRNA
  Snap25
tgctgcaaagcgctc

SEQ ID NO: 40780 - DNA, 15 bp, Artificial Sequence
  dgRNA
  Snap25
gctgcaaagcgctca

SEQ ID NO: 40781 - DNA, 15 bp, Artificial Sequence
  dgRNA
  Snap25
gcgctccgcacctcc

SEQ ID NO: 40782 - DNA, 15 bp, Artificial Sequence
  dgRNA
  Snap25
cgcccctcgaggagc

SEQ ID NO: 40783 - DNA, 15 bp, Artificial Sequence
  dgRNA
  Dnah7c
gcagacaaccggaag

SEQ ID NO: 40784 - DNA, 15 bp, Artificial Sequence
  dgRNA
  Dnah7c
agtcgcgattcccgc

SEQ ID NO: 40785 - DNA, 15 bp, Artificial Sequence
  dgRNA
  Dnah7c
tgcatctgcgagatc

SEQ ID NO: 40786 - DNA, 15 bp, Artificial Sequence
  dgRNA
  Dnah7c
ggaggattccacttc

SEQ ID NO: 40787 - DNA, 15 bp, Artificial Sequence
  dgRNA
  Gm6408
atatgctctatctag

SEQ ID NO: 40788 - DNA, 15 bp, Artificial Sequence
  dgRNA
  Ppp1r18
ccgcagaaccaattg

SEQ ID NO: 40789 - DNA, 15 bp, Artificial Sequence
  dgRNA
  Ppp1r18
cgcagaaccaattgt

SEQ ID NO: 40790 - DNA, 15 bp, Artificial Sequence
  dgRNA
  Ppp1r18
gaaccaattgtggga

SEQ ID NO: 40791 - DNA, 15 bp, Artificial Sequence
  dgRNA
  Ppp1r18
gagacctagtttttg

SEQ ID NO: 40792 - DNA, 15 bp, Artificial Sequence
  dgRNA
  Nsa2
gccggggagtaagag

SEQ ID NO: 40793 - DNA, 15 bp, Artificial Sequence
  dgRNA
  Nsa2
gaggaaccggcaaca

SEQ ID NO: 40794 - DNA, 15 bp, Artificial Sequence
  dgRNA
  Nsa2
cctcatacccgcaga

SEQ ID NO: 40795 - DNA, 15 bp, Artificial Sequence
  dgRNA
  Nsa2
cgcagaaggaacccg

SEQ ID NO: 40796 - DNA, 15 bp, Artificial Sequence
  dgRNA
  Ranbp10
aataaagtgagaccg

SEQ ID NO: 40797 - DNA, 15 bp, Artificial Sequence
  dgRNA
  Ranbp10
gtgagaccgtggacg

SEQ ID NO: 40798 - DNA, 15 bp, Artificial Sequence
  dgRNA
  Ranbp10
gaccgtggacgagga

SEQ ID NO: 40799 - DNA, 15 bp, Artificial Sequence
  dgRNA
  Ranbp10
gcgagcttcgaggtc

SEQ ID NO: 40800 - DNA, 15 bp, Artificial Sequence
  dgRNA
  Zdhhc17
agccccgggccgggt

SEQ ID NO: 40801 - DNA, 15 bp, Artificial Sequence
  dgRNA
  Zdhhc17
gccccgggccgggtc

SEQ ID NO: 40802 - DNA, 15 bp, Artificial Sequence
  dgRNA
  Zdhhc17
ccggcgcacgcgcat

SEQ ID NO: 40803 - DNA, 15 bp, Artificial Sequence
  dgRNA
  Zdhhc17
cggcgcacgcgcatc

SEQ ID NO: 40804 - DNA, 15 bp, Artificial Sequence
  dgRNA
  Cend1
gtctggattggatac

SEQ ID NO: 40805 - DNA, 15 bp, Artificial Sequence
  dgRNA
  Cend1
atacaggatacagtc

SEQ ID NO: 40806 - DNA, 15 bp, Artificial Sequence
  dgRNA
  Cend1
ccttgctccgccttc

SEQ ID NO: 40807 - DNA, 15 bp, Artificial Sequence
  dgRNA
  Cend1
tacctccgggttccc

SEQ ID NO: 40808 - DNA, 15 bp, Artificial Sequence
  dgRNA
  Dio1
aacaaagaatccggg

SEQ ID NO: 40809 - DNA, 15 bp, Artificial Sequence
  dgRNA
  Dio1
acaaagaatccggga

SEQ ID NO: 40810 - DNA, 15 bp, Artificial Sequence
  dgRNA
  Dio1
acccgattgacagca

SEQ ID NO: 40811 - DNA, 15 bp, Artificial Sequence
  dgRNA
  Dio1
gttggtcctcttgtc

SEQ ID NO: 40812 - DNA, 15 bp, Artificial Sequence
  dgRNA
  Lysmd4
taggagcacaagtcc

SEQ ID NO: 40813 - DNA, 15 bp, Artificial Sequence
  dgRNA
  Lysmd4
gtccagggtccacgc

SEQ ID NO: 40814 - DNA, 15 bp, Artificial Sequence
  dgRNA
  Lysmd4
ggagccccgcccatc

SEQ ID NO: 40815 - DNA, 15 bp, Artificial Sequence
  dgRNA
  Lysmd4
gagccccgcccatca

SEQ ID NO: 40816 - DNA, 15 bp, Artificial Sequence
  dgRNA
  Fgf5
gctcttgacaaccgc

SEQ ID NO: 40817 - DNA, 15 bp, Artificial Sequence
  dgRNA
  Fgf5
ctcttgacaaccgct

SEQ ID NO: 40818 - DNA, 15 bp, Artificial Sequence
  dgRNA
  Fgf5
tgcatgacccgtgca

SEQ ID NO: 40819 - DNA, 15 bp, Artificial Sequence
  dgRNA
  Fgf5
tcgcagccagcgtcc

SEQ ID NO: 40820 - DNA, 15 bp, Artificial Sequence
  dgRNA
  Psenen
ccccggctccctgag

SEQ ID NO: 40821 - DNA, 15 bp, Artificial Sequence
  dgRNA
  Psenen
tcacttccgttgctt

SEQ ID NO: 40822 - DNA, 15 bp, Artificial Sequence
  dgRNA
  Psenen
gttgcttaggagcgt

SEQ ID NO: 40823 - DNA, 15 bp, Artificial Sequence
  dgRNA
  Psenen
ttgcttaggagcgtt

SEQ ID NO: 40824 - DNA, 15 bp, Artificial Sequence
  dgRNA
  Plaur
aggcgaggcaacccc

SEQ ID NO: 40825 - DNA, 15 bp, Artificial Sequence
  dgRNA
  Plaur
ttagcaaacagtggg

SEQ ID NO: 40826 - DNA, 15 bp, Artificial Sequence
  dgRNA
  Suz12
gtccgggcccgcggt

SEQ ID NO: 40827 - DNA, 15 bp, Artificial Sequence
  dgRNA
  Suz12
ggtcggcagcgcgca

SEQ ID NO: 40828 - DNA, 15 bp, Artificial Sequence
  dgRNA
  Suz12
gtcggcagcgcgcac

SEQ ID NO: 40829 - DNA, 15 bp, Artificial Sequence
  dgRNA
  Suz12
cctccgcgtgactga

SEQ ID NO: 40830 - DNA, 15 bp, Artificial Sequence
  dgRNA
  Klra17
ttttcgatttggtca

SEQ ID NO: 40831 - DNA, 15 bp, Artificial Sequence
  dgRNA
  Klra17
tcgatttggtcaagg

SEQ ID NO: 40832 - DNA, 15 bp, Artificial Sequence
  dgRNA
  Klra17
atttggtcaaggagg

SEQ ID NO: 40833 - DNA, 15 bp, Artificial Sequence
  dgRNA
  Defb21
ttaccactctcccat

SEQ ID NO: 40834 - DNA, 15 bp, Artificial Sequence
  dgRNA
  Defb21
caattgtgaccttgg

SEQ ID NO: 40835 - DNA, 15 bp, Artificial Sequence
  dgRNA
  Tmem30a
gcgcagacgtcgctc

SEQ ID NO: 40836 - DNA, 15 bp, Artificial Sequence
  dgRNA
  Tmem30a
cgcagacgtcgctcc

SEQ ID NO: 40837 - DNA, 15 bp, Artificial Sequence
  dgRNA
  Tmem30a
acgtagccgcgcgcc

SEQ ID NO: 40838 - DNA, 15 bp, Artificial Sequence
  dgRNA
  Tmem30a
tcactttgtcgtcac

SEQ ID NO: 40839 - DNA, 15 bp, Artificial Sequence
  dgRNA
  Otud6b
tccgtgcgccccgtc

SEQ ID NO: 40840 - DNA, 15 bp, Artificial Sequence
  dgRNA
  Otud6b
ccgtgcgccccgtca

SEQ ID NO: 40841 - DNA, 15 bp, Artificial Sequence
  dgRNA
  Otud6b
tcagggccaatcgcc

SEQ ID NO: 40842 - DNA, 15 bp, Artificial Sequence
  dgRNA
  Otud6b
cgtagctttgtgctg

SEQ ID NO: 40843 - DNA, 15 bp, Artificial Sequence
  dgRNA
  Dicer1
gctccgtccaatcac

SEQ ID NO: 40844 - DNA, 15 bp, Artificial Sequence
  dgRNA
  Dicer1
cgtccaatcacagga

SEQ ID NO: 40845 - DNA, 15 bp, Artificial Sequence
  dgRNA
  Dicer1
aggacggctttcatg

SEQ ID NO: 40846 - DNA, 15 bp, Artificial Sequence
  dgRNA
  Dicer1
gctttcatgcggccg

SEQ ID NO: 40847 - DNA, 15 bp, Artificial Sequence
  dgRNA
  Uba1
cccaccacgtgcacc

SEQ ID NO: 40848 - DNA, 15 bp, Artificial Sequence
  dgRNA
  Uba1
aggcattagcgggac

SEQ ID NO: 40849 - DNA, 15 bp, Artificial Sequence
  dgRNA
  Uba1
gcatgcatcgcgcat

SEQ ID NO: 40850 - DNA, 15 bp, Artificial Sequence
  dgRNA
  Uba1
catgcatcgcgcatt

SEQ ID NO: 40851 - DNA, 15 bp, Artificial Sequence
  dgRNA
  Hunk
gatcggggcaccaga

SEQ ID NO: 40852 - DNA, 15 bp, Artificial Sequence
  dgRNA
  Hunk
atcggggcaccagac

SEQ ID NO: 40853 - DNA, 15 bp, Artificial Sequence
  dgRNA
  Hunk
caccagacgggaccg

SEQ ID NO: 40854 - DNA, 15 bp, Artificial Sequence
  dgRNA
  Hunk
accagacgggaccgc

SEQ ID NO: 40855 - DNA, 15 bp, Artificial Sequence
  dgRNA
  Olfr1325
ttttcaatcaaggat

SEQ ID NO: 40856 - DNA, 15 bp, Artificial Sequence
  dgRNA
  Olfr1325
atgaacttgtgtcaa

SEQ ID NO: 40857 - DNA, 15 bp, Artificial Sequence
  dgRNA
  Kxd1
ttaattgcccacttc

SEQ ID NO: 40858 - DNA, 15 bp, Artificial Sequence
  dgRNA
  Kxd1
gattgctcatccttt

SEQ ID NO: 40859 - DNA, 15 bp, Artificial Sequence
  dgRNA
  Kxd1
tttggcgttcacgtt

SEQ ID NO: 40860 - DNA, 15 bp, Artificial Sequence
  dgRNA
  Kxd1
ttggcgttcacgtta

SEQ ID NO: 40861 - DNA, 15 bp, Artificial Sequence
  dgRNA
  Ctage5
ctcgtgctccgaagt

SEQ ID NO: 40862 - DNA, 15 bp, Artificial Sequence
  dgRNA
  Ctage5
gtgctccgaagttgg

SEQ ID NO: 40863 - DNA, 15 bp, Artificial Sequence
  dgRNA
  Ctage5
cgaagttggaggccg

SEQ ID NO: 40864 - DNA, 15 bp, Artificial Sequence
  dgRNA
  Ctage5
ccggggagcggtgcg

SEQ ID NO: 40865 - DNA, 15 bp, Artificial Sequence
  dgRNA
  Srd5a1
ccgctgtggcgctga

SEQ ID NO: 40866 - DNA, 15 bp, Artificial Sequence
  dgRNA
  Srd5a1
cgctgtggcgctgag

SEQ ID NO: 40867 - DNA, 15 bp, Artificial Sequence
  dgRNA
  Srd5a1
cttttcgcgagccaa

SEQ ID NO: 40868 - DNA, 15 bp, Artificial Sequence
  dgRNA
  Srd5a1
gtagcgctccaagat

SEQ ID NO: 40869 - DNA, 15 bp, Artificial Sequence
  dgRNA
  Nmi
taagcttttctaagc

SEQ ID NO: 40870 - DNA, 15 bp, Artificial Sequence
  dgRNA
  Nmi
gcagcaatggcgccc

SEQ ID NO: 40871 - DNA, 15 bp, Artificial Sequence
  dgRNA
  Nmi
ctggacgaagtcctc

SEQ ID NO: 40872 - DNA, 15 bp, Artificial Sequence
  dgRNA
  Nmi
tggacgaagtcctca

SEQ ID NO: 40873 - DNA, 15 bp, Artificial Sequence
  dgRNA
  Zzz3
cctcccgtttgcccg

SEQ ID NO: 40874 - DNA, 15 bp, Artificial Sequence
  dgRNA
  Zzz3
cggcctcccagtgcg

SEQ ID NO: 40875 - DNA, 15 bp, Artificial Sequence
  dgRNA
  Zzz3
cccacgccgccatgt

SEQ ID NO: 40876 - DNA, 15 bp, Artificial Sequence
  dgRNA
  Zzz3
cccgcgagatgccag

SEQ ID NO: 40877 - DNA, 15 bp, Artificial Sequence
  dgRNA
  Pcdhb11
tggagcttgcaattc

SEQ ID NO: 40878 - DNA, 15 bp, Artificial Sequence
  dgRNA
  Pcdhb11
gtgcaaaagcaaata

SEQ ID NO: 40879 - DNA, 15 bp, Artificial Sequence
  dgRNA
  Fat1
tactcatagtcagtg

SEQ ID NO: 40880 - DNA, 15 bp, Artificial Sequence
  dgRNA
  Fat1
actcatagtcagtgt

SEQ ID NO: 40881 - DNA, 15 bp, Artificial Sequence
  dgRNA
  Fat1
ctattacaggtggcc

SEQ ID NO: 40882 - DNA, 15 bp, Artificial Sequence
  dgRNA
  Tufm
taaagcggccccctc

SEQ ID NO: 40883 - DNA, 15 bp, Artificial Sequence
  dgRNA
  Tufm
cttccgctccatgcc

SEQ ID NO: 40884 - DNA, 15 bp, Artificial Sequence
  dgRNA
  Tufm
atgcccggatatcag

SEQ ID NO: 40885 - DNA, 15 bp, Artificial Sequence
  dgRNA
  Tufm
ggatatcagtggccg

SEQ ID NO: 40886 - DNA, 15 bp, Artificial Sequence
  dgRNA
  Vim
cggcttccgatctgc

SEQ ID NO: 40887 - DNA, 15 bp, Artificial Sequence
  dgRNA
  Vim
tcaagacctttgcag

SEQ ID NO: 40888 - DNA, 15 bp, Artificial Sequence
  dgRNA
  Vim
acagcccaagatatc

SEQ ID NO: 40889 - DNA, 15 bp, Artificial Sequence
  dgRNA
  Vim
gcccgagattggggg

SEQ ID NO: 40890 - DNA, 15 bp, Artificial Sequence
  dgRNA
  Abca9
aggggtttaatccaa

SEQ ID NO: 40891 - DNA, 15 bp, Artificial Sequence
  dgRNA
  Abca9
taatccaaagggggt

SEQ ID NO: 40892 - DNA, 15 bp, Artificial Sequence
  dgRNA
  Abca9
agcaactatcaaacc

SEQ ID NO: 40893 - DNA, 15 bp, Artificial Sequence
  dgRNA
  Pkmyt1
tggacacgaatatta

SEQ ID NO: 40894 - DNA, 15 bp, Artificial Sequence
  dgRNA
  Pkmyt1
caaataccgacagag

SEQ ID NO: 40895 - DNA, 15 bp, Artificial Sequence
  dgRNA
  Pkmyt1
aaataccgacagaga

SEQ ID NO: 40896 - DNA, 15 bp, Artificial Sequence
  dgRNA
  Pkmyt1
aataccgacagagag

SEQ ID NO: 40897 - DNA, 15 bp, Artificial Sequence
  dgRNA
  Zfp330
ctttctttgcaacgc

SEQ ID NO: 40898 - DNA, 15 bp, Artificial Sequence
  dgRNA
  Zfp330
agtccacttccggga

SEQ ID NO: 40899 - DNA, 15 bp, Artificial Sequence
  dgRNA
  Zfp330
ccacttccgggaagg

SEQ ID NO: 40900 - DNA, 15 bp, Artificial Sequence
  dgRNA
  Zfp330
cacttccgggaaggc

SEQ ID NO: 40901 - DNA, 15 bp, Artificial Sequence
  dgRNA
  Gal3st1
attggctctggcgtc

SEQ ID NO: 40902 - DNA, 15 bp, Artificial Sequence
  dgRNA
  Gal3st1
tctggcgtcaggggc

SEQ ID NO: 40903 - DNA, 15 bp, Artificial Sequence
  dgRNA
  Gal3st1
ggcgagtgttgagag

SEQ ID NO: 40904 - DNA, 15 bp, Artificial Sequence
  dgRNA
  Gal3st1
gcgagtgttgagagc

SEQ ID NO: 40905 - DNA, 15 bp, Artificial Sequence
  dgRNA
  Olfr154
aacttaaattaacta

SEQ ID NO: 40906 - DNA, 15 bp, Artificial Sequence
  dgRNA
  Msantd2
gcggccggcaccagc

SEQ ID NO: 40907 - DNA, 15 bp, Artificial Sequence
  dgRNA
  Msantd2
ccggcaccagctggc

SEQ ID NO: 40908 - DNA, 15 bp, Artificial Sequence
  dgRNA
  Msantd2
aaaggcgaagatttg

SEQ ID NO: 40909 - DNA, 15 bp, Artificial Sequence
  dgRNA
  Msantd2
aaggcgaagatttgc

SEQ ID NO: 40910 - DNA, 15 bp, Artificial Sequence
  dgRNA
  Nos3
ctcatggcggaaccc

SEQ ID NO: 40911 - DNA, 15 bp, Artificial Sequence
  dgRNA
  Nos3
cggaacccaggcgtc

SEQ ID NO: 40912 - DNA, 15 bp, Artificial Sequence
  dgRNA
  Nos3
gcgggcatgaagccg

SEQ ID NO: 40913 - DNA, 15 bp, Artificial Sequence
  dgRNA
  Nos3
ttagagcctccctgc

SEQ ID NO: 40914 - DNA, 15 bp, Artificial Sequence
  dgRNA
  Irx6
atgggttgtagttgg

SEQ ID NO: 40915 - DNA, 15 bp, Artificial Sequence
  dgRNA
  Irx6
agagcaggggctcgc

SEQ ID NO: 40916 - DNA, 15 bp, Artificial Sequence
  dgRNA
  Irx6
aggagtctgatggcg

SEQ ID NO: 40917 - DNA, 15 bp, Artificial Sequence
  dgRNA
  Nrxn3
tacacttgaatgggg

SEQ ID NO: 40918 - DNA, 15 bp, Artificial Sequence
  dgRNA
  Nrxn3
ggccgggattcctgg

SEQ ID NO: 40919 - DNA, 15 bp, Artificial Sequence
  dgRNA
  Nrxn3
gtgtacgctagctcg

SEQ ID NO: 40920 - DNA, 15 bp, Artificial Sequence
  dgRNA
  Nrxn3
tgccgagggactggc

SEQ ID NO: 40921 - DNA, 15 bp, Artificial Sequence
  dgRNA
  Dus1l
cgagtgccaattgtc

SEQ ID NO: 40922 - DNA, 15 bp, Artificial Sequence
  dgRNA
  Dus1l
tgccaattgtctgga

SEQ ID NO: 40923 - DNA, 15 bp, Artificial Sequence
  dgRNA
  Dus1l
gccaattgtctggaa

SEQ ID NO: 40924 - DNA, 15 bp, Artificial Sequence
  dgRNA
  Dus1l
gggacagcgtgaccc

SEQ ID NO: 40925 - DNA, 15 bp, Artificial Sequence
  dgRNA
  Gyltl1b
cctaaaaggggttga

SEQ ID NO: 40926 - DNA, 15 bp, Artificial Sequence
  dgRNA
  Gyltl1b
ggttcccagaccgtg

SEQ ID NO: 40927 - DNA, 15 bp, Artificial Sequence
  dgRNA
  Gyltl1b
cagaccgtgcggtgc

SEQ ID NO: 40928 - DNA, 15 bp, Artificial Sequence
  dgRNA
  Gyltl1b
agaccgtgcggtgca

SEQ ID NO: 40929 - DNA, 15 bp, Artificial Sequence
  dgRNA
  Rps6kb2
tctgtgcgcgcggct

SEQ ID NO: 40930 - DNA, 15 bp, Artificial Sequence
  dgRNA
  Rps6kb2
ctgtgcgcgcggctc

SEQ ID NO: 40931 - DNA, 15 bp, Artificial Sequence
  dgRNA
  Rps6kb2
tgtgcgcgcggctcg

SEQ ID NO: 40932 - DNA, 15 bp, Artificial Sequence
  dgRNA
  Rps6kb2
gctcggggcgagagc

SEQ ID NO: 40933 - DNA, 15 bp, Artificial Sequence
  dgRNA
  Dnaja1
aagacttccgcactc

SEQ ID NO: 40934 - DNA, 15 bp, Artificial Sequence
  dgRNA
  Dnaja1
ctagaaaattctacg

SEQ ID NO: 40935 - DNA, 15 bp, Artificial Sequence
  dgRNA
  Dnaja1
aaattctacgaggct

SEQ ID NO: 40936 - DNA, 15 bp, Artificial Sequence
  dgRNA
  Dnaja1
aattctacgaggctc

SEQ ID NO: 40937 - DNA, 15 bp, Artificial Sequence
  dgRNA
  Cpeb3
cggcggtcgcggccc

SEQ ID NO: 40938 - DNA, 15 bp, Artificial Sequence
  dgRNA
  Cpeb3
ggcccgggttcctgc

SEQ ID NO: 40939 - DNA, 15 bp, Artificial Sequence
  dgRNA
  Cpeb3
cctgccggtccgccc

SEQ ID NO: 40940 - DNA, 15 bp, Artificial Sequence
  dgRNA
  Cpeb3
ctgccggtccgccca

SEQ ID NO: 40941 - DNA, 15 bp, Artificial Sequence
  dgRNA
  Cyp11b1
accgaatacatttct

SEQ ID NO: 40942 - DNA, 15 bp, Artificial Sequence
  dgRNA
  Cyp11b1
ccgaatacatttcta

SEQ ID NO: 40943 - DNA, 15 bp, Artificial Sequence
  dgRNA
  Cyp11b1
ttctagggcaagtcc

SEQ ID NO: 40944 - DNA, 15 bp, Artificial Sequence
  dgRNA
  Cyp11b1
tgtattcggtgctga

SEQ ID NO: 40945 - DNA, 15 bp, Artificial Sequence
  dgRNA
  Sema4a
gtgcgggagaaacaa

SEQ ID NO: 40946 - DNA, 15 bp, Artificial Sequence
  dgRNA
  Sema4a
agggcatcactgaac

SEQ ID NO: 40947 - DNA, 15 bp, Artificial Sequence
  dgRNA
  Sema4a
ctgaactggccggga

SEQ ID NO: 40948 - DNA, 15 bp, Artificial Sequence
  dgRNA
  Sema4a
ctggatagactaagg

SEQ ID NO: 40949 - DNA, 15 bp, Artificial Sequence
  dgRNA
  Olfr1163
gattttgtattaaac

SEQ ID NO: 40950 - DNA, 15 bp, Artificial Sequence
  dgRNA
  Olfr1163
gtaaacagtgccatt

SEQ ID NO: 40951 - DNA, 15 bp, Artificial Sequence
  dgRNA
  Dapk1
gctgcgcccgacgca

SEQ ID NO: 40952 - DNA, 15 bp, Artificial Sequence
  dgRNA
  Dapk1
gcccgacgcaaggag

SEQ ID NO: 40953 - DNA, 15 bp, Artificial Sequence
  dgRNA
  Dapk1
cgacgcaaggagcgg

SEQ ID NO: 40954 - DNA, 15 bp, Artificial Sequence
  dgRNA
  Dapk1
ggagcggaggccgct

SEQ ID NO: 40955 - DNA, 15 bp, Artificial Sequence
  dgRNA
  Fam196b
tgggtctgctcacgt

SEQ ID NO: 40956 - DNA, 15 bp, Artificial Sequence
  dgRNA
  Fam196b
tgcaagaagtgtagt

SEQ ID NO: 40957 - DNA, 15 bp, Artificial Sequence
  dgRNA
  Fam196b
atgcaagaagtgtag

SEQ ID NO: 40958 - DNA, 15 bp, Artificial Sequence
  dgRNA
  Trpc1
aaatccgccaccaag

SEQ ID NO: 40959 - DNA, 15 bp, Artificial Sequence
  dgRNA
  Trpc1
cgcgcccaagatgct

SEQ ID NO: 40960 - DNA, 15 bp, Artificial Sequence
  dgRNA
  Trpc1
ggcgaccgaccagag

SEQ ID NO: 40961 - DNA, 15 bp, Artificial Sequence
  dgRNA
  Trpc1
gaggcgcgtcagccc

SEQ ID NO: 40962 - DNA, 15 bp, Artificial Sequence
  dgRNA
  Slfn14
gggtcaatgttatga

SEQ ID NO: 40963 - DNA, 15 bp, Artificial Sequence
  dgRNA
  Slfn14
atgttatgaaggcta

SEQ ID NO: 40964 - DNA, 15 bp, Artificial Sequence
  dgRNA
  Slfn14
ttgattagcaaacta

SEQ ID NO: 40965 - DNA, 15 bp, Artificial Sequence
  dgRNA
  Heph
ggatctcaggttaat

SEQ ID NO: 40966 - DNA, 15 bp, Artificial Sequence
  dgRNA
  Heph
tcaggttaatgggtt

SEQ ID NO: 40967 - DNA, 15 bp, Artificial Sequence
  dgRNA
  Heph
aaggcatttatgaca

SEQ ID NO: 40968 - DNA, 15 bp, Artificial Sequence
  dgRNA
  Cers6
aggtgcgacccaact

SEQ ID NO: 40969 - DNA, 15 bp, Artificial Sequence
  dgRNA
  Cers6
ggtgcgacccaactt

SEQ ID NO: 40970 - DNA, 15 bp, Artificial Sequence
  dgRNA
  Cers6
gtgcgacccaacttg

SEQ ID NO: 40971 - DNA, 15 bp, Artificial Sequence
  dgRNA
  Cers6
tgcgggacgcgctcc

SEQ ID NO: 40972 - DNA, 15 bp, Artificial Sequence
  dgRNA
  Rps6ka1
ccgcggagcctccgg

SEQ ID NO: 40973 - DNA, 15 bp, Artificial Sequence
  dgRNA
  Rps6ka1
cgcggagcctccggt

SEQ ID NO: 40974 - DNA, 15 bp, Artificial Sequence
  dgRNA
  Rps6ka1
ggcagggccgacagt

SEQ ID NO: 40975 - DNA, 15 bp, Artificial Sequence
  dgRNA
  Rps6ka1
gggccgacagtgggc

SEQ ID NO: 40976 - DNA, 15 bp, Artificial Sequence
  dgRNA
  Gtf3c1
tcccggcggggccca

SEQ ID NO: 40977 - DNA, 15 bp, Artificial Sequence
  dgRNA
  Gtf3c1
accgtccatccctag

SEQ ID NO: 40978 - DNA, 15 bp, Artificial Sequence
  dgRNA
  Gtf3c1
gtccatccctagagg

SEQ ID NO: 40979 - DNA, 15 bp, Artificial Sequence
  dgRNA
  Gtf3c1
catccctagaggcgg

SEQ ID NO: 40980 - DNA, 15 bp, Artificial Sequence
  dgRNA
  Tnni3
gccggcatggatttc

SEQ ID NO: 40981 - DNA, 15 bp, Artificial Sequence
  dgRNA
  Tnni3
ccggcatggatttct

SEQ ID NO: 40982 - DNA, 15 bp, Artificial Sequence
  dgRNA
  Tnni3
gggcgctagagtcaa

SEQ ID NO: 40983 - DNA, 15 bp, Artificial Sequence
  dgRNA
  Tnni3
cgctagagtcaaagg

SEQ ID NO: 40984 - DNA, 15 bp, Artificial Sequence
  dgRNA
  Ifne
gaaccagaaaaccta

SEQ ID NO: 40985 - DNA, 15 bp, Artificial Sequence
  dgRNA
  Ifne
cctaaggtataaact

SEQ ID NO: 40986 - DNA, 15 bp, Artificial Sequence
  dgRNA
  Ifne
ctaaggtataaactt

SEQ ID NO: 40987 - DNA, 15 bp, Artificial Sequence
  dgRNA
  Ifne
gggaaacgacgtaca

SEQ ID NO: 40988 - DNA, 15 bp, Artificial Sequence
  dgRNA
  Nog
gccgctggagtccgc

SEQ ID NO: 40989 - DNA, 15 bp, Artificial Sequence
  dgRNA
  Nog
ccgctggagtccgcc

SEQ ID NO: 40990 - DNA, 15 bp, Artificial Sequence
  dgRNA
  Nog
tccgccgggcagagc

SEQ ID NO: 40991 - DNA, 15 bp, Artificial Sequence
  dgRNA
  Nog
gccggctgcgctgcc

SEQ ID NO: 40992 - DNA, 15 bp, Artificial Sequence
  dgRNA
  Calm1
tgacggacacgcgcc

SEQ ID NO: 40993 - DNA, 15 bp, Artificial Sequence
  dgRNA
  Calm1
acgcgcctggaagcc

SEQ ID NO: 40994 - DNA, 15 bp, Artificial Sequence
  dgRNA
  Calm1
cgcgcctggaagccc

SEQ ID NO: 40995 - DNA, 15 bp, Artificial Sequence
  dgRNA
  Calm1
cagatttcgctacgc

SEQ ID NO: 40996 - DNA, 15 bp, Artificial Sequence
  dgRNA
  Bmpr1a
gggcgccgaactcca

SEQ ID NO: 40997 - DNA, 15 bp, Artificial Sequence
  dgRNA
  Bmpr1a
ggcgccgaactccac

SEQ ID NO: 40998 - DNA, 15 bp, Artificial Sequence
  dgRNA
  Bmpr1a
actccacgggccctt

SEQ ID NO: 40999 - DNA, 15 bp, Artificial Sequence
  dgRNA
  Bmpr1a
ctccacgggcccttc

SEQ ID NO: 41000 - DNA, 15 bp, Artificial Sequence
  dgRNA
  Sptssb
gggaccttagagtga

SEQ ID NO: 41001 - DNA, 15 bp, Artificial Sequence
  dgRNA
  Sptssb
gaccttagagtgaag

SEQ ID NO: 41002 - DNA, 15 bp, Artificial Sequence
  dgRNA
  Sptssb
accttagagtgaagg

SEQ ID NO: 41003 - DNA, 15 bp, Artificial Sequence
  dgRNA
  Sptssb
gcccgcattctcttc

SEQ ID NO: 41004 - DNA, 15 bp, Artificial Sequence
  dgRNA
  Nlgn2
ccctcgaccctgccc

SEQ ID NO: 41005 - DNA, 15 bp, Artificial Sequence
  dgRNA
  Nlgn2
cttgtgtctctgcgg

SEQ ID NO: 41006 - DNA, 15 bp, Artificial Sequence
  dgRNA
  Nlgn2
gggaatcctagactc

SEQ ID NO: 41007 - DNA, 15 bp, Artificial Sequence
  dgRNA
  Nlgn2
ccagggcagggtcga

SEQ ID NO: 41008 - DNA, 15 bp, Artificial Sequence
  dgRNA
  Sh3kbp1
gggggcgaccctctg

SEQ ID NO: 41009 - DNA, 15 bp, Artificial Sequence
  dgRNA
  Sh3kbp1
ctgcggagctccagc

SEQ ID NO: 41010 - DNA, 15 bp, Artificial Sequence
  dgRNA
  Sh3kbp1
gacgagccccagagt

SEQ ID NO: 41011 - DNA, 15 bp, Artificial Sequence
  dgRNA
  Sh3kbp1
acgagccccagagtc

SEQ ID NO: 41012 - DNA, 15 bp, Artificial Sequence
  dgRNA
  Zfp276
cggtgtctagctcga

SEQ ID NO: 41013 - DNA, 15 bp, Artificial Sequence
  dgRNA
  Zfp276
gctcgatggccttgt

SEQ ID NO: 41014 - DNA, 15 bp, Artificial Sequence
  dgRNA
  Zfp276
catggcgctctgcag

SEQ ID NO: 41015 - DNA, 15 bp, Artificial Sequence
  dgRNA
  Zfp276
tcgccccgccgtccc

SEQ ID NO: 41016 - DNA, 15 bp, Artificial Sequence
  dgRNA
  Ceacam19
tctaggggaggtagt

SEQ ID NO: 41017 - DNA, 15 bp, Artificial Sequence
  dgRNA
  Ceacam19
ctaggggaggtagta

SEQ ID NO: 41018 - DNA, 15 bp, Artificial Sequence
  dgRNA
  Ceacam19
ggtagtagggtgcgg

SEQ ID NO: 41019 - DNA, 15 bp, Artificial Sequence
  dgRNA
  Ceacam19
gtagtagggtgcggt

SEQ ID NO: 41020 - DNA, 15 bp, Artificial Sequence
  dgRNA
  Ccdc141
aatggttcaaataac

SEQ ID NO: 41021 - DNA, 15 bp, Artificial Sequence
  dgRNA
  Ccdc141
ttctgttaccatact

SEQ ID NO: 41022 - DNA, 15 bp, Artificial Sequence
  dgRNA
  Ccdc141
tctgttaccatacta

SEQ ID NO: 41023 - DNA, 15 bp, Artificial Sequence
  dgRNA
  Ccdc141
ctgttaccatactag

SEQ ID NO: 41024 - DNA, 15 bp, Artificial Sequence
  dgRNA
  Akr1c20
tctgtcaaactgcct

SEQ ID NO: 41025 - DNA, 15 bp, Artificial Sequence
  dgRNA
  St3gal2
gcatgcctgagcgag

SEQ ID NO: 41026 - DNA, 15 bp, Artificial Sequence
  dgRNA
  St3gal2
tgagcgagtggtggt

SEQ ID NO: 41027 - DNA, 15 bp, Artificial Sequence
  dgRNA
  St3gal2
aggggagagccccgg

SEQ ID NO: 41028 - DNA, 15 bp, Artificial Sequence
  dgRNA
  St3gal2
cccggaggatgtgaa

SEQ ID NO: 41029 - DNA, 15 bp, Artificial Sequence
  dgRNA
  Rgs3
ggcaggggctctaac

SEQ ID NO: 41030 - DNA, 15 bp, Artificial Sequence
  dgRNA
  Rgs3
ggtcagaacactgcg

SEQ ID NO: 41031 - DNA, 15 bp, Artificial Sequence
  dgRNA
  Rbpj
accagtcagccctac

SEQ ID NO: 41032 - DNA, 15 bp, Artificial Sequence
  dgRNA
  Rbpj
actaactaccaattc

SEQ ID NO: 41033 - DNA, 15 bp, Artificial Sequence
  dgRNA
  Rbpj
ctcagccctccagta

SEQ ID NO: 41034 - DNA, 15 bp, Artificial Sequence
  dgRNA
  Rbpj
gagtgccgaggttgg

SEQ ID NO: 41035 - DNA, 15 bp, Artificial Sequence
  dgRNA
  Cyfip1
tgagcagcaagcggc

SEQ ID NO: 41036 - DNA, 15 bp, Artificial Sequence
  dgRNA
  Cyfip1
cggcaggcggggcta

SEQ ID NO: 41037 - DNA, 15 bp, Artificial Sequence
  dgRNA
  Cyfip1
ggcggggctacggta

SEQ ID NO: 41038 - DNA, 15 bp, Artificial Sequence
  dgRNA
  Cyfip1
gcggggctacggtac

SEQ ID NO: 41039 - DNA, 15 bp, Artificial Sequence
  dgRNA
  Rprd1b
gttaaagcgcatttt

SEQ ID NO: 41040 - DNA, 15 bp, Artificial Sequence
  dgRNA
  Rprd1b
cattttcggtgttcg

SEQ ID NO: 41041 - DNA, 15 bp, Artificial Sequence
  dgRNA
  Rprd1b
cggtgttcgaggacc

SEQ ID NO: 41042 - DNA, 15 bp, Artificial Sequence
  dgRNA
  Rprd1b
tttgttccctcggcc

SEQ ID NO: 41043 - DNA, 15 bp, Artificial Sequence
  dgRNA
  Pbk
ttctagccatcgctc

SEQ ID NO: 41044 - DNA, 15 bp, Artificial Sequence
  dgRNA
  Pbk
aactccagtaaacct

SEQ ID NO: 41045 - DNA, 15 bp, Artificial Sequence
  dgRNA
  Pbk
tccagtaaacctggg

SEQ ID NO: 41046 - DNA, 15 bp, Artificial Sequence
  dgRNA
  Pbk
aatcttccagagcga

SEQ ID NO: 41047 - DNA, 15 bp, Artificial Sequence
  dgRNA
  Wdr7
actgcgtccttatag

SEQ ID NO: 41048 - DNA, 15 bp, Artificial Sequence
  dgRNA
  Wdr7
ctgcgtccttatagc

SEQ ID NO: 41049 - DNA, 15 bp, Artificial Sequence
  dgRNA
  Wdr7
cagaccacgcctgcc

SEQ ID NO: 41050 - DNA, 15 bp, Artificial Sequence
  dgRNA
  Wdr7
cacgcctgcctggac

SEQ ID NO: 41051 - DNA, 15 bp, Artificial Sequence
  dgRNA
  Ddit4l
gagatgctctttagg

SEQ ID NO: 41052 - DNA, 15 bp, Artificial Sequence
  dgRNA
  Ddit4l
ccagtggccaactca

SEQ ID NO: 41053 - DNA, 15 bp, Artificial Sequence
  dgRNA
  Ddit4l
gcaggtgtccgccca

SEQ ID NO: 41054 - DNA, 15 bp, Artificial Sequence
  dgRNA
  Ddit4l
tgtccgcccaaggcg

SEQ ID NO: 41055 - DNA, 15 bp, Artificial Sequence
  dgRNA
  Morf4l2
tgacgtgtctgccta

SEQ ID NO: 41056 - DNA, 15 bp, Artificial Sequence
  dgRNA
  Morf4l2
aacctggctttacta

SEQ ID NO: 41057 - DNA, 15 bp, Artificial Sequence
  dgRNA
  Morf4l2
ctggctttactatgg

SEQ ID NO: 41058 - DNA, 15 bp, Artificial Sequence
  dgRNA
  Morf4l2
ctggattctcgtttc

SEQ ID NO: 41059 - DNA, 15 bp, Artificial Sequence
  dgRNA
  Disp1
catctagtggacacc

SEQ ID NO: 41060 - DNA, 15 bp, Artificial Sequence
  dgRNA
  Disp1
agctaagacggagac

SEQ ID NO: 41061 - DNA, 15 bp, Artificial Sequence
  dgRNA
  Disp1
gcggctttgagtagc

SEQ ID NO: 41062 - DNA, 15 bp, Artificial Sequence
  dgRNA
  Disp1
gcctgggcccatagc

SEQ ID NO: 41063 - DNA, 15 bp, Artificial Sequence
  dgRNA
  Vars
cgcactccagacact

SEQ ID NO: 41064 - DNA, 15 bp, Artificial Sequence
  dgRNA
  Vars
tagacacgaagaccc

SEQ ID NO: 41065 - DNA, 15 bp, Artificial Sequence
  dgRNA
  Vars
accccgggctgcccg

SEQ ID NO: 41066 - DNA, 15 bp, Artificial Sequence
  dgRNA
  Vars
ccgggctgcccgcgg

SEQ ID NO: 41067 - DNA, 15 bp, Artificial Sequence
  dgRNA
  Olfr470
gctgctgctagatta

SEQ ID NO: 41068 - DNA, 15 bp, Artificial Sequence
  dgRNA
  Klf7
ttacatggtcacacg

SEQ ID NO: 41069 - DNA, 15 bp, Artificial Sequence
  dgRNA
  Klf7
tcacacgcggcctaa

SEQ ID NO: 41070 - DNA, 15 bp, Artificial Sequence
  dgRNA
  Klf7
tcctccgagatccca

SEQ ID NO: 41071 - DNA, 15 bp, Artificial Sequence
  dgRNA
  Klf7
cggctgcgcgcaaaa

SEQ ID NO: 41072 - DNA, 15 bp, Artificial Sequence
  dgRNA
  Ifna14
tgtcgctggtcccct

SEQ ID NO: 41073 - DNA, 15 bp, Artificial Sequence
  dgRNA
  Ifna14
atgtcgctggtcccc

SEQ ID NO: 41074 - DNA, 15 bp, Artificial Sequence
  dgRNA
  Diras2
tgattaagtacacta

SEQ ID NO: 41075 - DNA, 15 bp, Artificial Sequence
  dgRNA
  Diras2
taagtacactagggt

SEQ ID NO: 41076 - DNA, 15 bp, Artificial Sequence
  dgRNA
  Diras2
agaagctttcggtag

SEQ ID NO: 41077 - DNA, 15 bp, Artificial Sequence
  dgRNA
  Diras2
gaagctttcggtaga

SEQ ID NO: 41078 - DNA, 15 bp, Artificial Sequence
  dgRNA
  Pcmtd2
gcttatgtccactca

SEQ ID NO: 41079 - DNA, 15 bp, Artificial Sequence
  dgRNA
  Celf2
gataacataacttgt

SEQ ID NO: 41080 - DNA, 15 bp, Artificial Sequence
  dgRNA
  Celf2
cataacttgtcggag

SEQ ID NO: 41081 - DNA, 15 bp, Artificial Sequence
  dgRNA
  Celf2
ggcatgtttttgcac

SEQ ID NO: 41082 - DNA, 15 bp, Artificial Sequence
  dgRNA
  Celf2
caagttatgttatct

SEQ ID NO: 41083 - DNA, 15 bp, Artificial Sequence
  dgRNA
  Ccdc6
cgggagcacgtgcgc

SEQ ID NO: 41084 - DNA, 15 bp, Artificial Sequence
  dgRNA
  Ccdc6
gggagcacgtgcgcg

SEQ ID NO: 41085 - DNA, 15 bp, Artificial Sequence
  dgRNA
  Ccdc6
tgctaggagagcgct

SEQ ID NO: 41086 - DNA, 15 bp, Artificial Sequence
  dgRNA
  Ccdc6
gctaggagagcgctg

SEQ ID NO: 41087 - DNA, 15 bp, Artificial Sequence
  dgRNA
  BC048679
tcggtcagattggct

SEQ ID NO: 41088 - DNA, 15 bp, Artificial Sequence
  dgRNA
  BC048679
cgtccaggtaagtga

SEQ ID NO: 41089 - DNA, 15 bp, Artificial Sequence
  dgRNA
  BC048679
tgagggctggcgtcc

SEQ ID NO: 41090 - DNA, 15 bp, Artificial Sequence
  dgRNA
  BC048679
ttagatatgaccctg

SEQ ID NO: 41091 - DNA, 15 bp, Artificial Sequence
  dgRNA
  Crygc
cttggtaaatctggg

SEQ ID NO: 41092 - DNA, 15 bp, Artificial Sequence
  dgRNA
  Crygc
acttggtaaatctgg

SEQ ID NO: 41093 - DNA, 15 bp, Artificial Sequence
  dgRNA
  Crygc
atacttggtaaatct

SEQ ID NO: 41094 - DNA, 15 bp, Artificial Sequence
  dgRNA
  Ptprn
gaggaacctactata

SEQ ID NO: 41095 - DNA, 15 bp, Artificial Sequence
  dgRNA
  Ptprn
gaacctactatatgg

SEQ ID NO: 41096 - DNA, 15 bp, Artificial Sequence
  dgRNA
  Ptprn
cctactatatggtgg

SEQ ID NO: 41097 - DNA, 15 bp, Artificial Sequence
  dgRNA
  Ptprn
aggcttaggttgagt

SEQ ID NO: 41098 - DNA, 15 bp, Artificial Sequence
  dgRNA
  Zfp516
acctgcccgccctag

SEQ ID NO: 41099 - DNA, 15 bp, Artificial Sequence
  dgRNA
  Zfp516
cccgccctagaggcg

SEQ ID NO: 41100 - DNA, 15 bp, Artificial Sequence
  dgRNA
  Zfp516
ggcgtggcgtgctgc

SEQ ID NO: 41101 - DNA, 15 bp, Artificial Sequence
  dgRNA
  Zfp516
gcgtggcgtgctgct

SEQ ID NO: 41102 - DNA, 15 bp, Artificial Sequence
  dgRNA
  Mfsd7b
cggcaactccccgat

SEQ ID NO: 41103 - DNA, 15 bp, Artificial Sequence
  dgRNA
  Mfsd7b
ccccgattggttttc

SEQ ID NO: 41104 - DNA, 15 bp, Artificial Sequence
  dgRNA
  Mfsd7b
gaaacgctcaatgat

SEQ ID NO: 41105 - DNA, 15 bp, Artificial Sequence
  dgRNA
  Mfsd7b
cgctcaatgattgga

SEQ ID NO: 41106 - DNA, 15 bp, Artificial Sequence
  dgRNA
  Zfp874b
ggtgacgtcacagat

SEQ ID NO: 41107 - DNA, 15 bp, Artificial Sequence
  dgRNA
  Zfp874b
cacagatcggtactt

SEQ ID NO: 41108 - DNA, 15 bp, Artificial Sequence
  dgRNA
  Zfp874b
cctagttaagaagca

SEQ ID NO: 41109 - DNA, 15 bp, Artificial Sequence
  dgRNA
  Zfp874b
actacaaaatggtcc

SEQ ID NO: 41110 - DNA, 15 bp, Artificial Sequence
  dgRNA
  4931417E11Rik
aaccctaattagacc

SEQ ID NO: 41111 - DNA, 15 bp, Artificial Sequence
  dgRNA
  4931417E11Rik
gaaacagatcacccc

SEQ ID NO: 41112 - DNA, 15 bp, Artificial Sequence
  dgRNA
  4931417E11Rik
aaacagatcacccct

SEQ ID NO: 41113 - DNA, 15 bp, Artificial Sequence
  dgRNA
  4931417E11Rik
agggggttaggaccc

SEQ ID NO: 41114 - DNA, 15 bp, Artificial Sequence
  dgRNA
  Unc93b1
accatggacagtatt

SEQ ID NO: 41115 - DNA, 15 bp, Artificial Sequence
  dgRNA
  Unc93b1
atggacagtattagg

SEQ ID NO: 41116 - DNA, 15 bp, Artificial Sequence
  dgRNA
  Unc93b1
gcggcccacactaga

SEQ ID NO: 41117 - DNA, 15 bp, Artificial Sequence
  dgRNA
  Unc93b1
cggcccacactagac

SEQ ID NO: 41118 - DNA, 15 bp, Artificial Sequence
  dgRNA
  Spcs1
cagcgctcgctccgc

SEQ ID NO: 41119 - DNA, 15 bp, Artificial Sequence
  dgRNA
  Spcs1
cgctccgcaggcccc

SEQ ID NO: 41120 - DNA, 15 bp, Artificial Sequence
  dgRNA
  Spcs1
gccccggcccaccgc

SEQ ID NO: 41121 - DNA, 15 bp, Artificial Sequence
  dgRNA
  Spcs1
ccccggcccaccgcc

SEQ ID NO: 41122 - DNA, 15 bp, Artificial Sequence
  dgRNA
  Vmn1r46
atctttttgccagct

SEQ ID NO: 41123 - DNA, 15 bp, Artificial Sequence
  dgRNA
  Vmn1r46
ttgccagctcggtgt

SEQ ID NO: 41124 - DNA, 15 bp, Artificial Sequence
  dgRNA
  Vmn1r46
cagctcggtgttggt

SEQ ID NO: 41125 - DNA, 15 bp, Artificial Sequence
  dgRNA
  Vmn1r46
caaccaacaccgagc

SEQ ID NO: 41126 - DNA, 15 bp, Artificial Sequence
  dgRNA
  As3mt
gtttacctaaggcac

SEQ ID NO: 41127 - DNA, 15 bp, Artificial Sequence
  dgRNA
  As3mt
gtgaatcagtaaagg

SEQ ID NO: 41128 - DNA, 15 bp, Artificial Sequence
  dgRNA
  As3mt
ctaagaggcttccgt

SEQ ID NO: 41129 - DNA, 15 bp, Artificial Sequence
  dgRNA
  As3mt
taagaggcttccgta

SEQ ID NO: 41130 - DNA, 15 bp, Artificial Sequence
  dgRNA
  3110035E14Rik
aagatcctgttcccc

SEQ ID NO: 41131 - DNA, 15 bp, Artificial Sequence
  dgRNA
  3110035E14Rik
ggtctcattccagaa

SEQ ID NO: 41132 - DNA, 15 bp, Artificial Sequence
  dgRNA
  3110035E14Rik
gctatcagtgtgccc

SEQ ID NO: 41133 - DNA, 15 bp, Artificial Sequence
  dgRNA
  Lpin3
tcctgtcgtgacagc

SEQ ID NO: 41134 - DNA, 15 bp, Artificial Sequence
  dgRNA
  Lpin3
tcgtgacagctggtg

SEQ ID NO: 41135 - DNA, 15 bp, Artificial Sequence
  dgRNA
  Lpin3
ggccacgggtgtggc

SEQ ID NO: 41136 - DNA, 15 bp, Artificial Sequence
  dgRNA
  Lpin3
gccacgggtgtggct

SEQ ID NO: 41137 - DNA, 15 bp, Artificial Sequence
  dgRNA
  St7
gaagagctcttcagg

SEQ ID NO: 41138 - DNA, 15 bp, Artificial Sequence
  dgRNA
  St7
gggggaatgtgcttg

SEQ ID NO: 41139 - DNA, 15 bp, Artificial Sequence
  dgRNA
  St7
gttcccttgaaaccc

SEQ ID NO: 41140 - DNA, 15 bp, Artificial Sequence
  dgRNA
  St7
gtccctgacgtcatc

SEQ ID NO: 41141 - DNA, 15 bp, Artificial Sequence
  dgRNA
  Havcr1
tggccagaagtcata

SEQ ID NO: 41142 - DNA, 15 bp, Artificial Sequence
  dgRNA
  Havcr1
ggctgtacgtgagaa

SEQ ID NO: 41143 - DNA, 15 bp, Artificial Sequence
  dgRNA
  Havcr1
ggtatcctagcggag

SEQ ID NO: 41144 - DNA, 15 bp, Artificial Sequence
  dgRNA
  Havcr1
tagcggagaggcctg

SEQ ID NO: 41145 - DNA, 15 bp, Artificial Sequence
  dgRNA
  Kcnab1
agcgaggtagttggc

SEQ ID NO: 41146 - DNA, 15 bp, Artificial Sequence
  dgRNA
  Kcnab1
gagaccacgggtccg

SEQ ID NO: 41147 - DNA, 15 bp, Artificial Sequence
  dgRNA
  Kcnab1
agaccacgggtccgc

SEQ ID NO: 41148 - DNA, 15 bp, Artificial Sequence
  dgRNA
  Kcnab1
gaccacgggtccgcg

SEQ ID NO: 41149 - DNA, 15 bp, Artificial Sequence
  dgRNA
  Tbc1d9
cgcagtgtccacgag

SEQ ID NO: 41150 - DNA, 15 bp, Artificial Sequence
  dgRNA
  Tbc1d9
cacgagcggtgatct

SEQ ID NO: 41151 - DNA, 15 bp, Artificial Sequence
  dgRNA
  Tbc1d9
acgagcggtgatctc

SEQ ID NO: 41152 - DNA, 15 bp, Artificial Sequence
  dgRNA
  Tbc1d9
cggtgatctcgggct

SEQ ID NO: 41153 - DNA, 15 bp, Artificial Sequence
  dgRNA
  Fdps
gcgccaccctttcat

SEQ ID NO: 41154 - DNA, 15 bp, Artificial Sequence
  dgRNA
  Fdps
tggccagccgtcaca

SEQ ID NO: 41155 - DNA, 15 bp, Artificial Sequence
  dgRNA
  Fdps
gcccatgctcacacg

SEQ ID NO: 41156 - DNA, 15 bp, Artificial Sequence
  dgRNA
  Fdps
gccaatcagcgaact

SEQ ID NO: 41157 - DNA, 15 bp, Artificial Sequence
  dgRNA
  Cldn34a
cagtttcgagaacaa

SEQ ID NO: 41158 - DNA, 15 bp, Artificial Sequence
  dgRNA
  Cldn34a
aactgacagtgcccc

SEQ ID NO: 41159 - DNA, 15 bp, Artificial Sequence
  dgRNA
  Cldn34a
ctcgaaactgttatt

SEQ ID NO: 41160 - DNA, 15 bp, Artificial Sequence
  dgRNA
  Cldn34a
tctcgaaactgttat

SEQ ID NO: 41161 - DNA, 15 bp, Artificial Sequence
  dgRNA
  Enpp3
cgctgtttgttaaca

SEQ ID NO: 41162 - DNA, 15 bp, Artificial Sequence
  dgRNA
  Enpp3
taatgcatactaatc

SEQ ID NO: 41163 - DNA, 15 bp, Artificial Sequence
  dgRNA
  Enpp3
ataatgcatactaat

SEQ ID NO: 41164 - DNA, 15 bp, Artificial Sequence
  dgRNA
  Enpp3
ctctctcggacattg

SEQ ID NO: 41165 - DNA, 15 bp, Artificial Sequence
  dgRNA
  Pip5k1c
tccgccctgtagtgc

SEQ ID NO: 41166 - DNA, 15 bp, Artificial Sequence
  dgRNA
  Pip5k1c
gccctgtagtgcagg

SEQ ID NO: 41167 - DNA, 15 bp, Artificial Sequence
  dgRNA
  Pip5k1c
gcgcttgttgttcag

SEQ ID NO: 41168 - DNA, 15 bp, Artificial Sequence
  dgRNA
  Pip5k1c
gcactacagggcgga

SEQ ID NO: 41169 - DNA, 15 bp, Artificial Sequence
  dgRNA
  Oca2
tgagcttgctacaca

SEQ ID NO: 41170 - DNA, 15 bp, Artificial Sequence
  dgRNA
  Oca2
tggaccattctcaag

SEQ ID NO: 41171 - DNA, 15 bp, Artificial Sequence
  dgRNA
  Oca2
gaccattctcaagag

SEQ ID NO: 41172 - DNA, 15 bp, Artificial Sequence
  dgRNA
  Oca2
ggcgtggccagcaca

SEQ ID NO: 41173 - DNA, 15 bp, Artificial Sequence
  dgRNA
  Zfp90
cagccccccactagg

SEQ ID NO: 41174 - DNA, 15 bp, Artificial Sequence
  dgRNA
  Zfp90
cccccactaggaggc

SEQ ID NO: 41175 - DNA, 15 bp, Artificial Sequence
  dgRNA
  Zfp90
cagggcgggcacgcg

SEQ ID NO: 41176 - DNA, 15 bp, Artificial Sequence
  dgRNA
  Zfp90
gcacgcgaggatagc

SEQ ID NO: 41177 - DNA, 15 bp, Artificial Sequence
  dgRNA
  Pip5k1b
cgaccagaggagcgg

SEQ ID NO: 41178 - DNA, 15 bp, Artificial Sequence
  dgRNA
  Pip5k1b
gaccagaggagcggc

SEQ ID NO: 41179 - DNA, 15 bp, Artificial Sequence
  dgRNA
  Pip5k1b
agcggcgggaaggaa

SEQ ID NO: 41180 - DNA, 15 bp, Artificial Sequence
  dgRNA
  Pip5k1b
cggggacacgcacac

SEQ ID NO: 41181 - DNA, 15 bp, Artificial Sequence
  dgRNA
  Stx2
aagccacgcagcgag

SEQ ID NO: 41182 - DNA, 15 bp, Artificial Sequence
  dgRNA
  Stx2
cagcgagaggacttt

SEQ ID NO: 41183 - DNA, 15 bp, Artificial Sequence
  dgRNA
  Stx2
agaggactttaggcc

SEQ ID NO: 41184 - DNA, 15 bp, Artificial Sequence
  dgRNA
  Stx2
cgcgacgacccgccc

SEQ ID NO: 41185 - DNA, 15 bp, Artificial Sequence
  dgRNA
  Olfr519
atcgtagattcagaa

SEQ ID NO: 41186 - DNA, 15 bp, Artificial Sequence
  dgRNA
  Olfr519
cagaatggtcctacg

SEQ ID NO: 41187 - DNA, 15 bp, Artificial Sequence
  dgRNA
  Olfr519
ccctaagaccaacat

SEQ ID NO: 41188 - DNA, 15 bp, Artificial Sequence
  dgRNA
  Olfr519
cctaagaccaacata

SEQ ID NO: 41189 - DNA, 15 bp, Artificial Sequence
  dgRNA
  Padi6
tgtgaacccttaaca

SEQ ID NO: 41190 - DNA, 15 bp, Artificial Sequence
  dgRNA
  Padi6
gtgaacccttaacaa

SEQ ID NO: 41191 - DNA, 15 bp, Artificial Sequence
  dgRNA
  Padi6
tgaacccttaacaag

SEQ ID NO: 41192 - DNA, 15 bp, Artificial Sequence
  dgRNA
  Padi6
gaacccttaacaagg

SEQ ID NO: 41193 - DNA, 15 bp, Artificial Sequence
  dgRNA
  Tm6sf1
tgggtggtatacacc

SEQ ID NO: 41194 - DNA, 15 bp, Artificial Sequence
  dgRNA
  Tm6sf1
gggtggtatacacca

SEQ ID NO: 41195 - DNA, 15 bp, Artificial Sequence
  dgRNA
  Tm6sf1
atatttcgccagaat

SEQ ID NO: 41196 - DNA, 15 bp, Artificial Sequence
  dgRNA
  Tm6sf1
aagtcctgccagtat

SEQ ID NO: 41197 - DNA, 15 bp, Artificial Sequence
  dgRNA
  Syngr4
gatggataggctgag

SEQ ID NO: 41198 - DNA, 15 bp, Artificial Sequence
  dgRNA
  Syngr4
gtgtcccgggaggta

SEQ ID NO: 41199 - DNA, 15 bp, Artificial Sequence
  dgRNA
  Syngr4
tttgggtgtcccggg

SEQ ID NO: 41200 - DNA, 15 bp, Artificial Sequence
  dgRNA
  Rab11b
cgtaacgtcacctag

SEQ ID NO: 41201 - DNA, 15 bp, Artificial Sequence
  dgRNA
  Rab11b
cccctacaggttcgc

SEQ ID NO: 41202 - DNA, 15 bp, Artificial Sequence
  dgRNA
  Rab11b
tacaggttcgctgga

SEQ ID NO: 41203 - DNA, 15 bp, Artificial Sequence
  dgRNA
  Rab11b
ctctaggtgacgtta

SEQ ID NO: 41204 - DNA, 15 bp, Artificial Sequence
  dgRNA
  Dpp9
tcccctagagtttca

SEQ ID NO: 41205 - DNA, 15 bp, Artificial Sequence
  dgRNA
  Dpp9
gagtttcacggacgt

SEQ ID NO: 41206 - DNA, 15 bp, Artificial Sequence
  dgRNA
  Dpp9
caacttccgggtcaa

SEQ ID NO: 41207 - DNA, 15 bp, Artificial Sequence
  dgRNA
  Dpp9
cttccgggtcaaagg

SEQ ID NO: 41208 - DNA, 15 bp, Artificial Sequence
  dgRNA
  Aip
atgctaaactggggc

SEQ ID NO: 41209 - DNA, 15 bp, Artificial Sequence
  dgRNA
  Aip
tgctaaactggggcc

SEQ ID NO: 41210 - DNA, 15 bp, Artificial Sequence
  dgRNA
  Aip
taaactggggccggg

SEQ ID NO: 41211 - DNA, 15 bp, Artificial Sequence
  dgRNA
  Aip
gccgggcggcgctca

SEQ ID NO: 41212 - DNA, 15 bp, Artificial Sequence
  dgRNA
  Lrp2bp
acctggcctgggcgc

SEQ ID NO: 41213 - DNA, 15 bp, Artificial Sequence
  dgRNA
  Lrp2bp
gcgctggctcctgat

SEQ ID NO: 41214 - DNA, 15 bp, Artificial Sequence
  dgRNA
  Lrp2bp
ttcattggatgagag

SEQ ID NO: 41215 - DNA, 15 bp, Artificial Sequence
  dgRNA
  Lrp2bp
acaggatactatttt

SEQ ID NO: 41216 - DNA, 15 bp, Artificial Sequence
  dgRNA
  Atp5k
tgggcgacagattcc

SEQ ID NO: 41217 - DNA, 15 bp, Artificial Sequence
  dgRNA
  Atp5k
gggcgacagattcca

SEQ ID NO: 41218 - DNA, 15 bp, Artificial Sequence
  dgRNA
  Atp5k
tcagtcattacacgc

SEQ ID NO: 41219 - DNA, 15 bp, Artificial Sequence
  dgRNA
  Atp5k
ggtgctgaagtaacg

SEQ ID NO: 41220 - DNA, 15 bp, Artificial Sequence
  dgRNA
  Cyp4a12b
attgctccccaaagg

SEQ ID NO: 41221 - DNA, 15 bp, Artificial Sequence
  dgRNA
  Rhov
gtccttgtaccttcg

SEQ ID NO: 41222 - DNA, 15 bp, Artificial Sequence
  dgRNA
  Rhov
taccttcgtggagcc

SEQ ID NO: 41223 - DNA, 15 bp, Artificial Sequence
  dgRNA
  Rhov
gaggctccaggtcgg

SEQ ID NO: 41224 - DNA, 15 bp, Artificial Sequence
  dgRNA
  Rhov
aggctccaggtcggt

SEQ ID NO: 41225 - DNA, 15 bp, Artificial Sequence
  dgRNA
  Wars
acacacggaagctct

SEQ ID NO: 41226 - DNA, 15 bp, Artificial Sequence
  dgRNA
  Wars
ggtccacccctacaa

SEQ ID NO: 41227 - DNA, 15 bp, Artificial Sequence
  dgRNA
  Wars
acccctacaacggtc

SEQ ID NO: 41228 - DNA, 15 bp, Artificial Sequence
  dgRNA
  Wars
gtccggccagcactc

SEQ ID NO: 41229 - DNA, 15 bp, Artificial Sequence
  dgRNA
  Edc3
tccgccctgtgtcaa

SEQ ID NO: 41230 - DNA, 15 bp, Artificial Sequence
  dgRNA
  Edc3
ttggggtaatgttaa

SEQ ID NO: 41231 - DNA, 15 bp, Artificial Sequence
  dgRNA
  Edc3
cttggggtaatgtta

SEQ ID NO: 41232 - DNA, 15 bp, Artificial Sequence
  dgRNA
  Edc3
acagggcggagccaa

SEQ ID NO: 41233 - DNA, 15 bp, Artificial Sequence
  dgRNA
  Olfr411
attaactacctctca

SEQ ID NO: 41234 - DNA, 15 bp, Artificial Sequence
  dgRNA
  Olfr411
acctctcatggtgtg

SEQ ID NO: 41235 - DNA, 15 bp, Artificial Sequence
  dgRNA
  Olfr411
ggggagaaatgtcta

SEQ ID NO: 41236 - DNA, 15 bp, Artificial Sequence
  dgRNA
  Olfr411
gccagtaagggctag

SEQ ID NO: 41237 - DNA, 15 bp, Artificial Sequence
  dgRNA
  Pknox2
ccgagcctccagtag

SEQ ID NO: 41238 - DNA, 15 bp, Artificial Sequence
  dgRNA
  Pknox2
cgagcctccagtaga

SEQ ID NO: 41239 - DNA, 15 bp, Artificial Sequence
  dgRNA
  Pknox2
tagcagctcctcgcc

SEQ ID NO: 41240 - DNA, 15 bp, Artificial Sequence
  dgRNA
  Pknox2
cgcctgggaagcggc

SEQ ID NO: 41241 - DNA, 15 bp, Artificial Sequence
  dgRNA
  Irgc1
acccacagcttgaag

SEQ ID NO: 41242 - DNA, 15 bp, Artificial Sequence
  dgRNA
  Irgc1
agcaatgcccaactt

SEQ ID NO: 41243 - DNA, 15 bp, Artificial Sequence
  dgRNA
  Irgc1
gcaatgcccaacttt

SEQ ID NO: 41244 - DNA, 15 bp, Artificial Sequence
  dgRNA
  Irgc1
tactgagccttactc

SEQ ID NO: 41245 - DNA, 15 bp, Artificial Sequence
  dgRNA
  Dagla
cctccctggcgctag

SEQ ID NO: 41246 - DNA, 15 bp, Artificial Sequence
  dgRNA
  Dagla
ctccctggcgctagg

SEQ ID NO: 41247 - DNA, 15 bp, Artificial Sequence
  dgRNA
  Dagla
ggcgctgccgcccca

SEQ ID NO: 41248 - DNA, 15 bp, Artificial Sequence
  dgRNA
  Dagla
ccacggccgtcgcca

SEQ ID NO: 41249 - DNA, 15 bp, Artificial Sequence
  dgRNA
  Sprr3
agcagccacaccata

SEQ ID NO: 41250 - DNA, 15 bp, Artificial Sequence
  dgRNA
  Sprr3
gcagccacaccataa

SEQ ID NO: 41251 - DNA, 15 bp, Artificial Sequence
  dgRNA
  Sprr3
gccacaccataaggg

SEQ ID NO: 41252 - DNA, 15 bp, Artificial Sequence
  dgRNA
  Sprr3
gtggacaatggaatc

SEQ ID NO: 41253 - DNA, 15 bp, Artificial Sequence
  dgRNA
  Usp47
tagcgcggcgtaccc

SEQ ID NO: 41254 - DNA, 15 bp, Artificial Sequence
  dgRNA
  Usp47
agcgcggcgtacccc

SEQ ID NO: 41255 - DNA, 15 bp, Artificial Sequence
  dgRNA
  Usp47
gcgcggcgtaccccg

SEQ ID NO: 41256 - DNA, 15 bp, Artificial Sequence
  dgRNA
  Usp47
atcccgagctcacga

SEQ ID NO: 41257 - DNA, 15 bp, Artificial Sequence
  dgRNA
  Piwil4
cggcaaggcgggggt

SEQ ID NO: 41258 - DNA, 15 bp, Artificial Sequence
  dgRNA
  Piwil4
ggcgcggcaaggcgg

SEQ ID NO: 41259 - DNA, 15 bp, Artificial Sequence
  dgRNA
  Piwil4
gggcgcggcaaggcg

SEQ ID NO: 41260 - DNA, 15 bp, Artificial Sequence
  dgRNA
  Piwil4
tgggcgcggcaaggc

SEQ ID NO: 41261 - DNA, 15 bp, Artificial Sequence
  dgRNA
  Mgll
agcccgccgcagacc

SEQ ID NO: 41262 - DNA, 15 bp, Artificial Sequence
  dgRNA
  Mgll
agacccggacccgcg

SEQ ID NO: 41263 - DNA, 15 bp, Artificial Sequence
  dgRNA
  Mgll
gacccgcgtggtgct

SEQ ID NO: 41264 - DNA, 15 bp, Artificial Sequence
  dgRNA
  Mgll
acccgcgtggtgctc

SEQ ID NO: 41265 - DNA, 15 bp, Artificial Sequence
  dgRNA
  Stk38l
ttccgcccgcgaagg

SEQ ID NO: 41266 - DNA, 15 bp, Artificial Sequence
  dgRNA
  Stk38l
tccgcccgcgaaggt

SEQ ID NO: 41267 - DNA, 15 bp, Artificial Sequence
  dgRNA
  Stk38l
ccgcccgcgaaggtg

SEQ ID NO: 41268 - DNA, 15 bp, Artificial Sequence
  dgRNA
  Stk38l
cgcccgcgaaggtgg

SEQ ID NO: 41269 - DNA, 15 bp, Artificial Sequence
  dgRNA
  Ppm1b
gttaccccagtaagt

SEQ ID NO: 41270 - DNA, 15 bp, Artificial Sequence
  dgRNA
  Ppm1b
ttaccccagtaagtc

SEQ ID NO: 41271 - DNA, 15 bp, Artificial Sequence
  dgRNA
  Ppm1b
tcggtccagaataaa

SEQ ID NO: 41272 - DNA, 15 bp, Artificial Sequence
  dgRNA
  Ppm1b
ctttaagtgcagtga

SEQ ID NO: 41273 - DNA, 15 bp, Artificial Sequence
  dgRNA
  Celsr2
agcgtgaacccgcag

SEQ ID NO: 41274 - DNA, 15 bp, Artificial Sequence
  dgRNA
  Celsr2
aacccgcagtggtcg

SEQ ID NO: 41275 - DNA, 15 bp, Artificial Sequence
  dgRNA
  Celsr2
gtggtcgcggcgact

SEQ ID NO: 41276 - DNA, 15 bp, Artificial Sequence
  dgRNA
  Celsr2
tggtcgcggcgactc

SEQ ID NO: 41277 - DNA, 15 bp, Artificial Sequence
  dgRNA
  Wfdc8
gatttgacctctccc

SEQ ID NO: 41278 - DNA, 15 bp, Artificial Sequence
  dgRNA
  Wfdc8
gggaaccgccagcag

SEQ ID NO: 41279 - DNA, 15 bp, Artificial Sequence
  dgRNA
  Tmem121
ctacgcaacagcctt

SEQ ID NO: 41280 - DNA, 15 bp, Artificial Sequence
  dgRNA
  Tmem121
aacagccttaggacc

SEQ ID NO: 41281 - DNA, 15 bp, Artificial Sequence
  dgRNA
  Tmem121
gggtcctctcttggc

SEQ ID NO: 41282 - DNA, 15 bp, Artificial Sequence
  dgRNA
  Tmem121
ggtcctctcttggct

SEQ ID NO: 41283 - DNA, 15 bp, Artificial Sequence
  dgRNA
  Ranbp9
ccaccgcatcgctcc

SEQ ID NO: 41284 - DNA, 15 bp, Artificial Sequence
  dgRNA
  Ranbp9
gtgcccgccagcgcc

SEQ ID NO: 41285 - DNA, 15 bp, Artificial Sequence
  dgRNA
  Ranbp9
gcgcccgcccgcggt

SEQ ID NO: 41286 - DNA, 15 bp, Artificial Sequence
  dgRNA
  Ranbp9
ctccgccgggccgcg

SEQ ID NO: 41287 - DNA, 15 bp, Artificial Sequence
  dgRNA
  Gm3411
cgggcgcgggcccac

SEQ ID NO: 41288 - DNA, 15 bp, Artificial Sequence
  dgRNA
  Gm3411
cgcgggcccacagga

SEQ ID NO: 41289 - DNA, 15 bp, Artificial Sequence
  dgRNA
  Pak3
aagctaggtcggaat

SEQ ID NO: 41290 - DNA, 15 bp, Artificial Sequence
  dgRNA
  Pak3
gcgtgcgtgcatccc

SEQ ID NO: 41291 - DNA, 15 bp, Artificial Sequence
  dgRNA
  Pak3
tgcatccccgggcca

SEQ ID NO: 41292 - DNA, 15 bp, Artificial Sequence
  dgRNA
  Pak3
gcatccccgggccat

SEQ ID NO: 41293 - DNA, 15 bp, Artificial Sequence
  dgRNA
  Olfr734
aatgtcgatattttg

SEQ ID NO: 41294 - DNA, 15 bp, Artificial Sequence
  dgRNA
  Olfr734
tattagctgccccaa

SEQ ID NO: 41295 - DNA, 15 bp, Artificial Sequence
  dgRNA
  Olfr734
attagctgccccaat

SEQ ID NO: 41296 - DNA, 15 bp, Artificial Sequence
  dgRNA
  Olfr734
agctgccccaatggg

SEQ ID NO: 41297 - DNA, 15 bp, Artificial Sequence
  dgRNA
  Eif4ebp2
ctccaacgtcacgtc

SEQ ID NO: 41298 - DNA, 15 bp, Artificial Sequence
  dgRNA
  Eif4ebp2
gccttcgaccgcttc

SEQ ID NO: 41299 - DNA, 15 bp, Artificial Sequence
  dgRNA
  Eif4ebp2
cggaggccggaggac

SEQ ID NO: 41300 - DNA, 15 bp, Artificial Sequence
  dgRNA
  Eif4ebp2
ggccggaggaccggg

SEQ ID NO: 41301 - DNA, 15 bp, Artificial Sequence
  dgRNA
  Kcnip2
aagagctttgcgggt

SEQ ID NO: 41302 - DNA, 15 bp, Artificial Sequence
  dgRNA
  Kcnip2
gcttatgacctgaaa

SEQ ID NO: 41303 - DNA, 15 bp, Artificial Sequence
  dgRNA
  Kcnip2
aaaggtgcgcctatg

SEQ ID NO: 41304 - DNA, 15 bp, Artificial Sequence
  dgRNA
  Kcnip2
caccacccactctaa

SEQ ID NO: 41305 - DNA, 15 bp, Artificial Sequence
  dgRNA
  Stra6l
agccgtcctggttta

SEQ ID NO: 41306 - DNA, 15 bp, Artificial Sequence
  dgRNA
  Stra6l
tcctggtttacggct

SEQ ID NO: 41307 - DNA, 15 bp, Artificial Sequence
  dgRNA
  Stra6l
tttatagctagccaa

SEQ ID NO: 41308 - DNA, 15 bp, Artificial Sequence
  dgRNA
  Stra6l
ggacggctggcttag

SEQ ID NO: 41309 - DNA, 15 bp, Artificial Sequence
  dgRNA
  Smim1
ggctcctgcggtctg

SEQ ID NO: 41310 - DNA, 15 bp, Artificial Sequence
  dgRNA
  Smim1
gctcctgcggtctgt

SEQ ID NO: 41311 - DNA, 15 bp, Artificial Sequence
  dgRNA
  Smim1
cgctcactcacctgc

SEQ ID NO: 41312 - DNA, 15 bp, Artificial Sequence
  dgRNA
  Smim1
gtgccaccagttcaa

SEQ ID NO: 41313 - DNA, 15 bp, Artificial Sequence
  dgRNA
  Rhoa
aggctccgccatgac

SEQ ID NO: 41314 - DNA, 15 bp, Artificial Sequence
  dgRNA
  Rhoa
tggccagcgccccac

SEQ ID NO: 41315 - DNA, 15 bp, Artificial Sequence
  dgRNA
  Rhoa
ggccagcgccccacc

SEQ ID NO: 41316 - DNA, 15 bp, Artificial Sequence
  dgRNA
  Rhoa
tactgcgcaagcgta

SEQ ID NO: 41317 - DNA, 15 bp, Artificial Sequence
  dgRNA
  Iws1
ccgaactcagagcca

SEQ ID NO: 41318 - DNA, 15 bp, Artificial Sequence
  dgRNA
  Iws1
cgaactcagagccaa

SEQ ID NO: 41319 - DNA, 15 bp, Artificial Sequence
  dgRNA
  Iws1
gcgacagaccaaacc

SEQ ID NO: 41320 - DNA, 15 bp, Artificial Sequence
  dgRNA
  Iws1
gaccaaacccggccg

SEQ ID NO: 41321 - DNA, 15 bp, Artificial Sequence
  dgRNA
  Fam180a
cagccaacttctcgc

SEQ ID NO: 41322 - DNA, 15 bp, Artificial Sequence
  dgRNA
  Fam180a
agccaacttctcgcc

SEQ ID NO: 41323 - DNA, 15 bp, Artificial Sequence
  dgRNA
  Fam180a
ctctaacaagttccg

SEQ ID NO: 41324 - DNA, 15 bp, Artificial Sequence
  dgRNA
  Fam180a
tctaacaagttccgc

SEQ ID NO: 41325 - DNA, 15 bp, Artificial Sequence
  dgRNA
  Pygm
agaccctcccacgtc

SEQ ID NO: 41326 - DNA, 15 bp, Artificial Sequence
  dgRNA
  Pygm
accctcccacgtccg

SEQ ID NO: 41327 - DNA, 15 bp, Artificial Sequence
  dgRNA
  Pygm
ctcccacgtccgggg

SEQ ID NO: 41328 - DNA, 15 bp, Artificial Sequence
  dgRNA
  Pygm
acgtccggggaggcg

SEQ ID NO: 41329 - DNA, 15 bp, Artificial Sequence
  dgRNA
  AA467197
ctttcactcaggtct

SEQ ID NO: 41330 - DNA, 15 bp, Artificial Sequence
  dgRNA
  AA467197
aacctcccagacgtt

SEQ ID NO: 41331 - DNA, 15 bp, Artificial Sequence
  dgRNA
  AA467197
ctcccagacgtttgg

SEQ ID NO: 41332 - DNA, 15 bp, Artificial Sequence
  dgRNA
  AA467197
gcgatggtcgaccgc

SEQ ID NO: 41333 - DNA, 15 bp, Artificial Sequence
  dgRNA
  Neurod1
gaatggagcgctccg

SEQ ID NO: 41334 - DNA, 15 bp, Artificial Sequence
  dgRNA
  Neurod1
ccgcggcatacaaat

SEQ ID NO: 41335 - DNA, 15 bp, Artificial Sequence
  dgRNA
  Neurod1
ggcatacaaataggc

SEQ ID NO: 41336 - DNA, 15 bp, Artificial Sequence
  dgRNA
  Neurod1
aataggcaggtcacg

SEQ ID NO: 41337 - DNA, 15 bp, Artificial Sequence
  dgRNA
  Uhrf1
gacaattgaatctcg

SEQ ID NO: 41338 - DNA, 15 bp, Artificial Sequence
  dgRNA
  Uhrf1
cgacaattgaatctc

SEQ ID NO: 41339 - DNA, 15 bp, Artificial Sequence
  dgRNA
  Nkx2-9
acaatcgctaatacc

SEQ ID NO: 41340 - DNA, 15 bp, Artificial Sequence
  dgRNA
  Nkx2-9
gcttcctgcgacctc

SEQ ID NO: 41341 - DNA, 15 bp, Artificial Sequence
  dgRNA
  Nkx2-9
cttcctgcgacctct

SEQ ID NO: 41342 - DNA, 15 bp, Artificial Sequence
  dgRNA
  Nkx2-9
gaggtagtcttgcag

SEQ ID NO: 41343 - DNA, 15 bp, Artificial Sequence
  dgRNA
  Mterf3
accctccccacatta

SEQ ID NO: 41344 - DNA, 15 bp, Artificial Sequence
  dgRNA
  Mterf3
ctccccacattacgg

SEQ ID NO: 41345 - DNA, 15 bp, Artificial Sequence
  dgRNA
  Mterf3
cggagtgactgatcc

SEQ ID NO: 41346 - DNA, 15 bp, Artificial Sequence
  dgRNA
  Mterf3
ggagtgactgatcct

SEQ ID NO: 41347 - DNA, 15 bp, Artificial Sequence
  dgRNA
  Gmps
tctattgcccagact

SEQ ID NO: 41348 - DNA, 15 bp, Artificial Sequence
  dgRNA
  Gmps
ctattgcccagactg

SEQ ID NO: 41349 - DNA, 15 bp, Artificial Sequence
  dgRNA
  Gmps
tattgcccagactgg

SEQ ID NO: 41350 - DNA, 15 bp, Artificial Sequence
  dgRNA
  Gmps
cctttctggtaggtt

SEQ ID NO: 41351 - DNA, 15 bp, Artificial Sequence
  dgRNA
  Arf1
gtgcgcacgcgccgg

SEQ ID NO: 41352 - DNA, 15 bp, Artificial Sequence
  dgRNA
  Arf1
acgcgccggcggaca

SEQ ID NO: 41353 - DNA, 15 bp, Artificial Sequence
  dgRNA
  Arf1
tgctcgttctagtgc

SEQ ID NO: 41354 - DNA, 15 bp, Artificial Sequence
  dgRNA
  Arf1
gctcgttctagtgcc

SEQ ID NO: 41355 - DNA, 15 bp, Artificial Sequence
  dgRNA
  Ffar2
gtaacggagatggtg

SEQ ID NO: 41356 - DNA, 15 bp, Artificial Sequence
  dgRNA
  Ffar2
ggacccatggagact

SEQ ID NO: 41357 - DNA, 15 bp, Artificial Sequence
  dgRNA
  Ffar2
aggttcctggtcacg

SEQ ID NO: 41358 - DNA, 15 bp, Artificial Sequence
  dgRNA
  Ffar2
ggttcctggtcacgt

SEQ ID NO: 41359 - DNA, 15 bp, Artificial Sequence
  dgRNA
  Hmha1
gctaatgcctggatc

SEQ ID NO: 41360 - DNA, 15 bp, Artificial Sequence
  dgRNA
  Hmha1
aatgcctggatcggg

SEQ ID NO: 41361 - DNA, 15 bp, Artificial Sequence
  dgRNA
  Hmha1
atcgggtggccacac

SEQ ID NO: 41362 - DNA, 15 bp, Artificial Sequence
  dgRNA
  Hmha1
ctgggggcggatctg

SEQ ID NO: 41363 - DNA, 15 bp, Artificial Sequence
  dgRNA
  Asphd1
cttcttttcgcattg

SEQ ID NO: 41364 - DNA, 15 bp, Artificial Sequence
  dgRNA
  Asphd1
ttcttttcgcattgc

SEQ ID NO: 41365 - DNA, 15 bp, Artificial Sequence
  dgRNA
  Asphd1
tcttttcgcattgcg

SEQ ID NO: 41366 - DNA, 15 bp, Artificial Sequence
  dgRNA
  Asphd1
tttcgcattgcgggg

SEQ ID NO: 41367 - DNA, 15 bp, Artificial Sequence
  dgRNA
  Zfp180
cctcactcgagttcg

SEQ ID NO: 41368 - DNA, 15 bp, Artificial Sequence
  dgRNA
  Zfp180
cgaggcctcgcccct

SEQ ID NO: 41369 - DNA, 15 bp, Artificial Sequence
  dgRNA
  Zfp180
agccgctgagagttc

SEQ ID NO: 41370 - DNA, 15 bp, Artificial Sequence
  dgRNA
  Zfp180
taaccccctacttcc

SEQ ID NO: 41371 - DNA, 15 bp, Artificial Sequence
  dgRNA
  Klk1b1
ctacttgcaccatcc

SEQ ID NO: 41372 - DNA, 15 bp, Artificial Sequence
  dgRNA
  Map3k10
gaacgggtctcctgc

SEQ ID NO: 41373 - DNA, 15 bp, Artificial Sequence
  dgRNA
  Map3k10
aacgggtctcctgca

SEQ ID NO: 41374 - DNA, 15 bp, Artificial Sequence
  dgRNA
  Map3k10
ttcattcgccctgat

SEQ ID NO: 41375 - DNA, 15 bp, Artificial Sequence
  dgRNA
  Map3k10
ccctgataggagata

SEQ ID NO: 41376 - DNA, 15 bp, Artificial Sequence
  dgRNA
  Egr2
cgggtggttgtccac

SEQ ID NO: 41377 - DNA, 15 bp, Artificial Sequence
  dgRNA
  Egr2
gctgcaaatcgttcc

SEQ ID NO: 41378 - DNA, 15 bp, Artificial Sequence
  dgRNA
  Egr2
tcctggcgagctcag

SEQ ID NO: 41379 - DNA, 15 bp, Artificial Sequence
  dgRNA
  Egr2
agcccgtatgcaaat

SEQ ID NO: 41380 - DNA, 15 bp, Artificial Sequence
  dgRNA
  Lrmp
gcaatatgaaactca

SEQ ID NO: 41381 - DNA, 15 bp, Artificial Sequence
  dgRNA
  Lrmp
ttcaattgtcccagg

SEQ ID NO: 41382 - DNA, 15 bp, Artificial Sequence
  dgRNA
  Lrmp
ctttagcctgcgcag

SEQ ID NO: 41383 - DNA, 15 bp, Artificial Sequence
  dgRNA
  Lrmp
gaagtgcagggcgca

SEQ ID NO: 41384 - DNA, 15 bp, Artificial Sequence
  dgRNA
  Fam110b
agagcatcaaggctt

SEQ ID NO: 41385 - DNA, 15 bp, Artificial Sequence
  dgRNA
  Fam110b
gggcgtggggctgat

SEQ ID NO: 41386 - DNA, 15 bp, Artificial Sequence
  dgRNA
  Fam110b
gggccaaggcgcagg

SEQ ID NO: 41387 - DNA, 15 bp, Artificial Sequence
  dgRNA
  Fam110b
ggccaaggcgcaggt

SEQ ID NO: 41388 - DNA, 15 bp, Artificial Sequence
  dgRNA
  Gnaz
cctgtctgtcgttat

SEQ ID NO: 41389 - DNA, 15 bp, Artificial Sequence
  dgRNA
  Gnaz
tactcgcacgtccgt

SEQ ID NO: 41390 - DNA, 15 bp, Artificial Sequence
  dgRNA
  Gnaz
gcagttatcgcccaa

SEQ ID NO: 41391 - DNA, 15 bp, Artificial Sequence
  dgRNA
  Gnaz
caatggaaaacgagc

SEQ ID NO: 41392 - DNA, 15 bp, Artificial Sequence
  dgRNA
  Glmn
cggcagagtcagcca

SEQ ID NO: 41393 - DNA, 15 bp, Artificial Sequence
  dgRNA
  Glmn
aaatgcggtcagaag

SEQ ID NO: 41394 - DNA, 15 bp, Artificial Sequence
  dgRNA
  Glmn
atgcggtcagaagag

SEQ ID NO: 41395 - DNA, 15 bp, Artificial Sequence
  dgRNA
  Glmn
tcctcacgcttcgcc

SEQ ID NO: 41396 - DNA, 15 bp, Artificial Sequence
  dgRNA
  Nobox
gtacccttggctcac

SEQ ID NO: 41397 - DNA, 15 bp, Artificial Sequence
  dgRNA
  Nobox
tacccttggctcaca

SEQ ID NO: 41398 - DNA, 15 bp, Artificial Sequence
  dgRNA
  Nobox
tgcggtgcctcgccc

SEQ ID NO: 41399 - DNA, 15 bp, Artificial Sequence
  dgRNA
  Nobox
gcggtgcctcgccct

SEQ ID NO: 41400 - DNA, 15 bp, Artificial Sequence
  dgRNA
  Slc2a9
acttgggcgtgactc

SEQ ID NO: 41401 - DNA, 15 bp, Artificial Sequence
  dgRNA
  Slc2a9
cttgggcgtgactcc

SEQ ID NO: 41402 - DNA, 15 bp, Artificial Sequence
  dgRNA
  Slc2a9
ttgggcgtgactccg

SEQ ID NO: 41403 - DNA, 15 bp, Artificial Sequence
  dgRNA
  Slc2a9
gctcgcttcctgttc

SEQ ID NO: 41404 - DNA, 15 bp, Artificial Sequence
  dgRNA
  Gm5464
catccgcttcgcgag

SEQ ID NO: 41405 - DNA, 15 bp, Artificial Sequence
  dgRNA
  Gm5464
gaggcgctcactgat

SEQ ID NO: 41406 - DNA, 15 bp, Artificial Sequence
  dgRNA
  Gm5464
gattggtcagaatcg

SEQ ID NO: 41407 - DNA, 15 bp, Artificial Sequence
  dgRNA
  Gm5464
attggtcagaatcgt

SEQ ID NO: 41408 - DNA, 15 bp, Artificial Sequence
  dgRNA
  Flii
cctccacgttccgac

SEQ ID NO: 41409 - DNA, 15 bp, Artificial Sequence
  dgRNA
  Flii
gttccgacaggagac

SEQ ID NO: 41410 - DNA, 15 bp, Artificial Sequence
  dgRNA
  Flii
gttgatcatctccag

SEQ ID NO: 41411 - DNA, 15 bp, Artificial Sequence
  dgRNA
  Flii
cagcgggacccctac

SEQ ID NO: 41412 - DNA, 15 bp, Artificial Sequence
  dgRNA
  Sp1
tcaccctccctcatt

SEQ ID NO: 41413 - DNA, 15 bp, Artificial Sequence
  dgRNA
  Sp1
ctccctcattgggcg

SEQ ID NO: 41414 - DNA, 15 bp, Artificial Sequence
  dgRNA
  Sp1
gcggggcagtagata

SEQ ID NO: 41415 - DNA, 15 bp, Artificial Sequence
  dgRNA
  Sp1
cggggcagtagataa

SEQ ID NO: 41416 - DNA, 15 bp, Artificial Sequence
  dgRNA
  Naca
ccaaaacttaaacct

SEQ ID NO: 41417 - DNA, 15 bp, Artificial Sequence
  dgRNA
  Naca
caacgatgcgaacac

SEQ ID NO: 41418 - DNA, 15 bp, Artificial Sequence
  dgRNA
  Naca
ctctgtgacgttccc

SEQ ID NO: 41419 - DNA, 15 bp, Artificial Sequence
  dgRNA
  Naca
gctcggttctctcca

SEQ ID NO: 41420 - DNA, 15 bp, Artificial Sequence
  dgRNA
  Nxph4
gtccagggtgtgtca

SEQ ID NO: 41421 - DNA, 15 bp, Artificial Sequence
  dgRNA
  Nxph4
ttgcccccagctggg

SEQ ID NO: 41422 - DNA, 15 bp, Artificial Sequence
  dgRNA
  Nxph4
gggattggagcaccg

SEQ ID NO: 41423 - DNA, 15 bp, Artificial Sequence
  dgRNA
  Nxph4
ctcccgcccagctgg

SEQ ID NO: 41424 - DNA, 15 bp, Artificial Sequence
  dgRNA
  Ap2s1
tttggtactcgcatt

SEQ ID NO: 41425 - DNA, 15 bp, Artificial Sequence
  dgRNA
  Ap2s1
tcgcatttggcgact

SEQ ID NO: 41426 - DNA, 15 bp, Artificial Sequence
  dgRNA
  Ap2s1
actaggtctcttgat

SEQ ID NO: 41427 - DNA, 15 bp, Artificial Sequence
  dgRNA
  Ap2s1
agtcgcagagcatgc

SEQ ID NO: 41428 - DNA, 15 bp, Artificial Sequence
  dgRNA
  Ptges3
cccgcgagcgtgctc

SEQ ID NO: 41429 - DNA, 15 bp, Artificial Sequence
  dgRNA
  Ptges3
gcgagcgtgctcagg

SEQ ID NO: 41430 - DNA, 15 bp, Artificial Sequence
  dgRNA
  Ptges3
gcgtgctcaggcggt

SEQ ID NO: 41431 - DNA, 15 bp, Artificial Sequence
  dgRNA
  Ptges3
tgctcaggcggttgg

SEQ ID NO: 41432 - DNA, 15 bp, Artificial Sequence
  dgRNA
  Usp1
tcctgcgcgccagcc

SEQ ID NO: 41433 - DNA, 15 bp, Artificial Sequence
  dgRNA
  Usp1
gcgcgcgcctctgcg

SEQ ID NO: 41434 - DNA, 15 bp, Artificial Sequence
  dgRNA
  Usp1
actgcagaacccgtt

SEQ ID NO: 41435 - DNA, 15 bp, Artificial Sequence
  dgRNA
  Usp1
gaacccgttaggccc

SEQ ID NO: 41436 - DNA, 15 bp, Artificial Sequence
  dgRNA
  Map4k2
tctgcacctgtagcg

SEQ ID NO: 41437 - DNA, 15 bp, Artificial Sequence
  dgRNA
  Map4k2
tagcgcggcgagaat

SEQ ID NO: 41438 - DNA, 15 bp, Artificial Sequence
  dgRNA
  Map4k2
agcgcggcgagaatt

SEQ ID NO: 41439 - DNA, 15 bp, Artificial Sequence
  dgRNA
  Map4k2
gcggcgagaattggg

SEQ ID NO: 41440 - DNA, 15 bp, Artificial Sequence
  dgRNA
  4921507P07Rik
gttgaagcggaaacg

SEQ ID NO: 41441 - DNA, 15 bp, Artificial Sequence
  dgRNA
  4921507P07Rik
gaagcggaaacgcgg

SEQ ID NO: 41442 - DNA, 15 bp, Artificial Sequence
  dgRNA
  4921507P07Rik
ctccccgccacacgt

SEQ ID NO: 41443 - DNA, 15 bp, Artificial Sequence
  dgRNA
  4921507P07Rik
cagcgccccaccctc

SEQ ID NO: 41444 - DNA, 15 bp, Artificial Sequence
  dgRNA
  Lmod1
gctctgtactaaatt

SEQ ID NO: 41445 - DNA, 15 bp, Artificial Sequence
  dgRNA
  Lmod1
cgctccaagattccc

SEQ ID NO: 41446 - DNA, 15 bp, Artificial Sequence
  dgRNA
  Lmod1
acagctctgaccgtg

SEQ ID NO: 41447 - DNA, 15 bp, Artificial Sequence
  dgRNA
  Lmod1
ctctgaccgtgaggc

SEQ ID NO: 41448 - DNA, 15 bp, Artificial Sequence
  dgRNA
  Amigo1
cacgctcgctagctc

SEQ ID NO: 41449 - DNA, 15 bp, Artificial Sequence
  dgRNA
  Amigo1
acgctcgctagctct

SEQ ID NO: 41450 - DNA, 15 bp, Artificial Sequence
  dgRNA
  Amigo1
agcccgggatggcag

SEQ ID NO: 41451 - DNA, 15 bp, Artificial Sequence
  dgRNA
  Amigo1
acccccgactgcagc

SEQ ID NO: 41452 - DNA, 15 bp, Artificial Sequence
  dgRNA
  Cd79b
agctgccctcccata

SEQ ID NO: 41453 - DNA, 15 bp, Artificial Sequence
  dgRNA
  Cd79b
ccatagggtccctgg

SEQ ID NO: 41454 - DNA, 15 bp, Artificial Sequence
  dgRNA
  Cd79b
gggtctcaatttgca

SEQ ID NO: 41455 - DNA, 15 bp, Artificial Sequence
  dgRNA
  Cd79b
aggaaggggcctaat

SEQ ID NO: 41456 - DNA, 15 bp, Artificial Sequence
  dgRNA
  Ica1l
gagcaagcgacaccc

SEQ ID NO: 41457 - DNA, 15 bp, Artificial Sequence
  dgRNA
  Ica1l
agcaagcgacaccca

SEQ ID NO: 41458 - DNA, 15 bp, Artificial Sequence
  dgRNA
  Ica1l
gacacccagggcgcg

SEQ ID NO: 41459 - DNA, 15 bp, Artificial Sequence
  dgRNA
  Ica1l
ggcgcgcggcctccg

SEQ ID NO: 41460 - DNA, 15 bp, Artificial Sequence
  dgRNA
  Fam47c
ttttgcccattctag

SEQ ID NO: 41461 - DNA, 15 bp, Artificial Sequence
  dgRNA
  Fam47c
ggaattttagctacg

SEQ ID NO: 41462 - DNA, 15 bp, Artificial Sequence
  dgRNA
  Fam47c
gctccactggactag

SEQ ID NO: 41463 - DNA, 15 bp, Artificial Sequence
  dgRNA
  Fam47c
tgctccactggacta

SEQ ID NO: 41464 - DNA, 15 bp, Artificial Sequence
  dgRNA
  Dpysl4
tccgcacaggtggac

SEQ ID NO: 41465 - DNA, 15 bp, Artificial Sequence
  dgRNA
  Dpysl4
ccgcacaggtggacc

SEQ ID NO: 41466 - DNA, 15 bp, Artificial Sequence
  dgRNA
  Dpysl4
cgcacaggtggaccg

SEQ ID NO: 41467 - DNA, 15 bp, Artificial Sequence
  dgRNA
  Dpysl4
tggaccggggtgcag

SEQ ID NO: 41468 - DNA, 15 bp, Artificial Sequence
  dgRNA
  Pdlim5
ccttggggcgaggcg

SEQ ID NO: 41469 - DNA, 15 bp, Artificial Sequence
  dgRNA
  Pdlim5
gcggaagttccccac

SEQ ID NO: 41470 - DNA, 15 bp, Artificial Sequence
  dgRNA
  Pdlim5
ccccaccggcttgag

SEQ ID NO: 41471 - DNA, 15 bp, Artificial Sequence
  dgRNA
  Pdlim5
cccaccggcttgaga

SEQ ID NO: 41472 - DNA, 15 bp, Artificial Sequence
  dgRNA
  Tfg
ggctgcccggaaaac

SEQ ID NO: 41473 - DNA, 15 bp, Artificial Sequence
  dgRNA
  Tfg
gaaaaccggaagtgc

SEQ ID NO: 41474 - DNA, 15 bp, Artificial Sequence
  dgRNA
  Tfg
catgcgtgtccgcct

SEQ ID NO: 41475 - DNA, 15 bp, Artificial Sequence
  dgRNA
  Tfg
cgcacttcctacact

SEQ ID NO: 41476 - DNA, 15 bp, Artificial Sequence
  dgRNA
  Adam28
aatagctcctaatag

SEQ ID NO: 41477 - DNA, 15 bp, Artificial Sequence
  dgRNA
  Adam28
cctgccatgccattg

SEQ ID NO: 41478 - DNA, 15 bp, Artificial Sequence
  dgRNA
  Adam28
ctattatagctcaag

SEQ ID NO: 41479 - DNA, 15 bp, Artificial Sequence
  dgRNA
  Adam28
ggcaggcggaagtcc

SEQ ID NO: 41480 - DNA, 15 bp, Artificial Sequence
  dgRNA
  Adck2
aggatttaagctacg

SEQ ID NO: 41481 - DNA, 15 bp, Artificial Sequence
  dgRNA
  Adck2
tacgaggctgtgaag

SEQ ID NO: 41482 - DNA, 15 bp, Artificial Sequence
  dgRNA
  Adck2
gcagacgcggaaaag

SEQ ID NO: 41483 - DNA, 15 bp, Artificial Sequence
  dgRNA
  Adck2
cagacgcggaaaaga

SEQ ID NO: 41484 - DNA, 15 bp, Artificial Sequence
  dgRNA
  Hipk4
caggattccggtcag

SEQ ID NO: 41485 - DNA, 15 bp, Artificial Sequence
  dgRNA
  Hipk4
aggattccggtcagc

SEQ ID NO: 41486 - DNA, 15 bp, Artificial Sequence
  dgRNA
  Hipk4
attccggtcagcggg

SEQ ID NO: 41487 - DNA, 15 bp, Artificial Sequence
  dgRNA
  Hipk4
ttccggtcagcgggt

SEQ ID NO: 41488 - DNA, 15 bp, Artificial Sequence
  dgRNA
  Mcu
tagaatttgcccgta

SEQ ID NO: 41489 - DNA, 15 bp, Artificial Sequence
  dgRNA
  Mcu
cccgtaaggtaactc

SEQ ID NO: 41490 - DNA, 15 bp, Artificial Sequence
  dgRNA
  Mcu
cagacagcccgaagc

SEQ ID NO: 41491 - DNA, 15 bp, Artificial Sequence
  dgRNA
  Mcu
agacagcccgaagcc

SEQ ID NO: 41492 - DNA, 15 bp, Artificial Sequence
  dgRNA
  Dbn1
ccggtgctggccagc

SEQ ID NO: 41493 - DNA, 15 bp, Artificial Sequence
  dgRNA
  Dbn1
gtgtgtgggacgccc

SEQ ID NO: 41494 - DNA, 15 bp, Artificial Sequence
  dgRNA
  Dbn1
tgtgtgggacgcccc

SEQ ID NO: 41495 - DNA, 15 bp, Artificial Sequence
  dgRNA
  Dbn1
gtgtgggacgccccg

SEQ ID NO: 41496 - DNA, 15 bp, Artificial Sequence
  dgRNA
  Mup5
atagcagacccatac

SEQ ID NO: 41497 - DNA, 15 bp, Artificial Sequence
  dgRNA
  Phka1
cgaaaataactcccc

SEQ ID NO: 41498 - DNA, 15 bp, Artificial Sequence
  dgRNA
  Phka1
gaaaataactccccc

SEQ ID NO: 41499 - DNA, 15 bp, Artificial Sequence
  dgRNA
  Phka1
aaaataactcccccg

SEQ ID NO: 41500 - DNA, 15 bp, Artificial Sequence
  dgRNA
  Phka1
aaataactcccccgg

SEQ ID NO: 41501 - DNA, 15 bp, Artificial Sequence
  dgRNA
  Mdfi
gcgtgcatgaggtga

SEQ ID NO: 41502 - DNA, 15 bp, Artificial Sequence
  dgRNA
  Mdfi
aggtagacttctgac

SEQ ID NO: 41503 - DNA, 15 bp, Artificial Sequence
  dgRNA
  Mdfi
ggtagacttctgacg

SEQ ID NO: 41504 - DNA, 15 bp, Artificial Sequence
  dgRNA
  Mdfi
gacttctgacggggt

SEQ ID NO: 41505 - DNA, 15 bp, Artificial Sequence
  dgRNA
  Tbc1d24
cctccccccggatcg

SEQ ID NO: 41506 - DNA, 15 bp, Artificial Sequence
  dgRNA
  Tbc1d24
ctccccccggatcgt

SEQ ID NO: 41507 - DNA, 15 bp, Artificial Sequence
  dgRNA
  Tbc1d24
agccccctcccgcgc

SEQ ID NO: 41508 - DNA, 15 bp, Artificial Sequence
  dgRNA
  Tbc1d24
ctggctgtcgggaca

SEQ ID NO: 41509 - DNA, 15 bp, Artificial Sequence
  dgRNA
  Il1rl1
ggcgggtgatttaat

SEQ ID NO: 41510 - DNA, 15 bp, Artificial Sequence
  dgRNA
  Il1rl1
atgacgttgtgctca

SEQ ID NO: 41511 - DNA, 15 bp, Artificial Sequence
  dgRNA
  Il1rl1
gctgatactgtcagg

SEQ ID NO: 41512 - DNA, 15 bp, Artificial Sequence
  dgRNA
  Il1rl1
ctgctgatactgtca

SEQ ID NO: 41513 - DNA, 15 bp, Artificial Sequence
  dgRNA
  Sco1
accgctatcagccgc

SEQ ID NO: 41514 - DNA, 15 bp, Artificial Sequence
  dgRNA
  Sco1
atcagccgccggacc

SEQ ID NO: 41515 - DNA, 15 bp, Artificial Sequence
  dgRNA
  Sco1
tcagccgccggaccc

SEQ ID NO: 41516 - DNA, 15 bp, Artificial Sequence
  dgRNA
  Sco1
caccaacgagccaag

SEQ ID NO: 41517 - DNA, 15 bp, Artificial Sequence
  dgRNA
  Hoxc6
tacttagtctcaact

SEQ ID NO: 41518 - DNA, 15 bp, Artificial Sequence
  dgRNA
  Hoxc6
ccctttcttgacatc

SEQ ID NO: 41519 - DNA, 15 bp, Artificial Sequence
  dgRNA
  Hoxc6
catctggcttgcgat

SEQ ID NO: 41520 - DNA, 15 bp, Artificial Sequence
  dgRNA
  Hoxc6
ttgcgattggctgga

SEQ ID NO: 41521 - DNA, 15 bp, Artificial Sequence
  dgRNA
  Slc22a3
aatcttttagccctg

SEQ ID NO: 41522 - DNA, 15 bp, Artificial Sequence
  dgRNA
  Slc22a3
cgccatcatcccacc

SEQ ID NO: 41523 - DNA, 15 bp, Artificial Sequence
  dgRNA
  Slc22a3
catcccacccggagc

SEQ ID NO: 41524 - DNA, 15 bp, Artificial Sequence
  dgRNA
  Slc22a3
ggaatgtgatgacgc

SEQ ID NO: 41525 - DNA, 15 bp, Artificial Sequence
  dgRNA
  Bmf
tacgtcccctgttcc

SEQ ID NO: 41526 - DNA, 15 bp, Artificial Sequence
  dgRNA
  Bmf
ttgtgttgtgcaagg

SEQ ID NO: 41527 - DNA, 15 bp, Artificial Sequence
  dgRNA
  Bmf
ggggcttagcacgtt

SEQ ID NO: 41528 - DNA, 15 bp, Artificial Sequence
  dgRNA
  Bmf
gcttagcacgttagg

SEQ ID NO: 41529 - DNA, 15 bp, Artificial Sequence
  dgRNA
  Minpp1
ctacctactagaaaa

SEQ ID NO: 41530 - DNA, 15 bp, Artificial Sequence
  dgRNA
  Minpp1
caggaatctttgaat

SEQ ID NO: 41531 - DNA, 15 bp, Artificial Sequence
  dgRNA
  Minpp1
ttgaatcggttcctg

SEQ ID NO: 41532 - DNA, 15 bp, Artificial Sequence
  dgRNA
  Minpp1
gaggcgccaagctgc

SEQ ID NO: 41533 - DNA, 15 bp, Artificial Sequence
  dgRNA
  Furin
aggagcctgcggtta

SEQ ID NO: 41534 - DNA, 15 bp, Artificial Sequence
  dgRNA
  Furin
aaagccccgtcacgc

SEQ ID NO: 41535 - DNA, 15 bp, Artificial Sequence
  dgRNA
  Furin
aagccccgtcacgct

SEQ ID NO: 41536 - DNA, 15 bp, Artificial Sequence
  dgRNA
  Furin
cctacagacaccact

SEQ ID NO: 41537 - DNA, 15 bp, Artificial Sequence
  dgRNA
  Bphl
aaggcacagcgggcc

SEQ ID NO: 41538 - DNA, 15 bp, Artificial Sequence
  dgRNA
  Bphl
cccgctgtgccttgc

SEQ ID NO: 41539 - DNA, 15 bp, Artificial Sequence
  dgRNA
  Bphl
tcgaagtcccgcccc

SEQ ID NO: 41540 - DNA, 15 bp, Artificial Sequence
  dgRNA
  Bphl
gcgcatgcgcccggc

SEQ ID NO: 41541 - DNA, 15 bp, Artificial Sequence
  dgRNA
  Kcnj16
accctagagcctacc

SEQ ID NO: 41542 - DNA, 15 bp, Artificial Sequence
  dgRNA
  Kcnj16
tggtttgaactcctc

SEQ ID NO: 41543 - DNA, 15 bp, Artificial Sequence
  dgRNA
  Kcnj16
ttccaatcaaggtta

SEQ ID NO: 41544 - DNA, 15 bp, Artificial Sequence
  dgRNA
  Kcnj16
tccaatcaaggttaa

SEQ ID NO: 41545 - DNA, 15 bp, Artificial Sequence
  dgRNA
  Bri3
tctccggccgtggcc

SEQ ID NO: 41546 - DNA, 15 bp, Artificial Sequence
  dgRNA
  Bri3
tccaagatccattgt

SEQ ID NO: 41547 - DNA, 15 bp, Artificial Sequence
  dgRNA
  Bri3
ccaagatccattgtg

SEQ ID NO: 41548 - DNA, 15 bp, Artificial Sequence
  dgRNA
  Bri3
gggcgggactgaacg

SEQ ID NO: 41549 - DNA, 15 bp, Artificial Sequence
  dgRNA
  Pfkfb2
cctatctacatcttg

SEQ ID NO: 41550 - DNA, 15 bp, Artificial Sequence
  dgRNA
  Pfkfb2
gataggatggatact

SEQ ID NO: 41551 - DNA, 15 bp, Artificial Sequence
  dgRNA
  Pfkfb2
ccacaagatgtagat

SEQ ID NO: 41552 - DNA, 15 bp, Artificial Sequence
  dgRNA
  Grid2ip
gggagtttacataca

SEQ ID NO: 41553 - DNA, 15 bp, Artificial Sequence
  dgRNA
  Grid2ip
tacatacacggcttg

SEQ ID NO: 41554 - DNA, 15 bp, Artificial Sequence
  dgRNA
  Grid2ip
acatacacggcttgt

SEQ ID NO: 41555 - DNA, 15 bp, Artificial Sequence
  dgRNA
  Grid2ip
ctgccattcaccccg

SEQ ID NO: 41556 - DNA, 15 bp, Artificial Sequence
  dgRNA
  Fkbp11
gcccctctttacagt

SEQ ID NO: 41557 - DNA, 15 bp, Artificial Sequence
  dgRNA
  Fkbp11
tccagccgtcgtcat

SEQ ID NO: 41558 - DNA, 15 bp, Artificial Sequence
  dgRNA
  Fkbp11
cgcgacctccatcac

SEQ ID NO: 41559 - DNA, 15 bp, Artificial Sequence
  dgRNA
  Fkbp11
ctccatcacaggtta

SEQ ID NO: 41560 - DNA, 15 bp, Artificial Sequence
  dgRNA
  Pdpr
acggaggacgttggc

SEQ ID NO: 41561 - DNA, 15 bp, Artificial Sequence
  dgRNA
  Pdpr
cactcgtcgtcaacc

SEQ ID NO: 41562 - DNA, 15 bp, Artificial Sequence
  dgRNA
  Pdpr
tcgtcgtcaaccagg

SEQ ID NO: 41563 - DNA, 15 bp, Artificial Sequence
  dgRNA
  Pdpr
tcgtcaaccaggcgg

SEQ ID NO: 41564 - DNA, 15 bp, Artificial Sequence
  dgRNA
  Pramel1
gattcaaaaaagcgt

SEQ ID NO: 41565 - DNA, 15 bp, Artificial Sequence
  dgRNA
  Pramel1
tcaaaaaagcgttgg

SEQ ID NO: 41566 - DNA, 15 bp, Artificial Sequence
  dgRNA
  Pramel1
aagcgttggaggagt

SEQ ID NO: 41567 - DNA, 15 bp, Artificial Sequence
  dgRNA
  Pramel1
gaaatcccgtgaaag

SEQ ID NO: 41568 - DNA, 15 bp, Artificial Sequence
  dgRNA
  Tmem26
ggccccagcatccgc

SEQ ID NO: 41569 - DNA, 15 bp, Artificial Sequence
  dgRNA
  Tmem26
catccgcaggaggat

SEQ ID NO: 41570 - DNA, 15 bp, Artificial Sequence
  dgRNA
  Tmem26
aaccccgagagagcc

SEQ ID NO: 41571 - DNA, 15 bp, Artificial Sequence
  dgRNA
  Tmem26
accccgagagagcct

SEQ ID NO: 41572 - DNA, 15 bp, Artificial Sequence
  dgRNA
  Notch4
aggaactcccccatt

SEQ ID NO: 41573 - DNA, 15 bp, Artificial Sequence
  dgRNA
  Notch4
cggcttccttttcac

SEQ ID NO: 41574 - DNA, 15 bp, Artificial Sequence
  dgRNA
  Notch4
gggtcagccaaatgg

SEQ ID NO: 41575 - DNA, 15 bp, Artificial Sequence
  dgRNA
  Notch4
ggggtcagccaaatg

SEQ ID NO: 41576 - DNA, 15 bp, Artificial Sequence
  dgRNA
  Mrpl4
tatcaataatggtaa

SEQ ID NO: 41577 - DNA, 15 bp, Artificial Sequence
  dgRNA
  Mrpl4
aatacgcagtgtagc

SEQ ID NO: 41578 - DNA, 15 bp, Artificial Sequence
  dgRNA
  Mrpl4
acgcagtgtagcagg

SEQ ID NO: 41579 - DNA, 15 bp, Artificial Sequence
  dgRNA
  Mrpl4
aaacgcttattagcc

SEQ ID NO: 41580 - DNA, 15 bp, Artificial Sequence
  dgRNA
  Ktn1
accaaggccgactgg

SEQ ID NO: 41581 - DNA, 15 bp, Artificial Sequence
  dgRNA
  Ktn1
atgaagggattccgc

SEQ ID NO: 41582 - DNA, 15 bp, Artificial Sequence
  dgRNA
  Ktn1
tgaagggattccgca

SEQ ID NO: 41583 - DNA, 15 bp, Artificial Sequence
  dgRNA
  Ktn1
gggacttccaggcgg

SEQ ID NO: 41584 - DNA, 15 bp, Artificial Sequence
  dgRNA
  Prom1
tccaagcagcgattt

SEQ ID NO: 41585 - DNA, 15 bp, Artificial Sequence
  dgRNA
  Prom1
cagcgatttaggatt

SEQ ID NO: 41586 - DNA, 15 bp, Artificial Sequence
  dgRNA
  Prom1
tagagaagggtgttc

SEQ ID NO: 41587 - DNA, 15 bp, Artificial Sequence
  dgRNA
  Prom1
aaatgctctgtcccg

SEQ ID NO: 41588 - DNA, 15 bp, Artificial Sequence
  dgRNA
  Podn
ttctcctcaggtgcg

SEQ ID NO: 41589 - DNA, 15 bp, Artificial Sequence
  dgRNA
  Podn
tctcctcaggtgcgg

SEQ ID NO: 41590 - DNA, 15 bp, Artificial Sequence
  dgRNA
  Podn
ctcctcaggtgcggg

SEQ ID NO: 41591 - DNA, 15 bp, Artificial Sequence
  dgRNA
  Podn
tgcggggggcctgcc

SEQ ID NO: 41592 - DNA, 15 bp, Artificial Sequence
  dgRNA
  Srcap
ctgtgacccggtcta

SEQ ID NO: 41593 - DNA, 15 bp, Artificial Sequence
  dgRNA
  Srcap
tgtgacccggtctat

SEQ ID NO: 41594 - DNA, 15 bp, Artificial Sequence
  dgRNA
  Srcap
cccggtctatgggat

SEQ ID NO: 41595 - DNA, 15 bp, Artificial Sequence
  dgRNA
  Srcap
ccggtctatgggatc

SEQ ID NO: 41596 - DNA, 15 bp, Artificial Sequence
  dgRNA
  Matk
ggccgcagcttgcct

SEQ ID NO: 41597 - DNA, 15 bp, Artificial Sequence
  dgRNA
  Matk
gtctccttcccggac

SEQ ID NO: 41598 - DNA, 15 bp, Artificial Sequence
  dgRNA
  Matk
agctgcggccctgcc

SEQ ID NO: 41599 - DNA, 15 bp, Artificial Sequence
  dgRNA
  Matk
ccgggaaggagacca

SEQ ID NO: 41600 - DNA, 15 bp, Artificial Sequence
  dgRNA
  Sdhaf2
tcccttccgcggcgc

SEQ ID NO: 41601 - DNA, 15 bp, Artificial Sequence
  dgRNA
  Sdhaf2
tccttccggccccgc

SEQ ID NO: 41602 - DNA, 15 bp, Artificial Sequence
  dgRNA
  Sdhaf2
gcgcgcccccgttac

SEQ ID NO: 41603 - DNA, 15 bp, Artificial Sequence
  dgRNA
  Sdhaf2
cgcgcccccgttacc

SEQ ID NO: 41604 - DNA, 15 bp, Artificial Sequence
  dgRNA
  Olfr459
tggtgcagttaacgt

SEQ ID NO: 41605 - DNA, 15 bp, Artificial Sequence
  dgRNA
  Olfr459
tgcagttaacgtagg

SEQ ID NO: 41606 - DNA, 15 bp, Artificial Sequence
  dgRNA
  Olfr459
aaaacccgaggatgg

SEQ ID NO: 41607 - DNA, 15 bp, Artificial Sequence
  dgRNA
  Olfr459
gaaaacccgaggatg

SEQ ID NO: 41608 - DNA, 15 bp, Artificial Sequence
  dgRNA
  Npbwr1
gagcttagtagcagc

SEQ ID NO: 41609 - DNA, 15 bp, Artificial Sequence
  dgRNA
  Npbwr1
agcttagtagcagcg

SEQ ID NO: 41610 - DNA, 15 bp, Artificial Sequence
  dgRNA
  Npbwr1
ggggaacgccccctc

SEQ ID NO: 41611 - DNA, 15 bp, Artificial Sequence
  dgRNA
  Npbwr1
cacagcttacatttc

SEQ ID NO: 41612 - DNA, 15 bp, Artificial Sequence
  dgRNA
  Fam45a
ctagacaaacgaaca

SEQ ID NO: 41613 - DNA, 15 bp, Artificial Sequence
  dgRNA
  Fam45a
gacctaagcgtagaa

SEQ ID NO: 41614 - DNA, 15 bp, Artificial Sequence
  dgRNA
  Fam45a
tgcaccctgccggaa

SEQ ID NO: 41615 - DNA, 15 bp, Artificial Sequence
  dgRNA
  Fam45a
cctgccggaagggac

SEQ ID NO: 41616 - DNA, 15 bp, Artificial Sequence
  dgRNA
  Bop1
cggcgcgctctcgct

SEQ ID NO: 41617 - DNA, 15 bp, Artificial Sequence
  dgRNA
  Bop1
ggcgcgctctcgcta

SEQ ID NO: 41618 - DNA, 15 bp, Artificial Sequence
  dgRNA
  Bop1
gtagcctctgtgcgc

SEQ ID NO: 41619 - DNA, 15 bp, Artificial Sequence
  dgRNA
  Bop1
ccctgcctactttgc

SEQ ID NO: 41620 - DNA, 15 bp, Artificial Sequence
  dgRNA
  Sirt4
gcgggcaatccgtag

SEQ ID NO: 41621 - DNA, 15 bp, Artificial Sequence
  dgRNA
  Sirt4
agcgcccaagaatct

SEQ ID NO: 41622 - DNA, 15 bp, Artificial Sequence
  dgRNA
  Sirt4
ccaagaatcttggcg

SEQ ID NO: 41623 - DNA, 15 bp, Artificial Sequence
  dgRNA
  Sirt4
caagaatcttggcgt

SEQ ID NO: 41624 - DNA, 15 bp, Artificial Sequence
  dgRNA
  Lig3
tcaagatttccgggt

SEQ ID NO: 41625 - DNA, 15 bp, Artificial Sequence
  dgRNA
  Lig3
gaacagcgacccacg

SEQ ID NO: 41626 - DNA, 15 bp, Artificial Sequence
  dgRNA
  Lig3
gacccacgtggcgac

SEQ ID NO: 41627 - DNA, 15 bp, Artificial Sequence
  dgRNA
  Lig3
ccacgtggcgaccgg

SEQ ID NO: 41628 - DNA, 15 bp, Artificial Sequence
  dgRNA
  Micall1
agggttgactcgatc

SEQ ID NO: 41629 - DNA, 15 bp, Artificial Sequence
  dgRNA
  Micall1
gttgactcgatctgg

SEQ ID NO: 41630 - DNA, 15 bp, Artificial Sequence
  dgRNA
  Micall1
ctcgatctggaggag

SEQ ID NO: 41631 - DNA, 15 bp, Artificial Sequence
  dgRNA
  Micall1
gggcgtccgcccttc

SEQ ID NO: 41632 - DNA, 15 bp, Artificial Sequence
  dgRNA
  Zfp637
ccaccgctcctccac

SEQ ID NO: 41633 - DNA, 15 bp, Artificial Sequence
  dgRNA
  Zfp637
cgctcctccacagga

SEQ ID NO: 41634 - DNA, 15 bp, Artificial Sequence
  dgRNA
  Zfp637
gtttctgccgcagct

SEQ ID NO: 41635 - DNA, 15 bp, Artificial Sequence
  dgRNA
  Zfp637
gccgcagctcggtcg

SEQ ID NO: 41636 - DNA, 15 bp, Artificial Sequence
  dgRNA
  Olfr420
gattgtacaccattg

SEQ ID NO: 41637 - DNA, 15 bp, Artificial Sequence
  dgRNA
  Olfr420
accacagaactatag

SEQ ID NO: 41638 - DNA, 15 bp, Artificial Sequence
  dgRNA
  Olfr420
tccactatagttctg

SEQ ID NO: 41639 - DNA, 15 bp, Artificial Sequence
  dgRNA
  Tmem186
ggacagtcgttaccg

SEQ ID NO: 41640 - DNA, 15 bp, Artificial Sequence
  dgRNA
  Tmem186
tcgttaccgcggtct

SEQ ID NO: 41641 - DNA, 15 bp, Artificial Sequence
  dgRNA
  Tmem186
cgttaccgcggtcta

SEQ ID NO: 41642 - DNA, 15 bp, Artificial Sequence
  dgRNA
  Tmem186
cggtctagggcagca

SEQ ID NO: 41643 - DNA, 15 bp, Artificial Sequence
  dgRNA
  Pum2
acgcacttcactgcg

SEQ ID NO: 41644 - DNA, 15 bp, Artificial Sequence
  dgRNA
  Pum2
cactgcgaggcgtcg

SEQ ID NO: 41645 - DNA, 15 bp, Artificial Sequence
  dgRNA
  Pum2
gcgaggcgtcgcggc

SEQ ID NO: 41646 - DNA, 15 bp, Artificial Sequence
  dgRNA
  Pum2
cgaggcgtcgcggct

SEQ ID NO: 41647 - DNA, 15 bp, Artificial Sequence
  dgRNA
  Id1
tactagtagatccag

SEQ ID NO: 41648 - DNA, 15 bp, Artificial Sequence
  dgRNA
  Id1
ttctgaacccgccct

SEQ ID NO: 41649 - DNA, 15 bp, Artificial Sequence
  dgRNA
  Id1
ggtagagcagctagt

SEQ ID NO: 41650 - DNA, 15 bp, Artificial Sequence
  dgRNA
  Id1
cttaggctgatggag

SEQ ID NO: 41651 - DNA, 15 bp, Artificial Sequence
  dgRNA
  Ipo11
actatcgattttctc

SEQ ID NO: 41652 - DNA, 15 bp, Artificial Sequence
  dgRNA
  Ipo11
ttttctccggaccta

SEQ ID NO: 41653 - DNA, 15 bp, Artificial Sequence
  dgRNA
  Ipo11
caggggcccctaagc

SEQ ID NO: 41654 - DNA, 15 bp, Artificial Sequence
  dgRNA
  Ipo11
gccggcgccttgctc

SEQ ID NO: 41655 - DNA, 15 bp, Artificial Sequence
  dgRNA
  Gdpd1
caacctcttgcctcg

SEQ ID NO: 41656 - DNA, 15 bp, Artificial Sequence
  dgRNA
  Gdpd1
cgaagcacctgcgcg

SEQ ID NO: 41657 - DNA, 15 bp, Artificial Sequence
  dgRNA
  Gdpd1
gaagcacctgcgcgt

SEQ ID NO: 41658 - DNA, 15 bp, Artificial Sequence
  dgRNA
  Gdpd1
ttgttgctcgggcgc

SEQ ID NO: 41659 - DNA, 15 bp, Artificial Sequence
  dgRNA
  Tollip
tgcgactgggtgagc

SEQ ID NO: 41660 - DNA, 15 bp, Artificial Sequence
  dgRNA
  Tollip
caggcttctgcccgc

SEQ ID NO: 41661 - DNA, 15 bp, Artificial Sequence
  dgRNA
  Tollip
cgcaggagagtgttc

SEQ ID NO: 41662 - DNA, 15 bp, Artificial Sequence
  dgRNA
  Tollip
tgctgagcgcccgaa

SEQ ID NO: 41663 - DNA, 15 bp, Artificial Sequence
  dgRNA
  Plgrkt
aggcaccggactccg

SEQ ID NO: 41664 - DNA, 15 bp, Artificial Sequence
  dgRNA
  Plgrkt
ccacgctgcttcctt

SEQ ID NO: 41665 - DNA, 15 bp, Artificial Sequence
  dgRNA
  Plgrkt
cttacaagaccatgc

SEQ ID NO: 41666 - DNA, 15 bp, Artificial Sequence
  dgRNA
  Plgrkt
gcaggttggaatttg

SEQ ID NO: 41667 - DNA, 15 bp, Artificial Sequence
  dgRNA
  Adnp2
gacccagggggtcca

SEQ ID NO: 41668 - DNA, 15 bp, Artificial Sequence
  dgRNA
  Adnp2
cacagcctcgaggcc

SEQ ID NO: 41669 - DNA, 15 bp, Artificial Sequence
  dgRNA
  Adnp2
acagcctcgaggcct

SEQ ID NO: 41670 - DNA, 15 bp, Artificial Sequence
  dgRNA
  Adnp2
cgggaaaagagccca

SEQ ID NO: 41671 - DNA, 15 bp, Artificial Sequence
  dgRNA
  St6gal2
aagtgagaatgcggg

SEQ ID NO: 41672 - DNA, 15 bp, Artificial Sequence
  dgRNA
  St6gal2
gcgggcggcttgagt

SEQ ID NO: 41673 - DNA, 15 bp, Artificial Sequence
  dgRNA
  St6gal2
gcgcccgacagtgca

SEQ ID NO: 41674 - DNA, 15 bp, Artificial Sequence
  dgRNA
  St6gal2
agcgcccgacagtgc

SEQ ID NO: 41675 - DNA, 15 bp, Artificial Sequence
  dgRNA
  Klhdc8a
cagcctgtcacgaac

SEQ ID NO: 41676 - DNA, 15 bp, Artificial Sequence
  dgRNA
  Klhdc8a
agcctgtcacgaact

SEQ ID NO: 41677 - DNA, 15 bp, Artificial Sequence
  dgRNA
  Klhdc8a
gtactgtagacaaac

SEQ ID NO: 41678 - DNA, 15 bp, Artificial Sequence
  dgRNA
  Klhdc8a
tactgtagacaaacc

SEQ ID NO: 41679 - DNA, 15 bp, Artificial Sequence
  dgRNA
  Hspd1
gcaagggggccgacg

SEQ ID NO: 41680 - DNA, 15 bp, Artificial Sequence
  dgRNA
  Hspd1
caagggggccgacgc

SEQ ID NO: 41681 - DNA, 15 bp, Artificial Sequence
  dgRNA
  Hspd1
gggggccgacgcggg

SEQ ID NO: 41682 - DNA, 15 bp, Artificial Sequence
  dgRNA
  Hspd1
gccgacgcgggcggc

SEQ ID NO: 41683 - DNA, 15 bp, Artificial Sequence
  dgRNA
  Cyb5r4
ggctgtgcgggggtt

SEQ ID NO: 41684 - DNA, 15 bp, Artificial Sequence
  dgRNA
  Cyb5r4
tcgcccggcttggga

SEQ ID NO: 41685 - DNA, 15 bp, Artificial Sequence
  dgRNA
  Cyb5r4
gtgagcccggtcgcc

SEQ ID NO: 41686 - DNA, 15 bp, Artificial Sequence
  dgRNA
  Cyb5r4
acgagaggcggggcg

SEQ ID NO: 41687 - DNA, 15 bp, Artificial Sequence
  dgRNA
  Gphb5
gaagtgaatcagttt

SEQ ID NO: 41688 - DNA, 15 bp, Artificial Sequence
  dgRNA
  Gphb5
tggcttcatactccg

SEQ ID NO: 41689 - DNA, 15 bp, Artificial Sequence
  dgRNA
  Gphb5
tcagtagttcctgta

SEQ ID NO: 41690 - DNA, 15 bp, Artificial Sequence
  dgRNA
  Gphb5
ggggtgacataatcc

SEQ ID NO: 41691 - DNA, 15 bp, Artificial Sequence
  dgRNA
  Slc25a33
ctttgaccagtttgc

SEQ ID NO: 41692 - DNA, 15 bp, Artificial Sequence
  dgRNA
  Slc25a33
cacctgccgtccaat

SEQ ID NO: 41693 - DNA, 15 bp, Artificial Sequence
  dgRNA
  Slc25a33
cgtccaataggcgta

SEQ ID NO: 41694 - DNA, 15 bp, Artificial Sequence
  dgRNA
  Slc25a33
gtccaataggcgtac

SEQ ID NO: 41695 - DNA, 15 bp, Artificial Sequence
  dgRNA
  Abracl
gtaagatactctgtc

SEQ ID NO: 41696 - DNA, 15 bp, Artificial Sequence
  dgRNA
  Abracl
agatgcattaggctg

SEQ ID NO: 41697 - DNA, 15 bp, Artificial Sequence
  dgRNA
  Abracl
gatgcattaggctgt

SEQ ID NO: 41698 - DNA, 15 bp, Artificial Sequence
  dgRNA
  Abracl
tgggtcctgacgagt

SEQ ID NO: 41699 - DNA, 15 bp, Artificial Sequence
  dgRNA
  Fam189a1
tatccgactcggccc

SEQ ID NO: 41700 - DNA, 15 bp, Artificial Sequence
  dgRNA
  Fam189a1
ccgactcggcccagg

SEQ ID NO: 41701 - DNA, 15 bp, Artificial Sequence
  dgRNA
  Fam189a1
actcggcccaggagg

SEQ ID NO: 41702 - DNA, 15 bp, Artificial Sequence
  dgRNA
  Fam189a1
gaggaggcaccaacg

SEQ ID NO: 41703 - DNA, 15 bp, Artificial Sequence
  dgRNA
  Tm4sf5
gagctgattgtacaa

SEQ ID NO: 41704 - DNA, 15 bp, Artificial Sequence
  dgRNA
  Tm4sf5
ggagctgattgtaca

SEQ ID NO: 41705 - DNA, 15 bp, Artificial Sequence
  dgRNA
  Tm4sf5
ggcagtaggcgctgc

SEQ ID NO: 41706 - DNA, 15 bp, Artificial Sequence
  dgRNA
  Tm4sf5
tggcagtaggcgctg

SEQ ID NO: 41707 - DNA, 15 bp, Artificial Sequence
  dgRNA
  Olfr493
gttgctgccagatca

SEQ ID NO: 41708 - DNA, 15 bp, Artificial Sequence
  dgRNA
  Mtpn
cacggccccgcccat

SEQ ID NO: 41709 - DNA, 15 bp, Artificial Sequence
  dgRNA
  Mtpn
ctgaggtaagcagtc

SEQ ID NO: 41710 - DNA, 15 bp, Artificial Sequence
  dgRNA
  Mtpn
tgaggtaagcagtcg

SEQ ID NO: 41711 - DNA, 15 bp, Artificial Sequence
  dgRNA
  Mtpn
ggtaagcagtcgggg

SEQ ID NO: 41712 - DNA, 15 bp, Artificial Sequence
  dgRNA
  Tmem11
taaaacctgactggg

SEQ ID NO: 41713 - DNA, 15 bp, Artificial Sequence
  dgRNA
  Tmem11
aggaaaaggcgtttt

SEQ ID NO: 41714 - DNA, 15 bp, Artificial Sequence
  dgRNA
  Tmem11
ggaaaaggcgtttta

SEQ ID NO: 41715 - DNA, 15 bp, Artificial Sequence
  dgRNA
  Tmem11
cagccgggcaagttc

SEQ ID NO: 41716 - DNA, 15 bp, Artificial Sequence
  dgRNA
  2410015M20Rik
actcaattctccgcg

SEQ ID NO: 41717 - DNA, 15 bp, Artificial Sequence
  dgRNA
  2410015M20Rik
ctcaattctccgcgc

SEQ ID NO: 41718 - DNA, 15 bp, Artificial Sequence
  dgRNA
  2410015M20Rik
ttctccgcgcgggcg

SEQ ID NO: 41719 - DNA, 15 bp, Artificial Sequence
  dgRNA
  2410015M20Rik
tctccgcgcgggcgc

SEQ ID NO: 41720 - DNA, 15 bp, Artificial Sequence
  dgRNA
  Vwc2
ctaggcagctgcgac

SEQ ID NO: 41721 - DNA, 15 bp, Artificial Sequence
  dgRNA
  Vwc2
agctgcgacaggcgg

SEQ ID NO: 41722 - DNA, 15 bp, Artificial Sequence
  dgRNA
  Vwc2
gctgcgacaggcggc

SEQ ID NO: 41723 - DNA, 15 bp, Artificial Sequence
  dgRNA
  Vwc2
caggcggcgggcgtg

SEQ ID NO: 41724 - DNA, 15 bp, Artificial Sequence
  dgRNA
  Scyl2
tcgggcttcctagcc

SEQ ID NO: 41725 - DNA, 15 bp, Artificial Sequence
  dgRNA
  Scyl2
cgggcttcctagcct

SEQ ID NO: 41726 - DNA, 15 bp, Artificial Sequence
  dgRNA
  Scyl2
ggggccccggaaagc

SEQ ID NO: 41727 - DNA, 15 bp, Artificial Sequence
  dgRNA
  Scyl2
tacggctgtcagcag

SEQ ID NO: 41728 - DNA, 15 bp, Artificial Sequence
  dgRNA
  Pla2r1
aagtttgagcactca

SEQ ID NO: 41729 - DNA, 15 bp, Artificial Sequence
  dgRNA
  Pla2r1
acccgtccccagtgt

SEQ ID NO: 41730 - DNA, 15 bp, Artificial Sequence
  dgRNA
  Pla2r1
cacccgtccccagtg

SEQ ID NO: 41731 - DNA, 15 bp, Artificial Sequence
  dgRNA
  Pla2r1
gctaaagcagcaccg

SEQ ID NO: 41732 - DNA, 15 bp, Artificial Sequence
  dgRNA
  Tec
gcgcttgccgagctc

SEQ ID NO: 41733 - DNA, 15 bp, Artificial Sequence
  dgRNA
  Tec
cgcttgccgagctcc

SEQ ID NO: 41734 - DNA, 15 bp, Artificial Sequence
  dgRNA
  Asb16
ctgttgaccaacaaa

SEQ ID NO: 41735 - DNA, 15 bp, Artificial Sequence
  dgRNA
  Asb16
tgttgaccaacaaaa

SEQ ID NO: 41736 - DNA, 15 bp, Artificial Sequence
  dgRNA
  Asb16
caaaagggtaccagc

SEQ ID NO: 41737 - DNA, 15 bp, Artificial Sequence
  dgRNA
  Asb16
taagatcatgactct

SEQ ID NO: 41738 - DNA, 15 bp, Artificial Sequence
  dgRNA
  Ddost
tggcgggagctagcc

SEQ ID NO: 41739 - DNA, 15 bp, Artificial Sequence
  dgRNA
  Ddost
ggcgggagctagcct

SEQ ID NO: 41740 - DNA, 15 bp, Artificial Sequence
  dgRNA
  Ddost
agctagcctgggcgg

SEQ ID NO: 41741 - DNA, 15 bp, Artificial Sequence
  dgRNA
  Ddost
ctgggcggaggcaaa

SEQ ID NO: 41742 - DNA, 15 bp, Artificial Sequence
  dgRNA
  Bag1
tcagttccgagggcg

SEQ ID NO: 41743 - DNA, 15 bp, Artificial Sequence
  dgRNA
  Bag1
ggcgtggcgagtaga

SEQ ID NO: 41744 - DNA, 15 bp, Artificial Sequence
  dgRNA
  Bag1
gcgtggcgagtagat

SEQ ID NO: 41745 - DNA, 15 bp, Artificial Sequence
  dgRNA
  Bag1
cgtggcgagtagatg

SEQ ID NO: 41746 - DNA, 15 bp, Artificial Sequence
  dgRNA
  Gtf3a
accttaagtcatgtc

SEQ ID NO: 41747 - DNA, 15 bp, Artificial Sequence
  dgRNA
  Gtf3a
tgtcaggttgatatt

SEQ ID NO: 41748 - DNA, 15 bp, Artificial Sequence
  dgRNA
  Gtf3a
gtcaggttgatattt

SEQ ID NO: 41749 - DNA, 15 bp, Artificial Sequence
  dgRNA
  Gtf3a
ggctgcctctcgccg

SEQ ID NO: 41750 - DNA, 15 bp, Artificial Sequence
  dgRNA
  Psd4
ttagcagcagccttc

SEQ ID NO: 41751 - DNA, 15 bp, Artificial Sequence
  dgRNA
  Psd4
gcagccttcgggtcc

SEQ ID NO: 41752 - DNA, 15 bp, Artificial Sequence
  dgRNA
  Psd4
ccctgcgtcacaagc

SEQ ID NO: 41753 - DNA, 15 bp, Artificial Sequence
  dgRNA
  Psd4
tgcgtcacaagctgg

SEQ ID NO: 41754 - DNA, 15 bp, Artificial Sequence
  dgRNA
  Prmt1
cagccaatatcaacg

SEQ ID NO: 41755 - DNA, 15 bp, Artificial Sequence
  dgRNA
  Prmt1
agccaatatcaacga

SEQ ID NO: 41756 - DNA, 15 bp, Artificial Sequence
  dgRNA
  Prmt1
caatatcaacgaggg

SEQ ID NO: 41757 - DNA, 15 bp, Artificial Sequence
  dgRNA
  Prmt1
tatcaacgagggagg

SEQ ID NO: 41758 - DNA, 15 bp, Artificial Sequence
  dgRNA
  Zfp280c
ggcatatatgcagtt

SEQ ID NO: 41759 - DNA, 15 bp, Artificial Sequence
  dgRNA
  Ablim3
cccgataccccctcc

SEQ ID NO: 41760 - DNA, 15 bp, Artificial Sequence
  dgRNA
  Ablim3
ggcaaaaagccctgc

SEQ ID NO: 41761 - DNA, 15 bp, Artificial Sequence
  dgRNA
  Ablim3
gcctcagacacgcgc

SEQ ID NO: 41762 - DNA, 15 bp, Artificial Sequence
  dgRNA
  Ablim3
gccggcgcgtccagc

SEQ ID NO: 41763 - DNA, 15 bp, Artificial Sequence
  dgRNA
  Fiz1
ttcgcaagatcgagc

SEQ ID NO: 41764 - DNA, 15 bp, Artificial Sequence
  dgRNA
  Fiz1
tcgcaagatcgagca

SEQ ID NO: 41765 - DNA, 15 bp, Artificial Sequence
  dgRNA
  Fiz1
cgcaagatcgagcag

SEQ ID NO: 41766 - DNA, 15 bp, Artificial Sequence
  dgRNA
  Fiz1
aagatcgagcagggg

SEQ ID NO: 41767 - DNA, 15 bp, Artificial Sequence
  dgRNA
  Olfr1105
acagatctcctataa

SEQ ID NO: 41768 - DNA, 15 bp, Artificial Sequence
  dgRNA
  Olfr1105
tataggagatctgta

SEQ ID NO: 41769 - DNA, 15 bp, Artificial Sequence
  dgRNA
  Gm362
tagaactgattccga

SEQ ID NO: 41770 - DNA, 15 bp, Artificial Sequence
  dgRNA
  Gm362
agaactgattccgaa

SEQ ID NO: 41771 - DNA, 15 bp, Artificial Sequence
  dgRNA
  Gm362
tgattccgaagggaa

SEQ ID NO: 41772 - DNA, 15 bp, Artificial Sequence
  dgRNA
  Gm362
gattccgaagggaaa

SEQ ID NO: 41773 - DNA, 15 bp, Artificial Sequence
  dgRNA
  Plod1
ccctcctcgcccact

SEQ ID NO: 41774 - DNA, 15 bp, Artificial Sequence
  dgRNA
  Plod1
agagcatggacggtc

SEQ ID NO: 41775 - DNA, 15 bp, Artificial Sequence
  dgRNA
  Plod1
tggacggtccggcat

SEQ ID NO: 41776 - DNA, 15 bp, Artificial Sequence
  dgRNA
  Plod1
ggacggtccggcatc

SEQ ID NO: 41777 - DNA, 15 bp, Artificial Sequence
  dgRNA
  Ogfrl1
ccctggccactcccg

SEQ ID NO: 41778 - DNA, 15 bp, Artificial Sequence
  dgRNA
  Ogfrl1
cactcccggggaccg

SEQ ID NO: 41779 - DNA, 15 bp, Artificial Sequence
  dgRNA
  Ogfrl1
tcccggggaccgtgg

SEQ ID NO: 41780 - DNA, 15 bp, Artificial Sequence
  dgRNA
  Ogfrl1
cccggggaccgtgga

SEQ ID NO: 41781 - DNA, 15 bp, Artificial Sequence
  dgRNA
  Trp53inp1
acccggagtgttctc

SEQ ID NO: 41782 - DNA, 15 bp, Artificial Sequence
  dgRNA
  Trp53inp1
tcccgctttgttgcc

SEQ ID NO: 41783 - DNA, 15 bp, Artificial Sequence
  dgRNA
  Trp53inp1
cccgctttgttgccc

SEQ ID NO: 41784 - DNA, 15 bp, Artificial Sequence
  dgRNA
  Trp53inp1
cgccggcccagtgcc

SEQ ID NO: 41785 - DNA, 15 bp, Artificial Sequence
  dgRNA
  Olfr418
tctttgactactaga

SEQ ID NO: 41786 - DNA, 15 bp, Artificial Sequence
  dgRNA
  Olfr418
tactagatggacagc

SEQ ID NO: 41787 - DNA, 15 bp, Artificial Sequence
  dgRNA
  Olfr418
gacatcgagtcagca

SEQ ID NO: 41788 - DNA, 15 bp, Artificial Sequence
  dgRNA
  Fdxr
tagacttccggcatc

SEQ ID NO: 41789 - DNA, 15 bp, Artificial Sequence
  dgRNA
  Fdxr
acttccggcatctgg

SEQ ID NO: 41790 - DNA, 15 bp, Artificial Sequence
  dgRNA
  Fdxr
gcatctggaggtact

SEQ ID NO: 41791 - DNA, 15 bp, Artificial Sequence
  dgRNA
  Fdxr
aggattggacgttct

SEQ ID NO: 41792 - DNA, 15 bp, Artificial Sequence
  dgRNA
  Skint8
agctcctagtctttt

SEQ ID NO: 41793 - DNA, 15 bp, Artificial Sequence
  dgRNA
  Skint8
tgctgaactacctac

SEQ ID NO: 41794 - DNA, 15 bp, Artificial Sequence
  dgRNA
  Skint8
agggttttcgaagcc

SEQ ID NO: 41795 - DNA, 15 bp, Artificial Sequence
  dgRNA
  Skint8
ttcaccgaaaagact

SEQ ID NO: 41796 - DNA, 15 bp, Artificial Sequence
  dgRNA
  Nlrp4a
aatggatagtggatc

SEQ ID NO: 41797 - DNA, 15 bp, Artificial Sequence
  dgRNA
  Nlrp4a
ctccgccatcaactc

SEQ ID NO: 41798 - DNA, 15 bp, Artificial Sequence
  dgRNA
  Nlrp4a
ttagcagcctaagtc

SEQ ID NO: 41799 - DNA, 15 bp, Artificial Sequence
  dgRNA
  Nlrp4a
tagcagcctaagtca

SEQ ID NO: 41800 - DNA, 15 bp, Artificial Sequence
  dgRNA
  Olfr651
ccactgtcatattga

SEQ ID NO: 41801 - DNA, 15 bp, Artificial Sequence
  dgRNA
  Olfr651
cactgtcatattgaa

SEQ ID NO: 41802 - DNA, 15 bp, Artificial Sequence
  dgRNA
  Olfr651
actgtcatattgaag

SEQ ID NO: 41803 - DNA, 15 bp, Artificial Sequence
  dgRNA
  Olfr651
gagcaagcaatctac

SEQ ID NO: 41804 - DNA, 15 bp, Artificial Sequence
  dgRNA
  Gm19668
tggtctcggctcatg

SEQ ID NO: 41805 - DNA, 15 bp, Artificial Sequence
  dgRNA
  Gm19668
aagccagtttatgac

SEQ ID NO: 41806 - DNA, 15 bp, Artificial Sequence
  dgRNA
  Gm19668
aggcgcccggccctg

SEQ ID NO: 41807 - DNA, 15 bp, Artificial Sequence
  dgRNA
  Gm19668
gaggcgcccggccct

SEQ ID NO: 41808 - DNA, 15 bp, Artificial Sequence
  dgRNA
  D10Jhu81e
ccggtctcttaggtg

SEQ ID NO: 41809 - DNA, 15 bp, Artificial Sequence
  dgRNA
  D10Jhu81e
cggtctcttaggtga

SEQ ID NO: 41810 - DNA, 15 bp, Artificial Sequence
  dgRNA
  D10Jhu81e
ggtctcttaggtgag

SEQ ID NO: 41811 - DNA, 15 bp, Artificial Sequence
  dgRNA
  D10Jhu81e
gtctcttaggtgagg

SEQ ID NO: 41812 - DNA, 15 bp, Artificial Sequence
  dgRNA
  Alg3
gccaatgaatcattt

SEQ ID NO: 41813 - DNA, 15 bp, Artificial Sequence
  dgRNA
  Alg3
agacttctggttact

SEQ ID NO: 41814 - DNA, 15 bp, Artificial Sequence
  dgRNA
  Alg3
cccagagcgtgagac

SEQ ID NO: 41815 - DNA, 15 bp, Artificial Sequence
  dgRNA
  Alg3
ctgttaattagactc

SEQ ID NO: 41816 - DNA, 15 bp, Artificial Sequence
  dgRNA
  Tpi1
gtttccctgagcgcg

SEQ ID NO: 41817 - DNA, 15 bp, Artificial Sequence
  dgRNA
  Tpi1
actgtcgagccactg

SEQ ID NO: 41818 - DNA, 15 bp, Artificial Sequence
  dgRNA
  Tpi1
tcgagccactgaggc

SEQ ID NO: 41819 - DNA, 15 bp, Artificial Sequence
  dgRNA
  Tpi1
tgaacctcgcgctca

SEQ ID NO: 41820 - DNA, 15 bp, Artificial Sequence
  dgRNA
  Olfr1383
ggtagaccacaatta

SEQ ID NO: 41821 - DNA, 15 bp, Artificial Sequence
  dgRNA
  Mblac2
cctgcgttactgcct

SEQ ID NO: 41822 - DNA, 15 bp, Artificial Sequence
  dgRNA
  Mblac2
agaagctgcggcaac

SEQ ID NO: 41823 - DNA, 15 bp, Artificial Sequence
  dgRNA
  Mblac2
gaagctgcggcaact

SEQ ID NO: 41824 - DNA, 15 bp, Artificial Sequence
  dgRNA
  Mblac2
aagctgcggcaactg

SEQ ID NO: 41825 - DNA, 15 bp, Artificial Sequence
  dgRNA
  Kif20b
ttgctactgccccat

SEQ ID NO: 41826 - DNA, 15 bp, Artificial Sequence
  dgRNA
  Kif20b
gccccatcggtcgcc

SEQ ID NO: 41827 - DNA, 15 bp, Artificial Sequence
  dgRNA
  Kif20b
gaaagccttttccgg

SEQ ID NO: 41828 - DNA, 15 bp, Artificial Sequence
  dgRNA
  Kif20b
agccttttccggagg

SEQ ID NO: 41829 - DNA, 15 bp, Artificial Sequence
  dgRNA
  Gabrq
tgactagtgctggtc

SEQ ID NO: 41830 - DNA, 15 bp, Artificial Sequence
  dgRNA
  Gabrq
actgcgcgcagcctg

SEQ ID NO: 41831 - DNA, 15 bp, Artificial Sequence
  dgRNA
  Gabrq
ctgcgcgcagcctga

SEQ ID NO: 41832 - DNA, 15 bp, Artificial Sequence
  dgRNA
  Gabrq
tgcgcgcagcctgag

SEQ ID NO: 41833 - DNA, 15 bp, Artificial Sequence
  dgRNA
  Pdgfra
acttcaacaacaacg

SEQ ID NO: 41834 - DNA, 15 bp, Artificial Sequence
  dgRNA
  Pdgfra
cttatgcaatcaggg

SEQ ID NO: 41835 - DNA, 15 bp, Artificial Sequence
  dgRNA
  Pdgfra
tcttatgcaatcagg

SEQ ID NO: 41836 - DNA, 15 bp, Artificial Sequence
  dgRNA
  Pdgfra
ctcttatgcaatcag

SEQ ID NO: 41837 - DNA, 15 bp, Artificial Sequence
  dgRNA
  Gse1
cccctcggtacttct

SEQ ID NO: 41838 - DNA, 15 bp, Artificial Sequence
  dgRNA
  Gse1
cacccagtagctaag

SEQ ID NO: 41839 - DNA, 15 bp, Artificial Sequence
  dgRNA
  Gse1
aagccgatttctcct

SEQ ID NO: 41840 - DNA, 15 bp, Artificial Sequence
  dgRNA
  Gse1
tttcgcctcgtcaat

SEQ ID NO: 41841 - DNA, 15 bp, Artificial Sequence
  dgRNA
  B3gnt7
gataaggtaacttta

SEQ ID NO: 41842 - DNA, 15 bp, Artificial Sequence
  dgRNA
  B3gnt7
agcaaccaggccgct

SEQ ID NO: 41843 - DNA, 15 bp, Artificial Sequence
  dgRNA
  B3gnt7
caggccgctaggcgc

SEQ ID NO: 41844 - DNA, 15 bp, Artificial Sequence
  dgRNA
  B3gnt7
aggccgctaggcgcc

SEQ ID NO: 41845 - DNA, 15 bp, Artificial Sequence
  dgRNA
  Rbm41
tgccgcacagattgc

SEQ ID NO: 41846 - DNA, 15 bp, Artificial Sequence
  dgRNA
  Rbm41
gccgcacagattgct

SEQ ID NO: 41847 - DNA, 15 bp, Artificial Sequence
  dgRNA
  Rbm41
atgaaggttggagcg

SEQ ID NO: 41848 - DNA, 15 bp, Artificial Sequence
  dgRNA
  Rbm41
gtgcggcagactcaa

SEQ ID NO: 41849 - DNA, 15 bp, Artificial Sequence
  dgRNA
  Hexb
acactacctgaagag

SEQ ID NO: 41850 - DNA, 15 bp, Artificial Sequence
  dgRNA
  Hexb
ttcctcaggcgtgac

SEQ ID NO: 41851 - DNA, 15 bp, Artificial Sequence
  dgRNA
  Hexb
gggccaatcccctct

SEQ ID NO: 41852 - DNA, 15 bp, Artificial Sequence
  dgRNA
  Hexb
ccaatcccctctcgg

SEQ ID NO: 41853 - DNA, 15 bp, Artificial Sequence
  dgRNA
  Vmn1r26
gattactttagagta

SEQ ID NO: 41854 - DNA, 15 bp, Artificial Sequence
  dgRNA
  Ttc23
ggaattttagatcag

SEQ ID NO: 41855 - DNA, 15 bp, Artificial Sequence
  dgRNA
  Ttc23
ttcaccaatagggag

SEQ ID NO: 41856 - DNA, 15 bp, Artificial Sequence
  dgRNA
  4833420G17Rik
tgtgacagtgtcgcc

SEQ ID NO: 41857 - DNA, 15 bp, Artificial Sequence
  dgRNA
  4833420G17Rik
gtcgcctggtaaaac

SEQ ID NO: 41858 - DNA, 15 bp, Artificial Sequence
  dgRNA
  4833420G17Rik
taaccctaatcccca

SEQ ID NO: 41859 - DNA, 15 bp, Artificial Sequence
  dgRNA
  4833420G17Rik
atccccacggaaact

SEQ ID NO: 41860 - DNA, 15 bp, Artificial Sequence
  dgRNA
  Hps5
acagccgctgcacgg

SEQ ID NO: 41861 - DNA, 15 bp, Artificial Sequence
  dgRNA
  Hps5
accgcctctgttgcc

SEQ ID NO: 41862 - DNA, 15 bp, Artificial Sequence
  dgRNA
  Hps5
ccgcctctgttgccg

SEQ ID NO: 41863 - DNA, 15 bp, Artificial Sequence
  dgRNA
  Hps5
cgcctctgttgccgg

SEQ ID NO: 41864 - DNA, 15 bp, Artificial Sequence
  dgRNA
  Hist1h3f
ttccgcatacatcat

SEQ ID NO: 41865 - DNA, 15 bp, Artificial Sequence
  dgRNA
  Hist1h3f
agatttcaaccaatc

SEQ ID NO: 41866 - DNA, 15 bp, Artificial Sequence
  dgRNA
  Hist1h3f
tggtaattggataac

SEQ ID NO: 41867 - DNA, 15 bp, Artificial Sequence
  dgRNA
  Hist1h3f
gtatgcggaagtact

SEQ ID NO: 41868 - DNA, 15 bp, Artificial Sequence
  dgRNA
  Olfr212
ttctgcaatacgctg

SEQ ID NO: 41869 - DNA, 15 bp, Artificial Sequence
  dgRNA
  Olfr212
gtggcgcattctcct

SEQ ID NO: 41870 - DNA, 15 bp, Artificial Sequence
  dgRNA
  Olfr212
tggcgcattctcctt

SEQ ID NO: 41871 - DNA, 15 bp, Artificial Sequence
  dgRNA
  Olfr212
ggcgcattctccttg

SEQ ID NO: 41872 - DNA, 15 bp, Artificial Sequence
  dgRNA
  Prkcg
cgccgcccgtgcctg

SEQ ID NO: 41873 - DNA, 15 bp, Artificial Sequence
  dgRNA
  Prkcg
cgctttctccccggt

SEQ ID NO: 41874 - DNA, 15 bp, Artificial Sequence
  dgRNA
  Prkcg
cggtgctgcccgtgc

SEQ ID NO: 41875 - DNA, 15 bp, Artificial Sequence
  dgRNA
  Prkcg
cgcaggcacgggcgg

SEQ ID NO: 41876 - DNA, 15 bp, Artificial Sequence
  dgRNA
  Lrfn2
ctttgcgcgcacgcg

SEQ ID NO: 41877 - DNA, 15 bp, Artificial Sequence
  dgRNA
  Lrfn2
tttgcgcgcacgcgt

SEQ ID NO: 41878 - DNA, 15 bp, Artificial Sequence
  dgRNA
  Lrfn2
ttgcgcgcacgcgtg

SEQ ID NO: 41879 - DNA, 15 bp, Artificial Sequence
  dgRNA
  Lrfn2
tgcgcgcacgcgtgg

SEQ ID NO: 41880 - DNA, 15 bp, Artificial Sequence
  dgRNA
  Pogk
gatgcctgagcggaa

SEQ ID NO: 41881 - DNA, 15 bp, Artificial Sequence
  dgRNA
  Pogk
aaatgcccacctcgg

SEQ ID NO: 41882 - DNA, 15 bp, Artificial Sequence
  dgRNA
  Pogk
gccaccgggctaacg

SEQ ID NO: 41883 - DNA, 15 bp, Artificial Sequence
  dgRNA
  Pogk
cggctcgaagcaccg

SEQ ID NO: 41884 - DNA, 15 bp, Artificial Sequence
  dgRNA
  Elmod3
gagtaataccagact

SEQ ID NO: 41885 - DNA, 15 bp, Artificial Sequence
  dgRNA
  Elmod3
agttcaattgcctaa

SEQ ID NO: 41886 - DNA, 15 bp, Artificial Sequence
  dgRNA
  Elmod3
gttcaattgcctaat

SEQ ID NO: 41887 - DNA, 15 bp, Artificial Sequence
  dgRNA
  Elmod3
gttctagcgcgagac

SEQ ID NO: 41888 - DNA, 15 bp, Artificial Sequence
  dgRNA
  Dmrtb1
cctattgcagttctc

SEQ ID NO: 41889 - DNA, 15 bp, Artificial Sequence
  dgRNA
  Dmrtb1
agcaccagggactta

SEQ ID NO: 41890 - DNA, 15 bp, Artificial Sequence
  dgRNA
  Dmrtb1
gcaccagggacttat

SEQ ID NO: 41891 - DNA, 15 bp, Artificial Sequence
  dgRNA
  Dmrtb1
ttgggcaatggtgta

SEQ ID NO: 41892 - DNA, 15 bp, Artificial Sequence
  dgRNA
  Sprr1a
tgtcattatatcagc

SEQ ID NO: 41893 - DNA, 15 bp, Artificial Sequence
  dgRNA
  Sprr1a
gtcattatatcagct

SEQ ID NO: 41894 - DNA, 15 bp, Artificial Sequence
  dgRNA
  Sprr1a
attatatcagctggg

SEQ ID NO: 41895 - DNA, 15 bp, Artificial Sequence
  dgRNA
  Sprr1a
gccaagtgtgtttcc

SEQ ID NO: 41896 - DNA, 15 bp, Artificial Sequence
  dgRNA
  Vasn
aaaatcactcctcac

SEQ ID NO: 41897 - DNA, 15 bp, Artificial Sequence
  dgRNA
  Vasn
aaatcactcctcact

SEQ ID NO: 41898 - DNA, 15 bp, Artificial Sequence
  dgRNA
  Vasn
atctaggtgcagact

SEQ ID NO: 41899 - DNA, 15 bp, Artificial Sequence
  dgRNA
  Vasn
gcctcagccaattgg

SEQ ID NO: 41900 - DNA, 15 bp, Artificial Sequence
  dgRNA
  D630033O11Rik
ctgtcccacctcgct

SEQ ID NO: 41901 - DNA, 15 bp, Artificial Sequence
  dgRNA
  D630033O11Rik
cacctcgctgggtgc

SEQ ID NO: 41902 - DNA, 15 bp, Artificial Sequence
  dgRNA
  D630033O11Rik
acggctcacacagtg

SEQ ID NO: 41903 - DNA, 15 bp, Artificial Sequence
  dgRNA
  D630033O11Rik
cccctcagacactac

SEQ ID NO: 41904 - DNA, 15 bp, Artificial Sequence
  dgRNA
  Egf
gaacttctcaaacag

SEQ ID NO: 41905 - DNA, 15 bp, Artificial Sequence
  dgRNA
  Egf
aagaccatgccgctt

SEQ ID NO: 41906 - DNA, 15 bp, Artificial Sequence
  dgRNA
  Egf
cgagcgcatgcgctg

SEQ ID NO: 41907 - DNA, 15 bp, Artificial Sequence
  dgRNA
  Egf
gagcgcatgcgctga

SEQ ID NO: 41908 - DNA, 15 bp, Artificial Sequence
  dgRNA
  Osbpl11
gtcaccgcctccttt

SEQ ID NO: 41909 - DNA, 15 bp, Artificial Sequence
  dgRNA
  Osbpl11
tcaccgcctcctttc

SEQ ID NO: 41910 - DNA, 15 bp, Artificial Sequence
  dgRNA
  Osbpl11
ccgcttcaatgctag

SEQ ID NO: 41911 - DNA, 15 bp, Artificial Sequence
  dgRNA
  Osbpl11
gagctcacacgacac

SEQ ID NO: 41912 - DNA, 15 bp, Artificial Sequence
  dgRNA
  Ogg1
ttcgtactttcttct

SEQ ID NO: 41913 - DNA, 15 bp, Artificial Sequence
  dgRNA
  Ogg1
actttcttctcggat

SEQ ID NO: 41914 - DNA, 15 bp, Artificial Sequence
  dgRNA
  Ogg1
ctagggtcaaataag

SEQ ID NO: 41915 - DNA, 15 bp, Artificial Sequence
  dgRNA
  Ogg1
tagggtcaaataagc

SEQ ID NO: 41916 - DNA, 15 bp, Artificial Sequence
  dgRNA
  Fbxo44
tacagccccacggcc

SEQ ID NO: 41917 - DNA, 15 bp, Artificial Sequence
  dgRNA
  Fbxo44
gatcgctcagcgcga

SEQ ID NO: 41918 - DNA, 15 bp, Artificial Sequence
  dgRNA
  Fbxo44
agcgcgacggatcgc

SEQ ID NO: 41919 - DNA, 15 bp, Artificial Sequence
  dgRNA
  Fbxo44
atcgcaggtgactgc

SEQ ID NO: 41920 - DNA, 15 bp, Artificial Sequence
  dgRNA
  Spg11
aggcgtggtttttgc

SEQ ID NO: 41921 - DNA, 15 bp, Artificial Sequence
  dgRNA
  Spg11
gcaaatgccgggcgc

SEQ ID NO: 41922 - DNA, 15 bp, Artificial Sequence
  dgRNA
  Spg11
ctcgtgagagtcaca

SEQ ID NO: 41923 - DNA, 15 bp, Artificial Sequence
  dgRNA
  Spg11
tccgaatcactgcgc

SEQ ID NO: 41924 - DNA, 15 bp, Artificial Sequence
  dgRNA
  Trim35
aaggatggcggcccg

SEQ ID NO: 41925 - DNA, 15 bp, Artificial Sequence
  dgRNA
  Trim35
aacccgacactgcag

SEQ ID NO: 41926 - DNA, 15 bp, Artificial Sequence
  dgRNA
  Trim35
acccgacactgcagt

SEQ ID NO: 41927 - DNA, 15 bp, Artificial Sequence
  dgRNA
  Trim35
cagatccttccgcct

SEQ ID NO: 41928 - DNA, 15 bp, Artificial Sequence
  dgRNA
  Olfr209
cctaactgtgaattg

SEQ ID NO: 41929 - DNA, 15 bp, Artificial Sequence
  dgRNA
  Olfr209
gaattgtggagcacc

SEQ ID NO: 41930 - DNA, 15 bp, Artificial Sequence
  dgRNA
  Olfr209
aattgtggagcacct

SEQ ID NO: 41931 - DNA, 15 bp, Artificial Sequence
  dgRNA
  Olfr209
gttaggatagtggtc

SEQ ID NO: 41932 - DNA, 15 bp, Artificial Sequence
  dgRNA
  Esp24
aagttgtttagccac

SEQ ID NO: 41933 - DNA, 15 bp, Artificial Sequence
  dgRNA
  Esp24
tttagccactggtag

SEQ ID NO: 41934 - DNA, 15 bp, Artificial Sequence
  dgRNA
  Esp24
ttttgcctctaccag

SEQ ID NO: 41935 - DNA, 15 bp, Artificial Sequence
  dgRNA
  Esp24
tatcatagttgaagc

SEQ ID NO: 41936 - DNA, 15 bp, Artificial Sequence
  dgRNA
  Tagln2
cttactctatcctgt

SEQ ID NO: 41937 - DNA, 15 bp, Artificial Sequence
  dgRNA
  Tagln2
taggaaggcgcttcc

SEQ ID NO: 41938 - DNA, 15 bp, Artificial Sequence
  dgRNA
  Tagln2
cctttttgtaatagt

SEQ ID NO: 41939 - DNA, 15 bp, Artificial Sequence
  dgRNA
  Tagln2
gacagcacccccacg

SEQ ID NO: 41940 - DNA, 15 bp, Artificial Sequence
  dgRNA
  Cisd2
gcagtttcagttccg

SEQ ID NO: 41941 - DNA, 15 bp, Artificial Sequence
  dgRNA
  Cisd2
ttgctattcaacagt

SEQ ID NO: 41942 - DNA, 15 bp, Artificial Sequence
  dgRNA
  Cisd2
caacagtaggctcct

SEQ ID NO: 41943 - DNA, 15 bp, Artificial Sequence
  dgRNA
  Cisd2
gcgaatgcattaccc

SEQ ID NO: 41944 - DNA, 15 bp, Artificial Sequence
  dgRNA
  Add1
agcgttcctgtgagc

SEQ ID NO: 41945 - DNA, 15 bp, Artificial Sequence
  dgRNA
  Add1
accagcccgccgtcc

SEQ ID NO: 41946 - DNA, 15 bp, Artificial Sequence
  dgRNA
  Add1
gacaccgccttcagc

SEQ ID NO: 41947 - DNA, 15 bp, Artificial Sequence
  dgRNA
  Add1
accgccttcagccgg

SEQ ID NO: 41948 - DNA, 15 bp, Artificial Sequence
  dgRNA
  Siva1
ccgcgccagcgccct

SEQ ID NO: 41949 - DNA, 15 bp, Artificial Sequence
  dgRNA
  Siva1
cccccgacgtcactc

SEQ ID NO: 41950 - DNA, 15 bp, Artificial Sequence
  dgRNA
  Siva1
gcctatcccgcgcag

SEQ ID NO: 41951 - DNA, 15 bp, Artificial Sequence
  dgRNA
  Siva1
cctatcccgcgcagc

SEQ ID NO: 41952 - DNA, 15 bp, Artificial Sequence
  dgRNA
  Zfp703
tttgtgttgctcgcc

SEQ ID NO: 41953 - DNA, 15 bp, Artificial Sequence
  dgRNA
  Zfp703
ttgtgttgctcgcct

SEQ ID NO: 41954 - DNA, 15 bp, Artificial Sequence
  dgRNA
  Zfp703
cgcctgggctagctg

SEQ ID NO: 41955 - DNA, 15 bp, Artificial Sequence
  dgRNA
  Zfp703
ctgggctagctgcgg

SEQ ID NO: 41956 - DNA, 15 bp, Artificial Sequence
  dgRNA
  Slc46a1
agtgttccgacgccc

SEQ ID NO: 41957 - DNA, 15 bp, Artificial Sequence
  dgRNA
  Slc46a1
ttccgacgcccagga

SEQ ID NO: 41958 - DNA, 15 bp, Artificial Sequence
  dgRNA
  Slc46a1
cgacgcccaggaagg

SEQ ID NO: 41959 - DNA, 15 bp, Artificial Sequence
  dgRNA
  Slc46a1
gcgttgcctgaagtg

SEQ ID NO: 41960 - DNA, 15 bp, Artificial Sequence
  dgRNA
  Nr4a3
acaccctcgcacacg

SEQ ID NO: 41961 - DNA, 15 bp, Artificial Sequence
  dgRNA
  Nr4a3
tcgcacacgcggaac

SEQ ID NO: 41962 - DNA, 15 bp, Artificial Sequence
  dgRNA
  Nr4a3
acacgcggaaccggc

SEQ ID NO: 41963 - DNA, 15 bp, Artificial Sequence
  dgRNA
  Nr4a3
cacgcggaaccggct

SEQ ID NO: 41964 - DNA, 15 bp, Artificial Sequence
  dgRNA
  AI661453
gtagctcgcatttcc

SEQ ID NO: 41965 - DNA, 15 bp, Artificial Sequence
  dgRNA
  AI661453
gcatttccaggcgag

SEQ ID NO: 41966 - DNA, 15 bp, Artificial Sequence
  dgRNA
  AI661453
tttccaggcgagcgg

SEQ ID NO: 41967 - DNA, 15 bp, Artificial Sequence
  dgRNA
  AI661453
cgcaccacctgtcgc

SEQ ID NO: 41968 - DNA, 15 bp, Artificial Sequence
  dgRNA
  Hnf1a
ctagccctgcgcccc

SEQ ID NO: 41969 - DNA, 15 bp, Artificial Sequence
  dgRNA
  Hnf1a
catgactcccggtcc

SEQ ID NO: 41970 - DNA, 15 bp, Artificial Sequence
  dgRNA
  Hnf1a
ctctcacccgccatg

SEQ ID NO: 41971 - DNA, 15 bp, Artificial Sequence
  dgRNA
  Hnf1a
ccttcgctaagcgca

SEQ ID NO: 41972 - DNA, 15 bp, Artificial Sequence
  dgRNA
  Noc3l
gaaaaggaatccggg

SEQ ID NO: 41973 - DNA, 15 bp, Artificial Sequence
  dgRNA
  Noc3l
aaaaggaatccgggc

SEQ ID NO: 41974 - DNA, 15 bp, Artificial Sequence
  dgRNA
  Noc3l
tcagcgattctcaca

SEQ ID NO: 41975 - DNA, 15 bp, Artificial Sequence
  dgRNA
  Noc3l
cagcgattctcacaa

SEQ ID NO: 41976 - DNA, 15 bp, Artificial Sequence
  dgRNA
  Ep400
tcgtcctgtccgaag

SEQ ID NO: 41977 - DNA, 15 bp, Artificial Sequence
  dgRNA
  Ep400
cggtcccgcctcgta

SEQ ID NO: 41978 - DNA, 15 bp, Artificial Sequence
  dgRNA
  Ep400
cgcctcgtacggatg

SEQ ID NO: 41979 - DNA, 15 bp, Artificial Sequence
  dgRNA
  Ep400
acggatgaggccttt

SEQ ID NO: 41980 - DNA, 15 bp, Artificial Sequence
  dgRNA
  Tex9
tactgtgagtgggat

SEQ ID NO: 41981 - DNA, 15 bp, Artificial Sequence
  dgRNA
  Tex9
gtgggattggcctac

SEQ ID NO: 41982 - DNA, 15 bp, Artificial Sequence
  dgRNA
  Tex9
tgggattggcctact

SEQ ID NO: 41983 - DNA, 15 bp, Artificial Sequence
  dgRNA
  Tex9
attggcctactgggc

SEQ ID NO: 41984 - DNA, 15 bp, Artificial Sequence
  dgRNA
  Nudcd1
aaacaaagcggggac

SEQ ID NO: 41985 - DNA, 15 bp, Artificial Sequence
  dgRNA
  Nudcd1
gcggggactggctcc

SEQ ID NO: 41986 - DNA, 15 bp, Artificial Sequence
  dgRNA
  Nudcd1
agcagcacgccctgt

SEQ ID NO: 41987 - DNA, 15 bp, Artificial Sequence
  dgRNA
  Nudcd1
gtcggagagccctac

SEQ ID NO: 41988 - DNA, 15 bp, Artificial Sequence
  dgRNA
  Ppp3ca
cacacacgcgcagcc

SEQ ID NO: 41989 - DNA, 15 bp, Artificial Sequence
  dgRNA
  Ppp3ca
gcgcagcccggagcg

SEQ ID NO: 41990 - DNA, 15 bp, Artificial Sequence
  dgRNA
  Ppp3ca
cagcccggagcgagg

SEQ ID NO: 41991 - DNA, 15 bp, Artificial Sequence
  dgRNA
  Ppp3ca
cccggagcgaggcgg

SEQ ID NO: 41992 - DNA, 15 bp, Artificial Sequence
  dgRNA
  Ocrl
gaatagtatgcttgt

SEQ ID NO: 41993 - DNA, 15 bp, Artificial Sequence
  dgRNA
  Ocrl
gcttgtgggtcctat

SEQ ID NO: 41994 - DNA, 15 bp, Artificial Sequence
  dgRNA
  Ocrl
taggcccagttcaac

SEQ ID NO: 41995 - DNA, 15 bp, Artificial Sequence
  dgRNA
  Ocrl
ttgaactgggcctat

SEQ ID NO: 41996 - DNA, 15 bp, Artificial Sequence
  dgRNA
  Ttc23l
tgtccttgtgcgaca

SEQ ID NO: 41997 - DNA, 15 bp, Artificial Sequence
  dgRNA
  Ttc23l
gtaaggatgaacgcc

SEQ ID NO: 41998 - DNA, 15 bp, Artificial Sequence
  dgRNA
  Ttc23l
taaggatgaacgcca

SEQ ID NO: 41999 - DNA, 15 bp, Artificial Sequence
  dgRNA
  Ttc23l
cgccagggtttgcct

SEQ ID NO: 42000 - DNA, 15 bp, Artificial Sequence
  dgRNA
  Arhgef1
acttgttgtgtaagg

SEQ ID NO: 42001 - DNA, 15 bp, Artificial Sequence
  dgRNA
  Arhgef1
cgaacttgttgtgta

SEQ ID NO: 42002 - DNA, 15 bp, Artificial Sequence
  dgRNA
  Arhgef1
cttagtttgcgacaa

SEQ ID NO: 42003 - DNA, 15 bp, Artificial Sequence
  dgRNA
  Arhgef1
tcttagtttgcgaca

SEQ ID NO: 42004 - DNA, 15 bp, Artificial Sequence
  dgRNA
  Artn
ctagcccccacctag

SEQ ID NO: 42005 - DNA, 15 bp, Artificial Sequence
  dgRNA
  Artn
tagcccccacctaga

SEQ ID NO: 42006 - DNA, 15 bp, Artificial Sequence
  dgRNA
  Artn
cctagcctagccagc

SEQ ID NO: 42007 - DNA, 15 bp, Artificial Sequence
  dgRNA
  Artn
ctagcctagccagcg

SEQ ID NO: 42008 - DNA, 15 bp, Artificial Sequence
  dgRNA
  Casp7
gcagcaggtagcccg

SEQ ID NO: 42009 - DNA, 15 bp, Artificial Sequence
  dgRNA
  Casp7
ggtagcccggggtca

SEQ ID NO: 42010 - DNA, 15 bp, Artificial Sequence
  dgRNA
  Casp7
tcacggtcacttttc

SEQ ID NO: 42011 - DNA, 15 bp, Artificial Sequence
  dgRNA
  Casp7
gcccgccagttctgt

SEQ ID NO: 42012 - DNA, 15 bp, Artificial Sequence
  dgRNA
  Pdlim1
acctagctttcatgc

SEQ ID NO: 42013 - DNA, 15 bp, Artificial Sequence
  dgRNA
  Pdlim1
ctttcatgccgggtt

SEQ ID NO: 42014 - DNA, 15 bp, Artificial Sequence
  dgRNA
  Pdlim1
tgcgggcggaggttc

SEQ ID NO: 42015 - DNA, 15 bp, Artificial Sequence
  dgRNA
  Pdlim1
gcgggcggaggttcg

SEQ ID NO: 42016 - DNA, 15 bp, Artificial Sequence
  dgRNA
  Siglecf
aggttaatgcacaga

SEQ ID NO: 42017 - DNA, 15 bp, Artificial Sequence
  dgRNA
  Siglecf
gaggttaatgcacag

SEQ ID NO: 42018 - DNA, 15 bp, Artificial Sequence
  dgRNA
  Siglecf
gtgtatcatcatggg

SEQ ID NO: 42019 - DNA, 15 bp, Artificial Sequence
  dgRNA
  Pgrmc2
agcccctcacgtgat

SEQ ID NO: 42020 - DNA, 15 bp, Artificial Sequence
  dgRNA
  Pgrmc2
tggctgagcgccgcc

SEQ ID NO: 42021 - DNA, 15 bp, Artificial Sequence
  dgRNA
  Pgrmc2
ctgagcgccgcctgg

SEQ ID NO: 42022 - DNA, 15 bp, Artificial Sequence
  dgRNA
  Pgrmc2
tgagcgccgcctggt

SEQ ID NO: 42023 - DNA, 15 bp, Artificial Sequence
  dgRNA
  Dag1
ccccgccctcgcgct

SEQ ID NO: 42024 - DNA, 15 bp, Artificial Sequence
  dgRNA
  Dag1
cgccctctcaccgct

SEQ ID NO: 42025 - DNA, 15 bp, Artificial Sequence
  dgRNA
  Dag1
cggtacgtgatcgcg

SEQ ID NO: 42026 - DNA, 15 bp, Artificial Sequence
  dgRNA
  Dag1
tacgtgatcgcgcgg

SEQ ID NO: 42027 - DNA, 15 bp, Artificial Sequence
  dgRNA
  Olfr1189
actatactccttttt

SEQ ID NO: 42028 - DNA, 15 bp, Artificial Sequence
  dgRNA
  Serpina3k
caaatccatattacc

SEQ ID NO: 42029 - DNA, 15 bp, Artificial Sequence
  dgRNA
  Serpina3k
ttgtaaaccgaacac

SEQ ID NO: 42030 - DNA, 15 bp, Artificial Sequence
  dgRNA
  Serpina3k
tgtaaaccgaacaca

SEQ ID NO: 42031 - DNA, 15 bp, Artificial Sequence
  dgRNA
  Serpina3k
agattcctggtaata

SEQ ID NO: 42032 - DNA, 15 bp, Artificial Sequence
  dgRNA
  Tbcd
accggcccactgctc

SEQ ID NO: 42033 - DNA, 15 bp, Artificial Sequence
  dgRNA
  Tbcd
gaggcttagtttttc

SEQ ID NO: 42034 - DNA, 15 bp, Artificial Sequence
  dgRNA
  Tbcd
ggtacgatctttaca

SEQ ID NO: 42035 - DNA, 15 bp, Artificial Sequence
  dgRNA
  Tbcd
cggtacgatctttac

SEQ ID NO: 42036 - DNA, 15 bp, Artificial Sequence
  dgRNA
  Nit1
aattcgacaccgccc

SEQ ID NO: 42037 - DNA, 15 bp, Artificial Sequence
  dgRNA
  Nit1
attcgacaccgcccc

SEQ ID NO: 42038 - DNA, 15 bp, Artificial Sequence
  dgRNA
  Nit1
tcactgcgtcacatc

SEQ ID NO: 42039 - DNA, 15 bp, Artificial Sequence
  dgRNA
  Nit1
tgcgtcacatccggc

SEQ ID NO: 42040 - DNA, 15 bp, Artificial Sequence
  dgRNA
  Pdlim7
aaggcgcggcgtccg

SEQ ID NO: 42041 - DNA, 15 bp, Artificial Sequence
  dgRNA
  Pdlim7
gcgcggcgtccgcgg

SEQ ID NO: 42042 - DNA, 15 bp, Artificial Sequence
  dgRNA
  Frmpd4
ccccacttacagttc

SEQ ID NO: 42043 - DNA, 15 bp, Artificial Sequence
  dgRNA
  Kcne3
aaccgcacccggtta

SEQ ID NO: 42044 - DNA, 15 bp, Artificial Sequence
  dgRNA
  Kcne3
acccggttaaggcta

SEQ ID NO: 42045 - DNA, 15 bp, Artificial Sequence
  dgRNA
  Kcne3
agccaacgctgaagc

SEQ ID NO: 42046 - DNA, 15 bp, Artificial Sequence
  dgRNA
  Kcne3
tgctaaggcagggcg

SEQ ID NO: 42047 - DNA, 15 bp, Artificial Sequence
  dgRNA
  Cdpf1
gcaaggacgctcttt

SEQ ID NO: 42048 - DNA, 15 bp, Artificial Sequence
  dgRNA
  Cdpf1
cttgcttaaggaggc

SEQ ID NO: 42049 - DNA, 15 bp, Artificial Sequence
  dgRNA
  Cdpf1
ttgcttaaggaggct

SEQ ID NO: 42050 - DNA, 15 bp, Artificial Sequence
  dgRNA
  Cdpf1
tgcttaggcgccatg

SEQ ID NO: 42051 - DNA, 15 bp, Artificial Sequence
  dgRNA
  Asb4
atagaacggctgaat

SEQ ID NO: 42052 - DNA, 15 bp, Artificial Sequence
  dgRNA
  Mfap2
cagccccgtgacctc

SEQ ID NO: 42053 - DNA, 15 bp, Artificial Sequence
  dgRNA
  Mfap2
agccccgtgacctct

SEQ ID NO: 42054 - DNA, 15 bp, Artificial Sequence
  dgRNA
  Mfap2
agaggggtgtcccgt

SEQ ID NO: 42055 - DNA, 15 bp, Artificial Sequence
  dgRNA
  Mfap2
gggtgtcccgttggc

SEQ ID NO: 42056 - DNA, 15 bp, Artificial Sequence
  dgRNA
  Ank3
actcccctgatctca

SEQ ID NO: 42057 - DNA, 15 bp, Artificial Sequence
  dgRNA
  Gdf7
gcgataggcctgagt

SEQ ID NO: 42058 - DNA, 15 bp, Artificial Sequence
  dgRNA
  Gdf7
cgataggcctgagtt

SEQ ID NO: 42059 - DNA, 15 bp, Artificial Sequence
  dgRNA
  Gdf7
ataggcctgagttgg

SEQ ID NO: 42060 - DNA, 15 bp, Artificial Sequence
  dgRNA
  Gdf7
taggcctgagttggg

SEQ ID NO: 42061 - DNA, 15 bp, Artificial Sequence
  dgRNA
  Ankrd17
ctcgctcgctcgcgg

SEQ ID NO: 42062 - DNA, 15 bp, Artificial Sequence
  dgRNA
  Ankrd17
ggctccgcgctcgcg

SEQ ID NO: 42063 - DNA, 15 bp, Artificial Sequence
  dgRNA
  Ankrd17
ctcgcgcggccgccg

SEQ ID NO: 42064 - DNA, 15 bp, Artificial Sequence
  dgRNA
  Ankrd17
cgcggcgccggctga

SEQ ID NO: 42065 - DNA, 15 bp, Artificial Sequence
  dgRNA
  Alas1
aagcccttcgttgat

SEQ ID NO: 42066 - DNA, 15 bp, Artificial Sequence
  dgRNA
  Alas1
cggatcttaagaccc

SEQ ID NO: 42067 - DNA, 15 bp, Artificial Sequence
  dgRNA
  Alas1
gatttccttcccggg

SEQ ID NO: 42068 - DNA, 15 bp, Artificial Sequence
  dgRNA
  Alas1
gtttacgacctacag

SEQ ID NO: 42069 - DNA, 15 bp, Artificial Sequence
  dgRNA
  9-Sep
tccgttggtggcccg

SEQ ID NO: 42070 - DNA, 15 bp, Artificial Sequence
  dgRNA
  9-Sep
ccgttggtggcccgc

SEQ ID NO: 42071 - DNA, 15 bp, Artificial Sequence
  dgRNA
  9-Sep
gcccgcgggcctccc

SEQ ID NO: 42072 - DNA, 15 bp, Artificial Sequence
  dgRNA
  9-Sep
gccccgggaaagttg

SEQ ID NO: 42073 - DNA, 15 bp, Artificial Sequence
  dgRNA
  Kctd5
ggagcctctttgagt

SEQ ID NO: 42074 - DNA, 15 bp, Artificial Sequence
  dgRNA
  Kctd5
gagcctctttgagta

SEQ ID NO: 42075 - DNA, 15 bp, Artificial Sequence
  dgRNA
  Kctd5
gcggagcttgagccg

SEQ ID NO: 42076 - DNA, 15 bp, Artificial Sequence
  dgRNA
  Kctd5
acccgagacttgctc

SEQ ID NO: 42077 - DNA, 15 bp, Artificial Sequence
  dgRNA
  Ptprd
acacttactgttgta

SEQ ID NO: 42078 - DNA, 15 bp, Artificial Sequence
  dgRNA
  Ptprd
tagtgcttggctagt

SEQ ID NO: 42079 - DNA, 15 bp, Artificial Sequence
  dgRNA
  Ptprd
atagtgcttggctag

SEQ ID NO: 42080 - DNA, 15 bp, Artificial Sequence
  dgRNA
  Ptprd
cacgtttatagtgct

SEQ ID NO: 42081 - DNA, 15 bp, Artificial Sequence
  dgRNA
  Mcm2
aggtcacactctaga

SEQ ID NO: 42082 - DNA, 15 bp, Artificial Sequence
  dgRNA
  Mcm2
tctagaaggccggat

SEQ ID NO: 42083 - DNA, 15 bp, Artificial Sequence
  dgRNA
  Mcm2
ttccttgccttagcg

SEQ ID NO: 42084 - DNA, 15 bp, Artificial Sequence
  dgRNA
  Mcm2
cgtggtaaacgctga

SEQ ID NO: 42085 - DNA, 15 bp, Artificial Sequence
  dgRNA
  Plch2
tgggctgaatccagc

SEQ ID NO: 42086 - DNA, 15 bp, Artificial Sequence
  dgRNA
  Plch2
atccagcaggattac

SEQ ID NO: 42087 - DNA, 15 bp, Artificial Sequence
  dgRNA
  Plch2
tccagcaggattact

SEQ ID NO: 42088 - DNA, 15 bp, Artificial Sequence
  dgRNA
  Plch2
gattactgggcggat

SEQ ID NO: 42089 - DNA, 15 bp, Artificial Sequence
  dgRNA
  Sez6l2
tagatcgcagagcaa

SEQ ID NO: 42090 - DNA, 15 bp, Artificial Sequence
  dgRNA
  Sez6l2
ttgccgacccttagc

SEQ ID NO: 42091 - DNA, 15 bp, Artificial Sequence
  dgRNA
  Sez6l2
ggccgagagggccga

SEQ ID NO: 42092 - DNA, 15 bp, Artificial Sequence
  dgRNA
  Sez6l2
cccgctgcggggggt

SEQ ID NO: 42093 - DNA, 15 bp, Artificial Sequence
  dgRNA
  Psd
ccggaaagacacaag

SEQ ID NO: 42094 - DNA, 15 bp, Artificial Sequence
  dgRNA
  Psd
tcgtctcagtctact

SEQ ID NO: 42095 - DNA, 15 bp, Artificial Sequence
  dgRNA
  Psd
ggcgcgcaccacctc

SEQ ID NO: 42096 - DNA, 15 bp, Artificial Sequence
  dgRNA
  Psd
gcgcgcaccacctcc

SEQ ID NO: 42097 - DNA, 15 bp, Artificial Sequence
  dgRNA
  Zmynd8
ctgggggatcgagcc

SEQ ID NO: 42098 - DNA, 15 bp, Artificial Sequence
  dgRNA
  Zmynd8
tgggggatcgagcca

SEQ ID NO: 42099 - DNA, 15 bp, Artificial Sequence
  dgRNA
  Zmynd8
gggggatcgagccag

SEQ ID NO: 42100 - DNA, 15 bp, Artificial Sequence
  dgRNA
  Zmynd8
ggggatcgagccagg

SEQ ID NO: 42101 - DNA, 15 bp, Artificial Sequence
  dgRNA
  Chp2
ctggctgagcggatc

SEQ ID NO: 42102 - DNA, 15 bp, Artificial Sequence
  dgRNA
  Chp2
tggctgagcggatct

SEQ ID NO: 42103 - DNA, 15 bp, Artificial Sequence
  dgRNA
  Chp2
ctgagcggatctggg

SEQ ID NO: 42104 - DNA, 15 bp, Artificial Sequence
  dgRNA
  Chp2
gtgtctagggagtgt

SEQ ID NO: 42105 - DNA, 15 bp, Artificial Sequence
  dgRNA
  Cdc40
ggtctttaatcaacg

SEQ ID NO: 42106 - DNA, 15 bp, Artificial Sequence
  dgRNA
  Cdc40
gtgtttgaagcctcg

SEQ ID NO: 42107 - DNA, 15 bp, Artificial Sequence
  dgRNA
  Tmem144
gtctaaggtgcccct

SEQ ID NO: 42108 - DNA, 15 bp, Artificial Sequence
  dgRNA
  Tmem144
cgtcagcccagagac

SEQ ID NO: 42109 - DNA, 15 bp, Artificial Sequence
  dgRNA
  Tmem144
ttccctggacgcgtg

SEQ ID NO: 42110 - DNA, 15 bp, Artificial Sequence
  dgRNA
  Tmem144
gcgctgactcttccc

SEQ ID NO: 42111 - DNA, 15 bp, Artificial Sequence
  dgRNA
  Tmem131
ggggagcacgcgaac

SEQ ID NO: 42112 - DNA, 15 bp, Artificial Sequence
  dgRNA
  Tmem131
gagcacgcgaaccgg

SEQ ID NO: 42113 - DNA, 15 bp, Artificial Sequence
  dgRNA
  Tmem131
agcacgcgaaccggc

SEQ ID NO: 42114 - DNA, 15 bp, Artificial Sequence
  dgRNA
  Tmem131
accggcgggccgccc

SEQ ID NO: 42115 - DNA, 15 bp, Artificial Sequence
  dgRNA
  Tnnc2
gaccttggctaaatt

SEQ ID NO: 42116 - DNA, 15 bp, Artificial Sequence
  dgRNA
  Tnnc2
ggctaaattaggtaa

SEQ ID NO: 42117 - DNA, 15 bp, Artificial Sequence
  dgRNA
  Tnnc2
gctaaattaggtaat

SEQ ID NO: 42118 - DNA, 15 bp, Artificial Sequence
  dgRNA
  Tnnc2
attaggtaatgggct

SEQ ID NO: 42119 - DNA, 15 bp, Artificial Sequence
  dgRNA
  Gigyf2
ggctccgtcctcgcc

SEQ ID NO: 42120 - DNA, 15 bp, Artificial Sequence
  dgRNA
  Gigyf2
gcccggccctgcatc

SEQ ID NO: 42121 - DNA, 15 bp, Artificial Sequence
  dgRNA
  Gigyf2
cccggccctgcatcc

SEQ ID NO: 42122 - DNA, 15 bp, Artificial Sequence
  dgRNA
  Gigyf2
ctgcatccgggtctc

SEQ ID NO: 42123 - DNA, 15 bp, Artificial Sequence
  dgRNA
  Tnfrsf21
tttaaagttaagtcg

SEQ ID NO: 42124 - DNA, 15 bp, Artificial Sequence
  dgRNA
  Tnfrsf21
agttaagtcggggtg

SEQ ID NO: 42125 - DNA, 15 bp, Artificial Sequence
  dgRNA
  Tnfrsf21
gttaagtcggggtga

SEQ ID NO: 42126 - DNA, 15 bp, Artificial Sequence
  dgRNA
  Tnfrsf21
ttaagtcggggtgag

SEQ ID NO: 42127 - DNA, 15 bp, Artificial Sequence
  dgRNA
  Xrra1
cagcgcagagcccat

SEQ ID NO: 42128 - DNA, 15 bp, Artificial Sequence
  dgRNA
  Xrra1
agcgcagagcccatc

SEQ ID NO: 42129 - DNA, 15 bp, Artificial Sequence
  dgRNA
  Xrra1
tcgggatccgtagtc

SEQ ID NO: 42130 - DNA, 15 bp, Artificial Sequence
  dgRNA
  Xrra1
gctgaaagaggccgc

SEQ ID NO: 42131 - DNA, 15 bp, Artificial Sequence
  dgRNA
  Fbxw11
ctgtgcgtcctgcgt

SEQ ID NO: 42132 - DNA, 15 bp, Artificial Sequence
  dgRNA
  Fbxw11
gtcctgcgtcggccg

SEQ ID NO: 42133 - DNA, 15 bp, Artificial Sequence
  dgRNA
  Fbxw11
tcctgcgtcggccga

SEQ ID NO: 42134 - DNA, 15 bp, Artificial Sequence
  dgRNA
  Fbxw11
cgtcggccgagggtg

SEQ ID NO: 42135 - DNA, 15 bp, Artificial Sequence
  dgRNA
  Npm2
cttgacctgttcaat

SEQ ID NO: 42136 - DNA, 15 bp, Artificial Sequence
  dgRNA
  Npm2
gcttctagagtagga

SEQ ID NO: 42137 - DNA, 15 bp, Artificial Sequence
  dgRNA
  Npm2
tgaacaggtcaaggc

SEQ ID NO: 42138 - DNA, 15 bp, Artificial Sequence
  dgRNA
  Npm2
gctgttaagaagcct

SEQ ID NO: 42139 - DNA, 15 bp, Artificial Sequence
  dgRNA
  Mad2l1
cccggctctctaatg

SEQ ID NO: 42140 - DNA, 15 bp, Artificial Sequence
  dgRNA
  Mad2l1
ccggctctctaatgt

SEQ ID NO: 42141 - DNA, 15 bp, Artificial Sequence
  dgRNA
  Mad2l1
caaaacggaagcctg

SEQ ID NO: 42142 - DNA, 15 bp, Artificial Sequence
  dgRNA
  Mad2l1
aacggaagcctgagg

SEQ ID NO: 42143 - DNA, 15 bp, Artificial Sequence
  dgRNA
  Slc25a12
aaccttgctcaatac

SEQ ID NO: 42144 - DNA, 15 bp, Artificial Sequence
  dgRNA
  Slc25a12
cctttaagccccaag

SEQ ID NO: 42145 - DNA, 15 bp, Artificial Sequence
  dgRNA
  Slc25a12
ctttaagccccaaga

SEQ ID NO: 42146 - DNA, 15 bp, Artificial Sequence
  dgRNA
  Slc25a12
agagggaaccgactt

SEQ ID NO: 42147 - DNA, 15 bp, Artificial Sequence
  dgRNA
  Abi3bp
aagctgttgcagcat

SEQ ID NO: 42148 - DNA, 15 bp, Artificial Sequence
  dgRNA
  Abi3bp
cgcctctgtcagtgg

SEQ ID NO: 42149 - DNA, 15 bp, Artificial Sequence
  dgRNA
  Abi3bp
cttactcacaggggg

SEQ ID NO: 42150 - DNA, 15 bp, Artificial Sequence
  dgRNA
  Abi3bp
gtgggcttactcaca

SEQ ID NO: 42151 - DNA, 15 bp, Artificial Sequence
  dgRNA
  Snx22
gactttagtgagcca

SEQ ID NO: 42152 - DNA, 15 bp, Artificial Sequence
  dgRNA
  Snx22
accctgggcgtggcg

SEQ ID NO: 42153 - DNA, 15 bp, Artificial Sequence
  dgRNA
  Snx22
ccctgggcgtggcga

SEQ ID NO: 42154 - DNA, 15 bp, Artificial Sequence
  dgRNA
  Snx22
gggctcccgtatcag

SEQ ID NO: 42155 - DNA, 15 bp, Artificial Sequence
  dgRNA
  Mllt10
ggccaggggacgcgg

SEQ ID NO: 42156 - DNA, 15 bp, Artificial Sequence
  dgRNA
  Mllt10
cggcggcgcgcacgc

SEQ ID NO: 42157 - DNA, 15 bp, Artificial Sequence
  dgRNA
  Mllt10
caggcctcgcctctc

SEQ ID NO: 42158 - DNA, 15 bp, Artificial Sequence
  dgRNA
  Mllt10
aggcctcgcctctct

SEQ ID NO: 42159 - DNA, 15 bp, Artificial Sequence
  dgRNA
  Gm11127
atgcccattgagagg

SEQ ID NO: 42160 - DNA, 15 bp, Artificial Sequence
  dgRNA
  Gm11127
ggaggtccctagaaa

SEQ ID NO: 42161 - DNA, 15 bp, Artificial Sequence
  dgRNA
  Gm11127
cctctcaatgggcat

SEQ ID NO: 42162 - DNA, 15 bp, Artificial Sequence
  dgRNA
  Gm11127
tcctctcaatgggca

SEQ ID NO: 42163 - DNA, 15 bp, Artificial Sequence
  dgRNA
  Pgr
agactagtgagtagc

SEQ ID NO: 42164 - DNA, 15 bp, Artificial Sequence
  dgRNA
  Pgr
gatctagccagtgat

SEQ ID NO: 42165 - DNA, 15 bp, Artificial Sequence
  dgRNA
  Pgr
tagtctgattccacc

SEQ ID NO: 42166 - DNA, 15 bp, Artificial Sequence
  dgRNA
  Pgr
ctaaatctctggcgt

SEQ ID NO: 42167 - DNA, 15 bp, Artificial Sequence
  dgRNA
  Gfer
gagtacccgcagagc

SEQ ID NO: 42168 - DNA, 15 bp, Artificial Sequence
  dgRNA
  Gfer
ccgccagtgccgcct

SEQ ID NO: 42169 - DNA, 15 bp, Artificial Sequence
  dgRNA
  Gfer
agtgccgcctcggcc

SEQ ID NO: 42170 - DNA, 15 bp, Artificial Sequence
  dgRNA
  Gfer
gtgccgcctcggcct

SEQ ID NO: 42171 - DNA, 15 bp, Artificial Sequence
  dgRNA
  Exog
aacccatccattaac

SEQ ID NO: 42172 - DNA, 15 bp, Artificial Sequence
  dgRNA
  Exog
atccattaactggcc

SEQ ID NO: 42173 - DNA, 15 bp, Artificial Sequence
  dgRNA
  Exog
taactggccaggacc

SEQ ID NO: 42174 - DNA, 15 bp, Artificial Sequence
  dgRNA
  Exog
gcgtgcctcccctgc

SEQ ID NO: 42175 - DNA, 15 bp, Artificial Sequence
  dgRNA
  Zfp932
atcagagcctctacg

SEQ ID NO: 42176 - DNA, 15 bp, Artificial Sequence
  dgRNA
  Zfp932
ggaaggcgggttttc

SEQ ID NO: 42177 - DNA, 15 bp, Artificial Sequence
  dgRNA
  Zfp932
gttttccggatacct

SEQ ID NO: 42178 - DNA, 15 bp, Artificial Sequence
  dgRNA
  Zfp932
cgtagaggctctgat

SEQ ID NO: 42179 - DNA, 15 bp, Artificial Sequence
  dgRNA
  Surf2
ggccccactccactc

SEQ ID NO: 42180 - DNA, 15 bp, Artificial Sequence
  dgRNA
  Surf2
actccactccgggcc

SEQ ID NO: 42181 - DNA, 15 bp, Artificial Sequence
  dgRNA
  Surf2
ttacccgtcccgcgt

SEQ ID NO: 42182 - DNA, 15 bp, Artificial Sequence
  dgRNA
  Surf2
ccgcgtcatccgtcg

SEQ ID NO: 42183 - DNA, 15 bp, Artificial Sequence
  dgRNA
  Pigl
aggattccgccaccg

SEQ ID NO: 42184 - DNA, 15 bp, Artificial Sequence
  dgRNA
  Pigl
ccgccaccgaggaga

SEQ ID NO: 42185 - DNA, 15 bp, Artificial Sequence
  dgRNA
  Pigl
cgccaccgaggagac

SEQ ID NO: 42186 - DNA, 15 bp, Artificial Sequence
  dgRNA
  Pigl
gccaccgaggagacg

SEQ ID NO: 42187 - DNA, 15 bp, Artificial Sequence
  dgRNA
  Senp1
cagttatataaggct

SEQ ID NO: 42188 - DNA, 15 bp, Artificial Sequence
  dgRNA
  Senp1
agtgggattcaccag

SEQ ID NO: 42189 - DNA, 15 bp, Artificial Sequence
  dgRNA
  Senp1
acagtgatctctagt

SEQ ID NO: 42190 - DNA, 15 bp, Artificial Sequence
  dgRNA
  Senp1
ctagccttatataac

SEQ ID NO: 42191 - DNA, 15 bp, Artificial Sequence
  dgRNA
  Ccin
cagttcgaacattcc

SEQ ID NO: 42192 - DNA, 15 bp, Artificial Sequence
  dgRNA
  Ccin
ttcccggcgaagccg

SEQ ID NO: 42193 - DNA, 15 bp, Artificial Sequence
  dgRNA
  Ccin
cgaactggtttgggt

SEQ ID NO: 42194 - DNA, 15 bp, Artificial Sequence
  dgRNA
  Ccin
tcgaactggtttggg

SEQ ID NO: 42195 - DNA, 15 bp, Artificial Sequence
  dgRNA
  Atpaf1
aagcctggcgcgcag

SEQ ID NO: 42196 - DNA, 15 bp, Artificial Sequence
  dgRNA
  Atpaf1
agaggctgctggtcg

SEQ ID NO: 42197 - DNA, 15 bp, Artificial Sequence
  dgRNA
  Atpaf1
tgctggtcgggggta

SEQ ID NO: 42198 - DNA, 15 bp, Artificial Sequence
  dgRNA
  Atpaf1
gctggtcgggggtag

SEQ ID NO: 42199 - DNA, 15 bp, Artificial Sequence
  dgRNA
  Wfdc16
cgctggagatcattt

SEQ ID NO: 42200 - DNA, 15 bp, Artificial Sequence
  dgRNA
  Ecd
ccagggcgggggcct

SEQ ID NO: 42201 - DNA, 15 bp, Artificial Sequence
  dgRNA
  Ecd
agggcgggggcctcg

SEQ ID NO: 42202 - DNA, 15 bp, Artificial Sequence
  dgRNA
  Ecd
ccctcccgccggctc

SEQ ID NO: 42203 - DNA, 15 bp, Artificial Sequence
  dgRNA
  Ecd
ccgtcgcttagattc

SEQ ID NO: 42204 - DNA, 15 bp, Artificial Sequence
  dgRNA
  Ptgs2
gaaccacagggcgcc

SEQ ID NO: 42205 - DNA, 15 bp, Artificial Sequence
  dgRNA
  Ptgs2
cacagggcgcctgga

SEQ ID NO: 42206 - DNA, 15 bp, Artificial Sequence
  dgRNA
  Ptgs2
tctcttggcaccacc

SEQ ID NO: 42207 - DNA, 15 bp, Artificial Sequence
  dgRNA
  Ptgs2
ctcttggcaccacct

SEQ ID NO: 42208 - DNA, 15 bp, Artificial Sequence
  dgRNA
  Eif2s3y
tgcaggcaacgtcaa

SEQ ID NO: 42209 - DNA, 15 bp, Artificial Sequence
  dgRNA
  Eif2s3y
gtgcaggcaacgtca

SEQ ID NO: 42210 - DNA, 15 bp, Artificial Sequence
  dgRNA
  Eif2s3y
cataactattagtgc

SEQ ID NO: 42211 - DNA, 15 bp, Artificial Sequence
  dgRNA
  Eif2s3y
tgtagccttattacg

SEQ ID NO: 42212 - DNA, 15 bp, Artificial Sequence
  dgRNA
  Defb14
tgcggtgagagacac

SEQ ID NO: 42213 - DNA, 15 bp, Artificial Sequence
  dgRNA
  Defb14
ctggaaagacacgtc

SEQ ID NO: 42214 - DNA, 15 bp, Artificial Sequence
  dgRNA
  Defb14
tgtcatccgtcatca

SEQ ID NO: 42215 - DNA, 15 bp, Artificial Sequence
  dgRNA
  Defb14
cttaccttgttatat

SEQ ID NO: 42216 - DNA, 15 bp, Artificial Sequence
  dgRNA
  1700008O03Rik
gcctcctcgcctcac

SEQ ID NO: 42217 - DNA, 15 bp, Artificial Sequence
  dgRNA
  1700008O03Rik
ggtccgaactcacaa

SEQ ID NO: 42218 - DNA, 15 bp, Artificial Sequence
  dgRNA
  1700008O03Rik
aaaggatagtctacc

SEQ ID NO: 42219 - DNA, 15 bp, Artificial Sequence
  dgRNA
  1700008O03Rik
acctgtgaggcgagg

SEQ ID NO: 42220 - DNA, 15 bp, Artificial Sequence
  dgRNA
  Cdip1
agcgcttggccggtg

SEQ ID NO: 42221 - DNA, 15 bp, Artificial Sequence
  dgRNA
  Cdip1
gcgcttggccggtga

SEQ ID NO: 42222 - DNA, 15 bp, Artificial Sequence
  dgRNA
  Cdip1
cgcttggccggtgag

SEQ ID NO: 42223 - DNA, 15 bp, Artificial Sequence
  dgRNA
  Cdip1
ccaagcggcttccga

SEQ ID NO: 42224 - DNA, 15 bp, Artificial Sequence
  dgRNA
  Dab2
tctaaggcctaagtc

SEQ ID NO: 42225 - DNA, 15 bp, Artificial Sequence
  dgRNA
  Dab2
aatagttttcacggt

SEQ ID NO: 42226 - DNA, 15 bp, Artificial Sequence
  dgRNA
  Dab2
atagttttcacggtt

SEQ ID NO: 42227 - DNA, 15 bp, Artificial Sequence
  dgRNA
  Shroom2
ttccgcgctccctcc

SEQ ID NO: 42228 - DNA, 15 bp, Artificial Sequence
  dgRNA
  Shroom2
aagcaagttcagcgg

SEQ ID NO: 42229 - DNA, 15 bp, Artificial Sequence
  dgRNA
  Shroom2
aagttcagcggtggc

SEQ ID NO: 42230 - DNA, 15 bp, Artificial Sequence
  dgRNA
  Shroom2
ttcagcggtggccgg

SEQ ID NO: 42231 - DNA, 15 bp, Artificial Sequence
  dgRNA
  Ralgds
ttacccatactttcc

SEQ ID NO: 42232 - DNA, 15 bp, Artificial Sequence
  dgRNA
  Ralgds
ggaattcccgggaag

SEQ ID NO: 42233 - DNA, 15 bp, Artificial Sequence
  dgRNA
  Ralgds
ctccaagagtgtgac

SEQ ID NO: 42234 - DNA, 15 bp, Artificial Sequence
  dgRNA
  Ralgds
tcacctggaaagtat

SEQ ID NO: 42235 - DNA, 15 bp, Artificial Sequence
  dgRNA
  Flywch1
gcagtagcgggacca

SEQ ID NO: 42236 - DNA, 15 bp, Artificial Sequence
  dgRNA
  Flywch1
cagtagcgggaccat

SEQ ID NO: 42237 - DNA, 15 bp, Artificial Sequence
  dgRNA
  Flywch1
gcccctgatgctgat

SEQ ID NO: 42238 - DNA, 15 bp, Artificial Sequence
  dgRNA
  Flywch1
agtggtatccgcctc

SEQ ID NO: 42239 - DNA, 15 bp, Artificial Sequence
  dgRNA
  Klk6
gcatgtgggcggctt

SEQ ID NO: 42240 - DNA, 15 bp, Artificial Sequence
  dgRNA
  Klk6
agaaaagggcgtgac

SEQ ID NO: 42241 - DNA, 15 bp, Artificial Sequence
  dgRNA
  Klk6
gaccagatagctaca

SEQ ID NO: 42242 - DNA, 15 bp, Artificial Sequence
  dgRNA
  Ptgds
gtgggctttgccggc

SEQ ID NO: 42243 - DNA, 15 bp, Artificial Sequence
  dgRNA
  Ptgds
ctttgccggcaggag

SEQ ID NO: 42244 - DNA, 15 bp, Artificial Sequence
  dgRNA
  Ptgds
tttgccggcaggagt

SEQ ID NO: 42245 - DNA, 15 bp, Artificial Sequence
  dgRNA
  Ptgds
gccgggtgtgtactc

SEQ ID NO: 42246 - DNA, 15 bp, Artificial Sequence
  dgRNA
  Ldb2
cctctctcgctatag

SEQ ID NO: 42247 - DNA, 15 bp, Artificial Sequence
  dgRNA
  Ldb2
ctctctcgctataga

SEQ ID NO: 42248 - DNA, 15 bp, Artificial Sequence
  dgRNA
  Ldb2
cctctatagcgagag

SEQ ID NO: 42249 - DNA, 15 bp, Artificial Sequence
  dgRNA
  Mul1
aaggcacgctctcat

SEQ ID NO: 42250 - DNA, 15 bp, Artificial Sequence
  dgRNA
  Mul1
gaacgtctagaaacc

SEQ ID NO: 42251 - DNA, 15 bp, Artificial Sequence
  dgRNA
  Mul1
cgtctagaaacccgg

SEQ ID NO: 42252 - DNA, 15 bp, Artificial Sequence
  dgRNA
  Mul1
gtctagaaacccgga

SEQ ID NO: 42253 - DNA, 15 bp, Artificial Sequence
  dgRNA
  Ptk2b
tcaaccaactgcaag

SEQ ID NO: 42254 - DNA, 15 bp, Artificial Sequence
  dgRNA
  Ptk2b
aactcctaccacacc

SEQ ID NO: 42255 - DNA, 15 bp, Artificial Sequence
  dgRNA
  Hmx2
tgcgagtgcgcgtct

SEQ ID NO: 42256 - DNA, 15 bp, Artificial Sequence
  dgRNA
  Hmx2
gtctaggcttgctcc

SEQ ID NO: 42257 - DNA, 15 bp, Artificial Sequence
  dgRNA
  Hmx2
gctcccggagcttcc

SEQ ID NO: 42258 - DNA, 15 bp, Artificial Sequence
  dgRNA
  Hmx2
ccggtgctgcgtgct

SEQ ID NO: 42259 - DNA, 15 bp, Artificial Sequence
  dgRNA
  Ncdn
ttagctcgagcactc

SEQ ID NO: 42260 - DNA, 15 bp, Artificial Sequence
  dgRNA
  Ncdn
gcaagatggccgcac

SEQ ID NO: 42261 - DNA, 15 bp, Artificial Sequence
  dgRNA
  Ncdn
agatggccgcaccgg

SEQ ID NO: 42262 - DNA, 15 bp, Artificial Sequence
  dgRNA
  Ncdn
gagcccagcgccgat

SEQ ID NO: 42263 - DNA, 15 bp, Artificial Sequence
  dgRNA
  Olfr1241
aatcctcttaggcga

SEQ ID NO: 42264 - DNA, 15 bp, Artificial Sequence
  dgRNA
  Olfr1241
taatagaagatgtat

SEQ ID NO: 42265 - DNA, 15 bp, Artificial Sequence
  dgRNA
  Olfr1241
gccatagtgaactga

SEQ ID NO: 42266 - DNA, 15 bp, Artificial Sequence
  dgRNA
  Olfr1241
tcacaacgtcaaggc

SEQ ID NO: 42267 - DNA, 15 bp, Artificial Sequence
  dgRNA
  Krt20
attgccgtacaaaag

SEQ ID NO: 42268 - DNA, 15 bp, Artificial Sequence
  dgRNA
  Krt20
ttgccgtacaaaaga

SEQ ID NO: 42269 - DNA, 15 bp, Artificial Sequence
  dgRNA
  Krt20
tgccgtacaaaagag

SEQ ID NO: 42270 - DNA, 15 bp, Artificial Sequence
  dgRNA
  Krt20
gccgtacaaaagagg

SEQ ID NO: 42271 - DNA, 15 bp, Artificial Sequence
  dgRNA
  Abcf1
cagctgcttaggcgt

SEQ ID NO: 42272 - DNA, 15 bp, Artificial Sequence
  dgRNA
  Abcf1
agctgcttaggcgtt

SEQ ID NO: 42273 - DNA, 15 bp, Artificial Sequence
  dgRNA
  Abcf1
gcttaggcgttggga

SEQ ID NO: 42274 - DNA, 15 bp, Artificial Sequence
  dgRNA
  Abcf1
ccactccagtcaagt

SEQ ID NO: 42275 - DNA, 15 bp, Artificial Sequence
  dgRNA
  Akap11
ggtttaaagctccca

SEQ ID NO: 42276 - DNA, 15 bp, Artificial Sequence
  dgRNA
  Akap11
gtttaaagctcccac

SEQ ID NO: 42277 - DNA, 15 bp, Artificial Sequence
  dgRNA
  Akap11
agctcccacgggccg

SEQ ID NO: 42278 - DNA, 15 bp, Artificial Sequence
  dgRNA
  Akap11
gctcccacgggccga

SEQ ID NO: 42279 - DNA, 15 bp, Artificial Sequence
  dgRNA
  Igf1
gattaactttccaca

SEQ ID NO: 42280 - DNA, 15 bp, Artificial Sequence
  dgRNA
  Igf1
ttcgctcttaaaaac

SEQ ID NO: 42281 - DNA, 15 bp, Artificial Sequence
  dgRNA
  Actl7a
tctttactacaaaac

SEQ ID NO: 42282 - DNA, 15 bp, Artificial Sequence
  dgRNA
  Actl7a
ttactacaaaactgg

SEQ ID NO: 42283 - DNA, 15 bp, Artificial Sequence
  dgRNA
  Spaca7
aacaaaccccatacc

SEQ ID NO: 42284 - DNA, 15 bp, Artificial Sequence
  dgRNA
  Spaca7
taaccatgttctcac

SEQ ID NO: 42285 - DNA, 15 bp, Artificial Sequence
  dgRNA
  Spaca7
aaccatgttctcaca

SEQ ID NO: 42286 - DNA, 15 bp, Artificial Sequence
  dgRNA
  Spaca7
aacatacactctaat

SEQ ID NO: 42287 - DNA, 15 bp, Artificial Sequence
  dgRNA
  Spic
gaagtagaattatgc

SEQ ID NO: 42288 - DNA, 15 bp, Artificial Sequence
  dgRNA
  Spic
taatgcgactctgcc

SEQ ID NO: 42289 - DNA, 15 bp, Artificial Sequence
  dgRNA
  Spic
aatgcgactctgcca

SEQ ID NO: 42290 - DNA, 15 bp, Artificial Sequence
  dgRNA
  Aox4
aaggtaccgatttac

SEQ ID NO: 42291 - DNA, 15 bp, Artificial Sequence
  dgRNA
  Aox4
gtaccgatttacagg

SEQ ID NO: 42292 - DNA, 15 bp, Artificial Sequence
  dgRNA
  Aox4
taccgatttacaggc

SEQ ID NO: 42293 - DNA, 15 bp, Artificial Sequence
  dgRNA
  Aox4
aacccgcctgtaaat

SEQ ID NO: 42294 - DNA, 15 bp, Artificial Sequence
  dgRNA
  Olfr318
gccttagagctattc

SEQ ID NO: 42295 - DNA, 15 bp, Artificial Sequence
  dgRNA
  Olfr318
ctttagggcacatac

SEQ ID NO: 42296 - DNA, 15 bp, Artificial Sequence
  dgRNA
  Crisp1
atcctgtgtcatacc

SEQ ID NO: 42297 - DNA, 15 bp, Artificial Sequence
  dgRNA
  Crisp1
tggtcttggttaacc

SEQ ID NO: 42298 - DNA, 15 bp, Artificial Sequence
  dgRNA
  Crisp1
tctgcttgtgcaagc

SEQ ID NO: 42299 - DNA, 15 bp, Artificial Sequence
  dgRNA
  Zfp518b
gcgcacgcgcgccgc

SEQ ID NO: 42300 - DNA, 15 bp, Artificial Sequence
  dgRNA
  Zfp518b
ccgactccgcccccc

SEQ ID NO: 42301 - DNA, 15 bp, Artificial Sequence
  dgRNA
  Zfp518b
cgactccgccccccc

SEQ ID NO: 42302 - DNA, 15 bp, Artificial Sequence
  dgRNA
  Zfp518b
tccgcccccccgggt

SEQ ID NO: 42303 - DNA, 15 bp, Artificial Sequence
  dgRNA
  Timmdc1
gggcgcaaacgccaa

SEQ ID NO: 42304 - DNA, 15 bp, Artificial Sequence
  dgRNA
  Timmdc1
ccgccaactcacttc

SEQ ID NO: 42305 - DNA, 15 bp, Artificial Sequence
  dgRNA
  Timmdc1
cgccaactcacttcc

SEQ ID NO: 42306 - DNA, 15 bp, Artificial Sequence
  dgRNA
  Timmdc1
gccaactcacttccg

SEQ ID NO: 42307 - DNA, 15 bp, Artificial Sequence
  dgRNA
  Olfr765
tcataggatataaat

SEQ ID NO: 42308 - DNA, 15 bp, Artificial Sequence
  dgRNA
  Olfr765
aatgggccattagcc

SEQ ID NO: 42309 - DNA, 15 bp, Artificial Sequence
  dgRNA
  Olfr765
atgggccattagcct

SEQ ID NO: 42310 - DNA, 15 bp, Artificial Sequence
  dgRNA
  Yif1b
gccctgctgccgcta

SEQ ID NO: 42311 - DNA, 15 bp, Artificial Sequence
  dgRNA
  Yif1b
gctgccgctaaggta

SEQ ID NO: 42312 - DNA, 15 bp, Artificial Sequence
  dgRNA
  Yif1b
cttcccttacgtcat

SEQ ID NO: 42313 - DNA, 15 bp, Artificial Sequence
  dgRNA
  Yif1b
gacgcccactcaacc

SEQ ID NO: 42314 - DNA, 15 bp, Artificial Sequence
  dgRNA
  Olfr1039
catgattataaccaa

SEQ ID NO: 42315 - DNA, 15 bp, Artificial Sequence
  dgRNA
  Olfr1039
cacttgcaatgagtt

SEQ ID NO: 42316 - DNA, 15 bp, Artificial Sequence
  dgRNA
  Olfr1039
tggcggctcttcaat

SEQ ID NO: 42317 - DNA, 15 bp, Artificial Sequence
  dgRNA
  Olfr1039
aagtattgacatgta

SEQ ID NO: 42318 - DNA, 15 bp, Artificial Sequence
  dgRNA
  4930550L24Rik
tcctgtaacagcgag

SEQ ID NO: 42319 - DNA, 15 bp, Artificial Sequence
  dgRNA
  4930550L24Rik
ggaggggcccacgag

SEQ ID NO: 42320 - DNA, 15 bp, Artificial Sequence
  dgRNA
  4930550L24Rik
aggaggggcccacga

SEQ ID NO: 42321 - DNA, 15 bp, Artificial Sequence
  dgRNA
  4930550L24Rik
aaggaggggcccacg

SEQ ID NO: 42322 - DNA, 15 bp, Artificial Sequence
  dgRNA
  Mtx3
gcacagctcctagtc

SEQ ID NO: 42323 - DNA, 15 bp, Artificial Sequence
  dgRNA
  Mtx3
ctccattccacgtgc

SEQ ID NO: 42324 - DNA, 15 bp, Artificial Sequence
  dgRNA
  Mtx3
cggtacgagtacttc

SEQ ID NO: 42325 - DNA, 15 bp, Artificial Sequence
  dgRNA
  Mtx3
ggtacgagtacttcc

SEQ ID NO: 42326 - DNA, 15 bp, Artificial Sequence
  dgRNA
  Kcnj2
ccacagcaggttccg

SEQ ID NO: 42327 - DNA, 15 bp, Artificial Sequence
  dgRNA
  Kcnj2
agagccagggtccgc

SEQ ID NO: 42328 - DNA, 15 bp, Artificial Sequence
  dgRNA
  Kcnj2
cctgatggcggttcc

SEQ ID NO: 42329 - DNA, 15 bp, Artificial Sequence
  dgRNA
  Kcnj2
ctgatggcggttccc

SEQ ID NO: 42330 - DNA, 15 bp, Artificial Sequence
  dgRNA
  Col6a4
accatttttggcgaa

SEQ ID NO: 42331 - DNA, 15 bp, Artificial Sequence
  dgRNA
  Col6a4
gagagcattaaatgc

SEQ ID NO: 42332 - DNA, 15 bp, Artificial Sequence
  dgRNA
  Col6a4
cgaaaaataataatg

SEQ ID NO: 42333 - DNA, 15 bp, Artificial Sequence
  dgRNA
  Col6a4
tccgaaaaataataa

SEQ ID NO: 42334 - DNA, 15 bp, Artificial Sequence
  dgRNA
  Ankrd39
gctcaagtgatgctt

SEQ ID NO: 42335 - DNA, 15 bp, Artificial Sequence
  dgRNA
  Ankrd39
cctggggaacctgcg

SEQ ID NO: 42336 - DNA, 15 bp, Artificial Sequence
  dgRNA
  Ankrd39
gaacctgcgaggcct

SEQ ID NO: 42337 - DNA, 15 bp, Artificial Sequence
  dgRNA
  Ankrd39
gcgaggcctcggttc

SEQ ID NO: 42338 - DNA, 15 bp, Artificial Sequence
  dgRNA
  Pnmal2
tgctgcgaccgtacc

SEQ ID NO: 42339 - DNA, 15 bp, Artificial Sequence
  dgRNA
  Pnmal2
gctgcgaccgtaccc

SEQ ID NO: 42340 - DNA, 15 bp, Artificial Sequence
  dgRNA
  Pnmal2
cctgcagtgttacta

SEQ ID NO: 42341 - DNA, 15 bp, Artificial Sequence
  dgRNA
  Pnmal2
gttactatggagacg

SEQ ID NO: 42342 - DNA, 15 bp, Artificial Sequence
  dgRNA
  Tmem117
ccgcccggtccggtc

SEQ ID NO: 42343 - DNA, 15 bp, Artificial Sequence
  dgRNA
  Tmem117
ggtctggctccgcag

SEQ ID NO: 42344 - DNA, 15 bp, Artificial Sequence
  dgRNA
  Tmem117
ccgcagaggcgcggc

SEQ ID NO: 42345 - DNA, 15 bp, Artificial Sequence
  dgRNA
  Tmem117
agaggcgcggcaggc

SEQ ID NO: 42346 - DNA, 15 bp, Artificial Sequence
  dgRNA
  Prl4a1
gttacaataccctga

SEQ ID NO: 42347 - DNA, 15 bp, Artificial Sequence
  dgRNA
  Prl4a1
tctcatttgggactc

SEQ ID NO: 42348 - DNA, 15 bp, Artificial Sequence
  dgRNA
  Prl4a1
ttccctagtagtgta

SEQ ID NO: 42349 - DNA, 15 bp, Artificial Sequence
  dgRNA
  Prl4a1
tagtgtatggcctga

SEQ ID NO: 42350 - DNA, 15 bp, Artificial Sequence
  dgRNA
  Scfd2
cggaatgtgcttaca

SEQ ID NO: 42351 - DNA, 15 bp, Artificial Sequence
  dgRNA
  Scfd2
acggaatgtgcttac

SEQ ID NO: 42352 - DNA, 15 bp, Artificial Sequence
  dgRNA
  Scfd2
gtctgcacttgaagg

SEQ ID NO: 42353 - DNA, 15 bp, Artificial Sequence
  dgRNA
  Scfd2
aacgtctgcacttga

SEQ ID NO: 42354 - DNA, 15 bp, Artificial Sequence
  dgRNA
  Sorl1
cgcaactcttcactg

SEQ ID NO: 42355 - DNA, 15 bp, Artificial Sequence
  dgRNA
  Sorl1
actcttcactgcggt

SEQ ID NO: 42356 - DNA, 15 bp, Artificial Sequence
  dgRNA
  Sorl1
ctcttcactgcggta

SEQ ID NO: 42357 - DNA, 15 bp, Artificial Sequence
  dgRNA
  Sorl1
ttcactgcggtaggg

SEQ ID NO: 42358 - DNA, 15 bp, Artificial Sequence
  dgRNA
  Shoc2
aggtttccctctgat

SEQ ID NO: 42359 - DNA, 15 bp, Artificial Sequence
  dgRNA
  Shoc2
ggtttccctctgatt

SEQ ID NO: 42360 - DNA, 15 bp, Artificial Sequence
  dgRNA
  Shoc2
ccctagcgaatgccc

SEQ ID NO: 42361 - DNA, 15 bp, Artificial Sequence
  dgRNA
  Shoc2
cccaggctcgctcaa

SEQ ID NO: 42362 - DNA, 15 bp, Artificial Sequence
  dgRNA
  Tada2b
acgctggttcccgag

SEQ ID NO: 42363 - DNA, 15 bp, Artificial Sequence
  dgRNA
  Tada2b
ggttcccgagaggcg

SEQ ID NO: 42364 - DNA, 15 bp, Artificial Sequence
  dgRNA
  Tada2b
gaggcgtggcccgca

SEQ ID NO: 42365 - DNA, 15 bp, Artificial Sequence
  dgRNA
  Tada2b
cgcacggcctacttc

SEQ ID NO: 42366 - DNA, 15 bp, Artificial Sequence
  dgRNA
  Shpk
tccacctatcaccgg

SEQ ID NO: 42367 - DNA, 15 bp, Artificial Sequence
  dgRNA
  Shpk
caccggaggccgctg

SEQ ID NO: 42368 - DNA, 15 bp, Artificial Sequence
  dgRNA
  Shpk
accggaggccgctgt

SEQ ID NO: 42369 - DNA, 15 bp, Artificial Sequence
  dgRNA
  Shpk
ccggaggccgctgtg

SEQ ID NO: 42370 - DNA, 15 bp, Artificial Sequence
  dgRNA
  Dvl1
aggatcgcagcctgt

SEQ ID NO: 42371 - DNA, 15 bp, Artificial Sequence
  dgRNA
  Dvl1
ggatcgcagcctgtt

SEQ ID NO: 42372 - DNA, 15 bp, Artificial Sequence
  dgRNA
  Dvl1
agcctgttgggaatc

SEQ ID NO: 42373 - DNA, 15 bp, Artificial Sequence
  dgRNA
  Dvl1
gcctgttgggaatct

SEQ ID NO: 42374 - DNA, 15 bp, Artificial Sequence
  dgRNA
  Polr3f
gcgacactttcttgt

SEQ ID NO: 42375 - DNA, 15 bp, Artificial Sequence
  dgRNA
  Polr3f
tgccttctcggcggc

SEQ ID NO: 42376 - DNA, 15 bp, Artificial Sequence
  dgRNA
  Polr3f
ctcggcggctggaag

SEQ ID NO: 42377 - DNA, 15 bp, Artificial Sequence
  dgRNA
  Polr3f
ctgaagggtgcgtac

SEQ ID NO: 42378 - DNA, 15 bp, Artificial Sequence
  dgRNA
  Klf11
gatcacgccgcagcc

SEQ ID NO: 42379 - DNA, 15 bp, Artificial Sequence
  dgRNA
  Klf11
tcacgcgcccccccg

SEQ ID NO: 42380 - DNA, 15 bp, Artificial Sequence
  dgRNA
  Klf11
ccccgcggcgcccat

SEQ ID NO: 42381 - DNA, 15 bp, Artificial Sequence
  dgRNA
  Klf11
tggcccgcttcttgc

SEQ ID NO: 42382 - DNA, 15 bp, Artificial Sequence
  dgRNA
  Atp13a4
tttcccctgtaagtt

SEQ ID NO: 42383 - DNA, 15 bp, Artificial Sequence
  dgRNA
  Atp13a4
acaaaaagatcggca

SEQ ID NO: 42384 - DNA, 15 bp, Artificial Sequence
  dgRNA
  Atp13a4
caaaaagatcggcat

SEQ ID NO: 42385 - DNA, 15 bp, Artificial Sequence
  dgRNA
  Atp13a4
agatcggcatgggag

SEQ ID NO: 42386 - DNA, 15 bp, Artificial Sequence
  dgRNA
  9030617O03Rik
aagaaactcccgcaa

SEQ ID NO: 42387 - DNA, 15 bp, Artificial Sequence
  dgRNA
  9030617O03Rik
agaaactcccgcaaa

SEQ ID NO: 42388 - DNA, 15 bp, Artificial Sequence
  dgRNA
  9030617O03Rik
gggaagtaaccttag

SEQ ID NO: 42389 - DNA, 15 bp, Artificial Sequence
  dgRNA
  9030617O03Rik
ggaagtaaccttaga

SEQ ID NO: 42390 - DNA, 15 bp, Artificial Sequence
  dgRNA
  Eif4ebp1
cccagagtctcgggg

SEQ ID NO: 42391 - DNA, 15 bp, Artificial Sequence
  dgRNA
  Eif4ebp1
tctcggggaggaacc

SEQ ID NO: 42392 - DNA, 15 bp, Artificial Sequence
  dgRNA
  Eif4ebp1
ctcggggaggaacca

SEQ ID NO: 42393 - DNA, 15 bp, Artificial Sequence
  dgRNA
  Eif4ebp1
caaggggcccacact

SEQ ID NO: 42394 - DNA, 15 bp, Artificial Sequence
  dgRNA
  Arhgap23
tagacccaagtaggc

SEQ ID NO: 42395 - DNA, 15 bp, Artificial Sequence
  dgRNA
  Arhgap23
tggaggccaatcggg

SEQ ID NO: 42396 - DNA, 15 bp, Artificial Sequence
  dgRNA
  Arhgap23
acgccaccaccgacg

SEQ ID NO: 42397 - DNA, 15 bp, Artificial Sequence
  dgRNA
  Arhgap23
acttgggtctaggtc

SEQ ID NO: 42398 - DNA, 15 bp, Artificial Sequence
  dgRNA
  Cdk19
gcgcgctgagggggt

SEQ ID NO: 42399 - DNA, 15 bp, Artificial Sequence
  dgRNA
  Cdk19
gcggcggcagagcgc

SEQ ID NO: 42400 - DNA, 15 bp, Artificial Sequence
  dgRNA
  Cdk19
ggcgtacatgccttg

SEQ ID NO: 42401 - DNA, 15 bp, Artificial Sequence
  dgRNA
  Cdk19
gtacatgccttgtgg

SEQ ID NO: 42402 - DNA, 15 bp, Artificial Sequence
  dgRNA
  Gm16286
gcgcgagattagact

SEQ ID NO: 42403 - DNA, 15 bp, Artificial Sequence
  dgRNA
  Gm16286
cgcgagattagactc

SEQ ID NO: 42404 - DNA, 15 bp, Artificial Sequence
  dgRNA
  Olfr1426
atttgagcataagac

SEQ ID NO: 42405 - DNA, 15 bp, Artificial Sequence
  dgRNA
  Olfr1426
gtacaaattccttag

SEQ ID NO: 42406 - DNA, 15 bp, Artificial Sequence
  dgRNA
  Nppc
cggctccttcggagg

SEQ ID NO: 42407 - DNA, 15 bp, Artificial Sequence
  dgRNA
  Nppc
ggctccttcggaggt

SEQ ID NO: 42408 - DNA, 15 bp, Artificial Sequence
  dgRNA
  Nppc
ttcggaggtgggatg

SEQ ID NO: 42409 - DNA, 15 bp, Artificial Sequence
  dgRNA
  Nppc
cccgtggccccctcc

SEQ ID NO: 42410 - DNA, 15 bp, Artificial Sequence
  dgRNA
  Nod1
cccgggtcccggcat

SEQ ID NO: 42411 - DNA, 15 bp, Artificial Sequence
  dgRNA
  Nod1
attggttgtggttac

SEQ ID NO: 42412 - DNA, 15 bp, Artificial Sequence
  dgRNA
  Nod1
tgtggttacaggcgc

SEQ ID NO: 42413 - DNA, 15 bp, Artificial Sequence
  dgRNA
  Nod1
gtggttacaggcgct

SEQ ID NO: 42414 - DNA, 15 bp, Artificial Sequence
  dgRNA
  Slc17a9
atttctggcgggtct

SEQ ID NO: 42415 - DNA, 15 bp, Artificial Sequence
  dgRNA
  Slc17a9
tttctggcgggtctc

SEQ ID NO: 42416 - DNA, 15 bp, Artificial Sequence
  dgRNA
  Slc17a9
ggccacaaaaccccc

SEQ ID NO: 42417 - DNA, 15 bp, Artificial Sequence
  dgRNA
  Slc17a9
cctctagttgctcga

SEQ ID NO: 42418 - DNA, 15 bp, Artificial Sequence
  dgRNA
  Trem3
ggtgtcacaaaaaat

SEQ ID NO: 42419 - DNA, 15 bp, Artificial Sequence
  dgRNA
  Trem3
cggtcagtttctatg

SEQ ID NO: 42420 - DNA, 15 bp, Artificial Sequence
  dgRNA
  Trem3
atcacttacagttgc

SEQ ID NO: 42421 - DNA, 15 bp, Artificial Sequence
  dgRNA
  F2rl1
tccagcctcacccgc

SEQ ID NO: 42422 - DNA, 15 bp, Artificial Sequence
  dgRNA
  F2rl1
acgctggccagcaca

SEQ ID NO: 42423 - DNA, 15 bp, Artificial Sequence
  dgRNA
  F2rl1
acgggagctacggtc

SEQ ID NO: 42424 - DNA, 15 bp, Artificial Sequence
  dgRNA
  F2rl1
acggtcaggctgtgc

SEQ ID NO: 42425 - DNA, 15 bp, Artificial Sequence
  dgRNA
  Krtap6-5
gtcattaaagaggct

SEQ ID NO: 42426 - DNA, 15 bp, Artificial Sequence
  dgRNA
  Sars
accaggtcagcgcgc

SEQ ID NO: 42427 - DNA, 15 bp, Artificial Sequence
  dgRNA
  Sars
gcctgcgcgctgacc

SEQ ID NO: 42428 - DNA, 15 bp, Artificial Sequence
  dgRNA
  Atp1b1
cccctttagctttgc

SEQ ID NO: 42429 - DNA, 15 bp, Artificial Sequence
  dgRNA
  Atp1b1
gccggctcctttgtg

SEQ ID NO: 42430 - DNA, 15 bp, Artificial Sequence
  dgRNA
  Atp1b1
ccggctcctttgtgc

SEQ ID NO: 42431 - DNA, 15 bp, Artificial Sequence
  dgRNA
  Atp1b1
cggctcctttgtgcg

SEQ ID NO: 42432 - DNA, 15 bp, Artificial Sequence
  dgRNA
  Rps26
tcatagaccatttct

SEQ ID NO: 42433 - DNA, 15 bp, Artificial Sequence
  dgRNA
  Rps26
aaccctacatttcac

SEQ ID NO: 42434 - DNA, 15 bp, Artificial Sequence
  dgRNA
  Rps26
agcataatagctgct

SEQ ID NO: 42435 - DNA, 15 bp, Artificial Sequence
  dgRNA
  Rps26
gcataatagctgcta

SEQ ID NO: 42436 - DNA, 15 bp, Artificial Sequence
  dgRNA
  Cttnbp2nl
ggatcttgcggcccc

SEQ ID NO: 42437 - DNA, 15 bp, Artificial Sequence
  dgRNA
  Cttnbp2nl
tcttgcggccccagg

SEQ ID NO: 42438 - DNA, 15 bp, Artificial Sequence
  dgRNA
  Cttnbp2nl
gagccgggatgactt

SEQ ID NO: 42439 - DNA, 15 bp, Artificial Sequence
  dgRNA
  Cttnbp2nl
agaagccccgccttc

SEQ ID NO: 42440 - DNA, 15 bp, Artificial Sequence
  dgRNA
  Vwf
gtcctggctgcctaa

SEQ ID NO: 42441 - DNA, 15 bp, Artificial Sequence
  dgRNA
  Vwf
tcctggctgcctaaa

SEQ ID NO: 42442 - DNA, 15 bp, Artificial Sequence
  dgRNA
  Vwf
cctaaaggggcactc

SEQ ID NO: 42443 - DNA, 15 bp, Artificial Sequence
  dgRNA
  Vwf
ctaaaggggcactca

SEQ ID NO: 42444 - DNA, 15 bp, Artificial Sequence
  dgRNA
  Tro
ctagtcgtattttag

SEQ ID NO: 42445 - DNA, 15 bp, Artificial Sequence
  dgRNA
  Tro
aggcgctgaacatta

SEQ ID NO: 42446 - DNA, 15 bp, Artificial Sequence
  dgRNA
  Tro
actagattaagatag

SEQ ID NO: 42447 - DNA, 15 bp, Artificial Sequence
  dgRNA
  Ppwd1
atcaaaaagcgcttc

SEQ ID NO: 42448 - DNA, 15 bp, Artificial Sequence
  dgRNA
  Ppwd1
acaaaagctgcgccg

SEQ ID NO: 42449 - DNA, 15 bp, Artificial Sequence
  dgRNA
  Ppwd1
agctgcgccgcggct

SEQ ID NO: 42450 - DNA, 15 bp, Artificial Sequence
  dgRNA
  Ppwd1
gctgcgccgcggctc

SEQ ID NO: 42451 - DNA, 15 bp, Artificial Sequence
  dgRNA
  4932438H23Rik
caggttctctcctac

SEQ ID NO: 42452 - DNA, 15 bp, Artificial Sequence
  dgRNA
  4932438H23Rik
gttaataaaactggt

SEQ ID NO: 42453 - DNA, 15 bp, Artificial Sequence
  dgRNA
  4932438H23Rik
gtagactgaccacaa

SEQ ID NO: 42454 - DNA, 15 bp, Artificial Sequence
  dgRNA
  4932438H23Rik
gaatgcgtggtctcg

SEQ ID NO: 42455 - DNA, 15 bp, Artificial Sequence
  dgRNA
  Arfgap1
cgtcgcgctttgcaa

SEQ ID NO: 42456 - DNA, 15 bp, Artificial Sequence
  dgRNA
  Arfgap1
acgtcgcgctttgca

SEQ ID NO: 42457 - DNA, 15 bp, Artificial Sequence
  dgRNA
  Zfp524
aggcgcctgatacgc

SEQ ID NO: 42458 - DNA, 15 bp, Artificial Sequence
  dgRNA
  Zfp524
ttgttgctagcgtgt

SEQ ID NO: 42459 - DNA, 15 bp, Artificial Sequence
  dgRNA
  Zfp524
tgttgctagcgtgtc

SEQ ID NO: 42460 - DNA, 15 bp, Artificial Sequence
  dgRNA
  Zfp524
gttgctagcgtgtcg

SEQ ID NO: 42461 - DNA, 15 bp, Artificial Sequence
  dgRNA
  Nudt22
tatgcgttgacaagt

SEQ ID NO: 42462 - DNA, 15 bp, Artificial Sequence
  dgRNA
  Nudt22
cgttgacaagtaggt

SEQ ID NO: 42463 - DNA, 15 bp, Artificial Sequence
  dgRNA
  Nudt22
tgacaagtaggtcgg

SEQ ID NO: 42464 - DNA, 15 bp, Artificial Sequence
  dgRNA
  Nudt22
gacaagtaggtcggc

SEQ ID NO: 42465 - DNA, 15 bp, Artificial Sequence
  dgRNA
  Gtf2h5
gcccgtcctacctgc

SEQ ID NO: 42466 - DNA, 15 bp, Artificial Sequence
  dgRNA
  Gtf2h5
ccggcgcaatgactc

SEQ ID NO: 42467 - DNA, 15 bp, Artificial Sequence
  dgRNA
  Gtf2h5
ctctggcagcccgga

SEQ ID NO: 42468 - DNA, 15 bp, Artificial Sequence
  dgRNA
  Gtf2h5
agcccggacggctcg

SEQ ID NO: 42469 - DNA, 15 bp, Artificial Sequence
  dgRNA
  Per2
ttcattgaggaaccc

SEQ ID NO: 42470 - DNA, 15 bp, Artificial Sequence
  dgRNA
  Per2
attgaggaacccggg

SEQ ID NO: 42471 - DNA, 15 bp, Artificial Sequence
  dgRNA
  Per2
cccgggcggcgaaca

SEQ ID NO: 42472 - DNA, 15 bp, Artificial Sequence
  dgRNA
  Per2
tgtaaagagagcgac

SEQ ID NO: 42473 - DNA, 15 bp, Artificial Sequence
  dgRNA
  Ewsr1
accactcgtcacgtc

SEQ ID NO: 42474 - DNA, 15 bp, Artificial Sequence
  dgRNA
  Ewsr1
tcacgtccggctctt

SEQ ID NO: 42475 - DNA, 15 bp, Artificial Sequence
  dgRNA
  Ewsr1
cacgtccggctcttt

SEQ ID NO: 42476 - DNA, 15 bp, Artificial Sequence
  dgRNA
  Ewsr1
ccggctctttgggag

SEQ ID NO: 42477 - DNA, 15 bp, Artificial Sequence
  dgRNA
  Gm11541
atggggggatgcacg

SEQ ID NO: 42478 - DNA, 15 bp, Artificial Sequence
  dgRNA
  Gm11541
tggggggatgcacgt

SEQ ID NO: 42479 - DNA, 15 bp, Artificial Sequence
  dgRNA
  Gm11541
ggggatgcacgtggg

SEQ ID NO: 42480 - DNA, 15 bp, Artificial Sequence
  dgRNA
  Gm11541
gggatgcacgtgggt

SEQ ID NO: 42481 - DNA, 15 bp, Artificial Sequence
  dgRNA
  Mydgf
acgaagtcgccctcc

SEQ ID NO: 42482 - DNA, 15 bp, Artificial Sequence
  dgRNA
  Mydgf
gcgagcgtcaatcag

SEQ ID NO: 42483 - DNA, 15 bp, Artificial Sequence
  dgRNA
  Mydgf
ccatggcagccaaat

SEQ ID NO: 42484 - DNA, 15 bp, Artificial Sequence
  dgRNA
  Mydgf
catggcagccaaatc

SEQ ID NO: 42485 - DNA, 15 bp, Artificial Sequence
  dgRNA
  Agpat1
gcagcgagggagccg

SEQ ID NO: 42486 - DNA, 15 bp, Artificial Sequence
  dgRNA
  Agpat1
gggagccggggtcac

SEQ ID NO: 42487 - DNA, 15 bp, Artificial Sequence
  dgRNA
  Agpat1
caccggtgctgaaac

SEQ ID NO: 42488 - DNA, 15 bp, Artificial Sequence
  dgRNA
  Agpat1
cggtgctgaaaccgg

SEQ ID NO: 42489 - DNA, 15 bp, Artificial Sequence
  dgRNA
  Exosc1
accacccagctgcgc

SEQ ID NO: 42490 - DNA, 15 bp, Artificial Sequence
  dgRNA
  Exosc1
cgcaggcgcgaggcc

SEQ ID NO: 42491 - DNA, 15 bp, Artificial Sequence
  dgRNA
  Exosc1
gcccggagcccgcaa

SEQ ID NO: 42492 - DNA, 15 bp, Artificial Sequence
  dgRNA
  Exosc1
cagagatctgtcccg

SEQ ID NO: 42493 - DNA, 15 bp, Artificial Sequence
  dgRNA
  Zfp385a
ggggcggtaactgaa

SEQ ID NO: 42494 - DNA, 15 bp, Artificial Sequence
  dgRNA
  Zfp385a
aagcgggaggctgcc

SEQ ID NO: 42495 - DNA, 15 bp, Artificial Sequence
  dgRNA
  Zfp385a
caggacgccccctcg

SEQ ID NO: 42496 - DNA, 15 bp, Artificial Sequence
  dgRNA
  Zfp385a
ccccctcgcggagcc

SEQ ID NO: 42497 - DNA, 15 bp, Artificial Sequence
  dgRNA
  Fbxo32
ggcaccgagggtcag

SEQ ID NO: 42498 - DNA, 15 bp, Artificial Sequence
  dgRNA
  Fbxo32
gcaccgagggtcagc

SEQ ID NO: 42499 - DNA, 15 bp, Artificial Sequence
  dgRNA
  Fbxo32
gcgggacatctggcc

SEQ ID NO: 42500 - DNA, 15 bp, Artificial Sequence
  dgRNA
  Fbxo32
gtttccacggacgca

SEQ ID NO: 42501 - DNA, 15 bp, Artificial Sequence
  dgRNA
  Igf1
aaaggcagtttaccc

SEQ ID NO: 42502 - DNA, 15 bp, Artificial Sequence
  dgRNA
  Igf1
cgtctttttccccca

SEQ ID NO: 42503 - DNA, 15 bp, Artificial Sequence
  dgRNA
  Igf1
agtaaattgcacagc

SEQ ID NO: 42504 - DNA, 15 bp, Artificial Sequence
  dgRNA
  Ifi30
cagacatgctagccg

SEQ ID NO: 42505 - DNA, 15 bp, Artificial Sequence
  dgRNA
  Ifi30
acatgctagccgcgg

SEQ ID NO: 42506 - DNA, 15 bp, Artificial Sequence
  dgRNA
  Ifi30
ctagccgcggaggac

SEQ ID NO: 42507 - DNA, 15 bp, Artificial Sequence
  dgRNA
  Ifi30
gccgcggaggactgg

SEQ ID NO: 42508 - DNA, 15 bp, Artificial Sequence
  dgRNA
  B4galt1
gaaaaacccggctga

SEQ ID NO: 42509 - DNA, 15 bp, Artificial Sequence
  dgRNA
  B4galt1
aaaagacccgctttg

SEQ ID NO: 42510 - DNA, 15 bp, Artificial Sequence
  dgRNA
  B4galt1
agactccgccccccc

SEQ ID NO: 42511 - DNA, 15 bp, Artificial Sequence
  dgRNA
  B4galt1
tccgaaacccggttg

SEQ ID NO: 42512 - DNA, 15 bp, Artificial Sequence
  dgRNA
  Casp9
gattgctggtctacg

SEQ ID NO: 42513 - DNA, 15 bp, Artificial Sequence
  dgRNA
  Casp9
ctggtctacgaggcg

SEQ ID NO: 42514 - DNA, 15 bp, Artificial Sequence
  dgRNA
  Casp9
gtctacgaggcgagg

SEQ ID NO: 42515 - DNA, 15 bp, Artificial Sequence
  dgRNA
  Casp9
tctacgaggcgagga

SEQ ID NO: 42516 - DNA, 15 bp, Artificial Sequence
  dgRNA
  Cdc42ep1
ggtcgccccgcctag

SEQ ID NO: 42517 - DNA, 15 bp, Artificial Sequence
  dgRNA
  Cdc42ep1
cgccccgcctagggg

SEQ ID NO: 42518 - DNA, 15 bp, Artificial Sequence
  dgRNA
  Cdc42ep1
cccgcctaggggtgg

SEQ ID NO: 42519 - DNA, 15 bp, Artificial Sequence
  dgRNA
  Cdc42ep1
ccgcctaggggtggt

SEQ ID NO: 42520 - DNA, 15 bp, Artificial Sequence
  dgRNA
  Epb41l1
ccgagttcccctccc

SEQ ID NO: 42521 - DNA, 15 bp, Artificial Sequence
  dgRNA
  Id4
ccccgagcagctctc

SEQ ID NO: 42522 - DNA, 15 bp, Artificial Sequence
  dgRNA
  Id4
tctccggtcgatttc

SEQ ID NO: 42523 - DNA, 15 bp, Artificial Sequence
  dgRNA
  Id4
tcgatttctggagct

SEQ ID NO: 42524 - DNA, 15 bp, Artificial Sequence
  dgRNA
  Id4
gagctcggagccgcc

SEQ ID NO: 42525 - DNA, 15 bp, Artificial Sequence
  dgRNA
  Fgf1
gtgcactgatgtggt

SEQ ID NO: 42526 - DNA, 15 bp, Artificial Sequence
  dgRNA
  Fgf1
tgcactgatgtggta

SEQ ID NO: 42527 - DNA, 15 bp, Artificial Sequence
  dgRNA
  Fgf1
ggaggccagcgctct

SEQ ID NO: 42528 - DNA, 15 bp, Artificial Sequence
  dgRNA
  Fgf1
gggagccgagagcgc

SEQ ID NO: 42529 - DNA, 15 bp, Artificial Sequence
  dgRNA
  Arrdc2
tactgactttctcgc

SEQ ID NO: 42530 - DNA, 15 bp, Artificial Sequence
  dgRNA
  Arrdc2
cccttcacacgctat

SEQ ID NO: 42531 - DNA, 15 bp, Artificial Sequence
  dgRNA
  Arrdc2
cacacgctattggcc

SEQ ID NO: 42532 - DNA, 15 bp, Artificial Sequence
  dgRNA
  Arrdc2
gcctggtcccttgta

SEQ ID NO: 42533 - DNA, 15 bp, Artificial Sequence
  dgRNA
  Fabp7
cctttagagcatggg

SEQ ID NO: 42534 - DNA, 15 bp, Artificial Sequence
  dgRNA
  Fabp7
actccgctaacccag

SEQ ID NO: 42535 - DNA, 15 bp, Artificial Sequence
  dgRNA
  Fabp7
gagcaaatcacaagg

SEQ ID NO: 42536 - DNA, 15 bp, Artificial Sequence
  dgRNA
  Fabp7
aagtcagcggggcct

SEQ ID NO: 42537 - DNA, 15 bp, Artificial Sequence
  dgRNA
  Il27
ttccctggctaaaat

SEQ ID NO: 42538 - DNA, 15 bp, Artificial Sequence
  dgRNA
  Il27
cttccctggctaaaa

SEQ ID NO: 42539 - DNA, 15 bp, Artificial Sequence
  dgRNA
  Il27
ggggtcttatactgg

SEQ ID NO: 42540 - DNA, 15 bp, Artificial Sequence
  dgRNA
  Il27
gggggtcttatactg

SEQ ID NO: 42541 - DNA, 15 bp, Artificial Sequence
  dgRNA
  Wdr44
gtctgggacctgcgc

SEQ ID NO: 42542 - DNA, 15 bp, Artificial Sequence
  dgRNA
  Pafah2
acagagctgctcgct

SEQ ID NO: 42543 - DNA, 15 bp, Artificial Sequence
  dgRNA
  Pafah2
cagagctgctcgcta

SEQ ID NO: 42544 - DNA, 15 bp, Artificial Sequence
  dgRNA
  Pafah2
agagctgctcgctag

SEQ ID NO: 42545 - DNA, 15 bp, Artificial Sequence
  dgRNA
  Pafah2
ctgctcgctaggggc

SEQ ID NO: 42546 - DNA, 15 bp, Artificial Sequence
  dgRNA
  Emilin3
cctcgtgtttgcacg

SEQ ID NO: 42547 - DNA, 15 bp, Artificial Sequence
  dgRNA
  Emilin3
ttgcacgcggccctt

SEQ ID NO: 42548 - DNA, 15 bp, Artificial Sequence
  dgRNA
  Emilin3
tgcacgcggcccttc

SEQ ID NO: 42549 - DNA, 15 bp, Artificial Sequence
  dgRNA
  Emilin3
cttcgggcgtcagct

SEQ ID NO: 42550 - DNA, 15 bp, Artificial Sequence
  dgRNA
  C2cd5
cacctaaccgacccg

SEQ ID NO: 42551 - DNA, 15 bp, Artificial Sequence
  dgRNA
  C2cd5
taaccgacccgaggc

SEQ ID NO: 42552 - DNA, 15 bp, Artificial Sequence
  dgRNA
  C2cd5
aaccgacccgaggct

SEQ ID NO: 42553 - DNA, 15 bp, Artificial Sequence
  dgRNA
  C2cd5
gatgcagggctcgac

SEQ ID NO: 42554 - DNA, 15 bp, Artificial Sequence
  dgRNA
  Atp5g1
tcgtaaccccgaact

SEQ ID NO: 42555 - DNA, 15 bp, Artificial Sequence
  dgRNA
  Atp5g1
ccgcctttatccgca

SEQ ID NO: 42556 - DNA, 15 bp, Artificial Sequence
  dgRNA
  Atp5g1
cctttatccgcaagg

SEQ ID NO: 42557 - DNA, 15 bp, Artificial Sequence
  dgRNA
  Atp5g1
ttatccgcaaggagg

SEQ ID NO: 42558 - DNA, 15 bp, Artificial Sequence
  dgRNA
  Ect2l
actgcctgggaccgg

SEQ ID NO: 42559 - DNA, 15 bp, Artificial Sequence
  dgRNA
  Ect2l
aaggtgacaaccttc

SEQ ID NO: 42560 - DNA, 15 bp, Artificial Sequence
  dgRNA
  Ect2l
agcaaagaccgaggt

SEQ ID NO: 42561 - DNA, 15 bp, Artificial Sequence
  dgRNA
  Ect2l
accgaggttggccac

SEQ ID NO: 42562 - DNA, 15 bp, Artificial Sequence
  dgRNA
  Phf11d
agttattttaggccc

SEQ ID NO: 42563 - DNA, 15 bp, Artificial Sequence
  dgRNA
  Phf11d
cacttcccgccaatt

SEQ ID NO: 42564 - DNA, 15 bp, Artificial Sequence
  dgRNA
  Phf11d
tcgggaaacgaaact

SEQ ID NO: 42565 - DNA, 15 bp, Artificial Sequence
  dgRNA
  Phf11d
aaagacctaattggc

SEQ ID NO: 42566 - DNA, 15 bp, Artificial Sequence
  dgRNA
  Hist1h1d
ctttctctggcaacg

SEQ ID NO: 42567 - DNA, 15 bp, Artificial Sequence
  dgRNA
  Hist1h1d
tggcaacgcggcgca

SEQ ID NO: 42568 - DNA, 15 bp, Artificial Sequence
  dgRNA
  Hist1h1d
gcggcgcacggcgca

SEQ ID NO: 42569 - DNA, 15 bp, Artificial Sequence
  dgRNA
  Hist1h1d
cacggcgcacggcgc

SEQ ID NO: 42570 - DNA, 15 bp, Artificial Sequence
  dgRNA
  Rapgef4
cctcccccgaggtga

SEQ ID NO: 42571 - DNA, 15 bp, Artificial Sequence
  dgRNA
  Rapgef4
ggtgagggtagacgc

SEQ ID NO: 42572 - DNA, 15 bp, Artificial Sequence
  dgRNA
  Rapgef4
gggtagacgcgggcc

SEQ ID NO: 42573 - DNA, 15 bp, Artificial Sequence
  dgRNA
  Rapgef4
tagacgcgggcctgg

SEQ ID NO: 42574 - DNA, 15 bp, Artificial Sequence
  dgRNA
  Fam65b
cagagcctgacgtgc

SEQ ID NO: 42575 - DNA, 15 bp, Artificial Sequence
  dgRNA
  Fam65b
aggcagacgatcagc

SEQ ID NO: 42576 - DNA, 15 bp, Artificial Sequence
  dgRNA
  Fam65b
cagacgatcagctgg

SEQ ID NO: 42577 - DNA, 15 bp, Artificial Sequence
  dgRNA
  Fam65b
ccaagcgcaccctga

SEQ ID NO: 42578 - DNA, 15 bp, Artificial Sequence
  dgRNA
  Iffo1
cctcagacccgggaa

SEQ ID NO: 42579 - DNA, 15 bp, Artificial Sequence
  dgRNA
  Iffo1
gctgatgccctaatg

SEQ ID NO: 42580 - DNA, 15 bp, Artificial Sequence
  dgRNA
  Iffo1
ctgatgccctaatga

SEQ ID NO: 42581 - DNA, 15 bp, Artificial Sequence
  dgRNA
  Iffo1
atgagggcctttcat

SEQ ID NO: 42582 - DNA, 15 bp, Artificial Sequence
  dgRNA
  Gpx7
tcccaattctacact

SEQ ID NO: 42583 - DNA, 15 bp, Artificial Sequence
  dgRNA
  Gpx7
ttcccgtaaagaaac

SEQ ID NO: 42584 - DNA, 15 bp, Artificial Sequence
  dgRNA
  Gpx7
tcccgtaaagaaact

SEQ ID NO: 42585 - DNA, 15 bp, Artificial Sequence
  dgRNA
  Gpx7
cccgtaaagaaactg

SEQ ID NO: 42586 - DNA, 15 bp, Artificial Sequence
  dgRNA
  Mpc1
caaccgccagtcgtc

SEQ ID NO: 42587 - DNA, 15 bp, Artificial Sequence
  dgRNA
  Mpc1
aaccgccagtcgtcc

SEQ ID NO: 42588 - DNA, 15 bp, Artificial Sequence
  dgRNA
  Mpc1
agtcgtccgggccgc

SEQ ID NO: 42589 - DNA, 15 bp, Artificial Sequence
  dgRNA
  Mpc1
gtcgtccgggccgcc

SEQ ID NO: 42590 - DNA, 15 bp, Artificial Sequence
  dgRNA
  Ror1
atcaacatcaatggc

SEQ ID NO: 42591 - DNA, 15 bp, Artificial Sequence
  dgRNA
  Ror1
tggtccccagcgagt

SEQ ID NO: 42592 - DNA, 15 bp, Artificial Sequence
  dgRNA
  Ror1
ggtccccagcgagtg

SEQ ID NO: 42593 - DNA, 15 bp, Artificial Sequence
  dgRNA
  Ror1
gtccccagcgagtgg

SEQ ID NO: 42594 - DNA, 15 bp, Artificial Sequence
  dgRNA
  Adamts2
tgacccggcgcttct

SEQ ID NO: 42595 - DNA, 15 bp, Artificial Sequence
  dgRNA
  Adamts2
cagcctgcggtgacc

SEQ ID NO: 42596 - DNA, 15 bp, Artificial Sequence
  dgRNA
  Adamts2
gggcgcctcagcctg

SEQ ID NO: 42597 - DNA, 15 bp, Artificial Sequence
  dgRNA
  Adamts2
cgaaggcaagcgagg

SEQ ID NO: 42598 - DNA, 15 bp, Artificial Sequence
  dgRNA
  Stt3b
cgcacgccgccattc

SEQ ID NO: 42599 - DNA, 15 bp, Artificial Sequence
  dgRNA
  Stt3b
ctgtcgctctgtgac

SEQ ID NO: 42600 - DNA, 15 bp, Artificial Sequence
  dgRNA
  Stt3b
tcgctctgtgacagg

SEQ ID NO: 42601 - DNA, 15 bp, Artificial Sequence
  dgRNA
  Stt3b
ctgtgacaggcggag

SEQ ID NO: 42602 - DNA, 15 bp, Artificial Sequence
  dgRNA
  Chmp7
cttcccgtcgcacaa

SEQ ID NO: 42603 - DNA, 15 bp, Artificial Sequence
  dgRNA
  Chmp7
gtcgcacaaaggcca

SEQ ID NO: 42604 - DNA, 15 bp, Artificial Sequence
  dgRNA
  Chmp7
cacggagagaaggtc

SEQ ID NO: 42605 - DNA, 15 bp, Artificial Sequence
  dgRNA
  Chmp7
cgccctgaagacttg

SEQ ID NO: 42606 - DNA, 15 bp, Artificial Sequence
  dgRNA
  Bach1
atccacaacgttaca

SEQ ID NO: 42607 - DNA, 15 bp, Artificial Sequence
  dgRNA
  Bach1
ttacacggagctcgc

SEQ ID NO: 42608 - DNA, 15 bp, Artificial Sequence
  dgRNA
  Bach1
cacggagctcgcagg

SEQ ID NO: 42609 - DNA, 15 bp, Artificial Sequence
  dgRNA
  Bach1
agaggctcttactag

SEQ ID NO: 42610 - DNA, 15 bp, Artificial Sequence
  dgRNA
  Mphosph9
gtcgtactcctccca

SEQ ID NO: 42611 - DNA, 15 bp, Artificial Sequence
  dgRNA
  Mphosph9
gcacgctagaaaccc

SEQ ID NO: 42612 - DNA, 15 bp, Artificial Sequence
  dgRNA
  Mphosph9
tcgccctgccctctc

SEQ ID NO: 42613 - DNA, 15 bp, Artificial Sequence
  dgRNA
  Mphosph9
cgcagttgatgagaa

SEQ ID NO: 42614 - DNA, 15 bp, Artificial Sequence
  dgRNA
  Scrg1
agagtctacatcatg

SEQ ID NO: 42615 - DNA, 15 bp, Artificial Sequence
  dgRNA
  Scrg1
aaactcgataccttg

SEQ ID NO: 42616 - DNA, 15 bp, Artificial Sequence
  dgRNA
  Scrg1
aaaactcgatacctt

SEQ ID NO: 42617 - DNA, 15 bp, Artificial Sequence
  dgRNA
  Scrg1
taaaactcgatacct

SEQ ID NO: 42618 - DNA, 15 bp, Artificial Sequence
  dgRNA
  Laptm5
cggtgttcagcatcc

SEQ ID NO: 42619 - DNA, 15 bp, Artificial Sequence
  dgRNA
  Laptm5
agtagttctaatgga

SEQ ID NO: 42620 - DNA, 15 bp, Artificial Sequence
  dgRNA
  Laptm5
aaaaagaatccgata

SEQ ID NO: 42621 - DNA, 15 bp, Artificial Sequence
  dgRNA
  Tmem129
ccgctctcgcagtcc

SEQ ID NO: 42622 - DNA, 15 bp, Artificial Sequence
  dgRNA
  Tmem129
tcaaataccgaaagt

SEQ ID NO: 42623 - DNA, 15 bp, Artificial Sequence
  dgRNA
  Tmem129
agccaatcagcgcgt

SEQ ID NO: 42624 - DNA, 15 bp, Artificial Sequence
  dgRNA
  Tmem129
agcgcgttggagaag

SEQ ID NO: 42625 - DNA, 15 bp, Artificial Sequence
  dgRNA
  Nkx3-1
attccagtaagaatt

SEQ ID NO: 42626 - DNA, 15 bp, Artificial Sequence
  dgRNA
  Nkx3-1
agaatttggcgtttg

SEQ ID NO: 42627 - DNA, 15 bp, Artificial Sequence
  dgRNA
  Nkx3-1
ggttaagggctcatc

SEQ ID NO: 42628 - DNA, 15 bp, Artificial Sequence
  dgRNA
  Nkx3-1
gagcctaatccgccc

SEQ ID NO: 42629 - DNA, 15 bp, Artificial Sequence
  dgRNA
  Anpep
tgtgttggttacagc

SEQ ID NO: 42630 - DNA, 15 bp, Artificial Sequence
  dgRNA
  Anpep
ccttcgcctgagctc

SEQ ID NO: 42631 - DNA, 15 bp, Artificial Sequence
  dgRNA
  Anpep
cgactgcaggtggcc

SEQ ID NO: 42632 - DNA, 15 bp, Artificial Sequence
  dgRNA
  Anpep
ggttacgactgcagg

SEQ ID NO: 42633 - DNA, 15 bp, Artificial Sequence
  dgRNA
  Pxn
gactagtctgccaga

SEQ ID NO: 42634 - DNA, 15 bp, Artificial Sequence
  dgRNA
  Pxn
tcagactgaacgcag

SEQ ID NO: 42635 - DNA, 15 bp, Artificial Sequence
  dgRNA
  Pxn
gcctgtccagccgcc

SEQ ID NO: 42636 - DNA, 15 bp, Artificial Sequence
  dgRNA
  Pxn
ctgtccagccgccag

SEQ ID NO: 42637 - DNA, 15 bp, Artificial Sequence
  dgRNA
  Phf21a
tgtaattttaaacgg

SEQ ID NO: 42638 - DNA, 15 bp, Artificial Sequence
  dgRNA
  Phf21a
agacataagagagcg

SEQ ID NO: 42639 - DNA, 15 bp, Artificial Sequence
  dgRNA
  Phf21a
aactgtatcccccaa

SEQ ID NO: 42640 - DNA, 15 bp, Artificial Sequence
  dgRNA
  Sh2d3c
gccttctaggtccca

SEQ ID NO: 42641 - DNA, 15 bp, Artificial Sequence
  dgRNA
  Sh2d3c
ggtcccaagggtttg

SEQ ID NO: 42642 - DNA, 15 bp, Artificial Sequence
  dgRNA
  Sh2d3c
cgccccctgtggaga

SEQ ID NO: 42643 - DNA, 15 bp, Artificial Sequence
  dgRNA
  Sh2d3c
cccctgtggagacgg

SEQ ID NO: 42644 - DNA, 15 bp, Artificial Sequence
  dgRNA
  Chchd5
ctggctgctcgatca

SEQ ID NO: 42645 - DNA, 15 bp, Artificial Sequence
  dgRNA
  Chchd5
ccgaagtcctgcttc

SEQ ID NO: 42646 - DNA, 15 bp, Artificial Sequence
  dgRNA
  Chchd5
gcgaccaccacaagc

SEQ ID NO: 42647 - DNA, 15 bp, Artificial Sequence
  dgRNA
  Chchd5
aaatagctgacggac

SEQ ID NO: 42648 - DNA, 15 bp, Artificial Sequence
  dgRNA
  Plxna3
cttgcactagagtcc

SEQ ID NO: 42649 - DNA, 15 bp, Artificial Sequence
  dgRNA
  Plxna3
tgcgctctgcttctt

SEQ ID NO: 42650 - DNA, 15 bp, Artificial Sequence
  dgRNA
  Plxna3
gcgctctgcttctta

SEQ ID NO: 42651 - DNA, 15 bp, Artificial Sequence
  dgRNA
  Plxna3
tgcttcttagggccc

SEQ ID NO: 42652 - DNA, 15 bp, Artificial Sequence
  dgRNA
  Camk2n2
gttctctgccgcagt

SEQ ID NO: 42653 - DNA, 15 bp, Artificial Sequence
  dgRNA
  Camk2n2
ttctctgccgcagtc

SEQ ID NO: 42654 - DNA, 15 bp, Artificial Sequence
  dgRNA
  Camk2n2
ccgccgcctgcccag

SEQ ID NO: 42655 - DNA, 15 bp, Artificial Sequence
  dgRNA
  Camk2n2
cctgcccagcggccc

SEQ ID NO: 42656 - DNA, 15 bp, Artificial Sequence
  dgRNA
  Lamc1
cccatctcgcttctc

SEQ ID NO: 42657 - DNA, 15 bp, Artificial Sequence
  dgRNA
  Lamc1
ggcccaccgccctcc

SEQ ID NO: 42658 - DNA, 15 bp, Artificial Sequence
  dgRNA
  Lamc1
gccgccgggagtcgc

SEQ ID NO: 42659 - DNA, 15 bp, Artificial Sequence
  dgRNA
  Lamc1
ccgccgggagtcgct

SEQ ID NO: 42660 - DNA, 15 bp, Artificial Sequence
  dgRNA
  Slmap
aacaaagatggcgcc

SEQ ID NO: 42661 - DNA, 15 bp, Artificial Sequence
  dgRNA
  Slmap
acaaagatggcgcca

SEQ ID NO: 42662 - DNA, 15 bp, Artificial Sequence
  dgRNA
  Slmap
gataccccctatcta

SEQ ID NO: 42663 - DNA, 15 bp, Artificial Sequence
  dgRNA
  Slmap
cccctatctacggca

SEQ ID NO: 42664 - DNA, 15 bp, Artificial Sequence
  dgRNA
  Kcnf1
agcagctaggctagc

SEQ ID NO: 42665 - DNA, 15 bp, Artificial Sequence
  dgRNA
  Kcnf1
acaagttgtggtaca

SEQ ID NO: 42666 - DNA, 15 bp, Artificial Sequence
  dgRNA
  Kcnf1
gtcaaggacttatcc

SEQ ID NO: 42667 - DNA, 15 bp, Artificial Sequence
  dgRNA
  Kcnf1
gccatcacttcaccc

SEQ ID NO: 42668 - DNA, 15 bp, Artificial Sequence
  dgRNA
  Fcrl5
catcagacgtgatca

SEQ ID NO: 42669 - DNA, 15 bp, Artificial Sequence
  dgRNA
  Macrod1
gggaaaacccacgca

SEQ ID NO: 42670 - DNA, 15 bp, Artificial Sequence
  dgRNA
  Macrod1
cgaatcaccgagctt

SEQ ID NO: 42671 - DNA, 15 bp, Artificial Sequence
  dgRNA
  Macrod1
tcaccgagcttcgga

SEQ ID NO: 42672 - DNA, 15 bp, Artificial Sequence
  dgRNA
  Macrod1
cgagcttcggaaggt

SEQ ID NO: 42673 - DNA, 15 bp, Artificial Sequence
  dgRNA
  Crnkl1
aacttggtccaatcg

SEQ ID NO: 42674 - DNA, 15 bp, Artificial Sequence
  dgRNA
  Crnkl1
acttggtccaatcgc

SEQ ID NO: 42675 - DNA, 15 bp, Artificial Sequence
  dgRNA
  Crnkl1
cttggtccaatcgcg

SEQ ID NO: 42676 - DNA, 15 bp, Artificial Sequence
  dgRNA
  Crnkl1
tcgcggggaagccta

SEQ ID NO: 42677 - DNA, 15 bp, Artificial Sequence
  dgRNA
  Slc18a1
ggttctccggtatct

SEQ ID NO: 42678 - DNA, 15 bp, Artificial Sequence
  dgRNA
  Slc18a1
tgtcctccagtgaag

SEQ ID NO: 42679 - DNA, 15 bp, Artificial Sequence
  dgRNA
  Slc18a1
atctccctctagccg

SEQ ID NO: 42680 - DNA, 15 bp, Artificial Sequence
  dgRNA
  Slc18a1
tctccctctagccgc

SEQ ID NO: 42681 - DNA, 15 bp, Artificial Sequence
  dgRNA
  Itfg1
tcaaacctgagcgct

SEQ ID NO: 42682 - DNA, 15 bp, Artificial Sequence
  dgRNA
  Itfg1
cctgagcgcttggcc

SEQ ID NO: 42683 - DNA, 15 bp, Artificial Sequence
  dgRNA
  Itfg1
ctgagcgcttggccc

SEQ ID NO: 42684 - DNA, 15 bp, Artificial Sequence
  dgRNA
  Itfg1
agctgccagtcagcg

SEQ ID NO: 42685 - DNA, 15 bp, Artificial Sequence
  dgRNA
  Vhl
aaacccaactgtagg

SEQ ID NO: 42686 - DNA, 15 bp, Artificial Sequence
  dgRNA
  Vhl
cccaactgtaggagg

SEQ ID NO: 42687 - DNA, 15 bp, Artificial Sequence
  dgRNA
  Vhl
gtggaatttataacc

SEQ ID NO: 42688 - DNA, 15 bp, Artificial Sequence
  dgRNA
  Vhl
tggaatttataaccc

SEQ ID NO: 42689 - DNA, 15 bp, Artificial Sequence
  dgRNA
  Ttc24
gtctgagcaccatta

SEQ ID NO: 42690 - DNA, 15 bp, Artificial Sequence
  dgRNA
  Ttc24
acagctgtcactcga

SEQ ID NO: 42691 - DNA, 15 bp, Artificial Sequence
  dgRNA
  Ttc24
actcgaaggattacc

SEQ ID NO: 42692 - DNA, 15 bp, Artificial Sequence
  dgRNA
  Ttc24
ctcgaaggattacct

SEQ ID NO: 42693 - DNA, 15 bp, Artificial Sequence
  dgRNA
  Clcf1
ccttggccgacacca

SEQ ID NO: 42694 - DNA, 15 bp, Artificial Sequence
  dgRNA
  Clcf1
ctcaggagtttgccg

SEQ ID NO: 42695 - DNA, 15 bp, Artificial Sequence
  dgRNA
  Clcf1
tcaggagtttgccga

SEQ ID NO: 42696 - DNA, 15 bp, Artificial Sequence
  dgRNA
  Clcf1
ccccctcagtgttgt

SEQ ID NO: 42697 - DNA, 15 bp, Artificial Sequence
  dgRNA
  Rab18
gcccctgcgcacacc

SEQ ID NO: 42698 - DNA, 15 bp, Artificial Sequence
  dgRNA
  Rab18
acaccaggagccacg

SEQ ID NO: 42699 - DNA, 15 bp, Artificial Sequence
  dgRNA
  Rab18
aaacgcctgcgctcc

SEQ ID NO: 42700 - DNA, 15 bp, Artificial Sequence
  dgRNA
  Rab18
aacgcctgcgctcca

SEQ ID NO: 42701 - DNA, 15 bp, Artificial Sequence
  dgRNA
  Olfr1346
aatcccttgctaagt

SEQ ID NO: 42702 - DNA, 15 bp, Artificial Sequence
  dgRNA
  Olfr1346
ggattgacctgtggc

SEQ ID NO: 42703 - DNA, 15 bp, Artificial Sequence
  dgRNA
  Olfr1346
gaaccaacttagcaa

SEQ ID NO: 42704 - DNA, 15 bp, Artificial Sequence
  dgRNA
  Olfr1346
gtataaaggtagcta

SEQ ID NO: 42705 - DNA, 15 bp, Artificial Sequence
  dgRNA
  Ace3
gtgtgcgtagcaggc

SEQ ID NO: 42706 - DNA, 15 bp, Artificial Sequence
  dgRNA
  Ace3
tgtgcgtagcaggct

SEQ ID NO: 42707 - DNA, 15 bp, Artificial Sequence
  dgRNA
  Ace3
gcgtagcaggctggg

SEQ ID NO: 42708 - DNA, 15 bp, Artificial Sequence
  dgRNA
  Ace3
gatctgactcatgat

SEQ ID NO: 42709 - DNA, 15 bp, Artificial Sequence
  dgRNA
  Il1f8
ccacacctatatgtg

SEQ ID NO: 42710 - DNA, 15 bp, Artificial Sequence
  dgRNA
  Il1f8
ccacacatataggtg

SEQ ID NO: 42711 - DNA, 15 bp, Artificial Sequence
  dgRNA
  Il1f8
gggagccacacatat

SEQ ID NO: 42712 - DNA, 15 bp, Artificial Sequence
  dgRNA
  Il1f8
ccggaaggtggtgga

SEQ ID NO: 42713 - DNA, 15 bp, Artificial Sequence
  dgRNA
  Gria4
agcctcatcacctcg

SEQ ID NO: 42714 - DNA, 15 bp, Artificial Sequence
  dgRNA
  Gria4
catccatccgcatca

SEQ ID NO: 42715 - DNA, 15 bp, Artificial Sequence
  dgRNA
  Gria4
atccatccgcatcaa

SEQ ID NO: 42716 - DNA, 15 bp, Artificial Sequence
  dgRNA
  Gria4
ctttgcagattcccc

SEQ ID NO: 42717 - DNA, 15 bp, Artificial Sequence
  dgRNA
  Klri1
gtatcgaactcagag

SEQ ID NO: 42718 - DNA, 15 bp, Artificial Sequence
  dgRNA
  Klri1
gcatgtgattctatg

SEQ ID NO: 42719 - DNA, 15 bp, Artificial Sequence
  dgRNA
  Klri1
gtgattctatgtggc

SEQ ID NO: 42720 - DNA, 15 bp, Artificial Sequence
  dgRNA
  Klri1
agttcgatacattta

SEQ ID NO: 42721 - DNA, 15 bp, Artificial Sequence
  dgRNA
  Rhobtb3
actttctgcgaaggc

SEQ ID NO: 42722 - DNA, 15 bp, Artificial Sequence
  dgRNA
  Rhobtb3
ctttctgcgaaggct

SEQ ID NO: 42723 - DNA, 15 bp, Artificial Sequence
  dgRNA
  Rhobtb3
tgcgaaggctggggt

SEQ ID NO: 42724 - DNA, 15 bp, Artificial Sequence
  dgRNA
  Rhobtb3
tgggtacgggaccgc

SEQ ID NO: 42725 - DNA, 15 bp, Artificial Sequence
  dgRNA
  Nsmf
ctcaggctcagcgtc

SEQ ID NO: 42726 - DNA, 15 bp, Artificial Sequence
  dgRNA
  Nsmf
aggctcagcgtcagg

SEQ ID NO: 42727 - DNA, 15 bp, Artificial Sequence
  dgRNA
  Nsmf
gcggagcaccgcccc

SEQ ID NO: 42728 - DNA, 15 bp, Artificial Sequence
  dgRNA
  Nsmf
cggagcaccgccccc

SEQ ID NO: 42729 - DNA, 15 bp, Artificial Sequence
  dgRNA
  Fgf21
ttgcatcatccgtcc

SEQ ID NO: 42730 - DNA, 15 bp, Artificial Sequence
  dgRNA
  Fgf21
ccgtccaggccgccc

SEQ ID NO: 42731 - DNA, 15 bp, Artificial Sequence
  dgRNA
  Fgf21
aggccgccctggcca

SEQ ID NO: 42732 - DNA, 15 bp, Artificial Sequence
  dgRNA
  Fgf21
ccgccctggccacgg

SEQ ID NO: 42733 - DNA, 15 bp, Artificial Sequence
  dgRNA
  Phf19
atggcgccccgcgcc

SEQ ID NO: 42734 - DNA, 15 bp, Artificial Sequence
  dgRNA
  Phf19
tggcgccccgcgccc

SEQ ID NO: 42735 - DNA, 15 bp, Artificial Sequence
  dgRNA
  Phf19
ggcgccccgcgcccg

SEQ ID NO: 42736 - DNA, 15 bp, Artificial Sequence
  dgRNA
  Phf19
cgccccgcgcccggg

SEQ ID NO: 42737 - DNA, 15 bp, Artificial Sequence
  dgRNA
  D230025D16Rik
tgccttttcttgcgt

SEQ ID NO: 42738 - DNA, 15 bp, Artificial Sequence
  dgRNA
  D230025D16Rik
ttgcgtaggcatata

SEQ ID NO: 42739 - DNA, 15 bp, Artificial Sequence
  dgRNA
  D230025D16Rik
ccagctctacccgcg

SEQ ID NO: 42740 - DNA, 15 bp, Artificial Sequence
  dgRNA
  D230025D16Rik
cagctctacccgcgc

SEQ ID NO: 42741 - DNA, 15 bp, Artificial Sequence
  dgRNA
  Fgd1
ccgcggtgcagaccc

SEQ ID NO: 42742 - DNA, 15 bp, Artificial Sequence
  dgRNA
  Fgd1
gacccaggacgaagg

SEQ ID NO: 42743 - DNA, 15 bp, Artificial Sequence
  dgRNA
  Fgd1
aagcccggtccagcc

SEQ ID NO: 42744 - DNA, 15 bp, Artificial Sequence
  dgRNA
  Fgd1
ggtcctccgcccgca

SEQ ID NO: 42745 - DNA, 15 bp, Artificial Sequence
  dgRNA
  Ube2j2
ccggagcggccatct

SEQ ID NO: 42746 - DNA, 15 bp, Artificial Sequence
  dgRNA
  Ube2j2
ttggaggctgagcgg

SEQ ID NO: 42747 - DNA, 15 bp, Artificial Sequence
  dgRNA
  Ube2j2
gctgagcggcggtag

SEQ ID NO: 42748 - DNA, 15 bp, Artificial Sequence
  dgRNA
  Ube2j2
cgaggctgcttgcgg

SEQ ID NO: 42749 - DNA, 15 bp, Artificial Sequence
  dgRNA
  Ms4a6d
gtgtattctagatct

SEQ ID NO: 42750 - DNA, 15 bp, Artificial Sequence
  dgRNA
  Ms4a6d
taattggaccagttc

SEQ ID NO: 42751 - DNA, 15 bp, Artificial Sequence
  dgRNA
  Zxdc
cccagatgcaaaagt

SEQ ID NO: 42752 - DNA, 15 bp, Artificial Sequence
  dgRNA
  Zxdc
atctgggtagcgcaa

SEQ ID NO: 42753 - DNA, 15 bp, Artificial Sequence
  dgRNA
  Zxdc
tcctacttttgcatc

SEQ ID NO: 42754 - DNA, 15 bp, Artificial Sequence
  dgRNA
  Zxdc
agggtcttcagattt

SEQ ID NO: 42755 - DNA, 15 bp, Artificial Sequence
  dgRNA
  Ttc17
cccgaccgagagtaa

SEQ ID NO: 42756 - DNA, 15 bp, Artificial Sequence
  dgRNA
  Ttc17
ccgaccgagagtaaa

SEQ ID NO: 42757 - DNA, 15 bp, Artificial Sequence
  dgRNA
  Ttc17
cgagagtaaagggac

SEQ ID NO: 42758 - DNA, 15 bp, Artificial Sequence
  dgRNA
  Ttc17
ccggtatcgtctccg

SEQ ID NO: 42759 - DNA, 15 bp, Artificial Sequence
  dgRNA
  1600014C10Rik
cacttggacctagac

SEQ ID NO: 42760 - DNA, 15 bp, Artificial Sequence
  dgRNA
  1600014C10Rik
gccacactctctatt

SEQ ID NO: 42761 - DNA, 15 bp, Artificial Sequence
  dgRNA
  1600014C10Rik
ccacactctctattt

SEQ ID NO: 42762 - DNA, 15 bp, Artificial Sequence
  dgRNA
  1600014C10Rik
ctatttgggtggcat

SEQ ID NO: 42763 - DNA, 15 bp, Artificial Sequence
  dgRNA
  Rnf14
gtggaccgttacttc

SEQ ID NO: 42764 - DNA, 15 bp, Artificial Sequence
  dgRNA
  Rnf14
ttcacgtttagcgat

SEQ ID NO: 42765 - DNA, 15 bp, Artificial Sequence
  dgRNA
  Rnf14
gcttgcacattctgt

SEQ ID NO: 42766 - DNA, 15 bp, Artificial Sequence
  dgRNA
  Rnf14
taacggtccacctag

SEQ ID NO: 42767 - DNA, 15 bp, Artificial Sequence
  dgRNA
  Pdlim2
accgatgcgcgtcgt

SEQ ID NO: 42768 - DNA, 15 bp, Artificial Sequence
  dgRNA
  Pdlim2
tgcgcgtcgtaggtg

SEQ ID NO: 42769 - DNA, 15 bp, Artificial Sequence
  dgRNA
  Pdlim2
gcgtcgtaggtgagg

SEQ ID NO: 42770 - DNA, 15 bp, Artificial Sequence
  dgRNA
  Pdlim2
cgagggcaattctct

SEQ ID NO: 42771 - DNA, 15 bp, Artificial Sequence
  dgRNA
  Mgarp
ccattaagcgactgc

SEQ ID NO: 42772 - DNA, 15 bp, Artificial Sequence
  dgRNA
  Mgarp
cattaagcgactgct

SEQ ID NO: 42773 - DNA, 15 bp, Artificial Sequence
  dgRNA
  Mgarp
attaagcgactgctg

SEQ ID NO: 42774 - DNA, 15 bp, Artificial Sequence
  dgRNA
  Mgarp
aactctattagagct

SEQ ID NO: 42775 - DNA, 15 bp, Artificial Sequence
  dgRNA
  Slc16a12
ctggctcacgactcg

SEQ ID NO: 42776 - DNA, 15 bp, Artificial Sequence
  dgRNA
  Slc16a12
tggctcacgactcgc

SEQ ID NO: 42777 - DNA, 15 bp, Artificial Sequence
  dgRNA
  Slc16a12
aagcattacataacc

SEQ ID NO: 42778 - DNA, 15 bp, Artificial Sequence
  dgRNA
  Slc16a12
cattacataacctgg

SEQ ID NO: 42779 - DNA, 15 bp, Artificial Sequence
  dgRNA
  Slc2a1
ctaccattttgctag

SEQ ID NO: 42780 - DNA, 15 bp, Artificial Sequence
  dgRNA
  Slc2a1
agcgagcgcccccaa

SEQ ID NO: 42781 - DNA, 15 bp, Artificial Sequence
  dgRNA
  Slc2a1
gcgagcgcccccaac

SEQ ID NO: 42782 - DNA, 15 bp, Artificial Sequence
  dgRNA
  Slc2a1
gtgccccgcacaccc

SEQ ID NO: 42783 - DNA, 15 bp, Artificial Sequence
  dgRNA
  Meis2
gctcactttcttatc

SEQ ID NO: 42784 - DNA, 15 bp, Artificial Sequence
  dgRNA
  Meis2
tttcttatccggact

SEQ ID NO: 42785 - DNA, 15 bp, Artificial Sequence
  dgRNA
  Meis2
atatacgacacatcc

SEQ ID NO: 42786 - DNA, 15 bp, Artificial Sequence
  dgRNA
  Meis2
agactgatggcgcaa

SEQ ID NO: 42787 - DNA, 15 bp, Artificial Sequence
  dgRNA
  Fadd
tccacgttacacttc

SEQ ID NO: 42788 - DNA, 15 bp, Artificial Sequence
  dgRNA
  Fadd
atctgttctgcctcg

SEQ ID NO: 42789 - DNA, 15 bp, Artificial Sequence
  dgRNA
  Fadd
aagctactacaacag

SEQ ID NO: 42790 - DNA, 15 bp, Artificial Sequence
  dgRNA
  Fadd
cagcggatgccagcc

SEQ ID NO: 42791 - DNA, 15 bp, Artificial Sequence
  dgRNA
  7-Mar
tgcggccgcttaccg

SEQ ID NO: 42792 - DNA, 15 bp, Artificial Sequence
  dgRNA
  7-Mar
tcgcagcttcccccg

SEQ ID NO: 42793 - DNA, 15 bp, Artificial Sequence
  dgRNA
  7-Mar
cgaggcggccctcaa

SEQ ID NO: 42794 - DNA, 15 bp, Artificial Sequence
  dgRNA
  7-Mar
cagagcaccaccccg

SEQ ID NO: 42795 - DNA, 15 bp, Artificial Sequence
  dgRNA
  Khdrbs1
ggcgggcgcccgcgc

SEQ ID NO: 42796 - DNA, 15 bp, Artificial Sequence
  dgRNA
  Khdrbs1
caggcgccctaagct

SEQ ID NO: 42797 - DNA, 15 bp, Artificial Sequence
  dgRNA
  Khdrbs1
gctcggagcccaagc

SEQ ID NO: 42798 - DNA, 15 bp, Artificial Sequence
  dgRNA
  Khdrbs1
ctcggagcccaagcg

SEQ ID NO: 42799 - DNA, 15 bp, Artificial Sequence
  dgRNA
  Nup62
agtgcgcttgctcag

SEQ ID NO: 42800 - DNA, 15 bp, Artificial Sequence
  dgRNA
  Nup62
gctcagcggatgcgc

SEQ ID NO: 42801 - DNA, 15 bp, Artificial Sequence
  dgRNA
  Nup62
gcgcctgcgcgaccg

SEQ ID NO: 42802 - DNA, 15 bp, Artificial Sequence
  dgRNA
  Nup62
cccgcgagctctgaa

SEQ ID NO: 42803 - DNA, 15 bp, Artificial Sequence
  dgRNA
  Trim28
cgcctccacgttcgg

SEQ ID NO: 42804 - DNA, 15 bp, Artificial Sequence
  dgRNA
  Trim28
gcctccacgttcggc

SEQ ID NO: 42805 - DNA, 15 bp, Artificial Sequence
  dgRNA
  Trim28
tcggcgggaacttcc

SEQ ID NO: 42806 - DNA, 15 bp, Artificial Sequence
  dgRNA
  Trim28
cgctttgctctgccg

SEQ ID NO: 42807 - DNA, 15 bp, Artificial Sequence
  dgRNA
  Gpn3
accggtgctgcggcc

SEQ ID NO: 42808 - DNA, 15 bp, Artificial Sequence
  dgRNA
  Gpn3
cggtgctgcggcccg

SEQ ID NO: 42809 - DNA, 15 bp, Artificial Sequence
  dgRNA
  Gpn3
ggtgctgcggcccgg

SEQ ID NO: 42810 - DNA, 15 bp, Artificial Sequence
  dgRNA
  Gpn3
gatccgctatcacct

SEQ ID NO: 42811 - DNA, 15 bp, Artificial Sequence
  dgRNA
  Cdh15
acacgtgcagtccct

SEQ ID NO: 42812 - DNA, 15 bp, Artificial Sequence
  dgRNA
  Cdh15
acatgtaggtgggcc

SEQ ID NO: 42813 - DNA, 15 bp, Artificial Sequence
  dgRNA
  Cdh15
gggactgcacgtgtg

SEQ ID NO: 42814 - DNA, 15 bp, Artificial Sequence
  dgRNA
  Mzb1
ggtcccctgcatgcg

SEQ ID NO: 42815 - DNA, 15 bp, Artificial Sequence
  dgRNA
  Mzb1
atgcgtggcgtctcc

SEQ ID NO: 42816 - DNA, 15 bp, Artificial Sequence
  dgRNA
  Mzb1
tgcgtggcgtctcca

SEQ ID NO: 42817 - DNA, 15 bp, Artificial Sequence
  dgRNA
  Mzb1
cagggcctcgcggaa

SEQ ID NO: 42818 - DNA, 15 bp, Artificial Sequence
  dgRNA
  Kcp
gatcctcaggggaac

SEQ ID NO: 42819 - DNA, 15 bp, Artificial Sequence
  dgRNA
  Kcp
atcctcaggggaacg

SEQ ID NO: 42820 - DNA, 15 bp, Artificial Sequence
  dgRNA
  Kcp
agccctaggtgcgat

SEQ ID NO: 42821 - DNA, 15 bp, Artificial Sequence
  dgRNA
  Kcp
gccctaggtgcgata

SEQ ID NO: 42822 - DNA, 15 bp, Artificial Sequence
  dgRNA
  Emc8
tggggtgctcgcgac

SEQ ID NO: 42823 - DNA, 15 bp, Artificial Sequence
  dgRNA
  Emc8
tcgcgaccggaagaa

SEQ ID NO: 42824 - DNA, 15 bp, Artificial Sequence
  dgRNA
  Emc8
cgcgaccggaagaac

SEQ ID NO: 42825 - DNA, 15 bp, Artificial Sequence
  dgRNA
  Emc8
gcgaccggaagaacg

SEQ ID NO: 42826 - DNA, 15 bp, Artificial Sequence
  dgRNA
  Hist1h2af
agctaccattggttt

SEQ ID NO: 42827 - DNA, 15 bp, Artificial Sequence
  dgRNA
  Hist1h2af
aacgcataatatttc

SEQ ID NO: 42828 - DNA, 15 bp, Artificial Sequence
  dgRNA
  Hist1h2af
acggagtgatctcgt

SEQ ID NO: 42829 - DNA, 15 bp, Artificial Sequence
  dgRNA
  Hist1h2af
cttctggcgcgaaaa

SEQ ID NO: 42830 - DNA, 15 bp, Artificial Sequence
  dgRNA
  Arfip2
tgctccatcacgcca

SEQ ID NO: 42831 - DNA, 15 bp, Artificial Sequence
  dgRNA
  Arfip2
gctccatcacgccaa

SEQ ID NO: 42832 - DNA, 15 bp, Artificial Sequence
  dgRNA
  Arfip2
agtcacttccgcccg

SEQ ID NO: 42833 - DNA, 15 bp, Artificial Sequence
  dgRNA
  Arfip2
cacttccgcccgtgg

SEQ ID NO: 42834 - DNA, 15 bp, Artificial Sequence
  dgRNA
  Thbs3
ggaaaatcattatgg

SEQ ID NO: 42835 - DNA, 15 bp, Artificial Sequence
  dgRNA
  Thbs3
tctggtttcgggagc

SEQ ID NO: 42836 - DNA, 15 bp, Artificial Sequence
  dgRNA
  Thbs3
ccggtgatgcctcca

SEQ ID NO: 42837 - DNA, 15 bp, Artificial Sequence
  dgRNA
  Thbs3
cgaaaccagaggcac

SEQ ID NO: 42838 - DNA, 15 bp, Artificial Sequence
  dgRNA
  Arhgap32
tgaatagtcagtaac

SEQ ID NO: 42839 - DNA, 15 bp, Artificial Sequence
  dgRNA
  Arhgap32
ggaagcgctcacctg

SEQ ID NO: 42840 - DNA, 15 bp, Artificial Sequence
  dgRNA
  Arhgap32
gcgctcacctgtggg

SEQ ID NO: 42841 - DNA, 15 bp, Artificial Sequence
  dgRNA
  Arhgap32
ggcatgttaagccaa

SEQ ID NO: 42842 - DNA, 15 bp, Artificial Sequence
  dgRNA
  Dlx1
gcctttaatcagaag

SEQ ID NO: 42843 - DNA, 15 bp, Artificial Sequence
  dgRNA
  Csrp2
cgcgcgggaagccgc

SEQ ID NO: 42844 - DNA, 15 bp, Artificial Sequence
  dgRNA
  Csrp2
gaagaggcgggattc

SEQ ID NO: 42845 - DNA, 15 bp, Artificial Sequence
  dgRNA
  Csrp2
tccggtcttttgtct

SEQ ID NO: 42846 - DNA, 15 bp, Artificial Sequence
  dgRNA
  Csrp2
ccggtcttttgtctc

SEQ ID NO: 42847 - DNA, 15 bp, Artificial Sequence
  dgRNA
  Shc4
accccccgcgctccg

SEQ ID NO: 42848 - DNA, 15 bp, Artificial Sequence
  dgRNA
  Shc4
ccccccgcgctccgg

SEQ ID NO: 42849 - DNA, 15 bp, Artificial Sequence
  dgRNA
  Shc4
ccgggggcctctgcc

SEQ ID NO: 42850 - DNA, 15 bp, Artificial Sequence
  dgRNA
  Shc4
cgggggcctctgcca

SEQ ID NO: 42851 - DNA, 15 bp, Artificial Sequence
  dgRNA
  Kpna4
atcgtcccttttgat

SEQ ID NO: 42852 - DNA, 15 bp, Artificial Sequence
  dgRNA
  Kpna4
actccggagcccggc

SEQ ID NO: 42853 - DNA, 15 bp, Artificial Sequence
  dgRNA
  Kpna4
gcccggccggccaat

SEQ ID NO: 42854 - DNA, 15 bp, Artificial Sequence
  dgRNA
  Kpna4
cggccggccaatcgg

SEQ ID NO: 42855 - DNA, 15 bp, Artificial Sequence
  dgRNA
  B3galt5
cacagactcccgcat

SEQ ID NO: 42856 - DNA, 15 bp, Artificial Sequence
  dgRNA
  B3galt5
gggaacatgccctgc

SEQ ID NO: 42857 - DNA, 15 bp, Artificial Sequence
  dgRNA
  B3galt5
aggcgtgggttcctg

SEQ ID NO: 42858 - DNA, 15 bp, Artificial Sequence
  dgRNA
  B3galt5
agaggcgtgggttcc

SEQ ID NO: 42859 - DNA, 15 bp, Artificial Sequence
  dgRNA
  Insc
gtgggcgccctcgcc

SEQ ID NO: 42860 - DNA, 15 bp, Artificial Sequence
  dgRNA
  Insc
gcgccctcgcctggc

SEQ ID NO: 42861 - DNA, 15 bp, Artificial Sequence
  dgRNA
  Insc
tcgcctggccggctc

SEQ ID NO: 42862 - DNA, 15 bp, Artificial Sequence
  dgRNA
  Insc
acagatgacagcgcg

SEQ ID NO: 42863 - DNA, 15 bp, Artificial Sequence
  dgRNA
  Cldn13
ttaacacgcatgctc

SEQ ID NO: 42864 - DNA, 15 bp, Artificial Sequence
  dgRNA
  Cldn13
taacacgcatgctca

SEQ ID NO: 42865 - DNA, 15 bp, Artificial Sequence
  dgRNA
  Cldn13
gatctcgtccagaga

SEQ ID NO: 42866 - DNA, 15 bp, Artificial Sequence
  dgRNA
  Cldn13
gtgcgcctgcgtgct

SEQ ID NO: 42867 - DNA, 15 bp, Artificial Sequence
  dgRNA
  Lrrc1
ttataccgaaagact

SEQ ID NO: 42868 - DNA, 15 bp, Artificial Sequence
  dgRNA
  Lrrc1
tagttacatggctag

SEQ ID NO: 42869 - DNA, 15 bp, Artificial Sequence
  dgRNA
  Lrrc1
agtggagaaacgttc

SEQ ID NO: 42870 - DNA, 15 bp, Artificial Sequence
  dgRNA
  Lrrc1
ttctggtccactaag

SEQ ID NO: 42871 - DNA, 15 bp, Artificial Sequence
  dgRNA
  Olfr1447
gcatagctactgaag

SEQ ID NO: 42872 - DNA, 15 bp, Artificial Sequence
  dgRNA
  Olfr1447
ttgaagtgctcttat

SEQ ID NO: 42873 - DNA, 15 bp, Artificial Sequence
  dgRNA
  Olfr1447
tgcaggaaactagtg

SEQ ID NO: 42874 - DNA, 15 bp, Artificial Sequence
  dgRNA
  Sema5b
cggccgcgcatccag

SEQ ID NO: 42875 - DNA, 15 bp, Artificial Sequence
  dgRNA
  Sema5b
gcatccagcggctgt

SEQ ID NO: 42876 - DNA, 15 bp, Artificial Sequence
  dgRNA
  Sema5b
cagccggagcgcagc

SEQ ID NO: 42877 - DNA, 15 bp, Artificial Sequence
  dgRNA
  Sema5b
gcagccgggcccgac

SEQ ID NO: 42878 - DNA, 15 bp, Artificial Sequence
  dgRNA
  Rab6a
ccccccttgcttacc

SEQ ID NO: 42879 - DNA, 15 bp, Artificial Sequence
  dgRNA
  Rab6a
cagtcgaaacctgat

SEQ ID NO: 42880 - DNA, 15 bp, Artificial Sequence
  dgRNA
  Rab6a
cctttctccaccgca

SEQ ID NO: 42881 - DNA, 15 bp, Artificial Sequence
  dgRNA
  Rab6a
ctttctccaccgcac

SEQ ID NO: 42882 - DNA, 15 bp, Artificial Sequence
  dgRNA
  Gabrg3
ggcgtccctaagaga

SEQ ID NO: 42883 - DNA, 15 bp, Artificial Sequence
  dgRNA
  Gabrg3
gaaggcacacggcac

SEQ ID NO: 42884 - DNA, 15 bp, Artificial Sequence
  dgRNA
  Gabrg3
actccatcgatgaca

SEQ ID NO: 42885 - DNA, 15 bp, Artificial Sequence
  dgRNA
  Gabrg3
ctccatcgatgacac

SEQ ID NO: 42886 - DNA, 15 bp, Artificial Sequence
  dgRNA
  Olfr872
gtaattaggagctct

SEQ ID NO: 42887 - DNA, 15 bp, Artificial Sequence
  dgRNA
  Olfr872
aggttgaagtacagt

SEQ ID NO: 42888 - DNA, 15 bp, Artificial Sequence
  dgRNA
  Olfr872
ggttgaagtacagtt

SEQ ID NO: 42889 - DNA, 15 bp, Artificial Sequence
  dgRNA
  Olfr872
gttgaagtacagttg

SEQ ID NO: 42890 - DNA, 15 bp, Artificial Sequence
  dgRNA
  Efhb
tcttggtcgtgctgt

SEQ ID NO: 42891 - DNA, 15 bp, Artificial Sequence
  dgRNA
  Efhb
gtttattccgttacc

SEQ ID NO: 42892 - DNA, 15 bp, Artificial Sequence
  dgRNA
  Gnat1
cactcccgggactaa

SEQ ID NO: 42893 - DNA, 15 bp, Artificial Sequence
  dgRNA
  Gnat1
aaatgtatataggac

SEQ ID NO: 42894 - DNA, 15 bp, Artificial Sequence
  dgRNA
  Gnat1
gcagttgaaggattg

SEQ ID NO: 42895 - DNA, 15 bp, Artificial Sequence
  dgRNA
  Gnat1
tagtcccgggagtgg

SEQ ID NO: 42896 - DNA, 15 bp, Artificial Sequence
  dgRNA
  Polr1d
gcgggaccaggctga

SEQ ID NO: 42897 - DNA, 15 bp, Artificial Sequence
  dgRNA
  Polr1d
gagaacaggtggcgg

SEQ ID NO: 42898 - DNA, 15 bp, Artificial Sequence
  dgRNA
  Polr1d
gggcggctgacgtgt

SEQ ID NO: 42899 - DNA, 15 bp, Artificial Sequence
  dgRNA
  Polr1d
gacgtgtaggtgtgc

SEQ ID NO: 42900 - DNA, 15 bp, Artificial Sequence
  dgRNA
  Mchr1
gccatgcaagataag

SEQ ID NO: 42901 - DNA, 15 bp, Artificial Sequence
  dgRNA
  Mchr1
agacagcgcaaaggc

SEQ ID NO: 42902 - DNA, 15 bp, Artificial Sequence
  dgRNA
  Mchr1
caggctcctccgcat

SEQ ID NO: 42903 - DNA, 15 bp, Artificial Sequence
  dgRNA
  Mchr1
ctcctccgcatggga

SEQ ID NO: 42904 - DNA, 15 bp, Artificial Sequence
  dgRNA
  Lpcat2
ggaaacgaaacacgc

SEQ ID NO: 42905 - DNA, 15 bp, Artificial Sequence
  dgRNA
  Lpcat2
gtttacttactagat

SEQ ID NO: 42906 - DNA, 15 bp, Artificial Sequence
  dgRNA
  Lpcat2
cggggccagagcccg

SEQ ID NO: 42907 - DNA, 15 bp, Artificial Sequence
  dgRNA
  Lpcat2
cggggtgcgtcccgg

SEQ ID NO: 42908 - DNA, 15 bp, Artificial Sequence
  dgRNA
  Nr1i2
gtaaatacggtaatc

SEQ ID NO: 42909 - DNA, 15 bp, Artificial Sequence
  dgRNA
  Nr1i2
tggtcattgctagct

SEQ ID NO: 42910 - DNA, 15 bp, Artificial Sequence
  dgRNA
  Nr1i2
ggtcattgctagctc

SEQ ID NO: 42911 - DNA, 15 bp, Artificial Sequence
  dgRNA
  Nr1i2
tgctagctcgggtgc

SEQ ID NO: 42912 - DNA, 15 bp, Artificial Sequence
  dgRNA
  Vta1
agccgtgtgcgacac

SEQ ID NO: 42913 - DNA, 15 bp, Artificial Sequence
  dgRNA
  Vta1
taactgccttaaacc

SEQ ID NO: 42914 - DNA, 15 bp, Artificial Sequence
  dgRNA
  Vta1
ttcgggcacccgtcg

SEQ ID NO: 42915 - DNA, 15 bp, Artificial Sequence
  dgRNA
  Vta1
gggaaaataacgtaa

SEQ ID NO: 42916 - DNA, 15 bp, Artificial Sequence
  dgRNA
  B4galnt1
tacactgtgaacgag

SEQ ID NO: 42917 - DNA, 15 bp, Artificial Sequence
  dgRNA
  B4galnt1
acactgtgaacgagt

SEQ ID NO: 42918 - DNA, 15 bp, Artificial Sequence
  dgRNA
  B4galnt1
cactgtgaacgagtg

SEQ ID NO: 42919 - DNA, 15 bp, Artificial Sequence
  dgRNA
  B4galnt1
agtggggaaatggcg

SEQ ID NO: 42920 - DNA, 15 bp, Artificial Sequence
  dgRNA
  Olfr639
tatgtcaatttctac

SEQ ID NO: 42921 - DNA, 15 bp, Artificial Sequence
  dgRNA
  Olfr639
taagtgtgacttaac

SEQ ID NO: 42922 - DNA, 15 bp, Artificial Sequence
  dgRNA
  Olfr639
gtttgtctcaactgc

SEQ ID NO: 42923 - DNA, 15 bp, Artificial Sequence
  dgRNA
  Olfr639
acttatctctacggt

SEQ ID NO: 42924 - DNA, 15 bp, Artificial Sequence
  dgRNA
  Habp2
cctctccattcgttc

SEQ ID NO: 42925 - DNA, 15 bp, Artificial Sequence
  dgRNA
  Habp2
ggggtgccttgtctt

SEQ ID NO: 42926 - DNA, 15 bp, Artificial Sequence
  dgRNA
  Habp2
ccggaacgaatggag

SEQ ID NO: 42927 - DNA, 15 bp, Artificial Sequence
  dgRNA
  Habp2
ggattccggaacgaa

SEQ ID NO: 42928 - DNA, 15 bp, Artificial Sequence
  dgRNA
  Tox3
gcgcgagcccggagg

SEQ ID NO: 42929 - DNA, 15 bp, Artificial Sequence
  dgRNA
  Tox3
gagcccggaggcggt

SEQ ID NO: 42930 - DNA, 15 bp, Artificial Sequence
  dgRNA
  Tox3
cccggaggcggtcgg

SEQ ID NO: 42931 - DNA, 15 bp, Artificial Sequence
  dgRNA
  Tox3
ggaggcggtcggcgg

SEQ ID NO: 42932 - DNA, 15 bp, Artificial Sequence
  dgRNA
  Naa38
tacgtaagtagggcg

SEQ ID NO: 42933 - DNA, 15 bp, Artificial Sequence
  dgRNA
  Naa38
agtagggcggggttt

SEQ ID NO: 42934 - DNA, 15 bp, Artificial Sequence
  dgRNA
  Naa38
gctgcgcgtgtccac

SEQ ID NO: 42935 - DNA, 15 bp, Artificial Sequence
  dgRNA
  Naa38
ccaccggaagcattc

SEQ ID NO: 42936 - DNA, 15 bp, Artificial Sequence
  dgRNA
  Pex7
gttagagcaaatcat

SEQ ID NO: 42937 - DNA, 15 bp, Artificial Sequence
  dgRNA
  Pex7
gaaaaatggtcctcg

SEQ ID NO: 42938 - DNA, 15 bp, Artificial Sequence
  dgRNA
  Pex7
gcccaatcaaaatct

SEQ ID NO: 42939 - DNA, 15 bp, Artificial Sequence
  dgRNA
  Pex7
caaaatctaggattc

SEQ ID NO: 42940 - DNA, 15 bp, Artificial Sequence
  dgRNA
  Gngt2
ggggctggcctgcta

SEQ ID NO: 42941 - DNA, 15 bp, Artificial Sequence
  dgRNA
  Gngt2
gggctggcctgctat

SEQ ID NO: 42942 - DNA, 15 bp, Artificial Sequence
  dgRNA
  Gngt2
ggctggcctgctatg

SEQ ID NO: 42943 - DNA, 15 bp, Artificial Sequence
  dgRNA
  Gngt2
gggatgagtcaccac

SEQ ID NO: 42944 - DNA, 15 bp, Artificial Sequence
  dgRNA
  R3hdm4
cagtcgccccggggc

SEQ ID NO: 42945 - DNA, 15 bp, Artificial Sequence
  dgRNA
  R3hdm4
ccgtctcctcccggg

SEQ ID NO: 42946 - DNA, 15 bp, Artificial Sequence
  dgRNA
  R3hdm4
gccagcacgtcctgg

SEQ ID NO: 42947 - DNA, 15 bp, Artificial Sequence
  dgRNA
  R3hdm4
ccagcacgtcctggt

SEQ ID NO: 42948 - DNA, 15 bp, Artificial Sequence
  dgRNA
  Gyltl1b
gacggctacccaggg

SEQ ID NO: 42949 - DNA, 15 bp, Artificial Sequence
  dgRNA
  Gyltl1b
ggggacggctaccca

SEQ ID NO: 42950 - DNA, 15 bp, Artificial Sequence
  dgRNA
  Gyltl1b
tggggacggctaccc

SEQ ID NO: 42951 - DNA, 15 bp, Artificial Sequence
  dgRNA
  Lamc3
ggcacgtccagcagg

SEQ ID NO: 42952 - DNA, 15 bp, Artificial Sequence
  dgRNA
  Lamc3
gcacgtccagcaggt

SEQ ID NO: 42953 - DNA, 15 bp, Artificial Sequence
  dgRNA
  Lamc3
cacgtccagcaggtg

SEQ ID NO: 42954 - DNA, 15 bp, Artificial Sequence
  dgRNA
  Lamc3
tgggggtgagcacga

SEQ ID NO: 42955 - DNA, 15 bp, Artificial Sequence
  dgRNA
  Insig2
tacatcccctgccat

SEQ ID NO: 42956 - DNA, 15 bp, Artificial Sequence
  dgRNA
  Insig2
tattgaggcaatggc

SEQ ID NO: 42957 - DNA, 15 bp, Artificial Sequence
  dgRNA
  Insig2
taatatagattggtg

SEQ ID NO: 42958 - DNA, 15 bp, Artificial Sequence
  dgRNA
  Anxa10
caacgcataagcagg

SEQ ID NO: 42959 - DNA, 15 bp, Artificial Sequence
  dgRNA
  Anxa10
cttgcctgagatatt

SEQ ID NO: 42960 - DNA, 15 bp, Artificial Sequence
  dgRNA
  Anxa10
aaatttggaactgca

SEQ ID NO: 42961 - DNA, 15 bp, Artificial Sequence
  dgRNA
  Anxa10
ttatgcgttggttta

SEQ ID NO: 42962 - DNA, 15 bp, Artificial Sequence
  dgRNA
  Csn2
gtcacagagtctgat

SEQ ID NO: 42963 - DNA, 15 bp, Artificial Sequence
  dgRNA
  Dlg1
ctccgccccttaacg

SEQ ID NO: 42964 - DNA, 15 bp, Artificial Sequence
  dgRNA
  Dlg1
tccgccccttaacgc

SEQ ID NO: 42965 - DNA, 15 bp, Artificial Sequence
  dgRNA
  Dlg1
cttaacgcgggtgac

SEQ ID NO: 42966 - DNA, 15 bp, Artificial Sequence
  dgRNA
  Dlg1
gttggggatccaccc

SEQ ID NO: 42967 - DNA, 15 bp, Artificial Sequence
  dgRNA
  Txnrd2
accagttcccacgta

SEQ ID NO: 42968 - DNA, 15 bp, Artificial Sequence
  dgRNA
  Txnrd2
ccagttcccacgtac

SEQ ID NO: 42969 - DNA, 15 bp, Artificial Sequence
  dgRNA
  Txnrd2
cccgagtccgagctc

SEQ ID NO: 42970 - DNA, 15 bp, Artificial Sequence
  dgRNA
  Txnrd2
ccgagtccgagctcc

SEQ ID NO: 42971 - DNA, 15 bp, Artificial Sequence
  dgRNA
  Cd47
ctttcaggccggccc

SEQ ID NO: 42972 - DNA, 15 bp, Artificial Sequence
  dgRNA
  Cd47
cccaggacacgaagc

SEQ ID NO: 42973 - DNA, 15 bp, Artificial Sequence
  dgRNA
  Cd47
cggaagagagctggc

SEQ ID NO: 42974 - DNA, 15 bp, Artificial Sequence
  dgRNA
  Cd47
caacccgcgcagccc

SEQ ID NO: 42975 - DNA, 15 bp, Artificial Sequence
  dgRNA
  Fam122b
gagctggcccctcgg

SEQ ID NO: 42976 - DNA, 15 bp, Artificial Sequence
  dgRNA
  Olfr1342
cattcaactcaatac

SEQ ID NO: 42977 - DNA, 15 bp, Artificial Sequence
  dgRNA
  Olfr1342
gtttgactgcattgt

SEQ ID NO: 42978 - DNA, 15 bp, Artificial Sequence
  dgRNA
  Olfr1342
gtgccatcgtgcacg

SEQ ID NO: 42979 - DNA, 15 bp, Artificial Sequence
  dgRNA
  Olfr1342
tatgacactggacaa

SEQ ID NO: 42980 - DNA, 15 bp, Artificial Sequence
  dgRNA
  Ydjc
ttgcagagcgttagc

SEQ ID NO: 42981 - DNA, 15 bp, Artificial Sequence
  dgRNA
  Ydjc
tcagagacctctagg

SEQ ID NO: 42982 - DNA, 15 bp, Artificial Sequence
  dgRNA
  Ydjc
aggtggcgagaacaa

SEQ ID NO: 42983 - DNA, 15 bp, Artificial Sequence
  dgRNA
  Ydjc
cttgcagccgcattt

SEQ ID NO: 42984 - DNA, 15 bp, Artificial Sequence
  dgRNA
  Slc18b1
cgacgatgacaaaaa

SEQ ID NO: 42985 - DNA, 15 bp, Artificial Sequence
  dgRNA
  Slc18b1
agcccacgatcagca

SEQ ID NO: 42986 - DNA, 15 bp, Artificial Sequence
  dgRNA
  Slc18b1
gcccacgatcagcat

SEQ ID NO: 42987 - DNA, 15 bp, Artificial Sequence
  dgRNA
  Slc18b1
cacgatcagcatggg

SEQ ID NO: 42988 - DNA, 15 bp, Artificial Sequence
  dgRNA
  Adh6a
ctccacttgcccttc

SEQ ID NO: 42989 - DNA, 15 bp, Artificial Sequence
  dgRNA
  Adh6a
agtctctatcttgat

SEQ ID NO: 42990 - DNA, 15 bp, Artificial Sequence
  dgRNA
  Adh6a
gtctctatcttgata

SEQ ID NO: 42991 - DNA, 15 bp, Artificial Sequence
  dgRNA
  Adh6a
aaccctataaatact

SEQ ID NO: 42992 - DNA, 15 bp, Artificial Sequence
  dgRNA
  Elac1
cgcagccagcgcatt

SEQ ID NO: 42993 - DNA, 15 bp, Artificial Sequence
  dgRNA
  Elac1
gcagccagcgcatta

SEQ ID NO: 42994 - DNA, 15 bp, Artificial Sequence
  dgRNA
  Elac1
agcgcattagggagc

SEQ ID NO: 42995 - DNA, 15 bp, Artificial Sequence
  dgRNA
  Elac1
gccagcccgggcgag

SEQ ID NO: 42996 - DNA, 15 bp, Artificial Sequence
  dgRNA
  Fank1
tcgcgtggtccctag

SEQ ID NO: 42997 - DNA, 15 bp, Artificial Sequence
  dgRNA
  Fank1
gagcgttcccgagct

SEQ ID NO: 42998 - DNA, 15 bp, Artificial Sequence
  dgRNA
  Fank1
gcgttcccgagctcg

SEQ ID NO: 42999 - DNA, 15 bp, Artificial Sequence
  dgRNA
  Fank1
aagccgccgcgctcc

SEQ ID NO: 43000 - DNA, 15 bp, Artificial Sequence
  dgRNA
  Yes1
cgcgatccggagcgg

SEQ ID NO: 43001 - DNA, 15 bp, Artificial Sequence
  dgRNA
  Yes1
gcgatccggagcgga

SEQ ID NO: 43002 - DNA, 15 bp, Artificial Sequence
  dgRNA
  Yes1
cgatccggagcggag

SEQ ID NO: 43003 - DNA, 15 bp, Artificial Sequence
  dgRNA
  Yes1
tccggagcggagggg

SEQ ID NO: 43004 - DNA, 15 bp, Artificial Sequence
  dgRNA
  Olfr965
ccaacagttcttcat

SEQ ID NO: 43005 - DNA, 15 bp, Artificial Sequence
  dgRNA
  Zfp935
ggcctccggataggc

SEQ ID NO: 43006 - DNA, 15 bp, Artificial Sequence
  dgRNA
  Zfp935
gcctccggataggca

SEQ ID NO: 43007 - DNA, 15 bp, Artificial Sequence
  dgRNA
  Zfp935
gggcaatagaagtag

SEQ ID NO: 43008 - DNA, 15 bp, Artificial Sequence
  dgRNA
  Zfp935
ccgtgtgccttgttc

SEQ ID NO: 43009 - DNA, 15 bp, Artificial Sequence
  dgRNA
  Soga3
gcatccgattttaag

SEQ ID NO: 43010 - DNA, 15 bp, Artificial Sequence
  dgRNA
  Soga3
gattttaagcggtct

SEQ ID NO: 43011 - DNA, 15 bp, Artificial Sequence
  dgRNA
  Soga3
ggaatttgatgagcc

SEQ ID NO: 43012 - DNA, 15 bp, Artificial Sequence
  dgRNA
  Soga3
tctgcatctcgggcg

SEQ ID NO: 43013 - DNA, 15 bp, Artificial Sequence
  dgRNA
  Pcdh7
ctctacgcgctactc

SEQ ID NO: 43014 - DNA, 15 bp, Artificial Sequence
  dgRNA
  Pcdh7
cttcctttcccggag

SEQ ID NO: 43015 - DNA, 15 bp, Artificial Sequence
  dgRNA
  Pcdh7
cggccgatgggaggg

SEQ ID NO: 43016 - DNA, 15 bp, Artificial Sequence
  dgRNA
  Pcdh7
tcggccgatgggagg

SEQ ID NO: 43017 - DNA, 15 bp, Artificial Sequence
  dgRNA
  CAAA01180111.1
gcggatctgccagtg

SEQ ID NO: 43018 - DNA, 15 bp, Artificial Sequence
  dgRNA
  Ubac1
ggccgtgagcctgcc

SEQ ID NO: 43019 - DNA, 15 bp, Artificial Sequence
  dgRNA
  Ubac1
gccgtgagcctgcct

SEQ ID NO: 43020 - DNA, 15 bp, Artificial Sequence
  dgRNA
  Ubac1
gggaacgacaactcc

SEQ ID NO: 43021 - DNA, 15 bp, Artificial Sequence
  dgRNA
  Ubac1
actcccggcgtgcct

SEQ ID NO: 43022 - DNA, 15 bp, Artificial Sequence
  dgRNA
  AC182748.1
aatccattaggggcg

SEQ ID NO: 43023 - DNA, 15 bp, Artificial Sequence
  dgRNA
  AC182748.1
taggggcgtggaaag

SEQ ID NO: 43024 - DNA, 15 bp, Artificial Sequence
  dgRNA
  AC182748.1
agcacgagcaaaaag

SEQ ID NO: 43025 - DNA, 15 bp, Artificial Sequence
  dgRNA
  AC182748.1
gcacgagcaaaaagc

SEQ ID NO: 43026 - DNA, 15 bp, Artificial Sequence
  dgRNA
  Ankrd40
gggccgcgagcagcc

SEQ ID NO: 43027 - DNA, 15 bp, Artificial Sequence
  dgRNA
  Ankrd40
ggccgcgagcagcca

SEQ ID NO: 43028 - DNA, 15 bp, Artificial Sequence
  dgRNA
  Ankrd40
cagggagctgtcggt

SEQ ID NO: 43029 - DNA, 15 bp, Artificial Sequence
  dgRNA
  Ankrd40
gagctgtcggtgggc

SEQ ID NO: 43030 - DNA, 15 bp, Artificial Sequence
  dgRNA
  Olfr1124
cagccataatacatt

SEQ ID NO: 43031 - DNA, 15 bp, Artificial Sequence
  dgRNA
  Olfr1124
tgaagtatatcaggt

SEQ ID NO: 43032 - DNA, 15 bp, Artificial Sequence
  dgRNA
  Olfr1124
taggtaaaattattc

SEQ ID NO: 43033 - DNA, 15 bp, Artificial Sequence
  dgRNA
  Olfr1124
agcctctcacactag

SEQ ID NO: 43034 - DNA, 15 bp, Artificial Sequence
  dgRNA
  Pou3f1
accaccggttccagc

SEQ ID NO: 43035 - DNA, 15 bp, Artificial Sequence
  dgRNA
  Pou3f1
ccaccggttccagct

SEQ ID NO: 43036 - DNA, 15 bp, Artificial Sequence
  dgRNA
  Pou3f1
ccggttccagctggg

SEQ ID NO: 43037 - DNA, 15 bp, Artificial Sequence
  dgRNA
  Pou3f1
aggctacagcagcgc

SEQ ID NO: 43038 - DNA, 15 bp, Artificial Sequence
  dgRNA
  Stard6
caaaccgacccaaca

SEQ ID NO: 43039 - DNA, 15 bp, Artificial Sequence
  dgRNA
  Stard6
gacccaacatggcgc

SEQ ID NO: 43040 - DNA, 15 bp, Artificial Sequence
  dgRNA
  Stard6
atggcgccgggccgc

SEQ ID NO: 43041 - DNA, 15 bp, Artificial Sequence
  dgRNA
  Stard6
tggcgccgggccgca

SEQ ID NO: 43042 - DNA, 15 bp, Artificial Sequence
  dgRNA
  Olfr1248
ttagagcagcacttg

SEQ ID NO: 43043 - DNA, 15 bp, Artificial Sequence
  dgRNA
  Skil
ccctcgctgtccccc

SEQ ID NO: 43044 - DNA, 15 bp, Artificial Sequence
  dgRNA
  Skil
tcgctgtcccccggg

SEQ ID NO: 43045 - DNA, 15 bp, Artificial Sequence
  dgRNA
  Skil
tgtcccccgggcggc

SEQ ID NO: 43046 - DNA, 15 bp, Artificial Sequence
  dgRNA
  Skil
ccgggcggccggaga

SEQ ID NO: 43047 - DNA, 15 bp, Artificial Sequence
  dgRNA
  Zscan18
gatgttatagtgata

SEQ ID NO: 43048 - DNA, 15 bp, Artificial Sequence
  dgRNA
  Zscan18
gggataaatctgatt

SEQ ID NO: 43049 - DNA, 15 bp, Artificial Sequence
  dgRNA
  Zscan18
atggtacattcatct

SEQ ID NO: 43050 - DNA, 15 bp, Artificial Sequence
  dgRNA
  Zscan18
atctaggtgtatagc

SEQ ID NO: 43051 - DNA, 15 bp, Artificial Sequence
  dgRNA
  Prl2b1
acacttgtaacagcc

SEQ ID NO: 43052 - DNA, 15 bp, Artificial Sequence
  dgRNA
  Prl2b1
ctggtcacggataat

SEQ ID NO: 43053 - DNA, 15 bp, Artificial Sequence
  dgRNA
  Prl2b1
cttctgccgtctaac

SEQ ID NO: 43054 - DNA, 15 bp, Artificial Sequence
  dgRNA
  Prl2b1
tgtgctctactatat

SEQ ID NO: 43055 - DNA, 15 bp, Artificial Sequence
  dgRNA
  Tfr2
ggtgaaacttccaag

SEQ ID NO: 43056 - DNA, 15 bp, Artificial Sequence
  dgRNA
  D6Wsu163e
aagggggtcttggat

SEQ ID NO: 43057 - DNA, 15 bp, Artificial Sequence
  dgRNA
  D6Wsu163e
gataggcgttttcct

SEQ ID NO: 43058 - DNA, 15 bp, Artificial Sequence
  dgRNA
  D6Wsu163e
tttccttggcgcttg

SEQ ID NO: 43059 - DNA, 15 bp, Artificial Sequence
  dgRNA
  D6Wsu163e
ccgaatctgccaaag

SEQ ID NO: 43060 - DNA, 15 bp, Artificial Sequence
  dgRNA
  Oas3
ggaacattggggacc

SEQ ID NO: 43061 - DNA, 15 bp, Artificial Sequence
  dgRNA
  Oas3
gagattatctgttta

SEQ ID NO: 43062 - DNA, 15 bp, Artificial Sequence
  dgRNA
  Nop2
ctcgggagtagcggg

SEQ ID NO: 43063 - DNA, 15 bp, Artificial Sequence
  dgRNA
  Nop2
ccaccttccgaaccg

SEQ ID NO: 43064 - DNA, 15 bp, Artificial Sequence
  dgRNA
  Nop2
ccctctctgaaccgc

SEQ ID NO: 43065 - DNA, 15 bp, Artificial Sequence
  dgRNA
  Nop2
tctgaaccgcgggtg

SEQ ID NO: 43066 - DNA, 15 bp, Artificial Sequence
  dgRNA
  Fosb
acccccgagaccccc

SEQ ID NO: 43067 - DNA, 15 bp, Artificial Sequence
  dgRNA
  Fosb
cccccgagaccccca

SEQ ID NO: 43068 - DNA, 15 bp, Artificial Sequence
  dgRNA
  Fosb
ggtcacactatgggc

SEQ ID NO: 43069 - DNA, 15 bp, Artificial Sequence
  dgRNA
  Fosb
cacactatgggcagg

SEQ ID NO: 43070 - DNA, 15 bp, Artificial Sequence
  dgRNA
  Idnk
gtccctgcatcccgg

SEQ ID NO: 43071 - DNA, 15 bp, Artificial Sequence
  dgRNA
  Idnk
cccagcggtcagcgc

SEQ ID NO: 43072 - DNA, 15 bp, Artificial Sequence
  dgRNA
  Idnk
agcgctggagatgcg

SEQ ID NO: 43073 - DNA, 15 bp, Artificial Sequence
  dgRNA
  Idnk
gcgctggagatgcgg

SEQ ID NO: 43074 - DNA, 15 bp, Artificial Sequence
  dgRNA
  Myocd
cgggagtctctgcac

SEQ ID NO: 43075 - DNA, 15 bp, Artificial Sequence
  dgRNA
  Stx4a
gagatgttccggtag

SEQ ID NO: 43076 - DNA, 15 bp, Artificial Sequence
  dgRNA
  Stx4a
agatgttccggtagt

SEQ ID NO: 43077 - DNA, 15 bp, Artificial Sequence
  dgRNA
  Stx4a
gatgttccggtagtg

SEQ ID NO: 43078 - DNA, 15 bp, Artificial Sequence
  dgRNA
  Stx4a
atgttccggtagtgg

SEQ ID NO: 43079 - DNA, 15 bp, Artificial Sequence
  dgRNA
  Npas4
tcccgttcgacgtca

SEQ ID NO: 43080 - DNA, 15 bp, Artificial Sequence
  dgRNA
  Npas4
cccgttcgacgtcac

SEQ ID NO: 43081 - DNA, 15 bp, Artificial Sequence
  dgRNA
  Npas4
gtcacgggatgacgt

SEQ ID NO: 43082 - DNA, 15 bp, Artificial Sequence
  dgRNA
  Npas4
atgacgtcggaagtc

SEQ ID NO: 43083 - DNA, 15 bp, Artificial Sequence
  dgRNA
  Mrgprg
ggtcccgagcaccta

SEQ ID NO: 43084 - DNA, 15 bp, Artificial Sequence
  dgRNA
  Mrgprg
cgagcacctaaggcc

SEQ ID NO: 43085 - DNA, 15 bp, Artificial Sequence
  dgRNA
  Mrgprg
gagcacctaaggcca

SEQ ID NO: 43086 - DNA, 15 bp, Artificial Sequence
  dgRNA
  Mrgprg
ggaccattccagaat

SEQ ID NO: 43087 - DNA, 15 bp, Artificial Sequence
  dgRNA
  Rnf44
tcccgggccgcgcta

SEQ ID NO: 43088 - DNA, 15 bp, Artificial Sequence
  dgRNA
  Rnf44
gggccgcgctagggg

SEQ ID NO: 43089 - DNA, 15 bp, Artificial Sequence
  dgRNA
  Rnf44
ggccgcgctaggggc

SEQ ID NO: 43090 - DNA, 15 bp, Artificial Sequence
  dgRNA
  Rnf44
gccgcgctaggggcg

SEQ ID NO: 43091 - DNA, 15 bp, Artificial Sequence
  dgRNA
  Obsl1
caggaagcccggccg

SEQ ID NO: 43092 - DNA, 15 bp, Artificial Sequence
  dgRNA
  Obsl1
aggaagcccggccgc

SEQ ID NO: 43093 - DNA, 15 bp, Artificial Sequence
  dgRNA
  Obsl1
ggccgcgggcagtct

SEQ ID NO: 43094 - DNA, 15 bp, Artificial Sequence
  dgRNA
  Obsl1
gcagtctaggctgta

SEQ ID NO: 43095 - DNA, 15 bp, Artificial Sequence
  dgRNA
  P4ha1
gccccatggtaacca

SEQ ID NO: 43096 - DNA, 15 bp, Artificial Sequence
  dgRNA
  P4ha1
tggtaaccacgggaa

SEQ ID NO: 43097 - DNA, 15 bp, Artificial Sequence
  dgRNA
  P4ha1
taaccacgggaacgg

SEQ ID NO: 43098 - DNA, 15 bp, Artificial Sequence
  dgRNA
  P4ha1
acgggaacggtggcg

SEQ ID NO: 43099 - DNA, 15 bp, Artificial Sequence
  dgRNA
  Il19
atggcccaagatgac

SEQ ID NO: 43100 - DNA, 15 bp, Artificial Sequence
  dgRNA
  Il19
ccggactcttttaga

SEQ ID NO: 43101 - DNA, 15 bp, Artificial Sequence
  dgRNA
  Il19
gagtccggtcatctt

SEQ ID NO: 43102 - DNA, 15 bp, Artificial Sequence
  dgRNA
  Il19
agagtccggtcatct

SEQ ID NO: 43103 - DNA, 15 bp, Artificial Sequence
  dgRNA
  Slc13a3
gggatgacggtgctg

SEQ ID NO: 43104 - DNA, 15 bp, Artificial Sequence
  dgRNA
  Slc13a3
cacgtgagtccagag

SEQ ID NO: 43105 - DNA, 15 bp, Artificial Sequence
  dgRNA
  Slc13a3
acgtgagtccagagt

SEQ ID NO: 43106 - DNA, 15 bp, Artificial Sequence
  dgRNA
  Slc13a3
cgtgagtccagagtg

SEQ ID NO: 43107 - DNA, 15 bp, Artificial Sequence
  dgRNA
  Sdf4
gactggaaggctcgg

SEQ ID NO: 43108 - DNA, 15 bp, Artificial Sequence
  dgRNA
  1700011E24Rik
acacaccgaagaact

SEQ ID NO: 43109 - DNA, 15 bp, Artificial Sequence
  dgRNA
  1700011E24Rik
cacaccgaagaactc

SEQ ID NO: 43110 - DNA, 15 bp, Artificial Sequence
  dgRNA
  1700011E24Rik
gattctttctgcacg

SEQ ID NO: 43111 - DNA, 15 bp, Artificial Sequence
  dgRNA
  1700011E24Rik
ggctttcacgcgcgc

SEQ ID NO: 43112 - DNA, 15 bp, Artificial Sequence
  dgRNA
  Pias2
ccgctgtcgccgtcg

SEQ ID NO: 43113 - DNA, 15 bp, Artificial Sequence
  dgRNA
  Pias2
cgtcgcggtcgtcgc

SEQ ID NO: 43114 - DNA, 15 bp, Artificial Sequence
  dgRNA
  Pias2
gtcgcggtcgtcgcc

SEQ ID NO: 43115 - DNA, 15 bp, Artificial Sequence
  dgRNA
  Pias2
tcgcggtcgtcgccg

SEQ ID NO: 43116 - DNA, 15 bp, Artificial Sequence
  dgRNA
  Olfr780
ttcagctaagtatgc

SEQ ID NO: 43117 - DNA, 15 bp, Artificial Sequence
  dgRNA
  Cdc42
ctgcgtgctgacgtc

SEQ ID NO: 43118 - DNA, 15 bp, Artificial Sequence
  dgRNA
  Cdc42
gacgtcagcacgcag

SEQ ID NO: 43119 - DNA, 15 bp, Artificial Sequence
  dgRNA
  Cdc42
ctgacgtcagcacgc

SEQ ID NO: 43120 - DNA, 15 bp, Artificial Sequence
  dgRNA
  Cldn12
ggtggtctcaggaat

SEQ ID NO: 43121 - DNA, 15 bp, Artificial Sequence
  dgRNA
  Cldn12
tcaggaattggcccg

SEQ ID NO: 43122 - DNA, 15 bp, Artificial Sequence
  dgRNA
  Cldn12
ttggcccgcggccag

SEQ ID NO: 43123 - DNA, 15 bp, Artificial Sequence
  dgRNA
  Cldn12
cggccagcggcccga

SEQ ID NO: 43124 - DNA, 15 bp, Artificial Sequence
  dgRNA
  Kcnd2
cgggagcctgggatc

SEQ ID NO: 43125 - DNA, 15 bp, Artificial Sequence
  dgRNA
  Kcnd2
ctgctcgggagccgc

SEQ ID NO: 43126 - DNA, 15 bp, Artificial Sequence
  dgRNA
  Kcnd2
ccctttccgggtaca

SEQ ID NO: 43127 - DNA, 15 bp, Artificial Sequence
  dgRNA
  Kcnd2
tatgcaactcagccc

SEQ ID NO: 43128 - DNA, 15 bp, Artificial Sequence
  dgRNA
  Eif2b3
aacgttagagattga

SEQ ID NO: 43129 - DNA, 15 bp, Artificial Sequence
  dgRNA
  Eif2b3
acgttagagattgaa

SEQ ID NO: 43130 - DNA, 15 bp, Artificial Sequence
  dgRNA
  Eif2b3
cgttagagattgaag

SEQ ID NO: 43131 - DNA, 15 bp, Artificial Sequence
  dgRNA
  Eif2b3
agaaactccacgcca

SEQ ID NO: 43132 - DNA, 15 bp, Artificial Sequence
  dgRNA
  B4galt3
aactgaggtgagcga

SEQ ID NO: 43133 - DNA, 15 bp, Artificial Sequence
  dgRNA
  B4galt3
cgatggaaccccgtt

SEQ ID NO: 43134 - DNA, 15 bp, Artificial Sequence
  dgRNA
  B4galt3
gactgcgaagtcgag

SEQ ID NO: 43135 - DNA, 15 bp, Artificial Sequence
  dgRNA
  B4galt3
gtcgagaggaagcac

SEQ ID NO: 43136 - DNA, 15 bp, Artificial Sequence
  dgRNA
  Ttll3
caaatcaagagtatg

SEQ ID NO: 43137 - DNA, 15 bp, Artificial Sequence
  dgRNA
  Ttll3
agtatgtggcaagta

SEQ ID NO: 43138 - DNA, 15 bp, Artificial Sequence
  dgRNA
  Ttll3
tattcgacttcccta

SEQ ID NO: 43139 - DNA, 15 bp, Artificial Sequence
  dgRNA
  Ttll3
accacgcagctatcg

SEQ ID NO: 43140 - DNA, 15 bp, Artificial Sequence
  dgRNA
  Mtm1
ccggacctggcaaac

SEQ ID NO: 43141 - DNA, 15 bp, Artificial Sequence
  dgRNA
  Mtm1
tgcaagaggctactt

SEQ ID NO: 43142 - DNA, 15 bp, Artificial Sequence
  dgRNA
  Mtm1
ccatgtcctgccaat

SEQ ID NO: 43143 - DNA, 15 bp, Artificial Sequence
  dgRNA
  Mtm1
cctgccaatcggaac

SEQ ID NO: 43144 - DNA, 15 bp, Artificial Sequence
  dgRNA
  Ulk1
agtcccgcccagtat

SEQ ID NO: 43145 - DNA, 15 bp, Artificial Sequence
  dgRNA
  Ulk1
gtcccgcccagtata

SEQ ID NO: 43146 - DNA, 15 bp, Artificial Sequence
  dgRNA
  Ulk1
cgcccagtatagggc

SEQ ID NO: 43147 - DNA, 15 bp, Artificial Sequence
  dgRNA
  Ulk1
gcccagtatagggct

SEQ ID NO: 43148 - DNA, 15 bp, Artificial Sequence
  dgRNA
  Capn15
atggactacaattcc

SEQ ID NO: 43149 - DNA, 15 bp, Artificial Sequence
  dgRNA
  Capn15
cgtcgctctgccctg

SEQ ID NO: 43150 - DNA, 15 bp, Artificial Sequence
  dgRNA
  Capn15
gtcgctctgccctgt

SEQ ID NO: 43151 - DNA, 15 bp, Artificial Sequence
  dgRNA
  Capn15
tgggagccgtagtcc

SEQ ID NO: 43152 - DNA, 15 bp, Artificial Sequence
  dgRNA
  Sdhaf4
ctaagagcgctgccc

SEQ ID NO: 43153 - DNA, 15 bp, Artificial Sequence
  dgRNA
  Sdhaf4
gcccaggtactgcgc

SEQ ID NO: 43154 - DNA, 15 bp, Artificial Sequence
  dgRNA
  Sdhaf4
tactgcgcaggacca

SEQ ID NO: 43155 - DNA, 15 bp, Artificial Sequence
  dgRNA
  Sdhaf4
gcaggaccaagggcg

SEQ ID NO: 43156 - DNA, 15 bp, Artificial Sequence
  dgRNA
  Angptl7
gagactgtacagacg

SEQ ID NO: 43157 - DNA, 15 bp, Artificial Sequence
  dgRNA
  Angptl7
ctgacttcactcaac

SEQ ID NO: 43158 - DNA, 15 bp, Artificial Sequence
  dgRNA
  Angptl7
tgaccctcccagatg

SEQ ID NO: 43159 - DNA, 15 bp, Artificial Sequence
  dgRNA
  Angptl7
cacagggccctcgta

SEQ ID NO: 43160 - DNA, 15 bp, Artificial Sequence
  dgRNA
  Chtf8
cgggcctccgacccc

SEQ ID NO: 43161 - DNA, 15 bp, Artificial Sequence
  dgRNA
  Chtf8
accccttccgaacag

SEQ ID NO: 43162 - DNA, 15 bp, Artificial Sequence
  dgRNA
  Chtf8
ccccttccgaacagt

SEQ ID NO: 43163 - DNA, 15 bp, Artificial Sequence
  dgRNA
  Chtf8
gaactcacctaccgc

SEQ ID NO: 43164 - DNA, 15 bp, Artificial Sequence
  dgRNA
  Rad51
cttgtagtcctcagt

SEQ ID NO: 43165 - DNA, 15 bp, Artificial Sequence
  dgRNA
  Rad51
ttgtagtcctcagtc

SEQ ID NO: 43166 - DNA, 15 bp, Artificial Sequence
  dgRNA
  Rad51
gtcgggtaaccagaa

SEQ ID NO: 43167 - DNA, 15 bp, Artificial Sequence
  dgRNA
  Rad51
ccctacgaaatcact

SEQ ID NO: 43168 - DNA, 15 bp, Artificial Sequence
  dgRNA
  Zmynd8
cacttggttgaagtc

SEQ ID NO: 43169 - DNA, 15 bp, Artificial Sequence
  dgRNA
  Zmynd8
caccccctttccata

SEQ ID NO: 43170 - DNA, 15 bp, Artificial Sequence
  dgRNA
  Zmynd8
ccctttccataagga

SEQ ID NO: 43171 - DNA, 15 bp, Artificial Sequence
  dgRNA
  Zmynd8
ggcggttttgctctc

SEQ ID NO: 43172 - DNA, 15 bp, Artificial Sequence
  dgRNA
  Rps7
caggtctccaactag

SEQ ID NO: 43173 - DNA, 15 bp, Artificial Sequence
  dgRNA
  Rps7
ctccaactaggggag

SEQ ID NO: 43174 - DNA, 15 bp, Artificial Sequence
  dgRNA
  Rps7
aacgctgacgactac

SEQ ID NO: 43175 - DNA, 15 bp, Artificial Sequence
  dgRNA
  Rps7
acgctgacgactacc

SEQ ID NO: 43176 - DNA, 15 bp, Artificial Sequence
  dgRNA
  Cops8
cataatgcacctaac

SEQ ID NO: 43177 - DNA, 15 bp, Artificial Sequence
  dgRNA
  Cops8
atagaatctgttcga

SEQ ID NO: 43178 - DNA, 15 bp, Artificial Sequence
  dgRNA
  Cops8
acttatcccattact

SEQ ID NO: 43179 - DNA, 15 bp, Artificial Sequence
  dgRNA
  Cops8
tcccattacttggag

SEQ ID NO: 43180 - DNA, 15 bp, Artificial Sequence
  dgRNA
  Uba3
ccgggcggacccgct

SEQ ID NO: 43181 - DNA, 15 bp, Artificial Sequence
  dgRNA
  Uba3
gacccgctcggcgcg

SEQ ID NO: 43182 - DNA, 15 bp, Artificial Sequence
  dgRNA
  Uba3
acccgctcggcgcga

SEQ ID NO: 43183 - DNA, 15 bp, Artificial Sequence
  dgRNA
  Uba3
cggcgcgagggcctc

SEQ ID NO: 43184 - DNA, 15 bp, Artificial Sequence
  dgRNA
  Terf2
tcaaaatagcgcgcc

SEQ ID NO: 43185 - DNA, 15 bp, Artificial Sequence
  dgRNA
  Terf2
aatagcgcgcctggc

SEQ ID NO: 43186 - DNA, 15 bp, Artificial Sequence
  dgRNA
  Terf2
atagcgcgcctggct

SEQ ID NO: 43187 - DNA, 15 bp, Artificial Sequence
  dgRNA
  Terf2
gaactacggatgccg

SEQ ID NO: 43188 - DNA, 15 bp, Artificial Sequence
  dgRNA
  Atp13a2
gatctcagcgagctc

SEQ ID NO: 43189 - DNA, 15 bp, Artificial Sequence
  dgRNA
  Atp13a2
gcgagctccggacag

SEQ ID NO: 43190 - DNA, 15 bp, Artificial Sequence
  dgRNA
  Atp13a2
tcccggcagcccgcg

SEQ ID NO: 43191 - DNA, 15 bp, Artificial Sequence
  dgRNA
  Atp13a2
cccgcgcggcagcga

SEQ ID NO: 43192 - DNA, 15 bp, Artificial Sequence
  dgRNA
  Cct2
aaagcagcccgcccc

SEQ ID NO: 43193 - DNA, 15 bp, Artificial Sequence
  dgRNA
  Cct2
ttccgccaccaactg

SEQ ID NO: 43194 - DNA, 15 bp, Artificial Sequence
  dgRNA
  Cct2
gagccgctacgcttc

SEQ ID NO: 43195 - DNA, 15 bp, Artificial Sequence
  dgRNA
  Cct2
ccgccacgcaggagg

SEQ ID NO: 43196 - DNA, 15 bp, Artificial Sequence
  dgRNA
  Tll2
aagtgattggctgtc

SEQ ID NO: 43197 - DNA, 15 bp, Artificial Sequence
  dgRNA
  Tll2
gtgattggctgtccg

SEQ ID NO: 43198 - DNA, 15 bp, Artificial Sequence
  dgRNA
  Tll2
gctgtccggggccct

SEQ ID NO: 43199 - DNA, 15 bp, Artificial Sequence
  dgRNA
  Tll2
ccggggcccttggag

SEQ ID NO: 43200 - DNA, 15 bp, Artificial Sequence
  dgRNA
  Rgs7
ccagcgcgggggaca

SEQ ID NO: 43201 - DNA, 15 bp, Artificial Sequence
  dgRNA
  Rgs7
ggcctgtgctcccga

SEQ ID NO: 43202 - DNA, 15 bp, Artificial Sequence
  dgRNA
  Rgs7
gcctgtgctcccgag

SEQ ID NO: 43203 - DNA, 15 bp, Artificial Sequence
  dgRNA
  Rgs7
gctcccgaggggttg

SEQ ID NO: 43204 - DNA, 15 bp, Artificial Sequence
  dgRNA
  Abhd3
tccatggtctccggg

SEQ ID NO: 43205 - DNA, 15 bp, Artificial Sequence
  dgRNA
  Abhd3
tccgggcggtccagc

SEQ ID NO: 43206 - DNA, 15 bp, Artificial Sequence
  dgRNA
  Abhd3
ggtccagctggcgtc

SEQ ID NO: 43207 - DNA, 15 bp, Artificial Sequence
  dgRNA
  Abhd3
cagctggcgtctgga

SEQ ID NO: 43208 - DNA, 15 bp, Artificial Sequence
  dgRNA
  Aste1
ctagcaagtttccta

SEQ ID NO: 43209 - DNA, 15 bp, Artificial Sequence
  dgRNA
  Aste1
gtttagagggcatag

SEQ ID NO: 43210 - DNA, 15 bp, Artificial Sequence
  dgRNA
  Aste1
gacttaattcagctg

SEQ ID NO: 43211 - DNA, 15 bp, Artificial Sequence
  dgRNA
  Aste1
atagtctgcaaatta

SEQ ID NO: 43212 - DNA, 15 bp, Artificial Sequence
  dgRNA
  Ap4b1
ctcacaaccgcgcgc

SEQ ID NO: 43213 - DNA, 15 bp, Artificial Sequence
  dgRNA
  Ap4b1
ccgcgcgctggagct

SEQ ID NO: 43214 - DNA, 15 bp, Artificial Sequence
  dgRNA
  Ap4b1
ttgtcaaagctcgcg

SEQ ID NO: 43215 - DNA, 15 bp, Artificial Sequence
  dgRNA
  Ap4b1
tcaaagctcgcgcgg

SEQ ID NO: 43216 - DNA, 15 bp, Artificial Sequence
  dgRNA
  Mapk1ip1l
ccgcgctccacccag

SEQ ID NO: 43217 - DNA, 15 bp, Artificial Sequence
  dgRNA
  Mapk1ip1l
cgcgctccacccaga

SEQ ID NO: 43218 - DNA, 15 bp, Artificial Sequence
  dgRNA
  Mapk1ip1l
ctgcctgcagtttcg

SEQ ID NO: 43219 - DNA, 15 bp, Artificial Sequence
  dgRNA
  Mapk1ip1l
tgcctgcagtttcgt

SEQ ID NO: 43220 - DNA, 15 bp, Artificial Sequence
  dgRNA
  Syp
tccggtagaactgag

SEQ ID NO: 43221 - DNA, 15 bp, Artificial Sequence
  dgRNA
  Syp
accgctcagttctac

SEQ ID NO: 43222 - DNA, 15 bp, Artificial Sequence
  dgRNA
  Mynn
atttatgacgtccgc

SEQ ID NO: 43223 - DNA, 15 bp, Artificial Sequence
  dgRNA
  Mynn
acgtccgcaggttct

SEQ ID NO: 43224 - DNA, 15 bp, Artificial Sequence
  dgRNA
  Mynn
cgtccgcaggttcta

SEQ ID NO: 43225 - DNA, 15 bp, Artificial Sequence
  dgRNA
  Mynn
ctaactctgatttcg

SEQ ID NO: 43226 - DNA, 15 bp, Artificial Sequence
  dgRNA
  Cabyr
aggggtataaatagt

SEQ ID NO: 43227 - DNA, 15 bp, Artificial Sequence
  dgRNA
  Cabyr
ggtataaatagtcgg

SEQ ID NO: 43228 - DNA, 15 bp, Artificial Sequence
  dgRNA
  Cabyr
tgcgctctctcgcac

SEQ ID NO: 43229 - DNA, 15 bp, Artificial Sequence
  dgRNA
  Pdpn
gtcatcttgtgatgc

SEQ ID NO: 43230 - DNA, 15 bp, Artificial Sequence
  dgRNA
  Pdpn
tggccaaacagagtt

SEQ ID NO: 43231 - DNA, 15 bp, Artificial Sequence
  dgRNA
  Pdpn
ccaaacagagttcgg

SEQ ID NO: 43232 - DNA, 15 bp, Artificial Sequence
  dgRNA
  Pdpn
gcggtcctagatctc

SEQ ID NO: 43233 - DNA, 15 bp, Artificial Sequence
  dgRNA
  Mocos
ccaagtggacttgct

SEQ ID NO: 43234 - DNA, 15 bp, Artificial Sequence
  dgRNA
  Mocos
agcacctagatattt

SEQ ID NO: 43235 - DNA, 15 bp, Artificial Sequence
  dgRNA
  Mocos
gcacctagatatttc

SEQ ID NO: 43236 - DNA, 15 bp, Artificial Sequence
  dgRNA
  Mocos
tcgggactcgcgtcc

SEQ ID NO: 43237 - DNA, 15 bp, Artificial Sequence
  dgRNA
  Lrrc46
cccatgcgcgctgcg

SEQ ID NO: 43238 - DNA, 15 bp, Artificial Sequence
  dgRNA
  Lrrc46
cgcgctgcgcggaga

SEQ ID NO: 43239 - DNA, 15 bp, Artificial Sequence
  dgRNA
  Lrrc46
agacggaagtagcta

SEQ ID NO: 43240 - DNA, 15 bp, Artificial Sequence
  dgRNA
  Lrrc46
agtagctaaggattg

SEQ ID NO: 43241 - DNA, 15 bp, Artificial Sequence
  dgRNA
  Tmprss11f
gtggtacttacaggc

SEQ ID NO: 43242 - DNA, 15 bp, Artificial Sequence
  dgRNA
  Tmprss11f
gcctgaacttatgat

SEQ ID NO: 43243 - DNA, 15 bp, Artificial Sequence
  dgRNA
  Tmprss11f
acttatgattggcta

SEQ ID NO: 43244 - DNA, 15 bp, Artificial Sequence
  dgRNA
  Tmprss11f
aaagatgacgtgact

SEQ ID NO: 43245 - DNA, 15 bp, Artificial Sequence
  dgRNA
  Pag1
cgcgctgctccgcct

SEQ ID NO: 43246 - DNA, 15 bp, Artificial Sequence
  dgRNA
  Pag1
tgctgcggcacgtca

SEQ ID NO: 43247 - DNA, 15 bp, Artificial Sequence
  dgRNA
  Pag1
tgttcgcgactgctg

SEQ ID NO: 43248 - DNA, 15 bp, Artificial Sequence
  dgRNA
  Pag1
ggcggagcagcgcgc

SEQ ID NO: 43249 - DNA, 15 bp, Artificial Sequence
  dgRNA
  Ube2j2
cggcgaacctgaacg

SEQ ID NO: 43250 - DNA, 15 bp, Artificial Sequence
  dgRNA
  Ube2j2
acctgaacgcggccg

SEQ ID NO: 43251 - DNA, 15 bp, Artificial Sequence
  dgRNA
  Ube2j2
cgcggccgcggcctc

SEQ ID NO: 43252 - DNA, 15 bp, Artificial Sequence
  dgRNA
  Ube2j2
gcggccgcggcctca

SEQ ID NO: 43253 - DNA, 15 bp, Artificial Sequence
  dgRNA
  Tkfc
ccacgaactagagtt

SEQ ID NO: 43254 - DNA, 15 bp, Artificial Sequence
  dgRNA
  Tkfc
actagagtttggact

SEQ ID NO: 43255 - DNA, 15 bp, Artificial Sequence
  dgRNA
  Tkfc
gctccctaattctta

SEQ ID NO: 43256 - DNA, 15 bp, Artificial Sequence
  dgRNA
  Tkfc
taattcttaaggcac

SEQ ID NO: 43257 - DNA, 15 bp, Artificial Sequence
  dgRNA
  Dolpp1
gagatagcgcctgat

SEQ ID NO: 43258 - DNA, 15 bp, Artificial Sequence
  dgRNA
  Dolpp1
gagctttggttaggc

SEQ ID NO: 43259 - DNA, 15 bp, Artificial Sequence
  dgRNA
  Dolpp1
cgtgttgtactttgg

SEQ ID NO: 43260 - DNA, 15 bp, Artificial Sequence
  dgRNA
  Dolpp1
gggcgtgttgtactt

SEQ ID NO: 43261 - DNA, 15 bp, Artificial Sequence
  dgRNA
  Acsl5
attctgcgtgtcgtg

SEQ ID NO: 43262 - DNA, 15 bp, Artificial Sequence
  dgRNA
  Acsl5
gtcgtgaggttgcag

SEQ ID NO: 43263 - DNA, 15 bp, Artificial Sequence
  dgRNA
  Acsl5
tcgtgaggttgcagc

SEQ ID NO: 43264 - DNA, 15 bp, Artificial Sequence
  dgRNA
  Acsl5
ggttgcagcgggagt

SEQ ID NO: 43265 - DNA, 15 bp, Artificial Sequence
  dgRNA
  Raly
ccgcccgtcagccct

SEQ ID NO: 43266 - DNA, 15 bp, Artificial Sequence
  dgRNA
  Raly
cgcccgtcagccctc

SEQ ID NO: 43267 - DNA, 15 bp, Artificial Sequence
  dgRNA
  Raly
cccgccttcagcacc

SEQ ID NO: 43268 - DNA, 15 bp, Artificial Sequence
  dgRNA
  Raly
ccttcagcacccggc

SEQ ID NO: 43269 - DNA, 15 bp, Artificial Sequence
  dgRNA
  Ptpn2
gacgtccgacccacg

SEQ ID NO: 43270 - DNA, 15 bp, Artificial Sequence
  dgRNA
  Ptpn2
acccacgcggcgccc

SEQ ID NO: 43271 - DNA, 15 bp, Artificial Sequence
  dgRNA
  Ptpn2
gacgtccgacgttcc

SEQ ID NO: 43272 - DNA, 15 bp, Artificial Sequence
  dgRNA
  Ptpn2
tactttccccaaggc

SEQ ID NO: 43273 - DNA, 15 bp, Artificial Sequence
  dgRNA
  Olfr1320
ttaactggctctaat

SEQ ID NO: 43274 - DNA, 15 bp, Artificial Sequence
  dgRNA
  Olfr1320
agtggtctgacatac

SEQ ID NO: 43275 - DNA, 15 bp, Artificial Sequence
  dgRNA
  Olfr1320
tctgacatactggta

SEQ ID NO: 43276 - DNA, 15 bp, Artificial Sequence
  dgRNA
  Olfr1320
aactacgactctctc

SEQ ID NO: 43277 - DNA, 15 bp, Artificial Sequence
  dgRNA
  Olfr366
ggaatcccctccatc

SEQ ID NO: 43278 - DNA, 15 bp, Artificial Sequence
  dgRNA
  Olfr366
gcatcgtggtgcttt

SEQ ID NO: 43279 - DNA, 15 bp, Artificial Sequence
  dgRNA
  Olfr366
atagaactggcatcg

SEQ ID NO: 43280 - DNA, 15 bp, Artificial Sequence
  dgRNA
  Olfr366
acgacttcatagaac

SEQ ID NO: 43281 - DNA, 15 bp, Artificial Sequence
  dgRNA
  Glcci1
attactgcttgttac

SEQ ID NO: 43282 - DNA, 15 bp, Artificial Sequence
  dgRNA
  Glcci1
cagggcgctcgtcgc

SEQ ID NO: 43283 - DNA, 15 bp, Artificial Sequence
  dgRNA
  Glcci1
agggcgctcgtcgca

SEQ ID NO: 43284 - DNA, 15 bp, Artificial Sequence
  dgRNA
  Glcci1
gggcgctcgtcgcag

SEQ ID NO: 43285 - DNA, 15 bp, Artificial Sequence
  dgRNA
  Vbp1
taagcattagccttc

SEQ ID NO: 43286 - DNA, 15 bp, Artificial Sequence
  dgRNA
  Vbp1
aatacgcagattcgc

SEQ ID NO: 43287 - DNA, 15 bp, Artificial Sequence
  dgRNA
  Vbp1
atacgcagattcgca

SEQ ID NO: 43288 - DNA, 15 bp, Artificial Sequence
  dgRNA
  Vbp1
gattcgcagggagag

SEQ ID NO: 43289 - DNA, 15 bp, Artificial Sequence
  dgRNA
  Pign
gagtggcaagatcga

SEQ ID NO: 43290 - DNA, 15 bp, Artificial Sequence
  dgRNA
  Pign
cgaaggaaccgctcc

SEQ ID NO: 43291 - DNA, 15 bp, Artificial Sequence
  dgRNA
  Pign
gcccacaagctctcg

SEQ ID NO: 43292 - DNA, 15 bp, Artificial Sequence
  dgRNA
  Pign
caagctctcgaggat

SEQ ID NO: 43293 - DNA, 15 bp, Artificial Sequence
  dgRNA
  Snx10
ccagctacattcttc

SEQ ID NO: 43294 - DNA, 15 bp, Artificial Sequence
  dgRNA
  Snx10
cagctacattcttca

SEQ ID NO: 43295 - DNA, 15 bp, Artificial Sequence
  dgRNA
  Snx10
gacaagaacgtccag

SEQ ID NO: 43296 - DNA, 15 bp, Artificial Sequence
  dgRNA
  Snx10
aagagttaaaccatt

SEQ ID NO: 43297 - DNA, 15 bp, Artificial Sequence
  dgRNA
  Myom1
cttcctggccataaa

SEQ ID NO: 43298 - DNA, 15 bp, Artificial Sequence
  dgRNA
  Myom1
gtaggattaggttaa

SEQ ID NO: 43299 - DNA, 15 bp, Artificial Sequence
  dgRNA
  Myom1
tagcagcacatgggg

SEQ ID NO: 43300 - DNA, 15 bp, Artificial Sequence
  dgRNA
  Myom1
ataatgcatgtggtc

SEQ ID NO: 43301 - DNA, 15 bp, Artificial Sequence
  dgRNA
  Cyc1
attagagttgcggcc

SEQ ID NO: 43302 - DNA, 15 bp, Artificial Sequence
  dgRNA
  Cyc1
cggccaggctcaacc

SEQ ID NO: 43303 - DNA, 15 bp, Artificial Sequence
  dgRNA
  Cyc1
ctcaacccggactag

SEQ ID NO: 43304 - DNA, 15 bp, Artificial Sequence
  dgRNA
  Cyc1
ccggactagaggagc

SEQ ID NO: 43305 - DNA, 15 bp, Artificial Sequence
  dgRNA
  Mettl21b
gtctcaaaccaagtc

SEQ ID NO: 43306 - DNA, 15 bp, Artificial Sequence
  dgRNA
  Mettl21b
caagtctggcccgta

SEQ ID NO: 43307 - DNA, 15 bp, Artificial Sequence
  dgRNA
  Mettl21b
ccgtatggtgttgtg

SEQ ID NO: 43308 - DNA, 15 bp, Artificial Sequence
  dgRNA
  Mettl21b
cgtatggtgttgtgt

SEQ ID NO: 43309 - DNA, 15 bp, Artificial Sequence
  dgRNA
  Prss58
tttatgacccaaacc

SEQ ID NO: 43310 - DNA, 15 bp, Artificial Sequence
  dgRNA
  Ccng1
caatctggctaatag

SEQ ID NO: 43311 - DNA, 15 bp, Artificial Sequence
  dgRNA
  Ccng1
tgcccgggcaagcct

SEQ ID NO: 43312 - DNA, 15 bp, Artificial Sequence
  dgRNA
  Ccng1
cagttccgcagctta

SEQ ID NO: 43313 - DNA, 15 bp, Artificial Sequence
  dgRNA
  Ccng1
tccgcagcttaagga

SEQ ID NO: 43314 - DNA, 15 bp, Artificial Sequence
  dgRNA
  Foxd4
agggaaatcgagtca

SEQ ID NO: 43315 - DNA, 15 bp, Artificial Sequence
  dgRNA
  Foxd4
gggaaatcgagtcac

SEQ ID NO: 43316 - DNA, 15 bp, Artificial Sequence
  dgRNA
  Foxd4
agtcacgggattatt

SEQ ID NO: 43317 - DNA, 15 bp, Artificial Sequence
  dgRNA
  Foxd4
ttggtgaagtttacg

SEQ ID NO: 43318 - DNA, 15 bp, Artificial Sequence
  dgRNA
  Gm1110
cctgctgatggattg

SEQ ID NO: 43319 - DNA, 15 bp, Artificial Sequence
  dgRNA
  Gm1110
gcgtttcacttcctg

SEQ ID NO: 43320 - DNA, 15 bp, Artificial Sequence
  dgRNA
  Gm1110
ccgagagaagggctt

SEQ ID NO: 43321 - DNA, 15 bp, Artificial Sequence
  dgRNA
  Gm1110
cgagagaagggcttc

SEQ ID NO: 43322 - DNA, 15 bp, Artificial Sequence
  dgRNA
  Olfr237-ps1
tagtcaagtgaaatt

SEQ ID NO: 43323 - DNA, 15 bp, Artificial Sequence
  dgRNA
  Olfr237-ps1
gagcattagtagcaa

SEQ ID NO: 43324 - DNA, 15 bp, Artificial Sequence
  dgRNA
  Olfr237-ps1
gtgcatcacctaaga

SEQ ID NO: 43325 - DNA, 15 bp, Artificial Sequence
  dgRNA
  Fam187b
agttcacagggccgg

SEQ ID NO: 43326 - DNA, 15 bp, Artificial Sequence
  dgRNA
  Fam187b
gtgcccaagttctgt

SEQ ID NO: 43327 - DNA, 15 bp, Artificial Sequence
  dgRNA
  Fam187b
tcaaatataacaacc

SEQ ID NO: 43328 - DNA, 15 bp, Artificial Sequence
  dgRNA
  Fam187b
cggccctgtgaactg

SEQ ID NO: 43329 - DNA, 15 bp, Artificial Sequence
  dgRNA
  Bud13
ccgattcgtcgtctc

SEQ ID NO: 43330 - DNA, 15 bp, Artificial Sequence
  dgRNA
  Bud13
gcacgcactctcccc

SEQ ID NO: 43331 - DNA, 15 bp, Artificial Sequence
  dgRNA
  Bud13
taaagcttccgcttc

SEQ ID NO: 43332 - DNA, 15 bp, Artificial Sequence
  dgRNA
  Bud13
cctgagacgacgaat

SEQ ID NO: 43333 - DNA, 15 bp, Artificial Sequence
  dgRNA
  Olfr729
ggttgttcaaatgtt

SEQ ID NO: 43334 - DNA, 15 bp, Artificial Sequence
  dgRNA
  Zfp691
ttttgcgagtcccaa

SEQ ID NO: 43335 - DNA, 15 bp, Artificial Sequence
  dgRNA
  Zfp691
gtcccaaaggccgcc

SEQ ID NO: 43336 - DNA, 15 bp, Artificial Sequence
  dgRNA
  Zfp691
ccttactgttggcct

SEQ ID NO: 43337 - DNA, 15 bp, Artificial Sequence
  dgRNA
  Zfp691
tacccggcggccttt

SEQ ID NO: 43338 - DNA, 15 bp, Artificial Sequence
  dgRNA
  Ctps2
ggacgtctagagcag

SEQ ID NO: 43339 - DNA, 15 bp, Artificial Sequence
  dgRNA
  Ctps2
gacgtctagagcaga

SEQ ID NO: 43340 - DNA, 15 bp, Artificial Sequence
  dgRNA
  Ctps2
gttttgtactgtccc

SEQ ID NO: 43341 - DNA, 15 bp, Artificial Sequence
  dgRNA
  Ctps2
cagcgtgagtcagct

SEQ ID NO: 43342 - DNA, 15 bp, Artificial Sequence
  dgRNA
  Ccdc105
aaagcggctccctca

SEQ ID NO: 43343 - DNA, 15 bp, Artificial Sequence
  dgRNA
  Ccdc105
ggaacgcaatctcca

SEQ ID NO: 43344 - DNA, 15 bp, Artificial Sequence
  dgRNA
  Ccdc105
ggttgccacggtgag

SEQ ID NO: 43345 - DNA, 15 bp, Artificial Sequence
  dgRNA
  Ccdc105
cggtgaggggagctc

SEQ ID NO: 43346 - DNA, 15 bp, Artificial Sequence
  dgRNA
  Slc8a2
gtctagccccctctc

SEQ ID NO: 43347 - DNA, 15 bp, Artificial Sequence
  dgRNA
  Slc8a2
ctagccccctctccg

SEQ ID NO: 43348 - DNA, 15 bp, Artificial Sequence
  dgRNA
  Slc8a2
ccgttaagagagtct

SEQ ID NO: 43349 - DNA, 15 bp, Artificial Sequence
  dgRNA
  Slc8a2
taggggaatacagct

SEQ ID NO: 43350 - DNA, 15 bp, Artificial Sequence
  dgRNA
  Inpp4a
ccccacattcgctgc

SEQ ID NO: 43351 - DNA, 15 bp, Artificial Sequence
  dgRNA
  Inpp4a
gccagcagcgaatgt

SEQ ID NO: 43352 - DNA, 15 bp, Artificial Sequence
  dgRNA
  Inpp4a
ggccagcagcgaatg

SEQ ID NO: 43353 - DNA, 15 bp, Artificial Sequence
  dgRNA
  l7Rn6
cgatctgcgcacagc

SEQ ID NO: 43354 - DNA, 15 bp, Artificial Sequence
  dgRNA
  l7Rn6
ctgcgcacagctggt

SEQ ID NO: 43355 - DNA, 15 bp, Artificial Sequence
  dgRNA
  l7Rn6
tgcgcacagctggta

SEQ ID NO: 43356 - DNA, 15 bp, Artificial Sequence
  dgRNA
  l7Rn6
gcgcacagctggtag

SEQ ID NO: 43357 - DNA, 15 bp, Artificial Sequence
  dgRNA
  Arhgef9
gtcagagactcacgc

SEQ ID NO: 43358 - DNA, 15 bp, Artificial Sequence
  dgRNA
  Arhgef9
tctgcgtgaataaaa

SEQ ID NO: 43359 - DNA, 15 bp, Artificial Sequence
  dgRNA
  Arhgef9
gcaacctaccggctg

SEQ ID NO: 43360 - DNA, 15 bp, Artificial Sequence
  dgRNA
  Arhgef9
acctaccggctgagg

SEQ ID NO: 43361 - DNA, 15 bp, Artificial Sequence
  dgRNA
  Clrn1
gtaagtgacatgaga

SEQ ID NO: 43362 - DNA, 15 bp, Artificial Sequence
  dgRNA
  Clrn1
taagtgacatgagag

SEQ ID NO: 43363 - DNA, 15 bp, Artificial Sequence
  dgRNA
  Clrn1
gtatagggtaacaga

SEQ ID NO: 43364 - DNA, 15 bp, Artificial Sequence
  dgRNA
  Clrn1
tccaaattgcctgca

SEQ ID NO: 43365 - DNA, 15 bp, Artificial Sequence
  dgRNA
  Egfem1
cctcgagagcgagcc

SEQ ID NO: 43366 - DNA, 15 bp, Artificial Sequence
  dgRNA
  Egfem1
ccgggctcgctctcg

SEQ ID NO: 43367 - DNA, 15 bp, Artificial Sequence
  dgRNA
  Egfem1
gaagttgctagtgcc

SEQ ID NO: 43368 - DNA, 15 bp, Artificial Sequence
  dgRNA
  Egfem1
agaagttgctagtgc

SEQ ID NO: 43369 - DNA, 15 bp, Artificial Sequence
  dgRNA
  Aldh1a1
ccagatagaacttca

SEQ ID NO: 43370 - DNA, 15 bp, Artificial Sequence
  dgRNA
  Aldh1a1
ggtgcaggttcctta

SEQ ID NO: 43371 - DNA, 15 bp, Artificial Sequence
  dgRNA
  Aldh1a1
aggatttacatgtaa

SEQ ID NO: 43372 - DNA, 15 bp, Artificial Sequence
  dgRNA
  Aldh1a1
ggtgttacaagtgag

SEQ ID NO: 43373 - DNA, 15 bp, Artificial Sequence
  dgRNA
  Socs1
gagccggaaccccag

SEQ ID NO: 43374 - DNA, 15 bp, Artificial Sequence
  dgRNA
  Socs1
ccagaggtcccaatg

SEQ ID NO: 43375 - DNA, 15 bp, Artificial Sequence
  dgRNA
  Socs1
ggtcccaatgtggga

SEQ ID NO: 43376 - DNA, 15 bp, Artificial Sequence
  dgRNA
  Socs1
atgtgggaaggtgcg

SEQ ID NO: 43377 - DNA, 15 bp, Artificial Sequence
  dgRNA
  Mpped1
gcgatcgcgctcctg

SEQ ID NO: 43378 - DNA, 15 bp, Artificial Sequence
  dgRNA
  Mpped1
cgatcgcgctcctgc

SEQ ID NO: 43379 - DNA, 15 bp, Artificial Sequence
  dgRNA
  Mpped1
gatcgcgctcctgcg

SEQ ID NO: 43380 - DNA, 15 bp, Artificial Sequence
  dgRNA
  Mpped1
cgctcctgcggggcc

SEQ ID NO: 43381 - DNA, 15 bp, Artificial Sequence
  dgRNA
  Pepd
tgcttaatcagctgc

SEQ ID NO: 43382 - DNA, 15 bp, Artificial Sequence
  dgRNA
  Pepd
ggactcctccactta

SEQ ID NO: 43383 - DNA, 15 bp, Artificial Sequence
  dgRNA
  Pepd
gactcctccacttaa

SEQ ID NO: 43384 - DNA, 15 bp, Artificial Sequence
  dgRNA
  Pepd
taagggtgtgaagtc

SEQ ID NO: 43385 - DNA, 15 bp, Artificial Sequence
  dgRNA
  Cdh24
accttgccgtgctgc

SEQ ID NO: 43386 - DNA, 15 bp, Artificial Sequence
  dgRNA
  Cdh24
tgccgtgctgcgggc

SEQ ID NO: 43387 - DNA, 15 bp, Artificial Sequence
  dgRNA
  Cdh24
cgggctggcccggga

SEQ ID NO: 43388 - DNA, 15 bp, Artificial Sequence
  dgRNA
  Cdh24
atgcgcccagcagcc

SEQ ID NO: 43389 - DNA, 15 bp, Artificial Sequence
  dgRNA
  Dtnbp1
aagcagtcataacct

SEQ ID NO: 43390 - DNA, 15 bp, Artificial Sequence
  dgRNA
  Dtnbp1
cgagcgcgctcgcga

SEQ ID NO: 43391 - DNA, 15 bp, Artificial Sequence
  dgRNA
  Dtnbp1
ctgagcgccgcactg

SEQ ID NO: 43392 - DNA, 15 bp, Artificial Sequence
  dgRNA
  Dtnbp1
gccgggcgcgcggag

SEQ ID NO: 43393 - DNA, 15 bp, Artificial Sequence
  dgRNA
  Abca15
acggctcaccgcact

SEQ ID NO: 43394 - DNA, 15 bp, Artificial Sequence
  dgRNA
  Abca15
gcacgagatccgatc

SEQ ID NO: 43395 - DNA, 15 bp, Artificial Sequence
  dgRNA
  Abca15
cacgagatccgatcc

SEQ ID NO: 43396 - DNA, 15 bp, Artificial Sequence
  dgRNA
  Abca15
acgagatccgatccg

SEQ ID NO: 43397 - DNA, 15 bp, Artificial Sequence
  dgRNA
  Mterf4
agtgttgcttgttcc

SEQ ID NO: 43398 - DNA, 15 bp, Artificial Sequence
  dgRNA
  Mterf4
agtatgcccaactaa

SEQ ID NO: 43399 - DNA, 15 bp, Artificial Sequence
  dgRNA
  Mterf4
gtatgcccaactaaa

SEQ ID NO: 43400 - DNA, 15 bp, Artificial Sequence
  dgRNA
  Mterf4
ctgggcacgagcatc

SEQ ID NO: 43401 - DNA, 15 bp, Artificial Sequence
  dgRNA
  Angptl1
caattttaagcgtcc

SEQ ID NO: 43402 - DNA, 15 bp, Artificial Sequence
  dgRNA
  Angptl1
ttttaagcgtcccgg

SEQ ID NO: 43403 - DNA, 15 bp, Artificial Sequence
  dgRNA
  Angptl1
tagctgcaggctgta

SEQ ID NO: 43404 - DNA, 15 bp, Artificial Sequence
  dgRNA
  Pspc1
agtctgcactatctt

SEQ ID NO: 43405 - DNA, 15 bp, Artificial Sequence
  dgRNA
  Pspc1
ggttgcgatgtccct

SEQ ID NO: 43406 - DNA, 15 bp, Artificial Sequence
  dgRNA
  Pspc1
cgatgtccctaggag

SEQ ID NO: 43407 - DNA, 15 bp, Artificial Sequence
  dgRNA
  Pspc1
taggagtggactcta

SEQ ID NO: 43408 - DNA, 15 bp, Artificial Sequence
  dgRNA
  Ifna4
tgagtcttctcctac

SEQ ID NO: 43409 - DNA, 15 bp, Artificial Sequence
  dgRNA
  Ifna4
gggtcttgtagatgc

SEQ ID NO: 43410 - DNA, 15 bp, Artificial Sequence
  dgRNA
  Ddx19a
agaaataagcgactc

SEQ ID NO: 43411 - DNA, 15 bp, Artificial Sequence
  dgRNA
  Ddx19a
tggaagacggacgcg

SEQ ID NO: 43412 - DNA, 15 bp, Artificial Sequence
  dgRNA
  Ddx19a
ggaagacggacgcgc

SEQ ID NO: 43413 - DNA, 15 bp, Artificial Sequence
  dgRNA
  Ddx19a
gaagacggacgcgcg

SEQ ID NO: 43414 - DNA, 15 bp, Artificial Sequence
  dgRNA
  Lhfpl3
gagtaagggggcgtg

SEQ ID NO: 43415 - DNA, 15 bp, Artificial Sequence
  dgRNA
  Lhfpl3
ggcgtgagggctcgc

SEQ ID NO: 43416 - DNA, 15 bp, Artificial Sequence
  dgRNA
  Lhfpl3
tgcagcaacgagcag

SEQ ID NO: 43417 - DNA, 15 bp, Artificial Sequence
  dgRNA
  Lhfpl3
gctggagccgggtcc

SEQ ID NO: 43418 - DNA, 15 bp, Artificial Sequence
  dgRNA
  Rps15
gtgagtattcgtgca

SEQ ID NO: 43419 - DNA, 15 bp, Artificial Sequence
  dgRNA
  Rps15
agtattcgtgcacgg

SEQ ID NO: 43420 - DNA, 15 bp, Artificial Sequence
  dgRNA
  Rps15
ggcggtctgtgctcc

SEQ ID NO: 43421 - DNA, 15 bp, Artificial Sequence
  dgRNA
  Rps15
gcggtctgtgctccc

SEQ ID NO: 43422 - DNA, 15 bp, Artificial Sequence
  dgRNA
  Dux
aggagtccttacctt

SEQ ID NO: 43423 - DNA, 15 bp, Artificial Sequence
  dgRNA
  Lysmd1
cttcgctgctccttt

SEQ ID NO: 43424 - DNA, 15 bp, Artificial Sequence
  dgRNA
  Lysmd1
gaatctgtacttccg

SEQ ID NO: 43425 - DNA, 15 bp, Artificial Sequence
  dgRNA
  Lysmd1
ttgcgtcgcgcgaac

SEQ ID NO: 43426 - DNA, 15 bp, Artificial Sequence
  dgRNA
  Lysmd1
gcgaagtaggcgtag

SEQ ID NO: 43427 - DNA, 15 bp, Artificial Sequence
  dgRNA
  Bik
cagtagcaggtctac

SEQ ID NO: 43428 - DNA, 15 bp, Artificial Sequence
  dgRNA
  Bik
gtctacaggcgacag

SEQ ID NO: 43429 - DNA, 15 bp, Artificial Sequence
  dgRNA
  Bik
taacgactttaaaac

SEQ ID NO: 43430 - DNA, 15 bp, Artificial Sequence
  dgRNA
  Bik
aacgactttaaaaca

SEQ ID NO: 43431 - DNA, 15 bp, Artificial Sequence
  dgRNA
  Kdm4b
tcccgccccaggtcg

SEQ ID NO: 43432 - DNA, 15 bp, Artificial Sequence
  dgRNA
  Kdm4b
cgccccaggtcgcgg

SEQ ID NO: 43433 - DNA, 15 bp, Artificial Sequence
  dgRNA
  Kdm4b
gccccaggtcgcgga

SEQ ID NO: 43434 - DNA, 15 bp, Artificial Sequence
  dgRNA
  Kdm4b
ccaggtcgcggaggg

SEQ ID NO: 43435 - DNA, 15 bp, Artificial Sequence
  dgRNA
  Sf3b1
cacgttacccaccac

SEQ ID NO: 43436 - DNA, 15 bp, Artificial Sequence
  dgRNA
  Sf3b1
ttacccaccactggc

SEQ ID NO: 43437 - DNA, 15 bp, Artificial Sequence
  dgRNA
  Sf3b1
caccactggccggac

SEQ ID NO: 43438 - DNA, 15 bp, Artificial Sequence
  dgRNA
  Sf3b1
aggctacagccctct

SEQ ID NO: 43439 - DNA, 15 bp, Artificial Sequence
  dgRNA
  Uhrf1
gctatgaggtttaca

SEQ ID NO: 43440 - DNA, 15 bp, Artificial Sequence
  dgRNA
  Uhrf1
atgaggtttacatgg

SEQ ID NO: 43441 - DNA, 15 bp, Artificial Sequence
  dgRNA
  Uhrf1
taaagtgagcatagc

SEQ ID NO: 43442 - DNA, 15 bp, Artificial Sequence
  dgRNA
  Uhrf1
gtgagcatagccggc

SEQ ID NO: 43443 - DNA, 15 bp, Artificial Sequence
  dgRNA
  Usp37
gagggcactttcatt

SEQ ID NO: 43444 - DNA, 15 bp, Artificial Sequence
  dgRNA
  Usp37
ttcgaaatccttaaa

SEQ ID NO: 43445 - DNA, 15 bp, Artificial Sequence
  dgRNA
  Usp37
attcgaaatccttaa

SEQ ID NO: 43446 - DNA, 15 bp, Artificial Sequence
  dgRNA
  Oxct2b
acccacgaccatccc

SEQ ID NO: 43447 - DNA, 15 bp, Artificial Sequence
  dgRNA
  Oxct2b
ctgccaaagtgcacc

SEQ ID NO: 43448 - DNA, 15 bp, Artificial Sequence
  dgRNA
  Oxct2b
agccgaggacaccct

SEQ ID NO: 43449 - DNA, 15 bp, Artificial Sequence
  dgRNA
  Oxct2b
tgccagggatggtcg

SEQ ID NO: 43450 - DNA, 15 bp, Artificial Sequence
  dgRNA
  Shisa2
ctggcttccaaggcg

SEQ ID NO: 43451 - DNA, 15 bp, Artificial Sequence
  dgRNA
  Shisa2
acccgcaccgctgcc

SEQ ID NO: 43452 - DNA, 15 bp, Artificial Sequence
  dgRNA
  Shisa2
ccactgccacacctt

SEQ ID NO: 43453 - DNA, 15 bp, Artificial Sequence
  dgRNA
  Shisa2
ccacacctttggtga

SEQ ID NO: 43454 - DNA, 15 bp, Artificial Sequence
  dgRNA
  Pcdhga4
aacaacttagtgctc

SEQ ID NO: 43455 - DNA, 15 bp, Artificial Sequence
  dgRNA
  Pcdhga4
acaacttagtgctct

SEQ ID NO: 43456 - DNA, 15 bp, Artificial Sequence
  dgRNA
  Pcdhga4
cgctgttcaccactc

SEQ ID NO: 43457 - DNA, 15 bp, Artificial Sequence
  dgRNA
  Pcdhga4
aacccacttctctaa

SEQ ID NO: 43458 - DNA, 15 bp, Artificial Sequence
  dgRNA
  Rasgrf2
caatatacgatgtaa

SEQ ID NO: 43459 - DNA, 15 bp, Artificial Sequence
  dgRNA
  Hyls1
acagtacgctagaaa

SEQ ID NO: 43460 - DNA, 15 bp, Artificial Sequence
  dgRNA
  Hyls1
gtacgctagaaaagg

SEQ ID NO: 43461 - DNA, 15 bp, Artificial Sequence
  dgRNA
  Hyls1
tacgctagaaaagga

SEQ ID NO: 43462 - DNA, 15 bp, Artificial Sequence
  dgRNA
  Hyls1
aataatagtgcgttc

SEQ ID NO: 43463 - DNA, 15 bp, Artificial Sequence
  dgRNA
  Pycrl
actctagctagcttc

SEQ ID NO: 43464 - DNA, 15 bp, Artificial Sequence
  dgRNA
  Pycrl
tggtttaccaaagct

SEQ ID NO: 43465 - DNA, 15 bp, Artificial Sequence
  dgRNA
  Pycrl
ggtttaccaaagctt

SEQ ID NO: 43466 - DNA, 15 bp, Artificial Sequence
  dgRNA
  Pycrl
gtttaccaaagcttg

SEQ ID NO: 43467 - DNA, 15 bp, Artificial Sequence
  dgRNA
  Prosc
gttactttaatgtct

SEQ ID NO: 43468 - DNA, 15 bp, Artificial Sequence
  dgRNA
  Prosc
ccgccttccccaaga

SEQ ID NO: 43469 - DNA, 15 bp, Artificial Sequence
  dgRNA
  Prosc
aagatggcgcccgcc

SEQ ID NO: 43470 - DNA, 15 bp, Artificial Sequence
  dgRNA
  Prosc
agatggcgcccgcct

SEQ ID NO: 43471 - DNA, 15 bp, Artificial Sequence
  dgRNA
  Chrdl2
agagccggtaaagaa

SEQ ID NO: 43472 - DNA, 15 bp, Artificial Sequence
  dgRNA
  Chrdl2
ctgttgcacctgttc

SEQ ID NO: 43473 - DNA, 15 bp, Artificial Sequence
  dgRNA
  Chrdl2
tgttgcacctgttca

SEQ ID NO: 43474 - DNA, 15 bp, Artificial Sequence
  dgRNA
  Chrdl2
ttagtttagcacatc

SEQ ID NO: 43475 - DNA, 15 bp, Artificial Sequence
  dgRNA
  Amn
acgacaccctcttat

SEQ ID NO: 43476 - DNA, 15 bp, Artificial Sequence
  dgRNA
  Amn
cgacaccctcttatt

SEQ ID NO: 43477 - DNA, 15 bp, Artificial Sequence
  dgRNA
  Amn
tcttattgggtaccc

SEQ ID NO: 43478 - DNA, 15 bp, Artificial Sequence
  dgRNA
  Amn
cttattgggtaccca

SEQ ID NO: 43479 - DNA, 15 bp, Artificial Sequence
  dgRNA
  Ddx47
tcgtctcagttcctt

SEQ ID NO: 43480 - DNA, 15 bp, Artificial Sequence
  dgRNA
  Ddx47
gccagacccgccagc

SEQ ID NO: 43481 - DNA, 15 bp, Artificial Sequence
  dgRNA
  Ddx47
agacccgccagcagg

SEQ ID NO: 43482 - DNA, 15 bp, Artificial Sequence
  dgRNA
  Ddx47
agcgccccacacagg

SEQ ID NO: 43483 - DNA, 15 bp, Artificial Sequence
  dgRNA
  1700008P02Rik
ttgacagctaaatcc

SEQ ID NO: 43484 - DNA, 15 bp, Artificial Sequence
  dgRNA
  1700008P02Rik
gggcattcagacata

SEQ ID NO: 43485 - DNA, 15 bp, Artificial Sequence
  dgRNA
  1700008P02Rik
ttcagacatagggtg

SEQ ID NO: 43486 - DNA, 15 bp, Artificial Sequence
  dgRNA
  1700008P02Rik
gaggagtgacccgag

SEQ ID NO: 43487 - DNA, 15 bp, Artificial Sequence
  dgRNA
  Ttll1
aagcagtagcgccag

SEQ ID NO: 43488 - DNA, 15 bp, Artificial Sequence
  dgRNA
  Ttll1
cggttttcgcgttct

SEQ ID NO: 43489 - DNA, 15 bp, Artificial Sequence
  dgRNA
  Ttll1
gcgttctcggttgct

SEQ ID NO: 43490 - DNA, 15 bp, Artificial Sequence
  dgRNA
  Ttll1
acacctctccggaag

SEQ ID NO: 43491 - DNA, 15 bp, Artificial Sequence
  dgRNA
  Ubxn10
gagttccaatggcag

SEQ ID NO: 43492 - DNA, 15 bp, Artificial Sequence
  dgRNA
  Ubxn10
caatggcaggggtcc

SEQ ID NO: 43493 - DNA, 15 bp, Artificial Sequence
  dgRNA
  Ubxn10
gtccaattcagcttg

SEQ ID NO: 43494 - DNA, 15 bp, Artificial Sequence
  dgRNA
  Ubxn10
ttcagcttgcggtcc

SEQ ID NO: 43495 - DNA, 15 bp, Artificial Sequence
  dgRNA
  Gad1
ttctggattactcat

SEQ ID NO: 43496 - DNA, 15 bp, Artificial Sequence
  dgRNA
  Gad1
cgcaaacccgtgagc

SEQ ID NO: 43497 - DNA, 15 bp, Artificial Sequence
  dgRNA
  Gad1
ggcgatgttgggtga

SEQ ID NO: 43498 - DNA, 15 bp, Artificial Sequence
  dgRNA
  Gad1
aggcgatgttgggtg

SEQ ID NO: 43499 - DNA, 15 bp, Artificial Sequence
  dgRNA
  Kctd6
gggcggagctccgcg

SEQ ID NO: 43500 - DNA, 15 bp, Artificial Sequence
  dgRNA
  Kctd6
ggcggagctccgcgc

SEQ ID NO: 43501 - DNA, 15 bp, Artificial Sequence
  dgRNA
  Kctd6
tccgcgcgggagtcc

SEQ ID NO: 43502 - DNA, 15 bp, Artificial Sequence
  dgRNA
  Kctd6
ccgcgcgggagtcct

SEQ ID NO: 43503 - DNA, 15 bp, Artificial Sequence
  dgRNA
  Akap3
gccagttcttctaac

SEQ ID NO: 43504 - DNA, 15 bp, Artificial Sequence
  dgRNA
  Akap3
tgagcactcaatctt

SEQ ID NO: 43505 - DNA, 15 bp, Artificial Sequence
  dgRNA
  Akap3
ttaggcagcctcaca

SEQ ID NO: 43506 - DNA, 15 bp, Artificial Sequence
  dgRNA
  Akap3
gtgttagagtgaaat

SEQ ID NO: 43507 - DNA, 15 bp, Artificial Sequence
  dgRNA
  Antxrl
gaaggtattgagcac

SEQ ID NO: 43508 - DNA, 15 bp, Artificial Sequence
  dgRNA
  Antxrl
aaggtattgagcaca

SEQ ID NO: 43509 - DNA, 15 bp, Artificial Sequence
  dgRNA
  Antxrl
aggtattgagcacag

SEQ ID NO: 43510 - DNA, 15 bp, Artificial Sequence
  dgRNA
  Antxrl
tgttttgtcccaagg

SEQ ID NO: 43511 - DNA, 15 bp, Artificial Sequence
  dgRNA
  Eif2b4
ggacccagtgcacgc

SEQ ID NO: 43512 - DNA, 15 bp, Artificial Sequence
  dgRNA
  Eif2b4
gaagttgtagtccgc

SEQ ID NO: 43513 - DNA, 15 bp, Artificial Sequence
  dgRNA
  Eif2b4
aagttgtagtccgct

SEQ ID NO: 43514 - DNA, 15 bp, Artificial Sequence
  dgRNA
  Eif2b4
agttgtagtccgctg

SEQ ID NO: 43515 - DNA, 15 bp, Artificial Sequence
  dgRNA
  Sh3gl1
acgtacacagatttc

SEQ ID NO: 43516 - DNA, 15 bp, Artificial Sequence
  dgRNA
  Sh3gl1
gccccctcatctcgt

SEQ ID NO: 43517 - DNA, 15 bp, Artificial Sequence
  dgRNA
  Sh3gl1
ctcatctcgttggtg

SEQ ID NO: 43518 - DNA, 15 bp, Artificial Sequence
  dgRNA
  Sh3gl1
tcatctcgttggtgt

SEQ ID NO: 43519 - DNA, 15 bp, Artificial Sequence
  dgRNA
  Tcf24
accttgtagaattaa

SEQ ID NO: 43520 - DNA, 15 bp, Artificial Sequence
  dgRNA
  Tcf24
gaattaaaggcggac

SEQ ID NO: 43521 - DNA, 15 bp, Artificial Sequence
  dgRNA
  Tcf24
aattaaaggcggacg

SEQ ID NO: 43522 - DNA, 15 bp, Artificial Sequence
  dgRNA
  Tcf24
gggacgcacacgcga

SEQ ID NO: 43523 - DNA, 15 bp, Artificial Sequence
  dgRNA
  Olfr893
aacaaatcctaattg

SEQ ID NO: 43524 - DNA, 15 bp, Artificial Sequence
  dgRNA
  Olfr893
caattgttgcaacac

SEQ ID NO: 43525 - DNA, 15 bp, Artificial Sequence
  dgRNA
  Magea4
actgtccattgttac

SEQ ID NO: 43526 - DNA, 15 bp, Artificial Sequence
  dgRNA
  Magea4
atatacacacctggt

SEQ ID NO: 43527 - DNA, 15 bp, Artificial Sequence
  dgRNA
  Magea4
gatatacacacctgg

SEQ ID NO: 43528 - DNA, 15 bp, Artificial Sequence
  dgRNA
  Ift122
gcgtccctacgcgcc

SEQ ID NO: 43529 - DNA, 15 bp, Artificial Sequence
  dgRNA
  Ift122
acgcgcccggcgctt

SEQ ID NO: 43530 - DNA, 15 bp, Artificial Sequence
  dgRNA
  Ift122
cgcccggcgcttcgg

SEQ ID NO: 43531 - DNA, 15 bp, Artificial Sequence
  dgRNA
  Ift122
ccggcgcttcggcgg

SEQ ID NO: 43532 - DNA, 15 bp, Artificial Sequence
  dgRNA
  Olfr1323
gagtttttaacaagt

SEQ ID NO: 43533 - DNA, 15 bp, Artificial Sequence
  dgRNA
  Zfp804b
gcgctcgccctctct

SEQ ID NO: 43534 - DNA, 15 bp, Artificial Sequence
  dgRNA
  Zfp804b
tctcggacactgcag

SEQ ID NO: 43535 - DNA, 15 bp, Artificial Sequence
  dgRNA
  Zfp804b
ctcggacactgcaga

SEQ ID NO: 43536 - DNA, 15 bp, Artificial Sequence
  dgRNA
  Zfp804b
tcggacactgcagag

SEQ ID NO: 43537 - DNA, 15 bp, Artificial Sequence
  dgRNA
  Tmed7
tttccgtcgacttcc

SEQ ID NO: 43538 - DNA, 15 bp, Artificial Sequence
  dgRNA
  Tmed7
tcgacttcccggcac

SEQ ID NO: 43539 - DNA, 15 bp, Artificial Sequence
  dgRNA
  Tmed7
gccgcccacgcaccg

SEQ ID NO: 43540 - DNA, 15 bp, Artificial Sequence
  dgRNA
  Tmed7
gcccacgcaccgcgg

SEQ ID NO: 43541 - DNA, 15 bp, Artificial Sequence
  dgRNA
  Celf5
aatcttggctgacat

SEQ ID NO: 43542 - DNA, 15 bp, Artificial Sequence
  dgRNA
  Celf5
acatttccggacctt

SEQ ID NO: 43543 - DNA, 15 bp, Artificial Sequence
  dgRNA
  Celf5
tcagtgactcacgtg

SEQ ID NO: 43544 - DNA, 15 bp, Artificial Sequence
  dgRNA
  Celf5
ccttgtggcaaaatc

SEQ ID NO: 43545 - DNA, 15 bp, Artificial Sequence
  dgRNA
  Fam189a2
gagccgctagctgca

SEQ ID NO: 43546 - DNA, 15 bp, Artificial Sequence
  dgRNA
  Fam189a2
ggttcccgccgtccc

SEQ ID NO: 43547 - DNA, 15 bp, Artificial Sequence
  dgRNA
  Fam189a2
ttcccggtgacccca

SEQ ID NO: 43548 - DNA, 15 bp, Artificial Sequence
  dgRNA
  Fam189a2
gcgcacttgtcaccg

SEQ ID NO: 43549 - DNA, 15 bp, Artificial Sequence
  dgRNA
  Myl4
accagcgaccgttac

SEQ ID NO: 43550 - DNA, 15 bp, Artificial Sequence
  dgRNA
  Myl4
ccagcgaccgttacc

SEQ ID NO: 43551 - DNA, 15 bp, Artificial Sequence
  dgRNA
  Myl4
cagcgaccgttaccg

SEQ ID NO: 43552 - DNA, 15 bp, Artificial Sequence
  dgRNA
  Myl4
agcgaccgttaccgg

SEQ ID NO: 43553 - DNA, 15 bp, Artificial Sequence
  dgRNA
  Invs
catctcgaagcacgt

SEQ ID NO: 43554 - DNA, 15 bp, Artificial Sequence
  dgRNA
  Invs
atctcgaagcacgtc

SEQ ID NO: 43555 - DNA, 15 bp, Artificial Sequence
  dgRNA
  Invs
cattgaccatgtcat

SEQ ID NO: 43556 - DNA, 15 bp, Artificial Sequence
  dgRNA
  Invs
atgtcatcggagagc

SEQ ID NO: 43557 - DNA, 15 bp, Artificial Sequence
  dgRNA
  Spaca1
caagcaactgacatc

SEQ ID NO: 43558 - DNA, 15 bp, Artificial Sequence
  dgRNA
  Spaca1
actgacatcaggtac

SEQ ID NO: 43559 - DNA, 15 bp, Artificial Sequence
  dgRNA
  Spaca1
gacatcaggtacagg

SEQ ID NO: 43560 - DNA, 15 bp, Artificial Sequence
  dgRNA
  Spaca1
ccaacatgctagttc

SEQ ID NO: 43561 - DNA, 15 bp, Artificial Sequence
  dgRNA
  Fbxl2
aagtgggcgggccga

SEQ ID NO: 43562 - DNA, 15 bp, Artificial Sequence
  dgRNA
  Fbxl2
agtgggcgggccgaa

SEQ ID NO: 43563 - DNA, 15 bp, Artificial Sequence
  dgRNA
  Fbxl2
cgaagggcgtgccta

SEQ ID NO: 43564 - DNA, 15 bp, Artificial Sequence
  dgRNA
  Fbxl2
tgcctacggatcacg

SEQ ID NO: 43565 - DNA, 15 bp, Artificial Sequence
  dgRNA
  Gm13277
tgacgattgcagggc

SEQ ID NO: 43566 - DNA, 15 bp, Artificial Sequence
  dgRNA
  Gm13277
agcctgacgattgca

SEQ ID NO: 43567 - DNA, 15 bp, Artificial Sequence
  dgRNA
  Cntnap5b
ctgctacggtttcag

SEQ ID NO: 43568 - DNA, 15 bp, Artificial Sequence
  dgRNA
  Cntnap5b
ctacggtttcagtgg

SEQ ID NO: 43569 - DNA, 15 bp, Artificial Sequence
  dgRNA
  Cntnap5b
agtgtctgtttaagg

SEQ ID NO: 43570 - DNA, 15 bp, Artificial Sequence
  dgRNA
  Cntnap5b
ggcgaggctgtgcga

SEQ ID NO: 43571 - DNA, 15 bp, Artificial Sequence
  dgRNA
  Slc38a3
ggctctcccacctat

SEQ ID NO: 43572 - DNA, 15 bp, Artificial Sequence
  dgRNA
  Slc38a3
cacctataggcttcg

SEQ ID NO: 43573 - DNA, 15 bp, Artificial Sequence
  dgRNA
  Slc38a3
gcttcgaggtcacca

SEQ ID NO: 43574 - DNA, 15 bp, Artificial Sequence
  dgRNA
  Slc38a3
cttcgaggtcaccaa

SEQ ID NO: 43575 - DNA, 15 bp, Artificial Sequence
  dgRNA
  Pde8b
tatgcgactcaaagt

SEQ ID NO: 43576 - DNA, 15 bp, Artificial Sequence
  dgRNA
  Pde8b
atgcgactcaaagtc

SEQ ID NO: 43577 - DNA, 15 bp, Artificial Sequence
  dgRNA
  Pde8b
tgcgactcaaagtcg

SEQ ID NO: 43578 - DNA, 15 bp, Artificial Sequence
  dgRNA
  Pde8b
ggggatcaacatcct

SEQ ID NO: 43579 - DNA, 15 bp, Artificial Sequence
  dgRNA
  Cadm1
gccgggttgggctcg

SEQ ID NO: 43580 - DNA, 15 bp, Artificial Sequence
  dgRNA
  Cadm1
tcgaggtgccacgat

SEQ ID NO: 43581 - DNA, 15 bp, Artificial Sequence
  dgRNA
  Cadm1
cattagctgtccgct

SEQ ID NO: 43582 - DNA, 15 bp, Artificial Sequence
  dgRNA
  Cadm1
attagctgtccgctc

SEQ ID NO: 43583 - DNA, 15 bp, Artificial Sequence
  dgRNA
  H2-T22
aggaagtcatgacgt

SEQ ID NO: 43584 - DNA, 15 bp, Artificial Sequence
  dgRNA
  H2-T22
catgacgtgggagaa

SEQ ID NO: 43585 - DNA, 15 bp, Artificial Sequence
  dgRNA
  H2-T22
gagcagggcggtaaa

SEQ ID NO: 43586 - DNA, 15 bp, Artificial Sequence
  dgRNA
  H2-T22
ggtcgcagagagagc

SEQ ID NO: 43587 - DNA, 15 bp, Artificial Sequence
  dgRNA
  Zfp46
actccaagtcccgtc

SEQ ID NO: 43588 - DNA, 15 bp, Artificial Sequence
  dgRNA
  Zfp46
tcccgtcaggccgcg

SEQ ID NO: 43589 - DNA, 15 bp, Artificial Sequence
  dgRNA
  Zfp46
tgcgcgcacgcgtga

SEQ ID NO: 43590 - DNA, 15 bp, Artificial Sequence
  dgRNA
  Zfp46
acccggccacgccgc

SEQ ID NO: 43591 - DNA, 15 bp, Artificial Sequence
  dgRNA
  Eefsec
tccctaatctcagac

SEQ ID NO: 43592 - DNA, 15 bp, Artificial Sequence
  dgRNA
  Eefsec
actggcgagactttg

SEQ ID NO: 43593 - DNA, 15 bp, Artificial Sequence
  dgRNA
  Eefsec
cgagactttgtggcg

SEQ ID NO: 43594 - DNA, 15 bp, Artificial Sequence
  dgRNA
  Eefsec
gagactttgtggcgt

SEQ ID NO: 43595 - DNA, 15 bp, Artificial Sequence
  dgRNA
  Olfr544
taactagtctctgtc

SEQ ID NO: 43596 - DNA, 15 bp, Artificial Sequence
  dgRNA
  Olfr544
ctaatccccacctac

SEQ ID NO: 43597 - DNA, 15 bp, Artificial Sequence
  dgRNA
  Olfr544
gatcctggtgaccac

SEQ ID NO: 43598 - DNA, 15 bp, Artificial Sequence
  dgRNA
  Olfr544
ttgttcccctcaggg

SEQ ID NO: 43599 - DNA, 15 bp, Artificial Sequence
  dgRNA
  Olfr545
ggggcaggtcctaac

SEQ ID NO: 43600 - DNA, 15 bp, Artificial Sequence
  dgRNA
  Olfr545
gggcaggtcctaaca

SEQ ID NO: 43601 - DNA, 15 bp, Artificial Sequence
  dgRNA
  Olfr545
ctccaatatttctag

SEQ ID NO: 43602 - DNA, 15 bp, Artificial Sequence
  dgRNA
  Olfr545
acgcctgagggctca

SEQ ID NO: 43603 - DNA, 15 bp, Artificial Sequence
  dgRNA
  Zfp319
tccgtcgccccagtg

SEQ ID NO: 43604 - DNA, 15 bp, Artificial Sequence
  dgRNA
  Zfp319
gttccacaggtctgc

SEQ ID NO: 43605 - DNA, 15 bp, Artificial Sequence
  dgRNA
  Zfp319
agacttgcaaaaagt

SEQ ID NO: 43606 - DNA, 15 bp, Artificial Sequence
  dgRNA
  Zfp319
gaagaccggagagtc

SEQ ID NO: 43607 - DNA, 15 bp, Artificial Sequence
  dgRNA
  Nanp
ccaccaagccattaa

SEQ ID NO: 43608 - DNA, 15 bp, Artificial Sequence
  dgRNA
  Nanp
aagccattaacggag

SEQ ID NO: 43609 - DNA, 15 bp, Artificial Sequence
  dgRNA
  Nanp
cgcgcgatcttgcca

SEQ ID NO: 43610 - DNA, 15 bp, Artificial Sequence
  dgRNA
  Nanp
cccggagctttggaa

SEQ ID NO: 43611 - DNA, 15 bp, Artificial Sequence
  dgRNA
  Ppp2r1a
tccgcctctccccaa

SEQ ID NO: 43612 - DNA, 15 bp, Artificial Sequence
  dgRNA
  Ppp2r1a
ccgcctctccccaag

SEQ ID NO: 43613 - DNA, 15 bp, Artificial Sequence
  dgRNA
  Ppp2r1a
accctcgactctcat

SEQ ID NO: 43614 - DNA, 15 bp, Artificial Sequence
  dgRNA
  Ppp2r1a
acctgcttgttcccg

SEQ ID NO: 43615 - DNA, 15 bp, Artificial Sequence
  dgRNA
  Gstm5
tgactcacgcttccc

SEQ ID NO: 43616 - DNA, 15 bp, Artificial Sequence
  dgRNA
  Gstm5
cttcccgggtaacta

SEQ ID NO: 43617 - DNA, 15 bp, Artificial Sequence
  dgRNA
  Gstm5
gggtaactaaggtcc

SEQ ID NO: 43618 - DNA, 15 bp, Artificial Sequence
  dgRNA
  Gstm5
aagcatcaacagccc

SEQ ID NO: 43619 - DNA, 15 bp, Artificial Sequence
  dgRNA
  Nme7
gcgtgagttccctct

SEQ ID NO: 43620 - DNA, 15 bp, Artificial Sequence
  dgRNA
  Nme7
gagttccctcttggt

SEQ ID NO: 43621 - DNA, 15 bp, Artificial Sequence
  dgRNA
  Nme7
actgatcagagtgct

SEQ ID NO: 43622 - DNA, 15 bp, Artificial Sequence
  dgRNA
  Nme7
tggtttccccgctaa

SEQ ID NO: 43623 - DNA, 15 bp, Artificial Sequence
  dgRNA
  Il15
agctacaaattaggt

SEQ ID NO: 43624 - DNA, 15 bp, Artificial Sequence
  dgRNA
  Il15
ttactgttcccaaac

SEQ ID NO: 43625 - DNA, 15 bp, Artificial Sequence
  dgRNA
  Il15
ggtcaagggttgttt

SEQ ID NO: 43626 - DNA, 15 bp, Artificial Sequence
  dgRNA
  Il15
aaattgacccctctt

SEQ ID NO: 43627 - DNA, 15 bp, Artificial Sequence
  dgRNA
  1700019B03Rik
ctgggagtactcttg

SEQ ID NO: 43628 - DNA, 15 bp, Artificial Sequence
  dgRNA
  1700019B03Rik
gaggtcacaatgacc

SEQ ID NO: 43629 - DNA, 15 bp, Artificial Sequence
  dgRNA
  1700019B03Rik
gggccagaccatctt

SEQ ID NO: 43630 - DNA, 15 bp, Artificial Sequence
  dgRNA
  1700019B03Rik
gtgtgactacctctg

SEQ ID NO: 43631 - DNA, 15 bp, Artificial Sequence
  dgRNA
  Brd8
gacgtttcttttctg

SEQ ID NO: 43632 - DNA, 15 bp, Artificial Sequence
  dgRNA
  Brd8
aacttcgcttctatt

SEQ ID NO: 43633 - DNA, 15 bp, Artificial Sequence
  dgRNA
  Brd8
acttcgcttctatta

SEQ ID NO: 43634 - DNA, 15 bp, Artificial Sequence
  dgRNA
  Brd8
cccacattacccacg

SEQ ID NO: 43635 - DNA, 15 bp, Artificial Sequence
  dgRNA
  Ros1
tgtggcctggctcgc

SEQ ID NO: 43636 - DNA, 15 bp, Artificial Sequence
  dgRNA
  Ros1
ttgactgagctatgc

SEQ ID NO: 43637 - DNA, 15 bp, Artificial Sequence
  dgRNA
  Ros1
caccgcacttctttg

SEQ ID NO: 43638 - DNA, 15 bp, Artificial Sequence
  dgRNA
  Oprl1
ttctggctgccgcac

SEQ ID NO: 43639 - DNA, 15 bp, Artificial Sequence
  dgRNA
  Oprl1
gtgcggcagccagaa

SEQ ID NO: 43640 - DNA, 15 bp, Artificial Sequence
  dgRNA
  Oprl1
agtgcggcagccaga

SEQ ID NO: 43641 - DNA, 15 bp, Artificial Sequence
  dgRNA
  Cldn1
taggagagacacgaa

SEQ ID NO: 43642 - DNA, 15 bp, Artificial Sequence
  dgRNA
  Cldn1
cgaagggaagaggtt

SEQ ID NO: 43643 - DNA, 15 bp, Artificial Sequence
  dgRNA
  Cldn1
cccaggtagcccacg

SEQ ID NO: 43644 - DNA, 15 bp, Artificial Sequence
  dgRNA
  Cldn1
catccaccacggagc

SEQ ID NO: 43645 - DNA, 15 bp, Artificial Sequence
  dgRNA
  Olfr1043
aaaccttctaatcga

SEQ ID NO: 43646 - DNA, 15 bp, Artificial Sequence
  dgRNA
  Olfr1043
agggttttacttgca

SEQ ID NO: 43647 - DNA, 15 bp, Artificial Sequence
  dgRNA
  Olfr1043
ttgcactttgtgcat

SEQ ID NO: 43648 - DNA, 15 bp, Artificial Sequence
  dgRNA
  Olfr1043
gagtgatcttgattc

SEQ ID NO: 43649 - DNA, 15 bp, Artificial Sequence
  dgRNA
  Mapkap1
cgtaggcgctgggtt

SEQ ID NO: 43650 - DNA, 15 bp, Artificial Sequence
  dgRNA
  Mapkap1
cgctgggttcggtgc

SEQ ID NO: 43651 - DNA, 15 bp, Artificial Sequence
  dgRNA
  Mapkap1
gctgggttcggtgca

SEQ ID NO: 43652 - DNA, 15 bp, Artificial Sequence
  dgRNA
  Mapkap1
ctgggttcggtgcag

SEQ ID NO: 43653 - DNA, 15 bp, Artificial Sequence
  dgRNA
  Map9
ttccttgtggcgtga

SEQ ID NO: 43654 - DNA, 15 bp, Artificial Sequence
  dgRNA
  Map9
tggcgtgatggcaga

SEQ ID NO: 43655 - DNA, 15 bp, Artificial Sequence
  dgRNA
  Map9
ccggtcttgtttcct

SEQ ID NO: 43656 - DNA, 15 bp, Artificial Sequence
  dgRNA
  Map9
tgcacacaagctgat

SEQ ID NO: 43657 - DNA, 15 bp, Artificial Sequence
  dgRNA
  Slc29a3
tgcagttactgccgt

SEQ ID NO: 43658 - DNA, 15 bp, Artificial Sequence
  dgRNA
  Slc29a3
ttactgccgtaggcc

SEQ ID NO: 43659 - DNA, 15 bp, Artificial Sequence
  dgRNA
  Slc29a3
ccgtaggccaggaag

SEQ ID NO: 43660 - DNA, 15 bp, Artificial Sequence
  dgRNA
  Slc29a3
aggaagaggcgcgcg

SEQ ID NO: 43661 - DNA, 15 bp, Artificial Sequence
  dgRNA
  Golga2
ccataggccgctgtg

SEQ ID NO: 43662 - DNA, 15 bp, Artificial Sequence
  dgRNA
  Golga2
cataggccgctgtga

SEQ ID NO: 43663 - DNA, 15 bp, Artificial Sequence
  dgRNA
  Golga2
ataggccgctgtgag

SEQ ID NO: 43664 - DNA, 15 bp, Artificial Sequence
  dgRNA
  Golga2
cgctgtgaggggtca

SEQ ID NO: 43665 - DNA, 15 bp, Artificial Sequence
  dgRNA
  Fcrl6
caaactcaccactcc

SEQ ID NO: 43666 - DNA, 15 bp, Artificial Sequence
  dgRNA
  Fcrl6
gataggttttgacgt

SEQ ID NO: 43667 - DNA, 15 bp, Artificial Sequence
  dgRNA
  Fcrl6
gacgtaggttcttcc

SEQ ID NO: 43668 - DNA, 15 bp, Artificial Sequence
  dgRNA
  Fcrl6
acgtaggttcttcca

SEQ ID NO: 43669 - DNA, 15 bp, Artificial Sequence
  dgRNA
  Mettl25
gcgccgcaaaccctc

SEQ ID NO: 43670 - DNA, 15 bp, Artificial Sequence
  dgRNA
  Mettl25
ctccggtccgccact

SEQ ID NO: 43671 - DNA, 15 bp, Artificial Sequence
  dgRNA
  Mettl25
ccgccacttggaaga

SEQ ID NO: 43672 - DNA, 15 bp, Artificial Sequence
  dgRNA
  Mettl25
ggaagacggccgcga

SEQ ID NO: 43673 - DNA, 15 bp, Artificial Sequence
  dgRNA
  Prpf19
gtccccgcagcctca

SEQ ID NO: 43674 - DNA, 15 bp, Artificial Sequence
  dgRNA
  Prpf19
tccccgcagcctcat

SEQ ID NO: 43675 - DNA, 15 bp, Artificial Sequence
  dgRNA
  Prpf19
ccgcctcaggcctct

SEQ ID NO: 43676 - DNA, 15 bp, Artificial Sequence
  dgRNA
  Prpf19
ctgcggggaccgcca

SEQ ID NO: 43677 - DNA, 15 bp, Artificial Sequence
  dgRNA
  Irs1
cgggctggagcctcc

SEQ ID NO: 43678 - DNA, 15 bp, Artificial Sequence
  dgRNA
  Irs1
gctggagcctcccgg

SEQ ID NO: 43679 - DNA, 15 bp, Artificial Sequence
  dgRNA
  Irs1
ggagcctcccggcgg

SEQ ID NO: 43680 - DNA, 15 bp, Artificial Sequence
  dgRNA
  Irs1
ctcccggcggcggcc

SEQ ID NO: 43681 - DNA, 15 bp, Artificial Sequence
  dgRNA
  Gas7
ggtgcccttgttcat

SEQ ID NO: 43682 - DNA, 15 bp, Artificial Sequence
  dgRNA
  Gas7
ttagacaggactccc

SEQ ID NO: 43683 - DNA, 15 bp, Artificial Sequence
  dgRNA
  Gas7
tactgcattttagac

SEQ ID NO: 43684 - DNA, 15 bp, Artificial Sequence
  dgRNA
  Gas7
aaggcctatgaacaa

SEQ ID NO: 43685 - DNA, 15 bp, Artificial Sequence
  dgRNA
  Tubgcp2
agggttcctctccac

SEQ ID NO: 43686 - DNA, 15 bp, Artificial Sequence
  dgRNA
  Tubgcp2
ccacgggcagcggtt

SEQ ID NO: 43687 - DNA, 15 bp, Artificial Sequence
  dgRNA
  Tubgcp2
cggttcggctgcccc

SEQ ID NO: 43688 - DNA, 15 bp, Artificial Sequence
  dgRNA
  Tubgcp2
cccggctccccggcc

SEQ ID NO: 43689 - DNA, 15 bp, Artificial Sequence
  dgRNA
  Lmod2
ggcacaagctaaata

SEQ ID NO: 43690 - DNA, 15 bp, Artificial Sequence
  dgRNA
  Lmod2
agctaaatatggctc

SEQ ID NO: 43691 - DNA, 15 bp, Artificial Sequence
  dgRNA
  Lmod2
atcaccgctcttaaa

SEQ ID NO: 43692 - DNA, 15 bp, Artificial Sequence
  dgRNA
  Lmod2
cttgtgcctgatagc

SEQ ID NO: 43693 - DNA, 15 bp, Artificial Sequence
  dgRNA
  Svep1
ccaagagtctttagc

SEQ ID NO: 43694 - DNA, 15 bp, Artificial Sequence
  dgRNA
  Casp12
ataatagcagagccc

SEQ ID NO: 43695 - DNA, 15 bp, Artificial Sequence
  dgRNA
  Sumo1
gcgctggtctccctg

SEQ ID NO: 43696 - DNA, 15 bp, Artificial Sequence
  dgRNA
  Sumo1
cgctggtctccctga

SEQ ID NO: 43697 - DNA, 15 bp, Artificial Sequence
  dgRNA
  Sumo1
gaggattttagcccc

SEQ ID NO: 43698 - DNA, 15 bp, Artificial Sequence
  dgRNA
  Sumo1
ccccggccttcctta

SEQ ID NO: 43699 - DNA, 15 bp, Artificial Sequence
  dgRNA
  Zfp260
tcagactaaacaatc

SEQ ID NO: 43700 - DNA, 15 bp, Artificial Sequence
  dgRNA
  Zfp260
attgagactgataat

SEQ ID NO: 43701 - DNA, 15 bp, Artificial Sequence
  dgRNA
  Zfp260
agttgtatcagactc

SEQ ID NO: 43702 - DNA, 15 bp, Artificial Sequence
  dgRNA
  Zfp260
tctcaggctgatagt

SEQ ID NO: 43703 - DNA, 15 bp, Artificial Sequence
  dgRNA
  Olfr1036
aggcgatatgtaaaa

SEQ ID NO: 43704 - DNA, 15 bp, Artificial Sequence
  dgRNA
  Tmem218
acgctttgcgttgcc

SEQ ID NO: 43705 - DNA, 15 bp, Artificial Sequence
  dgRNA
  Tmem218
caacgtcagctattg

SEQ ID NO: 43706 - DNA, 15 bp, Artificial Sequence
  dgRNA
  Tmem218
cccttaagtgctgaa

SEQ ID NO: 43707 - DNA, 15 bp, Artificial Sequence
  dgRNA
  Tmem218
aagggcggctttgat

SEQ ID NO: 43708 - DNA, 15 bp, Artificial Sequence
  dgRNA
  Krt24
agtagagtaggttcg

SEQ ID NO: 43709 - DNA, 15 bp, Artificial Sequence
  dgRNA
  Krt24
aaaggaacaccctat

SEQ ID NO: 43710 - DNA, 15 bp, Artificial Sequence
  dgRNA
  Krt24
atcggtgtgtatata

SEQ ID NO: 43711 - DNA, 15 bp, Artificial Sequence
  dgRNA
  Krt24
tcggtgtgtatataa

SEQ ID NO: 43712 - DNA, 15 bp, Artificial Sequence
  dgRNA
  Adprhl2
tgtcggccgcatttg

SEQ ID NO: 43713 - DNA, 15 bp, Artificial Sequence
  dgRNA
  Adprhl2
gcgtgcgagtactta

SEQ ID NO: 43714 - DNA, 15 bp, Artificial Sequence
  dgRNA
  Adprhl2
cgtgcgagtacttat

SEQ ID NO: 43715 - DNA, 15 bp, Artificial Sequence
  dgRNA
  Adprhl2
gtgcgagtacttatg

SEQ ID NO: 43716 - DNA, 15 bp, Artificial Sequence
  dgRNA
  Fam110c
ttgtgggttcgtgcc

SEQ ID NO: 43717 - DNA, 15 bp, Artificial Sequence
  dgRNA
  Fam110c
tgtgggttcgtgccc

SEQ ID NO: 43718 - DNA, 15 bp, Artificial Sequence
  dgRNA
  Fam110c
gcccgggaaaccaaa

SEQ ID NO: 43719 - DNA, 15 bp, Artificial Sequence
  dgRNA
  Fam110c
ggagccagctggcgc

SEQ ID NO: 43720 - DNA, 15 bp, Artificial Sequence
  dgRNA
  Vipas39
cccttccgataactg

SEQ ID NO: 43721 - DNA, 15 bp, Artificial Sequence
  dgRNA
  Vipas39
tccgataactgcgga

SEQ ID NO: 43722 - DNA, 15 bp, Artificial Sequence
  dgRNA
  Vipas39
atgcgctagtatttc

SEQ ID NO: 43723 - DNA, 15 bp, Artificial Sequence
  dgRNA
  Vipas39
tgcgctagtatttct

SEQ ID NO: 43724 - DNA, 15 bp, Artificial Sequence
  dgRNA
  Csrp1
cccagagatcgccat

SEQ ID NO: 43725 - DNA, 15 bp, Artificial Sequence
  dgRNA
  Csrp1
gagaagtcacggctg

SEQ ID NO: 43726 - DNA, 15 bp, Artificial Sequence
  dgRNA
  Csrp1
ggcggcagccacgcc

SEQ ID NO: 43727 - DNA, 15 bp, Artificial Sequence
  dgRNA
  Csrp1
gcggcagccacgccc

SEQ ID NO: 43728 - DNA, 15 bp, Artificial Sequence
  dgRNA
  Phtf2
aatgaccgcgccccc

SEQ ID NO: 43729 - DNA, 15 bp, Artificial Sequence
  dgRNA
  Phtf2
atgaccgcgccccct

SEQ ID NO: 43730 - DNA, 15 bp, Artificial Sequence
  dgRNA
  Phtf2
gccccttagtcctat

SEQ ID NO: 43731 - DNA, 15 bp, Artificial Sequence
  dgRNA
  Phtf2
cttagtcctataggt

SEQ ID NO: 43732 - DNA, 15 bp, Artificial Sequence
  dgRNA
  Sgce
ctttggcccgccgct

SEQ ID NO: 43733 - DNA, 15 bp, Artificial Sequence
  dgRNA
  Sgce
tttggcccgccgcta

SEQ ID NO: 43734 - DNA, 15 bp, Artificial Sequence
  dgRNA
  Sgce
ttggcccgccgctag

SEQ ID NO: 43735 - DNA, 15 bp, Artificial Sequence
  dgRNA
  Sgce
ccgctaggggcagca

SEQ ID NO: 43736 - DNA, 15 bp, Artificial Sequence
  dgRNA
  Ngp
gtgaacgggcaggtc

SEQ ID NO: 43737 - DNA, 15 bp, Artificial Sequence
  dgRNA
  Ngp
cgggcaggtctggag

SEQ ID NO: 43738 - DNA, 15 bp, Artificial Sequence
  dgRNA
  Ngp
ctggagagggtcgac

SEQ ID NO: 43739 - DNA, 15 bp, Artificial Sequence
  dgRNA
  Ngp
tggagagggtcgaca

SEQ ID NO: 43740 - DNA, 15 bp, Artificial Sequence
  dgRNA
  Evi5
atctattagtatgcc

SEQ ID NO: 43741 - DNA, 15 bp, Artificial Sequence
  dgRNA
  Evi5
catactaatagatgt

SEQ ID NO: 43742 - DNA, 15 bp, Artificial Sequence
  dgRNA
  Evi5
gccttttgaatatcc

SEQ ID NO: 43743 - DNA, 15 bp, Artificial Sequence
  dgRNA
  Evi5
atcgatgcagcctcc

SEQ ID NO: 43744 - DNA, 15 bp, Artificial Sequence
  dgRNA
  Plppr3
acgcagggaggcaac

SEQ ID NO: 43745 - DNA, 15 bp, Artificial Sequence
  dgRNA
  Plppr3
gcaactggaggcgcg

SEQ ID NO: 43746 - DNA, 15 bp, Artificial Sequence
  dgRNA
  Plppr3
gcgccgcgcgctcct

SEQ ID NO: 43747 - DNA, 15 bp, Artificial Sequence
  dgRNA
  Plppr3
cgcgctcctaggtcc

SEQ ID NO: 43748 - DNA, 15 bp, Artificial Sequence
  dgRNA
  4933434E20Rik
cggacataagtcacg

SEQ ID NO: 43749 - DNA, 15 bp, Artificial Sequence
  dgRNA
  Papln
aatgctgggtacccg

SEQ ID NO: 43750 - DNA, 15 bp, Artificial Sequence
  dgRNA
  Papln
cccggggcctctcgg

SEQ ID NO: 43751 - DNA, 15 bp, Artificial Sequence
  dgRNA
  Papln
ccggggcctctcggt

SEQ ID NO: 43752 - DNA, 15 bp, Artificial Sequence
  dgRNA
  Papln
cggggcctctcggtg

SEQ ID NO: 43753 - DNA, 15 bp, Artificial Sequence
  dgRNA
  Ccdc33
cacctcatatacagt

SEQ ID NO: 43754 - DNA, 15 bp, Artificial Sequence
  dgRNA
  Ccdc33
gatcaaatgctaaat

SEQ ID NO: 43755 - DNA, 15 bp, Artificial Sequence
  dgRNA
  Ccdc33
aacctactgtatatg

SEQ ID NO: 43756 - DNA, 15 bp, Artificial Sequence
  dgRNA
  Ccdc33
cagattaggcacttg

SEQ ID NO: 43757 - DNA, 15 bp, Artificial Sequence
  dgRNA
  Prex2
taggtttgggaacct

SEQ ID NO: 43758 - DNA, 15 bp, Artificial Sequence
  dgRNA
  Prex2
aggatacacttcccc

SEQ ID NO: 43759 - DNA, 15 bp, Artificial Sequence
  dgRNA
  Prex2
ggatacacttcccca

SEQ ID NO: 43760 - DNA, 15 bp, Artificial Sequence
  dgRNA
  Prex2
tttggctaagggtaa

SEQ ID NO: 43761 - DNA, 15 bp, Artificial Sequence
  dgRNA
  Tmem230
gatgacacgatttcc

SEQ ID NO: 43762 - DNA, 15 bp, Artificial Sequence
  dgRNA
  Tmem230
ccacgtcacttccgc

SEQ ID NO: 43763 - DNA, 15 bp, Artificial Sequence
  dgRNA
  Tmem230
acataaggtttgcct

SEQ ID NO: 43764 - DNA, 15 bp, Artificial Sequence
  dgRNA
  Tmem230
aacataaggtttgcc

SEQ ID NO: 43765 - DNA, 15 bp, Artificial Sequence
  dgRNA
  Fam124a
tgcactcctcgctca

SEQ ID NO: 43766 - DNA, 15 bp, Artificial Sequence
  dgRNA
  Fam124a
tcccgtgcacccgct

SEQ ID NO: 43767 - DNA, 15 bp, Artificial Sequence
  dgRNA
  Fam124a
gctcggatcctcgcc

SEQ ID NO: 43768 - DNA, 15 bp, Artificial Sequence
  dgRNA
  Fam124a
cggatcctcgcctgg

SEQ ID NO: 43769 - DNA, 15 bp, Artificial Sequence
  dgRNA
  Lin7a
ccaggcaggcgctcg

SEQ ID NO: 43770 - DNA, 15 bp, Artificial Sequence
  dgRNA
  Lin7a
actgaagattcgccg

SEQ ID NO: 43771 - DNA, 15 bp, Artificial Sequence
  dgRNA
  Lin7a
gaagattcgccgcgg

SEQ ID NO: 43772 - DNA, 15 bp, Artificial Sequence
  dgRNA
  Lin7a
gcgcctgcctggcca

SEQ ID NO: 43773 - DNA, 15 bp, Artificial Sequence
  dgRNA
  Aven
ctcatcggacacctt

SEQ ID NO: 43774 - DNA, 15 bp, Artificial Sequence
  dgRNA
  Aven
ttacagatcacttcg

SEQ ID NO: 43775 - DNA, 15 bp, Artificial Sequence
  dgRNA
  Aven
tcgtggtccccgccc

SEQ ID NO: 43776 - DNA, 15 bp, Artificial Sequence
  dgRNA
  Aven
gcgccccgatcacca

SEQ ID NO: 43777 - DNA, 15 bp, Artificial Sequence
  dgRNA
  Tyw1
agtgcgcggctcttc

SEQ ID NO: 43778 - DNA, 15 bp, Artificial Sequence
  dgRNA
  Tyw1
cttccggaacctacc

SEQ ID NO: 43779 - DNA, 15 bp, Artificial Sequence
  dgRNA
  Tyw1
ttccggaacctacca

SEQ ID NO: 43780 - DNA, 15 bp, Artificial Sequence
  dgRNA
  Tyw1
tgcacatgcgtcaag

SEQ ID NO: 43781 - DNA, 15 bp, Artificial Sequence
  dgRNA
  Vnn3
ccagtacgtttagta

SEQ ID NO: 43782 - DNA, 15 bp, Artificial Sequence
  dgRNA
  Vnn3
tagtatggactcaac

SEQ ID NO: 43783 - DNA, 15 bp, Artificial Sequence
  dgRNA
  Vnn3
atggactcaactggt

SEQ ID NO: 43784 - DNA, 15 bp, Artificial Sequence
  dgRNA
  Vnn3
ggtcaagttcttaat

SEQ ID NO: 43785 - DNA, 15 bp, Artificial Sequence
  dgRNA
  Samd4
cgagaggaattcacc

SEQ ID NO: 43786 - DNA, 15 bp, Artificial Sequence
  dgRNA
  Samd4
cgggtgaattcctct

SEQ ID NO: 43787 - DNA, 15 bp, Artificial Sequence
  dgRNA
  2610008E11Rik
gattcacgcacgaat

SEQ ID NO: 43788 - DNA, 15 bp, Artificial Sequence
  dgRNA
  2610008E11Rik
gaaatgctatccaat

SEQ ID NO: 43789 - DNA, 15 bp, Artificial Sequence
  dgRNA
  2610008E11Rik
gcgagcatggagggc

SEQ ID NO: 43790 - DNA, 15 bp, Artificial Sequence
  dgRNA
  2610008E11Rik
gattggatagcattt

SEQ ID NO: 43791 - DNA, 15 bp, Artificial Sequence
  dgRNA
  Xrcc4
ttaccatagtgaggc

SEQ ID NO: 43792 - DNA, 15 bp, Artificial Sequence
  dgRNA
  Xrcc4
tcacccttccgggcc

SEQ ID NO: 43793 - DNA, 15 bp, Artificial Sequence
  dgRNA
  Xrcc4
cacccttccgggccg

SEQ ID NO: 43794 - DNA, 15 bp, Artificial Sequence
  dgRNA
  Xrcc4
ccttccgggccgggg

SEQ ID NO: 43795 - DNA, 15 bp, Artificial Sequence
  dgRNA
  Efemp2
tggctgggcgtccgc

SEQ ID NO: 43796 - DNA, 15 bp, Artificial Sequence
  dgRNA
  Efemp2
tccgcaggcgactcc

SEQ ID NO: 43797 - DNA, 15 bp, Artificial Sequence
  dgRNA
  Efemp2
ctccaggcagcgccg

SEQ ID NO: 43798 - DNA, 15 bp, Artificial Sequence
  dgRNA
  Efemp2
tccaggcagcgccgc

SEQ ID NO: 43799 - DNA, 15 bp, Artificial Sequence
  dgRNA
  Prnp
ttgctgagcgtcgtc

SEQ ID NO: 43800 - DNA, 15 bp, Artificial Sequence
  dgRNA
  Prnp
tgctgagcgtcgtca

SEQ ID NO: 43801 - DNA, 15 bp, Artificial Sequence
  dgRNA
  Prnp
gcatttaagccagtc

SEQ ID NO: 43802 - DNA, 15 bp, Artificial Sequence
  dgRNA
  Prnp
taagccagtccggag

SEQ ID NO: 43803 - DNA, 15 bp, Artificial Sequence
  dgRNA
  Zfp821
gtgcgcggaaacgtc

SEQ ID NO: 43804 - DNA, 15 bp, Artificial Sequence
  dgRNA
  Zfp821
cagctccgcgtcgcc

SEQ ID NO: 43805 - DNA, 15 bp, Artificial Sequence
  dgRNA
  Zfp821
gccaggaccagatcg

SEQ ID NO: 43806 - DNA, 15 bp, Artificial Sequence
  dgRNA
  Zfp821
ccaggaccagatcgc

SEQ ID NO: 43807 - DNA, 15 bp, Artificial Sequence
  dgRNA
  Foxc2
caagttaacttgagc

SEQ ID NO: 43808 - DNA, 15 bp, Artificial Sequence
  dgRNA
  Foxc2
aagttaacttgagct

SEQ ID NO: 43809 - DNA, 15 bp, Artificial Sequence
  dgRNA
  Foxc2
agttaacttgagctg

SEQ ID NO: 43810 - DNA, 15 bp, Artificial Sequence
  dgRNA
  Foxc2
gttaacttgagctgg

SEQ ID NO: 43811 - DNA, 15 bp, Artificial Sequence
  dgRNA
  Zbtb20
tgtggtttgtaaggt

SEQ ID NO: 43812 - DNA, 15 bp, Artificial Sequence
  dgRNA
  Zbtb20
cacaacatcaagagc

SEQ ID NO: 43813 - DNA, 15 bp, Artificial Sequence
  dgRNA
  Zbtb20
atggactcattaggg

SEQ ID NO: 43814 - DNA, 15 bp, Artificial Sequence
  dgRNA
  Osgin1
aaactgaacccggga

SEQ ID NO: 43815 - DNA, 15 bp, Artificial Sequence
  dgRNA
  Osgin1
aactgaacccgggaa

SEQ ID NO: 43816 - DNA, 15 bp, Artificial Sequence
  dgRNA
  Osgin1
tgaacccgggaaggg

SEQ ID NO: 43817 - DNA, 15 bp, Artificial Sequence
  dgRNA
  Osgin1
ggggccctttaagac

SEQ ID NO: 43818 - DNA, 15 bp, Artificial Sequence
  dgRNA
  Sec13
aaaacctgctagcga

SEQ ID NO: 43819 - DNA, 15 bp, Artificial Sequence
  dgRNA
  Sec13
aggatccagaagacg

SEQ ID NO: 43820 - DNA, 15 bp, Artificial Sequence
  dgRNA
  Sec13
agactaagttttttc

SEQ ID NO: 43821 - DNA, 15 bp, Artificial Sequence
  dgRNA
  Sec13
gaagccgtcgctagc

SEQ ID NO: 43822 - DNA, 15 bp, Artificial Sequence
  dgRNA
  Tmtc2
ccagtgggggtagac

SEQ ID NO: 43823 - DNA, 15 bp, Artificial Sequence
  dgRNA
  Tmtc2
tctgcggggaggatc

SEQ ID NO: 43824 - DNA, 15 bp, Artificial Sequence
  dgRNA
  Tmtc2
ctgcggggaggatct

SEQ ID NO: 43825 - DNA, 15 bp, Artificial Sequence
  dgRNA
  Tmtc2
gggccgggctagctt

SEQ ID NO: 43826 - DNA, 15 bp, Artificial Sequence
  dgRNA
  Chic1
tcagcacccgcagac

SEQ ID NO: 43827 - DNA, 15 bp, Artificial Sequence
  dgRNA
  Chic1
acctcgagaattccc

SEQ ID NO: 43828 - DNA, 15 bp, Artificial Sequence
  dgRNA
  Chic1
accgaatttactccc

SEQ ID NO: 43829 - DNA, 15 bp, Artificial Sequence
  dgRNA
  Chic1
atctacccaacacgc

SEQ ID NO: 43830 - DNA, 15 bp, Artificial Sequence
  dgRNA
  Mal
cagagagcactccgt

SEQ ID NO: 43831 - DNA, 15 bp, Artificial Sequence
  dgRNA
  Mal
agagagcactccgtc

SEQ ID NO: 43832 - DNA, 15 bp, Artificial Sequence
  dgRNA
  Mal
actccgtcgggtttc

SEQ ID NO: 43833 - DNA, 15 bp, Artificial Sequence
  dgRNA
  Mal
ctccgtcgggtttca

SEQ ID NO: 43834 - DNA, 15 bp, Artificial Sequence
  dgRNA
  Smtnl2
tcactaagtgcctcc

SEQ ID NO: 43835 - DNA, 15 bp, Artificial Sequence
  dgRNA
  Smtnl2
cactaagtgcctccg

SEQ ID NO: 43836 - DNA, 15 bp, Artificial Sequence
  dgRNA
  Smtnl2
agtgcctccggggcc

SEQ ID NO: 43837 - DNA, 15 bp, Artificial Sequence
  dgRNA
  Smtnl2
catcccgcaccgacc

SEQ ID NO: 43838 - DNA, 15 bp, Artificial Sequence
  dgRNA
  Ppp1r3d
gcggctgcgctgcgg

SEQ ID NO: 43839 - DNA, 15 bp, Artificial Sequence
  dgRNA
  Ppp1r3d
ctgcgctgcggcgga

SEQ ID NO: 43840 - DNA, 15 bp, Artificial Sequence
  dgRNA
  Ppp1r3d
tgcgctgcggcggaa

SEQ ID NO: 43841 - DNA, 15 bp, Artificial Sequence
  dgRNA
  Ppp1r3d
ctgcggcggaagggt

SEQ ID NO: 43842 - DNA, 15 bp, Artificial Sequence
  dgRNA
  Lrrc59
agctcctcccggcgg

SEQ ID NO: 43843 - DNA, 15 bp, Artificial Sequence
  dgRNA
  Lrrc59
tcctcccggcggagg

SEQ ID NO: 43844 - DNA, 15 bp, Artificial Sequence
  dgRNA
  Lrrc59
gcgccggtacacgct

SEQ ID NO: 43845 - DNA, 15 bp, Artificial Sequence
  dgRNA
  Lrrc59
cgccggtacacgctc

SEQ ID NO: 43846 - DNA, 15 bp, Artificial Sequence
  dgRNA
  Trim10
ccactagccttgtac

SEQ ID NO: 43847 - DNA, 15 bp, Artificial Sequence
  dgRNA
  Trim10
gctatgtttaagagc

SEQ ID NO: 43848 - DNA, 15 bp, Artificial Sequence
  dgRNA
  Trim10
gtggtgatgcctcca

SEQ ID NO: 43849 - DNA, 15 bp, Artificial Sequence
  dgRNA
  Trim10
ataaggctcttgagc

SEQ ID NO: 43850 - DNA, 15 bp, Artificial Sequence
  dgRNA
  Elf5
actgtctggctaaag

SEQ ID NO: 43851 - DNA, 15 bp, Artificial Sequence
  dgRNA
  Elf5
acccctctataaaaa

SEQ ID NO: 43852 - DNA, 15 bp, Artificial Sequence
  dgRNA
  Elf5
cccctctataaaaat

SEQ ID NO: 43853 - DNA, 15 bp, Artificial Sequence
  dgRNA
  Elf5
tctctcagtggcacg

SEQ ID NO: 43854 - DNA, 15 bp, Artificial Sequence
  dgRNA
  Cd96
ggaagcgtcttttaa

SEQ ID NO: 43855 - DNA, 15 bp, Artificial Sequence
  dgRNA
  Cd96
ggtgagacaggcgca

SEQ ID NO: 43856 - DNA, 15 bp, Artificial Sequence
  dgRNA
  Cd96
ctaaaatcgaaacaa

SEQ ID NO: 43857 - DNA, 15 bp, Artificial Sequence
  dgRNA
  Cd96
aagtagtgtggttca

SEQ ID NO: 43858 - DNA, 15 bp, Artificial Sequence
  dgRNA
  Olfr466
aataagtacagctgc

SEQ ID NO: 43859 - DNA, 15 bp, Artificial Sequence
  dgRNA
  Olfr466
cactttactacctac

SEQ ID NO: 43860 - DNA, 15 bp, Artificial Sequence
  dgRNA
  Clhc1
tacactcacccacga

SEQ ID NO: 43861 - DNA, 15 bp, Artificial Sequence
  dgRNA
  Clhc1
actcacccacgatgg

SEQ ID NO: 43862 - DNA, 15 bp, Artificial Sequence
  dgRNA
  Clhc1
aaggacccgcccctt

SEQ ID NO: 43863 - DNA, 15 bp, Artificial Sequence
  dgRNA
  Clhc1
gacccgccccttagg

SEQ ID NO: 43864 - DNA, 15 bp, Artificial Sequence
  dgRNA
  Col12a1
ctattaagtagcccg

SEQ ID NO: 43865 - DNA, 15 bp, Artificial Sequence
  dgRNA
  Col12a1
aagtagcccgcggcg

SEQ ID NO: 43866 - DNA, 15 bp, Artificial Sequence
  dgRNA
  Col12a1
cttcccagtcggcaa

SEQ ID NO: 43867 - DNA, 15 bp, Artificial Sequence
  dgRNA
  Col12a1
cccagtcggcaaagg

SEQ ID NO: 43868 - DNA, 15 bp, Artificial Sequence
  dgRNA
  Mmaa
gccaggacgcattcc

SEQ ID NO: 43869 - DNA, 15 bp, Artificial Sequence
  dgRNA
  Mmaa
aggacgcattccagg

SEQ ID NO: 43870 - DNA, 15 bp, Artificial Sequence
  dgRNA
  Mmaa
ggacgcattccaggt

SEQ ID NO: 43871 - DNA, 15 bp, Artificial Sequence
  dgRNA
  Mmaa
gacgcattccaggtg

SEQ ID NO: 43872 - DNA, 15 bp, Artificial Sequence
  dgRNA
  Usp38
cctgcgcgccaggga

SEQ ID NO: 43873 - DNA, 15 bp, Artificial Sequence
  dgRNA
  Usp38
ctgcgcgccagggaa

SEQ ID NO: 43874 - DNA, 15 bp, Artificial Sequence
  dgRNA
  Usp38
tgcgcgccagggaag

SEQ ID NO: 43875 - DNA, 15 bp, Artificial Sequence
  dgRNA
  Usp38
gcgcgccagggaagg

SEQ ID NO: 43876 - DNA, 15 bp, Artificial Sequence
  dgRNA
  Hdgfl1
gccagcatcctcgag

SEQ ID NO: 43877 - DNA, 15 bp, Artificial Sequence
  dgRNA
  Hdgfl1
gcgcactctacccag

SEQ ID NO: 43878 - DNA, 15 bp, Artificial Sequence
  dgRNA
  Hdgfl1
caagagaggtaccta

SEQ ID NO: 43879 - DNA, 15 bp, Artificial Sequence
  dgRNA
  Hdgfl1
gttgcactgcaaaga

SEQ ID NO: 43880 - DNA, 15 bp, Artificial Sequence
  dgRNA
  Stxbp3
gtaggcttccgctag

SEQ ID NO: 43881 - DNA, 15 bp, Artificial Sequence
  dgRNA
  Stxbp3
taggcttccgctagg

SEQ ID NO: 43882 - DNA, 15 bp, Artificial Sequence
  dgRNA
  Stxbp3
acgcagccgcagtcc

SEQ ID NO: 43883 - DNA, 15 bp, Artificial Sequence
  dgRNA
  Stxbp3
ccgcagtccaggcac

SEQ ID NO: 43884 - DNA, 15 bp, Artificial Sequence
  dgRNA
  Ifngr2
ggtactagagatctc

SEQ ID NO: 43885 - DNA, 15 bp, Artificial Sequence
  dgRNA
  Ifngr2
cattggaggtcggct

SEQ ID NO: 43886 - DNA, 15 bp, Artificial Sequence
  dgRNA
  Ifngr2
gaggtcggctcggcg

SEQ ID NO: 43887 - DNA, 15 bp, Artificial Sequence
  dgRNA
  Ifngr2
cggctcggcgaggtg

SEQ ID NO: 43888 - DNA, 15 bp, Artificial Sequence
  dgRNA
  Lin28b
agatgaaatggcgat

SEQ ID NO: 43889 - DNA, 15 bp, Artificial Sequence
  dgRNA
  Lin28b
ccccttaaggatccg

SEQ ID NO: 43890 - DNA, 15 bp, Artificial Sequence
  dgRNA
  Lin28b
gagtcacgtgtgctc

SEQ ID NO: 43891 - DNA, 15 bp, Artificial Sequence
  dgRNA
  Lin28b
gtcacgtgtgctcag

SEQ ID NO: 43892 - DNA, 15 bp, Artificial Sequence
  dgRNA
  1810011H11Rik
agctttagcatccag

SEQ ID NO: 43893 - DNA, 15 bp, Artificial Sequence
  dgRNA
  1810011H11Rik
agtggtacaccctcc

SEQ ID NO: 43894 - DNA, 15 bp, Artificial Sequence
  dgRNA
  1810011H11Rik
gtggtacaccctcct

SEQ ID NO: 43895 - DNA, 15 bp, Artificial Sequence
  dgRNA
  1810011H11Rik
ctcccactcgccact

SEQ ID NO: 43896 - DNA, 15 bp, Artificial Sequence
  dgRNA
  Dpf2
atcgcgcctgcgcac

SEQ ID NO: 43897 - DNA, 15 bp, Artificial Sequence
  dgRNA
  Dpf2
tcgcgcctgcgcact

SEQ ID NO: 43898 - DNA, 15 bp, Artificial Sequence
  dgRNA
  Dpf2
ctgcgcagagggtcg

SEQ ID NO: 43899 - DNA, 15 bp, Artificial Sequence
  dgRNA
  Dpf2
gcgcgttgtaggttt

SEQ ID NO: 43900 - DNA, 15 bp, Artificial Sequence
  dgRNA
  Vmn2r72
atagtgtcacctgga

SEQ ID NO: 43901 - DNA, 15 bp, Artificial Sequence
  dgRNA
  Vmn2r72
tagtgtcacctggat

SEQ ID NO: 43902 - DNA, 15 bp, Artificial Sequence
  dgRNA
  Vmn2r72
ataatctatatcctt

SEQ ID NO: 43903 - DNA, 15 bp, Artificial Sequence
  dgRNA
  Vmn2r72
tgtacctactgctaa

SEQ ID NO: 43904 - DNA, 15 bp, Artificial Sequence
  dgRNA
  Cbll1
ttcccgcctcagtcc

SEQ ID NO: 43905 - DNA, 15 bp, Artificial Sequence
  dgRNA
  Cbll1
gtctgactccttcgc

SEQ ID NO: 43906 - DNA, 15 bp, Artificial Sequence
  dgRNA
  Cbll1
ctccttcgccggagt

SEQ ID NO: 43907 - DNA, 15 bp, Artificial Sequence
  dgRNA
  Cbll1
tccttcgccggagtc

SEQ ID NO: 43908 - DNA, 15 bp, Artificial Sequence
  dgRNA
  Arap3
gccctctttcctagg

SEQ ID NO: 43909 - DNA, 15 bp, Artificial Sequence
  dgRNA
  Arap3
cagattgggactagt

SEQ ID NO: 43910 - DNA, 15 bp, Artificial Sequence
  dgRNA
  Arap3
gattgggactagttg

SEQ ID NO: 43911 - DNA, 15 bp, Artificial Sequence
  dgRNA
  Arap3
ctagttggggccctc

SEQ ID NO: 43912 - DNA, 15 bp, Artificial Sequence
  dgRNA
  Dnah1
cgcccacctacagac

SEQ ID NO: 43913 - DNA, 15 bp, Artificial Sequence
  dgRNA
  Dnah1
acctacagaccggac

SEQ ID NO: 43914 - DNA, 15 bp, Artificial Sequence
  dgRNA
  Dnah1
gaaccagacctcttg

SEQ ID NO: 43915 - DNA, 15 bp, Artificial Sequence
  dgRNA
  Dnah1
acctcttgggggcga

SEQ ID NO: 43916 - DNA, 15 bp, Artificial Sequence
  dgRNA
  Mlip
tccgtgctctgttta

SEQ ID NO: 43917 - DNA, 15 bp, Artificial Sequence
  dgRNA
  Mlip
ccgtgctctgtttat

SEQ ID NO: 43918 - DNA, 15 bp, Artificial Sequence
  dgRNA
  Mlip
cgtgctctgtttatg

SEQ ID NO: 43919 - DNA, 15 bp, Artificial Sequence
  dgRNA
  Mlip
ccagaaattatcgcc

SEQ ID NO: 43920 - DNA, 15 bp, Artificial Sequence
  dgRNA
  Cnn3
gcccgctgaccagcg

SEQ ID NO: 43921 - DNA, 15 bp, Artificial Sequence
  dgRNA
  Cnn3
cgctgaccagcgggg

SEQ ID NO: 43922 - DNA, 15 bp, Artificial Sequence
  dgRNA
  Cnn3
gggcgccgaggtcct

SEQ ID NO: 43923 - DNA, 15 bp, Artificial Sequence
  dgRNA
  Cnn3
cgccgaggtcctagg

SEQ ID NO: 43924 - DNA, 15 bp, Artificial Sequence
  dgRNA
  Mmp20
tgttaccccttcatc

SEQ ID NO: 43925 - DNA, 15 bp, Artificial Sequence
  dgRNA
  Mmp20
ttaccccttcatcag

SEQ ID NO: 43926 - DNA, 15 bp, Artificial Sequence
  dgRNA
  Mmp20
taccccttcatcagg

SEQ ID NO: 43927 - DNA, 15 bp, Artificial Sequence
  dgRNA
  Mmp20
tgaatcatcacttac

SEQ ID NO: 43928 - DNA, 15 bp, Artificial Sequence
  dgRNA
  Dlgap2
gggatccgctgtgcg

SEQ ID NO: 43929 - DNA, 15 bp, Artificial Sequence
  dgRNA
  Dlgap2
ggatccgctgtgcgc

SEQ ID NO: 43930 - DNA, 15 bp, Artificial Sequence
  dgRNA
  Dlgap2
ctgtgcgcgggctcc

SEQ ID NO: 43931 - DNA, 15 bp, Artificial Sequence
  dgRNA
  Dlgap2
tgtgcgcgggctccc

SEQ ID NO: 43932 - DNA, 15 bp, Artificial Sequence
  dgRNA
  Btbd8
cagcgcccggtcacg

SEQ ID NO: 43933 - DNA, 15 bp, Artificial Sequence
  dgRNA
  Btbd8
ccggtcacgtggcta

SEQ ID NO: 43934 - DNA, 15 bp, Artificial Sequence
  dgRNA
  Btbd8
cggtcacgtggctac

SEQ ID NO: 43935 - DNA, 15 bp, Artificial Sequence
  dgRNA
  Btbd8
cgggctttgagtcct

SEQ ID NO: 43936 - DNA, 15 bp, Artificial Sequence
  dgRNA
  Fam20a
cagagccggcagcaa

SEQ ID NO: 43937 - DNA, 15 bp, Artificial Sequence
  dgRNA
  Fam20a
agagccggcagcaaa

SEQ ID NO: 43938 - DNA, 15 bp, Artificial Sequence
  dgRNA
  Fam20a
cggcagcaaagggat

SEQ ID NO: 43939 - DNA, 15 bp, Artificial Sequence
  dgRNA
  Fam20a
ggtgccagctaagag

SEQ ID NO: 43940 - DNA, 15 bp, Artificial Sequence
  dgRNA
  Nfkbie
cgaaacaatccacgc

SEQ ID NO: 43941 - DNA, 15 bp, Artificial Sequence
  dgRNA
  Nfkbie
acgcaagcagcaaac

SEQ ID NO: 43942 - DNA, 15 bp, Artificial Sequence
  dgRNA
  Nfkbie
cgcaagcagcaaaca

SEQ ID NO: 43943 - DNA, 15 bp, Artificial Sequence
  dgRNA
  Nfkbie
caaacagggggattc

SEQ ID NO: 43944 - DNA, 15 bp, Artificial Sequence
  dgRNA
  Sil1
agatacagctcccag

SEQ ID NO: 43945 - DNA, 15 bp, Artificial Sequence
  dgRNA
  Sil1
tacagctcccagcgg

SEQ ID NO: 43946 - DNA, 15 bp, Artificial Sequence
  dgRNA
  Sil1
acagctcccagcgga

SEQ ID NO: 43947 - DNA, 15 bp, Artificial Sequence
  dgRNA
  Sil1
cagcattttttgcgg

SEQ ID NO: 43948 - DNA, 15 bp, Artificial Sequence
  dgRNA
  Fsbp
taagtcagcttaagc

SEQ ID NO: 43949 - DNA, 15 bp, Artificial Sequence
  dgRNA
  Fsbp
gtcagcttaagctgg

SEQ ID NO: 43950 - DNA, 15 bp, Artificial Sequence
  dgRNA
  Fsbp
taagccctcccctgt

SEQ ID NO: 43951 - DNA, 15 bp, Artificial Sequence
  dgRNA
  Fsbp
ctcccctgtaggcgt

SEQ ID NO: 43952 - DNA, 15 bp, Artificial Sequence
  dgRNA
  Eml2
ccttggtcccggcaa

SEQ ID NO: 43953 - DNA, 15 bp, Artificial Sequence
  dgRNA
  Eml2
cttggtcccggcaat

SEQ ID NO: 43954 - DNA, 15 bp, Artificial Sequence
  dgRNA
  Eml2
acacctgacgcctgc

SEQ ID NO: 43955 - DNA, 15 bp, Artificial Sequence
  dgRNA
  Eml2
tgcaggggtcagccg

SEQ ID NO: 43956 - DNA, 15 bp, Artificial Sequence
  dgRNA
  Cdkl2
aaatctttccctacc

SEQ ID NO: 43957 - DNA, 15 bp, Artificial Sequence
  dgRNA
  Cdkl2
ctttccctaccaggc

SEQ ID NO: 43958 - DNA, 15 bp, Artificial Sequence
  dgRNA
  Cdkl2
actactaggctcttc

SEQ ID NO: 43959 - DNA, 15 bp, Artificial Sequence
  dgRNA
  Cdkl2
ttccggtccaccgcc

SEQ ID NO: 43960 - DNA, 15 bp, Artificial Sequence
  dgRNA
  BC094916
agcgatgcactctgc

SEQ ID NO: 43961 - DNA, 15 bp, Artificial Sequence
  dgRNA
  BC094916
gcgatgcactctgct

SEQ ID NO: 43962 - DNA, 15 bp, Artificial Sequence
  dgRNA
  Frmd3
tctttgctggccgcc

SEQ ID NO: 43963 - DNA, 15 bp, Artificial Sequence
  dgRNA
  Frmd3
ctggccgccaggatc

SEQ ID NO: 43964 - DNA, 15 bp, Artificial Sequence
  dgRNA
  Frmd3
tggccgccaggatcc

SEQ ID NO: 43965 - DNA, 15 bp, Artificial Sequence
  dgRNA
  Frmd3
gggaattcacaatgc

SEQ ID NO: 43966 - DNA, 15 bp, Artificial Sequence
  dgRNA
  Zdhhc24
aagccacaccagggg

SEQ ID NO: 43967 - DNA, 15 bp, Artificial Sequence
  dgRNA
  Zdhhc24
gctactgcagtacgc

SEQ ID NO: 43968 - DNA, 15 bp, Artificial Sequence
  dgRNA
  Zdhhc24
ctactgcagtacgct

SEQ ID NO: 43969 - DNA, 15 bp, Artificial Sequence
  dgRNA
  Zdhhc24
ctgcagtacgctggg

SEQ ID NO: 43970 - DNA, 15 bp, Artificial Sequence
  dgRNA
  Zfp644
cctattccaccttaa

SEQ ID NO: 43971 - DNA, 15 bp, Artificial Sequence
  dgRNA
  Zfp644
ctattccaccttaaa

SEQ ID NO: 43972 - DNA, 15 bp, Artificial Sequence
  dgRNA
  Zfp644
caccttaaagggcct

SEQ ID NO: 43973 - DNA, 15 bp, Artificial Sequence
  dgRNA
  Zfp644
gggcctaggcattcc

SEQ ID NO: 43974 - DNA, 15 bp, Artificial Sequence
  dgRNA
  Sphk1
aactccggttagtca

SEQ ID NO: 43975 - DNA, 15 bp, Artificial Sequence
  dgRNA
  Sphk1
gtcacggacaccctc

SEQ ID NO: 43976 - DNA, 15 bp, Artificial Sequence
  dgRNA
  Sphk1
cgaagcgcatacacc

SEQ ID NO: 43977 - DNA, 15 bp, Artificial Sequence
  dgRNA
  Sphk1
gaagcgcatacaccg

SEQ ID NO: 43978 - DNA, 15 bp, Artificial Sequence
  dgRNA
  Pou4f2
aaggaccggagcctg

SEQ ID NO: 43979 - DNA, 15 bp, Artificial Sequence
  dgRNA
  Pou4f2
ggaccggagcctgcg

SEQ ID NO: 43980 - DNA, 15 bp, Artificial Sequence
  dgRNA
  Pou4f2
gcagtgcgtcctggc

SEQ ID NO: 43981 - DNA, 15 bp, Artificial Sequence
  dgRNA
  Pou4f2
ggcgggggtcaggcg

SEQ ID NO: 43982 - DNA, 15 bp, Artificial Sequence
  dgRNA
  Olfr50
atagcatgttttaac

SEQ ID NO: 43983 - DNA, 15 bp, Artificial Sequence
  dgRNA
  Slc4a7
aagccccttagccac

SEQ ID NO: 43984 - DNA, 15 bp, Artificial Sequence
  dgRNA
  Slc4a7
gcggtcgctcgacgc

SEQ ID NO: 43985 - DNA, 15 bp, Artificial Sequence
  dgRNA
  Slc4a7
gctcgacgccggacc

SEQ ID NO: 43986 - DNA, 15 bp, Artificial Sequence
  dgRNA
  Slc4a7
gacctggtgcctaac

SEQ ID NO: 43987 - DNA, 15 bp, Artificial Sequence
  dgRNA
  Dnah6
tgacgtcaaatactc

SEQ ID NO: 43988 - DNA, 15 bp, Artificial Sequence
  dgRNA
  Dnah6
gacgtcaaatactct

SEQ ID NO: 43989 - DNA, 15 bp, Artificial Sequence
  dgRNA
  Dnah6
tctgggaacaccgat

SEQ ID NO: 43990 - DNA, 15 bp, Artificial Sequence
  dgRNA
  Dnah6
tacttggcgcgctcc

SEQ ID NO: 43991 - DNA, 15 bp, Artificial Sequence
  dgRNA
  Dlg1
tttacactacgctga

SEQ ID NO: 43992 - DNA, 15 bp, Artificial Sequence
  dgRNA
  Dlg1
ttacactacgctgat

SEQ ID NO: 43993 - DNA, 15 bp, Artificial Sequence
  dgRNA
  Dlg1
ggaacttagtaaccc

SEQ ID NO: 43994 - DNA, 15 bp, Artificial Sequence
  dgRNA
  Nt5dc1
aaactggggcgatcc

SEQ ID NO: 43995 - DNA, 15 bp, Artificial Sequence
  dgRNA
  Nt5dc1
ctggggcgatccagg

SEQ ID NO: 43996 - DNA, 15 bp, Artificial Sequence
  dgRNA
  Nt5dc1
ctgacttggagacgc

SEQ ID NO: 43997 - DNA, 15 bp, Artificial Sequence
  dgRNA
  Nt5dc1
cccagttttgctggc

SEQ ID NO: 43998 - DNA, 15 bp, Artificial Sequence
  dgRNA
  Ptdss1
aacaagagccgaaac

SEQ ID NO: 43999 - DNA, 15 bp, Artificial Sequence
  dgRNA
  Ptdss1
tgcacttcgtaataa

SEQ ID NO: 44000 - DNA, 15 bp, Artificial Sequence
  dgRNA
  Ptdss1
gcacttcgtaataaa

SEQ ID NO: 44001 - DNA, 15 bp, Artificial Sequence
  dgRNA
  Ptdss1
taataaagggcctct

SEQ ID NO: 44002 - DNA, 15 bp, Artificial Sequence
  dgRNA
  Dupd1
gactgcttgagtcaa

SEQ ID NO: 44003 - DNA, 15 bp, Artificial Sequence
  dgRNA
  Dupd1
tctgaccctaaaaat

SEQ ID NO: 44004 - DNA, 15 bp, Artificial Sequence
  dgRNA
  Dupd1
atgtggccgccagga

SEQ ID NO: 44005 - DNA, 15 bp, Artificial Sequence
  dgRNA
  Dupd1
cagtcctgtacctgg

SEQ ID NO: 44006 - DNA, 15 bp, Artificial Sequence
  dgRNA
  Npnt
gcgtcccagcagccg

SEQ ID NO: 44007 - DNA, 15 bp, Artificial Sequence
  dgRNA
  Npnt
cgtcccagcagccgc

SEQ ID NO: 44008 - DNA, 15 bp, Artificial Sequence
  dgRNA
  Npnt
cgggtgccgcgccga

SEQ ID NO: 44009 - DNA, 15 bp, Artificial Sequence
  dgRNA
  Npnt
gtgccgcgccgaagg

SEQ ID NO: 44010 - DNA, 15 bp, Artificial Sequence
  dgRNA
  Rad51b
aagcaatcactacaa

SEQ ID NO: 44011 - DNA, 15 bp, Artificial Sequence
  dgRNA
  Rad51b
tgctcgcacttttcg

SEQ ID NO: 44012 - DNA, 15 bp, Artificial Sequence
  dgRNA
  Rad51b
gctcgcacttttcgc

SEQ ID NO: 44013 - DNA, 15 bp, Artificial Sequence
  dgRNA
  Rad51b
gcgggtaattgtgtg

SEQ ID NO: 44014 - DNA, 15 bp, Artificial Sequence
  dgRNA
  Grm4
agcgggagccgccgg

SEQ ID NO: 44015 - DNA, 15 bp, Artificial Sequence
  dgRNA
  Grm4
gcgggagccgccggc

SEQ ID NO: 44016 - DNA, 15 bp, Artificial Sequence
  dgRNA
  Grm4
cgggagccgccggcg

SEQ ID NO: 44017 - DNA, 15 bp, Artificial Sequence
  dgRNA
  Grm4
gagccgccggcgggg

SEQ ID NO: 44018 - DNA, 15 bp, Artificial Sequence
  dgRNA
  Muc4
aaaagatggcgtata

SEQ ID NO: 44019 - DNA, 15 bp, Artificial Sequence
  dgRNA
  Muc4
atctgaggatactag

SEQ ID NO: 44020 - DNA, 15 bp, Artificial Sequence
  dgRNA
  Muc4
tatctgaggatacta

SEQ ID NO: 44021 - DNA, 15 bp, Artificial Sequence
  dgRNA
  Muc4
gtatctgaggatact

SEQ ID NO: 44022 - DNA, 15 bp, Artificial Sequence
  dgRNA
  Olfr262
agcggtcctagaaga

SEQ ID NO: 44023 - DNA, 15 bp, Artificial Sequence
  dgRNA
  Olfr262
gatcttagaaacacc

SEQ ID NO: 44024 - DNA, 15 bp, Artificial Sequence
  dgRNA
  Olfr262
atacatagttgacca

SEQ ID NO: 44025 - DNA, 15 bp, Artificial Sequence
  dgRNA
  Dact1
ggaccgcggtgccgc

SEQ ID NO: 44026 - DNA, 15 bp, Artificial Sequence
  dgRNA
  Dact1
ccgcaggaccgaaaa

SEQ ID NO: 44027 - DNA, 15 bp, Artificial Sequence
  dgRNA
  Dact1
cgcaggaccgaaaaa

SEQ ID NO: 44028 - DNA, 15 bp, Artificial Sequence
  dgRNA
  Dact1
gcaggaccgaaaaag

SEQ ID NO: 44029 - DNA, 15 bp, Artificial Sequence
  dgRNA
  Steap2
gttaatccaaaatcg

SEQ ID NO: 44030 - DNA, 15 bp, Artificial Sequence
  dgRNA
  Steap2
ttaatccaaaatcgg

SEQ ID NO: 44031 - DNA, 15 bp, Artificial Sequence
  dgRNA
  Steap2
taatccaaaatcggg

SEQ ID NO: 44032 - DNA, 15 bp, Artificial Sequence
  dgRNA
  Steap2
aatccaaaatcgggg

SEQ ID NO: 44033 - DNA, 15 bp, Artificial Sequence
  dgRNA
  Mpst
ttctgcgtcttcgca

SEQ ID NO: 44034 - DNA, 15 bp, Artificial Sequence
  dgRNA
  Mpst
tctgcgtcttcgcac

SEQ ID NO: 44035 - DNA, 15 bp, Artificial Sequence
  dgRNA
  Mpst
tctcatacataaagg

SEQ ID NO: 44036 - DNA, 15 bp, Artificial Sequence
  dgRNA
  Mpst
gctatttgaagctcg

SEQ ID NO: 44037 - DNA, 15 bp, Artificial Sequence
  dgRNA
  Nprl3
tgttatgtgatgagc

SEQ ID NO: 44038 - DNA, 15 bp, Artificial Sequence
  dgRNA
  Nprl3
aaagtttatacgctc

SEQ ID NO: 44039 - DNA, 15 bp, Artificial Sequence
  dgRNA
  Nprl3
actagagtgcagcca

SEQ ID NO: 44040 - DNA, 15 bp, Artificial Sequence
  dgRNA
  Nprl3
gccaaggcgtcgcgc

SEQ ID NO: 44041 - DNA, 15 bp, Artificial Sequence
  dgRNA
  Sh3pxd2b
ctcgagcaagatgct

SEQ ID NO: 44042 - DNA, 15 bp, Artificial Sequence
  dgRNA
  Sh3pxd2b
tcgagcaagatgctt

SEQ ID NO: 44043 - DNA, 15 bp, Artificial Sequence
  dgRNA
  Sh3pxd2b
gggtttagagtcgcc

SEQ ID NO: 44044 - DNA, 15 bp, Artificial Sequence
  dgRNA
  Sh3pxd2b
tagagtcgccaggcc

SEQ ID NO: 44045 - DNA, 15 bp, Artificial Sequence
  dgRNA
  Olfr474
tagtatttccatgat

SEQ ID NO: 44046 - DNA, 15 bp, Artificial Sequence
  dgRNA
  Olfr474
gatggttcctgttaa

SEQ ID NO: 44047 - DNA, 15 bp, Artificial Sequence
  dgRNA
  Pex3
tttccgtctcctgta

SEQ ID NO: 44048 - DNA, 15 bp, Artificial Sequence
  dgRNA
  Pex3
tacggacaccacgca

SEQ ID NO: 44049 - DNA, 15 bp, Artificial Sequence
  dgRNA
  Pex3
acggacaccacgcac

SEQ ID NO: 44050 - DNA, 15 bp, Artificial Sequence
  dgRNA
  Pex3
cacgcacgggccgtc

SEQ ID NO: 44051 - DNA, 15 bp, Artificial Sequence
  dgRNA
  Pced1a
tcaccccgcccgctg

SEQ ID NO: 44052 - DNA, 15 bp, Artificial Sequence
  dgRNA
  Pced1a
tcagcagtttccgga

SEQ ID NO: 44053 - DNA, 15 bp, Artificial Sequence
  dgRNA
  Pced1a
tttccggaaggagac

SEQ ID NO: 44054 - DNA, 15 bp, Artificial Sequence
  dgRNA
  Pced1a
cactcgctgtcgccg

SEQ ID NO: 44055 - DNA, 15 bp, Artificial Sequence
  dgRNA
  Dgcr2
tctcggttcagccaa

SEQ ID NO: 44056 - DNA, 15 bp, Artificial Sequence
  dgRNA
  Dgcr2
actcgctcattccct

SEQ ID NO: 44057 - DNA, 15 bp, Artificial Sequence
  dgRNA
  Dgcr2
cccgcgtctggagct

SEQ ID NO: 44058 - DNA, 15 bp, Artificial Sequence
  dgRNA
  Dgcr2
ccgcgtctggagctc

SEQ ID NO: 44059 - DNA, 15 bp, Artificial Sequence
  dgRNA
  Srsf11
gaggtttcagcggct

SEQ ID NO: 44060 - DNA, 15 bp, Artificial Sequence
  dgRNA
  Srsf11
gtttcagcggctagg

SEQ ID NO: 44061 - DNA, 15 bp, Artificial Sequence
  dgRNA
  Srsf11
tcagcggctaggtgg

SEQ ID NO: 44062 - DNA, 15 bp, Artificial Sequence
  dgRNA
  Srsf11
cagcggctaggtgga

SEQ ID NO: 44063 - DNA, 15 bp, Artificial Sequence
  dgRNA
  Tgif1
ccttgcaatccaatc

SEQ ID NO: 44064 - DNA, 15 bp, Artificial Sequence
  dgRNA
  Tgif1
tcagagctttagccc

SEQ ID NO: 44065 - DNA, 15 bp, Artificial Sequence
  dgRNA
  Tgif1
cagagctttagcccg

SEQ ID NO: 44066 - DNA, 15 bp, Artificial Sequence
  dgRNA
  Tgif1
agagctttagcccgg

SEQ ID NO: 44067 - DNA, 15 bp, Artificial Sequence
  dgRNA
  Sass6
gttgtcagtcccctt

SEQ ID NO: 44068 - DNA, 15 bp, Artificial Sequence
  dgRNA
  Sass6
ttcccttaacaaacg

SEQ ID NO: 44069 - DNA, 15 bp, Artificial Sequence
  dgRNA
  Sass6
aaacgtggccgcctg

SEQ ID NO: 44070 - DNA, 15 bp, Artificial Sequence
  dgRNA
  Sass6
aacgtggccgcctga

SEQ ID NO: 44071 - DNA, 15 bp, Artificial Sequence
  dgRNA
  9530003J23Rik
tcaattcaaacattg

SEQ ID NO: 44072 - DNA, 15 bp, Artificial Sequence
  dgRNA
  9530003J23Rik
tgaattgagatactc

SEQ ID NO: 44073 - DNA, 15 bp, Artificial Sequence
  dgRNA
  Med27
aatgacttccctaga

SEQ ID NO: 44074 - DNA, 15 bp, Artificial Sequence
  dgRNA
  Med27
ggagatcataacttg

SEQ ID NO: 44075 - DNA, 15 bp, Artificial Sequence
  dgRNA
  Med27
ttcgctagagcttcc

SEQ ID NO: 44076 - DNA, 15 bp, Artificial Sequence
  dgRNA
  Med27
cgccgcgcgccgctc

SEQ ID NO: 44077 - DNA, 15 bp, Artificial Sequence
  dgRNA
  Elf1
cctagcagaataatt

SEQ ID NO: 44078 - DNA, 15 bp, Artificial Sequence
  dgRNA
  Elf1
gggtccacagcaaca

SEQ ID NO: 44079 - DNA, 15 bp, Artificial Sequence
  dgRNA
  Elf1
ggtccacagcaacat

SEQ ID NO: 44080 - DNA, 15 bp, Artificial Sequence
  dgRNA
  Elf1
cattggacaggagcg

SEQ ID NO: 44081 - DNA, 15 bp, Artificial Sequence
  dgRNA
  Cacna1s
gctaattttactcgc

SEQ ID NO: 44082 - DNA, 15 bp, Artificial Sequence
  dgRNA
  Cacna1s
ctaattttactcgct

SEQ ID NO: 44083 - DNA, 15 bp, Artificial Sequence
  dgRNA
  Cacna1s
aggataggctcagtc

SEQ ID NO: 44084 - DNA, 15 bp, Artificial Sequence
  dgRNA
  Cacna1s
gtccagtccccaagg

SEQ ID NO: 44085 - DNA, 15 bp, Artificial Sequence
  dgRNA
  Apol6
attctgccctgatac

SEQ ID NO: 44086 - DNA, 15 bp, Artificial Sequence
  dgRNA
  Apol6
gcctgctggactgat

SEQ ID NO: 44087 - DNA, 15 bp, Artificial Sequence
  dgRNA
  Apol6
ggaccctaatcgacc

SEQ ID NO: 44088 - DNA, 15 bp, Artificial Sequence
  dgRNA
  Apol6
aactgggccaatggc

SEQ ID NO: 44089 - DNA, 15 bp, Artificial Sequence
  dgRNA
  Arhgef17
agcctcgcgcgctcc

SEQ ID NO: 44090 - DNA, 15 bp, Artificial Sequence
  dgRNA
  Arhgef17
cctcttttgggcgcc

SEQ ID NO: 44091 - DNA, 15 bp, Artificial Sequence
  dgRNA
  Arhgef17
tcggggaggagccga

SEQ ID NO: 44092 - DNA, 15 bp, Artificial Sequence
  dgRNA
  Arhgef17
ggagcgcgcgaggct

SEQ ID NO: 44093 - DNA, 15 bp, Artificial Sequence
  dgRNA
  Cpne8
gccggattcgcgacg

SEQ ID NO: 44094 - DNA, 15 bp, Artificial Sequence
  dgRNA
  Cpne8
acctcgtcgcgaatc

SEQ ID NO: 44095 - DNA, 15 bp, Artificial Sequence
  dgRNA
  Cpne8
aggcggcgcgggaag

SEQ ID NO: 44096 - DNA, 15 bp, Artificial Sequence
  dgRNA
  Cpne8
gaggcggcgcgggaa

SEQ ID NO: 44097 - DNA, 15 bp, Artificial Sequence
  dgRNA
  Isg20l2
cgtcacgacttccac

SEQ ID NO: 44098 - DNA, 15 bp, Artificial Sequence
  dgRNA
  Isg20l2
gtcacgacttccact

SEQ ID NO: 44099 - DNA, 15 bp, Artificial Sequence
  dgRNA
  Isg20l2
catttgcgcagccgc

SEQ ID NO: 44100 - DNA, 15 bp, Artificial Sequence
  dgRNA
  Isg20l2
atttgcgcagccgca

SEQ ID NO: 44101 - DNA, 15 bp, Artificial Sequence
  dgRNA
  Mettl4
acgtcaggattgcga

SEQ ID NO: 44102 - DNA, 15 bp, Artificial Sequence
  dgRNA
  Mettl4
cggctcaacgcgctc

SEQ ID NO: 44103 - DNA, 15 bp, Artificial Sequence
  dgRNA
  Mettl4
ggctcaacgcgctcc

SEQ ID NO: 44104 - DNA, 15 bp, Artificial Sequence
  dgRNA
  Mettl4
ggtcatcgtcggtgt

SEQ ID NO: 44105 - DNA, 15 bp, Artificial Sequence
  dgRNA
  Slc26a7
aaatcctctggcagt

SEQ ID NO: 44106 - DNA, 15 bp, Artificial Sequence
  dgRNA
  Slc26a7
aatcctctggcagtc

SEQ ID NO: 44107 - DNA, 15 bp, Artificial Sequence
  dgRNA
  Slc26a7
ttcgcttctgcttgt

SEQ ID NO: 44108 - DNA, 15 bp, Artificial Sequence
  dgRNA
  Slc26a7
gcttgtaggagacgc

SEQ ID NO: 44109 - DNA, 15 bp, Artificial Sequence
  dgRNA
  Rfc5
ccctggtgaggcccg

SEQ ID NO: 44110 - DNA, 15 bp, Artificial Sequence
  dgRNA
  Rfc5
tggtgaggcccgcgg

SEQ ID NO: 44111 - DNA, 15 bp, Artificial Sequence
  dgRNA
  Rfc5
ggcccgcggtggctc

SEQ ID NO: 44112 - DNA, 15 bp, Artificial Sequence
  dgRNA
  Rfc5
tctggcttcagcgcg

SEQ ID NO: 44113 - DNA, 15 bp, Artificial Sequence
  dgRNA
  Gtf3c5
gccgaaaaccagctc

SEQ ID NO: 44114 - DNA, 15 bp, Artificial Sequence
  dgRNA
  Gtf3c5
ccgaaaaccagctca

SEQ ID NO: 44115 - DNA, 15 bp, Artificial Sequence
  dgRNA
  Gtf3c5
gggccagaggacgcc

SEQ ID NO: 44116 - DNA, 15 bp, Artificial Sequence
  dgRNA
  Gtf3c5
caagctctcattgga

SEQ ID NO: 44117 - DNA, 15 bp, Artificial Sequence
  dgRNA
  Acot10
tggatcctgcatatt

SEQ ID NO: 44118 - DNA, 15 bp, Artificial Sequence
  dgRNA
  Acot10
ggatcctgcatattt

SEQ ID NO: 44119 - DNA, 15 bp, Artificial Sequence
  dgRNA
  Acot10
tcttcggtttctatc

SEQ ID NO: 44120 - DNA, 15 bp, Artificial Sequence
  dgRNA
  Acot10
aggccttctaatata

SEQ ID NO: 44121 - DNA, 15 bp, Artificial Sequence
  dgRNA
  Fer
atctcaaagattacc

SEQ ID NO: 44122 - DNA, 15 bp, Artificial Sequence
  dgRNA
  Fer
ctcaaagattaccag

SEQ ID NO: 44123 - DNA, 15 bp, Artificial Sequence
  dgRNA
  Fer
ccaggggcctttaat

SEQ ID NO: 44124 - DNA, 15 bp, Artificial Sequence
  dgRNA
  Fer
caggggcctttaata

SEQ ID NO: 44125 - DNA, 15 bp, Artificial Sequence
  dgRNA
  Pcna
tgacttccacttccg

SEQ ID NO: 44126 - DNA, 15 bp, Artificial Sequence
  dgRNA
  Pcna
tccacttccgtggcg

SEQ ID NO: 44127 - DNA, 15 bp, Artificial Sequence
  dgRNA
  Pcna
cgcggaaacttccta

SEQ ID NO: 44128 - DNA, 15 bp, Artificial Sequence
  dgRNA
  Pcna
tcgagctgtgcgcgg

SEQ ID NO: 44129 - DNA, 15 bp, Artificial Sequence
  dgRNA
  Ky
tagattgaggcttta

SEQ ID NO: 44130 - DNA, 15 bp, Artificial Sequence
  dgRNA
  Ky
agttttcgtagattg

SEQ ID NO: 44131 - DNA, 15 bp, Artificial Sequence
  dgRNA
  Ky
gaactggtatagttt

SEQ ID NO: 44132 - DNA, 15 bp, Artificial Sequence
  dgRNA
  Ttc9b
agaacaactagaccc

SEQ ID NO: 44133 - DNA, 15 bp, Artificial Sequence
  dgRNA
  Ttc9b
gtttgagggtgagcg

SEQ ID NO: 44134 - DNA, 15 bp, Artificial Sequence
  dgRNA
  Ttc9b
tttgagggtgagcga

SEQ ID NO: 44135 - DNA, 15 bp, Artificial Sequence
  dgRNA
  Ttc9b
gagcgagggggagtt

SEQ ID NO: 44136 - DNA, 15 bp, Artificial Sequence
  dgRNA
  Sf3a3
tcaacctcagcctac

SEQ ID NO: 44137 - DNA, 15 bp, Artificial Sequence
  dgRNA
  Sf3a3
agccagctttcaacg

SEQ ID NO: 44138 - DNA, 15 bp, Artificial Sequence
  dgRNA
  Sf3a3
cagctttcaacgcgg

SEQ ID NO: 44139 - DNA, 15 bp, Artificial Sequence
  dgRNA
  Sf3a3
ggggaagcgtagcca

SEQ ID NO: 44140 - DNA, 15 bp, Artificial Sequence
  dgRNA
  Carf
cttaaattgtgtgag

SEQ ID NO: 44141 - DNA, 15 bp, Artificial Sequence
  dgRNA
  Carf
tgagaggccatagta

SEQ ID NO: 44142 - DNA, 15 bp, Artificial Sequence
  dgRNA
  Carf
attgtccagttgacc

SEQ ID NO: 44143 - DNA, 15 bp, Artificial Sequence
  dgRNA
  Carf
accagaatgcattta

SEQ ID NO: 44144 - DNA, 15 bp, Artificial Sequence
  dgRNA
  Sgf29
ttcacatgcgaagcg

SEQ ID NO: 44145 - DNA, 15 bp, Artificial Sequence
  dgRNA
  Sgf29
cgcttcgcatgtgaa

SEQ ID NO: 44146 - DNA, 15 bp, Artificial Sequence
  dgRNA
  Sgf29
gctgcattgcactct

SEQ ID NO: 44147 - DNA, 15 bp, Artificial Sequence
  dgRNA
  Sgf29
tgctgcattgcactc

SEQ ID NO: 44148 - DNA, 15 bp, Artificial Sequence
  dgRNA
  0610037L13Rik
gaaaacagccgagcc

SEQ ID NO: 44149 - DNA, 15 bp, Artificial Sequence
  dgRNA
  0610037L13Rik
acagccgagcccggc

SEQ ID NO: 44150 - DNA, 15 bp, Artificial Sequence
  dgRNA
  0610037L13Rik
gagcccggcaggtta

SEQ ID NO: 44151 - DNA, 15 bp, Artificial Sequence
  dgRNA
  0610037L13Rik
ccggcaggttaagga

SEQ ID NO: 44152 - DNA, 15 bp, Artificial Sequence
  dgRNA
  Calm2
caggcgcggttcccc

SEQ ID NO: 44153 - DNA, 15 bp, Artificial Sequence
  dgRNA
  Calm2
cccccggccttttaa

SEQ ID NO: 44154 - DNA, 15 bp, Artificial Sequence
  dgRNA
  Calm2
ttttaacggcttgcc

SEQ ID NO: 44155 - DNA, 15 bp, Artificial Sequence
  dgRNA
  Calm2
tttaacggcttgcct

SEQ ID NO: 44156 - DNA, 15 bp, Artificial Sequence
  dgRNA
  Cdkl2
gaggtctcctggcgc

SEQ ID NO: 44157 - DNA, 15 bp, Artificial Sequence
  dgRNA
  Cdkl2
ctggcgccggcagaa

SEQ ID NO: 44158 - DNA, 15 bp, Artificial Sequence
  dgRNA
  Cdkl2
caaacttaagaccgt

SEQ ID NO: 44159 - DNA, 15 bp, Artificial Sequence
  dgRNA
  Cdkl2
ttaagaccgtaggtg

SEQ ID NO: 44160 - DNA, 15 bp, Artificial Sequence
  dgRNA
  Trappc5
aaaaaatcacgtgtc

SEQ ID NO: 44161 - DNA, 15 bp, Artificial Sequence
  dgRNA
  Trappc5
aaaaatcacgtgtca

SEQ ID NO: 44162 - DNA, 15 bp, Artificial Sequence
  dgRNA
  Trappc5
gaagatacgtgcccg

SEQ ID NO: 44163 - DNA, 15 bp, Artificial Sequence
  dgRNA
  Trappc5
aagatacgtgcccga

SEQ ID NO: 44164 - DNA, 15 bp, Artificial Sequence
  dgRNA
  Pgbd5
ccggggctatggccg

SEQ ID NO: 44165 - DNA, 15 bp, Artificial Sequence
  dgRNA
  Pgbd5
ggctatggccgaggg

SEQ ID NO: 44166 - DNA, 15 bp, Artificial Sequence
  dgRNA
  Pgbd5
tatggccgagggcgg

SEQ ID NO: 44167 - DNA, 15 bp, Artificial Sequence
  dgRNA
  Pgbd5
atggccgagggcggt

SEQ ID NO: 44168 - DNA, 15 bp, Artificial Sequence
  dgRNA
  Cd84
gttatggtacagttg

SEQ ID NO: 44169 - DNA, 15 bp, Artificial Sequence
  dgRNA
  Cd84
gtgcttggactacta

SEQ ID NO: 44170 - DNA, 15 bp, Artificial Sequence
  dgRNA
  Cd84
cggctcatttactgc

SEQ ID NO: 44171 - DNA, 15 bp, Artificial Sequence
  dgRNA
  Cd84
cccgtgttccttttc

SEQ ID NO: 44172 - DNA, 15 bp, Artificial Sequence
  dgRNA
  Sp3
gaacctacggcgcca

SEQ ID NO: 44173 - DNA, 15 bp, Artificial Sequence
  dgRNA
  Sp3
ctccccttcaacccg

SEQ ID NO: 44174 - DNA, 15 bp, Artificial Sequence
  dgRNA
  Sp3
tccccttcaacccgg

SEQ ID NO: 44175 - DNA, 15 bp, Artificial Sequence
  dgRNA
  Sp3
aacccgggggcaaac

SEQ ID NO: 44176 - DNA, 15 bp, Artificial Sequence
  dgRNA
  Bmi1
gactccgagccattt

SEQ ID NO: 44177 - DNA, 15 bp, Artificial Sequence
  dgRNA
  Bmi1
gcccgcaagcacact

SEQ ID NO: 44178 - DNA, 15 bp, Artificial Sequence
  dgRNA
  Bmi1
aaaatgcacggctga

SEQ ID NO: 44179 - DNA, 15 bp, Artificial Sequence
  dgRNA
  Bmi1
tgcgggccgggtggc

SEQ ID NO: 44180 - DNA, 15 bp, Artificial Sequence
  dgRNA
  Nr1h3
ttggtgtcgcaattc

SEQ ID NO: 44181 - DNA, 15 bp, Artificial Sequence
  dgRNA
  Nr1h3
tggtgtcgcaattcc

SEQ ID NO: 44182 - DNA, 15 bp, Artificial Sequence
  dgRNA
  Nr1h3
aattccgggccgtgc

SEQ ID NO: 44183 - DNA, 15 bp, Artificial Sequence
  dgRNA
  Nr1h3
attccgggccgtgcc

SEQ ID NO: 44184 - DNA, 15 bp, Artificial Sequence
  dgRNA
  Elf3
gggcccaaccccaga

SEQ ID NO: 44185 - DNA, 15 bp, Artificial Sequence
  dgRNA
  Elf3
ccgcctgctaggatc

SEQ ID NO: 44186 - DNA, 15 bp, Artificial Sequence
  dgRNA
  Elf3
cgcctgctaggatct

SEQ ID NO: 44187 - DNA, 15 bp, Artificial Sequence
  dgRNA
  Elf3
gcgggaacattgcag

SEQ ID NO: 44188 - DNA, 15 bp, Artificial Sequence
  dgRNA
  Mecp2
caatccgcagctgaa

SEQ ID NO: 44189 - DNA, 15 bp, Artificial Sequence
  dgRNA
  Mecp2
aatccgcagctgaat

SEQ ID NO: 44190 - DNA, 15 bp, Artificial Sequence
  dgRNA
  Mecp2
atccgcagctgaatg

SEQ ID NO: 44191 - DNA, 15 bp, Artificial Sequence
  dgRNA
  Mecp2
agggcgtcaccgcta

SEQ ID NO: 44192 - DNA, 15 bp, Artificial Sequence
  dgRNA
  Cgnl1
ctgcgggtgggaacg

SEQ ID NO: 44193 - DNA, 15 bp, Artificial Sequence
  dgRNA
  Cgnl1
aacggggtgctggta

SEQ ID NO: 44194 - DNA, 15 bp, Artificial Sequence
  dgRNA
  Cgnl1
acggggtgctggtat

SEQ ID NO: 44195 - DNA, 15 bp, Artificial Sequence
  dgRNA
  Cgnl1
tgctggtatgggcgc

SEQ ID NO: 44196 - DNA, 15 bp, Artificial Sequence
  dgRNA
  Fuom
cacggatgcttctta

SEQ ID NO: 44197 - DNA, 15 bp, Artificial Sequence
  dgRNA
  Fuom
ttcccgcaatctgcc

SEQ ID NO: 44198 - DNA, 15 bp, Artificial Sequence
  dgRNA
  Fuom
cagttacccagctgt

SEQ ID NO: 44199 - DNA, 15 bp, Artificial Sequence
  dgRNA
  Fuom
agttacccagctgtt

SEQ ID NO: 44200 - DNA, 15 bp, Artificial Sequence
  dgRNA
  Il10ra
gttcccaagctccgt

SEQ ID NO: 44201 - DNA, 15 bp, Artificial Sequence
  dgRNA
  Il10ra
tccgtgggctgaggg

SEQ ID NO: 44202 - DNA, 15 bp, Artificial Sequence
  dgRNA
  Il10ra
cgaggctccgccttc

SEQ ID NO: 44203 - DNA, 15 bp, Artificial Sequence
  dgRNA
  Il10ra
aggttgatgtcaagc

SEQ ID NO: 44204 - DNA, 15 bp, Artificial Sequence
  dgRNA
  Gpr165
gcgggggttgagtcg

SEQ ID NO: 44205 - DNA, 15 bp, Artificial Sequence
  dgRNA
  Gpr165
gtcgaggctccccat

SEQ ID NO: 44206 - DNA, 15 bp, Artificial Sequence
  dgRNA
  Gpr165
ccattggctccagcg

SEQ ID NO: 44207 - DNA, 15 bp, Artificial Sequence
  dgRNA
  Gpr165
cattggctccagcgc

SEQ ID NO: 44208 - DNA, 15 bp, Artificial Sequence
  dgRNA
  Tcp11l2
tcacccgctgcactt

SEQ ID NO: 44209 - DNA, 15 bp, Artificial Sequence
  dgRNA
  Tcp11l2
cgcccttacacagcc

SEQ ID NO: 44210 - DNA, 15 bp, Artificial Sequence
  dgRNA
  Tcp11l2
gcctccgaacgcttt

SEQ ID NO: 44211 - DNA, 15 bp, Artificial Sequence
  dgRNA
  Tcp11l2
ggcgctcccggccgt

SEQ ID NO: 44212 - DNA, 15 bp, Artificial Sequence
  dgRNA
  Napa
agttccgccgaggcg

SEQ ID NO: 44213 - DNA, 15 bp, Artificial Sequence
  dgRNA
  Napa
tcaaaggtcgcgctt

SEQ ID NO: 44214 - DNA, 15 bp, Artificial Sequence
  dgRNA
  Napa
caaaggtcgcgcttt

SEQ ID NO: 44215 - DNA, 15 bp, Artificial Sequence
  dgRNA
  Napa
aaaggtcgcgctttg

SEQ ID NO: 44216 - DNA, 15 bp, Artificial Sequence
  dgRNA
  Fkbp1a
aagcagacgaaacag

SEQ ID NO: 44217 - DNA, 15 bp, Artificial Sequence
  dgRNA
  Trnt1
gcgtgctgacgtcac

SEQ ID NO: 44218 - DNA, 15 bp, Artificial Sequence
  dgRNA
  Trnt1
cactggtccgcgacc

SEQ ID NO: 44219 - DNA, 15 bp, Artificial Sequence
  dgRNA
  Camk1d
tgccattaaatatgc

SEQ ID NO: 44220 - DNA, 15 bp, Artificial Sequence
  dgRNA
  Camk1d
aaatcgtgttaccta

SEQ ID NO: 44221 - DNA, 15 bp, Artificial Sequence
  dgRNA
  Camk1d
taaggactgcactcc

SEQ ID NO: 44222 - DNA, 15 bp, Artificial Sequence
  dgRNA
  Camk1d
aaaatgggcggtctg

SEQ ID NO: 44223 - DNA, 15 bp, Artificial Sequence
  dgRNA
  Cers3
ttccgagttgctcta

SEQ ID NO: 44224 - DNA, 15 bp, Artificial Sequence
  dgRNA
  Cers3
atgcccgtgtaccct

SEQ ID NO: 44225 - DNA, 15 bp, Artificial Sequence
  dgRNA
  Cers3
cccgtgtaccctagg

SEQ ID NO: 44226 - DNA, 15 bp, Artificial Sequence
  dgRNA
  Cers3
taccctaggcggtgc

SEQ ID NO: 44227 - DNA, 15 bp, Artificial Sequence
  dgRNA
  Olfr360
taatgctgaaggtta

SEQ ID NO: 44228 - DNA, 15 bp, Artificial Sequence
  dgRNA
  Olfr360
caaccaaagtaagta

SEQ ID NO: 44229 - DNA, 15 bp, Artificial Sequence
  dgRNA
  Olfr360
taaccttcagcatta

SEQ ID NO: 44230 - DNA, 15 bp, Artificial Sequence
  dgRNA
  Olfr360
aagtgagttagtcat

SEQ ID NO: 44231 - DNA, 15 bp, Artificial Sequence
  dgRNA
  Tspan8
atttacttgagagcc

SEQ ID NO: 44232 - DNA, 15 bp, Artificial Sequence
  dgRNA
  Tspan8
gcagccgatttccgc

SEQ ID NO: 44233 - DNA, 15 bp, Artificial Sequence
  dgRNA
  Tspan8
cagccgatttccgca

SEQ ID NO: 44234 - DNA, 15 bp, Artificial Sequence
  dgRNA
  Tspan8
ggctctcaagtaaat

SEQ ID NO: 44235 - DNA, 15 bp, Artificial Sequence
  dgRNA
  Ttc5
agttctggattaagt

SEQ ID NO: 44236 - DNA, 15 bp, Artificial Sequence
  dgRNA
  Ttc5
gttctggattaagtt

SEQ ID NO: 44237 - DNA, 15 bp, Artificial Sequence
  dgRNA
  Ttc5
ctctgaggcgcagat

SEQ ID NO: 44238 - DNA, 15 bp, Artificial Sequence
  dgRNA
  Ttc5
gtttcagcgtaggca

SEQ ID NO: 44239 - DNA, 15 bp, Artificial Sequence
  dgRNA
  Gabrr3
caacaagcagcattg

SEQ ID NO: 44240 - DNA, 15 bp, Artificial Sequence
  dgRNA
  Gabrr3
attggcatcactcac

SEQ ID NO: 44241 - DNA, 15 bp, Artificial Sequence
  dgRNA
  Pnkd
gtctgtacttagcct

SEQ ID NO: 44242 - DNA, 15 bp, Artificial Sequence
  dgRNA
  Pnkd
ttcgcagcgcgtgcc

SEQ ID NO: 44243 - DNA, 15 bp, Artificial Sequence
  dgRNA
  Pnkd
gtgccaggccgtagc

SEQ ID NO: 44244 - DNA, 15 bp, Artificial Sequence
  dgRNA
  Pnkd
aggccgtagctggcg

SEQ ID NO: 44245 - DNA, 15 bp, Artificial Sequence
  dgRNA
  Fam104a
aacaggcggctgccc

SEQ ID NO: 44246 - DNA, 15 bp, Artificial Sequence
  dgRNA
  Fam104a
ccccggacacctaaa

SEQ ID NO: 44247 - DNA, 15 bp, Artificial Sequence
  dgRNA
  Fam104a
cccggacacctaaac

SEQ ID NO: 44248 - DNA, 15 bp, Artificial Sequence
  dgRNA
  Fam104a
ccggacacctaaacg

SEQ ID NO: 44249 - DNA, 15 bp, Artificial Sequence
  dgRNA
  Rnf152
gtgctcgctggtcta

SEQ ID NO: 44250 - DNA, 15 bp, Artificial Sequence
  dgRNA
  Rnf152
ctcgctggtctacgg

SEQ ID NO: 44251 - DNA, 15 bp, Artificial Sequence
  dgRNA
  Rnf152
tcgctggtctacggt

SEQ ID NO: 44252 - DNA, 15 bp, Artificial Sequence
  dgRNA
  Rnf152
gtctacggtgggtag

SEQ ID NO: 44253 - DNA, 15 bp, Artificial Sequence
  dgRNA
  Cd163
gtgttccaaagtggg

SEQ ID NO: 44254 - DNA, 15 bp, Artificial Sequence
  dgRNA
  Khnyn
gttggcaggaggcgt

SEQ ID NO: 44255 - DNA, 15 bp, Artificial Sequence
  dgRNA
  Khnyn
tgtctgtgacccggt

SEQ ID NO: 44256 - DNA, 15 bp, Artificial Sequence
  dgRNA
  Khnyn
cccggtaggccccgc

SEQ ID NO: 44257 - DNA, 15 bp, Artificial Sequence
  dgRNA
  Khnyn
ccggtaggccccgca

SEQ ID NO: 44258 - DNA, 15 bp, Artificial Sequence
  dgRNA
  Phf1
agtggccgtgtgccc

SEQ ID NO: 44259 - DNA, 15 bp, Artificial Sequence
  dgRNA
  Phf1
ccgtgtgcccaggtg

SEQ ID NO: 44260 - DNA, 15 bp, Artificial Sequence
  dgRNA
  Phf1
ccaggtgcggcgcac

SEQ ID NO: 44261 - DNA, 15 bp, Artificial Sequence
  dgRNA
  Phf1
ggtgcggcgcacagg

SEQ ID NO: 44262 - DNA, 15 bp, Artificial Sequence
  dgRNA
  Mbnl1
gtccgcgcgccttcc

SEQ ID NO: 44263 - DNA, 15 bp, Artificial Sequence
  dgRNA
  Mbnl1
cgcgcgccttcctgg

SEQ ID NO: 44264 - DNA, 15 bp, Artificial Sequence
  dgRNA
  Mbnl1
gcgcgccttcctggc

SEQ ID NO: 44265 - DNA, 15 bp, Artificial Sequence
  dgRNA
  Mbnl1
cgcgccttcctggcg

SEQ ID NO: 44266 - DNA, 15 bp, Artificial Sequence
  dgRNA
  Lcn6
tgccattggttgagc

SEQ ID NO: 44267 - DNA, 15 bp, Artificial Sequence
  dgRNA
  Lcn6
gccattggttgagct

SEQ ID NO: 44268 - DNA, 15 bp, Artificial Sequence
  dgRNA
  Lcn6
ccaccctgagtaatt

SEQ ID NO: 44269 - DNA, 15 bp, Artificial Sequence
  dgRNA
  Lcn6
ggataatgtcaagac

SEQ ID NO: 44270 - DNA, 15 bp, Artificial Sequence
  dgRNA
  D730048I06Rik
gatggtaagattacc

SEQ ID NO: 44271 - DNA, 15 bp, Artificial Sequence
  dgRNA
  D730048I06Rik
gatacatgactcacc

SEQ ID NO: 44272 - DNA, 15 bp, Artificial Sequence
  dgRNA
  Olfr769
tttcatttgaaacgt

SEQ ID NO: 44273 - DNA, 15 bp, Artificial Sequence
  dgRNA
  C1qbp
cgcggtaacaaagct

SEQ ID NO: 44274 - DNA, 15 bp, Artificial Sequence
  dgRNA
  C1qbp
cctccccgactgcac

SEQ ID NO: 44275 - DNA, 15 bp, Artificial Sequence
  dgRNA
  C1qbp
ccccgactgcactgg

SEQ ID NO: 44276 - DNA, 15 bp, Artificial Sequence
  dgRNA
  C1qbp
gcagagggcgcggtc

SEQ ID NO: 44277 - DNA, 15 bp, Artificial Sequence
  dgRNA
  Sumf2
cacattggacctgca

SEQ ID NO: 44278 - DNA, 15 bp, Artificial Sequence
  dgRNA
  Sumf2
atgggcgggcctgac

SEQ ID NO: 44279 - DNA, 15 bp, Artificial Sequence
  dgRNA
  Sumf2
ggagcgccctgccat

SEQ ID NO: 44280 - DNA, 15 bp, Artificial Sequence
  dgRNA
  Sumf2
tcagtgcgagtgcgc

SEQ ID NO: 44281 - DNA, 15 bp, Artificial Sequence
  dgRNA
  Dctn2
actattaagaacgaa

SEQ ID NO: 44282 - DNA, 15 bp, Artificial Sequence
  dgRNA
  Dctn2
ttaatagtctatgaa

SEQ ID NO: 44283 - DNA, 15 bp, Artificial Sequence
  dgRNA
  Dctn2
acaataacaacgtta

SEQ ID NO: 44284 - DNA, 15 bp, Artificial Sequence
  dgRNA
  Dctn2
gacaataacaacgtt

SEQ ID NO: 44285 - DNA, 15 bp, Artificial Sequence
  dgRNA
  Tmem161b
gcccctgcgttctca

SEQ ID NO: 44286 - DNA, 15 bp, Artificial Sequence
  dgRNA
  Tmem161b
ttagagaacgccttg

SEQ ID NO: 44287 - DNA, 15 bp, Artificial Sequence
  dgRNA
  Tmem161b
cctctctgcgtggcg

SEQ ID NO: 44288 - DNA, 15 bp, Artificial Sequence
  dgRNA
  Tmem161b
ctctctgcgtggcgt

SEQ ID NO: 44289 - DNA, 15 bp, Artificial Sequence
  dgRNA
  Pqbp1
gagcgtactcctcca

SEQ ID NO: 44290 - DNA, 15 bp, Artificial Sequence
  dgRNA
  Pqbp1
catggcgccagagtc

SEQ ID NO: 44291 - DNA, 15 bp, Artificial Sequence
  dgRNA
  Pqbp1
cgccagagtccggcc

SEQ ID NO: 44292 - DNA, 15 bp, Artificial Sequence
  dgRNA
  Pqbp1
ccggcctggcgcagt

SEQ ID NO: 44293 - DNA, 15 bp, Artificial Sequence
  dgRNA
  Mon2
atcacaaacagacgt

SEQ ID NO: 44294 - DNA, 15 bp, Artificial Sequence
  dgRNA
  Mon2
tcacaaacagacgta

SEQ ID NO: 44295 - DNA, 15 bp, Artificial Sequence
  dgRNA
  Mon2
cctccgatcatcccc

SEQ ID NO: 44296 - DNA, 15 bp, Artificial Sequence
  dgRNA
  Mon2
cctgcgcagctgtgc

SEQ ID NO: 44297 - DNA, 15 bp, Artificial Sequence
  dgRNA
  Slc6a8
gctggccagcgcccc

SEQ ID NO: 44298 - DNA, 15 bp, Artificial Sequence
  dgRNA
  Slc6a8
catcctgctcccaac

SEQ ID NO: 44299 - DNA, 15 bp, Artificial Sequence
  dgRNA
  Slc6a8
cagcgtctcctctag

SEQ ID NO: 44300 - DNA, 15 bp, Artificial Sequence
  dgRNA
  Slc6a8
cgtctcctctagagg

SEQ ID NO: 44301 - DNA, 15 bp, Artificial Sequence
  dgRNA
  Gm11563
tagctgagtataaaa

SEQ ID NO: 44302 - DNA, 15 bp, Artificial Sequence
  dgRNA
  Gm11563
aatctactaatatgt

SEQ ID NO: 44303 - DNA, 15 bp, Artificial Sequence
  dgRNA
  Shisa3
gtcaccgccaaggcc

SEQ ID NO: 44304 - DNA, 15 bp, Artificial Sequence
  dgRNA
  Shisa3
tcaccgccaaggccc

SEQ ID NO: 44305 - DNA, 15 bp, Artificial Sequence
  dgRNA
  Shisa3
caccgccaaggcccg

SEQ ID NO: 44306 - DNA, 15 bp, Artificial Sequence
  dgRNA
  Shisa3
cccggggtagcgccg

SEQ ID NO: 44307 - DNA, 15 bp, Artificial Sequence
  dgRNA
  Gsta3
actctttagcaactc

SEQ ID NO: 44308 - DNA, 15 bp, Artificial Sequence
  dgRNA
  Gsta3
tagcttttcccttat

SEQ ID NO: 44309 - DNA, 15 bp, Artificial Sequence
  dgRNA
  Gsta3
ttgtctccccttaac

SEQ ID NO: 44310 - DNA, 15 bp, Artificial Sequence
  dgRNA
  Gsta3
tgtctccccttaact

SEQ ID NO: 44311 - DNA, 15 bp, Artificial Sequence
  dgRNA
  Cmip
gtattgacatgaagc

SEQ ID NO: 44312 - DNA, 15 bp, Artificial Sequence
  dgRNA
  Cmip
aacctgaactttatt

SEQ ID NO: 44313 - DNA, 15 bp, Artificial Sequence
  dgRNA
  Cmip
gttctgggtaaccac

SEQ ID NO: 44314 - DNA, 15 bp, Artificial Sequence
  dgRNA
  Cmip
tgtgggcaaacgcca

SEQ ID NO: 44315 - DNA, 15 bp, Artificial Sequence
  dgRNA
  Xiap
ttaaaagtcctgacg

SEQ ID NO: 44316 - DNA, 15 bp, Artificial Sequence
  dgRNA
  Xiap
tgacgtggatgcact

SEQ ID NO: 44317 - DNA, 15 bp, Artificial Sequence
  dgRNA
  Xiap
tcgagttttatccga

SEQ ID NO: 44318 - DNA, 15 bp, Artificial Sequence
  dgRNA
  Xiap
cgagttttatccgat

SEQ ID NO: 44319 - DNA, 15 bp, Artificial Sequence
  dgRNA
  Slc35d1
tgtcccggctgctcc

SEQ ID NO: 44320 - DNA, 15 bp, Artificial Sequence
  dgRNA
  Slc35d1
tcccggagcccatgc

SEQ ID NO: 44321 - DNA, 15 bp, Artificial Sequence
  dgRNA
  Slc35d1
ccgccgagccagccc

SEQ ID NO: 44322 - DNA, 15 bp, Artificial Sequence
  dgRNA
  Slc35d1
ttccctgaccccgcg

SEQ ID NO: 44323 - DNA, 15 bp, Artificial Sequence
  dgRNA
  Triobp
ctgcgaaccgccggc

SEQ ID NO: 44324 - DNA, 15 bp, Artificial Sequence
  dgRNA
  Triobp
gccggccggagagcc

SEQ ID NO: 44325 - DNA, 15 bp, Artificial Sequence
  dgRNA
  Triobp
cccgccccgtcgtac

SEQ ID NO: 44326 - DNA, 15 bp, Artificial Sequence
  dgRNA
  Triobp
ggccctcgctcccat

SEQ ID NO: 44327 - DNA, 15 bp, Artificial Sequence
  dgRNA
  Ccdc68
ctagatcctttctcc

SEQ ID NO: 44328 - DNA, 15 bp, Artificial Sequence
  dgRNA
  Ccdc68
tgggacaggcgcctt

SEQ ID NO: 44329 - DNA, 15 bp, Artificial Sequence
  dgRNA
  Ccdc68
gggacaggcgcctta

SEQ ID NO: 44330 - DNA, 15 bp, Artificial Sequence
  dgRNA
  Ccdc68
acaggcgccttaggg

SEQ ID NO: 44331 - DNA, 15 bp, Artificial Sequence
  dgRNA
  Gm5938
catacttcatttacc

SEQ ID NO: 44332 - DNA, 15 bp, Artificial Sequence
  dgRNA
  Kpnb1
tcaacgctagccgtc

SEQ ID NO: 44333 - DNA, 15 bp, Artificial Sequence
  dgRNA
  Kpnb1
agccgtccggccaat

SEQ ID NO: 44334 - DNA, 15 bp, Artificial Sequence
  dgRNA
  Kpnb1
gccgtccggccaatc

SEQ ID NO: 44335 - DNA, 15 bp, Artificial Sequence
  dgRNA
  Kpnb1
ccgtccggccaatcg

SEQ ID NO: 44336 - DNA, 15 bp, Artificial Sequence
  dgRNA
  4930451I11Rik
ccttggggctcaatg

SEQ ID NO: 44337 - DNA, 15 bp, Artificial Sequence
  dgRNA
  4930451I11Rik
cttggggctcaatgg

SEQ ID NO: 44338 - DNA, 15 bp, Artificial Sequence
  dgRNA
  4930451I11Rik
gaagcacctcatagt

SEQ ID NO: 44339 - DNA, 15 bp, Artificial Sequence
  dgRNA
  4930451I11Rik
aagcacctcatagtc

SEQ ID NO: 44340 - DNA, 15 bp, Artificial Sequence
  dgRNA
  Dnajb5
gctgagacggaatca

SEQ ID NO: 44341 - DNA, 15 bp, Artificial Sequence
  dgRNA
  Dnajb5
gacggaatcatggaa

SEQ ID NO: 44342 - DNA, 15 bp, Artificial Sequence
  dgRNA
  Dnajb5
ggttcatgtcagaac

SEQ ID NO: 44343 - DNA, 15 bp, Artificial Sequence
  dgRNA
  Dnajb5
ggcatgacctgctga

SEQ ID NO: 44344 - DNA, 15 bp, Artificial Sequence
  dgRNA
  Wdr1
aagtcttttgcaagc

SEQ ID NO: 44345 - DNA, 15 bp, Artificial Sequence
  dgRNA
  Wdr1
gtcttttgcaagccg

SEQ ID NO: 44346 - DNA, 15 bp, Artificial Sequence
  dgRNA
  Wdr1
gccggggcgccaagc

SEQ ID NO: 44347 - DNA, 15 bp, Artificial Sequence
  dgRNA
  Wdr1
gcgccaagctggcgt

SEQ ID NO: 44348 - DNA, 15 bp, Artificial Sequence
  dgRNA
  Ehmt1
tgaatttcagcgcgc

SEQ ID NO: 44349 - DNA, 15 bp, Artificial Sequence
  dgRNA
  Ehmt1
cgcgcaggcgccacc

SEQ ID NO: 44350 - DNA, 15 bp, Artificial Sequence
  dgRNA
  Ehmt1
ctcgcctccagacgc

SEQ ID NO: 44351 - DNA, 15 bp, Artificial Sequence
  dgRNA
  Ehmt1
gacgcaggcgccgca

SEQ ID NO: 44352 - DNA, 15 bp, Artificial Sequence
  dgRNA
  Asxl1
cggaaaacaggagcc

SEQ ID NO: 44353 - DNA, 15 bp, Artificial Sequence
  dgRNA
  Asxl1
gagcccggggcactc

SEQ ID NO: 44354 - DNA, 15 bp, Artificial Sequence
  dgRNA
  Asxl1
agcccggggcactcc

SEQ ID NO: 44355 - DNA, 15 bp, Artificial Sequence
  dgRNA
  Asxl1
gcactccgggaaatg

SEQ ID NO: 44356 - DNA, 15 bp, Artificial Sequence
  dgRNA
  Slc5a12
taaaagcatgccatc

SEQ ID NO: 44357 - DNA, 15 bp, Artificial Sequence
  dgRNA
  Slc5a12
tacctataattgcca

SEQ ID NO: 44358 - DNA, 15 bp, Artificial Sequence
  dgRNA
  Slc5a12
atacctataattgcc

SEQ ID NO: 44359 - DNA, 15 bp, Artificial Sequence
  dgRNA
  Slc5a12
tattaggaaccatgg

SEQ ID NO: 44360 - DNA, 15 bp, Artificial Sequence
  dgRNA
  Dnaaf1
ccagggacggaagcg

SEQ ID NO: 44361 - DNA, 15 bp, Artificial Sequence
  dgRNA
  Dnaaf1
cggaagcggggcgcg

SEQ ID NO: 44362 - DNA, 15 bp, Artificial Sequence
  dgRNA
  Dnaaf1
ggaagcggggcgcga

SEQ ID NO: 44363 - DNA, 15 bp, Artificial Sequence
  dgRNA
  Dnaaf1
gaagcggggcgcgag

SEQ ID NO: 44364 - DNA, 15 bp, Artificial Sequence
  dgRNA
  Cd276
tgggtcttcccccgt

SEQ ID NO: 44365 - DNA, 15 bp, Artificial Sequence
  dgRNA
  Cd276
gggtcttcccccgtc

SEQ ID NO: 44366 - DNA, 15 bp, Artificial Sequence
  dgRNA
  Cd276
ggtcttcccccgtcg

SEQ ID NO: 44367 - DNA, 15 bp, Artificial Sequence
  dgRNA
  Cd276
cgtcggggtccaaca

SEQ ID NO: 44368 - DNA, 15 bp, Artificial Sequence
  dgRNA
  Hist1h2bn
gcccttgctatgatt

SEQ ID NO: 44369 - DNA, 15 bp, Artificial Sequence
  dgRNA
  Hist1h2bn
ctatgattgggtatt

SEQ ID NO: 44370 - DNA, 15 bp, Artificial Sequence
  dgRNA
  Hist1h2bn
atgcaactctgttat

SEQ ID NO: 44371 - DNA, 15 bp, Artificial Sequence
  dgRNA
  Psap
tctagagtgacactt

SEQ ID NO: 44372 - DNA, 15 bp, Artificial Sequence
  dgRNA
  Psap
taggttgtaggaccc

SEQ ID NO: 44373 - DNA, 15 bp, Artificial Sequence
  dgRNA
  Psap
gaactagctataatt

SEQ ID NO: 44374 - DNA, 15 bp, Artificial Sequence
  dgRNA
  Psap
aactagctataattt

SEQ ID NO: 44375 - DNA, 15 bp, Artificial Sequence
  dgRNA
  Ada
ctgaaggggcccgga

SEQ ID NO: 44376 - DNA, 15 bp, Artificial Sequence
  dgRNA
  Ada
tgaaggggcccggaa

SEQ ID NO: 44377 - DNA, 15 bp, Artificial Sequence
  dgRNA
  Ada
tggagtcgcgtctgc

SEQ ID NO: 44378 - DNA, 15 bp, Artificial Sequence
  dgRNA
  Ada
ggagtcgcgtctgca

SEQ ID NO: 44379 - DNA, 15 bp, Artificial Sequence
  dgRNA
  Ccdc166
ctagagctacgcacc

SEQ ID NO: 44380 - DNA, 15 bp, Artificial Sequence
  dgRNA
  Ccdc166
ctggtgcgtagctct

SEQ ID NO: 44381 - DNA, 15 bp, Artificial Sequence
  dgRNA
  Szrd1
agaccaggcgagtgg

SEQ ID NO: 44382 - DNA, 15 bp, Artificial Sequence
  dgRNA
  Szrd1
gccgggcgcctcttc

SEQ ID NO: 44383 - DNA, 15 bp, Artificial Sequence
  dgRNA
  Szrd1
ccgggcgcctcttcc

SEQ ID NO: 44384 - DNA, 15 bp, Artificial Sequence
  dgRNA
  Szrd1
cgcctcttccgggct

SEQ ID NO: 44385 - DNA, 15 bp, Artificial Sequence
  dgRNA
  Ak8
gctccacaggcgttc

SEQ ID NO: 44386 - DNA, 15 bp, Artificial Sequence
  dgRNA
  Ak8
ctccacaggcgttct

SEQ ID NO: 44387 - DNA, 15 bp, Artificial Sequence
  dgRNA
  Ak8
tccacaggcgttctg

SEQ ID NO: 44388 - DNA, 15 bp, Artificial Sequence
  dgRNA
  Ak8
agccgactgcagatc

SEQ ID NO: 44389 - DNA, 15 bp, Artificial Sequence
  dgRNA
  Vmn2r78
tgtaatagtaactac

SEQ ID NO: 44390 - DNA, 15 bp, Artificial Sequence
  dgRNA
  Tjp3
gtaagttgcagcgcg

SEQ ID NO: 44391 - DNA, 15 bp, Artificial Sequence
  dgRNA
  Tjp3
gcccattcatcccgt

SEQ ID NO: 44392 - DNA, 15 bp, Artificial Sequence
  dgRNA
  Tjp3
ctagctaggcctctc

SEQ ID NO: 44393 - DNA, 15 bp, Artificial Sequence
  dgRNA
  Tjp3
gggttaaggcctgtc

SEQ ID NO: 44394 - DNA, 15 bp, Artificial Sequence
  dgRNA
  Qars
cattttgggcattca

SEQ ID NO: 44395 - DNA, 15 bp, Artificial Sequence
  dgRNA
  Qars
catgggaagggcgat

SEQ ID NO: 44396 - DNA, 15 bp, Artificial Sequence
  dgRNA
  Qars
tgctagtgttctgac

SEQ ID NO: 44397 - DNA, 15 bp, Artificial Sequence
  dgRNA
  Qars
gttctgacagggtcc

SEQ ID NO: 44398 - DNA, 15 bp, Artificial Sequence
  dgRNA
  Gcc1
ccccctgtcgctcac

SEQ ID NO: 44399 - DNA, 15 bp, Artificial Sequence
  dgRNA
  Gcc1
ctggtggtagcttga

SEQ ID NO: 44400 - DNA, 15 bp, Artificial Sequence
  dgRNA
  Gcc1
tctagacttacctac

SEQ ID NO: 44401 - DNA, 15 bp, Artificial Sequence
  dgRNA
  Gcc1
ggttactccctctcc

SEQ ID NO: 44402 - DNA, 15 bp, Artificial Sequence
  dgRNA
  Jmjd8
tttccctccgccttg

SEQ ID NO: 44403 - DNA, 15 bp, Artificial Sequence
  dgRNA
  Jmjd8
gcgcttgtatgaaga

SEQ ID NO: 44404 - DNA, 15 bp, Artificial Sequence
  dgRNA
  Jmjd8
gtagctacagcagtc

SEQ ID NO: 44405 - DNA, 15 bp, Artificial Sequence
  dgRNA
  Jmjd8
cggatgataagccaa

SEQ ID NO: 44406 - DNA, 15 bp, Artificial Sequence
  dgRNA
  Siae
tttttttaactacgg

SEQ ID NO: 44407 - DNA, 15 bp, Artificial Sequence
  dgRNA
  Siae
tttaactacggaggc

SEQ ID NO: 44408 - DNA, 15 bp, Artificial Sequence
  dgRNA
  Siae
actacggaggccggg

SEQ ID NO: 44409 - DNA, 15 bp, Artificial Sequence
  dgRNA
  Siae
ctacggaggccggga

SEQ ID NO: 44410 - DNA, 15 bp, Artificial Sequence
  dgRNA
  Gm11568
attggcccaaacttt

SEQ ID NO: 44411 - DNA, 15 bp, Artificial Sequence
  dgRNA
  Gm11568
gtttactttcctaat

SEQ ID NO: 44412 - DNA, 15 bp, Artificial Sequence
  dgRNA
  Gm11568
gatgccccaaagttt

SEQ ID NO: 44413 - DNA, 15 bp, Artificial Sequence
  dgRNA
  Mocs1
aacacgcttccgtcc

SEQ ID NO: 44414 - DNA, 15 bp, Artificial Sequence
  dgRNA
  Mocs1
cgcttccgtcctgga

SEQ ID NO: 44415 - DNA, 15 bp, Artificial Sequence
  dgRNA
  Mocs1
gcttccgtcctggaa

SEQ ID NO: 44416 - DNA, 15 bp, Artificial Sequence
  dgRNA
  Mocs1
cttccgtcctggaag

SEQ ID NO: 44417 - DNA, 15 bp, Artificial Sequence
  dgRNA
  Vrtn
gctatgtggggggtt

SEQ ID NO: 44418 - DNA, 15 bp, Artificial Sequence
  dgRNA
  Vrtn
ctatgtggggggttc

SEQ ID NO: 44419 - DNA, 15 bp, Artificial Sequence
  dgRNA
  Vrtn
tatgtggggggttcg

SEQ ID NO: 44420 - DNA, 15 bp, Artificial Sequence
  dgRNA
  Vrtn
ttcttcggtgcacct

SEQ ID NO: 44421 - DNA, 15 bp, Artificial Sequence
  dgRNA
  Fbxw9
cattcacacccgcac

SEQ ID NO: 44422 - DNA, 15 bp, Artificial Sequence
  dgRNA
  Fbxw9
caagcaatatctggc

SEQ ID NO: 44423 - DNA, 15 bp, Artificial Sequence
  dgRNA
  Fbxw9
tctgacgtcatctaa

SEQ ID NO: 44424 - DNA, 15 bp, Artificial Sequence
  dgRNA
  Fbxw9
ctgacgtcatctaat

SEQ ID NO: 44425 - DNA, 15 bp, Artificial Sequence
  dgRNA
  Rhox12
atagcagtttcatcc

SEQ ID NO: 44426 - DNA, 15 bp, Artificial Sequence
  dgRNA
  Rhox12
tgaaaccttgtatcc

SEQ ID NO: 44427 - DNA, 15 bp, Artificial Sequence
  dgRNA
  Rhox12
acaaggtttcaatcc

SEQ ID NO: 44428 - DNA, 15 bp, Artificial Sequence
  dgRNA
  Rhox12
gtgaatctggtcaag

SEQ ID NO: 44429 - DNA, 15 bp, Artificial Sequence
  dgRNA
  Vimp
aaacgcgcttccgcc

SEQ ID NO: 44430 - DNA, 15 bp, Artificial Sequence
  dgRNA
  Vimp
aacgcgcttccgcct

SEQ ID NO: 44431 - DNA, 15 bp, Artificial Sequence
  dgRNA
  Vimp
ttcagccccgccctc

SEQ ID NO: 44432 - DNA, 15 bp, Artificial Sequence
  dgRNA
  Vimp
caccccccctgtgat

SEQ ID NO: 44433 - DNA, 15 bp, Artificial Sequence
  dgRNA
  Slc5a8
gcagagcgcgccctg

SEQ ID NO: 44434 - DNA, 15 bp, Artificial Sequence
  dgRNA
  Slc5a8
gccctgtggattcgc

SEQ ID NO: 44435 - DNA, 15 bp, Artificial Sequence
  dgRNA
  Slc5a8
tggattcgctggacg

SEQ ID NO: 44436 - DNA, 15 bp, Artificial Sequence
  dgRNA
  Slc5a8
attcgctggacgcgg

SEQ ID NO: 44437 - DNA, 15 bp, Artificial Sequence
  dgRNA
  Gnb1l
catcagcctccgcgc

SEQ ID NO: 44438 - DNA, 15 bp, Artificial Sequence
  dgRNA
  Gnb1l
tccgcgctggcgcgc

SEQ ID NO: 44439 - DNA, 15 bp, Artificial Sequence
  dgRNA
  Gnb1l
gctggcgcgctggcg

SEQ ID NO: 44440 - DNA, 15 bp, Artificial Sequence
  dgRNA
  Gnb1l
tgaccctctgcgaga

SEQ ID NO: 44441 - DNA, 15 bp, Artificial Sequence
  dgRNA
  Tlk2
cagccctgtcaggcg

SEQ ID NO: 44442 - DNA, 15 bp, Artificial Sequence
  dgRNA
  Tlk2
cgcggcctgttccgc

SEQ ID NO: 44443 - DNA, 15 bp, Artificial Sequence
  dgRNA
  Tlk2
cctgttccgccggtg

SEQ ID NO: 44444 - DNA, 15 bp, Artificial Sequence
  dgRNA
  Tlk2
ctgttccgccggtgc

SEQ ID NO: 44445 - DNA, 15 bp, Artificial Sequence
  dgRNA
  4921536K21Rik
cgccaagtagccaga

SEQ ID NO: 44446 - DNA, 15 bp, Artificial Sequence
  dgRNA
  4921536K21Rik
cacccttcgtctcct

SEQ ID NO: 44447 - DNA, 15 bp, Artificial Sequence
  dgRNA
  4921536K21Rik
ctaaagactgtcacg

SEQ ID NO: 44448 - DNA, 15 bp, Artificial Sequence
  dgRNA
  4921536K21Rik
acgcggtctgcttgc

SEQ ID NO: 44449 - DNA, 15 bp, Artificial Sequence
  dgRNA
  Neurod6
taacagttgcaccat

SEQ ID NO: 44450 - DNA, 15 bp, Artificial Sequence
  dgRNA
  Neurod6
agttgcaccattggc

SEQ ID NO: 44451 - DNA, 15 bp, Artificial Sequence
  dgRNA
  Neurod6
gttgcaccattggca

SEQ ID NO: 44452 - DNA, 15 bp, Artificial Sequence
  dgRNA
  Neurod6
gtttcgccctgccaa

SEQ ID NO: 44453 - DNA, 15 bp, Artificial Sequence
  dgRNA
  Trex2
atagggcgtgtgtcc

SEQ ID NO: 44454 - DNA, 15 bp, Artificial Sequence
  dgRNA
  Trex2
gggcgtgtgtcctgg

SEQ ID NO: 44455 - DNA, 15 bp, Artificial Sequence
  dgRNA
  Trex2
gcaagccggccgcac

SEQ ID NO: 44456 - DNA, 15 bp, Artificial Sequence
  dgRNA
  Trex2
tcctggttgcccaac

SEQ ID NO: 44457 - DNA, 15 bp, Artificial Sequence
  dgRNA
  Hmgxb4
ccgagattgcggaga

SEQ ID NO: 44458 - DNA, 15 bp, Artificial Sequence
  dgRNA
  Hmgxb4
gtcatgaaattttcg

SEQ ID NO: 44459 - DNA, 15 bp, Artificial Sequence
  dgRNA
  Hmgxb4
gtttgtataagcacg

SEQ ID NO: 44460 - DNA, 15 bp, Artificial Sequence
  dgRNA
  Hmgxb4
aatctcggtcctttc

SEQ ID NO: 44461 - DNA, 15 bp, Artificial Sequence
  dgRNA
  Lekr1
tgcccgtcgtccccg

SEQ ID NO: 44462 - DNA, 15 bp, Artificial Sequence
  dgRNA
  Lekr1
gcccgtcgtccccgc

SEQ ID NO: 44463 - DNA, 15 bp, Artificial Sequence
  dgRNA
  Lekr1
cgcctagctcgcttt

SEQ ID NO: 44464 - DNA, 15 bp, Artificial Sequence
  dgRNA
  Lekr1
gcctagctcgctttt

SEQ ID NO: 44465 - DNA, 15 bp, Artificial Sequence
  dgRNA
  Klre1
cagccagtaatagtc

SEQ ID NO: 44466 - DNA, 15 bp, Artificial Sequence
  dgRNA
  Hsh2d
accctgttcacctgc

SEQ ID NO: 44467 - DNA, 15 bp, Artificial Sequence
  dgRNA
  Hsh2d
agctcaagagccctt

SEQ ID NO: 44468 - DNA, 15 bp, Artificial Sequence
  dgRNA
  Hsh2d
tctctaccaactcta

SEQ ID NO: 44469 - DNA, 15 bp, Artificial Sequence
  dgRNA
  Hsh2d
cacgtcagaggggca

SEQ ID NO: 44470 - DNA, 15 bp, Artificial Sequence
  dgRNA
  Hspa2
ttctgcgctgctcat

SEQ ID NO: 44471 - DNA, 15 bp, Artificial Sequence
  dgRNA
  Hspa2
tctgcgctgctcatt

SEQ ID NO: 44472 - DNA, 15 bp, Artificial Sequence
  dgRNA
  Hspa2
atcacgctttagaaa

SEQ ID NO: 44473 - DNA, 15 bp, Artificial Sequence
  dgRNA
  Hspa2
agggggctttcacac

SEQ ID NO: 44474 - DNA, 15 bp, Artificial Sequence
  dgRNA
  Rgl1
tattttgtcacctgg

SEQ ID NO: 44475 - DNA, 15 bp, Artificial Sequence
  dgRNA
  Rgl1
gaaaccccgatgaag

SEQ ID NO: 44476 - DNA, 15 bp, Artificial Sequence
  dgRNA
  Rgl1
tgctcccttgatccg

SEQ ID NO: 44477 - DNA, 15 bp, Artificial Sequence
  dgRNA
  Rgl1
gctcccttgatccgc

SEQ ID NO: 44478 - DNA, 15 bp, Artificial Sequence
  dgRNA
  Nhsl1
gtctacgttctgcac

SEQ ID NO: 44479 - DNA, 15 bp, Artificial Sequence
  dgRNA
  Nhsl1
gctaccactgaagta

SEQ ID NO: 44480 - DNA, 15 bp, Artificial Sequence
  dgRNA
  Nhsl1
ctgaagtacggtctg

SEQ ID NO: 44481 - DNA, 15 bp, Artificial Sequence
  dgRNA
  Nhsl1
aagtacggtctgtgg

SEQ ID NO: 44482 - DNA, 15 bp, Artificial Sequence
  dgRNA
  Myl12a
gtgtttcctcccgcg

SEQ ID NO: 44483 - DNA, 15 bp, Artificial Sequence
  dgRNA
  Myl12a
tgtttcctcccgcgt

SEQ ID NO: 44484 - DNA, 15 bp, Artificial Sequence
  dgRNA
  Myl12a
cctagcttcctgcgc

SEQ ID NO: 44485 - DNA, 15 bp, Artificial Sequence
  dgRNA
  Myl12a
ggcgcgctccagctg

SEQ ID NO: 44486 - DNA, 15 bp, Artificial Sequence
  dgRNA
  Ovol2
attcatgcctaagga

SEQ ID NO: 44487 - DNA, 15 bp, Artificial Sequence
  dgRNA
  Ovol2
ggcagccccggccgc

SEQ ID NO: 44488 - DNA, 15 bp, Artificial Sequence
  dgRNA
  Ovol2
cccggccgccggaac

SEQ ID NO: 44489 - DNA, 15 bp, Artificial Sequence
  dgRNA
  Ovol2
gccgccggaaccggt

SEQ ID NO: 44490 - DNA, 15 bp, Artificial Sequence
  dgRNA
  Acyp1
cattgtatgcaaaac

SEQ ID NO: 44491 - DNA, 15 bp, Artificial Sequence
  dgRNA
  Acyp1
gcgggttcttgaaca

SEQ ID NO: 44492 - DNA, 15 bp, Artificial Sequence
  dgRNA
  Acyp1
ggagccacctctgat

SEQ ID NO: 44493 - DNA, 15 bp, Artificial Sequence
  dgRNA
  Acyp1
tgattggttaaatcg

SEQ ID NO: 44494 - DNA, 15 bp, Artificial Sequence
  dgRNA
  Esd
ggcggggccgtgaga

SEQ ID NO: 44495 - DNA, 15 bp, Artificial Sequence
  dgRNA
  Esd
gcggggccgtgagag

SEQ ID NO: 44496 - DNA, 15 bp, Artificial Sequence
  dgRNA
  Esd
agagtaagcggccaa

SEQ ID NO: 44497 - DNA, 15 bp, Artificial Sequence
  dgRNA
  Esd
gtaagcggccaaagg

SEQ ID NO: 44498 - DNA, 15 bp, Artificial Sequence
  dgRNA
  Defb48
ccaatacaattgata

SEQ ID NO: 44499 - DNA, 15 bp, Artificial Sequence
  dgRNA
  Defb48
gtggcaataatgcaa

SEQ ID NO: 44500 - DNA, 15 bp, Artificial Sequence
  dgRNA
  Defb48
aagtggacataagtg

SEQ ID NO: 44501 - DNA, 15 bp, Artificial Sequence
  dgRNA
  Sel1l
aggccgtggtccaac

SEQ ID NO: 44502 - DNA, 15 bp, Artificial Sequence
  dgRNA
  Sel1l
ggccgtggtccaacc

SEQ ID NO: 44503 - DNA, 15 bp, Artificial Sequence
  dgRNA
  Sel1l
tccaaccgggaaagc

SEQ ID NO: 44504 - DNA, 15 bp, Artificial Sequence
  dgRNA
  Sel1l
gggcgtgactatgtg

SEQ ID NO: 44505 - DNA, 15 bp, Artificial Sequence
  dgRNA
  Mrpl35
cccccataagcacgc

SEQ ID NO: 44506 - DNA, 15 bp, Artificial Sequence
  dgRNA
  Mrpl35
ccccataagcacgca

SEQ ID NO: 44507 - DNA, 15 bp, Artificial Sequence
  dgRNA
  Mrpl35
cgaacccaaacataa

SEQ ID NO: 44508 - DNA, 15 bp, Artificial Sequence
  dgRNA
  Mrpl35
taattaagaagacgg

SEQ ID NO: 44509 - DNA, 15 bp, Artificial Sequence
  dgRNA
  Fam172a
tcctctttcagaacg

SEQ ID NO: 44510 - DNA, 15 bp, Artificial Sequence
  dgRNA
  Fam172a
tcagaacgaggcttt

SEQ ID NO: 44511 - DNA, 15 bp, Artificial Sequence
  dgRNA
  Fam172a
atagcagcgtacgac

SEQ ID NO: 44512 - DNA, 15 bp, Artificial Sequence
  dgRNA
  Fam172a
tagcagcgtacgaca

SEQ ID NO: 44513 - DNA, 15 bp, Artificial Sequence
  dgRNA
  Tmem196
cagcggccagatcat

SEQ ID NO: 44514 - DNA, 15 bp, Artificial Sequence
  dgRNA
  Tmem196
agcggccagatcatt

SEQ ID NO: 44515 - DNA, 15 bp, Artificial Sequence
  dgRNA
  Tmem196
caatgatctggccgc

SEQ ID NO: 44516 - DNA, 15 bp, Artificial Sequence
  dgRNA
  Tmem196
aggctcccaatgatc

SEQ ID NO: 44517 - DNA, 15 bp, Artificial Sequence
  dgRNA
  Hsp90aa1
cgcgcgcgtgcggcc

SEQ ID NO: 44518 - DNA, 15 bp, Artificial Sequence
  dgRNA
  Hsp90aa1
gcgcgcgtgcggccc

SEQ ID NO: 44519 - DNA, 15 bp, Artificial Sequence
  dgRNA
  Hsp90aa1
gcccgggaaggcgcc

SEQ ID NO: 44520 - DNA, 15 bp, Artificial Sequence
  dgRNA
  Hsp90aa1
gcccgccgagcgttc

SEQ ID NO: 44521 - DNA, 15 bp, Artificial Sequence
  dgRNA
  Isx
aattgaacctctatt

SEQ ID NO: 44522 - DNA, 15 bp, Artificial Sequence
  dgRNA
  Isx
acaactatagacctg

SEQ ID NO: 44523 - DNA, 15 bp, Artificial Sequence
  dgRNA
  Isx
tagacctgtggatag

SEQ ID NO: 44524 - DNA, 15 bp, Artificial Sequence
  dgRNA
  Isx
acctcctagtcttaa

SEQ ID NO: 44525 - DNA, 15 bp, Artificial Sequence
  dgRNA
  Nr5a2
taaaacaaagcgctc

SEQ ID NO: 44526 - DNA, 15 bp, Artificial Sequence
  dgRNA
  Nr5a2
aaagcgctccgggtg

SEQ ID NO: 44527 - DNA, 15 bp, Artificial Sequence
  dgRNA
  Nr5a2
aagcgctccgggtga

SEQ ID NO: 44528 - DNA, 15 bp, Artificial Sequence
  dgRNA
  Nr5a2
ctccgggtgagggcg

SEQ ID NO: 44529 - DNA, 15 bp, Artificial Sequence
  dgRNA
  Sgk3
gttcaacccccactc

SEQ ID NO: 44530 - DNA, 15 bp, Artificial Sequence
  dgRNA
  Sgk3
tacataggacctccc

SEQ ID NO: 44531 - DNA, 15 bp, Artificial Sequence
  dgRNA
  Sgk3
cctggatgcggtctg

SEQ ID NO: 44532 - DNA, 15 bp, Artificial Sequence
  dgRNA
  Sgk3
gcggaaacctttgtc

SEQ ID NO: 44533 - DNA, 15 bp, Artificial Sequence
  dgRNA
  Gm12888
acatacctgtctagt

SEQ ID NO: 44534 - DNA, 15 bp, Artificial Sequence
  dgRNA
  Gm12888
ggtaccctgattgcc

SEQ ID NO: 44535 - DNA, 15 bp, Artificial Sequence
  dgRNA
  Gm12888
gtgcttagaactgac

SEQ ID NO: 44536 - DNA, 15 bp, Artificial Sequence
  dgRNA
  Mrps33
acaaaatgatgcgtg

SEQ ID NO: 44537 - DNA, 15 bp, Artificial Sequence
  dgRNA
  Mrps33
acccggctttcctcg

SEQ ID NO: 44538 - DNA, 15 bp, Artificial Sequence
  dgRNA
  Mrps33
cccggctttcctcgc

SEQ ID NO: 44539 - DNA, 15 bp, Artificial Sequence
  dgRNA
  Mrps33
ggctttcctcgcggg

SEQ ID NO: 44540 - DNA, 15 bp, Artificial Sequence
  dgRNA
  Wdr54
tcgttgtagctgcag

SEQ ID NO: 44541 - DNA, 15 bp, Artificial Sequence
  dgRNA
  Wdr54
gtggccgcgacccaa

SEQ ID NO: 44542 - DNA, 15 bp, Artificial Sequence
  dgRNA
  Wdr54
acccaacggtctcct

SEQ ID NO: 44543 - DNA, 15 bp, Artificial Sequence
  dgRNA
  Wdr54
gtctcctcggcaacc

SEQ ID NO: 44544 - DNA, 15 bp, Artificial Sequence
  dgRNA
  Enthd1
aatcgatactttacc

SEQ ID NO: 44545 - DNA, 15 bp, Artificial Sequence
  dgRNA
  Enthd1
cgatactttaccagg

SEQ ID NO: 44546 - DNA, 15 bp, Artificial Sequence
  dgRNA
  Enthd1
gcttaggataaacac

SEQ ID NO: 44547 - DNA, 15 bp, Artificial Sequence
  dgRNA
  Enthd1
tatcgatttcctgca

SEQ ID NO: 44548 - DNA, 15 bp, Artificial Sequence
  dgRNA
  Tmem229b
gtggcgggagtcgtc

SEQ ID NO: 44549 - DNA, 15 bp, Artificial Sequence
  dgRNA
  Tmem229b
tggcgggagtcgtct

SEQ ID NO: 44550 - DNA, 15 bp, Artificial Sequence
  dgRNA
  Tmem229b
gggagtcgtctgggt

SEQ ID NO: 44551 - DNA, 15 bp, Artificial Sequence
  dgRNA
  Tmem229b
tcgtctgggttggcg

SEQ ID NO: 44552 - DNA, 15 bp, Artificial Sequence
  dgRNA
  Fam19a5
ggcggggctgattca

SEQ ID NO: 44553 - DNA, 15 bp, Artificial Sequence
  dgRNA
  Fam19a5
gcggggctgattcat

SEQ ID NO: 44554 - DNA, 15 bp, Artificial Sequence
  dgRNA
  Fam19a5
cggggctgattcatg

SEQ ID NO: 44555 - DNA, 15 bp, Artificial Sequence
  dgRNA
  Fam19a5
tgattcatggggccg

SEQ ID NO: 44556 - DNA, 15 bp, Artificial Sequence
  dgRNA
  Deptor
taaaagaggagcgaa

SEQ ID NO: 44557 - DNA, 15 bp, Artificial Sequence
  dgRNA
  Deptor
ataaaaacatcgggg

SEQ ID NO: 44558 - DNA, 15 bp, Artificial Sequence
  dgRNA
  Deptor
tcatggtcggggggc

SEQ ID NO: 44559 - DNA, 15 bp, Artificial Sequence
  dgRNA
  Deptor
tctctcatggtcggg

SEQ ID NO: 44560 - DNA, 15 bp, Artificial Sequence
  dgRNA
  Ubqln3
gttaagtggggaatt

SEQ ID NO: 44561 - DNA, 15 bp, Artificial Sequence
  dgRNA
  Ubqln3
gaatttgggattacc

SEQ ID NO: 44562 - DNA, 15 bp, Artificial Sequence
  dgRNA
  Ubqln3
agtctctagtatcca

SEQ ID NO: 44563 - DNA, 15 bp, Artificial Sequence
  dgRNA
  Ubqln3
atactagagactccg

SEQ ID NO: 44564 - DNA, 15 bp, Artificial Sequence
  dgRNA
  Nkx2-2
agacccgcccacacg

SEQ ID NO: 44565 - DNA, 15 bp, Artificial Sequence
  dgRNA
  Nkx2-2
cgtggccaacctttg

SEQ ID NO: 44566 - DNA, 15 bp, Artificial Sequence
  dgRNA
  Nkx2-2
ccccaggttcgtgag

SEQ ID NO: 44567 - DNA, 15 bp, Artificial Sequence
  dgRNA
  Nkx2-2
gagcccagccttata

SEQ ID NO: 44568 - DNA, 15 bp, Artificial Sequence
  dgRNA
  Cep350
gcgccacaccaaaga

SEQ ID NO: 44569 - DNA, 15 bp, Artificial Sequence
  dgRNA
  Cep350
cgcatcctctagcct

SEQ ID NO: 44570 - DNA, 15 bp, Artificial Sequence
  dgRNA
  Cep350
atcgcgctcctccgt

SEQ ID NO: 44571 - DNA, 15 bp, Artificial Sequence
  dgRNA
  Cep350
cggccacactcaaca

SEQ ID NO: 44572 - DNA, 15 bp, Artificial Sequence
  dgRNA
  Bmpr1b
cgaaatggtatttcc

SEQ ID NO: 44573 - DNA, 15 bp, Artificial Sequence
  dgRNA
  Bmpr1b
agaggggcaattatg

SEQ ID NO: 44574 - DNA, 15 bp, Artificial Sequence
  dgRNA
  Bmpr1b
ctttacagatgctat

SEQ ID NO: 44575 - DNA, 15 bp, Artificial Sequence
  dgRNA
  Nhp2
acccggttctaaatt

SEQ ID NO: 44576 - DNA, 15 bp, Artificial Sequence
  dgRNA
  Nhp2
taaattcggcctccc

SEQ ID NO: 44577 - DNA, 15 bp, Artificial Sequence
  dgRNA
  Nhp2
aaattcggcctccct

SEQ ID NO: 44578 - DNA, 15 bp, Artificial Sequence
  dgRNA
  Nhp2
gatctacttagagat

SEQ ID NO: 44579 - DNA, 15 bp, Artificial Sequence
  dgRNA
  Arl2
tttccgacagagtcc

SEQ ID NO: 44580 - DNA, 15 bp, Artificial Sequence
  dgRNA
  Arl2
acagagtcccggacc

SEQ ID NO: 44581 - DNA, 15 bp, Artificial Sequence
  dgRNA
  Arl2
ccggaccaggaccaa

SEQ ID NO: 44582 - DNA, 15 bp, Artificial Sequence
  dgRNA
  Arl2
acggttttccgtcac

SEQ ID NO: 44583 - DNA, 15 bp, Artificial Sequence
  dgRNA
  Gabra6
tgccaaaactagccg

SEQ ID NO: 44584 - DNA, 15 bp, Artificial Sequence
  dgRNA
  Gabra6
cctacatagccctga

SEQ ID NO: 44585 - DNA, 15 bp, Artificial Sequence
  dgRNA
  Gabra6
gagattatgttccaa

SEQ ID NO: 44586 - DNA, 15 bp, Artificial Sequence
  dgRNA
  Gabra6
ttcgaatgggctgtg

SEQ ID NO: 44587 - DNA, 15 bp, Artificial Sequence
  dgRNA
  Atp13a5
aacagaccaatactg

SEQ ID NO: 44588 - DNA, 15 bp, Artificial Sequence
  dgRNA
  Atp13a5
actgtggccaaggcg

SEQ ID NO: 44589 - DNA, 15 bp, Artificial Sequence
  dgRNA
  Atp13a5
aggagagcctcgcct

SEQ ID NO: 44590 - DNA, 15 bp, Artificial Sequence
  dgRNA
  Polrmt
ttcgactcctctcac

SEQ ID NO: 44591 - DNA, 15 bp, Artificial Sequence
  dgRNA
  Polrmt
ccctaagagcgcttc

SEQ ID NO: 44592 - DNA, 15 bp, Artificial Sequence
  dgRNA
  Polrmt
cagcgggcagcgtgg

SEQ ID NO: 44593 - DNA, 15 bp, Artificial Sequence
  dgRNA
  Polrmt
ccggaagcgctctta

SEQ ID NO: 44594 - DNA, 15 bp, Artificial Sequence
  dgRNA
  Pigm
ccactccgggatttc

SEQ ID NO: 44595 - DNA, 15 bp, Artificial Sequence
  dgRNA
  Pigm
gggatttccggacag

SEQ ID NO: 44596 - DNA, 15 bp, Artificial Sequence
  dgRNA
  Pigm
gaagcgtcgccaata

SEQ ID NO: 44597 - DNA, 15 bp, Artificial Sequence
  dgRNA
  Pigm
aagcgtcgccaataa

SEQ ID NO: 44598 - DNA, 15 bp, Artificial Sequence
  dgRNA
  Tcf7l2
tcactcaaatccgag

SEQ ID NO: 44599 - DNA, 15 bp, Artificial Sequence
  dgRNA
  Tcf7l2
cggcacgagatcctt

SEQ ID NO: 44600 - DNA, 15 bp, Artificial Sequence
  dgRNA
  Tcf7l2
atccttcggtgtctt

SEQ ID NO: 44601 - DNA, 15 bp, Artificial Sequence
  dgRNA
  Tcf7l2
ggatctcgtgccgct

SEQ ID NO: 44602 - DNA, 15 bp, Artificial Sequence
  dgRNA
  9230104L09Rik
tgctccatccgggac

SEQ ID NO: 44603 - DNA, 15 bp, Artificial Sequence
  dgRNA
  9230104L09Rik
tccatccgggacagg

SEQ ID NO: 44604 - DNA, 15 bp, Artificial Sequence
  dgRNA
  Plag1
cctgggcggagcgtg

SEQ ID NO: 44605 - DNA, 15 bp, Artificial Sequence
  dgRNA
  Plag1
ggagggcgggcacct

SEQ ID NO: 44606 - DNA, 15 bp, Artificial Sequence
  dgRNA
  Plag1
ggcgggcacctcggc

SEQ ID NO: 44607 - DNA, 15 bp, Artificial Sequence
  dgRNA
  Plag1
gggcacctcggcggg

SEQ ID NO: 44608 - DNA, 15 bp, Artificial Sequence
  dgRNA
  Rtn1
tgtttgggccggttc

SEQ ID NO: 44609 - DNA, 15 bp, Artificial Sequence
  dgRNA
  Rtn1
tgatctgcaacctgg

SEQ ID NO: 44610 - DNA, 15 bp, Artificial Sequence
  dgRNA
  Rtn1
tggtgatctgcaacc

SEQ ID NO: 44611 - DNA, 15 bp, Artificial Sequence
  dgRNA
  Rtn1
gggttagctgcataa

SEQ ID NO: 44612 - DNA, 15 bp, Artificial Sequence
  dgRNA
  Myl10
cgcatgagactaaat

SEQ ID NO: 44613 - DNA, 15 bp, Artificial Sequence
  dgRNA
  Myl10
actaaattggagacc

SEQ ID NO: 44614 - DNA, 15 bp, Artificial Sequence
  dgRNA
  Myl10
gacctgggcgcttac

SEQ ID NO: 44615 - DNA, 15 bp, Artificial Sequence
  dgRNA
  Myl10
gcgcttacaggctcc

SEQ ID NO: 44616 - DNA, 15 bp, Artificial Sequence
  dgRNA
  Kalrn
gcatttgcttagagc

SEQ ID NO: 44617 - DNA, 15 bp, Artificial Sequence
  dgRNA
  Kalrn
caacatccgagaatc

SEQ ID NO: 44618 - DNA, 15 bp, Artificial Sequence
  dgRNA
  Kalrn
agattctcggatgtt

SEQ ID NO: 44619 - DNA, 15 bp, Artificial Sequence
  dgRNA
  Kalrn
cagattctcggatgt

SEQ ID NO: 44620 - DNA, 15 bp, Artificial Sequence
  dgRNA
  Gm4906
aacatactttatcac

SEQ ID NO: 44621 - DNA, 15 bp, Artificial Sequence
  dgRNA
  Ctsc
tgtaaccccgccccg

SEQ ID NO: 44622 - DNA, 15 bp, Artificial Sequence
  dgRNA
  Ctsc
gttagtgacagtgta

SEQ ID NO: 44623 - DNA, 15 bp, Artificial Sequence
  dgRNA
  Ctsc
gcacgaggtggcctg

SEQ ID NO: 44624 - DNA, 15 bp, Artificial Sequence
  dgRNA
  Ctsc
agcggcgaggctgtg

SEQ ID NO: 44625 - DNA, 15 bp, Artificial Sequence
  dgRNA
  1700122O11Rik
ctaaggagctagatt

SEQ ID NO: 44626 - DNA, 15 bp, Artificial Sequence
  dgRNA
  1700122O11Rik
gctccttagggtctc

SEQ ID NO: 44627 - DNA, 15 bp, Artificial Sequence
  dgRNA
  1700122O11Rik
aaatctagctcctta

SEQ ID NO: 44628 - DNA, 15 bp, Artificial Sequence
  dgRNA
  1700122O11Rik
gagccataagtccaa

SEQ ID NO: 44629 - DNA, 15 bp, Artificial Sequence
  dgRNA
  Chst10
cgcggtgcgtcctcc

SEQ ID NO: 44630 - DNA, 15 bp, Artificial Sequence
  dgRNA
  Chst10
tggcttcctgcaacg

SEQ ID NO: 44631 - DNA, 15 bp, Artificial Sequence
  dgRNA
  Chst10
cgcgcgcgtgcacag

SEQ ID NO: 44632 - DNA, 15 bp, Artificial Sequence
  dgRNA
  Chst10
gcgcgtgcacagcgg

SEQ ID NO: 44633 - DNA, 15 bp, Artificial Sequence
  dgRNA
  Fut4
gaggtatccagtgca

SEQ ID NO: 44634 - DNA, 15 bp, Artificial Sequence
  dgRNA
  Fut4
atccagtgcaaggcg

SEQ ID NO: 44635 - DNA, 15 bp, Artificial Sequence
  dgRNA
  Fut4
tccagtgcaaggcga

SEQ ID NO: 44636 - DNA, 15 bp, Artificial Sequence
  dgRNA
  Fut4
tgccagcctaggcgc

SEQ ID NO: 44637 - DNA, 15 bp, Artificial Sequence
  dgRNA
  Capn6
aaggcctttcaaatg

SEQ ID NO: 44638 - DNA, 15 bp, Artificial Sequence
  dgRNA
  Capn6
caatttactggtggg

SEQ ID NO: 44639 - DNA, 15 bp, Artificial Sequence
  dgRNA
  Capn6
actggtgggtggatc

SEQ ID NO: 44640 - DNA, 15 bp, Artificial Sequence
  dgRNA
  Capn6
ttttcctcgtgactc

SEQ ID NO: 44641 - DNA, 15 bp, Artificial Sequence
  dgRNA
  Cacna1c
tgtttggtgcaataa

SEQ ID NO: 44642 - DNA, 15 bp, Artificial Sequence
  dgRNA
  Cacna1c
gtttggtgcaataat

SEQ ID NO: 44643 - DNA, 15 bp, Artificial Sequence
  dgRNA
  Cacna1c
tttggtgcaataatg

SEQ ID NO: 44644 - DNA, 15 bp, Artificial Sequence
  dgRNA
  Cacna1c
gcaataatggggatc

SEQ ID NO: 44645 - DNA, 15 bp, Artificial Sequence
  dgRNA
  Dmtf1
ccgcagggggggtgc

SEQ ID NO: 44646 - DNA, 15 bp, Artificial Sequence
  dgRNA
  Dmtf1
cgcagggggggtgct

SEQ ID NO: 44647 - DNA, 15 bp, Artificial Sequence
  dgRNA
  Brd4
ttttgtcaagtgagg

SEQ ID NO: 44648 - DNA, 15 bp, Artificial Sequence
  dgRNA
  Lmna
cgcccctttgggtac

SEQ ID NO: 44649 - DNA, 15 bp, Artificial Sequence
  dgRNA
  Lmna
atccaccccctgtag

SEQ ID NO: 44650 - DNA, 15 bp, Artificial Sequence
  dgRNA
  Lmna
accccctgtagagga

SEQ ID NO: 44651 - DNA, 15 bp, Artificial Sequence
  dgRNA
  Lmna
ctctaagcttgcctt

SEQ ID NO: 44652 - DNA, 15 bp, Artificial Sequence
  dgRNA
  Ctse
ctacatactgactcg

SEQ ID NO: 44653 - DNA, 15 bp, Artificial Sequence
  dgRNA
  Olfr1387
acccatactccttac

SEQ ID NO: 44654 - DNA, 15 bp, Artificial Sequence
  dgRNA
  Olfr1387
tggcttaaggtgtgg

SEQ ID NO: 44655 - DNA, 15 bp, Artificial Sequence
  dgRNA
  Olfr1387
cactggcttaaggtg

SEQ ID NO: 44656 - DNA, 15 bp, Artificial Sequence
  dgRNA
  Olfr1387
gagatcactggctta

SEQ ID NO: 44657 - DNA, 15 bp, Artificial Sequence
  dgRNA
  Trnp1
tatctaccccaaatt

SEQ ID NO: 44658 - DNA, 15 bp, Artificial Sequence
  dgRNA
  Trnp1
gggatgatgcccaaa

SEQ ID NO: 44659 - DNA, 15 bp, Artificial Sequence
  dgRNA
  Trnp1
caaacggagccaatc

SEQ ID NO: 44660 - DNA, 15 bp, Artificial Sequence
  dgRNA
  Trnp1
aaacggagccaatct

SEQ ID NO: 44661 - DNA, 15 bp, Artificial Sequence
  dgRNA
  Lhx2
gaccgaagcccagat

SEQ ID NO: 44662 - DNA, 15 bp, Artificial Sequence
  dgRNA
  Lhx2
cgaagcccagatggg

SEQ ID NO: 44663 - DNA, 15 bp, Artificial Sequence
  dgRNA
  Lhx2
gcgggaagcagccga

SEQ ID NO: 44664 - DNA, 15 bp, Artificial Sequence
  dgRNA
  Lhx2
ttgaaacagtactcc

SEQ ID NO: 44665 - DNA, 15 bp, Artificial Sequence
  dgRNA
  Dok6
ccatatcctaggcgc

SEQ ID NO: 44666 - DNA, 15 bp, Artificial Sequence
  dgRNA
  Dok6
tatcctaggcgcggg

SEQ ID NO: 44667 - DNA, 15 bp, Artificial Sequence
  dgRNA
  Dok6
gccctgccaccccgc

SEQ ID NO: 44668 - DNA, 15 bp, Artificial Sequence
  dgRNA
  Dok6
gccaccccgcgggca

SEQ ID NO: 44669 - DNA, 15 bp, Artificial Sequence
  dgRNA
  Rdx
tctttgttgcacccg

SEQ ID NO: 44670 - DNA, 15 bp, Artificial Sequence
  dgRNA
  Rdx
ctttgttgcacccgt

SEQ ID NO: 44671 - DNA, 15 bp, Artificial Sequence
  dgRNA
  Rdx
tgcacccgtggggag

SEQ ID NO: 44672 - DNA, 15 bp, Artificial Sequence
  dgRNA
  Rdx
ccacaagtattcagt

SEQ ID NO: 44673 - DNA, 15 bp, Artificial Sequence
  dgRNA
  Sbf2
gggcctctaagcgcc

SEQ ID NO: 44674 - DNA, 15 bp, Artificial Sequence
  dgRNA
  Sbf2
ctaagcgcccggcct

SEQ ID NO: 44675 - DNA, 15 bp, Artificial Sequence
  dgRNA
  Sbf2
agcgcccggcctcgg

SEQ ID NO: 44676 - DNA, 15 bp, Artificial Sequence
  dgRNA
  Sbf2
gcccggcctcggtgg

SEQ ID NO: 44677 - DNA, 15 bp, Artificial Sequence
  dgRNA
  Rbm24
gactctcaagtcaac

SEQ ID NO: 44678 - DNA, 15 bp, Artificial Sequence
  dgRNA
  Rbm24
ctggtcgtgccagcg

SEQ ID NO: 44679 - DNA, 15 bp, Artificial Sequence
  dgRNA
  Rbm24
agcaagaagctagcg

SEQ ID NO: 44680 - DNA, 15 bp, Artificial Sequence
  dgRNA
  Rbm24
tagcgtggtctgctt

SEQ ID NO: 44681 - DNA, 15 bp, Artificial Sequence
  dgRNA
  Icam5
gatctttcccccacg

SEQ ID NO: 44682 - DNA, 15 bp, Artificial Sequence
  dgRNA
  Icam5
atctttcccccacgg

SEQ ID NO: 44683 - DNA, 15 bp, Artificial Sequence
  dgRNA
  Icam5
gggaccgctcttgcc

SEQ ID NO: 44684 - DNA, 15 bp, Artificial Sequence
  dgRNA
  Icam5
agctcgcctgcatta

SEQ ID NO: 44685 - DNA, 15 bp, Artificial Sequence
  dgRNA
  Spint5
ggggggttcctcctc

SEQ ID NO: 44686 - DNA, 15 bp, Artificial Sequence
  dgRNA
  Spint5
gggctctgtcaaaca

SEQ ID NO: 44687 - DNA, 15 bp, Artificial Sequence
  dgRNA
  Spint5
ttcaaactccatggc

SEQ ID NO: 44688 - DNA, 15 bp, Artificial Sequence
  dgRNA
  Spint5
accagagccgtgtcc

SEQ ID NO: 44689 - DNA, 15 bp, Artificial Sequence
  dgRNA
  Cenpl
agtccctctgacgcc

SEQ ID NO: 44690 - DNA, 15 bp, Artificial Sequence
  dgRNA
  Cenpl
cgccaaagttacgca

SEQ ID NO: 44691 - DNA, 15 bp, Artificial Sequence
  dgRNA
  Cenpl
gttacgcaaggattc

SEQ ID NO: 44692 - DNA, 15 bp, Artificial Sequence
  dgRNA
  Cenpl
ggattccggccaatc

SEQ ID NO: 44693 - DNA, 15 bp, Artificial Sequence
  dgRNA
  Emp3
aacatgctccacccc

SEQ ID NO: 44694 - DNA, 15 bp, Artificial Sequence
  dgRNA
  Emp3
tgggcgaggctaaag

SEQ ID NO: 44695 - DNA, 15 bp, Artificial Sequence
  dgRNA
  Emp3
tggatataaaagggt

SEQ ID NO: 44696 - DNA, 15 bp, Artificial Sequence
  dgRNA
  Emp3
tgggacctcctttca

SEQ ID NO: 44697 - DNA, 15 bp, Artificial Sequence
  dgRNA
  Crlf2
ccgcttccccctatc

SEQ ID NO: 44698 - DNA, 15 bp, Artificial Sequence
  dgRNA
  Crlf2
cgcttccccctatcc

SEQ ID NO: 44699 - DNA, 15 bp, Artificial Sequence
  dgRNA
  Crlf2
tatccgggtgattga

SEQ ID NO: 44700 - DNA, 15 bp, Artificial Sequence
  dgRNA
  Crlf2
atccgggtgattgat

SEQ ID NO: 44701 - DNA, 15 bp, Artificial Sequence
  dgRNA
  Asl
ctggccaacctttca

SEQ ID NO: 44702 - DNA, 15 bp, Artificial Sequence
  dgRNA
  Asl
gactgctgcgatcgc

SEQ ID NO: 44703 - DNA, 15 bp, Artificial Sequence
  dgRNA
  Asl
gctaacagttatcac

SEQ ID NO: 44704 - DNA, 15 bp, Artificial Sequence
  dgRNA
  Asl
tagaaggtcggctgt

SEQ ID NO: 44705 - DNA, 15 bp, Artificial Sequence
  dgRNA
  Crtac1
ctgccaccgcaatcc

SEQ ID NO: 44706 - DNA, 15 bp, Artificial Sequence
  dgRNA
  Crtac1
gctcctaaatcagcg

SEQ ID NO: 44707 - DNA, 15 bp, Artificial Sequence
  dgRNA
  Crtac1
ctcctaaatcagcgc

SEQ ID NO: 44708 - DNA, 15 bp, Artificial Sequence
  dgRNA
  Crtac1
tcctaaatcagcgcg

SEQ ID NO: 44709 - DNA, 15 bp, Artificial Sequence
  dgRNA
  Ocm
gtggtttcattacta

SEQ ID NO: 44710 - DNA, 15 bp, Artificial Sequence
  dgRNA
  Ocm
aacgatcacagtttc

SEQ ID NO: 44711 - DNA, 15 bp, Artificial Sequence
  dgRNA
  Sh2b3
gggcgcgacgcaact

SEQ ID NO: 44712 - DNA, 15 bp, Artificial Sequence
  dgRNA
  Sh2b3
ggcgcgacgcaactt

SEQ ID NO: 44713 - DNA, 15 bp, Artificial Sequence
  dgRNA
  Sh2b3
agagagcgcgcctta

SEQ ID NO: 44714 - DNA, 15 bp, Artificial Sequence
  dgRNA
  Sh2b3
gagagcgcgccttat

SEQ ID NO: 44715 - DNA, 15 bp, Artificial Sequence
  dgRNA
  Gng3
accaccccatttgag

SEQ ID NO: 44716 - DNA, 15 bp, Artificial Sequence
  dgRNA
  Gng3
ccaccccatttgaga

SEQ ID NO: 44717 - DNA, 15 bp, Artificial Sequence
  dgRNA
  Gng3
caccccatttgagag

SEQ ID NO: 44718 - DNA, 15 bp, Artificial Sequence
  dgRNA
  Gng3
atctagtttagacta

SEQ ID NO: 44719 - DNA, 15 bp, Artificial Sequence
  dgRNA
  Slc6a20b
gtatctgttggaggc

SEQ ID NO: 44720 - DNA, 15 bp, Artificial Sequence
  dgRNA
  Cybb
cagagacgatttgtc

SEQ ID NO: 44721 - DNA, 15 bp, Artificial Sequence
  dgRNA
  Cybb
cattggccaactgaa

SEQ ID NO: 44722 - DNA, 15 bp, Artificial Sequence
  dgRNA
  Cybb
aaattagctaatcat

SEQ ID NO: 44723 - DNA, 15 bp, Artificial Sequence
  dgRNA
  Dcaf12
aaatgtcccgacaga

SEQ ID NO: 44724 - DNA, 15 bp, Artificial Sequence
  dgRNA
  Dcaf12
gtcccgacagaaggc

SEQ ID NO: 44725 - DNA, 15 bp, Artificial Sequence
  dgRNA
  Dcaf12
cagcttaaccgccat

SEQ ID NO: 44726 - DNA, 15 bp, Artificial Sequence
  dgRNA
  Dcaf12
agcggaagttctccg

SEQ ID NO: 44727 - DNA, 15 bp, Artificial Sequence
  dgRNA
  Slc15a1
tgggaccagcgtcct

SEQ ID NO: 44728 - DNA, 15 bp, Artificial Sequence
  dgRNA
  Slc15a1
gggaccagcgtccta

SEQ ID NO: 44729 - DNA, 15 bp, Artificial Sequence
  dgRNA
  Slc15a1
cagcgtcctagggac

SEQ ID NO: 44730 - DNA, 15 bp, Artificial Sequence
  dgRNA
  Slc15a1
aagcgatgttagcct

SEQ ID NO: 44731 - DNA, 15 bp, Artificial Sequence
  dgRNA
  Tarbp2
ccactcgtagtagct

SEQ ID NO: 44732 - DNA, 15 bp, Artificial Sequence
  dgRNA
  Tarbp2
cactcgtagtagctt

SEQ ID NO: 44733 - DNA, 15 bp, Artificial Sequence
  dgRNA
  Tarbp2
gggaagcttccgccg

SEQ ID NO: 44734 - DNA, 15 bp, Artificial Sequence
  dgRNA
  Tarbp2
ggaagcttccgccga

SEQ ID NO: 44735 - DNA, 15 bp, Artificial Sequence
  dgRNA
  Pax2
ttccctagctacccg

SEQ ID NO: 44736 - DNA, 15 bp, Artificial Sequence
  dgRNA
  Pax2
tccctagctacccga

SEQ ID NO: 44737 - DNA, 15 bp, Artificial Sequence
  dgRNA
  Pax2
gctacccgagggtcc

SEQ ID NO: 44738 - DNA, 15 bp, Artificial Sequence
  dgRNA
  Pax2
tctcctaccatccgt

SEQ ID NO: 44739 - DNA, 15 bp, Artificial Sequence
  dgRNA
  Grsf1
ggacaacttccactc

SEQ ID NO: 44740 - DNA, 15 bp, Artificial Sequence
  dgRNA
  Grsf1
actctggaggcgctc

SEQ ID NO: 44741 - DNA, 15 bp, Artificial Sequence
  dgRNA
  Grsf1
ccacacccttaccgg

SEQ ID NO: 44742 - DNA, 15 bp, Artificial Sequence
  dgRNA
  Grsf1
cacacccttaccggc

SEQ ID NO: 44743 - DNA, 15 bp, Artificial Sequence
  dgRNA
  Atg4c
actgaatgctccacc

SEQ ID NO: 44744 - DNA, 15 bp, Artificial Sequence
  dgRNA
  Atg4c
gtcttttaatccaag

SEQ ID NO: 44745 - DNA, 15 bp, Artificial Sequence
  dgRNA
  Atg4c
taatccaagtgggct

SEQ ID NO: 44746 - DNA, 15 bp, Artificial Sequence
  dgRNA
  Atg4c
gtattgattacatcc

SEQ ID NO: 44747 - DNA, 15 bp, Artificial Sequence
  dgRNA
  Traf3ip3
tacagcaccaaccag

SEQ ID NO: 44748 - DNA, 15 bp, Artificial Sequence
  dgRNA
  Traf3ip3
gagagcagaccaatc

SEQ ID NO: 44749 - DNA, 15 bp, Artificial Sequence
  dgRNA
  Traf3ip3
gaccaatcaggtagt

SEQ ID NO: 44750 - DNA, 15 bp, Artificial Sequence
  dgRNA
  Traf3ip3
gaaaccccggcattc

SEQ ID NO: 44751 - DNA, 15 bp, Artificial Sequence
  dgRNA
  Ahr
ctcacaccccttttg

SEQ ID NO: 44752 - DNA, 15 bp, Artificial Sequence
  dgRNA
  Ahr
gactgcaagaagtgt

SEQ ID NO: 44753 - DNA, 15 bp, Artificial Sequence
  dgRNA
  Ahr
tcacgtgctgcgaag

SEQ ID NO: 44754 - DNA, 15 bp, Artificial Sequence
  dgRNA
  Ahr
cacgtgctgcgaaga

SEQ ID NO: 44755 - DNA, 15 bp, Artificial Sequence
  dgRNA
  Vasp
tccaactccggagtg

SEQ ID NO: 44756 - DNA, 15 bp, Artificial Sequence
  dgRNA
  Vasp
tccggagtgaggctc

SEQ ID NO: 44757 - DNA, 15 bp, Artificial Sequence
  dgRNA
  Vasp
ccggagtgaggctca

SEQ ID NO: 44758 - DNA, 15 bp, Artificial Sequence
  dgRNA
  Vasp
cccacgccacaagac

SEQ ID NO: 44759 - DNA, 15 bp, Artificial Sequence
  dgRNA
  Olfr742
ctattcaatagttat

SEQ ID NO: 44760 - DNA, 15 bp, Artificial Sequence
  dgRNA
  Atxn2l
cgctaagcgcctgcg

SEQ ID NO: 44761 - DNA, 15 bp, Artificial Sequence
  dgRNA
  Atxn2l
ctccttttccgcccc

SEQ ID NO: 44762 - DNA, 15 bp, Artificial Sequence
  dgRNA
  Atxn2l
tccttttccgcccca

SEQ ID NO: 44763 - DNA, 15 bp, Artificial Sequence
  dgRNA
  Atxn2l
aggggctaggccggt

SEQ ID NO: 44764 - DNA, 15 bp, Artificial Sequence
  dgRNA
  Ccdc106
gagcacccaaaggcg

SEQ ID NO: 44765 - DNA, 15 bp, Artificial Sequence
  dgRNA
  Ccdc106
cccaaaggcggggaa

SEQ ID NO: 44766 - DNA, 15 bp, Artificial Sequence
  dgRNA
  Ccdc106
ggggaacggtgccca

SEQ ID NO: 44767 - DNA, 15 bp, Artificial Sequence
  dgRNA
  Ccdc106
tcgacacccccatgc

SEQ ID NO: 44768 - DNA, 15 bp, Artificial Sequence
  dgRNA
  Clptm1l
tggggcgccgccgta

SEQ ID NO: 44769 - DNA, 15 bp, Artificial Sequence
  dgRNA
  Clptm1l
gccgtaaggctgcac

SEQ ID NO: 44770 - DNA, 15 bp, Artificial Sequence
  dgRNA
  Clptm1l
ccgtaaggctgcaca

SEQ ID NO: 44771 - DNA, 15 bp, Artificial Sequence
  dgRNA
  Clptm1l
aaccgggtgccgcca

SEQ ID NO: 44772 - DNA, 15 bp, Artificial Sequence
  dgRNA
  Bdnf
gctcctctagtgagg

SEQ ID NO: 44773 - DNA, 15 bp, Artificial Sequence
  dgRNA
  Bdnf
aatcctcctcactag

SEQ ID NO: 44774 - DNA, 15 bp, Artificial Sequence
  dgRNA
  Gdf15
ctgccgcctcctgtt

SEQ ID NO: 44775 - DNA, 15 bp, Artificial Sequence
  dgRNA
  Gdf15
cgcctcctgtttgga

SEQ ID NO: 44776 - DNA, 15 bp, Artificial Sequence
  dgRNA
  Gdf15
aggaacccctggtct

SEQ ID NO: 44777 - DNA, 15 bp, Artificial Sequence
  dgRNA
  Gdf15
cctgaaaggtaaatc

SEQ ID NO: 44778 - DNA, 15 bp, Artificial Sequence
  dgRNA
  En2
gcacggccactttaa

SEQ ID NO: 44779 - DNA, 15 bp, Artificial Sequence
  dgRNA
  En2
cacggccactttaaa

SEQ ID NO: 44780 - DNA, 15 bp, Artificial Sequence
  dgRNA
  En2
acggccactttaaag

SEQ ID NO: 44781 - DNA, 15 bp, Artificial Sequence
  dgRNA
  En2
cggccactttaaagg

SEQ ID NO: 44782 - DNA, 15 bp, Artificial Sequence
  dgRNA
  Rarg
cggaagcctagcaaa

SEQ ID NO: 44783 - DNA, 15 bp, Artificial Sequence
  dgRNA
  Rarg
ggaagcctagcaaat

SEQ ID NO: 44784 - DNA, 15 bp, Artificial Sequence
  dgRNA
  Rarg
cccagggcaccgagg

SEQ ID NO: 44785 - DNA, 15 bp, Artificial Sequence
  dgRNA
  Rarg
accgaggagggagcc

SEQ ID NO: 44786 - DNA, 15 bp, Artificial Sequence
  dgRNA
  Rnf157
gcgaagcacgcgccg

SEQ ID NO: 44787 - DNA, 15 bp, Artificial Sequence
  dgRNA
  Rnf157
cgaagcacgcgccgc

SEQ ID NO: 44788 - DNA, 15 bp, Artificial Sequence
  dgRNA
  Rnf157
tcgtttcctattggc

SEQ ID NO: 44789 - DNA, 15 bp, Artificial Sequence
  dgRNA
  Rnf157
tggctggccggcccg

SEQ ID NO: 44790 - DNA, 15 bp, Artificial Sequence
  dgRNA
  Dlg1
ggaaagcagtcacgt

SEQ ID NO: 44791 - DNA, 15 bp, Artificial Sequence
  dgRNA
  Dlg1
agtcacgtgggcgcg

SEQ ID NO: 44792 - DNA, 15 bp, Artificial Sequence
  dgRNA
  Dlg1
cttggcggaaagttt

SEQ ID NO: 44793 - DNA, 15 bp, Artificial Sequence
  dgRNA
  Dlg1
ttggcggaaagttta

SEQ ID NO: 44794 - DNA, 15 bp, Artificial Sequence
  dgRNA
  Tmbim1
ccgggtgacaagtgc

SEQ ID NO: 44795 - DNA, 15 bp, Artificial Sequence
  dgRNA
  Tmbim1
aaatcgctgatatgt

SEQ ID NO: 44796 - DNA, 15 bp, Artificial Sequence
  dgRNA
  Tmbim1
aatagcacttcttac

SEQ ID NO: 44797 - DNA, 15 bp, Artificial Sequence
  dgRNA
  Tmbim1
atagcacttcttact

SEQ ID NO: 44798 - DNA, 15 bp, Artificial Sequence
  dgRNA
  Dmkn
cccgatggcctgctc

SEQ ID NO: 44799 - DNA, 15 bp, Artificial Sequence
  dgRNA
  Dmkn
taggccctgagtcac

SEQ ID NO: 44800 - DNA, 15 bp, Artificial Sequence
  dgRNA
  Dmkn
aggagggatcttaag

SEQ ID NO: 44801 - DNA, 15 bp, Artificial Sequence
  dgRNA
  Dmkn
ccaacctacagtata

SEQ ID NO: 44802 - DNA, 15 bp, Artificial Sequence
  dgRNA
  Rnf38
gacttttagagttgc

SEQ ID NO: 44803 - DNA, 15 bp, Artificial Sequence
  dgRNA
  Rnf38
agcgagagctgccgc

SEQ ID NO: 44804 - DNA, 15 bp, Artificial Sequence
  dgRNA
  Rnf38
gcgagagctgccgcc

SEQ ID NO: 44805 - DNA, 15 bp, Artificial Sequence
  dgRNA
  Rnf38
agctgccgccgggct

SEQ ID NO: 44806 - DNA, 15 bp, Artificial Sequence
  dgRNA
  Gucy1b3
gacttgtcaccagac

SEQ ID NO: 44807 - DNA, 15 bp, Artificial Sequence
  dgRNA
  Gucy1b3
gattggctaagatat

SEQ ID NO: 44808 - DNA, 15 bp, Artificial Sequence
  dgRNA
  Gucy1b3
ggctccactcgtcat

SEQ ID NO: 44809 - DNA, 15 bp, Artificial Sequence
  dgRNA
  Gucy1b3
ggtggcaatcagagt

SEQ ID NO: 44810 - DNA, 15 bp, Artificial Sequence
  dgRNA
  Ccdc60
gaccccgaaagagtt

SEQ ID NO: 44811 - DNA, 15 bp, Artificial Sequence
  dgRNA
  Ccdc60
aacccagaagaattc

SEQ ID NO: 44812 - DNA, 15 bp, Artificial Sequence
  dgRNA
  Ccdc60
gaagaattccggtcc

SEQ ID NO: 44813 - DNA, 15 bp, Artificial Sequence
  dgRNA
  Ccdc60
ggtctccaccaatcc

SEQ ID NO: 44814 - DNA, 15 bp, Artificial Sequence
  dgRNA
  Lrp4
actgagtaggagcta

SEQ ID NO: 44815 - DNA, 15 bp, Artificial Sequence
  dgRNA
  Lrp4
taaggcgagcgcaag

SEQ ID NO: 44816 - DNA, 15 bp, Artificial Sequence
  dgRNA
  Lrp4
gagcgcaagaggcac

SEQ ID NO: 44817 - DNA, 15 bp, Artificial Sequence
  dgRNA
  Lrp4
aggcgggtggggtcc

SEQ ID NO: 44818 - DNA, 15 bp, Artificial Sequence
  dgRNA
  Haghl
gagttcaactgacac

SEQ ID NO: 44819 - DNA, 15 bp, Artificial Sequence
  dgRNA
  Rhbdl1
tatgatgggagcaac

SEQ ID NO: 44820 - DNA, 15 bp, Artificial Sequence
  dgRNA
  Rhbdl1
aacaggctgcctaag

SEQ ID NO: 44821 - DNA, 15 bp, Artificial Sequence
  dgRNA
  Rhbdl1
gcctaagagggtatt

SEQ ID NO: 44822 - DNA, 15 bp, Artificial Sequence
  dgRNA
  Rhbdl1
agcttctgccgcacg

SEQ ID NO: 44823 - DNA, 15 bp, Artificial Sequence
  dgRNA
  Palm3
cagcctagcgcagcg

SEQ ID NO: 44824 - DNA, 15 bp, Artificial Sequence
  dgRNA
  Palm3
cctagcgcagcgtgg

SEQ ID NO: 44825 - DNA, 15 bp, Artificial Sequence
  dgRNA
  Palm3
gcgcagcgtggaggc

SEQ ID NO: 44826 - DNA, 15 bp, Artificial Sequence
  dgRNA
  Palm3
cccgcccaaaccagc

SEQ ID NO: 44827 - DNA, 15 bp, Artificial Sequence
  dgRNA
  Clcn2
cccctgccgcctctc

SEQ ID NO: 44828 - DNA, 15 bp, Artificial Sequence
  dgRNA
  Clcn2
tctccggacaccagg

SEQ ID NO: 44829 - DNA, 15 bp, Artificial Sequence
  dgRNA
  Clcn2
ccggacaccaggagg

SEQ ID NO: 44830 - DNA, 15 bp, Artificial Sequence
  dgRNA
  Clcn2
aatgcagaccccggc

SEQ ID NO: 44831 - DNA, 15 bp, Artificial Sequence
  dgRNA
  Dpep2
ggaactaagtccttg

SEQ ID NO: 44832 - DNA, 15 bp, Artificial Sequence
  dgRNA
  Odf2
ttcaacgacttcata

SEQ ID NO: 44833 - DNA, 15 bp, Artificial Sequence
  dgRNA
  Odf2
ataaggagacggttc

SEQ ID NO: 44834 - DNA, 15 bp, Artificial Sequence
  dgRNA
  Odf2
taaggagacggttct

SEQ ID NO: 44835 - DNA, 15 bp, Artificial Sequence
  dgRNA
  Odf2
cagccgtgccgctct

SEQ ID NO: 44836 - DNA, 15 bp, Artificial Sequence
  dgRNA
  Drosha
cccaaggcacgatcg

SEQ ID NO: 44837 - DNA, 15 bp, Artificial Sequence
  dgRNA
  Drosha
aaggcacgatcgcgg

SEQ ID NO: 44838 - DNA, 15 bp, Artificial Sequence
  dgRNA
  Drosha
aaacgcgcgctcacc

SEQ ID NO: 44839 - DNA, 15 bp, Artificial Sequence
  dgRNA
  Drosha
acccggttgcgcttc

SEQ ID NO: 44840 - DNA, 15 bp, Artificial Sequence
  dgRNA
  Timm8b
gccatgtcgctttcg

SEQ ID NO: 44841 - DNA, 15 bp, Artificial Sequence
  dgRNA
  Timm8b
ccatgtcgctttcga

SEQ ID NO: 44842 - DNA, 15 bp, Artificial Sequence
  dgRNA
  Timm8b
gctttcgagggctca

SEQ ID NO: 44843 - DNA, 15 bp, Artificial Sequence
  dgRNA
  Timm8b
ggtcactctacaacc

SEQ ID NO: 44844 - DNA, 15 bp, Artificial Sequence
  dgRNA
  Sh2b1
cggggaccgagatgc

SEQ ID NO: 44845 - DNA, 15 bp, Artificial Sequence
  dgRNA
  Sh2b1
gaccgagatgcaggt

SEQ ID NO: 44846 - DNA, 15 bp, Artificial Sequence
  dgRNA
  Sh2b1
aggtgggaccggaac

SEQ ID NO: 44847 - DNA, 15 bp, Artificial Sequence
  dgRNA
  Sh2b1
gtcgtctgagaagcc

SEQ ID NO: 44848 - DNA, 15 bp, Artificial Sequence
  dgRNA
  Lurap1
tgctgcgtgtctagt

SEQ ID NO: 44849 - DNA, 15 bp, Artificial Sequence
  dgRNA
  Lurap1
tagtcgaacgcctcc

SEQ ID NO: 44850 - DNA, 15 bp, Artificial Sequence
  dgRNA
  Lurap1
agtcgaacgcctcca

SEQ ID NO: 44851 - DNA, 15 bp, Artificial Sequence
  dgRNA
  Lurap1
gctcccccaactgcg

SEQ ID NO: 44852 - DNA, 15 bp, Artificial Sequence
  dgRNA
  Cep57
cgtgcgcgctgagtg

SEQ ID NO: 44853 - DNA, 15 bp, Artificial Sequence
  dgRNA
  Cep57
agtgtggcgtccttg

SEQ ID NO: 44854 - DNA, 15 bp, Artificial Sequence
  dgRNA
  Cep57
tggtttgcgagaccg

SEQ ID NO: 44855 - DNA, 15 bp, Artificial Sequence
  dgRNA
  Cep57
gaccgaggctcctat

SEQ ID NO: 44856 - DNA, 15 bp, Artificial Sequence
  dgRNA
  2700029M09Rik
ccccggatgtagctc

SEQ ID NO: 44857 - DNA, 15 bp, Artificial Sequence
  dgRNA
  2700029M09Rik
cccggatgtagctca

SEQ ID NO: 44858 - DNA, 15 bp, Artificial Sequence
  dgRNA
  2700029M09Rik
ggcggtgcttgcgtt

SEQ ID NO: 44859 - DNA, 15 bp, Artificial Sequence
  dgRNA
  2700029M09Rik
gcggtgcttgcgttc

SEQ ID NO: 44860 - DNA, 15 bp, Artificial Sequence
  dgRNA
  Lipt1
cgtctttacatattt

SEQ ID NO: 44861 - DNA, 15 bp, Artificial Sequence
  dgRNA
  Lipt1
aatgcattggcctga

SEQ ID NO: 44862 - DNA, 15 bp, Artificial Sequence
  dgRNA
  Lipt1
ttagccacgacctcc

SEQ ID NO: 44863 - DNA, 15 bp, Artificial Sequence
  dgRNA
  Lipt1
tagccacgacctcct

SEQ ID NO: 44864 - DNA, 15 bp, Artificial Sequence
  dgRNA
  Gfy
gctcgcagaaggcac

SEQ ID NO: 44865 - DNA, 15 bp, Artificial Sequence
  dgRNA
  Gfy
atccctgctcgcaga

SEQ ID NO: 44866 - DNA, 15 bp, Artificial Sequence
  dgRNA
  Gfy
gtgatgatacaggcc

SEQ ID NO: 44867 - DNA, 15 bp, Artificial Sequence
  dgRNA
  Gfy
tcgataaggtagaaa

SEQ ID NO: 44868 - DNA, 15 bp, Artificial Sequence
  dgRNA
  Iqch
gtgcccgcaccatct

SEQ ID NO: 44869 - DNA, 15 bp, Artificial Sequence
  dgRNA
  Iqch
ctaggagcgctccgc

SEQ ID NO: 44870 - DNA, 15 bp, Artificial Sequence
  dgRNA
  Iqch
ggagcgctccgcagg

SEQ ID NO: 44871 - DNA, 15 bp, Artificial Sequence
  dgRNA
  Iqch
gctcctagatggtgc

SEQ ID NO: 44872 - DNA, 15 bp, Artificial Sequence
  dgRNA
  Fam186b
aggcgaaacaaacaa

SEQ ID NO: 44873 - DNA, 15 bp, Artificial Sequence
  dgRNA
  Fam186b
atggcaggcaacggc

SEQ ID NO: 44874 - DNA, 15 bp, Artificial Sequence
  dgRNA
  Fam186b
cggctggcatacagc

SEQ ID NO: 44875 - DNA, 15 bp, Artificial Sequence
  dgRNA
  Ltf
taccagcgcctgtgt

SEQ ID NO: 44876 - DNA, 15 bp, Artificial Sequence
  dgRNA
  Ltf
accagcgcctgtgta

SEQ ID NO: 44877 - DNA, 15 bp, Artificial Sequence
  dgRNA
  Ltf
ccagcgcctgtgtag

SEQ ID NO: 44878 - DNA, 15 bp, Artificial Sequence
  dgRNA
  Ltf
cagcgcctgtgtagg

SEQ ID NO: 44879 - DNA, 15 bp, Artificial Sequence
  dgRNA
  Tmem176a
tgagggcccctttag

SEQ ID NO: 44880 - DNA, 15 bp, Artificial Sequence
  dgRNA
  Tmem176a
ctgagggccccttta

SEQ ID NO: 44881 - DNA, 15 bp, Artificial Sequence
  dgRNA
  Tmem176a
actgagggccccttt

SEQ ID NO: 44882 - DNA, 15 bp, Artificial Sequence
  dgRNA
  Tmem176a
ctcacacagaggcgc

SEQ ID NO: 44883 - DNA, 15 bp, Artificial Sequence
  dgRNA
  Tmem159
gttcctagagtgtgt

SEQ ID NO: 44884 - DNA, 15 bp, Artificial Sequence
  dgRNA
  Tmem159
gtggcctagcaaagg

SEQ ID NO: 44885 - DNA, 15 bp, Artificial Sequence
  dgRNA
  Tmem159
aaggtggcagccgcg

SEQ ID NO: 44886 - DNA, 15 bp, Artificial Sequence
  dgRNA
  Tmem159
tagccatctagatac

SEQ ID NO: 44887 - DNA, 15 bp, Artificial Sequence
  dgRNA
  Surf1
ctgcggatgagcatc

SEQ ID NO: 44888 - DNA, 15 bp, Artificial Sequence
  dgRNA
  Surf1
catctggtcagaagg

SEQ ID NO: 44889 - DNA, 15 bp, Artificial Sequence
  dgRNA
  Surf1
ggtcccacgctttcc

SEQ ID NO: 44890 - DNA, 15 bp, Artificial Sequence
  dgRNA
  Surf1
caggcacaatactcc

SEQ ID NO: 44891 - DNA, 15 bp, Artificial Sequence
  dgRNA
  Tor4a
ctaagtagggtcttt

SEQ ID NO: 44892 - DNA, 15 bp, Artificial Sequence
  dgRNA
  Tor4a
taagtagggtctttt

SEQ ID NO: 44893 - DNA, 15 bp, Artificial Sequence
  dgRNA
  Tor4a
ggggtatcctggcag

SEQ ID NO: 44894 - DNA, 15 bp, Artificial Sequence
  dgRNA
  Tor4a
aggcgatgtcagtag

SEQ ID NO: 44895 - DNA, 15 bp, Artificial Sequence
  dgRNA
  Adam32
ccagtactgcgcatg

SEQ ID NO: 44896 - DNA, 15 bp, Artificial Sequence
  dgRNA
  Adam32
cagtactgcgcatgc

SEQ ID NO: 44897 - DNA, 15 bp, Artificial Sequence
  dgRNA
  Adam32
cattgcgaagcagcc

SEQ ID NO: 44898 - DNA, 15 bp, Artificial Sequence
  dgRNA
  Adam32
ggctctgttagagct

SEQ ID NO: 44899 - DNA, 15 bp, Artificial Sequence
  dgRNA
  Ovol3
gtgatttgaataact

SEQ ID NO: 44900 - DNA, 15 bp, Artificial Sequence
  dgRNA
  Ovol3
tttgaataactaggc

SEQ ID NO: 44901 - DNA, 15 bp, Artificial Sequence
  dgRNA
  Ovol3
ctggactgatttgcc

SEQ ID NO: 44902 - DNA, 15 bp, Artificial Sequence
  dgRNA
  Ovol3
gtacccttccaggtc

SEQ ID NO: 44903 - DNA, 15 bp, Artificial Sequence
  dgRNA
  Prl6a1
caggtctatgatagt

SEQ ID NO: 44904 - DNA, 15 bp, Artificial Sequence
  dgRNA
  Prl6a1
aggtctatgatagta

SEQ ID NO: 44905 - DNA, 15 bp, Artificial Sequence
  dgRNA
  Prl6a1
agtagtacatggcct

SEQ ID NO: 44906 - DNA, 15 bp, Artificial Sequence
  dgRNA
  Prl6a1
gtagtacatggcctt

SEQ ID NO: 44907 - DNA, 15 bp, Artificial Sequence
  dgRNA
  Upk1b
ggaccggagcgtcag

SEQ ID NO: 44908 - DNA, 15 bp, Artificial Sequence
  dgRNA
  Upk1b
cgtcagaggatacag

SEQ ID NO: 44909 - DNA, 15 bp, Artificial Sequence
  dgRNA
  Upk1b
ggaggcatctcacat

SEQ ID NO: 44910 - DNA, 15 bp, Artificial Sequence
  dgRNA
  Upk1b
cggtccggggaaggg

SEQ ID NO: 44911 - DNA, 15 bp, Artificial Sequence
  dgRNA
  Mad2l1bp
gccccaggggacgac

SEQ ID NO: 44912 - DNA, 15 bp, Artificial Sequence
  dgRNA
  Mad2l1bp
ccccaggggacgact

SEQ ID NO: 44913 - DNA, 15 bp, Artificial Sequence
  dgRNA
  Mad2l1bp
actgggtcgcctaag

SEQ ID NO: 44914 - DNA, 15 bp, Artificial Sequence
  dgRNA
  Mad2l1bp
ctgggtcgcctaagt

SEQ ID NO: 44915 - DNA, 15 bp, Artificial Sequence
  dgRNA
  Car2
caggatccccgctcc

SEQ ID NO: 44916 - DNA, 15 bp, Artificial Sequence
  dgRNA
  Car2
gacgctccccgccca

SEQ ID NO: 44917 - DNA, 15 bp, Artificial Sequence
  dgRNA
  Car2
gcagccgcgtgcgtg

SEQ ID NO: 44918 - DNA, 15 bp, Artificial Sequence
  dgRNA
  Car2
cagccgcgtgcgtgc

SEQ ID NO: 44919 - DNA, 15 bp, Artificial Sequence
  dgRNA
  Emilin2
ctgtaaccaagaccc

SEQ ID NO: 44920 - DNA, 15 bp, Artificial Sequence
  dgRNA
  Emilin2
cggttcctaaccctt

SEQ ID NO: 44921 - DNA, 15 bp, Artificial Sequence
  dgRNA
  Emilin2
gaaccccctgccgag

SEQ ID NO: 44922 - DNA, 15 bp, Artificial Sequence
  dgRNA
  Emilin2
cctgccgagaggcga

SEQ ID NO: 44923 - DNA, 15 bp, Artificial Sequence
  dgRNA
  Prmt7
tcgacctcgctgctc

SEQ ID NO: 44924 - DNA, 15 bp, Artificial Sequence
  dgRNA
  Prmt7
cgacctcgctgctcc

SEQ ID NO: 44925 - DNA, 15 bp, Artificial Sequence
  dgRNA
  Prmt7
gacctcgctgctccg

SEQ ID NO: 44926 - DNA, 15 bp, Artificial Sequence
  dgRNA
  Prmt7
acctcgctgctccgg

SEQ ID NO: 44927 - DNA, 15 bp, Artificial Sequence
  dgRNA
  Fam49b
cctcgtcccaggtga

SEQ ID NO: 44928 - DNA, 15 bp, Artificial Sequence
  dgRNA
  Fam49b
ggggacccggcgccc

SEQ ID NO: 44929 - DNA, 15 bp, Artificial Sequence
  dgRNA
  Fam49b
gggacccggcgccct

SEQ ID NO: 44930 - DNA, 15 bp, Artificial Sequence
  dgRNA
  Fam49b
ggacccggcgccctg

SEQ ID NO: 44931 - DNA, 15 bp, Artificial Sequence
  dgRNA
  Acvr1c
ctaaggtttcaacaa

SEQ ID NO: 44932 - DNA, 15 bp, Artificial Sequence
  dgRNA
  Acvr1c
tcgtgatctgaatag

SEQ ID NO: 44933 - DNA, 15 bp, Artificial Sequence
  dgRNA
  Acvr1c
ccaaggtgtaaaaag

SEQ ID NO: 44934 - DNA, 15 bp, Artificial Sequence
  dgRNA
  Acvr1c
ctttttacaccttgg

SEQ ID NO: 44935 - DNA, 15 bp, Artificial Sequence
  dgRNA
  Itga9
ccgaggtccagaacc

SEQ ID NO: 44936 - DNA, 15 bp, Artificial Sequence
  dgRNA
  Itga9
agaccgcgtccagca

SEQ ID NO: 44937 - DNA, 15 bp, Artificial Sequence
  dgRNA
  Itga9
gaccgcgtccagcag

SEQ ID NO: 44938 - DNA, 15 bp, Artificial Sequence
  dgRNA
  Itga9
accgcgtccagcagg

SEQ ID NO: 44939 - DNA, 15 bp, Artificial Sequence
  dgRNA
  Irf7
gtactataaaagcac

SEQ ID NO: 44940 - DNA, 15 bp, Artificial Sequence
  dgRNA
  Irf7
cttcgggcagaggcg

SEQ ID NO: 44941 - DNA, 15 bp, Artificial Sequence
  dgRNA
  Irf7
tacttcgggcagagg

SEQ ID NO: 44942 - DNA, 15 bp, Artificial Sequence
  dgRNA
  Irf7
tagtacttcgggcag

SEQ ID NO: 44943 - DNA, 15 bp, Artificial Sequence
  dgRNA
  Tbx10
tccgcccttccatct

SEQ ID NO: 44944 - DNA, 15 bp, Artificial Sequence
  dgRNA
  Tbx10
cgcccccacatgcac

SEQ ID NO: 44945 - DNA, 15 bp, Artificial Sequence
  dgRNA
  Tbx10
tggggcccattgatc

SEQ ID NO: 44946 - DNA, 15 bp, Artificial Sequence
  dgRNA
  Tbx10
tgatcaggaatagct

SEQ ID NO: 44947 - DNA, 15 bp, Artificial Sequence
  dgRNA
  Mgat4c
cgagtgccgttatga

SEQ ID NO: 44948 - DNA, 15 bp, Artificial Sequence
  dgRNA
  Mgat4c
atcataacggcactc

SEQ ID NO: 44949 - DNA, 15 bp, Artificial Sequence
  dgRNA
  Mgat4c
catcataacggcact

SEQ ID NO: 44950 - DNA, 15 bp, Artificial Sequence
  dgRNA
  Mgat4c
gcatgagtgatcctt

SEQ ID NO: 44951 - DNA, 15 bp, Artificial Sequence
  dgRNA
  Megf11
gtaaaagaacgataa

SEQ ID NO: 44952 - DNA, 15 bp, Artificial Sequence
  dgRNA
  Megf11
taaaagaacgataac

SEQ ID NO: 44953 - DNA, 15 bp, Artificial Sequence
  dgRNA
  Megf11
aagaacgataacggg

SEQ ID NO: 44954 - DNA, 15 bp, Artificial Sequence
  dgRNA
  Megf11
ctaggaaaaagagcg

SEQ ID NO: 44955 - DNA, 15 bp, Artificial Sequence
  dgRNA
  Il1a
tataatctgtccttc

SEQ ID NO: 44956 - DNA, 15 bp, Artificial Sequence
  dgRNA
  Il1a
cttctggccggtatc

SEQ ID NO: 44957 - DNA, 15 bp, Artificial Sequence
  dgRNA
  Il1a
actcctacctgcttg

SEQ ID NO: 44958 - DNA, 15 bp, Artificial Sequence
  dgRNA
  Il1a
ttgcaaagattccac

SEQ ID NO: 44959 - DNA, 15 bp, Artificial Sequence
  dgRNA
  Pmepa1
cgcagcgccggcgac

SEQ ID NO: 44960 - DNA, 15 bp, Artificial Sequence
  dgRNA
  Pmepa1
ggcgaccggtctaca

SEQ ID NO: 44961 - DNA, 15 bp, Artificial Sequence
  dgRNA
  Pmepa1
gtctacatggacgct

SEQ ID NO: 44962 - DNA, 15 bp, Artificial Sequence
  dgRNA
  Pmepa1
catggacgctaggct

SEQ ID NO: 44963 - DNA, 15 bp, Artificial Sequence
  dgRNA
  Pcdhga6
ttcttgctcgggtta

SEQ ID NO: 44964 - DNA, 15 bp, Artificial Sequence
  dgRNA
  Pcdhga6
tttcttgctcgggtt

SEQ ID NO: 44965 - DNA, 15 bp, Artificial Sequence
  dgRNA
  Gnb1l
gacccaagccggctc

SEQ ID NO: 44966 - DNA, 15 bp, Artificial Sequence
  dgRNA
  Gnb1l
acccaagccggctct

SEQ ID NO: 44967 - DNA, 15 bp, Artificial Sequence
  dgRNA
  Gnb1l
ccggcttgggtctaa

SEQ ID NO: 44968 - DNA, 15 bp, Artificial Sequence
  dgRNA
  Gnb1l
acccagagccggctt

SEQ ID NO: 44969 - DNA, 15 bp, Artificial Sequence
  dgRNA
  Spata22
cctttaactctcgcg

SEQ ID NO: 44970 - DNA, 15 bp, Artificial Sequence
  dgRNA
  Spata22
ccgcgcttgcttgcg

SEQ ID NO: 44971 - DNA, 15 bp, Artificial Sequence
  dgRNA
  Spata22
cgtggttagtagcgc

SEQ ID NO: 44972 - DNA, 15 bp, Artificial Sequence
  dgRNA
  Spata22
tgcgcactgagcttc

SEQ ID NO: 44973 - DNA, 15 bp, Artificial Sequence
  dgRNA
  Soat2
tgatcatagtggttg

SEQ ID NO: 44974 - DNA, 15 bp, Artificial Sequence
  dgRNA
  Soat2
ctatctaaccctcaa

SEQ ID NO: 44975 - DNA, 15 bp, Artificial Sequence
  dgRNA
  Soat2
tatctaaccctcaac

SEQ ID NO: 44976 - DNA, 15 bp, Artificial Sequence
  dgRNA
  Soat2
atctaaccctcaacg

SEQ ID NO: 44977 - DNA, 15 bp, Artificial Sequence
  dgRNA
  Abcf2
ttcttcaaaccggct

SEQ ID NO: 44978 - DNA, 15 bp, Artificial Sequence
  dgRNA
  Abcf2
tcaaaccggcttggt

SEQ ID NO: 44979 - DNA, 15 bp, Artificial Sequence
  dgRNA
  Abcf2
accggcttggtagga

SEQ ID NO: 44980 - DNA, 15 bp, Artificial Sequence
  dgRNA
  Abcf2
ccggcttggtaggac

SEQ ID NO: 44981 - DNA, 15 bp, Artificial Sequence
  dgRNA
  Cox19
gatcctttcgcaaca

SEQ ID NO: 44982 - DNA, 15 bp, Artificial Sequence
  dgRNA
  Cox19
ctttcgcaacacggc

SEQ ID NO: 44983 - DNA, 15 bp, Artificial Sequence
  dgRNA
  Cox19
tttcgcaacacggca

SEQ ID NO: 44984 - DNA, 15 bp, Artificial Sequence
  dgRNA
  Cox19
ttcgcaacacggcag

SEQ ID NO: 44985 - DNA, 15 bp, Artificial Sequence
  dgRNA
  Med23
agcgctgtcagctta

SEQ ID NO: 44986 - DNA, 15 bp, Artificial Sequence
  dgRNA
  Med23
gcgctgtcagcttac

SEQ ID NO: 44987 - DNA, 15 bp, Artificial Sequence
  dgRNA
  Med23
cgctgtcagcttacg

SEQ ID NO: 44988 - DNA, 15 bp, Artificial Sequence
  dgRNA
  Med23
ggtcacctctacgag

SEQ ID NO: 44989 - DNA, 15 bp, Artificial Sequence
  dgRNA
  Evi2a
caatgggatgacaag

SEQ ID NO: 44990 - DNA, 15 bp, Artificial Sequence
  dgRNA
  Gm7073
atggctggcagtatt

SEQ ID NO: 44991 - DNA, 15 bp, Artificial Sequence
  dgRNA
  Gm7073
catggctggcagtat

SEQ ID NO: 44992 - DNA, 15 bp, Artificial Sequence
  dgRNA
  Gm7073
gggaccatttctgca

SEQ ID NO: 44993 - DNA, 15 bp, Artificial Sequence
  dgRNA
  Slc38a7
actggataaacgggt

SEQ ID NO: 44994 - DNA, 15 bp, Artificial Sequence
  dgRNA
  Slc38a7
gctcagaactattgt

SEQ ID NO: 44995 - DNA, 15 bp, Artificial Sequence
  dgRNA
  Slc38a7
ctcagaactattgtt

SEQ ID NO: 44996 - DNA, 15 bp, Artificial Sequence
  dgRNA
  Slc38a7
gctggtgtggtccga

SEQ ID NO: 44997 - DNA, 15 bp, Artificial Sequence
  dgRNA
  Tcfl5
ggcgtggcctgtcca

SEQ ID NO: 44998 - DNA, 15 bp, Artificial Sequence
  dgRNA
  Tcfl5
gcggggcaagcgggc

SEQ ID NO: 44999 - DNA, 15 bp, Artificial Sequence
  dgRNA
  Tcfl5
aagcgggcgggcagt

SEQ ID NO: 45000 - DNA, 15 bp, Artificial Sequence
  dgRNA
  Tcfl5
gggcgggcagttggc

SEQ ID NO: 45001 - DNA, 15 bp, Artificial Sequence
  dgRNA
  Mpdu1
gcgtaaacaaaagtg

SEQ ID NO: 45002 - DNA, 15 bp, Artificial Sequence
  dgRNA
  Mpdu1
aagtcctaacagcgc

SEQ ID NO: 45003 - DNA, 15 bp, Artificial Sequence
  dgRNA
  Mpdu1
cgcaggcgccaaacg

SEQ ID NO: 45004 - DNA, 15 bp, Artificial Sequence
  dgRNA
  Mpdu1
aaaattcgaacgtca

SEQ ID NO: 45005 - DNA, 15 bp, Artificial Sequence
  dgRNA
  Chchd6
gtctcagcgtctatt

SEQ ID NO: 45006 - DNA, 15 bp, Artificial Sequence
  dgRNA
  Chchd6
cagcgtctatttggc

SEQ ID NO: 45007 - DNA, 15 bp, Artificial Sequence
  dgRNA
  Chchd6
atggcgccagaatgc

SEQ ID NO: 45008 - DNA, 15 bp, Artificial Sequence
  dgRNA
  Chchd6
atagacgctgagaca

SEQ ID NO: 45009 - DNA, 15 bp, Artificial Sequence
  dgRNA
  Galc
ctaagatgatccatc

SEQ ID NO: 45010 - DNA, 15 bp, Artificial Sequence
  dgRNA
  Galc
atgatccatcaggtg

SEQ ID NO: 45011 - DNA, 15 bp, Artificial Sequence
  dgRNA
  Galc
attacacgcagagac

SEQ ID NO: 45012 - DNA, 15 bp, Artificial Sequence
  dgRNA
  Galc
acaacggtcaaaaga

SEQ ID NO: 45013 - DNA, 15 bp, Artificial Sequence
  dgRNA
  Wdyhv1
cacccggaaccacgc

SEQ ID NO: 45014 - DNA, 15 bp, Artificial Sequence
  dgRNA
  Wdyhv1
caggcttcgtcatcc

SEQ ID NO: 45015 - DNA, 15 bp, Artificial Sequence
  dgRNA
  Wdyhv1
aggcttcgtcatccc

SEQ ID NO: 45016 - DNA, 15 bp, Artificial Sequence
  dgRNA
  Wdyhv1
cgccctcacgctgca

SEQ ID NO: 45017 - DNA, 15 bp, Artificial Sequence
  dgRNA
  Mrps18b
aggattcatcgtgac

SEQ ID NO: 45018 - DNA, 15 bp, Artificial Sequence
  dgRNA
  Mrps18b
tcatcgtgactggtc

SEQ ID NO: 45019 - DNA, 15 bp, Artificial Sequence
  dgRNA
  Mrps18b
catcgtgactggtcc

SEQ ID NO: 45020 - DNA, 15 bp, Artificial Sequence
  dgRNA
  Mrps18b
ttaaattcgcgtctg

SEQ ID NO: 45021 - DNA, 15 bp, Artificial Sequence
  dgRNA
  Olfr114
atagcttgagatcta

SEQ ID NO: 45022 - DNA, 15 bp, Artificial Sequence
  dgRNA
  Olfr114
taaatgggccatcac

SEQ ID NO: 45023 - DNA, 15 bp, Artificial Sequence
  dgRNA
  Olfr114
ggtgaatgtataaat

SEQ ID NO: 45024 - DNA, 15 bp, Artificial Sequence
  dgRNA
  Anks4b
ggtcattgccatggt

SEQ ID NO: 45025 - DNA, 15 bp, Artificial Sequence
  dgRNA
  Anks4b
caagtccaggattgc

SEQ ID NO: 45026 - DNA, 15 bp, Artificial Sequence
  dgRNA
  Anks4b
gattgcaggtcttcc

SEQ ID NO: 45027 - DNA, 15 bp, Artificial Sequence
  dgRNA
  Anks4b
ggccggagtgaactt

SEQ ID NO: 45028 - DNA, 15 bp, Artificial Sequence
  dgRNA
  Il6ra
gtgtggcgcggctgc

SEQ ID NO: 45029 - DNA, 15 bp, Artificial Sequence
  dgRNA
  Il6ra
ggaagtaaccccctc

SEQ ID NO: 45030 - DNA, 15 bp, Artificial Sequence
  dgRNA
  Il6ra
agtaaccccctccgg

SEQ ID NO: 45031 - DNA, 15 bp, Artificial Sequence
  dgRNA
  Il6ra
ccccctccggtggcc

SEQ ID NO: 45032 - DNA, 15 bp, Artificial Sequence
  dgRNA
  Trim36
tagcgagagcgtgag

SEQ ID NO: 45033 - DNA, 15 bp, Artificial Sequence
  dgRNA
  Trim36
cgagagcgtgagtgg

SEQ ID NO: 45034 - DNA, 15 bp, Artificial Sequence
  dgRNA
  Trim36
gagagcgtgagtggt

SEQ ID NO: 45035 - DNA, 15 bp, Artificial Sequence
  dgRNA
  Trim36
cccgccccctttgtg

SEQ ID NO: 45036 - DNA, 15 bp, Artificial Sequence
  dgRNA
  Uqcrc1
cataccgcctccctc

SEQ ID NO: 45037 - DNA, 15 bp, Artificial Sequence
  dgRNA
  Uqcrc1
accgcctccctcagg

SEQ ID NO: 45038 - DNA, 15 bp, Artificial Sequence
  dgRNA
  Uqcrc1
gggcccctccctcgc

SEQ ID NO: 45039 - DNA, 15 bp, Artificial Sequence
  dgRNA
  Uqcrc1
tcccgaagatcctag

SEQ ID NO: 45040 - DNA, 15 bp, Artificial Sequence
  dgRNA
  Xrcc1
gccgctcttgttgct

SEQ ID NO: 45041 - DNA, 15 bp, Artificial Sequence
  dgRNA
  Xrcc1
agtctccacgttatc

SEQ ID NO: 45042 - DNA, 15 bp, Artificial Sequence
  dgRNA
  Xrcc1
ctccacgttatcagg

SEQ ID NO: 45043 - DNA, 15 bp, Artificial Sequence
  dgRNA
  Xrcc1
cgttatcaggcggct

SEQ ID NO: 45044 - DNA, 15 bp, Artificial Sequence
  dgRNA
  Defb2
tctcaggaatcgtga

SEQ ID NO: 45045 - DNA, 15 bp, Artificial Sequence
  dgRNA
  Defb2
gtctcaggaatcgtg

SEQ ID NO: 45046 - DNA, 15 bp, Artificial Sequence
  dgRNA
  Opcml
tagtcaatttctgcc

SEQ ID NO: 45047 - DNA, 15 bp, Artificial Sequence
  dgRNA
  Opcml
tgtcccgagacctgc

SEQ ID NO: 45048 - DNA, 15 bp, Artificial Sequence
  dgRNA
  Opcml
gtcccgagacctgct

SEQ ID NO: 45049 - DNA, 15 bp, Artificial Sequence
  dgRNA
  Opcml
tcccgagacctgctg

SEQ ID NO: 45050 - DNA, 15 bp, Artificial Sequence
  dgRNA
  Ankrd6
cttgttggcagccgc

SEQ ID NO: 45051 - DNA, 15 bp, Artificial Sequence
  dgRNA
  Ankrd6
gctccttggataagg

SEQ ID NO: 45052 - DNA, 15 bp, Artificial Sequence
  dgRNA
  Ankrd6
ctgccaacaagcatt

SEQ ID NO: 45053 - DNA, 15 bp, Artificial Sequence
  dgRNA
  Ankrd6
gttcccccttatcca

SEQ ID NO: 45054 - DNA, 15 bp, Artificial Sequence
  dgRNA
  Pkd1l3
cgtattgttcttttg

SEQ ID NO: 45055 - DNA, 15 bp, Artificial Sequence
  dgRNA
  Pkd1l3
agatgtacggaggct

SEQ ID NO: 45056 - DNA, 15 bp, Artificial Sequence
  dgRNA
  Pkd1l3
aagagagatgtacgg

SEQ ID NO: 45057 - DNA, 15 bp, Artificial Sequence
  dgRNA
  Mmab
gctcctttacagatt

SEQ ID NO: 45058 - DNA, 15 bp, Artificial Sequence
  dgRNA
  Mmab
ctacaagtaatccaa

SEQ ID NO: 45059 - DNA, 15 bp, Artificial Sequence
  dgRNA
  Mmab
tacaagtaatccaat

SEQ ID NO: 45060 - DNA, 15 bp, Artificial Sequence
  dgRNA
  Mmab
gggagtgccccgccc

SEQ ID NO: 45061 - DNA, 15 bp, Artificial Sequence
  dgRNA
  Pitpnb
tcgtgctccgtgagc

SEQ ID NO: 45062 - DNA, 15 bp, Artificial Sequence
  dgRNA
  Pitpnb
cgtgctccgtgagcg

SEQ ID NO: 45063 - DNA, 15 bp, Artificial Sequence
  dgRNA
  Pitpnb
gagcggggcgtggac

SEQ ID NO: 45064 - DNA, 15 bp, Artificial Sequence
  dgRNA
  Pitpnb
agcggggcgtggact

SEQ ID NO: 45065 - DNA, 15 bp, Artificial Sequence
  dgRNA
  Dok3
gcagcaagaacccta

SEQ ID NO: 45066 - DNA, 15 bp, Artificial Sequence
  dgRNA
  Dok3
cagcaagaaccctaa

SEQ ID NO: 45067 - DNA, 15 bp, Artificial Sequence
  dgRNA
  Dok3
cccttaagtgaagcc

SEQ ID NO: 45068 - DNA, 15 bp, Artificial Sequence
  dgRNA
  Dok3
ccttaagtgaagccc

SEQ ID NO: 45069 - DNA, 15 bp, Artificial Sequence
  dgRNA
  Pfkm
attacttacttcacg

SEQ ID NO: 45070 - DNA, 15 bp, Artificial Sequence
  dgRNA
  Pes1
gagctttagagaatt

SEQ ID NO: 45071 - DNA, 15 bp, Artificial Sequence
  dgRNA
  Pes1
tggttgtaaataacg

SEQ ID NO: 45072 - DNA, 15 bp, Artificial Sequence
  dgRNA
  Pes1
tctctggatttgtac

SEQ ID NO: 45073 - DNA, 15 bp, Artificial Sequence
  dgRNA
  Pes1
cctcagctggcggcg

SEQ ID NO: 45074 - DNA, 15 bp, Artificial Sequence
  dgRNA
  Ddi2
agcctagcgtcgcga

SEQ ID NO: 45075 - DNA, 15 bp, Artificial Sequence
  dgRNA
  Ddi2
cgtcgcgaaggctgc

SEQ ID NO: 45076 - DNA, 15 bp, Artificial Sequence
  dgRNA
  Ddi2
gcctggcgcgcttta

SEQ ID NO: 45077 - DNA, 15 bp, Artificial Sequence
  dgRNA
  Ddi2
cgcgctttacggccg

SEQ ID NO: 45078 - DNA, 15 bp, Artificial Sequence
  dgRNA
  Ndufb5
tgcccttactaaaca

SEQ ID NO: 45079 - DNA, 15 bp, Artificial Sequence
  dgRNA
  Ndufb5
acatggccgctccca

SEQ ID NO: 45080 - DNA, 15 bp, Artificial Sequence
  dgRNA
  Ndufb5
tgccatagagtttac

SEQ ID NO: 45081 - DNA, 15 bp, Artificial Sequence
  dgRNA
  Ndufb5
gccatagagtttaca

SEQ ID NO: 45082 - DNA, 15 bp, Artificial Sequence
  dgRNA
  Lin52
actttaaccactccg

SEQ ID NO: 45083 - DNA, 15 bp, Artificial Sequence
  dgRNA
  Lin52
ctttaaccactccgt

SEQ ID NO: 45084 - DNA, 15 bp, Artificial Sequence
  dgRNA
  Lin52
taaccactccgtggg

SEQ ID NO: 45085 - DNA, 15 bp, Artificial Sequence
  dgRNA
  Lin52
aaccactccgtgggt

SEQ ID NO: 45086 - DNA, 15 bp, Artificial Sequence
  dgRNA
  Olfr969
ataagtgacatgtat

SEQ ID NO: 45087 - DNA, 15 bp, Artificial Sequence
  dgRNA
  Eml1
gagccccgacttgac

SEQ ID NO: 45088 - DNA, 15 bp, Artificial Sequence
  dgRNA
  Eml1
cttgactggcaccct

SEQ ID NO: 45089 - DNA, 15 bp, Artificial Sequence
  dgRNA
  Eml1
gactggcaccctagg

SEQ ID NO: 45090 - DNA, 15 bp, Artificial Sequence
  dgRNA
  Eml1
gggagcgcacctctc

SEQ ID NO: 45091 - DNA, 15 bp, Artificial Sequence
  dgRNA
  Nxf3
agtaccagagtctcg

SEQ ID NO: 45092 - DNA, 15 bp, Artificial Sequence
  dgRNA
  Nxf3
gcttcagactctagt

SEQ ID NO: 45093 - DNA, 15 bp, Artificial Sequence
  dgRNA
  Nxf3
actctagttggcttc

SEQ ID NO: 45094 - DNA, 15 bp, Artificial Sequence
  dgRNA
  Nxf3
gctcgtagaaacttc

SEQ ID NO: 45095 - DNA, 15 bp, Artificial Sequence
  dgRNA
  Mettl15
acaccctttcaaagt

SEQ ID NO: 45096 - DNA, 15 bp, Artificial Sequence
  dgRNA
  Mettl15
gagcagcggaactaa

SEQ ID NO: 45097 - DNA, 15 bp, Artificial Sequence
  dgRNA
  Mettl15
cttcagttgctccga

SEQ ID NO: 45098 - DNA, 15 bp, Artificial Sequence
  dgRNA
  Mettl15
agttgctccgacgga

SEQ ID NO: 45099 - DNA, 15 bp, Artificial Sequence
  dgRNA
  Gm11562
agtgatcatgtgcct

SEQ ID NO: 45100 - DNA, 15 bp, Artificial Sequence
  dgRNA
  Gm11562
tgtccaggtatataa

SEQ ID NO: 45101 - DNA, 15 bp, Artificial Sequence
  dgRNA
  Gm11562
gttagcattgactaa

SEQ ID NO: 45102 - DNA, 15 bp, Artificial Sequence
  dgRNA
  Gm11562
ctcttgtaaatgctc

SEQ ID NO: 45103 - DNA, 15 bp, Artificial Sequence
  dgRNA
  Khdc3
actctgtcccaatgt

SEQ ID NO: 45104 - DNA, 15 bp, Artificial Sequence
  dgRNA
  Khdc3
ctctgtcccaatgtt

SEQ ID NO: 45105 - DNA, 15 bp, Artificial Sequence
  dgRNA
  Khdc3
cctgtggtcatactt

SEQ ID NO: 45106 - DNA, 15 bp, Artificial Sequence
  dgRNA
  Khdc3
ggtttgggatccaat

SEQ ID NO: 45107 - DNA, 15 bp, Artificial Sequence
  dgRNA
  Fbxo28
gagtggaaacgagca

SEQ ID NO: 45108 - DNA, 15 bp, Artificial Sequence
  dgRNA
  Fbxo28
acacttcaagagagg

SEQ ID NO: 45109 - DNA, 15 bp, Artificial Sequence
  dgRNA
  Fbxo28
tgcacacttcaagag

SEQ ID NO: 45110 - DNA, 15 bp, Artificial Sequence
  dgRNA
  Fbxo28
gtccatcggaaagga

SEQ ID NO: 45111 - DNA, 15 bp, Artificial Sequence
  dgRNA
  Hoxc5
gaaattcctccgagt

SEQ ID NO: 45112 - DNA, 15 bp, Artificial Sequence
  dgRNA
  Hoxc5
ctccgagtcggcacc

SEQ ID NO: 45113 - DNA, 15 bp, Artificial Sequence
  dgRNA
  Hoxc5
gaagttgttgcttgt

SEQ ID NO: 45114 - DNA, 15 bp, Artificial Sequence
  dgRNA
  Hoxc5
tcttgtagcatcgct

SEQ ID NO: 45115 - DNA, 15 bp, Artificial Sequence
  dgRNA
  Klk14
gaaaagatgcctacc

SEQ ID NO: 45116 - DNA, 15 bp, Artificial Sequence
  dgRNA
  Snapin
agatccgccccctac

SEQ ID NO: 45117 - DNA, 15 bp, Artificial Sequence
  dgRNA
  Snapin
tcccggcccgcttgc

SEQ ID NO: 45118 - DNA, 15 bp, Artificial Sequence
  dgRNA
  Snapin
cccggcccgcttgcc

SEQ ID NO: 45119 - DNA, 15 bp, Artificial Sequence
  dgRNA
  Snapin
ccggcccgcttgccg

SEQ ID NO: 45120 - DNA, 15 bp, Artificial Sequence
  dgRNA
  Ankfn1
gaagcttagtgatca

SEQ ID NO: 45121 - DNA, 15 bp, Artificial Sequence
  dgRNA
  Ankfn1
gcgatgcatgggcag

SEQ ID NO: 45122 - DNA, 15 bp, Artificial Sequence
  dgRNA
  Ankfn1
gcaggagcgatgcat

SEQ ID NO: 45123 - DNA, 15 bp, Artificial Sequence
  dgRNA
  Ankfn1
agcaggagcgatgca

SEQ ID NO: 45124 - DNA, 15 bp, Artificial Sequence
  dgRNA
  Tomm40l
ttgggcggtcttaaa

SEQ ID NO: 45125 - DNA, 15 bp, Artificial Sequence
  dgRNA
  Tomm40l
tgggcggtcttaaaa

SEQ ID NO: 45126 - DNA, 15 bp, Artificial Sequence
  dgRNA
  Tomm40l
gggcggtcttaaaag

SEQ ID NO: 45127 - DNA, 15 bp, Artificial Sequence
  dgRNA
  Tomm40l
ggcggtcttaaaagg

SEQ ID NO: 45128 - DNA, 15 bp, Artificial Sequence
  dgRNA
  Dzip3
actgcagtcggtgat

SEQ ID NO: 45129 - DNA, 15 bp, Artificial Sequence
  dgRNA
  Dzip3
cagtcggtgattggc

SEQ ID NO: 45130 - DNA, 15 bp, Artificial Sequence
  dgRNA
  Dzip3
agtcggtgattggca

SEQ ID NO: 45131 - DNA, 15 bp, Artificial Sequence
  dgRNA
  Dzip3
cggtgattggcaggg

SEQ ID NO: 45132 - DNA, 15 bp, Artificial Sequence
  dgRNA
  Glrx3
caccaatacaaagca

SEQ ID NO: 45133 - DNA, 15 bp, Artificial Sequence
  dgRNA
  Glrx3
agttctcccagtccg

SEQ ID NO: 45134 - DNA, 15 bp, Artificial Sequence
  dgRNA
  Glrx3
gttctcccagtccga

SEQ ID NO: 45135 - DNA, 15 bp, Artificial Sequence
  dgRNA
  Glrx3
cgtgaccttcagtgc

SEQ ID NO: 45136 - DNA, 15 bp, Artificial Sequence
  dgRNA
  Zfp324
cccgccatggatacc

SEQ ID NO: 45137 - DNA, 15 bp, Artificial Sequence
  dgRNA
  Zfp324
accctcctgtcattc

SEQ ID NO: 45138 - DNA, 15 bp, Artificial Sequence
  dgRNA
  Zfp324
atccgtgctgtgcat

SEQ ID NO: 45139 - DNA, 15 bp, Artificial Sequence
  dgRNA
  Zfp324
tccgtgctgtgcatt

SEQ ID NO: 45140 - DNA, 15 bp, Artificial Sequence
  dgRNA
  Il7r
gcttcagatgatctc

SEQ ID NO: 45141 - DNA, 15 bp, Artificial Sequence
  dgRNA
  Il7r
tacttttgagcaagg

SEQ ID NO: 45142 - DNA, 15 bp, Artificial Sequence
  dgRNA
  Il7r
gtagagaaaacggag

SEQ ID NO: 45143 - DNA, 15 bp, Artificial Sequence
  dgRNA
  Ndufs5
cacgacagtgctgaa

SEQ ID NO: 45144 - DNA, 15 bp, Artificial Sequence
  dgRNA
  Ndufs5
acgacagtgctgaaa

SEQ ID NO: 45145 - DNA, 15 bp, Artificial Sequence
  dgRNA
  Ndufs5
gggagaactcactac

SEQ ID NO: 45146 - DNA, 15 bp, Artificial Sequence
  dgRNA
  Ndufs5
ggagaactcactacc

SEQ ID NO: 45147 - DNA, 15 bp, Artificial Sequence
  dgRNA
  Fermt1
gggcgggcagctgtc

SEQ ID NO: 45148 - DNA, 15 bp, Artificial Sequence
  dgRNA
  Fermt1
tctggagaatctaac

SEQ ID NO: 45149 - DNA, 15 bp, Artificial Sequence
  dgRNA
  Fermt1
gcggtgagccactct

SEQ ID NO: 45150 - DNA, 15 bp, Artificial Sequence
  dgRNA
  Fermt1
ctcagtctgatcaga

SEQ ID NO: 45151 - DNA, 15 bp, Artificial Sequence
  dgRNA
  Baiap2l2
ccaggcgtggggcct

SEQ ID NO: 45152 - DNA, 15 bp, Artificial Sequence
  dgRNA
  Baiap2l2
cgtggggccttgggt

SEQ ID NO: 45153 - DNA, 15 bp, Artificial Sequence
  dgRNA
  Baiap2l2
gggtaggaggcgacc

SEQ ID NO: 45154 - DNA, 15 bp, Artificial Sequence
  dgRNA
  Baiap2l2
ggtaggaggcgacct

SEQ ID NO: 45155 - DNA, 15 bp, Artificial Sequence
  dgRNA
  Sppl2c
gagctccctccctac

SEQ ID NO: 45156 - DNA, 15 bp, Artificial Sequence
  dgRNA
  Sppl2c
acctcactttatgac

SEQ ID NO: 45157 - DNA, 15 bp, Artificial Sequence
  dgRNA
  Sppl2c
atcctggctccagta

SEQ ID NO: 45158 - DNA, 15 bp, Artificial Sequence
  dgRNA
  Sppl2c
ggtagagcactcagt

SEQ ID NO: 45159 - DNA, 15 bp, Artificial Sequence
  dgRNA
  Tac1
agttcccaaagtccg

SEQ ID NO: 45160 - DNA, 15 bp, Artificial Sequence
  dgRNA
  Tac1
ttgatgagtaatctc

SEQ ID NO: 45161 - DNA, 15 bp, Artificial Sequence
  dgRNA
  Tac1
cttgttcggaagaag

SEQ ID NO: 45162 - DNA, 15 bp, Artificial Sequence
  dgRNA
  Tac1
tcagacgaagaaaac

SEQ ID NO: 45163 - DNA, 15 bp, Artificial Sequence
  dgRNA
  Stx16
gccgtgaaaagccta

SEQ ID NO: 45164 - DNA, 15 bp, Artificial Sequence
  dgRNA
  Stx16
atcaggactacaagg

SEQ ID NO: 45165 - DNA, 15 bp, Artificial Sequence
  dgRNA
  Stx16
actacaagggggggt

SEQ ID NO: 45166 - DNA, 15 bp, Artificial Sequence
  dgRNA
  Stx16
agggggggtcacaaa

SEQ ID NO: 45167 - DNA, 15 bp, Artificial Sequence
  dgRNA
  Fmn1
gaccaggagaatcgt

SEQ ID NO: 45168 - DNA, 15 bp, Artificial Sequence
  dgRNA
  Fmn1
gaatcgtaggctctg

SEQ ID NO: 45169 - DNA, 15 bp, Artificial Sequence
  dgRNA
  Fmn1
tcgtaggctctgggg

SEQ ID NO: 45170 - DNA, 15 bp, Artificial Sequence
  dgRNA
  Fmn1
ctgggattacgggac

SEQ ID NO: 45171 - DNA, 15 bp, Artificial Sequence
  dgRNA
  Tbrg4
acgtttcccacgacc

SEQ ID NO: 45172 - DNA, 15 bp, Artificial Sequence
  dgRNA
  Tbrg4
tgagcgcaacaaaga

SEQ ID NO: 45173 - DNA, 15 bp, Artificial Sequence
  dgRNA
  Tbrg4
caaagatggcgactg

SEQ ID NO: 45174 - DNA, 15 bp, Artificial Sequence
  dgRNA
  Tbrg4
gatggcgactgcgga

SEQ ID NO: 45175 - DNA, 15 bp, Artificial Sequence
  dgRNA
  Arhgef2
ggacagccgagctaa

SEQ ID NO: 45176 - DNA, 15 bp, Artificial Sequence
  dgRNA
  Arhgef2
taagggaggtcgctg

SEQ ID NO: 45177 - DNA, 15 bp, Artificial Sequence
  dgRNA
  Arhgef2
gttcctaagcgctaa

SEQ ID NO: 45178 - DNA, 15 bp, Artificial Sequence
  dgRNA
  Arhgef2
ttcctaagcgctaaa

SEQ ID NO: 45179 - DNA, 15 bp, Artificial Sequence
  dgRNA
  Zfp239
caacttgaactattc

SEQ ID NO: 45180 - DNA, 15 bp, Artificial Sequence
  dgRNA
  Zfp239
aacttgaactattca

SEQ ID NO: 45181 - DNA, 15 bp, Artificial Sequence
  dgRNA
  Zfp239
accacaacctcaaac

SEQ ID NO: 45182 - DNA, 15 bp, Artificial Sequence
  dgRNA
  Zfp239
cacaacctcaaactg

SEQ ID NO: 45183 - DNA, 15 bp, Artificial Sequence
  dgRNA
  Cdk5r1
gcgccgctcgcgctg

SEQ ID NO: 45184 - DNA, 15 bp, Artificial Sequence
  dgRNA
  Cdk5r1
cgccgctcgcgctga

SEQ ID NO: 45185 - DNA, 15 bp, Artificial Sequence
  dgRNA
  Cdk5r1
gctgagggacgcgag

SEQ ID NO: 45186 - DNA, 15 bp, Artificial Sequence
  dgRNA
  Cdk5r1
gagggacgcgagtgg

SEQ ID NO: 45187 - DNA, 15 bp, Artificial Sequence
  dgRNA
  Ddx28
gacgaaataagctga

SEQ ID NO: 45188 - DNA, 15 bp, Artificial Sequence
  dgRNA
  Ddx28
tctaaactaaagaac

SEQ ID NO: 45189 - DNA, 15 bp, Artificial Sequence
  dgRNA
  Ddx28
tgaccctacctctcc

SEQ ID NO: 45190 - DNA, 15 bp, Artificial Sequence
  dgRNA
  Ddx28
ggtctccgttctttc

SEQ ID NO: 45191 - DNA, 15 bp, Artificial Sequence
  dgRNA
  Serpinb8
attccaactgccaac

SEQ ID NO: 45192 - DNA, 15 bp, Artificial Sequence
  dgRNA
  Serpinb8
aatgcaagagccggt

SEQ ID NO: 45193 - DNA, 15 bp, Artificial Sequence
  dgRNA
  Sdcbp
aatgagcattcgttc

SEQ ID NO: 45194 - DNA, 15 bp, Artificial Sequence
  dgRNA
  Sdcbp
tcgttctgggaacaa

SEQ ID NO: 45195 - DNA, 15 bp, Artificial Sequence
  dgRNA
  Sdcbp
cgttctgggaacaaa

SEQ ID NO: 45196 - DNA, 15 bp, Artificial Sequence
  dgRNA
  Sdcbp
aagggtagtaaaagg

SEQ ID NO: 45197 - DNA, 15 bp, Artificial Sequence
  dgRNA
  Jarid2
aaggggactattcta

SEQ ID NO: 45198 - DNA, 15 bp, Artificial Sequence
  dgRNA
  Jarid2
gtccccttgatcttc

SEQ ID NO: 45199 - DNA, 15 bp, Artificial Sequence
  dgRNA
  Nr4a2
agcgtagcatcacca

SEQ ID NO: 45200 - DNA, 15 bp, Artificial Sequence
  dgRNA
  Nr4a2
tcaccacggacttca

SEQ ID NO: 45201 - DNA, 15 bp, Artificial Sequence
  dgRNA
  Nr4a2
cggacttcacggacc

SEQ ID NO: 45202 - DNA, 15 bp, Artificial Sequence
  dgRNA
  Nr4a2
ggacttcacggacct

SEQ ID NO: 45203 - DNA, 15 bp, Artificial Sequence
  dgRNA
  Tulp1
ccggccgctgtagtg

SEQ ID NO: 45204 - DNA, 15 bp, Artificial Sequence
  dgRNA
  Tulp1
gcctcttggcccgga

SEQ ID NO: 45205 - DNA, 15 bp, Artificial Sequence
  dgRNA
  Tulp1
tcttggcccggaagg

SEQ ID NO: 45206 - DNA, 15 bp, Artificial Sequence
  dgRNA
  Tulp1
cttggcccggaaggt

SEQ ID NO: 45207 - DNA, 15 bp, Artificial Sequence
  dgRNA
  Taco1
tcacctgaatctctc

SEQ ID NO: 45208 - DNA, 15 bp, Artificial Sequence
  dgRNA
  Taco1
tcgtttccaagcaac

SEQ ID NO: 45209 - DNA, 15 bp, Artificial Sequence
  dgRNA
  Taco1
accgggagcaaagaa

SEQ ID NO: 45210 - DNA, 15 bp, Artificial Sequence
  dgRNA
  Taco1
gggttgcgtcactcc

SEQ ID NO: 45211 - DNA, 15 bp, Artificial Sequence
  dgRNA
  P4ha3
tcccccaaatgtgac

SEQ ID NO: 45212 - DNA, 15 bp, Artificial Sequence
  dgRNA
  P4ha3
gtgtggagttagcgg

SEQ ID NO: 45213 - DNA, 15 bp, Artificial Sequence
  dgRNA
  P4ha3
tgtggagttagcggc

SEQ ID NO: 45214 - DNA, 15 bp, Artificial Sequence
  dgRNA
  P4ha3
agttagcggcgggcc

SEQ ID NO: 45215 - DNA, 15 bp, Artificial Sequence
  dgRNA
  Amdhd1
cctttactccaaacc

SEQ ID NO: 45216 - DNA, 15 bp, Artificial Sequence
  dgRNA
  Amdhd1
actccaaacctggaa

SEQ ID NO: 45217 - DNA, 15 bp, Artificial Sequence
  dgRNA
  Amdhd1
ttattccaggcgctc

SEQ ID NO: 45218 - DNA, 15 bp, Artificial Sequence
  dgRNA
  Amdhd1
tccaggcgctctggt

SEQ ID NO: 45219 - DNA, 15 bp, Artificial Sequence
  dgRNA
  Tmem132b
tgagcgagccgagca

SEQ ID NO: 45220 - DNA, 15 bp, Artificial Sequence
  dgRNA
  Tmem132b
gtgagcgagccgagc

SEQ ID NO: 45221 - DNA, 15 bp, Artificial Sequence
  dgRNA
  Corin
ttaagggttatgggt

SEQ ID NO: 45222 - DNA, 15 bp, Artificial Sequence
  dgRNA
  Corin
agagacgtgagtgaa

SEQ ID NO: 45223 - DNA, 15 bp, Artificial Sequence
  dgRNA
  Corin
gacgtgagtgaaggg

SEQ ID NO: 45224 - DNA, 15 bp, Artificial Sequence
  dgRNA
  Corin
ggagtggtctgcggg

SEQ ID NO: 45225 - DNA, 15 bp, Artificial Sequence
  dgRNA
  Rnps1
actttagaccagtcg

SEQ ID NO: 45226 - DNA, 15 bp, Artificial Sequence
  dgRNA
  Rnps1
ttagaccagtcgggg

SEQ ID NO: 45227 - DNA, 15 bp, Artificial Sequence
  dgRNA
  Rnps1
tagaccagtcgggga

SEQ ID NO: 45228 - DNA, 15 bp, Artificial Sequence
  dgRNA
  Rnps1
accgctaacttgcat

SEQ ID NO: 45229 - DNA, 15 bp, Artificial Sequence
  dgRNA
  Tsx
tttaggatactacag

SEQ ID NO: 45230 - DNA, 15 bp, Artificial Sequence
  dgRNA
  Tsx
cattcccaatacccg

SEQ ID NO: 45231 - DNA, 15 bp, Artificial Sequence
  dgRNA
  Tsx
agggtaaaagtatta

SEQ ID NO: 45232 - DNA, 15 bp, Artificial Sequence
  dgRNA
  Tsx
gcctatcttccatgg

SEQ ID NO: 45233 - DNA, 15 bp, Artificial Sequence
  dgRNA
  Cnot8
gcgcgcacgggggga

SEQ ID NO: 45234 - DNA, 15 bp, Artificial Sequence
  dgRNA
  Cnot8
ggacggagccgagac

SEQ ID NO: 45235 - DNA, 15 bp, Artificial Sequence
  dgRNA
  Cnot8
cggagccgagaccgg

SEQ ID NO: 45236 - DNA, 15 bp, Artificial Sequence
  dgRNA
  Cnot8
ggagccgagaccggc

SEQ ID NO: 45237 - DNA, 15 bp, Artificial Sequence
  dgRNA
  Gltscr2
tacgctttatcaaga

SEQ ID NO: 45238 - DNA, 15 bp, Artificial Sequence
  dgRNA
  Gltscr2
aagatggtcgcaaac

SEQ ID NO: 45239 - DNA, 15 bp, Artificial Sequence
  dgRNA
  Gltscr2
gcgcacgttccaaac

SEQ ID NO: 45240 - DNA, 15 bp, Artificial Sequence
  dgRNA
  Gltscr2
ttccaaaccggatat

SEQ ID NO: 45241 - DNA, 15 bp, Artificial Sequence
  dgRNA
  Lap3
tgccgcccttcccta

SEQ ID NO: 45242 - DNA, 15 bp, Artificial Sequence
  dgRNA
  Lap3
cctaaggctcagtag

SEQ ID NO: 45243 - DNA, 15 bp, Artificial Sequence
  dgRNA
  Lap3
ccgcccagttgccga

SEQ ID NO: 45244 - DNA, 15 bp, Artificial Sequence
  dgRNA
  Lap3
acggccccgccccca

SEQ ID NO: 45245 - DNA, 15 bp, Artificial Sequence
  dgRNA
  Gpr21
agttctgcagtaggc

SEQ ID NO: 45246 - DNA, 15 bp, Artificial Sequence
  dgRNA
  Gpr21
tagaggaattcccga

SEQ ID NO: 45247 - DNA, 15 bp, Artificial Sequence
  dgRNA
  Gpr21
cacactctagcgtgc

SEQ ID NO: 45248 - DNA, 15 bp, Artificial Sequence
  dgRNA
  Gpr21
gcaacttgtgtgcta

SEQ ID NO: 45249 - DNA, 15 bp, Artificial Sequence
  dgRNA
  Glp2r
atccgaatctcaatc

SEQ ID NO: 45250 - DNA, 15 bp, Artificial Sequence
  dgRNA
  Glp2r
atagaatcctcggaa

SEQ ID NO: 45251 - DNA, 15 bp, Artificial Sequence
  dgRNA
  Glp2r
gcagcgtagacgtct

SEQ ID NO: 45252 - DNA, 15 bp, Artificial Sequence
  dgRNA
  Glp2r
cagcgtagacgtctt

SEQ ID NO: 45253 - DNA, 15 bp, Artificial Sequence
  dgRNA
  Nova2
gaggatgatggccgc

SEQ ID NO: 45254 - DNA, 15 bp, Artificial Sequence
  dgRNA
  Nova2
tgatggccgccggcg

SEQ ID NO: 45255 - DNA, 15 bp, Artificial Sequence
  dgRNA
  Nova2
cgccggcgcggtgca

SEQ ID NO: 45256 - DNA, 15 bp, Artificial Sequence
  dgRNA
  Nova2
tgcacggcctcttca

SEQ ID NO: 45257 - DNA, 15 bp, Artificial Sequence
  dgRNA
  Crmp1
tgcccccgtgtccaa

SEQ ID NO: 45258 - DNA, 15 bp, Artificial Sequence
  dgRNA
  Crmp1
ctagtggcgtgagcg

SEQ ID NO: 45259 - DNA, 15 bp, Artificial Sequence
  dgRNA
  Crmp1
gccccggcttaagcg

SEQ ID NO: 45260 - DNA, 15 bp, Artificial Sequence
  dgRNA
  Crmp1
ccccggcttaagcga

SEQ ID NO: 45261 - DNA, 15 bp, Artificial Sequence
  dgRNA
  Ube2d3
cctaaggtctccttc

SEQ ID NO: 45262 - DNA, 15 bp, Artificial Sequence
  dgRNA
  Ube2d3
cgtcccccgccctcc

SEQ ID NO: 45263 - DNA, 15 bp, Artificial Sequence
  dgRNA
  Ube2d3
cccgtttcctcactt

SEQ ID NO: 45264 - DNA, 15 bp, Artificial Sequence
  dgRNA
  Ube2d3
ccccgtttcctcact

SEQ ID NO: 45265 - DNA, 15 bp, Artificial Sequence
  dgRNA
  Tmem88b
ataaggggaagtgca

SEQ ID NO: 45266 - DNA, 15 bp, Artificial Sequence
  dgRNA
  Tmem88b
tgcaggggctagtac

SEQ ID NO: 45267 - DNA, 15 bp, Artificial Sequence
  dgRNA
  Tmem88b
gcaggggctagtact

SEQ ID NO: 45268 - DNA, 15 bp, Artificial Sequence
  dgRNA
  Tmem88b
cccttatctgacacc

SEQ ID NO: 45269 - DNA, 15 bp, Artificial Sequence
  dgRNA
  Eif4a1
gccaatgaggccata

SEQ ID NO: 45270 - DNA, 15 bp, Artificial Sequence
  dgRNA
  Eif4a1
tgaggccatagggcg

SEQ ID NO: 45271 - DNA, 15 bp, Artificial Sequence
  dgRNA
  Eif4a1
ccatagggcggggct

SEQ ID NO: 45272 - DNA, 15 bp, Artificial Sequence
  dgRNA
  Eif4a1
gggctaggccatgat

SEQ ID NO: 45273 - DNA, 15 bp, Artificial Sequence
  dgRNA
  Bbip1
ccccttgagcgagcc

SEQ ID NO: 45274 - DNA, 15 bp, Artificial Sequence
  dgRNA
  Bbip1
cccttgagcgagcct

SEQ ID NO: 45275 - DNA, 15 bp, Artificial Sequence
  dgRNA
  Bbip1
gcctgggcattcgct

SEQ ID NO: 45276 - DNA, 15 bp, Artificial Sequence
  dgRNA
  Bbip1
cctgggcattcgcta

SEQ ID NO: 45277 - DNA, 15 bp, Artificial Sequence
  dgRNA
  Zwint
tgcttcctactgcgc

SEQ ID NO: 45278 - DNA, 15 bp, Artificial Sequence
  dgRNA
  Zwint
gcctacgcttgcgta

SEQ ID NO: 45279 - DNA, 15 bp, Artificial Sequence
  dgRNA
  Zwint
cctacgcttgcgtac

SEQ ID NO: 45280 - DNA, 15 bp, Artificial Sequence
  dgRNA
  Zwint
ctacgcttgcgtacg

SEQ ID NO: 45281 - DNA, 15 bp, Artificial Sequence
  dgRNA
  Fah
aaacggggtggtctc

SEQ ID NO: 45282 - DNA, 15 bp, Artificial Sequence
  dgRNA
  Fah
aacggggtggtctca

SEQ ID NO: 45283 - DNA, 15 bp, Artificial Sequence
  dgRNA
  Fah
tctcagggcgggtac

SEQ ID NO: 45284 - DNA, 15 bp, Artificial Sequence
  dgRNA
  Fah
ctcagggcgggtacc

SEQ ID NO: 45285 - DNA, 15 bp, Artificial Sequence
  dgRNA
  Sycp3
gagtcgggtgtgctg

SEQ ID NO: 45286 - DNA, 15 bp, Artificial Sequence
  dgRNA
  Sycp3
gacttcctaaagcga

SEQ ID NO: 45287 - DNA, 15 bp, Artificial Sequence
  dgRNA
  Sycp3
tcctaaagcgaagga

SEQ ID NO: 45288 - DNA, 15 bp, Artificial Sequence
  dgRNA
  Sycp3
tcgtgtccctgccgt

SEQ ID NO: 45289 - DNA, 15 bp, Artificial Sequence
  dgRNA
  Brd3
tcatgcgctacgccg

SEQ ID NO: 45290 - DNA, 15 bp, Artificial Sequence
  dgRNA
  Exoc6b
aactacgaatcccag

SEQ ID NO: 45291 - DNA, 15 bp, Artificial Sequence
  dgRNA
  Exoc6b
actacgaatcccagt

SEQ ID NO: 45292 - DNA, 15 bp, Artificial Sequence
  dgRNA
  Exoc6b
tgcgcgcgacgctcg

SEQ ID NO: 45293 - DNA, 15 bp, Artificial Sequence
  dgRNA
  Exoc6b
gcgacgctcgcggcc

SEQ ID NO: 45294 - DNA, 15 bp, Artificial Sequence
  dgRNA
  Rlbp1
aaggagtagtctccc

SEQ ID NO: 45295 - DNA, 15 bp, Artificial Sequence
  dgRNA
  Rlbp1
gtttgagaagcgaga

SEQ ID NO: 45296 - DNA, 15 bp, Artificial Sequence
  dgRNA
  Rlbp1
gcttctcaaactggg

SEQ ID NO: 45297 - DNA, 15 bp, Artificial Sequence
  dgRNA
  Rlbp1
ctcgcttctcaaact

SEQ ID NO: 45298 - DNA, 15 bp, Artificial Sequence
  dgRNA
  Stard4
cccgctaacacccca

SEQ ID NO: 45299 - DNA, 15 bp, Artificial Sequence
  dgRNA
  Stard4
gctaacaccccacgg

SEQ ID NO: 45300 - DNA, 15 bp, Artificial Sequence
  dgRNA
  Stard4
ggaggttcccctccg

SEQ ID NO: 45301 - DNA, 15 bp, Artificial Sequence
  dgRNA
  Stard4
tcccctccgaggatt

SEQ ID NO: 45302 - DNA, 15 bp, Artificial Sequence
  dgRNA
  Ldb1
cacgcatgccgttcc

SEQ ID NO: 45303 - DNA, 15 bp, Artificial Sequence
  dgRNA
  Ldb1
acgcatgccgttccc

SEQ ID NO: 45304 - DNA, 15 bp, Artificial Sequence
  dgRNA
  Ldb1
ctgcccctcgccgcg

SEQ ID NO: 45305 - DNA, 15 bp, Artificial Sequence
  dgRNA
  Ldb1
cgcgccgcgctcgcc

SEQ ID NO: 45306 - DNA, 15 bp, Artificial Sequence
  dgRNA
  Lsm7
gccgtggcgctcacc

SEQ ID NO: 45307 - DNA, 15 bp, Artificial Sequence
  dgRNA
  Lsm7
ccgtggcgctcacct

SEQ ID NO: 45308 - DNA, 15 bp, Artificial Sequence
  dgRNA
  Lsm7
cgcggccatgtccgc

SEQ ID NO: 45309 - DNA, 15 bp, Artificial Sequence
  dgRNA
  Lsm7
tccccccgcagctct

SEQ ID NO: 45310 - DNA, 15 bp, Artificial Sequence
  dgRNA
  Pga5
tttcctctcctgacg

SEQ ID NO: 45311 - DNA, 15 bp, Artificial Sequence
  dgRNA
  Pga5
ttcctctcctgacga

SEQ ID NO: 45312 - DNA, 15 bp, Artificial Sequence
  dgRNA
  Pga5
atcaggccccattag

SEQ ID NO: 45313 - DNA, 15 bp, Artificial Sequence
  dgRNA
  Pga5
ttttcgtggctgaga

SEQ ID NO: 45314 - DNA, 15 bp, Artificial Sequence
  dgRNA
  Nek4
aggagcgaagctcta

SEQ ID NO: 45315 - DNA, 15 bp, Artificial Sequence
  dgRNA
  Nek4
gcgaagctctatggc

SEQ ID NO: 45316 - DNA, 15 bp, Artificial Sequence
  dgRNA
  Nek4
atggcaggtcctccg

SEQ ID NO: 45317 - DNA, 15 bp, Artificial Sequence
  dgRNA
  Nek4
gctgccgaaccgctc

SEQ ID NO: 45318 - DNA, 15 bp, Artificial Sequence
  dgRNA
  Stat5a
cgccgcccagcctag

SEQ ID NO: 45319 - DNA, 15 bp, Artificial Sequence
  dgRNA
  Stat5a
gcccagcctagtggt

SEQ ID NO: 45320 - DNA, 15 bp, Artificial Sequence
  dgRNA
  Stat5a
ggtcggtcttgtaag

SEQ ID NO: 45321 - DNA, 15 bp, Artificial Sequence
  dgRNA
  Stat5a
gtcggtcttgtaagc

SEQ ID NO: 45322 - DNA, 15 bp, Artificial Sequence
  dgRNA
  Gm4884
cagtcagcggccaat

SEQ ID NO: 45323 - DNA, 15 bp, Artificial Sequence
  dgRNA
  Gm4884
tcagtcagcggccaa

SEQ ID NO: 45324 - DNA, 15 bp, Artificial Sequence
  dgRNA
  Olfr46
ctcgaattttcaact

SEQ ID NO: 45325 - DNA, 15 bp, Artificial Sequence
  dgRNA
  Olfr46
tatttacatctgcga

SEQ ID NO: 45326 - DNA, 15 bp, Artificial Sequence
  dgRNA
  Mpdz
tgtccgtcacccacg

SEQ ID NO: 45327 - DNA, 15 bp, Artificial Sequence
  dgRNA
  Mpdz
gtccgtcacccacgc

SEQ ID NO: 45328 - DNA, 15 bp, Artificial Sequence
  dgRNA
  Mpdz
tcacccacgcgggcc

SEQ ID NO: 45329 - DNA, 15 bp, Artificial Sequence
  dgRNA
  Mpdz
cacccacgcgggccc

SEQ ID NO: 45330 - DNA, 15 bp, Artificial Sequence
  dgRNA
  Creld2
cccgatagaagatta

SEQ ID NO: 45331 - DNA, 15 bp, Artificial Sequence
  dgRNA
  Creld2
cgcgggacgctgacc

SEQ ID NO: 45332 - DNA, 15 bp, Artificial Sequence
  dgRNA
  Creld2
gcgggacgctgaccc

SEQ ID NO: 45333 - DNA, 15 bp, Artificial Sequence
  dgRNA
  Creld2
cgggacgctgacccg

SEQ ID NO: 45334 - DNA, 15 bp, Artificial Sequence
  dgRNA
  1700013H16Rik
ggagcagcccaccac

SEQ ID NO: 45335 - DNA, 15 bp, Artificial Sequence
  dgRNA
  1700013H16Rik
gagcagcccaccacg

SEQ ID NO: 45336 - DNA, 15 bp, Artificial Sequence
  dgRNA
  1700013H16Rik
ccacacacgcatgcg

SEQ ID NO: 45337 - DNA, 15 bp, Artificial Sequence
  dgRNA
  1700013H16Rik
aatccacgaagctac

SEQ ID NO: 45338 - DNA, 15 bp, Artificial Sequence
  dgRNA
  Xkr4
ctcgtgctgcagccg

SEQ ID NO: 45339 - DNA, 15 bp, Artificial Sequence
  dgRNA
  Xkr4
tcgtgctgcagccgc

SEQ ID NO: 45340 - DNA, 15 bp, Artificial Sequence
  dgRNA
  Xkr4
cgtgctgcagccgcg

SEQ ID NO: 45341 - DNA, 15 bp, Artificial Sequence
  dgRNA
  Xkr4
ctgcagccgcggggc

SEQ ID NO: 45342 - DNA, 15 bp, Artificial Sequence
  dgRNA
  Tmem213
gcaagtgcaggtcta

SEQ ID NO: 45343 - DNA, 15 bp, Artificial Sequence
  dgRNA
  Tmem213
caagtgcaggtctaa

SEQ ID NO: 45344 - DNA, 15 bp, Artificial Sequence
  dgRNA
  Tmem213
cccagcttagcgtgt

SEQ ID NO: 45345 - DNA, 15 bp, Artificial Sequence
  dgRNA
  3110043O21Rik
gtgtctagacagtcc

SEQ ID NO: 45346 - DNA, 15 bp, Artificial Sequence
  dgRNA
  3110043O21Rik
tgtctagacagtcca

SEQ ID NO: 45347 - DNA, 15 bp, Artificial Sequence
  dgRNA
  3110043O21Rik
gagggaggtgcgttt

SEQ ID NO: 45348 - DNA, 15 bp, Artificial Sequence
  dgRNA
  3110043O21Rik
ccacaacggtgacca

SEQ ID NO: 45349 - DNA, 15 bp, Artificial Sequence
  dgRNA
  Tgtp2
aagctagccatttcc

SEQ ID NO: 45350 - DNA, 15 bp, Artificial Sequence
  dgRNA
  Tgtp2
ttcggtttcgattcc

SEQ ID NO: 45351 - DNA, 15 bp, Artificial Sequence
  dgRNA
  Tgtp2
aatcagagtaggttt

SEQ ID NO: 45352 - DNA, 15 bp, Artificial Sequence
  dgRNA
  Ablim1
ggcgcggccgccgtg

SEQ ID NO: 45353 - DNA, 15 bp, Artificial Sequence
  dgRNA
  Ablim1
cggccgccgtgcggg

SEQ ID NO: 45354 - DNA, 15 bp, Artificial Sequence
  dgRNA
  Ablim1
ggccgccgtgcgggc

SEQ ID NO: 45355 - DNA, 15 bp, Artificial Sequence
  dgRNA
  Ablim1
cgtgcgggcgggcgt

SEQ ID NO: 45356 - DNA, 15 bp, Artificial Sequence
  dgRNA
  Gm648
ccggaggatgacgtc

SEQ ID NO: 45357 - DNA, 15 bp, Artificial Sequence
  dgRNA
  Gm648
tctacactagtttta

SEQ ID NO: 45358 - DNA, 15 bp, Artificial Sequence
  dgRNA
  Gm648
ggtcagattgcctca

SEQ ID NO: 45359 - DNA, 15 bp, Artificial Sequence
  dgRNA
  Gm648
taaaactagtgtaga

SEQ ID NO: 45360 - DNA, 15 bp, Artificial Sequence
  dgRNA
  9-Mar
cactcgccccgcccc

SEQ ID NO: 45361 - DNA, 15 bp, Artificial Sequence
  dgRNA
  9-Mar
actcgccccgcccct

SEQ ID NO: 45362 - DNA, 15 bp, Artificial Sequence
  dgRNA
  9-Mar
gacacctgctcgtgc

SEQ ID NO: 45363 - DNA, 15 bp, Artificial Sequence
  dgRNA
  9-Mar
acacctgctcgtgct

SEQ ID NO: 45364 - DNA, 15 bp, Artificial Sequence
  dgRNA
  Shprh
ggcgctggcggcttc

SEQ ID NO: 45365 - DNA, 15 bp, Artificial Sequence
  dgRNA
  Shprh
tggcggcttccggcc

SEQ ID NO: 45366 - DNA, 15 bp, Artificial Sequence
  dgRNA
  Shprh
ggcggcttccggcct

SEQ ID NO: 45367 - DNA, 15 bp, Artificial Sequence
  dgRNA
  Shprh
tccggcctgggtgcc

SEQ ID NO: 45368 - DNA, 15 bp, Artificial Sequence
  dgRNA
  Syvn1
agctctcgctcgttc

SEQ ID NO: 45369 - DNA, 15 bp, Artificial Sequence
  dgRNA
  Syvn1
ccggttgctcgcgca

SEQ ID NO: 45370 - DNA, 15 bp, Artificial Sequence
  dgRNA
  Syvn1
cggttgctcgcgcac

SEQ ID NO: 45371 - DNA, 15 bp, Artificial Sequence
  dgRNA
  Syvn1
gggccccagaagcgc

SEQ ID NO: 45372 - DNA, 15 bp, Artificial Sequence
  dgRNA
  Clec10a
gctcagtattattta

SEQ ID NO: 45373 - DNA, 15 bp, Artificial Sequence
  dgRNA
  Clec10a
gttaagacttgaaat

SEQ ID NO: 45374 - DNA, 15 bp, Artificial Sequence
  dgRNA
  Clec10a
tgcacttgtcctcaa

SEQ ID NO: 45375 - DNA, 15 bp, Artificial Sequence
  dgRNA
  Clec10a
cgtgacaaggctatg

SEQ ID NO: 45376 - DNA, 15 bp, Artificial Sequence
  dgRNA
  AY761185
aggatggtaaccttg

SEQ ID NO: 45377 - DNA, 15 bp, Artificial Sequence
  dgRNA
  AY761185
cctataaatgctggc

SEQ ID NO: 45378 - DNA, 15 bp, Artificial Sequence
  dgRNA
  AY761185
tcattggtaggaact

SEQ ID NO: 45379 - DNA, 15 bp, Artificial Sequence
  dgRNA
  AY761185
ttcattggtaggaac

SEQ ID NO: 45380 - DNA, 15 bp, Artificial Sequence
  dgRNA
  Esyt2
gccctagattctttc

SEQ ID NO: 45381 - DNA, 15 bp, Artificial Sequence
  dgRNA
  Esyt2
agattctttcagggt

SEQ ID NO: 45382 - DNA, 15 bp, Artificial Sequence
  dgRNA
  Esyt2
gtgtcagtcgccaac

SEQ ID NO: 45383 - DNA, 15 bp, Artificial Sequence
  dgRNA
  Esyt2
aaagaatctagggcg

SEQ ID NO: 45384 - DNA, 15 bp, Artificial Sequence
  dgRNA
  Olfr890
tttaaggatattggt

SEQ ID NO: 45385 - DNA, 15 bp, Artificial Sequence
  dgRNA
  Olfr890
tatccttgttggcac

SEQ ID NO: 45386 - DNA, 15 bp, Artificial Sequence
  dgRNA
  Olfr890
taatcctatccttgt

SEQ ID NO: 45387 - DNA, 15 bp, Artificial Sequence
  dgRNA
  AI987944
gacttagtgaccaat

SEQ ID NO: 45388 - DNA, 15 bp, Artificial Sequence
  dgRNA
  AI987944
gaccaatcggagcct

SEQ ID NO: 45389 - DNA, 15 bp, Artificial Sequence
  dgRNA
  AI987944
accaatcggagcctt

SEQ ID NO: 45390 - DNA, 15 bp, Artificial Sequence
  dgRNA
  AI987944
ccaatcggagccttg

SEQ ID NO: 45391 - DNA, 15 bp, Artificial Sequence
  dgRNA
  Olfr1394
ggaccaattcatgct

SEQ ID NO: 45392 - DNA, 15 bp, Artificial Sequence
  dgRNA
  Olfr1394
atgaattgttactgc

SEQ ID NO: 45393 - DNA, 15 bp, Artificial Sequence
  dgRNA
  Olfr1394
ctagtctccaccttt

SEQ ID NO: 45394 - DNA, 15 bp, Artificial Sequence
  dgRNA
  Olfr1394
agggtaacggatgag

SEQ ID NO: 45395 - DNA, 15 bp, Artificial Sequence
  dgRNA
  Psma1
gctttctctgcgcat

SEQ ID NO: 45396 - DNA, 15 bp, Artificial Sequence
  dgRNA
  Psma1
gttctcagctttcgc

SEQ ID NO: 45397 - DNA, 15 bp, Artificial Sequence
  dgRNA
  Psma1
ccgcccacttaaggc

SEQ ID NO: 45398 - DNA, 15 bp, Artificial Sequence
  dgRNA
  Psma1
ttagacgccgatccg

SEQ ID NO: 45399 - DNA, 15 bp, Artificial Sequence
  dgRNA
  Socs2
cacacagttcttcgg

SEQ ID NO: 45400 - DNA, 15 bp, Artificial Sequence
  dgRNA
  Socs2
acacagttcttcggc

SEQ ID NO: 45401 - DNA, 15 bp, Artificial Sequence
  dgRNA
  Socs2
ccaactttagtgtct

SEQ ID NO: 45402 - DNA, 15 bp, Artificial Sequence
  dgRNA
  Socs2
gggcagggcgttagc

SEQ ID NO: 45403 - DNA, 15 bp, Artificial Sequence
  dgRNA
  Prcc
caaactacgaatccc

SEQ ID NO: 45404 - DNA, 15 bp, Artificial Sequence
  dgRNA
  Prcc
gcactgagttcccgg

SEQ ID NO: 45405 - DNA, 15 bp, Artificial Sequence
  dgRNA
  Prcc
ccggaggtagagaat

SEQ ID NO: 45406 - DNA, 15 bp, Artificial Sequence
  dgRNA
  Prcc
cggaggtagagaatg

SEQ ID NO: 45407 - DNA, 15 bp, Artificial Sequence
  dgRNA
  Shcbp1
gtccgccaatcccac

SEQ ID NO: 45408 - DNA, 15 bp, Artificial Sequence
  dgRNA
  Shcbp1
cacaggtggcgctga

SEQ ID NO: 45409 - DNA, 15 bp, Artificial Sequence
  dgRNA
  Shcbp1
cgccacctgtgggat

SEQ ID NO: 45410 - DNA, 15 bp, Artificial Sequence
  dgRNA
  Shcbp1
ttcagcgccacctgt

SEQ ID NO: 45411 - DNA, 15 bp, Artificial Sequence
  dgRNA
  Plxna2
gagccgtagctctgc

SEQ ID NO: 45412 - DNA, 15 bp, Artificial Sequence
  dgRNA
  Plxna2
agccgtagctctgcc

SEQ ID NO: 45413 - DNA, 15 bp, Artificial Sequence
  dgRNA
  Plxna2
ctctgccgggttctt

SEQ ID NO: 45414 - DNA, 15 bp, Artificial Sequence
  dgRNA
  Plxna2
ttgggtggaccagct

SEQ ID NO: 45415 - DNA, 15 bp, Artificial Sequence
  dgRNA
  Rsph4a
gacgcttgcaacctg

SEQ ID NO: 45416 - DNA, 15 bp, Artificial Sequence
  dgRNA
  Rsph4a
gctaggattttaggg

SEQ ID NO: 45417 - DNA, 15 bp, Artificial Sequence
  dgRNA
  Rsph4a
caggttgcaagcgtc

SEQ ID NO: 45418 - DNA, 15 bp, Artificial Sequence
  dgRNA
  Olfr48
ttggaaaccactaac

SEQ ID NO: 45419 - DNA, 15 bp, Artificial Sequence
  dgRNA
  Olfr48
agaggccccatactc

SEQ ID NO: 45420 - DNA, 15 bp, Artificial Sequence
  dgRNA
  Olfr48
tatctcacctgacag

SEQ ID NO: 45421 - DNA, 15 bp, Artificial Sequence
  dgRNA
  Defb37
tcctgtttagataag

SEQ ID NO: 45422 - DNA, 15 bp, Artificial Sequence
  dgRNA
  Defb37
atgggagcaaaacgt

SEQ ID NO: 45423 - DNA, 15 bp, Artificial Sequence
  dgRNA
  Defb37
gcaaaacgtaggcac

SEQ ID NO: 45424 - DNA, 15 bp, Artificial Sequence
  dgRNA
  Defb37
gaaagaacgccctca

SEQ ID NO: 45425 - DNA, 15 bp, Artificial Sequence
  dgRNA
  Znhit6
ttcagcgcctgagaa

SEQ ID NO: 45426 - DNA, 15 bp, Artificial Sequence
  dgRNA
  Znhit6
caagatccccgcccc

SEQ ID NO: 45427 - DNA, 15 bp, Artificial Sequence
  dgRNA
  Znhit6
aagatccccgcccct

SEQ ID NO: 45428 - DNA, 15 bp, Artificial Sequence
  dgRNA
  Znhit6
gggcgtggtctcacc

SEQ ID NO: 45429 - DNA, 15 bp, Artificial Sequence
  dgRNA
  2010107E04Rik
gaagcttgtaacacc

SEQ ID NO: 45430 - DNA, 15 bp, Artificial Sequence
  dgRNA
  2010107E04Rik
aagcttgtaacaccc

SEQ ID NO: 45431 - DNA, 15 bp, Artificial Sequence
  dgRNA
  2010107E04Rik
cacccgggcgaccac

SEQ ID NO: 45432 - DNA, 15 bp, Artificial Sequence
  dgRNA
  2010107E04Rik
acccgggcgaccact

SEQ ID NO: 45433 - DNA, 15 bp, Artificial Sequence
  dgRNA
  Atoh1
gcccccttctttgac

SEQ ID NO: 45434 - DNA, 15 bp, Artificial Sequence
  dgRNA
  Atoh1
gggcagacacgcgac

SEQ ID NO: 45435 - DNA, 15 bp, Artificial Sequence
  dgRNA
  Atoh1
cgactggcgcaagga

SEQ ID NO: 45436 - DNA, 15 bp, Artificial Sequence
  dgRNA
  Atoh1
gactggcgcaaggag

SEQ ID NO: 45437 - DNA, 15 bp, Artificial Sequence
  dgRNA
  Vmn1r20
atacttgttgatgat

SEQ ID NO: 45438 - DNA, 15 bp, Artificial Sequence
  dgRNA
  Tes
taagtcggtgcgccc

SEQ ID NO: 45439 - DNA, 15 bp, Artificial Sequence
  dgRNA
  Tes
aagtcggtgcgccca

SEQ ID NO: 45440 - DNA, 15 bp, Artificial Sequence
  dgRNA
  Tes
cccagggaactccgc

SEQ ID NO: 45441 - DNA, 15 bp, Artificial Sequence
  dgRNA
  Tes
ccagggaactccgca

SEQ ID NO: 45442 - DNA, 15 bp, Artificial Sequence
  dgRNA
  Fbxo36
cacttcgggtcaccc

SEQ ID NO: 45443 - DNA, 15 bp, Artificial Sequence
  dgRNA
  Fbxo36
gttccttgtaagccc

SEQ ID NO: 45444 - DNA, 15 bp, Artificial Sequence
  dgRNA
  Fbxo36
cacccccaagttaaa

SEQ ID NO: 45445 - DNA, 15 bp, Artificial Sequence
  dgRNA
  Fbxo36
cggccccctgacccc

SEQ ID NO: 45446 - DNA, 15 bp, Artificial Sequence
  dgRNA
  Rnf181
gctccgaaaagtccc

SEQ ID NO: 45447 - DNA, 15 bp, Artificial Sequence
  dgRNA
  Rnf181
tatccaaccaacgag

SEQ ID NO: 45448 - DNA, 15 bp, Artificial Sequence
  dgRNA
  Rnf181
ccaaccaacgagagg

SEQ ID NO: 45449 - DNA, 15 bp, Artificial Sequence
  dgRNA
  Rnf181
cactatgcccacccc

SEQ ID NO: 45450 - DNA, 15 bp, Artificial Sequence
  dgRNA
  Nrn1l
ggcagttttgccctc

SEQ ID NO: 45451 - DNA, 15 bp, Artificial Sequence
  dgRNA
  Nrn1l
tcttctctgcctagc

SEQ ID NO: 45452 - DNA, 15 bp, Artificial Sequence
  dgRNA
  Nrn1l
tgatgctccgcctcc

SEQ ID NO: 45453 - DNA, 15 bp, Artificial Sequence
  dgRNA
  Nrn1l
tagtgcaggagcgag

SEQ ID NO: 45454 - DNA, 15 bp, Artificial Sequence
  dgRNA
  Amigo2
aggggcgcggggcct

SEQ ID NO: 45455 - DNA, 15 bp, Artificial Sequence
  dgRNA
  Amigo2
ggggtgcagagtcgc

SEQ ID NO: 45456 - DNA, 15 bp, Artificial Sequence
  dgRNA
  Amigo2
tcgcaggcctcgctg

SEQ ID NO: 45457 - DNA, 15 bp, Artificial Sequence
  dgRNA
  Amigo2
cgctgcggtcccacc

SEQ ID NO: 45458 - DNA, 15 bp, Artificial Sequence
  dgRNA
  Tstd2
tgcggccgcctcctc

SEQ ID NO: 45459 - DNA, 15 bp, Artificial Sequence
  dgRNA
  Tstd2
tccggctttccaccc

SEQ ID NO: 45460 - DNA, 15 bp, Artificial Sequence
  dgRNA
  Tstd2
ccggctttccacccc

SEQ ID NO: 45461 - DNA, 15 bp, Artificial Sequence
  dgRNA
  Tstd2
caccccgggcccttc

SEQ ID NO: 45462 - DNA, 15 bp, Artificial Sequence
  dgRNA
  Rbm39
cttcccggtacggtg

SEQ ID NO: 45463 - DNA, 15 bp, Artificial Sequence
  dgRNA
  Rbm39
ccgtgcccttcatct

SEQ ID NO: 45464 - DNA, 15 bp, Artificial Sequence
  dgRNA
  Rbm39
cgtgcccttcatctc

SEQ ID NO: 45465 - DNA, 15 bp, Artificial Sequence
  dgRNA
  Rbm39
ccttcatctcgggca

SEQ ID NO: 45466 - DNA, 15 bp, Artificial Sequence
  dgRNA
  Zfp395
gtgtgtccctgcgtc

SEQ ID NO: 45467 - DNA, 15 bp, Artificial Sequence
  dgRNA
  Zfp395
gtccctgcgtctggc

SEQ ID NO: 45468 - DNA, 15 bp, Artificial Sequence
  dgRNA
  Zfp395
cgtctggctggctcg

SEQ ID NO: 45469 - DNA, 15 bp, Artificial Sequence
  dgRNA
  Zfp395
tggctggctcgcggg

SEQ ID NO: 45470 - DNA, 15 bp, Artificial Sequence
  dgRNA
  Fam168b
gctgcgtcacgtgcc

SEQ ID NO: 45471 - DNA, 15 bp, Artificial Sequence
  dgRNA
  Fam168b
tgcccggcgcgcccc

SEQ ID NO: 45472 - DNA, 15 bp, Artificial Sequence
  dgRNA
  Fam168b
cccccggctggcgcg

SEQ ID NO: 45473 - DNA, 15 bp, Artificial Sequence
  dgRNA
  Fam168b
ccggctggcgcgcgg

SEQ ID NO: 45474 - DNA, 15 bp, Artificial Sequence
  dgRNA
  Ehf
tcctcatccattaac

SEQ ID NO: 45475 - DNA, 15 bp, Artificial Sequence
  dgRNA
  Ehf
gacacaggcataacc

SEQ ID NO: 45476 - DNA, 15 bp, Artificial Sequence
  dgRNA
  Ehf
cactaacgtctgagt

SEQ ID NO: 45477 - DNA, 15 bp, Artificial Sequence
  dgRNA
  Ehf
gaggcgacctgttaa

SEQ ID NO: 45478 - DNA, 15 bp, Artificial Sequence
  dgRNA
  Ifnl3
ggtgagtcccgagaa

SEQ ID NO: 45479 - DNA, 15 bp, Artificial Sequence
  dgRNA
  Ifnl3
cccgagaatggtgtg

SEQ ID NO: 45480 - DNA, 15 bp, Artificial Sequence
  dgRNA
  Ifnl3
ccgagaatggtgtgt

SEQ ID NO: 45481 - DNA, 15 bp, Artificial Sequence
  dgRNA
  Ifnl3
ctcgggtctcccttg

SEQ ID NO: 45482 - DNA, 15 bp, Artificial Sequence
  dgRNA
  Ccpg1
caacagcaagacgat

SEQ ID NO: 45483 - DNA, 15 bp, Artificial Sequence
  dgRNA
  Ccpg1
ctacaatttctgggg

SEQ ID NO: 45484 - DNA, 15 bp, Artificial Sequence
  dgRNA
  Ccpg1
ggcagcccgtctccg

SEQ ID NO: 45485 - DNA, 15 bp, Artificial Sequence
  dgRNA
  Ccpg1
gctgttgctttccgt

SEQ ID NO: 45486 - DNA, 15 bp, Artificial Sequence
  dgRNA
  Ybx2
cattagccaatgggc

SEQ ID NO: 45487 - DNA, 15 bp, Artificial Sequence
  dgRNA
  Ybx2
attagccaatgggct

SEQ ID NO: 45488 - DNA, 15 bp, Artificial Sequence
  dgRNA
  Ybx2
gccgagggcatcacg

SEQ ID NO: 45489 - DNA, 15 bp, Artificial Sequence
  dgRNA
  Ybx2
ggcatcacgtggcgg

SEQ ID NO: 45490 - DNA, 15 bp, Artificial Sequence
  dgRNA
  Hid1
cagtcttgcggactg

SEQ ID NO: 45491 - DNA, 15 bp, Artificial Sequence
  dgRNA
  Hid1
gcggactgaggatcg

SEQ ID NO: 45492 - DNA, 15 bp, Artificial Sequence
  dgRNA
  Hid1
tcagttgcagacgaa

SEQ ID NO: 45493 - DNA, 15 bp, Artificial Sequence
  dgRNA
  Hid1
gcagacgaaaggacc

SEQ ID NO: 45494 - DNA, 15 bp, Artificial Sequence
  dgRNA
  Eftud1
gtcgcaggagcctgg

SEQ ID NO: 45495 - DNA, 15 bp, Artificial Sequence
  dgRNA
  Eftud1
aagtcgcaggagcct

SEQ ID NO: 45496 - DNA, 15 bp, Artificial Sequence
  dgRNA
  Eftud1
gaagtcgcaggagcc

SEQ ID NO: 45497 - DNA, 15 bp, Artificial Sequence
  dgRNA
  Eftud1
cagaccggaagtcgc

SEQ ID NO: 45498 - DNA, 15 bp, Artificial Sequence
  dgRNA
  Gtpbp2
catagcgatgcctct

SEQ ID NO: 45499 - DNA, 15 bp, Artificial Sequence
  dgRNA
  Gtpbp2
atagcgatgcctctt

SEQ ID NO: 45500 - DNA, 15 bp, Artificial Sequence
  dgRNA
  Gtpbp2
ttttctgacgcgact

SEQ ID NO: 45501 - DNA, 15 bp, Artificial Sequence
  dgRNA
  Gtpbp2
tctgacgcgactagg

SEQ ID NO: 45502 - DNA, 15 bp, Artificial Sequence
  dgRNA
  Btnl1
gggtagaagcattct

SEQ ID NO: 45503 - DNA, 15 bp, Artificial Sequence
  dgRNA
  Btnl1
agcgctcaggtctgg

SEQ ID NO: 45504 - DNA, 15 bp, Artificial Sequence
  dgRNA
  Btnl1
agaagcgctcaggtc

SEQ ID NO: 45505 - DNA, 15 bp, Artificial Sequence
  dgRNA
  Btnl1
cagggagaagcgctc

SEQ ID NO: 45506 - DNA, 15 bp, Artificial Sequence
  dgRNA
  Smarcd2
cgctcctccgggaaa

SEQ ID NO: 45507 - DNA, 15 bp, Artificial Sequence
  dgRNA
  Smarcd2
aggccgcctccccca

SEQ ID NO: 45508 - DNA, 15 bp, Artificial Sequence
  dgRNA
  Smarcd2
ggccgcctcccccaa

SEQ ID NO: 45509 - DNA, 15 bp, Artificial Sequence
  dgRNA
  Smarcd2
cgcctcccccaaggg

SEQ ID NO: 45510 - DNA, 15 bp, Artificial Sequence
  dgRNA
  Pcbp4
gggcgccggaccgcg

SEQ ID NO: 45511 - DNA, 15 bp, Artificial Sequence
  dgRNA
  Pcbp4
ggcgccggaccgcgc

SEQ ID NO: 45512 - DNA, 15 bp, Artificial Sequence
  dgRNA
  Pcbp4
gcgccggaccgcgcg

SEQ ID NO: 45513 - DNA, 15 bp, Artificial Sequence
  dgRNA
  Pcbp4
ccggaccgcgcgggg

SEQ ID NO: 45514 - DNA, 15 bp, Artificial Sequence
  dgRNA
  Gstcd
tccccccgaggcgcc

SEQ ID NO: 45515 - DNA, 15 bp, Artificial Sequence
  dgRNA
  Gstcd
cgaggcgccaggaag

SEQ ID NO: 45516 - DNA, 15 bp, Artificial Sequence
  dgRNA
  Gstcd
aggcgccaggaagcg

SEQ ID NO: 45517 - DNA, 15 bp, Artificial Sequence
  dgRNA
  Gstcd
ctccgccccgccact

SEQ ID NO: 45518 - DNA, 15 bp, Artificial Sequence
  dgRNA
  Mark3
ctccgcccgctagag

SEQ ID NO: 45519 - DNA, 15 bp, Artificial Sequence
  dgRNA
  Mark3
gcaagacctttccga

SEQ ID NO: 45520 - DNA, 15 bp, Artificial Sequence
  dgRNA
  Mark3
tccgaccgcgctgat

SEQ ID NO: 45521 - DNA, 15 bp, Artificial Sequence
  dgRNA
  Mark3
gaccgcgctgattgg

SEQ ID NO: 45522 - DNA, 15 bp, Artificial Sequence
  dgRNA
  Gm266
gaggaggctcgggcg

SEQ ID NO: 45523 - DNA, 15 bp, Artificial Sequence
  dgRNA
  Gm266
gggcgaggtgctagt

SEQ ID NO: 45524 - DNA, 15 bp, Artificial Sequence
  dgRNA
  Gm266
ggcgaggtgctagta

SEQ ID NO: 45525 - DNA, 15 bp, Artificial Sequence
  dgRNA
  Gm266
aggtgctagtagggc

SEQ ID NO: 45526 - DNA, 15 bp, Artificial Sequence
  dgRNA
  Smtnl1
ggttgttgcttgtca

SEQ ID NO: 45527 - DNA, 15 bp, Artificial Sequence
  dgRNA
  Smtnl1
cagagcacttcggga

SEQ ID NO: 45528 - DNA, 15 bp, Artificial Sequence
  dgRNA
  Smtnl1
aaggacggtgatctc

SEQ ID NO: 45529 - DNA, 15 bp, Artificial Sequence
  dgRNA
  Smtnl1
cacctgtcagatctt

SEQ ID NO: 45530 - DNA, 15 bp, Artificial Sequence
  dgRNA
  Gapdh
cagtcagcacgtccc

SEQ ID NO: 45531 - DNA, 15 bp, Artificial Sequence
  dgRNA
  Gapdh
cagcacgtccctgga

SEQ ID NO: 45532 - DNA, 15 bp, Artificial Sequence
  dgRNA
  Gapdh
agcacgtccctggat

SEQ ID NO: 45533 - DNA, 15 bp, Artificial Sequence
  dgRNA
  Gapdh
gcacgtccctggatg

SEQ ID NO: 45534 - DNA, 15 bp, Artificial Sequence
  dgRNA
  Zkscan6
cctgctccctgcgag

SEQ ID NO: 45535 - DNA, 15 bp, Artificial Sequence
  dgRNA
  Zkscan6
gctccctgcgagggg

SEQ ID NO: 45536 - DNA, 15 bp, Artificial Sequence
  dgRNA
  Zkscan6
ctccctgcgagggga

SEQ ID NO: 45537 - DNA, 15 bp, Artificial Sequence
  dgRNA
  Zkscan6
actcgggtcgtgaac

SEQ ID NO: 45538 - DNA, 15 bp, Artificial Sequence
  dgRNA
  Apoc4
ttcgtgtcttgtaca

SEQ ID NO: 45539 - DNA, 15 bp, Artificial Sequence
  dgRNA
  Apoc4
gtcttgtacaaggcc

SEQ ID NO: 45540 - DNA, 15 bp, Artificial Sequence
  dgRNA
  Apoc4
ggcggcacactgttt

SEQ ID NO: 45541 - DNA, 15 bp, Artificial Sequence
  dgRNA
  Apoc4
cctgccaaggagtgt

SEQ ID NO: 45542 - DNA, 15 bp, Artificial Sequence
  dgRNA
  Tyw3
ttccctaacttcgct

SEQ ID NO: 45543 - DNA, 15 bp, Artificial Sequence
  dgRNA
  Tyw3
ctaggctccccctct

SEQ ID NO: 45544 - DNA, 15 bp, Artificial Sequence
  dgRNA
  Tyw3
cggtttacgcctgta

SEQ ID NO: 45545 - DNA, 15 bp, Artificial Sequence
  dgRNA
  Tyw3
tacgcctgtacggtc

SEQ ID NO: 45546 - DNA, 15 bp, Artificial Sequence
  dgRNA
  Tas2r105
taagttaagtcttac

SEQ ID NO: 45547 - DNA, 15 bp, Artificial Sequence
  dgRNA
  Tm7sf3
agcaagaactcgtcc

SEQ ID NO: 45548 - DNA, 15 bp, Artificial Sequence
  dgRNA
  Tm7sf3
cttgccccgtgagcc

SEQ ID NO: 45549 - DNA, 15 bp, Artificial Sequence
  dgRNA
  Tm7sf3
ttgccccgtgagccc

SEQ ID NO: 45550 - DNA, 15 bp, Artificial Sequence
  dgRNA
  Tm7sf3
tgccccgtgagcccg

SEQ ID NO: 45551 - DNA, 15 bp, Artificial Sequence
  dgRNA
  Ubash3a
agtctgtagacacgg

SEQ ID NO: 45552 - DNA, 15 bp, Artificial Sequence
  dgRNA
  Ubash3a
tagacacggaggcta

SEQ ID NO: 45553 - DNA, 15 bp, Artificial Sequence
  dgRNA
  Ubash3a
cggaggctaaggtcc

SEQ ID NO: 45554 - DNA, 15 bp, Artificial Sequence
  dgRNA
  Ubash3a
ccaccctcgccatcc

SEQ ID NO: 45555 - DNA, 15 bp, Artificial Sequence
  dgRNA
  Fcgr4
tggttctatccccct

SEQ ID NO: 45556 - DNA, 15 bp, Artificial Sequence
  dgRNA
  Fcgr4
agagctgagcacccg

SEQ ID NO: 45557 - DNA, 15 bp, Artificial Sequence
  dgRNA
  Ceacam14
agctcatatgattct

SEQ ID NO: 45558 - DNA, 15 bp, Artificial Sequence
  dgRNA
  Ceacam14
acatatggtgcggtg

SEQ ID NO: 45559 - DNA, 15 bp, Artificial Sequence
  dgRNA
  Ceacam14
tagaatcatatgagc

SEQ ID NO: 45560 - DNA, 15 bp, Artificial Sequence
  dgRNA
  Bzw1
accctacagacgccc

SEQ ID NO: 45561 - DNA, 15 bp, Artificial Sequence
  dgRNA
  Bzw1
ccgggctccagcttc

SEQ ID NO: 45562 - DNA, 15 bp, Artificial Sequence
  dgRNA
  Bzw1
tccggaggaggggtc

SEQ ID NO: 45563 - DNA, 15 bp, Artificial Sequence
  dgRNA
  Bzw1
ccggaggaggggtct

SEQ ID NO: 45564 - DNA, 15 bp, Artificial Sequence
  dgRNA
  Steap3
ggaacggctggtgga

SEQ ID NO: 45565 - DNA, 15 bp, Artificial Sequence
  dgRNA
  Steap3
cggctggtggagggt

SEQ ID NO: 45566 - DNA, 15 bp, Artificial Sequence
  dgRNA
  Steap3
ctccacttgtagtgc

SEQ ID NO: 45567 - DNA, 15 bp, Artificial Sequence
  dgRNA
  Steap3
tccacttgtagtgca

SEQ ID NO: 45568 - DNA, 15 bp, Artificial Sequence
  dgRNA
  Tas2r135
tgttgacaatgggta

SEQ ID NO: 45569 - DNA, 15 bp, Artificial Sequence
  dgRNA
  Tas2r135
gttgacaatgggtag

SEQ ID NO: 45570 - DNA, 15 bp, Artificial Sequence
  dgRNA
  Tas2r135
tcaggcccttgcata

SEQ ID NO: 45571 - DNA, 15 bp, Artificial Sequence
  dgRNA
  Tas2r115
gaatttcagccaagc

SEQ ID NO: 45572 - DNA, 15 bp, Artificial Sequence
  dgRNA
  Tas2r115
atccataactgatta

SEQ ID NO: 45573 - DNA, 15 bp, Artificial Sequence
  dgRNA
  Psmd3
agatgtacactagag

SEQ ID NO: 45574 - DNA, 15 bp, Artificial Sequence
  dgRNA
  Psmd3
aaaatcaccactctc

SEQ ID NO: 45575 - DNA, 15 bp, Artificial Sequence
  dgRNA
  Psmd3
cttcatcgtgcacct

SEQ ID NO: 45576 - DNA, 15 bp, Artificial Sequence
  dgRNA
  Psmd3
ttggatgtccgcgag

SEQ ID NO: 45577 - DNA, 15 bp, Artificial Sequence
  dgRNA
  Ptpn12
cgggggcgcgcccgt

SEQ ID NO: 45578 - DNA, 15 bp, Artificial Sequence
  dgRNA
  Ptpn12
gggggcgcgcccgtg

SEQ ID NO: 45579 - DNA, 15 bp, Artificial Sequence
  dgRNA
  Ptpn12
cgcgcccgtggggag

SEQ ID NO: 45580 - DNA, 15 bp, Artificial Sequence
  dgRNA
  Ptpn12
gccgtgttcctgagg

SEQ ID NO: 45581 - DNA, 15 bp, Artificial Sequence
  dgRNA
  Lemd1
attgattgggtaccc

SEQ ID NO: 45582 - DNA, 15 bp, Artificial Sequence
  dgRNA
  Lemd1
agccgagaatcagac

SEQ ID NO: 45583 - DNA, 15 bp, Artificial Sequence
  dgRNA
  Lemd1
gccgagaatcagacc

SEQ ID NO: 45584 - DNA, 15 bp, Artificial Sequence
  dgRNA
  Lemd1
gagaatcagaccggg

SEQ ID NO: 45585 - DNA, 15 bp, Artificial Sequence
  dgRNA
  Ndst1
gcatgcggcgccccc

SEQ ID NO: 45586 - DNA, 15 bp, Artificial Sequence
  dgRNA
  Ndst1
gttgactgctcccag

SEQ ID NO: 45587 - DNA, 15 bp, Artificial Sequence
  dgRNA
  Ndst1
ggggccctgacgccc

SEQ ID NO: 45588 - DNA, 15 bp, Artificial Sequence
  dgRNA
  Ndst1
gggccctgacgccct

SEQ ID NO: 45589 - DNA, 15 bp, Artificial Sequence
  dgRNA
  Zfp787
cgccatagagcaaaa

SEQ ID NO: 45590 - DNA, 15 bp, Artificial Sequence
  dgRNA
  Zfp787
gcaaaacggaggacc

SEQ ID NO: 45591 - DNA, 15 bp, Artificial Sequence
  dgRNA
  Zfp787
caaaacggaggacct

SEQ ID NO: 45592 - DNA, 15 bp, Artificial Sequence
  dgRNA
  Zfp787
ggaagtagcgtcccg

SEQ ID NO: 45593 - DNA, 15 bp, Artificial Sequence
  dgRNA
  Myl6b
aggccctttcaattc

SEQ ID NO: 45594 - DNA, 15 bp, Artificial Sequence
  dgRNA
  Myl6b
tttcaattccggaac

SEQ ID NO: 45595 - DNA, 15 bp, Artificial Sequence
  dgRNA
  Myl6b
accggcgcacgcctc

SEQ ID NO: 45596 - DNA, 15 bp, Artificial Sequence
  dgRNA
  Myl6b
accaactctcacggc

SEQ ID NO: 45597 - DNA, 15 bp, Artificial Sequence
  dgRNA
  Ndufb6
gctcatacttaaccc

SEQ ID NO: 45598 - DNA, 15 bp, Artificial Sequence
  dgRNA
  Ndufb6
gcctgctttccgcga

SEQ ID NO: 45599 - DNA, 15 bp, Artificial Sequence
  dgRNA
  Ndufb6
tttccgcgaaggagt

SEQ ID NO: 45600 - DNA, 15 bp, Artificial Sequence
  dgRNA
  Ndufb6
tcggcccgcccccag

SEQ ID NO: 45601 - DNA, 15 bp, Artificial Sequence
  dgRNA
  Hcar1
ggaggacgggtagtc

SEQ ID NO: 45602 - DNA, 15 bp, Artificial Sequence
  dgRNA
  Hcar1
cgggtagtcaggcaa

SEQ ID NO: 45603 - DNA, 15 bp, Artificial Sequence
  dgRNA
  Hcar1
gcccagaacgactcc

SEQ ID NO: 45604 - DNA, 15 bp, Artificial Sequence
  dgRNA
  Hcar1
ttagatttctccacc

SEQ ID NO: 45605 - DNA, 15 bp, Artificial Sequence
  dgRNA
  Irx2
tcccccggcctcagc

SEQ ID NO: 45606 - DNA, 15 bp, Artificial Sequence
  dgRNA
  Irx2
cccccggcctcagcg

SEQ ID NO: 45607 - DNA, 15 bp, Artificial Sequence
  dgRNA
  Irx2
tcagcggggcctcgg

SEQ ID NO: 45608 - DNA, 15 bp, Artificial Sequence
  dgRNA
  Irx2
gtgtgacggacagct

SEQ ID NO: 45609 - DNA, 15 bp, Artificial Sequence
  dgRNA
  Fancg
cttccagccacggag

SEQ ID NO: 45610 - DNA, 15 bp, Artificial Sequence
  dgRNA
  Fancg
ttccagccacggagc

SEQ ID NO: 45611 - DNA, 15 bp, Artificial Sequence
  dgRNA
  Fancg
tccagccacggagcg

SEQ ID NO: 45612 - DNA, 15 bp, Artificial Sequence
  dgRNA
  Fancg
cggagcggggaaacc

SEQ ID NO: 45613 - DNA, 15 bp, Artificial Sequence
  dgRNA
  Sema4f
agctccgcctacacc

SEQ ID NO: 45614 - DNA, 15 bp, Artificial Sequence
  dgRNA
  Sema4f
gctccgcctacacct

SEQ ID NO: 45615 - DNA, 15 bp, Artificial Sequence
  dgRNA
  Sema4f
cgcctacacctgggt

SEQ ID NO: 45616 - DNA, 15 bp, Artificial Sequence
  dgRNA
  Sema4f
gcctacacctgggta

SEQ ID NO: 45617 - DNA, 15 bp, Artificial Sequence
  dgRNA
  Klc1
ctgagccccgcccgg

SEQ ID NO: 45618 - DNA, 15 bp, Artificial Sequence
  dgRNA
  Klc1
cgcccggcggcgcga

SEQ ID NO: 45619 - DNA, 15 bp, Artificial Sequence
  dgRNA
  Klc1
ccggcggcgcgaggg

SEQ ID NO: 45620 - DNA, 15 bp, Artificial Sequence
  dgRNA
  Klc1
gggcgggtgacgtca

SEQ ID NO: 45621 - DNA, 15 bp, Artificial Sequence
  dgRNA
  Med29
gtgattggcgagctg

SEQ ID NO: 45622 - DNA, 15 bp, Artificial Sequence
  dgRNA
  Med29
tgattggcgagctgt

SEQ ID NO: 45623 - DNA, 15 bp, Artificial Sequence
  dgRNA
  Med29
gcgagctgtgggtga

SEQ ID NO: 45624 - DNA, 15 bp, Artificial Sequence
  dgRNA
  Med29
cgagctgtgggtgaa

SEQ ID NO: 45625 - DNA, 15 bp, Artificial Sequence
  dgRNA
  Smim5
tcagacggagccccc

SEQ ID NO: 45626 - DNA, 15 bp, Artificial Sequence
  dgRNA
  Smim5
cagacggagcccccc

SEQ ID NO: 45627 - DNA, 15 bp, Artificial Sequence
  dgRNA
  Smim5
agacggagccccccg

SEQ ID NO: 45628 - DNA, 15 bp, Artificial Sequence
  dgRNA
  Smim5
cggggttatttccac

SEQ ID NO: 45629 - DNA, 15 bp, Artificial Sequence
  dgRNA
  Rbbp6
actagccgggaggtg

SEQ ID NO: 45630 - DNA, 15 bp, Artificial Sequence
  dgRNA
  Rbbp6
gaggtgcggccgcta

SEQ ID NO: 45631 - DNA, 15 bp, Artificial Sequence
  dgRNA
  Rbbp6
ggacccctgaccccg

SEQ ID NO: 45632 - DNA, 15 bp, Artificial Sequence
  dgRNA
  Rbbp6
gacccctgaccccgc

SEQ ID NO: 45633 - DNA, 15 bp, Artificial Sequence
  dgRNA
  Rhbdd3
aaaaaaaggcgcctc

SEQ ID NO: 45634 - DNA, 15 bp, Artificial Sequence
  dgRNA
  Rhbdd3
aaaaaaggcgcctcg

SEQ ID NO: 45635 - DNA, 15 bp, Artificial Sequence
  dgRNA
  Rhbdd3
aaaaaggcgcctcgg

SEQ ID NO: 45636 - DNA, 15 bp, Artificial Sequence
  dgRNA
  Rhbdd3
gcgcgccagtgagcg

SEQ ID NO: 45637 - DNA, 15 bp, Artificial Sequence
  dgRNA
  C1galt1c1
aacacgcacgcccct

SEQ ID NO: 45638 - DNA, 15 bp, Artificial Sequence
  dgRNA
  C1galt1c1
acacgcacgcccctc

SEQ ID NO: 45639 - DNA, 15 bp, Artificial Sequence
  dgRNA
  C1galt1c1
cacgcacgcccctcg

SEQ ID NO: 45640 - DNA, 15 bp, Artificial Sequence
  dgRNA
  C1galt1c1
ctcggggcatcccat

SEQ ID NO: 45641 - DNA, 15 bp, Artificial Sequence
  dgRNA
  Gpr107
catggcaaacgcttc

SEQ ID NO: 45642 - DNA, 15 bp, Artificial Sequence
  dgRNA
  Gpr107
atggcaaacgcttca

SEQ ID NO: 45643 - DNA, 15 bp, Artificial Sequence
  dgRNA
  Gpr107
gccggaagtccgtcc

SEQ ID NO: 45644 - DNA, 15 bp, Artificial Sequence
  dgRNA
  Gpr107
ccggaagtccgtcct

SEQ ID NO: 45645 - DNA, 15 bp, Artificial Sequence
  dgRNA
  Oas1a
agccattggctgccg

SEQ ID NO: 45646 - DNA, 15 bp, Artificial Sequence
  dgRNA
  Oas1a
ttggctgccggggcc

SEQ ID NO: 45647 - DNA, 15 bp, Artificial Sequence
  dgRNA
  Oas1a
cttaggatcccacct

SEQ ID NO: 45648 - DNA, 15 bp, Artificial Sequence
  dgRNA
  Oas1a
ggccccggcagccaa

SEQ ID NO: 45649 - DNA, 15 bp, Artificial Sequence
  dgRNA
  Krtap3-3
ggtaattagcagaat

SEQ ID NO: 45650 - DNA, 15 bp, Artificial Sequence
  dgRNA
  Krtap3-3
gtaattagcagaata

SEQ ID NO: 45651 - DNA, 15 bp, Artificial Sequence
  dgRNA
  Krtap3-3
atagggactctttac

SEQ ID NO: 45652 - DNA, 15 bp, Artificial Sequence
  dgRNA
  Krtap3-3
aggcatctaaatggc

SEQ ID NO: 45653 - DNA, 15 bp, Artificial Sequence
  dgRNA
  Gmfg
gttgcaaatttaact

SEQ ID NO: 45654 - DNA, 15 bp, Artificial Sequence
  dgRNA
  Gmfg
gagatgcctaaaaag

SEQ ID NO: 45655 - DNA, 15 bp, Artificial Sequence
  dgRNA
  Gmfg
tttgcaactctggtc

SEQ ID NO: 45656 - DNA, 15 bp, Artificial Sequence
  dgRNA
  Gmfg
ttcagtcactaagat

SEQ ID NO: 45657 - DNA, 15 bp, Artificial Sequence
  dgRNA
  Gm1045
tgcgtgacgcttgcc

SEQ ID NO: 45658 - DNA, 15 bp, Artificial Sequence
  dgRNA
  Gm1045
ttgacgaagactgtc

SEQ ID NO: 45659 - DNA, 15 bp, Artificial Sequence
  dgRNA
  Gm1045
caccacaggtccggg

SEQ ID NO: 45660 - DNA, 15 bp, Artificial Sequence
  dgRNA
  Gm1045
aggtccgggtggttg

SEQ ID NO: 45661 - DNA, 15 bp, Artificial Sequence
  dgRNA
  C130060K24Rik
ctcgcgccgctcgca

SEQ ID NO: 45662 - DNA, 15 bp, Artificial Sequence
  dgRNA
  C130060K24Rik
gccgctcgcacggca

SEQ ID NO: 45663 - DNA, 15 bp, Artificial Sequence
  dgRNA
  C130060K24Rik
ctcgcacggcacggc

SEQ ID NO: 45664 - DNA, 15 bp, Artificial Sequence
  dgRNA
  C130060K24Rik
tcgcacggcacggca

SEQ ID NO: 45665 - DNA, 15 bp, Artificial Sequence
  dgRNA
  Il18r1
gctttccacccatcc

SEQ ID NO: 45666 - DNA, 15 bp, Artificial Sequence
  dgRNA
  Il18r1
ttccacccatccagg

SEQ ID NO: 45667 - DNA, 15 bp, Artificial Sequence
  dgRNA
  Il18r1
ctgggcatcctgcgc

SEQ ID NO: 45668 - DNA, 15 bp, Artificial Sequence
  dgRNA
  Il18r1
gcatcctgcgctggc

SEQ ID NO: 45669 - DNA, 15 bp, Artificial Sequence
  dgRNA
  Mkln1
cgatgagcttgggaa

SEQ ID NO: 45670 - DNA, 15 bp, Artificial Sequence
  dgRNA
  Mkln1
tcgatgagcttggga

SEQ ID NO: 45671 - DNA, 15 bp, Artificial Sequence
  dgRNA
  Mkln1
aaattcgatgagctt

SEQ ID NO: 45672 - DNA, 15 bp, Artificial Sequence
  dgRNA
  Mkln1
aaaattcgatgagct

SEQ ID NO: 45673 - DNA, 15 bp, Artificial Sequence
  dgRNA
  Fez1
aatctaggttttgca

SEQ ID NO: 45674 - DNA, 15 bp, Artificial Sequence
  dgRNA
  Fez1
gttcctccgcagaac

SEQ ID NO: 45675 - DNA, 15 bp, Artificial Sequence
  dgRNA
  Fez1
gcgtgggagggtgac

SEQ ID NO: 45676 - DNA, 15 bp, Artificial Sequence
  dgRNA
  Fez1
aagggacgcgtggga

SEQ ID NO: 45677 - DNA, 15 bp, Artificial Sequence
  dgRNA
  Map10
ccgacaaaaccccat

SEQ ID NO: 45678 - DNA, 15 bp, Artificial Sequence
  dgRNA
  Map10
tcccaagagcactcg

SEQ ID NO: 45679 - DNA, 15 bp, Artificial Sequence
  dgRNA
  Map10
aagagcactcggggc

SEQ ID NO: 45680 - DNA, 15 bp, Artificial Sequence
  dgRNA
  Map10
aagtcaagtctcgcg

SEQ ID NO: 45681 - DNA, 15 bp, Artificial Sequence
  dgRNA
  Lman2
gctttcccccgtccc

SEQ ID NO: 45682 - DNA, 15 bp, Artificial Sequence
  dgRNA
  Lman2
acctctgcatttcgt

SEQ ID NO: 45683 - DNA, 15 bp, Artificial Sequence
  dgRNA
  Lman2
gtgctgctccatgat

SEQ ID NO: 45684 - DNA, 15 bp, Artificial Sequence
  dgRNA
  Lman2
gctcatgagaaccct

SEQ ID NO: 45685 - DNA, 15 bp, Artificial Sequence
  dgRNA
  Olfr943
ataacttggcaattg

SEQ ID NO: 45686 - DNA, 15 bp, Artificial Sequence
  dgRNA
  Olfr943
ttcaactcctaataa

SEQ ID NO: 45687 - DNA, 15 bp, Artificial Sequence
  dgRNA
  Olfr943
gagcttaagtttttc

SEQ ID NO: 45688 - DNA, 15 bp, Artificial Sequence
  dgRNA
  Extl1
gtaccccagcgaaag

SEQ ID NO: 45689 - DNA, 15 bp, Artificial Sequence
  dgRNA
  Extl1
gcgaaagaggttgca

SEQ ID NO: 45690 - DNA, 15 bp, Artificial Sequence
  dgRNA
  Extl1
cgaaagaggttgcaa

SEQ ID NO: 45691 - DNA, 15 bp, Artificial Sequence
  dgRNA
  Extl1
ttgcaaggggttaag

SEQ ID NO: 45692 - DNA, 15 bp, Artificial Sequence
  dgRNA
  Npepl1
agctggagcgcttcc

SEQ ID NO: 45693 - DNA, 15 bp, Artificial Sequence
  dgRNA
  Npepl1
ctggagcgcttccag

SEQ ID NO: 45694 - DNA, 15 bp, Artificial Sequence
  dgRNA
  Npepl1
ccacttgccccccaa

SEQ ID NO: 45695 - DNA, 15 bp, Artificial Sequence
  dgRNA
  Npepl1
cttgccccccaacgg

SEQ ID NO: 45696 - DNA, 15 bp, Artificial Sequence
  dgRNA
  Rapgef6
cggaagctgggtatg

SEQ ID NO: 45697 - DNA, 15 bp, Artificial Sequence
  dgRNA
  Rapgef6
acaatcctgtaaccg

SEQ ID NO: 45698 - DNA, 15 bp, Artificial Sequence
  dgRNA
  Rapgef6
atcctgtaaccgagg

SEQ ID NO: 45699 - DNA, 15 bp, Artificial Sequence
  dgRNA
  Rapgef6
catctctctacgtca

SEQ ID NO: 45700 - DNA, 15 bp, Artificial Sequence
  dgRNA
  Ubtfl1
gagtaggtgtatctt

SEQ ID NO: 45701 - DNA, 15 bp, Artificial Sequence
  dgRNA
  Il17c
tcaccgtcactgtga

SEQ ID NO: 45702 - DNA, 15 bp, Artificial Sequence
  dgRNA
  Il17c
cctatcccagagggg

SEQ ID NO: 45703 - DNA, 15 bp, Artificial Sequence
  dgRNA
  Il17c
ttgcccacctacaaa

SEQ ID NO: 45704 - DNA, 15 bp, Artificial Sequence
  dgRNA
  Il17c
cctcacacctggcga

SEQ ID NO: 45705 - DNA, 15 bp, Artificial Sequence
  dgRNA
  Ide
gtaactgctcaagaa

SEQ ID NO: 45706 - DNA, 15 bp, Artificial Sequence
  dgRNA
  Zbed4
tccggagatggggcg

SEQ ID NO: 45707 - DNA, 15 bp, Artificial Sequence
  dgRNA
  Zbed4
ccggagatggggcga

SEQ ID NO: 45708 - DNA, 15 bp, Artificial Sequence
  dgRNA
  Zbed4
cggagatggggcgag

SEQ ID NO: 45709 - DNA, 15 bp, Artificial Sequence
  dgRNA
  Zbed4
cccgtttgcctagcc

SEQ ID NO: 45710 - DNA, 15 bp, Artificial Sequence
  dgRNA
  Rgs12
gcagggtgccctcac

SEQ ID NO: 45711 - DNA, 15 bp, Artificial Sequence
  dgRNA
  Rgs12
atcagctgttatcac

SEQ ID NO: 45712 - DNA, 15 bp, Artificial Sequence
  dgRNA
  Rgs12
cagggagtcaccggc

SEQ ID NO: 45713 - DNA, 15 bp, Artificial Sequence
  dgRNA
  Rgs12
agggagtcaccggct

SEQ ID NO: 45714 - DNA, 15 bp, Artificial Sequence
  dgRNA
  Cct7
ccacgcctgttcgtg

SEQ ID NO: 45715 - DNA, 15 bp, Artificial Sequence
  dgRNA
  Cct7
taggccacttcctat

SEQ ID NO: 45716 - DNA, 15 bp, Artificial Sequence
  dgRNA
  Cct7
gaaccgggcgctgat

SEQ ID NO: 45717 - DNA, 15 bp, Artificial Sequence
  dgRNA
  Cct7
agcaactgcagttcg

SEQ ID NO: 45718 - DNA, 15 bp, Artificial Sequence
  dgRNA
  Cc2d1a
taacagaacgatgtg

SEQ ID NO: 45719 - DNA, 15 bp, Artificial Sequence
  dgRNA
  Cc2d1a
cagaacgatgtgcgg

SEQ ID NO: 45720 - DNA, 15 bp, Artificial Sequence
  dgRNA
  Cc2d1a
cgatgtgcggcggtg

SEQ ID NO: 45721 - DNA, 15 bp, Artificial Sequence
  dgRNA
  Cc2d1a
tttttcccgcccgtg

SEQ ID NO: 45722 - DNA, 15 bp, Artificial Sequence
  dgRNA
  Tapbpl
atcacagatctgaac

SEQ ID NO: 45723 - DNA, 15 bp, Artificial Sequence
  dgRNA
  Tapbpl
aagggtccagagtac

SEQ ID NO: 45724 - DNA, 15 bp, Artificial Sequence
  dgRNA
  Tapbpl
gggtccagagtaccg

SEQ ID NO: 45725 - DNA, 15 bp, Artificial Sequence
  dgRNA
  Tapbpl
cagccctctcatagt

SEQ ID NO: 45726 - DNA, 15 bp, Artificial Sequence
  dgRNA
  Acadm
aggctcgggcaaggt

SEQ ID NO: 45727 - DNA, 15 bp, Artificial Sequence
  dgRNA
  Acadm
ggctcgggcaaggtc

SEQ ID NO: 45728 - DNA, 15 bp, Artificial Sequence
  dgRNA
  Acadm
ggcaaggtcgggagc

SEQ ID NO: 45729 - DNA, 15 bp, Artificial Sequence
  dgRNA
  Acadm
ggacgcatgcgcaga

SEQ ID NO: 45730 - DNA, 15 bp, Artificial Sequence
  dgRNA
  Kazald1
tagggtcgaagtgaa

SEQ ID NO: 45731 - DNA, 15 bp, Artificial Sequence
  dgRNA
  Kazald1
cgaagtgaaaggccc

SEQ ID NO: 45732 - DNA, 15 bp, Artificial Sequence
  dgRNA
  Kazald1
gggtccttgtgagac

SEQ ID NO: 45733 - DNA, 15 bp, Artificial Sequence
  dgRNA
  Kazald1
actggataaaattat

SEQ ID NO: 45734 - DNA, 15 bp, Artificial Sequence
  dgRNA
  Pigx
gcacgcatccggttg

SEQ ID NO: 45735 - DNA, 15 bp, Artificial Sequence
  dgRNA
  Pigx
cacgcatccggttgt

SEQ ID NO: 45736 - DNA, 15 bp, Artificial Sequence
  dgRNA
  Pigx
catccggttgtgggc

SEQ ID NO: 45737 - DNA, 15 bp, Artificial Sequence
  dgRNA
  Pigx
aagcggggctgagcg

SEQ ID NO: 45738 - DNA, 15 bp, Artificial Sequence
  dgRNA
  Map4k4
tctctcgcccgctcc

SEQ ID NO: 45739 - DNA, 15 bp, Artificial Sequence
  dgRNA
  Map4k4
cgcccgctcccggag

SEQ ID NO: 45740 - DNA, 15 bp, Artificial Sequence
  dgRNA
  Map4k4
cccggagcggcgacc

SEQ ID NO: 45741 - DNA, 15 bp, Artificial Sequence
  dgRNA
  Map4k4
cggagcggcgacccg

SEQ ID NO: 45742 - DNA, 15 bp, Artificial Sequence
  dgRNA
  Gys1
tcgtgctagaccagc

SEQ ID NO: 45743 - DNA, 15 bp, Artificial Sequence
  dgRNA
  Gys1
cgtgctagaccagca

SEQ ID NO: 45744 - DNA, 15 bp, Artificial Sequence
  dgRNA
  Gys1
ctagaccagcagggt

SEQ ID NO: 45745 - DNA, 15 bp, Artificial Sequence
  dgRNA
  Gys1
ctcctggcggccacg

SEQ ID NO: 45746 - DNA, 15 bp, Artificial Sequence
  dgRNA
  Mid1
aagctgccctaatcc

SEQ ID NO: 45747 - DNA, 15 bp, Artificial Sequence
  dgRNA
  Mid1
ccctaatcctggtaa

SEQ ID NO: 45748 - DNA, 15 bp, Artificial Sequence
  dgRNA
  Mid1
tgctcctgattggcg

SEQ ID NO: 45749 - DNA, 15 bp, Artificial Sequence
  dgRNA
  Mid1
gaggctctccgcgac

SEQ ID NO: 45750 - DNA, 15 bp, Artificial Sequence
  dgRNA
  Vmn2r69
gcaatctatgtcctt

SEQ ID NO: 45751 - DNA, 15 bp, Artificial Sequence
  dgRNA
  Vmn2r69
tacgtttgcctctgg

SEQ ID NO: 45752 - DNA, 15 bp, Artificial Sequence
  dgRNA
  Vmn2r69
ttctacgtttgcctc

SEQ ID NO: 45753 - DNA, 15 bp, Artificial Sequence
  dgRNA
  Arhgef1
cgaaatacggaaaca

SEQ ID NO: 45754 - DNA, 15 bp, Artificial Sequence
  dgRNA
  Arhgef1
ccagagcggccctat

SEQ ID NO: 45755 - DNA, 15 bp, Artificial Sequence
  dgRNA
  Arhgef1
cagagcggccctatc

SEQ ID NO: 45756 - DNA, 15 bp, Artificial Sequence
  dgRNA
  Arhgef1
cctatcgggccagcg

SEQ ID NO: 45757 - DNA, 15 bp, Artificial Sequence
  dgRNA
  Patz1
cgcgccggcgccgcc

SEQ ID NO: 45758 - DNA, 15 bp, Artificial Sequence
  dgRNA
  Patz1
gccggcgccgcctgg

SEQ ID NO: 45759 - DNA, 15 bp, Artificial Sequence
  dgRNA
  Patz1
ccggcgccgcctggc

SEQ ID NO: 45760 - DNA, 15 bp, Artificial Sequence
  dgRNA
  Patz1
gcgccgcctggcggg

SEQ ID NO: 45761 - DNA, 15 bp, Artificial Sequence
  dgRNA
  Serpina5
gccgtgtgctcagtc

SEQ ID NO: 45762 - DNA, 15 bp, Artificial Sequence
  dgRNA
  Serpina5
gtgtcatcaattcca

SEQ ID NO: 45763 - DNA, 15 bp, Artificial Sequence
  dgRNA
  Serpina5
agggtccccgataaa

SEQ ID NO: 45764 - DNA, 15 bp, Artificial Sequence
  dgRNA
  Serpina5
tctaagattttcgta

SEQ ID NO: 45765 - DNA, 15 bp, Artificial Sequence
  dgRNA
  Tmed9
agtcatctcgctatt

SEQ ID NO: 45766 - DNA, 15 bp, Artificial Sequence
  dgRNA
  Tmed9
aaaccagccccaatc

SEQ ID NO: 45767 - DNA, 15 bp, Artificial Sequence
  dgRNA
  Tmed9
tcaggtactgccgcg

SEQ ID NO: 45768 - DNA, 15 bp, Artificial Sequence
  dgRNA
  Tmed9
ggtactgccgcgcgg

SEQ ID NO: 45769 - DNA, 15 bp, Artificial Sequence
  dgRNA
  Plbd2
agcgcgagtccttta

SEQ ID NO: 45770 - DNA, 15 bp, Artificial Sequence
  dgRNA
  Plbd2
cgagtcctttaaggc

SEQ ID NO: 45771 - DNA, 15 bp, Artificial Sequence
  dgRNA
  Plbd2
agaccacgcccatcc

SEQ ID NO: 45772 - DNA, 15 bp, Artificial Sequence
  dgRNA
  Plbd2
gactcgcgctctctg

SEQ ID NO: 45773 - DNA, 15 bp, Artificial Sequence
  dgRNA
  Pcp4
gtatagaatcctttt

SEQ ID NO: 45774 - DNA, 15 bp, Artificial Sequence
  dgRNA
  Pcp4
tatagaatcctttta

SEQ ID NO: 45775 - DNA, 15 bp, Artificial Sequence
  dgRNA
  Pcp4
agaatccttttaggg

SEQ ID NO: 45776 - DNA, 15 bp, Artificial Sequence
  dgRNA
  Pcp4
ttagggtggatgctt

SEQ ID NO: 45777 - DNA, 15 bp, Artificial Sequence
  dgRNA
  Lrcol1
ctacactgctgggta

SEQ ID NO: 45778 - DNA, 15 bp, Artificial Sequence
  dgRNA
  Lrcol1
ttggctattggtagc

SEQ ID NO: 45779 - DNA, 15 bp, Artificial Sequence
  dgRNA
  Lrcol1
tagctggtcttgatt

SEQ ID NO: 45780 - DNA, 15 bp, Artificial Sequence
  dgRNA
  Lrcol1
gcaggtaaagtatgg

SEQ ID NO: 45781 - DNA, 15 bp, Artificial Sequence
  dgRNA
  Ccser2
agagaccggagtgaa

SEQ ID NO: 45782 - DNA, 15 bp, Artificial Sequence
  dgRNA
  Ccser2
ggcggagcctgcgaa

SEQ ID NO: 45783 - DNA, 15 bp, Artificial Sequence
  dgRNA
  Ccser2
gagcctgcgaacggc

SEQ ID NO: 45784 - DNA, 15 bp, Artificial Sequence
  dgRNA
  Ccser2
cgaacggctggcgcg

SEQ ID NO: 45785 - DNA, 15 bp, Artificial Sequence
  dgRNA
  Cd27
caggtccggcggctg

SEQ ID NO: 45786 - DNA, 15 bp, Artificial Sequence
  dgRNA
  Cd27
aggtccggcggctgt

SEQ ID NO: 45787 - DNA, 15 bp, Artificial Sequence
  dgRNA
  Cd27
agtctctccggagtg

SEQ ID NO: 45788 - DNA, 15 bp, Artificial Sequence
  dgRNA
  Cd27
atagggatggacgct

SEQ ID NO: 45789 - DNA, 15 bp, Artificial Sequence
  dgRNA
  Dennd4c
cacgtttgagaaatg

SEQ ID NO: 45790 - DNA, 15 bp, Artificial Sequence
  dgRNA
  Dennd4c
gagttaggaataatc

SEQ ID NO: 45791 - DNA, 15 bp, Artificial Sequence
  dgRNA
  P2ry14
tccctacgttcagca

SEQ ID NO: 45792 - DNA, 15 bp, Artificial Sequence
  dgRNA
  P2ry14
gtgggctcacggact

SEQ ID NO: 45793 - DNA, 15 bp, Artificial Sequence
  dgRNA
  P2ry14
tcacggactaggaat

SEQ ID NO: 45794 - DNA, 15 bp, Artificial Sequence
  dgRNA
  P2ry14
cacggactaggaatt

SEQ ID NO: 45795 - DNA, 15 bp, Artificial Sequence
  dgRNA
  Iqcd
actcgcgcaaccaac

SEQ ID NO: 45796 - DNA, 15 bp, Artificial Sequence
  dgRNA
  Iqcd
cctgcgtctttccat

SEQ ID NO: 45797 - DNA, 15 bp, Artificial Sequence
  dgRNA
  Iqcd
ggcgaaacgtcagag

SEQ ID NO: 45798 - DNA, 15 bp, Artificial Sequence
  dgRNA
  Iqcd
aaacgtcagagaggc

SEQ ID NO: 45799 - DNA, 15 bp, Artificial Sequence
  dgRNA
  Suox
cgcgacccggcgacc

SEQ ID NO: 45800 - DNA, 15 bp, Artificial Sequence
  dgRNA
  Suox
cggcgacccggcgac

SEQ ID NO: 45801 - DNA, 15 bp, Artificial Sequence
  dgRNA
  Suox
aggggccaatagctg

SEQ ID NO: 45802 - DNA, 15 bp, Artificial Sequence
  dgRNA
  Suox
ctgcggagccggcga

SEQ ID NO: 45803 - DNA, 15 bp, Artificial Sequence
  dgRNA
  Eif5a
gcgagctgtcgctca

SEQ ID NO: 45804 - DNA, 15 bp, Artificial Sequence
  dgRNA
  Eif5a
gagctgtcgctcaag

SEQ ID NO: 45805 - DNA, 15 bp, Artificial Sequence
  dgRNA
  Eif5a
ctgtcgctcaagggg

SEQ ID NO: 45806 - DNA, 15 bp, Artificial Sequence
  dgRNA
  Eif5a
tgtcgctcaagggga

SEQ ID NO: 45807 - DNA, 15 bp, Artificial Sequence
  dgRNA
  Metap1d
ctggtggaagcgagc

SEQ ID NO: 45808 - DNA, 15 bp, Artificial Sequence
  dgRNA
  Metap1d
cgagctggccgcaga

SEQ ID NO: 45809 - DNA, 15 bp, Artificial Sequence
  dgRNA
  Metap1d
tggcctcgacaccag

SEQ ID NO: 45810 - DNA, 15 bp, Artificial Sequence
  dgRNA
  Metap1d
aggcactcgctagcc

SEQ ID NO: 45811 - DNA, 15 bp, Artificial Sequence
  dgRNA
  Rbpj
cgtagtaatgccctc

SEQ ID NO: 45812 - DNA, 15 bp, Artificial Sequence
  dgRNA
  Rbpj
ccacgtacgtccccg

SEQ ID NO: 45813 - DNA, 15 bp, Artificial Sequence
  dgRNA
  Rbpj
cacgtacgtccccga

SEQ ID NO: 45814 - DNA, 15 bp, Artificial Sequence
  dgRNA
  Rbpj
gcgcgtcccaaaacc

SEQ ID NO: 45815 - DNA, 15 bp, Artificial Sequence
  dgRNA
  Bfar
ctattacgatgcatt

SEQ ID NO: 45816 - DNA, 15 bp, Artificial Sequence
  dgRNA
  Bfar
tattacgatgcattc

SEQ ID NO: 45817 - DNA, 15 bp, Artificial Sequence
  dgRNA
  Bfar
tgcattcgggcactg

SEQ ID NO: 45818 - DNA, 15 bp, Artificial Sequence
  dgRNA
  Bfar
gcattcgggcactgt

SEQ ID NO: 45819 - DNA, 15 bp, Artificial Sequence
  dgRNA
  Prdm1
gaaccccacgctgca

SEQ ID NO: 45820 - DNA, 15 bp, Artificial Sequence
  dgRNA
  Prdm1
cccacgctgcacggc

SEQ ID NO: 45821 - DNA, 15 bp, Artificial Sequence
  dgRNA
  Prdm1
ccacgctgcacggct

SEQ ID NO: 45822 - DNA, 15 bp, Artificial Sequence
  dgRNA
  Prdm1
gccacgcccccatcg

SEQ ID NO: 45823 - DNA, 15 bp, Artificial Sequence
  dgRNA
  Acot12
tgctccgagagaggc

SEQ ID NO: 45824 - DNA, 15 bp, Artificial Sequence
  dgRNA
  Acot12
cctcgcgacagtccc

SEQ ID NO: 45825 - DNA, 15 bp, Artificial Sequence
  dgRNA
  Acot12
ccccggctgactcgt

SEQ ID NO: 45826 - DNA, 15 bp, Artificial Sequence
  dgRNA
  Acot12
taagcacctggcagc

SEQ ID NO: 45827 - DNA, 15 bp, Artificial Sequence
  dgRNA
  Pde4b
cctggcacgaccaga

SEQ ID NO: 45828 - DNA, 15 bp, Artificial Sequence
  dgRNA
  Pde4b
ttgcactgatgctag

SEQ ID NO: 45829 - DNA, 15 bp, Artificial Sequence
  dgRNA
  Pde4b
tttgcactgatgcta

SEQ ID NO: 45830 - DNA, 15 bp, Artificial Sequence
  dgRNA
  Pde4b
cttctggtcgtgcca

SEQ ID NO: 45831 - DNA, 15 bp, Artificial Sequence
  dgRNA
  3110021N24Rik
cctgtccgttagcac

SEQ ID NO: 45832 - DNA, 15 bp, Artificial Sequence
  dgRNA
  3110021N24Rik
ctgtccgttagcaca

SEQ ID NO: 45833 - DNA, 15 bp, Artificial Sequence
  dgRNA
  3110021N24Rik
acgagaagaatgttc

SEQ ID NO: 45834 - DNA, 15 bp, Artificial Sequence
  dgRNA
  3110021N24Rik
ccgttgaagtgggag

SEQ ID NO: 45835 - DNA, 15 bp, Artificial Sequence
  dgRNA
  Zdhhc16
aagacgacttctcat

SEQ ID NO: 45836 - DNA, 15 bp, Artificial Sequence
  dgRNA
  Zdhhc16
tcattggtcagctag

SEQ ID NO: 45837 - DNA, 15 bp, Artificial Sequence
  dgRNA
  Zdhhc16
tacacgagtaccaat

SEQ ID NO: 45838 - DNA, 15 bp, Artificial Sequence
  dgRNA
  Zdhhc16
gcgccttcgaccgca

SEQ ID NO: 45839 - DNA, 15 bp, Artificial Sequence
  dgRNA
  C1galt1
atctccgagacccct

SEQ ID NO: 45840 - DNA, 15 bp, Artificial Sequence
  dgRNA
  C1galt1
tccgagacccctggg

SEQ ID NO: 45841 - DNA, 15 bp, Artificial Sequence
  dgRNA
  C1galt1
tggcggctgcgcagt

SEQ ID NO: 45842 - DNA, 15 bp, Artificial Sequence
  dgRNA
  C1galt1
cggctgcgcagtagg

SEQ ID NO: 45843 - DNA, 15 bp, Artificial Sequence
  dgRNA
  Zcchc17
ccagaacttccggag

SEQ ID NO: 45844 - DNA, 15 bp, Artificial Sequence
  dgRNA
  Zcchc17
agaggagcaaccaat

SEQ ID NO: 45845 - DNA, 15 bp, Artificial Sequence
  dgRNA
  Zcchc17
gatgacgtcacgaga

SEQ ID NO: 45846 - DNA, 15 bp, Artificial Sequence
  dgRNA
  Zcchc17
acgagaaggcgactc

SEQ ID NO: 45847 - DNA, 15 bp, Artificial Sequence
  dgRNA
  4933427D06Rik
gaatcaatctacaat

SEQ ID NO: 45848 - DNA, 15 bp, Artificial Sequence
  dgRNA
  4933427D06Rik
acgacaggatgctaa

SEQ ID NO: 45849 - DNA, 15 bp, Artificial Sequence
  dgRNA
  4933427D06Rik
tagttcttcaacgac

SEQ ID NO: 45850 - DNA, 15 bp, Artificial Sequence
  dgRNA
  Olfr482
tatgcttacttgtaa

SEQ ID NO: 45851 - DNA, 15 bp, Artificial Sequence
  dgRNA
  Olfr482
ccaactatgtattat

SEQ ID NO: 45852 - DNA, 15 bp, Artificial Sequence
  dgRNA
  Olfr482
agcatattatccaaa

SEQ ID NO: 45853 - DNA, 15 bp, Artificial Sequence
  dgRNA
  Olfr482
cctataatacatagt

SEQ ID NO: 45854 - DNA, 15 bp, Artificial Sequence
  dgRNA
  Asb10
aacagcgcttcaacc

SEQ ID NO: 45855 - DNA, 15 bp, Artificial Sequence
  dgRNA
  Asb10
tcactcctcctacac

SEQ ID NO: 45856 - DNA, 15 bp, Artificial Sequence
  dgRNA
  Asb10
gttgaagcgctgttc

SEQ ID NO: 45857 - DNA, 15 bp, Artificial Sequence
  dgRNA
  Asb10
agcggaatgacatcc

SEQ ID NO: 45858 - DNA, 15 bp, Artificial Sequence
  dgRNA
  Taf6
tgtggcgccttctga

SEQ ID NO: 45859 - DNA, 15 bp, Artificial Sequence
  dgRNA
  Taf6
gactgtgaaacgata

SEQ ID NO: 45860 - DNA, 15 bp, Artificial Sequence
  dgRNA
  Taf6
ggtctattttgacat

SEQ ID NO: 45861 - DNA, 15 bp, Artificial Sequence
  dgRNA
  Taf6
cattacccagctgtc

SEQ ID NO: 45862 - DNA, 15 bp, Artificial Sequence
  dgRNA
  Rps12
gccgcgttcttacca

SEQ ID NO: 45863 - DNA, 15 bp, Artificial Sequence
  dgRNA
  Rps12
cacggacgctcctaa

SEQ ID NO: 45864 - DNA, 15 bp, Artificial Sequence
  dgRNA
  Rps12
ggacgctcctaaagg

SEQ ID NO: 45865 - DNA, 15 bp, Artificial Sequence
  dgRNA
  Rps12
tcctaaaggcggaag

SEQ ID NO: 45866 - DNA, 15 bp, Artificial Sequence
  dgRNA
  Mocs2
aagaggtcgcagcac

SEQ ID NO: 45867 - DNA, 15 bp, Artificial Sequence
  dgRNA
  Mocs2
gagcgaagtgtacgc

SEQ ID NO: 45868 - DNA, 15 bp, Artificial Sequence
  dgRNA
  Mocs2
gtgtccacacgcccg

SEQ ID NO: 45869 - DNA, 15 bp, Artificial Sequence
  dgRNA
  Mocs2
gtcaccggcgcctct

SEQ ID NO: 45870 - DNA, 15 bp, Artificial Sequence
  dgRNA
  Gria1
agcgctccaagcatg

SEQ ID NO: 45871 - DNA, 15 bp, Artificial Sequence
  dgRNA
  Gria1
gcccgtcctcatgct

SEQ ID NO: 45872 - DNA, 15 bp, Artificial Sequence
  dgRNA
  Cdkn1a
gaccagcagcaaaat

SEQ ID NO: 45873 - DNA, 15 bp, Artificial Sequence
  dgRNA
  Cdkn1a
aaatcggagctcagc

SEQ ID NO: 45874 - DNA, 15 bp, Artificial Sequence
  dgRNA
  Cdkn1a
gggtctgttcagtcc

SEQ ID NO: 45875 - DNA, 15 bp, Artificial Sequence
  dgRNA
  Cdkn1a
ggtctgttcagtcct

SEQ ID NO: 45876 - DNA, 15 bp, Artificial Sequence
  dgRNA
  Zc3h12b
cgcattctactctag

SEQ ID NO: 45877 - DNA, 15 bp, Artificial Sequence
  dgRNA
  Zc3h12b
atgcggggggagcaa

SEQ ID NO: 45878 - DNA, 15 bp, Artificial Sequence
  dgRNA
  Zc3h12b
agagtagaatgcggg

SEQ ID NO: 45879 - DNA, 15 bp, Artificial Sequence
  dgRNA
  Zc3h12b
tagagtagaatgcgg

SEQ ID NO: 45880 - DNA, 15 bp, Artificial Sequence
  dgRNA
  Ppp2r2a
gccacttgggcaccg

SEQ ID NO: 45881 - DNA, 15 bp, Artificial Sequence
  dgRNA
  Ppp2r2a
ttgggcaccgcggct

SEQ ID NO: 45882 - DNA, 15 bp, Artificial Sequence
  dgRNA
  Ppp2r2a
tctcaaggatcctag

SEQ ID NO: 45883 - DNA, 15 bp, Artificial Sequence
  dgRNA
  Ppp2r2a
ctcaaggatcctagc

SEQ ID NO: 45884 - DNA, 15 bp, Artificial Sequence
  dgRNA
  Csnk1d
agggggatttaggcc

SEQ ID NO: 45885 - DNA, 15 bp, Artificial Sequence
  dgRNA
  Csnk1d
atccgagtccatccg

SEQ ID NO: 45886 - DNA, 15 bp, Artificial Sequence
  dgRNA
  Csnk1d
cgagtccatccgcgg

SEQ ID NO: 45887 - DNA, 15 bp, Artificial Sequence
  dgRNA
  Csnk1d
gagtccatccgcggc

SEQ ID NO: 45888 - DNA, 15 bp, Artificial Sequence
  dgRNA
  Arl11
ggtggcctgcgcttc

SEQ ID NO: 45889 - DNA, 15 bp, Artificial Sequence
  dgRNA
  Arl11
cgcttcaggattccc

SEQ ID NO: 45890 - DNA, 15 bp, Artificial Sequence
  dgRNA
  Arl11
gggctccactaacaa

SEQ ID NO: 45891 - DNA, 15 bp, Artificial Sequence
  dgRNA
  Arl11
ggaatcctgaagcgc

SEQ ID NO: 45892 - DNA, 15 bp, Artificial Sequence
  dgRNA
  Mef2c
accgcttgacgatca

SEQ ID NO: 45893 - DNA, 15 bp, Artificial Sequence
  dgRNA
  Mef2c
ccgcttgacgatcaa

SEQ ID NO: 45894 - DNA, 15 bp, Artificial Sequence
  dgRNA
  Mef2c
cgcttgacgatcaag

SEQ ID NO: 45895 - DNA, 15 bp, Artificial Sequence
  dgRNA
  Mef2c
gcttgacgatcaagg

SEQ ID NO: 45896 - DNA, 15 bp, Artificial Sequence
  dgRNA
  Vmn1r218
gaatggtctcaacta

SEQ ID NO: 45897 - DNA, 15 bp, Artificial Sequence
  dgRNA
  Vmn1r218
acataatactttatc

SEQ ID NO: 45898 - DNA, 15 bp, Artificial Sequence
  dgRNA
  Tm9sf4
tccgtttcacaatta

SEQ ID NO: 45899 - DNA, 15 bp, Artificial Sequence
  dgRNA
  Tm9sf4
tcacaattaaggtcc

SEQ ID NO: 45900 - DNA, 15 bp, Artificial Sequence
  dgRNA
  Tm9sf4
cacaattaaggtccc

SEQ ID NO: 45901 - DNA, 15 bp, Artificial Sequence
  dgRNA
  Tm9sf4
ggtcccgggtaaccc

SEQ ID NO: 45902 - DNA, 15 bp, Artificial Sequence
  dgRNA
  Fads3
gggggcagtgccccg

SEQ ID NO: 45903 - DNA, 15 bp, Artificial Sequence
  dgRNA
  Fads3
ggggcagtgccccgg

SEQ ID NO: 45904 - DNA, 15 bp, Artificial Sequence
  dgRNA
  Fads3
gccccaggccctcga

SEQ ID NO: 45905 - DNA, 15 bp, Artificial Sequence
  dgRNA
  Fads3
ccaggccctcgaggg

SEQ ID NO: 45906 - DNA, 15 bp, Artificial Sequence
  dgRNA
  Akap9
aggccgcggtcgctt

SEQ ID NO: 45907 - DNA, 15 bp, Artificial Sequence
  dgRNA
  Akap9
cggtcgctttggaat

SEQ ID NO: 45908 - DNA, 15 bp, Artificial Sequence
  dgRNA
  Akap9
attggaaatgcagcg

SEQ ID NO: 45909 - DNA, 15 bp, Artificial Sequence
  dgRNA
  Akap9
gcgtgttccgagcac

SEQ ID NO: 45910 - DNA, 15 bp, Artificial Sequence
  dgRNA
  Retnlg
ttcggctggttagag

SEQ ID NO: 45911 - DNA, 15 bp, Artificial Sequence
  dgRNA
  Retnlg
tcggctggttagagt

SEQ ID NO: 45912 - DNA, 15 bp, Artificial Sequence
  dgRNA
  Retnlg
cggctggttagagtg

SEQ ID NO: 45913 - DNA, 15 bp, Artificial Sequence
  dgRNA
  Retnlg
gctataatagacatc

SEQ ID NO: 45914 - DNA, 15 bp, Artificial Sequence
  dgRNA
  Sh3gl2
ccaggcttcggaccg

SEQ ID NO: 45915 - DNA, 15 bp, Artificial Sequence
  dgRNA
  Sh3gl2
ggcttcggaccgtgg

SEQ ID NO: 45916 - DNA, 15 bp, Artificial Sequence
  dgRNA
  Sh3gl2
gcttcggaccgtgga

SEQ ID NO: 45917 - DNA, 15 bp, Artificial Sequence
  dgRNA
  Sh3gl2
cgcccccgcacagtg

SEQ ID NO: 45918 - DNA, 15 bp, Artificial Sequence
  dgRNA
  Gins4
ccgaacgcccccacg

SEQ ID NO: 45919 - DNA, 15 bp, Artificial Sequence
  dgRNA
  Gins4
gtggccgtcccgaga

SEQ ID NO: 45920 - DNA, 15 bp, Artificial Sequence
  dgRNA
  Gins4
cgagacggtgccacc

SEQ ID NO: 45921 - DNA, 15 bp, Artificial Sequence
  dgRNA
  Gins4
ccggcacttcactcc

SEQ ID NO: 45922 - DNA, 15 bp, Artificial Sequence
  dgRNA
  Crtc1
cccgacgcgttgccc

SEQ ID NO: 45923 - DNA, 15 bp, Artificial Sequence
  dgRNA
  Crtc1
tgcccaggcacgcgc

SEQ ID NO: 45924 - DNA, 15 bp, Artificial Sequence
  dgRNA
  Crtc1
gcctctcccgcgcgc

SEQ ID NO: 45925 - DNA, 15 bp, Artificial Sequence
  dgRNA
  Crtc1
gccggcgccacgctc

SEQ ID NO: 45926 - DNA, 15 bp, Artificial Sequence
  dgRNA
  Tmem258
tcacacaccgcaaga

SEQ ID NO: 45927 - DNA, 15 bp, Artificial Sequence
  dgRNA
  Tmem258
ccgcaagatggaaaa

SEQ ID NO: 45928 - DNA, 15 bp, Artificial Sequence
  dgRNA
  Tmem258
tagggctgcttaccc

SEQ ID NO: 45929 - DNA, 15 bp, Artificial Sequence
  dgRNA
  Tmem258
tggggttaccacatc

SEQ ID NO: 45930 - DNA, 15 bp, Artificial Sequence
  dgRNA
  Zfp316
tggggctggacgtcg

SEQ ID NO: 45931 - DNA, 15 bp, Artificial Sequence
  dgRNA
  Zfp316
ggggctggacgtcgt

SEQ ID NO: 45932 - DNA, 15 bp, Artificial Sequence
  dgRNA
  Zfp316
ctggacgtcgtgggc

SEQ ID NO: 45933 - DNA, 15 bp, Artificial Sequence
  dgRNA
  Zfp316
tggacgtcgtgggca

SEQ ID NO: 45934 - DNA, 15 bp, Artificial Sequence
  dgRNA
  4930415L06Rik
tttacgaagaatctt

SEQ ID NO: 45935 - DNA, 15 bp, Artificial Sequence
  dgRNA
  4930415L06Rik
aggcccttaagcaaa

SEQ ID NO: 45936 - DNA, 15 bp, Artificial Sequence
  dgRNA
  4930415L06Rik
accgatactcttaaa

SEQ ID NO: 45937 - DNA, 15 bp, Artificial Sequence
  dgRNA
  4930415L06Rik
aaccgatactcttaa

SEQ ID NO: 45938 - DNA, 15 bp, Artificial Sequence
  dgRNA
  Ptpn11
gcgagccgggcggcg

SEQ ID NO: 45939 - DNA, 15 bp, Artificial Sequence
  dgRNA
  Ptpn11
cggccgcgcagtgtc

SEQ ID NO: 45940 - DNA, 15 bp, Artificial Sequence
  dgRNA
  Ptpn11
ggccgcgcagtgtcc

SEQ ID NO: 45941 - DNA, 15 bp, Artificial Sequence
  dgRNA
  Ptpn11
cagtgtccgggatcc

SEQ ID NO: 45942 - DNA, 15 bp, Artificial Sequence
  dgRNA
  Gm5431
gcaaaatgatcagtt

SEQ ID NO: 45943 - DNA, 15 bp, Artificial Sequence
  dgRNA
  Gm5431
caaaatgatcagtta

SEQ ID NO: 45944 - DNA, 15 bp, Artificial Sequence
  dgRNA
  Gm5431
aaatgatcagttagg

SEQ ID NO: 45945 - DNA, 15 bp, Artificial Sequence
  dgRNA
  Gm5431
aatgatcagttaggg

SEQ ID NO: 45946 - DNA, 15 bp, Artificial Sequence
  dgRNA
  Rcan2
gtcgaatctcaacct

SEQ ID NO: 45947 - DNA, 15 bp, Artificial Sequence
  dgRNA
  Rcan2
aatctcaacctagga

SEQ ID NO: 45948 - DNA, 15 bp, Artificial Sequence
  dgRNA
  Rcan2
ccctccctcgcagag

SEQ ID NO: 45949 - DNA, 15 bp, Artificial Sequence
  dgRNA
  Rcan2
ccactctgcgaggga

SEQ ID NO: 45950 - DNA, 15 bp, Artificial Sequence
  dgRNA
  Mrpl33
gggtattgtgatatt

SEQ ID NO: 45951 - DNA, 15 bp, Artificial Sequence
  dgRNA
  Mrpl33
atcttttgtatggag

SEQ ID NO: 45952 - DNA, 15 bp, Artificial Sequence
  dgRNA
  Mrpl33
gactgcccgaacttc

SEQ ID NO: 45953 - DNA, 15 bp, Artificial Sequence
  dgRNA
  Mrpl33
ctgcccgaacttcag

SEQ ID NO: 45954 - DNA, 15 bp, Artificial Sequence
  dgRNA
  Trcg1
aggcaaatgtctacc

SEQ ID NO: 45955 - DNA, 15 bp, Artificial Sequence
  dgRNA
  Trcg1
gatgggttctgaacc

SEQ ID NO: 45956 - DNA, 15 bp, Artificial Sequence
  dgRNA
  Trcg1
ggaacacacggggat

SEQ ID NO: 45957 - DNA, 15 bp, Artificial Sequence
  dgRNA
  Trcg1
atggtggaacacacg

SEQ ID NO: 45958 - DNA, 15 bp, Artificial Sequence
  dgRNA
  Adrbk1
agccggcgacgagcg

SEQ ID NO: 45959 - DNA, 15 bp, Artificial Sequence
  dgRNA
  Adrbk1
gcgacgagcgaggac

SEQ ID NO: 45960 - DNA, 15 bp, Artificial Sequence
  dgRNA
  Adrbk1
cgacgagcgaggacc

SEQ ID NO: 45961 - DNA, 15 bp, Artificial Sequence
  dgRNA
  Adrbk1
cgagcgaggaccggg

SEQ ID NO: 45962 - DNA, 15 bp, Artificial Sequence
  dgRNA
  Mro
tctccagcaactagc

SEQ ID NO: 45963 - DNA, 15 bp, Artificial Sequence
  dgRNA
  Mro
ctccagcaactagca

SEQ ID NO: 45964 - DNA, 15 bp, Artificial Sequence
  dgRNA
  Mro
tccagcaactagcag

SEQ ID NO: 45965 - DNA, 15 bp, Artificial Sequence
  dgRNA
  Mro
agctcactgcagatt

SEQ ID NO: 45966 - DNA, 15 bp, Artificial Sequence
  dgRNA
  Mfsd4
gcctttagcactagc

SEQ ID NO: 45967 - DNA, 15 bp, Artificial Sequence
  dgRNA
  Mfsd4
tttagcactagctgg

SEQ ID NO: 45968 - DNA, 15 bp, Artificial Sequence
  dgRNA
  Mfsd4
ttagcactagctggc

SEQ ID NO: 45969 - DNA, 15 bp, Artificial Sequence
  dgRNA
  Mfsd4
ggcgggtcgcgctcc

SEQ ID NO: 45970 - DNA, 15 bp, Artificial Sequence
  dgRNA
  Cald1
tgctctgtatcgttc

SEQ ID NO: 45971 - DNA, 15 bp, Artificial Sequence
  dgRNA
  Cald1
tgatgggcttctatt

SEQ ID NO: 45972 - DNA, 15 bp, Artificial Sequence
  dgRNA
  Cald1
gatgggcttctatta

SEQ ID NO: 45973 - DNA, 15 bp, Artificial Sequence
  dgRNA
  Cald1
ggggctaggatgacg

SEQ ID NO: 45974 - DNA, 15 bp, Artificial Sequence
  dgRNA
  Saraf
actgaacgaaccttc

SEQ ID NO: 45975 - DNA, 15 bp, Artificial Sequence
  dgRNA
  Saraf
tttgagcactcgcta

SEQ ID NO: 45976 - DNA, 15 bp, Artificial Sequence
  dgRNA
  Saraf
ctcgctagggtacca

SEQ ID NO: 45977 - DNA, 15 bp, Artificial Sequence
  dgRNA
  Saraf
tactgacaagtcaga

SEQ ID NO: 45978 - DNA, 15 bp, Artificial Sequence
  dgRNA
  Birc5
accctccgtgtcctc

SEQ ID NO: 45979 - DNA, 15 bp, Artificial Sequence
  dgRNA
  Birc5
ccctccgtgtcctct

SEQ ID NO: 45980 - DNA, 15 bp, Artificial Sequence
  dgRNA
  Birc5
ccgagggcggtggac

SEQ ID NO: 45981 - DNA, 15 bp, Artificial Sequence
  dgRNA
  Birc5
gccgagggcggtgga

SEQ ID NO: 45982 - DNA, 15 bp, Artificial Sequence
  dgRNA
  Olfr1484
atttgaccaattacc

SEQ ID NO: 45983 - DNA, 15 bp, Artificial Sequence
  dgRNA
  Olfr1484
taagtaactctcttt

SEQ ID NO: 45984 - DNA, 15 bp, Artificial Sequence
  dgRNA
  Olfr1484
catttcacactgtac

SEQ ID NO: 45985 - DNA, 15 bp, Artificial Sequence
  dgRNA
  Olfr1484
tggtaattggtcaaa

SEQ ID NO: 45986 - DNA, 15 bp, Artificial Sequence
  dgRNA
  Slc19a3
tagcgctttacaaac

SEQ ID NO: 45987 - DNA, 15 bp, Artificial Sequence
  dgRNA
  Slc19a3
ttacaaactggctga

SEQ ID NO: 45988 - DNA, 15 bp, Artificial Sequence
  dgRNA
  Slc19a3
tccggatcaaagacc

SEQ ID NO: 45989 - DNA, 15 bp, Artificial Sequence
  dgRNA
  Slc19a3
ccggatcaaagacct

SEQ ID NO: 45990 - DNA, 15 bp, Artificial Sequence
  dgRNA
  Arhgef2
aaaccttattcgctt

SEQ ID NO: 45991 - DNA, 15 bp, Artificial Sequence
  dgRNA
  Arhgef2
aaccttattcgctta

SEQ ID NO: 45992 - DNA, 15 bp, Artificial Sequence
  dgRNA
  Arhgef2
gtgtgggcaaaacac

SEQ ID NO: 45993 - DNA, 15 bp, Artificial Sequence
  dgRNA
  Arhgef2
gctgacacaacctcc

SEQ ID NO: 45994 - DNA, 15 bp, Artificial Sequence
  dgRNA
  Grpr
agctgccgtttgcta

SEQ ID NO: 45995 - DNA, 15 bp, Artificial Sequence
  dgRNA
  Grpr
tgcctataggattgg

SEQ ID NO: 45996 - DNA, 15 bp, Artificial Sequence
  dgRNA
  Grpr
caggttctacaaatc

SEQ ID NO: 45997 - DNA, 15 bp, Artificial Sequence
  dgRNA
  Grpr
gctgccgctctgaag

SEQ ID NO: 45998 - DNA, 15 bp, Artificial Sequence
  dgRNA
  Spata33
cttaccgtccatggc

SEQ ID NO: 45999 - DNA, 15 bp, Artificial Sequence
  dgRNA
  Spata33
ccgtccatggccggt

SEQ ID NO: 46000 - DNA, 15 bp, Artificial Sequence
  dgRNA
  Spata33
cgtccatggccggtc

SEQ ID NO: 46001 - DNA, 15 bp, Artificial Sequence
  dgRNA
  Spata33
cccgctgtctccgcg

SEQ ID NO: 46002 - DNA, 15 bp, Artificial Sequence
  dgRNA
  Mlh1
gtcatccacattctg

SEQ ID NO: 46003 - DNA, 15 bp, Artificial Sequence
  dgRNA
  Mlh1
atccacattctgcgg

SEQ ID NO: 46004 - DNA, 15 bp, Artificial Sequence
  dgRNA
  Mlh1
ttctgcggaggccac

SEQ ID NO: 46005 - DNA, 15 bp, Artificial Sequence
  dgRNA
  Mlh1
gaacgccgagctctg

SEQ ID NO: 46006 - DNA, 15 bp, Artificial Sequence
  dgRNA
  Olfr681
agcgcctgagaaaca

SEQ ID NO: 46007 - DNA, 15 bp, Artificial Sequence
  dgRNA
  Olfr681
atatacaattgtagc

SEQ ID NO: 46008 - DNA, 15 bp, Artificial Sequence
  dgRNA
  Prex1
cccagtttccgcatg

SEQ ID NO: 46009 - DNA, 15 bp, Artificial Sequence
  dgRNA
  Prex1
accatgaccccgccc

SEQ ID NO: 46010 - DNA, 15 bp, Artificial Sequence
  dgRNA
  Prex1
gattgggcggggatt

SEQ ID NO: 46011 - DNA, 15 bp, Artificial Sequence
  dgRNA
  Prex1
ctgggcggggactaa

SEQ ID NO: 46012 - DNA, 15 bp, Artificial Sequence
  dgRNA
  Mbd3l1
tggatctaataacaa

SEQ ID NO: 46013 - DNA, 15 bp, Artificial Sequence
  dgRNA
  Mbd3l1
ggatctaataacaaa

SEQ ID NO: 46014 - DNA, 15 bp, Artificial Sequence
  dgRNA
  Mbd3l1
gttattagatccaaa

SEQ ID NO: 46015 - DNA, 15 bp, Artificial Sequence
  dgRNA
  Mycbp
caagaaacacggcat

SEQ ID NO: 46016 - DNA, 15 bp, Artificial Sequence
  dgRNA
  Mycbp
gcgcccactaacacg

SEQ ID NO: 46017 - DNA, 15 bp, Artificial Sequence
  dgRNA
  Mycbp
cgcccactaacacgt

SEQ ID NO: 46018 - DNA, 15 bp, Artificial Sequence
  dgRNA
  Mycbp
gcccactaacacgtg

SEQ ID NO: 46019 - DNA, 15 bp, Artificial Sequence
  dgRNA
  Ccdc184
acttcctcgttgcca

SEQ ID NO: 46020 - DNA, 15 bp, Artificial Sequence
  dgRNA
  Ccdc184
gctgcaatgtttaat

SEQ ID NO: 46021 - DNA, 15 bp, Artificial Sequence
  dgRNA
  Ccdc184
ctgacgggcggggca

SEQ ID NO: 46022 - DNA, 15 bp, Artificial Sequence
  dgRNA
  Ccdc184
gctgacgggcggggc

SEQ ID NO: 46023 - DNA, 15 bp, Artificial Sequence
  dgRNA
  Slc13a5
cagtcctctccatag

SEQ ID NO: 46024 - DNA, 15 bp, Artificial Sequence
  dgRNA
  Slc13a5
agtcctctccataga

SEQ ID NO: 46025 - DNA, 15 bp, Artificial Sequence
  dgRNA
  Slc13a5
cgcctcactctgccg

SEQ ID NO: 46026 - DNA, 15 bp, Artificial Sequence
  dgRNA
  Slc13a5
gcctcactctgccgc

SEQ ID NO: 46027 - DNA, 15 bp, Artificial Sequence
  dgRNA
  Nmt2
ccacttaggcagtcg

SEQ ID NO: 46028 - DNA, 15 bp, Artificial Sequence
  dgRNA
  Zscan21
tgctccccctccaga

SEQ ID NO: 46029 - DNA, 15 bp, Artificial Sequence
  dgRNA
  Zscan21
gctccccctccagag

SEQ ID NO: 46030 - DNA, 15 bp, Artificial Sequence
  dgRNA
  Zscan21
gctctgacgcgcttc

SEQ ID NO: 46031 - DNA, 15 bp, Artificial Sequence
  dgRNA
  Zscan21
ctgacgcgcttccgg

SEQ ID NO: 46032 - DNA, 15 bp, Artificial Sequence
  dgRNA
  Cav1
cttaggacagtgtta

SEQ ID NO: 46033 - DNA, 15 bp, Artificial Sequence
  dgRNA
  Cav1
gttaagggttaagag

SEQ ID NO: 46034 - DNA, 15 bp, Artificial Sequence
  dgRNA
  Cav1
ttaagagagggacca

SEQ ID NO: 46035 - DNA, 15 bp, Artificial Sequence
  dgRNA
  Cav1
gagggaccacggagc

SEQ ID NO: 46036 - DNA, 15 bp, Artificial Sequence
  dgRNA
  Gnl2
cactgggccgagaac

SEQ ID NO: 46037 - DNA, 15 bp, Artificial Sequence
  dgRNA
  Gnl2
gactgcccggtgccc

SEQ ID NO: 46038 - DNA, 15 bp, Artificial Sequence
  dgRNA
  Gnl2
ccctggacgttgcta

SEQ ID NO: 46039 - DNA, 15 bp, Artificial Sequence
  dgRNA
  Gnl2
ggacgttgctatgga

SEQ ID NO: 46040 - DNA, 15 bp, Artificial Sequence
  dgRNA
  Dll4
gggcacgcgcagagc

SEQ ID NO: 46041 - DNA, 15 bp, Artificial Sequence
  dgRNA
  Dll4
ggacctgcgccctac

SEQ ID NO: 46042 - DNA, 15 bp, Artificial Sequence
  dgRNA
  Dll4
ctgcgccctactggc

SEQ ID NO: 46043 - DNA, 15 bp, Artificial Sequence
  dgRNA
  Dll4
acagggggagcggcg

SEQ ID NO: 46044 - DNA, 15 bp, Artificial Sequence
  dgRNA
  Ptprf
ccacgctcgttcctg

SEQ ID NO: 46045 - DNA, 15 bp, Artificial Sequence
  dgRNA
  Ptprf
ttttgatgttccagg

SEQ ID NO: 46046 - DNA, 15 bp, Artificial Sequence
  dgRNA
  Ptprf
caggcggtttagact

SEQ ID NO: 46047 - DNA, 15 bp, Artificial Sequence
  dgRNA
  Ptprf
ggcggtttagacttg

SEQ ID NO: 46048 - DNA, 15 bp, Artificial Sequence
  dgRNA
  Pax6
acaacgacgaaagag

SEQ ID NO: 46049 - DNA, 15 bp, Artificial Sequence
  dgRNA
  Pax6
gaggatgcctcttaa

SEQ ID NO: 46050 - DNA, 15 bp, Artificial Sequence
  dgRNA
  Pax6
cccccactgctacgc

SEQ ID NO: 46051 - DNA, 15 bp, Artificial Sequence
  dgRNA
  Pax6
ccccactgctacgcc

SEQ ID NO: 46052 - DNA, 15 bp, Artificial Sequence
  dgRNA
  Acbd4
agccaccgcacagca

SEQ ID NO: 46053 - DNA, 15 bp, Artificial Sequence
  dgRNA
  Acbd4
acagcatggtctcga

SEQ ID NO: 46054 - DNA, 15 bp, Artificial Sequence
  dgRNA
  Acbd4
cagcatggtctcgaa

SEQ ID NO: 46055 - DNA, 15 bp, Artificial Sequence
  dgRNA
  Acbd4
ggtctcgaagggccc

SEQ ID NO: 46056 - DNA, 15 bp, Artificial Sequence
  dgRNA
  2010300C02Rik
tgattcacctagaga

SEQ ID NO: 46057 - DNA, 15 bp, Artificial Sequence
  dgRNA
  2010300C02Rik
attcacctagagacg

SEQ ID NO: 46058 - DNA, 15 bp, Artificial Sequence
  dgRNA
  2010300C02Rik
cacctagagacgggg

SEQ ID NO: 46059 - DNA, 15 bp, Artificial Sequence
  dgRNA
  2010300C02Rik
tagccctcagacgct

SEQ ID NO: 46060 - DNA, 15 bp, Artificial Sequence
  dgRNA
  Tnmd
agcatgtattgccac

SEQ ID NO: 46061 - DNA, 15 bp, Artificial Sequence
  dgRNA
  Tnmd
gggggacgacgacaa

SEQ ID NO: 46062 - DNA, 15 bp, Artificial Sequence
  dgRNA
  Tnmd
aaggggatcaagcct

SEQ ID NO: 46063 - DNA, 15 bp, Artificial Sequence
  dgRNA
  Camk2n1
cgagccggcgcgcac

SEQ ID NO: 46064 - DNA, 15 bp, Artificial Sequence
  dgRNA
  Camk2n1
ggcgcgcacaggctc

SEQ ID NO: 46065 - DNA, 15 bp, Artificial Sequence
  dgRNA
  Camk2n1
gcgcgcacaggctcc

SEQ ID NO: 46066 - DNA, 15 bp, Artificial Sequence
  dgRNA
  Camk2n1
gcacaggctccgggt

SEQ ID NO: 46067 - DNA, 15 bp, Artificial Sequence
  dgRNA
  Hebp1
aaagtggggtgctac

SEQ ID NO: 46068 - DNA, 15 bp, Artificial Sequence
  dgRNA
  Hebp1
cgcacccaggagact

SEQ ID NO: 46069 - DNA, 15 bp, Artificial Sequence
  dgRNA
  Hebp1
gagactgggctcacg

SEQ ID NO: 46070 - DNA, 15 bp, Artificial Sequence
  dgRNA
  Hebp1
agactgggctcacgt

SEQ ID NO: 46071 - DNA, 15 bp, Artificial Sequence
  dgRNA
  Rapgef2
gtctacaagtgtgaa

SEQ ID NO: 46072 - DNA, 15 bp, Artificial Sequence
  dgRNA
  Rapgef2
tcggaggctctgaca

SEQ ID NO: 46073 - DNA, 15 bp, Artificial Sequence
  dgRNA
  Rapgef2
aactctaaccctcgg

SEQ ID NO: 46074 - DNA, 15 bp, Artificial Sequence
  dgRNA
  Rapgef2
ctgaacgacagggct

SEQ ID NO: 46075 - DNA, 15 bp, Artificial Sequence
  dgRNA
  4930568D16Rik
acaaggtgttacctc

SEQ ID NO: 46076 - DNA, 15 bp, Artificial Sequence
  dgRNA
  Prrc2a
agccctgaagagcgg

SEQ ID NO: 46077 - DNA, 15 bp, Artificial Sequence
  dgRNA
  Prrc2a
gccctgaagagcgga

SEQ ID NO: 46078 - DNA, 15 bp, Artificial Sequence
  dgRNA
  Prrc2a
ccctgaagagcggag

SEQ ID NO: 46079 - DNA, 15 bp, Artificial Sequence
  dgRNA
  Prrc2a
aggggtcggagagta

SEQ ID NO: 46080 - DNA, 15 bp, Artificial Sequence
  dgRNA
  Ddx11
aaagcgcaatatttc

SEQ ID NO: 46081 - DNA, 15 bp, Artificial Sequence
  dgRNA
  Ddx11
aagcgcaatatttct

SEQ ID NO: 46082 - DNA, 15 bp, Artificial Sequence
  dgRNA
  Ddx11
agcgcaatatttctg

SEQ ID NO: 46083 - DNA, 15 bp, Artificial Sequence
  dgRNA
  Ddx11
acaacccccaatagc

SEQ ID NO: 46084 - DNA, 15 bp, Artificial Sequence
  dgRNA
  Oma1
caggtagcttaaatc

SEQ ID NO: 46085 - DNA, 15 bp, Artificial Sequence
  dgRNA
  Oma1
cctcccaccacacgg

SEQ ID NO: 46086 - DNA, 15 bp, Artificial Sequence
  dgRNA
  Oma1
cacacgggggcgaga

SEQ ID NO: 46087 - DNA, 15 bp, Artificial Sequence
  dgRNA
  Oma1
ccgtacagccgcagc

SEQ ID NO: 46088 - DNA, 15 bp, Artificial Sequence
  dgRNA
  Klhdc10
gaagcgggcgagctc

SEQ ID NO: 46089 - DNA, 15 bp, Artificial Sequence
  dgRNA
  Klhdc10
aagcgggcgagctcc

SEQ ID NO: 46090 - DNA, 15 bp, Artificial Sequence
  dgRNA
  Klhdc10
ttttagctatagcta

SEQ ID NO: 46091 - DNA, 15 bp, Artificial Sequence
  dgRNA
  Klhdc10
aaggcggccagccat

SEQ ID NO: 46092 - DNA, 15 bp, Artificial Sequence
  dgRNA
  Mrps16
cttccgtagcagtca

SEQ ID NO: 46093 - DNA, 15 bp, Artificial Sequence
  dgRNA
  Mrps16
tcaaggatcagtcac

SEQ ID NO: 46094 - DNA, 15 bp, Artificial Sequence
  dgRNA
  Mrps16
gtcaccggcgccctg

SEQ ID NO: 46095 - DNA, 15 bp, Artificial Sequence
  dgRNA
  Mrps16
ggcactcccggcgct

SEQ ID NO: 46096 - DNA, 15 bp, Artificial Sequence
  dgRNA
  Nsmce2
ggacctcgaacccgc

SEQ ID NO: 46097 - DNA, 15 bp, Artificial Sequence
  dgRNA
  Nsmce2
tcagccgtccgacgc

SEQ ID NO: 46098 - DNA, 15 bp, Artificial Sequence
  dgRNA
  Nsmce2
ccgacgctggccgcg

SEQ ID NO: 46099 - DNA, 15 bp, Artificial Sequence
  dgRNA
  Nsmce2
gctggccgcgtggac

SEQ ID NO: 46100 - DNA, 15 bp, Artificial Sequence
  dgRNA
  11-Sep
gcgggcgagcagatg

SEQ ID NO: 46101 - DNA, 15 bp, Artificial Sequence
  dgRNA
  11-Sep
gcgagcagatgcggc

SEQ ID NO: 46102 - DNA, 15 bp, Artificial Sequence
  dgRNA
  Chdh
agggtcctcttatcc

SEQ ID NO: 46103 - DNA, 15 bp, Artificial Sequence
  dgRNA
  Chdh
cccgccgcagttctc

SEQ ID NO: 46104 - DNA, 15 bp, Artificial Sequence
  dgRNA
  Chdh
ccgccgcagttctcc

SEQ ID NO: 46105 - DNA, 15 bp, Artificial Sequence
  dgRNA
  Chdh
tgcccaagccggcgc

SEQ ID NO: 46106 - DNA, 15 bp, Artificial Sequence
  dgRNA
  Prf1
gtcacaagccggatg

SEQ ID NO: 46107 - DNA, 15 bp, Artificial Sequence
  dgRNA
  Prf1
acaagccggatgagg

SEQ ID NO: 46108 - DNA, 15 bp, Artificial Sequence
  dgRNA
  Prf1
gtaatgatatgacgt

SEQ ID NO: 46109 - DNA, 15 bp, Artificial Sequence
  dgRNA
  Prf1
gatatgacgttggcc

SEQ ID NO: 46110 - DNA, 15 bp, Artificial Sequence
  dgRNA
  Plscr4
gacaaatcatgtgcg

SEQ ID NO: 46111 - DNA, 15 bp, Artificial Sequence
  dgRNA
  Plscr4
acaaatcatgtgcga

SEQ ID NO: 46112 - DNA, 15 bp, Artificial Sequence
  dgRNA
  Plscr4
atgtgcgagggaaaa

SEQ ID NO: 46113 - DNA, 15 bp, Artificial Sequence
  dgRNA
  Plscr4
cttagcgagatgtaa

SEQ ID NO: 46114 - DNA, 15 bp, Artificial Sequence
  dgRNA
  Wdr34
aatcccaaatcgctg

SEQ ID NO: 46115 - DNA, 15 bp, Artificial Sequence
  dgRNA
  Wdr34
gcggttttgttgtat

SEQ ID NO: 46116 - DNA, 15 bp, Artificial Sequence
  dgRNA
  Wdr34
ttcacttcctctcgt

SEQ ID NO: 46117 - DNA, 15 bp, Artificial Sequence
  dgRNA
  Wdr34
tcggacttccgtttg

SEQ ID NO: 46118 - DNA, 15 bp, Artificial Sequence
  dgRNA
  0610009B22Rik
atccaagatggcggc

SEQ ID NO: 46119 - DNA, 15 bp, Artificial Sequence
  dgRNA
  0610009B22Rik
agatggcggccggac

SEQ ID NO: 46120 - DNA, 15 bp, Artificial Sequence
  dgRNA
  0610009B22Rik
gatggcggccggacc

SEQ ID NO: 46121 - DNA, 15 bp, Artificial Sequence
  dgRNA
  0610009B22Rik
atggcggccggaccg

SEQ ID NO: 46122 - DNA, 15 bp, Artificial Sequence
  dgRNA
  Ttc39d
tgagatgcagcgtta

SEQ ID NO: 46123 - DNA, 15 bp, Artificial Sequence
  dgRNA
  Ttc39d
gtgagatgcagcgtt

SEQ ID NO: 46124 - DNA, 15 bp, Artificial Sequence
  dgRNA
  Ttc39d
gctgcactcctgacc

SEQ ID NO: 46125 - DNA, 15 bp, Artificial Sequence
  dgRNA
  Ttc39d
tgctttctcggttag

SEQ ID NO: 46126 - DNA, 15 bp, Artificial Sequence
  dgRNA
  Etv4
cccctactttctgat

SEQ ID NO: 46127 - DNA, 15 bp, Artificial Sequence
  dgRNA
  Etv4
tctgattggtcttcg

SEQ ID NO: 46128 - DNA, 15 bp, Artificial Sequence
  dgRNA
  Etv4
ttggtcttcgtggct

SEQ ID NO: 46129 - DNA, 15 bp, Artificial Sequence
  dgRNA
  Etv4
agctagccgagtctg

SEQ ID NO: 46130 - DNA, 15 bp, Artificial Sequence
  dgRNA
  Mfsd2b
ggacccgaagcttcg

SEQ ID NO: 46131 - DNA, 15 bp, Artificial Sequence
  dgRNA
  Mfsd2b
gaagcttcgaggtcc

SEQ ID NO: 46132 - DNA, 15 bp, Artificial Sequence
  dgRNA
  Mfsd2b
aagcttcgaggtcct

SEQ ID NO: 46133 - DNA, 15 bp, Artificial Sequence
  dgRNA
  Mfsd2b
gcctcaggtggcacg

SEQ ID NO: 46134 - DNA, 15 bp, Artificial Sequence
  dgRNA
  Atp7a
ccaagatgtaaagtt

SEQ ID NO: 46135 - DNA, 15 bp, Artificial Sequence
  dgRNA
  Cirh1a
cggcctcgttccccg

SEQ ID NO: 46136 - DNA, 15 bp, Artificial Sequence
  dgRNA
  Cirh1a
gcgcccctccgcccg

SEQ ID NO: 46137 - DNA, 15 bp, Artificial Sequence
  dgRNA
  Cirh1a
cggcctgacctgcaa

SEQ ID NO: 46138 - DNA, 15 bp, Artificial Sequence
  dgRNA
  Cirh1a
cctgacctgcaatgg

SEQ ID NO: 46139 - DNA, 15 bp, Artificial Sequence
  dgRNA
  Cacna1g
gctgtggtgtgcgcc

SEQ ID NO: 46140 - DNA, 15 bp, Artificial Sequence
  dgRNA
  Cacna1g
ggcgcacaccacagc

SEQ ID NO: 46141 - DNA, 15 bp, Artificial Sequence
  dgRNA
  Cacna1g
cggcggcgaggagcc

SEQ ID NO: 46142 - DNA, 15 bp, Artificial Sequence
  dgRNA
  Cacna1g
gagaaagcggcggcg

SEQ ID NO: 46143 - DNA, 15 bp, Artificial Sequence
  dgRNA
  Pyurf
gttttgtaaaagcgg

SEQ ID NO: 46144 - DNA, 15 bp, Artificial Sequence
  dgRNA
  Pyurf
gcagccactgacccg

SEQ ID NO: 46145 - DNA, 15 bp, Artificial Sequence
  dgRNA
  Pyurf
tgacccggggaatgt

SEQ ID NO: 46146 - DNA, 15 bp, Artificial Sequence
  dgRNA
  Pyurf
aatgtcggtctgccc

SEQ ID NO: 46147 - DNA, 15 bp, Artificial Sequence
  dgRNA
  Panx1
catcaacgctctcaa

SEQ ID NO: 46148 - DNA, 15 bp, Artificial Sequence
  dgRNA
  Panx1
caacgctctcaatgg

SEQ ID NO: 46149 - DNA, 15 bp, Artificial Sequence
  dgRNA
  Panx1
ggctagctcgtgctc

SEQ ID NO: 46150 - DNA, 15 bp, Artificial Sequence
  dgRNA
  Panx1
gctagctcgtgctcc

SEQ ID NO: 46151 - DNA, 15 bp, Artificial Sequence
  dgRNA
  Tenm4
ccttggggaccacgg

SEQ ID NO: 46152 - DNA, 15 bp, Artificial Sequence
  dgRNA
  Tenm4
cctctctgcattcgc

SEQ ID NO: 46153 - DNA, 15 bp, Artificial Sequence
  dgRNA
  Tenm4
ctgcattcgcaggtc

SEQ ID NO: 46154 - DNA, 15 bp, Artificial Sequence
  dgRNA
  Tenm4
tgcattcgcaggtcc

SEQ ID NO: 46155 - DNA, 15 bp, Artificial Sequence
  dgRNA
  Dync1i1
cgtacctgtacagaa

SEQ ID NO: 46156 - DNA, 15 bp, Artificial Sequence
  dgRNA
  Dync1i1
agtgaaagttgccca

SEQ ID NO: 46157 - DNA, 15 bp, Artificial Sequence
  dgRNA
  Dync1i1
ggtacggttgaacat

SEQ ID NO: 46158 - DNA, 15 bp, Artificial Sequence
  dgRNA
  Dync1i1
cattctgtacaggta

SEQ ID NO: 46159 - DNA, 15 bp, Artificial Sequence
  dgRNA
  Slc7a9
cctgccggctcccgc

SEQ ID NO: 46160 - DNA, 15 bp, Artificial Sequence
  dgRNA
  Slc7a9
ctgccggctcccgct

SEQ ID NO: 46161 - DNA, 15 bp, Artificial Sequence
  dgRNA
  Slc7a9
tgccggctcccgctg

SEQ ID NO: 46162 - DNA, 15 bp, Artificial Sequence
  dgRNA
  Slc7a9
tcccgctggggcacg

SEQ ID NO: 46163 - DNA, 15 bp, Artificial Sequence
  dgRNA
  Arhgap1
gggcgatacgaacct

SEQ ID NO: 46164 - DNA, 15 bp, Artificial Sequence
  dgRNA
  Arhgap1
aacctaggatttcag

SEQ ID NO: 46165 - DNA, 15 bp, Artificial Sequence
  dgRNA
  Arhgap1
ctagtttcctgcatc

SEQ ID NO: 46166 - DNA, 15 bp, Artificial Sequence
  dgRNA
  Arhgap1
taggtagcggcgagt

SEQ ID NO: 46167 - DNA, 15 bp, Artificial Sequence
  dgRNA
  Gpr84
tagagtaagttgcag

SEQ ID NO: 46168 - DNA, 15 bp, Artificial Sequence
  dgRNA
  Gpr84
cacggtaaaattagt

SEQ ID NO: 46169 - DNA, 15 bp, Artificial Sequence
  dgRNA
  Gpr84
attagtaggactagc

SEQ ID NO: 46170 - DNA, 15 bp, Artificial Sequence
  dgRNA
  Gpr84
agtaggactagctgg

SEQ ID NO: 46171 - DNA, 15 bp, Artificial Sequence
  dgRNA
  Tdrd7
ttcatcacagtcaac

SEQ ID NO: 46172 - DNA, 15 bp, Artificial Sequence
  dgRNA
  Tdrd7
gttgactgtgatgaa

SEQ ID NO: 46173 - DNA, 15 bp, Artificial Sequence
  dgRNA
  Tdrd7
tacatcaactgccaa

SEQ ID NO: 46174 - DNA, 15 bp, Artificial Sequence
  dgRNA
  Nelfe
atgacgtaaaggggc

SEQ ID NO: 46175 - DNA, 15 bp, Artificial Sequence
  dgRNA
  Nelfe
gatgacgtaaagggg

SEQ ID NO: 46176 - DNA, 15 bp, Artificial Sequence
  dgRNA
  Nelfe
ggcgatgacgtaaag

SEQ ID NO: 46177 - DNA, 15 bp, Artificial Sequence
  dgRNA
  Nelfe
cggcgatgacgtaaa

SEQ ID NO: 46178 - DNA, 15 bp, Artificial Sequence
  dgRNA
  Ces1g
gccgacagaacactg

SEQ ID NO: 46179 - DNA, 15 bp, Artificial Sequence
  dgRNA
  Ces1g
tccttggttagttta

SEQ ID NO: 46180 - DNA, 15 bp, Artificial Sequence
  dgRNA
  Ces1g
gtttaaactctaggt

SEQ ID NO: 46181 - DNA, 15 bp, Artificial Sequence
  dgRNA
  Ces1g
ctaagaagtcccatt

SEQ ID NO: 46182 - DNA, 15 bp, Artificial Sequence
  dgRNA
  Cstf2t
cttgcggtttcccgc

SEQ ID NO: 46183 - DNA, 15 bp, Artificial Sequence
  dgRNA
  Cstf2t
gcggtttcccgccgg

SEQ ID NO: 46184 - DNA, 15 bp, Artificial Sequence
  dgRNA
  Cstf2t
acagccccgagtgtg

SEQ ID NO: 46185 - DNA, 15 bp, Artificial Sequence
  dgRNA
  Cstf2t
aaacacagacgctgc

SEQ ID NO: 46186 - DNA, 15 bp, Artificial Sequence
  dgRNA
  Dynlrb1
actcgtcctcaccga

SEQ ID NO: 46187 - DNA, 15 bp, Artificial Sequence
  dgRNA
  Dynlrb1
tcctcaccgatggag

SEQ ID NO: 46188 - DNA, 15 bp, Artificial Sequence
  dgRNA
  Dynlrb1
cccgcccatcactgc

SEQ ID NO: 46189 - DNA, 15 bp, Artificial Sequence
  dgRNA
  Dynlrb1
cgagttgtcatgtct

SEQ ID NO: 46190 - DNA, 15 bp, Artificial Sequence
  dgRNA
  Haus8
tattttagcccgctc

SEQ ID NO: 46191 - DNA, 15 bp, Artificial Sequence
  dgRNA
  Haus8
ttagcccgctcaggt

SEQ ID NO: 46192 - DNA, 15 bp, Artificial Sequence
  dgRNA
  Haus8
cgctcaggttggtgc

SEQ ID NO: 46193 - DNA, 15 bp, Artificial Sequence
  dgRNA
  Haus8
aagcccacacgtctg

SEQ ID NO: 46194 - DNA, 15 bp, Artificial Sequence
  dgRNA
  Kcnk15
cccgttctactccca

SEQ ID NO: 46195 - DNA, 15 bp, Artificial Sequence
  dgRNA
  Kcnk15
ctactcccacggaga

SEQ ID NO: 46196 - DNA, 15 bp, Artificial Sequence
  dgRNA
  Kcnk15
tactcccacggagaa

SEQ ID NO: 46197 - DNA, 15 bp, Artificial Sequence
  dgRNA
  Kcnk15
cccacggagaagggt

SEQ ID NO: 46198 - DNA, 15 bp, Artificial Sequence
  dgRNA
  Gh
gtgggctctgtcgct

SEQ ID NO: 46199 - DNA, 15 bp, Artificial Sequence
  dgRNA
  Gh
caatgcccataagcc

SEQ ID NO: 46200 - DNA, 15 bp, Artificial Sequence
  dgRNA
  Gh
ccataagcctggcaa

SEQ ID NO: 46201 - DNA, 15 bp, Artificial Sequence
  dgRNA
  Gh
ggcgatgagacgata

SEQ ID NO: 46202 - DNA, 15 bp, Artificial Sequence
  dgRNA
  Tmem212
ttccacttaccttgg

SEQ ID NO: 46203 - DNA, 15 bp, Artificial Sequence
  dgRNA
  Tmem212
ttccaccaaggtaag

SEQ ID NO: 46204 - DNA, 15 bp, Artificial Sequence
  dgRNA
  Gm28557
cagcttgcctgcacg

SEQ ID NO: 46205 - DNA, 15 bp, Artificial Sequence
  dgRNA
  Gm28557
agcttgcctgcacgt

SEQ ID NO: 46206 - DNA, 15 bp, Artificial Sequence
  dgRNA
  Gm28557
gcttgcctgcacgtg

SEQ ID NO: 46207 - DNA, 15 bp, Artificial Sequence
  dgRNA
  Gm28557
cacgtggggaggacg

SEQ ID NO: 46208 - DNA, 15 bp, Artificial Sequence
  dgRNA
  Arv1
tgccatcttcccgca

SEQ ID NO: 46209 - DNA, 15 bp, Artificial Sequence
  dgRNA
  Arv1
cttcccgcacggcgc

SEQ ID NO: 46210 - DNA, 15 bp, Artificial Sequence
  dgRNA
  Arv1
cgcacggcgcaggcg

SEQ ID NO: 46211 - DNA, 15 bp, Artificial Sequence
  dgRNA
  Arv1
ctgctctgcccgccg

SEQ ID NO: 46212 - DNA, 15 bp, Artificial Sequence
  dgRNA
  Olfr1201
ataaattaagcctag

SEQ ID NO: 46213 - DNA, 15 bp, Artificial Sequence
  dgRNA
  Olfr1201
attaagcctagagga

SEQ ID NO: 46214 - DNA, 15 bp, Artificial Sequence
  dgRNA
  Olfr1201
taagtgctaactcat

SEQ ID NO: 46215 - DNA, 15 bp, Artificial Sequence
  dgRNA
  Olfr1201
cttccaaatttagct

SEQ ID NO: 46216 - DNA, 15 bp, Artificial Sequence
  dgRNA
  Zer1
tagcccctcgctaga

SEQ ID NO: 46217 - DNA, 15 bp, Artificial Sequence
  dgRNA
  Zer1
cgctagaaggaaccc

SEQ ID NO: 46218 - DNA, 15 bp, Artificial Sequence
  dgRNA
  Zer1
ccctggaagctaacg

SEQ ID NO: 46219 - DNA, 15 bp, Artificial Sequence
  dgRNA
  Zer1
agctaacgtggagac

SEQ ID NO: 46220 - DNA, 15 bp, Artificial Sequence
  dgRNA
  Pdcd1
gcgggagccaagaac

SEQ ID NO: 46221 - DNA, 15 bp, Artificial Sequence
  dgRNA
  Pdcd1
ccctccaacatgacc

SEQ ID NO: 46222 - DNA, 15 bp, Artificial Sequence
  dgRNA
  Pdcd1
actagtgagagattg

SEQ ID NO: 46223 - DNA, 15 bp, Artificial Sequence
  dgRNA
  Pdcd1
gactagtgagagatt

SEQ ID NO: 46224 - DNA, 15 bp, Artificial Sequence
  dgRNA
  Limk1
cttcgctctgactga

SEQ ID NO: 46225 - DNA, 15 bp, Artificial Sequence
  dgRNA
  Limk1
gaagtcagcaagacg

SEQ ID NO: 46226 - DNA, 15 bp, Artificial Sequence
  dgRNA
  Ddrgk1
acgaccttgaaatgt

SEQ ID NO: 46227 - DNA, 15 bp, Artificial Sequence
  dgRNA
  Ddrgk1
tcgtctctggctata

SEQ ID NO: 46228 - DNA, 15 bp, Artificial Sequence
  dgRNA
  Ddrgk1
tttcaaggtcgtctc

SEQ ID NO: 46229 - DNA, 15 bp, Artificial Sequence
  dgRNA
  Cse1l
ctcgcagaacctgct

SEQ ID NO: 46230 - DNA, 15 bp, Artificial Sequence
  dgRNA
  Cse1l
tcgcagaacctgcta

SEQ ID NO: 46231 - DNA, 15 bp, Artificial Sequence
  dgRNA
  Cse1l
gaagcctgcgtcaaa

SEQ ID NO: 46232 - DNA, 15 bp, Artificial Sequence
  dgRNA
  Cse1l
ctgcgtcaaaaggca

SEQ ID NO: 46233 - DNA, 15 bp, Artificial Sequence
  dgRNA
  Scamp5
cggacagctcctgca

SEQ ID NO: 46234 - DNA, 15 bp, Artificial Sequence
  dgRNA
  Scamp5
tcctgcaaggtgcgg

SEQ ID NO: 46235 - DNA, 15 bp, Artificial Sequence
  dgRNA
  Scamp5
aaggtgcggaggcgc

SEQ ID NO: 46236 - DNA, 15 bp, Artificial Sequence
  dgRNA
  Scamp5
tctcgcgagcgctcg

SEQ ID NO: 46237 - DNA, 15 bp, Artificial Sequence
  dgRNA
  Phactr1
aaaccctatcctacc

SEQ ID NO: 46238 - DNA, 15 bp, Artificial Sequence
  dgRNA
  Phactr1
aagtactccacacct

SEQ ID NO: 46239 - DNA, 15 bp, Artificial Sequence
  dgRNA
  Phactr1
gtgcgagctacattc

SEQ ID NO: 46240 - DNA, 15 bp, Artificial Sequence
  dgRNA
  Phactr1
gctgccaaacaaggt

SEQ ID NO: 46241 - DNA, 15 bp, Artificial Sequence
  dgRNA
  Pls3
gttcgaatttgaatc

SEQ ID NO: 46242 - DNA, 15 bp, Artificial Sequence
  dgRNA
  Pls3
tggcaaaggagtgta

SEQ ID NO: 46243 - DNA, 15 bp, Artificial Sequence
  dgRNA
  Pls3
ttcatgctttcgttt

SEQ ID NO: 46244 - DNA, 15 bp, Artificial Sequence
  dgRNA
  Olfr59
gatacaatcacacat

SEQ ID NO: 46245 - DNA, 15 bp, Artificial Sequence
  dgRNA
  Olfr59
acacattggctcttc

SEQ ID NO: 46246 - DNA, 15 bp, Artificial Sequence
  dgRNA
  Olfr332
tgagacttgcatcag

SEQ ID NO: 46247 - DNA, 15 bp, Artificial Sequence
  dgRNA
  Olfr332
gcatcagaggtttct

SEQ ID NO: 46248 - DNA, 15 bp, Artificial Sequence
  dgRNA
  Olfr332
tggttaattgaagtc

SEQ ID NO: 46249 - DNA, 15 bp, Artificial Sequence
  dgRNA
  Olfr332
ggttaattgaagtct

SEQ ID NO: 46250 - DNA, 15 bp, Artificial Sequence
  dgRNA
  Cog6
gcaggtagagcgtct

SEQ ID NO: 46251 - DNA, 15 bp, Artificial Sequence
  dgRNA
  Cog6
gagcgtctcggatcg

SEQ ID NO: 46252 - DNA, 15 bp, Artificial Sequence
  dgRNA
  Cog6
tgcgcatgcgcggcc

SEQ ID NO: 46253 - DNA, 15 bp, Artificial Sequence
  dgRNA
  Cog6
acgctcagaagagat

SEQ ID NO: 46254 - DNA, 15 bp, Artificial Sequence
  dgRNA
  Zfp503
aagtccctccgagca

SEQ ID NO: 46255 - DNA, 15 bp, Artificial Sequence
  dgRNA
  Zfp503
agtccctccgagcaa

SEQ ID NO: 46256 - DNA, 15 bp, Artificial Sequence
  dgRNA
  Zfp503
gtccctccgagcaag

SEQ ID NO: 46257 - DNA, 15 bp, Artificial Sequence
  dgRNA
  Zfp503
tccctccgagcaagg

SEQ ID NO: 46258 - DNA, 15 bp, Artificial Sequence
  dgRNA
  Pdzph1
taggaccaattaaga

SEQ ID NO: 46259 - DNA, 15 bp, Artificial Sequence
  dgRNA
  Pdzph1
ataatagactgatta

SEQ ID NO: 46260 - DNA, 15 bp, Artificial Sequence
  dgRNA
  Pdzph1
taatagactgattaa

SEQ ID NO: 46261 - DNA, 15 bp, Artificial Sequence
  dgRNA
  Pdzph1
ataatgatgcattgt

SEQ ID NO: 46262 - DNA, 15 bp, Artificial Sequence
  dgRNA
  Olfr516
ccctaagaccaacaa

SEQ ID NO: 46263 - DNA, 15 bp, Artificial Sequence
  dgRNA
  Tyk2
tgtacagtagtgagt

SEQ ID NO: 46264 - DNA, 15 bp, Artificial Sequence
  dgRNA
  Tyk2
gctatcactaaaagt

SEQ ID NO: 46265 - DNA, 15 bp, Artificial Sequence
  dgRNA
  Tyk2
tatcactaaaagtag

SEQ ID NO: 46266 - DNA, 15 bp, Artificial Sequence
  dgRNA
  Canx
acgaagaatagccct

SEQ ID NO: 46267 - DNA, 15 bp, Artificial Sequence
  dgRNA
  Canx
cgaagaatagcccta

SEQ ID NO: 46268 - DNA, 15 bp, Artificial Sequence
  dgRNA
  Canx
gaagaatagccctag

SEQ ID NO: 46269 - DNA, 15 bp, Artificial Sequence
  dgRNA
  Canx
gccctagggggcgta

SEQ ID NO: 46270 - DNA, 15 bp, Artificial Sequence
  dgRNA
  Ablim1
ttaggttatcgctct

SEQ ID NO: 46271 - DNA, 15 bp, Artificial Sequence
  dgRNA
  Ablim1
ggttatcgctctagg

SEQ ID NO: 46272 - DNA, 15 bp, Artificial Sequence
  dgRNA
  Ablim1
tatcgctctaggtgg

SEQ ID NO: 46273 - DNA, 15 bp, Artificial Sequence
  dgRNA
  Ablim1
attttgctttccgat

SEQ ID NO: 46274 - DNA, 15 bp, Artificial Sequence
  dgRNA
  Ccr10
tactttacacagcga

SEQ ID NO: 46275 - DNA, 15 bp, Artificial Sequence
  dgRNA
  Ccr10
gatagaaatcgggca

SEQ ID NO: 46276 - DNA, 15 bp, Artificial Sequence
  dgRNA
  Ccr10
agaaatcgggcaagg

SEQ ID NO: 46277 - DNA, 15 bp, Artificial Sequence
  dgRNA
  Ccr10
gaaatcgggcaaggt

SEQ ID NO: 46278 - DNA, 15 bp, Artificial Sequence
  dgRNA
  Uevld
gtcagtctctagttt

SEQ ID NO: 46279 - DNA, 15 bp, Artificial Sequence
  dgRNA
  Uevld
tctagtttagggtaa

SEQ ID NO: 46280 - DNA, 15 bp, Artificial Sequence
  dgRNA
  Uevld
tagatgcagaacccg

SEQ ID NO: 46281 - DNA, 15 bp, Artificial Sequence
  dgRNA
  Uevld
agatgcagaacccgc

SEQ ID NO: 46282 - DNA, 15 bp, Artificial Sequence
  dgRNA
  Fam46c
cgcaacgctgcctct

SEQ ID NO: 46283 - DNA, 15 bp, Artificial Sequence
  dgRNA
  Fam46c
cctttgcgccgcccg

SEQ ID NO: 46284 - DNA, 15 bp, Artificial Sequence
  dgRNA
  Fam46c
ggtttactcgtctct

SEQ ID NO: 46285 - DNA, 15 bp, Artificial Sequence
  dgRNA
  Fam46c
gcaaccattgacccg

SEQ ID NO: 46286 - DNA, 15 bp, Artificial Sequence
  dgRNA
  Il15ra
ggcactttcttgagt

SEQ ID NO: 46287 - DNA, 15 bp, Artificial Sequence
  dgRNA
  Il15ra
ggtacagccggaaga

SEQ ID NO: 46288 - DNA, 15 bp, Artificial Sequence
  dgRNA
  Il15ra
gccaagtgtttgaaa

SEQ ID NO: 46289 - DNA, 15 bp, Artificial Sequence
  dgRNA
  Chmp2b
ttgccaacctaggtc

SEQ ID NO: 46290 - DNA, 15 bp, Artificial Sequence
  dgRNA
  Chmp2b
caacctaggtccgga

SEQ ID NO: 46291 - DNA, 15 bp, Artificial Sequence
  dgRNA
  Chmp2b
aacctaggtccggac

SEQ ID NO: 46292 - DNA, 15 bp, Artificial Sequence
  dgRNA
  Chmp2b
ccggacgggtcgcaa

SEQ ID NO: 46293 - DNA, 15 bp, Artificial Sequence
  dgRNA
  Fzd7
gtgcaggcaggccgc

SEQ ID NO: 46294 - DNA, 15 bp, Artificial Sequence
  dgRNA
  Fzd7
gcaggccgcgggtgc

SEQ ID NO: 46295 - DNA, 15 bp, Artificial Sequence
  dgRNA
  Fzd7
caggccgcgggtgca

SEQ ID NO: 46296 - DNA, 15 bp, Artificial Sequence
  dgRNA
  Fzd7
aggccgcgggtgcag

SEQ ID NO: 46297 - DNA, 15 bp, Artificial Sequence
  dgRNA
  Rps2
acgccaacgtcgcca

SEQ ID NO: 46298 - DNA, 15 bp, Artificial Sequence
  dgRNA
  Rps2
cgccaacgtcgccac

SEQ ID NO: 46299 - DNA, 15 bp, Artificial Sequence
  dgRNA
  Rps2
gtcgccacgggttcc

SEQ ID NO: 46300 - DNA, 15 bp, Artificial Sequence
  dgRNA
  Rps2
tggacacaagcggga

SEQ ID NO: 46301 - DNA, 15 bp, Artificial Sequence
  dgRNA
  Olfr103
ctagtctggatagat

SEQ ID NO: 46302 - DNA, 15 bp, Artificial Sequence
  dgRNA
  Olfr103
gattggcctcattcc

SEQ ID NO: 46303 - DNA, 15 bp, Artificial Sequence
  dgRNA
  Olfr103
tcttgcttagacagg

SEQ ID NO: 46304 - DNA, 15 bp, Artificial Sequence
  dgRNA
  Olfr103
ttgtcgaatgcaacc

SEQ ID NO: 46305 - DNA, 15 bp, Artificial Sequence
  dgRNA
  Parp6
tcacgccttcaactc

SEQ ID NO: 46306 - DNA, 15 bp, Artificial Sequence
  dgRNA
  Parp6
cctggctagcaccct

SEQ ID NO: 46307 - DNA, 15 bp, Artificial Sequence
  dgRNA
  Parp6
gctagcaccctgggg

SEQ ID NO: 46308 - DNA, 15 bp, Artificial Sequence
  dgRNA
  Parp6
ctagcaccctggggt

SEQ ID NO: 46309 - DNA, 15 bp, Artificial Sequence
  dgRNA
  3110082J24Rik
gttgcgggtctgagg

SEQ ID NO: 46310 - DNA, 15 bp, Artificial Sequence
  dgRNA
  3110082J24Rik
ttgcgggtctgagga

SEQ ID NO: 46311 - DNA, 15 bp, Artificial Sequence
  dgRNA
  3110082J24Rik
tgcgggtctgaggag

SEQ ID NO: 46312 - DNA, 15 bp, Artificial Sequence
  dgRNA
  3110082J24Rik
gtcccattagcattc

SEQ ID NO: 46313 - DNA, 15 bp, Artificial Sequence
  dgRNA
  Ppp1r3g
ccggcaacccccaga

SEQ ID NO: 46314 - DNA, 15 bp, Artificial Sequence
  dgRNA
  Ppp1r3g
ctgactgagccttag

SEQ ID NO: 46315 - DNA, 15 bp, Artificial Sequence
  dgRNA
  Ppp1r3g
gagccttagagggtc

SEQ ID NO: 46316 - DNA, 15 bp, Artificial Sequence
  dgRNA
  Ppp1r3g
ctgggatccttgcgg

SEQ ID NO: 46317 - DNA, 15 bp, Artificial Sequence
  dgRNA
  Tmem147
cggatgagcgagaag

SEQ ID NO: 46318 - DNA, 15 bp, Artificial Sequence
  dgRNA
  Tmem147
tggctccgagccgag

SEQ ID NO: 46319 - DNA, 15 bp, Artificial Sequence
  dgRNA
  Tmem147
cgagccgagtgggag

SEQ ID NO: 46320 - DNA, 15 bp, Artificial Sequence
  dgRNA
  Tmem147
cgctgtctgaacaca

SEQ ID NO: 46321 - DNA, 15 bp, Artificial Sequence
  dgRNA
  Grip1
tgatagtgaactgaa

SEQ ID NO: 46322 - DNA, 15 bp, Artificial Sequence
  dgRNA
  Grip1
ccagatgacatgtag

SEQ ID NO: 46323 - DNA, 15 bp, Artificial Sequence
  dgRNA
  Grip1
tttgtcactccccac

SEQ ID NO: 46324 - DNA, 15 bp, Artificial Sequence
  dgRNA
  Grip1
ttgtcactccccact

SEQ ID NO: 46325 - DNA, 15 bp, Artificial Sequence
  dgRNA
  Bcl2l13
gacagcttcgtacac

SEQ ID NO: 46326 - DNA, 15 bp, Artificial Sequence
  dgRNA
  Bcl2l13
cgcaaactgaccagc

SEQ ID NO: 46327 - DNA, 15 bp, Artificial Sequence
  dgRNA
  Bcl2l13
agttgaccgagccgc

SEQ ID NO: 46328 - DNA, 15 bp, Artificial Sequence
  dgRNA
  Bcl2l13
cgctggcttccggct

SEQ ID NO: 46329 - DNA, 15 bp, Artificial Sequence
  dgRNA
  Tex12
tcgaagattccaagt

SEQ ID NO: 46330 - DNA, 15 bp, Artificial Sequence
  dgRNA
  Tex12
cgaagattccaagtt

SEQ ID NO: 46331 - DNA, 15 bp, Artificial Sequence
  dgRNA
  Tex12
gggaagtgccgctat

SEQ ID NO: 46332 - DNA, 15 bp, Artificial Sequence
  dgRNA
  Tex12
ccgctataggctgat

SEQ ID NO: 46333 - DNA, 15 bp, Artificial Sequence
  dgRNA
  Alox12
gactagtctggggcg

SEQ ID NO: 46334 - DNA, 15 bp, Artificial Sequence
  dgRNA
  Alox12
gcctaggagttgtga

SEQ ID NO: 46335 - DNA, 15 bp, Artificial Sequence
  dgRNA
  Alox12
tggatcagctacagt

SEQ ID NO: 46336 - DNA, 15 bp, Artificial Sequence
  dgRNA
  Alox12
ttggatcagctacag

SEQ ID NO: 46337 - DNA, 15 bp, Artificial Sequence
  dgRNA
  Olfr1155
tcactcataatatac

SEQ ID NO: 46338 - DNA, 15 bp, Artificial Sequence
  dgRNA
  Olfr1155
tactgatagtcaatt

SEQ ID NO: 46339 - DNA, 15 bp, Artificial Sequence
  dgRNA
  Dcun1d2
gtgcctcggagctga

SEQ ID NO: 46340 - DNA, 15 bp, Artificial Sequence
  dgRNA
  Dcun1d2
tgcctcggagctgag

SEQ ID NO: 46341 - DNA, 15 bp, Artificial Sequence
  dgRNA
  Dcun1d2
tgtccacgctgcacg

SEQ ID NO: 46342 - DNA, 15 bp, Artificial Sequence
  dgRNA
  Dcun1d2
gcggagagccgaaga

SEQ ID NO: 46343 - DNA, 15 bp, Artificial Sequence
  dgRNA
  D130043K22Rik
gcgagggaccagagc

SEQ ID NO: 46344 - DNA, 15 bp, Artificial Sequence
  dgRNA
  D130043K22Rik
gcagggaagcaacgg

SEQ ID NO: 46345 - DNA, 15 bp, Artificial Sequence
  dgRNA
  D130043K22Rik
ggcccctctgcttag

SEQ ID NO: 46346 - DNA, 15 bp, Artificial Sequence
  dgRNA
  D130043K22Rik
cccctctgcttagcg

SEQ ID NO: 46347 - DNA, 15 bp, Artificial Sequence
  dgRNA
  Cfap44
agtagcttcttcccc

SEQ ID NO: 46348 - DNA, 15 bp, Artificial Sequence
  dgRNA
  Cfap44
acacggacgactctg

SEQ ID NO: 46349 - DNA, 15 bp, Artificial Sequence
  dgRNA
  Cfap44
tttaggcaaaaacct

SEQ ID NO: 46350 - DNA, 15 bp, Artificial Sequence
  dgRNA
  Cfap44
ttaggcaaaaacctt

SEQ ID NO: 46351 - DNA, 15 bp, Artificial Sequence
  dgRNA
  Nmb
gggaaccacctttgc

SEQ ID NO: 46352 - DNA, 15 bp, Artificial Sequence
  dgRNA
  Nmb
ggaaccacctttgct

SEQ ID NO: 46353 - DNA, 15 bp, Artificial Sequence
  dgRNA
  Nmb
ataagcacgcgagtg

SEQ ID NO: 46354 - DNA, 15 bp, Artificial Sequence
  dgRNA
  Nmb
agcacgcgagtgtgg

SEQ ID NO: 46355 - DNA, 15 bp, Artificial Sequence
  dgRNA
  Mettl16
gtagttccaagttcc

SEQ ID NO: 46356 - DNA, 15 bp, Artificial Sequence
  dgRNA
  Mettl16
gccagcggactagtg

SEQ ID NO: 46357 - DNA, 15 bp, Artificial Sequence
  dgRNA
  Mettl16
acctaagaagactcc

SEQ ID NO: 46358 - DNA, 15 bp, Artificial Sequence
  dgRNA
  Mettl16
gcccggccaggaact

SEQ ID NO: 46359 - DNA, 15 bp, Artificial Sequence
  dgRNA
  Ube2e2
aacccgcctttgctc

SEQ ID NO: 46360 - DNA, 15 bp, Artificial Sequence
  dgRNA
  Ube2e2
cacaggtcctcgagc

SEQ ID NO: 46361 - DNA, 15 bp, Artificial Sequence
  dgRNA
  Ube2e2
gcgggcacgcgccgg

SEQ ID NO: 46362 - DNA, 15 bp, Artificial Sequence
  dgRNA
  Ube2e2
cgggcacgcgccggc

SEQ ID NO: 46363 - DNA, 15 bp, Artificial Sequence
  dgRNA
  Rbl1
ctccgttagagtccg

SEQ ID NO: 46364 - DNA, 15 bp, Artificial Sequence
  dgRNA
  Rbl1
tcccattccgggaga

SEQ ID NO: 46365 - DNA, 15 bp, Artificial Sequence
  dgRNA
  Rbl1
cccattccgggagac

SEQ ID NO: 46366 - DNA, 15 bp, Artificial Sequence
  dgRNA
  Rbl1
gagacgggctgctgc

SEQ ID NO: 46367 - DNA, 15 bp, Artificial Sequence
  dgRNA
  Uchl4
cttaccatctttagc

SEQ ID NO: 46368 - DNA, 15 bp, Artificial Sequence
  dgRNA
  Uchl4
tgggttaaccataaa

SEQ ID NO: 46369 - DNA, 15 bp, Artificial Sequence
  dgRNA
  Dgkh
atgtgaagcacgcag

SEQ ID NO: 46370 - DNA, 15 bp, Artificial Sequence
  dgRNA
  Dgkh
cgcagaggtctcggc

SEQ ID NO: 46371 - DNA, 15 bp, Artificial Sequence
  dgRNA
  Dgkh
gcagaggtctcggca

SEQ ID NO: 46372 - DNA, 15 bp, Artificial Sequence
  dgRNA
  Dgkh
ggcggcgcgtgatcc

SEQ ID NO: 46373 - DNA, 15 bp, Artificial Sequence
  dgRNA
  Ccr1
ttgcaatctttagaa

SEQ ID NO: 46374 - DNA, 15 bp, Artificial Sequence
  dgRNA
  Ccr1
tgcaatctttagaag

SEQ ID NO: 46375 - DNA, 15 bp, Artificial Sequence
  dgRNA
  Ccr1
aatgaggacctccag

SEQ ID NO: 46376 - DNA, 15 bp, Artificial Sequence
  dgRNA
  Ccr1
gtcatagagttcttg

SEQ ID NO: 46377 - DNA, 15 bp, Artificial Sequence
  dgRNA
  Borcs8
cctgtctgccccaat

SEQ ID NO: 46378 - DNA, 15 bp, Artificial Sequence
  dgRNA
  Borcs8
cggatccacagacgg

SEQ ID NO: 46379 - DNA, 15 bp, Artificial Sequence
  dgRNA
  Borcs8
ggatccacagacggt

SEQ ID NO: 46380 - DNA, 15 bp, Artificial Sequence
  dgRNA
  Borcs8
tccacagacggtggg

SEQ ID NO: 46381 - DNA, 15 bp, Artificial Sequence
  dgRNA
  Cnfn
ccggctagtctccct

SEQ ID NO: 46382 - DNA, 15 bp, Artificial Sequence
  dgRNA
  Cnfn
gtcagagccccgccc

SEQ ID NO: 46383 - DNA, 15 bp, Artificial Sequence
  dgRNA
  Cnfn
catataagcagctcc

SEQ ID NO: 46384 - DNA, 15 bp, Artificial Sequence
  dgRNA
  Cnfn
ccaagggagactagc

SEQ ID NO: 46385 - DNA, 15 bp, Artificial Sequence
  dgRNA
  Casp2
tgtagttacttcagg

SEQ ID NO: 46386 - DNA, 15 bp, Artificial Sequence
  dgRNA
  Casp2
gtagttacttcagga

SEQ ID NO: 46387 - DNA, 15 bp, Artificial Sequence
  dgRNA
  Casp2
tagttacttcaggag

SEQ ID NO: 46388 - DNA, 15 bp, Artificial Sequence
  dgRNA
  Casp2
tacttcaggaggggt

SEQ ID NO: 46389 - DNA, 15 bp, Artificial Sequence
  dgRNA
  Rab38
tgtgtcatggacggg

SEQ ID NO: 46390 - DNA, 15 bp, Artificial Sequence
  dgRNA
  Rab38
aaataccagcttgac

SEQ ID NO: 46391 - DNA, 15 bp, Artificial Sequence
  dgRNA
  Rab38
gacaggcagtagcac

SEQ ID NO: 46392 - DNA, 15 bp, Artificial Sequence
  dgRNA
  Rab38
tggagtccgcagagt

SEQ ID NO: 46393 - DNA, 15 bp, Artificial Sequence
  dgRNA
  3110009E18Rik
cgttccaactgagct

SEQ ID NO: 46394 - DNA, 15 bp, Artificial Sequence
  dgRNA
  3110009E18Rik
gttccaactgagctc

SEQ ID NO: 46395 - DNA, 15 bp, Artificial Sequence
  dgRNA
  3110009E18Rik
ctgagctcgggcgag

SEQ ID NO: 46396 - DNA, 15 bp, Artificial Sequence
  dgRNA
  3110009E18Rik
agtcggatctgcttt

SEQ ID NO: 46397 - DNA, 15 bp, Artificial Sequence
  dgRNA
  Miip
ggggagttgctagtg

SEQ ID NO: 46398 - DNA, 15 bp, Artificial Sequence
  dgRNA
  Miip
ggggtccgcgtgaaa

SEQ ID NO: 46399 - DNA, 15 bp, Artificial Sequence
  dgRNA
  Miip
tagagactttacatc

SEQ ID NO: 46400 - DNA, 15 bp, Artificial Sequence
  dgRNA
  Miip
gtcctcaatttgaat

SEQ ID NO: 46401 - DNA, 15 bp, Artificial Sequence
  dgRNA
  Trim55
tgtcactggcttata

SEQ ID NO: 46402 - DNA, 15 bp, Artificial Sequence
  dgRNA
  Trim55
tggacaagtcagtcc

SEQ ID NO: 46403 - DNA, 15 bp, Artificial Sequence
  dgRNA
  Trim55
tagcaggggttatga

SEQ ID NO: 46404 - DNA, 15 bp, Artificial Sequence
  dgRNA
  Trim55
aagtcccatttagca

SEQ ID NO: 46405 - DNA, 15 bp, Artificial Sequence
  dgRNA
  Robo3
actctaacttgcgcg

SEQ ID NO: 46406 - DNA, 15 bp, Artificial Sequence
  dgRNA
  Robo3
gcgcggccctgttag

SEQ ID NO: 46407 - DNA, 15 bp, Artificial Sequence
  dgRNA
  Robo3
ttaagcccttaatta

SEQ ID NO: 46408 - DNA, 15 bp, Artificial Sequence
  dgRNA
  Robo3
acggcgtgatccgag

SEQ ID NO: 46409 - DNA, 15 bp, Artificial Sequence
  dgRNA
  Tmem8b
ggccccagttgataa

SEQ ID NO: 46410 - DNA, 15 bp, Artificial Sequence
  dgRNA
  Tmem8b
gtccagggccaatga

SEQ ID NO: 46411 - DNA, 15 bp, Artificial Sequence
  dgRNA
  Tmem8b
tgcgctctagaaccc

SEQ ID NO: 46412 - DNA, 15 bp, Artificial Sequence
  dgRNA
  Tmem8b
caggcttcgatcccc

SEQ ID NO: 46413 - DNA, 15 bp, Artificial Sequence
  dgRNA
  Lix1
aatttaggaacctgc

SEQ ID NO: 46414 - DNA, 15 bp, Artificial Sequence
  dgRNA
  Lix1
cttgagtacctattc

SEQ ID NO: 46415 - DNA, 15 bp, Artificial Sequence
  dgRNA
  Lix1
ttgagtacctattcc

SEQ ID NO: 46416 - DNA, 15 bp, Artificial Sequence
  dgRNA
  Lix1
tgagtacctattccg

SEQ ID NO: 46417 - DNA, 15 bp, Artificial Sequence
  dgRNA
  Dcp1b
cgggcttccttgagc

SEQ ID NO: 46418 - DNA, 15 bp, Artificial Sequence
  dgRNA
  Dcp1b
acgatcctccgcgag

SEQ ID NO: 46419 - DNA, 15 bp, Artificial Sequence
  dgRNA
  Dcp1b
ctccgcgagaggacc

SEQ ID NO: 46420 - DNA, 15 bp, Artificial Sequence
  dgRNA
  Dcp1b
tagcgaagcctagcc

SEQ ID NO: 46421 - DNA, 15 bp, Artificial Sequence
  dgRNA
  Sh3glb2
tccgcagagacctcc

SEQ ID NO: 46422 - DNA, 15 bp, Artificial Sequence
  dgRNA
  Sh3glb2
ccgcagagacctcca

SEQ ID NO: 46423 - DNA, 15 bp, Artificial Sequence
  dgRNA
  Sh3glb2
agggtgcacggaaac

SEQ ID NO: 46424 - DNA, 15 bp, Artificial Sequence
  dgRNA
  Sh3glb2
gagcgaacagcccgc

SEQ ID NO: 46425 - DNA, 15 bp, Artificial Sequence
  dgRNA
  Lime1
tgttcacctcattaa

SEQ ID NO: 46426 - DNA, 15 bp, Artificial Sequence
  dgRNA
  Lime1
gttcacctcattaat

SEQ ID NO: 46427 - DNA, 15 bp, Artificial Sequence
  dgRNA
  Lime1
gtatctgcctcattg

SEQ ID NO: 46428 - DNA, 15 bp, Artificial Sequence
  dgRNA
  Lime1
ctggatggattatcg

SEQ ID NO: 46429 - DNA, 15 bp, Artificial Sequence
  dgRNA
  Fam84b
cttgcatttctatac

SEQ ID NO: 46430 - DNA, 15 bp, Artificial Sequence
  dgRNA
  Fam84b
ttctatactggcagg

SEQ ID NO: 46431 - DNA, 15 bp, Artificial Sequence
  dgRNA
  Fam84b
ggctcagggcggtag

SEQ ID NO: 46432 - DNA, 15 bp, Artificial Sequence
  dgRNA
  Fam84b
ggaagcctgctcccg

SEQ ID NO: 46433 - DNA, 15 bp, Artificial Sequence
  dgRNA
  Gm13119
tgctggtggcgggta

SEQ ID NO: 46434 - DNA, 15 bp, Artificial Sequence
  dgRNA
  Sigirr
gcgggttgcgctggt

SEQ ID NO: 46435 - DNA, 15 bp, Artificial Sequence
  dgRNA
  Sigirr
cgggttgcgctggtt

SEQ ID NO: 46436 - DNA, 15 bp, Artificial Sequence
  dgRNA
  Sigirr
ctggttgggctcctt

SEQ ID NO: 46437 - DNA, 15 bp, Artificial Sequence
  dgRNA
  Sigirr
accctgcccctaagc

SEQ ID NO: 46438 - DNA, 15 bp, Artificial Sequence
  dgRNA
  Kif21b
cagccacccgatgga

SEQ ID NO: 46439 - DNA, 15 bp, Artificial Sequence
  dgRNA
  Kif21b
agccacccgatggac

SEQ ID NO: 46440 - DNA, 15 bp, Artificial Sequence
  dgRNA
  Kif21b
tggacgggagccaag

SEQ ID NO: 46441 - DNA, 15 bp, Artificial Sequence
  dgRNA
  Kif21b
gcctctgctgctcgt

SEQ ID NO: 46442 - DNA, 15 bp, Artificial Sequence
  dgRNA
  Prop1
aagaatctggtcccc

SEQ ID NO: 46443 - DNA, 15 bp, Artificial Sequence
  dgRNA
  Prop1
atcctcccccgagcc

SEQ ID NO: 46444 - DNA, 15 bp, Artificial Sequence
  dgRNA
  Prop1
tcctcccccgagcca

SEQ ID NO: 46445 - DNA, 15 bp, Artificial Sequence
  dgRNA
  Prop1
cctcccccgagccag

SEQ ID NO: 46446 - DNA, 15 bp, Artificial Sequence
  dgRNA
  Senp3
tccgcgtagagctcg

SEQ ID NO: 46447 - DNA, 15 bp, Artificial Sequence
  dgRNA
  Senp3
ccgcgtagagctcga

SEQ ID NO: 46448 - DNA, 15 bp, Artificial Sequence
  dgRNA
  Senp3
cgtagagctcgaggg

SEQ ID NO: 46449 - DNA, 15 bp, Artificial Sequence
  dgRNA
  Senp3
gtagagctcgagggc

SEQ ID NO: 46450 - DNA, 15 bp, Artificial Sequence
  dgRNA
  Itgav
attgcagccagtccc

SEQ ID NO: 46451 - DNA, 15 bp, Artificial Sequence
  dgRNA
  Itgav
agtccccggcttgca

SEQ ID NO: 46452 - DNA, 15 bp, Artificial Sequence
  dgRNA
  Itgav
cggcttgcagggctt

SEQ ID NO: 46453 - DNA, 15 bp, Artificial Sequence
  dgRNA
  Itgav
ttgcagggcttcggc

SEQ ID NO: 46454 - DNA, 15 bp, Artificial Sequence
  dgRNA
  Morf4l1
ggtctggatacttag

SEQ ID NO: 46455 - DNA, 15 bp, Artificial Sequence
  dgRNA
  Morf4l1
ggatacttagagggc

SEQ ID NO: 46456 - DNA, 15 bp, Artificial Sequence
  dgRNA
  Morf4l1
gatacttagagggct

SEQ ID NO: 46457 - DNA, 15 bp, Artificial Sequence
  dgRNA
  Morf4l1
ggcggtggtggatcg

SEQ ID NO: 46458 - DNA, 15 bp, Artificial Sequence
  dgRNA
  Plekhh2
agtgggaatacctct

SEQ ID NO: 46459 - DNA, 15 bp, Artificial Sequence
  dgRNA
  Plekhh2
gtgggaatacctctt

SEQ ID NO: 46460 - DNA, 15 bp, Artificial Sequence
  dgRNA
  Plekhh2
aatacctcttgggtc

SEQ ID NO: 46461 - DNA, 15 bp, Artificial Sequence
  dgRNA
  Plekhh2
atacctcttgggtca

SEQ ID NO: 46462 - DNA, 15 bp, Artificial Sequence
  dgRNA
  Itgb8
aattcttgagaacga

SEQ ID NO: 46463 - DNA, 15 bp, Artificial Sequence
  dgRNA
  Itgb8
attcttgagaacgat

SEQ ID NO: 46464 - DNA, 15 bp, Artificial Sequence
  dgRNA
  Itgb8
aactattagattcga

SEQ ID NO: 46465 - DNA, 15 bp, Artificial Sequence
  dgRNA
  Itgb8
actattagattcgag

SEQ ID NO: 46466 - DNA, 15 bp, Artificial Sequence
  dgRNA
  Serpina1e
tcagtgcccaatcga

SEQ ID NO: 46467 - DNA, 15 bp, Artificial Sequence
  dgRNA
  Serpina1e
ctatgtccatcgatt

SEQ ID NO: 46468 - DNA, 15 bp, Artificial Sequence
  dgRNA
  Serpina1e
gctatgtccatcgat

SEQ ID NO: 46469 - DNA, 15 bp, Artificial Sequence
  dgRNA
  Car5a
gtttagcactctggc

SEQ ID NO: 46470 - DNA, 15 bp, Artificial Sequence
  dgRNA
  Car5a
tgctaaacttgacat

SEQ ID NO: 46471 - DNA, 15 bp, Artificial Sequence
  dgRNA
  Car5a
gtcactgctttggcc

SEQ ID NO: 46472 - DNA, 15 bp, Artificial Sequence
  dgRNA
  Sidt1
ctagctgcctaaatc

SEQ ID NO: 46473 - DNA, 15 bp, Artificial Sequence
  dgRNA
  Sidt1
gtcttcaagccgagc

SEQ ID NO: 46474 - DNA, 15 bp, Artificial Sequence
  dgRNA
  Sidt1
tcttcaagccgagct

SEQ ID NO: 46475 - DNA, 15 bp, Artificial Sequence
  dgRNA
  Hist2h2ac
ttcattggacttctc

SEQ ID NO: 46476 - DNA, 15 bp, Artificial Sequence
  dgRNA
  Hist2h2ac
tcattggacttctca

SEQ ID NO: 46477 - DNA, 15 bp, Artificial Sequence
  dgRNA
  Hist2h2ac
taggagcgcctataa

SEQ ID NO: 46478 - DNA, 15 bp, Artificial Sequence
  dgRNA
  Hist2h2ac
taaggcgttcataaa

SEQ ID NO: 46479 - DNA, 15 bp, Artificial Sequence
  dgRNA
  Gle1
cgcagagcatcaccc

SEQ ID NO: 46480 - DNA, 15 bp, Artificial Sequence
  dgRNA
  Gle1
gattcagatccacgt

SEQ ID NO: 46481 - DNA, 15 bp, Artificial Sequence
  dgRNA
  Gle1
cccgcattcttgctc

SEQ ID NO: 46482 - DNA, 15 bp, Artificial Sequence
  dgRNA
  Gle1
ggcggcgctcactag

SEQ ID NO: 46483 - DNA, 15 bp, Artificial Sequence
  dgRNA
  Slc34a2
cggccgttcctactg

SEQ ID NO: 46484 - DNA, 15 bp, Artificial Sequence
  dgRNA
  Slc34a2
ggccgttcctactgc

SEQ ID NO: 46485 - DNA, 15 bp, Artificial Sequence
  dgRNA
  Slc34a2
ttcctactgcgggcc

SEQ ID NO: 46486 - DNA, 15 bp, Artificial Sequence
  dgRNA
  Slc34a2
tgcgggcctggtctg

SEQ ID NO: 46487 - DNA, 15 bp, Artificial Sequence
  dgRNA
  Eif4e
aatcccgatactttg

SEQ ID NO: 46488 - DNA, 15 bp, Artificial Sequence
  dgRNA
  Eif4e
atcccgatactttgt

SEQ ID NO: 46489 - DNA, 15 bp, Artificial Sequence
  dgRNA
  Eif4e
tcccgatactttgtg

SEQ ID NO: 46490 - DNA, 15 bp, Artificial Sequence
  dgRNA
  Eif4e
cccgatactttgtgg

SEQ ID NO: 46491 - DNA, 15 bp, Artificial Sequence
  dgRNA
  Krtap3-2
ccaactgaattaata

SEQ ID NO: 46492 - DNA, 15 bp, Artificial Sequence
  dgRNA
  Krtap3-2
tgaattaataagggc

SEQ ID NO: 46493 - DNA, 15 bp, Artificial Sequence
  dgRNA
  Krtap3-2
gactcatacccactg

SEQ ID NO: 46494 - DNA, 15 bp, Artificial Sequence
  dgRNA
  Krtap3-2
ccttattaattcagt

SEQ ID NO: 46495 - DNA, 15 bp, Artificial Sequence
  dgRNA
  Dynlt1f
acatgccctgttact

SEQ ID NO: 46496 - DNA, 15 bp, Artificial Sequence
  dgRNA
  Dynlt1f
aagctggtctccgag

SEQ ID NO: 46497 - DNA, 15 bp, Artificial Sequence
  dgRNA
  Neil2
cccgggacccacctg

SEQ ID NO: 46498 - DNA, 15 bp, Artificial Sequence
  dgRNA
  Neil2
tggacatgcgcagcc

SEQ ID NO: 46499 - DNA, 15 bp, Artificial Sequence
  dgRNA
  Neil2
tgacgcagccccagg

SEQ ID NO: 46500 - DNA, 15 bp, Artificial Sequence
  dgRNA
  Neil2
ggctgacgcagcccc

SEQ ID NO: 46501 - DNA, 15 bp, Artificial Sequence
  dgRNA
  Them4
tgatgagtctttcgc

SEQ ID NO: 46502 - DNA, 15 bp, Artificial Sequence
  dgRNA
  Them4
gagtctttcgctggc

SEQ ID NO: 46503 - DNA, 15 bp, Artificial Sequence
  dgRNA
  Them4
ccagtgcagtaaccg

SEQ ID NO: 46504 - DNA, 15 bp, Artificial Sequence
  dgRNA
  Them4
ggacgcaaaatctcc

SEQ ID NO: 46505 - DNA, 15 bp, Artificial Sequence
  dgRNA
  Nsf
cattaaaaggccacg

SEQ ID NO: 46506 - DNA, 15 bp, Artificial Sequence
  dgRNA
  Nsf
aaccgggtagcagtg

SEQ ID NO: 46507 - DNA, 15 bp, Artificial Sequence
  dgRNA
  Nsf
cgggtagcagtgagg

SEQ ID NO: 46508 - DNA, 15 bp, Artificial Sequence
  dgRNA
  Nsf
caaaatggcggtgct

SEQ ID NO: 46509 - DNA, 15 bp, Artificial Sequence
  dgRNA
  Wdr20rt
cctccctggtatttc

SEQ ID NO: 46510 - DNA, 15 bp, Artificial Sequence
  dgRNA
  Wdr20rt
ccctaacgcctacag

SEQ ID NO: 46511 - DNA, 15 bp, Artificial Sequence
  dgRNA
  Wdr20rt
aacgcctacagaggc

SEQ ID NO: 46512 - DNA, 15 bp, Artificial Sequence
  dgRNA
  Wdr20rt
acgcctacagaggca

SEQ ID NO: 46513 - DNA, 15 bp, Artificial Sequence
  dgRNA
  4921539E11Rik
caatatctagaaggc

SEQ ID NO: 46514 - DNA, 15 bp, Artificial Sequence
  dgRNA
  4921539E11Rik
cagccttctagatat

SEQ ID NO: 46515 - DNA, 15 bp, Artificial Sequence
  dgRNA
  2810474O19Rik
taaattctaggtgca

SEQ ID NO: 46516 - DNA, 15 bp, Artificial Sequence
  dgRNA
  2810474O19Rik
ccctcagactgtaga

SEQ ID NO: 46517 - DNA, 15 bp, Artificial Sequence
  dgRNA
  2810474O19Rik
ccggcactaggaccg

SEQ ID NO: 46518 - DNA, 15 bp, Artificial Sequence
  dgRNA
  2810474O19Rik
ctaggaccgcggccc

SEQ ID NO: 46519 - DNA, 15 bp, Artificial Sequence
  dgRNA
  Ctla2a
actcactagcgaagc

SEQ ID NO: 46520 - DNA, 15 bp, Artificial Sequence
  dgRNA
  Ctla2a
tgagttattacagac

SEQ ID NO: 46521 - DNA, 15 bp, Artificial Sequence
  dgRNA
  Xk
gcaggcgggccagat

SEQ ID NO: 46522 - DNA, 15 bp, Artificial Sequence
  dgRNA
  Xk
ggccagatcggttga

SEQ ID NO: 46523 - DNA, 15 bp, Artificial Sequence
  dgRNA
  Xk
actttgcccccagcg

SEQ ID NO: 46524 - DNA, 15 bp, Artificial Sequence
  dgRNA
  Xk
ttgcccccagcgcgg

SEQ ID NO: 46525 - DNA, 15 bp, Artificial Sequence
  dgRNA
  Wbp5
ctgccgcgctttttg

SEQ ID NO: 46526 - DNA, 15 bp, Artificial Sequence
  dgRNA
  Wbp5
tgccgcgctttttgt

SEQ ID NO: 46527 - DNA, 15 bp, Artificial Sequence
  dgRNA
  Wbp5
cgctttttgtgggag

SEQ ID NO: 46528 - DNA, 15 bp, Artificial Sequence
  dgRNA
  Wbp5
gtggagatcggggac

SEQ ID NO: 46529 - DNA, 15 bp, Artificial Sequence
  dgRNA
  Atp8b4
gccatcgactccgag

SEQ ID NO: 46530 - DNA, 15 bp, Artificial Sequence
  dgRNA
  Atp8b4
gagaggaacagtacc

SEQ ID NO: 46531 - DNA, 15 bp, Artificial Sequence
  dgRNA
  Atp8b4
gtttgtgggacacat

SEQ ID NO: 46532 - DNA, 15 bp, Artificial Sequence
  dgRNA
  Atp8b4
ggggccgtggttaca

SEQ ID NO: 46533 - DNA, 15 bp, Artificial Sequence
  dgRNA
  Ptprr
ctcatgcaacatacc

SEQ ID NO: 46534 - DNA, 15 bp, Artificial Sequence
  dgRNA
  Ptprr
acctggggcgtcccc

SEQ ID NO: 46535 - DNA, 15 bp, Artificial Sequence
  dgRNA
  Ptprr
cctggggcgtcccct

SEQ ID NO: 46536 - DNA, 15 bp, Artificial Sequence
  dgRNA
  Ptprr
cccctgggatagcac

SEQ ID NO: 46537 - DNA, 15 bp, Artificial Sequence
  dgRNA
  F2r
ctcaaccacaccggg

SEQ ID NO: 46538 - DNA, 15 bp, Artificial Sequence
  dgRNA
  F2r
tcaaccacaccgggt

SEQ ID NO: 46539 - DNA, 15 bp, Artificial Sequence
  dgRNA
  F2r
acaccgggtgggaca

SEQ ID NO: 46540 - DNA, 15 bp, Artificial Sequence
  dgRNA
  F2r
caccgggtgggacaa

SEQ ID NO: 46541 - DNA, 15 bp, Artificial Sequence
  dgRNA
  Ccrl2
ttccactccaagacc

SEQ ID NO: 46542 - DNA, 15 bp, Artificial Sequence
  dgRNA
  Ccrl2
caggactttcccccg

SEQ ID NO: 46543 - DNA, 15 bp, Artificial Sequence
  dgRNA
  Ccrl2
ggcttcccctgagcg

SEQ ID NO: 46544 - DNA, 15 bp, Artificial Sequence
  dgRNA
  Ccrl2
aattggacagttgcc

SEQ ID NO: 46545 - DNA, 15 bp, Artificial Sequence
  dgRNA
  Tnfsf13
gccctcctccaactt

SEQ ID NO: 46546 - DNA, 15 bp, Artificial Sequence
  dgRNA
  Tnfsf13
ccctcctccaactta

SEQ ID NO: 46547 - DNA, 15 bp, Artificial Sequence
  dgRNA
  Tnfsf13
cctcctccaacttag

SEQ ID NO: 46548 - DNA, 15 bp, Artificial Sequence
  dgRNA
  Tnfsf13
cttaggggccgcccc

SEQ ID NO: 46549 - DNA, 15 bp, Artificial Sequence
  dgRNA
  Cstl1
ctattgttcttttgc

SEQ ID NO: 46550 - DNA, 15 bp, Artificial Sequence
  dgRNA
  Cstl1
tgggggcaaaacatt

SEQ ID NO: 46551 - DNA, 15 bp, Artificial Sequence
  dgRNA
  Cstl1
gggggcaaaacatta

SEQ ID NO: 46552 - DNA, 15 bp, Artificial Sequence
  dgRNA
  Cstl1
gagctcttaacatac

SEQ ID NO: 46553 - DNA, 15 bp, Artificial Sequence
  dgRNA
  Fst
gagccggcacaccct

SEQ ID NO: 46554 - DNA, 15 bp, Artificial Sequence
  dgRNA
  Fst
gcacaccctcggtcg

SEQ ID NO: 46555 - DNA, 15 bp, Artificial Sequence
  dgRNA
  Fst
tctagatttaaagcg

SEQ ID NO: 46556 - DNA, 15 bp, Artificial Sequence
  dgRNA
  Fst
aagcgcggctgcgcc

SEQ ID NO: 46557 - DNA, 15 bp, Artificial Sequence
  dgRNA
  Plcb3
gccgccccaaccgcg

SEQ ID NO: 46558 - DNA, 15 bp, Artificial Sequence
  dgRNA
  Plcb3
ccgccccaaccgcga

SEQ ID NO: 46559 - DNA, 15 bp, Artificial Sequence
  dgRNA
  Plcb3
cgccccaaccgcgag

SEQ ID NO: 46560 - DNA, 15 bp, Artificial Sequence
  dgRNA
  Plcb3
gccccaaccgcgagg

SEQ ID NO: 46561 - DNA, 15 bp, Artificial Sequence
  dgRNA
  Eif4enif1
gccatccggcccacg

SEQ ID NO: 46562 - DNA, 15 bp, Artificial Sequence
  dgRNA
  Eif4enif1
acgcggaacccagcg

SEQ ID NO: 46563 - DNA, 15 bp, Artificial Sequence
  dgRNA
  Eif4enif1
cggaacccagcgcgg

SEQ ID NO: 46564 - DNA, 15 bp, Artificial Sequence
  dgRNA
  Eif4enif1
tgccaggcaccgctg

SEQ ID NO: 46565 - DNA, 15 bp, Artificial Sequence
  dgRNA
  Plcb1
ccgggcatgctcaga

SEQ ID NO: 46566 - DNA, 15 bp, Artificial Sequence
  dgRNA
  Plcb1
gagggtgtgcggcgc

SEQ ID NO: 46567 - DNA, 15 bp, Artificial Sequence
  dgRNA
  Plcb1
gtgcggcgcaggcgt

SEQ ID NO: 46568 - DNA, 15 bp, Artificial Sequence
  dgRNA
  Plcb1
aggcgtcggctgcag

SEQ ID NO: 46569 - DNA, 15 bp, Artificial Sequence
  dgRNA
  Rbm14
tccccccgaaggtgg

SEQ ID NO: 46570 - DNA, 15 bp, Artificial Sequence
  dgRNA
  Rbm14
cccgaaggtggcggt

SEQ ID NO: 46571 - DNA, 15 bp, Artificial Sequence
  dgRNA
  Rbm14
ccccctccgttaaca

SEQ ID NO: 46572 - DNA, 15 bp, Artificial Sequence
  dgRNA
  Rbm14
cccctccgttaacaa

SEQ ID NO: 46573 - DNA, 15 bp, Artificial Sequence
  dgRNA
  Pdss2
ttcatgcctccaaca

SEQ ID NO: 46574 - DNA, 15 bp, Artificial Sequence
  dgRNA
  Pdss2
tggcgccccccatgt

SEQ ID NO: 46575 - DNA, 15 bp, Artificial Sequence
  dgRNA
  Pdss2
tgtggttaccagcgc

SEQ ID NO: 46576 - DNA, 15 bp, Artificial Sequence
  dgRNA
  Pdss2
gttctgagcagccgc

SEQ ID NO: 46577 - DNA, 15 bp, Artificial Sequence
  dgRNA
  Cmas
gcgccattcaactag

SEQ ID NO: 46578 - DNA, 15 bp, Artificial Sequence
  dgRNA
  Cmas
ggccggccccactgc

SEQ ID NO: 46579 - DNA, 15 bp, Artificial Sequence
  dgRNA
  Cmas
gccggccccactgca

SEQ ID NO: 46580 - DNA, 15 bp, Artificial Sequence
  dgRNA
  Cmas
tgcagggtgacggcg

SEQ ID NO: 46581 - DNA, 15 bp, Artificial Sequence
  dgRNA
  Cyp2c38
ccatataatgttcaa

SEQ ID NO: 46582 - DNA, 15 bp, Artificial Sequence
  dgRNA
  Cyp2c38
ataacatctctatca

SEQ ID NO: 46583 - DNA, 15 bp, Artificial Sequence
  dgRNA
  Cyp2c38
gctataaaagatcag

SEQ ID NO: 46584 - DNA, 15 bp, Artificial Sequence
  dgRNA
  Cyp2c38
gcccatttgaatatc

SEQ ID NO: 46585 - DNA, 15 bp, Artificial Sequence
  dgRNA
  Adat3
ctcaaagtgtcacaa

SEQ ID NO: 46586 - DNA, 15 bp, Artificial Sequence
  dgRNA
  Adat3
aagcagccacgcgca

SEQ ID NO: 46587 - DNA, 15 bp, Artificial Sequence
  dgRNA
  Adat3
acgcgcacggcctta

SEQ ID NO: 46588 - DNA, 15 bp, Artificial Sequence
  dgRNA
  Adat3
cgcgcacggccttaa

SEQ ID NO: 46589 - DNA, 15 bp, Artificial Sequence
  dgRNA
  Alg12
cccggtttccgcagc

SEQ ID NO: 46590 - DNA, 15 bp, Artificial Sequence
  dgRNA
  Alg12
tgcggaaaccgggcc

SEQ ID NO: 46591 - DNA, 15 bp, Artificial Sequence
  dgRNA
  Alg12
ccggctgcggaaacc

SEQ ID NO: 46592 - DNA, 15 bp, Artificial Sequence
  dgRNA
  Alg12
gccggctgcggaaac

SEQ ID NO: 46593 - DNA, 15 bp, Artificial Sequence
  dgRNA
  Cmtm1
ctgcactcgaccagc

SEQ ID NO: 46594 - DNA, 15 bp, Artificial Sequence
  dgRNA
  Cmtm1
aggcctcactgcata

SEQ ID NO: 46595 - DNA, 15 bp, Artificial Sequence
  dgRNA
  Cmtm1
ctttttcccacaacg

SEQ ID NO: 46596 - DNA, 15 bp, Artificial Sequence
  dgRNA
  Cmtm1
tggtcgagtgcagca

SEQ ID NO: 46597 - DNA, 15 bp, Artificial Sequence
  dgRNA
  Fam168a
agaaccaggccgcgc

SEQ ID NO: 46598 - DNA, 15 bp, Artificial Sequence
  dgRNA
  Fam168a
gaaccaggccgcgca

SEQ ID NO: 46599 - DNA, 15 bp, Artificial Sequence
  dgRNA
  Fam168a
ggccgcgcagggccg

SEQ ID NO: 46600 - DNA, 15 bp, Artificial Sequence
  dgRNA
  Fam168a
cgtggcagagcatgc

SEQ ID NO: 46601 - DNA, 15 bp, Artificial Sequence
  dgRNA
  Gm884
accctctaaatccaa

SEQ ID NO: 46602 - DNA, 15 bp, Artificial Sequence
  dgRNA
  Gm884
ctcctttggatttag

SEQ ID NO: 46603 - DNA, 15 bp, Artificial Sequence
  dgRNA
  Arsg
tctcttatcctatac

SEQ ID NO: 46604 - DNA, 15 bp, Artificial Sequence
  dgRNA
  Arsg
tataccggctgcagc

SEQ ID NO: 46605 - DNA, 15 bp, Artificial Sequence
  dgRNA
  Arsg
gcagccggtctccgc

SEQ ID NO: 46606 - DNA, 15 bp, Artificial Sequence
  dgRNA
  Arsg
ggtctccgccggcct

SEQ ID NO: 46607 - DNA, 15 bp, Artificial Sequence
  dgRNA
  Snx21
cctcttaaatccgcc

SEQ ID NO: 46608 - DNA, 15 bp, Artificial Sequence
  dgRNA
  Snx21
gctgcaccaaatccc

SEQ ID NO: 46609 - DNA, 15 bp, Artificial Sequence
  dgRNA
  Snx21
cgccccgaacgcact

SEQ ID NO: 46610 - DNA, 15 bp, Artificial Sequence
  dgRNA
  Snx21
gccccgaacgcactt

SEQ ID NO: 46611 - DNA, 15 bp, Artificial Sequence
  dgRNA
  Ciao1
cccgcaacgcccaga

SEQ ID NO: 46612 - DNA, 15 bp, Artificial Sequence
  dgRNA
  Ciao1
cgcccagacggaccc

SEQ ID NO: 46613 - DNA, 15 bp, Artificial Sequence
  dgRNA
  Ciao1
tggccgatgcacttc

SEQ ID NO: 46614 - DNA, 15 bp, Artificial Sequence
  dgRNA
  Ciao1
cgcttgttcttgcgc

SEQ ID NO: 46615 - DNA, 15 bp, Artificial Sequence
  dgRNA
  Lck
caggtagtcccccaa

SEQ ID NO: 46616 - DNA, 15 bp, Artificial Sequence
  dgRNA
  Lck
gtagtcccccaaagg

SEQ ID NO: 46617 - DNA, 15 bp, Artificial Sequence
  dgRNA
  Lck
cggtttgcccatccc

SEQ ID NO: 46618 - DNA, 15 bp, Artificial Sequence
  dgRNA
  Lck
ttgcccatcccaggt

SEQ ID NO: 46619 - DNA, 15 bp, Artificial Sequence
  dgRNA
  Rpp14
tgacgacagttccga

SEQ ID NO: 46620 - DNA, 15 bp, Artificial Sequence
  dgRNA
  Rpp14
cgacagttccgaggg

SEQ ID NO: 46621 - DNA, 15 bp, Artificial Sequence
  dgRNA
  Rpp14
gagggtggacgctag

SEQ ID NO: 46622 - DNA, 15 bp, Artificial Sequence
  dgRNA
  Rpp14
agggtggacgctaga

SEQ ID NO: 46623 - DNA, 15 bp, Artificial Sequence
  dgRNA
  Oas1c
ttccatttcccggga

SEQ ID NO: 46624 - DNA, 15 bp, Artificial Sequence
  dgRNA
  Oas1c
tccatttcccgggaa

SEQ ID NO: 46625 - DNA, 15 bp, Artificial Sequence
  dgRNA
  Oas1c
ttcccgggaagggcg

SEQ ID NO: 46626 - DNA, 15 bp, Artificial Sequence
  dgRNA
  Oas1c
gcagccaatggcgtt

SEQ ID NO: 46627 - DNA, 15 bp, Artificial Sequence
  dgRNA
  Ube2m
gcttcctactctact

SEQ ID NO: 46628 - DNA, 15 bp, Artificial Sequence
  dgRNA
  Ube2m
ctgggtgcgcgtccc

SEQ ID NO: 46629 - DNA, 15 bp, Artificial Sequence
  dgRNA
  Ube2m
cctcaaactacaatg

SEQ ID NO: 46630 - DNA, 15 bp, Artificial Sequence
  dgRNA
  Ube2m
accagggggctgcaa

SEQ ID NO: 46631 - DNA, 15 bp, Artificial Sequence
  dgRNA
  Gm815
gcgggagtacccacc

SEQ ID NO: 46632 - DNA, 15 bp, Artificial Sequence
  dgRNA
  Gm815
ggtatgtgcctcaag

SEQ ID NO: 46633 - DNA, 15 bp, Artificial Sequence
  dgRNA
  Gm815
ggtgttccctcctgc

SEQ ID NO: 46634 - DNA, 15 bp, Artificial Sequence
  dgRNA
  Gm815
ctcccgcaggcatcc

SEQ ID NO: 46635 - DNA, 15 bp, Artificial Sequence
  dgRNA
  Clpx
ccgtagcgcgctcat

SEQ ID NO: 46636 - DNA, 15 bp, Artificial Sequence
  dgRNA
  Clpx
cgctcattggtgccc

SEQ ID NO: 46637 - DNA, 15 bp, Artificial Sequence
  dgRNA
  Clpx
taccgccccattctc

SEQ ID NO: 46638 - DNA, 15 bp, Artificial Sequence
  dgRNA
  Clpx
actcacgcctcctcc

SEQ ID NO: 46639 - DNA, 15 bp, Artificial Sequence
  dgRNA
  Nmnat3
gatgacaatctactg

SEQ ID NO: 46640 - DNA, 15 bp, Artificial Sequence
  dgRNA
  Nmnat3
aggacctgaagagcg

SEQ ID NO: 46641 - DNA, 15 bp, Artificial Sequence
  dgRNA
  Nmnat3
ggacctgaagagcgg

SEQ ID NO: 46642 - DNA, 15 bp, Artificial Sequence
  dgRNA
  Nmnat3
acggggcgtggtctt

SEQ ID NO: 46643 - DNA, 15 bp, Artificial Sequence
  dgRNA
  Acer1
ctaccctggtgcaat

SEQ ID NO: 46644 - DNA, 15 bp, Artificial Sequence
  dgRNA
  Acer1
cgacagtaagcaggg

SEQ ID NO: 46645 - DNA, 15 bp, Artificial Sequence
  dgRNA
  Acer1
tgggcgacagtaagc

SEQ ID NO: 46646 - DNA, 15 bp, Artificial Sequence
  dgRNA
  Acer1
caccgaggctgcctt

SEQ ID NO: 46647 - DNA, 15 bp, Artificial Sequence
  dgRNA
  Cntnap3
gaggctgtcgtcgca

SEQ ID NO: 46648 - DNA, 15 bp, Artificial Sequence
  dgRNA
  Cntnap3
gctgtcgtcgcaagg

SEQ ID NO: 46649 - DNA, 15 bp, Artificial Sequence
  dgRNA
  Cntnap3
gtcgtcgcaaggtgg

SEQ ID NO: 46650 - DNA, 15 bp, Artificial Sequence
  dgRNA
  Cntnap3
cttacacgcgcagcg

SEQ ID NO: 46651 - DNA, 15 bp, Artificial Sequence
  dgRNA
  Olfr685
cagctagactcagcc

SEQ ID NO: 46652 - DNA, 15 bp, Artificial Sequence
  dgRNA
  Ssx9
ctgtagacctaatca

SEQ ID NO: 46653 - DNA, 15 bp, Artificial Sequence
  dgRNA
  Ssx9
cttgattaggtctac

SEQ ID NO: 46654 - DNA, 15 bp, Artificial Sequence
  dgRNA
  Iqcb1
ctgcgagcttgagtt

SEQ ID NO: 46655 - DNA, 15 bp, Artificial Sequence
  dgRNA
  Iqcb1
ttgagttcggtgccc

SEQ ID NO: 46656 - DNA, 15 bp, Artificial Sequence
  dgRNA
  Iqcb1
acctccagacgcgtg

SEQ ID NO: 46657 - DNA, 15 bp, Artificial Sequence
  dgRNA
  Iqcb1
cgtgcggccgcccct

SEQ ID NO: 46658 - DNA, 15 bp, Artificial Sequence
  dgRNA
  Styk1
gacagggaacttact

SEQ ID NO: 46659 - DNA, 15 bp, Artificial Sequence
  dgRNA
  Styk1
gagtgctgtttttgc

SEQ ID NO: 46660 - DNA, 15 bp, Artificial Sequence
  dgRNA
  Ptpn4
atcgctgcctggcga

SEQ ID NO: 46661 - DNA, 15 bp, Artificial Sequence
  dgRNA
  Ptpn4
tcgctgcctggcgat

SEQ ID NO: 46662 - DNA, 15 bp, Artificial Sequence
  dgRNA
  Ptpn4
cgctgcctggcgatg

SEQ ID NO: 46663 - DNA, 15 bp, Artificial Sequence
  dgRNA
  Ptpn4
cccgcgctccgaaac

SEQ ID NO: 46664 - DNA, 15 bp, Artificial Sequence
  dgRNA
  Olfr1252
tggaagtctaggttt

SEQ ID NO: 46665 - DNA, 15 bp, Artificial Sequence
  dgRNA
  Olfr1252
ggaggattttattag

SEQ ID NO: 46666 - DNA, 15 bp, Artificial Sequence
  dgRNA
  Dctn1
gatagtgaggggtac

SEQ ID NO: 46667 - DNA, 15 bp, Artificial Sequence
  dgRNA
  Dctn1
cctgggttcgtgtga

SEQ ID NO: 46668 - DNA, 15 bp, Artificial Sequence
  dgRNA
  Dctn1
gggttcgtgtgaagg

SEQ ID NO: 46669 - DNA, 15 bp, Artificial Sequence
  dgRNA
  Dctn1
ggttcgtgtgaagga

SEQ ID NO: 46670 - DNA, 15 bp, Artificial Sequence
  dgRNA
  Cmya5
taacgttatcttctc

SEQ ID NO: 46671 - DNA, 15 bp, Artificial Sequence
  dgRNA
  Cmya5
ggatgctgcctcatt

SEQ ID NO: 46672 - DNA, 15 bp, Artificial Sequence
  dgRNA
  Cmya5
agtgtaagaaccacc

SEQ ID NO: 46673 - DNA, 15 bp, Artificial Sequence
  dgRNA
  Cmya5
cactagatggaaggc

SEQ ID NO: 46674 - DNA, 15 bp, Artificial Sequence
  dgRNA
  Tbc1d9b
cgatcccctccaaac

SEQ ID NO: 46675 - DNA, 15 bp, Artificial Sequence
  dgRNA
  Tbc1d9b
gccagcgcggccgct

SEQ ID NO: 46676 - DNA, 15 bp, Artificial Sequence
  dgRNA
  Tbc1d9b
ccagcgcggccgcta

SEQ ID NO: 46677 - DNA, 15 bp, Artificial Sequence
  dgRNA
  Tbc1d9b
cagcgcggccgctag

SEQ ID NO: 46678 - DNA, 15 bp, Artificial Sequence
  dgRNA
  Cacna2d3
ccggggccgccgagg

SEQ ID NO: 46679 - DNA, 15 bp, Artificial Sequence
  dgRNA
  Cacna2d3
cggggccgccgaggc

SEQ ID NO: 46680 - DNA, 15 bp, Artificial Sequence
  dgRNA
  Cacna2d3
ccgccgaggcggggc

SEQ ID NO: 46681 - DNA, 15 bp, Artificial Sequence
  dgRNA
  Cacna2d3
cgccgaggcggggct

SEQ ID NO: 46682 - DNA, 15 bp, Artificial Sequence
  dgRNA
  Hagh
cgagtctacaggcca

SEQ ID NO: 46683 - DNA, 15 bp, Artificial Sequence
  dgRNA
  Hagh
agctagggaacattt

SEQ ID NO: 46684 - DNA, 15 bp, Artificial Sequence
  dgRNA
  Hagh
gctagggaacatttt

SEQ ID NO: 46685 - DNA, 15 bp, Artificial Sequence
  dgRNA
  Hagh
ggagctactactgat

SEQ ID NO: 46686 - DNA, 15 bp, Artificial Sequence
  dgRNA
  Aatk
gctcccgcgtgtttt

SEQ ID NO: 46687 - DNA, 15 bp, Artificial Sequence
  dgRNA
  Aatk
agccccgcggcgccg

SEQ ID NO: 46688 - DNA, 15 bp, Artificial Sequence
  dgRNA
  Aatk
tgtcgccgcccccac

SEQ ID NO: 46689 - DNA, 15 bp, Artificial Sequence
  dgRNA
  Aatk
ctggtgcccgcgctg

SEQ ID NO: 46690 - DNA, 15 bp, Artificial Sequence
  dgRNA
  A430078G23Rik
gtgtgcccgagtgtt

SEQ ID NO: 46691 - DNA, 15 bp, Artificial Sequence
  dgRNA
  A430078G23Rik
ccgagtgttagggtg

SEQ ID NO: 46692 - DNA, 15 bp, Artificial Sequence
  dgRNA
  A430078G23Rik
agcagttggcgccac

SEQ ID NO: 46693 - DNA, 15 bp, Artificial Sequence
  dgRNA
  A430078G23Rik
ccctcccctcgtggg

SEQ ID NO: 46694 - DNA, 15 bp, Artificial Sequence
  dgRNA
  Marcks
accgtttgcaaagcg

SEQ ID NO: 46695 - DNA, 15 bp, Artificial Sequence
  dgRNA
  Marcks
gctccattgttcgcc

SEQ ID NO: 46696 - DNA, 15 bp, Artificial Sequence
  dgRNA
  Marcks
gttcgcccggagcgc

SEQ ID NO: 46697 - DNA, 15 bp, Artificial Sequence
  dgRNA
  Marcks
gtgcggcgcgcggat

SEQ ID NO: 46698 - DNA, 15 bp, Artificial Sequence
  dgRNA
  Nphs1
ccttcccacgcacac

SEQ ID NO: 46699 - DNA, 15 bp, Artificial Sequence
  dgRNA
  Nphs1
cgttccatcctgagc

SEQ ID NO: 46700 - DNA, 15 bp, Artificial Sequence
  dgRNA
  Nphs1
ggggtcacccgggct

SEQ ID NO: 46701 - DNA, 15 bp, Artificial Sequence
  dgRNA
  Nphs1
gggtcacccgggctg

SEQ ID NO: 46702 - DNA, 15 bp, Artificial Sequence
  dgRNA
  Pramel6
gatggtagaggttgc

SEQ ID NO: 46703 - DNA, 15 bp, Artificial Sequence
  dgRNA
  Kctd21
ccctttaaggccagc

SEQ ID NO: 46704 - DNA, 15 bp, Artificial Sequence
  dgRNA
  Kctd21
tggtcccagtgccgg

SEQ ID NO: 46705 - DNA, 15 bp, Artificial Sequence
  dgRNA
  Kctd21
ggtcccagtgccggc

SEQ ID NO: 46706 - DNA, 15 bp, Artificial Sequence
  dgRNA
  Kctd21
gtcccagtgccggcg

SEQ ID NO: 46707 - DNA, 15 bp, Artificial Sequence
  dgRNA
  Rps21
ggctggactccgcaa

SEQ ID NO: 46708 - DNA, 15 bp, Artificial Sequence
  dgRNA
  Rps21
tggactccgcaatgg

SEQ ID NO: 46709 - DNA, 15 bp, Artificial Sequence
  dgRNA
  Rps21
actccgcaatggagg

SEQ ID NO: 46710 - DNA, 15 bp, Artificial Sequence
  dgRNA
  Rps21
ctccgcaatggaggc

SEQ ID NO: 46711 - DNA, 15 bp, Artificial Sequence
  dgRNA
  Ushbp1
tgatatctttagagc

SEQ ID NO: 46712 - DNA, 15 bp, Artificial Sequence
  dgRNA
  Ushbp1
tttagagcgggacaa

SEQ ID NO: 46713 - DNA, 15 bp, Artificial Sequence
  dgRNA
  Ushbp1
gcgggacaaaggtcc

SEQ ID NO: 46714 - DNA, 15 bp, Artificial Sequence
  dgRNA
  Ushbp1
atcctcctcccgttc

SEQ ID NO: 46715 - DNA, 15 bp, Artificial Sequence
  dgRNA
  Tm4sf19
gctggggccttgaat

SEQ ID NO: 46716 - DNA, 15 bp, Artificial Sequence
  dgRNA
  Tm4sf19
ataggagcttaccaa

SEQ ID NO: 46717 - DNA, 15 bp, Artificial Sequence
  dgRNA
  Tm4sf19
taccaaaggcctgtc

SEQ ID NO: 46718 - DNA, 15 bp, Artificial Sequence
  dgRNA
  Tm4sf19
cgactgtgacactcc

SEQ ID NO: 46719 - DNA, 15 bp, Artificial Sequence
  dgRNA
  Krtap3-1
tgaatcccttttatg

SEQ ID NO: 46720 - DNA, 15 bp, Artificial Sequence
  dgRNA
  Krtap3-1
aaatatcttgaccat

SEQ ID NO: 46721 - DNA, 15 bp, Artificial Sequence
  dgRNA
  Krtap3-1
cataggttgacgccc

SEQ ID NO: 46722 - DNA, 15 bp, Artificial Sequence
  dgRNA
  Krtap3-1
ataggttgacgccca

SEQ ID NO: 46723 - DNA, 15 bp, Artificial Sequence
  dgRNA
  Esyt1
ctggtccaatcacgg

SEQ ID NO: 46724 - DNA, 15 bp, Artificial Sequence
  dgRNA
  Esyt1
cttcccaagtctacg

SEQ ID NO: 46725 - DNA, 15 bp, Artificial Sequence
  dgRNA
  Esyt1
cggcgctgccccaac

SEQ ID NO: 46726 - DNA, 15 bp, Artificial Sequence
  dgRNA
  Esyt1
gggcttgaggtcccg

SEQ ID NO: 46727 - DNA, 15 bp, Artificial Sequence
  dgRNA
  1700088E04Rik
gatgccttctccgcc

SEQ ID NO: 46728 - DNA, 15 bp, Artificial Sequence
  dgRNA
  1700088E04Rik
atgccttctccgccc

SEQ ID NO: 46729 - DNA, 15 bp, Artificial Sequence
  dgRNA
  1700088E04Rik
tgccttctccgcccg

SEQ ID NO: 46730 - DNA, 15 bp, Artificial Sequence
  dgRNA
  1700088E04Rik
cttgcgccgtgaccc

SEQ ID NO: 46731 - DNA, 15 bp, Artificial Sequence
  dgRNA
  Lmtk2
ccaccttgccgccta

SEQ ID NO: 46732 - DNA, 15 bp, Artificial Sequence
  dgRNA
  Lmtk2
ccgcctatggctgag

SEQ ID NO: 46733 - DNA, 15 bp, Artificial Sequence
  dgRNA
  Lmtk2
cgcctatggctgaga

SEQ ID NO: 46734 - DNA, 15 bp, Artificial Sequence
  dgRNA
  Lmtk2
ctcccggagtcagta

SEQ ID NO: 46735 - DNA, 15 bp, Artificial Sequence
  dgRNA
  Ptbp1
ataactcggagccgt

SEQ ID NO: 46736 - DNA, 15 bp, Artificial Sequence
  dgRNA
  Ptbp1
taactcggagccgtt

SEQ ID NO: 46737 - DNA, 15 bp, Artificial Sequence
  dgRNA
  Ptbp1
tcggagccgttgggt

SEQ ID NO: 46738 - DNA, 15 bp, Artificial Sequence
  dgRNA
  Ptbp1
cagaaaccgacccaa

SEQ ID NO: 46739 - DNA, 15 bp, Artificial Sequence
  dgRNA
  Fam234b
gatgactttccttac

SEQ ID NO: 46740 - DNA, 15 bp, Artificial Sequence
  dgRNA
  Fam234b
ccttaccggctgctg

SEQ ID NO: 46741 - DNA, 15 bp, Artificial Sequence
  dgRNA
  Fam234b
caagcgactcaacct

SEQ ID NO: 46742 - DNA, 15 bp, Artificial Sequence
  dgRNA
  Fam234b
agtgacctgcgacag

SEQ ID NO: 46743 - DNA, 15 bp, Artificial Sequence
  dgRNA
  Eef1b2
gacccctcaaaaccc

SEQ ID NO: 46744 - DNA, 15 bp, Artificial Sequence
  dgRNA
  Eef1b2
gccgctaagtcaata

SEQ ID NO: 46745 - DNA, 15 bp, Artificial Sequence
  dgRNA
  Eef1b2
gctaagtcaatatgg

SEQ ID NO: 46746 - DNA, 15 bp, Artificial Sequence
  dgRNA
  Eef1b2
tctgtcagcccgacc

SEQ ID NO: 46747 - DNA, 15 bp, Artificial Sequence
  dgRNA
  Robo1
acctgagggcgcagt

SEQ ID NO: 46748 - DNA, 15 bp, Artificial Sequence
  dgRNA
  Robo1
cctgagggcgcagtt

SEQ ID NO: 46749 - DNA, 15 bp, Artificial Sequence
  dgRNA
  Robo1
gcagttgggcgctcc

SEQ ID NO: 46750 - DNA, 15 bp, Artificial Sequence
  dgRNA
  Robo1
ggcgctccaggcatg

SEQ ID NO: 46751 - DNA, 15 bp, Artificial Sequence
  dgRNA
  Cxcl5
taaaaggggtgcagt

SEQ ID NO: 46752 - DNA, 15 bp, Artificial Sequence
  dgRNA
  Cxcl5
tctttgccaaatcgg

SEQ ID NO: 46753 - DNA, 15 bp, Artificial Sequence
  dgRNA
  Cxcl5
ggctctttgccaaat

SEQ ID NO: 46754 - DNA, 15 bp, Artificial Sequence
  dgRNA
  Cxcl5
gaaattccctggact

SEQ ID NO: 46755 - DNA, 15 bp, Artificial Sequence
  dgRNA
  Cbr4
ctcatagaactaacc

SEQ ID NO: 46756 - DNA, 15 bp, Artificial Sequence
  dgRNA
  Cbr4
gaactaaccaggctt

SEQ ID NO: 46757 - DNA, 15 bp, Artificial Sequence
  dgRNA
  Cbr4
agcacaagccgtgtg

SEQ ID NO: 46758 - DNA, 15 bp, Artificial Sequence
  dgRNA
  Cbr4
ctggttagttctatg

SEQ ID NO: 46759 - DNA, 15 bp, Artificial Sequence
  dgRNA
  Olfr1348
ttcacttaatttgac

SEQ ID NO: 46760 - DNA, 15 bp, Artificial Sequence
  dgRNA
  Olfr1348
tcacttaatttgacg

SEQ ID NO: 46761 - DNA, 15 bp, Artificial Sequence
  dgRNA
  Olfr1348
aaccctcctatatac

SEQ ID NO: 46762 - DNA, 15 bp, Artificial Sequence
  dgRNA
  Olfr1348
ttccagtatatagga

SEQ ID NO: 46763 - DNA, 15 bp, Artificial Sequence
  dgRNA
  Opa1
cctacactttgaggg

SEQ ID NO: 46764 - DNA, 15 bp, Artificial Sequence
  dgRNA
  Opa1
agaggagcactacac

SEQ ID NO: 46765 - DNA, 15 bp, Artificial Sequence
  dgRNA
  Opa1
acaggtcccgcccag

SEQ ID NO: 46766 - DNA, 15 bp, Artificial Sequence
  dgRNA
  Opa1
tgcgcatgtcatccg

SEQ ID NO: 46767 - DNA, 15 bp, Artificial Sequence
  dgRNA
  Zbp1
gactggtctcccacc

SEQ ID NO: 46768 - DNA, 15 bp, Artificial Sequence
  dgRNA
  Zbp1
aattgaaatcggggt

SEQ ID NO: 46769 - DNA, 15 bp, Artificial Sequence
  dgRNA
  Zbp1
aaattgaaatcgggg

SEQ ID NO: 46770 - DNA, 15 bp, Artificial Sequence
  dgRNA
  Zbp1
tcgaaattgaaatcg

SEQ ID NO: 46771 - DNA, 15 bp, Artificial Sequence
  dgRNA
  BC048671
ctgttccgtagaact

SEQ ID NO: 46772 - DNA, 15 bp, Artificial Sequence
  dgRNA
  Las1l
gtgaatgaacgcttc

SEQ ID NO: 46773 - DNA, 15 bp, Artificial Sequence
  dgRNA
  Las1l
gcttccggcagcgag

SEQ ID NO: 46774 - DNA, 15 bp, Artificial Sequence
  dgRNA
  Las1l
gtcccacgttcctat

SEQ ID NO: 46775 - DNA, 15 bp, Artificial Sequence
  dgRNA
  Las1l
tacagtcacgttgag

SEQ ID NO: 46776 - DNA, 15 bp, Artificial Sequence
  dgRNA
  Lamtor4
catcgtctttcacat

SEQ ID NO: 46777 - DNA, 15 bp, Artificial Sequence
  dgRNA
  Lamtor4
ggatcggcccaaata

SEQ ID NO: 46778 - DNA, 15 bp, Artificial Sequence
  dgRNA
  Lamtor4
tgaaagacgatggtt

SEQ ID NO: 46779 - DNA, 15 bp, Artificial Sequence
  dgRNA
  Lamtor4
caatgtgaaagacga

SEQ ID NO: 46780 - DNA, 15 bp, Artificial Sequence
  dgRNA
  Olfr895
gtgttatacacaaga

SEQ ID NO: 46781 - DNA, 15 bp, Artificial Sequence
  dgRNA
  Olfr895
gattacatacaattt

SEQ ID NO: 46782 - DNA, 15 bp, Artificial Sequence
  dgRNA
  Olfr895
ttgtatgtaatctta

SEQ ID NO: 46783 - DNA, 15 bp, Artificial Sequence
  dgRNA
  Pttg1
gggtgagggcgtctt

SEQ ID NO: 46784 - DNA, 15 bp, Artificial Sequence
  dgRNA
  Pttg1
cgtcttgggcgagct

SEQ ID NO: 46785 - DNA, 15 bp, Artificial Sequence
  dgRNA
  Pttg1
gtcttgggcgagctt

SEQ ID NO: 46786 - DNA, 15 bp, Artificial Sequence
  dgRNA
  Pttg1
tcttgggcgagcttg

SEQ ID NO: 46787 - DNA, 15 bp, Artificial Sequence
  dgRNA
  Acvr2b
cgtcgccccatagcc

SEQ ID NO: 46788 - DNA, 15 bp, Artificial Sequence
  dgRNA
  Acvr2b
gtcgccccatagccc

SEQ ID NO: 46789 - DNA, 15 bp, Artificial Sequence
  dgRNA
  Acvr2b
tctccgcatactgcc

SEQ ID NO: 46790 - DNA, 15 bp, Artificial Sequence
  dgRNA
  Acvr2b
ctccgcatactgcct

SEQ ID NO: 46791 - DNA, 15 bp, Artificial Sequence
  dgRNA
  Adamdec1
cattggtctcaaagg

SEQ ID NO: 46792 - DNA, 15 bp, Artificial Sequence
  dgRNA
  Adamdec1
gtccgcaacacaatt

SEQ ID NO: 46793 - DNA, 15 bp, Artificial Sequence
  dgRNA
  Adamdec1
ttaagggctcacagc

SEQ ID NO: 46794 - DNA, 15 bp, Artificial Sequence
  dgRNA
  Adamdec1
ggggaggctcattaa

SEQ ID NO: 46795 - DNA, 15 bp, Artificial Sequence
  dgRNA
  Trappc3
tcacagtgccagtcg

SEQ ID NO: 46796 - DNA, 15 bp, Artificial Sequence
  dgRNA
  Trappc3
cacagtgccagtcgt

SEQ ID NO: 46797 - DNA, 15 bp, Artificial Sequence
  dgRNA
  Trappc3
acagtgccagtcgtg

SEQ ID NO: 46798 - DNA, 15 bp, Artificial Sequence
  dgRNA
  Trappc3
tgccagtcgtggggg

SEQ ID NO: 46799 - DNA, 15 bp, Artificial Sequence
  dgRNA
  Rhof
acacaacccaccttt

SEQ ID NO: 46800 - DNA, 15 bp, Artificial Sequence
  dgRNA
  Rhof
ttctccgaacgaccg

SEQ ID NO: 46801 - DNA, 15 bp, Artificial Sequence
  dgRNA
  Rhof
cgcggctacaacctg

SEQ ID NO: 46802 - DNA, 15 bp, Artificial Sequence
  dgRNA
  Rhof
gcggctacaacctgt

SEQ ID NO: 46803 - DNA, 15 bp, Artificial Sequence
  dgRNA
  Sp7
tctcgccttcctcat

SEQ ID NO: 46804 - DNA, 15 bp, Artificial Sequence
  dgRNA
  Sp7
cttcctcattggatc

SEQ ID NO: 46805 - DNA, 15 bp, Artificial Sequence
  dgRNA
  Sp7
cggagtcttctccgc

SEQ ID NO: 46806 - DNA, 15 bp, Artificial Sequence
  dgRNA
  Sp7
ggagtcttctccgct

SEQ ID NO: 46807 - DNA, 15 bp, Artificial Sequence
  dgRNA
  Vsig2
ttcagagattgcagg

SEQ ID NO: 46808 - DNA, 15 bp, Artificial Sequence
  dgRNA
  Vsig2
gattgcaggggggtt

SEQ ID NO: 46809 - DNA, 15 bp, Artificial Sequence
  dgRNA
  Vsig2
aagcttttcagccct

SEQ ID NO: 46810 - DNA, 15 bp, Artificial Sequence
  dgRNA
  Vsig2
gaggcgggcaccctc

SEQ ID NO: 46811 - DNA, 15 bp, Artificial Sequence
  dgRNA
  Rnaseh2c
atattagggctgggt

SEQ ID NO: 46812 - DNA, 15 bp, Artificial Sequence
  dgRNA
  Rnaseh2c
actacgtttcccata

SEQ ID NO: 46813 - DNA, 15 bp, Artificial Sequence
  dgRNA
  Rnaseh2c
gctcggtctcccgac

SEQ ID NO: 46814 - DNA, 15 bp, Artificial Sequence
  dgRNA
  Rnaseh2c
gccctaatattttta

SEQ ID NO: 46815 - DNA, 15 bp, Artificial Sequence
  dgRNA
  Asb1
agcggggttgcgtct

SEQ ID NO: 46816 - DNA, 15 bp, Artificial Sequence
  dgRNA
  Asb1
gcggggttgcgtctt

SEQ ID NO: 46817 - DNA, 15 bp, Artificial Sequence
  dgRNA
  Asb1
cggggttgcgtcttg

SEQ ID NO: 46818 - DNA, 15 bp, Artificial Sequence
  dgRNA
  Asb1
tgtcccttgggcgtc

SEQ ID NO: 46819 - DNA, 15 bp, Artificial Sequence
  dgRNA
  Mbp
cgcgcgccactggga

SEQ ID NO: 46820 - DNA, 15 bp, Artificial Sequence
  dgRNA
  Mbp
acgcgcgccactggg

SEQ ID NO: 46821 - DNA, 15 bp, Artificial Sequence
  dgRNA
  Mbp
taaacgcgcgccact

SEQ ID NO: 46822 - DNA, 15 bp, Artificial Sequence
  dgRNA
  Mbp
gtaaacgcgcgccac

SEQ ID NO: 46823 - DNA, 15 bp, Artificial Sequence
  dgRNA
  Aqp12
tgcagtacccctcgc

SEQ ID NO: 46824 - DNA, 15 bp, Artificial Sequence
  dgRNA
  Aqp12
agggtacctcagcct

SEQ ID NO: 46825 - DNA, 15 bp, Artificial Sequence
  dgRNA
  Aqp12
gggtacctcagcctg

SEQ ID NO: 46826 - DNA, 15 bp, Artificial Sequence
  dgRNA
  Aqp12
gggaagacgccaagc

SEQ ID NO: 46827 - DNA, 15 bp, Artificial Sequence
  dgRNA
  Ccdc148
ccgcccggccagtcc

SEQ ID NO: 46828 - DNA, 15 bp, Artificial Sequence
  dgRNA
  Ccdc148
gccagtcccggcacc

SEQ ID NO: 46829 - DNA, 15 bp, Artificial Sequence
  dgRNA
  Ccdc148
ccagtcccggcaccc

SEQ ID NO: 46830 - DNA, 15 bp, Artificial Sequence
  dgRNA
  Ccdc148
ctgccgtccccagac

SEQ ID NO: 46831 - DNA, 15 bp, Artificial Sequence
  dgRNA
  Tpt1
ccccgtagtccccgc

SEQ ID NO: 46832 - DNA, 15 bp, Artificial Sequence
  dgRNA
  Tpt1
ttctttccgagaaag

SEQ ID NO: 46833 - DNA, 15 bp, Artificial Sequence
  dgRNA
  Tpt1
tttccgagaaagggg

SEQ ID NO: 46834 - DNA, 15 bp, Artificial Sequence
  dgRNA
  Tpt1
ggaactgaagcggcg

SEQ ID NO: 46835 - DNA, 15 bp, Artificial Sequence
  dgRNA
  Cox8c
atacagcggagaagc

SEQ ID NO: 46836 - DNA, 15 bp, Artificial Sequence
  dgRNA
  Cox8c
cgcacactttaccaa

SEQ ID NO: 46837 - DNA, 15 bp, Artificial Sequence
  dgRNA
  Cox8c
gaaagggcgggcagc

SEQ ID NO: 46838 - DNA, 15 bp, Artificial Sequence
  dgRNA
  Cox8c
gcgcgaggaaagggc

SEQ ID NO: 46839 - DNA, 15 bp, Artificial Sequence
  dgRNA
  Sytl4
caaagatagactaga

SEQ ID NO: 46840 - DNA, 15 bp, Artificial Sequence
  dgRNA
  Sytl4
tagactagacggaaa

SEQ ID NO: 46841 - DNA, 15 bp, Artificial Sequence
  dgRNA
  Sytl4
agtgccttaaggctt

SEQ ID NO: 46842 - DNA, 15 bp, Artificial Sequence
  dgRNA
  Sytl4
ctctactgtactagt

SEQ ID NO: 46843 - DNA, 15 bp, Artificial Sequence
  dgRNA
  Cdh20
ccacggggtgccaac

SEQ ID NO: 46844 - DNA, 15 bp, Artificial Sequence
  dgRNA
  Cdh20
aggagcgcacattcc

SEQ ID NO: 46845 - DNA, 15 bp, Artificial Sequence
  dgRNA
  Cdh20
attcctggcaccaat

SEQ ID NO: 46846 - DNA, 15 bp, Artificial Sequence
  dgRNA
  Cdh20
gaatattcatgagcg

SEQ ID NO: 46847 - DNA, 15 bp, Artificial Sequence
  dgRNA
  Tas2r114
tgaacagcaatagat

SEQ ID NO: 46848 - DNA, 15 bp, Artificial Sequence
  dgRNA
  B4galnt2
gaaaagcctgggcgt

SEQ ID NO: 46849 - DNA, 15 bp, Artificial Sequence
  dgRNA
  B4galnt2
ctgggcgttggtcac

SEQ ID NO: 46850 - DNA, 15 bp, Artificial Sequence
  dgRNA
  B4galnt2
ggcgttggtcaccgg

SEQ ID NO: 46851 - DNA, 15 bp, Artificial Sequence
  dgRNA
  B4galnt2
gcgttggtcaccgga

SEQ ID NO: 46852 - DNA, 15 bp, Artificial Sequence
  dgRNA
  Cited2
ggtccggagacctgc

SEQ ID NO: 46853 - DNA, 15 bp, Artificial Sequence
  dgRNA
  Cited2
gtccggagacctgct

SEQ ID NO: 46854 - DNA, 15 bp, Artificial Sequence
  dgRNA
  Cited2
cctgctgggcggcgc

SEQ ID NO: 46855 - DNA, 15 bp, Artificial Sequence
  dgRNA
  Cited2
tgcgcacgtgcagcg

SEQ ID NO: 46856 - DNA, 15 bp, Artificial Sequence
  dgRNA
  Akap8l
ctccccttggcctat

SEQ ID NO: 46857 - DNA, 15 bp, Artificial Sequence
  dgRNA
  Akap8l
ttggcctattggcgc

SEQ ID NO: 46858 - DNA, 15 bp, Artificial Sequence
  dgRNA
  Akap8l
gtttttgttaacagg

SEQ ID NO: 46859 - DNA, 15 bp, Artificial Sequence
  dgRNA
  Akap8l
ggcggagagtaaggc

SEQ ID NO: 46860 - DNA, 15 bp, Artificial Sequence
  dgRNA
  Cyp2a12
tccatgttaggagat

SEQ ID NO: 46861 - DNA, 15 bp, Artificial Sequence
  dgRNA
  Cyp2a12
ctaaaagactcaact

SEQ ID NO: 46862 - DNA, 15 bp, Artificial Sequence
  dgRNA
  Cyp2a12
tccctgggagtataa

SEQ ID NO: 46863 - DNA, 15 bp, Artificial Sequence
  dgRNA
  Cyp2a12
gtagtatctcagcct

SEQ ID NO: 46864 - DNA, 15 bp, Artificial Sequence
  dgRNA
  Hdlbp
tggtggcctcaactc

SEQ ID NO: 46865 - DNA, 15 bp, Artificial Sequence
  dgRNA
  Hdlbp
caactctggcacctc

SEQ ID NO: 46866 - DNA, 15 bp, Artificial Sequence
  dgRNA
  Hdlbp
tcctcgccccctgtc

SEQ ID NO: 46867 - DNA, 15 bp, Artificial Sequence
  dgRNA
  Hdlbp
gagttggtccgctcc

SEQ ID NO: 46868 - DNA, 15 bp, Artificial Sequence
  dgRNA
  Rnf222
cctctgattcagccc

SEQ ID NO: 46869 - DNA, 15 bp, Artificial Sequence
  dgRNA
  Rnf222
ctctgattcagccca

SEQ ID NO: 46870 - DNA, 15 bp, Artificial Sequence
  dgRNA
  Rnf222
tggcctcaaacgggt

SEQ ID NO: 46871 - DNA, 15 bp, Artificial Sequence
  dgRNA
  Rnf222
ggcctcaaacgggtt

SEQ ID NO: 46872 - DNA, 15 bp, Artificial Sequence
  dgRNA
  Ush1g
ctatattgggcttca

SEQ ID NO: 46873 - DNA, 15 bp, Artificial Sequence
  dgRNA
  Ush1g
tatattgggcttcaa

SEQ ID NO: 46874 - DNA, 15 bp, Artificial Sequence
  dgRNA
  Ush1g
gctgcaacgccagag

SEQ ID NO: 46875 - DNA, 15 bp, Artificial Sequence
  dgRNA
  Ush1g
ctgcaacgccagagt

SEQ ID NO: 46876 - DNA, 15 bp, Artificial Sequence
  dgRNA
  Leprot
gtgtgaggttgtaat

SEQ ID NO: 46877 - DNA, 15 bp, Artificial Sequence
  dgRNA
  Leprot
cgggaagccacggga

SEQ ID NO: 46878 - DNA, 15 bp, Artificial Sequence
  dgRNA
  Leprot
gggaagccacgggat

SEQ ID NO: 46879 - DNA, 15 bp, Artificial Sequence
  dgRNA
  Leprot
gcggagtctaaaatc

SEQ ID NO: 46880 - DNA, 15 bp, Artificial Sequence
  dgRNA
  Nr2c2ap
catccacggcgagca

SEQ ID NO: 46881 - DNA, 15 bp, Artificial Sequence
  dgRNA
  Nr2c2ap
ccctttaagaggcga

SEQ ID NO: 46882 - DNA, 15 bp, Artificial Sequence
  dgRNA
  Nr2c2ap
cctttaagaggcgaa

SEQ ID NO: 46883 - DNA, 15 bp, Artificial Sequence
  dgRNA
  Nr2c2ap
ctttaagaggcgaag

SEQ ID NO: 46884 - DNA, 15 bp, Artificial Sequence
  dgRNA
  Trmt44
tacattcagtcgttg

SEQ ID NO: 46885 - DNA, 15 bp, Artificial Sequence
  dgRNA
  Trmt44
gtcgttgaggacccc

SEQ ID NO: 46886 - DNA, 15 bp, Artificial Sequence
  dgRNA
  Trmt44
gttgaggaccccagg

SEQ ID NO: 46887 - DNA, 15 bp, Artificial Sequence
  dgRNA
  Trmt44
ctcctcccgcgtccc

SEQ ID NO: 46888 - DNA, 15 bp, Artificial Sequence
  dgRNA
  P2rx7
ccccgctgcagtcac

SEQ ID NO: 46889 - DNA, 15 bp, Artificial Sequence
  dgRNA
  P2rx7
cgctgcagtcactgg

SEQ ID NO: 46890 - DNA, 15 bp, Artificial Sequence
  dgRNA
  P2rx7
cagtgactgcagcgg

SEQ ID NO: 46891 - DNA, 15 bp, Artificial Sequence
  dgRNA
  P2rx7
ccagtgactgcagcg

SEQ ID NO: 46892 - DNA, 15 bp, Artificial Sequence
  dgRNA
  Abcc10
agctcaaaggcgctt

SEQ ID NO: 46893 - DNA, 15 bp, Artificial Sequence
  dgRNA
  Abcc10
ccaagtgcgggagac

SEQ ID NO: 46894 - DNA, 15 bp, Artificial Sequence
  dgRNA
  Abcc10
gtgaacgtaagtacc

SEQ ID NO: 46895 - DNA, 15 bp, Artificial Sequence
  dgRNA
  Abcc10
aaactggcctgcccc

SEQ ID NO: 46896 - DNA, 15 bp, Artificial Sequence
  dgRNA
  Hnrnpdl
cttcagcaagcggcg

SEQ ID NO: 46897 - DNA, 15 bp, Artificial Sequence
  dgRNA
  Hnrnpdl
ttcagcaagcggcgc

SEQ ID NO: 46898 - DNA, 15 bp, Artificial Sequence
  dgRNA
  Hnrnpdl
acgccgcccttttgc

SEQ ID NO: 46899 - DNA, 15 bp, Artificial Sequence
  dgRNA
  Hnrnpdl
gcccttttgccggag

SEQ ID NO: 46900 - DNA, 15 bp, Artificial Sequence
  dgRNA
  Ccdc186
gccccttaactagag

SEQ ID NO: 46901 - DNA, 15 bp, Artificial Sequence
  dgRNA
  Ccdc186
actagagaggccagc

SEQ ID NO: 46902 - DNA, 15 bp, Artificial Sequence
  dgRNA
  Ccdc186
aagagggggtcacta

SEQ ID NO: 46903 - DNA, 15 bp, Artificial Sequence
  dgRNA
  Ccdc186
ctacggtgaccccac

SEQ ID NO: 46904 - DNA, 15 bp, Artificial Sequence
  dgRNA
  Arl6ip4
agcccgcgggctcgc

SEQ ID NO: 46905 - DNA, 15 bp, Artificial Sequence
  dgRNA
  Arl6ip4
ccgcgggctcgcagg

SEQ ID NO: 46906 - DNA, 15 bp, Artificial Sequence
  dgRNA
  Arl6ip4
cgtcccctgccaacg

SEQ ID NO: 46907 - DNA, 15 bp, Artificial Sequence
  dgRNA
  Arl6ip4
cccctgccaacgcgg

SEQ ID NO: 46908 - DNA, 15 bp, Artificial Sequence
  dgRNA
  Srms
cgtgcccagctagcc

SEQ ID NO: 46909 - DNA, 15 bp, Artificial Sequence
  dgRNA
  Srms
ctagcccggcaaagc

SEQ ID NO: 46910 - DNA, 15 bp, Artificial Sequence
  dgRNA
  Srms
acctgcgtctgttag

SEQ ID NO: 46911 - DNA, 15 bp, Artificial Sequence
  dgRNA
  Srms
cctgcgtctgttagt

SEQ ID NO: 46912 - DNA, 15 bp, Artificial Sequence
  dgRNA
  Krtap9-5
gtgtaaacaacatca

SEQ ID NO: 46913 - DNA, 15 bp, Artificial Sequence
  dgRNA
  Krtap9-5
caaaccttggaggtc

SEQ ID NO: 46914 - DNA, 15 bp, Artificial Sequence
  dgRNA
  Krtap9-5
gtctggcatataaaa

SEQ ID NO: 46915 - DNA, 15 bp, Artificial Sequence
  dgRNA
  Krtap9-5
aactcatcatattgt

SEQ ID NO: 46916 - DNA, 15 bp, Artificial Sequence
  dgRNA
  Ift140
ctattcgaagcgata

SEQ ID NO: 46917 - DNA, 15 bp, Artificial Sequence
  dgRNA
  Ift140
agtatcccagtttgc

SEQ ID NO: 46918 - DNA, 15 bp, Artificial Sequence
  dgRNA
  Ift140
ggaggtccccgcctc

SEQ ID NO: 46919 - DNA, 15 bp, Artificial Sequence
  dgRNA
  Ift140
ctctggttatcccct

SEQ ID NO: 46920 - DNA, 15 bp, Artificial Sequence
  dgRNA
  Kazn
aaccattggatgctc

SEQ ID NO: 46921 - DNA, 15 bp, Artificial Sequence
  dgRNA
  Kazn
gatgctcgggagtgt

SEQ ID NO: 46922 - DNA, 15 bp, Artificial Sequence
  dgRNA
  Kazn
gaactggacggagcc

SEQ ID NO: 46923 - DNA, 15 bp, Artificial Sequence
  dgRNA
  Kazn
aactggacggagcct

SEQ ID NO: 46924 - DNA, 15 bp, Artificial Sequence
  dgRNA
  Eif4e2
acggggaggttaaag

SEQ ID NO: 46925 - DNA, 15 bp, Artificial Sequence
  dgRNA
  Eif4e2
caagacagccccggt

SEQ ID NO: 46926 - DNA, 15 bp, Artificial Sequence
  dgRNA
  Eif4e2
caagcgctgtcgtcc

SEQ ID NO: 46927 - DNA, 15 bp, Artificial Sequence
  dgRNA
  Eif4e2
aagcgctgtcgtccc

SEQ ID NO: 46928 - DNA, 15 bp, Artificial Sequence
  dgRNA
  Tns4
cagttaggacacctc

SEQ ID NO: 46929 - DNA, 15 bp, Artificial Sequence
  dgRNA
  Tns4
agttaggacacctct

SEQ ID NO: 46930 - DNA, 15 bp, Artificial Sequence
  dgRNA
  Tns4
gttaggacacctctg

SEQ ID NO: 46931 - DNA, 15 bp, Artificial Sequence
  dgRNA
  Tns4
gacacctctggggcg

SEQ ID NO: 46932 - DNA, 15 bp, Artificial Sequence
  dgRNA
  Enpp6
gaggtagtcggtctc

SEQ ID NO: 46933 - DNA, 15 bp, Artificial Sequence
  dgRNA
  Enpp6
aggtagtcggtctct

SEQ ID NO: 46934 - DNA, 15 bp, Artificial Sequence
  dgRNA
  Enpp6
acctctagatagggc

SEQ ID NO: 46935 - DNA, 15 bp, Artificial Sequence
  dgRNA
  Enpp6
cgactacctctagat

SEQ ID NO: 46936 - DNA, 15 bp, Artificial Sequence
  dgRNA
  Nolc1
agcaaaggtaatgcg

SEQ ID NO: 46937 - DNA, 15 bp, Artificial Sequence
  dgRNA
  Nolc1
gcaaaggtaatgcgc

SEQ ID NO: 46938 - DNA, 15 bp, Artificial Sequence
  dgRNA
  Nolc1
caagttttcccgcct

SEQ ID NO: 46939 - DNA, 15 bp, Artificial Sequence
  dgRNA
  Nolc1
tttcccgcctcggac

SEQ ID NO: 46940 - DNA, 15 bp, Artificial Sequence
  dgRNA
  Slc25a45
gtggtctcactaaaa

SEQ ID NO: 46941 - DNA, 15 bp, Artificial Sequence
  dgRNA
  Slc25a45
tcagccctagcttga

SEQ ID NO: 46942 - DNA, 15 bp, Artificial Sequence
  dgRNA
  Slc25a45
gccctagcttgaagg

SEQ ID NO: 46943 - DNA, 15 bp, Artificial Sequence
  dgRNA
  Slc25a45
agcaatgccggcatt

SEQ ID NO: 46944 - DNA, 15 bp, Artificial Sequence
  dgRNA
  Ankle1
aatttgaactgcaga

SEQ ID NO: 46945 - DNA, 15 bp, Artificial Sequence
  dgRNA
  Ankle1
cagttcaaattcgcg

SEQ ID NO: 46946 - DNA, 15 bp, Artificial Sequence
  dgRNA
  Olfr1
gtatagtaatgttat

SEQ ID NO: 46947 - DNA, 15 bp, Artificial Sequence
  dgRNA
  Olfr1
aaactggtcctacag

SEQ ID NO: 46948 - DNA, 15 bp, Artificial Sequence
  dgRNA
  Olfr1
gttactggactcctc

SEQ ID NO: 46949 - DNA, 15 bp, Artificial Sequence
  dgRNA
  Olfr1
actatacttaaggga

SEQ ID NO: 46950 - DNA, 15 bp, Artificial Sequence
  dgRNA
  Ccdc81
acattctaaagtggc

SEQ ID NO: 46951 - DNA, 15 bp, Artificial Sequence
  dgRNA
  Ccdc81
attctcttagggggc

SEQ ID NO: 46952 - DNA, 15 bp, Artificial Sequence
  dgRNA
  Ccdc81
ttctcttagggggcc

SEQ ID NO: 46953 - DNA, 15 bp, Artificial Sequence
  dgRNA
  Ccdc81
gttgctagggcctca

SEQ ID NO: 46954 - DNA, 15 bp, Artificial Sequence
  dgRNA
  AW551984
gtgggcgtgttttcc

SEQ ID NO: 46955 - DNA, 15 bp, Artificial Sequence
  dgRNA
  AW551984
agcaccgggatttct

SEQ ID NO: 46956 - DNA, 15 bp, Artificial Sequence
  dgRNA
  AW551984
gcaccgggatttctg

SEQ ID NO: 46957 - DNA, 15 bp, Artificial Sequence
  dgRNA
  AW551984
cggctccacttattc

SEQ ID NO: 46958 - DNA, 15 bp, Artificial Sequence
  dgRNA
  Tmem240
ggagaacctcgcccc

SEQ ID NO: 46959 - DNA, 15 bp, Artificial Sequence
  dgRNA
  Tmem240
ctcgcccctggatgc

SEQ ID NO: 46960 - DNA, 15 bp, Artificial Sequence
  dgRNA
  Tmem240
ctggatgctggcgcg

SEQ ID NO: 46961 - DNA, 15 bp, Artificial Sequence
  dgRNA
  Tmem240
gatgctggcgcgggg

SEQ ID NO: 46962 - DNA, 15 bp, Artificial Sequence
  dgRNA
  Spink4
atgaagagattaacg

SEQ ID NO: 46963 - DNA, 15 bp, Artificial Sequence
  dgRNA
  Spink4
atcagcacaataaat

SEQ ID NO: 46964 - DNA, 15 bp, Artificial Sequence
  dgRNA
  Spink4
taacgctgggcccta

SEQ ID NO: 46965 - DNA, 15 bp, Artificial Sequence
  dgRNA
  Spink4
ataacgctgggccct

SEQ ID NO: 46966 - DNA, 15 bp, Artificial Sequence
  dgRNA
  Rbm18
gacgtcttaagcatc

SEQ ID NO: 46967 - DNA, 15 bp, Artificial Sequence
  dgRNA
  Rbm18
tcggctgagtgacaa

SEQ ID NO: 46968 - DNA, 15 bp, Artificial Sequence
  dgRNA
  Rbm18
tagaagtcccgcccc

SEQ ID NO: 46969 - DNA, 15 bp, Artificial Sequence
  dgRNA
  Rbm18
ccgcccccggcctta

SEQ ID NO: 46970 - DNA, 15 bp, Artificial Sequence
  dgRNA
  Brpf1
ccacttagaacatgg

SEQ ID NO: 46971 - DNA, 15 bp, Artificial Sequence
  dgRNA
  Brpf1
tctggacaccttaaa

SEQ ID NO: 46972 - DNA, 15 bp, Artificial Sequence
  dgRNA
  Brpf1
ctctggacaccttaa

SEQ ID NO: 46973 - DNA, 15 bp, Artificial Sequence
  dgRNA
  Teddm2
ttcgttgtttgtcaa

SEQ ID NO: 46974 - DNA, 15 bp, Artificial Sequence
  dgRNA
  Teddm2
tcgttgtttgtcaat

SEQ ID NO: 46975 - DNA, 15 bp, Artificial Sequence
  dgRNA
  Teddm2
ttgtcaatgggtagc

SEQ ID NO: 46976 - DNA, 15 bp, Artificial Sequence
  dgRNA
  Teddm2
accccaccctaagtt

SEQ ID NO: 46977 - DNA, 15 bp, Artificial Sequence
  dgRNA
  Sp9
gcccgcagacttgac

SEQ ID NO: 46978 - DNA, 15 bp, Artificial Sequence
  dgRNA
  Sp9
tgactggcacgcgcc

SEQ ID NO: 46979 - DNA, 15 bp, Artificial Sequence
  dgRNA
  Sp9
cacgcgccaggagcc

SEQ ID NO: 46980 - DNA, 15 bp, Artificial Sequence
  dgRNA
  Sp9
acgcgccaggagccc

SEQ ID NO: 46981 - DNA, 15 bp, Artificial Sequence
  dgRNA
  Tbxa2r
tggttcccaccctag

SEQ ID NO: 46982 - DNA, 15 bp, Artificial Sequence
  dgRNA
  Tbxa2r
accctagcggctgag

SEQ ID NO: 46983 - DNA, 15 bp, Artificial Sequence
  dgRNA
  Tbxa2r
agcggctgagaggcg

SEQ ID NO: 46984 - DNA, 15 bp, Artificial Sequence
  dgRNA
  Tbxa2r
ccagcgccagcgcag

SEQ ID NO: 46985 - DNA, 15 bp, Artificial Sequence
  dgRNA
  Brcc3
acccgctcttctccc

SEQ ID NO: 46986 - DNA, 15 bp, Artificial Sequence
  dgRNA
  Brcc3
ccgcgctgttcttcc

SEQ ID NO: 46987 - DNA, 15 bp, Artificial Sequence
  dgRNA
  Brcc3
cgcgctgttcttcca

SEQ ID NO: 46988 - DNA, 15 bp, Artificial Sequence
  dgRNA
  Brcc3
cgccggggcggacgt

SEQ ID NO: 46989 - DNA, 15 bp, Artificial Sequence
  dgRNA
  Slc39a8
ctagggatcccaccg

SEQ ID NO: 46990 - DNA, 15 bp, Artificial Sequence
  dgRNA
  Slc39a8
gggatcccaccgtgg

SEQ ID NO: 46991 - DNA, 15 bp, Artificial Sequence
  dgRNA
  Slc39a8
tcccaccgtggaggt

SEQ ID NO: 46992 - DNA, 15 bp, Artificial Sequence
  dgRNA
  Slc39a8
aggcaccacagcggc

SEQ ID NO: 46993 - DNA, 15 bp, Artificial Sequence
  dgRNA
  Gmip
acatccccggcttgc

SEQ ID NO: 46994 - DNA, 15 bp, Artificial Sequence
  dgRNA
  Gmip
ctggaagagtgctac

SEQ ID NO: 46995 - DNA, 15 bp, Artificial Sequence
  dgRNA
  Gmip
tggaagagtgctaca

SEQ ID NO: 46996 - DNA, 15 bp, Artificial Sequence
  dgRNA
  Gmip
gtgctacagggactt

SEQ ID NO: 46997 - DNA, 15 bp, Artificial Sequence
  dgRNA
  Capns2
ggtagcattctaatg

SEQ ID NO: 46998 - DNA, 15 bp, Artificial Sequence
  dgRNA
  Capns2
aacatgacagttgct

SEQ ID NO: 46999 - DNA, 15 bp, Artificial Sequence
  dgRNA
  Capns2
ggtacccttctagac

SEQ ID NO: 47000 - DNA, 15 bp, Artificial Sequence
  dgRNA
  Capns2
ctaccttaaatagaa

SEQ ID NO: 47001 - DNA, 15 bp, Artificial Sequence
  dgRNA
  Fam65c
ctttacctcgaaatg

SEQ ID NO: 47002 - DNA, 15 bp, Artificial Sequence
  dgRNA
  Fam65c
ttgcagggttctgat

SEQ ID NO: 47003 - DNA, 15 bp, Artificial Sequence
  dgRNA
  Fam65c
ctaaatttagcatgg

SEQ ID NO: 47004 - DNA, 15 bp, Artificial Sequence
  dgRNA
  Fam65c
tggctaaatttagca

SEQ ID NO: 47005 - DNA, 15 bp, Artificial Sequence
  dgRNA
  Nwd2
ccaactttgccacct

SEQ ID NO: 47006 - DNA, 15 bp, Artificial Sequence
  dgRNA
  Nwd2
gcactttgccagaag

SEQ ID NO: 47007 - DNA, 15 bp, Artificial Sequence
  dgRNA
  Nwd2
cactttgccagaagt

SEQ ID NO: 47008 - DNA, 15 bp, Artificial Sequence
  dgRNA
  Nwd2
ttggctcaaggttgt

SEQ ID NO: 47009 - DNA, 15 bp, Artificial Sequence
  dgRNA
  Etnk2
ccagtactaggatac

SEQ ID NO: 47010 - DNA, 15 bp, Artificial Sequence
  dgRNA
  Etnk2
ccctttgcgtcatta

SEQ ID NO: 47011 - DNA, 15 bp, Artificial Sequence
  dgRNA
  Etnk2
tttgcgtcattaagg

SEQ ID NO: 47012 - DNA, 15 bp, Artificial Sequence
  dgRNA
  Etnk2
ttgcgtcattaaggc

SEQ ID NO: 47013 - DNA, 15 bp, Artificial Sequence
  dgRNA
  Gdpgp1
cttagcgccgctcag

SEQ ID NO: 47014 - DNA, 15 bp, Artificial Sequence
  dgRNA
  Gdpgp1
ttagcgccgctcagc

SEQ ID NO: 47015 - DNA, 15 bp, Artificial Sequence
  dgRNA
  Gdpgp1
cgccgctcagcgggc

SEQ ID NO: 47016 - DNA, 15 bp, Artificial Sequence
  dgRNA
  Gdpgp1
cagcgggccggctcc

SEQ ID NO: 47017 - DNA, 15 bp, Artificial Sequence
  dgRNA
  Larp7
tgacgtcatcaagca

SEQ ID NO: 47018 - DNA, 15 bp, Artificial Sequence
  dgRNA
  Larp7
gcagggacggtaccg

SEQ ID NO: 47019 - DNA, 15 bp, Artificial Sequence
  dgRNA
  Larp7
gggacggtaccgcgg

SEQ ID NO: 47020 - DNA, 15 bp, Artificial Sequence
  dgRNA
  Larp7
ttcgcaaaccaccaa

SEQ ID NO: 47021 - DNA, 15 bp, Artificial Sequence
  dgRNA
  Csde1
tattcacgacactcc

SEQ ID NO: 47022 - DNA, 15 bp, Artificial Sequence
  dgRNA
  Csde1
gtcgctgaaagcttt

SEQ ID NO: 47023 - DNA, 15 bp, Artificial Sequence
  dgRNA
  Csde1
tcgctgaaagctttc

SEQ ID NO: 47024 - DNA, 15 bp, Artificial Sequence
  dgRNA
  Csde1
cgggctcgcgaacac

SEQ ID NO: 47025 - DNA, 15 bp, Artificial Sequence
  dgRNA
  Rpap1
gaagccgaactctag

SEQ ID NO: 47026 - DNA, 15 bp, Artificial Sequence
  dgRNA
  Rpap1
gccgcctctagagtt

SEQ ID NO: 47027 - DNA, 15 bp, Artificial Sequence
  dgRNA
  Fzd6
ggagccttagccgcg

SEQ ID NO: 47028 - DNA, 15 bp, Artificial Sequence
  dgRNA
  Fzd6
aggagccttagccgc

SEQ ID NO: 47029 - DNA, 15 bp, Artificial Sequence
  dgRNA
  Fzd6
gaggagccttagccg

SEQ ID NO: 47030 - DNA, 15 bp, Artificial Sequence
  dgRNA
  Tmc4
gaagtttggccgctc

SEQ ID NO: 47031 - DNA, 15 bp, Artificial Sequence
  dgRNA
  Tmc4
gtttggccgctcagg

SEQ ID NO: 47032 - DNA, 15 bp, Artificial Sequence
  dgRNA
  Tmc4
ccaggagacctttat

SEQ ID NO: 47033 - DNA, 15 bp, Artificial Sequence
  dgRNA
  Tmc4
tgtaccgcagtcacc

SEQ ID NO: 47034 - DNA, 15 bp, Artificial Sequence
  dgRNA
  Lef1
gaaagggtggtttcg

SEQ ID NO: 47035 - DNA, 15 bp, Artificial Sequence
  dgRNA
  Lef1
aaagggtggtttcgg

SEQ ID NO: 47036 - DNA, 15 bp, Artificial Sequence
  dgRNA
  Lef1
ggtggtttcgggggc

SEQ ID NO: 47037 - DNA, 15 bp, Artificial Sequence
  dgRNA
  Lef1
gtggtttcgggggcg

SEQ ID NO: 47038 - DNA, 15 bp, Artificial Sequence
  dgRNA
  Prdm2
gcgggcttcccttcg

SEQ ID NO: 47039 - DNA, 15 bp, Artificial Sequence
  dgRNA
  Prdm2
gaggtaataacgctc

SEQ ID NO: 47040 - DNA, 15 bp, Artificial Sequence
  dgRNA
  Prdm2
aggtaataacgctct

SEQ ID NO: 47041 - DNA, 15 bp, Artificial Sequence
  dgRNA
  Prdm2
ggtaataacgctctg

SEQ ID NO: 47042 - DNA, 15 bp, Artificial Sequence
  dgRNA
  Fam83h
ccaggcaaaccagtc

SEQ ID NO: 47043 - DNA, 15 bp, Artificial Sequence
  dgRNA
  Fam83h
tgtgagtcagcgggc

SEQ ID NO: 47044 - DNA, 15 bp, Artificial Sequence
  dgRNA
  Fam83h
gtgagtcagcgggct

SEQ ID NO: 47045 - DNA, 15 bp, Artificial Sequence
  dgRNA
  Fam83h
ccagactggtttgcc

SEQ ID NO: 47046 - DNA, 15 bp, Artificial Sequence
  dgRNA
  Chd7
ccgagcacgagttgc

SEQ ID NO: 47047 - DNA, 15 bp, Artificial Sequence
  dgRNA
  Chd7
tgcgttcgagagaaa

SEQ ID NO: 47048 - DNA, 15 bp, Artificial Sequence
  dgRNA
  Chd7
gcgttcgagagaaaa

SEQ ID NO: 47049 - DNA, 15 bp, Artificial Sequence
  dgRNA
  Chd7
gttgggttccaactc

SEQ ID NO: 47050 - DNA, 15 bp, Artificial Sequence
  dgRNA
  Lum
gtaatccaagagggg

SEQ ID NO: 47051 - DNA, 15 bp, Artificial Sequence
  dgRNA
  Lum
tttggccacccctct

SEQ ID NO: 47052 - DNA, 15 bp, Artificial Sequence
  dgRNA
  Lum
aatgagcacacgcaa

SEQ ID NO: 47053 - DNA, 15 bp, Artificial Sequence
  dgRNA
  Vkorc1l1
ctccacacttatgag

SEQ ID NO: 47054 - DNA, 15 bp, Artificial Sequence
  dgRNA
  Vkorc1l1
gctccgccccaattc

SEQ ID NO: 47055 - DNA, 15 bp, Artificial Sequence
  dgRNA
  Vkorc1l1
cgcgcaacagcgggg

SEQ ID NO: 47056 - DNA, 15 bp, Artificial Sequence
  dgRNA
  Vkorc1l1
gagcgcgcaacagcg

SEQ ID NO: 47057 - DNA, 15 bp, Artificial Sequence
  dgRNA
  Akt2
agctcctcagtgaac

SEQ ID NO: 47058 - DNA, 15 bp, Artificial Sequence
  dgRNA
  Akt2
gaatttcatcaccac

SEQ ID NO: 47059 - DNA, 15 bp, Artificial Sequence
  dgRNA
  Akt2
gcgtcacagacacct

SEQ ID NO: 47060 - DNA, 15 bp, Artificial Sequence
  dgRNA
  Akt2
cagacacctcggctg

SEQ ID NO: 47061 - DNA, 15 bp, Artificial Sequence
  dgRNA
  St6galnac6
ctcgctcggccctaa

SEQ ID NO: 47062 - DNA, 15 bp, Artificial Sequence
  dgRNA
  St6galnac6
tcgctcggccctaac

SEQ ID NO: 47063 - DNA, 15 bp, Artificial Sequence
  dgRNA
  St6galnac6
cgggactgcgagcgc

SEQ ID NO: 47064 - DNA, 15 bp, Artificial Sequence
  dgRNA
  St6galnac6
gcgagcgccggcgct

SEQ ID NO: 47065 - DNA, 15 bp, Artificial Sequence
  dgRNA
  Ppp1r32
cttgtccaggcagcg

SEQ ID NO: 47066 - DNA, 15 bp, Artificial Sequence
  dgRNA
  Ppp1r32
ggtcagcccctcagt

SEQ ID NO: 47067 - DNA, 15 bp, Artificial Sequence
  dgRNA
  Ppp1r32
ggcatagcacaaatt

SEQ ID NO: 47068 - DNA, 15 bp, Artificial Sequence
  dgRNA
  Ppp1r32
accatggcccactga

SEQ ID NO: 47069 - DNA, 15 bp, Artificial Sequence
  dgRNA
  Rgs6
gccttatcatgagcc

SEQ ID NO: 47070 - DNA, 15 bp, Artificial Sequence
  dgRNA
  Rgs6
gagccgggcgccagc

SEQ ID NO: 47071 - DNA, 15 bp, Artificial Sequence
  dgRNA
  Rgs6
agccgggcgccagcc

SEQ ID NO: 47072 - DNA, 15 bp, Artificial Sequence
  dgRNA
  Rgs6
cgccagccgggcttt

SEQ ID NO: 47073 - DNA, 15 bp, Artificial Sequence
  dgRNA
  Adcy7
cacatctgttcgttt

SEQ ID NO: 47074 - DNA, 15 bp, Artificial Sequence
  dgRNA
  Adcy7
caacataccgtgacc

SEQ ID NO: 47075 - DNA, 15 bp, Artificial Sequence
  dgRNA
  Adcy7
aacataccgtgacct

SEQ ID NO: 47076 - DNA, 15 bp, Artificial Sequence
  dgRNA
  Adcy7
ggcctggccaacatc

SEQ ID NO: 47077 - DNA, 15 bp, Artificial Sequence
  dgRNA
  Rnls
tttataggcctcttc

SEQ ID NO: 47078 - DNA, 15 bp, Artificial Sequence
  dgRNA
  Fundc2
ctctgcgcaagtgtg

SEQ ID NO: 47079 - DNA, 15 bp, Artificial Sequence
  dgRNA
  Fundc2
atgtctaatgggacc

SEQ ID NO: 47080 - DNA, 15 bp, Artificial Sequence
  dgRNA
  Fundc2
tgtctccgactgcca

SEQ ID NO: 47081 - DNA, 15 bp, Artificial Sequence
  dgRNA
  Fundc2
cgactgccaagggac

SEQ ID NO: 47082 - DNA, 15 bp, Artificial Sequence
  dgRNA
  Dnaja3
agcacttgtacacgt

SEQ ID NO: 47083 - DNA, 15 bp, Artificial Sequence
  dgRNA
  Dnaja3
tgtacacgttggcct

SEQ ID NO: 47084 - DNA, 15 bp, Artificial Sequence
  dgRNA
  Dnaja3
ctaggttctaccgtt

SEQ ID NO: 47085 - DNA, 15 bp, Artificial Sequence
  dgRNA
  Dnaja3
accgttcggagaccg

SEQ ID NO: 47086 - DNA, 15 bp, Artificial Sequence
  dgRNA
  Ginm1
atctcaaactcccgg

SEQ ID NO: 47087 - DNA, 15 bp, Artificial Sequence
  dgRNA
  Ginm1
ggacgctcacaaagt

SEQ ID NO: 47088 - DNA, 15 bp, Artificial Sequence
  dgRNA
  Ginm1
gcccatagacgtcaa

SEQ ID NO: 47089 - DNA, 15 bp, Artificial Sequence
  dgRNA
  Ginm1
tcgacccgccccatt

SEQ ID NO: 47090 - DNA, 15 bp, Artificial Sequence
  dgRNA
  Exo5
tgaccgtcctctcac

SEQ ID NO: 47091 - DNA, 15 bp, Artificial Sequence
  dgRNA
  Exo5
gaccgtcctctcacc

SEQ ID NO: 47092 - DNA, 15 bp, Artificial Sequence
  dgRNA
  Exo5
cgtcctctcaccggg

SEQ ID NO: 47093 - DNA, 15 bp, Artificial Sequence
  dgRNA
  Exo5
gtcctctcaccgggc

SEQ ID NO: 47094 - DNA, 15 bp, Artificial Sequence
  dgRNA
  Chat
cctcacgtgccatct

SEQ ID NO: 47095 - DNA, 15 bp, Artificial Sequence
  dgRNA
  Chat
ctcacgtgccatcta

SEQ ID NO: 47096 - DNA, 15 bp, Artificial Sequence
  dgRNA
  Chat
ctgggcccaacgcat

SEQ ID NO: 47097 - DNA, 15 bp, Artificial Sequence
  dgRNA
  Chat
tgtcgcctgcaaatc

SEQ ID NO: 47098 - DNA, 15 bp, Artificial Sequence
  dgRNA
  Dnajc19
attccgcccaccccg

SEQ ID NO: 47099 - DNA, 15 bp, Artificial Sequence
  dgRNA
  Mrgprx2
acttaggagtcatgg

SEQ ID NO: 47100 - DNA, 15 bp, Artificial Sequence
  dgRNA
  Mrgprx2
ctggactaacttaat

SEQ ID NO: 47101 - DNA, 15 bp, Artificial Sequence
  dgRNA
  Mrgprx2
atttggcatgaccag

SEQ ID NO: 47102 - DNA, 15 bp, Artificial Sequence
  dgRNA
  Mrgprx2
tcccttccctattag

SEQ ID NO: 47103 - DNA, 15 bp, Artificial Sequence
  dgRNA
  Tlr11
gagaactgaaacgta

SEQ ID NO: 47104 - DNA, 15 bp, Artificial Sequence
  dgRNA
  Tlr11
cgtatggagtgtact

SEQ ID NO: 47105 - DNA, 15 bp, Artificial Sequence
  dgRNA
  Tlr11
tattggtgataggtg

SEQ ID NO: 47106 - DNA, 15 bp, Artificial Sequence
  dgRNA
  Tlr11
ttattggtgataggt

SEQ ID NO: 47107 - DNA, 15 bp, Artificial Sequence
  dgRNA
  Lyar
acccgcgccaaccca

SEQ ID NO: 47108 - DNA, 15 bp, Artificial Sequence
  dgRNA
  Lyar
cccgcgccaacccac

SEQ ID NO: 47109 - DNA, 15 bp, Artificial Sequence
  dgRNA
  Lyar
gggagtcgagtgtcc

SEQ ID NO: 47110 - DNA, 15 bp, Artificial Sequence
  dgRNA
  Lyar
ggagtcgagtgtccc

SEQ ID NO: 47111 - DNA, 15 bp, Artificial Sequence
  dgRNA
  Anks1b
cggagcatcctgctc

SEQ ID NO: 47112 - DNA, 15 bp, Artificial Sequence
  dgRNA
  Anks1b
ggagcatcctgctca

SEQ ID NO: 47113 - DNA, 15 bp, Artificial Sequence
  dgRNA
  Anks1b
ttcctcggcagcgcc

SEQ ID NO: 47114 - DNA, 15 bp, Artificial Sequence
  dgRNA
  Anks1b
tcctcggcagcgccc

SEQ ID NO: 47115 - DNA, 15 bp, Artificial Sequence
  dgRNA
  Ctsa
cagccatactccagc

SEQ ID NO: 47116 - DNA, 15 bp, Artificial Sequence
  dgRNA
  Ctsa
ccagacgcacgctct

SEQ ID NO: 47117 - DNA, 15 bp, Artificial Sequence
  dgRNA
  Ctsa
gacgcacgctcttgg

SEQ ID NO: 47118 - DNA, 15 bp, Artificial Sequence
  dgRNA
  Ctsa
tctaccacagcgtag

SEQ ID NO: 47119 - DNA, 15 bp, Artificial Sequence
  dgRNA
  Nek11
cttccgcccgaccgc

SEQ ID NO: 47120 - DNA, 15 bp, Artificial Sequence
  dgRNA
  Nek11
gcaggtaggatcccg

SEQ ID NO: 47121 - DNA, 15 bp, Artificial Sequence
  dgRNA
  Nek11
gaaacggcagacccg

SEQ ID NO: 47122 - DNA, 15 bp, Artificial Sequence
  dgRNA
  Nek11
aaacggcagacccgc

SEQ ID NO: 47123 - DNA, 15 bp, Artificial Sequence
  dgRNA
  Clcnka
ccacctgctttcacg

SEQ ID NO: 47124 - DNA, 15 bp, Artificial Sequence
  dgRNA
  Clcnka
ctgctttcacgcgga

SEQ ID NO: 47125 - DNA, 15 bp, Artificial Sequence
  dgRNA
  Clcnka
tgctttcacgcggat

SEQ ID NO: 47126 - DNA, 15 bp, Artificial Sequence
  dgRNA
  Clcnka
cccatgcagtgtaac

SEQ ID NO: 47127 - DNA, 15 bp, Artificial Sequence
  dgRNA
  Olfr979
actagacttacacag

SEQ ID NO: 47128 - DNA, 15 bp, Artificial Sequence
  dgRNA
  Plek2
cttgggcgatcaccg

SEQ ID NO: 47129 - DNA, 15 bp, Artificial Sequence
  dgRNA
  Plek2
ttgggcgatcaccgc

SEQ ID NO: 47130 - DNA, 15 bp, Artificial Sequence
  dgRNA
  Plek2
tcaccgcgggccgtg

SEQ ID NO: 47131 - DNA, 15 bp, Artificial Sequence
  dgRNA
  Plek2
caccgcgggccgtgc

SEQ ID NO: 47132 - DNA, 15 bp, Artificial Sequence
  dgRNA
  Pfdn5
ttgagatccgaaaag

SEQ ID NO: 47133 - DNA, 15 bp, Artificial Sequence
  dgRNA
  Pfdn5
tgagatccgaaaagc

SEQ ID NO: 47134 - DNA, 15 bp, Artificial Sequence
  dgRNA
  Pfdn5
gcgggtccgaaacac

SEQ ID NO: 47135 - DNA, 15 bp, Artificial Sequence
  dgRNA
  Pfdn5
ggatcatagagacga

SEQ ID NO: 47136 - DNA, 15 bp, Artificial Sequence
  dgRNA
  Rgma
acacacccactagcg

SEQ ID NO: 47137 - DNA, 15 bp, Artificial Sequence
  dgRNA
  Rgma
tagcgcggatcagca

SEQ ID NO: 47138 - DNA, 15 bp, Artificial Sequence
  dgRNA
  Rgma
agcgcggatcagcaa

SEQ ID NO: 47139 - DNA, 15 bp, Artificial Sequence
  dgRNA
  Rgma
cggatcagcaagggt

SEQ ID NO: 47140 - DNA, 15 bp, Artificial Sequence
  dgRNA
  Dnajc5
gggcgcaacctttcg

SEQ ID NO: 47141 - DNA, 15 bp, Artificial Sequence
  dgRNA
  Dnajc5
gggaccgagttctac

SEQ ID NO: 47142 - DNA, 15 bp, Artificial Sequence
  dgRNA
  Dnajc5
gttctaccggagctc

SEQ ID NO: 47143 - DNA, 15 bp, Artificial Sequence
  dgRNA
  Dnajc5
tccggagctttcgtg

SEQ ID NO: 47144 - DNA, 15 bp, Artificial Sequence
  dgRNA
  Hcn4
caagccgggcccggg

SEQ ID NO: 47145 - DNA, 15 bp, Artificial Sequence
  dgRNA
  Hcn4
gcagcgcggcgaacc

SEQ ID NO: 47146 - DNA, 15 bp, Artificial Sequence
  dgRNA
  Hcn4
cagcgcggcgaaccc

SEQ ID NO: 47147 - DNA, 15 bp, Artificial Sequence
  dgRNA
  Hcn4
agcgcggcgaacccg

SEQ ID NO: 47148 - DNA, 15 bp, Artificial Sequence
  dgRNA
  Greb1
cctgagctaccccat

SEQ ID NO: 47149 - DNA, 15 bp, Artificial Sequence
  dgRNA
  Greb1
aagggtcacttatgg

SEQ ID NO: 47150 - DNA, 15 bp, Artificial Sequence
  dgRNA
  Greb1
ggctacgtttctaga

SEQ ID NO: 47151 - DNA, 15 bp, Artificial Sequence
  dgRNA
  Greb1
cccatggggtagctc

SEQ ID NO: 47152 - DNA, 15 bp, Artificial Sequence
  dgRNA
  Six1
cctaacacctcctaa

SEQ ID NO: 47153 - DNA, 15 bp, Artificial Sequence
  dgRNA
  Bloc1s4
gcactgcgggctctc

SEQ ID NO: 47154 - DNA, 15 bp, Artificial Sequence
  dgRNA
  Bloc1s4
gcttggctacttgtt

SEQ ID NO: 47155 - DNA, 15 bp, Artificial Sequence
  dgRNA
  Bloc1s4
cttggctacttgtta

SEQ ID NO: 47156 - DNA, 15 bp, Artificial Sequence
  dgRNA
  Bloc1s4
ttggctacttgttag

SEQ ID NO: 47157 - DNA, 15 bp, Artificial Sequence
  dgRNA
  Olfr270
ttggtagagactcat

SEQ ID NO: 47158 - DNA, 15 bp, Artificial Sequence
  dgRNA
  Fmr1nb
gttttaagtcccagg

SEQ ID NO: 47159 - DNA, 15 bp, Artificial Sequence
  dgRNA
  Fmr1nb
tggactgctcgcaag

SEQ ID NO: 47160 - DNA, 15 bp, Artificial Sequence
  dgRNA
  Fmr1nb
actgctcgcaagcgg

SEQ ID NO: 47161 - DNA, 15 bp, Artificial Sequence
  dgRNA
  Fmr1nb
cgtcactatcacctc

SEQ ID NO: 47162 - DNA, 15 bp, Artificial Sequence
  dgRNA
  Ccdc9
actaaagtccgtgtt

SEQ ID NO: 47163 - DNA, 15 bp, Artificial Sequence
  dgRNA
  Ush2a
ttaggaatgcttcat

SEQ ID NO: 47164 - DNA, 15 bp, Artificial Sequence
  dgRNA
  Ush2a
gtcgaagccggtgcc

SEQ ID NO: 47165 - DNA, 15 bp, Artificial Sequence
  dgRNA
  Ush2a
aacatgagtcgaagc

SEQ ID NO: 47166 - DNA, 15 bp, Artificial Sequence
  dgRNA
  Ush2a
gttcaccagaaatcc

SEQ ID NO: 47167 - DNA, 15 bp, Artificial Sequence
  dgRNA
  Tns1
ggaggcggactccga

SEQ ID NO: 47168 - DNA, 15 bp, Artificial Sequence
  dgRNA
  Tns1
gaggcggactccgac

SEQ ID NO: 47169 - DNA, 15 bp, Artificial Sequence
  dgRNA
  Tns1
aggcggactccgacg

SEQ ID NO: 47170 - DNA, 15 bp, Artificial Sequence
  dgRNA
  Tns1
cggactccgacgggg

SEQ ID NO: 47171 - DNA, 15 bp, Artificial Sequence
  dgRNA
  Fbxo30
aagcaaaggcgcgaa

SEQ ID NO: 47172 - DNA, 15 bp, Artificial Sequence
  dgRNA
  Fbxo30
caaaggcgcgaaagg

SEQ ID NO: 47173 - DNA, 15 bp, Artificial Sequence
  dgRNA
  Fbxo30
cgcgaaaggcggacc

SEQ ID NO: 47174 - DNA, 15 bp, Artificial Sequence
  dgRNA
  Fbxo30
aaaggcggacccggc

SEQ ID NO: 47175 - DNA, 15 bp, Artificial Sequence
  dgRNA
  Tmco5b
cccgaattgttctaa

SEQ ID NO: 47176 - DNA, 15 bp, Artificial Sequence
  dgRNA
  Tmco5b
ctcccactttgctac

SEQ ID NO: 47177 - DNA, 15 bp, Artificial Sequence
  dgRNA
  Tmco5b
ggtgtcttatgaaac

SEQ ID NO: 47178 - DNA, 15 bp, Artificial Sequence
  dgRNA
  Tmco5b
gcagcatgtcatagt

SEQ ID NO: 47179 - DNA, 15 bp, Artificial Sequence
  dgRNA
  Nxpe2
ggactacggactgac

SEQ ID NO: 47180 - DNA, 15 bp, Artificial Sequence
  dgRNA
  Nxpe2
tacggactgactgga

SEQ ID NO: 47181 - DNA, 15 bp, Artificial Sequence
  dgRNA
  Nxpe2
gactgactggacggt

SEQ ID NO: 47182 - DNA, 15 bp, Artificial Sequence
  dgRNA
  Nxpe2
tatcataagcagtgg

SEQ ID NO: 47183 - DNA, 15 bp, Artificial Sequence
  dgRNA
  Hoxb5
ctccccccctctcgg

SEQ ID NO: 47184 - DNA, 15 bp, Artificial Sequence
  dgRNA
  Hoxb5
aggctcgcattgaat

SEQ ID NO: 47185 - DNA, 15 bp, Artificial Sequence
  dgRNA
  Hoxb5
gtgagaatttacgac

SEQ ID NO: 47186 - DNA, 15 bp, Artificial Sequence
  dgRNA
  Hoxb5
aaccccccccatatt

SEQ ID NO: 47187 - DNA, 15 bp, Artificial Sequence
  dgRNA
  Fdxacb1
aaaacgagcctttgg

SEQ ID NO: 47188 - DNA, 15 bp, Artificial Sequence
  dgRNA
  Fdxacb1
tttggaggcgcacaa

SEQ ID NO: 47189 - DNA, 15 bp, Artificial Sequence
  dgRNA
  Fdxacb1
ggcgcacaaaggtga

SEQ ID NO: 47190 - DNA, 15 bp, Artificial Sequence
  dgRNA
  Fdxacb1
cgcacaaaggtgaag

SEQ ID NO: 47191 - DNA, 15 bp, Artificial Sequence
  dgRNA
  Mlf1
gccccgccctagtcg

SEQ ID NO: 47192 - DNA, 15 bp, Artificial Sequence
  dgRNA
  Mlf1
ccccgccctagtcgc

SEQ ID NO: 47193 - DNA, 15 bp, Artificial Sequence
  dgRNA
  Mlf1
ccctagtcgcgggcg

SEQ ID NO: 47194 - DNA, 15 bp, Artificial Sequence
  dgRNA
  Mlf1
cgcggcgattgccgc

SEQ ID NO: 47195 - DNA, 15 bp, Artificial Sequence
  dgRNA
  Col9a1
ataggaatacagtgc

SEQ ID NO: 47196 - DNA, 15 bp, Artificial Sequence
  dgRNA
  Col9a1
gcagcaagctactat

SEQ ID NO: 47197 - DNA, 15 bp, Artificial Sequence
  dgRNA
  Col9a1
ggctcaaaactaaca

SEQ ID NO: 47198 - DNA, 15 bp, Artificial Sequence
  dgRNA
  Cfhr2
tgacatttaccaaac

SEQ ID NO: 47199 - DNA, 15 bp, Artificial Sequence
  dgRNA
  Cfhr2
tactagcatccagtt

SEQ ID NO: 47200 - DNA, 15 bp, Artificial Sequence
  dgRNA
  Napepld
cctgcgctccgcgca

SEQ ID NO: 47201 - DNA, 15 bp, Artificial Sequence
  dgRNA
  Napepld
tccaccctcgcaaga

SEQ ID NO: 47202 - DNA, 15 bp, Artificial Sequence
  dgRNA
  Napepld
tccagcgccgcccac

SEQ ID NO: 47203 - DNA, 15 bp, Artificial Sequence
  dgRNA
  Napepld
cgccgcccaccggca

SEQ ID NO: 47204 - DNA, 15 bp, Artificial Sequence
  dgRNA
  Tmem167
tcgtttctcacccac

SEQ ID NO: 47205 - DNA, 15 bp, Artificial Sequence
  dgRNA
  Tmem167
gccaaataatcccct

SEQ ID NO: 47206 - DNA, 15 bp, Artificial Sequence
  dgRNA
  Tmem167
ccaaataatcccctc

SEQ ID NO: 47207 - DNA, 15 bp, Artificial Sequence
  dgRNA
  Tmem167
taatcccctcgggaa

SEQ ID NO: 47208 - DNA, 15 bp, Artificial Sequence
  dgRNA
  Aspscr1
tttggtccgcgccgt

SEQ ID NO: 47209 - DNA, 15 bp, Artificial Sequence
  dgRNA
  Aspscr1
ttggtccgcgccgtc

SEQ ID NO: 47210 - DNA, 15 bp, Artificial Sequence
  dgRNA
  Aspscr1
cgtcgggacgccatc

SEQ ID NO: 47211 - DNA, 15 bp, Artificial Sequence
  dgRNA
  Aspscr1
agagccagagcgccg

SEQ ID NO: 47212 - DNA, 15 bp, Artificial Sequence
  dgRNA
  Sema6a
taccctggtcctcgc

SEQ ID NO: 47213 - DNA, 15 bp, Artificial Sequence
  dgRNA
  Sema6a
tctgagtcccctcgg

SEQ ID NO: 47214 - DNA, 15 bp, Artificial Sequence
  dgRNA
  Sema6a
aaccagcgaggacca

SEQ ID NO: 47215 - DNA, 15 bp, Artificial Sequence
  dgRNA
  Sema6a
aaaccagcgaggacc

SEQ ID NO: 47216 - DNA, 15 bp, Artificial Sequence
  dgRNA
  Cnpy2
ggcaccccatgcgct

SEQ ID NO: 47217 - DNA, 15 bp, Artificial Sequence
  dgRNA
  Cnpy2
ttcgccacgcaagtc

SEQ ID NO: 47218 - DNA, 15 bp, Artificial Sequence
  dgRNA
  Cnpy2
tcgccacgcaagtct

SEQ ID NO: 47219 - DNA, 15 bp, Artificial Sequence
  dgRNA
  Cnpy2
cgcatggggtgcctg

SEQ ID NO: 47220 - DNA, 15 bp, Artificial Sequence
  dgRNA
  Aimp2
tcaccgcgggagagt

SEQ ID NO: 47221 - DNA, 15 bp, Artificial Sequence
  dgRNA
  Aimp2
tggcgctgccgctct

SEQ ID NO: 47222 - DNA, 15 bp, Artificial Sequence
  dgRNA
  Aimp2
ggcgctgccgctctc

SEQ ID NO: 47223 - DNA, 15 bp, Artificial Sequence
  dgRNA
  Aimp2
aaaagacgcgtctcc

SEQ ID NO: 47224 - DNA, 15 bp, Artificial Sequence
  dgRNA
  Ssfa2
gcgtggcctccgtcg

SEQ ID NO: 47225 - DNA, 15 bp, Artificial Sequence
  dgRNA
  Ssfa2
cgtggcctccgtcgt

SEQ ID NO: 47226 - DNA, 15 bp, Artificial Sequence
  dgRNA
  Ssfa2
cctccgtcgtgggcg

SEQ ID NO: 47227 - DNA, 15 bp, Artificial Sequence
  dgRNA
  Ssfa2
gcgcacagctgcgag

SEQ ID NO: 47228 - DNA, 15 bp, Artificial Sequence
  dgRNA
  Rfxap
cgaccggctgtcagc

SEQ ID NO: 47229 - DNA, 15 bp, Artificial Sequence
  dgRNA
  Rfxap
gaccggctgtcagcc

SEQ ID NO: 47230 - DNA, 15 bp, Artificial Sequence
  dgRNA
  Rfxap
tgtcagccgggttct

SEQ ID NO: 47231 - DNA, 15 bp, Artificial Sequence
  dgRNA
  Rfxap
cctaggaatcgcttg

SEQ ID NO: 47232 - DNA, 15 bp, Artificial Sequence
  dgRNA
  Krt28
tatcctgaagcgatg

SEQ ID NO: 47233 - DNA, 15 bp, Artificial Sequence
  dgRNA
  Krt28
atcctgaagcgatga

SEQ ID NO: 47234 - DNA, 15 bp, Artificial Sequence
  dgRNA
  Krt28
tcctgaagcgatgag

SEQ ID NO: 47235 - DNA, 15 bp, Artificial Sequence
  dgRNA
  Krt28
cctgaagcgatgagg

SEQ ID NO: 47236 - DNA, 15 bp, Artificial Sequence
  dgRNA
  Dclk2
gcggccgcctttagc

SEQ ID NO: 47237 - DNA, 15 bp, Artificial Sequence
  dgRNA
  Dclk2
ctccacctgcgagca

SEQ ID NO: 47238 - DNA, 15 bp, Artificial Sequence
  dgRNA
  Dclk2
ccgaatgcccgcgcc

SEQ ID NO: 47239 - DNA, 15 bp, Artificial Sequence
  dgRNA
  Dclk2
cccgctgctttaaga

SEQ ID NO: 47240 - DNA, 15 bp, Artificial Sequence
  dgRNA
  Arl16
cttggagctgacggg

SEQ ID NO: 47241 - DNA, 15 bp, Artificial Sequence
  dgRNA
  Arl16
gcggacgcgttacct

SEQ ID NO: 47242 - DNA, 15 bp, Artificial Sequence
  dgRNA
  Arl16
ctaggagacgctcga

SEQ ID NO: 47243 - DNA, 15 bp, Artificial Sequence
  dgRNA
  Arl16
cgctgcctcgcccca

SEQ ID NO: 47244 - DNA, 15 bp, Artificial Sequence
  dgRNA
  Mknk1
acccgcaacaaccag

SEQ ID NO: 47245 - DNA, 15 bp, Artificial Sequence
  dgRNA
  Mknk1
gcctgcgcagtgaac

SEQ ID NO: 47246 - DNA, 15 bp, Artificial Sequence
  dgRNA
  Mknk1
gcttctcgccacgtg

SEQ ID NO: 47247 - DNA, 15 bp, Artificial Sequence
  dgRNA
  Mknk1
gccacgtgtggccct

SEQ ID NO: 47248 - DNA, 15 bp, Artificial Sequence
  dgRNA
  Mycbp2
gctgctcgtaaaacc

SEQ ID NO: 47249 - DNA, 15 bp, Artificial Sequence
  dgRNA
  Mycbp2
taaaacccggagcag

SEQ ID NO: 47250 - DNA, 15 bp, Artificial Sequence
  dgRNA
  Mycbp2
gattgcttgtcgctt

SEQ ID NO: 47251 - DNA, 15 bp, Artificial Sequence
  dgRNA
  Mycbp2
tggacatccacagct

SEQ ID NO: 47252 - DNA, 15 bp, Artificial Sequence
  dgRNA
  Gdpd2
ccatagcgcctctcc

SEQ ID NO: 47253 - DNA, 15 bp, Artificial Sequence
  dgRNA
  Gdpd2
tcccggccttccaag

SEQ ID NO: 47254 - DNA, 15 bp, Artificial Sequence
  dgRNA
  Gdpd2
gcagacaactcggag

SEQ ID NO: 47255 - DNA, 15 bp, Artificial Sequence
  dgRNA
  Gdpd2
actcggagaggagct

SEQ ID NO: 47256 - DNA, 15 bp, Artificial Sequence
  dgRNA
  Ssh2
ctgcccgcccgcttc

SEQ ID NO: 47257 - DNA, 15 bp, Artificial Sequence
  dgRNA
  Ssh2
gcttccggcaactta

SEQ ID NO: 47258 - DNA, 15 bp, Artificial Sequence
  dgRNA
  Ssh2
cttccggcaacttaa

SEQ ID NO: 47259 - DNA, 15 bp, Artificial Sequence
  dgRNA
  Ssh2
agggttacgccgccg

SEQ ID NO: 47260 - DNA, 15 bp, Artificial Sequence
  dgRNA
  Tmem175
gagggtgcgatccta

SEQ ID NO: 47261 - DNA, 15 bp, Artificial Sequence
  dgRNA
  Tmem175
cctcaagctcctagg

SEQ ID NO: 47262 - DNA, 15 bp, Artificial Sequence
  dgRNA
  Tmem175
tcctaggaggcacgg

SEQ ID NO: 47263 - DNA, 15 bp, Artificial Sequence
  dgRNA
  Tmem175
gaccctaacctcatc

SEQ ID NO: 47264 - DNA, 15 bp, Artificial Sequence
  dgRNA
  Olfr155
tgtcaaaggtgcctc

SEQ ID NO: 47265 - DNA, 15 bp, Artificial Sequence
  dgRNA
  Olfr155
cacctttgacaatct

SEQ ID NO: 47266 - DNA, 15 bp, Artificial Sequence
  dgRNA
  Map4
tgccggccttcaaga

SEQ ID NO: 47267 - DNA, 15 bp, Artificial Sequence
  dgRNA
  Map4
ttcaagagggcgacg

SEQ ID NO: 47268 - DNA, 15 bp, Artificial Sequence
  dgRNA
  Map4
cccgcccctccggct

SEQ ID NO: 47269 - DNA, 15 bp, Artificial Sequence
  dgRNA
  Map4
ctccggctaggtctg

SEQ ID NO: 47270 - DNA, 15 bp, Artificial Sequence
  dgRNA
  Fhl3
agcaaggagtggtcg

SEQ ID NO: 47271 - DNA, 15 bp, Artificial Sequence
  dgRNA
  Fhl3
aaggagtggtcgagg

SEQ ID NO: 47272 - DNA, 15 bp, Artificial Sequence
  dgRNA
  Fhl3
agcaccaggttcgac

SEQ ID NO: 47273 - DNA, 15 bp, Artificial Sequence
  dgRNA
  Fhl3
gcaccaggttcgact

SEQ ID NO: 47274 - DNA, 15 bp, Artificial Sequence
  dgRNA
  Tmem53
cggcccgccctccct

SEQ ID NO: 47275 - DNA, 15 bp, Artificial Sequence
  dgRNA
  Tmem53
cggcccgcccccttc

SEQ ID NO: 47276 - DNA, 15 bp, Artificial Sequence
  dgRNA
  Tmem53
ggcccgcccccttcg

SEQ ID NO: 47277 - DNA, 15 bp, Artificial Sequence
  dgRNA
  Tmem53
gcccgcccccttcgg

SEQ ID NO: 47278 - DNA, 15 bp, Artificial Sequence
  dgRNA
  Hiat1
ttgtcagatttgagt

SEQ ID NO: 47279 - DNA, 15 bp, Artificial Sequence
  dgRNA
  Hiat1
cgctcagcgccttag

SEQ ID NO: 47280 - DNA, 15 bp, Artificial Sequence
  dgRNA
  Hiat1
gctcagcgccttaga

SEQ ID NO: 47281 - DNA, 15 bp, Artificial Sequence
  dgRNA
  Hiat1
ctccacccgctcccg

SEQ ID NO: 47282 - DNA, 15 bp, Artificial Sequence
  dgRNA
  Mpl
ggccccgggggggat

SEQ ID NO: 47283 - DNA, 15 bp, Artificial Sequence
  dgRNA
  Mpl
gccccgggggggatt

SEQ ID NO: 47284 - DNA, 15 bp, Artificial Sequence
  dgRNA
  Mpl
ccccgggggggattg

SEQ ID NO: 47285 - DNA, 15 bp, Artificial Sequence
  dgRNA
  Mpl
gagccttctgttggc

SEQ ID NO: 47286 - DNA, 15 bp, Artificial Sequence
  dgRNA
  Fam60a
gtttacgtgacgttg

SEQ ID NO: 47287 - DNA, 15 bp, Artificial Sequence
  dgRNA
  Fam60a
gtgacgttgcggagt

SEQ ID NO: 47288 - DNA, 15 bp, Artificial Sequence
  dgRNA
  Fam60a
cgttgcggagtaggc

SEQ ID NO: 47289 - DNA, 15 bp, Artificial Sequence
  dgRNA
  Fam60a
ccgcccccgtccccg

SEQ ID NO: 47290 - DNA, 15 bp, Artificial Sequence
  dgRNA
  Slk
ttcccgggtccggag

SEQ ID NO: 47291 - DNA, 15 bp, Artificial Sequence
  dgRNA
  Slk
gagcggccgccgccc

SEQ ID NO: 47292 - DNA, 15 bp, Artificial Sequence
  dgRNA
  Slk
gccccgggagacgcg

SEQ ID NO: 47293 - DNA, 15 bp, Artificial Sequence
  dgRNA
  Slk
agacgcgcggtgaca

SEQ ID NO: 47294 - DNA, 15 bp, Artificial Sequence
  dgRNA
  Zfp87
ctatcaaagcctcaa

SEQ ID NO: 47295 - DNA, 15 bp, Artificial Sequence
  dgRNA
  Zfp87
cgtccgttttacaac

SEQ ID NO: 47296 - DNA, 15 bp, Artificial Sequence
  dgRNA
  Zfp87
tcctccgctgtcagt

SEQ ID NO: 47297 - DNA, 15 bp, Artificial Sequence
  dgRNA
  Zfp87
cctccgctgtcagta

SEQ ID NO: 47298 - DNA, 15 bp, Artificial Sequence
  dgRNA
  Tgs1
ggaaatcggcgacct

SEQ ID NO: 47299 - DNA, 15 bp, Artificial Sequence
  dgRNA
  Tgs1
ggcgacctcggcagc

SEQ ID NO: 47300 - DNA, 15 bp, Artificial Sequence
  dgRNA
  Tgs1
acctcggcagctggt

SEQ ID NO: 47301 - DNA, 15 bp, Artificial Sequence
  dgRNA
  Tgs1
tcggcagctggtcgg

SEQ ID NO: 47302 - DNA, 15 bp, Artificial Sequence
  dgRNA
  Irx4
ctacacccgcgcacc

SEQ ID NO: 47303 - DNA, 15 bp, Artificial Sequence
  dgRNA
  Irx4
cgcgcacccggtgcg

SEQ ID NO: 47304 - DNA, 15 bp, Artificial Sequence
  dgRNA
  Irx4
acccggtgcgcggcc

SEQ ID NO: 47305 - DNA, 15 bp, Artificial Sequence
  dgRNA
  Irx4
cccggtgcgcggcca

SEQ ID NO: 47306 - DNA, 15 bp, Artificial Sequence
  dgRNA
  Tmem115
tccctttactgcatc

SEQ ID NO: 47307 - DNA, 15 bp, Artificial Sequence
  dgRNA
  Tmem115
agcccgtacactcta

SEQ ID NO: 47308 - DNA, 15 bp, Artificial Sequence
  dgRNA
  Tmem115
gcccgtacactctac

SEQ ID NO: 47309 - DNA, 15 bp, Artificial Sequence
  dgRNA
  Tmem115
tacactctacgggac

SEQ ID NO: 47310 - DNA, 15 bp, Artificial Sequence
  dgRNA
  Rtl1
gaaaggtattcgctg

SEQ ID NO: 47311 - DNA, 15 bp, Artificial Sequence
  dgRNA
  Rtl1
aaaggtattcgctga

SEQ ID NO: 47312 - DNA, 15 bp, Artificial Sequence
  dgRNA
  Rtl1
ttcatagatgctccg

SEQ ID NO: 47313 - DNA, 15 bp, Artificial Sequence
  dgRNA
  Rtl1
atgttcagcatgggc

SEQ ID NO: 47314 - DNA, 15 bp, Artificial Sequence
  dgRNA
  Zfp36
tttctataatagggt

SEQ ID NO: 47315 - DNA, 15 bp, Artificial Sequence
  dgRNA
  Zfp36
atagggttggctcta

SEQ ID NO: 47316 - DNA, 15 bp, Artificial Sequence
  dgRNA
  Zfp36
tcctccttaccttcg

SEQ ID NO: 47317 - DNA, 15 bp, Artificial Sequence
  dgRNA
  Zfp36
aaacaaatctaggcg

SEQ ID NO: 47318 - DNA, 15 bp, Artificial Sequence
  dgRNA
  Krtap16-3
tagtgcgctcaacac

SEQ ID NO: 47319 - DNA, 15 bp, Artificial Sequence
  dgRNA
  Krtap16-3
agtgcgctcaacaca

SEQ ID NO: 47320 - DNA, 15 bp, Artificial Sequence
  dgRNA
  Krtap16-3
gcattctggatagct

SEQ ID NO: 47321 - DNA, 15 bp, Artificial Sequence
  dgRNA
  Krtap16-3
gcactaaacagggac

SEQ ID NO: 47322 - DNA, 15 bp, Artificial Sequence
  dgRNA
  Fbxl6
gcacgccacttagcc

SEQ ID NO: 47323 - DNA, 15 bp, Artificial Sequence
  dgRNA
  Fbxl6
gccacttagcccgga

SEQ ID NO: 47324 - DNA, 15 bp, Artificial Sequence
  dgRNA
  Fbxl6
gttgtagtaagacgc

SEQ ID NO: 47325 - DNA, 15 bp, Artificial Sequence
  dgRNA
  Fbxl6
taatgcgctagactg

SEQ ID NO: 47326 - DNA, 15 bp, Artificial Sequence
  dgRNA
  Cers4
ggagtagcagaccag

SEQ ID NO: 47327 - DNA, 15 bp, Artificial Sequence
  dgRNA
  Cers4
tggcggcggcgggta

SEQ ID NO: 47328 - DNA, 15 bp, Artificial Sequence
  dgRNA
  Cers4
cgggtagggggctgt

SEQ ID NO: 47329 - DNA, 15 bp, Artificial Sequence
  dgRNA
  Cers4
gctggtaatagtcta

SEQ ID NO: 47330 - DNA, 15 bp, Artificial Sequence
  dgRNA
  Inpp5f
gcggagtcggaaggt

SEQ ID NO: 47331 - DNA, 15 bp, Artificial Sequence
  dgRNA
  Inpp5f
gagtcggaaggtcgg

SEQ ID NO: 47332 - DNA, 15 bp, Artificial Sequence
  dgRNA
  Inpp5f
tcggaaggtcggagg

SEQ ID NO: 47333 - DNA, 15 bp, Artificial Sequence
  dgRNA
  Inpp5f
caagggcggagccta

SEQ ID NO: 47334 - DNA, 15 bp, Artificial Sequence
  dgRNA
  Pzp
ttaaccgtgagctag

SEQ ID NO: 47335 - DNA, 15 bp, Artificial Sequence
  dgRNA
  Pzp
tcctagaaaatggtc

SEQ ID NO: 47336 - DNA, 15 bp, Artificial Sequence
  dgRNA
  Pzp
ctttcactgcccatc

SEQ ID NO: 47337 - DNA, 15 bp, Artificial Sequence
  dgRNA
  Pzp
cggttaataatacac

SEQ ID NO: 47338 - DNA, 15 bp, Artificial Sequence
  dgRNA
  Zfp764
caagtaatgcaaccc

SEQ ID NO: 47339 - DNA, 15 bp, Artificial Sequence
  dgRNA
  Zfp764
aagtaatgcaaccct

SEQ ID NO: 47340 - DNA, 15 bp, Artificial Sequence
  dgRNA
  Zfp764
ggaccacatacaggg

SEQ ID NO: 47341 - DNA, 15 bp, Artificial Sequence
  dgRNA
  Zfp764
gtgaggaccacatac

SEQ ID NO: 47342 - DNA, 15 bp, Artificial Sequence
  dgRNA
  Ankrd39
gtgcttagttagcct

SEQ ID NO: 47343 - DNA, 15 bp, Artificial Sequence
  dgRNA
  Ankrd39
ttgggcgccctcccg

SEQ ID NO: 47344 - DNA, 15 bp, Artificial Sequence
  dgRNA
  Ankrd39
ttggttgctaagcta

SEQ ID NO: 47345 - DNA, 15 bp, Artificial Sequence
  dgRNA
  Ankrd39
ctaaggtctaaatgc

SEQ ID NO: 47346 - DNA, 15 bp, Artificial Sequence
  dgRNA
  Alms1
tgggtgactttgtgc

SEQ ID NO: 47347 - DNA, 15 bp, Artificial Sequence
  dgRNA
  Alms1
cccaaagcccggact

SEQ ID NO: 47348 - DNA, 15 bp, Artificial Sequence
  dgRNA
  Alms1
acggtactgtgagcg

SEQ ID NO: 47349 - DNA, 15 bp, Artificial Sequence
  dgRNA
  Alms1
agtgacgctcttctg

SEQ ID NO: 47350 - DNA, 15 bp, Artificial Sequence
  dgRNA
  Ankrd13a
aactaccccgttatc

SEQ ID NO: 47351 - DNA, 15 bp, Artificial Sequence
  dgRNA
  Ankrd13a
tatcaggagagtatc

SEQ ID NO: 47352 - DNA, 15 bp, Artificial Sequence
  dgRNA
  Ankrd13a
caggttccagctcgc

SEQ ID NO: 47353 - DNA, 15 bp, Artificial Sequence
  dgRNA
  Ankrd13a
gtttctgaccaatcg

SEQ ID NO: 47354 - DNA, 15 bp, Artificial Sequence
  dgRNA
  Cacng7
gcattagccaatgag

SEQ ID NO: 47355 - DNA, 15 bp, Artificial Sequence
  dgRNA
  Cacng7
ccaatgagcggccgc

SEQ ID NO: 47356 - DNA, 15 bp, Artificial Sequence
  dgRNA
  Cacng7
tgcgtccgctgagtg

SEQ ID NO: 47357 - DNA, 15 bp, Artificial Sequence
  dgRNA
  Cacng7
cgctgagtgaggccg

SEQ ID NO: 47358 - DNA, 15 bp, Artificial Sequence
  dgRNA
  2010001E11Rik
ctttgtgcggtgacc

SEQ ID NO: 47359 - DNA, 15 bp, Artificial Sequence
  dgRNA
  2010001E11Rik
tttgtgcggtgaccc

SEQ ID NO: 47360 - DNA, 15 bp, Artificial Sequence
  dgRNA
  2010001E11Rik
ccgggagaccagtag

SEQ ID NO: 47361 - DNA, 15 bp, Artificial Sequence
  dgRNA
  2010001E11Rik
ggtgcgagcaccgcg

SEQ ID NO: 47362 - DNA, 15 bp, Artificial Sequence
  dgRNA
  Ahcyl1
ttcaactactcaccc

SEQ ID NO: 47363 - DNA, 15 bp, Artificial Sequence
  dgRNA
  Ahcyl1
tcaactactcaccct

SEQ ID NO: 47364 - DNA, 15 bp, Artificial Sequence
  dgRNA
  Ahcyl1
ggacgttcatcaccg

SEQ ID NO: 47365 - DNA, 15 bp, Artificial Sequence
  dgRNA
  Ahcyl1
tcatcaccgaggcgc

SEQ ID NO: 47366 - DNA, 15 bp, Artificial Sequence
  dgRNA
  Suv420h1
gacacaccagatcgt

SEQ ID NO: 47367 - DNA, 15 bp, Artificial Sequence
  dgRNA
  Suv420h1
acacaccagatcgtt

SEQ ID NO: 47368 - DNA, 15 bp, Artificial Sequence
  dgRNA
  Suv420h1
gttgggaacgacgtc

SEQ ID NO: 47369 - DNA, 15 bp, Artificial Sequence
  dgRNA
  Suv420h1
gaacgacgtctggtt

SEQ ID NO: 47370 - DNA, 15 bp, Artificial Sequence
  dgRNA
  Arvcf
cgggaggctgaactg

SEQ ID NO: 47371 - DNA, 15 bp, Artificial Sequence
  dgRNA
  Arvcf
gggggcgcacctcaa

SEQ ID NO: 47372 - DNA, 15 bp, Artificial Sequence
  dgRNA
  Arvcf
gggcgcacctcaaag

SEQ ID NO: 47373 - DNA, 15 bp, Artificial Sequence
  dgRNA
  Arvcf
tgccatggtaataga

SEQ ID NO: 47374 - DNA, 15 bp, Artificial Sequence
  dgRNA
  Irf1
cgggcccgagggggt

SEQ ID NO: 47375 - DNA, 15 bp, Artificial Sequence
  dgRNA
  Irf1
ttccccgaaatgatg

SEQ ID NO: 47376 - DNA, 15 bp, Artificial Sequence
  dgRNA
  Irf1
aatgatgaggccgag

SEQ ID NO: 47377 - DNA, 15 bp, Artificial Sequence
  dgRNA
  Irf1
atgatgaggccgagt

SEQ ID NO: 47378 - DNA, 15 bp, Artificial Sequence
  dgRNA
  Inadl
agaggcccaaggtcg

SEQ ID NO: 47379 - DNA, 15 bp, Artificial Sequence
  dgRNA
  Inadl
gaggcccaaggtcgt

SEQ ID NO: 47380 - DNA, 15 bp, Artificial Sequence
  dgRNA
  Inadl
tcttcccacgacctt

SEQ ID NO: 47381 - DNA, 15 bp, Artificial Sequence
  dgRNA
  Inadl
ctcttcccacgacct

SEQ ID NO: 47382 - DNA, 15 bp, Artificial Sequence
  dgRNA
  Plac1
atgttatcaatgttc

SEQ ID NO: 47383 - DNA, 15 bp, Artificial Sequence
  dgRNA
  Plac1
ggacaactttaggac

SEQ ID NO: 47384 - DNA, 15 bp, Artificial Sequence
  dgRNA
  Plac1
acattgacctccagt

SEQ ID NO: 47385 - DNA, 15 bp, Artificial Sequence
  dgRNA
  Plac1
agactcttggctaag

SEQ ID NO: 47386 - DNA, 15 bp, Artificial Sequence
  dgRNA
  Sirt2
cgccctttatcaata

SEQ ID NO: 47387 - DNA, 15 bp, Artificial Sequence
  dgRNA
  Sirt2
tatcaatatggccgc

SEQ ID NO: 47388 - DNA, 15 bp, Artificial Sequence
  dgRNA
  Sirt2
atggccgccggcgcc

SEQ ID NO: 47389 - DNA, 15 bp, Artificial Sequence
  dgRNA
  Sirt2
ggcgccaggcttttt

SEQ ID NO: 47390 - DNA, 15 bp, Artificial Sequence
  dgRNA
  Etv5
caagccggtgctgat

SEQ ID NO: 47391 - DNA, 15 bp, Artificial Sequence
  dgRNA
  Etv5
gtgctgattggtcaa

SEQ ID NO: 47392 - DNA, 15 bp, Artificial Sequence
  dgRNA
  Etv5
cctctgagggcgttg

SEQ ID NO: 47393 - DNA, 15 bp, Artificial Sequence
  dgRNA
  Etv5
ctctgagggcgttga

SEQ ID NO: 47394 - DNA, 15 bp, Artificial Sequence
  dgRNA
  Triml2
aggcttaatcttgtc

SEQ ID NO: 47395 - DNA, 15 bp, Artificial Sequence
  dgRNA
  Triml2
ttaatcttgtctggc

SEQ ID NO: 47396 - DNA, 15 bp, Artificial Sequence
  dgRNA
  Triml2
aatcttgtctggccg

SEQ ID NO: 47397 - DNA, 15 bp, Artificial Sequence
  dgRNA
  Triml2
tactgaaaagctagt

SEQ ID NO: 47398 - DNA, 15 bp, Artificial Sequence
  dgRNA
  Brk1
tcttcacatcgcgag

SEQ ID NO: 47399 - DNA, 15 bp, Artificial Sequence
  dgRNA
  Brk1
tcacatcgcgagtgg

SEQ ID NO: 47400 - DNA, 15 bp, Artificial Sequence
  dgRNA
  Brk1
ttgtttaccccagcg

SEQ ID NO: 47401 - DNA, 15 bp, Artificial Sequence
  dgRNA
  Brk1
tgtttaccccagcgt

SEQ ID NO: 47402 - DNA, 15 bp, Artificial Sequence
  dgRNA
  Bex6
ataacattaactcat

SEQ ID NO: 47403 - DNA, 15 bp, Artificial Sequence
  dgRNA
  Bex6
tatcaataattctag

SEQ ID NO: 47404 - DNA, 15 bp, Artificial Sequence
  dgRNA
  Bex6
aggtgacttttaggt

SEQ ID NO: 47405 - DNA, 15 bp, Artificial Sequence
  dgRNA
  Ggh
ggcgatggacaagct

SEQ ID NO: 47406 - DNA, 15 bp, Artificial Sequence
  dgRNA
  Ggh
cgcaccgcaagcacc

SEQ ID NO: 47407 - DNA, 15 bp, Artificial Sequence
  dgRNA
  Ggh
gaggcctgagcggcg

SEQ ID NO: 47408 - DNA, 15 bp, Artificial Sequence
  dgRNA
  Ggh
cggtgcggagctggg

SEQ ID NO: 47409 - DNA, 15 bp, Artificial Sequence
  dgRNA
  Smpdl3b
ttctttcgaaaagtc

SEQ ID NO: 47410 - DNA, 15 bp, Artificial Sequence
  dgRNA
  Smpdl3b
tctttcgaaaagtcg

SEQ ID NO: 47411 - DNA, 15 bp, Artificial Sequence
  dgRNA
  Smpdl3b
ttctagtcgaattga

SEQ ID NO: 47412 - DNA, 15 bp, Artificial Sequence
  dgRNA
  Smpdl3b
atgataggatcttcg

SEQ ID NO: 47413 - DNA, 15 bp, Artificial Sequence
  dgRNA
  Zyx
gttctccagcactcg

SEQ ID NO: 47414 - DNA, 15 bp, Artificial Sequence
  dgRNA
  Zyx
ccagcactcgcgggt

SEQ ID NO: 47415 - DNA, 15 bp, Artificial Sequence
  dgRNA
  Zyx
cagcactcgcgggtc

SEQ ID NO: 47416 - DNA, 15 bp, Artificial Sequence
  dgRNA
  Zyx
cactcgcgggtcggg

SEQ ID NO: 47417 - DNA, 15 bp, Artificial Sequence
  dgRNA
  Glyctk
gtaaaggaacgtcta

SEQ ID NO: 47418 - DNA, 15 bp, Artificial Sequence
  dgRNA
  Glyctk
aagggggcactgccg

SEQ ID NO: 47419 - DNA, 15 bp, Artificial Sequence
  dgRNA
  Glyctk
cactgccgtggtgtg

SEQ ID NO: 47420 - DNA, 15 bp, Artificial Sequence
  dgRNA
  Glyctk
actgccgtggtgtga

SEQ ID NO: 47421 - DNA, 15 bp, Artificial Sequence
  dgRNA
  A2m
aaagtgagcagtaac

SEQ ID NO: 47422 - DNA, 15 bp, Artificial Sequence
  dgRNA
  A2m
gggaattccggctaa

SEQ ID NO: 47423 - DNA, 15 bp, Artificial Sequence
  dgRNA
  A2m
ggaattccggctaac

SEQ ID NO: 47424 - DNA, 15 bp, Artificial Sequence
  dgRNA
  A2m
tccggctaacgggtc

SEQ ID NO: 47425 - DNA, 15 bp, Artificial Sequence
  dgRNA
  Gm10406
ctccatggcgcggtg

SEQ ID NO: 47426 - DNA, 15 bp, Artificial Sequence
  dgRNA
  Gm10406
gctccatggcgcggt

SEQ ID NO: 47427 - DNA, 15 bp, Artificial Sequence
  dgRNA
  Mipol1
ccagttagcgcgcac

SEQ ID NO: 47428 - DNA, 15 bp, Artificial Sequence
  dgRNA
  Mipol1
cagaacgcgacctcg

SEQ ID NO: 47429 - DNA, 15 bp, Artificial Sequence
  dgRNA
  Mipol1
agccctccagctcgc

SEQ ID NO: 47430 - DNA, 15 bp, Artificial Sequence
  dgRNA
  Mipol1
ccccgcggcagccag

SEQ ID NO: 47431 - DNA, 15 bp, Artificial Sequence
  dgRNA
  Ctsd
tttaagctggcatcc

SEQ ID NO: 47432 - DNA, 15 bp, Artificial Sequence
  dgRNA
  Ctsd
accacatcctggtag

SEQ ID NO: 47433 - DNA, 15 bp, Artificial Sequence
  dgRNA
  Ctsd
ccacatcctggtagt

SEQ ID NO: 47434 - DNA, 15 bp, Artificial Sequence
  dgRNA
  Ctsd
caggatccgcccctc

SEQ ID NO: 47435 - DNA, 15 bp, Artificial Sequence
  dgRNA
  Eva1a
acaaggtggggaccg

SEQ ID NO: 47436 - DNA, 15 bp, Artificial Sequence
  dgRNA
  Eva1a
gtggggaccgcggat

SEQ ID NO: 47437 - DNA, 15 bp, Artificial Sequence
  dgRNA
  Eva1a
tggggaccgcggatg

SEQ ID NO: 47438 - DNA, 15 bp, Artificial Sequence
  dgRNA
  Eva1a
gatcatgtaacccag

SEQ ID NO: 47439 - DNA, 15 bp, Artificial Sequence
  dgRNA
  Sgk2
actccagctggacta

SEQ ID NO: 47440 - DNA, 15 bp, Artificial Sequence
  dgRNA
  Sgk2
ttaggagagccttcg

SEQ ID NO: 47441 - DNA, 15 bp, Artificial Sequence
  dgRNA
  Sgk2
ggagagccttcgtgg

SEQ ID NO: 47442 - DNA, 15 bp, Artificial Sequence
  dgRNA
  Sgk2
ccttcgtggaggctc

SEQ ID NO: 47443 - DNA, 15 bp, Artificial Sequence
  dgRNA
  Dnlz
ccgagctgagcctgt

SEQ ID NO: 47444 - DNA, 15 bp, Artificial Sequence
  dgRNA
  Dnlz
gttggatatgcaagc

SEQ ID NO: 47445 - DNA, 15 bp, Artificial Sequence
  dgRNA
  Dnlz
ttggatatgcaagcg

SEQ ID NO: 47446 - DNA, 15 bp, Artificial Sequence
  dgRNA
  Dnlz
aagcggggcgacacc

SEQ ID NO: 47447 - DNA, 15 bp, Artificial Sequence
  dgRNA
  Hrh1
ggtggcagtgtcgga

SEQ ID NO: 47448 - DNA, 15 bp, Artificial Sequence
  dgRNA
  Hrh1
cggagggctgtcgcc

SEQ ID NO: 47449 - DNA, 15 bp, Artificial Sequence
  dgRNA
  Hrh1
cttccgatccatcct

SEQ ID NO: 47450 - DNA, 15 bp, Artificial Sequence
  dgRNA
  Hrh1
gctccgccacagatg

SEQ ID NO: 47451 - DNA, 15 bp, Artificial Sequence
  dgRNA
  Optc
ccttgttctggcagg

SEQ ID NO: 47452 - DNA, 15 bp, Artificial Sequence
  dgRNA
  Optc
gctgaggagtcctcg

SEQ ID NO: 47453 - DNA, 15 bp, Artificial Sequence
  dgRNA
  Optc
tcctcggggtctatt

SEQ ID NO: 47454 - DNA, 15 bp, Artificial Sequence
  dgRNA
  Optc
cctggcatcgcaagc

SEQ ID NO: 47455 - DNA, 15 bp, Artificial Sequence
  dgRNA
  Gast
ttgaacctacattcc

SEQ ID NO: 47456 - DNA, 15 bp, Artificial Sequence
  dgRNA
  Gast
ttgggaggaacctcg

SEQ ID NO: 47457 - DNA, 15 bp, Artificial Sequence
  dgRNA
  Gast
ctcgagggctttata

SEQ ID NO: 47458 - DNA, 15 bp, Artificial Sequence
  dgRNA
  Gast
tttataaggcagacc

SEQ ID NO: 47459 - DNA, 15 bp, Artificial Sequence
  dgRNA
  Scrt2
cgctttttctcttga

SEQ ID NO: 47460 - DNA, 15 bp, Artificial Sequence
  dgRNA
  Cog7
attgacgtctgagaa

SEQ ID NO: 47461 - DNA, 15 bp, Artificial Sequence
  dgRNA
  Cog7
gattgacgtctgaga

SEQ ID NO: 47462 - DNA, 15 bp, Artificial Sequence
  dgRNA
  Cog7
tcgcgcagtccggac

SEQ ID NO: 47463 - DNA, 15 bp, Artificial Sequence
  dgRNA
  Cog7
gagcttcgcgcagtc

SEQ ID NO: 47464 - DNA, 15 bp, Artificial Sequence
  dgRNA
  Tm4sf1
tggcctaggaaacgc

SEQ ID NO: 47465 - DNA, 15 bp, Artificial Sequence
  dgRNA
  Tm4sf1
ggcctaggaaacgca

SEQ ID NO: 47466 - DNA, 15 bp, Artificial Sequence
  dgRNA
  Tm4sf1
ctaccagtaagtgtg

SEQ ID NO: 47467 - DNA, 15 bp, Artificial Sequence
  dgRNA
  Phyhipl
gggagtcattttaga

SEQ ID NO: 47468 - DNA, 15 bp, Artificial Sequence
  dgRNA
  Phyhipl
atacccaggtcacta

SEQ ID NO: 47469 - DNA, 15 bp, Artificial Sequence
  dgRNA
  Phyhipl
tgctatgtttccaag

SEQ ID NO: 47470 - DNA, 15 bp, Artificial Sequence
  dgRNA
  Phyhipl
gtctccctagtgacc

SEQ ID NO: 47471 - DNA, 15 bp, Artificial Sequence
  dgRNA
  Kif17
cccccgttccccgcc

SEQ ID NO: 47472 - DNA, 15 bp, Artificial Sequence
  dgRNA
  Kif17
ccccgttccccgccc

SEQ ID NO: 47473 - DNA, 15 bp, Artificial Sequence
  dgRNA
  Kif17
ttccccgcccgggcc

SEQ ID NO: 47474 - DNA, 15 bp, Artificial Sequence
  dgRNA
  Kif17
ccgggcccggcctca

SEQ ID NO: 47475 - DNA, 15 bp, Artificial Sequence
  dgRNA
  Rtkn
aagggttaagcgtgg

SEQ ID NO: 47476 - DNA, 15 bp, Artificial Sequence
  dgRNA
  Rtkn
acccccctcccgcct

SEQ ID NO: 47477 - DNA, 15 bp, Artificial Sequence
  dgRNA
  Rtkn
cccgcctgggattcc

SEQ ID NO: 47478 - DNA, 15 bp, Artificial Sequence
  dgRNA
  Rtkn
ttcccgggccagtga

SEQ ID NO: 47479 - DNA, 15 bp, Artificial Sequence
  dgRNA
  Carkd
gtccctaaaccgcca

SEQ ID NO: 47480 - DNA, 15 bp, Artificial Sequence
  dgRNA
  Carkd
aaccttggcggttta

SEQ ID NO: 47481 - DNA, 15 bp, Artificial Sequence
  dgRNA
  Carkd
gaaccttggcggttt

SEQ ID NO: 47482 - DNA, 15 bp, Artificial Sequence
  dgRNA
  Nfkb2
gggggcgaggcggct

SEQ ID NO: 47483 - DNA, 15 bp, Artificial Sequence
  dgRNA
  Nfkb2
ccccgactgagcccc

SEQ ID NO: 47484 - DNA, 15 bp, Artificial Sequence
  dgRNA
  Nfkb2
cccgactgagcccca

SEQ ID NO: 47485 - DNA, 15 bp, Artificial Sequence
  dgRNA
  Nfkb2
gaaccaggaaccgcc

SEQ ID NO: 47486 - DNA, 15 bp, Artificial Sequence
  dgRNA
  Slc20a1
ccagccagtcccacg

SEQ ID NO: 47487 - DNA, 15 bp, Artificial Sequence
  dgRNA
  Slc20a1
ggaccagctcctcgt

SEQ ID NO: 47488 - DNA, 15 bp, Artificial Sequence
  dgRNA
  Slc20a1
accagctcctcgttg

SEQ ID NO: 47489 - DNA, 15 bp, Artificial Sequence
  dgRNA
  Slc20a1
gctcctcgttggggg

SEQ ID NO: 47490 - DNA, 15 bp, Artificial Sequence
  dgRNA
  Plekha7
gaagataggacttgc

SEQ ID NO: 47491 - DNA, 15 bp, Artificial Sequence
  dgRNA
  Plekha7
ataggacttgcaggg

SEQ ID NO: 47492 - DNA, 15 bp, Artificial Sequence
  dgRNA
  Plekha7
cacccttttgaagtc

SEQ ID NO: 47493 - DNA, 15 bp, Artificial Sequence
  dgRNA
  Plekha7
atggttccaacacac

SEQ ID NO: 47494 - DNA, 15 bp, Artificial Sequence
  dgRNA
  Kbtbd6
tcccaagagaaccgg

SEQ ID NO: 47495 - DNA, 15 bp, Artificial Sequence
  dgRNA
  Kbtbd6
aaaggctcgcgactt

SEQ ID NO: 47496 - DNA, 15 bp, Artificial Sequence
  dgRNA
  Kbtbd6
tgtaacgtaccctgc

SEQ ID NO: 47497 - DNA, 15 bp, Artificial Sequence
  dgRNA
  Kbtbd6
ttgggatttattgtc

SEQ ID NO: 47498 - DNA, 15 bp, Artificial Sequence
  dgRNA
  Smad9
tttctggggatgacc

SEQ ID NO: 47499 - DNA, 15 bp, Artificial Sequence
  dgRNA
  Smad9
atgtgcagagcgggc

SEQ ID NO: 47500 - DNA, 15 bp, Artificial Sequence
  dgRNA
  Smad9
gagcgtggcgcggcc

SEQ ID NO: 47501 - DNA, 15 bp, Artificial Sequence
  dgRNA
  Smad9
cgcggccagggcgct

SEQ ID NO: 47502 - DNA, 15 bp, Artificial Sequence
  dgRNA
  Gramd1b
ccgggtggcaaagct

SEQ ID NO: 47503 - DNA, 15 bp, Artificial Sequence
  dgRNA
  Gramd1b
actgtcactgcgtcc

SEQ ID NO: 47504 - DNA, 15 bp, Artificial Sequence
  dgRNA
  Gramd1b
cgcctcttccctcgt

SEQ ID NO: 47505 - DNA, 15 bp, Artificial Sequence
  dgRNA
  Gramd1b
tcgtcggactgagcg

SEQ ID NO: 47506 - DNA, 15 bp, Artificial Sequence
  dgRNA
  Kcng1
cgaaggaggccatga

SEQ ID NO: 47507 - DNA, 15 bp, Artificial Sequence
  dgRNA
  Kcng1
ccgaaggaggccatg

SEQ ID NO: 47508 - DNA, 15 bp, Artificial Sequence
  dgRNA
  Kcng1
tgaaaataccgaagg

SEQ ID NO: 47509 - DNA, 15 bp, Artificial Sequence
  dgRNA
  Kcng1
atgtgaaaataccga

SEQ ID NO: 47510 - DNA, 15 bp, Artificial Sequence
  dgRNA
  Bdh1
gatcagatgacagcg

SEQ ID NO: 47511 - DNA, 15 bp, Artificial Sequence
  dgRNA
  Bdh1
gcgaggatctgtacc

SEQ ID NO: 47512 - DNA, 15 bp, Artificial Sequence
  dgRNA
  Bdh1
gatctgtaccaggct

SEQ ID NO: 47513 - DNA, 15 bp, Artificial Sequence
  dgRNA
  Bdh1
gagcaggtttacctc

SEQ ID NO: 47514 - DNA, 15 bp, Artificial Sequence
  dgRNA
  Rock1
agcgaccgcagaaaa

SEQ ID NO: 47515 - DNA, 15 bp, Artificial Sequence
  dgRNA
  Rock1
gcgaccgcagaaaat

SEQ ID NO: 47516 - DNA, 15 bp, Artificial Sequence
  dgRNA
  Rock1
agcagctcttggccg

SEQ ID NO: 47517 - DNA, 15 bp, Artificial Sequence
  dgRNA
  Rock1
cagtgccgggccgag

SEQ ID NO: 47518 - DNA, 15 bp, Artificial Sequence
  dgRNA
  Rimklb
cgagcgcgcgccccg

SEQ ID NO: 47519 - DNA, 15 bp, Artificial Sequence
  dgRNA
  Rimklb
ccgcggctacccctc

SEQ ID NO: 47520 - DNA, 15 bp, Artificial Sequence
  dgRNA
  Rimklb
cggctacccctccgg

SEQ ID NO: 47521 - DNA, 15 bp, Artificial Sequence
  dgRNA
  Rimklb
ctacccctccggcgg

SEQ ID NO: 47522 - DNA, 15 bp, Artificial Sequence
  dgRNA
  Dennd2c
ggtctgataaattgc

SEQ ID NO: 47523 - DNA, 15 bp, Artificial Sequence
  dgRNA
  Dennd2c
tctggtgacttggcc

SEQ ID NO: 47524 - DNA, 15 bp, Artificial Sequence
  dgRNA
  Dennd2c
gtcttcaatttagtg

SEQ ID NO: 47525 - DNA, 15 bp, Artificial Sequence
  dgRNA
  Dennd2c
gttaccacaccctgt

SEQ ID NO: 47526 - DNA, 15 bp, Artificial Sequence
  dgRNA
  Cpxm2
gtgacagtcttctag

SEQ ID NO: 47527 - DNA, 15 bp, Artificial Sequence
  dgRNA
  Cpxm2
cctgggcgggtagga

SEQ ID NO: 47528 - DNA, 15 bp, Artificial Sequence
  dgRNA
  Cpxm2
gcgcctagcctctcc

SEQ ID NO: 47529 - DNA, 15 bp, Artificial Sequence
  dgRNA
  Cpxm2
cgcctagcctctcct

SEQ ID NO: 47530 - DNA, 15 bp, Artificial Sequence
  dgRNA
  Scgb2b18
atgtttgcggatggg

SEQ ID NO: 47531 - DNA, 15 bp, Artificial Sequence
  dgRNA
  Adgrv1
tagtcatggccaagg

SEQ ID NO: 47532 - DNA, 15 bp, Artificial Sequence
  dgRNA
  Adgrv1
gggagttcaccacga

SEQ ID NO: 47533 - DNA, 15 bp, Artificial Sequence
  dgRNA
  Adgrv1
caccacgacggagtg

SEQ ID NO: 47534 - DNA, 15 bp, Artificial Sequence
  dgRNA
  Adgrv1
gacggagtgcggacc

SEQ ID NO: 47535 - DNA, 15 bp, Artificial Sequence
  dgRNA
  Crabp2
gtccgcctactgatg

SEQ ID NO: 47536 - DNA, 15 bp, Artificial Sequence
  dgRNA
  Crabp2
tccgcctactgatgc

SEQ ID NO: 47537 - DNA, 15 bp, Artificial Sequence
  dgRNA
  Crabp2
tactgatgcgggaga

SEQ ID NO: 47538 - DNA, 15 bp, Artificial Sequence
  dgRNA
  Crabp2
ggagggattccggaa

SEQ ID NO: 47539 - DNA, 15 bp, Artificial Sequence
  dgRNA
  Runx1
cctgtgcggatttgg

SEQ ID NO: 47540 - DNA, 15 bp, Artificial Sequence
  dgRNA
  Runx1
tgtcctgtgcggatt

SEQ ID NO: 47541 - DNA, 15 bp, Artificial Sequence
  dgRNA
  Pomt1
gctaaagtagacgcg

SEQ ID NO: 47542 - DNA, 15 bp, Artificial Sequence
  dgRNA
  Pomt1
acgcgaggcccgaaa

SEQ ID NO: 47543 - DNA, 15 bp, Artificial Sequence
  dgRNA
  Pomt1
cacgtgaacagcttg

SEQ ID NO: 47544 - DNA, 15 bp, Artificial Sequence
  dgRNA
  Pomt1
tatgcccaactttga

SEQ ID NO: 47545 - DNA, 15 bp, Artificial Sequence
  dgRNA
  Gcnt2
agctggtacaaaggg

SEQ ID NO: 47546 - DNA, 15 bp, Artificial Sequence
  dgRNA
  Gcnt2
aaacactcgacataa

SEQ ID NO: 47547 - DNA, 15 bp, Artificial Sequence
  dgRNA
  Gcnt2
caccatttaactccc

SEQ ID NO: 47548 - DNA, 15 bp, Artificial Sequence
  dgRNA
  Gcnt2
ccctttgtaccagct

SEQ ID NO: 47549 - DNA, 15 bp, Artificial Sequence
  dgRNA
  Lig1
caccggctcatccac

SEQ ID NO: 47550 - DNA, 15 bp, Artificial Sequence
  dgRNA
  Lig1
accggctcatccaca

SEQ ID NO: 47551 - DNA, 15 bp, Artificial Sequence
  dgRNA
  Lig1
tccgggcgatagttg

SEQ ID NO: 47552 - DNA, 15 bp, Artificial Sequence
  dgRNA
  Lig1
gcacgcgctactcgc

SEQ ID NO: 47553 - DNA, 15 bp, Artificial Sequence
  dgRNA
  Hrsp12
ctgccaaaagttccg

SEQ ID NO: 47554 - DNA, 15 bp, Artificial Sequence
  dgRNA
  Hrsp12
tgccaaaagttccga

SEQ ID NO: 47555 - DNA, 15 bp, Artificial Sequence
  dgRNA
  Hrsp12
ttccgagggcttcgc

SEQ ID NO: 47556 - DNA, 15 bp, Artificial Sequence
  dgRNA
  Hrsp12
ccggtaagaatgaca

SEQ ID NO: 47557 - DNA, 15 bp, Artificial Sequence
  dgRNA
  4930595M18Rik
ccagtaatgacacgg

SEQ ID NO: 47558 - DNA, 15 bp, Artificial Sequence
  dgRNA
  4930595M18Rik
agccttatgactcag

SEQ ID NO: 47559 - DNA, 15 bp, Artificial Sequence
  dgRNA
  4930595M18Rik
ccattctagaatgtc

SEQ ID NO: 47560 - DNA, 15 bp, Artificial Sequence
  dgRNA
  4930595M18Rik
ccaccgtgtcattac

SEQ ID NO: 47561 - DNA, 15 bp, Artificial Sequence
  dgRNA
  Chga
gcgggaccccgaagg

SEQ ID NO: 47562 - DNA, 15 bp, Artificial Sequence
  dgRNA
  Chga
cgggaccccgaaggt

SEQ ID NO: 47563 - DNA, 15 bp, Artificial Sequence
  dgRNA
  Chga
gggaccccgaaggtg

SEQ ID NO: 47564 - DNA, 15 bp, Artificial Sequence
  dgRNA
  Chga
cccgaaggtggggaa

SEQ ID NO: 47565 - DNA, 15 bp, Artificial Sequence
  dgRNA
  Esp1
ctacacatttaaagg

SEQ ID NO: 47566 - DNA, 15 bp, Artificial Sequence
  dgRNA
  Esp1
tagagggcgggtatt

SEQ ID NO: 47567 - DNA, 15 bp, Artificial Sequence
  dgRNA
  Oard1
ctggccggggttatg

SEQ ID NO: 47568 - DNA, 15 bp, Artificial Sequence
  dgRNA
  Oard1
gctggccggggttat

SEQ ID NO: 47569 - DNA, 15 bp, Artificial Sequence
  dgRNA
  Oard1
ggctggccggggtta

SEQ ID NO: 47570 - DNA, 15 bp, Artificial Sequence
  dgRNA
  Ndrg3
gttcctagcgtaagc

SEQ ID NO: 47571 - DNA, 15 bp, Artificial Sequence
  dgRNA
  Ndrg3
gcatgcgtaaacccc

SEQ ID NO: 47572 - DNA, 15 bp, Artificial Sequence
  dgRNA
  Ndrg3
cttgcggtgtcccgg

SEQ ID NO: 47573 - DNA, 15 bp, Artificial Sequence
  dgRNA
  Ndrg3
cttcttgcggtgtcc

SEQ ID NO: 47574 - DNA, 15 bp, Artificial Sequence
  dgRNA
  Vmn2r110
tcccaattgaagtga

SEQ ID NO: 47575 - DNA, 15 bp, Artificial Sequence
  dgRNA
  Vmn2r110
caattgaagtgaagg

SEQ ID NO: 47576 - DNA, 15 bp, Artificial Sequence
  dgRNA
  Vmn2r110
gcaacagaaaaggtt

SEQ ID NO: 47577 - DNA, 15 bp, Artificial Sequence
  dgRNA
  Vmn2r110
tccttcacttcaatt

SEQ ID NO: 47578 - DNA, 15 bp, Artificial Sequence
  dgRNA
  Bcl2
cgggcgggcgctcag

SEQ ID NO: 47579 - DNA, 15 bp, Artificial Sequence
  dgRNA
  Bcl2
gcgggcgctcagagg

SEQ ID NO: 47580 - DNA, 15 bp, Artificial Sequence
  dgRNA
  Bcl2
cgggcgctcagagga

SEQ ID NO: 47581 - DNA, 15 bp, Artificial Sequence
  dgRNA
  Bcl2
cggtgacgtacgtac

SEQ ID NO: 47582 - DNA, 15 bp, Artificial Sequence
  dgRNA
  Sox18
ggggggctctgcgct

SEQ ID NO: 47583 - DNA, 15 bp, Artificial Sequence
  dgRNA
  Sox18
tgccgggaagaaaaa

SEQ ID NO: 47584 - DNA, 15 bp, Artificial Sequence
  dgRNA
  Sox18
aaaagggagccaccg

SEQ ID NO: 47585 - DNA, 15 bp, Artificial Sequence
  dgRNA
  Sox18
agggagccaccgcgg

SEQ ID NO: 47586 - DNA, 15 bp, Artificial Sequence
  dgRNA
  Celf2
gtcaaaaacggaacc

SEQ ID NO: 47587 - DNA, 15 bp, Artificial Sequence
  dgRNA
  Srp14
cgtcactcctcatcc

SEQ ID NO: 47588 - DNA, 15 bp, Artificial Sequence
  dgRNA
  Srp14
catcctggatagacg

SEQ ID NO: 47589 - DNA, 15 bp, Artificial Sequence
  dgRNA
  Srp14
atcctggatagacgc

SEQ ID NO: 47590 - DNA, 15 bp, Artificial Sequence
  dgRNA
  Srp14
ctggatagacgcggg

SEQ ID NO: 47591 - DNA, 15 bp, Artificial Sequence
  dgRNA
  Pole4
aagcatccggacttc

SEQ ID NO: 47592 - DNA, 15 bp, Artificial Sequence
  dgRNA
  Pole4
acttccggctcagct

SEQ ID NO: 47593 - DNA, 15 bp, Artificial Sequence
  dgRNA
  Pole4
cagctaggccacgcc

SEQ ID NO: 47594 - DNA, 15 bp, Artificial Sequence
  dgRNA
  Pole4
agaccccggagtcag

SEQ ID NO: 47595 - DNA, 15 bp, Artificial Sequence
  dgRNA
  Adm2
ctaccgcagcccacc

SEQ ID NO: 47596 - DNA, 15 bp, Artificial Sequence
  dgRNA
  Adm2
taccgcagcccaccc

SEQ ID NO: 47597 - DNA, 15 bp, Artificial Sequence
  dgRNA
  Adm2
cgcagcccacccggg

SEQ ID NO: 47598 - DNA, 15 bp, Artificial Sequence
  dgRNA
  Adm2
agcccacccgggtgg

SEQ ID NO: 47599 - DNA, 15 bp, Artificial Sequence
  dgRNA
  Olfr800
gttaatcactactcc

SEQ ID NO: 47600 - DNA, 15 bp, Artificial Sequence
  dgRNA
  Olfr800
aatgcagattgggta

SEQ ID NO: 47601 - DNA, 15 bp, Artificial Sequence
  dgRNA
  Olfr800
atgcagattgggtag

SEQ ID NO: 47602 - DNA, 15 bp, Artificial Sequence
  dgRNA
  Olfr800
acacactggttgctt

SEQ ID NO: 47603 - DNA, 15 bp, Artificial Sequence
  dgRNA
  Hecw1
tccagataagcctcg

SEQ ID NO: 47604 - DNA, 15 bp, Artificial Sequence
  dgRNA
  Hecw1
acgcgtgctaagtgt

SEQ ID NO: 47605 - DNA, 15 bp, Artificial Sequence
  dgRNA
  Hecw1
gtgctaagtgttgga

SEQ ID NO: 47606 - DNA, 15 bp, Artificial Sequence
  dgRNA
  Hecw1
ggtgcgtgaggctgc

SEQ ID NO: 47607 - DNA, 15 bp, Artificial Sequence
  dgRNA
  C030039L03Rik
gcgcagctgccagat

SEQ ID NO: 47608 - DNA, 15 bp, Artificial Sequence
  dgRNA
  C030039L03Rik
gcccaggttgcatgc

SEQ ID NO: 47609 - DNA, 15 bp, Artificial Sequence
  dgRNA
  C030039L03Rik
cccaggttgcatgct

SEQ ID NO: 47610 - DNA, 15 bp, Artificial Sequence
  dgRNA
  C030039L03Rik
cgccctgtgctttgt

SEQ ID NO: 47611 - DNA, 15 bp, Artificial Sequence
  dgRNA
  Cd300c
ctgcacctgttcatc

SEQ ID NO: 47612 - DNA, 15 bp, Artificial Sequence
  dgRNA
  Dcpp2
gctgtagtgccaact

SEQ ID NO: 47613 - DNA, 15 bp, Artificial Sequence
  dgRNA
  Dcpp2
cagcctacgtctaca

SEQ ID NO: 47614 - DNA, 15 bp, Artificial Sequence
  dgRNA
  Ssna1
tagagtcgcagtcat

SEQ ID NO: 47615 - DNA, 15 bp, Artificial Sequence
  dgRNA
  Ssna1
agtcgcagtcatcgg

SEQ ID NO: 47616 - DNA, 15 bp, Artificial Sequence
  dgRNA
  Ssna1
ccaccgccacaccct

SEQ ID NO: 47617 - DNA, 15 bp, Artificial Sequence
  dgRNA
  Ssna1
gcccagtagagcgca

SEQ ID NO: 47618 - DNA, 15 bp, Artificial Sequence
  dgRNA
  Tmcc3
tttatcacactcaag

SEQ ID NO: 47619 - DNA, 15 bp, Artificial Sequence
  dgRNA
  Tmcc3
gtcgctcatctgagc

SEQ ID NO: 47620 - DNA, 15 bp, Artificial Sequence
  dgRNA
  Tmcc3
tcgctcatctgagcc

SEQ ID NO: 47621 - DNA, 15 bp, Artificial Sequence
  dgRNA
  Tmcc3
agccgggagaggcgt

SEQ ID NO: 47622 - DNA, 15 bp, Artificial Sequence
  dgRNA
  Stc1
gtcttatcggtcctc

SEQ ID NO: 47623 - DNA, 15 bp, Artificial Sequence
  dgRNA
  Stc1
ttatagccgtcttat

SEQ ID NO: 47624 - DNA, 15 bp, Artificial Sequence
  dgRNA
  Vmn2r106
gtaatagaaaagcct

SEQ ID NO: 47625 - DNA, 15 bp, Artificial Sequence
  dgRNA
  Vmn2r106
tgaggcactctactc

SEQ ID NO: 47626 - DNA, 15 bp, Artificial Sequence
  dgRNA
  Rab11fip1
acggactcagacaac

SEQ ID NO: 47627 - DNA, 15 bp, Artificial Sequence
  dgRNA
  Rab11fip1
cggactcagacaact

SEQ ID NO: 47628 - DNA, 15 bp, Artificial Sequence
  dgRNA
  Rab11fip1
cccgccttctccgcg

SEQ ID NO: 47629 - DNA, 15 bp, Artificial Sequence
  dgRNA
  Rab11fip1
gcgaggcccgccccc

SEQ ID NO: 47630 - DNA, 15 bp, Artificial Sequence
  dgRNA
  Prss53
gttcaaaatcattgg

SEQ ID NO: 47631 - DNA, 15 bp, Artificial Sequence
  dgRNA
  Prss53
gggccacacaaccac

SEQ ID NO: 47632 - DNA, 15 bp, Artificial Sequence
  dgRNA
  Prss53
caagctaagcgctgt

SEQ ID NO: 47633 - DNA, 15 bp, Artificial Sequence
  dgRNA
  Prss53
aaagtaacacctgac

SEQ ID NO: 47634 - DNA, 15 bp, Artificial Sequence
  dgRNA
  Arl2bp
tggctgctggaaccg

SEQ ID NO: 47635 - DNA, 15 bp, Artificial Sequence
  dgRNA
  Arl2bp
ggtaaccatagtgac

SEQ ID NO: 47636 - DNA, 15 bp, Artificial Sequence
  dgRNA
  Arl2bp
aaccatagtgacagg

SEQ ID NO: 47637 - DNA, 15 bp, Artificial Sequence
  dgRNA
  Arl2bp
tagtgacaggaggcg

SEQ ID NO: 47638 - DNA, 15 bp, Artificial Sequence
  dgRNA
  Spcs3
ctctttgatgattgg

SEQ ID NO: 47639 - DNA, 15 bp, Artificial Sequence
  dgRNA
  Spcs3
gaaagcaccgccttc

SEQ ID NO: 47640 - DNA, 15 bp, Artificial Sequence
  dgRNA
  Spcs3
cttccggcgcgtgca

SEQ ID NO: 47641 - DNA, 15 bp, Artificial Sequence
  dgRNA
  Spcs3
tgcacggccgcccag

SEQ ID NO: 47642 - DNA, 15 bp, Artificial Sequence
  dgRNA
  Ankrd22
ctctcactaatgagt

SEQ ID NO: 47643 - DNA, 15 bp, Artificial Sequence
  dgRNA
  Ankrd22
gttggctgactatga

SEQ ID NO: 47644 - DNA, 15 bp, Artificial Sequence
  dgRNA
  Ankrd22
tactgccgcctccac

SEQ ID NO: 47645 - DNA, 15 bp, Artificial Sequence
  dgRNA
  Ankrd22
cgcctccactggcag

SEQ ID NO: 47646 - DNA, 15 bp, Artificial Sequence
  dgRNA
  Ing1
cccgctcgtccctcc

SEQ ID NO: 47647 - DNA, 15 bp, Artificial Sequence
  dgRNA
  Ing1
cgtccctcctggaag

SEQ ID NO: 47648 - DNA, 15 bp, Artificial Sequence
  dgRNA
  Ing1
tagtactaggcgtgc

SEQ ID NO: 47649 - DNA, 15 bp, Artificial Sequence
  dgRNA
  Ing1
agtactaggcgtgcg

SEQ ID NO: 47650 - DNA, 15 bp, Artificial Sequence
  dgRNA
  1700021F05Rik
ccgacctcaacagcg

SEQ ID NO: 47651 - DNA, 15 bp, Artificial Sequence
  dgRNA
  1700021F05Rik
cagcgtggtcctcca

SEQ ID NO: 47652 - DNA, 15 bp, Artificial Sequence
  dgRNA
  1700021F05Rik
ggcgccgcgtccagc

SEQ ID NO: 47653 - DNA, 15 bp, Artificial Sequence
  dgRNA
  1700021F05Rik
gcgccgcgtccagca

SEQ ID NO: 47654 - DNA, 15 bp, Artificial Sequence
  dgRNA
  Tbata
cagcttcgcgtctcc

SEQ ID NO: 47655 - DNA, 15 bp, Artificial Sequence
  dgRNA
  Tbata
agcttcgcgtctccc

SEQ ID NO: 47656 - DNA, 15 bp, Artificial Sequence
  dgRNA
  Tbata
tcgcgtctcccggga

SEQ ID NO: 47657 - DNA, 15 bp, Artificial Sequence
  dgRNA
  Tbata
ccgggaaggaccacg

SEQ ID NO: 47658 - DNA, 15 bp, Artificial Sequence
  dgRNA
  Ucn3
cctattaaaaatctc

SEQ ID NO: 47659 - DNA, 15 bp, Artificial Sequence
  dgRNA
  Ucn3
gccccagatttccac

SEQ ID NO: 47660 - DNA, 15 bp, Artificial Sequence
  dgRNA
  Ucn3
ctcccagtggaaatc

SEQ ID NO: 47661 - DNA, 15 bp, Artificial Sequence
  dgRNA
  Phactr2
gccctcctgcgccac

SEQ ID NO: 47662 - DNA, 15 bp, Artificial Sequence
  dgRNA
  Phactr2
ccctcctgcgccaca

SEQ ID NO: 47663 - DNA, 15 bp, Artificial Sequence
  dgRNA
  Phactr2
cctcctgcgccacag

SEQ ID NO: 47664 - DNA, 15 bp, Artificial Sequence
  dgRNA
  Phactr2
ctcctgcgccacagg

SEQ ID NO: 47665 - DNA, 15 bp, Artificial Sequence
  dgRNA
  1700061G19Rik
atgagctaagaagcg

SEQ ID NO: 47666 - DNA, 15 bp, Artificial Sequence
  dgRNA
  1700061G19Rik
tggtgtatgaccaga

SEQ ID NO: 47667 - DNA, 15 bp, Artificial Sequence
  dgRNA
  1700061G19Rik
ggtgtatgaccagaa

SEQ ID NO: 47668 - DNA, 15 bp, Artificial Sequence
  dgRNA
  1700061G19Rik
gtcatgttgccatcg

SEQ ID NO: 47669 - DNA, 15 bp, Artificial Sequence
  dgRNA
  Cyb561a3
acctgtctctggacg

SEQ ID NO: 47670 - DNA, 15 bp, Artificial Sequence
  dgRNA
  Cyb561a3
tctggacggggtctg

SEQ ID NO: 47671 - DNA, 15 bp, Artificial Sequence
  dgRNA
  Cyb561a3
ggacgcagcgctcct

SEQ ID NO: 47672 - DNA, 15 bp, Artificial Sequence
  dgRNA
  Cyb561a3
agcgctcctaggaat

SEQ ID NO: 47673 - DNA, 15 bp, Artificial Sequence
  dgRNA
  Mtnr1a
ccgagtccaagttgc

SEQ ID NO: 47674 - DNA, 15 bp, Artificial Sequence
  dgRNA
  Mtnr1a
cgagtccaagttgct

SEQ ID NO: 47675 - DNA, 15 bp, Artificial Sequence
  dgRNA
  Mtnr1a
agggtgtcctaccac

SEQ ID NO: 47676 - DNA, 15 bp, Artificial Sequence
  dgRNA
  Mtnr1a
gggtgtcctaccacc

SEQ ID NO: 47677 - DNA, 15 bp, Artificial Sequence
  dgRNA
  Wac
aaagcagcaaccgga

SEQ ID NO: 47678 - DNA, 15 bp, Artificial Sequence
  dgRNA
  Wac
aagcagcaaccggaa

SEQ ID NO: 47679 - DNA, 15 bp, Artificial Sequence
  dgRNA
  Wac
accggaagggcttga

SEQ ID NO: 47680 - DNA, 15 bp, Artificial Sequence
  dgRNA
  Wac
ccggaagggcttgac

SEQ ID NO: 47681 - DNA, 15 bp, Artificial Sequence
  dgRNA
  Fbxo44
ctccattggtccgta

SEQ ID NO: 47682 - DNA, 15 bp, Artificial Sequence
  dgRNA
  Fbxo44
gtaaggctcatcccc

SEQ ID NO: 47683 - DNA, 15 bp, Artificial Sequence
  dgRNA
  Fbxo44
gttgacaaggagaat

SEQ ID NO: 47684 - DNA, 15 bp, Artificial Sequence
  dgRNA
  Fbxo44
ggtctgatgagtagt

SEQ ID NO: 47685 - DNA, 15 bp, Artificial Sequence
  dgRNA
  Tmem209
ccggtaactgtagcc

SEQ ID NO: 47686 - DNA, 15 bp, Artificial Sequence
  dgRNA
  Tmem209
tgcgcatgtgcagta

SEQ ID NO: 47687 - DNA, 15 bp, Artificial Sequence
  dgRNA
  Tmem209
gttaccggaagaacc

SEQ ID NO: 47688 - DNA, 15 bp, Artificial Sequence
  dgRNA
  Tmem209
agttaccggaagaac

SEQ ID NO: 47689 - DNA, 15 bp, Artificial Sequence
  dgRNA
  Isy1
ttgctgacttaggcg

SEQ ID NO: 47690 - DNA, 15 bp, Artificial Sequence
  dgRNA
  Isy1
tgctgacttaggcgc

SEQ ID NO: 47691 - DNA, 15 bp, Artificial Sequence
  dgRNA
  Isy1
cgcgggatgacgcac

SEQ ID NO: 47692 - DNA, 15 bp, Artificial Sequence
  dgRNA
  Isy1
gcactggacacgcgt

SEQ ID NO: 47693 - DNA, 15 bp, Artificial Sequence
  dgRNA
  Phyhip
atctgtatagctccc

SEQ ID NO: 47694 - DNA, 15 bp, Artificial Sequence
  dgRNA
  Phyhip
tctgtatagctccca

SEQ ID NO: 47695 - DNA, 15 bp, Artificial Sequence
  dgRNA
  Phyhip
ctgtatagctcccag

SEQ ID NO: 47696 - DNA, 15 bp, Artificial Sequence
  dgRNA
  Phyhip
caagcctgggcgagc

SEQ ID NO: 47697 - DNA, 15 bp, Artificial Sequence
  dgRNA
  Nek7
aaacgagagttttcc

SEQ ID NO: 47698 - DNA, 15 bp, Artificial Sequence
  dgRNA
  Tube1
ctcaaggatgttgac

SEQ ID NO: 47699 - DNA, 15 bp, Artificial Sequence
  dgRNA
  Tube1
ctaggatttacctgc

SEQ ID NO: 47700 - DNA, 15 bp, Artificial Sequence
  dgRNA
  Tube1
ggatttacctgccgg

SEQ ID NO: 47701 - DNA, 15 bp, Artificial Sequence
  dgRNA
  Tube1
gaggcccagtcgcta

SEQ ID NO: 47702 - DNA, 15 bp, Artificial Sequence
  dgRNA
  Otud7a
agctcggcgcgaccg

SEQ ID NO: 47703 - DNA, 15 bp, Artificial Sequence
  dgRNA
  Otud7a
cgcgaccgaggccaa

SEQ ID NO: 47704 - DNA, 15 bp, Artificial Sequence
  dgRNA
  Otud7a
gaccgaggccaacgg

SEQ ID NO: 47705 - DNA, 15 bp, Artificial Sequence
  dgRNA
  Otud7a
ctacccgcaccactt

SEQ ID NO: 47706 - DNA, 15 bp, Artificial Sequence
  dgRNA
  Nmur1
tacctaaatgacttc

SEQ ID NO: 47707 - DNA, 15 bp, Artificial Sequence
  dgRNA
  Nmur1
caactacagagtatc

SEQ ID NO: 47708 - DNA, 15 bp, Artificial Sequence
  dgRNA
  Nmur1
tagtcacatgccact

SEQ ID NO: 47709 - DNA, 15 bp, Artificial Sequence
  dgRNA
  Nmur1
ttagtcacatgccac

SEQ ID NO: 47710 - DNA, 15 bp, Artificial Sequence
  dgRNA
  Taar7b
agcctttatataata

SEQ ID NO: 47711 - DNA, 15 bp, Artificial Sequence
  dgRNA
  Taar7b
gactgtgaattagga

SEQ ID NO: 47712 - DNA, 15 bp, Artificial Sequence
  dgRNA
  Taar7b
cgtcttgtgttaaga

SEQ ID NO: 47713 - DNA, 15 bp, Artificial Sequence
  dgRNA
  Spsb4
gcgccacttcggccc

SEQ ID NO: 47714 - DNA, 15 bp, Artificial Sequence
  dgRNA
  Spsb4
cgccacttcggccca

SEQ ID NO: 47715 - DNA, 15 bp, Artificial Sequence
  dgRNA
  Spsb4
gccacttcggcccag

SEQ ID NO: 47716 - DNA, 15 bp, Artificial Sequence
  dgRNA
  Spsb4
ttcggcccaggggcg

SEQ ID NO: 47717 - DNA, 15 bp, Artificial Sequence
  dgRNA
  Pogz
aatcactcgaacccg

SEQ ID NO: 47718 - DNA, 15 bp, Artificial Sequence
  dgRNA
  Pogz
atcactcgaacccga

SEQ ID NO: 47719 - DNA, 15 bp, Artificial Sequence
  dgRNA
  Pogz
actcgaacccgaggg

SEQ ID NO: 47720 - DNA, 15 bp, Artificial Sequence
  dgRNA
  Pogz
ttcaccctcggggag

SEQ ID NO: 47721 - DNA, 15 bp, Artificial Sequence
  dgRNA
  Pkia
aatcagcctccactc

SEQ ID NO: 47722 - DNA, 15 bp, Artificial Sequence
  dgRNA
  Pkia
tcagcctccactccg

SEQ ID NO: 47723 - DNA, 15 bp, Artificial Sequence
  dgRNA
  Pkia
gggagcagcgtcttt

SEQ ID NO: 47724 - DNA, 15 bp, Artificial Sequence
  dgRNA
  Pkia
ggagcagcgtctttc

SEQ ID NO: 47725 - DNA, 15 bp, Artificial Sequence
  dgRNA
  Agpat4
tctggctccaacagg

SEQ ID NO: 47726 - DNA, 15 bp, Artificial Sequence
  dgRNA
  Agpat4
tgactcatgttacac

SEQ ID NO: 47727 - DNA, 15 bp, Artificial Sequence
  dgRNA
  Agpat4
gactcatgttacacg

SEQ ID NO: 47728 - DNA, 15 bp, Artificial Sequence
  dgRNA
  Agpat4
agtcgtagctttaaa

SEQ ID NO: 47729 - DNA, 15 bp, Artificial Sequence
  dgRNA
  Chpf
ggacagcggccgcct

SEQ ID NO: 47730 - DNA, 15 bp, Artificial Sequence
  dgRNA
  Chpf
cagcggccgccttgg

SEQ ID NO: 47731 - DNA, 15 bp, Artificial Sequence
  dgRNA
  Chpf
gccgccttggaggcc

SEQ ID NO: 47732 - DNA, 15 bp, Artificial Sequence
  dgRNA
  Chpf
ccgccttggaggccc

SEQ ID NO: 47733 - DNA, 15 bp, Artificial Sequence
  dgRNA
  Slc45a3
cggtcgcgaccagaa

SEQ ID NO: 47734 - DNA, 15 bp, Artificial Sequence
  dgRNA
  Slc45a3
ccccactgagtaacc

SEQ ID NO: 47735 - DNA, 15 bp, Artificial Sequence
  dgRNA
  Slc45a3
cgggcagcccccgcg

SEQ ID NO: 47736 - DNA, 15 bp, Artificial Sequence
  dgRNA
  Slc45a3
tggtcgcgaccggac

SEQ ID NO: 47737 - DNA, 15 bp, Artificial Sequence
  dgRNA
  Akap2
cgctagcattgcctc

SEQ ID NO: 47738 - DNA, 15 bp, Artificial Sequence
  dgRNA
  Akap2
catcctgggccgact

SEQ ID NO: 47739 - DNA, 15 bp, Artificial Sequence
  dgRNA
  Akap2
atcctgggccgacta

SEQ ID NO: 47740 - DNA, 15 bp, Artificial Sequence
  dgRNA
  Akap2
ctgggccgactaggg

SEQ ID NO: 47741 - DNA, 15 bp, Artificial Sequence
  dgRNA
  9130023H24Rik
gccgtgagctgcgcg

SEQ ID NO: 47742 - DNA, 15 bp, Artificial Sequence
  dgRNA
  9130023H24Rik
gagagcgagtccgta

SEQ ID NO: 47743 - DNA, 15 bp, Artificial Sequence
  dgRNA
  9130023H24Rik
agagcgagtccgtaa

SEQ ID NO: 47744 - DNA, 15 bp, Artificial Sequence
  dgRNA
  9130023H24Rik
cgagtccgtaagggc

SEQ ID NO: 47745 - DNA, 15 bp, Artificial Sequence
  dgRNA
  Golph3
aagtgtccgccgaag

SEQ ID NO: 47746 - DNA, 15 bp, Artificial Sequence
  dgRNA
  Golph3
agtgtccgccgaagt

SEQ ID NO: 47747 - DNA, 15 bp, Artificial Sequence
  dgRNA
  Golph3
gtccgccgaagtggg

SEQ ID NO: 47748 - DNA, 15 bp, Artificial Sequence
  dgRNA
  Golph3
cgccgaagtgggagg

SEQ ID NO: 47749 - DNA, 15 bp, Artificial Sequence
  dgRNA
  Tmx3
cacttgcgccgtcac

SEQ ID NO: 47750 - DNA, 15 bp, Artificial Sequence
  dgRNA
  Tmx3
aggaagaaccccgca

SEQ ID NO: 47751 - DNA, 15 bp, Artificial Sequence
  dgRNA
  Tmx3
cgcgtgcgcactgct

SEQ ID NO: 47752 - DNA, 15 bp, Artificial Sequence
  dgRNA
  Tmx3
gcgtgcgcactgctt

SEQ ID NO: 47753 - DNA, 15 bp, Artificial Sequence
  dgRNA
  Kcne4
ctgggttggtcggtc

SEQ ID NO: 47754 - DNA, 15 bp, Artificial Sequence
  dgRNA
  Kcne4
tgggttggtcggtcc

SEQ ID NO: 47755 - DNA, 15 bp, Artificial Sequence
  dgRNA
  Kcne4
tggtcggtccgggac

SEQ ID NO: 47756 - DNA, 15 bp, Artificial Sequence
  dgRNA
  Kcne4
ggtcggtccgggaca

SEQ ID NO: 47757 - DNA, 15 bp, Artificial Sequence
  dgRNA
  Anapc7
ttactagcctccgcg

SEQ ID NO: 47758 - DNA, 15 bp, Artificial Sequence
  dgRNA
  Anapc7
aactacgattcctac

SEQ ID NO: 47759 - DNA, 15 bp, Artificial Sequence
  dgRNA
  Anapc7
actacgattcctact

SEQ ID NO: 47760 - DNA, 15 bp, Artificial Sequence
  dgRNA
  Anapc7
cgattcctactggga

SEQ ID NO: 47761 - DNA, 15 bp, Artificial Sequence
  dgRNA
  Sh3bp2
cttcctcattcgcat

SEQ ID NO: 47762 - DNA, 15 bp, Artificial Sequence
  dgRNA
  Sh3bp2
cctcattcgcattgg

SEQ ID NO: 47763 - DNA, 15 bp, Artificial Sequence
  dgRNA
  Sh3bp2
gatggctcttaattc

SEQ ID NO: 47764 - DNA, 15 bp, Artificial Sequence
  dgRNA
  Sh3bp2
gaaactgacgtaagg

SEQ ID NO: 47765 - DNA, 15 bp, Artificial Sequence
  dgRNA
  Ano4
tgccgcccctgcacc

SEQ ID NO: 47766 - DNA, 15 bp, Artificial Sequence
  dgRNA
  Ano4
cgcccctgcacccgg

SEQ ID NO: 47767 - DNA, 15 bp, Artificial Sequence
  dgRNA
  Ano4
gcccctgcacccggt

SEQ ID NO: 47768 - DNA, 15 bp, Artificial Sequence
  dgRNA
  Ano4
cccctgcacccggtg

SEQ ID NO: 47769 - DNA, 15 bp, Artificial Sequence
  dgRNA
  Hes1
tcaggcgcgcgccat

SEQ ID NO: 47770 - DNA, 15 bp, Artificial Sequence
  dgRNA
  Hes1
gtgcctagcggccaa

SEQ ID NO: 47771 - DNA, 15 bp, Artificial Sequence
  dgRNA
  Hes1
tgcctagcggccaat

SEQ ID NO: 47772 - DNA, 15 bp, Artificial Sequence
  dgRNA
  Hes1
gcctagcggccaatg

SEQ ID NO: 47773 - DNA, 15 bp, Artificial Sequence
  dgRNA
  Epdr1
tgtcctccttgaggg

SEQ ID NO: 47774 - DNA, 15 bp, Artificial Sequence
  dgRNA
  Epdr1
gggggttgcagttct

SEQ ID NO: 47775 - DNA, 15 bp, Artificial Sequence
  dgRNA
  Epdr1
agtgcgatgcccttt

SEQ ID NO: 47776 - DNA, 15 bp, Artificial Sequence
  dgRNA
  Epdr1
cctttaggatgctag

SEQ ID NO: 47777 - DNA, 15 bp, Artificial Sequence
  dgRNA
  Aup1
gtcaggagctaacag

SEQ ID NO: 47778 - DNA, 15 bp, Artificial Sequence
  dgRNA
  Aup1
gcccgccatgcccga

SEQ ID NO: 47779 - DNA, 15 bp, Artificial Sequence
  dgRNA
  Aup1
gcccgccctactcag

SEQ ID NO: 47780 - DNA, 15 bp, Artificial Sequence
  dgRNA
  Aup1
cgccctactcagagg

SEQ ID NO: 47781 - DNA, 15 bp, Artificial Sequence
  dgRNA
  Itpka
cttccacgttacact

SEQ ID NO: 47782 - DNA, 15 bp, Artificial Sequence
  dgRNA
  Itpka
ttccacgttacactc

SEQ ID NO: 47783 - DNA, 15 bp, Artificial Sequence
  dgRNA
  Itpka
agcagcgagggcccc

SEQ ID NO: 47784 - DNA, 15 bp, Artificial Sequence
  dgRNA
  Itpka
agcgagggcccccgg

SEQ ID NO: 47785 - DNA, 15 bp, Artificial Sequence
  dgRNA
  Cldn12
caccttattagggat

SEQ ID NO: 47786 - DNA, 15 bp, Artificial Sequence
  dgRNA
  Slx4ip
ccgccatttttattt

SEQ ID NO: 47787 - DNA, 15 bp, Artificial Sequence
  dgRNA
  Slx4ip
aagccatttttcgtt

SEQ ID NO: 47788 - DNA, 15 bp, Artificial Sequence
  dgRNA
  Slx4ip
agccatttttcgttt

SEQ ID NO: 47789 - DNA, 15 bp, Artificial Sequence
  dgRNA
  Slx4ip
cccattaccttagcc

SEQ ID NO: 47790 - DNA, 15 bp, Artificial Sequence
  dgRNA
  Cyp4f37
aggccaaatcaagtt

SEQ ID NO: 47791 - DNA, 15 bp, Artificial Sequence
  dgRNA
  Cyp4f37
caggccaaatcaagt

SEQ ID NO: 47792 - DNA, 15 bp, Artificial Sequence
  dgRNA
  Hvcn1
ttgtatctcgagctg

SEQ ID NO: 47793 - DNA, 15 bp, Artificial Sequence
  dgRNA
  Hvcn1
tgtatctcgagctga

SEQ ID NO: 47794 - DNA, 15 bp, Artificial Sequence
  dgRNA
  Hvcn1
cacacccgccagccg

SEQ ID NO: 47795 - DNA, 15 bp, Artificial Sequence
  dgRNA
  Hvcn1
acacccgccagccgc

SEQ ID NO: 47796 - DNA, 15 bp, Artificial Sequence
  dgRNA
  Theg
acttagctccaacac

SEQ ID NO: 47797 - DNA, 15 bp, Artificial Sequence
  dgRNA
  Theg
gggcctcggaatcca

SEQ ID NO: 47798 - DNA, 15 bp, Artificial Sequence
  dgRNA
  Theg
ggcctcggaatccat

SEQ ID NO: 47799 - DNA, 15 bp, Artificial Sequence
  dgRNA
  Theg
ctcggaatccatggg

SEQ ID NO: 47800 - DNA, 15 bp, Artificial Sequence
  dgRNA
  Gm826
aaacctatttatagc

SEQ ID NO: 47801 - DNA, 15 bp, Artificial Sequence
  dgRNA
  Gm826
atgcaagagttaatg

SEQ ID NO: 47802 - DNA, 15 bp, Artificial Sequence
  dgRNA
  Gm826
taatgtggccagcgg

SEQ ID NO: 47803 - DNA, 15 bp, Artificial Sequence
  dgRNA
  Gm826
aatgtggccagcggt

SEQ ID NO: 47804 - DNA, 15 bp, Artificial Sequence
  dgRNA
  Pank4
gacacttgcttgtct

SEQ ID NO: 47805 - DNA, 15 bp, Artificial Sequence
  dgRNA
  Pank4
cttgtctaggacggt

SEQ ID NO: 47806 - DNA, 15 bp, Artificial Sequence
  dgRNA
  Pank4
ttgtctaggacggtc

SEQ ID NO: 47807 - DNA, 15 bp, Artificial Sequence
  dgRNA
  Pank4
tctaggacggtcggg

SEQ ID NO: 47808 - DNA, 15 bp, Artificial Sequence
  dgRNA
  Map7
tcgcgctcgctcgct

SEQ ID NO: 47809 - DNA, 15 bp, Artificial Sequence
  dgRNA
  Map7
tcgctcgctcgggcg

SEQ ID NO: 47810 - DNA, 15 bp, Artificial Sequence
  dgRNA
  Map7
ctcgctcgggcgcgg

SEQ ID NO: 47811 - DNA, 15 bp, Artificial Sequence
  dgRNA
  Map7
ggcgcggcggtggct

SEQ ID NO: 47812 - DNA, 15 bp, Artificial Sequence
  dgRNA
  Atp6v0e2
cggaagtcccgccct

SEQ ID NO: 47813 - DNA, 15 bp, Artificial Sequence
  dgRNA
  Atp6v0e2
ggttctgcgtgatag

SEQ ID NO: 47814 - DNA, 15 bp, Artificial Sequence
  dgRNA
  Atp6v0e2
ggcgagctatcccag

SEQ ID NO: 47815 - DNA, 15 bp, Artificial Sequence
  dgRNA
  Atp6v0e2
cagcggacgatgttc

SEQ ID NO: 47816 - DNA, 15 bp, Artificial Sequence
  dgRNA
  Gm19345
cttagggtaggatga

SEQ ID NO: 47817 - DNA, 15 bp, Artificial Sequence
  dgRNA
  Gm19345
ccacactttttggag

SEQ ID NO: 47818 - DNA, 15 bp, Artificial Sequence
  dgRNA
  Gm19345
atccttaatccactg

SEQ ID NO: 47819 - DNA, 15 bp, Artificial Sequence
  dgRNA
  Gm19345
tccttaatccactgg

SEQ ID NO: 47820 - DNA, 15 bp, Artificial Sequence
  dgRNA
  Ptpro
aggcggagcctggtc

SEQ ID NO: 47821 - DNA, 15 bp, Artificial Sequence
  dgRNA
  Ptpro
ggcggagcctggtct

SEQ ID NO: 47822 - DNA, 15 bp, Artificial Sequence
  dgRNA
  Ptpro
gcggagcctggtctg

SEQ ID NO: 47823 - DNA, 15 bp, Artificial Sequence
  dgRNA
  Ptpro
cggagcctggtctgg

SEQ ID NO: 47824 - DNA, 15 bp, Artificial Sequence
  dgRNA
  Nelfb
ccctgaaactgtcgt

SEQ ID NO: 47825 - DNA, 15 bp, Artificial Sequence
  dgRNA
  Nelfb
aactgtcgtaggttc

SEQ ID NO: 47826 - DNA, 15 bp, Artificial Sequence
  dgRNA
  Nelfb
tactgacaagagcgc

SEQ ID NO: 47827 - DNA, 15 bp, Artificial Sequence
  dgRNA
  Nelfb
gagcgcgggctagag

SEQ ID NO: 47828 - DNA, 15 bp, Artificial Sequence
  dgRNA
  9530077C05Rik
ccgcgttgtgcacgc

SEQ ID NO: 47829 - DNA, 15 bp, Artificial Sequence
  dgRNA
  9530077C05Rik
cgcgttgtgcacgct

SEQ ID NO: 47830 - DNA, 15 bp, Artificial Sequence
  dgRNA
  9530077C05Rik
tctctccctacgagc

SEQ ID NO: 47831 - DNA, 15 bp, Artificial Sequence
  dgRNA
  9530077C05Rik
ctctccctacgagca

SEQ ID NO: 47832 - DNA, 15 bp, Artificial Sequence
  dgRNA
  Rusc1
acgtcaagtgttgcg

SEQ ID NO: 47833 - DNA, 15 bp, Artificial Sequence
  dgRNA
  Rusc1
cgtcaagtgttgcgt

SEQ ID NO: 47834 - DNA, 15 bp, Artificial Sequence
  dgRNA
  Rusc1
gtcaagtgttgcgtg

SEQ ID NO: 47835 - DNA, 15 bp, Artificial Sequence
  dgRNA
  Rusc1
tcaagtgttgcgtgg

SEQ ID NO: 47836 - DNA, 15 bp, Artificial Sequence
  dgRNA
  6430548M08Rik
tgaggcgcggcggag

SEQ ID NO: 47837 - DNA, 15 bp, Artificial Sequence
  dgRNA
  Mpv17l
gaggtccaatcgctc

SEQ ID NO: 47838 - DNA, 15 bp, Artificial Sequence
  dgRNA
  Mpv17l
aagcgccagagcgat

SEQ ID NO: 47839 - DNA, 15 bp, Artificial Sequence
  dgRNA
  Slc26a2
ccacgcagtagatcg

SEQ ID NO: 47840 - DNA, 15 bp, Artificial Sequence
  dgRNA
  Slc26a2
cacgcagtagatcgc

SEQ ID NO: 47841 - DNA, 15 bp, Artificial Sequence
  dgRNA
  Slc26a2
agatcgcgggatcca

SEQ ID NO: 47842 - DNA, 15 bp, Artificial Sequence
  dgRNA
  Slc26a2
acagacattgacgtg

SEQ ID NO: 47843 - DNA, 15 bp, Artificial Sequence
  dgRNA
  Tiprl
tggggtgacgtcacc

SEQ ID NO: 47844 - DNA, 15 bp, Artificial Sequence
  dgRNA
  Tiprl
tcacccggagacttc

SEQ ID NO: 47845 - DNA, 15 bp, Artificial Sequence
  dgRNA
  Tiprl
cacccggagacttca

SEQ ID NO: 47846 - DNA, 15 bp, Artificial Sequence
  dgRNA
  Tiprl
ccggagacttcaggg

SEQ ID NO: 47847 - DNA, 15 bp, Artificial Sequence
  dgRNA
  Rapgef5
aacagtcgaacagtg

SEQ ID NO: 47848 - DNA, 15 bp, Artificial Sequence
  dgRNA
  Rapgef5
aatattttgatgccc

SEQ ID NO: 47849 - DNA, 15 bp, Artificial Sequence
  dgRNA
  Rapgef5
tgagtaattgctacc

SEQ ID NO: 47850 - DNA, 15 bp, Artificial Sequence
  dgRNA
  Rapgef5
taattgctaccagga

SEQ ID NO: 47851 - DNA, 15 bp, Artificial Sequence
  dgRNA
  Odf3l2
tccggccgaccagct

SEQ ID NO: 47852 - DNA, 15 bp, Artificial Sequence
  dgRNA
  Odf3l2
cgaccagcttggctc

SEQ ID NO: 47853 - DNA, 15 bp, Artificial Sequence
  dgRNA
  Odf3l2
gagatccttgcttag

SEQ ID NO: 47854 - DNA, 15 bp, Artificial Sequence
  dgRNA
  Odf3l2
cttgcttaggggaca

SEQ ID NO: 47855 - DNA, 15 bp, Artificial Sequence
  dgRNA
  Marco
cctggggtagctaac

SEQ ID NO: 47856 - DNA, 15 bp, Artificial Sequence
  dgRNA
  Marco
gtagctaactggatc

SEQ ID NO: 47857 - DNA, 15 bp, Artificial Sequence
  dgRNA
  Marco
ctaactggatctgga

SEQ ID NO: 47858 - DNA, 15 bp, Artificial Sequence
  dgRNA
  Marco
tcacctaagggcctg

SEQ ID NO: 47859 - DNA, 15 bp, Artificial Sequence
  dgRNA
  Nkx1-1
gaggctgattttgcg

SEQ ID NO: 47860 - DNA, 15 bp, Artificial Sequence
  dgRNA
  Nkx1-1
gattttgcggggcgc

SEQ ID NO: 47861 - DNA, 15 bp, Artificial Sequence
  dgRNA
  Nkx1-1
attttgcggggcgca

SEQ ID NO: 47862 - DNA, 15 bp, Artificial Sequence
  dgRNA
  Nkx1-1
gcggggcgcagggat

SEQ ID NO: 47863 - DNA, 15 bp, Artificial Sequence
  dgRNA
  Cfl1
ggtccattgcaccaa

SEQ ID NO: 47864 - DNA, 15 bp, Artificial Sequence
  dgRNA
  Cfl1
gtccattgcaccaat

SEQ ID NO: 47865 - DNA, 15 bp, Artificial Sequence
  dgRNA
  Cfl1
acagcccacgcctct

SEQ ID NO: 47866 - DNA, 15 bp, Artificial Sequence
  dgRNA
  Cfl1
gcgcctcaagctctg

SEQ ID NO: 47867 - DNA, 15 bp, Artificial Sequence
  dgRNA
  Akr1c18
tgagaataaacggtc

SEQ ID NO: 47868 - DNA, 15 bp, Artificial Sequence
  dgRNA
  Akr1c18
gattactcattcact

SEQ ID NO: 47869 - DNA, 15 bp, Artificial Sequence
  dgRNA
  Akr1c18
agcattctacttgtg

SEQ ID NO: 47870 - DNA, 15 bp, Artificial Sequence
  dgRNA
  Akr1c18
cagtcaatggcacgg

SEQ ID NO: 47871 - DNA, 15 bp, Artificial Sequence
  dgRNA
  Zfhx4
tagtcgcctcgtcca

SEQ ID NO: 47872 - DNA, 15 bp, Artificial Sequence
  dgRNA
  Zfhx4
tccagccgcaacgct

SEQ ID NO: 47873 - DNA, 15 bp, Artificial Sequence
  dgRNA
  Zfhx4
caacgctaggagccc

SEQ ID NO: 47874 - DNA, 15 bp, Artificial Sequence
  dgRNA
  Zfhx4
gccctggaagtcgcg

SEQ ID NO: 47875 - DNA, 15 bp, Artificial Sequence
  dgRNA
  Gcm2
gctgaggagtgcgca

SEQ ID NO: 47876 - DNA, 15 bp, Artificial Sequence
  dgRNA
  Gcm2
agctgaggagtgcgc

SEQ ID NO: 47877 - DNA, 15 bp, Artificial Sequence
  dgRNA
  Il31ra
gtgcttggcatgata

SEQ ID NO: 47878 - DNA, 15 bp, Artificial Sequence
  dgRNA
  Il31ra
tgcactgctttgtag

SEQ ID NO: 47879 - DNA, 15 bp, Artificial Sequence
  dgRNA
  Il31ra
tgtaaccccttgcca

SEQ ID NO: 47880 - DNA, 15 bp, Artificial Sequence
  dgRNA
  Il31ra
ttgtaaccccttgcc

SEQ ID NO: 47881 - DNA, 15 bp, Artificial Sequence
  dgRNA
  Pde6a
ggcccttatcagacc

SEQ ID NO: 47882 - DNA, 15 bp, Artificial Sequence
  dgRNA
  Pde6a
gcccttatcagacca

SEQ ID NO: 47883 - DNA, 15 bp, Artificial Sequence
  dgRNA
  Pde6a
ggccccagcggtatc

SEQ ID NO: 47884 - DNA, 15 bp, Artificial Sequence
  dgRNA
  Pde6a
acttaatccctcggc

SEQ ID NO: 47885 - DNA, 15 bp, Artificial Sequence
  dgRNA
  Vmn2r14
acgacatagaatgaa

SEQ ID NO: 47886 - DNA, 15 bp, Artificial Sequence
  dgRNA
  Vmn2r14
ctatgtcgtactccc

SEQ ID NO: 47887 - DNA, 15 bp, Artificial Sequence
  dgRNA
  Vmn2r14
ctaggatctaagatc

SEQ ID NO: 47888 - DNA, 15 bp, Artificial Sequence
  dgRNA
  Smim9
caactagagcccaca

SEQ ID NO: 47889 - DNA, 15 bp, Artificial Sequence
  dgRNA
  Smim9
catgtgggctctagt

SEQ ID NO: 47890 - DNA, 15 bp, Artificial Sequence
  dgRNA
  Smim9
ctttgacacccatgt

SEQ ID NO: 47891 - DNA, 15 bp, Artificial Sequence
  dgRNA
  Smim9
cctttgacacccatg

SEQ ID NO: 47892 - DNA, 15 bp, Artificial Sequence
  dgRNA
  4933402D24Rik
cggtgtcgtctgtac

SEQ ID NO: 47893 - DNA, 15 bp, Artificial Sequence
  dgRNA
  4933402D24Rik
ggtgtcgtctgtaca

SEQ ID NO: 47894 - DNA, 15 bp, Artificial Sequence
  dgRNA
  4933402D24Rik
catagcaacccccta

SEQ ID NO: 47895 - DNA, 15 bp, Artificial Sequence
  dgRNA
  4933402D24Rik
tctctccaattggag

SEQ ID NO: 47896 - DNA, 15 bp, Artificial Sequence
  dgRNA
  Shtn1
ccagcgtgtgtgaag

SEQ ID NO: 47897 - DNA, 15 bp, Artificial Sequence
  dgRNA
  Shtn1
gtcaccgcagtcttg

SEQ ID NO: 47898 - DNA, 15 bp, Artificial Sequence
  dgRNA
  Rtcb
tgtaacgagatgatc

SEQ ID NO: 47899 - DNA, 15 bp, Artificial Sequence
  dgRNA
  Rtcb
agatggcaagcgccg

SEQ ID NO: 47900 - DNA, 15 bp, Artificial Sequence
  dgRNA
  Ddah2
gcggtgcctgagttc

SEQ ID NO: 47901 - DNA, 15 bp, Artificial Sequence
  dgRNA
  Ddah2
cggtgcctgagttca

SEQ ID NO: 47902 - DNA, 15 bp, Artificial Sequence
  dgRNA
  Ddah2
tgggcgcggcctagc

SEQ ID NO: 47903 - DNA, 15 bp, Artificial Sequence
  dgRNA
  Ddah2
gggcgcggcctagca

SEQ ID NO: 47904 - DNA, 15 bp, Artificial Sequence
  dgRNA
  Axin1
ccgcaagacagtgct

SEQ ID NO: 47905 - DNA, 15 bp, Artificial Sequence
  dgRNA
  Axin1
ctccgccccacaccg

SEQ ID NO: 47906 - DNA, 15 bp, Artificial Sequence
  dgRNA
  Axin1
tcccgccccacacca

SEQ ID NO: 47907 - DNA, 15 bp, Artificial Sequence
  dgRNA
  Axin1
ggcggggcgtgaact

SEQ ID NO: 47908 - DNA, 15 bp, Artificial Sequence
  dgRNA
  Paip2
aactagaaaaacccg

SEQ ID NO: 47909 - DNA, 15 bp, Artificial Sequence
  dgRNA
  Paip2
ctctattggcctagc

SEQ ID NO: 47910 - DNA, 15 bp, Artificial Sequence
  dgRNA
  Paip2
cggggccggcggtga

SEQ ID NO: 47911 - DNA, 15 bp, Artificial Sequence
  dgRNA
  Paip2
gcaaagacctaccac

SEQ ID NO: 47912 - DNA, 15 bp, Artificial Sequence
  dgRNA
  Rps27rt
ggactagttatgtgg

SEQ ID NO: 47913 - DNA, 15 bp, Artificial Sequence
  dgRNA
  Rps27rt
tgtggactagttatg

SEQ ID NO: 47914 - DNA, 15 bp, Artificial Sequence
  dgRNA
  Rps27rt
ggataactcaaaatg

SEQ ID NO: 47915 - DNA, 15 bp, Artificial Sequence
  dgRNA
  Rps27rt
gagacaggcgtttgt

SEQ ID NO: 47916 - DNA, 15 bp, Artificial Sequence
  dgRNA
  Hmgn2
ttacctccgactccg

SEQ ID NO: 47917 - DNA, 15 bp, Artificial Sequence
  dgRNA
  Hmgn2
cgaggcggcaggctt

SEQ ID NO: 47918 - DNA, 15 bp, Artificial Sequence
  dgRNA
  Hmgn2
gaggggcgcgcgagg

SEQ ID NO: 47919 - DNA, 15 bp, Artificial Sequence
  dgRNA
  Hmgn2
aatgaggggcgcgcg

SEQ ID NO: 47920 - DNA, 15 bp, Artificial Sequence
  dgRNA
  1810055G02Rik
tcacttccgttagat

SEQ ID NO: 47921 - DNA, 15 bp, Artificial Sequence
  dgRNA
  1810055G02Rik
ccaaatagctctgcg

SEQ ID NO: 47922 - DNA, 15 bp, Artificial Sequence
  dgRNA
  1810055G02Rik
agctctgcgtggcca

SEQ ID NO: 47923 - DNA, 15 bp, Artificial Sequence
  dgRNA
  1810055G02Rik
cgggaccaagttgga

SEQ ID NO: 47924 - DNA, 15 bp, Artificial Sequence
  dgRNA
  Fam126b
ttgttattaagcgcg

SEQ ID NO: 47925 - DNA, 15 bp, Artificial Sequence
  dgRNA
  Fam126b
tgttattaagcgcgt

SEQ ID NO: 47926 - DNA, 15 bp, Artificial Sequence
  dgRNA
  Fam126b
tatgctgcagttggc

SEQ ID NO: 47927 - DNA, 15 bp, Artificial Sequence
  dgRNA
  Sall3
atttgcataggccgc

SEQ ID NO: 47928 - DNA, 15 bp, Artificial Sequence
  dgRNA
  Sall3
gccgccggagtccgc

SEQ ID NO: 47929 - DNA, 15 bp, Artificial Sequence
  dgRNA
  Sall3
gccggagtccgctgg

SEQ ID NO: 47930 - DNA, 15 bp, Artificial Sequence
  dgRNA
  Sall3
gagtccgctggaggc

SEQ ID NO: 47931 - DNA, 15 bp, Artificial Sequence
  dgRNA
  Arc
cttgagggcacccac

SEQ ID NO: 47932 - DNA, 15 bp, Artificial Sequence
  dgRNA
  Arc
agggcacccacggga

SEQ ID NO: 47933 - DNA, 15 bp, Artificial Sequence
  dgRNA
  Arc
gggcacccacgggag

SEQ ID NO: 47934 - DNA, 15 bp, Artificial Sequence
  dgRNA
  Arc
gggagcgagtaggcg

SEQ ID NO: 47935 - DNA, 15 bp, Artificial Sequence
  dgRNA
  Cltc
gagaaaccggagcct

SEQ ID NO: 47936 - DNA, 15 bp, Artificial Sequence
  dgRNA
  Cltc
ccctacgcccgaccg

SEQ ID NO: 47937 - DNA, 15 bp, Artificial Sequence
  dgRNA
  Cltc
cgcccgaccgcggcg

SEQ ID NO: 47938 - DNA, 15 bp, Artificial Sequence
  dgRNA
  Cltc
gcggcgcggcgtctg

SEQ ID NO: 47939 - DNA, 15 bp, Artificial Sequence
  dgRNA
  Kctd15
caactgcgagcacaa

SEQ ID NO: 47940 - DNA, 15 bp, Artificial Sequence
  dgRNA
  Kctd15
aactgcgagcacaat

SEQ ID NO: 47941 - DNA, 15 bp, Artificial Sequence
  dgRNA
  Kctd15
ttccctctgctcggg

SEQ ID NO: 47942 - DNA, 15 bp, Artificial Sequence
  dgRNA
  Kctd15
tccctctgctcgggc

SEQ ID NO: 47943 - DNA, 15 bp, Artificial Sequence
  dgRNA
  Il12a
tacgctcaatcagcc

SEQ ID NO: 47944 - DNA, 15 bp, Artificial Sequence
  dgRNA
  Il12a
acgctcaatcagcct

SEQ ID NO: 47945 - DNA, 15 bp, Artificial Sequence
  dgRNA
  Il12a
gcctggggagttatc

SEQ ID NO: 47946 - DNA, 15 bp, Artificial Sequence
  dgRNA
  Il12a
agcctgttaccccac

SEQ ID NO: 47947 - DNA, 15 bp, Artificial Sequence
  dgRNA
  A630095N17Rik
cactaacgagtcaca

SEQ ID NO: 47948 - DNA, 15 bp, Artificial Sequence
  dgRNA
  A630095N17Rik
acgcatggggtttct

SEQ ID NO: 47949 - DNA, 15 bp, Artificial Sequence
  dgRNA
  A630095N17Rik
atggctttacgcatg

SEQ ID NO: 47950 - DNA, 15 bp, Artificial Sequence
  dgRNA
  A630095N17Rik
tatggctttacgcat

SEQ ID NO: 47951 - DNA, 15 bp, Artificial Sequence
  dgRNA
  Manbal
attgcccccagttcg

SEQ ID NO: 47952 - DNA, 15 bp, Artificial Sequence
  dgRNA
  Manbal
cttcggtgtctaatt

SEQ ID NO: 47953 - DNA, 15 bp, Artificial Sequence
  dgRNA
  Manbal
ttcggtgtctaatta

SEQ ID NO: 47954 - DNA, 15 bp, Artificial Sequence
  dgRNA
  Manbal
tcggtgtctaattag

SEQ ID NO: 47955 - DNA, 15 bp, Artificial Sequence
  dgRNA
  Gpr37
gacgtagatagtttg

SEQ ID NO: 47956 - DNA, 15 bp, Artificial Sequence
  dgRNA
  Dnajc8
ccctttaagttcagc

SEQ ID NO: 47957 - DNA, 15 bp, Artificial Sequence
  dgRNA
  Dnajc8
agttcagctggcggg

SEQ ID NO: 47958 - DNA, 15 bp, Artificial Sequence
  dgRNA
  Dnajc8
gttcagctggcgggc

SEQ ID NO: 47959 - DNA, 15 bp, Artificial Sequence
  dgRNA
  Dnajc8
ttcagctggcgggcg

SEQ ID NO: 47960 - DNA, 15 bp, Artificial Sequence
  dgRNA
  Enpep
acccctttgctgtat

SEQ ID NO: 47961 - DNA, 15 bp, Artificial Sequence
  dgRNA
  Enpep
tcgctccagttcaga

SEQ ID NO: 47962 - DNA, 15 bp, Artificial Sequence
  dgRNA
  Enpep
cgctccagttcagaa

SEQ ID NO: 47963 - DNA, 15 bp, Artificial Sequence
  dgRNA
  Enpep
ggccaatacagcaaa

SEQ ID NO: 47964 - DNA, 15 bp, Artificial Sequence
  dgRNA
  Zfp513
gaatggaagcggcgg

SEQ ID NO: 47965 - DNA, 15 bp, Artificial Sequence
  dgRNA
  Zfp513
ctgagctggattccg

SEQ ID NO: 47966 - DNA, 15 bp, Artificial Sequence
  dgRNA
  Zfp513
gctggattccggggc

SEQ ID NO: 47967 - DNA, 15 bp, Artificial Sequence
  dgRNA
  Zfp513
ctggattccggggcc

SEQ ID NO: 47968 - DNA, 15 bp, Artificial Sequence
  dgRNA
  Sardh
ccagctgggttgtcc

SEQ ID NO: 47969 - DNA, 15 bp, Artificial Sequence
  dgRNA
  Sardh
gccccggttgtagtc

SEQ ID NO: 47970 - DNA, 15 bp, Artificial Sequence
  dgRNA
  Sardh
ccggaccagcagcaa

SEQ ID NO: 47971 - DNA, 15 bp, Artificial Sequence
  dgRNA
  Sardh
ccgacagccccttca

SEQ ID NO: 47972 - DNA, 15 bp, Artificial Sequence
  dgRNA
  Aknad1
tatttatccacgagg

SEQ ID NO: 47973 - DNA, 15 bp, Artificial Sequence
  dgRNA
  Aknad1
ttctatttatccacg

SEQ ID NO: 47974 - DNA, 15 bp, Artificial Sequence
  dgRNA
  Nxph3
gccgccgccagtggg

SEQ ID NO: 47975 - DNA, 15 bp, Artificial Sequence
  dgRNA
  Nxph3
ccgccgccagtggga

SEQ ID NO: 47976 - DNA, 15 bp, Artificial Sequence
  dgRNA
  Nxph3
gaagcgggaggcgcc

SEQ ID NO: 47977 - DNA, 15 bp, Artificial Sequence
  dgRNA
  Nxph3
aagcgggaggcgcct

SEQ ID NO: 47978 - DNA, 15 bp, Artificial Sequence
  dgRNA
  Ankzf1
cacccgcagccagtc

SEQ ID NO: 47979 - DNA, 15 bp, Artificial Sequence
  dgRNA
  Ankzf1
ccaattcttagccca

SEQ ID NO: 47980 - DNA, 15 bp, Artificial Sequence
  dgRNA
  Ankzf1
caattcttagcccag

SEQ ID NO: 47981 - DNA, 15 bp, Artificial Sequence
  dgRNA
  Ankzf1
gctgaaggcgggtct

SEQ ID NO: 47982 - DNA, 15 bp, Artificial Sequence
  dgRNA
  Olfr728
gtaaacaatataatg

SEQ ID NO: 47983 - DNA, 15 bp, Artificial Sequence
  dgRNA
  Slc5a7
aactgagcttgcatg

SEQ ID NO: 47984 - DNA, 15 bp, Artificial Sequence
  dgRNA
  Slc5a7
catgtggacacctca

SEQ ID NO: 47985 - DNA, 15 bp, Artificial Sequence
  dgRNA
  Slc5a7
tggacacctcaaggc

SEQ ID NO: 47986 - DNA, 15 bp, Artificial Sequence
  dgRNA
  Slc5a7
ggacacctcaaggcg

SEQ ID NO: 47987 - DNA, 15 bp, Artificial Sequence
  dgRNA
  Tnfsf9
ggacgggcgggcaca

SEQ ID NO: 47988 - DNA, 15 bp, Artificial Sequence
  dgRNA
  Tnfsf9
aagttccgggagtcg

SEQ ID NO: 47989 - DNA, 15 bp, Artificial Sequence
  dgRNA
  Tnfsf9
agttccgggagtcga

SEQ ID NO: 47990 - DNA, 15 bp, Artificial Sequence
  dgRNA
  Tnfsf9
gttccgggagtcgag

SEQ ID NO: 47991 - DNA, 15 bp, Artificial Sequence
  dgRNA
  Olfr572
cactcccagagaggt

SEQ ID NO: 47992 - DNA, 15 bp, Artificial Sequence
  dgRNA
  Olfr572
caatccgacctctct

SEQ ID NO: 47993 - DNA, 15 bp, Artificial Sequence
  dgRNA
  Olfr572
acaatccgacctctc

SEQ ID NO: 47994 - DNA, 15 bp, Artificial Sequence
  dgRNA
  Mtrf1l
gtttccacgcccccg

SEQ ID NO: 47995 - DNA, 15 bp, Artificial Sequence
  dgRNA
  Mtrf1l
tccacgcccccgtgg

SEQ ID NO: 47996 - DNA, 15 bp, Artificial Sequence
  dgRNA
  Mtrf1l
acgcccccgtggagg

SEQ ID NO: 47997 - DNA, 15 bp, Artificial Sequence
  dgRNA
  Mtrf1l
tggagctccgccctg

SEQ ID NO: 47998 - DNA, 15 bp, Artificial Sequence
  dgRNA
  Kcnk1
atctatctgtaccct

SEQ ID NO: 47999 - DNA, 15 bp, Artificial Sequence
  dgRNA
  Kcnk1
atagtagctttaatc

SEQ ID NO: 48000 - DNA, 15 bp, Artificial Sequence
  dgRNA
  Kcnk1
gtagctttaatcagg

SEQ ID NO: 48001 - DNA, 15 bp, Artificial Sequence
  dgRNA
  Kcnk1
tacttttgtcccccc

SEQ ID NO: 48002 - DNA, 15 bp, Artificial Sequence
  dgRNA
  Olah
cctagtaaattgtca

SEQ ID NO: 48003 - DNA, 15 bp, Artificial Sequence
  dgRNA
  Olah
aatcatctgaggcac

SEQ ID NO: 48004 - DNA, 15 bp, Artificial Sequence
  dgRNA
  Olah
ctctcctatttgagc

SEQ ID NO: 48005 - DNA, 15 bp, Artificial Sequence
  dgRNA
  Olah
cctctcggtgtgctg

SEQ ID NO: 48006 - DNA, 15 bp, Artificial Sequence
  dgRNA
  Olfr998
ataatcttgggtaca

SEQ ID NO: 48007 - DNA, 15 bp, Artificial Sequence
  dgRNA
  Olfr998
tataatcttgggtac

SEQ ID NO: 48008 - DNA, 15 bp, Artificial Sequence
  dgRNA
  Olfr998
tatcatgtataatct

SEQ ID NO: 48009 - DNA, 15 bp, Artificial Sequence
  dgRNA
  Olfr998
gtggatggttagcta

SEQ ID NO: 48010 - DNA, 15 bp, Artificial Sequence
  dgRNA
  Cpeb3
ccagtcttgtgaccg

SEQ ID NO: 48011 - DNA, 15 bp, Artificial Sequence
  dgRNA
  Cpeb3
cctcggtcacaagac

SEQ ID NO: 48012 - DNA, 15 bp, Artificial Sequence
  dgRNA
  Cpeb3
gtcaagataattctg

SEQ ID NO: 48013 - DNA, 15 bp, Artificial Sequence
  dgRNA
  Cpeb3
cagtcaagataattc

SEQ ID NO: 48014 - DNA, 15 bp, Artificial Sequence
  dgRNA
  Pou2f1
tggagctcttccaag

SEQ ID NO: 48015 - DNA, 15 bp, Artificial Sequence
  dgRNA
  Pou2f1
ggagctcttccaagg

SEQ ID NO: 48016 - DNA, 15 bp, Artificial Sequence
  dgRNA
  Pou2f1
ttccaagggggccgg

SEQ ID NO: 48017 - DNA, 15 bp, Artificial Sequence
  dgRNA
  Pou2f1
ggcggagagcagcgc

SEQ ID NO: 48018 - DNA, 15 bp, Artificial Sequence
  dgRNA
  Supt16
gcccgcgctgcacct

SEQ ID NO: 48019 - DNA, 15 bp, Artificial Sequence
  dgRNA
  Supt16
tcacttttgcgtcct

SEQ ID NO: 48020 - DNA, 15 bp, Artificial Sequence
  dgRNA
  Supt16
accctacggaacgag

SEQ ID NO: 48021 - DNA, 15 bp, Artificial Sequence
  dgRNA
  Supt16
ctacggaacgagcgg

SEQ ID NO: 48022 - DNA, 15 bp, Artificial Sequence
  dgRNA
  Apol8
ttgcgcaactctgct

SEQ ID NO: 48023 - DNA, 15 bp, Artificial Sequence
  dgRNA
  Apol8
tgcgcaactctgctc

SEQ ID NO: 48024 - DNA, 15 bp, Artificial Sequence
  dgRNA
  Apol8
tgctcgggttccagc

SEQ ID NO: 48025 - DNA, 15 bp, Artificial Sequence
  dgRNA
  Apol8
gctcgggttccagct

SEQ ID NO: 48026 - DNA, 15 bp, Artificial Sequence
  dgRNA
  Hmgxb3
cgcagtcccagcttc

SEQ ID NO: 48027 - DNA, 15 bp, Artificial Sequence
  dgRNA
  Hmgxb3
cggctctgggaagtt

SEQ ID NO: 48028 - DNA, 15 bp, Artificial Sequence
  dgRNA
  Hmgxb3
tcctaagcctccaat

SEQ ID NO: 48029 - DNA, 15 bp, Artificial Sequence
  dgRNA
  Hmgxb3
caacagaggcccagt

SEQ ID NO: 48030 - DNA, 15 bp, Artificial Sequence
  dgRNA
  Nf2
ttccgcacccacagc

SEQ ID NO: 48031 - DNA, 15 bp, Artificial Sequence
  dgRNA
  Nf2
tccgcacccacagcc

SEQ ID NO: 48032 - DNA, 15 bp, Artificial Sequence
  dgRNA
  Nf2
acagccgggtcctcg

SEQ ID NO: 48033 - DNA, 15 bp, Artificial Sequence
  dgRNA
  Nf2
cctcgcggcccatgc

SEQ ID NO: 48034 - DNA, 15 bp, Artificial Sequence
  dgRNA
  Spns3
ctcctgtatctaacc

SEQ ID NO: 48035 - DNA, 15 bp, Artificial Sequence
  dgRNA
  Spns3
atctaacctggttca

SEQ ID NO: 48036 - DNA, 15 bp, Artificial Sequence
  dgRNA
  Spns3
ttgaccaggatggta

SEQ ID NO: 48037 - DNA, 15 bp, Artificial Sequence
  dgRNA
  Spns3
gggtaggtgttgacc

SEQ ID NO: 48038 - DNA, 15 bp, Artificial Sequence
  dgRNA
  Eppin
gtgtagagtacactt

SEQ ID NO: 48039 - DNA, 15 bp, Artificial Sequence
  dgRNA
  Eppin
tgtagagtacacttt

SEQ ID NO: 48040 - DNA, 15 bp, Artificial Sequence
  dgRNA
  Eppin
atgatctcgagaact

SEQ ID NO: 48041 - DNA, 15 bp, Artificial Sequence
  dgRNA
  Eppin
tcccagcaagatagt

SEQ ID NO: 48042 - DNA, 15 bp, Artificial Sequence
  dgRNA
  Chka
cgcgacccctagaca

SEQ ID NO: 48043 - DNA, 15 bp, Artificial Sequence
  dgRNA
  Chka
acccctccctcatcg

SEQ ID NO: 48044 - DNA, 15 bp, Artificial Sequence
  dgRNA
  Chka
ccgcctgagcctagg

SEQ ID NO: 48045 - DNA, 15 bp, Artificial Sequence
  dgRNA
  Chka
cgcctgagcctagga

SEQ ID NO: 48046 - DNA, 15 bp, Artificial Sequence
  dgRNA
  Tut1
cgggccaatcaacgc

SEQ ID NO: 48047 - DNA, 15 bp, Artificial Sequence
  dgRNA
  Tut1
caactagttaactgt

SEQ ID NO: 48048 - DNA, 15 bp, Artificial Sequence
  dgRNA
  Tut1
aataagcatcgtcga

SEQ ID NO: 48049 - DNA, 15 bp, Artificial Sequence
  dgRNA
  Tut1
ataagcatcgtcgaa

SEQ ID NO: 48050 - DNA, 15 bp, Artificial Sequence
  dgRNA
  Rnf208
tctcacccgcagctc

SEQ ID NO: 48051 - DNA, 15 bp, Artificial Sequence
  dgRNA
  Rnf208
cggagccttcagccc

SEQ ID NO: 48052 - DNA, 15 bp, Artificial Sequence
  dgRNA
  Rnf208
ctgggcgccctgtcc

SEQ ID NO: 48053 - DNA, 15 bp, Artificial Sequence
  dgRNA
  Rnf208
cgtgagggcagcacg

SEQ ID NO: 48054 - DNA, 15 bp, Artificial Sequence
  dgRNA
  Gtf2ird1
cgcagcccgcgccgg

SEQ ID NO: 48055 - DNA, 15 bp, Artificial Sequence
  dgRNA
  Gtf2ird1
gcccgcgccgggggt

SEQ ID NO: 48056 - DNA, 15 bp, Artificial Sequence
  dgRNA
  Gtf2ird1
cgcgcagcccccggc

SEQ ID NO: 48057 - DNA, 15 bp, Artificial Sequence
  dgRNA
  Gtf2ird1
cggggcccccacccc

SEQ ID NO: 48058 - DNA, 15 bp, Artificial Sequence
  dgRNA
  Rprml
gcgcagacagcacgc

SEQ ID NO: 48059 - DNA, 15 bp, Artificial Sequence
  dgRNA
  Rprml
cgcagacagcacgct

SEQ ID NO: 48060 - DNA, 15 bp, Artificial Sequence
  dgRNA
  Rprml
agacagcacgctggg

SEQ ID NO: 48061 - DNA, 15 bp, Artificial Sequence
  dgRNA
  Rprml
gacagcacgctggga

SEQ ID NO: 48062 - DNA, 15 bp, Artificial Sequence
  dgRNA
  Olfr1028
caataattcctagca

SEQ ID NO: 48063 - DNA, 15 bp, Artificial Sequence
  dgRNA
  Olfr1028
aatcatacatatgcc

SEQ ID NO: 48064 - DNA, 15 bp, Artificial Sequence
  dgRNA
  Olfr1028
aattattggaatcta

SEQ ID NO: 48065 - DNA, 15 bp, Artificial Sequence
  dgRNA
  Olfr1028
cttgctaggaattat

SEQ ID NO: 48066 - DNA, 15 bp, Artificial Sequence
  dgRNA
  Cdca7
attcagcagtttccg

SEQ ID NO: 48067 - DNA, 15 bp, Artificial Sequence
  dgRNA
  Cdca7
ttccgaggacactca

SEQ ID NO: 48068 - DNA, 15 bp, Artificial Sequence
  dgRNA
  Cdca7
agagctgggacgctt

SEQ ID NO: 48069 - DNA, 15 bp, Artificial Sequence
  dgRNA
  Cdca7
gagctgggacgcttc

SEQ ID NO: 48070 - DNA, 15 bp, Artificial Sequence
  dgRNA
  Hist1h1e
tgagaggacactccg

SEQ ID NO: 48071 - DNA, 15 bp, Artificial Sequence
  dgRNA
  Hist1h1e
ccgcggctgccagcg

SEQ ID NO: 48072 - DNA, 15 bp, Artificial Sequence
  dgRNA
  Hist1h1e
cggctgccagcgagg

SEQ ID NO: 48073 - DNA, 15 bp, Artificial Sequence
  dgRNA
  Hist1h1e
gccagcgaggcgggc

SEQ ID NO: 48074 - DNA, 15 bp, Artificial Sequence
  dgRNA
  Slc5a3
gtgtccacgctccgc

SEQ ID NO: 48075 - DNA, 15 bp, Artificial Sequence
  dgRNA
  Slc5a3
cacgctccgcaggct

SEQ ID NO: 48076 - DNA, 15 bp, Artificial Sequence
  dgRNA
  Slc5a3
acgctccgcaggctc

SEQ ID NO: 48077 - DNA, 15 bp, Artificial Sequence
  dgRNA
  Slc5a3
cgctccgcaggctcg

SEQ ID NO: 48078 - DNA, 15 bp, Artificial Sequence
  dgRNA
  Tekt5
ggggcttcaaccacc

SEQ ID NO: 48079 - DNA, 15 bp, Artificial Sequence
  dgRNA
  Tekt5
gcggctcctagctct

SEQ ID NO: 48080 - DNA, 15 bp, Artificial Sequence
  dgRNA
  Tekt5
cggctcctagctctt

SEQ ID NO: 48081 - DNA, 15 bp, Artificial Sequence
  dgRNA
  Tekt5
ggtgtcataaagcat

SEQ ID NO: 48082 - DNA, 15 bp, Artificial Sequence
  dgRNA
  Prelid1
gaagctccgctgcgc

SEQ ID NO: 48083 - DNA, 15 bp, Artificial Sequence
  dgRNA
  Prelid1
aagctccgctgcgcc

SEQ ID NO: 48084 - DNA, 15 bp, Artificial Sequence
  dgRNA
  Prelid1
agctccgctgcgccg

SEQ ID NO: 48085 - DNA, 15 bp, Artificial Sequence
  dgRNA
  Prelid1
gttaccgactgaatc

SEQ ID NO: 48086 - DNA, 15 bp, Artificial Sequence
  dgRNA
  Ccdc181
gggatgcgagtcttc

SEQ ID NO: 48087 - DNA, 15 bp, Artificial Sequence
  dgRNA
  Ccdc181
ggatgcgagtcttcc

SEQ ID NO: 48088 - DNA, 15 bp, Artificial Sequence
  dgRNA
  Ccdc181
gagtcttccgggtct

SEQ ID NO: 48089 - DNA, 15 bp, Artificial Sequence
  dgRNA
  Ccdc181
gggtcttggaaacgc

SEQ ID NO: 48090 - DNA, 15 bp, Artificial Sequence
  dgRNA
  Fam19a1
gcgctgcttgagtca

SEQ ID NO: 48091 - DNA, 15 bp, Artificial Sequence
  dgRNA
  Fam19a1
cgctgcttgagtcat

SEQ ID NO: 48092 - DNA, 15 bp, Artificial Sequence
  dgRNA
  Fam19a1
ccttatctataatcg

SEQ ID NO: 48093 - DNA, 15 bp, Artificial Sequence
  dgRNA
  Fam19a1
cttatctataatcga

SEQ ID NO: 48094 - DNA, 15 bp, Artificial Sequence
  dgRNA
  Pim2
caggcccttcctccg

SEQ ID NO: 48095 - DNA, 15 bp, Artificial Sequence
  dgRNA
  Pim2
ctccgcggaagaacc

SEQ ID NO: 48096 - DNA, 15 bp, Artificial Sequence
  dgRNA
  Pim2
tgtattttgcataag

SEQ ID NO: 48097 - DNA, 15 bp, Artificial Sequence
  dgRNA
  Pim2
gcacttgaaacgttg

SEQ ID NO: 48098 - DNA, 15 bp, Artificial Sequence
  dgRNA
  Itsn1
tttttgcccacctag

SEQ ID NO: 48099 - DNA, 15 bp, Artificial Sequence
  dgRNA
  Itsn1
ttttgcccacctagt

SEQ ID NO: 48100 - DNA, 15 bp, Artificial Sequence
  dgRNA
  Itsn1
agtgggcggagtcat

SEQ ID NO: 48101 - DNA, 15 bp, Artificial Sequence
  dgRNA
  Itsn1
tctccgccgtccgat

SEQ ID NO: 48102 - DNA, 15 bp, Artificial Sequence
  dgRNA
  Mbl2
ggtgtcagttgaagc

SEQ ID NO: 48103 - DNA, 15 bp, Artificial Sequence
  dgRNA
  Mbl2
agttgaagcgggaaa

SEQ ID NO: 48104 - DNA, 15 bp, Artificial Sequence
  dgRNA
  Mbl2
aatggcgctgcatta

SEQ ID NO: 48105 - DNA, 15 bp, Artificial Sequence
  dgRNA
  Mbl2
tgctgcacttactgc

SEQ ID NO: 48106 - DNA, 15 bp, Artificial Sequence
  dgRNA
  Rlf
ttctatcacttgcag

SEQ ID NO: 48107 - DNA, 15 bp, Artificial Sequence
  dgRNA
  Rlf
ttcacttgtacagga

SEQ ID NO: 48108 - DNA, 15 bp, Artificial Sequence
  dgRNA
  Olfr446
tcgctctttcagctc

SEQ ID NO: 48109 - DNA, 15 bp, Artificial Sequence
  dgRNA
  Olfr446
gttgacttgcaaatt

SEQ ID NO: 48110 - DNA, 15 bp, Artificial Sequence
  dgRNA
  Sytl1
gtcgggcccaaccac

SEQ ID NO: 48111 - DNA, 15 bp, Artificial Sequence
  dgRNA
  Sytl1
tcgggcccaaccaca

SEQ ID NO: 48112 - DNA, 15 bp, Artificial Sequence
  dgRNA
  Sytl1
cgggcccaaccacag

SEQ ID NO: 48113 - DNA, 15 bp, Artificial Sequence
  dgRNA
  Sytl1
ctctaacagctgttg

SEQ ID NO: 48114 - DNA, 15 bp, Artificial Sequence
  dgRNA
  Serpine1
tttccggctcacatc

SEQ ID NO: 48115 - DNA, 15 bp, Artificial Sequence
  dgRNA
  Serpine1
tcacatctggtataa

SEQ ID NO: 48116 - DNA, 15 bp, Artificial Sequence
  dgRNA
  Serpine1
acgtgtgaaagggca

SEQ ID NO: 48117 - DNA, 15 bp, Artificial Sequence
  dgRNA
  Serpine1
gtctgggctgcccgc

SEQ ID NO: 48118 - DNA, 15 bp, Artificial Sequence
  dgRNA
  Ccdc114
caggtgttttagacc

SEQ ID NO: 48119 - DNA, 15 bp, Artificial Sequence
  dgRNA
  Ccdc114
ggtcagtttgactac

SEQ ID NO: 48120 - DNA, 15 bp, Artificial Sequence
  dgRNA
  Ccdc114
cttaaggatgccccc

SEQ ID NO: 48121 - DNA, 15 bp, Artificial Sequence
  dgRNA
  Ppp1r36
tcaaagcacagcgtg

SEQ ID NO: 48122 - DNA, 15 bp, Artificial Sequence
  dgRNA
  Ppp1r36
caaagcacagcgtga

SEQ ID NO: 48123 - DNA, 15 bp, Artificial Sequence
  dgRNA
  Ppp1r36
agcgtgagggtttca

SEQ ID NO: 48124 - DNA, 15 bp, Artificial Sequence
  dgRNA
  Ppp1r36
gcgtgagggtttcat

SEQ ID NO: 48125 - DNA, 15 bp, Artificial Sequence
  dgRNA
  Mreg
acaaagcgtgtattg

SEQ ID NO: 48126 - DNA, 15 bp, Artificial Sequence
  dgRNA
  Mreg
caaagcgtgtattgt

SEQ ID NO: 48127 - DNA, 15 bp, Artificial Sequence
  dgRNA
  Mreg
ctcagcggtcacctc

SEQ ID NO: 48128 - DNA, 15 bp, Artificial Sequence
  dgRNA
  Mreg
tcagcggtcacctcc

SEQ ID NO: 48129 - DNA, 15 bp, Artificial Sequence
  dgRNA
  Tfeb
gcacggaggagcatc

SEQ ID NO: 48130 - DNA, 15 bp, Artificial Sequence
  dgRNA
  Tfeb
aggtatgaaatactc

SEQ ID NO: 48131 - DNA, 15 bp, Artificial Sequence
  dgRNA
  Tfeb
tagctcccagttcat

SEQ ID NO: 48132 - DNA, 15 bp, Artificial Sequence
  dgRNA
  Tfeb
caccacgcctcctca

SEQ ID NO: 48133 - DNA, 15 bp, Artificial Sequence
  dgRNA
  Zfp879
cactctgcaccatac

SEQ ID NO: 48134 - DNA, 15 bp, Artificial Sequence
  dgRNA
  Zfp879
ctgcaccatacaggg

SEQ ID NO: 48135 - DNA, 15 bp, Artificial Sequence
  dgRNA
  Zfp879
tgcaccatacagggt

SEQ ID NO: 48136 - DNA, 15 bp, Artificial Sequence
  dgRNA
  Zfp879
gtaatactactaaag

SEQ ID NO: 48137 - DNA, 15 bp, Artificial Sequence
  dgRNA
  Yeats4
aaacgttcaccattt

SEQ ID NO: 48138 - DNA, 15 bp, Artificial Sequence
  dgRNA
  Yeats4
ctgcaacagctcatc

SEQ ID NO: 48139 - DNA, 15 bp, Artificial Sequence
  dgRNA
  Yeats4
tcatcaggctcttac

SEQ ID NO: 48140 - DNA, 15 bp, Artificial Sequence
  dgRNA
  Yeats4
catcaggctcttacc

SEQ ID NO: 48141 - DNA, 15 bp, Artificial Sequence
  dgRNA
  E130308A19Rik
ccccgcgctccaagc

SEQ ID NO: 48142 - DNA, 15 bp, Artificial Sequence
  dgRNA
  E130308A19Rik
cccgcgctccaagcc

SEQ ID NO: 48143 - DNA, 15 bp, Artificial Sequence
  dgRNA
  E130308A19Rik
cgggcgcgcggagcc

SEQ ID NO: 48144 - DNA, 15 bp, Artificial Sequence
  dgRNA
  E130308A19Rik
gggcgcgcggagccc

SEQ ID NO: 48145 - DNA, 15 bp, Artificial Sequence
  dgRNA
  Nek10
gcaatgttaattctg

SEQ ID NO: 48146 - DNA, 15 bp, Artificial Sequence
  dgRNA
  Nek10
tagattgagtggtac

SEQ ID NO: 48147 - DNA, 15 bp, Artificial Sequence
  dgRNA
  Nek10
aattattagattgag

SEQ ID NO: 48148 - DNA, 15 bp, Artificial Sequence
  dgRNA
  Fbxo11
ccttgcccgtgcgcc

SEQ ID NO: 48149 - DNA, 15 bp, Artificial Sequence
  dgRNA
  Fbxo11
tgcgccaggcccggc

SEQ ID NO: 48150 - DNA, 15 bp, Artificial Sequence
  dgRNA
  Fbxo11
gccaggcccggccgg

SEQ ID NO: 48151 - DNA, 15 bp, Artificial Sequence
  dgRNA
  Fbxo11
gcctcgctcaagctc

SEQ ID NO: 48152 - DNA, 15 bp, Artificial Sequence
  dgRNA
  Rpl21
ataggctcgagctac

SEQ ID NO: 48153 - DNA, 15 bp, Artificial Sequence
  dgRNA
  Rpl21
agggtctcgcctatg

SEQ ID NO: 48154 - DNA, 15 bp, Artificial Sequence
  dgRNA
  Rpl21
tcgcctatgtggctc

SEQ ID NO: 48155 - DNA, 15 bp, Artificial Sequence
  dgRNA
  Rpl21
cacaccgcaaaacgc

SEQ ID NO: 48156 - DNA, 15 bp, Artificial Sequence
  dgRNA
  Ccz1
agcccaataaacacg

SEQ ID NO: 48157 - DNA, 15 bp, Artificial Sequence
  dgRNA
  Ccz1
gcccaataaacacga

SEQ ID NO: 48158 - DNA, 15 bp, Artificial Sequence
  dgRNA
  Ccz1
taaacacgagggaac

SEQ ID NO: 48159 - DNA, 15 bp, Artificial Sequence
  dgRNA
  Ccz1
acggacctatcagag

SEQ ID NO: 48160 - DNA, 15 bp, Artificial Sequence
  dgRNA
  Arpp19
agaggactaaatagg

SEQ ID NO: 48161 - DNA, 15 bp, Artificial Sequence
  dgRNA
  Arpp19
actaaataggaggtc

SEQ ID NO: 48162 - DNA, 15 bp, Artificial Sequence
  dgRNA
  Arpp19
ttgtctggaaaggcg

SEQ ID NO: 48163 - DNA, 15 bp, Artificial Sequence
  dgRNA
  Arpp19
tgtctggaaaggcgg

SEQ ID NO: 48164 - DNA, 15 bp, Artificial Sequence
  dgRNA
  Kbtbd7
gatgcaaagcggctt

SEQ ID NO: 48165 - DNA, 15 bp, Artificial Sequence
  dgRNA
  Kbtbd7
atatagtccgtgagc

SEQ ID NO: 48166 - DNA, 15 bp, Artificial Sequence
  dgRNA
  Kbtbd7
tagtccgtgagccgg

SEQ ID NO: 48167 - DNA, 15 bp, Artificial Sequence
  dgRNA
  Kbtbd7
tcccgtcatgcatcg

SEQ ID NO: 48168 - DNA, 15 bp, Artificial Sequence
  dgRNA
  Chordc1
cacgccgggagaatg

SEQ ID NO: 48169 - DNA, 15 bp, Artificial Sequence
  dgRNA
  Chordc1
acgccgggagaatgc

SEQ ID NO: 48170 - DNA, 15 bp, Artificial Sequence
  dgRNA
  Chordc1
cgccgggagaatgcg

SEQ ID NO: 48171 - DNA, 15 bp, Artificial Sequence
  dgRNA
  Chordc1
cgggagaatgcgggg

SEQ ID NO: 48172 - DNA, 15 bp, Artificial Sequence
  dgRNA
  Ndufv3
accatggtgtgcgat

SEQ ID NO: 48173 - DNA, 15 bp, Artificial Sequence
  dgRNA
  Ndufv3
tgcgattggtgaacg

SEQ ID NO: 48174 - DNA, 15 bp, Artificial Sequence
  dgRNA
  Ndufv3
tggtgaacgtggacg

SEQ ID NO: 48175 - DNA, 15 bp, Artificial Sequence
  dgRNA
  Ndufv3
ggtgaacgtggacgc

SEQ ID NO: 48176 - DNA, 15 bp, Artificial Sequence
  dgRNA
  Mt2
cgcaaagggcgcgcg

SEQ ID NO: 48177 - DNA, 15 bp, Artificial Sequence
  dgRNA
  Mt2
gcaaagggcgcgcgc

SEQ ID NO: 48178 - DNA, 15 bp, Artificial Sequence
  dgRNA
  Mt2
cgcgcgggagcaagc

SEQ ID NO: 48179 - DNA, 15 bp, Artificial Sequence
  dgRNA
  Mt2
ggaaccggttcccac

SEQ ID NO: 48180 - DNA, 15 bp, Artificial Sequence
  dgRNA
  Apon
ctggactatggtcta

SEQ ID NO: 48181 - DNA, 15 bp, Artificial Sequence
  dgRNA
  Apon
accgcctagccacaa

SEQ ID NO: 48182 - DNA, 15 bp, Artificial Sequence
  dgRNA
  Apon
gcctagccacaaagg

SEQ ID NO: 48183 - DNA, 15 bp, Artificial Sequence
  dgRNA
  Apon
actataaccccagta

SEQ ID NO: 48184 - DNA, 15 bp, Artificial Sequence
  dgRNA
  Hcls1
agtactcaaagtata

SEQ ID NO: 48185 - DNA, 15 bp, Artificial Sequence
  dgRNA
  Tktl2
gcgcggcttaagacc

SEQ ID NO: 48186 - DNA, 15 bp, Artificial Sequence
  dgRNA
  Tktl2
cgcggcttaagacca

SEQ ID NO: 48187 - DNA, 15 bp, Artificial Sequence
  dgRNA
  Tktl2
gcagactttcctcaa

SEQ ID NO: 48188 - DNA, 15 bp, Artificial Sequence
  dgRNA
  Tktl2
tcctcaacggtcgcc

SEQ ID NO: 48189 - DNA, 15 bp, Artificial Sequence
  dgRNA
  Rxrg
cggagccgctattcc

SEQ ID NO: 48190 - DNA, 15 bp, Artificial Sequence
  dgRNA
  Rxrg
ggagccgctattcct

SEQ ID NO: 48191 - DNA, 15 bp, Artificial Sequence
  dgRNA
  Rxrg
cgtatgcctgtacag

SEQ ID NO: 48192 - DNA, 15 bp, Artificial Sequence
  dgRNA
  Rxrg
gtatgcctgtacaga

SEQ ID NO: 48193 - DNA, 15 bp, Artificial Sequence
  dgRNA
  Jun
actgtaggagcgcag

SEQ ID NO: 48194 - DNA, 15 bp, Artificial Sequence
  dgRNA
  Jun
tcccgtgagccttcg

SEQ ID NO: 48195 - DNA, 15 bp, Artificial Sequence
  dgRNA
  Jun
aggtctccatggcga

SEQ ID NO: 48196 - DNA, 15 bp, Artificial Sequence
  dgRNA
  Jun
ctccatggcgacggg

SEQ ID NO: 48197 - DNA, 15 bp, Artificial Sequence
  dgRNA
  Mtcp1
cgctcacgtccgcca

SEQ ID NO: 48198 - DNA, 15 bp, Artificial Sequence
  dgRNA
  Mtcp1
gctcacgtccgccaa

SEQ ID NO: 48199 - DNA, 15 bp, Artificial Sequence
  dgRNA
  Mtcp1
gcggctcgtccaacc

SEQ ID NO: 48200 - DNA, 15 bp, Artificial Sequence
  dgRNA
  Mtcp1
cagcgcgggttccac

SEQ ID NO: 48201 - DNA, 15 bp, Artificial Sequence
  dgRNA
  Gm13125
ttctcacgcttttcc

SEQ ID NO: 48202 - DNA, 15 bp, Artificial Sequence
  dgRNA
  Pnmal1
agaaaaagtagtccg

SEQ ID NO: 48203 - DNA, 15 bp, Artificial Sequence
  dgRNA
  Pnmal1
aaaagtagtccgtgg

SEQ ID NO: 48204 - DNA, 15 bp, Artificial Sequence
  dgRNA
  Pnmal1
agaaacggctctgga

SEQ ID NO: 48205 - DNA, 15 bp, Artificial Sequence
  dgRNA
  Pnmal1
gccgtttctccacca

SEQ ID NO: 48206 - DNA, 15 bp, Artificial Sequence
  dgRNA
  Gabrp
ggagtgtggctaaaa

SEQ ID NO: 48207 - DNA, 15 bp, Artificial Sequence
  dgRNA
  Gabrp
gagctccaccaaggg

SEQ ID NO: 48208 - DNA, 15 bp, Artificial Sequence
  dgRNA
  Gabrp
ccacccacctatacc

SEQ ID NO: 48209 - DNA, 15 bp, Artificial Sequence
  dgRNA
  Gabrp
tctatgctttgattc

SEQ ID NO: 48210 - DNA, 15 bp, Artificial Sequence
  dgRNA
  Dnajc6
acacctgttcgtgcc

SEQ ID NO: 48211 - DNA, 15 bp, Artificial Sequence
  dgRNA
  Dnajc6
cacctgttcgtgccc

SEQ ID NO: 48212 - DNA, 15 bp, Artificial Sequence
  dgRNA
  Dnajc6
acctgttcgtgcccg

SEQ ID NO: 48213 - DNA, 15 bp, Artificial Sequence
  dgRNA
  Dnajc6
gtgcccggggtcccg

SEQ ID NO: 48214 - DNA, 15 bp, Artificial Sequence
  dgRNA
  St8sia3
aagtacataggctac

SEQ ID NO: 48215 - DNA, 15 bp, Artificial Sequence
  dgRNA
  St8sia3
agtacataggctaca

SEQ ID NO: 48216 - DNA, 15 bp, Artificial Sequence
  dgRNA
  St8sia3
ttcattgctacaata

SEQ ID NO: 48217 - DNA, 15 bp, Artificial Sequence
  dgRNA
  St8sia3
tgtagcctatgtact

SEQ ID NO: 48218 - DNA, 15 bp, Artificial Sequence
  dgRNA
  Pabpc6
cagtgtccggaaccc

SEQ ID NO: 48219 - DNA, 15 bp, Artificial Sequence
  dgRNA
  Pabpc6
gtccggaacccaggt

SEQ ID NO: 48220 - DNA, 15 bp, Artificial Sequence
  dgRNA
  Pabpc6
tccggaacccaggta

SEQ ID NO: 48221 - DNA, 15 bp, Artificial Sequence
  dgRNA
  Pabpc6
cggacaaccagctta

SEQ ID NO: 48222 - DNA, 15 bp, Artificial Sequence
  dgRNA
  Tmem8
ccaatgagacctttt

SEQ ID NO: 48223 - DNA, 15 bp, Artificial Sequence
  dgRNA
  Tmem8
tgttcgcctccactc

SEQ ID NO: 48224 - DNA, 15 bp, Artificial Sequence
  dgRNA
  Tmem8
ctggccaaggtgacg

SEQ ID NO: 48225 - DNA, 15 bp, Artificial Sequence
  dgRNA
  Tmem8
cggtccagcatcctc

SEQ ID NO: 48226 - DNA, 15 bp, Artificial Sequence
  dgRNA
  Slc25a22
atgtgaatgaactcg

SEQ ID NO: 48227 - DNA, 15 bp, Artificial Sequence
  dgRNA
  Slc25a22
gaactcggggtcact

SEQ ID NO: 48228 - DNA, 15 bp, Artificial Sequence
  dgRNA
  Slc25a22
cggggtcactcggct

SEQ ID NO: 48229 - DNA, 15 bp, Artificial Sequence
  dgRNA
  Slc25a22
tgagtaatattcccc

SEQ ID NO: 48230 - DNA, 15 bp, Artificial Sequence
  dgRNA
  Rpusd2
ccgaagatttccttt

SEQ ID NO: 48231 - DNA, 15 bp, Artificial Sequence
  dgRNA
  Rpusd2
gtgaccttgggcata

SEQ ID NO: 48232 - DNA, 15 bp, Artificial Sequence
  dgRNA
  Rpusd2
tgaccttgggcataa

SEQ ID NO: 48233 - DNA, 15 bp, Artificial Sequence
  dgRNA
  Rpusd2
agggtactccaagca

SEQ ID NO: 48234 - DNA, 15 bp, Artificial Sequence
  dgRNA
  Fut10
gctcttgcgaagacc

SEQ ID NO: 48235 - DNA, 15 bp, Artificial Sequence
  dgRNA
  Rac2
taagtcaagtgccct

SEQ ID NO: 48236 - DNA, 15 bp, Artificial Sequence
  dgRNA
  Rac2
ccaacctagcacctg

SEQ ID NO: 48237 - DNA, 15 bp, Artificial Sequence
  dgRNA
  Rac2
caacctagcacctgt

SEQ ID NO: 48238 - DNA, 15 bp, Artificial Sequence
  dgRNA
  Rac2
aagggcacttgactt

SEQ ID NO: 48239 - DNA, 15 bp, Artificial Sequence
  dgRNA
  Ogdh
ggagagcggagtgta

SEQ ID NO: 48240 - DNA, 15 bp, Artificial Sequence
  dgRNA
  Ogdh
gtatctacacggtga

SEQ ID NO: 48241 - DNA, 15 bp, Artificial Sequence
  dgRNA
  Ogdh
cacggtgaaggagca

SEQ ID NO: 48242 - DNA, 15 bp, Artificial Sequence
  dgRNA
  Ogdh
gagaagtgacgggct

SEQ ID NO: 48243 - DNA, 15 bp, Artificial Sequence
  dgRNA
  Tfdp2
actgtagagtgttgt

SEQ ID NO: 48244 - DNA, 15 bp, Artificial Sequence
  dgRNA
  Clca4b
ccacaatcagctaac

SEQ ID NO: 48245 - DNA, 15 bp, Artificial Sequence
  dgRNA
  Clca4b
gcagggttataaaat

SEQ ID NO: 48246 - DNA, 15 bp, Artificial Sequence
  dgRNA
  Cdr1
atattcacgaagaca

SEQ ID NO: 48247 - DNA, 15 bp, Artificial Sequence
  dgRNA
  Cdr1
aagtcgtggattttt

SEQ ID NO: 48248 - DNA, 15 bp, Artificial Sequence
  dgRNA
  Cep76
cgaggctggagcgcg

SEQ ID NO: 48249 - DNA, 15 bp, Artificial Sequence
  dgRNA
  Cep76
ggctggagcgcgcgg

SEQ ID NO: 48250 - DNA, 15 bp, Artificial Sequence
  dgRNA
  Cep76
gctggagcgcgcggc

SEQ ID NO: 48251 - DNA, 15 bp, Artificial Sequence
  dgRNA
  Cep76
gcgggtagcgctccc

SEQ ID NO: 48252 - DNA, 15 bp, Artificial Sequence
  dgRNA
  Mob1b
ctatccatgagaccc

SEQ ID NO: 48253 - DNA, 15 bp, Artificial Sequence
  dgRNA
  Mob1b
ccaggcgtcctggaa

SEQ ID NO: 48254 - DNA, 15 bp, Artificial Sequence
  dgRNA
  Mob1b
ggcgtcctggaacgg

SEQ ID NO: 48255 - DNA, 15 bp, Artificial Sequence
  dgRNA
  Mob1b
ggtccacttccccgc

SEQ ID NO: 48256 - DNA, 15 bp, Artificial Sequence
  dgRNA
  Prm3
actctctcgctaccc

SEQ ID NO: 48257 - DNA, 15 bp, Artificial Sequence
  dgRNA
  Prm3
gttaactcatgtgct

SEQ ID NO: 48258 - DNA, 15 bp, Artificial Sequence
  dgRNA
  Prm3
tgttaactcatgtgc

SEQ ID NO: 48259 - DNA, 15 bp, Artificial Sequence
  dgRNA
  Prm3
gagggcacaaactag

SEQ ID NO: 48260 - DNA, 15 bp, Artificial Sequence
  dgRNA
  Tpst2
gcgtcatggcgctag

SEQ ID NO: 48261 - DNA, 15 bp, Artificial Sequence
  dgRNA
  Tpst2
cgtcatggcgctaga

SEQ ID NO: 48262 - DNA, 15 bp, Artificial Sequence
  dgRNA
  Tpst2
gtcatggcgctagag

SEQ ID NO: 48263 - DNA, 15 bp, Artificial Sequence
  dgRNA
  Tpst2
cggaggccgtgcgtg

SEQ ID NO: 48264 - DNA, 15 bp, Artificial Sequence
  dgRNA
  Vmn1r72
ttaaatggaaggtat

SEQ ID NO: 48265 - DNA, 15 bp, Artificial Sequence
  dgRNA
  Hivep3
agacaagcggggcat

SEQ ID NO: 48266 - DNA, 15 bp, Artificial Sequence
  dgRNA
  Hivep3
aagcggggcatgggt

SEQ ID NO: 48267 - DNA, 15 bp, Artificial Sequence
  dgRNA
  Hivep3
ggcatgggttggctc

SEQ ID NO: 48268 - DNA, 15 bp, Artificial Sequence
  dgRNA
  Hivep3
ttccgtgtttccagc

SEQ ID NO: 48269 - DNA, 15 bp, Artificial Sequence
  dgRNA
  Il4i1
atctgaccctagctc

SEQ ID NO: 48270 - DNA, 15 bp, Artificial Sequence
  dgRNA
  Il4i1
cacttttaattcccg

SEQ ID NO: 48271 - DNA, 15 bp, Artificial Sequence
  dgRNA
  Il4i1
acttttaattcccga

SEQ ID NO: 48272 - DNA, 15 bp, Artificial Sequence
  dgRNA
  Il4i1
tttaattcccgaggg

SEQ ID NO: 48273 - DNA, 15 bp, Artificial Sequence
  dgRNA
  Prdx3
attcaggaggtcaaa

SEQ ID NO: 48274 - DNA, 15 bp, Artificial Sequence
  dgRNA
  Prdx3
aatttccccctgagc

SEQ ID NO: 48275 - DNA, 15 bp, Artificial Sequence
  dgRNA
  Prdx3
agccccgcctcgctg

SEQ ID NO: 48276 - DNA, 15 bp, Artificial Sequence
  dgRNA
  Prdx3
aggccccgccctcat

SEQ ID NO: 48277 - DNA, 15 bp, Artificial Sequence
  dgRNA
  Chrna9
atgacaagactgact

SEQ ID NO: 48278 - DNA, 15 bp, Artificial Sequence
  dgRNA
  Chrna9
atagaggtgctggat

SEQ ID NO: 48279 - DNA, 15 bp, Artificial Sequence
  dgRNA
  Chrna9
cggagtaagcaggtg

SEQ ID NO: 48280 - DNA, 15 bp, Artificial Sequence
  dgRNA
  Chrna9
gcggagtaagcaggt

SEQ ID NO: 48281 - DNA, 15 bp, Artificial Sequence
  dgRNA
  Gzf1
ccgaggcaccccgga

SEQ ID NO: 48282 - DNA, 15 bp, Artificial Sequence
  dgRNA
  Gzf1
gcctagctgcgcagc

SEQ ID NO: 48283 - DNA, 15 bp, Artificial Sequence
  dgRNA
  Gzf1
tgcggtgttctgcgc

SEQ ID NO: 48284 - DNA, 15 bp, Artificial Sequence
  dgRNA
  Gzf1
tgttctgcgcaggcg

SEQ ID NO: 48285 - DNA, 15 bp, Artificial Sequence
  dgRNA
  Sphk2
tgccctcacttataa

SEQ ID NO: 48286 - DNA, 15 bp, Artificial Sequence
  dgRNA
  Sphk2
gctgcctagctcggc

SEQ ID NO: 48287 - DNA, 15 bp, Artificial Sequence
  dgRNA
  Sphk2
accgccgcctagccc

SEQ ID NO: 48288 - DNA, 15 bp, Artificial Sequence
  dgRNA
  Sphk2
ggcgcgtagttatga

SEQ ID NO: 48289 - DNA, 15 bp, Artificial Sequence
  dgRNA
  Gapdh
ccctgagtcctatcc

SEQ ID NO: 48290 - DNA, 15 bp, Artificial Sequence
  dgRNA
  Gapdh
ctgggaaccatcacc

SEQ ID NO: 48291 - DNA, 15 bp, Artificial Sequence
  dgRNA
  Gapdh
cggtcacctcctgag

SEQ ID NO: 48292 - DNA, 15 bp, Artificial Sequence
  dgRNA
  Gapdh
gtcacctcctgagcg

SEQ ID NO: 48293 - DNA, 15 bp, Artificial Sequence
  dgRNA
  R3hcc1
gaagccctatgcgtt

SEQ ID NO: 48294 - DNA, 15 bp, Artificial Sequence
  dgRNA
  R3hcc1
aagccctatgcgttt

SEQ ID NO: 48295 - DNA, 15 bp, Artificial Sequence
  dgRNA
  R3hcc1
gggttagagcagctc

SEQ ID NO: 48296 - DNA, 15 bp, Artificial Sequence
  dgRNA
  R3hcc1
gaacacgcccctctg

SEQ ID NO: 48297 - DNA, 15 bp, Artificial Sequence
  dgRNA
  Olfr108
tctattactcaacag

SEQ ID NO: 48298 - DNA, 15 bp, Artificial Sequence
  dgRNA
  Olfr108
gaggtcccattgaca

SEQ ID NO: 48299 - DNA, 15 bp, Artificial Sequence
  dgRNA
  Olfr108
aggtcccattgacaa

SEQ ID NO: 48300 - DNA, 15 bp, Artificial Sequence
  dgRNA
  Olfr108
cattgacaagggacc

SEQ ID NO: 48301 - DNA, 15 bp, Artificial Sequence
  dgRNA
  Ggn
ctggacttagcaagg

SEQ ID NO: 48302 - DNA, 15 bp, Artificial Sequence
  dgRNA
  Ggn
tagcaaggcggagct

SEQ ID NO: 48303 - DNA, 15 bp, Artificial Sequence
  dgRNA
  Ggn
gacaggtcaaataag

SEQ ID NO: 48304 - DNA, 15 bp, Artificial Sequence
  dgRNA
  Ggn
ggtgtggcattataa

SEQ ID NO: 48305 - DNA, 15 bp, Artificial Sequence
  dgRNA
  Crem
cagcatcgttgtagt

SEQ ID NO: 48306 - DNA, 15 bp, Artificial Sequence
  dgRNA
  Crem
cttcgagcgcacgcg

SEQ ID NO: 48307 - DNA, 15 bp, Artificial Sequence
  dgRNA
  Crem
ctcaatcccaaagtg

SEQ ID NO: 48308 - DNA, 15 bp, Artificial Sequence
  dgRNA
  Rpa1
tcgttgagcagcccg

SEQ ID NO: 48309 - DNA, 15 bp, Artificial Sequence
  dgRNA
  Rpa1
cgttgagcagcccgc

SEQ ID NO: 48310 - DNA, 15 bp, Artificial Sequence
  dgRNA
  Rpa1
gggctgctcaacgat

SEQ ID NO: 48311 - DNA, 15 bp, Artificial Sequence
  dgRNA
  Xdh
gtaggatctgtggat

SEQ ID NO: 48312 - DNA, 15 bp, Artificial Sequence
  dgRNA
  Xdh
tgcagccgtagatta

SEQ ID NO: 48313 - DNA, 15 bp, Artificial Sequence
  dgRNA
  Xdh
ttgcacaatccagga

SEQ ID NO: 48314 - DNA, 15 bp, Artificial Sequence
  dgRNA
  Xdh
aggtttgcacaatcc

SEQ ID NO: 48315 - DNA, 15 bp, Artificial Sequence
  dgRNA
  Zfyve19
gctctcaggttcaac

SEQ ID NO: 48316 - DNA, 15 bp, Artificial Sequence
  dgRNA
  Zfyve19
gtcctcaagcctttc

SEQ ID NO: 48317 - DNA, 15 bp, Artificial Sequence
  dgRNA
  Zfyve19
tcaggaagtgcccgg

SEQ ID NO: 48318 - DNA, 15 bp, Artificial Sequence
  dgRNA
  Zfyve19
cccctttttagtcat

SEQ ID NO: 48319 - DNA, 15 bp, Artificial Sequence
  dgRNA
  Cd46
cagccgcttgaactg

SEQ ID NO: 48320 - DNA, 15 bp, Artificial Sequence
  dgRNA
  Cd46
ttactgccagccgat

SEQ ID NO: 48321 - DNA, 15 bp, Artificial Sequence
  dgRNA
  Cd46
gcacactttagtttc

SEQ ID NO: 48322 - DNA, 15 bp, Artificial Sequence
  dgRNA
  Cd46
tcccgccaggaattt

SEQ ID NO: 48323 - DNA, 15 bp, Artificial Sequence
  dgRNA
  Bod1l
gcgcacgctcctacc

SEQ ID NO: 48324 - DNA, 15 bp, Artificial Sequence
  dgRNA
  Bod1l
ctctgtttcgctccc

SEQ ID NO: 48325 - DNA, 15 bp, Artificial Sequence
  dgRNA
  Bod1l
cgtctcagcctcgtg

SEQ ID NO: 48326 - DNA, 15 bp, Artificial Sequence
  dgRNA
  Bod1l
ggcgcccgcgcctcg

SEQ ID NO: 48327 - DNA, 15 bp, Artificial Sequence
  dgRNA
  Olfr1368
ctaatgcacaggaac

SEQ ID NO: 48328 - DNA, 15 bp, Artificial Sequence
  dgRNA
  Olfr1368
taatgcacaggaact

SEQ ID NO: 48329 - DNA, 15 bp, Artificial Sequence
  dgRNA
  Olfr1368
ggctacaagtaacta

SEQ ID NO: 48330 - DNA, 15 bp, Artificial Sequence
  dgRNA
  Olfr1368
actatggagaagctc

SEQ ID NO: 48331 - DNA, 15 bp, Artificial Sequence
  dgRNA
  Tfcp2
cgagagcctgcgacc

SEQ ID NO: 48332 - DNA, 15 bp, Artificial Sequence
  dgRNA
  Tfcp2
gagagcctgcgaccc

SEQ ID NO: 48333 - DNA, 15 bp, Artificial Sequence
  dgRNA
  Tfcp2
gcccgcccactactc

SEQ ID NO: 48334 - DNA, 15 bp, Artificial Sequence
  dgRNA
  Tfcp2
cccgcccactactcc

SEQ ID NO: 48335 - DNA, 15 bp, Artificial Sequence
  dgRNA
  Tmem184c
caatgctttgcgttg

SEQ ID NO: 48336 - DNA, 15 bp, Artificial Sequence
  dgRNA
  Tmem184c
aatgctttgcgttgc

SEQ ID NO: 48337 - DNA, 15 bp, Artificial Sequence
  dgRNA
  Tmem184c
ttgcgttgcgggaca

SEQ ID NO: 48338 - DNA, 15 bp, Artificial Sequence
  dgRNA
  Tmem184c
gcatctgatcggaaa

SEQ ID NO: 48339 - DNA, 15 bp, Artificial Sequence
  dgRNA
  Jag1
ggcgtgcccaataga

SEQ ID NO: 48340 - DNA, 15 bp, Artificial Sequence
  dgRNA
  Jag1
ccgcgtgttgagaag

SEQ ID NO: 48341 - DNA, 15 bp, Artificial Sequence
  dgRNA
  Jag1
cgtgttgagaagagg

SEQ ID NO: 48342 - DNA, 15 bp, Artificial Sequence
  dgRNA
  Jag1
ggccagccggagtcc

SEQ ID NO: 48343 - DNA, 15 bp, Artificial Sequence
  dgRNA
  Gfra1
ccagaacccgggttc

SEQ ID NO: 48344 - DNA, 15 bp, Artificial Sequence
  dgRNA
  Gfra1
cgcacctcctgctct

SEQ ID NO: 48345 - DNA, 15 bp, Artificial Sequence
  dgRNA
  Gfra1
ctctcggacccgagt

SEQ ID NO: 48346 - DNA, 15 bp, Artificial Sequence
  dgRNA
  Gfra1
tctcggacccgagtg

SEQ ID NO: 48347 - DNA, 15 bp, Artificial Sequence
  dgRNA
  Sart1
gactaccatcttaga

SEQ ID NO: 48348 - DNA, 15 bp, Artificial Sequence
  dgRNA
  Sart1
cttagatggcgcgag

SEQ ID NO: 48349 - DNA, 15 bp, Artificial Sequence
  dgRNA
  Sart1
ttagatggcgcgaga

SEQ ID NO: 48350 - DNA, 15 bp, Artificial Sequence
  dgRNA
  Sart1
gatggcgcgagaggg

SEQ ID NO: 48351 - DNA, 15 bp, Artificial Sequence
  dgRNA
  Fastkd5
caaagcgacccatcc

SEQ ID NO: 48352 - DNA, 15 bp, Artificial Sequence
  dgRNA
  Fastkd5
ggaaaacttcgacta

SEQ ID NO: 48353 - DNA, 15 bp, Artificial Sequence
  dgRNA
  Fastkd5
gaacctcagcggctc

SEQ ID NO: 48354 - DNA, 15 bp, Artificial Sequence
  dgRNA
  Fastkd5
cggtaccaacgtaag

SEQ ID NO: 48355 - DNA, 15 bp, Artificial Sequence
  dgRNA
  Txnl4b
tgcaaccccgcgaac

SEQ ID NO: 48356 - DNA, 15 bp, Artificial Sequence
  dgRNA
  Txnl4b
gcgaccaatcgcgct

SEQ ID NO: 48357 - DNA, 15 bp, Artificial Sequence
  dgRNA
  Txnl4b
tcaacaccccgcctc

SEQ ID NO: 48358 - DNA, 15 bp, Artificial Sequence
  dgRNA
  Txnl4b
accccgcctctggct

SEQ ID NO: 48359 - DNA, 15 bp, Artificial Sequence
  dgRNA
  Lgals4
ggtcactctagtatg

SEQ ID NO: 48360 - DNA, 15 bp, Artificial Sequence
  dgRNA
  Lgals4
gtcactctagtatga

SEQ ID NO: 48361 - DNA, 15 bp, Artificial Sequence
  dgRNA
  Lgals4
agctgcgtgtgcact

SEQ ID NO: 48362 - DNA, 15 bp, Artificial Sequence
  dgRNA
  Lgals4
ctgttacatagcgtg

SEQ ID NO: 48363 - DNA, 15 bp, Artificial Sequence
  dgRNA
  Plcb4
agtccagttcatcag

SEQ ID NO: 48364 - DNA, 15 bp, Artificial Sequence
  dgRNA
  Plcb4
tcggcatctgcagac

SEQ ID NO: 48365 - DNA, 15 bp, Artificial Sequence
  dgRNA
  Plcb4
catccactgatgaac

SEQ ID NO: 48366 - DNA, 15 bp, Artificial Sequence
  dgRNA
  Slc4a11
agcgggtgaacacgc

SEQ ID NO: 48367 - DNA, 15 bp, Artificial Sequence
  dgRNA
  Slc4a11
gaacacgcgggagcg

SEQ ID NO: 48368 - DNA, 15 bp, Artificial Sequence
  dgRNA
  Slc4a11
aacacgcgggagcgt

SEQ ID NO: 48369 - DNA, 15 bp, Artificial Sequence
  dgRNA
  Slc4a11
acgcgggagcgtggg

SEQ ID NO: 48370 - DNA, 15 bp, Artificial Sequence
  dgRNA
  Adgrl3
attggagtactgaag

SEQ ID NO: 48371 - DNA, 15 bp, Artificial Sequence
  dgRNA
  Adgrl3
tctcggaggaatggc

SEQ ID NO: 48372 - DNA, 15 bp, Artificial Sequence
  dgRNA
  Tdrd5
gtcaaagtcgcttta

SEQ ID NO: 48373 - DNA, 15 bp, Artificial Sequence
  dgRNA
  Tdrd5
ataagcgcagaccta

SEQ ID NO: 48374 - DNA, 15 bp, Artificial Sequence
  dgRNA
  Tdrd5
taagcgcagacctac

SEQ ID NO: 48375 - DNA, 15 bp, Artificial Sequence
  dgRNA
  Tdrd5
aagcgcagacctacg

SEQ ID NO: 48376 - DNA, 15 bp, Artificial Sequence
  dgRNA
  Igf2bp2
ctcccgcgcgccgcc

SEQ ID NO: 48377 - DNA, 15 bp, Artificial Sequence
  dgRNA
  Igf2bp2
tggctccgccgctcc

SEQ ID NO: 48378 - DNA, 15 bp, Artificial Sequence
  dgRNA
  Igf2bp2
cgctcccggccccgt

SEQ ID NO: 48379 - DNA, 15 bp, Artificial Sequence
  dgRNA
  Igf2bp2
ctcccggccccgttg

SEQ ID NO: 48380 - DNA, 15 bp, Artificial Sequence
  dgRNA
  Pdlim5
gccacttgtcagcgc

SEQ ID NO: 48381 - DNA, 15 bp, Artificial Sequence
  dgRNA
  Pdlim5
gtcagcgctggtctg

SEQ ID NO: 48382 - DNA, 15 bp, Artificial Sequence
  dgRNA
  Pdlim5
agcgctggtctgagg

SEQ ID NO: 48383 - DNA, 15 bp, Artificial Sequence
  dgRNA
  Rgs19
tacgactcacccctc

SEQ ID NO: 48384 - DNA, 15 bp, Artificial Sequence
  dgRNA
  Rgs19
acgactcacccctca

SEQ ID NO: 48385 - DNA, 15 bp, Artificial Sequence
  dgRNA
  Rgs19
catgccacgctaccg

SEQ ID NO: 48386 - DNA, 15 bp, Artificial Sequence
  dgRNA
  Rgs19
acgacacgccagccg

SEQ ID NO: 48387 - DNA, 15 bp, Artificial Sequence
  dgRNA
  Rgs9
tcagcatccctgatc

SEQ ID NO: 48388 - DNA, 15 bp, Artificial Sequence
  dgRNA
  Timp4
tggagcctcgtaaat

SEQ ID NO: 48389 - DNA, 15 bp, Artificial Sequence
  dgRNA
  Timp4
ggagcctcgtaaata

SEQ ID NO: 48390 - DNA, 15 bp, Artificial Sequence
  dgRNA
  Timp4
tatgcagctcagcaa

SEQ ID NO: 48391 - DNA, 15 bp, Artificial Sequence
  dgRNA
  Timp4
tggcgctgtcagcca

SEQ ID NO: 48392 - DNA, 15 bp, Artificial Sequence
  dgRNA
  Ndufb8
agccgctcaccgtcc

SEQ ID NO: 48393 - DNA, 15 bp, Artificial Sequence
  dgRNA
  Ndufb8
ccgggacttctgcgc

SEQ ID NO: 48394 - DNA, 15 bp, Artificial Sequence
  dgRNA
  Ndufb8
tcggagatcgccgtt

SEQ ID NO: 48395 - DNA, 15 bp, Artificial Sequence
  dgRNA
  Ndufb8
ggtgagcggctgatg

SEQ ID NO: 48396 - DNA, 15 bp, Artificial Sequence
  dgRNA
  Masp2
ctggtcccactagga

SEQ ID NO: 48397 - DNA, 15 bp, Artificial Sequence
  dgRNA
  Masp2
tttttactaccaggc

SEQ ID NO: 48398 - DNA, 15 bp, Artificial Sequence
  dgRNA
  Masp2
ccgaaccttcctgcc

SEQ ID NO: 48399 - DNA, 15 bp, Artificial Sequence
  dgRNA
  Masp2
ctagtgggaccagga

SEQ ID NO: 48400 - DNA, 15 bp, Artificial Sequence
  dgRNA
  Anxa2
tgtactctaggagta

SEQ ID NO: 48401 - DNA, 15 bp, Artificial Sequence
  dgRNA
  Anxa2
gtactctaggagtaa

SEQ ID NO: 48402 - DNA, 15 bp, Artificial Sequence
  dgRNA
  Anxa2
tactctaggagtaag

SEQ ID NO: 48403 - DNA, 15 bp, Artificial Sequence
  dgRNA
  Anxa2
taaggggatttgggc

SEQ ID NO: 48404 - DNA, 15 bp, Artificial Sequence
  dgRNA
  Clgn
gagagggactgacgt

SEQ ID NO: 48405 - DNA, 15 bp, Artificial Sequence
  dgRNA
  Clgn
gggactgacgttgga

SEQ ID NO: 48406 - DNA, 15 bp, Artificial Sequence
  dgRNA
  Clgn
ggaccgcatcccccc

SEQ ID NO: 48407 - DNA, 15 bp, Artificial Sequence
  dgRNA
  Clgn
atccccccaggcgcg

SEQ ID NO: 48408 - DNA, 15 bp, Artificial Sequence
  dgRNA
  Rpl12
ggtggcactggtact

SEQ ID NO: 48409 - DNA, 15 bp, Artificial Sequence
  dgRNA
  Rpl12
gtggcactggtacta

SEQ ID NO: 48410 - DNA, 15 bp, Artificial Sequence
  dgRNA
  Rpl12
agggtcgctcaagtc

SEQ ID NO: 48411 - DNA, 15 bp, Artificial Sequence
  dgRNA
  Rpl12
ggtgcagatccctta

SEQ ID NO: 48412 - DNA, 15 bp, Artificial Sequence
  dgRNA
  Tyms
acaccctgatcctat

SEQ ID NO: 48413 - DNA, 15 bp, Artificial Sequence
  dgRNA
  Tyms
cttaatgccataata

SEQ ID NO: 48414 - DNA, 15 bp, Artificial Sequence
  dgRNA
  Tyms
accacttctgtcacg

SEQ ID NO: 48415 - DNA, 15 bp, Artificial Sequence
  dgRNA
  Tyms
ccacttctgtcacgt

SEQ ID NO: 48416 - DNA, 15 bp, Artificial Sequence
  dgRNA
  Ifna15
gaagaccatcctgta

SEQ ID NO: 48417 - DNA, 15 bp, Artificial Sequence
  dgRNA
  Mrps33
gagtgagagtagttc

SEQ ID NO: 48418 - DNA, 15 bp, Artificial Sequence
  dgRNA
  Mrps33
agtgagagtagttcc

SEQ ID NO: 48419 - DNA, 15 bp, Artificial Sequence
  dgRNA
  Mrps33
ggggcgggccttccg

SEQ ID NO: 48420 - DNA, 15 bp, Artificial Sequence
  dgRNA
  Mrps33
agtcggcggacaacc

SEQ ID NO: 48421 - DNA, 15 bp, Artificial Sequence
  dgRNA
  Tor1b
tttaatggtctctag

SEQ ID NO: 48422 - DNA, 15 bp, Artificial Sequence
  dgRNA
  Tor1b
tgacactcacaacgt

SEQ ID NO: 48423 - DNA, 15 bp, Artificial Sequence
  dgRNA
  Tor1b
cgcccctttccaaca

SEQ ID NO: 48424 - DNA, 15 bp, Artificial Sequence
  dgRNA
  Tor1b
ccctttccaacaagg

SEQ ID NO: 48425 - DNA, 15 bp, Artificial Sequence
  dgRNA
  Zbtb45
cagcttctgcgattt

SEQ ID NO: 48426 - DNA, 15 bp, Artificial Sequence
  dgRNA
  Zbtb45
ctgcgattttggttg

SEQ ID NO: 48427 - DNA, 15 bp, Artificial Sequence
  dgRNA
  Zbtb45
attttggttgtggcg

SEQ ID NO: 48428 - DNA, 15 bp, Artificial Sequence
  dgRNA
  Zbtb45
tggcgcggaccagac

SEQ ID NO: 48429 - DNA, 15 bp, Artificial Sequence
  dgRNA
  Echs1
gcatacggccatcac

SEQ ID NO: 48430 - DNA, 15 bp, Artificial Sequence
  dgRNA
  Echs1
catacggccatcaca

SEQ ID NO: 48431 - DNA, 15 bp, Artificial Sequence
  dgRNA
  Echs1
atacggccatcacag

SEQ ID NO: 48432 - DNA, 15 bp, Artificial Sequence
  dgRNA
  Echs1
tctggcttcgtaaac

SEQ ID NO: 48433 - DNA, 15 bp, Artificial Sequence
  dgRNA
  Cabp2
agcaggatacggagc

SEQ ID NO: 48434 - DNA, 15 bp, Artificial Sequence
  dgRNA
  Cabp2
ccacctggatcagcg

SEQ ID NO: 48435 - DNA, 15 bp, Artificial Sequence
  dgRNA
  Cabp2
tcagcgaggagcccc

SEQ ID NO: 48436 - DNA, 15 bp, Artificial Sequence
  dgRNA
  Cabp2
cgaggagccccaggg

SEQ ID NO: 48437 - DNA, 15 bp, Artificial Sequence
  dgRNA
  Ehd2
cttatttgctaagag

SEQ ID NO: 48438 - DNA, 15 bp, Artificial Sequence
  dgRNA
  Ehd2
tggaccgcgtggggg

SEQ ID NO: 48439 - DNA, 15 bp, Artificial Sequence
  dgRNA
  Ehd2
gctggaccgcgtggg

SEQ ID NO: 48440 - DNA, 15 bp, Artificial Sequence
  dgRNA
  Ehd2
agctggaccgcgtgg

SEQ ID NO: 48441 - DNA, 15 bp, Artificial Sequence
  dgRNA
  U2surp
ggcgcgtgacgtgac

SEQ ID NO: 48442 - DNA, 15 bp, Artificial Sequence
  dgRNA
  U2surp
gcgcgtgacgtgact

SEQ ID NO: 48443 - DNA, 15 bp, Artificial Sequence
  dgRNA
  U2surp
ccgcaattcaccgga

SEQ ID NO: 48444 - DNA, 15 bp, Artificial Sequence
  dgRNA
  U2surp
tcaccggaaggcgag

SEQ ID NO: 48445 - DNA, 15 bp, Artificial Sequence
  dgRNA
  Phip
gagaaagcgcccgcc

SEQ ID NO: 48446 - DNA, 15 bp, Artificial Sequence
  dgRNA
  Phip
ggcagcccgccgctt

SEQ ID NO: 48447 - DNA, 15 bp, Artificial Sequence
  dgRNA
  Phip
gacatctcctcgcgc

SEQ ID NO: 48448 - DNA, 15 bp, Artificial Sequence
  dgRNA
  Phip
aataagtggcggccc

SEQ ID NO: 48449 - DNA, 15 bp, Artificial Sequence
  dgRNA
  5031439G07Rik
gaagtaggcggggcc

SEQ ID NO: 48450 - DNA, 15 bp, Artificial Sequence
  dgRNA
  5031439G07Rik
tctgggcggagtttt

SEQ ID NO: 48451 - DNA, 15 bp, Artificial Sequence
  dgRNA
  5031439G07Rik
agggcctttgcgtgt

SEQ ID NO: 48452 - DNA, 15 bp, Artificial Sequence
  dgRNA
  5031439G07Rik
gggcctttgcgtgtc

SEQ ID NO: 48453 - DNA, 15 bp, Artificial Sequence
  dgRNA
  Cnnm1
cactgtgacggtgcg

SEQ ID NO: 48454 - DNA, 15 bp, Artificial Sequence
  dgRNA
  Cnnm1
cggtgcgtggccacc

SEQ ID NO: 48455 - DNA, 15 bp, Artificial Sequence
  dgRNA
  Cnnm1
gcgtggccaccaggc

SEQ ID NO: 48456 - DNA, 15 bp, Artificial Sequence
  dgRNA
  Cnnm1
cagcccacgcgcgca

SEQ ID NO: 48457 - DNA, 15 bp, Artificial Sequence
  dgRNA
  Tom1
gcgcactgaagcttc

SEQ ID NO: 48458 - DNA, 15 bp, Artificial Sequence
  dgRNA
  Tom1
cgcactgaagcttca

SEQ ID NO: 48459 - DNA, 15 bp, Artificial Sequence
  dgRNA
  Tom1
gcgtggcttagaagc

SEQ ID NO: 48460 - DNA, 15 bp, Artificial Sequence
  dgRNA
  Tom1
gaagccggccctccc

SEQ ID NO: 48461 - DNA, 15 bp, Artificial Sequence
  dgRNA
  Zbtb14
cgcccctcgcagctg

SEQ ID NO: 48462 - DNA, 15 bp, Artificial Sequence
  dgRNA
  Zbtb14
ttcccccggagccga

SEQ ID NO: 48463 - DNA, 15 bp, Artificial Sequence
  dgRNA
  Zbtb14
tcccccggagccgac

SEQ ID NO: 48464 - DNA, 15 bp, Artificial Sequence
  dgRNA
  Zbtb14
gcgtccgccgagctc

SEQ ID NO: 48465 - DNA, 15 bp, Artificial Sequence
  dgRNA
  Dck
tgagctcattgcgca

SEQ ID NO: 48466 - DNA, 15 bp, Artificial Sequence
  dgRNA
  Dck
cactgctcatcccgc

SEQ ID NO: 48467 - DNA, 15 bp, Artificial Sequence
  dgRNA
  Dck
acagctcgtcgcgca

SEQ ID NO: 48468 - DNA, 15 bp, Artificial Sequence
  dgRNA
  Dck
gcacggtcagtcgcc

SEQ ID NO: 48469 - DNA, 15 bp, Artificial Sequence
  dgRNA
  Ntng1
agctgcgagcggaga

SEQ ID NO: 48470 - DNA, 15 bp, Artificial Sequence
  dgRNA
  Ntng1
aggttgccgagacct

SEQ ID NO: 48471 - DNA, 15 bp, Artificial Sequence
  dgRNA
  Ntng1
tgccgagacctcgga

SEQ ID NO: 48472 - DNA, 15 bp, Artificial Sequence
  dgRNA
  Ntng1
cgagacctcggaagg

SEQ ID NO: 48473 - DNA, 15 bp, Artificial Sequence
  dgRNA
  Olfr610
gtggcattgccaccc

SEQ ID NO: 48474 - DNA, 15 bp, Artificial Sequence
  dgRNA
  Nppb
ggggcaggatgtcat

SEQ ID NO: 48475 - DNA, 15 bp, Artificial Sequence
  dgRNA
  Nppb
atgaatactccacac

SEQ ID NO: 48476 - DNA, 15 bp, Artificial Sequence
  dgRNA
  Nppb
ctattggaaatggcg

SEQ ID NO: 48477 - DNA, 15 bp, Artificial Sequence
  dgRNA
  Nppb
cacccctattggaaa

SEQ ID NO: 48478 - DNA, 15 bp, Artificial Sequence
  dgRNA
  Tbc1d10c
aggaggtcgtggctc

SEQ ID NO: 48479 - DNA, 15 bp, Artificial Sequence
  dgRNA
  Tbc1d10c
cgtggctctggcact

SEQ ID NO: 48480 - DNA, 15 bp, Artificial Sequence
  dgRNA
  Tbc1d10c
ggcactagggcaagc

SEQ ID NO: 48481 - DNA, 15 bp, Artificial Sequence
  dgRNA
  Tbc1d10c
gggagtccccccacc

SEQ ID NO: 48482 - DNA, 15 bp, Artificial Sequence
  dgRNA
  Bcl2a1c
tcatggaccgaactt

SEQ ID NO: 48483 - DNA, 15 bp, Artificial Sequence
  dgRNA
  Bcl2a1c
gcctccgtggcctct

SEQ ID NO: 48484 - DNA, 15 bp, Artificial Sequence
  dgRNA
  Bcl2a1c
tccgtggcctctagg

SEQ ID NO: 48485 - DNA, 15 bp, Artificial Sequence
  dgRNA
  Bcl2a1c
ttcggtccatgaagg

SEQ ID NO: 48486 - DNA, 15 bp, Artificial Sequence
  dgRNA
  Ogfod3
gagggcggcggccgt

SEQ ID NO: 48487 - DNA, 15 bp, Artificial Sequence
  dgRNA
  Ogfod3
gcggccgtaggagac

SEQ ID NO: 48488 - DNA, 15 bp, Artificial Sequence
  dgRNA
  Ogfod3
cgggcccagcacaat

SEQ ID NO: 48489 - DNA, 15 bp, Artificial Sequence
  dgRNA
  Ogfod3
gcccagcacaatcgg

SEQ ID NO: 48490 - DNA, 15 bp, Artificial Sequence
  dgRNA
  Erg
gagtggaatgcctga

SEQ ID NO: 48491 - DNA, 15 bp, Artificial Sequence
  dgRNA
  Erg
agaatttgtcaatac

SEQ ID NO: 48492 - DNA, 15 bp, Artificial Sequence
  dgRNA
  Erg
aataagatgaccgag

SEQ ID NO: 48493 - DNA, 15 bp, Artificial Sequence
  dgRNA
  Erg
caataagatgaccga

SEQ ID NO: 48494 - DNA, 15 bp, Artificial Sequence
  dgRNA
  Vmn2r80
aggtgttaaaaccca

SEQ ID NO: 48495 - DNA, 15 bp, Artificial Sequence
  dgRNA
  Vmn2r80
aagatctaagtcgtg

SEQ ID NO: 48496 - DNA, 15 bp, Artificial Sequence
  dgRNA
  Spdef
gccttatgagcgtgc

SEQ ID NO: 48497 - DNA, 15 bp, Artificial Sequence
  dgRNA
  Spdef
gcaatggtcatttaa

SEQ ID NO: 48498 - DNA, 15 bp, Artificial Sequence
  dgRNA
  Spdef
cctcaagggttaacc

SEQ ID NO: 48499 - DNA, 15 bp, Artificial Sequence
  dgRNA
  Spdef
cctgcggtctgaggt

SEQ ID NO: 48500 - DNA, 15 bp, Artificial Sequence
  dgRNA
  BC049715
ttatgagtctcccct

SEQ ID NO: 48501 - DNA, 15 bp, Artificial Sequence
  dgRNA
  BC049715
taataacttctcctc

SEQ ID NO: 48502 - DNA, 15 bp, Artificial Sequence
  dgRNA
  1810011O10Rik
gcacaatgccgtctg

SEQ ID NO: 48503 - DNA, 15 bp, Artificial Sequence
  dgRNA
  1810011O10Rik
gtctgaggtgtaaag

SEQ ID NO: 48504 - DNA, 15 bp, Artificial Sequence
  dgRNA
  1810011O10Rik
ccggagccagatctt

SEQ ID NO: 48505 - DNA, 15 bp, Artificial Sequence
  dgRNA
  1810011O10Rik
ttgtttagagatagc

SEQ ID NO: 48506 - DNA, 15 bp, Artificial Sequence
  dgRNA
  Syngr4
cgcgctgaagacgtg

SEQ ID NO: 48507 - DNA, 15 bp, Artificial Sequence
  dgRNA
  Syngr4
gtgtggtccgctatt

SEQ ID NO: 48508 - DNA, 15 bp, Artificial Sequence
  dgRNA
  Syngr4
tccgctatttggagc

SEQ ID NO: 48509 - DNA, 15 bp, Artificial Sequence
  dgRNA
  Syngr4
ccgctatttggagct

SEQ ID NO: 48510 - DNA, 15 bp, Artificial Sequence
  dgRNA
  Sez6
ggtaagctacaaacc

SEQ ID NO: 48511 - DNA, 15 bp, Artificial Sequence
  dgRNA
  Sez6
gtaagctacaaaccc

SEQ ID NO: 48512 - DNA, 15 bp, Artificial Sequence
  dgRNA
  Sez6
ctacaaacccgggag

SEQ ID NO: 48513 - DNA, 15 bp, Artificial Sequence
  dgRNA
  Sez6
tacaaacccgggaga

SEQ ID NO: 48514 - DNA, 15 bp, Artificial Sequence
  dgRNA
  Cwc22
ctcgtgttctttgta

SEQ ID NO: 48515 - DNA, 15 bp, Artificial Sequence
  dgRNA
  Cwc22
gacagtgttactagc

SEQ ID NO: 48516 - DNA, 15 bp, Artificial Sequence
  dgRNA
  Cwc22
cgcgctactttcacc

SEQ ID NO: 48517 - DNA, 15 bp, Artificial Sequence
  dgRNA
  Cwc22
gcgctactttcaccc

SEQ ID NO: 48518 - DNA, 15 bp, Artificial Sequence
  dgRNA
  Ccdc51
cccctgatcgtatgc

SEQ ID NO: 48519 - DNA, 15 bp, Artificial Sequence
  dgRNA
  Ccdc51
tcgtatgccggaaac

SEQ ID NO: 48520 - DNA, 15 bp, Artificial Sequence
  dgRNA
  Ccdc51
tgccgcacctatgcg

SEQ ID NO: 48521 - DNA, 15 bp, Artificial Sequence
  dgRNA
  Ccdc51
tgcgtggcccctgat

SEQ ID NO: 48522 - DNA, 15 bp, Artificial Sequence
  dgRNA
  Asb18
gtaaggccctggaag

SEQ ID NO: 48523 - DNA, 15 bp, Artificial Sequence
  dgRNA
  Asb18
cctcctcggccctga

SEQ ID NO: 48524 - DNA, 15 bp, Artificial Sequence
  dgRNA
  Asb18
tcggccctgaaggca

SEQ ID NO: 48525 - DNA, 15 bp, Artificial Sequence
  dgRNA
  Asb18
ggacagggctaactt

SEQ ID NO: 48526 - DNA, 15 bp, Artificial Sequence
  dgRNA
  Soat1
tcctcgtagccacac

SEQ ID NO: 48527 - DNA, 15 bp, Artificial Sequence
  dgRNA
  Soat1
tcgtagccacactgg

SEQ ID NO: 48528 - DNA, 15 bp, Artificial Sequence
  dgRNA
  Soat1
gggtaccctagatat

SEQ ID NO: 48529 - DNA, 15 bp, Artificial Sequence
  dgRNA
  Soat1
taccctagatatggg

SEQ ID NO: 48530 - DNA, 15 bp, Artificial Sequence
  dgRNA
  Sox21
agtgcgcagactccg

SEQ ID NO: 48531 - DNA, 15 bp, Artificial Sequence
  dgRNA
  Sox21
agactccgcggcgcg

SEQ ID NO: 48532 - DNA, 15 bp, Artificial Sequence
  dgRNA
  Sox21
ctccgcggcgcgcgg

SEQ ID NO: 48533 - DNA, 15 bp, Artificial Sequence
  dgRNA
  Sox21
gcttggtgtcgccgg

SEQ ID NO: 48534 - DNA, 15 bp, Artificial Sequence
  dgRNA
  Siah3
aggctcaattcatca

SEQ ID NO: 48535 - DNA, 15 bp, Artificial Sequence
  dgRNA
  Siah3
gaaggcgcgctaagc

SEQ ID NO: 48536 - DNA, 15 bp, Artificial Sequence
  dgRNA
  Siah3
aaggcgcgctaagcc

SEQ ID NO: 48537 - DNA, 15 bp, Artificial Sequence
  dgRNA
  Siah3
cgcgctaagccgggc

SEQ ID NO: 48538 - DNA, 15 bp, Artificial Sequence
  dgRNA
  Iars
gtgtctctcgttcat

SEQ ID NO: 48539 - DNA, 15 bp, Artificial Sequence
  dgRNA
  Iars
tagccactgacttgc

SEQ ID NO: 48540 - DNA, 15 bp, Artificial Sequence
  dgRNA
  Iars
ctgacttgccgggtt

SEQ ID NO: 48541 - DNA, 15 bp, Artificial Sequence
  dgRNA
  Iars
tgacttgccgggtta

SEQ ID NO: 48542 - DNA, 15 bp, Artificial Sequence
  dgRNA
  Tenm4
cctcttgtaatgaag

SEQ ID NO: 48543 - DNA, 15 bp, Artificial Sequence
  dgRNA
  Tenm4
atgtttgattacaac

SEQ ID NO: 48544 - DNA, 15 bp, Artificial Sequence
  dgRNA
  Tenm4
acgctccccagtgcc

SEQ ID NO: 48545 - DNA, 15 bp, Artificial Sequence
  dgRNA
  Tenm4
cgctccccagtgcca

SEQ ID NO: 48546 - DNA, 15 bp, Artificial Sequence
  dgRNA
  Gad2
acgtgaaattgccct

SEQ ID NO: 48547 - DNA, 15 bp, Artificial Sequence
  dgRNA
  Gad2
taggccagcgtgctg

SEQ ID NO: 48548 - DNA, 15 bp, Artificial Sequence
  dgRNA
  Gad2
ctggacagcgcgttc

SEQ ID NO: 48549 - DNA, 15 bp, Artificial Sequence
  dgRNA
  Gad2
cggcagaagcagacc

SEQ ID NO: 48550 - DNA, 15 bp, Artificial Sequence
  dgRNA
  F9
cccaaagatacaccg

SEQ ID NO: 48551 - DNA, 15 bp, Artificial Sequence
  dgRNA
  F9
ccaaagatacaccga

SEQ ID NO: 48552 - DNA, 15 bp, Artificial Sequence
  dgRNA
  F9
atacaccgagggaga

SEQ ID NO: 48553 - DNA, 15 bp, Artificial Sequence
  dgRNA
  F9
attcagcttgcactt

SEQ ID NO: 48554 - DNA, 15 bp, Artificial Sequence
  dgRNA
  Kmt2b
ggactcctgctcccg

SEQ ID NO: 48555 - DNA, 15 bp, Artificial Sequence
  dgRNA
  Kmt2b
gtggtgccccgcgcg

SEQ ID NO: 48556 - DNA, 15 bp, Artificial Sequence
  dgRNA
  Kmt2b
ctgcccgccccacag

SEQ ID NO: 48557 - DNA, 15 bp, Artificial Sequence
  dgRNA
  Kmt2b
gccccacagcggcgc

SEQ ID NO: 48558 - DNA, 15 bp, Artificial Sequence
  dgRNA
  Rrp36
agacgtgaagttcta

SEQ ID NO: 48559 - DNA, 15 bp, Artificial Sequence
  dgRNA
  Rrp36
gaagttctacggctg

SEQ ID NO: 48560 - DNA, 15 bp, Artificial Sequence
  dgRNA
  Rrp36
aagttctacggctgc

SEQ ID NO: 48561 - DNA, 15 bp, Artificial Sequence
  dgRNA
  Rrp36
agttctacggctgcg

SEQ ID NO: 48562 - DNA, 15 bp, Artificial Sequence
  dgRNA
  Gls2
actccgactgcgcag

SEQ ID NO: 48563 - DNA, 15 bp, Artificial Sequence
  dgRNA
  Gls2
agctctgacgcgcgc

SEQ ID NO: 48564 - DNA, 15 bp, Artificial Sequence
  dgRNA
  Gls2
ctcagtgattggacg

SEQ ID NO: 48565 - DNA, 15 bp, Artificial Sequence
  dgRNA
  Gls2
aaacgcgccagggct

SEQ ID NO: 48566 - DNA, 15 bp, Artificial Sequence
  dgRNA
  Mapk1
cgtagcccgcccgtc

SEQ ID NO: 48567 - DNA, 15 bp, Artificial Sequence
  dgRNA
  Mapk1
gcccgcccgtcaggc

SEQ ID NO: 48568 - DNA, 15 bp, Artificial Sequence
  dgRNA
  Mapk1
cagtggttctaccgg

SEQ ID NO: 48569 - DNA, 15 bp, Artificial Sequence
  dgRNA
  Mapk1
ctcgttcccgatcgc

SEQ ID NO: 48570 - DNA, 15 bp, Artificial Sequence
  dgRNA
  Chrna10
cctgatacgagttcc

SEQ ID NO: 48571 - DNA, 15 bp, Artificial Sequence
  dgRNA
  Chrna10
catactggtgcccat

SEQ ID NO: 48572 - DNA, 15 bp, Artificial Sequence
  dgRNA
  Chrna10
gcagggttggcatac

SEQ ID NO: 48573 - DNA, 15 bp, Artificial Sequence
  dgRNA
  Chrna10
ttttagcttaattgc

SEQ ID NO: 48574 - DNA, 15 bp, Artificial Sequence
  dgRNA
  Stmnd1
gacgcctgtttatta

SEQ ID NO: 48575 - DNA, 15 bp, Artificial Sequence
  dgRNA
  Stmnd1
agcaaccggctggac

SEQ ID NO: 48576 - DNA, 15 bp, Artificial Sequence
  dgRNA
  Stmnd1
gtctaagcaaccggc

SEQ ID NO: 48577 - DNA, 15 bp, Artificial Sequence
  dgRNA
  Stmnd1
ctgagtctaagcaac

SEQ ID NO: 48578 - DNA, 15 bp, Artificial Sequence
  dgRNA
  Nck2
agctccaatctagag

SEQ ID NO: 48579 - DNA, 15 bp, Artificial Sequence
  dgRNA
  Nck2
gctccaatctagagc

SEQ ID NO: 48580 - DNA, 15 bp, Artificial Sequence
  dgRNA
  Nck2
atctagagcgggtta

SEQ ID NO: 48581 - DNA, 15 bp, Artificial Sequence
  dgRNA
  Nck2
cggcttgaagccccc

SEQ ID NO: 48582 - DNA, 15 bp, Artificial Sequence
  dgRNA
  Utp15
cgtagcccatcctct

SEQ ID NO: 48583 - DNA, 15 bp, Artificial Sequence
  dgRNA
  Utp15
cctctcggagaacca

SEQ ID NO: 48584 - DNA, 15 bp, Artificial Sequence
  dgRNA
  Utp15
ggatcgcctcagttc

SEQ ID NO: 48585 - DNA, 15 bp, Artificial Sequence
  dgRNA
  Utp15
gatcgcctcagttcc

SEQ ID NO: 48586 - DNA, 15 bp, Artificial Sequence
  dgRNA
  Dnpep
gcctccacttcggct

SEQ ID NO: 48587 - DNA, 15 bp, Artificial Sequence
  dgRNA
  Dnpep
tccacttcggctcgg

SEQ ID NO: 48588 - DNA, 15 bp, Artificial Sequence
  dgRNA
  Dnpep
cttcggctcggtggc

SEQ ID NO: 48589 - DNA, 15 bp, Artificial Sequence
  dgRNA
  Dnpep
ggccgcgcgcccttt

SEQ ID NO: 48590 - DNA, 15 bp, Artificial Sequence
  dgRNA
  Iffo2
ggccttcgcctatag

SEQ ID NO: 48591 - DNA, 15 bp, Artificial Sequence
  dgRNA
  Iffo2
gccttcgcctataga

SEQ ID NO: 48592 - DNA, 15 bp, Artificial Sequence
  dgRNA
  Iffo2
ttcgcctatagaggg

SEQ ID NO: 48593 - DNA, 15 bp, Artificial Sequence
  dgRNA
  Iffo2
tcgcctatagagggc

SEQ ID NO: 48594 - DNA, 15 bp, Artificial Sequence
  dgRNA
  Ric3
ggtgcttggatgccc

SEQ ID NO: 48595 - DNA, 15 bp, Artificial Sequence
  dgRNA
  Ric3
ttggatgcccgggcc

SEQ ID NO: 48596 - DNA, 15 bp, Artificial Sequence
  dgRNA
  Ric3
gaacgcaagcgagct

SEQ ID NO: 48597 - DNA, 15 bp, Artificial Sequence
  dgRNA
  Ric3
atagaagcttgctgt

SEQ ID NO: 48598 - DNA, 15 bp, Artificial Sequence
  dgRNA
  Sh2b2
agggccaggggcgcg

SEQ ID NO: 48599 - DNA, 15 bp, Artificial Sequence
  dgRNA
  Sh2b2
cgcggcgcgcgagtc

SEQ ID NO: 48600 - DNA, 15 bp, Artificial Sequence
  dgRNA
  Sh2b2
gcggcgcgcgagtct

SEQ ID NO: 48601 - DNA, 15 bp, Artificial Sequence
  dgRNA
  Sh2b2
gcgcgagtctgggat

SEQ ID NO: 48602 - DNA, 15 bp, Artificial Sequence
  dgRNA
  Ralgps2
ccctcccccgagcgc

SEQ ID NO: 48603 - DNA, 15 bp, Artificial Sequence
  dgRNA
  Ralgps2
tcccccgagcgccgg

SEQ ID NO: 48604 - DNA, 15 bp, Artificial Sequence
  dgRNA
  Ralgps2
ccgagcgccggcggc

SEQ ID NO: 48605 - DNA, 15 bp, Artificial Sequence
  dgRNA
  Ralgps2
gagacgccgactgct

SEQ ID NO: 48606 - DNA, 15 bp, Artificial Sequence
  dgRNA
  Dgcr14
tgatcatagtctaga

SEQ ID NO: 48607 - DNA, 15 bp, Artificial Sequence
  dgRNA
  Dgcr14
gatcatagtctagat

SEQ ID NO: 48608 - DNA, 15 bp, Artificial Sequence
  dgRNA
  Dgcr14
tgggcatgagcaacg

SEQ ID NO: 48609 - DNA, 15 bp, Artificial Sequence
  dgRNA
  Dgcr14
gggcatgagcaacgc

SEQ ID NO: 48610 - DNA, 15 bp, Artificial Sequence
  dgRNA
  Arhgap44
aaagcctaaacgtct

SEQ ID NO: 48611 - DNA, 15 bp, Artificial Sequence
  dgRNA
  Arhgap44
tgtccctacaaactt

SEQ ID NO: 48612 - DNA, 15 bp, Artificial Sequence
  dgRNA
  Arhgap44
cggcgcattccgcac

SEQ ID NO: 48613 - DNA, 15 bp, Artificial Sequence
  dgRNA
  Arhgap44
ttagccttgtagtaa

SEQ ID NO: 48614 - DNA, 15 bp, Artificial Sequence
  dgRNA
  Tiam2
agccccgtgtctctg

SEQ ID NO: 48615 - DNA, 15 bp, Artificial Sequence
  dgRNA
  Tiam2
ccgggtaatcactcc

SEQ ID NO: 48616 - DNA, 15 bp, Artificial Sequence
  dgRNA
  Tiam2
ggaaaaaccgctttt

SEQ ID NO: 48617 - DNA, 15 bp, Artificial Sequence
  dgRNA
  Tiam2
atagcgttccatcaa

SEQ ID NO: 48618 - DNA, 15 bp, Artificial Sequence
  dgRNA
  Glce
caaacttttcagcat

SEQ ID NO: 48619 - DNA, 15 bp, Artificial Sequence
  dgRNA
  Mcoln2
gtcccggacctgact

SEQ ID NO: 48620 - DNA, 15 bp, Artificial Sequence
  dgRNA
  Mcoln2
tcccggacctgactt

SEQ ID NO: 48621 - DNA, 15 bp, Artificial Sequence
  dgRNA
  Mcoln2
gtggaccatgtctgg

SEQ ID NO: 48622 - DNA, 15 bp, Artificial Sequence
  dgRNA
  Mcoln2
tgtctggtggtcgtc

SEQ ID NO: 48623 - DNA, 15 bp, Artificial Sequence
  dgRNA
  St6gal1
ccattggcacgggtt

SEQ ID NO: 48624 - DNA, 15 bp, Artificial Sequence
  dgRNA
  St6gal1
ttggcacgggtttgg

SEQ ID NO: 48625 - DNA, 15 bp, Artificial Sequence
  dgRNA
  St6gal1
ttttcttaagagtcg

SEQ ID NO: 48626 - DNA, 15 bp, Artificial Sequence
  dgRNA
  St6gal1
tttcttaagagtcgt

SEQ ID NO: 48627 - DNA, 15 bp, Artificial Sequence
  dgRNA
  Smad2
cggcgctccacccag

SEQ ID NO: 48628 - DNA, 15 bp, Artificial Sequence
  dgRNA
  Smad2
tccacccagaggcgc

SEQ ID NO: 48629 - DNA, 15 bp, Artificial Sequence
  dgRNA
  Smad2
cacccagaggcgccg

SEQ ID NO: 48630 - DNA, 15 bp, Artificial Sequence
  dgRNA
  Smad2
ccagaggcgccgggg

SEQ ID NO: 48631 - DNA, 15 bp, Artificial Sequence
  dgRNA
  Gtf2e2
tattggtaatgttgc

SEQ ID NO: 48632 - DNA, 15 bp, Artificial Sequence
  dgRNA
  Gtf2e2
ggtaatgttgccggt

SEQ ID NO: 48633 - DNA, 15 bp, Artificial Sequence
  dgRNA
  Gtf2e2
gtaatgttgccggtt

SEQ ID NO: 48634 - DNA, 15 bp, Artificial Sequence
  dgRNA
  Gtf2e2
ctggtagagtaaacg

SEQ ID NO: 48635 - DNA, 15 bp, Artificial Sequence
  dgRNA
  Tmco4
ggtggctagtctaac

SEQ ID NO: 48636 - DNA, 15 bp, Artificial Sequence
  dgRNA
  Tmco4
ctagtctaacaggaa

SEQ ID NO: 48637 - DNA, 15 bp, Artificial Sequence
  dgRNA
  Tmco4
ggaaccccaaaacgg

SEQ ID NO: 48638 - DNA, 15 bp, Artificial Sequence
  dgRNA
  Tmco4
caaaacggaggcccg

SEQ ID NO: 48639 - DNA, 15 bp, Artificial Sequence
  dgRNA
  Plau
agcgcggtccagttg

SEQ ID NO: 48640 - DNA, 15 bp, Artificial Sequence
  dgRNA
  Plau
gcggtccagttgcgg

SEQ ID NO: 48641 - DNA, 15 bp, Artificial Sequence
  dgRNA
  Plau
cggtccagttgcggt

SEQ ID NO: 48642 - DNA, 15 bp, Artificial Sequence
  dgRNA
  Plau
gttgcggtgggatgc

SEQ ID NO: 48643 - DNA, 15 bp, Artificial Sequence
  dgRNA
  Sgk1
tggtgaaataagccc

SEQ ID NO: 48644 - DNA, 15 bp, Artificial Sequence
  dgRNA
  Sgk1
tgatgttgcaacggc

SEQ ID NO: 48645 - DNA, 15 bp, Artificial Sequence
  dgRNA
  Sgk1
tgcaaagttcaacac

SEQ ID NO: 48646 - DNA, 15 bp, Artificial Sequence
  dgRNA
  Smpdl3a
acctatctatcacct

SEQ ID NO: 48647 - DNA, 15 bp, Artificial Sequence
  dgRNA
  Smpdl3a
ttcatttatcagcgg

SEQ ID NO: 48648 - DNA, 15 bp, Artificial Sequence
  dgRNA
  Smpdl3a
atcagcggtggcctg

SEQ ID NO: 48649 - DNA, 15 bp, Artificial Sequence
  dgRNA
  Smpdl3a
tctgtcataaatccc

SEQ ID NO: 48650 - DNA, 15 bp, Artificial Sequence
  dgRNA
  Bag6
ggacgttgattaacg

SEQ ID NO: 48651 - DNA, 15 bp, Artificial Sequence
  dgRNA
  Bag6
tcacaatttttctcg

SEQ ID NO: 48652 - DNA, 15 bp, Artificial Sequence
  dgRNA
  Bag6
gtagccaccccggtc

SEQ ID NO: 48653 - DNA, 15 bp, Artificial Sequence
  dgRNA
  Bag6
ggtccggttgcactc

SEQ ID NO: 48654 - DNA, 15 bp, Artificial Sequence
  dgRNA
  Ccdc61
gactgtaaacctcgg

SEQ ID NO: 48655 - DNA, 15 bp, Artificial Sequence
  dgRNA
  Ccdc61
accaattgtaaactt

SEQ ID NO: 48656 - DNA, 15 bp, Artificial Sequence
  dgRNA
  Ccdc61
attgtaaacttcgga

SEQ ID NO: 48657 - DNA, 15 bp, Artificial Sequence
  dgRNA
  Ccdc61
gtaaacttcggaagg

SEQ ID NO: 48658 - DNA, 15 bp, Artificial Sequence
  dgRNA
  Smoc1
gcttccacctgccgg

SEQ ID NO: 48659 - DNA, 15 bp, Artificial Sequence
  dgRNA
  Smoc1
cacctgccggagggt

SEQ ID NO: 48660 - DNA, 15 bp, Artificial Sequence
  dgRNA
  Smoc1
cccggggtttataac

SEQ ID NO: 48661 - DNA, 15 bp, Artificial Sequence
  dgRNA
  Smoc1
taacgggaattccca

SEQ ID NO: 48662 - DNA, 15 bp, Artificial Sequence
  dgRNA
  Cryaa
ctcagcgtgtgttgc

SEQ ID NO: 48663 - DNA, 15 bp, Artificial Sequence
  dgRNA
  Cryaa
tcagcgtgtgttgct

SEQ ID NO: 48664 - DNA, 15 bp, Artificial Sequence
  dgRNA
  Cryaa
cagcgtgtgttgctg

SEQ ID NO: 48665 - DNA, 15 bp, Artificial Sequence
  dgRNA
  Cryaa
gagcatagacatttt

SEQ ID NO: 48666 - DNA, 15 bp, Artificial Sequence
  dgRNA
  Gjb2
agtgacctaggctcc

SEQ ID NO: 48667 - DNA, 15 bp, Artificial Sequence
  dgRNA
  Gjb2
ggagagctcgcgact

SEQ ID NO: 48668 - DNA, 15 bp, Artificial Sequence
  dgRNA
  Gjb2
gagctcgcgactcgg

SEQ ID NO: 48669 - DNA, 15 bp, Artificial Sequence
  dgRNA
  Gjb2
agctcgcgactcggc

SEQ ID NO: 48670 - DNA, 15 bp, Artificial Sequence
  dgRNA
  Polr2a
gcgcgcgctccgtgt

SEQ ID NO: 48671 - DNA, 15 bp, Artificial Sequence
  dgRNA
  Polr2a
gcgctccgtgtaggc

SEQ ID NO: 48672 - DNA, 15 bp, Artificial Sequence
  dgRNA
  Polr2a
ccgtgtaggccggtg

SEQ ID NO: 48673 - DNA, 15 bp, Artificial Sequence
  dgRNA
  Polr2a
cgtgtaggccggtgc

SEQ ID NO: 48674 - DNA, 15 bp, Artificial Sequence
  dgRNA
  Lpin2
gaccgtcttgtgatt

SEQ ID NO: 48675 - DNA, 15 bp, Artificial Sequence
  dgRNA
  Lpin2
gtcttgtgattgggc

SEQ ID NO: 48676 - DNA, 15 bp, Artificial Sequence
  dgRNA
  Lpin2
cctgcttatcatccg

SEQ ID NO: 48677 - DNA, 15 bp, Artificial Sequence
  dgRNA
  Lpin2
tcatccgtggagaga

SEQ ID NO: 48678 - DNA, 15 bp, Artificial Sequence
  dgRNA
  Mrc1
ccgcccccatgtgac

SEQ ID NO: 48679 - DNA, 15 bp, Artificial Sequence
  dgRNA
  Mrc1
aggatatctctcaat

SEQ ID NO: 48680 - DNA, 15 bp, Artificial Sequence
  dgRNA
  Mrc1
tatctctcaattgga

SEQ ID NO: 48681 - DNA, 15 bp, Artificial Sequence
  dgRNA
  Mrc1
cgtaagctaaggcac

SEQ ID NO: 48682 - DNA, 15 bp, Artificial Sequence
  dgRNA
  Daxx
tcccgtacagcaata

SEQ ID NO: 48683 - DNA, 15 bp, Artificial Sequence
  dgRNA
  Daxx
aatatggccgccctc

SEQ ID NO: 48684 - DNA, 15 bp, Artificial Sequence
  dgRNA
  Daxx
caggcggaagcgcta

SEQ ID NO: 48685 - DNA, 15 bp, Artificial Sequence
  dgRNA
  Daxx
aagcgctaaggcttc

SEQ ID NO: 48686 - DNA, 15 bp, Artificial Sequence
  dgRNA
  Rab12
agggccgagggaaca

SEQ ID NO: 48687 - DNA, 15 bp, Artificial Sequence
  dgRNA
  Rab12
gggccgagggaacag

SEQ ID NO: 48688 - DNA, 15 bp, Artificial Sequence
  dgRNA
  Rab12
ataacatacacccca

SEQ ID NO: 48689 - DNA, 15 bp, Artificial Sequence
  dgRNA
  Rab12
atacaccccacggag

SEQ ID NO: 48690 - DNA, 15 bp, Artificial Sequence
  dgRNA
  Pnliprp1
aaggactgatttaag

SEQ ID NO: 48691 - DNA, 15 bp, Artificial Sequence
  dgRNA
  Pnliprp1
ctttccgcgccaaga

SEQ ID NO: 48692 - DNA, 15 bp, Artificial Sequence
  dgRNA
  Pnliprp1
tctttccgcgccaag

SEQ ID NO: 48693 - DNA, 15 bp, Artificial Sequence
  dgRNA
  C2cd4b
tatacagctagcagc

SEQ ID NO: 48694 - DNA, 15 bp, Artificial Sequence
  dgRNA
  C2cd4b
gaagggacggctgaa

SEQ ID NO: 48695 - DNA, 15 bp, Artificial Sequence
  dgRNA
  C2cd4b
ggacggctgaaaggc

SEQ ID NO: 48696 - DNA, 15 bp, Artificial Sequence
  dgRNA
  C2cd4b
gctgaaaggcgggtt

SEQ ID NO: 48697 - DNA, 15 bp, Artificial Sequence
  dgRNA
  Gm17660
ggttcagcattgaat

SEQ ID NO: 48698 - DNA, 15 bp, Artificial Sequence
  dgRNA
  Gm17660
taaatactagctaga

SEQ ID NO: 48699 - DNA, 15 bp, Artificial Sequence
  dgRNA
  Gm17660
atactagctagatgg

SEQ ID NO: 48700 - DNA, 15 bp, Artificial Sequence
  dgRNA
  Gm17660
tactagctagatggc

SEQ ID NO: 48701 - DNA, 15 bp, Artificial Sequence
  dgRNA
  Atp10b
aaacagatgcatcgc

SEQ ID NO: 48702 - DNA, 15 bp, Artificial Sequence
  dgRNA
  Atp10b
gaggataatacaaca

SEQ ID NO: 48703 - DNA, 15 bp, Artificial Sequence
  dgRNA
  Atp10b
gaagttgctgtgatc

SEQ ID NO: 48704 - DNA, 15 bp, Artificial Sequence
  dgRNA
  Olfr497
gctgctactagatta

SEQ ID NO: 48705 - DNA, 15 bp, Artificial Sequence
  dgRNA
  Mrgprh
ccaagtacaggtcac

SEQ ID NO: 48706 - DNA, 15 bp, Artificial Sequence
  dgRNA
  Mrgprh
aagaggacggacggt

SEQ ID NO: 48707 - DNA, 15 bp, Artificial Sequence
  dgRNA
  Mrgprh
aggacggacggttgg

SEQ ID NO: 48708 - DNA, 15 bp, Artificial Sequence
  dgRNA
  Mrgprh
ggacggacggttggt

SEQ ID NO: 48709 - DNA, 15 bp, Artificial Sequence
  dgRNA
  Gm6760
gagagcaccattggc

SEQ ID NO: 48710 - DNA, 15 bp, Artificial Sequence
  dgRNA
  Gm6760
gacaaggtgctgtcg

SEQ ID NO: 48711 - DNA, 15 bp, Artificial Sequence
  dgRNA
  Gm6760
agctgacacattcat

SEQ ID NO: 48712 - DNA, 15 bp, Artificial Sequence
  dgRNA
  Fxyd7
tcttgtgcgaaaact

SEQ ID NO: 48713 - DNA, 15 bp, Artificial Sequence
  dgRNA
  Fxyd7
cttgtgcgaaaactc

SEQ ID NO: 48714 - DNA, 15 bp, Artificial Sequence
  dgRNA
  Fxyd7
actcgggagccccct

SEQ ID NO: 48715 - DNA, 15 bp, Artificial Sequence
  dgRNA
  Fxyd7
cccttggccccggca

SEQ ID NO: 48716 - DNA, 15 bp, Artificial Sequence
  dgRNA
  Ski
cggggcgcgtggatg

SEQ ID NO: 48717 - DNA, 15 bp, Artificial Sequence
  dgRNA
  Ski
gcgtggatgtggcgc

SEQ ID NO: 48718 - DNA, 15 bp, Artificial Sequence
  dgRNA
  Ski
cgtggatgtggcgcc

SEQ ID NO: 48719 - DNA, 15 bp, Artificial Sequence
  dgRNA
  Ski
atgtggcgccgggcc

SEQ ID NO: 48720 - DNA, 15 bp, Artificial Sequence
  dgRNA
  Arl14ep
gatacaagttcccca

SEQ ID NO: 48721 - DNA, 15 bp, Artificial Sequence
  dgRNA
  Arl14ep
acaagttccccaagg

SEQ ID NO: 48722 - DNA, 15 bp, Artificial Sequence
  dgRNA
  Arl14ep
aagcaactcttgcgt

SEQ ID NO: 48723 - DNA, 15 bp, Artificial Sequence
  dgRNA
  Arl14ep
cctccggaggcctcc

SEQ ID NO: 48724 - DNA, 15 bp, Artificial Sequence
  dgRNA
  Sh3bp4
gtgcgattccgcccc

SEQ ID NO: 48725 - DNA, 15 bp, Artificial Sequence
  dgRNA
  Sh3bp4
ctccgcccccagctt

SEQ ID NO: 48726 - DNA, 15 bp, Artificial Sequence
  dgRNA
  Sh3bp4
ccgctgtttgcgccc

SEQ ID NO: 48727 - DNA, 15 bp, Artificial Sequence
  dgRNA
  Sh3bp4
gctcgcgccccgccc

SEQ ID NO: 48728 - DNA, 15 bp, Artificial Sequence
  dgRNA
  Sik2
tctcaggcctcgccg

SEQ ID NO: 48729 - DNA, 15 bp, Artificial Sequence
  dgRNA
  Sik2
aggcctcgccgcggc

SEQ ID NO: 48730 - DNA, 15 bp, Artificial Sequence
  dgRNA
  Sik2
tcccgcccccgacgt

SEQ ID NO: 48731 - DNA, 15 bp, Artificial Sequence
  dgRNA
  Sik2
cccccgacgtcggcg

SEQ ID NO: 48732 - DNA, 15 bp, Artificial Sequence
  dgRNA
  Plpp1
cttccagattcgggg

SEQ ID NO: 48733 - DNA, 15 bp, Artificial Sequence
  dgRNA
  Plpp1
ttccagattcggggc

SEQ ID NO: 48734 - DNA, 15 bp, Artificial Sequence
  dgRNA
  Plpp1
gcgggctccgcaagt

SEQ ID NO: 48735 - DNA, 15 bp, Artificial Sequence
  dgRNA
  Plpp1
ggctccgcaagtcgg

SEQ ID NO: 48736 - DNA, 15 bp, Artificial Sequence
  dgRNA
  Lrch4
ttggatgtcgctgcg

SEQ ID NO: 48737 - DNA, 15 bp, Artificial Sequence
  dgRNA
  Lrch4
tggatgtcgctgcgc

SEQ ID NO: 48738 - DNA, 15 bp, Artificial Sequence
  dgRNA
  Lrch4
ggatgtcgctgcgcg

SEQ ID NO: 48739 - DNA, 15 bp, Artificial Sequence
  dgRNA
  Lrch4
tgtcgctgcgcgggg

SEQ ID NO: 48740 - DNA, 15 bp, Artificial Sequence
  dgRNA
  Cacul1
tttatcacgtaatgt

SEQ ID NO: 48741 - DNA, 15 bp, Artificial Sequence
  dgRNA
  Cacul1
tcacgtaatgtcggc

SEQ ID NO: 48742 - DNA, 15 bp, Artificial Sequence
  dgRNA
  Cacul1
cacgtaatgtcggcc

SEQ ID NO: 48743 - DNA, 15 bp, Artificial Sequence
  dgRNA
  Cacul1
acgtaatgtcggccg

SEQ ID NO: 48744 - DNA, 15 bp, Artificial Sequence
  dgRNA
  Tia1
gggtttcattgttcg

SEQ ID NO: 48745 - DNA, 15 bp, Artificial Sequence
  dgRNA
  Tia1
cccgatccaagatgg

SEQ ID NO: 48746 - DNA, 15 bp, Artificial Sequence
  dgRNA
  Tia1
aaccccgatccaaga

SEQ ID NO: 48747 - DNA, 15 bp, Artificial Sequence
  dgRNA
  Mafg
ggagcacggtcaacc

SEQ ID NO: 48748 - DNA, 15 bp, Artificial Sequence
  dgRNA
  Mafg
caacccggcgagcgc

SEQ ID NO: 48749 - DNA, 15 bp, Artificial Sequence
  dgRNA
  Mafg
aacccggcgagcgcc

SEQ ID NO: 48750 - DNA, 15 bp, Artificial Sequence
  dgRNA
  Mafg
ccgcgagacattgcc

SEQ ID NO: 48751 - DNA, 15 bp, Artificial Sequence
  dgRNA
  Olfr808
tatacttaatgcctt

SEQ ID NO: 48752 - DNA, 15 bp, Artificial Sequence
  dgRNA
  2010003K11Rik
agaaggatcccgagc

SEQ ID NO: 48753 - DNA, 15 bp, Artificial Sequence
  dgRNA
  2010003K11Rik
gctgtatagtcccac

SEQ ID NO: 48754 - DNA, 15 bp, Artificial Sequence
  dgRNA
  2010003K11Rik
ctgtatagtcccaca

SEQ ID NO: 48755 - DNA, 15 bp, Artificial Sequence
  dgRNA
  2010003K11Rik
gggactatacagcgc

SEQ ID NO: 48756 - DNA, 15 bp, Artificial Sequence
  dgRNA
  Tmem14a
tcatgccttgaaatc

SEQ ID NO: 48757 - DNA, 15 bp, Artificial Sequence
  dgRNA
  Tmem14a
aagaccttcgcattc

SEQ ID NO: 48758 - DNA, 15 bp, Artificial Sequence
  dgRNA
  Tmem14a
ttcttatgacgatgt

SEQ ID NO: 48759 - DNA, 15 bp, Artificial Sequence
  dgRNA
  Tmem14a
tcttatgacgatgta

SEQ ID NO: 48760 - DNA, 15 bp, Artificial Sequence
  dgRNA
  Arg2
ttatggtatccgcct

SEQ ID NO: 48761 - DNA, 15 bp, Artificial Sequence
  dgRNA
  Arg2
tggtatccgccttgg

SEQ ID NO: 48762 - DNA, 15 bp, Artificial Sequence
  dgRNA
  Arg2
ccgccttggtggctt

SEQ ID NO: 48763 - DNA, 15 bp, Artificial Sequence
  dgRNA
  Arg2
ggtggcttaggcatc

SEQ ID NO: 48764 - DNA, 15 bp, Artificial Sequence
  dgRNA
  Mov10l1
gctgagttctatgac

SEQ ID NO: 48765 - DNA, 15 bp, Artificial Sequence
  dgRNA
  Mov10l1
atgcaagaaccccat

SEQ ID NO: 48766 - DNA, 15 bp, Artificial Sequence
  dgRNA
  Mov10l1
aagaaccccattggc

SEQ ID NO: 48767 - DNA, 15 bp, Artificial Sequence
  dgRNA
  Mov10l1
ccagcgcatgcgtgc

SEQ ID NO: 48768 - DNA, 15 bp, Artificial Sequence
  dgRNA
  Rbm7
aaactgggccctcgg

SEQ ID NO: 48769 - DNA, 15 bp, Artificial Sequence
  dgRNA
  Rbm7
cctcggcggcgccgc

SEQ ID NO: 48770 - DNA, 15 bp, Artificial Sequence
  dgRNA
  Rbm7
ccatttttcacgcaa

SEQ ID NO: 48771 - DNA, 15 bp, Artificial Sequence
  dgRNA
  Rbm7
tttttcacgcaacgg

SEQ ID NO: 48772 - DNA, 15 bp, Artificial Sequence
  dgRNA
  Il1rn
aattacacagggtaa

SEQ ID NO: 48773 - DNA, 15 bp, Artificial Sequence
  dgRNA
  Il1rn
attacacagggtaag

SEQ ID NO: 48774 - DNA, 15 bp, Artificial Sequence
  dgRNA
  Il1rn
ttacacagggtaagg

SEQ ID NO: 48775 - DNA, 15 bp, Artificial Sequence
  dgRNA
  Il1rn
cattgcgacactttc

SEQ ID NO: 48776 - DNA, 15 bp, Artificial Sequence
  dgRNA
  Ccl1
tattcgaggtatgtt

SEQ ID NO: 48777 - DNA, 15 bp, Artificial Sequence
  dgRNA
  Ccl1
aggggggcgtattcg

SEQ ID NO: 48778 - DNA, 15 bp, Artificial Sequence
  dgRNA
  Ccl1
ggaactcatacccaa

SEQ ID NO: 48779 - DNA, 15 bp, Artificial Sequence
  dgRNA
  Ccl1
ttatcagaaggcccg

SEQ ID NO: 48780 - DNA, 15 bp, Artificial Sequence
  dgRNA
  Ccdc58
agggaattagtttaa

SEQ ID NO: 48781 - DNA, 15 bp, Artificial Sequence
  dgRNA
  Ccdc58
ggccagactctaaca

SEQ ID NO: 48782 - DNA, 15 bp, Artificial Sequence
  dgRNA
  Ccdc58
atgagtgggggccaa

SEQ ID NO: 48783 - DNA, 15 bp, Artificial Sequence
  dgRNA
  Ccdc58
gtccatgttagagtc

SEQ ID NO: 48784 - DNA, 15 bp, Artificial Sequence
  dgRNA
  Sars2
ttcctgcgtcactga

SEQ ID NO: 48785 - DNA, 15 bp, Artificial Sequence
  dgRNA
  Sars2
tcctgcgtcactgaa

SEQ ID NO: 48786 - DNA, 15 bp, Artificial Sequence
  dgRNA
  Sars2
cgtcactgaagggac

SEQ ID NO: 48787 - DNA, 15 bp, Artificial Sequence
  dgRNA
  Sars2
gacaaggatgacgat

SEQ ID NO: 48788 - DNA, 15 bp, Artificial Sequence
  dgRNA
  Lpar5
aatcatctgccttat

SEQ ID NO: 48789 - DNA, 15 bp, Artificial Sequence
  dgRNA
  Lpar5
ttattggctgcgtgc

SEQ ID NO: 48790 - DNA, 15 bp, Artificial Sequence
  dgRNA
  Lpar5
tattggctgcgtgct

SEQ ID NO: 48791 - DNA, 15 bp, Artificial Sequence
  dgRNA
  Lpar5
attggctgcgtgctg

SEQ ID NO: 48792 - DNA, 15 bp, Artificial Sequence
  dgRNA
  Rnft2
ccgcagccaacgcgc

SEQ ID NO: 48793 - DNA, 15 bp, Artificial Sequence
  dgRNA
  Rnft2
agtgacgccaacgcc

SEQ ID NO: 48794 - DNA, 15 bp, Artificial Sequence
  dgRNA
  Rnft2
atgcctcctcgccat

SEQ ID NO: 48795 - DNA, 15 bp, Artificial Sequence
  dgRNA
  Rnft2
cgccattggttctgc

SEQ ID NO: 48796 - DNA, 15 bp, Artificial Sequence
  dgRNA
  Prtn3
gtatcacaggatctg

SEQ ID NO: 48797 - DNA, 15 bp, Artificial Sequence
  dgRNA
  Prtn3
accctcagcacgctc

SEQ ID NO: 48798 - DNA, 15 bp, Artificial Sequence
  dgRNA
  Prtn3
ccctcagcacgctct

SEQ ID NO: 48799 - DNA, 15 bp, Artificial Sequence
  dgRNA
  Prtn3
tcagcacgctctggg

SEQ ID NO: 48800 - DNA, 15 bp, Artificial Sequence
  dgRNA
  Gpa33
ggcctttcatagagt

SEQ ID NO: 48801 - DNA, 15 bp, Artificial Sequence
  dgRNA
  Gpa33
ggggcctcaccccat

SEQ ID NO: 48802 - DNA, 15 bp, Artificial Sequence
  dgRNA
  Gpa33
tgccagtccgttgac

SEQ ID NO: 48803 - DNA, 15 bp, Artificial Sequence
  dgRNA
  Gpa33
gccagtccgttgact

SEQ ID NO: 48804 - DNA, 15 bp, Artificial Sequence
  dgRNA
  Ppm1e
ggctgagctctcggt

SEQ ID NO: 48805 - DNA, 15 bp, Artificial Sequence
  dgRNA
  Ppm1e
gctgagctctcggta

SEQ ID NO: 48806 - DNA, 15 bp, Artificial Sequence
  dgRNA
  Ppm1e
tctcggtagggattg

SEQ ID NO: 48807 - DNA, 15 bp, Artificial Sequence
  dgRNA
  Ppm1e
ctcggtagggattgc

SEQ ID NO: 48808 - DNA, 15 bp, Artificial Sequence
  dgRNA
  Lrp1
cgcgctgccctgggg

SEQ ID NO: 48809 - DNA, 15 bp, Artificial Sequence
  dgRNA
  Lrp1
tggcgcgctgccctg

SEQ ID NO: 48810 - DNA, 15 bp, Artificial Sequence
  dgRNA
  Lrp1
ttggcgcgctgccct

SEQ ID NO: 48811 - DNA, 15 bp, Artificial Sequence
  dgRNA
  Lrp1
tttggcgcgctgccc

SEQ ID NO: 48812 - DNA, 15 bp, Artificial Sequence
  dgRNA
  Pcdhga9
tgttcaccaacacta

SEQ ID NO: 48813 - DNA, 15 bp, Artificial Sequence
  dgRNA
  Pcdhga9
aatccggatggagct

SEQ ID NO: 48814 - DNA, 15 bp, Artificial Sequence
  dgRNA
  Pcdhga9
acaggaaaatccgga

SEQ ID NO: 48815 - DNA, 15 bp, Artificial Sequence
  dgRNA
  Thsd7a
gatgatgccttttat

SEQ ID NO: 48816 - DNA, 15 bp, Artificial Sequence
  dgRNA
  Thsd7a
cagcgcaccatgtgc

SEQ ID NO: 48817 - DNA, 15 bp, Artificial Sequence
  dgRNA
  Thsd7a
agcgcaccatgtgcc

SEQ ID NO: 48818 - DNA, 15 bp, Artificial Sequence
  dgRNA
  Thsd7a
gcgcaccatgtgccg

SEQ ID NO: 48819 - DNA, 15 bp, Artificial Sequence
  dgRNA
  Enho
gcacaaccaatggcg

SEQ ID NO: 48820 - DNA, 15 bp, Artificial Sequence
  dgRNA
  Enho
cacaaccaatggcgc

SEQ ID NO: 48821 - DNA, 15 bp, Artificial Sequence
  dgRNA
  Enho
aatggcgcgggaact

SEQ ID NO: 48822 - DNA, 15 bp, Artificial Sequence
  dgRNA
  Enho
cgcgggaacttggcc

SEQ ID NO: 48823 - DNA, 15 bp, Artificial Sequence
  dgRNA
  Irf2bpl
caccgccgaagaggg

SEQ ID NO: 48824 - DNA, 15 bp, Artificial Sequence
  dgRNA
  Irf2bpl
tggaggcgcggagga

SEQ ID NO: 48825 - DNA, 15 bp, Artificial Sequence
  dgRNA
  Irf2bpl
gaggaggggccgaca

SEQ ID NO: 48826 - DNA, 15 bp, Artificial Sequence
  dgRNA
  Irf2bpl
gaggggccgacaggg

SEQ ID NO: 48827 - DNA, 15 bp, Artificial Sequence
  dgRNA
  Aimp1
gtgagggaagatcgg

SEQ ID NO: 48828 - DNA, 15 bp, Artificial Sequence
  dgRNA
  Aimp1
ggcgcaggcagcgga

SEQ ID NO: 48829 - DNA, 15 bp, Artificial Sequence
  dgRNA
  Aimp1
cggacggccgatgag

SEQ ID NO: 48830 - DNA, 15 bp, Artificial Sequence
  dgRNA
  Aimp1
gctcaggcatttatc

SEQ ID NO: 48831 - DNA, 15 bp, Artificial Sequence
  dgRNA
  Creb1
cgccacagtgaggct

SEQ ID NO: 48832 - DNA, 15 bp, Artificial Sequence
  dgRNA
  Creb1
atcgtgcctccagag

SEQ ID NO: 48833 - DNA, 15 bp, Artificial Sequence
  dgRNA
  Creb1
tcgtgcctccagagc

SEQ ID NO: 48834 - DNA, 15 bp, Artificial Sequence
  dgRNA
  Creb1
accccttcgcagcgc

SEQ ID NO: 48835 - DNA, 15 bp, Artificial Sequence
  dgRNA
  Zfp870
gggttcaagttgtcg

SEQ ID NO: 48836 - DNA, 15 bp, Artificial Sequence
  dgRNA
  Pspn
ggtttatggaatgtc

SEQ ID NO: 48837 - DNA, 15 bp, Artificial Sequence
  dgRNA
  Pspn
gagccatcaattctt

SEQ ID NO: 48838 - DNA, 15 bp, Artificial Sequence
  dgRNA
  Pspn
ccccaacggcttccc

SEQ ID NO: 48839 - DNA, 15 bp, Artificial Sequence
  dgRNA
  Pspn
cccaacggcttcccc

SEQ ID NO: 48840 - DNA, 15 bp, Artificial Sequence
  dgRNA
  Ctnnd1
aagaggacgatcaag

SEQ ID NO: 48841 - DNA, 15 bp, Artificial Sequence
  dgRNA
  Ctnnd1
agaggacgatcaaga

SEQ ID NO: 48842 - DNA, 15 bp, Artificial Sequence
  dgRNA
  Ctnnd1
ggacgatcaagaggg

SEQ ID NO: 48843 - DNA, 15 bp, Artificial Sequence
  dgRNA
  Ctnnd1
gacgatcaagaggga

SEQ ID NO: 48844 - DNA, 15 bp, Artificial Sequence
  dgRNA
  Hinfp
ctcccccttgggact

SEQ ID NO: 48845 - DNA, 15 bp, Artificial Sequence
  dgRNA
  Hinfp
actcggagccctctc

SEQ ID NO: 48846 - DNA, 15 bp, Artificial Sequence
  dgRNA
  Hinfp
gcctcttccgtgttt

SEQ ID NO: 48847 - DNA, 15 bp, Artificial Sequence
  dgRNA
  Hinfp
gtgttttggtgcgca

SEQ ID NO: 48848 - DNA, 15 bp, Artificial Sequence
  dgRNA
  Cope
gcacccgagctgcac

SEQ ID NO: 48849 - DNA, 15 bp, Artificial Sequence
  dgRNA
  Cope
cgagctgcaccggcg

SEQ ID NO: 48850 - DNA, 15 bp, Artificial Sequence
  dgRNA
  Cope
gagctgcaccggcgt

SEQ ID NO: 48851 - DNA, 15 bp, Artificial Sequence
  dgRNA
  Cope
acgtcacgtccaccc

SEQ ID NO: 48852 - DNA, 15 bp, Artificial Sequence
  dgRNA
  Nipa2
cggattttaaataac

SEQ ID NO: 48853 - DNA, 15 bp, Artificial Sequence
  dgRNA
  Nipa2
aaggtacggctcctc

SEQ ID NO: 48854 - DNA, 15 bp, Artificial Sequence
  dgRNA
  Nipa2
ctccggctcgctgtc

SEQ ID NO: 48855 - DNA, 15 bp, Artificial Sequence
  dgRNA
  Nipa2
tccggctcgctgtca

SEQ ID NO: 48856 - DNA, 15 bp, Artificial Sequence
  dgRNA
  Cldn4
tcttgtgatactggc

SEQ ID NO: 48857 - DNA, 15 bp, Artificial Sequence
  dgRNA
  Cldn4
actggcgggtgactc

SEQ ID NO: 48858 - DNA, 15 bp, Artificial Sequence
  dgRNA
  Cldn4
tggcgggtgactcag

SEQ ID NO: 48859 - DNA, 15 bp, Artificial Sequence
  dgRNA
  Cldn4
tctgaacgcctttgt

SEQ ID NO: 48860 - DNA, 15 bp, Artificial Sequence
  dgRNA
  Smarcb1
tctggctatgcgact

SEQ ID NO: 48861 - DNA, 15 bp, Artificial Sequence
  dgRNA
  Smarcb1
gctaccgcctgagtc

SEQ ID NO: 48862 - DNA, 15 bp, Artificial Sequence
  dgRNA
  Smarcb1
ctaccgcctgagtca

SEQ ID NO: 48863 - DNA, 15 bp, Artificial Sequence
  dgRNA
  Smarcb1
atttcggtcgctgag

SEQ ID NO: 48864 - DNA, 15 bp, Artificial Sequence
  dgRNA
  Olig3
ctcttttactgcaag

SEQ ID NO: 48865 - DNA, 15 bp, Artificial Sequence
  dgRNA
  Olig3
accaatgtgcagtgc

SEQ ID NO: 48866 - DNA, 15 bp, Artificial Sequence
  dgRNA
  Olig3
atagcgaagcaagcc

SEQ ID NO: 48867 - DNA, 15 bp, Artificial Sequence
  dgRNA
  Olig3
tttatagcgctgcag

SEQ ID NO: 48868 - DNA, 15 bp, Artificial Sequence
  dgRNA
  Asb8
ctagccctgctcagt

SEQ ID NO: 48869 - DNA, 15 bp, Artificial Sequence
  dgRNA
  Asb8
ggccactattgttgc

SEQ ID NO: 48870 - DNA, 15 bp, Artificial Sequence
  dgRNA
  Asb8
aggatcggtcttcaa

SEQ ID NO: 48871 - DNA, 15 bp, Artificial Sequence
  dgRNA
  Asb8
caggatcggtcttca

SEQ ID NO: 48872 - DNA, 15 bp, Artificial Sequence
  dgRNA
  Ss18
tcttacactccttgc

SEQ ID NO: 48873 - DNA, 15 bp, Artificial Sequence
  dgRNA
  Ss18
tgcggctcagcgtta

SEQ ID NO: 48874 - DNA, 15 bp, Artificial Sequence
  dgRNA
  Ss18
gcgttaaggccaagc

SEQ ID NO: 48875 - DNA, 15 bp, Artificial Sequence
  dgRNA
  Ss18
ccaagccggccagcg

SEQ ID NO: 48876 - DNA, 15 bp, Artificial Sequence
  dgRNA
  Nap1l2
ccatattagagaatc

SEQ ID NO: 48877 - DNA, 15 bp, Artificial Sequence
  dgRNA
  Nap1l2
catctactaatttac

SEQ ID NO: 48878 - DNA, 15 bp, Artificial Sequence
  dgRNA
  Nap1l2
ctaatttactggctc

SEQ ID NO: 48879 - DNA, 15 bp, Artificial Sequence
  dgRNA
  Nap1l2
ccagattctctaata

SEQ ID NO: 48880 - DNA, 15 bp, Artificial Sequence
  dgRNA
  Olfr488
agttgctccaaattt

SEQ ID NO: 48881 - DNA, 15 bp, Artificial Sequence
  dgRNA
  Dhcr7
gagaccccgcccccg

SEQ ID NO: 48882 - DNA, 15 bp, Artificial Sequence
  dgRNA
  Dhcr7
cgcaccctttaaagt

SEQ ID NO: 48883 - DNA, 15 bp, Artificial Sequence
  dgRNA
  Dhcr7
gcaccctttaaagta

SEQ ID NO: 48884 - DNA, 15 bp, Artificial Sequence
  dgRNA
  Dhcr7
agcgcctgcgcagta

SEQ ID NO: 48885 - DNA, 15 bp, Artificial Sequence
  dgRNA
  Olfr796
cctcattattagtcc

SEQ ID NO: 48886 - DNA, 15 bp, Artificial Sequence
  dgRNA
  Olfr796
cctggactaataatg

SEQ ID NO: 48887 - DNA, 15 bp, Artificial Sequence
  dgRNA
  Olfr796
gagattgaactcacc

SEQ ID NO: 48888 - DNA, 15 bp, Artificial Sequence
  dgRNA
  Celf4
gcagggaacttgaac

SEQ ID NO: 48889 - DNA, 15 bp, Artificial Sequence
  dgRNA
  Celf4
cctgtttaaaccgaa

SEQ ID NO: 48890 - DNA, 15 bp, Artificial Sequence
  dgRNA
  Celf4
agggcgcgcggtagg

SEQ ID NO: 48891 - DNA, 15 bp, Artificial Sequence
  dgRNA
  Celf4
gcgagggcgcgcggt

SEQ ID NO: 48892 - DNA, 15 bp, Artificial Sequence
  dgRNA
  Utf1
aaaaactccgttctc

SEQ ID NO: 48893 - DNA, 15 bp, Artificial Sequence
  dgRNA
  Utf1
tccgttctcaggtcc

SEQ ID NO: 48894 - DNA, 15 bp, Artificial Sequence
  dgRNA
  Utf1
ccgttctcaggtcct

SEQ ID NO: 48895 - DNA, 15 bp, Artificial Sequence
  dgRNA
  Utf1
actaggtaggcgagg

SEQ ID NO: 48896 - DNA, 15 bp, Artificial Sequence
  dgRNA
  Ddi1
gaacttgctacctta

SEQ ID NO: 48897 - DNA, 15 bp, Artificial Sequence
  dgRNA
  Ddi1
taatgtctagcctgt

SEQ ID NO: 48898 - DNA, 15 bp, Artificial Sequence
  dgRNA
  Ddi1
aaatcttcttagtac

SEQ ID NO: 48899 - DNA, 15 bp, Artificial Sequence
  dgRNA
  Tlr8
attatcattctgaac

SEQ ID NO: 48900 - DNA, 15 bp, Artificial Sequence
  dgRNA
  Tlr8
gcccaaattctttct

SEQ ID NO: 48901 - DNA, 15 bp, Artificial Sequence
  dgRNA
  Tlr8
gatgtgctctatagc

SEQ ID NO: 48902 - DNA, 15 bp, Artificial Sequence
  dgRNA
  C1qtnf5
cacagttcggcctct

SEQ ID NO: 48903 - DNA, 15 bp, Artificial Sequence
  dgRNA
  C1qtnf5
ccccacaattttggc

SEQ ID NO: 48904 - DNA, 15 bp, Artificial Sequence
  dgRNA
  C1qtnf5
attttggccggccgc

SEQ ID NO: 48905 - DNA, 15 bp, Artificial Sequence
  dgRNA
  C1qtnf5
ttttggccggccgcc

SEQ ID NO: 48906 - DNA, 15 bp, Artificial Sequence
  dgRNA
  Mxi1
aacttgagactgcac

SEQ ID NO: 48907 - DNA, 15 bp, Artificial Sequence
  dgRNA
  Mxi1
ggagcctgtgcgagc

SEQ ID NO: 48908 - DNA, 15 bp, Artificial Sequence
  dgRNA
  Mxi1
agcctgtgcgagccg

SEQ ID NO: 48909 - DNA, 15 bp, Artificial Sequence
  dgRNA
  Mxi1
gcctgtgcgagccgg

SEQ ID NO: 48910 - DNA, 15 bp, Artificial Sequence
  dgRNA
  Tacc1
gccgcgccagtagtt

SEQ ID NO: 48911 - DNA, 15 bp, Artificial Sequence
  dgRNA
  Tacc1
cagtagttcggtccg

SEQ ID NO: 48912 - DNA, 15 bp, Artificial Sequence
  dgRNA
  Tacc1
agtagttcggtccga

SEQ ID NO: 48913 - DNA, 15 bp, Artificial Sequence
  dgRNA
  Tacc1
gtagttcggtccgag

SEQ ID NO: 48914 - DNA, 15 bp, Artificial Sequence
  dgRNA
  Slc17a8
ttgtagtgcattaag

SEQ ID NO: 48915 - DNA, 15 bp, Artificial Sequence
  dgRNA
  Slc17a8
ccctccctggcaaac

SEQ ID NO: 48916 - DNA, 15 bp, Artificial Sequence
  dgRNA
  Slc17a8
cactaggttaagttg

SEQ ID NO: 48917 - DNA, 15 bp, Artificial Sequence
  dgRNA
  Slc17a8
aattatattgtgagg

SEQ ID NO: 48918 - DNA, 15 bp, Artificial Sequence
  dgRNA
  Nlrp4c
tatccggagtgcatc

SEQ ID NO: 48919 - DNA, 15 bp, Artificial Sequence
  dgRNA
  Nlrp4c
ccctggaccaatgag

SEQ ID NO: 48920 - DNA, 15 bp, Artificial Sequence
  dgRNA
  Nlrp4c
gatacggcatctccg

SEQ ID NO: 48921 - DNA, 15 bp, Artificial Sequence
  dgRNA
  Nlrp4c
attccggatgcactc

SEQ ID NO: 48922 - DNA, 15 bp, Artificial Sequence
  dgRNA
  Ptcd3
aagtaagtttattcg

SEQ ID NO: 48923 - DNA, 15 bp, Artificial Sequence
  dgRNA
  Ptcd3
ttgtgaccacccgtt

SEQ ID NO: 48924 - DNA, 15 bp, Artificial Sequence
  dgRNA
  Ptcd3
cccgcccctcgaccc

SEQ ID NO: 48925 - DNA, 15 bp, Artificial Sequence
  dgRNA
  Ptcd3
gcccctcgaccctgg

SEQ ID NO: 48926 - DNA, 15 bp, Artificial Sequence
  dgRNA
  Entpd7
aagctgcagcggtga

SEQ ID NO: 48927 - DNA, 15 bp, Artificial Sequence
  dgRNA
  Entpd7
ggtgaaggccaccgc

SEQ ID NO: 48928 - DNA, 15 bp, Artificial Sequence
  dgRNA
  Entpd7
gtgaaggccaccgca

SEQ ID NO: 48929 - DNA, 15 bp, Artificial Sequence
  dgRNA
  Entpd7
gccaccgcagggagc

SEQ ID NO: 48930 - DNA, 15 bp, Artificial Sequence
  dgRNA
  Ikbkb
gcctaaaaagtgcca

SEQ ID NO: 48931 - DNA, 15 bp, Artificial Sequence
  dgRNA
  Ikbkb
gctctccaagccgcc

SEQ ID NO: 48932 - DNA, 15 bp, Artificial Sequence
  dgRNA
  Ikbkb
aggtcctgcgccgcc

SEQ ID NO: 48933 - DNA, 15 bp, Artificial Sequence
  dgRNA
  Ikbkb
gtccagcaccttggc

SEQ ID NO: 48934 - DNA, 15 bp, Artificial Sequence
  dgRNA
  Defb13
tccaggcaaaaaggc

SEQ ID NO: 48935 - DNA, 15 bp, Artificial Sequence
  dgRNA
  Defb13
agacaaaaggtcgat

SEQ ID NO: 48936 - DNA, 15 bp, Artificial Sequence
  dgRNA
  Defb13
aaaaggtcgatcggc

SEQ ID NO: 48937 - DNA, 15 bp, Artificial Sequence
  dgRNA
  Defb13
ccactcgtcactcaa

SEQ ID NO: 48938 - DNA, 15 bp, Artificial Sequence
  dgRNA
  Gsg1
cgattgaaagacctc

SEQ ID NO: 48939 - DNA, 15 bp, Artificial Sequence
  dgRNA
  Gsg1
gcccttctctcaacc

SEQ ID NO: 48940 - DNA, 15 bp, Artificial Sequence
  dgRNA
  Gsg1
tgggcggggcatccg

SEQ ID NO: 48941 - DNA, 15 bp, Artificial Sequence
  dgRNA
  Gsg1
gggcggggcatccgg

SEQ ID NO: 48942 - DNA, 15 bp, Artificial Sequence
  dgRNA
  Chil5
ttaccacttatcaca

SEQ ID NO: 48943 - DNA, 15 bp, Artificial Sequence
  dgRNA
  Chil5
tttaccacttatcac

SEQ ID NO: 48944 - DNA, 15 bp, Artificial Sequence
  dgRNA
  Chil5
ggaaagcgtttgcta

SEQ ID NO: 48945 - DNA, 15 bp, Artificial Sequence
  dgRNA
  Chil5
tggaaagcgtttgct

SEQ ID NO: 48946 - DNA, 15 bp, Artificial Sequence
  dgRNA
  Nbr1
cagccccgcgattct

SEQ ID NO: 48947 - DNA, 15 bp, Artificial Sequence
  dgRNA
  Nbr1
agccccgcgattctc

SEQ ID NO: 48948 - DNA, 15 bp, Artificial Sequence
  dgRNA
  Nbr1
ccaatgtcagtgacc

SEQ ID NO: 48949 - DNA, 15 bp, Artificial Sequence
  dgRNA
  Nbr1
cgcataactgcgagg

SEQ ID NO: 48950 - DNA, 15 bp, Artificial Sequence
  dgRNA
  Vcan
tgggcgaagaactca

SEQ ID NO: 48951 - DNA, 15 bp, Artificial Sequence
  dgRNA
  Vcan
gctgtggccaagcgc

SEQ ID NO: 48952 - DNA, 15 bp, Artificial Sequence
  dgRNA
  Vcan
ctgtggccaagcgct

SEQ ID NO: 48953 - DNA, 15 bp, Artificial Sequence
  dgRNA
  Vcan
gcccagaaaggctcg

SEQ ID NO: 48954 - DNA, 15 bp, Artificial Sequence
  dgRNA
  Zfp385c
ggtagtacctgtccc

SEQ ID NO: 48955 - DNA, 15 bp, Artificial Sequence
  dgRNA
  Cep78
tcaagcccggttctc

SEQ ID NO: 48956 - DNA, 15 bp, Artificial Sequence
  dgRNA
  Cep78
attgcacctcacttt

SEQ ID NO: 48957 - DNA, 15 bp, Artificial Sequence
  dgRNA
  Cep78
acttttggtacccag

SEQ ID NO: 48958 - DNA, 15 bp, Artificial Sequence
  dgRNA
  Cep78
ctcgcctccagctga

SEQ ID NO: 48959 - DNA, 15 bp, Artificial Sequence
  dgRNA
  Mplkip
gaacctttgtgcagc

SEQ ID NO: 48960 - DNA, 15 bp, Artificial Sequence
  dgRNA
  Mplkip
gtgcagccggaacta

SEQ ID NO: 48961 - DNA, 15 bp, Artificial Sequence
  dgRNA
  Mplkip
gccggaactaaggtg

SEQ ID NO: 48962 - DNA, 15 bp, Artificial Sequence
  dgRNA
  Mplkip
agggtgtataaatag

SEQ ID NO: 48963 - DNA, 15 bp, Artificial Sequence
  dgRNA
  Ppm1k
aattgcctgtgcagg

SEQ ID NO: 48964 - DNA, 15 bp, Artificial Sequence
  dgRNA
  Ppm1k
atctaaatctgtaat

SEQ ID NO: 48965 - DNA, 15 bp, Artificial Sequence
  dgRNA
  Ppm1k
aattggctcagattg

SEQ ID NO: 48966 - DNA, 15 bp, Artificial Sequence
  dgRNA
  Ppm1k
ggaaatacactcctc

SEQ ID NO: 48967 - DNA, 15 bp, Artificial Sequence
  dgRNA
  Ostm1
ggctcatggaaggcg

SEQ ID NO: 48968 - DNA, 15 bp, Artificial Sequence
  dgRNA
  Ostm1
aaggcggggaactgc

SEQ ID NO: 48969 - DNA, 15 bp, Artificial Sequence
  dgRNA
  Ostm1
aggcggggaactgca

SEQ ID NO: 48970 - DNA, 15 bp, Artificial Sequence
  dgRNA
  Ostm1
gcagagcgtgcaaga

SEQ ID NO: 48971 - DNA, 15 bp, Artificial Sequence
  dgRNA
  Adsl
aaagcgttgaccctc

SEQ ID NO: 48972 - DNA, 15 bp, Artificial Sequence
  dgRNA
  Adsl
aagcgttgaccctca

SEQ ID NO: 48973 - DNA, 15 bp, Artificial Sequence
  dgRNA
  Adsl
agcgttgaccctcag

SEQ ID NO: 48974 - DNA, 15 bp, Artificial Sequence
  dgRNA
  Adsl
ccatcttcgccttcc

SEQ ID NO: 48975 - DNA, 15 bp, Artificial Sequence
  dgRNA
  Mettl7a3
aaaaatcgcagagtc

SEQ ID NO: 48976 - DNA, 15 bp, Artificial Sequence
  dgRNA
  Mettl7a3
tgcgagtgtctcttg

SEQ ID NO: 48977 - DNA, 15 bp, Artificial Sequence
  dgRNA
  Mettl7a3
ctgcgagtgtctctt

SEQ ID NO: 48978 - DNA, 15 bp, Artificial Sequence
  dgRNA
  Ifit1bl1
tatggtaggttggcc

SEQ ID NO: 48979 - DNA, 15 bp, Artificial Sequence
  dgRNA
  Cdyl
gtcccgccctctgct

SEQ ID NO: 48980 - DNA, 15 bp, Artificial Sequence
  dgRNA
  Cdyl
ctagcgcccacgtcc

SEQ ID NO: 48981 - DNA, 15 bp, Artificial Sequence
  dgRNA
  Cdyl
cgcccacgtccaggc

SEQ ID NO: 48982 - DNA, 15 bp, Artificial Sequence
  dgRNA
  Cdyl
gcccacgtccaggca

SEQ ID NO: 48983 - DNA, 15 bp, Artificial Sequence
  dgRNA
  4933436I01Rik
taaggttgccatgat

SEQ ID NO: 48984 - DNA, 15 bp, Artificial Sequence
  dgRNA
  4933436I01Rik
agctgacatagttta

SEQ ID NO: 48985 - DNA, 15 bp, Artificial Sequence
  dgRNA
  4933436I01Rik
catagtttatgggtg

SEQ ID NO: 48986 - DNA, 15 bp, Artificial Sequence
  dgRNA
  4933436I01Rik
tacacctctgaatta

SEQ ID NO: 48987 - DNA, 15 bp, Artificial Sequence
  dgRNA
  Ppp2r5a
gcttagccctgcgat

SEQ ID NO: 48988 - DNA, 15 bp, Artificial Sequence
  dgRNA
  Ppp2r5a
ccctgcgattggccg

SEQ ID NO: 48989 - DNA, 15 bp, Artificial Sequence
  dgRNA
  Ppp2r5a
cctgcgattggccga

SEQ ID NO: 48990 - DNA, 15 bp, Artificial Sequence
  dgRNA
  Ppp2r5a
attggccgagggcac

SEQ ID NO: 48991 - DNA, 15 bp, Artificial Sequence
  dgRNA
  Mapk1ip1
caccgtcgccgccgc

SEQ ID NO: 48992 - DNA, 15 bp, Artificial Sequence
  dgRNA
  Mapk1ip1
tcgccgccgccgggg

SEQ ID NO: 48993 - DNA, 15 bp, Artificial Sequence
  dgRNA
  Mapk1ip1
tgcccgtcgccccgc

SEQ ID NO: 48994 - DNA, 15 bp, Artificial Sequence
  dgRNA
  Mapk1ip1
ctccgcctcctccga

SEQ ID NO: 48995 - DNA, 15 bp, Artificial Sequence
  dgRNA
  Maneal
ccactcgcgatcact

SEQ ID NO: 48996 - DNA, 15 bp, Artificial Sequence
  dgRNA
  Maneal
tcgcgatcacttggt

SEQ ID NO: 48997 - DNA, 15 bp, Artificial Sequence
  dgRNA
  Maneal
ggcccgcccgcactg

SEQ ID NO: 48998 - DNA, 15 bp, Artificial Sequence
  dgRNA
  Maneal
gcccgcccgcactgc

SEQ ID NO: 48999 - DNA, 15 bp, Artificial Sequence
  dgRNA
  Usp51
ggtttttctgcctag

SEQ ID NO: 49000 - DNA, 15 bp, Artificial Sequence
  dgRNA
  Usp51
gtttttctgcctagg

SEQ ID NO: 49001 - DNA, 15 bp, Artificial Sequence
  dgRNA
  Usp51
actattcatccctgc

SEQ ID NO: 49002 - DNA, 15 bp, Artificial Sequence
  dgRNA
  Usp51
ctggaggcctgattc

SEQ ID NO: 49003 - DNA, 15 bp, Artificial Sequence
  dgRNA
  Spryd3
caccctcccgacacc

SEQ ID NO: 49004 - DNA, 15 bp, Artificial Sequence
  dgRNA
  Spryd3
accctcccgacacca

SEQ ID NO: 49005 - DNA, 15 bp, Artificial Sequence
  dgRNA
  Spryd3
acgccgccgagtgtt

SEQ ID NO: 49006 - DNA, 15 bp, Artificial Sequence
  dgRNA
  Spryd3
ggtacccagctcacc

SEQ ID NO: 49007 - DNA, 15 bp, Artificial Sequence
  dgRNA
  Hint3
aatgttaccaacccc

SEQ ID NO: 49008 - DNA, 15 bp, Artificial Sequence
  dgRNA
  Hint3
taccaacccctggat

SEQ ID NO: 49009 - DNA, 15 bp, Artificial Sequence
  dgRNA
  Hint3
aacgcctttgagcag

SEQ ID NO: 49010 - DNA, 15 bp, Artificial Sequence
  dgRNA
  Hint3
acgcctttgagcagt

SEQ ID NO: 49011 - DNA, 15 bp, Artificial Sequence
  dgRNA
  Rab3gap1
taggcgggcccgctt

SEQ ID NO: 49012 - DNA, 15 bp, Artificial Sequence
  dgRNA
  Rab3gap1
aggcgggcccgcttc

SEQ ID NO: 49013 - DNA, 15 bp, Artificial Sequence
  dgRNA
  Rab3gap1
ggcgggcccgcttcg

SEQ ID NO: 49014 - DNA, 15 bp, Artificial Sequence
  dgRNA
  Rab3gap1
cgctcttcttcaagg

SEQ ID NO: 49015 - DNA, 15 bp, Artificial Sequence
  dgRNA
  Rad51ap2
acgggggcgtgtcgg

SEQ ID NO: 49016 - DNA, 15 bp, Artificial Sequence
  dgRNA
  Rad51ap2
gtcgggggcgtgacc

SEQ ID NO: 49017 - DNA, 15 bp, Artificial Sequence
  dgRNA
  Rad51ap2
tcgggggcgtgacca

SEQ ID NO: 49018 - DNA, 15 bp, Artificial Sequence
  dgRNA
  Rad51ap2
ctaagtctggcctcg

SEQ ID NO: 49019 - DNA, 15 bp, Artificial Sequence
  dgRNA
  Eml1
ttcaatagaattccc

SEQ ID NO: 49020 - DNA, 15 bp, Artificial Sequence
  dgRNA
  Eml1
ttcactaagtgcagg

SEQ ID NO: 49021 - DNA, 15 bp, Artificial Sequence
  dgRNA
  Eml1
tatgtagggcagatg

SEQ ID NO: 49022 - DNA, 15 bp, Artificial Sequence
  dgRNA
  Eml1
gtatgtagggcagat

SEQ ID NO: 49023 - DNA, 15 bp, Artificial Sequence
  dgRNA
  Tbc1d15
cgcgcacgcgcagta

SEQ ID NO: 49024 - DNA, 15 bp, Artificial Sequence
  dgRNA
  Tbc1d15
cgcagtacggcacga

SEQ ID NO: 49025 - DNA, 15 bp, Artificial Sequence
  dgRNA
  Tbc1d15
gctggcgagtctctt

SEQ ID NO: 49026 - DNA, 15 bp, Artificial Sequence
  dgRNA
  Tbc1d15
aacttggggaacggc

SEQ ID NO: 49027 - DNA, 15 bp, Artificial Sequence
  dgRNA
  Cd151
gacctgcgtcagccg

SEQ ID NO: 49028 - DNA, 15 bp, Artificial Sequence
  dgRNA
  Cd151
acaatagtgtgtcta

SEQ ID NO: 49029 - DNA, 15 bp, Artificial Sequence
  dgRNA
  Cd151
gcagggtgtgactag

SEQ ID NO: 49030 - DNA, 15 bp, Artificial Sequence
  dgRNA
  Cd151
tgactaggggactcc

SEQ ID NO: 49031 - DNA, 15 bp, Artificial Sequence
  dgRNA
  Lifr
ccgcgcgcgacccag

SEQ ID NO: 49032 - DNA, 15 bp, Artificial Sequence
  dgRNA
  Lifr
gctccgactcacgcg

SEQ ID NO: 49033 - DNA, 15 bp, Artificial Sequence
  dgRNA
  Lifr
tcacgcgcggcctcg

SEQ ID NO: 49034 - DNA, 15 bp, Artificial Sequence
  dgRNA
  Lifr
cacgcgcggcctcgc

SEQ ID NO: 49035 - DNA, 15 bp, Artificial Sequence
  dgRNA
  Csn1s1
gagtttaaatagtca

SEQ ID NO: 49036 - DNA, 15 bp, Artificial Sequence
  dgRNA
  Nf2
cagtcttgctagagt

SEQ ID NO: 49037 - DNA, 15 bp, Artificial Sequence
  dgRNA
  Nf2
gtaggagtatacttt

SEQ ID NO: 49038 - DNA, 15 bp, Artificial Sequence
  dgRNA
  Nf2
aggaacaaaagcgct

SEQ ID NO: 49039 - DNA, 15 bp, Artificial Sequence
  dgRNA
  Nf2
acgccgagaacagac

SEQ ID NO: 49040 - DNA, 15 bp, Artificial Sequence
  dgRNA
  Neu1
gggcttcccaaccct

SEQ ID NO: 49041 - DNA, 15 bp, Artificial Sequence
  dgRNA
  Neu1
ggcttcccaacccta

SEQ ID NO: 49042 - DNA, 15 bp, Artificial Sequence
  dgRNA
  Neu1
ggactcatacaaact

SEQ ID NO: 49043 - DNA, 15 bp, Artificial Sequence
  dgRNA
  Neu1
tcatacaaactagga

SEQ ID NO: 49044 - DNA, 15 bp, Artificial Sequence
  dgRNA
  Olfr1423
ccatgaggcaatcaa

SEQ ID NO: 49045 - DNA, 15 bp, Artificial Sequence
  dgRNA
  Olfr1423
aatctgtgcttacta

SEQ ID NO: 49046 - DNA, 15 bp, Artificial Sequence
  dgRNA
  Olfr1423
ccattgattgcctca

SEQ ID NO: 49047 - DNA, 15 bp, Artificial Sequence
  dgRNA
  Kif7
gtggtttgtgtcagt

SEQ ID NO: 49048 - DNA, 15 bp, Artificial Sequence
  dgRNA
  Kif7
agttgggtgcccctt

SEQ ID NO: 49049 - DNA, 15 bp, Artificial Sequence
  dgRNA
  Kif7
gttgggtgccccttt

SEQ ID NO: 49050 - DNA, 15 bp, Artificial Sequence
  dgRNA
  Kif7
caaagctatgtggtc

SEQ ID NO: 49051 - DNA, 15 bp, Artificial Sequence
  dgRNA
  Grina
attcgccttacatca

SEQ ID NO: 49052 - DNA, 15 bp, Artificial Sequence
  dgRNA
  Grina
ccccgccccatcata

SEQ ID NO: 49053 - DNA, 15 bp, Artificial Sequence
  dgRNA
  Grina
gcccgcccagtcaca

SEQ ID NO: 49054 - DNA, 15 bp, Artificial Sequence
  dgRNA
  Grina
tctgcgtctccccag

SEQ ID NO: 49055 - DNA, 15 bp, Artificial Sequence
  dgRNA
  Atxn1
cggatccttgagctg

SEQ ID NO: 49056 - DNA, 15 bp, Artificial Sequence
  dgRNA
  Atxn1
atccttgagctgcgg

SEQ ID NO: 49057 - DNA, 15 bp, Artificial Sequence
  dgRNA
  Atxn1
cttgagctgcggcgg

SEQ ID NO: 49058 - DNA, 15 bp, Artificial Sequence
  dgRNA
  Atxn1
caactgctccatatt

SEQ ID NO: 49059 - DNA, 15 bp, Artificial Sequence
  dgRNA
  Ctps2
ggctagtcgtggggt

SEQ ID NO: 49060 - DNA, 15 bp, Artificial Sequence
  dgRNA
  Ctps2
gctagtcgtggggtg

SEQ ID NO: 49061 - DNA, 15 bp, Artificial Sequence
  dgRNA
  Ctps2
aagctagctaaccac

SEQ ID NO: 49062 - DNA, 15 bp, Artificial Sequence
  dgRNA
  Ctps2
ctagctaaccacagg

SEQ ID NO: 49063 - DNA, 15 bp, Artificial Sequence
  dgRNA
  Rps6ka2
atggctggtgataat

SEQ ID NO: 49064 - DNA, 15 bp, Artificial Sequence
  dgRNA
  Rps6ka2
gataattggagagta

SEQ ID NO: 49065 - DNA, 15 bp, Artificial Sequence
  dgRNA
  Rps6ka2
aattggagagtacgg

SEQ ID NO: 49066 - DNA, 15 bp, Artificial Sequence
  dgRNA
  Rps6ka2
tggagagtacggtgg

SEQ ID NO: 49067 - DNA, 15 bp, Artificial Sequence
  dgRNA
  Smlr1
caaagacgcatctcc

SEQ ID NO: 49068 - DNA, 15 bp, Artificial Sequence
  dgRNA
  Smlr1
gggaggtttactctt

SEQ ID NO: 49069 - DNA, 15 bp, Artificial Sequence
  dgRNA
  Smlr1
atgtcggaattgtca

SEQ ID NO: 49070 - DNA, 15 bp, Artificial Sequence
  dgRNA
  Smlr1
atggtcctggtaggc

SEQ ID NO: 49071 - DNA, 15 bp, Artificial Sequence
  dgRNA
  Wbscr27
acgcaatacgctcat

SEQ ID NO: 49072 - DNA, 15 bp, Artificial Sequence
  dgRNA
  Wbscr27
tacgctcattggctc

SEQ ID NO: 49073 - DNA, 15 bp, Artificial Sequence
  dgRNA
  Wbscr27
acgctcattggctca

SEQ ID NO: 49074 - DNA, 15 bp, Artificial Sequence
  dgRNA
  Wbscr27
atttctttctcggat

SEQ ID NO: 49075 - DNA, 15 bp, Artificial Sequence
  dgRNA
  Hbegf
aaatgtgagcgcctc

SEQ ID NO: 49076 - DNA, 15 bp, Artificial Sequence
  dgRNA
  Hbegf
aatgtgagcgcctcc

SEQ ID NO: 49077 - DNA, 15 bp, Artificial Sequence
  dgRNA
  Hbegf
cgcgaccgcctagtc

SEQ ID NO: 49078 - DNA, 15 bp, Artificial Sequence
  dgRNA
  Hbegf
gcgaccgcctagtcc

SEQ ID NO: 49079 - DNA, 15 bp, Artificial Sequence
  dgRNA
  Mesp2
acgggatagacatcc

SEQ ID NO: 49080 - DNA, 15 bp, Artificial Sequence
  dgRNA
  Mesp2
agcagccatctaccg

SEQ ID NO: 49081 - DNA, 15 bp, Artificial Sequence
  dgRNA
  Mesp2
catctaccgtggtgg

SEQ ID NO: 49082 - DNA, 15 bp, Artificial Sequence
  dgRNA
  Mesp2
atctaccgtggtggt

SEQ ID NO: 49083 - DNA, 15 bp, Artificial Sequence
  dgRNA
  Bod1
cccggaggtctgatt

SEQ ID NO: 49084 - DNA, 15 bp, Artificial Sequence
  dgRNA
  Bod1
ccggaggtctgattt

SEQ ID NO: 49085 - DNA, 15 bp, Artificial Sequence
  dgRNA
  Bod1
gagggctgccgtgac

SEQ ID NO: 49086 - DNA, 15 bp, Artificial Sequence
  dgRNA
  Bod1
agggctgccgtgact

SEQ ID NO: 49087 - DNA, 15 bp, Artificial Sequence
  dgRNA
  Coprs
gctcagtgcccaatc

SEQ ID NO: 49088 - DNA, 15 bp, Artificial Sequence
  dgRNA
  Coprs
gcccaatcaggccta

SEQ ID NO: 49089 - DNA, 15 bp, Artificial Sequence
  dgRNA
  Coprs
cgaaaccagcactag

SEQ ID NO: 49090 - DNA, 15 bp, Artificial Sequence
  dgRNA
  Coprs
cccgcacaacaacgc

SEQ ID NO: 49091 - DNA, 15 bp, Artificial Sequence
  dgRNA
  Ptx4
agcccactggattga

SEQ ID NO: 49092 - DNA, 15 bp, Artificial Sequence
  dgRNA
  Ptx4
tttcattaaggtggc

SEQ ID NO: 49093 - DNA, 15 bp, Artificial Sequence
  dgRNA
  Ptx4
ctagtggatgtgctc

SEQ ID NO: 49094 - DNA, 15 bp, Artificial Sequence
  dgRNA
  Ptx4
gggaaattgttctag

SEQ ID NO: 49095 - DNA, 15 bp, Artificial Sequence
  dgRNA
  Gng7
ctagtgaatggcccg

SEQ ID NO: 49096 - DNA, 15 bp, Artificial Sequence
  dgRNA
  Gng7
tggagacgccattcc

SEQ ID NO: 49097 - DNA, 15 bp, Artificial Sequence
  dgRNA
  Gng7
ggagacgccattcct

SEQ ID NO: 49098 - DNA, 15 bp, Artificial Sequence
  dgRNA
  Gng7
cgccattcctgggtt

SEQ ID NO: 49099 - DNA, 15 bp, Artificial Sequence
  dgRNA
  BC022687
ccgcagcaacataag

SEQ ID NO: 49100 - DNA, 15 bp, Artificial Sequence
  dgRNA
  BC022687
acataagtggtagtc

SEQ ID NO: 49101 - DNA, 15 bp, Artificial Sequence
  dgRNA
  BC022687
tagtcgggagaggat

SEQ ID NO: 49102 - DNA, 15 bp, Artificial Sequence
  dgRNA
  BC022687
tgggcggggcgctgt

SEQ ID NO: 49103 - DNA, 15 bp, Artificial Sequence
  dgRNA
  Pebp1
cgggaactgcgaaat

SEQ ID NO: 49104 - DNA, 15 bp, Artificial Sequence
  dgRNA
  Pebp1
gggaactgcgaaatg

SEQ ID NO: 49105 - DNA, 15 bp, Artificial Sequence
  dgRNA
  Pebp1
cagccatgcacgcac

SEQ ID NO: 49106 - DNA, 15 bp, Artificial Sequence
  dgRNA
  Pebp1
cacgcactggcctgc

SEQ ID NO: 49107 - DNA, 15 bp, Artificial Sequence
  dgRNA
  Bpifb4
ggcagatatatgaac

SEQ ID NO: 49108 - DNA, 15 bp, Artificial Sequence
  dgRNA
  Bpifb4
tttttattcactcgc

SEQ ID NO: 49109 - DNA, 15 bp, Artificial Sequence
  dgRNA
  Clec4e
gagtgagaattggcg

SEQ ID NO: 49110 - DNA, 15 bp, Artificial Sequence
  dgRNA
  Slc4a8
ttcctagcaagcagt

SEQ ID NO: 49111 - DNA, 15 bp, Artificial Sequence
  dgRNA
  Slc4a8
aaggacctcggagcc

SEQ ID NO: 49112 - DNA, 15 bp, Artificial Sequence
  dgRNA
  Slc4a8
gacctcggagcccgg

SEQ ID NO: 49113 - DNA, 15 bp, Artificial Sequence
  dgRNA
  Slc4a8
cccggaggcccccta

SEQ ID NO: 49114 - DNA, 15 bp, Artificial Sequence
  dgRNA
  Cygb
atccccacctcgtga

SEQ ID NO: 49115 - DNA, 15 bp, Artificial Sequence
  dgRNA
  Cygb
tccccacctcgtgaa

SEQ ID NO: 49116 - DNA, 15 bp, Artificial Sequence
  dgRNA
  Cygb
ctccgcaccagcccg

SEQ ID NO: 49117 - DNA, 15 bp, Artificial Sequence
  dgRNA
  Cygb
gcacgccagtacacc

SEQ ID NO: 49118 - DNA, 15 bp, Artificial Sequence
  dgRNA
  Scgb3a2
ctggggtaagtcaac

SEQ ID NO: 49119 - DNA, 15 bp, Artificial Sequence
  dgRNA
  Scgb3a2
atattagtacctctg

SEQ ID NO: 49120 - DNA, 15 bp, Artificial Sequence
  dgRNA
  Gspt1
aattctctccaaacg

SEQ ID NO: 49121 - DNA, 15 bp, Artificial Sequence
  dgRNA
  Gspt1
attctctccaaacgt

SEQ ID NO: 49122 - DNA, 15 bp, Artificial Sequence
  dgRNA
  Gspt1
ttctctccaaacgtg

SEQ ID NO: 49123 - DNA, 15 bp, Artificial Sequence
  dgRNA
  Gspt1
ctccaaacgtggggt

SEQ ID NO: 49124 - DNA, 15 bp, Artificial Sequence
  dgRNA
  Acsbg1
aagtcctaagcccat

SEQ ID NO: 49125 - DNA, 15 bp, Artificial Sequence
  dgRNA
  Acsbg1
gggcttaggacttct

SEQ ID NO: 49126 - DNA, 15 bp, Artificial Sequence
  dgRNA
  Acsbg1
ctagccaatgggctt

SEQ ID NO: 49127 - DNA, 15 bp, Artificial Sequence
  dgRNA
  Acsbg1
gaaggtctagccaat

SEQ ID NO: 49128 - DNA, 15 bp, Artificial Sequence
  dgRNA
  Snrnp35
gttccgacgacgtcg

SEQ ID NO: 49129 - DNA, 15 bp, Artificial Sequence
  dgRNA
  Snrnp35
tttaccctgcgattc

SEQ ID NO: 49130 - DNA, 15 bp, Artificial Sequence
  dgRNA
  Snrnp35
tcgccacgacgtcgt

SEQ ID NO: 49131 - DNA, 15 bp, Artificial Sequence
  dgRNA
  Mrpl43
gttctgtccgcaacg

SEQ ID NO: 49132 - DNA, 15 bp, Artificial Sequence
  dgRNA
  Mrpl43
ttctgtccgcaacgt

SEQ ID NO: 49133 - DNA, 15 bp, Artificial Sequence
  dgRNA
  Mrpl43
cgcacgcgctactcg

SEQ ID NO: 49134 - DNA, 15 bp, Artificial Sequence
  dgRNA
  Mrpl43
tactcgcggtgactc

SEQ ID NO: 49135 - DNA, 15 bp, Artificial Sequence
  dgRNA
  Mab21l2
aaagtataaataacg

SEQ ID NO: 49136 - DNA, 15 bp, Artificial Sequence
  dgRNA
  Mab21l2
tttgcacctagagaa

SEQ ID NO: 49137 - DNA, 15 bp, Artificial Sequence
  dgRNA
  Mab21l2
aacaacgcctccagt

SEQ ID NO: 49138 - DNA, 15 bp, Artificial Sequence
  dgRNA
  Mab21l2
cacgctgagaccgcg

SEQ ID NO: 49139 - DNA, 15 bp, Artificial Sequence
  dgRNA
  Dok7
ggcgcccaggacgcg

SEQ ID NO: 49140 - DNA, 15 bp, Artificial Sequence
  dgRNA
  Dok7
ccaggacgcgtggag

SEQ ID NO: 49141 - DNA, 15 bp, Artificial Sequence
  dgRNA
  Dok7
caggacgcgtggaga

SEQ ID NO: 49142 - DNA, 15 bp, Artificial Sequence
  dgRNA
  Dok7
agagggcgcagcggg

SEQ ID NO: 49143 - DNA, 15 bp, Artificial Sequence
  dgRNA
  Npffr1
gagtccggcggaccg

SEQ ID NO: 49144 - DNA, 15 bp, Artificial Sequence
  dgRNA
  Npffr1
ggcggaccgcggcgc

SEQ ID NO: 49145 - DNA, 15 bp, Artificial Sequence
  dgRNA
  Npffr1
gcggaccgcggcgct

SEQ ID NO: 49146 - DNA, 15 bp, Artificial Sequence
  dgRNA
  Npffr1
gaccgcggcgctggg

SEQ ID NO: 49147 - DNA, 15 bp, Artificial Sequence
  dgRNA
  Brpf3
ccgccgcgccgggct

SEQ ID NO: 49148 - DNA, 15 bp, Artificial Sequence
  dgRNA
  Brpf3
cgggggcatccgctc

SEQ ID NO: 49149 - DNA, 15 bp, Artificial Sequence
  dgRNA
  Brpf3
ctcccgcttcgcgtg

SEQ ID NO: 49150 - DNA, 15 bp, Artificial Sequence
  dgRNA
  Brpf3
ccgcttcgcgtgcgg

SEQ ID NO: 49151 - DNA, 15 bp, Artificial Sequence
  dgRNA
  Sctr
accatgtctcaatcg

SEQ ID NO: 49152 - DNA, 15 bp, Artificial Sequence
  dgRNA
  Sctr
aattttcctaaccct

SEQ ID NO: 49153 - DNA, 15 bp, Artificial Sequence
  dgRNA
  Sctr
caattttcctaaccc

SEQ ID NO: 49154 - DNA, 15 bp, Artificial Sequence
  dgRNA
  Sctr
tcctcgattgagaca

SEQ ID NO: 49155 - DNA, 15 bp, Artificial Sequence
  dgRNA
  Apobec3
gtcctaccctcaccg

SEQ ID NO: 49156 - DNA, 15 bp, Artificial Sequence
  dgRNA
  Apobec3
taccctcaccgcggt

SEQ ID NO: 49157 - DNA, 15 bp, Artificial Sequence
  dgRNA
  Apobec3
tctttgcgatccccg

SEQ ID NO: 49158 - DNA, 15 bp, Artificial Sequence
  dgRNA
  Apobec3
ctttgcgatccccgc

SEQ ID NO: 49159 - DNA, 15 bp, Artificial Sequence
  dgRNA
  Rrm2b
gaagcgggccagccg

SEQ ID NO: 49160 - DNA, 15 bp, Artificial Sequence
  dgRNA
  Rrm2b
cagagttcggcggcg

SEQ ID NO: 49161 - DNA, 15 bp, Artificial Sequence
  dgRNA
  Rrm2b
agagttcggcggcga

SEQ ID NO: 49162 - DNA, 15 bp, Artificial Sequence
  dgRNA
  Rrm2b
gagttcggcggcgag

SEQ ID NO: 49163 - DNA, 15 bp, Artificial Sequence
  dgRNA
  1700042G07Rik
agtctgagctatggt

SEQ ID NO: 49164 - DNA, 15 bp, Artificial Sequence
  dgRNA
  1700042G07Rik
atgaagcctgcctaa

SEQ ID NO: 49165 - DNA, 15 bp, Artificial Sequence
  dgRNA
  1700042G07Rik
tatgaagcctgccta

SEQ ID NO: 49166 - DNA, 15 bp, Artificial Sequence
  dgRNA
  Ears2
acccaccacgaccgc

SEQ ID NO: 49167 - DNA, 15 bp, Artificial Sequence
  dgRNA
  Ears2
cccaccacgaccgca

SEQ ID NO: 49168 - DNA, 15 bp, Artificial Sequence
  dgRNA
  Ears2
ccaccacgaccgcag

SEQ ID NO: 49169 - DNA, 15 bp, Artificial Sequence
  dgRNA
  Ears2
gaccgcaggggccgc

SEQ ID NO: 49170 - DNA, 15 bp, Artificial Sequence
  dgRNA
  Atp8b2
agatgagccagggcg

SEQ ID NO: 49171 - DNA, 15 bp, Artificial Sequence
  dgRNA
  Atp8b2
gagaagtgtgctacg

SEQ ID NO: 49172 - DNA, 15 bp, Artificial Sequence
  dgRNA
  Atp8b2
cactactcccgcatc

SEQ ID NO: 49173 - DNA, 15 bp, Artificial Sequence
  dgRNA
  Atp8b2
gctcctccccgaaga

SEQ ID NO: 49174 - DNA, 15 bp, Artificial Sequence
  dgRNA
  Dennd6a
ctcggtgcgcgtgcg

SEQ ID NO: 49175 - DNA, 15 bp, Artificial Sequence
  dgRNA
  Dennd6a
ggtgcgcgtgcgcgg

SEQ ID NO: 49176 - DNA, 15 bp, Artificial Sequence
  dgRNA
  Adam20
gagatattacaagta

SEQ ID NO: 49177 - DNA, 15 bp, Artificial Sequence
  dgRNA
  Adam20
gatattacaagtatg

SEQ ID NO: 49178 - DNA, 15 bp, Artificial Sequence
  dgRNA
  Bag3
tggcgcgaggcgcac

SEQ ID NO: 49179 - DNA, 15 bp, Artificial Sequence
  dgRNA
  Bag3
aggcgcacaggcccc

SEQ ID NO: 49180 - DNA, 15 bp, Artificial Sequence
  dgRNA
  Bag3
tagtctaggagaagg

SEQ ID NO: 49181 - DNA, 15 bp, Artificial Sequence
  dgRNA
  Bag3
ctccgatccctccca

SEQ ID NO: 49182 - DNA, 15 bp, Artificial Sequence
  dgRNA
  Zfp474
atctcgttctgcagg

SEQ ID NO: 49183 - DNA, 15 bp, Artificial Sequence
  dgRNA
  Zfp474
attatctcgttctgc

SEQ ID NO: 49184 - DNA, 15 bp, Artificial Sequence
  dgRNA
  Zfp474
aagttctgaacaccc

SEQ ID NO: 49185 - DNA, 15 bp, Artificial Sequence
  dgRNA
  Zfp474
aacccgtcaacagaa

SEQ ID NO: 49186 - DNA, 15 bp, Artificial Sequence
  dgRNA
  Emp1
ggctctgaaaaatct

SEQ ID NO: 49187 - DNA, 15 bp, Artificial Sequence
  dgRNA
  Emp1
ttgagtccatgctaa

SEQ ID NO: 49188 - DNA, 15 bp, Artificial Sequence
  dgRNA
  Emp1
tagtgtagtcaaacc

SEQ ID NO: 49189 - DNA, 15 bp, Artificial Sequence
  dgRNA
  Emp1
gtgtagtcaaaccag

SEQ ID NO: 49190 - DNA, 15 bp, Artificial Sequence
  dgRNA
  Erc1
ggcgtggtgacgtcg

SEQ ID NO: 49191 - DNA, 15 bp, Artificial Sequence
  dgRNA
  Erc1
gcgtggtgacgtcgc

SEQ ID NO: 49192 - DNA, 15 bp, Artificial Sequence
  dgRNA
  Erc1
tgacgtcgcgggcgc

SEQ ID NO: 49193 - DNA, 15 bp, Artificial Sequence
  dgRNA
  Erc1
gcgccggtcgtgctg

SEQ ID NO: 49194 - DNA, 15 bp, Artificial Sequence
  dgRNA
  Chil1
ccatgacccttcagc

SEQ ID NO: 49195 - DNA, 15 bp, Artificial Sequence
  dgRNA
  Chil1
gacccttcagctggc

SEQ ID NO: 49196 - DNA, 15 bp, Artificial Sequence
  dgRNA
  Chil1
gcaagacttgcccca

SEQ ID NO: 49197 - DNA, 15 bp, Artificial Sequence
  dgRNA
  Chil1
actccccgcctccac

SEQ ID NO: 49198 - DNA, 15 bp, Artificial Sequence
  dgRNA
  Zc2hc1b
tcaaggtctaggcaa

SEQ ID NO: 49199 - DNA, 15 bp, Artificial Sequence
  dgRNA
  Slc7a5
gtagtcctcagtttc

SEQ ID NO: 49200 - DNA, 15 bp, Artificial Sequence
  dgRNA
  Slc7a5
gtgctctaacagact

SEQ ID NO: 49201 - DNA, 15 bp, Artificial Sequence
  dgRNA
  Slc7a5
ggcgggggcccgcga

SEQ ID NO: 49202 - DNA, 15 bp, Artificial Sequence
  dgRNA
  Slc7a5
gggggcccgcgaagg

SEQ ID NO: 49203 - DNA, 15 bp, Artificial Sequence
  dgRNA
  Tlx1
gctccggcatctgtc

SEQ ID NO: 49204 - DNA, 15 bp, Artificial Sequence
  dgRNA
  Tlx1
ctccggcatctgtct

SEQ ID NO: 49205 - DNA, 15 bp, Artificial Sequence
  dgRNA
  Tlx1
tccacgcacagccaa

SEQ ID NO: 49206 - DNA, 15 bp, Artificial Sequence
  dgRNA
  Tlx1
ccggccgaaacagct

SEQ ID NO: 49207 - DNA, 15 bp, Artificial Sequence
  dgRNA
  Cdh3
ccggtggagggcacc

SEQ ID NO: 49208 - DNA, 15 bp, Artificial Sequence
  dgRNA
  Cdh3
cttcgagagtgcctt

SEQ ID NO: 49209 - DNA, 15 bp, Artificial Sequence
  dgRNA
  Cdh3
gagagtgccttcggc

SEQ ID NO: 49210 - DNA, 15 bp, Artificial Sequence
  dgRNA
  Cdh3
gtgccttcggcaggc

SEQ ID NO: 49211 - DNA, 15 bp, Artificial Sequence
  dgRNA
  Olfr345
aattgatgtactaag

SEQ ID NO: 49212 - DNA, 15 bp, Artificial Sequence
  dgRNA
  D630045J12Rik
gcggccggcgtgcag

SEQ ID NO: 49213 - DNA, 15 bp, Artificial Sequence
  dgRNA
  D630045J12Rik
agcggccccagtccg

SEQ ID NO: 49214 - DNA, 15 bp, Artificial Sequence
  dgRNA
  D630045J12Rik
cccagtccgcggatc

SEQ ID NO: 49215 - DNA, 15 bp, Artificial Sequence
  dgRNA
  D630045J12Rik
tccgcggatccggcc

SEQ ID NO: 49216 - DNA, 15 bp, Artificial Sequence
  dgRNA
  Btaf1
atctttatcgctctc

SEQ ID NO: 49217 - DNA, 15 bp, Artificial Sequence
  dgRNA
  Btaf1
ttaaagactgggagc

SEQ ID NO: 49218 - DNA, 15 bp, Artificial Sequence
  dgRNA
  Btaf1
ccgctcccactgccg

SEQ ID NO: 49219 - DNA, 15 bp, Artificial Sequence
  dgRNA
  Btaf1
cgctcccactgccgc

SEQ ID NO: 49220 - DNA, 15 bp, Artificial Sequence
  dgRNA
  Riiad1
accatatttctgaac

SEQ ID NO: 49221 - DNA, 15 bp, Artificial Sequence
  dgRNA
  Riiad1
gcatcagaggagttt

SEQ ID NO: 49222 - DNA, 15 bp, Artificial Sequence
  dgRNA
  Zfp52
cattgaccagagtcg

SEQ ID NO: 49223 - DNA, 15 bp, Artificial Sequence
  dgRNA
  Zfp52
ctaaagaccacaatc

SEQ ID NO: 49224 - DNA, 15 bp, Artificial Sequence
  dgRNA
  Zfp52
aaaaaacctcgactc

SEQ ID NO: 49225 - DNA, 15 bp, Artificial Sequence
  dgRNA
  Zfp52
gtctttagtaccaag

SEQ ID NO: 49226 - DNA, 15 bp, Artificial Sequence
  dgRNA
  Dennd1b
gcttcctataacagc

SEQ ID NO: 49227 - DNA, 15 bp, Artificial Sequence
  dgRNA
  Dennd1b
gagaccttcgtgtaa

SEQ ID NO: 49228 - DNA, 15 bp, Artificial Sequence
  dgRNA
  Dennd1b
cgtgtaatggctctg

SEQ ID NO: 49229 - DNA, 15 bp, Artificial Sequence
  dgRNA
  Dennd1b
caaaccagctgttat

SEQ ID NO: 49230 - DNA, 15 bp, Artificial Sequence
  dgRNA
  Opn1mw
ggatgatctaagtcc

SEQ ID NO: 49231 - DNA, 15 bp, Artificial Sequence
  dgRNA
  Opn1mw
gatgatctaagtcct

SEQ ID NO: 49232 - DNA, 15 bp, Artificial Sequence
  dgRNA
  Opn1mw
ggggcctttaaggta

SEQ ID NO: 49233 - DNA, 15 bp, Artificial Sequence
  dgRNA
  Opn1mw
gtcctgtaaccccat

SEQ ID NO: 49234 - DNA, 15 bp, Artificial Sequence
  dgRNA
  Clu
atcctgtgccagttc

SEQ ID NO: 49235 - DNA, 15 bp, Artificial Sequence
  dgRNA
  Clu
tagagccaccaattt

SEQ ID NO: 49236 - DNA, 15 bp, Artificial Sequence
  dgRNA
  Clu
agagccaccaattta

SEQ ID NO: 49237 - DNA, 15 bp, Artificial Sequence
  dgRNA
  Clu
ctacagcaaccaatg

SEQ ID NO: 49238 - DNA, 15 bp, Artificial Sequence
  dgRNA
  4930549C01Rik
agagaagcgttccat

SEQ ID NO: 49239 - DNA, 15 bp, Artificial Sequence
  dgRNA
  4930549C01Rik
agcgttccatgggag

SEQ ID NO: 49240 - DNA, 15 bp, Artificial Sequence
  dgRNA
  4930549C01Rik
cacagtgggccctta

SEQ ID NO: 49241 - DNA, 15 bp, Artificial Sequence
  dgRNA
  4930549C01Rik
gggcccttaaggcat

SEQ ID NO: 49242 - DNA, 15 bp, Artificial Sequence
  dgRNA
  Apobec2
cctgctgataaatag

SEQ ID NO: 49243 - DNA, 15 bp, Artificial Sequence
  dgRNA
  Apobec2
ctgctgataaatagg

SEQ ID NO: 49244 - DNA, 15 bp, Artificial Sequence
  dgRNA
  Apobec2
cccctatttatcagc

SEQ ID NO: 49245 - DNA, 15 bp, Artificial Sequence
  dgRNA
  Apobec2
aattggatgactgac

SEQ ID NO: 49246 - DNA, 15 bp, Artificial Sequence
  dgRNA
  Gm38100
gcattaagtgtttta

SEQ ID NO: 49247 - DNA, 15 bp, Artificial Sequence
  dgRNA
  Gm38100
ccttttagggaatcg

SEQ ID NO: 49248 - DNA, 15 bp, Artificial Sequence
  dgRNA
  Gm38100
cttttagggaatcga

SEQ ID NO: 49249 - DNA, 15 bp, Artificial Sequence
  dgRNA
  Gm38100
gaatcgagggcctga

SEQ ID NO: 49250 - DNA, 15 bp, Artificial Sequence
  dgRNA
  Ebna1bp2
cgccctcagatcctt

SEQ ID NO: 49251 - DNA, 15 bp, Artificial Sequence
  dgRNA
  Ebna1bp2
cttgcttcacggctc

SEQ ID NO: 49252 - DNA, 15 bp, Artificial Sequence
  dgRNA
  Ebna1bp2
ttgcttcacggctct

SEQ ID NO: 49253 - DNA, 15 bp, Artificial Sequence
  dgRNA
  Ebna1bp2
gttactagactacgt

SEQ ID NO: 49254 - DNA, 15 bp, Artificial Sequence
  dgRNA
  Apcdd1
aggacgagaggcacc

SEQ ID NO: 49255 - DNA, 15 bp, Artificial Sequence
  dgRNA
  Apcdd1
gcagaagggcgggct

SEQ ID NO: 49256 - DNA, 15 bp, Artificial Sequence
  dgRNA
  Apcdd1
cagaagggcgggcta

SEQ ID NO: 49257 - DNA, 15 bp, Artificial Sequence
  dgRNA
  Apcdd1
cgggctagggcagcg

SEQ ID NO: 49258 - DNA, 15 bp, Artificial Sequence
  dgRNA
  Asb1
cagccgctgcgatag

SEQ ID NO: 49259 - DNA, 15 bp, Artificial Sequence
  dgRNA
  Asb1
cggaccacagtccac

SEQ ID NO: 49260 - DNA, 15 bp, Artificial Sequence
  dgRNA
  Asb1
ggaccacagtccact

SEQ ID NO: 49261 - DNA, 15 bp, Artificial Sequence
  dgRNA
  Asb1
tccactgggccgtaa

SEQ ID NO: 49262 - DNA, 15 bp, Artificial Sequence
  dgRNA
  Toporsl
tagatttattagttg

SEQ ID NO: 49263 - DNA, 15 bp, Artificial Sequence
  dgRNA
  Toporsl
ttattagttgaggct

SEQ ID NO: 49264 - DNA, 15 bp, Artificial Sequence
  dgRNA
  Toporsl
cgcttcactcatgaa

SEQ ID NO: 49265 - DNA, 15 bp, Artificial Sequence
  dgRNA
  Toporsl
ttcactcatgaaagg

SEQ ID NO: 49266 - DNA, 15 bp, Artificial Sequence
  dgRNA
  Slco2b1
cttagccctaacgtc

SEQ ID NO: 49267 - DNA, 15 bp, Artificial Sequence
  dgRNA
  Slco2b1
gccctaacgtcaggc

SEQ ID NO: 49268 - DNA, 15 bp, Artificial Sequence
  dgRNA
  Slco2b1
cgttagggctaaggc

SEQ ID NO: 49269 - DNA, 15 bp, Artificial Sequence
  dgRNA
  Slco2b1
ctgacgttagggcta

SEQ ID NO: 49270 - DNA, 15 bp, Artificial Sequence
  dgRNA
  Evx2
actcggaaggatgta

SEQ ID NO: 49271 - DNA, 15 bp, Artificial Sequence
  dgRNA
  Evx2
ctcggaaggatgtat

SEQ ID NO: 49272 - DNA, 15 bp, Artificial Sequence
  dgRNA
  Evx2
gtcattccctcgctc

SEQ ID NO: 49273 - DNA, 15 bp, Artificial Sequence
  dgRNA
  Evx2
tttagagccgcttgc

SEQ ID NO: 49274 - DNA, 15 bp, Artificial Sequence
  dgRNA
  Helq
caaccagagcggcca

SEQ ID NO: 49275 - DNA, 15 bp, Artificial Sequence
  dgRNA
  Helq
cctaagcgccccgac

SEQ ID NO: 49276 - DNA, 15 bp, Artificial Sequence
  dgRNA
  Helq
ccgacaggtcctttc

SEQ ID NO: 49277 - DNA, 15 bp, Artificial Sequence
  dgRNA
  Helq
cgggattcgacgcaa

SEQ ID NO: 49278 - DNA, 15 bp, Artificial Sequence
  dgRNA
  Pcyt1a
ggaaactccgggtag

SEQ ID NO: 49279 - DNA, 15 bp, Artificial Sequence
  dgRNA
  Pcyt1a
gaaactccgggtagt

SEQ ID NO: 49280 - DNA, 15 bp, Artificial Sequence
  dgRNA
  Pcyt1a
agtgggtgctttgcg

SEQ ID NO: 49281 - DNA, 15 bp, Artificial Sequence
  dgRNA
  Pcyt1a
gctttgcgaggacaa

SEQ ID NO: 49282 - DNA, 15 bp, Artificial Sequence
  dgRNA
  Ppp1r18
gttctggagcgtatc

SEQ ID NO: 49283 - DNA, 15 bp, Artificial Sequence
  dgRNA
  Ppp1r18
ctggagcgtatccgg

SEQ ID NO: 49284 - DNA, 15 bp, Artificial Sequence
  dgRNA
  Ppp1r18
tggagcgtatccggt

SEQ ID NO: 49285 - DNA, 15 bp, Artificial Sequence
  dgRNA
  Ppp1r18
ggagcgtatccggtg

SEQ ID NO: 49286 - DNA, 15 bp, Artificial Sequence
  dgRNA
  Cradd
cgccatgtttgctgt

SEQ ID NO: 49287 - DNA, 15 bp, Artificial Sequence
  dgRNA
  Cradd
ccgccatgtttgctg

SEQ ID NO: 49288 - DNA, 15 bp, Artificial Sequence
  dgRNA
  Cradd
agggcgcaagacgtc

SEQ ID NO: 49289 - DNA, 15 bp, Artificial Sequence
  dgRNA
  Cradd
gttaaaggcaagagc

SEQ ID NO: 49290 - DNA, 15 bp, Artificial Sequence
  dgRNA
  Ube3b
accatgaaaagtcgg

SEQ ID NO: 49291 - DNA, 15 bp, Artificial Sequence
  dgRNA
  Ube3b
aaagtcggaggacgc

SEQ ID NO: 49292 - DNA, 15 bp, Artificial Sequence
  dgRNA
  Ube3b
cggagtctccaaatc

SEQ ID NO: 49293 - DNA, 15 bp, Artificial Sequence
  dgRNA
  Ube3b
caaatccggactgag

SEQ ID NO: 49294 - DNA, 15 bp, Artificial Sequence
  dgRNA
  2210011C24Rik
tcaacccgtgtgttc

SEQ ID NO: 49295 - DNA, 15 bp, Artificial Sequence
  dgRNA
  2210011C24Rik
acccgtgtgttcagg

SEQ ID NO: 49296 - DNA, 15 bp, Artificial Sequence
  dgRNA
  2210011C24Rik
cgtgtgttcaggtgg

SEQ ID NO: 49297 - DNA, 15 bp, Artificial Sequence
  dgRNA
  2210011C24Rik
gaatccggagagcag

SEQ ID NO: 49298 - DNA, 15 bp, Artificial Sequence
  dgRNA
  Klkb1
caaagggacccattt

SEQ ID NO: 49299 - DNA, 15 bp, Artificial Sequence
  dgRNA
  Klkb1
ttaagtagctgaacc

SEQ ID NO: 49300 - DNA, 15 bp, Artificial Sequence
  dgRNA
  Klkb1
tagctgaacctggac

SEQ ID NO: 49301 - DNA, 15 bp, Artificial Sequence
  dgRNA
  Klkb1
ggactgggatgtccg

SEQ ID NO: 49302 - DNA, 15 bp, Artificial Sequence
  dgRNA
  Tbc1d32
gctctgccggtacca

SEQ ID NO: 49303 - DNA, 15 bp, Artificial Sequence
  dgRNA
  Tbc1d32
tcagcaagttctcgg

SEQ ID NO: 49304 - DNA, 15 bp, Artificial Sequence
  dgRNA
  Tbc1d32
atcgccactcaaccg

SEQ ID NO: 49305 - DNA, 15 bp, Artificial Sequence
  dgRNA
  Tbc1d32
cttggactcgcgctg

SEQ ID NO: 49306 - DNA, 15 bp, Artificial Sequence
  dgRNA
  Serinc3
cgccccaagcgagcc

SEQ ID NO: 49307 - DNA, 15 bp, Artificial Sequence
  dgRNA
  Serinc3
cttctccccctccgt

SEQ ID NO: 49308 - DNA, 15 bp, Artificial Sequence
  dgRNA
  Serinc3
tccccctccgtgggc

SEQ ID NO: 49309 - DNA, 15 bp, Artificial Sequence
  dgRNA
  Serinc3
ccccctccgtgggcg

SEQ ID NO: 49310 - DNA, 15 bp, Artificial Sequence
  dgRNA
  Epha3
tcttccgcagctccg

SEQ ID NO: 49311 - DNA, 15 bp, Artificial Sequence
  dgRNA
  Epha3
cgcagctccgtggaa

SEQ ID NO: 49312 - DNA, 15 bp, Artificial Sequence
  dgRNA
  Epha3
tccgtggaacggagc

SEQ ID NO: 49313 - DNA, 15 bp, Artificial Sequence
  dgRNA
  Epha3
ttcttcagcgcccgc

SEQ ID NO: 49314 - DNA, 15 bp, Artificial Sequence
  dgRNA
  Klrg1
gtccgtgtgtatcta

SEQ ID NO: 49315 - DNA, 15 bp, Artificial Sequence
  dgRNA
  Klrg1
aaggagcaatctccg

SEQ ID NO: 49316 - DNA, 15 bp, Artificial Sequence
  dgRNA
  Klrg1
cgaggtgtgctgcag

SEQ ID NO: 49317 - DNA, 15 bp, Artificial Sequence
  dgRNA
  Klrg1
cttgcactactttac

SEQ ID NO: 49318 - DNA, 15 bp, Artificial Sequence
  dgRNA
  Draxin
gtctgccccgcgccc

SEQ ID NO: 49319 - DNA, 15 bp, Artificial Sequence
  dgRNA
  Draxin
tgccccgcgccctgg

SEQ ID NO: 49320 - DNA, 15 bp, Artificial Sequence
  dgRNA
  Draxin
cccgcgccctggcgg

SEQ ID NO: 49321 - DNA, 15 bp, Artificial Sequence
  dgRNA
  Draxin
ctggcggcggcgcca

SEQ ID NO: 49322 - DNA, 15 bp, Artificial Sequence
  dgRNA
  Lrrfip1
ctgcgtcccacctcg

SEQ ID NO: 49323 - DNA, 15 bp, Artificial Sequence
  dgRNA
  Lrrfip1
cccacctcgcggtct

SEQ ID NO: 49324 - DNA, 15 bp, Artificial Sequence
  dgRNA
  Lrrfip1
ccacctcgcggtctc

SEQ ID NO: 49325 - DNA, 15 bp, Artificial Sequence
  dgRNA
  Lrrfip1
cacctcgcggtctcg

SEQ ID NO: 49326 - DNA, 15 bp, Artificial Sequence
  dgRNA
  Vmn1r181
aatttatcttggtgc

SEQ ID NO: 49327 - DNA, 15 bp, Artificial Sequence
  dgRNA
  Vmn1r181
tctatatgatcaagt

SEQ ID NO: 49328 - DNA, 15 bp, Artificial Sequence
  dgRNA
  Zscan22
aacccaacccccggc

SEQ ID NO: 49329 - DNA, 15 bp, Artificial Sequence
  dgRNA
  Zscan22
ctgtactaggcactt

SEQ ID NO: 49330 - DNA, 15 bp, Artificial Sequence
  dgRNA
  Zscan22
tgtactaggcacttt

SEQ ID NO: 49331 - DNA, 15 bp, Artificial Sequence
  dgRNA
  Zscan22
ggtccctgggcacga

SEQ ID NO: 49332 - DNA, 15 bp, Artificial Sequence
  dgRNA
  Zic1
cgctttacaatacct

SEQ ID NO: 49333 - DNA, 15 bp, Artificial Sequence
  dgRNA
  Zic1
tacctgggattgatg

SEQ ID NO: 49334 - DNA, 15 bp, Artificial Sequence
  dgRNA
  Zic1
gattgatgaggcggg

SEQ ID NO: 49335 - DNA, 15 bp, Artificial Sequence
  dgRNA
  Zic1
attgatgaggcgggc

SEQ ID NO: 49336 - DNA, 15 bp, Artificial Sequence
  dgRNA
  Rapgef3
ccgggagggaaatcc

SEQ ID NO: 49337 - DNA, 15 bp, Artificial Sequence
  dgRNA
  Foxq1
aacaacctgcgcccg

SEQ ID NO: 49338 - DNA, 15 bp, Artificial Sequence
  dgRNA
  Foxq1
cccgcggagactctg

SEQ ID NO: 49339 - DNA, 15 bp, Artificial Sequence
  dgRNA
  Foxq1
gccgccgcgtggcct

SEQ ID NO: 49340 - DNA, 15 bp, Artificial Sequence
  dgRNA
  Foxq1
gcctgatgaacgcct

SEQ ID NO: 49341 - DNA, 15 bp, Artificial Sequence
  dgRNA
  Lmo7
gcaaggaccctggcg

SEQ ID NO: 49342 - DNA, 15 bp, Artificial Sequence
  dgRNA
  Lmo7
caaggaccctggcga

SEQ ID NO: 49343 - DNA, 15 bp, Artificial Sequence
  dgRNA
  Lmo7
aaggaccctggcgag

SEQ ID NO: 49344 - DNA, 15 bp, Artificial Sequence
  dgRNA
  Lmo7
gcaaggacggaagct

SEQ ID NO: 49345 - DNA, 15 bp, Artificial Sequence
  dgRNA
  Stoml1
tcaaccttagaacca

SEQ ID NO: 49346 - DNA, 15 bp, Artificial Sequence
  dgRNA
  Stoml1
tgtgctcccgccgtt

SEQ ID NO: 49347 - DNA, 15 bp, Artificial Sequence
  dgRNA
  Stoml1
cggtcctcccagcgc

SEQ ID NO: 49348 - DNA, 15 bp, Artificial Sequence
  dgRNA
  Stoml1
ggtcctcccagcgca

SEQ ID NO: 49349 - DNA, 15 bp, Artificial Sequence
  dgRNA
  Vmn2r53
ctgcacaagcgtttg

SEQ ID NO: 49350 - DNA, 15 bp, Artificial Sequence
  dgRNA
  Atp6v1c1
tgggcgggaattttc

SEQ ID NO: 49351 - DNA, 15 bp, Artificial Sequence
  dgRNA
  Atp6v1c1
gcgggaattttctgg

SEQ ID NO: 49352 - DNA, 15 bp, Artificial Sequence
  dgRNA
  Atp6v1c1
ctggccaaccaccgc

SEQ ID NO: 49353 - DNA, 15 bp, Artificial Sequence
  dgRNA
  Atp6v1c1
caccgcaggtgcatc

SEQ ID NO: 49354 - DNA, 15 bp, Artificial Sequence
  dgRNA
  Mrpl34
gtcatacgcacacgc

SEQ ID NO: 49355 - DNA, 15 bp, Artificial Sequence
  dgRNA
  Mrpl34
tcgttcgccctctcc

SEQ ID NO: 49356 - DNA, 15 bp, Artificial Sequence
  dgRNA
  Mrpl34
actatcgtcacctgc

SEQ ID NO: 49357 - DNA, 15 bp, Artificial Sequence
  dgRNA
  Mrpl34
actacagctcccgga

SEQ ID NO: 49358 - DNA, 15 bp, Artificial Sequence
  dgRNA
  Spdye4b
gaagtccgagttcca

SEQ ID NO: 49359 - DNA, 15 bp, Artificial Sequence
  dgRNA
  Spdye4b
cgcgccactgcatct

SEQ ID NO: 49360 - DNA, 15 bp, Artificial Sequence
  dgRNA
  Spdye4b
gcgccactgcatcta

SEQ ID NO: 49361 - DNA, 15 bp, Artificial Sequence
  dgRNA
  Spdye4b
ggaactcggacttcc

SEQ ID NO: 49362 - DNA, 15 bp, Artificial Sequence
  dgRNA
  Sh2b1
gctgggagcccgtcg

SEQ ID NO: 49363 - DNA, 15 bp, Artificial Sequence
  dgRNA
  Sh2b1
gggagcccgtcgcgg

SEQ ID NO: 49364 - DNA, 15 bp, Artificial Sequence
  dgRNA
  Sh2b1
agcccgtcgcggagg

SEQ ID NO: 49365 - DNA, 15 bp, Artificial Sequence
  dgRNA
  Sh2b1
gcccgtcgcggaggc

SEQ ID NO: 49366 - DNA, 15 bp, Artificial Sequence
  dgRNA
  Gbe1
gtcgacttttaaccg

SEQ ID NO: 49367 - DNA, 15 bp, Artificial Sequence
  dgRNA
  Gbe1
ttttaaccgtggtcc

SEQ ID NO: 49368 - DNA, 15 bp, Artificial Sequence
  dgRNA
  Gbe1
gaaaaccatcgccct

SEQ ID NO: 49369 - DNA, 15 bp, Artificial Sequence
  dgRNA
  Gbe1
gaccaccgggcagga

SEQ ID NO: 49370 - DNA, 15 bp, Artificial Sequence
  dgRNA
  Fam193b
ccgatcgcagccttt

SEQ ID NO: 49371 - DNA, 15 bp, Artificial Sequence
  dgRNA
  Fam193b
ttcggactagtgctt

SEQ ID NO: 49372 - DNA, 15 bp, Artificial Sequence
  dgRNA
  Fam193b
actagtgcttaggac

SEQ ID NO: 49373 - DNA, 15 bp, Artificial Sequence
  dgRNA
  Fam193b
ggacaggatctcgcc

SEQ ID NO: 49374 - DNA, 15 bp, Artificial Sequence
  dgRNA
  Efna2
acaagctcagcgctc

SEQ ID NO: 49375 - DNA, 15 bp, Artificial Sequence
  dgRNA
  Efna2
caagctcagcgctct

SEQ ID NO: 49376 - DNA, 15 bp, Artificial Sequence
  dgRNA
  Efna2
gtccccttcccgatg

SEQ ID NO: 49377 - DNA, 15 bp, Artificial Sequence
  dgRNA
  Efna2
tccccttcccgatgc

SEQ ID NO: 49378 - DNA, 15 bp, Artificial Sequence
  dgRNA
  Hacd3
tctctgaagcgccac

SEQ ID NO: 49379 - DNA, 15 bp, Artificial Sequence
  dgRNA
  Hacd3
cacaggaggtaagcg

SEQ ID NO: 49380 - DNA, 15 bp, Artificial Sequence
  dgRNA
  Hacd3
aagcctctgatccga

SEQ ID NO: 49381 - DNA, 15 bp, Artificial Sequence
  dgRNA
  Hacd3
gagccgctgatcacg

SEQ ID NO: 49382 - DNA, 15 bp, Artificial Sequence
  dgRNA
  Ccdc134
agatcatcagcgtgc

SEQ ID NO: 49383 - DNA, 15 bp, Artificial Sequence
  dgRNA
  Ccdc134
cagcgtgccgggcga

SEQ ID NO: 49384 - DNA, 15 bp, Artificial Sequence
  dgRNA
  Ccdc134
gcgacggcttctccc

SEQ ID NO: 49385 - DNA, 15 bp, Artificial Sequence
  dgRNA
  Ccdc134
cgcgccagagcacag

SEQ ID NO: 49386 - DNA, 15 bp, Artificial Sequence
  dgRNA
  Tbl3
cagcagccggtctcc

SEQ ID NO: 49387 - DNA, 15 bp, Artificial Sequence
  dgRNA
  Tbl3
cggcgcgcatgttga

SEQ ID NO: 49388 - DNA, 15 bp, Artificial Sequence
  dgRNA
  Tbl3
atgttgatggcgtca

SEQ ID NO: 49389 - DNA, 15 bp, Artificial Sequence
  dgRNA
  Tbl3
ggcgtcaaggagttg

SEQ ID NO: 49390 - DNA, 15 bp, Artificial Sequence
  dgRNA
  Creb3
tctgcgccccgccct

SEQ ID NO: 49391 - DNA, 15 bp, Artificial Sequence
  dgRNA
  Creb3
tctcccggtcgcttt

SEQ ID NO: 49392 - DNA, 15 bp, Artificial Sequence
  dgRNA
  Creb3
ctcccggtcgctttt

SEQ ID NO: 49393 - DNA, 15 bp, Artificial Sequence
  dgRNA
  Creb3
tcccggtcgcttttg

SEQ ID NO: 49394 - DNA, 15 bp, Artificial Sequence
  dgRNA
  Hexdc
tgtcacctctagcca

SEQ ID NO: 49395 - DNA, 15 bp, Artificial Sequence
  dgRNA
  Hexdc
cgtcccacccctgtt

SEQ ID NO: 49396 - DNA, 15 bp, Artificial Sequence
  dgRNA
  Hexdc
ttaggtcccacccct

SEQ ID NO: 49397 - DNA, 15 bp, Artificial Sequence
  dgRNA
  Hexdc
ctccgaccccgccct

SEQ ID NO: 49398 - DNA, 15 bp, Artificial Sequence
  dgRNA
  Ptch2
cgggaggcgaggcaa

SEQ ID NO: 49399 - DNA, 15 bp, Artificial Sequence
  dgRNA
  Ptch2
gccgttacctagcaa

SEQ ID NO: 49400 - DNA, 15 bp, Artificial Sequence
  dgRNA
  Ptch2
acctagcaacggatc

SEQ ID NO: 49401 - DNA, 15 bp, Artificial Sequence
  dgRNA
  Ptch2
acggatccggctgca

SEQ ID NO: 49402 - DNA, 15 bp, Artificial Sequence
  dgRNA
  Atf7
agaagtgaacacgcc

SEQ ID NO: 49403 - DNA, 15 bp, Artificial Sequence
  dgRNA
  Atf7
acacgcctggccgga

SEQ ID NO: 49404 - DNA, 15 bp, Artificial Sequence
  dgRNA
  Atf7
cacgcctggccggac

SEQ ID NO: 49405 - DNA, 15 bp, Artificial Sequence
  dgRNA
  Atf7
gcctggccggacggg

SEQ ID NO: 49406 - DNA, 15 bp, Artificial Sequence
  dgRNA
  Hiatl1
ctaaaacccacgaaa

SEQ ID NO: 49407 - DNA, 15 bp, Artificial Sequence
  dgRNA
  Hiatl1
taaaacccacgaaaa

SEQ ID NO: 49408 - DNA, 15 bp, Artificial Sequence
  dgRNA
  Hiatl1
aaaacccacgaaaag

SEQ ID NO: 49409 - DNA, 15 bp, Artificial Sequence
  dgRNA
  Hiatl1
gggatgacgtgcagt

SEQ ID NO: 49410 - DNA, 15 bp, Artificial Sequence
  dgRNA
  Prickle2
tagggattattgatt

SEQ ID NO: 49411 - DNA, 15 bp, Artificial Sequence
  dgRNA
  Prickle2
ttgatttggtaggcg

SEQ ID NO: 49412 - DNA, 15 bp, Artificial Sequence
  dgRNA
  Prickle2
ataaatctcaaccct

SEQ ID NO: 49413 - DNA, 15 bp, Artificial Sequence
  dgRNA
  Prickle2
cctgggcggccagac

SEQ ID NO: 49414 - DNA, 15 bp, Artificial Sequence
  dgRNA
  Stard6
ggtcaaagggcgttg

SEQ ID NO: 49415 - DNA, 15 bp, Artificial Sequence
  dgRNA
  Stard6
gtcaaagggcgttga

SEQ ID NO: 49416 - DNA, 15 bp, Artificial Sequence
  dgRNA
  Stard6
tcaaagggcgttgag

SEQ ID NO: 49417 - DNA, 15 bp, Artificial Sequence
  dgRNA
  Stard6
gcgttgaggggcgtt

SEQ ID NO: 49418 - DNA, 15 bp, Artificial Sequence
  dgRNA
  Mrrf
cttacacgttaacca

SEQ ID NO: 49419 - DNA, 15 bp, Artificial Sequence
  dgRNA
  Mrrf
ttacacgttaaccac

SEQ ID NO: 49420 - DNA, 15 bp, Artificial Sequence
  dgRNA
  Mrrf
tacacgttaaccacg

SEQ ID NO: 49421 - DNA, 15 bp, Artificial Sequence
  dgRNA
  Mrrf
tcaggccaacaacca

SEQ ID NO: 49422 - DNA, 15 bp, Artificial Sequence
  dgRNA
  Chd2
tctgatggagtggtc

SEQ ID NO: 49423 - DNA, 15 bp, Artificial Sequence
  dgRNA
  Chd2
gatggagtggtctgg

SEQ ID NO: 49424 - DNA, 15 bp, Artificial Sequence
  dgRNA
  Chd2
agaccactccatcag

SEQ ID NO: 49425 - DNA, 15 bp, Artificial Sequence
  dgRNA
  Chd2
tttaccccacaactc

SEQ ID NO: 49426 - DNA, 15 bp, Artificial Sequence
  dgRNA
  Ly6g6d
gaactactgctgcga

SEQ ID NO: 49427 - DNA, 15 bp, Artificial Sequence
  dgRNA
  Ly6g6d
aactactgctgcgaa

SEQ ID NO: 49428 - DNA, 15 bp, Artificial Sequence
  dgRNA
  Ly6g6d
actactgctgcgaag

SEQ ID NO: 49429 - DNA, 15 bp, Artificial Sequence
  dgRNA
  Ly6g6d
ctactgctgcgaagg

SEQ ID NO: 49430 - DNA, 15 bp, Artificial Sequence
  dgRNA
  Raf1
gcgtctggcccgctg

SEQ ID NO: 49431 - DNA, 15 bp, Artificial Sequence
  dgRNA
  Raf1
cgtctggcccgctga

SEQ ID NO: 49432 - DNA, 15 bp, Artificial Sequence
  dgRNA
  Raf1
ccgctgagggcctcg

SEQ ID NO: 49433 - DNA, 15 bp, Artificial Sequence
  dgRNA
  Raf1
cgctgagggcctcgc

SEQ ID NO: 49434 - DNA, 15 bp, Artificial Sequence
  dgRNA
  Recql
gggggctgatccgga

SEQ ID NO: 49435 - DNA, 15 bp, Artificial Sequence
  dgRNA
  Fam24a
gtacctctctgttgg

SEQ ID NO: 49436 - DNA, 15 bp, Artificial Sequence
  dgRNA
  Fam24a
gatgtacctctctgt

SEQ ID NO: 49437 - DNA, 15 bp, Artificial Sequence
  dgRNA
  Prom1
tgaatcatcctatct

SEQ ID NO: 49438 - DNA, 15 bp, Artificial Sequence
  dgRNA
  Prom1
ctgtagctccggagc

SEQ ID NO: 49439 - DNA, 15 bp, Artificial Sequence
  dgRNA
  Prom1
gggttccacctcgtt

SEQ ID NO: 49440 - DNA, 15 bp, Artificial Sequence
  dgRNA
  Prom1
ccggagctacaggta

SEQ ID NO: 49441 - DNA, 15 bp, Artificial Sequence
  dgRNA
  Tnik
cgcccttagccgatc

SEQ ID NO: 49442 - DNA, 15 bp, Artificial Sequence
  dgRNA
  Tnik
gcccttagccgatca

SEQ ID NO: 49443 - DNA, 15 bp, Artificial Sequence
  dgRNA
  Tnik
agcccacacgcaccg

SEQ ID NO: 49444 - DNA, 15 bp, Artificial Sequence
  dgRNA
  Tnik
cacgcaccgcggctc

SEQ ID NO: 49445 - DNA, 15 bp, Artificial Sequence
  dgRNA
  Eps15
ccatccaatgaaaac

SEQ ID NO: 49446 - DNA, 15 bp, Artificial Sequence
  dgRNA
  Eps15
atcaatggaacactc

SEQ ID NO: 49447 - DNA, 15 bp, Artificial Sequence
  dgRNA
  Hnrnph3
actccacgcccacca

SEQ ID NO: 49448 - DNA, 15 bp, Artificial Sequence
  dgRNA
  Hnrnph3
ccacgcccaccacgg

SEQ ID NO: 49449 - DNA, 15 bp, Artificial Sequence
  dgRNA
  Hnrnph3
caccacggtggcaac

SEQ ID NO: 49450 - DNA, 15 bp, Artificial Sequence
  dgRNA
  Hnrnph3
accacggtggcaacc

SEQ ID NO: 49451 - DNA, 15 bp, Artificial Sequence
  dgRNA
  Arl8b
attggcaccaaggcg

SEQ ID NO: 49452 - DNA, 15 bp, Artificial Sequence
  dgRNA
  Arl8b
ttggcaccaaggcga

SEQ ID NO: 49453 - DNA, 15 bp, Artificial Sequence
  dgRNA
  Arl8b
ggaagggtgtgtcgt

SEQ ID NO: 49454 - DNA, 15 bp, Artificial Sequence
  dgRNA
  Arl8b
gtgggattcaccatc

SEQ ID NO: 49455 - DNA, 15 bp, Artificial Sequence
  dgRNA
  Nde1
gagagcggcagccaa

SEQ ID NO: 49456 - DNA, 15 bp, Artificial Sequence
  dgRNA
  Nde1
agagcggcagccaat

SEQ ID NO: 49457 - DNA, 15 bp, Artificial Sequence
  dgRNA
  Nde1
cgcaccgcgcagtac

SEQ ID NO: 49458 - DNA, 15 bp, Artificial Sequence
  dgRNA
  Nde1
cagtaccggcgaggc

SEQ ID NO: 49459 - DNA, 15 bp, Artificial Sequence
  dgRNA
  Klrc1
cgtattcattgtcca

SEQ ID NO: 49460 - DNA, 15 bp, Artificial Sequence
  dgRNA
  Klrc1
gtattcattgtccaa

SEQ ID NO: 49461 - DNA, 15 bp, Artificial Sequence
  dgRNA
  Klrc1
ggcaacaacttaatg

SEQ ID NO: 49462 - DNA, 15 bp, Artificial Sequence
  dgRNA
  Klrc1
aggcaacaacttaat

SEQ ID NO: 49463 - DNA, 15 bp, Artificial Sequence
  dgRNA
  Trmt11
caagtggagtatccc

SEQ ID NO: 49464 - DNA, 15 bp, Artificial Sequence
  dgRNA
  Trmt11
aagtggagtatccct

SEQ ID NO: 49465 - DNA, 15 bp, Artificial Sequence
  dgRNA
  Trmt11
agtggagtatccctg

SEQ ID NO: 49466 - DNA, 15 bp, Artificial Sequence
  dgRNA
  Trmt11
ccctggggaactgcg

SEQ ID NO: 49467 - DNA, 15 bp, Artificial Sequence
  dgRNA
  Sra1
cctgcactgtaactt

SEQ ID NO: 49468 - DNA, 15 bp, Artificial Sequence
  dgRNA
  Sra1
tgtaacttaggcctg

SEQ ID NO: 49469 - DNA, 15 bp, Artificial Sequence
  dgRNA
  Sra1
ggctacagaacccta

SEQ ID NO: 49470 - DNA, 15 bp, Artificial Sequence
  dgRNA
  Sra1
gagtaggcaaggatc

SEQ ID NO: 49471 - DNA, 15 bp, Artificial Sequence
  dgRNA
  Stk11
cctgtgagtactgat

SEQ ID NO: 49472 - DNA, 15 bp, Artificial Sequence
  dgRNA
  Stk11
ctgtgagtactgata

SEQ ID NO: 49473 - DNA, 15 bp, Artificial Sequence
  dgRNA
  Stk11
atagggagcgcagaa

SEQ ID NO: 49474 - DNA, 15 bp, Artificial Sequence
  dgRNA
  Stk11
gcccagatgcaacgt

SEQ ID NO: 49475 - DNA, 15 bp, Artificial Sequence
  dgRNA
  2410004P03Rik
ccgctctcccgccca

SEQ ID NO: 49476 - DNA, 15 bp, Artificial Sequence
  dgRNA
  2410004P03Rik
cgctctcccgcccag

SEQ ID NO: 49477 - DNA, 15 bp, Artificial Sequence
  dgRNA
  2410004P03Rik
ctgcaccccaccgag

SEQ ID NO: 49478 - DNA, 15 bp, Artificial Sequence
  dgRNA
  2410004P03Rik
tggctccgaagtctt

SEQ ID NO: 49479 - DNA, 15 bp, Artificial Sequence
  dgRNA
  Acot4
tgctgaatccacgga

SEQ ID NO: 49480 - DNA, 15 bp, Artificial Sequence
  dgRNA
  Acot4
ttcacaacaccacgt

SEQ ID NO: 49481 - DNA, 15 bp, Artificial Sequence
  dgRNA
  Acot4
aacaccacgtgggag

SEQ ID NO: 49482 - DNA, 15 bp, Artificial Sequence
  dgRNA
  Acot4
ccgaagcatgacctt

SEQ ID NO: 49483 - DNA, 15 bp, Artificial Sequence
  dgRNA
  Tex19.2
aaggttgagctccag

SEQ ID NO: 49484 - DNA, 15 bp, Artificial Sequence
  dgRNA
  Tex19.2
cttgtatcttatgct

SEQ ID NO: 49485 - DNA, 15 bp, Artificial Sequence
  dgRNA
  Tex19.2
tgccgcagtccactc

SEQ ID NO: 49486 - DNA, 15 bp, Artificial Sequence
  dgRNA
  Tex19.2
atccttagaggagtc

SEQ ID NO: 49487 - DNA, 15 bp, Artificial Sequence
  dgRNA
  Pou2af1
ttagtcccaattggc

SEQ ID NO: 49488 - DNA, 15 bp, Artificial Sequence
  dgRNA
  Pou2af1
acacagtgggttgac

SEQ ID NO: 49489 - DNA, 15 bp, Artificial Sequence
  dgRNA
  Pou2af1
gaggatgtgatgacg

SEQ ID NO: 49490 - DNA, 15 bp, Artificial Sequence
  dgRNA
  Pou2af1
cgtggcccctctcag

SEQ ID NO: 49491 - DNA, 15 bp, Artificial Sequence
  dgRNA
  Ctbp2
gactggatcgggagc

SEQ ID NO: 49492 - DNA, 15 bp, Artificial Sequence
  dgRNA
  Ctbp2
tggatcgggagccgg

SEQ ID NO: 49493 - DNA, 15 bp, Artificial Sequence
  dgRNA
  Ctbp2
ggatcgggagccggt

SEQ ID NO: 49494 - DNA, 15 bp, Artificial Sequence
  dgRNA
  Ctbp2
tcgggagccggtggg

SEQ ID NO: 49495 - DNA, 15 bp, Artificial Sequence
  dgRNA
  Slc39a11
ctgttcctgcgagca

SEQ ID NO: 49496 - DNA, 15 bp, Artificial Sequence
  dgRNA
  Slc39a11
ccaggcaggattcgc

SEQ ID NO: 49497 - DNA, 15 bp, Artificial Sequence
  dgRNA
  Slc39a11
attcgccggttgcga

SEQ ID NO: 49498 - DNA, 15 bp, Artificial Sequence
  dgRNA
  Slc39a11
ttcgccggttgcgaa

SEQ ID NO: 49499 - DNA, 15 bp, Artificial Sequence
  dgRNA
  Tssk3
cagcctgttcctcgc

SEQ ID NO: 49500 - DNA, 15 bp, Artificial Sequence
  dgRNA
  Tssk3
ttccggcatttagtg

SEQ ID NO: 49501 - DNA, 15 bp, Artificial Sequence
  dgRNA
  Tssk3
tccggcatttagtga

SEQ ID NO: 49502 - DNA, 15 bp, Artificial Sequence
  dgRNA
  Tssk3
catttagtgagggcc

SEQ ID NO: 49503 - DNA, 15 bp, Artificial Sequence
  dgRNA
  Ccdc175
tcgtccttgtgattt

SEQ ID NO: 49504 - DNA, 15 bp, Artificial Sequence
  dgRNA
  Ccdc175
ggaggttccaacctc

SEQ ID NO: 49505 - DNA, 15 bp, Artificial Sequence
  dgRNA
  Ccdc175
ggttccaacctcagg

SEQ ID NO: 49506 - DNA, 15 bp, Artificial Sequence
  dgRNA
  Ccdc175
gttccaacctcaggt

SEQ ID NO: 49507 - DNA, 15 bp, Artificial Sequence
  dgRNA
  Vwa5b1
gtaagccagcaacac

SEQ ID NO: 49508 - DNA, 15 bp, Artificial Sequence
  dgRNA
  Vwa5b1
aagccagcaacaccg

SEQ ID NO: 49509 - DNA, 15 bp, Artificial Sequence
  dgRNA
  Vwa5b1
caacaccggggagcc

SEQ ID NO: 49510 - DNA, 15 bp, Artificial Sequence
  dgRNA
  Vwa5b1
cttaccccaagcacc

SEQ ID NO: 49511 - DNA, 15 bp, Artificial Sequence
  dgRNA
  Hist1h2ba
actgttttgagacgt

SEQ ID NO: 49512 - DNA, 15 bp, Artificial Sequence
  dgRNA
  Hist1h2ba
tttgagacgttggtg

SEQ ID NO: 49513 - DNA, 15 bp, Artificial Sequence
  dgRNA
  Hist1h2ba
ttgagacgttggtgt

SEQ ID NO: 49514 - DNA, 15 bp, Artificial Sequence
  dgRNA
  Hist1h2ba
acgttggtgtgggaa

SEQ ID NO: 49515 - DNA, 15 bp, Artificial Sequence
  dgRNA
  Nyx
tgtggtacggggagc

SEQ ID NO: 49516 - DNA, 15 bp, Artificial Sequence
  dgRNA
  Nyx
ccattaagttgtgag

SEQ ID NO: 49517 - DNA, 15 bp, Artificial Sequence
  dgRNA
  Nudt3
gacccgcacctacga

SEQ ID NO: 49518 - DNA, 15 bp, Artificial Sequence
  dgRNA
  Nudt3
cacctacgacggcga

SEQ ID NO: 49519 - DNA, 15 bp, Artificial Sequence
  dgRNA
  Nudt3
gacggctacaagaag

SEQ ID NO: 49520 - DNA, 15 bp, Artificial Sequence
  dgRNA
  Nudt3
acggctacaagaagc

SEQ ID NO: 49521 - DNA, 15 bp, Artificial Sequence
  dgRNA
  Igsf9
aactcccaggcggct

SEQ ID NO: 49522 - DNA, 15 bp, Artificial Sequence
  dgRNA
  Igsf9
actcccaggcggctc

SEQ ID NO: 49523 - DNA, 15 bp, Artificial Sequence
  dgRNA
  Igsf9
ctcccaggcggctcg

SEQ ID NO: 49524 - DNA, 15 bp, Artificial Sequence
  dgRNA
  Igsf9
tcccaggcggctcgg

SEQ ID NO: 49525 - DNA, 15 bp, Artificial Sequence
  dgRNA
  Cfd
tgcctaccttgagag

SEQ ID NO: 49526 - DNA, 15 bp, Artificial Sequence
  dgRNA
  Cfd
gcctaccttgagagt

SEQ ID NO: 49527 - DNA, 15 bp, Artificial Sequence
  dgRNA
  Cfd
gtcagggtgccatgc

SEQ ID NO: 49528 - DNA, 15 bp, Artificial Sequence
  dgRNA
  Cfd
ggttttctgcccacc

SEQ ID NO: 49529 - DNA, 15 bp, Artificial Sequence
  dgRNA
  Plcg1
aagacgtctgcgcag

SEQ ID NO: 49530 - DNA, 15 bp, Artificial Sequence
  dgRNA
  Plcg1
agacgtctgcgcaga

SEQ ID NO: 49531 - DNA, 15 bp, Artificial Sequence
  dgRNA
  Plcg1
gacgtctgcgcagag

SEQ ID NO: 49532 - DNA, 15 bp, Artificial Sequence
  dgRNA
  Plcg1
acgtctgcgcagagg

SEQ ID NO: 49533 - DNA, 15 bp, Artificial Sequence
  dgRNA
  Dclre1c
tgccggcctatgggt

SEQ ID NO: 49534 - DNA, 15 bp, Artificial Sequence
  dgRNA
  Dclre1c
cggcctatgggtagg

SEQ ID NO: 49535 - DNA, 15 bp, Artificial Sequence
  dgRNA
  Dclre1c
gggtaggcggtgcgc

SEQ ID NO: 49536 - DNA, 15 bp, Artificial Sequence
  dgRNA
  Dclre1c
gcaggttcccggaag

SEQ ID NO: 49537 - DNA, 15 bp, Artificial Sequence
  dgRNA
  AA986860
ggcgtggtagaaggc

SEQ ID NO: 49538 - DNA, 15 bp, Artificial Sequence
  dgRNA
  AA986860
ggtaggcgtggtaga

SEQ ID NO: 49539 - DNA, 15 bp, Artificial Sequence
  dgRNA
  Cldn19
cgaaaagagctctgc

SEQ ID NO: 49540 - DNA, 15 bp, Artificial Sequence
  dgRNA
  Cldn19
tctgtgggcgggttt

SEQ ID NO: 49541 - DNA, 15 bp, Artificial Sequence
  dgRNA
  Cldn19
ccgccccctgcattc

SEQ ID NO: 49542 - DNA, 15 bp, Artificial Sequence
  dgRNA
  Cldn19
ttagctccccttttc

SEQ ID NO: 49543 - DNA, 15 bp, Artificial Sequence
  dgRNA
  Afg3l2
ccgccactcctcctt

SEQ ID NO: 49544 - DNA, 15 bp, Artificial Sequence
  dgRNA
  Afg3l2
ctccggctctttaat

SEQ ID NO: 49545 - DNA, 15 bp, Artificial Sequence
  dgRNA
  Afg3l2
ggctctttaataggc

SEQ ID NO: 49546 - DNA, 15 bp, Artificial Sequence
  dgRNA
  Afg3l2
ccctctccggacccg

SEQ ID NO: 49547 - DNA, 15 bp, Artificial Sequence
  dgRNA
  Cass4
ccacttaccatgaag

SEQ ID NO: 49548 - DNA, 15 bp, Artificial Sequence
  dgRNA
  Cass4
ccacttcatggtaag

SEQ ID NO: 49549 - DNA, 15 bp, Artificial Sequence
  dgRNA
  Cass4
cggggccagagcttc

SEQ ID NO: 49550 - DNA, 15 bp, Artificial Sequence
  dgRNA
  Zgrf1
tctctcagcccgcta

SEQ ID NO: 49551 - DNA, 15 bp, Artificial Sequence
  dgRNA
  Zgrf1
cccgctacggaaaga

SEQ ID NO: 49552 - DNA, 15 bp, Artificial Sequence
  dgRNA
  Zgrf1
ccgctacggaaagac

SEQ ID NO: 49553 - DNA, 15 bp, Artificial Sequence
  dgRNA
  Zgrf1
acgggtccgaggccc

SEQ ID NO: 49554 - DNA, 15 bp, Artificial Sequence
  dgRNA
  Stim2
ccacgccccgcctat

SEQ ID NO: 49555 - DNA, 15 bp, Artificial Sequence
  dgRNA
  Stim2
ccccgcctatcggtc

SEQ ID NO: 49556 - DNA, 15 bp, Artificial Sequence
  dgRNA
  Stim2
cccgcctatcggtct

SEQ ID NO: 49557 - DNA, 15 bp, Artificial Sequence
  dgRNA
  Stim2
tctgggaacgcccct

SEQ ID NO: 49558 - DNA, 15 bp, Artificial Sequence
  dgRNA
  Pax3
caaactcgtccgccc

SEQ ID NO: 49559 - DNA, 15 bp, Artificial Sequence
  dgRNA
  Pax3
aaactcgtccgccct

SEQ ID NO: 49560 - DNA, 15 bp, Artificial Sequence
  dgRNA
  Pax3
cgtccgccctgggct

SEQ ID NO: 49561 - DNA, 15 bp, Artificial Sequence
  dgRNA
  Pax3
gtccgccctgggctt

SEQ ID NO: 49562 - DNA, 15 bp, Artificial Sequence
  dgRNA
  C87977
gtgagtaagggcata

SEQ ID NO: 49563 - DNA, 15 bp, Artificial Sequence
  dgRNA
  C87977
atcaattcatgacta

SEQ ID NO: 49564 - DNA, 15 bp, Artificial Sequence
  dgRNA
  C87977
tcatgactatgggtc

SEQ ID NO: 49565 - DNA, 15 bp, Artificial Sequence
  dgRNA
  Gnpda2
cttaacgaaagagag

SEQ ID NO: 49566 - DNA, 15 bp, Artificial Sequence
  dgRNA
  Gnpda2
agcacatcccttagg

SEQ ID NO: 49567 - DNA, 15 bp, Artificial Sequence
  dgRNA
  Gnpda2
tcagaagctgaattg

SEQ ID NO: 49568 - DNA, 15 bp, Artificial Sequence
  dgRNA
  Gnpda2
cagtctacagtcctt

SEQ ID NO: 49569 - DNA, 15 bp, Artificial Sequence
  dgRNA
  Cmah
ccggtaacccgtttc

SEQ ID NO: 49570 - DNA, 15 bp, Artificial Sequence
  dgRNA
  Cmah
tcacttgggacccgg

SEQ ID NO: 49571 - DNA, 15 bp, Artificial Sequence
  dgRNA
  Cmah
ctgaaacgggttacc

SEQ ID NO: 49572 - DNA, 15 bp, Artificial Sequence
  dgRNA
  Epn1
cctcgcgggaccctc

SEQ ID NO: 49573 - DNA, 15 bp, Artificial Sequence
  dgRNA
  Epn1
tgtggctaccctcgc

SEQ ID NO: 49574 - DNA, 15 bp, Artificial Sequence
  dgRNA
  Tgoln1
aagcagcatcggcaa

SEQ ID NO: 49575 - DNA, 15 bp, Artificial Sequence
  dgRNA
  Tgoln1
gcatcggcaacggag

SEQ ID NO: 49576 - DNA, 15 bp, Artificial Sequence
  dgRNA
  Tgoln1
cggcaacggagaggt

SEQ ID NO: 49577 - DNA, 15 bp, Artificial Sequence
  dgRNA
  Tgoln1
tggaaacacgagcag

SEQ ID NO: 49578 - DNA, 15 bp, Artificial Sequence
  dgRNA
  Gtsf1
catgtaggacccttt

SEQ ID NO: 49579 - DNA, 15 bp, Artificial Sequence
  dgRNA
  Gtsf1
ggaccctttaggcca

SEQ ID NO: 49580 - DNA, 15 bp, Artificial Sequence
  dgRNA
  Gtsf1
gaccctttaggccag

SEQ ID NO: 49581 - DNA, 15 bp, Artificial Sequence
  dgRNA
  Gtsf1
cccaagaagccgcct

SEQ ID NO: 49582 - DNA, 15 bp, Artificial Sequence
  dgRNA
  Lmo2
ccctatcctctatca

SEQ ID NO: 49583 - DNA, 15 bp, Artificial Sequence
  dgRNA
  Lmo2
ctatcagaagccccg

SEQ ID NO: 49584 - DNA, 15 bp, Artificial Sequence
  dgRNA
  Lmo2
tatcagaagccccga

SEQ ID NO: 49585 - DNA, 15 bp, Artificial Sequence
  dgRNA
  Lmo2
gccgggctttggcat

SEQ ID NO: 49586 - DNA, 15 bp, Artificial Sequence
  dgRNA
  Pbx1
cacagatttaagcgc

SEQ ID NO: 49587 - DNA, 15 bp, Artificial Sequence
  dgRNA
  Pbx1
acagatttaagcgcc

SEQ ID NO: 49588 - DNA, 15 bp, Artificial Sequence
  dgRNA
  Pbx1
tttcttttcgccaag

SEQ ID NO: 49589 - DNA, 15 bp, Artificial Sequence
  dgRNA
  Pbx1
ttcttttcgccaagt

SEQ ID NO: 49590 - DNA, 15 bp, Artificial Sequence
  dgRNA
  Metap1
cgccaccgcaagcct

SEQ ID NO: 49591 - DNA, 15 bp, Artificial Sequence
  dgRNA
  Metap1
gccaccgcaagcctt

SEQ ID NO: 49592 - DNA, 15 bp, Artificial Sequence
  dgRNA
  Metap1
ccaccgcaagccttg

SEQ ID NO: 49593 - DNA, 15 bp, Artificial Sequence
  dgRNA
  Metap1
ccgcaagccttgggg

SEQ ID NO: 49594 - DNA, 15 bp, Artificial Sequence
  dgRNA
  Fam162b
gcctcaaggattggt

SEQ ID NO: 49595 - DNA, 15 bp, Artificial Sequence
  dgRNA
  Fam162b
gcccgaaaatttccc

SEQ ID NO: 49596 - DNA, 15 bp, Artificial Sequence
  dgRNA
  Fam162b
cccgaaaatttccct

SEQ ID NO: 49597 - DNA, 15 bp, Artificial Sequence
  dgRNA
  Fam162b
ctaggaggtctgtcc

SEQ ID NO: 49598 - DNA, 15 bp, Artificial Sequence
  dgRNA
  Anks3
tccccgtgctgagta

SEQ ID NO: 49599 - DNA, 15 bp, Artificial Sequence
  dgRNA
  Anks3
gagtacggccaccca

SEQ ID NO: 49600 - DNA, 15 bp, Artificial Sequence
  dgRNA
  Anks3
tacggccacccacgg

SEQ ID NO: 49601 - DNA, 15 bp, Artificial Sequence
  dgRNA
  Anks3
ccacccacggcggcc

SEQ ID NO: 49602 - DNA, 15 bp, Artificial Sequence
  dgRNA
  Atxn7l1
gcagaatacccaatc

SEQ ID NO: 49603 - DNA, 15 bp, Artificial Sequence
  dgRNA
  Atxn7l1
gctctgttttgcggc

SEQ ID NO: 49604 - DNA, 15 bp, Artificial Sequence
  dgRNA
  Atxn7l1
ctctgttttgcggct

SEQ ID NO: 49605 - DNA, 15 bp, Artificial Sequence
  dgRNA
  Atxn7l1
gagtgtgcgacccga

SEQ ID NO: 49606 - DNA, 15 bp, Artificial Sequence
  dgRNA
  Fam159a
ttctcaagatctgcg

SEQ ID NO: 49607 - DNA, 15 bp, Artificial Sequence
  dgRNA
  Fam159a
gatctgcggggtctc

SEQ ID NO: 49608 - DNA, 15 bp, Artificial Sequence
  dgRNA
  Fam159a
tcgctcacccgctgt

SEQ ID NO: 49609 - DNA, 15 bp, Artificial Sequence
  dgRNA
  Fam159a
tcggtccgtccgtcc

SEQ ID NO: 49610 - DNA, 15 bp, Artificial Sequence
  dgRNA
  Tfe3
ttcactttttaggcg

SEQ ID NO: 49611 - DNA, 15 bp, Artificial Sequence
  dgRNA
  Tfe3
tcactttttaggcgt

SEQ ID NO: 49612 - DNA, 15 bp, Artificial Sequence
  dgRNA
  Tfe3
cactttttaggcgtg

SEQ ID NO: 49613 - DNA, 15 bp, Artificial Sequence
  dgRNA
  Tfe3
actttttaggcgtgg

SEQ ID NO: 49614 - DNA, 15 bp, Artificial Sequence
  dgRNA
  Ldlrad3
gcaatttgacccctg

SEQ ID NO: 49615 - DNA, 15 bp, Artificial Sequence
  dgRNA
  Ldlrad3
aaaaactggatccgc

SEQ ID NO: 49616 - DNA, 15 bp, Artificial Sequence
  dgRNA
  Ldlrad3
cggacctttgtaacc

SEQ ID NO: 49617 - DNA, 15 bp, Artificial Sequence
  dgRNA
  Ldlrad3
ttgtaacctggaccg

SEQ ID NO: 49618 - DNA, 15 bp, Artificial Sequence
  dgRNA
  Srsf1
cacactgctccgctt

SEQ ID NO: 49619 - DNA, 15 bp, Artificial Sequence
  dgRNA
  Srsf1
acctgcaactcccgc

SEQ ID NO: 49620 - DNA, 15 bp, Artificial Sequence
  dgRNA
  Srsf1
tgcaactcccgccgg

SEQ ID NO: 49621 - DNA, 15 bp, Artificial Sequence
  dgRNA
  Srsf1
tctatctccgccccg

SEQ ID NO: 49622 - DNA, 15 bp, Artificial Sequence
  dgRNA
  Slc30a9
cttcccacgccccgg

SEQ ID NO: 49623 - DNA, 15 bp, Artificial Sequence
  dgRNA
  Slc30a9
cgtaagactgtctcc

SEQ ID NO: 49624 - DNA, 15 bp, Artificial Sequence
  dgRNA
  Slc30a9
tcccgggacacgaca

SEQ ID NO: 49625 - DNA, 15 bp, Artificial Sequence
  dgRNA
  Slc30a9
cacaccgtcctggcc

SEQ ID NO: 49626 - DNA, 15 bp, Artificial Sequence
  dgRNA
  Cdc42se1
ccaggggacccggag

SEQ ID NO: 49627 - DNA, 15 bp, Artificial Sequence
  dgRNA
  Cdc42se1
agcccccgcccgcag

SEQ ID NO: 49628 - DNA, 15 bp, Artificial Sequence
  dgRNA
  Cdc42se1
gcccccgcccgcagt

SEQ ID NO: 49629 - DNA, 15 bp, Artificial Sequence
  dgRNA
  Cdc42se1
cccccgcccgcagtg

SEQ ID NO: 49630 - DNA, 15 bp, Artificial Sequence
  dgRNA
  Sh3bp5l
ggttggcgggtgaac

SEQ ID NO: 49631 - DNA, 15 bp, Artificial Sequence
  dgRNA
  Sh3bp5l
gttggcgggtgaact

SEQ ID NO: 49632 - DNA, 15 bp, Artificial Sequence
  dgRNA
  Sh3bp5l
taggaaaggcgacgt

SEQ ID NO: 49633 - DNA, 15 bp, Artificial Sequence
  dgRNA
  Sh3bp5l
tagcgccatcttgta

SEQ ID NO: 49634 - DNA, 15 bp, Artificial Sequence
  dgRNA
  Fyb
cttgttttgccatag

SEQ ID NO: 49635 - DNA, 15 bp, Artificial Sequence
  dgRNA
  Fyb
caatcagcagcttgc

SEQ ID NO: 49636 - DNA, 15 bp, Artificial Sequence
  dgRNA
  Fyb
gttgttggtcgtaca

SEQ ID NO: 49637 - DNA, 15 bp, Artificial Sequence
  dgRNA
  Fyb
tgttgttggtcgtac

SEQ ID NO: 49638 - DNA, 15 bp, Artificial Sequence
  dgRNA
  Pus7
tattacctaaccacc

SEQ ID NO: 49639 - DNA, 15 bp, Artificial Sequence
  dgRNA
  Pus7
attacctaaccacct

SEQ ID NO: 49640 - DNA, 15 bp, Artificial Sequence
  dgRNA
  Pus7
gggttctgccctaga

SEQ ID NO: 49641 - DNA, 15 bp, Artificial Sequence
  dgRNA
  Pus7
gaacccaggtggtta

SEQ ID NO: 49642 - DNA, 15 bp, Artificial Sequence
  dgRNA
  Zfp408
cgcttttccagatgc

SEQ ID NO: 49643 - DNA, 15 bp, Artificial Sequence
  dgRNA
  Zfp408
gttcgtatcgcccat

SEQ ID NO: 49644 - DNA, 15 bp, Artificial Sequence
  dgRNA
  Zfp408
tatcgcccatcggac

SEQ ID NO: 49645 - DNA, 15 bp, Artificial Sequence
  dgRNA
  Zfp408
atcgcccatcggaca

SEQ ID NO: 49646 - DNA, 15 bp, Artificial Sequence
  dgRNA
  Olfr31
accattttacttaga

SEQ ID NO: 49647 - DNA, 15 bp, Artificial Sequence
  dgRNA
  Mtfr1l
agcccgcgtccattc

SEQ ID NO: 49648 - DNA, 15 bp, Artificial Sequence
  dgRNA
  Mtfr1l
gcccgcgtccattcc

SEQ ID NO: 49649 - DNA, 15 bp, Artificial Sequence
  dgRNA
  Mtfr1l
tccgggcccctctct

SEQ ID NO: 49650 - DNA, 15 bp, Artificial Sequence
  dgRNA
  Mtfr1l
taggcccgcctctcc

SEQ ID NO: 49651 - DNA, 15 bp, Artificial Sequence
  dgRNA
  Car10
ttttgcctccgcccc

SEQ ID NO: 49652 - DNA, 15 bp, Artificial Sequence
  dgRNA
  Car10
tttgcctccgccccc

SEQ ID NO: 49653 - DNA, 15 bp, Artificial Sequence
  dgRNA
  Car10
gccgccccgctgacg

SEQ ID NO: 49654 - DNA, 15 bp, Artificial Sequence
  dgRNA
  Car10
ccgccccgctgacgt

SEQ ID NO: 49655 - DNA, 15 bp, Artificial Sequence
  dgRNA
  Pycard
gctaagttgttactc

SEQ ID NO: 49656 - DNA, 15 bp, Artificial Sequence
  dgRNA
  Pycard
gctgaagaaactagg

SEQ ID NO: 49657 - DNA, 15 bp, Artificial Sequence
  dgRNA
  Tuba3b
caggatgtacataac

SEQ ID NO: 49658 - DNA, 15 bp, Artificial Sequence
  dgRNA
  Tuba3b
agaaactcgtgtctt

SEQ ID NO: 49659 - DNA, 15 bp, Artificial Sequence
  dgRNA
  Tuba3b
cgtgtctttggaaga

SEQ ID NO: 49660 - DNA, 15 bp, Artificial Sequence
  dgRNA
  Tuba3b
gcaccaggtaatacg

SEQ ID NO: 49661 - DNA, 15 bp, Artificial Sequence
  dgRNA
  Med23
agatccgaatcacaa

SEQ ID NO: 49662 - DNA, 15 bp, Artificial Sequence
  dgRNA
  Fhl1
tgcccgtggtgcgag

SEQ ID NO: 49663 - DNA, 15 bp, Artificial Sequence
  dgRNA
  Fhl1
ctgcccgtggtgcga

SEQ ID NO: 49664 - DNA, 15 bp, Artificial Sequence
  dgRNA
  Fhl1
tctgcccgtggtgcg

SEQ ID NO: 49665 - DNA, 15 bp, Artificial Sequence
  dgRNA
  Fhl1
agcgcgcgtccgcct

SEQ ID NO: 49666 - DNA, 15 bp, Artificial Sequence
  dgRNA
  Helt
aggggcgaagcgagg

SEQ ID NO: 49667 - DNA, 15 bp, Artificial Sequence
  dgRNA
  Helt
acctgccgggatgtc

SEQ ID NO: 49668 - DNA, 15 bp, Artificial Sequence
  dgRNA
  Helt
tccggacaaataaag

SEQ ID NO: 49669 - DNA, 15 bp, Artificial Sequence
  dgRNA
  Helt
cggtgtaaacaaaaa

SEQ ID NO: 49670 - DNA, 15 bp, Artificial Sequence
  dgRNA
  Uimc1
cagagcttatttcga

SEQ ID NO: 49671 - DNA, 15 bp, Artificial Sequence
  dgRNA
  Uimc1
agagcttatttcgaa

SEQ ID NO: 49672 - DNA, 15 bp, Artificial Sequence
  dgRNA
  Uimc1
tttcgaagggtgtct

SEQ ID NO: 49673 - DNA, 15 bp, Artificial Sequence
  dgRNA
  Uimc1
ttcgaagggtgtcta

SEQ ID NO: 49674 - DNA, 15 bp, Artificial Sequence
  dgRNA
  Epm2a
ctctgggaagacgac

SEQ ID NO: 49675 - DNA, 15 bp, Artificial Sequence
  dgRNA
  Epm2a
acgacaggacaatgt

SEQ ID NO: 49676 - DNA, 15 bp, Artificial Sequence
  dgRNA
  Epm2a
cgacaggacaatgtc

SEQ ID NO: 49677 - DNA, 15 bp, Artificial Sequence
  dgRNA
  Epm2a
gacaggacaatgtcg

SEQ ID NO: 49678 - DNA, 15 bp, Artificial Sequence
  dgRNA
  Slc35a4
gcccaacgcgacctc

SEQ ID NO: 49679 - DNA, 15 bp, Artificial Sequence
  dgRNA
  Slc35a4
gacctccggagctgc

SEQ ID NO: 49680 - DNA, 15 bp, Artificial Sequence
  dgRNA
  Slc35a4
acctccggagctgca

SEQ ID NO: 49681 - DNA, 15 bp, Artificial Sequence
  dgRNA
  Slc35a4
tgcgccggagaccgc

SEQ ID NO: 49682 - DNA, 15 bp, Artificial Sequence
  dgRNA
  Slc23a3
taggttaatggctga

SEQ ID NO: 49683 - DNA, 15 bp, Artificial Sequence
  dgRNA
  Slc23a3
actccccacccacgt

SEQ ID NO: 49684 - DNA, 15 bp, Artificial Sequence
  dgRNA
  Slc23a3
ggggtgtcaatgaag

SEQ ID NO: 49685 - DNA, 15 bp, Artificial Sequence
  dgRNA
  Slc23a3
gctgcctacgtgggt

SEQ ID NO: 49686 - DNA, 15 bp, Artificial Sequence
  dgRNA
  Usp48
gtggcgagtcgcctt

SEQ ID NO: 49687 - DNA, 15 bp, Artificial Sequence
  dgRNA
  Usp48
tggcgagtcgccttt

SEQ ID NO: 49688 - DNA, 15 bp, Artificial Sequence
  dgRNA
  Usp48
ctttgggcagacgct

SEQ ID NO: 49689 - DNA, 15 bp, Artificial Sequence
  dgRNA
  Usp48
ctttcttccgccagt

SEQ ID NO: 49690 - DNA, 15 bp, Artificial Sequence
  dgRNA
  Efcab9
atgccataagaagtc

SEQ ID NO: 49691 - DNA, 15 bp, Artificial Sequence
  dgRNA
  Efcab9
tgccaggtcatcttg

SEQ ID NO: 49692 - DNA, 15 bp, Artificial Sequence
  dgRNA
  Efcab9
ctagaatgttggaca

SEQ ID NO: 49693 - DNA, 15 bp, Artificial Sequence
  dgRNA
  Efcab9
actagaatgttggac

SEQ ID NO: 49694 - DNA, 15 bp, Artificial Sequence
  dgRNA
  Sectm1a
taggggctgctcttt

SEQ ID NO: 49695 - DNA, 15 bp, Artificial Sequence
  dgRNA
  Sectm1a
tgattcagggtttag

SEQ ID NO: 49696 - DNA, 15 bp, Artificial Sequence
  dgRNA
  Sectm1a
taggaaatccctggc

SEQ ID NO: 49697 - DNA, 15 bp, Artificial Sequence
  dgRNA
  Sectm1a
gcgtctcaggaaccc

SEQ ID NO: 49698 - DNA, 15 bp, Artificial Sequence
  dgRNA
  Zfp322a
acggtttcaattcag

SEQ ID NO: 49699 - DNA, 15 bp, Artificial Sequence
  dgRNA
  Zfp322a
cggtttcaattcagt

SEQ ID NO: 49700 - DNA, 15 bp, Artificial Sequence
  dgRNA
  Zfp322a
gcagtcccaaattcc

SEQ ID NO: 49701 - DNA, 15 bp, Artificial Sequence
  dgRNA
  Zfp322a
ggacgcgaaagagcc

SEQ ID NO: 49702 - DNA, 15 bp, Artificial Sequence
  dgRNA
  Zfp42
cgccgacccaagaca

SEQ ID NO: 49703 - DNA, 15 bp, Artificial Sequence
  dgRNA
  Zfp42
gccgacccaagacaa

SEQ ID NO: 49704 - DNA, 15 bp, Artificial Sequence
  dgRNA
  Zfp42
ccgacccaagacaag

SEQ ID NO: 49705 - DNA, 15 bp, Artificial Sequence
  dgRNA
  Zfp42
caaggggacagctct

SEQ ID NO: 49706 - DNA, 15 bp, Artificial Sequence
  dgRNA
  Zbtb25
ggcacgcacactagc

SEQ ID NO: 49707 - DNA, 15 bp, Artificial Sequence
  dgRNA
  Zbtb25
gcacgcacactagcc

SEQ ID NO: 49708 - DNA, 15 bp, Artificial Sequence
  dgRNA
  Zbtb25
cacgcacactagccg

SEQ ID NO: 49709 - DNA, 15 bp, Artificial Sequence
  dgRNA
  Zbtb25
gtgccgctcgcttcc

SEQ ID NO: 49710 - DNA, 15 bp, Artificial Sequence
  dgRNA
  Bend3
ggagccgcgctgtgc

SEQ ID NO: 49711 - DNA, 15 bp, Artificial Sequence
  dgRNA
  Bend3
cccagctccccgccg

SEQ ID NO: 49712 - DNA, 15 bp, Artificial Sequence
  dgRNA
  Bend3
cgtgtgccccgctga

SEQ ID NO: 49713 - DNA, 15 bp, Artificial Sequence
  dgRNA
  Bend3
gtgtgccccgctgag

SEQ ID NO: 49714 - DNA, 15 bp, Artificial Sequence
  dgRNA
  Pla2g2c
agctccatccgcctc

SEQ ID NO: 49715 - DNA, 15 bp, Artificial Sequence
  dgRNA
  Pla2g2c
tccgcctccggtgcc

SEQ ID NO: 49716 - DNA, 15 bp, Artificial Sequence
  dgRNA
  Pla2g2c
ctggctgcgaccagc

SEQ ID NO: 49717 - DNA, 15 bp, Artificial Sequence
  dgRNA
  Pla2g2c
cctggcaaccgccaa

SEQ ID NO: 49718 - DNA, 15 bp, Artificial Sequence
  dgRNA
  Gp1ba
ctctagatctctccg

SEQ ID NO: 49719 - DNA, 15 bp, Artificial Sequence
  dgRNA
  Gp1ba
tctctccggggtgga

SEQ ID NO: 49720 - DNA, 15 bp, Artificial Sequence
  dgRNA
  Gp1ba
gagcctttgcccgca

SEQ ID NO: 49721 - DNA, 15 bp, Artificial Sequence
  dgRNA
  Gp1ba
agcctttgcccgcaa

SEQ ID NO: 49722 - DNA, 15 bp, Artificial Sequence
  dgRNA
  Olfr818
atggtaatgtaatgt

SEQ ID NO: 49723 - DNA, 15 bp, Artificial Sequence
  dgRNA
  Olfr818
tggtaatgtaatgta

SEQ ID NO: 49724 - DNA, 15 bp, Artificial Sequence
  dgRNA
  Olfr818
aagaaattttttcgt

SEQ ID NO: 49725 - DNA, 15 bp, Artificial Sequence
  dgRNA
  Cga
gatcaattgatgtca

SEQ ID NO: 49726 - DNA, 15 bp, Artificial Sequence
  dgRNA
  Cga
gtgccatccaatcac

SEQ ID NO: 49727 - DNA, 15 bp, Artificial Sequence
  dgRNA
  Cga
tttgtattactctgc

SEQ ID NO: 49728 - DNA, 15 bp, Artificial Sequence
  dgRNA
  Cga
tgattggatggcact

SEQ ID NO: 49729 - DNA, 15 bp, Artificial Sequence
  dgRNA
  1110012L19Rik
ccgtaccttcctatc

SEQ ID NO: 49730 - DNA, 15 bp, Artificial Sequence
  dgRNA
  1110012L19Rik
cgtaccttcctatcc

SEQ ID NO: 49731 - DNA, 15 bp, Artificial Sequence
  dgRNA
  1110012L19Rik
gcctgtagttctaat

SEQ ID NO: 49732 - DNA, 15 bp, Artificial Sequence
  dgRNA
  1110012L19Rik
tttactcgtgtaaat

SEQ ID NO: 49733 - DNA, 15 bp, Artificial Sequence
  dgRNA
  Cxadr
agggcgccaacactg

SEQ ID NO: 49734 - DNA, 15 bp, Artificial Sequence
  dgRNA
  Cxadr
gggcgccaacactgt

SEQ ID NO: 49735 - DNA, 15 bp, Artificial Sequence
  dgRNA
  Cxadr
ttgcttaggggctcc

SEQ ID NO: 49736 - DNA, 15 bp, Artificial Sequence
  dgRNA
  Cxadr
gttcacctgccgagc

SEQ ID NO: 49737 - DNA, 15 bp, Artificial Sequence
  dgRNA
  Srrm3
aggtgcggcaagtga

SEQ ID NO: 49738 - DNA, 15 bp, Artificial Sequence
  dgRNA
  Ypel1
taaatggcaactcaa

SEQ ID NO: 49739 - DNA, 15 bp, Artificial Sequence
  dgRNA
  Ypel1
acaatctaatcaatt

SEQ ID NO: 49740 - DNA, 15 bp, Artificial Sequence
  dgRNA
  Ypel1
caatctaatcaatta

SEQ ID NO: 49741 - DNA, 15 bp, Artificial Sequence
  dgRNA
  Ypel1
aagaagcgcagatgt

SEQ ID NO: 49742 - DNA, 15 bp, Artificial Sequence
  dgRNA
  Inpp5d
tagcgtcaggtttca

SEQ ID NO: 49743 - DNA, 15 bp, Artificial Sequence
  dgRNA
  Inpp5d
ggctcttttagcgtc

SEQ ID NO: 49744 - DNA, 15 bp, Artificial Sequence
  dgRNA
  1700034E13Rik
aagtgcgagaaccac

SEQ ID NO: 49745 - DNA, 15 bp, Artificial Sequence
  dgRNA
  1700034E13Rik
gcactttatgaggta

SEQ ID NO: 49746 - DNA, 15 bp, Artificial Sequence
  dgRNA
  1700034E13Rik
attaagtagcccagc

SEQ ID NO: 49747 - DNA, 15 bp, Artificial Sequence
  dgRNA
  Ccnd3
gtcagaagggacccg

SEQ ID NO: 49748 - DNA, 15 bp, Artificial Sequence
  dgRNA
  Ccnd3
tcagaagggacccga

SEQ ID NO: 49749 - DNA, 15 bp, Artificial Sequence
  dgRNA
  Ccnd3
gggcccggaagcgtg

SEQ ID NO: 49750 - DNA, 15 bp, Artificial Sequence
  dgRNA
  Ccnd3
ggcccggaagcgtgc

SEQ ID NO: 49751 - DNA, 15 bp, Artificial Sequence
  dgRNA
  Rnaseh2b
ctgctcgcccgcatt

SEQ ID NO: 49752 - DNA, 15 bp, Artificial Sequence
  dgRNA
  Rnaseh2b
ggaagccgagcgggc

SEQ ID NO: 49753 - DNA, 15 bp, Artificial Sequence
  dgRNA
  Rnaseh2b
ccgagcgggcgggcc

SEQ ID NO: 49754 - DNA, 15 bp, Artificial Sequence
  dgRNA
  Rnaseh2b
gggcgggcccggaaa

SEQ ID NO: 49755 - DNA, 15 bp, Artificial Sequence
  dgRNA
  Vsnl1
taaaatccgaagcct

SEQ ID NO: 49756 - DNA, 15 bp, Artificial Sequence
  dgRNA
  Vsnl1
tgcgccatcgccaag

SEQ ID NO: 49757 - DNA, 15 bp, Artificial Sequence
  dgRNA
  Vsnl1
tcgccaagcggcttt

SEQ ID NO: 49758 - DNA, 15 bp, Artificial Sequence
  dgRNA
  Vsnl1
cacaactatccaggc

SEQ ID NO: 49759 - DNA, 15 bp, Artificial Sequence
  dgRNA
  Lipo1
agtgaccgcaaaatg

SEQ ID NO: 49760 - DNA, 15 bp, Artificial Sequence
  dgRNA
  Zfp169
gagtccggcagtgct

SEQ ID NO: 49761 - DNA, 15 bp, Artificial Sequence
  dgRNA
  Zfp169
agtccggcagtgcta

SEQ ID NO: 49762 - DNA, 15 bp, Artificial Sequence
  dgRNA
  Zfp169
gtgtcctgcagtacg

SEQ ID NO: 49763 - DNA, 15 bp, Artificial Sequence
  dgRNA
  Zfp169
cagtacgcggcattc

SEQ ID NO: 49764 - DNA, 15 bp, Artificial Sequence
  dgRNA
  Hdac8
ttcaaatggccccgt

SEQ ID NO: 49765 - DNA, 15 bp, Artificial Sequence
  dgRNA
  Hdac8
tcaaatggccccgta

SEQ ID NO: 49766 - DNA, 15 bp, Artificial Sequence
  dgRNA
  Hdac8
ccccgtagggcaaca

SEQ ID NO: 49767 - DNA, 15 bp, Artificial Sequence
  dgRNA
  Hdac8
cgtggtttcaagttt

SEQ ID NO: 49768 - DNA, 15 bp, Artificial Sequence
  dgRNA
  Usp54
attgttcctggtagt

SEQ ID NO: 49769 - DNA, 15 bp, Artificial Sequence
  dgRNA
  Usp54
gacgaacgtcacagg

SEQ ID NO: 49770 - DNA, 15 bp, Artificial Sequence
  dgRNA
  Usp54
tatgacgaacgtcac

SEQ ID NO: 49771 - DNA, 15 bp, Artificial Sequence
  dgRNA
  Usp54
tttttgccaactacc

SEQ ID NO: 49772 - DNA, 15 bp, Artificial Sequence
  dgRNA
  Mbl1
agtgtctaagctata

SEQ ID NO: 49773 - DNA, 15 bp, Artificial Sequence
  dgRNA
  Mbl1
tctaagctatatgga

SEQ ID NO: 49774 - DNA, 15 bp, Artificial Sequence
  dgRNA
  Mbl1
gttgcttattaaact

SEQ ID NO: 49775 - DNA, 15 bp, Artificial Sequence
  dgRNA
  Mbl1
ggagctgttgtaatt

SEQ ID NO: 49776 - DNA, 15 bp, Artificial Sequence
  dgRNA
  Olfr495
gttgctgctagatta

SEQ ID NO: 49777 - DNA, 15 bp, Artificial Sequence
  dgRNA
  Olfr976
agtgaggccatgatc

SEQ ID NO: 49778 - DNA, 15 bp, Artificial Sequence
  dgRNA
  Olfr976
tgaattaccagatca

SEQ ID NO: 49779 - DNA, 15 bp, Artificial Sequence
  dgRNA
  Olfr976
tggcattcagttaag

SEQ ID NO: 49780 - DNA, 15 bp, Artificial Sequence
  dgRNA
  4930444P10Rik
ggccggcatccaccc

SEQ ID NO: 49781 - DNA, 15 bp, Artificial Sequence
  dgRNA
  4930444P10Rik
tggcttcataccgac

SEQ ID NO: 49782 - DNA, 15 bp, Artificial Sequence
  dgRNA
  4930444P10Rik
ggcttcataccgact

SEQ ID NO: 49783 - DNA, 15 bp, Artificial Sequence
  dgRNA
  4930444P10Rik
tccgcctagctcagt

SEQ ID NO: 49784 - DNA, 15 bp, Artificial Sequence
  dgRNA
  Dusp13
gagatcgtgacttgt

SEQ ID NO: 49785 - DNA, 15 bp, Artificial Sequence
  dgRNA
  Dusp13
gttctcggagacttt

SEQ ID NO: 49786 - DNA, 15 bp, Artificial Sequence
  dgRNA
  Dusp13
ttctcggagacttta

SEQ ID NO: 49787 - DNA, 15 bp, Artificial Sequence
  dgRNA
  Dusp13
cggagactttaggga

SEQ ID NO: 49788 - DNA, 15 bp, Artificial Sequence
  dgRNA
  Ppp2r5b
gttacccgtaaagtt

SEQ ID NO: 49789 - DNA, 15 bp, Artificial Sequence
  dgRNA
  Ppp2r5b
cgcagccccccctag

SEQ ID NO: 49790 - DNA, 15 bp, Artificial Sequence
  dgRNA
  Ppp2r5b
agccccccctagcgg

SEQ ID NO: 49791 - DNA, 15 bp, Artificial Sequence
  dgRNA
  Ppp2r5b
gccccccctagcgga

SEQ ID NO: 49792 - DNA, 15 bp, Artificial Sequence
  dgRNA
  Stat4
tcacataagtcaccc

SEQ ID NO: 49793 - DNA, 15 bp, Artificial Sequence
  dgRNA
  Stat4
cctcctgtaggtcat

SEQ ID NO: 49794 - DNA, 15 bp, Artificial Sequence
  dgRNA
  Stat4
gagcacctatgacaa

SEQ ID NO: 49795 - DNA, 15 bp, Artificial Sequence
  dgRNA
  Stat4
atcaaccccttagag

SEQ ID NO: 49796 - DNA, 15 bp, Artificial Sequence
  dgRNA
  Banf1
ccggctggcgtgcgg

SEQ ID NO: 49797 - DNA, 15 bp, Artificial Sequence
  dgRNA
  Banf1
gctggcgtgcggtgg

SEQ ID NO: 49798 - DNA, 15 bp, Artificial Sequence
  dgRNA
  Banf1
ggcggcgcgcagagg

SEQ ID NO: 49799 - DNA, 15 bp, Artificial Sequence
  dgRNA
  Banf1
gcggcgcgcagaggc

SEQ ID NO: 49800 - DNA, 15 bp, Artificial Sequence
  dgRNA
  Nlrp4g
gatagagggtgccta

SEQ ID NO: 49801 - DNA, 15 bp, Artificial Sequence
  dgRNA
  Scd2
ctccgagttattatc

SEQ ID NO: 49802 - DNA, 15 bp, Artificial Sequence
  dgRNA
  Scd2
gccattgttccaaaa

SEQ ID NO: 49803 - DNA, 15 bp, Artificial Sequence
  dgRNA
  Scd2
tacagaggcgcctgt

SEQ ID NO: 49804 - DNA, 15 bp, Artificial Sequence
  dgRNA
  Scd2
acagaggcgcctgtt

SEQ ID NO: 49805 - DNA, 15 bp, Artificial Sequence
  dgRNA
  1700016D06Rik
gatgccttacctcaa

SEQ ID NO: 49806 - DNA, 15 bp, Artificial Sequence
  dgRNA
  1700016D06Rik
ctgatcacttcctag

SEQ ID NO: 49807 - DNA, 15 bp, Artificial Sequence
  dgRNA
  1700016D06Rik
gccatgcttgttgtc

SEQ ID NO: 49808 - DNA, 15 bp, Artificial Sequence
  dgRNA
  1700016D06Rik
cactaggaagtgatc

SEQ ID NO: 49809 - DNA, 15 bp, Artificial Sequence
  dgRNA
  Tmem94
tcacacaattccgcc

SEQ ID NO: 49810 - DNA, 15 bp, Artificial Sequence
  dgRNA
  Tmem94
attccgccaggctcc

SEQ ID NO: 49811 - DNA, 15 bp, Artificial Sequence
  dgRNA
  Tmem94
ccgccaggctcccgg

SEQ ID NO: 49812 - DNA, 15 bp, Artificial Sequence
  dgRNA
  Tmem94
cgccaggctcccgga

SEQ ID NO: 49813 - DNA, 15 bp, Artificial Sequence
  dgRNA
  Nags
gtacccccatacaca

SEQ ID NO: 49814 - DNA, 15 bp, Artificial Sequence
  dgRNA
  Nags
tacccccatacacaa

SEQ ID NO: 49815 - DNA, 15 bp, Artificial Sequence
  dgRNA
  Nags
ggcggagaagtctag

SEQ ID NO: 49816 - DNA, 15 bp, Artificial Sequence
  dgRNA
  Nags
agaggcgccaccctc

SEQ ID NO: 49817 - DNA, 15 bp, Artificial Sequence
  dgRNA
  Gabpb1
gaaacgggcgcgggt

SEQ ID NO: 49818 - DNA, 15 bp, Artificial Sequence
  dgRNA
  Gabpb1
gggcgcgggttggcg

SEQ ID NO: 49819 - DNA, 15 bp, Artificial Sequence
  dgRNA
  Gabpb1
tggcgaggccgccgc

SEQ ID NO: 49820 - DNA, 15 bp, Artificial Sequence
  dgRNA
  Gabpb1
ccgccgcaggcatgc

SEQ ID NO: 49821 - DNA, 15 bp, Artificial Sequence
  dgRNA
  Mrps17
ccccaggacttccgc

SEQ ID NO: 49822 - DNA, 15 bp, Artificial Sequence
  dgRNA
  Mrps17
cccaggacttccgcc

SEQ ID NO: 49823 - DNA, 15 bp, Artificial Sequence
  dgRNA
  Mrps17
aggacttccgccggg

SEQ ID NO: 49824 - DNA, 15 bp, Artificial Sequence
  dgRNA
  Mrps17
cttgttcaaatagat

SEQ ID NO: 49825 - DNA, 15 bp, Artificial Sequence
  dgRNA
  Olfr173
ttcatgcaactatga

SEQ ID NO: 49826 - DNA, 15 bp, Artificial Sequence
  dgRNA
  Olfr173
tcatgcaactatgat

SEQ ID NO: 49827 - DNA, 15 bp, Artificial Sequence
  dgRNA
  Olfr173
ggcattgtttaatat

SEQ ID NO: 49828 - DNA, 15 bp, Artificial Sequence
  dgRNA
  Olfr173
gcaaggaatgtactt

SEQ ID NO: 49829 - DNA, 15 bp, Artificial Sequence
  dgRNA
  Exosc2
aattcatcattccgc

SEQ ID NO: 49830 - DNA, 15 bp, Artificial Sequence
  dgRNA
  Exosc2
tgccaatactcaaca

SEQ ID NO: 49831 - DNA, 15 bp, Artificial Sequence
  dgRNA
  Exosc2
actatccattcccat

SEQ ID NO: 49832 - DNA, 15 bp, Artificial Sequence
  dgRNA
  Exosc2
tggtcgcttctctga

SEQ ID NO: 49833 - DNA, 15 bp, Artificial Sequence
  dgRNA
  Stx7
cccgagcatgcgcag

SEQ ID NO: 49834 - DNA, 15 bp, Artificial Sequence
  dgRNA
  Stx7
gggttctttattcgg

SEQ ID NO: 49835 - DNA, 15 bp, Artificial Sequence
  dgRNA
  Stx7
gagccaagctctgat

SEQ ID NO: 49836 - DNA, 15 bp, Artificial Sequence
  dgRNA
  Stx7
gactggcaaaattgc

SEQ ID NO: 49837 - DNA, 15 bp, Artificial Sequence
  dgRNA
  Slc5a6
cgagaaccgagcgcg

SEQ ID NO: 49838 - DNA, 15 bp, Artificial Sequence
  dgRNA
  Slc5a6
cacgcgccagccttg

SEQ ID NO: 49839 - DNA, 15 bp, Artificial Sequence
  dgRNA
  Slc5a6
gccagccttgaggcg

SEQ ID NO: 49840 - DNA, 15 bp, Artificial Sequence
  dgRNA
  Slc5a6
gcgtggagagggccc

SEQ ID NO: 49841 - DNA, 15 bp, Artificial Sequence
  dgRNA
  Kdm1a
agtccttgatgaaaa

SEQ ID NO: 49842 - DNA, 15 bp, Artificial Sequence
  dgRNA
  Kdm1a
cttgatgaaaacggt

SEQ ID NO: 49843 - DNA, 15 bp, Artificial Sequence
  dgRNA
  Kdm1a
ttgatgaaaacggtc

SEQ ID NO: 49844 - DNA, 15 bp, Artificial Sequence
  dgRNA
  Kdm1a
tcagaacccgaagtc

SEQ ID NO: 49845 - DNA, 15 bp, Artificial Sequence
  dgRNA
  Parp16
ctcaggtcgtgagga

SEQ ID NO: 49846 - DNA, 15 bp, Artificial Sequence
  dgRNA
  Parp16
agtcatcttggggtc

SEQ ID NO: 49847 - DNA, 15 bp, Artificial Sequence
  dgRNA
  Parp16
ccggtcttttccctt

SEQ ID NO: 49848 - DNA, 15 bp, Artificial Sequence
  dgRNA
  Parp16
tcttttcccttcggc

SEQ ID NO: 49849 - DNA, 15 bp, Artificial Sequence
  dgRNA
  Hsf2bp
aaacgcaactgaagt

SEQ ID NO: 49850 - DNA, 15 bp, Artificial Sequence
  dgRNA
  Hsf2bp
gctacagtagaatcc

SEQ ID NO: 49851 - DNA, 15 bp, Artificial Sequence
  dgRNA
  Hsf2bp
ggtccatctcatccc

SEQ ID NO: 49852 - DNA, 15 bp, Artificial Sequence
  dgRNA
  Hsf2bp
gagatttgaaccttg

SEQ ID NO: 49853 - DNA, 15 bp, Artificial Sequence
  dgRNA
  Tmem107
cggacgcagttacca

SEQ ID NO: 49854 - DNA, 15 bp, Artificial Sequence
  dgRNA
  Srsf11
tccttgccctccgcg

SEQ ID NO: 49855 - DNA, 15 bp, Artificial Sequence
  dgRNA
  Srsf11
gtggaatcccgcacg

SEQ ID NO: 49856 - DNA, 15 bp, Artificial Sequence
  dgRNA
  Srsf11
tggaatcccgcacga

SEQ ID NO: 49857 - DNA, 15 bp, Artificial Sequence
  dgRNA
  Srsf11
acgagggtcaaacct

SEQ ID NO: 49858 - DNA, 15 bp, Artificial Sequence
  dgRNA
  Prss1
tacttctccctgaat

SEQ ID NO: 49859 - DNA, 15 bp, Artificial Sequence
  dgRNA
  Cep41
ttccttcccgcgctc

SEQ ID NO: 49860 - DNA, 15 bp, Artificial Sequence
  dgRNA
  Cep41
ttcccgcgctcaggc

SEQ ID NO: 49861 - DNA, 15 bp, Artificial Sequence
  dgRNA
  Cep41
tccaagctgcgctag

SEQ ID NO: 49862 - DNA, 15 bp, Artificial Sequence
  dgRNA
  Cep41
ccaagctgcgctagc

SEQ ID NO: 49863 - DNA, 15 bp, Artificial Sequence
  dgRNA
  Cpvl
gatacaaatactata

SEQ ID NO: 49864 - DNA, 15 bp, Artificial Sequence
  dgRNA
  Cpvl
tactataaggataac

SEQ ID NO: 49865 - DNA, 15 bp, Artificial Sequence
  dgRNA
  Cpvl
ccttggtaacttaga

SEQ ID NO: 49866 - DNA, 15 bp, Artificial Sequence
  dgRNA
  Cpvl
acgtggggttttcct

SEQ ID NO: 49867 - DNA, 15 bp, Artificial Sequence
  dgRNA
  Ido1
gttcccgggaaggcg

SEQ ID NO: 49868 - DNA, 15 bp, Artificial Sequence
  dgRNA
  Ido1
tacactgcagaatta

SEQ ID NO: 49869 - DNA, 15 bp, Artificial Sequence
  dgRNA
  Ido1
atcagctcgcccagc

SEQ ID NO: 49870 - DNA, 15 bp, Artificial Sequence
  dgRNA
  Ido1
tcagctcgcccagcc

SEQ ID NO: 49871 - DNA, 15 bp, Artificial Sequence
  dgRNA
  Khdc1a
ttgagtacactctca

SEQ ID NO: 49872 - DNA, 15 bp, Artificial Sequence
  dgRNA
  Khdc1a
ctggtctatttaatg

SEQ ID NO: 49873 - DNA, 15 bp, Artificial Sequence
  dgRNA
  Khdc1a
ttgagagtgtactca

SEQ ID NO: 49874 - DNA, 15 bp, Artificial Sequence
  dgRNA
  Rasgrp1
ggggactcgtagcct

SEQ ID NO: 49875 - DNA, 15 bp, Artificial Sequence
  dgRNA
  Rasgrp1
gggactcgtagcctt

SEQ ID NO: 49876 - DNA, 15 bp, Artificial Sequence
  dgRNA
  Rasgrp1
actcgtagccttggg

SEQ ID NO: 49877 - DNA, 15 bp, Artificial Sequence
  dgRNA
  Rasgrp1
cgtagccttgggtgg

SEQ ID NO: 49878 - DNA, 15 bp, Artificial Sequence
  dgRNA
  Pus10
cccgcaaaagcgaaa

SEQ ID NO: 49879 - DNA, 15 bp, Artificial Sequence
  dgRNA
  Pus10
caaaagcgaaaaggc

SEQ ID NO: 49880 - DNA, 15 bp, Artificial Sequence
  dgRNA
  Pus10
agctcctgcatccgt

SEQ ID NO: 49881 - DNA, 15 bp, Artificial Sequence
  dgRNA
  Pus10
gctcctgcatccgtg

SEQ ID NO: 49882 - DNA, 15 bp, Artificial Sequence
  dgRNA
  Gli1
agtttgcgcttctcg

SEQ ID NO: 49883 - DNA, 15 bp, Artificial Sequence
  dgRNA
  Gli1
gtttgcgcttctcgc

SEQ ID NO: 49884 - DNA, 15 bp, Artificial Sequence
  dgRNA
  Gli1
tgcgcttctcgcggg

SEQ ID NO: 49885 - DNA, 15 bp, Artificial Sequence
  dgRNA
  Gli1
tctcgcgggtggtcc

SEQ ID NO: 49886 - DNA, 15 bp, Artificial Sequence
  dgRNA
  Hccs
aggcctcggagcgga

SEQ ID NO: 49887 - DNA, 15 bp, Artificial Sequence
  dgRNA
  Hccs
ggcctcggagcggaa

SEQ ID NO: 49888 - DNA, 15 bp, Artificial Sequence
  dgRNA
  Hccs
gcctcggagcggaag

SEQ ID NO: 49889 - DNA, 15 bp, Artificial Sequence
  dgRNA
  Hccs
cctcggagcggaagg

SEQ ID NO: 49890 - DNA, 15 bp, Artificial Sequence
  dgRNA
  Zfp865
gggcgcatgcgcact

SEQ ID NO: 49891 - DNA, 15 bp, Artificial Sequence
  dgRNA
  Zfp865
gccccgttcgcccac

SEQ ID NO: 49892 - DNA, 15 bp, Artificial Sequence
  dgRNA
  Zfp865
caccggaagcagcct

SEQ ID NO: 49893 - DNA, 15 bp, Artificial Sequence
  dgRNA
  Zfp865
tcccgtgtctagtgc

SEQ ID NO: 49894 - DNA, 15 bp, Artificial Sequence
  dgRNA
  Hif3a
ctgagaacgggaaac

SEQ ID NO: 49895 - DNA, 15 bp, Artificial Sequence
  dgRNA
  Hif3a
ccccctcccaccggg

SEQ ID NO: 49896 - DNA, 15 bp, Artificial Sequence
  dgRNA
  Hif3a
acggcgtctctagct

SEQ ID NO: 49897 - DNA, 15 bp, Artificial Sequence
  dgRNA
  Hif3a
cggcgtctctagctc

SEQ ID NO: 49898 - DNA, 15 bp, Artificial Sequence
  dgRNA
  Aldh3b2
tgatttagccccagg

SEQ ID NO: 49899 - DNA, 15 bp, Artificial Sequence
  dgRNA
  Aldh3b2
ggtggtatcgatgtc

SEQ ID NO: 49900 - DNA, 15 bp, Artificial Sequence
  dgRNA
  Aldh3b2
gtcaggaaactgacg

SEQ ID NO: 49901 - DNA, 15 bp, Artificial Sequence
  dgRNA
  Lcp1
gatgaccctggtatt

SEQ ID NO: 49902 - DNA, 15 bp, Artificial Sequence
  dgRNA
  Lcp1
tctactaagcagagc

SEQ ID NO: 49903 - DNA, 15 bp, Artificial Sequence
  dgRNA
  Ugp2
gcctcccgatctaca

SEQ ID NO: 49904 - DNA, 15 bp, Artificial Sequence
  dgRNA
  Ugp2
ctcccgatctacacg

SEQ ID NO: 49905 - DNA, 15 bp, Artificial Sequence
  dgRNA
  Ugp2
ccagcagctcgccgc

SEQ ID NO: 49906 - DNA, 15 bp, Artificial Sequence
  dgRNA
  Ugp2
cagctcgccgctgga

SEQ ID NO: 49907 - DNA, 15 bp, Artificial Sequence
  dgRNA
  Cep97
gcatgtagtcagcag

SEQ ID NO: 49908 - DNA, 15 bp, Artificial Sequence
  dgRNA
  Atp6v1e1
ctctgcgcatgcgcc

SEQ ID NO: 49909 - DNA, 15 bp, Artificial Sequence
  dgRNA
  Atp6v1e1
gcatgcgcctgggaa

SEQ ID NO: 49910 - DNA, 15 bp, Artificial Sequence
  dgRNA
  Atp6v1e1
catgcgcctgggaaa

SEQ ID NO: 49911 - DNA, 15 bp, Artificial Sequence
  dgRNA
  Atp6v1e1
aggcagaacttccgc

SEQ ID NO: 49912 - DNA, 15 bp, Artificial Sequence
  dgRNA
  Limd1
agggacgccaaaact

SEQ ID NO: 49913 - DNA, 15 bp, Artificial Sequence
  dgRNA
  Limd1
cggcgtgcgcatcac

SEQ ID NO: 49914 - DNA, 15 bp, Artificial Sequence
  dgRNA
  Limd1
gcccgcgcccctgcg

SEQ ID NO: 49915 - DNA, 15 bp, Artificial Sequence
  dgRNA
  Limd1
cgcccctgcgcggcc

SEQ ID NO: 49916 - DNA, 15 bp, Artificial Sequence
  dgRNA
  Prdx6b
gttacagaccgttgg

SEQ ID NO: 49917 - DNA, 15 bp, Artificial Sequence
  dgRNA
  Prdx6b
ttacagaccgttggg

SEQ ID NO: 49918 - DNA, 15 bp, Artificial Sequence
  dgRNA
  Prdx6b
tacagaccgttgggg

SEQ ID NO: 49919 - DNA, 15 bp, Artificial Sequence
  dgRNA
  Prdx6b
gaccgttggggggga

SEQ ID NO: 49920 - DNA, 15 bp, Artificial Sequence
  dgRNA
  Mpv17
cggtcacgtgagaga

SEQ ID NO: 49921 - DNA, 15 bp, Artificial Sequence
  dgRNA
  Mpv17
ggttctgcgcagagc

SEQ ID NO: 49922 - DNA, 15 bp, Artificial Sequence
  dgRNA
  Mpv17
tcacgtgaccgaagc

SEQ ID NO: 49923 - DNA, 15 bp, Artificial Sequence
  dgRNA
  Olfr1512
cagttacaatcctcc

SEQ ID NO: 49924 - DNA, 15 bp, Artificial Sequence
  dgRNA
  Olfr1512
cgcaagtgggcggaa

SEQ ID NO: 49925 - DNA, 15 bp, Artificial Sequence
  dgRNA
  Olfr1512
gcgcaagtgggcgga

SEQ ID NO: 49926 - DNA, 15 bp, Artificial Sequence
  dgRNA
  Olfr1512
tgatgcgcaagtggg

SEQ ID NO: 49927 - DNA, 15 bp, Artificial Sequence
  dgRNA
  Nom1
acgcaagaaaatgca

SEQ ID NO: 49928 - DNA, 15 bp, Artificial Sequence
  dgRNA
  Nom1
gctacagccatacct

SEQ ID NO: 49929 - DNA, 15 bp, Artificial Sequence
  dgRNA
  Nom1
attgaagcgcgcttc

SEQ ID NO: 49930 - DNA, 15 bp, Artificial Sequence
  dgRNA
  Nom1
tggtaggagggtacc

SEQ ID NO: 49931 - DNA, 15 bp, Artificial Sequence
  dgRNA
  Ppcs
ctagacgcttcccga

SEQ ID NO: 49932 - DNA, 15 bp, Artificial Sequence
  dgRNA
  Ppcs
tagacgcttcccgac

SEQ ID NO: 49933 - DNA, 15 bp, Artificial Sequence
  dgRNA
  Ppcs
agccttagcgagatc

SEQ ID NO: 49934 - DNA, 15 bp, Artificial Sequence
  dgRNA
  Ppcs
cctactggcggacat

SEQ ID NO: 49935 - DNA, 15 bp, Artificial Sequence
  dgRNA
  Pcdh18
ctcccgcgcccctag

SEQ ID NO: 49936 - DNA, 15 bp, Artificial Sequence
  dgRNA
  Pcdh18
tcccgcgcccctagc

SEQ ID NO: 49937 - DNA, 15 bp, Artificial Sequence
  dgRNA
  Pcdh18
tggaagctcgctgat

SEQ ID NO: 49938 - DNA, 15 bp, Artificial Sequence
  dgRNA
  Pcdh18
agcgcggccgggggt

SEQ ID NO: 49939 - DNA, 15 bp, Artificial Sequence
  dgRNA
  Tlr7
acaggttgctttatc

SEQ ID NO: 49940 - DNA, 15 bp, Artificial Sequence
  dgRNA
  Tlr7
tctgcaacccccgtg

SEQ ID NO: 49941 - DNA, 15 bp, Artificial Sequence
  dgRNA
  Tlr7
taatcactagagttg

SEQ ID NO: 49942 - DNA, 15 bp, Artificial Sequence
  dgRNA
  Tlr7
ggttgcagaaacacc

SEQ ID NO: 49943 - DNA, 15 bp, Artificial Sequence
  dgRNA
  Hexa
ggcttggccagggcg

SEQ ID NO: 49944 - DNA, 15 bp, Artificial Sequence
  dgRNA
  Hexa
ccttcaccgcccacc

SEQ ID NO: 49945 - DNA, 15 bp, Artificial Sequence
  dgRNA
  Hexa
caccgcccacccggt

SEQ ID NO: 49946 - DNA, 15 bp, Artificial Sequence
  dgRNA
  Hexa
accgcccacccggtc

SEQ ID NO: 49947 - DNA, 15 bp, Artificial Sequence
  dgRNA
  Olfr399
tgtatcagtaactgc

SEQ ID NO: 49948 - DNA, 15 bp, Artificial Sequence
  dgRNA
  Olfr399
catcttgaatgcacc

SEQ ID NO: 49949 - DNA, 15 bp, Artificial Sequence
  dgRNA
  Olfr399
agtattgcaatgtcc

SEQ ID NO: 49950 - DNA, 15 bp, Artificial Sequence
  dgRNA
  Fcamr
gtaaaactcgagaga

SEQ ID NO: 49951 - DNA, 15 bp, Artificial Sequence
  dgRNA
  Fcamr
atataacttgcagaa

SEQ ID NO: 49952 - DNA, 15 bp, Artificial Sequence
  dgRNA
  Fcamr
agcctccagatcgag

SEQ ID NO: 49953 - DNA, 15 bp, Artificial Sequence
  dgRNA
  Fcamr
tcgagaggaagccac

SEQ ID NO: 49954 - DNA, 15 bp, Artificial Sequence
  dgRNA
  Acsm5
ttaagccctgggcaa

SEQ ID NO: 49955 - DNA, 15 bp, Artificial Sequence
  dgRNA
  Acsm5
aaaacagataggatc

SEQ ID NO: 49956 - DNA, 15 bp, Artificial Sequence
  dgRNA
  Acsm5
gtgccagtccctaac

SEQ ID NO: 49957 - DNA, 15 bp, Artificial Sequence
  dgRNA
  Acsm5
taacaggctgactcc

SEQ ID NO: 49958 - DNA, 15 bp, Artificial Sequence
  dgRNA
  Xrcc2
aacataaggaccata

SEQ ID NO: 49959 - DNA, 15 bp, Artificial Sequence
  dgRNA
  Xrcc2
actggcgtcaccaag

SEQ ID NO: 49960 - DNA, 15 bp, Artificial Sequence
  dgRNA
  Xrcc2
ctggcgtcaccaaga

SEQ ID NO: 49961 - DNA, 15 bp, Artificial Sequence
  dgRNA
  Xrcc2
tactgcgcatgccct

SEQ ID NO: 49962 - DNA, 15 bp, Artificial Sequence
  dgRNA
  Pfkm
caagcagcggccaca

SEQ ID NO: 49963 - DNA, 15 bp, Artificial Sequence
  dgRNA
  Pfkm
cggccacaaggcatc

SEQ ID NO: 49964 - DNA, 15 bp, Artificial Sequence
  dgRNA
  Pfkm
gcatcagggttctta

SEQ ID NO: 49965 - DNA, 15 bp, Artificial Sequence
  dgRNA
  Pfkm
agggttcttaagggg

SEQ ID NO: 49966 - DNA, 15 bp, Artificial Sequence
  dgRNA
  Serpinb9f
ctgtggttgcttacc

SEQ ID NO: 49967 - DNA, 15 bp, Artificial Sequence
  dgRNA
  Dhx32
gcccgccgcttactg

SEQ ID NO: 49968 - DNA, 15 bp, Artificial Sequence
  dgRNA
  Dhx32
cccgccgcttactgt

SEQ ID NO: 49969 - DNA, 15 bp, Artificial Sequence
  dgRNA
  Dhx32
ccgccgcttactgtg

SEQ ID NO: 49970 - DNA, 15 bp, Artificial Sequence
  dgRNA
  Dhx32
ggtcagctgctcccg

SEQ ID NO: 49971 - DNA, 15 bp, Artificial Sequence
  dgRNA
  Olfr1033
ttacccgctaatata

SEQ ID NO: 49972 - DNA, 15 bp, Artificial Sequence
  dgRNA
  Olfr1033
cattccttatattag

SEQ ID NO: 49973 - DNA, 15 bp, Artificial Sequence
  dgRNA
  Hsdl1
gcggctcagagactt

SEQ ID NO: 49974 - DNA, 15 bp, Artificial Sequence
  dgRNA
  Hsdl1
cggctcagagacttc

SEQ ID NO: 49975 - DNA, 15 bp, Artificial Sequence
  dgRNA
  Hsdl1
ggctcagagacttcg

SEQ ID NO: 49976 - DNA, 15 bp, Artificial Sequence
  dgRNA
  Hsdl1
agccctaatactcta

SEQ ID NO: 49977 - DNA, 15 bp, Artificial Sequence
  dgRNA
  Trp53inp2
gtcgctttcagtgtg

SEQ ID NO: 49978 - DNA, 15 bp, Artificial Sequence
  dgRNA
  Trp53inp2
ggtctgtgggtaact

SEQ ID NO: 49979 - DNA, 15 bp, Artificial Sequence
  dgRNA
  Trp53inp2
tccgagagcagctcc

SEQ ID NO: 49980 - DNA, 15 bp, Artificial Sequence
  dgRNA
  Trp53inp2
gctacagccacccgc

SEQ ID NO: 49981 - DNA, 15 bp, Artificial Sequence
  dgRNA
  Syndig1l
tgggtccggagtgcc

SEQ ID NO: 49982 - DNA, 15 bp, Artificial Sequence
  dgRNA
  Syndig1l
gtccggagtgcctgg

SEQ ID NO: 49983 - DNA, 15 bp, Artificial Sequence
  dgRNA
  Syndig1l
tccggagtgcctggt

SEQ ID NO: 49984 - DNA, 15 bp, Artificial Sequence
  dgRNA
  Syndig1l
gctggttctggagcg

SEQ ID NO: 49985 - DNA, 15 bp, Artificial Sequence
  dgRNA
  Sema6d
gacaccatcaatcgg

SEQ ID NO: 49986 - DNA, 15 bp, Artificial Sequence
  dgRNA
  Sema6d
tcaatcggaggacct

SEQ ID NO: 49987 - DNA, 15 bp, Artificial Sequence
  dgRNA
  Sema6d
atcggaggacctagg

SEQ ID NO: 49988 - DNA, 15 bp, Artificial Sequence
  dgRNA
  Sema6d
tcggaggacctaggt

SEQ ID NO: 49989 - DNA, 15 bp, Artificial Sequence
  dgRNA
  Proser1
ttcaggcttctgccg

SEQ ID NO: 49990 - DNA, 15 bp, Artificial Sequence
  dgRNA
  Proser1
tgcaaaagcgactta

SEQ ID NO: 49991 - DNA, 15 bp, Artificial Sequence
  dgRNA
  Proser1
agcgacttaaggtgg

SEQ ID NO: 49992 - DNA, 15 bp, Artificial Sequence
  dgRNA
  Proser1
caccattgcgtcttg

SEQ ID NO: 49993 - DNA, 15 bp, Artificial Sequence
  dgRNA
  Bnip2
agaggaagcccgccg

SEQ ID NO: 49994 - DNA, 15 bp, Artificial Sequence
  dgRNA
  Bnip2
cccgccgaggatttt

SEQ ID NO: 49995 - DNA, 15 bp, Artificial Sequence
  dgRNA
  Bnip2
tccctcggccgcgcc

SEQ ID NO: 49996 - DNA, 15 bp, Artificial Sequence
  dgRNA
  Bnip2
cgcccggcgccggtc

SEQ ID NO: 49997 - DNA, 15 bp, Artificial Sequence
  dgRNA
  Nedd4l
agcccggcctgtgat

SEQ ID NO: 49998 - DNA, 15 bp, Artificial Sequence
  dgRNA
  Nedd4l
cgcaagtgcccgccc

SEQ ID NO: 49999 - DNA, 15 bp, Artificial Sequence
  dgRNA
  Nedd4l
gcccgccccggcgag

SEQ ID NO: 50000 - DNA, 15 bp, Artificial Sequence
  dgRNA
  Nedd4l
cccgccccggcgagc

SEQ ID NO: 50001 - DNA, 15 bp, Artificial Sequence
  dgRNA
  Cldn24
aacactatattcaag

SEQ ID NO: 50002 - DNA, 15 bp, Artificial Sequence
  dgRNA
  Cldn24
ccaaagcttataccc

SEQ ID NO: 50003 - DNA, 15 bp, Artificial Sequence
  dgRNA
  Cldn24
caaagcttataccct

SEQ ID NO: 50004 - DNA, 15 bp, Artificial Sequence
  dgRNA
  Cldn24
gcagatcctatagag

SEQ ID NO: 50005 - DNA, 15 bp, Artificial Sequence
  dgRNA
  Suco
gagctttgtcagcgg

SEQ ID NO: 50006 - DNA, 15 bp, Artificial Sequence
  dgRNA
  Suco
agctttgtcagcgga

SEQ ID NO: 50007 - DNA, 15 bp, Artificial Sequence
  dgRNA
  Suco
ctttgtcagcggagg

SEQ ID NO: 50008 - DNA, 15 bp, Artificial Sequence
  dgRNA
  Suco
ccgcgctgtgacttg

SEQ ID NO: 50009 - DNA, 15 bp, Artificial Sequence
  dgRNA
  Acnat1
cttcaagatcctggt

SEQ ID NO: 50010 - DNA, 15 bp, Artificial Sequence
  dgRNA
  Acnat1
tcaagatcctggttg

SEQ ID NO: 50011 - DNA, 15 bp, Artificial Sequence
  dgRNA
  Hmgn5
agccggcagcatacg

SEQ ID NO: 50012 - DNA, 15 bp, Artificial Sequence
  dgRNA
  Hmgn5
gccggcagcatacga

SEQ ID NO: 50013 - DNA, 15 bp, Artificial Sequence
  dgRNA
  Hmgn5
agcatacgagggctt

SEQ ID NO: 50014 - DNA, 15 bp, Artificial Sequence
  dgRNA
  Hmgn5
gcatacgagggcttc

SEQ ID NO: 50015 - DNA, 15 bp, Artificial Sequence
  dgRNA
  Gpr101
gtgcgtcaccagcgc

SEQ ID NO: 50016 - DNA, 15 bp, Artificial Sequence
  dgRNA
  Gpr101
cgtcaccagcgcagg

SEQ ID NO: 50017 - DNA, 15 bp, Artificial Sequence
  dgRNA
  Gpr101
gtcaccagcgcaggc

SEQ ID NO: 50018 - DNA, 15 bp, Artificial Sequence
  dgRNA
  Gpr101
cgcaggcggggacag

SEQ ID NO: 50019 - DNA, 15 bp, Artificial Sequence
  dgRNA
  Nckap1
gtccccacggcggtg

SEQ ID NO: 50020 - DNA, 15 bp, Artificial Sequence
  dgRNA
  Nckap1
tccccacggcggtgc

SEQ ID NO: 50021 - DNA, 15 bp, Artificial Sequence
  dgRNA
  Nckap1
cggcggtgcgggccc

SEQ ID NO: 50022 - DNA, 15 bp, Artificial Sequence
  dgRNA
  Nckap1
ggcggtgcgggccct

SEQ ID NO: 50023 - DNA, 15 bp, Artificial Sequence
  dgRNA
  Rab13
attcggtcaaaagag

SEQ ID NO: 50024 - DNA, 15 bp, Artificial Sequence
  dgRNA
  Rab13
gaaactggccctccg

SEQ ID NO: 50025 - DNA, 15 bp, Artificial Sequence
  dgRNA
  Rab13
ctggccctccgaggc

SEQ ID NO: 50026 - DNA, 15 bp, Artificial Sequence
  dgRNA
  Rab13
tggccctccgaggct

SEQ ID NO: 50027 - DNA, 15 bp, Artificial Sequence
  dgRNA
  Trp53
aaagcgttcctgctg

SEQ ID NO: 50028 - DNA, 15 bp, Artificial Sequence
  dgRNA
  Trp53
aagcgttcctgctga

SEQ ID NO: 50029 - DNA, 15 bp, Artificial Sequence
  dgRNA
  Trp53
tgagggcaacatctc

SEQ ID NO: 50030 - DNA, 15 bp, Artificial Sequence
  dgRNA
  Trp53
ccctcaacccacgga

SEQ ID NO: 50031 - DNA, 15 bp, Artificial Sequence
  dgRNA
  2810021J22Rik
tcactaacgagtgac

SEQ ID NO: 50032 - DNA, 15 bp, Artificial Sequence
  dgRNA
  2810021J22Rik
cactaacgagtgacc

SEQ ID NO: 50033 - DNA, 15 bp, Artificial Sequence
  dgRNA
  2810021J22Rik
tatatgcccccaagg

SEQ ID NO: 50034 - DNA, 15 bp, Artificial Sequence
  dgRNA
  2810021J22Rik
ccaaggcggtttcac

SEQ ID NO: 50035 - DNA, 15 bp, Artificial Sequence
  dgRNA
  Palld
gcggacaccctaacc

SEQ ID NO: 50036 - DNA, 15 bp, Artificial Sequence
  dgRNA
  Palld
cggacaccctaacct

SEQ ID NO: 50037 - DNA, 15 bp, Artificial Sequence
  dgRNA
  Palld
ggacaccctaacctg

SEQ ID NO: 50038 - DNA, 15 bp, Artificial Sequence
  dgRNA
  Palld
gcagcccgaagccct

SEQ ID NO: 50039 - DNA, 15 bp, Artificial Sequence
  dgRNA
  Ropn1
actttacaggatgtt

SEQ ID NO: 50040 - DNA, 15 bp, Artificial Sequence
  dgRNA
  Ropn1
agtacaacagtccga

SEQ ID NO: 50041 - DNA, 15 bp, Artificial Sequence
  dgRNA
  Ropn1
aacagtccgaaggag

SEQ ID NO: 50042 - DNA, 15 bp, Artificial Sequence
  dgRNA
  Ropn1
gtccgaaggagtgga

SEQ ID NO: 50043 - DNA, 15 bp, Artificial Sequence
  dgRNA
  Cux2
agaccgctcccccaa

SEQ ID NO: 50044 - DNA, 15 bp, Artificial Sequence
  dgRNA
  Cux2
gaccgctcccccaac

SEQ ID NO: 50045 - DNA, 15 bp, Artificial Sequence
  dgRNA
  Cux2
accgctcccccaacg

SEQ ID NO: 50046 - DNA, 15 bp, Artificial Sequence
  dgRNA
  Cux2
aacggggaacataca

SEQ ID NO: 50047 - DNA, 15 bp, Artificial Sequence
  dgRNA
  Ank1
ccgcgcccagcctgg

SEQ ID NO: 50048 - DNA, 15 bp, Artificial Sequence
  dgRNA
  Ank1
cgcgcccagcctggt

SEQ ID NO: 50049 - DNA, 15 bp, Artificial Sequence
  dgRNA
  Ank1
cgagtccgccctccg

SEQ ID NO: 50050 - DNA, 15 bp, Artificial Sequence
  dgRNA
  Ank1
ccgccgccgcaggag

SEQ ID NO: 50051 - DNA, 15 bp, Artificial Sequence
  dgRNA
  Tvp23a
cctccgtgttgaact

SEQ ID NO: 50052 - DNA, 15 bp, Artificial Sequence
  dgRNA
  Tvp23a
cttgggtatcctctc

SEQ ID NO: 50053 - DNA, 15 bp, Artificial Sequence
  dgRNA
  Tvp23a
aaactcttctgcgcc

SEQ ID NO: 50054 - DNA, 15 bp, Artificial Sequence
  dgRNA
  Tvp23a
gctgagcgctcaggt

SEQ ID NO: 50055 - DNA, 15 bp, Artificial Sequence
  dgRNA
  Rnf113a1
acgccaacccgtcac

SEQ ID NO: 50056 - DNA, 15 bp, Artificial Sequence
  dgRNA
  Rnf113a1
tcttccggcagcacg

SEQ ID NO: 50057 - DNA, 15 bp, Artificial Sequence
  dgRNA
  Rnf113a1
cttccggcagcacgc

SEQ ID NO: 50058 - DNA, 15 bp, Artificial Sequence
  dgRNA
  Rnf113a1
ccggcagcacgcggg

SEQ ID NO: 50059 - DNA, 15 bp, Artificial Sequence
  dgRNA
  Mgat3
ctccagcgcagcgct

SEQ ID NO: 50060 - DNA, 15 bp, Artificial Sequence
  dgRNA
  Mgat3
cccccgctaccgccc

SEQ ID NO: 50061 - DNA, 15 bp, Artificial Sequence
  dgRNA
  Mgat3
ccccgctaccgcccc

SEQ ID NO: 50062 - DNA, 15 bp, Artificial Sequence
  dgRNA
  Mgat3
cccgctaccgccccg

SEQ ID NO: 50063 - DNA, 15 bp, Artificial Sequence
  dgRNA
  Rmi1
gggagacgagcacga

SEQ ID NO: 50064 - DNA, 15 bp, Artificial Sequence
  dgRNA
  Rmi1
gcgacgtccgtgcag

SEQ ID NO: 50065 - DNA, 15 bp, Artificial Sequence
  dgRNA
  Rmi1
cgttcgcgcactctg

SEQ ID NO: 50066 - DNA, 15 bp, Artificial Sequence
  dgRNA
  Rmi1
gcgcactctgtggtg

SEQ ID NO: 50067 - DNA, 15 bp, Artificial Sequence
  dgRNA
  Adgrb3
ttctcagcgcttttt

SEQ ID NO: 50068 - DNA, 15 bp, Artificial Sequence
  dgRNA
  Adgrb3
ccaatccgtttgttg

SEQ ID NO: 50069 - DNA, 15 bp, Artificial Sequence
  dgRNA
  Adgrb3
caatccgtttgttgc

SEQ ID NO: 50070 - DNA, 15 bp, Artificial Sequence
  dgRNA
  Adgrb3
aatccgtttgttgcg

SEQ ID NO: 50071 - DNA, 15 bp, Artificial Sequence
  dgRNA
  Fkbp1a
agctatcgtccttac

SEQ ID NO: 50072 - DNA, 15 bp, Artificial Sequence
  dgRNA
  Fkbp1a
gctatcgtccttaca

SEQ ID NO: 50073 - DNA, 15 bp, Artificial Sequence
  dgRNA
  Fkbp1a
acagggcaattagtt

SEQ ID NO: 50074 - DNA, 15 bp, Artificial Sequence
  dgRNA
  Fkbp1a
gagctcgtcagtagc

SEQ ID NO: 50075 - DNA, 15 bp, Artificial Sequence
  dgRNA
  Tle2
taatttctctccccc

SEQ ID NO: 50076 - DNA, 15 bp, Artificial Sequence
  dgRNA
  Tle2
tggggcgggaacact

SEQ ID NO: 50077 - DNA, 15 bp, Artificial Sequence
  dgRNA
  Tle2
ttccccagcgggtct

SEQ ID NO: 50078 - DNA, 15 bp, Artificial Sequence
  dgRNA
  Tle2
ggcggtgccacctta

SEQ ID NO: 50079 - DNA, 15 bp, Artificial Sequence
  dgRNA
  Snai2
cgcctccccgcccag

SEQ ID NO: 50080 - DNA, 15 bp, Artificial Sequence
  dgRNA
  Snai2
aaaatgggctgctca

SEQ ID NO: 50081 - DNA, 15 bp, Artificial Sequence
  dgRNA
  Snai2
cagactaaatttttc

SEQ ID NO: 50082 - DNA, 15 bp, Artificial Sequence
  dgRNA
  Snai2
gagctcctctgggcg

SEQ ID NO: 50083 - DNA, 15 bp, Artificial Sequence
  dgRNA
  Gdpd3
aagatctaaacacta

SEQ ID NO: 50084 - DNA, 15 bp, Artificial Sequence
  dgRNA
  Gdpd3
agatctaaacactag

SEQ ID NO: 50085 - DNA, 15 bp, Artificial Sequence
  dgRNA
  Gdpd3
gatctaaacactagg

SEQ ID NO: 50086 - DNA, 15 bp, Artificial Sequence
  dgRNA
  Gdpd3
ggccatactgcagtc

SEQ ID NO: 50087 - DNA, 15 bp, Artificial Sequence
  dgRNA
  Kpna7
aggtgcgaaccccta

SEQ ID NO: 50088 - DNA, 15 bp, Artificial Sequence
  dgRNA
  Kpna7
gcgaacccctatggc

SEQ ID NO: 50089 - DNA, 15 bp, Artificial Sequence
  dgRNA
  Kpna7
tggcttctacgtcac

SEQ ID NO: 50090 - DNA, 15 bp, Artificial Sequence
  dgRNA
  Kpna7
aatttaaaccagacg

SEQ ID NO: 50091 - DNA, 15 bp, Artificial Sequence
  dgRNA
  Slc35c1
acgacagtaacagaa

SEQ ID NO: 50092 - DNA, 15 bp, Artificial Sequence
  dgRNA
  Slc35c1
gttgaccttagataa

SEQ ID NO: 50093 - DNA, 15 bp, Artificial Sequence
  dgRNA
  Slc35c1
cttgatgggctcccg

SEQ ID NO: 50094 - DNA, 15 bp, Artificial Sequence
  dgRNA
  Slc35c1
ttgatgggctcccgt

SEQ ID NO: 50095 - DNA, 15 bp, Artificial Sequence
  dgRNA
  Eif2s3x
cgggaaggcggactg

SEQ ID NO: 50096 - DNA, 15 bp, Artificial Sequence
  dgRNA
  5730508B09Rik
atgctacacctccct

SEQ ID NO: 50097 - DNA, 15 bp, Artificial Sequence
  dgRNA
  5730508B09Rik
ggttccgcccctccc

SEQ ID NO: 50098 - DNA, 15 bp, Artificial Sequence
  dgRNA
  5730508B09Rik
aggtcccgccttcat

SEQ ID NO: 50099 - DNA, 15 bp, Artificial Sequence
  dgRNA
  5730508B09Rik
ggtcccgccttcatt

SEQ ID NO: 50100 - DNA, 15 bp, Artificial Sequence
  dgRNA
  Klc4
ggactgccggacttc

SEQ ID NO: 50101 - DNA, 15 bp, Artificial Sequence
  dgRNA
  Klc4
cggacttctggactt

SEQ ID NO: 50102 - DNA, 15 bp, Artificial Sequence
  dgRNA
  Klc4
cacggagccccaccc

SEQ ID NO: 50103 - DNA, 15 bp, Artificial Sequence
  dgRNA
  Ccdc9
ggtgcggacccttta

SEQ ID NO: 50104 - DNA, 15 bp, Artificial Sequence
  dgRNA
  Ccdc9
accctttaaggcacc

SEQ ID NO: 50105 - DNA, 15 bp, Artificial Sequence
  dgRNA
  Ccdc9
taaggcacccggaaa

SEQ ID NO: 50106 - DNA, 15 bp, Artificial Sequence
  dgRNA
  Ccdc9
aaggcacccggaaat

SEQ ID NO: 50107 - DNA, 15 bp, Artificial Sequence
  dgRNA
  Olfr1040
gtgactccttttgag

SEQ ID NO: 50108 - DNA, 15 bp, Artificial Sequence
  dgRNA
  Ccr1l1
ggtttagtaaactct

SEQ ID NO: 50109 - DNA, 15 bp, Artificial Sequence
  dgRNA
  Ccr1l1
gctattaaacacgta

SEQ ID NO: 50110 - DNA, 15 bp, Artificial Sequence
  dgRNA
  Ccr1l1
tgctattaaacacgt

SEQ ID NO: 50111 - DNA, 15 bp, Artificial Sequence
  dgRNA
  Ccr1l1
tgtaaactcttctac

SEQ ID NO: 50112 - DNA, 15 bp, Artificial Sequence
  dgRNA
  Dpf3
taactaccaccacgc

SEQ ID NO: 50113 - DNA, 15 bp, Artificial Sequence
  dgRNA
  Dpf3
accagccgcgccgat

SEQ ID NO: 50114 - DNA, 15 bp, Artificial Sequence
  dgRNA
  Dpf3
cgccgattggccggt

SEQ ID NO: 50115 - DNA, 15 bp, Artificial Sequence
  dgRNA
  Dpf3
gattggccggtaggc

SEQ ID NO: 50116 - DNA, 15 bp, Artificial Sequence
  dgRNA
  Azin2
agctgcgcagctttg

SEQ ID NO: 50117 - DNA, 15 bp, Artificial Sequence
  dgRNA
  Azin2
gcggagcagcctcgc

SEQ ID NO: 50118 - DNA, 15 bp, Artificial Sequence
  dgRNA
  Azin2
cggagcagcctcgca

SEQ ID NO: 50119 - DNA, 15 bp, Artificial Sequence
  dgRNA
  Azin2
gtccgaatcgaccaa

SEQ ID NO: 50120 - DNA, 15 bp, Artificial Sequence
  dgRNA
  Unc13b
tgaagccctttcagt

SEQ ID NO: 50121 - DNA, 15 bp, Artificial Sequence
  dgRNA
  Unc13b
agctgctatcaatct

SEQ ID NO: 50122 - DNA, 15 bp, Artificial Sequence
  dgRNA
  Unc13b
ctccgcccactgaaa

SEQ ID NO: 50123 - DNA, 15 bp, Artificial Sequence
  dgRNA
  Unc13b
gctccgcccactgaa

SEQ ID NO: 50124 - DNA, 15 bp, Artificial Sequence
  dgRNA
  Zfp710
gcttgcaattcgagt

SEQ ID NO: 50125 - DNA, 15 bp, Artificial Sequence
  dgRNA
  Zfp710
gaattgcaagcctgg

SEQ ID NO: 50126 - DNA, 15 bp, Artificial Sequence
  dgRNA
  Zfp710
ctcgaattgcaagcc

SEQ ID NO: 50127 - DNA, 15 bp, Artificial Sequence
  dgRNA
  Bmp4
agtacctcttgcacg

SEQ ID NO: 50128 - DNA, 15 bp, Artificial Sequence
  dgRNA
  Bmp4
tgcttcccgagctgg

SEQ ID NO: 50129 - DNA, 15 bp, Artificial Sequence
  dgRNA
  Bmp4
ccgagctggaggcat

SEQ ID NO: 50130 - DNA, 15 bp, Artificial Sequence
  dgRNA
  Bmp4
catcggtcccagcca

SEQ ID NO: 50131 - DNA, 15 bp, Artificial Sequence
  dgRNA
  Vcl
ccctcccttgggaat

SEQ ID NO: 50132 - DNA, 15 bp, Artificial Sequence
  dgRNA
  Vcl
ggggcgggaccttag

SEQ ID NO: 50133 - DNA, 15 bp, Artificial Sequence
  dgRNA
  Vcl
ttagcggctctgcct

SEQ ID NO: 50134 - DNA, 15 bp, Artificial Sequence
  dgRNA
  Vcl
tagcggctctgcctt

SEQ ID NO: 50135 - DNA, 15 bp, Artificial Sequence
  dgRNA
  Slc16a1
cccgagcgagcgagc

SEQ ID NO: 50136 - DNA, 15 bp, Artificial Sequence
  dgRNA
  Slc16a1
gcagcccgcagcgtg

SEQ ID NO: 50137 - DNA, 15 bp, Artificial Sequence
  dgRNA
  Slc16a1
gcccgcagcgtgtgg

SEQ ID NO: 50138 - DNA, 15 bp, Artificial Sequence
  dgRNA
  Slc16a1
cgcgagatgccgagc

SEQ ID NO: 50139 - DNA, 15 bp, Artificial Sequence
  dgRNA
  Nxt2
gtaatttaaaacgga

SEQ ID NO: 50140 - DNA, 15 bp, Artificial Sequence
  dgRNA
  Nxt2
taatttaaaacggat

SEQ ID NO: 50141 - DNA, 15 bp, Artificial Sequence
  dgRNA
  Nxt2
tttaaaacggatggg

SEQ ID NO: 50142 - DNA, 15 bp, Artificial Sequence
  dgRNA
  Nxt2
ttaaaacggatgggc

SEQ ID NO: 50143 - DNA, 15 bp, Artificial Sequence
  dgRNA
  Fmn1
cgccttcctatcccc

SEQ ID NO: 50144 - DNA, 15 bp, Artificial Sequence
  dgRNA
  Fmn1
gctgcacattcccat

SEQ ID NO: 50145 - DNA, 15 bp, Artificial Sequence
  dgRNA
  Fmn1
aacagcctgtcaagc

SEQ ID NO: 50146 - DNA, 15 bp, Artificial Sequence
  dgRNA
  Fmn1
aagcaggcgcgtgtt

SEQ ID NO: 50147 - DNA, 15 bp, Artificial Sequence
  dgRNA
  Add2
gacgctgcagcaagc

SEQ ID NO: 50148 - DNA, 15 bp, Artificial Sequence
  dgRNA
  Add2
cagcaagccgggctc

SEQ ID NO: 50149 - DNA, 15 bp, Artificial Sequence
  dgRNA
  Add2
aagccgggctctgga

SEQ ID NO: 50150 - DNA, 15 bp, Artificial Sequence
  dgRNA
  Add2
cgctgcgcactcgcc

SEQ ID NO: 50151 - DNA, 15 bp, Artificial Sequence
  dgRNA
  Spns2
ccggggcagcacgtg

SEQ ID NO: 50152 - DNA, 15 bp, Artificial Sequence
  dgRNA
  Spns2
cggggcagcacgtgc

SEQ ID NO: 50153 - DNA, 15 bp, Artificial Sequence
  dgRNA
  Spns2
ggggcagcacgtgcg

SEQ ID NO: 50154 - DNA, 15 bp, Artificial Sequence
  dgRNA
  Spns2
gcagcacgtgcgggg

SEQ ID NO: 50155 - DNA, 15 bp, Artificial Sequence
  dgRNA
  Crebzf
gtctagatgtcatat

SEQ ID NO: 50156 - DNA, 15 bp, Artificial Sequence
  dgRNA
  Crebzf
tgtcatattggatcg

SEQ ID NO: 50157 - DNA, 15 bp, Artificial Sequence
  dgRNA
  Crebzf
ttggatcgaggagag

SEQ ID NO: 50158 - DNA, 15 bp, Artificial Sequence
  dgRNA
  Crebzf
cgaggagagtggtac

SEQ ID NO: 50159 - DNA, 15 bp, Artificial Sequence
  dgRNA
  Mmp12
catggtcacagatcc

SEQ ID NO: 50160 - DNA, 15 bp, Artificial Sequence
  dgRNA
  Mmp12
atgtgaagtaacagc

SEQ ID NO: 50161 - DNA, 15 bp, Artificial Sequence
  dgRNA
  Plxna4
tttgcagcgcttggc

SEQ ID NO: 50162 - DNA, 15 bp, Artificial Sequence
  dgRNA
  Plxna4
ttgcagcgcttggcc

SEQ ID NO: 50163 - DNA, 15 bp, Artificial Sequence
  dgRNA
  Plxna4
gctcgctagctggct

SEQ ID NO: 50164 - DNA, 15 bp, Artificial Sequence
  dgRNA
  Plxna4
ctctggctcgctagc

SEQ ID NO: 50165 - DNA, 15 bp, Artificial Sequence
  dgRNA
  Pop1
attcgcacggcccga

SEQ ID NO: 50166 - DNA, 15 bp, Artificial Sequence
  dgRNA
  Pop1
ttcgcacggcccgat

SEQ ID NO: 50167 - DNA, 15 bp, Artificial Sequence
  dgRNA
  Pop1
gtttacaagcgactc

SEQ ID NO: 50168 - DNA, 15 bp, Artificial Sequence
  dgRNA
  Pop1
tttacaagcgactcc

SEQ ID NO: 50169 - DNA, 15 bp, Artificial Sequence
  dgRNA
  Pcp2
agctcagcgtcagtc

SEQ ID NO: 50170 - DNA, 15 bp, Artificial Sequence
  dgRNA
  Pcp2
tagagatcatctttc

SEQ ID NO: 50171 - DNA, 15 bp, Artificial Sequence
  dgRNA
  Pcp2
gggcttaagcattgg

SEQ ID NO: 50172 - DNA, 15 bp, Artificial Sequence
  dgRNA
  Pcp2
ggcttaagcattggt

SEQ ID NO: 50173 - DNA, 15 bp, Artificial Sequence
  dgRNA
  Trim62
tgtttttcccgtccc

SEQ ID NO: 50174 - DNA, 15 bp, Artificial Sequence
  dgRNA
  Trim62
gtttttcccgtccct

SEQ ID NO: 50175 - DNA, 15 bp, Artificial Sequence
  dgRNA
  Trim62
tttttcccgtccctg

SEQ ID NO: 50176 - DNA, 15 bp, Artificial Sequence
  dgRNA
  Trim62
ccgtccctgggggtc

SEQ ID NO: 50177 - DNA, 15 bp, Artificial Sequence
  dgRNA
  Galnt9
aagcgtgtccttcag

SEQ ID NO: 50178 - DNA, 15 bp, Artificial Sequence
  dgRNA
  Galnt9
gcgtgtccttcagag

SEQ ID NO: 50179 - DNA, 15 bp, Artificial Sequence
  dgRNA
  Tpp2
cgtcgtgactcgtag

SEQ ID NO: 50180 - DNA, 15 bp, Artificial Sequence
  dgRNA
  Tpp2
gttgaagcgtatgat

SEQ ID NO: 50181 - DNA, 15 bp, Artificial Sequence
  dgRNA
  Tpp2
ctgaccgcacacgat

SEQ ID NO: 50182 - DNA, 15 bp, Artificial Sequence
  dgRNA
  Tpp2
tgaccgcacacgatt

SEQ ID NO: 50183 - DNA, 15 bp, Artificial Sequence
  dgRNA
  Asah1
ggaaccgcgacgcct

SEQ ID NO: 50184 - DNA, 15 bp, Artificial Sequence
  dgRNA
  Asah1
ctctcccgagtcagt

SEQ ID NO: 50185 - DNA, 15 bp, Artificial Sequence
  dgRNA
  Asah1
accagcgtcttgccc

SEQ ID NO: 50186 - DNA, 15 bp, Artificial Sequence
  dgRNA
  Asah1
gctccaaacgagtga

SEQ ID NO: 50187 - DNA, 15 bp, Artificial Sequence
  dgRNA
  Wdr64
gatcccaatctgctg

SEQ ID NO: 50188 - DNA, 15 bp, Artificial Sequence
  dgRNA
  Wdr64
taacattatgaggtc

SEQ ID NO: 50189 - DNA, 15 bp, Artificial Sequence
  dgRNA
  Wdr64
gatccacctcctgca

SEQ ID NO: 50190 - DNA, 15 bp, Artificial Sequence
  dgRNA
  Wdr64
acattggccatcatg

SEQ ID NO: 50191 - DNA, 15 bp, Artificial Sequence
  dgRNA
  Nrbf2
gagctccctctcgcg

SEQ ID NO: 50192 - DNA, 15 bp, Artificial Sequence
  dgRNA
  Nrbf2
ccctctcgcgaggag

SEQ ID NO: 50193 - DNA, 15 bp, Artificial Sequence
  dgRNA
  Nrbf2
cctctcgcgaggaga

SEQ ID NO: 50194 - DNA, 15 bp, Artificial Sequence
  dgRNA
  Nrbf2
ctctcgcgaggagag

SEQ ID NO: 50195 - DNA, 15 bp, Artificial Sequence
  dgRNA
  Asic5
gtaaatgcccatagc

SEQ ID NO: 50196 - DNA, 15 bp, Artificial Sequence
  dgRNA
  Asic5
ggttgtaaactgtag

SEQ ID NO: 50197 - DNA, 15 bp, Artificial Sequence
  dgRNA
  Vps37d
ggctcgggaacaccc

SEQ ID NO: 50198 - DNA, 15 bp, Artificial Sequence
  dgRNA
  Vps37d
tcgggaacaccccgg

SEQ ID NO: 50199 - DNA, 15 bp, Artificial Sequence
  dgRNA
  Vps37d
cgggaacaccccggc

SEQ ID NO: 50200 - DNA, 15 bp, Artificial Sequence
  dgRNA
  Vps37d
ccggcgggagatctc

SEQ ID NO: 50201 - DNA, 15 bp, Artificial Sequence
  dgRNA
  Zfyve16
tgcaaaccggagtgc

SEQ ID NO: 50202 - DNA, 15 bp, Artificial Sequence
  dgRNA
  Zfyve16
gcaaaccggagtgcc

SEQ ID NO: 50203 - DNA, 15 bp, Artificial Sequence
  dgRNA
  Zfyve16
actagtcacctcctg

SEQ ID NO: 50204 - DNA, 15 bp, Artificial Sequence
  dgRNA
  Zfyve16
acagcgtccgagcgc

SEQ ID NO: 50205 - DNA, 15 bp, Artificial Sequence
  dgRNA
  Olfr1131
ctctatcacagatac

SEQ ID NO: 50206 - DNA, 15 bp, Artificial Sequence
  dgRNA
  Olfr1131
gatactggtaatttt

SEQ ID NO: 50207 - DNA, 15 bp, Artificial Sequence
  dgRNA
  Olfr1131
agattatccaccatt

SEQ ID NO: 50208 - DNA, 15 bp, Artificial Sequence
  dgRNA
  Tpmt
ggggcttaggtttga

SEQ ID NO: 50209 - DNA, 15 bp, Artificial Sequence
  dgRNA
  Tpmt
cttaggtttgaaggt

SEQ ID NO: 50210 - DNA, 15 bp, Artificial Sequence
  dgRNA
  Tpmt
ctgggcggcctgggt

SEQ ID NO: 50211 - DNA, 15 bp, Artificial Sequence
  dgRNA
  Tpmt
tgggcggcctgggtg

SEQ ID NO: 50212 - DNA, 15 bp, Artificial Sequence
  dgRNA
  Lrrtm1
attactttagcggct

SEQ ID NO: 50213 - DNA, 15 bp, Artificial Sequence
  dgRNA
  Lrrtm1
cccttttcaatctgc

SEQ ID NO: 50214 - DNA, 15 bp, Artificial Sequence
  dgRNA
  Lrrtm1
tcaatctgccggtgt

SEQ ID NO: 50215 - DNA, 15 bp, Artificial Sequence
  dgRNA
  Lrrtm1
atctgccggtgttgg

SEQ ID NO: 50216 - DNA, 15 bp, Artificial Sequence
  dgRNA
  Pfdn4
ataccaagtgtttcc

SEQ ID NO: 50217 - DNA, 15 bp, Artificial Sequence
  dgRNA
  Pfdn4
atagtgctgtgcgtt

SEQ ID NO: 50218 - DNA, 15 bp, Artificial Sequence
  dgRNA
  Pfdn4
tagtgctgtgcgtta

SEQ ID NO: 50219 - DNA, 15 bp, Artificial Sequence
  dgRNA
  Pfdn4
agtgctgtgcgttag

SEQ ID NO: 50220 - DNA, 15 bp, Artificial Sequence
  dgRNA
  Tmem178
gcggggagccggctt

SEQ ID NO: 50221 - DNA, 15 bp, Artificial Sequence
  dgRNA
  Tmem178
cggggagccggctta

SEQ ID NO: 50222 - DNA, 15 bp, Artificial Sequence
  dgRNA
  Tmem178
gggagccggcttagg

SEQ ID NO: 50223 - DNA, 15 bp, Artificial Sequence
  dgRNA
  Tmem178
agccggcttaggggg

SEQ ID NO: 50224 - DNA, 15 bp, Artificial Sequence
  dgRNA
  Rnf121
ccttcttaattccga

SEQ ID NO: 50225 - DNA, 15 bp, Artificial Sequence
  dgRNA
  Rnf121
taattccgaaggagc

SEQ ID NO: 50226 - DNA, 15 bp, Artificial Sequence
  dgRNA
  Rnf121
aggtagacggtctct

SEQ ID NO: 50227 - DNA, 15 bp, Artificial Sequence
  dgRNA
  Rnf121
cttgctgctccgccc

SEQ ID NO: 50228 - DNA, 15 bp, Artificial Sequence
  dgRNA
  E2f3
acccccgattatttt

SEQ ID NO: 50229 - DNA, 15 bp, Artificial Sequence
  dgRNA
  E2f3
attatttttggcccc

SEQ ID NO: 50230 - DNA, 15 bp, Artificial Sequence
  dgRNA
  E2f3
ttatttttggccccc

SEQ ID NO: 50231 - DNA, 15 bp, Artificial Sequence
  dgRNA
  E2f3
cccccggggcctgtg

SEQ ID NO: 50232 - DNA, 15 bp, Artificial Sequence
  dgRNA
  Gpr68
gcgctcactcaggtc

SEQ ID NO: 50233 - DNA, 15 bp, Artificial Sequence
  dgRNA
  Gpr68
gacctgagtgagcgc

SEQ ID NO: 50234 - DNA, 15 bp, Artificial Sequence
  dgRNA
  Plppr5
ggtgactggtacccc

SEQ ID NO: 50235 - DNA, 15 bp, Artificial Sequence
  dgRNA
  Plppr5
caagcagctaatcag

SEQ ID NO: 50236 - DNA, 15 bp, Artificial Sequence
  dgRNA
  Plppr5
gagaaaggctatacg

SEQ ID NO: 50237 - DNA, 15 bp, Artificial Sequence
  dgRNA
  Plppr5
gttcagggaattgca

SEQ ID NO: 50238 - DNA, 15 bp, Artificial Sequence
  dgRNA
  Trim21
gagttgagtggcaag

SEQ ID NO: 50239 - DNA, 15 bp, Artificial Sequence
  dgRNA
  Ndufc1
acagcccactaagtc

SEQ ID NO: 50240 - DNA, 15 bp, Artificial Sequence
  dgRNA
  Ndufc1
cagcccactaagtcc

SEQ ID NO: 50241 - DNA, 15 bp, Artificial Sequence
  dgRNA
  Ndufc1
ctaagtccgggttct

SEQ ID NO: 50242 - DNA, 15 bp, Artificial Sequence
  dgRNA
  Ndufc1
taagtccgggttctt

SEQ ID NO: 50243 - DNA, 15 bp, Artificial Sequence
  dgRNA
  Arhgap28
gtttgttaatcggcc

SEQ ID NO: 50244 - DNA, 15 bp, Artificial Sequence
  dgRNA
  Arhgap28
cccggtgtactctgt

SEQ ID NO: 50245 - DNA, 15 bp, Artificial Sequence
  dgRNA
  Arhgap28
gtgcgccttgttttg

SEQ ID NO: 50246 - DNA, 15 bp, Artificial Sequence
  dgRNA
  Arhgap28
tgcgccttgttttgt

SEQ ID NO: 50247 - DNA, 15 bp, Artificial Sequence
  dgRNA
  Il1rap
ccgcgtgggccactg

SEQ ID NO: 50248 - DNA, 15 bp, Artificial Sequence
  dgRNA
  Slc22a7
ggtcctggtgtactc

SEQ ID NO: 50249 - DNA, 15 bp, Artificial Sequence
  dgRNA
  Slc22a7
tggatcctacctaag

SEQ ID NO: 50250 - DNA, 15 bp, Artificial Sequence
  dgRNA
  Slc22a7
atggatcctacctaa

SEQ ID NO: 50251 - DNA, 15 bp, Artificial Sequence
  dgRNA
  Slc22a7
aatggatcctaccta

SEQ ID NO: 50252 - DNA, 15 bp, Artificial Sequence
  dgRNA
  Il1rl1
aaattctatgatggg

SEQ ID NO: 50253 - DNA, 15 bp, Artificial Sequence
  dgRNA
  Il1rl1
aattctatgatgggc

SEQ ID NO: 50254 - DNA, 15 bp, Artificial Sequence
  dgRNA
  Egln1
ggagccgcgaggagg

SEQ ID NO: 50255 - DNA, 15 bp, Artificial Sequence
  dgRNA
  Egln1
gagccgcgaggagga

SEQ ID NO: 50256 - DNA, 15 bp, Artificial Sequence
  dgRNA
  Egln1
agccgcgaggaggag

SEQ ID NO: 50257 - DNA, 15 bp, Artificial Sequence
  dgRNA
  Egln1
cccgcccgctaggcc

SEQ ID NO: 50258 - DNA, 15 bp, Artificial Sequence
  dgRNA
  AU022252
aagtccagaagctcg

SEQ ID NO: 50259 - DNA, 15 bp, Artificial Sequence
  dgRNA
  AU022252
cagaagctcgtggca

SEQ ID NO: 50260 - DNA, 15 bp, Artificial Sequence
  dgRNA
  AU022252
cacttactcttcgtg

SEQ ID NO: 50261 - DNA, 15 bp, Artificial Sequence
  dgRNA
  AU022252
gcgtggcttctgtgg

SEQ ID NO: 50262 - DNA, 15 bp, Artificial Sequence
  dgRNA
  Upk3bl
aggctcttgtggagt

SEQ ID NO: 50263 - DNA, 15 bp, Artificial Sequence
  dgRNA
  Upk3bl
tgtggagtcgggtgc

SEQ ID NO: 50264 - DNA, 15 bp, Artificial Sequence
  dgRNA
  Upk3bl
tctgtccgttctttt

SEQ ID NO: 50265 - DNA, 15 bp, Artificial Sequence
  dgRNA
  Upk3bl
ggctataggctctgg

SEQ ID NO: 50266 - DNA, 15 bp, Artificial Sequence
  dgRNA
  1500009L16Rik
gcgaaggtgaacaag

SEQ ID NO: 50267 - DNA, 15 bp, Artificial Sequence
  dgRNA
  1500009L16Rik
accgccaccaatgct

SEQ ID NO: 50268 - DNA, 15 bp, Artificial Sequence
  dgRNA
  1500009L16Rik
ccaggaacgcgcaga

SEQ ID NO: 50269 - DNA, 15 bp, Artificial Sequence
  dgRNA
  1500009L16Rik
cagaaggctgcgcat

SEQ ID NO: 50270 - DNA, 15 bp, Artificial Sequence
  dgRNA
  Eva1c
gacgctctccgcttt

SEQ ID NO: 50271 - DNA, 15 bp, Artificial Sequence
  dgRNA
  Eva1c
tctccgctttgggct

SEQ ID NO: 50272 - DNA, 15 bp, Artificial Sequence
  dgRNA
  Eva1c
ctcggcgcccccgat

SEQ ID NO: 50273 - DNA, 15 bp, Artificial Sequence
  dgRNA
  Eva1c
gcccccgatcggcct

SEQ ID NO: 50274 - DNA, 15 bp, Artificial Sequence
  dgRNA
  Cep68
gctggcacgcgcgtc

SEQ ID NO: 50275 - DNA, 15 bp, Artificial Sequence
  dgRNA
  Cep68
gctccggccacccat

SEQ ID NO: 50276 - DNA, 15 bp, Artificial Sequence
  dgRNA
  Cep68
ggccacccataggcc

SEQ ID NO: 50277 - DNA, 15 bp, Artificial Sequence
  dgRNA
  Cep68
gggggcgggttccca

SEQ ID NO: 50278 - DNA, 15 bp, Artificial Sequence
  dgRNA
  Hnrnpf
gcagcgtactttacc

SEQ ID NO: 50279 - DNA, 15 bp, Artificial Sequence
  dgRNA
  Hnrnpf
ctccaccaccctccg

SEQ ID NO: 50280 - DNA, 15 bp, Artificial Sequence
  dgRNA
  Hnrnpf
caccctccgaggcgc

SEQ ID NO: 50281 - DNA, 15 bp, Artificial Sequence
  dgRNA
  Hnrnpf
cgcccgagcccgcgc

SEQ ID NO: 50282 - DNA, 15 bp, Artificial Sequence
  dgRNA
  Gsn
tatatgtcagaccac

SEQ ID NO: 50283 - DNA, 15 bp, Artificial Sequence
  dgRNA
  Gsn
gccggatcttctgat

SEQ ID NO: 50284 - DNA, 15 bp, Artificial Sequence
  dgRNA
  Gsn
ggaaactagggtcca

SEQ ID NO: 50285 - DNA, 15 bp, Artificial Sequence
  dgRNA
  Gsn
gaaactagggtccaa

SEQ ID NO: 50286 - DNA, 15 bp, Artificial Sequence
  dgRNA
  Cldn7
cctatttcccatcaa

SEQ ID NO: 50287 - DNA, 15 bp, Artificial Sequence
  dgRNA
  Cldn7
tcaacggttagagcc

SEQ ID NO: 50288 - DNA, 15 bp, Artificial Sequence
  dgRNA
  Cldn7
gaaggggcgtgaccc

SEQ ID NO: 50289 - DNA, 15 bp, Artificial Sequence
  dgRNA
  Cldn7
ctcttcacctggacg

SEQ ID NO: 50290 - DNA, 15 bp, Artificial Sequence
  dgRNA
  Mtr
gactacatctcccat

SEQ ID NO: 50291 - DNA, 15 bp, Artificial Sequence
  dgRNA
  Mtr
acggagcaaagcctc

SEQ ID NO: 50292 - DNA, 15 bp, Artificial Sequence
  dgRNA
  Mtr
aaagcctccggcgat

SEQ ID NO: 50293 - DNA, 15 bp, Artificial Sequence
  dgRNA
  Mtr
aagcctccggcgatt

SEQ ID NO: 50294 - DNA, 15 bp, Artificial Sequence
  dgRNA
  Slc35f3
ctcgctaagattcgc

SEQ ID NO: 50295 - DNA, 15 bp, Artificial Sequence
  dgRNA
  Slc35f3
gattcgctggcctca

SEQ ID NO: 50296 - DNA, 15 bp, Artificial Sequence
  dgRNA
  Slc35f3
cgctggcctcatgga

SEQ ID NO: 50297 - DNA, 15 bp, Artificial Sequence
  dgRNA
  Slc35f3
cctggggccgcagtc

SEQ ID NO: 50298 - DNA, 15 bp, Artificial Sequence
  dgRNA
  Nln
acccggctgctcgca

SEQ ID NO: 50299 - DNA, 15 bp, Artificial Sequence
  dgRNA
  Nln
tgctcgcaaggctct

SEQ ID NO: 50300 - DNA, 15 bp, Artificial Sequence
  dgRNA
  Nln
gacgacagtgcttgc

SEQ ID NO: 50301 - DNA, 15 bp, Artificial Sequence
  dgRNA
  Nln
tgctggatccgcccc

SEQ ID NO: 50302 - DNA, 15 bp, Artificial Sequence
  dgRNA
  Leng1
ctcctttttgcccgc

SEQ ID NO: 50303 - DNA, 15 bp, Artificial Sequence
  dgRNA
  Leng1
tggcccagcgagctg

SEQ ID NO: 50304 - DNA, 15 bp, Artificial Sequence
  dgRNA
  Leng1
acttcctgataagtc

SEQ ID NO: 50305 - DNA, 15 bp, Artificial Sequence
  dgRNA
  Leng1
cttcatatcaagtga

SEQ ID NO: 50306 - DNA, 15 bp, Artificial Sequence
  dgRNA
  Prkcq
tccaaacacactcgt

SEQ ID NO: 50307 - DNA, 15 bp, Artificial Sequence
  dgRNA
  Prkcq
tctgtagtggcatag

SEQ ID NO: 50308 - DNA, 15 bp, Artificial Sequence
  dgRNA
  Prkcq
acctacgagtgtgtt

SEQ ID NO: 50309 - DNA, 15 bp, Artificial Sequence
  dgRNA
  Prkcq
aagggctaaggtcgc

SEQ ID NO: 50310 - DNA, 15 bp, Artificial Sequence
  dgRNA
  Actl11
cctcctaaagtcctc

SEQ ID NO: 50311 - DNA, 15 bp, Artificial Sequence
  dgRNA
  Psmc6
tcttctgcgctttcg

SEQ ID NO: 50312 - DNA, 15 bp, Artificial Sequence
  dgRNA
  Psmc6
gctttctgccgctct

SEQ ID NO: 50313 - DNA, 15 bp, Artificial Sequence
  dgRNA
  Psmc6
ctaggtgactgactt

SEQ ID NO: 50314 - DNA, 15 bp, Artificial Sequence
  dgRNA
  Psmc6
actgacttcggcgcc

SEQ ID NO: 50315 - DNA, 15 bp, Artificial Sequence
  dgRNA
  Siglece
tgaactggtgaatgt

SEQ ID NO: 50316 - DNA, 15 bp, Artificial Sequence
  dgRNA
  Siglece
agtagctgatactca

SEQ ID NO: 50317 - DNA, 15 bp, Artificial Sequence
  dgRNA
  Siglece
gtagctgatactcaa

SEQ ID NO: 50318 - DNA, 15 bp, Artificial Sequence
  dgRNA
  Siglece
cacccctgcttccgc

SEQ ID NO: 50319 - DNA, 15 bp, Artificial Sequence
  dgRNA
  Zdhhc14
tcctccgggcgcgcc

SEQ ID NO: 50320 - DNA, 15 bp, Artificial Sequence
  dgRNA
  Zdhhc14
ccgagccttgcgctc

SEQ ID NO: 50321 - DNA, 15 bp, Artificial Sequence
  dgRNA
  Zdhhc14
ccttgcgctctggcc

SEQ ID NO: 50322 - DNA, 15 bp, Artificial Sequence
  dgRNA
  Zdhhc14
ttgcgctctggcccg

SEQ ID NO: 50323 - DNA, 15 bp, Artificial Sequence
  dgRNA
  Robo4
ttgtatgggtacaat

SEQ ID NO: 50324 - DNA, 15 bp, Artificial Sequence
  dgRNA
  Robo4
tgtatgggtacaatt

SEQ ID NO: 50325 - DNA, 15 bp, Artificial Sequence
  dgRNA
  Robo4
aatcttggtctctat

SEQ ID NO: 50326 - DNA, 15 bp, Artificial Sequence
  dgRNA
  Lins1
tcgtaaagctgcccg

SEQ ID NO: 50327 - DNA, 15 bp, Artificial Sequence
  dgRNA
  Lins1
attcgcgacagttag

SEQ ID NO: 50328 - DNA, 15 bp, Artificial Sequence
  dgRNA
  Lins1
cgcgacagttagagg

SEQ ID NO: 50329 - DNA, 15 bp, Artificial Sequence
  dgRNA
  Lins1
gaggcgggctaatag

SEQ ID NO: 50330 - DNA, 15 bp, Artificial Sequence
  dgRNA
  Sun1
aatgttccggtaacc

SEQ ID NO: 50331 - DNA, 15 bp, Artificial Sequence
  dgRNA
  Sun1
ttccggtaacctggt

SEQ ID NO: 50332 - DNA, 15 bp, Artificial Sequence
  dgRNA
  Sun1
tacattctgccaggg

SEQ ID NO: 50333 - DNA, 15 bp, Artificial Sequence
  dgRNA
  Sun1
ggggctctattgtgc

SEQ ID NO: 50334 - DNA, 15 bp, Artificial Sequence
  dgRNA
  Abhd8
agcccttctcggtcc

SEQ ID NO: 50335 - DNA, 15 bp, Artificial Sequence
  dgRNA
  Abhd8
accgcgcgctgatcc

SEQ ID NO: 50336 - DNA, 15 bp, Artificial Sequence
  dgRNA
  Abhd8
ccgcgcgctgatcct

SEQ ID NO: 50337 - DNA, 15 bp, Artificial Sequence
  dgRNA
  Abhd8
gttggacggttatct

SEQ ID NO: 50338 - DNA, 15 bp, Artificial Sequence
  dgRNA
  Cldn18
cacgttccaaccacc

SEQ ID NO: 50339 - DNA, 15 bp, Artificial Sequence
  dgRNA
  Cldn18
acgttccaaccaccc

SEQ ID NO: 50340 - DNA, 15 bp, Artificial Sequence
  dgRNA
  Cldn18
ccatgcccttgaagc

SEQ ID NO: 50341 - DNA, 15 bp, Artificial Sequence
  dgRNA
  Cldn18
aaactgaactatcta

SEQ ID NO: 50342 - DNA, 15 bp, Artificial Sequence
  dgRNA
  Olfr432
atcctgtagatggaa

SEQ ID NO: 50343 - DNA, 15 bp, Artificial Sequence
  dgRNA
  Olfr432
actagtagtcagaag

SEQ ID NO: 50344 - DNA, 15 bp, Artificial Sequence
  dgRNA
  Olfm3
tcaagttgccagcaa

SEQ ID NO: 50345 - DNA, 15 bp, Artificial Sequence
  dgRNA
  Olfm3
ggagcgtaagtcctt

SEQ ID NO: 50346 - DNA, 15 bp, Artificial Sequence
  dgRNA
  Olfm3
acggtattatgaaac

SEQ ID NO: 50347 - DNA, 15 bp, Artificial Sequence
  dgRNA
  Olfm3
agagtcagctgtaca

SEQ ID NO: 50348 - DNA, 15 bp, Artificial Sequence
  dgRNA
  Fmo1
taagtacatatcacc

SEQ ID NO: 50349 - DNA, 15 bp, Artificial Sequence
  dgRNA
  Fmo1
acaacagctaacctt

SEQ ID NO: 50350 - DNA, 15 bp, Artificial Sequence
  dgRNA
  Fmo1
attgggtacttataa

SEQ ID NO: 50351 - DNA, 15 bp, Artificial Sequence
  dgRNA
  Fmo1
gattacttgcaacag

SEQ ID NO: 50352 - DNA, 15 bp, Artificial Sequence
  dgRNA
  Il17b
ggggctgttgaccaa

SEQ ID NO: 50353 - DNA, 15 bp, Artificial Sequence
  dgRNA
  Il17b
cggtgaggggtgtgt

SEQ ID NO: 50354 - DNA, 15 bp, Artificial Sequence
  dgRNA
  Il17b
gggctcactgtcagc

SEQ ID NO: 50355 - DNA, 15 bp, Artificial Sequence
  dgRNA
  Il17b
aattatagctccaca

SEQ ID NO: 50356 - DNA, 15 bp, Artificial Sequence
  dgRNA
  Kat7
tgccccaaacaatca

SEQ ID NO: 50357 - DNA, 15 bp, Artificial Sequence
  dgRNA
  Kat7
cctacctaactaaaa

SEQ ID NO: 50358 - DNA, 15 bp, Artificial Sequence
  dgRNA
  Kat7
aaaaggtctagccga

SEQ ID NO: 50359 - DNA, 15 bp, Artificial Sequence
  dgRNA
  Kat7
cgaaggtttcaccac

SEQ ID NO: 50360 - DNA, 15 bp, Artificial Sequence
  dgRNA
  Pla2g5
gccaattgaatacaa

SEQ ID NO: 50361 - DNA, 15 bp, Artificial Sequence
  dgRNA
  Pla2g5
tggaccggatgtgcc

SEQ ID NO: 50362 - DNA, 15 bp, Artificial Sequence
  dgRNA
  Pla2g5
tggaccggatgtgac

SEQ ID NO: 50363 - DNA, 15 bp, Artificial Sequence
  dgRNA
  Pla2g5
cggtccacagtcagg

SEQ ID NO: 50364 - DNA, 15 bp, Artificial Sequence
  dgRNA
  Mup6
atcaccagaaagtcg

SEQ ID NO: 50365 - DNA, 15 bp, Artificial Sequence
  dgRNA
  Mup6
tttttcttcgcgtat

SEQ ID NO: 50366 - DNA, 15 bp, Artificial Sequence
  dgRNA
  Mup6
ttttttcttcgcgta

SEQ ID NO: 50367 - DNA, 15 bp, Artificial Sequence
  dgRNA
  Mup6
acgactttctggtga

SEQ ID NO: 50368 - DNA, 15 bp, Artificial Sequence
  dgRNA
  Hspb6
caggcgtttaataac

SEQ ID NO: 50369 - DNA, 15 bp, Artificial Sequence
  dgRNA
  Hspb6
actaatgcctgagtt

SEQ ID NO: 50370 - DNA, 15 bp, Artificial Sequence
  dgRNA
  Hspb6
tgagaggcccgccgc

SEQ ID NO: 50371 - DNA, 15 bp, Artificial Sequence
  dgRNA
  Hspb6
gagaggcccgccgca

SEQ ID NO: 50372 - DNA, 15 bp, Artificial Sequence
  dgRNA
  Hax1
tttcctggacctcgg

SEQ ID NO: 50373 - DNA, 15 bp, Artificial Sequence
  dgRNA
  Hax1
ggtgagaatagttct

SEQ ID NO: 50374 - DNA, 15 bp, Artificial Sequence
  dgRNA
  Hax1
ctgggctggatatac

SEQ ID NO: 50375 - DNA, 15 bp, Artificial Sequence
  dgRNA
  Hax1
ggctggatatacggg

SEQ ID NO: 50376 - DNA, 15 bp, Artificial Sequence
  dgRNA
  Ptp4a3
aaccaggattccgtc

SEQ ID NO: 50377 - DNA, 15 bp, Artificial Sequence
  dgRNA
  Ptp4a3
attccgtctggtcag

SEQ ID NO: 50378 - DNA, 15 bp, Artificial Sequence
  dgRNA
  Ptp4a3
gagacgatcctgctc

SEQ ID NO: 50379 - DNA, 15 bp, Artificial Sequence
  dgRNA
  Ptp4a3
agacgatcctgctca

SEQ ID NO: 50380 - DNA, 15 bp, Artificial Sequence
  dgRNA
  Elmod2
ccaggccgagtccac

SEQ ID NO: 50381 - DNA, 15 bp, Artificial Sequence
  dgRNA
  Elmod2
ccacagggaactcgt

SEQ ID NO: 50382 - DNA, 15 bp, Artificial Sequence
  dgRNA
  Elmod2
ggaactcgttggcgc

SEQ ID NO: 50383 - DNA, 15 bp, Artificial Sequence
  dgRNA
  Elmod2
gaactcgttggcgct

SEQ ID NO: 50384 - DNA, 15 bp, Artificial Sequence
  dgRNA
  Zfp383
gcggaacgagctcct

SEQ ID NO: 50385 - DNA, 15 bp, Artificial Sequence
  dgRNA
  Zfp383
aggccgtgctctggc

SEQ ID NO: 50386 - DNA, 15 bp, Artificial Sequence
  dgRNA
  Zfp383
cgggaaatccgagaa

SEQ ID NO: 50387 - DNA, 15 bp, Artificial Sequence
  dgRNA
  Zfp383
cgccagttccaatcg

SEQ ID NO: 50388 - DNA, 15 bp, Artificial Sequence
  dgRNA
  Mgat5b
ggctctccggtctgc

SEQ ID NO: 50389 - DNA, 15 bp, Artificial Sequence
  dgRNA
  Mgat5b
ccctaggaagttgca

SEQ ID NO: 50390 - DNA, 15 bp, Artificial Sequence
  dgRNA
  Mgat5b
gaagttgcatggtcc

SEQ ID NO: 50391 - DNA, 15 bp, Artificial Sequence
  dgRNA
  Mgat5b
aagttgcatggtcca

SEQ ID NO: 50392 - DNA, 15 bp, Artificial Sequence
  dgRNA
  Rin3
aaggaggtcccattt

SEQ ID NO: 50393 - DNA, 15 bp, Artificial Sequence
  dgRNA
  Rin3
gtcccatttgggccg

SEQ ID NO: 50394 - DNA, 15 bp, Artificial Sequence
  dgRNA
  Rin3
tcccatttgggccgt

SEQ ID NO: 50395 - DNA, 15 bp, Artificial Sequence
  dgRNA
  Rin3
gagtgccttgctatc

SEQ ID NO: 50396 - DNA, 15 bp, Artificial Sequence
  dgRNA
  Igsf6
gcactctaaaatgcc

SEQ ID NO: 50397 - DNA, 15 bp, Artificial Sequence
  dgRNA
  Amotl1
aattcaaacgcggat

SEQ ID NO: 50398 - DNA, 15 bp, Artificial Sequence
  dgRNA
  Amotl1
attcaaacgcggata

SEQ ID NO: 50399 - DNA, 15 bp, Artificial Sequence
  dgRNA
  Amotl1
ttcaaacgcggatag

SEQ ID NO: 50400 - DNA, 15 bp, Artificial Sequence
  dgRNA
  Amotl1
ccctttttggtctca

SEQ ID NO: 50401 - DNA, 15 bp, Artificial Sequence
  dgRNA
  Ms4a4d
tctgggcggggtctc

SEQ ID NO: 50402 - DNA, 15 bp, Artificial Sequence
  dgRNA
  Ms4a4d
atctgggcggggtct

SEQ ID NO: 50403 - DNA, 15 bp, Artificial Sequence
  dgRNA
  Pck1
caatcattatctccc

SEQ ID NO: 50404 - DNA, 15 bp, Artificial Sequence
  dgRNA
  Pck1
aaaccgtgctgacca

SEQ ID NO: 50405 - DNA, 15 bp, Artificial Sequence
  dgRNA
  Pck1
atggctatgatccaa

SEQ ID NO: 50406 - DNA, 15 bp, Artificial Sequence
  dgRNA
  Pck1
tgccccttacgtcag

SEQ ID NO: 50407 - DNA, 15 bp, Artificial Sequence
  dgRNA
  Polr3b
tcggaagtacaccag

SEQ ID NO: 50408 - DNA, 15 bp, Artificial Sequence
  dgRNA
  Polr3b
cggaagtacaccagt

SEQ ID NO: 50409 - DNA, 15 bp, Artificial Sequence
  dgRNA
  Polr3b
gtagttttccacatc

SEQ ID NO: 50410 - DNA, 15 bp, Artificial Sequence
  dgRNA
  Polr3b
tttccacatccggct

SEQ ID NO: 50411 - DNA, 15 bp, Artificial Sequence
  dgRNA
  Pik3cd
acctggggtattaag

SEQ ID NO: 50412 - DNA, 15 bp, Artificial Sequence
  dgRNA
  Pik3cd
gtgcaatggtgaggc

SEQ ID NO: 50413 - DNA, 15 bp, Artificial Sequence
  dgRNA
  Pik3cd
tcccgccccattcct

SEQ ID NO: 50414 - DNA, 15 bp, Artificial Sequence
  dgRNA
  Pik3cd
tgctccgcctccgac

SEQ ID NO: 50415 - DNA, 15 bp, Artificial Sequence
  dgRNA
  Itgam
tagacgggtgtcaga

SEQ ID NO: 50416 - DNA, 15 bp, Artificial Sequence
  dgRNA
  Itgam
tgggtgtaaccctga

SEQ ID NO: 50417 - DNA, 15 bp, Artificial Sequence
  dgRNA
  Itgam
gtaaccctgatggtt

SEQ ID NO: 50418 - DNA, 15 bp, Artificial Sequence
  dgRNA
  Itgam
ctgatggttcgggcc

SEQ ID NO: 50419 - DNA, 15 bp, Artificial Sequence
  dgRNA
  Lmbrd2
ctcgtagtcctgcct

SEQ ID NO: 50420 - DNA, 15 bp, Artificial Sequence
  dgRNA
  Lmbrd2
aactccctgcggcgc

SEQ ID NO: 50421 - DNA, 15 bp, Artificial Sequence
  dgRNA
  Lmbrd2
ccctgcggcgccggg

SEQ ID NO: 50422 - DNA, 15 bp, Artificial Sequence
  dgRNA
  Lmbrd2
cctgcggcgccgggc

SEQ ID NO: 50423 - DNA, 15 bp, Artificial Sequence
  dgRNA
  Lyrm1
tctgcagcccaccgg

SEQ ID NO: 50424 - DNA, 15 bp, Artificial Sequence
  dgRNA
  Lyrm1
gcagcccaccggcgg

SEQ ID NO: 50425 - DNA, 15 bp, Artificial Sequence
  dgRNA
  Lyrm1
ttccggtaaccccgc

SEQ ID NO: 50426 - DNA, 15 bp, Artificial Sequence
  dgRNA
  Lyrm1
aaccccgccggccgc

SEQ ID NO: 50427 - DNA, 15 bp, Artificial Sequence
  dgRNA
  Car6
ataaggccactgtcc

SEQ ID NO: 50428 - DNA, 15 bp, Artificial Sequence
  dgRNA
  Car6
gggtgcgctgtgcct

SEQ ID NO: 50429 - DNA, 15 bp, Artificial Sequence
  dgRNA
  Car6
ggtgcgctgtgcctc

SEQ ID NO: 50430 - DNA, 15 bp, Artificial Sequence
  dgRNA
  Car6
ctcgctcatcatcca

SEQ ID NO: 50431 - DNA, 15 bp, Artificial Sequence
  dgRNA
  Ctrc
gaatgcactccacct

SEQ ID NO: 50432 - DNA, 15 bp, Artificial Sequence
  dgRNA
  Ctrc
gtcattaccaaggtt

SEQ ID NO: 50433 - DNA, 15 bp, Artificial Sequence
  dgRNA
  Ctrc
tcattaccaaggtta

SEQ ID NO: 50434 - DNA, 15 bp, Artificial Sequence
  dgRNA
  Ctrc
aggccttgtccggac

SEQ ID NO: 50435 - DNA, 15 bp, Artificial Sequence
  dgRNA
  Tdgf1
cgtgtttgaacacct

SEQ ID NO: 50436 - DNA, 15 bp, Artificial Sequence
  dgRNA
  Tdgf1
ttcctggcctagtaa

SEQ ID NO: 50437 - DNA, 15 bp, Artificial Sequence
  dgRNA
  Tdgf1
tcctggcctagtaat

SEQ ID NO: 50438 - DNA, 15 bp, Artificial Sequence
  dgRNA
  Tdgf1
gcctagtaatgggcg

SEQ ID NO: 50439 - DNA, 15 bp, Artificial Sequence
  dgRNA
  Inpp5a
aacccgcccttccag

SEQ ID NO: 50440 - DNA, 15 bp, Artificial Sequence
  dgRNA
  Inpp5a
agtggacccggagcc

SEQ ID NO: 50441 - DNA, 15 bp, Artificial Sequence
  dgRNA
  Inpp5a
gtggacccggagcca

SEQ ID NO: 50442 - DNA, 15 bp, Artificial Sequence
  dgRNA
  Inpp5a
ctgtagattgtgtgc

SEQ ID NO: 50443 - DNA, 15 bp, Artificial Sequence
  dgRNA
  Rps6
tcgcaaacggagatt

SEQ ID NO: 50444 - DNA, 15 bp, Artificial Sequence
  dgRNA
  Rps6
acagaccccgtcacc

SEQ ID NO: 50445 - DNA, 15 bp, Artificial Sequence
  dgRNA
  Rps6
accccgtcaccagga

SEQ ID NO: 50446 - DNA, 15 bp, Artificial Sequence
  dgRNA
  Rps6
cagctcgctgcaaac

SEQ ID NO: 50447 - DNA, 15 bp, Artificial Sequence
  dgRNA
  Entpd5
cctcttgtccttcgc

SEQ ID NO: 50448 - DNA, 15 bp, Artificial Sequence
  dgRNA
  Entpd5
ggagtctcaccgtgc

SEQ ID NO: 50449 - DNA, 15 bp, Artificial Sequence
  dgRNA
  Entpd5
accgtgctggtgtcc

SEQ ID NO: 50450 - DNA, 15 bp, Artificial Sequence
  dgRNA
  Entpd5
tggtggccgccacct

SEQ ID NO: 50451 - DNA, 15 bp, Artificial Sequence
  dgRNA
  Strn4
ctatagtaactgatg

SEQ ID NO: 50452 - DNA, 15 bp, Artificial Sequence
  dgRNA
  Strn4
gtaactgatgaggat

SEQ ID NO: 50453 - DNA, 15 bp, Artificial Sequence
  dgRNA
  Strn4
taactgatgaggata

SEQ ID NO: 50454 - DNA, 15 bp, Artificial Sequence
  dgRNA
  Strn4
gtgcaatgatagtag

SEQ ID NO: 50455 - DNA, 15 bp, Artificial Sequence
  dgRNA
  Vmn1r44
ccaaaccagtggacc

SEQ ID NO: 50456 - DNA, 15 bp, Artificial Sequence
  dgRNA
  Vmn1r44
tagtgatgtagaatc

SEQ ID NO: 50457 - DNA, 15 bp, Artificial Sequence
  dgRNA
  Vmn1r44
gtagctttacatatc

SEQ ID NO: 50458 - DNA, 15 bp, Artificial Sequence
  dgRNA
  Vmn1r44
ggtttggattattct

SEQ ID NO: 50459 - DNA, 15 bp, Artificial Sequence
  dgRNA
  Marveld1
ggcctgtcatgggcc

SEQ ID NO: 50460 - DNA, 15 bp, Artificial Sequence
  dgRNA
  Marveld1
gcgggcattcagccc

SEQ ID NO: 50461 - DNA, 15 bp, Artificial Sequence
  dgRNA
  Marveld1
aagggggggtagcca

SEQ ID NO: 50462 - DNA, 15 bp, Artificial Sequence
  dgRNA
  Marveld1
ggagggcgcgacggc

SEQ ID NO: 50463 - DNA, 15 bp, Artificial Sequence
  dgRNA
  Ntrk2
gtgcacacagcgcgg

SEQ ID NO: 50464 - DNA, 15 bp, Artificial Sequence
  dgRNA
  Ntrk2
cggcggttgcgcatc

SEQ ID NO: 50465 - DNA, 15 bp, Artificial Sequence
  dgRNA
  Ntrk2
gcgcagttcctaatg

SEQ ID NO: 50466 - DNA, 15 bp, Artificial Sequence
  dgRNA
  Ntrk2
atgcggtggtagcaa

SEQ ID NO: 50467 - DNA, 15 bp, Artificial Sequence
  dgRNA
  Wdr74
gcctttttgaaggtt

SEQ ID NO: 50468 - DNA, 15 bp, Artificial Sequence
  dgRNA
  Wdr74
ggctaaatgacagtt

SEQ ID NO: 50469 - DNA, 15 bp, Artificial Sequence
  dgRNA
  Wdr74
gctaaatgacagttt

SEQ ID NO: 50470 - DNA, 15 bp, Artificial Sequence
  dgRNA
  Wdr74
ttgtcagactgaatc

SEQ ID NO: 50471 - DNA, 15 bp, Artificial Sequence
  dgRNA
  Lrp10
gacacgtagcagtta

SEQ ID NO: 50472 - DNA, 15 bp, Artificial Sequence
  dgRNA
  Lrp10
acgtagcagttacgg

SEQ ID NO: 50473 - DNA, 15 bp, Artificial Sequence
  dgRNA
  Lrp10
cgtagcagttacggc

SEQ ID NO: 50474 - DNA, 15 bp, Artificial Sequence
  dgRNA
  Lrp10
tctgaaagataacgc

SEQ ID NO: 50475 - DNA, 15 bp, Artificial Sequence
  dgRNA
  Slk
gccgcgccgccagcc

SEQ ID NO: 50476 - DNA, 15 bp, Artificial Sequence
  dgRNA
  Slk
gccagcgcgcgtgcg

SEQ ID NO: 50477 - DNA, 15 bp, Artificial Sequence
  dgRNA
  Slk
cagcgcgcgtgcgcg

SEQ ID NO: 50478 - DNA, 15 bp, Artificial Sequence
  dgRNA
  Slk
cgtgcgcggggccag

SEQ ID NO: 50479 - DNA, 15 bp, Artificial Sequence
  dgRNA
  Sytl3
ctattccggctcatt

SEQ ID NO: 50480 - DNA, 15 bp, Artificial Sequence
  dgRNA
  Sytl3
agccggaatagtcgc

SEQ ID NO: 50481 - DNA, 15 bp, Artificial Sequence
  dgRNA
  Sytl3
gaggaccaaatgagc

SEQ ID NO: 50482 - DNA, 15 bp, Artificial Sequence
  dgRNA
  Spatc1l
cactcaatccctctg

SEQ ID NO: 50483 - DNA, 15 bp, Artificial Sequence
  dgRNA
  Spatc1l
aagaaggacgttcct

SEQ ID NO: 50484 - DNA, 15 bp, Artificial Sequence
  dgRNA
  Spatc1l
cgttccttggctttg

SEQ ID NO: 50485 - DNA, 15 bp, Artificial Sequence
  dgRNA
  Spatc1l
ggcgccgcctcttta

SEQ ID NO: 50486 - DNA, 15 bp, Artificial Sequence
  dgRNA
  Prrg1
gcagcttttctagct

SEQ ID NO: 50487 - DNA, 15 bp, Artificial Sequence
  dgRNA
  Prrg1
ttaaccctcttgatg

SEQ ID NO: 50488 - DNA, 15 bp, Artificial Sequence
  dgRNA
  Prrg1
taaccctcttgatgt

SEQ ID NO: 50489 - DNA, 15 bp, Artificial Sequence
  dgRNA
  Prrg1
tccccaaactaggcc

SEQ ID NO: 50490 - DNA, 15 bp, Artificial Sequence
  dgRNA
  Utp14a
gcagtgcggaccaac

SEQ ID NO: 50491 - DNA, 15 bp, Artificial Sequence
  dgRNA
  Utp14a
tgcggaccaactggc

SEQ ID NO: 50492 - DNA, 15 bp, Artificial Sequence
  dgRNA
  Utp14a
tccatcgaccaatcc

SEQ ID NO: 50493 - DNA, 15 bp, Artificial Sequence
  dgRNA
  Utp14a
ttgcaagcctccccc

SEQ ID NO: 50494 - DNA, 15 bp, Artificial Sequence
  dgRNA
  Prep
ggtcgccgagcggcg

SEQ ID NO: 50495 - DNA, 15 bp, Artificial Sequence
  dgRNA
  Prep
ccgagcggcgtggcg

SEQ ID NO: 50496 - DNA, 15 bp, Artificial Sequence
  dgRNA
  Prep
gctcctccgtgcgcc

SEQ ID NO: 50497 - DNA, 15 bp, Artificial Sequence
  dgRNA
  Prep
ctcctccgtgcgccc

SEQ ID NO: 50498 - DNA, 15 bp, Artificial Sequence
  dgRNA
  Asap1
tcgccgcgcccgcga

SEQ ID NO: 50499 - DNA, 15 bp, Artificial Sequence
  dgRNA
  Asap1
atcgcgggcgcggcg

SEQ ID NO: 50500 - DNA, 15 bp, Artificial Sequence
  dgRNA
  Asap1
attccatcgcgggcg

SEQ ID NO: 50501 - DNA, 15 bp, Artificial Sequence
  dgRNA
  Asap1
gcattattccatcgc

SEQ ID NO: 50502 - DNA, 15 bp, Artificial Sequence
  dgRNA
  Commd5
cgtctgttcttcaca

SEQ ID NO: 50503 - DNA, 15 bp, Artificial Sequence
  dgRNA
  Commd5
caaaacactgttaga

SEQ ID NO: 50504 - DNA, 15 bp, Artificial Sequence
  dgRNA
  Commd5
tagaaggcaagcgac

SEQ ID NO: 50505 - DNA, 15 bp, Artificial Sequence
  dgRNA
  Commd5
aggcaagcgaccggg

SEQ ID NO: 50506 - DNA, 15 bp, Artificial Sequence
  dgRNA
  Hsf5
gagaggggccggttc

SEQ ID NO: 50507 - DNA, 15 bp, Artificial Sequence
  dgRNA
  Hsf5
ctggaaggcacgcga

SEQ ID NO: 50508 - DNA, 15 bp, Artificial Sequence
  dgRNA
  Hsf5
cgctgctgccctcga

SEQ ID NO: 50509 - DNA, 15 bp, Artificial Sequence
  dgRNA
  Hsf5
cgtgcatcccaaccg

SEQ ID NO: 50510 - DNA, 15 bp, Artificial Sequence
  dgRNA
  Thoc5
cactaattcacactc

SEQ ID NO: 50511 - DNA, 15 bp, Artificial Sequence
  dgRNA
  Thoc5
ttcacactccggtga

SEQ ID NO: 50512 - DNA, 15 bp, Artificial Sequence
  dgRNA
  Thoc5
tcacactccggtgaa

SEQ ID NO: 50513 - DNA, 15 bp, Artificial Sequence
  dgRNA
  Thoc5
cacactccggtgaag

SEQ ID NO: 50514 - DNA, 15 bp, Artificial Sequence
  dgRNA
  Clcn1
gagggaattccctgt

SEQ ID NO: 50515 - DNA, 15 bp, Artificial Sequence
  dgRNA
  Clcn1
gttggactgtcccac

SEQ ID NO: 50516 - DNA, 15 bp, Artificial Sequence
  dgRNA
  Clcn1
tgcttcgaccccaga

SEQ ID NO: 50517 - DNA, 15 bp, Artificial Sequence
  dgRNA
  Clcn1
gatcagatgtggcgg

SEQ ID NO: 50518 - DNA, 15 bp, Artificial Sequence
  dgRNA
  Trp53i11
ccccctagccaagcg

SEQ ID NO: 50519 - DNA, 15 bp, Artificial Sequence
  dgRNA
  Trp53i11
cccctagccaagcga

SEQ ID NO: 50520 - DNA, 15 bp, Artificial Sequence
  dgRNA
  Trp53i11
gggtgcgccctccgc

SEQ ID NO: 50521 - DNA, 15 bp, Artificial Sequence
  dgRNA
  Trp53i11
tgcgccctccgcagg

SEQ ID NO: 50522 - DNA, 15 bp, Artificial Sequence
  dgRNA
  Trim15
aagcaaaggaatcgg

SEQ ID NO: 50523 - DNA, 15 bp, Artificial Sequence
  dgRNA
  Dnajc17
ttgcactcaccaagg

SEQ ID NO: 50524 - DNA, 15 bp, Artificial Sequence
  dgRNA
  Dnajc17
gcactcaccaaggcg

SEQ ID NO: 50525 - DNA, 15 bp, Artificial Sequence
  dgRNA
  Dnajc17
ctcaccaaggcgggg

SEQ ID NO: 50526 - DNA, 15 bp, Artificial Sequence
  dgRNA
  Dnajc17
aaggcggggcggcag

SEQ ID NO: 50527 - DNA, 15 bp, Artificial Sequence
  dgRNA
  Snrpa1
caccctcaagcttta

SEQ ID NO: 50528 - DNA, 15 bp, Artificial Sequence
  dgRNA
  Snrpa1
taaggtgactgtacc

SEQ ID NO: 50529 - DNA, 15 bp, Artificial Sequence
  dgRNA
  Snrpa1
ggcaatccagcctac

SEQ ID NO: 50530 - DNA, 15 bp, Artificial Sequence
  dgRNA
  Snrpa1
ccaagttagacattt

SEQ ID NO: 50531 - DNA, 15 bp, Artificial Sequence
  dgRNA
  Tnfrsf1a
caaaggagtccgaac

SEQ ID NO: 50532 - DNA, 15 bp, Artificial Sequence
  dgRNA
  Tnfrsf1a
cgaactggaattctg

SEQ ID NO: 50533 - DNA, 15 bp, Artificial Sequence
  dgRNA
  Tnfrsf1a
ggtgttaagtgggtt

SEQ ID NO: 50534 - DNA, 15 bp, Artificial Sequence
  dgRNA
  Tnfrsf1a
tggggcgccaagcta

SEQ ID NO: 50535 - DNA, 15 bp, Artificial Sequence
  dgRNA
  Tmem63a
cttgtgggcgttagc

SEQ ID NO: 50536 - DNA, 15 bp, Artificial Sequence
  dgRNA
  Tmem63a
gggcgttagctggtc

SEQ ID NO: 50537 - DNA, 15 bp, Artificial Sequence
  dgRNA
  Tmem63a
ccctagacctccgtg

SEQ ID NO: 50538 - DNA, 15 bp, Artificial Sequence
  dgRNA
  Tmem63a
gaggacggccacgcg

SEQ ID NO: 50539 - DNA, 15 bp, Artificial Sequence
  dgRNA
  Paqr7
agatctagacaaatc

SEQ ID NO: 50540 - DNA, 15 bp, Artificial Sequence
  dgRNA
  Paqr7
agggagagcgacatc

SEQ ID NO: 50541 - DNA, 15 bp, Artificial Sequence
  dgRNA
  Paqr7
gctgcgtcccaaact

SEQ ID NO: 50542 - DNA, 15 bp, Artificial Sequence
  dgRNA
  Paqr7
agctgcgtcccaaac

SEQ ID NO: 50543 - DNA, 15 bp, Artificial Sequence
  dgRNA
  Txlna
taatttcggaccctc

SEQ ID NO: 50544 - DNA, 15 bp, Artificial Sequence
  dgRNA
  Txlna
aatttcggaccctca

SEQ ID NO: 50545 - DNA, 15 bp, Artificial Sequence
  dgRNA
  Txlna
gaccctcagggtatt

SEQ ID NO: 50546 - DNA, 15 bp, Artificial Sequence
  dgRNA
  Txlna
ggctcctatgctttt

SEQ ID NO: 50547 - DNA, 15 bp, Artificial Sequence
  dgRNA
  Itgb1bp2
ctcgcccaagttcca

SEQ ID NO: 50548 - DNA, 15 bp, Artificial Sequence
  dgRNA
  Itgb1bp2
tcgcccaagttccaa

SEQ ID NO: 50549 - DNA, 15 bp, Artificial Sequence
  dgRNA
  Itgb1bp2
cacttttctattggc

SEQ ID NO: 50550 - DNA, 15 bp, Artificial Sequence
  dgRNA
  Itgb1bp2
cttggaacttgggcg

SEQ ID NO: 50551 - DNA, 15 bp, Artificial Sequence
  dgRNA
  Sptan1
ctctccgtactgcag

SEQ ID NO: 50552 - DNA, 15 bp, Artificial Sequence
  dgRNA
  Sptan1
tctcgcgtcgccaac

SEQ ID NO: 50553 - DNA, 15 bp, Artificial Sequence
  dgRNA
  Sptan1
ctcgcgtcgccaacc

SEQ ID NO: 50554 - DNA, 15 bp, Artificial Sequence
  dgRNA
  Sptan1
tcgcgtcgccaaccg

SEQ ID NO: 50555 - DNA, 15 bp, Artificial Sequence
  dgRNA
  Ifna2
gaacccacatgcgtg

SEQ ID NO: 50556 - DNA, 15 bp, Artificial Sequence
  dgRNA
  Ifna2
aacccacatgcgtga

SEQ ID NO: 50557 - DNA, 15 bp, Artificial Sequence
  dgRNA
  Ifna2
acccacatgcgtgag

SEQ ID NO: 50558 - DNA, 15 bp, Artificial Sequence
  dgRNA
  Ifna2
cccacatgcgtgagg

SEQ ID NO: 50559 - DNA, 15 bp, Artificial Sequence
  dgRNA
  Htt
tggccctcttcacta

SEQ ID NO: 50560 - DNA, 15 bp, Artificial Sequence
  dgRNA
  Htt
ggccctcttcactaa

SEQ ID NO: 50561 - DNA, 15 bp, Artificial Sequence
  dgRNA
  Htt
gccctcttcactaag

SEQ ID NO: 50562 - DNA, 15 bp, Artificial Sequence
  dgRNA
  Htt
ccctcttcactaagg

SEQ ID NO: 50563 - DNA, 15 bp, Artificial Sequence
  dgRNA
  Btg2
atgacctcagcgcct

SEQ ID NO: 50564 - DNA, 15 bp, Artificial Sequence
  dgRNA
  Btg2
gcgcctgggaggcgc

SEQ ID NO: 50565 - DNA, 15 bp, Artificial Sequence
  dgRNA
  Btg2
gcgcgggcgagctgg

SEQ ID NO: 50566 - DNA, 15 bp, Artificial Sequence
  dgRNA
  Btg2
cgcgggcgagctggc

SEQ ID NO: 50567 - DNA, 15 bp, Artificial Sequence
  dgRNA
  Cflar
ctccgccctcttgtt

SEQ ID NO: 50568 - DNA, 15 bp, Artificial Sequence
  dgRNA
  Cflar
ctaacaagagggcgg

SEQ ID NO: 50569 - DNA, 15 bp, Artificial Sequence
  dgRNA
  Cflar
acaatcctaacaaga

SEQ ID NO: 50570 - DNA, 15 bp, Artificial Sequence
  dgRNA
  Cflar
cacaatcctaacaag

SEQ ID NO: 50571 - DNA, 15 bp, Artificial Sequence
  dgRNA
  Amz2
gtatgaggaaccgtc

SEQ ID NO: 50572 - DNA, 15 bp, Artificial Sequence
  dgRNA
  Amz2
tatgaggaaccgtca

SEQ ID NO: 50573 - DNA, 15 bp, Artificial Sequence
  dgRNA
  Amz2
aggaaccgtcagggc

SEQ ID NO: 50574 - DNA, 15 bp, Artificial Sequence
  dgRNA
  Amz2
ggaaccgtcagggct

SEQ ID NO: 50575 - DNA, 15 bp, Artificial Sequence
  dgRNA
  Sntb2
gacaacctcgcctcc

SEQ ID NO: 50576 - DNA, 15 bp, Artificial Sequence
  dgRNA
  Sntb2
ctcgcctcccggaag

SEQ ID NO: 50577 - DNA, 15 bp, Artificial Sequence
  dgRNA
  Sntb2
cggaagcggcctcgc

SEQ ID NO: 50578 - DNA, 15 bp, Artificial Sequence
  dgRNA
  Sntb2
cgcccctccggaaag

SEQ ID NO: 50579 - DNA, 15 bp, Artificial Sequence
  dgRNA
  Lrrc45
cccaaccaatgaacg

SEQ ID NO: 50580 - DNA, 15 bp, Artificial Sequence
  dgRNA
  Lrrc45
tggaacgcgaccctg

SEQ ID NO: 50581 - DNA, 15 bp, Artificial Sequence
  dgRNA
  Lrrc45
aagcgttccccaagc

SEQ ID NO: 50582 - DNA, 15 bp, Artificial Sequence
  dgRNA
  Lrrc45
tccgcaatgcctcct

SEQ ID NO: 50583 - DNA, 15 bp, Artificial Sequence
  dgRNA
  Olfr866
acaggtgcacaatag

SEQ ID NO: 50584 - DNA, 15 bp, Artificial Sequence
  dgRNA
  Olfr866
tacatcctcataaac

SEQ ID NO: 50585 - DNA, 15 bp, Artificial Sequence
  dgRNA
  Ndufs6
agattttccgtgggt

SEQ ID NO: 50586 - DNA, 15 bp, Artificial Sequence
  dgRNA
  Ndufs6
atgcagattttccgt

SEQ ID NO: 50587 - DNA, 15 bp, Artificial Sequence
  dgRNA
  Ndufs6
aatgcagattttccg

SEQ ID NO: 50588 - DNA, 15 bp, Artificial Sequence
  dgRNA
  Ndufs6
gtgcttttatgccaa

SEQ ID NO: 50589 - DNA, 15 bp, Artificial Sequence
  dgRNA
  Krtap22-2
ccccacatgccattc

SEQ ID NO: 50590 - DNA, 15 bp, Artificial Sequence
  dgRNA
  Krtap22-2
agatcatgaaactcc

SEQ ID NO: 50591 - DNA, 15 bp, Artificial Sequence
  dgRNA
  Krtap22-2
cctgaatggcatgtg

SEQ ID NO: 50592 - DNA, 15 bp, Artificial Sequence
  dgRNA
  Krtap22-2
gcctgaatggcatgt

SEQ ID NO: 50593 - DNA, 15 bp, Artificial Sequence
  dgRNA
  Fancc
ggccgcaagggagtg

SEQ ID NO: 50594 - DNA, 15 bp, Artificial Sequence
  dgRNA
  Fancc
cggccgcaagggagt

SEQ ID NO: 50595 - DNA, 15 bp, Artificial Sequence
  dgRNA
  Gga3
gcgcacctcactccc

SEQ ID NO: 50596 - DNA, 15 bp, Artificial Sequence
  dgRNA
  Gga3
cgcacctcactccca

SEQ ID NO: 50597 - DNA, 15 bp, Artificial Sequence
  dgRNA
  Gga3
cccggaccagcgaag

SEQ ID NO: 50598 - DNA, 15 bp, Artificial Sequence
  dgRNA
  Gga3
gagcgcgcagcgcgg

SEQ ID NO: 50599 - DNA, 15 bp, Artificial Sequence
  dgRNA
  Sema3f
ggctgcatacggaaa

SEQ ID NO: 50600 - DNA, 15 bp, Artificial Sequence
  dgRNA
  Sema3f
ggtctttgcctccta

SEQ ID NO: 50601 - DNA, 15 bp, Artificial Sequence
  dgRNA
  Dfnb59
aagccctttcaactg

SEQ ID NO: 50602 - DNA, 15 bp, Artificial Sequence
  dgRNA
  Dfnb59
tacccgagttcatga

SEQ ID NO: 50603 - DNA, 15 bp, Artificial Sequence
  dgRNA
  Dfnb59
acccgagttcatgaa

SEQ ID NO: 50604 - DNA, 15 bp, Artificial Sequence
  dgRNA
  Dfnb59
cgagttcatgaaggg

SEQ ID NO: 50605 - DNA, 15 bp, Artificial Sequence
  dgRNA
  Dgkg
cgcgcgggtgtgtgg

SEQ ID NO: 50606 - DNA, 15 bp, Artificial Sequence
  dgRNA
  Dgkg
gcgcgggtgtgtggc

SEQ ID NO: 50607 - DNA, 15 bp, Artificial Sequence
  dgRNA
  Dgkg
cgcgggtgtgtggcg

SEQ ID NO: 50608 - DNA, 15 bp, Artificial Sequence
  dgRNA
  Dgkg
ggcgggcactgcgcc

SEQ ID NO: 50609 - DNA, 15 bp, Artificial Sequence
  dgRNA
  Gypc
cacccgggtctcctg

SEQ ID NO: 50610 - DNA, 15 bp, Artificial Sequence
  dgRNA
  Gypc
acccgggtctcctgt

SEQ ID NO: 50611 - DNA, 15 bp, Artificial Sequence
  dgRNA
  Gypc
tttcccgtgctctca

SEQ ID NO: 50612 - DNA, 15 bp, Artificial Sequence
  dgRNA
  Gypc
ttcccgtgctctcac

SEQ ID NO: 50613 - DNA, 15 bp, Artificial Sequence
  dgRNA
  Cdk9
tcctgcgcccccgat

SEQ ID NO: 50614 - DNA, 15 bp, Artificial Sequence
  dgRNA
  Cdk9
cctgcgcccccgatc

SEQ ID NO: 50615 - DNA, 15 bp, Artificial Sequence
  dgRNA
  Cdk9
ctgcgcccccgatcg

SEQ ID NO: 50616 - DNA, 15 bp, Artificial Sequence
  dgRNA
  Cdk9
ggccgccaacagcgc

SEQ ID NO: 50617 - DNA, 15 bp, Artificial Sequence
  dgRNA
  Hmx1
ccgacgcccgcctcg

SEQ ID NO: 50618 - DNA, 15 bp, Artificial Sequence
  dgRNA
  Hmx1
ccgacgccctcactc

SEQ ID NO: 50619 - DNA, 15 bp, Artificial Sequence
  dgRNA
  Hmx1
cgacgccctcactcc

SEQ ID NO: 50620 - DNA, 15 bp, Artificial Sequence
  dgRNA
  Hmx1
cctcactccgggcag

SEQ ID NO: 50621 - DNA, 15 bp, Artificial Sequence
  dgRNA
  Gon4l
atgaactgacgtacc

SEQ ID NO: 50622 - DNA, 15 bp, Artificial Sequence
  dgRNA
  Gon4l
tgaactgacgtacca

SEQ ID NO: 50623 - DNA, 15 bp, Artificial Sequence
  dgRNA
  Gon4l
gacgtaccagggctg

SEQ ID NO: 50624 - DNA, 15 bp, Artificial Sequence
  dgRNA
  Gon4l
gtaggcctgatttcg

SEQ ID NO: 50625 - DNA, 15 bp, Artificial Sequence
  dgRNA
  Adh1
atactacacacccca

SEQ ID NO: 50626 - DNA, 15 bp, Artificial Sequence
  dgRNA
  Adh1
gacggagatctcgac

SEQ ID NO: 50627 - DNA, 15 bp, Artificial Sequence
  dgRNA
  Adh1
acggagatctcgaca

SEQ ID NO: 50628 - DNA, 15 bp, Artificial Sequence
  dgRNA
  Adh1
atggggtgtgtagta

SEQ ID NO: 50629 - DNA, 15 bp, Artificial Sequence
  dgRNA
  Pak6
attgccaggcaacgt

SEQ ID NO: 50630 - DNA, 15 bp, Artificial Sequence
  dgRNA
  Pak6
ctgctcgcgccctac

SEQ ID NO: 50631 - DNA, 15 bp, Artificial Sequence
  dgRNA
  Pak6
tcgggggttgccatg

SEQ ID NO: 50632 - DNA, 15 bp, Artificial Sequence
  dgRNA
  Pak6
ttttgatatcgtcgg

SEQ ID NO: 50633 - DNA, 15 bp, Artificial Sequence
  dgRNA
  Snip1
cttcagcctcccggg

SEQ ID NO: 50634 - DNA, 15 bp, Artificial Sequence
  dgRNA
  Snip1
cgtggccactcgcgc

SEQ ID NO: 50635 - DNA, 15 bp, Artificial Sequence
  dgRNA
  Snip1
ggggccccgcccatc

SEQ ID NO: 50636 - DNA, 15 bp, Artificial Sequence
  dgRNA
  Snip1
ggccccgcccatcag

SEQ ID NO: 50637 - DNA, 15 bp, Artificial Sequence
  dgRNA
  Abo
tcctgtacacacgcc

SEQ ID NO: 50638 - DNA, 15 bp, Artificial Sequence
  dgRNA
  Abo
cctgtacacacgcct

SEQ ID NO: 50639 - DNA, 15 bp, Artificial Sequence
  dgRNA
  Abo
ttcttccccgcccac

SEQ ID NO: 50640 - DNA, 15 bp, Artificial Sequence
  dgRNA
  Abo
ggtatctccaaccac

SEQ ID NO: 50641 - DNA, 15 bp, Artificial Sequence
  dgRNA
  Aldh7a1
caccgccatttgcag

SEQ ID NO: 50642 - DNA, 15 bp, Artificial Sequence
  dgRNA
  Aldh7a1
gcagaggcctatcgc

SEQ ID NO: 50643 - DNA, 15 bp, Artificial Sequence
  dgRNA
  Aldh7a1
cagaggcctatcgct

SEQ ID NO: 50644 - DNA, 15 bp, Artificial Sequence
  dgRNA
  Aldh7a1
agaggcctatcgctg

SEQ ID NO: 50645 - DNA, 15 bp, Artificial Sequence
  dgRNA
  Npff
ttctaaggttccccc

SEQ ID NO: 50646 - DNA, 15 bp, Artificial Sequence
  dgRNA
  Npff
agtctatataactcc

SEQ ID NO: 50647 - DNA, 15 bp, Artificial Sequence
  dgRNA
  Npff
gtccccaggggagta

SEQ ID NO: 50648 - DNA, 15 bp, Artificial Sequence
  dgRNA
  Npff
tccccaggggagtac

SEQ ID NO: 50649 - DNA, 15 bp, Artificial Sequence
  dgRNA
  Fzd1
tcctccggtctgctg

SEQ ID NO: 50650 - DNA, 15 bp, Artificial Sequence
  dgRNA
  Fzd1
ctgcgggctccagtc

SEQ ID NO: 50651 - DNA, 15 bp, Artificial Sequence
  dgRNA
  Fzd1
tgcgggctccagtcc

SEQ ID NO: 50652 - DNA, 15 bp, Artificial Sequence
  dgRNA
  Fzd1
gctccagtccgggct

SEQ ID NO: 50653 - DNA, 15 bp, Artificial Sequence
  dgRNA
  Gnmt
ctgtcttactaagcc

SEQ ID NO: 50654 - DNA, 15 bp, Artificial Sequence
  dgRNA
  Gnmt
tactaagccaggtcc

SEQ ID NO: 50655 - DNA, 15 bp, Artificial Sequence
  dgRNA
  Gnmt
taagtgcggatcgcg

SEQ ID NO: 50656 - DNA, 15 bp, Artificial Sequence
  dgRNA
  Gnmt
ctcgccagggtggcc

SEQ ID NO: 50657 - DNA, 15 bp, Artificial Sequence
  dgRNA
  Baz2a
gcgctcgtcctcacc

SEQ ID NO: 50658 - DNA, 15 bp, Artificial Sequence
  dgRNA
  Baz2a
cgctcgtcctcaccc

SEQ ID NO: 50659 - DNA, 15 bp, Artificial Sequence
  dgRNA
  Baz2a
tcgtcctcacccggg

SEQ ID NO: 50660 - DNA, 15 bp, Artificial Sequence
  dgRNA
  Baz2a
ctccgccgccggcct

SEQ ID NO: 50661 - DNA, 15 bp, Artificial Sequence
  dgRNA
  Gm5416
tgctgcatcccttac

SEQ ID NO: 50662 - DNA, 15 bp, Artificial Sequence
  dgRNA
  Serpinb1c
aaagtaattgcccct

SEQ ID NO: 50663 - DNA, 15 bp, Artificial Sequence
  dgRNA
  Serpinb1c
aagtaattgcccctt

SEQ ID NO: 50664 - DNA, 15 bp, Artificial Sequence
  dgRNA
  Serpinb1c
ttctgcgtactataa

SEQ ID NO: 50665 - DNA, 15 bp, Artificial Sequence
  dgRNA
  Serpinb1c
tataaaggcaacacc

SEQ ID NO: 50666 - DNA, 15 bp, Artificial Sequence
  dgRNA
  Trim25
gcacctggtagccct

SEQ ID NO: 50667 - DNA, 15 bp, Artificial Sequence
  dgRNA
  Trim25
cacctggtagccctt

SEQ ID NO: 50668 - DNA, 15 bp, Artificial Sequence
  dgRNA
  Trim25
gggtcgtgcgtcgct

SEQ ID NO: 50669 - DNA, 15 bp, Artificial Sequence
  dgRNA
  Trim25
ggtcgtgcgtcgctc

SEQ ID NO: 50670 - DNA, 15 bp, Artificial Sequence
  dgRNA
  Syngr2
taggacatatttccc

SEQ ID NO: 50671 - DNA, 15 bp, Artificial Sequence
  dgRNA
  Syngr2
cccccttccgcaccc

SEQ ID NO: 50672 - DNA, 15 bp, Artificial Sequence
  dgRNA
  Syngr2
cttccacgagtttgg

SEQ ID NO: 50673 - DNA, 15 bp, Artificial Sequence
  dgRNA
  Syngr2
ttccacgagtttgga

SEQ ID NO: 50674 - DNA, 15 bp, Artificial Sequence
  dgRNA
  Pdgfd
cagacgctgtgacgc

SEQ ID NO: 50675 - DNA, 15 bp, Artificial Sequence
  dgRNA
  Pdgfd
gcagccgctgtccac

SEQ ID NO: 50676 - DNA, 15 bp, Artificial Sequence
  dgRNA
  Pdgfd
gccgctgtccaccgg

SEQ ID NO: 50677 - DNA, 15 bp, Artificial Sequence
  dgRNA
  Pdgfd
ccgctgtccaccgga

SEQ ID NO: 50678 - DNA, 15 bp, Artificial Sequence
  dgRNA
  Zfp207
ggtggagatagaacg

SEQ ID NO: 50679 - DNA, 15 bp, Artificial Sequence
  dgRNA
  Zfp207
atagaacgagggtgt

SEQ ID NO: 50680 - DNA, 15 bp, Artificial Sequence
  dgRNA
  Zfp207
tcctgcgggacgcgc

SEQ ID NO: 50681 - DNA, 15 bp, Artificial Sequence
  dgRNA
  Zfp207
tgcgggacgcgctgg

SEQ ID NO: 50682 - DNA, 15 bp, Artificial Sequence
  dgRNA
  Abi3
cagatgccccgacct

SEQ ID NO: 50683 - DNA, 15 bp, Artificial Sequence
  dgRNA
  Abi3
gtcaccacgggattg

SEQ ID NO: 50684 - DNA, 15 bp, Artificial Sequence
  dgRNA
  Abi3
gggatgagtcaccac

SEQ ID NO: 50685 - DNA, 15 bp, Artificial Sequence
  dgRNA
  Abi3
ggctggcctgctatg

SEQ ID NO: 50686 - DNA, 15 bp, Artificial Sequence
  dgRNA
  Radil
acctctacattccac

SEQ ID NO: 50687 - DNA, 15 bp, Artificial Sequence
  dgRNA
  Radil
gttggtgacgtcctg

SEQ ID NO: 50688 - DNA, 15 bp, Artificial Sequence
  dgRNA
  Radil
gcagaatcgtaaagt

SEQ ID NO: 50689 - DNA, 15 bp, Artificial Sequence
  dgRNA
  Iqcf1
gcgattcccgtgact

SEQ ID NO: 50690 - DNA, 15 bp, Artificial Sequence
  dgRNA
  Iqcf1
cgctctgggcattta

SEQ ID NO: 50691 - DNA, 15 bp, Artificial Sequence
  dgRNA
  Iqcf1
gcccttatgacatca

SEQ ID NO: 50692 - DNA, 15 bp, Artificial Sequence
  dgRNA
  Iqcf1
ggtccattgatgtaa

SEQ ID NO: 50693 - DNA, 15 bp, Artificial Sequence
  dgRNA
  Neto1
aatgcccctttgagt

SEQ ID NO: 50694 - DNA, 15 bp, Artificial Sequence
  dgRNA
  Neto1
tgaaaggcgtggaag

SEQ ID NO: 50695 - DNA, 15 bp, Artificial Sequence
  dgRNA
  Neto1
tggttcgtgggggat

SEQ ID NO: 50696 - DNA, 15 bp, Artificial Sequence
  dgRNA
  Neto1
ttggttcgtggggga

SEQ ID NO: 50697 - DNA, 15 bp, Artificial Sequence
  dgRNA
  Zfp597
tgccaggtgcgattc

SEQ ID NO: 50698 - DNA, 15 bp, Artificial Sequence
  dgRNA
  Zfp597
tgcgattcaggtcct

SEQ ID NO: 50699 - DNA, 15 bp, Artificial Sequence
  dgRNA
  Zfp597
gcgattcaggtcctc

SEQ ID NO: 50700 - DNA, 15 bp, Artificial Sequence
  dgRNA
  Zfp597
tcaattggtccatta

SEQ ID NO: 50701 - DNA, 15 bp, Artificial Sequence
  dgRNA
  Ghrhr
cacggagtcccattt

SEQ ID NO: 50702 - DNA, 15 bp, Artificial Sequence
  dgRNA
  Ghrhr
acggagtcccattta

SEQ ID NO: 50703 - DNA, 15 bp, Artificial Sequence
  dgRNA
  Ghrhr
cgttcaatattcagc

SEQ ID NO: 50704 - DNA, 15 bp, Artificial Sequence
  dgRNA
  Ghrhr
cacaccagttgctac

SEQ ID NO: 50705 - DNA, 15 bp, Artificial Sequence
  dgRNA
  Lrrc26
cccccgcccaagttg

SEQ ID NO: 50706 - DNA, 15 bp, Artificial Sequence
  dgRNA
  Lrrc26
cctcaacttgggcgg

SEQ ID NO: 50707 - DNA, 15 bp, Artificial Sequence
  dgRNA
  Lrrc26
tcctcaacttgggcg

SEQ ID NO: 50708 - DNA, 15 bp, Artificial Sequence
  dgRNA
  Lrrc26
ttcctcaacttgggc

SEQ ID NO: 50709 - DNA, 15 bp, Artificial Sequence
  dgRNA
  Strn4
gcccgcgcgcaccac

SEQ ID NO: 50710 - DNA, 15 bp, Artificial Sequence
  dgRNA
  Strn4
cccgcgcgcaccacc

SEQ ID NO: 50711 - DNA, 15 bp, Artificial Sequence
  dgRNA
  Strn4
ccgcgcgcaccaccg

SEQ ID NO: 50712 - DNA, 15 bp, Artificial Sequence
  dgRNA
  Strn4
ccaccggggtcgacc

SEQ ID NO: 50713 - DNA, 15 bp, Artificial Sequence
  dgRNA
  Lrrc17
gatgtgacgcgcctg

SEQ ID NO: 50714 - DNA, 15 bp, Artificial Sequence
  dgRNA
  Lrrc17
ctatagtagcaatcc

SEQ ID NO: 50715 - DNA, 15 bp, Artificial Sequence
  dgRNA
  Lrrc17
gctactataggcgcc

SEQ ID NO: 50716 - DNA, 15 bp, Artificial Sequence
  dgRNA
  Lrrc17
caggattgctactat

SEQ ID NO: 50717 - DNA, 15 bp, Artificial Sequence
  dgRNA
  Sel1l2
aatggcagactaaat

SEQ ID NO: 50718 - DNA, 15 bp, Artificial Sequence
  dgRNA
  Sel1l2
atggcagactaaata

SEQ ID NO: 50719 - DNA, 15 bp, Artificial Sequence
  dgRNA
  Sel1l2
attggcccaagagtg

SEQ ID NO: 50720 - DNA, 15 bp, Artificial Sequence
  dgRNA
  Sel1l2
acttcctaatacgga

SEQ ID NO: 50721 - DNA, 15 bp, Artificial Sequence
  dgRNA
  Glrx2
agcccggcggcggcg

SEQ ID NO: 50722 - DNA, 15 bp, Artificial Sequence
  dgRNA
  Glrx2
gcgcggacagcccga

SEQ ID NO: 50723 - DNA, 15 bp, Artificial Sequence
  dgRNA
  Glrx2
cgcggacagcccgat

SEQ ID NO: 50724 - DNA, 15 bp, Artificial Sequence
  dgRNA
  Glrx2
gcggacagcccgatg

SEQ ID NO: 50725 - DNA, 15 bp, Artificial Sequence
  dgRNA
  Fam214a
cgagctagccgaccc

SEQ ID NO: 50726 - DNA, 15 bp, Artificial Sequence
  dgRNA
  Fam214a
gccgacccaggagtg

SEQ ID NO: 50727 - DNA, 15 bp, Artificial Sequence
  dgRNA
  Fam214a
aagacttccaacacg

SEQ ID NO: 50728 - DNA, 15 bp, Artificial Sequence
  dgRNA
  Fam214a
tttaggcaacttgaa

SEQ ID NO: 50729 - DNA, 15 bp, Artificial Sequence
  dgRNA
  Clec4a3
atcacgagtagaact

SEQ ID NO: 50730 - DNA, 15 bp, Artificial Sequence
  dgRNA
  Clec4a3
gaggcctgattgcgg

SEQ ID NO: 50731 - DNA, 15 bp, Artificial Sequence
  dgRNA
  Clec4a3
aggcctgattgcgga

SEQ ID NO: 50732 - DNA, 15 bp, Artificial Sequence
  dgRNA
  Clec4a3
tgcggagggtgcctc

SEQ ID NO: 50733 - DNA, 15 bp, Artificial Sequence
  dgRNA
  Fam83c
cacacacgaagggcc

SEQ ID NO: 50734 - DNA, 15 bp, Artificial Sequence
  dgRNA
  Fam83c
gccacttccccgagc

SEQ ID NO: 50735 - DNA, 15 bp, Artificial Sequence
  dgRNA
  Fam83c
tgggactgacccgac

SEQ ID NO: 50736 - DNA, 15 bp, Artificial Sequence
  dgRNA
  Fam83c
cccgacaggttccca

SEQ ID NO: 50737 - DNA, 15 bp, Artificial Sequence
  dgRNA
  Nmnat1
tccgtcctccctgat

SEQ ID NO: 50738 - DNA, 15 bp, Artificial Sequence
  dgRNA
  Nmnat1
ccctgatcggaaaac

SEQ ID NO: 50739 - DNA, 15 bp, Artificial Sequence
  dgRNA
  Nmnat1
cctgccgcccgctag

SEQ ID NO: 50740 - DNA, 15 bp, Artificial Sequence
  dgRNA
  Nmnat1
ccgctagcggatccc

SEQ ID NO: 50741 - DNA, 15 bp, Artificial Sequence
  dgRNA
  Gtf2ird1
ggtgtctcaattcta

SEQ ID NO: 50742 - DNA, 15 bp, Artificial Sequence
  dgRNA
  Gtf2ird1
ctaaggcccgccttt

SEQ ID NO: 50743 - DNA, 15 bp, Artificial Sequence
  dgRNA
  Gtf2ird1
taaggcccgcctttt

SEQ ID NO: 50744 - DNA, 15 bp, Artificial Sequence
  dgRNA
  Gtf2ird1
aaggcccgccttttg

SEQ ID NO: 50745 - DNA, 15 bp, Artificial Sequence
  dgRNA
  Kctd14
gcccaaagaaccaat

SEQ ID NO: 50746 - DNA, 15 bp, Artificial Sequence
  dgRNA
  Kctd14
caatggggtccgtgc

SEQ ID NO: 50747 - DNA, 15 bp, Artificial Sequence
  dgRNA
  Kctd14
gacttagagttcctc

SEQ ID NO: 50748 - DNA, 15 bp, Artificial Sequence
  dgRNA
  Kctd14
agttcctcaggggcg

SEQ ID NO: 50749 - DNA, 15 bp, Artificial Sequence
  dgRNA
  Tnfsf4
cactcaattcataac

SEQ ID NO: 50750 - DNA, 15 bp, Artificial Sequence
  dgRNA
  Tnfsf4
actcaattcataact

SEQ ID NO: 50751 - DNA, 15 bp, Artificial Sequence
  dgRNA
  Tnfsf4
aactccctgttagcc

SEQ ID NO: 50752 - DNA, 15 bp, Artificial Sequence
  dgRNA
  Tnfsf4
tccctgttagcccgg

SEQ ID NO: 50753 - DNA, 15 bp, Artificial Sequence
  dgRNA
  Zfp51
taccagatccacttc

SEQ ID NO: 50754 - DNA, 15 bp, Artificial Sequence
  dgRNA
  Zfp51
gggcgagctgacagc

SEQ ID NO: 50755 - DNA, 15 bp, Artificial Sequence
  dgRNA
  Zfp51
ggcgagctgacagct

SEQ ID NO: 50756 - DNA, 15 bp, Artificial Sequence
  dgRNA
  Zfp51
agggacgggtctccg

SEQ ID NO: 50757 - DNA, 15 bp, Artificial Sequence
  dgRNA
  Aak1
acggcccctgagaag

SEQ ID NO: 50758 - DNA, 15 bp, Artificial Sequence
  dgRNA
  Aak1
gagaagcacttccgg

SEQ ID NO: 50759 - DNA, 15 bp, Artificial Sequence
  dgRNA
  Aak1
agcacttccggtggc

SEQ ID NO: 50760 - DNA, 15 bp, Artificial Sequence
  dgRNA
  Aak1
gtggcaggtcacttc

SEQ ID NO: 50761 - DNA, 15 bp, Artificial Sequence
  dgRNA
  2410004B18Rik
tctccgcccatgagt

SEQ ID NO: 50762 - DNA, 15 bp, Artificial Sequence
  dgRNA
  2410004B18Rik
ccatgagtaggagcg

SEQ ID NO: 50763 - DNA, 15 bp, Artificial Sequence
  dgRNA
  2410004B18Rik
gcggctccgccgcta

SEQ ID NO: 50764 - DNA, 15 bp, Artificial Sequence
  dgRNA
  2410004B18Rik
cggctccgccgctag

SEQ ID NO: 50765 - DNA, 15 bp, Artificial Sequence
  dgRNA
  Npc2
gctccgcccctagca

SEQ ID NO: 50766 - DNA, 15 bp, Artificial Sequence
  dgRNA
  Npc2
aatccccgcctagcc

SEQ ID NO: 50767 - DNA, 15 bp, Artificial Sequence
  dgRNA
  Npc2
atccccgcctagcct

SEQ ID NO: 50768 - DNA, 15 bp, Artificial Sequence
  dgRNA
  Npc2
tgggcttccggagga

SEQ ID NO: 50769 - DNA, 15 bp, Artificial Sequence
  dgRNA
  Pde6h
gatgcccctgtcatt

SEQ ID NO: 50770 - DNA, 15 bp, Artificial Sequence
  dgRNA
  Pde6h
tccttgcatctggtt

SEQ ID NO: 50771 - DNA, 15 bp, Artificial Sequence
  dgRNA
  Pde6h
ctaagcctatgacgc

SEQ ID NO: 50772 - DNA, 15 bp, Artificial Sequence
  dgRNA
  Pde6h
taagcctatgacgct

SEQ ID NO: 50773 - DNA, 15 bp, Artificial Sequence
  dgRNA
  Cyp2b9
gaatagcgaatgagc

SEQ ID NO: 50774 - DNA, 15 bp, Artificial Sequence
  dgRNA
  Cyp2b9
atacatgcgaaaata

SEQ ID NO: 50775 - DNA, 15 bp, Artificial Sequence
  dgRNA
  Cyp2b9
gatacatgcgaaaat

SEQ ID NO: 50776 - DNA, 15 bp, Artificial Sequence
  dgRNA
  Mmp9
gcctgacttggcaat

SEQ ID NO: 50777 - DNA, 15 bp, Artificial Sequence
  dgRNA
  Mmp9
cctgacttggcaatg

SEQ ID NO: 50778 - DNA, 15 bp, Artificial Sequence
  dgRNA
  Mmp9
gagtcagcataagcc

SEQ ID NO: 50779 - DNA, 15 bp, Artificial Sequence
  dgRNA
  Mmp9
attgccaagtcaggc

SEQ ID NO: 50780 - DNA, 15 bp, Artificial Sequence
  dgRNA
  Slc25a21
tacgatcaaaaagta

SEQ ID NO: 50781 - DNA, 15 bp, Artificial Sequence
  dgRNA
  Slc25a21
tcgactgcttgatgc

SEQ ID NO: 50782 - DNA, 15 bp, Artificial Sequence
  dgRNA
  Slc25a21
gtcgactgcttgatg

SEQ ID NO: 50783 - DNA, 15 bp, Artificial Sequence
  dgRNA
  Ccdc146
agactgacagccgat

SEQ ID NO: 50784 - DNA, 15 bp, Artificial Sequence
  dgRNA
  Ccdc146
acagccgattggtag

SEQ ID NO: 50785 - DNA, 15 bp, Artificial Sequence
  dgRNA
  Ccdc146
ttgcttcaagcccat

SEQ ID NO: 50786 - DNA, 15 bp, Artificial Sequence
  dgRNA
  Ccdc146
atgtaactgaccaat

SEQ ID NO: 50787 - DNA, 15 bp, Artificial Sequence
  dgRNA
  Prss42
gggaggtctctatca

SEQ ID NO: 50788 - DNA, 15 bp, Artificial Sequence
  dgRNA
  Prss42
ctcctgacagaacgg

SEQ ID NO: 50789 - DNA, 15 bp, Artificial Sequence
  dgRNA
  Prss42
tcctgacagaacgga

SEQ ID NO: 50790 - DNA, 15 bp, Artificial Sequence
  dgRNA
  Prss42
gcggccacgtgagcc

SEQ ID NO: 50791 - DNA, 15 bp, Artificial Sequence
  dgRNA
  Immt
cgtgcgcagtggtgc

SEQ ID NO: 50792 - DNA, 15 bp, Artificial Sequence
  dgRNA
  Immt
gcgcagtggtgccgg

SEQ ID NO: 50793 - DNA, 15 bp, Artificial Sequence
  dgRNA
  Immt
tgccggtggcccttc

SEQ ID NO: 50794 - DNA, 15 bp, Artificial Sequence
  dgRNA
  Immt
gcccttccggtgcgc

SEQ ID NO: 50795 - DNA, 15 bp, Artificial Sequence
  dgRNA
  Dmxl2
gccgcgtccccgcgc

SEQ ID NO: 50796 - DNA, 15 bp, Artificial Sequence
  dgRNA
  Dmxl2
cctctccctggcgcg

SEQ ID NO: 50797 - DNA, 15 bp, Artificial Sequence
  dgRNA
  Dmxl2
tggcgcgcggcgtga

SEQ ID NO: 50798 - DNA, 15 bp, Artificial Sequence
  dgRNA
  Dmxl2
cgcttgcgcgctctc

SEQ ID NO: 50799 - DNA, 15 bp, Artificial Sequence
  dgRNA
  Mta2
tttcgacgccactgc

SEQ ID NO: 50800 - DNA, 15 bp, Artificial Sequence
  dgRNA
  Mta2
ttcgacgccactgcc

SEQ ID NO: 50801 - DNA, 15 bp, Artificial Sequence
  dgRNA
  Mta2
tcgacgccactgccg

SEQ ID NO: 50802 - DNA, 15 bp, Artificial Sequence
  dgRNA
  Mta2
ctcctcaccgccctc

SEQ ID NO: 50803 - DNA, 15 bp, Artificial Sequence
  dgRNA
  Arhgap17
gccgggaagcgatgt

SEQ ID NO: 50804 - DNA, 15 bp, Artificial Sequence
  dgRNA
  Arhgap17
ggaagcgatgtaggt

SEQ ID NO: 50805 - DNA, 15 bp, Artificial Sequence
  dgRNA
  Arhgap17
gtaggacccgccaga

SEQ ID NO: 50806 - DNA, 15 bp, Artificial Sequence
  dgRNA
  Arhgap17
acctacatcgcttcc

SEQ ID NO: 50807 - DNA, 15 bp, Artificial Sequence
  dgRNA
  Zfyve19
ttactcgctccgagc

SEQ ID NO: 50808 - DNA, 15 bp, Artificial Sequence
  dgRNA
  Zfyve19
gcgcgctaagcctcc

SEQ ID NO: 50809 - DNA, 15 bp, Artificial Sequence
  dgRNA
  Zfyve19
cgcgctaagcctcct

SEQ ID NO: 50810 - DNA, 15 bp, Artificial Sequence
  dgRNA
  Zfyve19
cgattctcgtctgac

SEQ ID NO: 50811 - DNA, 15 bp, Artificial Sequence
  dgRNA
  Taf4b
attctgctgaagact

SEQ ID NO: 50812 - DNA, 15 bp, Artificial Sequence
  dgRNA
  Taf4b
gactcggagctactc

SEQ ID NO: 50813 - DNA, 15 bp, Artificial Sequence
  dgRNA
  Taf4b
cgcgattcctctcgc

SEQ ID NO: 50814 - DNA, 15 bp, Artificial Sequence
  dgRNA
  Taf4b
agaaggtcgaacttc

SEQ ID NO: 50815 - DNA, 15 bp, Artificial Sequence
  dgRNA
  Krtap1-4
gactatagcagatga

SEQ ID NO: 50816 - DNA, 15 bp, Artificial Sequence
  dgRNA
  Krtap1-4
ttgcaacttgcgtca

SEQ ID NO: 50817 - DNA, 15 bp, Artificial Sequence
  dgRNA
  Krtap1-4
tgcaacttgcgtcaa

SEQ ID NO: 50818 - DNA, 15 bp, Artificial Sequence
  dgRNA
  Krtap1-4
tgaatacgcagctat

SEQ ID NO: 50819 - DNA, 15 bp, Artificial Sequence
  dgRNA
  Il17ra
ttaaaacgggttcct

SEQ ID NO: 50820 - DNA, 15 bp, Artificial Sequence
  dgRNA
  Il17ra
cctgggccaaggcgg

SEQ ID NO: 50821 - DNA, 15 bp, Artificial Sequence
  dgRNA
  Il17ra
gccaaggcggaggcg

SEQ ID NO: 50822 - DNA, 15 bp, Artificial Sequence
  dgRNA
  Il17ra
aagccccgccccgag

SEQ ID NO: 50823 - DNA, 15 bp, Artificial Sequence
  dgRNA
  Dppa5a
ttcgaatacacatac

SEQ ID NO: 50824 - DNA, 15 bp, Artificial Sequence
  dgRNA
  Dppa5a
tagttagcttgaatc

SEQ ID NO: 50825 - DNA, 15 bp, Artificial Sequence
  dgRNA
  Dppa5a
tagcttgaatcaggc

SEQ ID NO: 50826 - DNA, 15 bp, Artificial Sequence
  dgRNA
  Dppa5a
cctgcgggagccgcc

SEQ ID NO: 50827 - DNA, 15 bp, Artificial Sequence
  dgRNA
  Vpreb3
gatagggcctgaccc

SEQ ID NO: 50828 - DNA, 15 bp, Artificial Sequence
  dgRNA
  Vpreb3
tcgtccttcagtcag

SEQ ID NO: 50829 - DNA, 15 bp, Artificial Sequence
  dgRNA
  Vpreb3
cgtccttcagtcagt

SEQ ID NO: 50830 - DNA, 15 bp, Artificial Sequence
  dgRNA
  Vpreb3
ttgcatgctctattg

SEQ ID NO: 50831 - DNA, 15 bp, Artificial Sequence
  dgRNA
  Fkbp1b
cccctttcagccagt

SEQ ID NO: 50832 - DNA, 15 bp, Artificial Sequence
  dgRNA
  Fkbp1b
ccagtgggttaatgg

SEQ ID NO: 50833 - DNA, 15 bp, Artificial Sequence
  dgRNA
  Fkbp1b
taatggtggttagtc

SEQ ID NO: 50834 - DNA, 15 bp, Artificial Sequence
  dgRNA
  Fkbp1b
gtggttagtctggcc

SEQ ID NO: 50835 - DNA, 15 bp, Artificial Sequence
  dgRNA
  Tcta
tcctttaagcaagca

SEQ ID NO: 50836 - DNA, 15 bp, Artificial Sequence
  dgRNA
  Tcta
tttaagcaagcaggg

SEQ ID NO: 50837 - DNA, 15 bp, Artificial Sequence
  dgRNA
  Tcta
ctgggtgcgcctgcg

SEQ ID NO: 50838 - DNA, 15 bp, Artificial Sequence
  dgRNA
  Tcta
cgcgtgcgcactgac

SEQ ID NO: 50839 - DNA, 15 bp, Artificial Sequence
  dgRNA
  Rictor
cccgtgtccccccgc

SEQ ID NO: 50840 - DNA, 15 bp, Artificial Sequence
  dgRNA
  Rictor
ccgtgtccccccgcc

SEQ ID NO: 50841 - DNA, 15 bp, Artificial Sequence
  dgRNA
  Rictor
cgtgtccccccgccg

SEQ ID NO: 50842 - DNA, 15 bp, Artificial Sequence
  dgRNA
  Rictor
gtgtccccccgccgg

SEQ ID NO: 50843 - DNA, 15 bp, Artificial Sequence
  dgRNA
  Cmip
ccaacccgttcgcgc

SEQ ID NO: 50844 - DNA, 15 bp, Artificial Sequence
  dgRNA
  Cmip
tcccgttcgtccccg

SEQ ID NO: 50845 - DNA, 15 bp, Artificial Sequence
  dgRNA
  Cmip
cccgttcgtccccgc

SEQ ID NO: 50846 - DNA, 15 bp, Artificial Sequence
  dgRNA
  Cmip
ccgttcgtccccgcg

SEQ ID NO: 50847 - DNA, 15 bp, Artificial Sequence
  dgRNA
  Zswim5
gtctcctcgcgcccg

SEQ ID NO: 50848 - DNA, 15 bp, Artificial Sequence
  dgRNA
  Zswim5
tcctcgcgcccgcgg

SEQ ID NO: 50849 - DNA, 15 bp, Artificial Sequence
  dgRNA
  Zswim5
cgcggcggccccgga

SEQ ID NO: 50850 - DNA, 15 bp, Artificial Sequence
  dgRNA
  Zswim5
cgcgtcgcctcgcgc

SEQ ID NO: 50851 - DNA, 15 bp, Artificial Sequence
  dgRNA
  Alg6
ctaaccccagccgcc

SEQ ID NO: 50852 - DNA, 15 bp, Artificial Sequence
  dgRNA
  Alg6
ggcttctcgaattcc

SEQ ID NO: 50853 - DNA, 15 bp, Artificial Sequence
  dgRNA
  Alg6
gcttctcgaattcca

SEQ ID NO: 50854 - DNA, 15 bp, Artificial Sequence
  dgRNA
  Alg6
ccgcctcccgcaacg

SEQ ID NO: 50855 - DNA, 15 bp, Artificial Sequence
  dgRNA
  Mxi1
gactacatctcccgg

SEQ ID NO: 50856 - DNA, 15 bp, Artificial Sequence
  dgRNA
  Mxi1
gagtccaccatgcgc

SEQ ID NO: 50857 - DNA, 15 bp, Artificial Sequence
  dgRNA
  Mxi1
tgcgcaggcgtactg

SEQ ID NO: 50858 - DNA, 15 bp, Artificial Sequence
  dgRNA
  Mxi1
gcaggcgtactgagg

SEQ ID NO: 50859 - DNA, 15 bp, Artificial Sequence
  dgRNA
  Sec14l2
caacattttggggta

SEQ ID NO: 50860 - DNA, 15 bp, Artificial Sequence
  dgRNA
  Sec14l2
cccggtccagccttg

SEQ ID NO: 50861 - DNA, 15 bp, Artificial Sequence
  dgRNA
  Sec14l2
cccaagtagctcctc

SEQ ID NO: 50862 - DNA, 15 bp, Artificial Sequence
  dgRNA
  Sec14l2
tatgagcaagcattc

SEQ ID NO: 50863 - DNA, 15 bp, Artificial Sequence
  dgRNA
  Atp5j
accgcgcccgtgcga

SEQ ID NO: 50864 - DNA, 15 bp, Artificial Sequence
  dgRNA
  Atp5j
ccgcgcccgtgcgac

SEQ ID NO: 50865 - DNA, 15 bp, Artificial Sequence
  dgRNA
  Atp5j
ccgcgtcccgcaacg

SEQ ID NO: 50866 - DNA, 15 bp, Artificial Sequence
  dgRNA
  Atp5j
tcccgcaacgcggcc

SEQ ID NO: 50867 - DNA, 15 bp, Artificial Sequence
  dgRNA
  Prr30
aggactccggtgttg

SEQ ID NO: 50868 - DNA, 15 bp, Artificial Sequence
  dgRNA
  Prr30
ggactccggtgttga

SEQ ID NO: 50869 - DNA, 15 bp, Artificial Sequence
  dgRNA
  Ncl
cagtcaacgtccgcc

SEQ ID NO: 50870 - DNA, 15 bp, Artificial Sequence
  dgRNA
  Ncl
agtcaacgtccgcct

SEQ ID NO: 50871 - DNA, 15 bp, Artificial Sequence
  dgRNA
  Ncl
acgagtcccgccctc

SEQ ID NO: 50872 - DNA, 15 bp, Artificial Sequence
  dgRNA
  Ncl
tcaggagcagacgtc

SEQ ID NO: 50873 - DNA, 15 bp, Artificial Sequence
  dgRNA
  Taf12
gattcacgccgtggt

SEQ ID NO: 50874 - DNA, 15 bp, Artificial Sequence
  dgRNA
  Taf12
attcacgccgtggta

SEQ ID NO: 50875 - DNA, 15 bp, Artificial Sequence
  dgRNA
  Taf12
ttcacgccgtggtag

SEQ ID NO: 50876 - DNA, 15 bp, Artificial Sequence
  dgRNA
  Taf12
ccgacctgccaagcc

SEQ ID NO: 50877 - DNA, 15 bp, Artificial Sequence
  dgRNA
  Cldn19
actattgagacaggg

SEQ ID NO: 50878 - DNA, 15 bp, Artificial Sequence
  dgRNA
  Cldn19
tcccccttttaacca

SEQ ID NO: 50879 - DNA, 15 bp, Artificial Sequence
  dgRNA
  Epha7
caacccgactccgct

SEQ ID NO: 50880 - DNA, 15 bp, Artificial Sequence
  dgRNA
  Epha7
ccgctcggcgttgat

SEQ ID NO: 50881 - DNA, 15 bp, Artificial Sequence
  dgRNA
  Epha7
gattggctcctgctc

SEQ ID NO: 50882 - DNA, 15 bp, Artificial Sequence
  dgRNA
  Epha7
aggaccccgcctcca

SEQ ID NO: 50883 - DNA, 15 bp, Artificial Sequence
  dgRNA
  Ccnl1
agagtccgggttatc

SEQ ID NO: 50884 - DNA, 15 bp, Artificial Sequence
  dgRNA
  Ccnl1
ccggacccctccgcc

SEQ ID NO: 50885 - DNA, 15 bp, Artificial Sequence
  dgRNA
  Ccnl1
tcaccgaccgaagcg

SEQ ID NO: 50886 - DNA, 15 bp, Artificial Sequence
  dgRNA
  Ccnl1
ccgaccgaagcgcgg

SEQ ID NO: 50887 - DNA, 15 bp, Artificial Sequence
  dgRNA
  Larp4
gcgttttgcacagcc

SEQ ID NO: 50888 - DNA, 15 bp, Artificial Sequence
  dgRNA
  Larp4
ttgcacagcccggcg

SEQ ID NO: 50889 - DNA, 15 bp, Artificial Sequence
  dgRNA
  Larp4
gagcgaagcacgcac

SEQ ID NO: 50890 - DNA, 15 bp, Artificial Sequence
  dgRNA
  Larp4
agcgaagcacgcaca

SEQ ID NO: 50891 - DNA, 15 bp, Artificial Sequence
  dgRNA
  Tex19.1
cactcaggtggcgca

SEQ ID NO: 50892 - DNA, 15 bp, Artificial Sequence
  dgRNA
  Tex19.1
actcaggtggcgcaa

SEQ ID NO: 50893 - DNA, 15 bp, Artificial Sequence
  dgRNA
  Tex19.1
gctttgggacctcat

SEQ ID NO: 50894 - DNA, 15 bp, Artificial Sequence
  dgRNA
  Tex19.1
gagctggagcatcgc

SEQ ID NO: 50895 - DNA, 15 bp, Artificial Sequence
  dgRNA
  Sav1
agccgcgtccgcgcc

SEQ ID NO: 50896 - DNA, 15 bp, Artificial Sequence
  dgRNA
  Sav1
cgcgtccgcgcccgg

SEQ ID NO: 50897 - DNA, 15 bp, Artificial Sequence
  dgRNA
  Sav1
gcgtccgcgcccggc

SEQ ID NO: 50898 - DNA, 15 bp, Artificial Sequence
  dgRNA
  Sav1
cgtccgcgcccggcg

SEQ ID NO: 50899 - DNA, 15 bp, Artificial Sequence
  dgRNA
  Samd1
gccgccgctccgccg

SEQ ID NO: 50900 - DNA, 15 bp, Artificial Sequence
  dgRNA
  Samd1
aggcgctgcgccccc

SEQ ID NO: 50901 - DNA, 15 bp, Artificial Sequence
  dgRNA
  Samd1
ggcgctgcgcccccc

SEQ ID NO: 50902 - DNA, 15 bp, Artificial Sequence
  dgRNA
  Samd1
gctgcgccccccggg

SEQ ID NO: 50903 - DNA, 15 bp, Artificial Sequence
  dgRNA
  Asic3
cttcaagccctacca

SEQ ID NO: 50904 - DNA, 15 bp, Artificial Sequence
  dgRNA
  Asic3
taccatggaccgctg

SEQ ID NO: 50905 - DNA, 15 bp, Artificial Sequence
  dgRNA
  Asic3
tcctcctggcgcctc

SEQ ID NO: 50906 - DNA, 15 bp, Artificial Sequence
  dgRNA
  Asic3
aacccagatagacat

SEQ ID NO: 50907 - DNA, 15 bp, Artificial Sequence
  dgRNA
  Lipe
ctatcctttctggat

SEQ ID NO: 50908 - DNA, 15 bp, Artificial Sequence
  dgRNA
  Lipe
ccagtttatcgcccc

SEQ ID NO: 50909 - DNA, 15 bp, Artificial Sequence
  dgRNA
  Lipe
acctcctatccagaa

SEQ ID NO: 50910 - DNA, 15 bp, Artificial Sequence
  dgRNA
  Lipe
gggactagtggggta

SEQ ID NO: 50911 - DNA, 15 bp, Artificial Sequence
  dgRNA
  1700093K21Rik
agcactccttcctta

SEQ ID NO: 50912 - DNA, 15 bp, Artificial Sequence
  dgRNA
  1700093K21Rik
caaagtatccatcta

SEQ ID NO: 50913 - DNA, 15 bp, Artificial Sequence
  dgRNA
  1700093K21Rik
gcaacgtcttcccta

SEQ ID NO: 50914 - DNA, 15 bp, Artificial Sequence
  dgRNA
  1700093K21Rik
ctacaggttagtgat

SEQ ID NO: 50915 - DNA, 15 bp, Artificial Sequence
  dgRNA
  Hephl1
gcaactctcccattg

SEQ ID NO: 50916 - DNA, 15 bp, Artificial Sequence
  dgRNA
  Hephl1
ttataactcgctctg

SEQ ID NO: 50917 - DNA, 15 bp, Artificial Sequence
  dgRNA
  Hephl1
tataactcgctctga

SEQ ID NO: 50918 - DNA, 15 bp, Artificial Sequence
  dgRNA
  Hephl1
taactcgctctgagg

SEQ ID NO: 50919 - DNA, 15 bp, Artificial Sequence
  dgRNA
  Prl7a1
ttggggatgattcaa

SEQ ID NO: 50920 - DNA, 15 bp, Artificial Sequence
  dgRNA
  Prl7a1
aatggactatatagg

SEQ ID NO: 50921 - DNA, 15 bp, Artificial Sequence
  dgRNA
  Prl7a1
ggactatataggagg

SEQ ID NO: 50922 - DNA, 15 bp, Artificial Sequence
  dgRNA
  Prl7a1
gaggtggattattta

SEQ ID NO: 50923 - DNA, 15 bp, Artificial Sequence
  dgRNA
  Tbc1d30
gacttgagcacaatt

SEQ ID NO: 50924 - DNA, 15 bp, Artificial Sequence
  dgRNA
  Tbc1d30
acttgagcacaattt

SEQ ID NO: 50925 - DNA, 15 bp, Artificial Sequence
  dgRNA
  Tbc1d30
aggtctgcttcgtgc

SEQ ID NO: 50926 - DNA, 15 bp, Artificial Sequence
  dgRNA
  Tbc1d30
tgcttcgtgctggag

SEQ ID NO: 50927 - DNA, 15 bp, Artificial Sequence
  dgRNA
  Eif2s1
gttgggcgaggactg

SEQ ID NO: 50928 - DNA, 15 bp, Artificial Sequence
  dgRNA
  Eif2s1
aggagacggaatgcc

SEQ ID NO: 50929 - DNA, 15 bp, Artificial Sequence
  dgRNA
  Eif2s1
cggaatgcccggatg

SEQ ID NO: 50930 - DNA, 15 bp, Artificial Sequence
  dgRNA
  Eif2s1
gaagcgcgcacagtc

SEQ ID NO: 50931 - DNA, 15 bp, Artificial Sequence
  dgRNA
  Rhox4b
gtacttgagctggta

SEQ ID NO: 50932 - DNA, 15 bp, Artificial Sequence
  dgRNA
  Rhox4b
gcatggtacttgagc

SEQ ID NO: 50933 - DNA, 15 bp, Artificial Sequence
  dgRNA
  Vps26a
aggagtggtcacgtg

SEQ ID NO: 50934 - DNA, 15 bp, Artificial Sequence
  dgRNA
  Vps26a
gtcacgtgcggctga

SEQ ID NO: 50935 - DNA, 15 bp, Artificial Sequence
  dgRNA
  Vps26a
gcggctgatggccta

SEQ ID NO: 50936 - DNA, 15 bp, Artificial Sequence
  dgRNA
  Vps26a
cctacggtcacgtga

SEQ ID NO: 50937 - DNA, 15 bp, Artificial Sequence
  dgRNA
  Rev1
cctccccgcgggcgc

SEQ ID NO: 50938 - DNA, 15 bp, Artificial Sequence
  dgRNA
  Rev1
gggcgccggcgcgag

SEQ ID NO: 50939 - DNA, 15 bp, Artificial Sequence
  dgRNA
  Rev1
cgccggcgcgagagg

SEQ ID NO: 50940 - DNA, 15 bp, Artificial Sequence
  dgRNA
  Rev1
gccggcgcgagagga

SEQ ID NO: 50941 - DNA, 15 bp, Artificial Sequence
  dgRNA
  Pafah1b2
ttccgtcatcctatc

SEQ ID NO: 50942 - DNA, 15 bp, Artificial Sequence
  dgRNA
  Pafah1b2
tcatcctatcaggac

SEQ ID NO: 50943 - DNA, 15 bp, Artificial Sequence
  dgRNA
  Pafah1b2
atggaggctcaagtc

SEQ ID NO: 50944 - DNA, 15 bp, Artificial Sequence
  dgRNA
  Pafah1b2
tggaggctcaagtcg

SEQ ID NO: 50945 - DNA, 15 bp, Artificial Sequence
  dgRNA
  Acrbp
ctgttgaagaccgac

SEQ ID NO: 50946 - DNA, 15 bp, Artificial Sequence
  dgRNA
  Acrbp
tgaagaccgactgga

SEQ ID NO: 50947 - DNA, 15 bp, Artificial Sequence
  dgRNA
  Acrbp
gaagaccgactggaa

SEQ ID NO: 50948 - DNA, 15 bp, Artificial Sequence
  dgRNA
  Acrbp
ttcgcgctagcagcg

SEQ ID NO: 50949 - DNA, 15 bp, Artificial Sequence
  dgRNA
  Atp5d
tcgtttgctgttaga

SEQ ID NO: 50950 - DNA, 15 bp, Artificial Sequence
  dgRNA
  Atp5d
ccagaatgacccacc

SEQ ID NO: 50951 - DNA, 15 bp, Artificial Sequence
  dgRNA
  Atp5d
cccacccggcatagg

SEQ ID NO: 50952 - DNA, 15 bp, Artificial Sequence
  dgRNA
  Atp5d
ctaggcatcactgca

SEQ ID NO: 50953 - DNA, 15 bp, Artificial Sequence
  dgRNA
  C2cd4c
cgccctatttatatt

SEQ ID NO: 50954 - DNA, 15 bp, Artificial Sequence
  dgRNA
  C2cd4c
gattccccgccagtt

SEQ ID NO: 50955 - DNA, 15 bp, Artificial Sequence
  dgRNA
  C2cd4c
attccccgccagttc

SEQ ID NO: 50956 - DNA, 15 bp, Artificial Sequence
  dgRNA
  C2cd4c
ccccgccagttcggg

SEQ ID NO: 50957 - DNA, 15 bp, Artificial Sequence
  dgRNA
  Nr1h2
aacgaaagaactttc

SEQ ID NO: 50958 - DNA, 15 bp, Artificial Sequence
  dgRNA
  Nr1h2
ccggtgtgccacttc

SEQ ID NO: 50959 - DNA, 15 bp, Artificial Sequence
  dgRNA
  Nr1h2
tgccacttccggccg

SEQ ID NO: 50960 - DNA, 15 bp, Artificial Sequence
  dgRNA
  Nr1h2
ccgaggcctcacagt

SEQ ID NO: 50961 - DNA, 15 bp, Artificial Sequence
  dgRNA
  Hnf1b
tgcagcacgtggagt

SEQ ID NO: 50962 - DNA, 15 bp, Artificial Sequence
  dgRNA
  Hnf1b
gcagcacgtggagtt

SEQ ID NO: 50963 - DNA, 15 bp, Artificial Sequence
  dgRNA
  Hnf1b
cagcacgtggagttg

SEQ ID NO: 50964 - DNA, 15 bp, Artificial Sequence
  dgRNA
  Hnf1b
acacaaaacgtgatt

SEQ ID NO: 50965 - DNA, 15 bp, Artificial Sequence
  dgRNA
  Ss18l1
gaagaggtggccgtc

SEQ ID NO: 50966 - DNA, 15 bp, Artificial Sequence
  dgRNA
  Ss18l1
cgtcgggcgagaaga

SEQ ID NO: 50967 - DNA, 15 bp, Artificial Sequence
  dgRNA
  Ss18l1
gcgagaagacggtga

SEQ ID NO: 50968 - DNA, 15 bp, Artificial Sequence
  dgRNA
  Ss18l1
aagacggtgatggcg

SEQ ID NO: 50969 - DNA, 15 bp, Artificial Sequence
  dgRNA
  Cnrip1
aatctacatccctta

SEQ ID NO: 50970 - DNA, 15 bp, Artificial Sequence
  dgRNA
  Cnrip1
tagggcctagactct

SEQ ID NO: 50971 - DNA, 15 bp, Artificial Sequence
  dgRNA
  Cnrip1
tgtagcaattaatct

SEQ ID NO: 50972 - DNA, 15 bp, Artificial Sequence
  dgRNA
  Cnrip1
ttaatcttggtccca

SEQ ID NO: 50973 - DNA, 15 bp, Artificial Sequence
  dgRNA
  C1qtnf7
tgagttgagctccac

SEQ ID NO: 50974 - DNA, 15 bp, Artificial Sequence
  dgRNA
  C1qtnf7
tttagctcaactatt

SEQ ID NO: 50975 - DNA, 15 bp, Artificial Sequence
  dgRNA
  C1qtnf7
acccgctattctgtc

SEQ ID NO: 50976 - DNA, 15 bp, Artificial Sequence
  dgRNA
  C1qtnf7
ccggctttccttgac

SEQ ID NO: 50977 - DNA, 15 bp, Artificial Sequence
  dgRNA
  Gng12
cccgcccacgcgcga

SEQ ID NO: 50978 - DNA, 15 bp, Artificial Sequence
  dgRNA
  Gng12
ccgcccacgcgcgag

SEQ ID NO: 50979 - DNA, 15 bp, Artificial Sequence
  dgRNA
  Gng12
cccacgcgcgagggg

SEQ ID NO: 50980 - DNA, 15 bp, Artificial Sequence
  dgRNA
  Gng12
agctggagcggagta

SEQ ID NO: 50981 - DNA, 15 bp, Artificial Sequence
  dgRNA
  Kcna3
tgacaaagaaggtcg

SEQ ID NO: 50982 - DNA, 15 bp, Artificial Sequence
  dgRNA
  Kcna3
gaaggtcgaggaaca

SEQ ID NO: 50983 - DNA, 15 bp, Artificial Sequence
  dgRNA
  Kcna3
aaggtcgaggaacaa

SEQ ID NO: 50984 - DNA, 15 bp, Artificial Sequence
  dgRNA
  Kcna3
aacaagggtggcaag

SEQ ID NO: 50985 - DNA, 15 bp, Artificial Sequence
  dgRNA
  Cdk14
cggtaattgcacatg

SEQ ID NO: 50986 - DNA, 15 bp, Artificial Sequence
  dgRNA
  Cdk14
agcatacagaacggg

SEQ ID NO: 50987 - DNA, 15 bp, Artificial Sequence
  dgRNA
  Zfp639
caggaaaccgatgag

SEQ ID NO: 50988 - DNA, 15 bp, Artificial Sequence
  dgRNA
  Zfp639
aggaaaccgatgagt

SEQ ID NO: 50989 - DNA, 15 bp, Artificial Sequence
  dgRNA
  Zfp639
gacagcgctgacctc

SEQ ID NO: 50990 - DNA, 15 bp, Artificial Sequence
  dgRNA
  Zfp639
agcgctgacctcagg

SEQ ID NO: 50991 - DNA, 15 bp, Artificial Sequence
  dgRNA
  Acot7
ataggggtttaataa

SEQ ID NO: 50992 - DNA, 15 bp, Artificial Sequence
  dgRNA
  Acot7
taggggtttaataag

SEQ ID NO: 50993 - DNA, 15 bp, Artificial Sequence
  dgRNA
  Acot7
aggggtttaataagg

SEQ ID NO: 50994 - DNA, 15 bp, Artificial Sequence
  dgRNA
  Acot7
aataagggggtcggt

SEQ ID NO: 50995 - DNA, 15 bp, Artificial Sequence
  dgRNA
  Kdf1
aggagctttgcggcc

SEQ ID NO: 50996 - DNA, 15 bp, Artificial Sequence
  dgRNA
  Kdf1
gctttgcggcccggt

SEQ ID NO: 50997 - DNA, 15 bp, Artificial Sequence
  dgRNA
  Kdf1
ccggtaggcgcccca

SEQ ID NO: 50998 - DNA, 15 bp, Artificial Sequence
  dgRNA
  Kdf1
cggtaggcgccccat

SEQ ID NO: 50999 - DNA, 15 bp, Artificial Sequence
  dgRNA
  Get4
aatacgttttgtttt

SEQ ID NO: 51000 - DNA, 15 bp, Artificial Sequence
  dgRNA
  Get4
cattactgtcaccta

SEQ ID NO: 51001 - DNA, 15 bp, Artificial Sequence
  dgRNA
  Get4
agggcccacgtgctg

SEQ ID NO: 51002 - DNA, 15 bp, Artificial Sequence
  dgRNA
  Get4
gcacggtgtgttctg

SEQ ID NO: 51003 - DNA, 15 bp, Artificial Sequence
  dgRNA
  Vmn1r33
cattgacgcaatgag

SEQ ID NO: 51004 - DNA, 15 bp, Artificial Sequence
  dgRNA
  Vmn1r33
attgacgcaatgaga

SEQ ID NO: 51005 - DNA, 15 bp, Artificial Sequence
  dgRNA
  Vmn1r33
gacgcaatgagaggg

SEQ ID NO: 51006 - DNA, 15 bp, Artificial Sequence
  dgRNA
  Vmn1r33
tcattgcgtcaatga

SEQ ID NO: 51007 - DNA, 15 bp, Artificial Sequence
  dgRNA
  Olfr502
tagactcattactgc

SEQ ID NO: 51008 - DNA, 15 bp, Artificial Sequence
  dgRNA
  Olfr502
gcaggcaaataagtt

SEQ ID NO: 51009 - DNA, 15 bp, Artificial Sequence
  dgRNA
  Olfr502
gtctacatttcaagt

SEQ ID NO: 51010 - DNA, 15 bp, Artificial Sequence
  dgRNA
  Tmem189
tgcgaccccgccccc

SEQ ID NO: 51011 - DNA, 15 bp, Artificial Sequence
  dgRNA
  Tmem189
cgccccccggcgccg

SEQ ID NO: 51012 - DNA, 15 bp, Artificial Sequence
  dgRNA
  Tmem189
ccccggcgccgcggt

SEQ ID NO: 51013 - DNA, 15 bp, Artificial Sequence
  dgRNA
  Tmem189
cgccgcggttggctg

SEQ ID NO: 51014 - DNA, 15 bp, Artificial Sequence
  dgRNA
  Slc1a4
tgctgtgcctcccgg

SEQ ID NO: 51015 - DNA, 15 bp, Artificial Sequence
  dgRNA
  Slc1a4
gctgtgcctcccgga

SEQ ID NO: 51016 - DNA, 15 bp, Artificial Sequence
  dgRNA
  Slc1a4
gtgcctcccggaggg

SEQ ID NO: 51017 - DNA, 15 bp, Artificial Sequence
  dgRNA
  Slc1a4
tgcctcccggagggt

SEQ ID NO: 51018 - DNA, 15 bp, Artificial Sequence
  dgRNA
  Spink5
ctagacttatgagga

SEQ ID NO: 51019 - DNA, 15 bp, Artificial Sequence
  dgRNA
  Spink5
tagacttatgaggat

SEQ ID NO: 51020 - DNA, 15 bp, Artificial Sequence
  dgRNA
  Spink5
atccaacaccttggc

SEQ ID NO: 51021 - DNA, 15 bp, Artificial Sequence
  dgRNA
  Spink5
atgagcctgaacaac

SEQ ID NO: 51022 - DNA, 15 bp, Artificial Sequence
  dgRNA
  Slc16a4
gtaaagtccacaggc

SEQ ID NO: 51023 - DNA, 15 bp, Artificial Sequence
  dgRNA
  Slc16a4
cttgactacagtgcc

SEQ ID NO: 51024 - DNA, 15 bp, Artificial Sequence
  dgRNA
  Slc16a4
actgtagtcaagcgg

SEQ ID NO: 51025 - DNA, 15 bp, Artificial Sequence
  dgRNA
  Slc16a4
cactgtagtcaagcg

SEQ ID NO: 51026 - DNA, 15 bp, Artificial Sequence
  dgRNA
  Cd14
tggaggtgaatcaat

SEQ ID NO: 51027 - DNA, 15 bp, Artificial Sequence
  dgRNA
  Cd14
cagaataatgatcta

SEQ ID NO: 51028 - DNA, 15 bp, Artificial Sequence
  dgRNA
  Cd14
cgcaccagacaagtc

SEQ ID NO: 51029 - DNA, 15 bp, Artificial Sequence
  dgRNA
  Cd14
gcaccagacaagtcc

SEQ ID NO: 51030 - DNA, 15 bp, Artificial Sequence
  dgRNA
  Snx31
gctgaggtttagtgg

SEQ ID NO: 51031 - DNA, 15 bp, Artificial Sequence
  dgRNA
  Snx31
ccacccgcagaccca

SEQ ID NO: 51032 - DNA, 15 bp, Artificial Sequence
  dgRNA
  Snx31
gttcagagggacctc

SEQ ID NO: 51033 - DNA, 15 bp, Artificial Sequence
  dgRNA
  Snx31
cgtgcgcacacaatc

SEQ ID NO: 51034 - DNA, 15 bp, Artificial Sequence
  dgRNA
  Retnla
acacctcttctactt

SEQ ID NO: 51035 - DNA, 15 bp, Artificial Sequence
  dgRNA
  Retnla
gctaaacagtacatg

SEQ ID NO: 51036 - DNA, 15 bp, Artificial Sequence
  dgRNA
  Retnla
ctaaacagtacatgt

SEQ ID NO: 51037 - DNA, 15 bp, Artificial Sequence
  dgRNA
  Retnla
aacagtacatgtggg

SEQ ID NO: 51038 - DNA, 15 bp, Artificial Sequence
  dgRNA
  Tas2r129
tgtgcagtaacaaat

SEQ ID NO: 51039 - DNA, 15 bp, Artificial Sequence
  dgRNA
  Tas2r129
aagttatgattcatg

SEQ ID NO: 51040 - DNA, 15 bp, Artificial Sequence
  dgRNA
  Ckm
catgttcccggcgaa

SEQ ID NO: 51041 - DNA, 15 bp, Artificial Sequence
  dgRNA
  Ckm
agcaagtcagccctt

SEQ ID NO: 51042 - DNA, 15 bp, Artificial Sequence
  dgRNA
  Ckm
gcaagtcagcccttg

SEQ ID NO: 51043 - DNA, 15 bp, Artificial Sequence
  dgRNA
  Ckm
ggggcagcccataca

SEQ ID NO: 51044 - DNA, 15 bp, Artificial Sequence
  dgRNA
  Gsg1l
tgggagcgtcttgcc

SEQ ID NO: 51045 - DNA, 15 bp, Artificial Sequence
  dgRNA
  Gsg1l
gggagcgtcttgcct

SEQ ID NO: 51046 - DNA, 15 bp, Artificial Sequence
  dgRNA
  Gsg1l
ctctccactcccgcg

SEQ ID NO: 51047 - DNA, 15 bp, Artificial Sequence
  dgRNA
  Gsg1l
ccccctctccgcgcg

SEQ ID NO: 51048 - DNA, 15 bp, Artificial Sequence
  dgRNA
  Fgf7
gtgaatgcccacttg

SEQ ID NO: 51049 - DNA, 15 bp, Artificial Sequence
  dgRNA
  Fgf7
tgggcattcacgctg

SEQ ID NO: 51050 - DNA, 15 bp, Artificial Sequence
  dgRNA
  Fgf7
cttaaatccacaagt

SEQ ID NO: 51051 - DNA, 15 bp, Artificial Sequence
  dgRNA
  Fgf7
gcttaaatccacaag

SEQ ID NO: 51052 - DNA, 15 bp, Artificial Sequence
  dgRNA
  Klhdc10
agcccggcgctaccc

SEQ ID NO: 51053 - DNA, 15 bp, Artificial Sequence
  dgRNA
  Klhdc10
ggccggggtagcgcc

SEQ ID NO: 51054 - DNA, 15 bp, Artificial Sequence
  dgRNA
  C1qtnf2
ctttctaaaatccga

SEQ ID NO: 51055 - DNA, 15 bp, Artificial Sequence
  dgRNA
  C1qtnf2
tttctaaaatccgaa

SEQ ID NO: 51056 - DNA, 15 bp, Artificial Sequence
  dgRNA
  C1qtnf2
gccagcgcacgtgac

SEQ ID NO: 51057 - DNA, 15 bp, Artificial Sequence
  dgRNA
  C1qtnf2
ccagcgcacgtgacc

SEQ ID NO: 51058 - DNA, 15 bp, Artificial Sequence
  dgRNA
  Rassf3
gggcgtggcgtgtgc

SEQ ID NO: 51059 - DNA, 15 bp, Artificial Sequence
  dgRNA
  Rassf3
tgctgggtccttgac

SEQ ID NO: 51060 - DNA, 15 bp, Artificial Sequence
  dgRNA
  Rassf3
gggtccttgacgggc

SEQ ID NO: 51061 - DNA, 15 bp, Artificial Sequence
  dgRNA
  Rassf3
ggtccttgacgggct

SEQ ID NO: 51062 - DNA, 15 bp, Artificial Sequence
  dgRNA
  Zfp551
catacaacagatccc

SEQ ID NO: 51063 - DNA, 15 bp, Artificial Sequence
  dgRNA
  Zfp551
ttaaactaagttcat

SEQ ID NO: 51064 - DNA, 15 bp, Artificial Sequence
  dgRNA
  Zfp551
taaactaagttcata

SEQ ID NO: 51065 - DNA, 15 bp, Artificial Sequence
  dgRNA
  Zfp551
aagttcataggggtc

SEQ ID NO: 51066 - DNA, 15 bp, Artificial Sequence
  dgRNA
  Hey2
tctgccaacgcctct

SEQ ID NO: 51067 - DNA, 15 bp, Artificial Sequence
  dgRNA
  Hey2
agccattggccagcg

SEQ ID NO: 51068 - DNA, 15 bp, Artificial Sequence
  dgRNA
  Hey2
gccattggccagcgc

SEQ ID NO: 51069 - DNA, 15 bp, Artificial Sequence
  dgRNA
  Hey2
aagccacaccgtccc

SEQ ID NO: 51070 - DNA, 15 bp, Artificial Sequence
  dgRNA
  Vmn1r236
aagccatatgactat

SEQ ID NO: 51071 - DNA, 15 bp, Artificial Sequence
  dgRNA
  Vmn1r236
tattggctagttgtg

SEQ ID NO: 51072 - DNA, 15 bp, Artificial Sequence
  dgRNA
  Vmn1r236
tagccaatagtcata

SEQ ID NO: 51073 - DNA, 15 bp, Artificial Sequence
  dgRNA
  Vmn1r236
acaacaatatctgta

SEQ ID NO: 51074 - DNA, 15 bp, Artificial Sequence
  dgRNA
  Gm10267
gaagtaatgttctac

SEQ ID NO: 51075 - DNA, 15 bp, Artificial Sequence
  dgRNA
  Gm10267
aagtaatgttctacc

SEQ ID NO: 51076 - DNA, 15 bp, Artificial Sequence
  dgRNA
  Gm10267
ctaccgggaaatatt

SEQ ID NO: 51077 - DNA, 15 bp, Artificial Sequence
  dgRNA
  Gm10267
cgggaaatatttggt

SEQ ID NO: 51078 - DNA, 15 bp, Artificial Sequence
  dgRNA
  Glud1
gcacgcgccgccgcc

SEQ ID NO: 51079 - DNA, 15 bp, Artificial Sequence
  dgRNA
  Glud1
cgcgccgccgcctgg

SEQ ID NO: 51080 - DNA, 15 bp, Artificial Sequence
  dgRNA
  Glud1
cgccgcctggaggcc

SEQ ID NO: 51081 - DNA, 15 bp, Artificial Sequence
  dgRNA
  Glud1
ggccgggcaaggccg

SEQ ID NO: 51082 - DNA, 15 bp, Artificial Sequence
  dgRNA
  Dusp12
gccttggactttaga

SEQ ID NO: 51083 - DNA, 15 bp, Artificial Sequence
  dgRNA
  Dusp12
gcttggaggttcctc

SEQ ID NO: 51084 - DNA, 15 bp, Artificial Sequence
  dgRNA
  Dusp12
atgtgagccgtgctc

SEQ ID NO: 51085 - DNA, 15 bp, Artificial Sequence
  dgRNA
  Dusp12
gatgtgagccgtgct

SEQ ID NO: 51086 - DNA, 15 bp, Artificial Sequence
  dgRNA
  Recql5
cttactcccacagcg

SEQ ID NO: 51087 - DNA, 15 bp, Artificial Sequence
  dgRNA
  Recql5
tcccacagcgcggtg

SEQ ID NO: 51088 - DNA, 15 bp, Artificial Sequence
  dgRNA
  Recql5
agcgcggtgtggctc

SEQ ID NO: 51089 - DNA, 15 bp, Artificial Sequence
  dgRNA
  Recql5
ctcataagccaattt

SEQ ID NO: 51090 - DNA, 15 bp, Artificial Sequence
  dgRNA
  Gpr157
aagcgattgagcttg

SEQ ID NO: 51091 - DNA, 15 bp, Artificial Sequence
  dgRNA
  Gpr157
ggagcaatgcgcaag

SEQ ID NO: 51092 - DNA, 15 bp, Artificial Sequence
  dgRNA
  Gpr157
gagcaatgcgcaagt

SEQ ID NO: 51093 - DNA, 15 bp, Artificial Sequence
  dgRNA
  Gpr157
agcaatgcgcaagtg

SEQ ID NO: 51094 - DNA, 15 bp, Artificial Sequence
  dgRNA
  Tex26
ggagtcgtagtccat

SEQ ID NO: 51095 - DNA, 15 bp, Artificial Sequence
  dgRNA
  Tex26
gagaactattggatt

SEQ ID NO: 51096 - DNA, 15 bp, Artificial Sequence
  dgRNA
  Tex26
agaactattggatta

SEQ ID NO: 51097 - DNA, 15 bp, Artificial Sequence
  dgRNA
  Tex26
cactccatgaaagtc

SEQ ID NO: 51098 - DNA, 15 bp, Artificial Sequence
  dgRNA
  Smap2
tttccaagggcacgc

SEQ ID NO: 51099 - DNA, 15 bp, Artificial Sequence
  dgRNA
  Smap2
ttccaagggcacgca

SEQ ID NO: 51100 - DNA, 15 bp, Artificial Sequence
  dgRNA
  Smap2
ccaagggcacgcagg

SEQ ID NO: 51101 - DNA, 15 bp, Artificial Sequence
  dgRNA
  Smap2
gcccccggctcttcc

SEQ ID NO: 51102 - DNA, 15 bp, Artificial Sequence
  dgRNA
  Tmem208
agctcgggaccccga

SEQ ID NO: 51103 - DNA, 15 bp, Artificial Sequence
  dgRNA
  Tmem208
tcgggaccccgaagg

SEQ ID NO: 51104 - DNA, 15 bp, Artificial Sequence
  dgRNA
  Tmem208
gggaccccgaaggcg

SEQ ID NO: 51105 - DNA, 15 bp, Artificial Sequence
  dgRNA
  Tmem208
gcctgtccccgacca

SEQ ID NO: 51106 - DNA, 15 bp, Artificial Sequence
  dgRNA
  Amdhd2
gttctcggatgtgac

SEQ ID NO: 51107 - DNA, 15 bp, Artificial Sequence
  dgRNA
  Amdhd2
gttctggcgcttctg

SEQ ID NO: 51108 - DNA, 15 bp, Artificial Sequence
  dgRNA
  Amdhd2
ttctggcgcttctgt

SEQ ID NO: 51109 - DNA, 15 bp, Artificial Sequence
  dgRNA
  Amdhd2
tggcgcttctgtggg

SEQ ID NO: 51110 - DNA, 15 bp, Artificial Sequence
  dgRNA
  Ibsp
acaatgcaagcctct

SEQ ID NO: 51111 - DNA, 15 bp, Artificial Sequence
  dgRNA
  Ibsp
ctttcacaatgatac

SEQ ID NO: 51112 - DNA, 15 bp, Artificial Sequence
  dgRNA
  Ibsp
gtgggatttaattga

SEQ ID NO: 51113 - DNA, 15 bp, Artificial Sequence
  dgRNA
  Ibsp
aagaggcttgcattg

SEQ ID NO: 51114 - DNA, 15 bp, Artificial Sequence
  dgRNA
  Smagp
gtgactgagctcccg

SEQ ID NO: 51115 - DNA, 15 bp, Artificial Sequence
  dgRNA
  Smagp
tgactgagctcccgc

SEQ ID NO: 51116 - DNA, 15 bp, Artificial Sequence
  dgRNA
  Smagp
cgctcgccctacagc

SEQ ID NO: 51117 - DNA, 15 bp, Artificial Sequence
  dgRNA
  Smagp
tggcgctgccgaccc

SEQ ID NO: 51118 - DNA, 15 bp, Artificial Sequence
  dgRNA
  Vmn1r69
gtgatctgcatggat

SEQ ID NO: 51119 - DNA, 15 bp, Artificial Sequence
  dgRNA
  Vmn1r69
gaatgatagctactg

SEQ ID NO: 51120 - DNA, 15 bp, Artificial Sequence
  dgRNA
  G0s2
ctgaagtggtgcctt

SEQ ID NO: 51121 - DNA, 15 bp, Artificial Sequence
  dgRNA
  G0s2
tttttgcagcaccag

SEQ ID NO: 51122 - DNA, 15 bp, Artificial Sequence
  dgRNA
  G0s2
ttttgcagcaccagc

SEQ ID NO: 51123 - DNA, 15 bp, Artificial Sequence
  dgRNA
  G0s2
cagcaccagcgggct

SEQ ID NO: 51124 - DNA, 15 bp, Artificial Sequence
  dgRNA
  Pcdh17
ttgatgctctccggt

SEQ ID NO: 51125 - DNA, 15 bp, Artificial Sequence
  dgRNA
  Pcdh17
tctccgcctcccatt

SEQ ID NO: 51126 - DNA, 15 bp, Artificial Sequence
  dgRNA
  Pcdh17
gcctcccattgggcg

SEQ ID NO: 51127 - DNA, 15 bp, Artificial Sequence
  dgRNA
  Pcdh17
cctcccattgggcgt

SEQ ID NO: 51128 - DNA, 15 bp, Artificial Sequence
  dgRNA
  Traf2
aaccttgctaggaac

SEQ ID NO: 51129 - DNA, 15 bp, Artificial Sequence
  dgRNA
  Traf2
aatcaccgctctctg

SEQ ID NO: 51130 - DNA, 15 bp, Artificial Sequence
  dgRNA
  Traf2
ttccgtgctcgttcc

SEQ ID NO: 51131 - DNA, 15 bp, Artificial Sequence
  dgRNA
  Traf2
gtgctcgttcctggt

SEQ ID NO: 51132 - DNA, 15 bp, Artificial Sequence
  dgRNA
  Sirpa
cgctcggcaggcggg

SEQ ID NO: 51133 - DNA, 15 bp, Artificial Sequence
  dgRNA
  Sirpa
gcgcgctcggcaggc

SEQ ID NO: 51134 - DNA, 15 bp, Artificial Sequence
  dgRNA
  Sirpa
agcgcgctcggcagg

SEQ ID NO: 51135 - DNA, 15 bp, Artificial Sequence
  dgRNA
  Sirpa
gtgagcgcgctcggc

SEQ ID NO: 51136 - DNA, 15 bp, Artificial Sequence
  dgRNA
  Ryk
aggctgaaacgcgcg

SEQ ID NO: 51137 - DNA, 15 bp, Artificial Sequence
  dgRNA
  Ryk
attacgttgtttgcc

SEQ ID NO: 51138 - DNA, 15 bp, Artificial Sequence
  dgRNA
  Pstpip2
agtcgttcagacgtc

SEQ ID NO: 51139 - DNA, 15 bp, Artificial Sequence
  dgRNA
  Pstpip2
gttcagacgtccggc

SEQ ID NO: 51140 - DNA, 15 bp, Artificial Sequence
  dgRNA
  Pstpip2
acgtccggcaggctg

SEQ ID NO: 51141 - DNA, 15 bp, Artificial Sequence
  dgRNA
  Pstpip2
cggcaggctgtggtt

SEQ ID NO: 51142 - DNA, 15 bp, Artificial Sequence
  dgRNA
  Gng2
acccgatactaagag

SEQ ID NO: 51143 - DNA, 15 bp, Artificial Sequence
  dgRNA
  Gng2
cgatactaagagagg

SEQ ID NO: 51144 - DNA, 15 bp, Artificial Sequence
  dgRNA
  Gng2
ttggctctaatcccc

SEQ ID NO: 51145 - DNA, 15 bp, Artificial Sequence
  dgRNA
  Gng2
tcctctcttagtatc

SEQ ID NO: 51146 - DNA, 15 bp, Artificial Sequence
  dgRNA
  Ntf5
gagctgaagtggtcg

SEQ ID NO: 51147 - DNA, 15 bp, Artificial Sequence
  dgRNA
  Ntf5
gaggccgagcttcca

SEQ ID NO: 51148 - DNA, 15 bp, Artificial Sequence
  dgRNA
  Ntf5
cggcccgcgcgtgct

SEQ ID NO: 51149 - DNA, 15 bp, Artificial Sequence
  dgRNA
  Ntf5
cccgcgcgtgctagg

SEQ ID NO: 51150 - DNA, 15 bp, Artificial Sequence
  dgRNA
  Adam18
gcgatgcctgctgcg

SEQ ID NO: 51151 - DNA, 15 bp, Artificial Sequence
  dgRNA
  Adam18
cgatgcctgctgcga

SEQ ID NO: 51152 - DNA, 15 bp, Artificial Sequence
  dgRNA
  Adam18
cctctggcgagcccc

SEQ ID NO: 51153 - DNA, 15 bp, Artificial Sequence
  dgRNA
  Adam18
ctggcgagcccctgg

SEQ ID NO: 51154 - DNA, 15 bp, Artificial Sequence
  dgRNA
  Sncaip
tcacccaccgcttgc

SEQ ID NO: 51155 - DNA, 15 bp, Artificial Sequence
  dgRNA
  Sncaip
gatgcccctaccata

SEQ ID NO: 51156 - DNA, 15 bp, Artificial Sequence
  dgRNA
  Sncaip
tagcgccacccaccc

SEQ ID NO: 51157 - DNA, 15 bp, Artificial Sequence
  dgRNA
  Sncaip
atgcctgcaagcggt

SEQ ID NO: 51158 - DNA, 15 bp, Artificial Sequence
  dgRNA
  Zfp82
gatacagtcactcgc

SEQ ID NO: 51159 - DNA, 15 bp, Artificial Sequence
  dgRNA
  Zfp82
agtcactcgctggac

SEQ ID NO: 51160 - DNA, 15 bp, Artificial Sequence
  dgRNA
  Zfp82
gtgtgcgatccacct

SEQ ID NO: 51161 - DNA, 15 bp, Artificial Sequence
  dgRNA
  Zfp82
tgtgcgatccaccta

SEQ ID NO: 51162 - DNA, 15 bp, Artificial Sequence
  dgRNA
  Gimap7
ggaagggattcacct

SEQ ID NO: 51163 - DNA, 15 bp, Artificial Sequence
  dgRNA
  Gimap7
gaagggattcaccta

SEQ ID NO: 51164 - DNA, 15 bp, Artificial Sequence
  dgRNA
  Gimap7
agcatccaccacaac

SEQ ID NO: 51165 - DNA, 15 bp, Artificial Sequence
  dgRNA
  Gimap7
gcatccaccacaaca

SEQ ID NO: 51166 - DNA, 15 bp, Artificial Sequence
  dgRNA
  Olfr19
ataatacaagtcttc

SEQ ID NO: 51167 - DNA, 15 bp, Artificial Sequence
  dgRNA
  Olfr19
actgtcctaacaata

SEQ ID NO: 51168 - DNA, 15 bp, Artificial Sequence
  dgRNA
  Olfr19
gtgtactgcttttta

SEQ ID NO: 51169 - DNA, 15 bp, Artificial Sequence
  dgRNA
  Olfr19
agtgtactgcttttt

SEQ ID NO: 51170 - DNA, 15 bp, Artificial Sequence
  dgRNA
  Ddx20
tggagccccgccgcg

SEQ ID NO: 51171 - DNA, 15 bp, Artificial Sequence
  dgRNA
  Ddx20
ccccgccgcgcggcc

SEQ ID NO: 51172 - DNA, 15 bp, Artificial Sequence
  dgRNA
  Ddx20
actcagagccgcggg

SEQ ID NO: 51173 - DNA, 15 bp, Artificial Sequence
  dgRNA
  Ddx20
agagccgcgggaggc

SEQ ID NO: 51174 - DNA, 15 bp, Artificial Sequence
  dgRNA
  Cldn12
gatgcccgagccgtg

SEQ ID NO: 51175 - DNA, 15 bp, Artificial Sequence
  dgRNA
  Cldn12
cgagccgtgaggagc

SEQ ID NO: 51176 - DNA, 15 bp, Artificial Sequence
  dgRNA
  Cldn12
ccgtgaggagccggt

SEQ ID NO: 51177 - DNA, 15 bp, Artificial Sequence
  dgRNA
  Cldn12
ccggtaggtgtggtc

SEQ ID NO: 51178 - DNA, 15 bp, Artificial Sequence
  dgRNA
  Il7
actagagaacctaga

SEQ ID NO: 51179 - DNA, 15 bp, Artificial Sequence
  dgRNA
  Il7
ctagagaacctagag

SEQ ID NO: 51180 - DNA, 15 bp, Artificial Sequence
  dgRNA
  Il7
gatgacttacatcgg

SEQ ID NO: 51181 - DNA, 15 bp, Artificial Sequence
  dgRNA
  Il7
gcgacgcctcctcag

SEQ ID NO: 51182 - DNA, 15 bp, Artificial Sequence
  dgRNA
  Cpeb4
aggtggcggctacgg

SEQ ID NO: 51183 - DNA, 15 bp, Artificial Sequence
  dgRNA
  Cpeb4
ggcggctacggtggc

SEQ ID NO: 51184 - DNA, 15 bp, Artificial Sequence
  dgRNA
  Cpeb4
gcggctacggtggct

SEQ ID NO: 51185 - DNA, 15 bp, Artificial Sequence
  dgRNA
  Cpeb4
cggctacggtggctg

SEQ ID NO: 51186 - DNA, 15 bp, Artificial Sequence
  dgRNA
  Tnp1
tcttcaatgcaggtt

SEQ ID NO: 51187 - DNA, 15 bp, Artificial Sequence
  dgRNA
  Tnp1
ggtacctaagtatta

SEQ ID NO: 51188 - DNA, 15 bp, Artificial Sequence
  dgRNA
  Tnp1
tttgctacaccttgc

SEQ ID NO: 51189 - DNA, 15 bp, Artificial Sequence
  dgRNA
  Mfi2
aatggcaaattgttg

SEQ ID NO: 51190 - DNA, 15 bp, Artificial Sequence
  dgRNA
  Mfi2
cgggtcagcaaccct

SEQ ID NO: 51191 - DNA, 15 bp, Artificial Sequence
  dgRNA
  Mfi2
aacccttggaccggc

SEQ ID NO: 51192 - DNA, 15 bp, Artificial Sequence
  dgRNA
  Mfi2
cttggaccggccggc

SEQ ID NO: 51193 - DNA, 15 bp, Artificial Sequence
  dgRNA
  Map2k1
ccgctggtcagcaga

SEQ ID NO: 51194 - DNA, 15 bp, Artificial Sequence
  dgRNA
  Map2k1
cgtcatctgcctctg

SEQ ID NO: 51195 - DNA, 15 bp, Artificial Sequence
  dgRNA
  Map2k1
ctgtcggcgaagcga

SEQ ID NO: 51196 - DNA, 15 bp, Artificial Sequence
  dgRNA
  Map2k1
tgtcggcgaagcgac

SEQ ID NO: 51197 - DNA, 15 bp, Artificial Sequence
  dgRNA
  Scmh1
gggctggcggtcgcg

SEQ ID NO: 51198 - DNA, 15 bp, Artificial Sequence
  dgRNA
  Scmh1
ctggcggtcgcgagg

SEQ ID NO: 51199 - DNA, 15 bp, Artificial Sequence
  dgRNA
  Scmh1
tggcggtcgcgaggc

SEQ ID NO: 51200 - DNA, 15 bp, Artificial Sequence
  dgRNA
  Scmh1
ggcggtcgcgaggcg

SEQ ID NO: 51201 - DNA, 15 bp, Artificial Sequence
  dgRNA
  Zfp141
gcgtgagtgcagcca

SEQ ID NO: 51202 - DNA, 15 bp, Artificial Sequence
  dgRNA
  Zfp141
gcgccgtccccgaag

SEQ ID NO: 51203 - DNA, 15 bp, Artificial Sequence
  dgRNA
  Zfp141
cgccgtccccgaagt

SEQ ID NO: 51204 - DNA, 15 bp, Artificial Sequence
  dgRNA
  Zfp141
cgtccccgaagtggg

SEQ ID NO: 51205 - DNA, 15 bp, Artificial Sequence
  dgRNA
  Arpp21
gtgtacccacctatg

SEQ ID NO: 51206 - DNA, 15 bp, Artificial Sequence
  dgRNA
  Arpp21
aacacctggtaacac

SEQ ID NO: 51207 - DNA, 15 bp, Artificial Sequence
  dgRNA
  Arpp21
tctgaccacataggt

SEQ ID NO: 51208 - DNA, 15 bp, Artificial Sequence
  dgRNA
  Gna15
aatagctgtgcccac

SEQ ID NO: 51209 - DNA, 15 bp, Artificial Sequence
  dgRNA
  Gna15
tggtcgcttcctatt

SEQ ID NO: 51210 - DNA, 15 bp, Artificial Sequence
  dgRNA
  Gna15
tcctatttggcccag

SEQ ID NO: 51211 - DNA, 15 bp, Artificial Sequence
  dgRNA
  Gna15
aagttagacacctcg

SEQ ID NO: 51212 - DNA, 15 bp, Artificial Sequence
  dgRNA
  AY358078
attcacaagaggccc

SEQ ID NO: 51213 - DNA, 15 bp, Artificial Sequence
  dgRNA
  Fam151a
aagatccagcttgga

SEQ ID NO: 51214 - DNA, 15 bp, Artificial Sequence
  dgRNA
  Fam151a
agatccagcttggat

SEQ ID NO: 51215 - DNA, 15 bp, Artificial Sequence
  dgRNA
  Fam151a
cgacccttggtgcaa

SEQ ID NO: 51216 - DNA, 15 bp, Artificial Sequence
  dgRNA
  Fam151a
ccgacccttggtgca

SEQ ID NO: 51217 - DNA, 15 bp, Artificial Sequence
  dgRNA
  Sltm
ggggcgtggtccccg

SEQ ID NO: 51218 - DNA, 15 bp, Artificial Sequence
  dgRNA
  Sltm
gggcgtggtccccgt

SEQ ID NO: 51219 - DNA, 15 bp, Artificial Sequence
  dgRNA
  Sltm
ggcgtggtccccgtg

SEQ ID NO: 51220 - DNA, 15 bp, Artificial Sequence
  dgRNA
  Sltm
gcgtggtccccgtgg

SEQ ID NO: 51221 - DNA, 15 bp, Artificial Sequence
  dgRNA
  Dab2
ggagttaccaagtcc

SEQ ID NO: 51222 - DNA, 15 bp, Artificial Sequence
  dgRNA
  Drd5
caccgaggccactct

SEQ ID NO: 51223 - DNA, 15 bp, Artificial Sequence
  dgRNA
  Drd5
tctcggatctgtgtg

SEQ ID NO: 51224 - DNA, 15 bp, Artificial Sequence
  dgRNA
  Drd5
acaattccaggacgc

SEQ ID NO: 51225 - DNA, 15 bp, Artificial Sequence
  dgRNA
  Drd5
ttccaggacgcaggt

SEQ ID NO: 51226 - DNA, 15 bp, Artificial Sequence
  dgRNA
  Vmn1r18
ctatgatatacagtc

SEQ ID NO: 51227 - DNA, 15 bp, Artificial Sequence
  dgRNA
  Hacl1
ttacctgcttcgcat

SEQ ID NO: 51228 - DNA, 15 bp, Artificial Sequence
  dgRNA
  Hacl1
gcttcgcataggacg

SEQ ID NO: 51229 - DNA, 15 bp, Artificial Sequence
  dgRNA
  Hacl1
ataggacgcggcctc

SEQ ID NO: 51230 - DNA, 15 bp, Artificial Sequence
  dgRNA
  Hacl1
gctgatggcggagtc

SEQ ID NO: 51231 - DNA, 15 bp, Artificial Sequence
  dgRNA
  Urah
cagggcgactgcctg

SEQ ID NO: 51232 - DNA, 15 bp, Artificial Sequence
  dgRNA
  Urah
tccaggaccgccccg

SEQ ID NO: 51233 - DNA, 15 bp, Artificial Sequence
  dgRNA
  Urah
acttaggctggccgc

SEQ ID NO: 51234 - DNA, 15 bp, Artificial Sequence
  dgRNA
  Urah
ggctggccgcaggta

SEQ ID NO: 51235 - DNA, 15 bp, Artificial Sequence
  dgRNA
  Prok2
gcgtccccaacgtcc

SEQ ID NO: 51236 - DNA, 15 bp, Artificial Sequence
  dgRNA
  Prok2
cgtccccaacgtccc

SEQ ID NO: 51237 - DNA, 15 bp, Artificial Sequence
  dgRNA
  Prok2
cgggtcccaacgccc

SEQ ID NO: 51238 - DNA, 15 bp, Artificial Sequence
  dgRNA
  Prok2
tggggacgcgtggcc

SEQ ID NO: 51239 - DNA, 15 bp, Artificial Sequence
  dgRNA
  Manba
tcgcttttcatcatt

SEQ ID NO: 51240 - DNA, 15 bp, Artificial Sequence
  dgRNA
  Manba
gagcgccccacttac

SEQ ID NO: 51241 - DNA, 15 bp, Artificial Sequence
  dgRNA
  Manba
cttacaggatcgagc

SEQ ID NO: 51242 - DNA, 15 bp, Artificial Sequence
  dgRNA
  Manba
aggtcgcagagaccc

SEQ ID NO: 51243 - DNA, 15 bp, Artificial Sequence
  dgRNA
  Aicda
atcatttaatccgtg

SEQ ID NO: 51244 - DNA, 15 bp, Artificial Sequence
  dgRNA
  Aicda
cccgcccatctttac

SEQ ID NO: 51245 - DNA, 15 bp, Artificial Sequence
  dgRNA
  Aicda
tactggacccaaccc

SEQ ID NO: 51246 - DNA, 15 bp, Artificial Sequence
  dgRNA
  Aicda
cagatgttggatacc

SEQ ID NO: 51247 - DNA, 15 bp, Artificial Sequence
  dgRNA
  Skor2
agctcgcgccagtac

SEQ ID NO: 51248 - DNA, 15 bp, Artificial Sequence
  dgRNA
  Skor2
gctcgcgccagtacc

SEQ ID NO: 51249 - DNA, 15 bp, Artificial Sequence
  dgRNA
  Skor2
cgcccgctggattcg

SEQ ID NO: 51250 - DNA, 15 bp, Artificial Sequence
  dgRNA
  Skor2
attcgaggacccgct

SEQ ID NO: 51251 - DNA, 15 bp, Artificial Sequence
  dgRNA
  Sdccag8
cagtgaatgcttgcg

SEQ ID NO: 51252 - DNA, 15 bp, Artificial Sequence
  dgRNA
  Sdccag8
agtgaatgcttgcga

SEQ ID NO: 51253 - DNA, 15 bp, Artificial Sequence
  dgRNA
  Sdccag8
tgcttgcgagggctc

SEQ ID NO: 51254 - DNA, 15 bp, Artificial Sequence
  dgRNA
  Sdccag8
gcttgcgagggctca

SEQ ID NO: 51255 - DNA, 15 bp, Artificial Sequence
  dgRNA
  Clec12a
cagtgagcttatttc

SEQ ID NO: 51256 - DNA, 15 bp, Artificial Sequence
  dgRNA
  Clec12a
gcctaaacaaaggtt

SEQ ID NO: 51257 - DNA, 15 bp, Artificial Sequence
  dgRNA
  Clec12a
agcctaaacaaaggt

SEQ ID NO: 51258 - DNA, 15 bp, Artificial Sequence
  dgRNA
  Clec12a
atacagcctaaacaa

SEQ ID NO: 51259 - DNA, 15 bp, Artificial Sequence
  dgRNA
  Ppp2cb
gtccaaggcgagaac

SEQ ID NO: 51260 - DNA, 15 bp, Artificial Sequence
  dgRNA
  Ppp2cb
gaaccggattcccca

SEQ ID NO: 51261 - DNA, 15 bp, Artificial Sequence
  dgRNA
  Ppp2cb
aaccggattccccaa

SEQ ID NO: 51262 - DNA, 15 bp, Artificial Sequence
  dgRNA
  Ppp2cb
ggaccgtttctccgc

SEQ ID NO: 51263 - DNA, 15 bp, Artificial Sequence
  dgRNA
  B230217C12Rik
aggcaagccagcgtc

SEQ ID NO: 51264 - DNA, 15 bp, Artificial Sequence
  dgRNA
  B230217C12Rik
cattccaccagacgc

SEQ ID NO: 51265 - DNA, 15 bp, Artificial Sequence
  dgRNA
  B230217C12Rik
ttgtcaatagggggc

SEQ ID NO: 51266 - DNA, 15 bp, Artificial Sequence
  dgRNA
  B230217C12Rik
caacttgtcaatagg

SEQ ID NO: 51267 - DNA, 15 bp, Artificial Sequence
  dgRNA
  Snrnp27
gcgcccagttcttcc

SEQ ID NO: 51268 - DNA, 15 bp, Artificial Sequence
  dgRNA
  Snrnp27
cctggggcgacttcc

SEQ ID NO: 51269 - DNA, 15 bp, Artificial Sequence
  dgRNA
  Snrnp27
ctggggcgacttcca

SEQ ID NO: 51270 - DNA, 15 bp, Artificial Sequence
  dgRNA
  Snrnp27
gtttgctggagccgc

SEQ ID NO: 51271 - DNA, 15 bp, Artificial Sequence
  dgRNA
  Cldn14
tgtcaccagcggtga

SEQ ID NO: 51272 - DNA, 15 bp, Artificial Sequence
  dgRNA
  Cldn14
gtcaccagcggtgac

SEQ ID NO: 51273 - DNA, 15 bp, Artificial Sequence
  dgRNA
  Cldn14
tgacgggcaacaatg

SEQ ID NO: 51274 - DNA, 15 bp, Artificial Sequence
  dgRNA
  Cldn14
agctgcagagacgtc

SEQ ID NO: 51275 - DNA, 15 bp, Artificial Sequence
  dgRNA
  Cideb
taacgctgttctaat

SEQ ID NO: 51276 - DNA, 15 bp, Artificial Sequence
  dgRNA
  Cideb
acaaacggcggactt

SEQ ID NO: 51277 - DNA, 15 bp, Artificial Sequence
  dgRNA
  Cideb
tctaccacttcacat

SEQ ID NO: 51278 - DNA, 15 bp, Artificial Sequence
  dgRNA
  Cideb
cgttagaacagtttc

SEQ ID NO: 51279 - DNA, 15 bp, Artificial Sequence
  dgRNA
  Bcas3
ctctttcctactcgc

SEQ ID NO: 51280 - DNA, 15 bp, Artificial Sequence
  dgRNA
  Bcas3
ttcctactcgctggt

SEQ ID NO: 51281 - DNA, 15 bp, Artificial Sequence
  dgRNA
  Bcas3
cgaagctgacctcca

SEQ ID NO: 51282 - DNA, 15 bp, Artificial Sequence
  dgRNA
  Bcas3
agggcggtgccgcgc

SEQ ID NO: 51283 - DNA, 15 bp, Artificial Sequence
  dgRNA
  Ankrd27
ccgcctctcgaattc

SEQ ID NO: 51284 - DNA, 15 bp, Artificial Sequence
  dgRNA
  Ankrd27
cgcctctcgaattct

SEQ ID NO: 51285 - DNA, 15 bp, Artificial Sequence
  dgRNA
  Ankrd27
ggcacgcgcactccc

SEQ ID NO: 51286 - DNA, 15 bp, Artificial Sequence
  dgRNA
  Ankrd27
cgcactccctggttc

SEQ ID NO: 51287 - DNA, 15 bp, Artificial Sequence
  dgRNA
  4930558K02Rik
acctaatgttctaga

SEQ ID NO: 51288 - DNA, 15 bp, Artificial Sequence
  dgRNA
  4930558K02Rik
tgtgacttcggacaa

SEQ ID NO: 51289 - DNA, 15 bp, Artificial Sequence
  dgRNA
  4930558K02Rik
caaatggattaatgc

SEQ ID NO: 51290 - DNA, 15 bp, Artificial Sequence
  dgRNA
  4930558K02Rik
acattaggtcaaggt

SEQ ID NO: 51291 - DNA, 15 bp, Artificial Sequence
  dgRNA
  Mien1
gatcagtgctggtcc

SEQ ID NO: 51292 - DNA, 15 bp, Artificial Sequence
  dgRNA
  Mien1
tattcgctctgcagc

SEQ ID NO: 51293 - DNA, 15 bp, Artificial Sequence
  dgRNA
  Mien1
acctgctgacggcag

SEQ ID NO: 51294 - DNA, 15 bp, Artificial Sequence
  dgRNA
  Mien1
cctgctgacggcaga

SEQ ID NO: 51295 - DNA, 15 bp, Artificial Sequence
  dgRNA
  Nup210l
cccccgctgacgtcg

SEQ ID NO: 51296 - DNA, 15 bp, Artificial Sequence
  dgRNA
  Nup210l
gtcgtggctgctgat

SEQ ID NO: 51297 - DNA, 15 bp, Artificial Sequence
  dgRNA
  Nup210l
cttgctaagaattgt

SEQ ID NO: 51298 - DNA, 15 bp, Artificial Sequence
  dgRNA
  Nup210l
acgtcagcgggggtg

SEQ ID NO: 51299 - DNA, 15 bp, Artificial Sequence
  dgRNA
  Olfr1501
tcactacaaactgct

SEQ ID NO: 51300 - DNA, 15 bp, Artificial Sequence
  dgRNA
  Necab3
ctgcccacacccgac

SEQ ID NO: 51301 - DNA, 15 bp, Artificial Sequence
  dgRNA
  Necab3
tgcccacacccgact

SEQ ID NO: 51302 - DNA, 15 bp, Artificial Sequence
  dgRNA
  Necab3
ccacacccgactggg

SEQ ID NO: 51303 - DNA, 15 bp, Artificial Sequence
  dgRNA
  Necab3
gactgggtggagcgc

SEQ ID NO: 51304 - DNA, 15 bp, Artificial Sequence
  dgRNA
  Areg
aaaacacaacgcgag

SEQ ID NO: 51305 - DNA, 15 bp, Artificial Sequence
  dgRNA
  Areg
aaacacaacgcgagt

SEQ ID NO: 51306 - DNA, 15 bp, Artificial Sequence
  dgRNA
  Areg
tctccccgcgtaatc

SEQ ID NO: 51307 - DNA, 15 bp, Artificial Sequence
  dgRNA
  Areg
ctccccgcgtaatca

SEQ ID NO: 51308 - DNA, 15 bp, Artificial Sequence
  dgRNA
  1700031F05Rik
ttaaaggacttgcgg

SEQ ID NO: 51309 - DNA, 15 bp, Artificial Sequence
  dgRNA
  1700031F05Rik
aacaatctgctgagt

SEQ ID NO: 51310 - DNA, 15 bp, Artificial Sequence
  dgRNA
  1700031F05Rik
cagattgttgttctc

SEQ ID NO: 51311 - DNA, 15 bp, Artificial Sequence
  dgRNA
  Adgrl2
ctgtgacgacataca

SEQ ID NO: 51312 - DNA, 15 bp, Artificial Sequence
  dgRNA
  Adgrl2
tgtgacgacatacaa

SEQ ID NO: 51313 - DNA, 15 bp, Artificial Sequence
  dgRNA
  Adgrl2
atgatgcagactgct

SEQ ID NO: 51314 - DNA, 15 bp, Artificial Sequence
  dgRNA
  Adgrl2
tgggttcgatgaagc

SEQ ID NO: 51315 - DNA, 15 bp, Artificial Sequence
  dgRNA
  Hfm1
tggggtatggaccac

SEQ ID NO: 51316 - DNA, 15 bp, Artificial Sequence
  dgRNA
  Hfm1
ggggtatggaccacc

SEQ ID NO: 51317 - DNA, 15 bp, Artificial Sequence
  dgRNA
  Hfm1
tatggaccaccgggc

SEQ ID NO: 51318 - DNA, 15 bp, Artificial Sequence
  dgRNA
  Hfm1
atggaccaccgggcc

SEQ ID NO: 51319 - DNA, 15 bp, Artificial Sequence
  dgRNA
  Smc4
cccgcgatacttgct

SEQ ID NO: 51320 - DNA, 15 bp, Artificial Sequence
  dgRNA
  Smc4
tgccagtcacccgag

SEQ ID NO: 51321 - DNA, 15 bp, Artificial Sequence
  dgRNA
  Smc4
cgccctctccctgga

SEQ ID NO: 51322 - DNA, 15 bp, Artificial Sequence
  dgRNA
  Smc4
cctggaaggtgttat

SEQ ID NO: 51323 - DNA, 15 bp, Artificial Sequence
  dgRNA
  Plekha7
ctcttcctgacgtta

SEQ ID NO: 51324 - DNA, 15 bp, Artificial Sequence
  dgRNA
  Plekha7
atggttagagacgtt

SEQ ID NO: 51325 - DNA, 15 bp, Artificial Sequence
  dgRNA
  Plekha7
atgtctagatgctag

SEQ ID NO: 51326 - DNA, 15 bp, Artificial Sequence
  dgRNA
  Plekha7
gctccaagaacactt

SEQ ID NO: 51327 - DNA, 15 bp, Artificial Sequence
  dgRNA
  Lsm6
tcgtattctattttc

SEQ ID NO: 51328 - DNA, 15 bp, Artificial Sequence
  dgRNA
  Lsm6
acttcaagccctggc

SEQ ID NO: 51329 - DNA, 15 bp, Artificial Sequence
  dgRNA
  Lsm6
ctggctgggtgccga

SEQ ID NO: 51330 - DNA, 15 bp, Artificial Sequence
  dgRNA
  Lsm6
aaacaaacccggtct

SEQ ID NO: 51331 - DNA, 15 bp, Artificial Sequence
  dgRNA
  Grm5
cgcagcacgtgctcc

SEQ ID NO: 51332 - DNA, 15 bp, Artificial Sequence
  dgRNA
  Grm5
acgtgctccaggcgc

SEQ ID NO: 51333 - DNA, 15 bp, Artificial Sequence
  dgRNA
  Grm5
gcggctggctagcct

SEQ ID NO: 51334 - DNA, 15 bp, Artificial Sequence
  dgRNA
  Grm5
gcaattgggggcggc

SEQ ID NO: 51335 - DNA, 15 bp, Artificial Sequence
  dgRNA
  Kif26b
gctccgcgctgctcc

SEQ ID NO: 51336 - DNA, 15 bp, Artificial Sequence
  dgRNA
  Kif26b
cgcgctgctcccgga

SEQ ID NO: 51337 - DNA, 15 bp, Artificial Sequence
  dgRNA
  Kif26b
cacgcgtcctgaccg

SEQ ID NO: 51338 - DNA, 15 bp, Artificial Sequence
  dgRNA
  Kif26b
acgcgtcctgaccgc

SEQ ID NO: 51339 - DNA, 15 bp, Artificial Sequence
  dgRNA
  Serpinb12
tttcaacatggtacc

SEQ ID NO: 51340 - DNA, 15 bp, Artificial Sequence
  dgRNA
  Serpinb12
gcttgccagcatagg

SEQ ID NO: 51341 - DNA, 15 bp, Artificial Sequence
  dgRNA
  Serpinb12
cttgccagcatagga

SEQ ID NO: 51342 - DNA, 15 bp, Artificial Sequence
  dgRNA
  Serpinb12
ttgccagcataggag

SEQ ID NO: 51343 - DNA, 15 bp, Artificial Sequence
  dgRNA
  Slc50a1
ggtctcgatgatgca

SEQ ID NO: 51344 - DNA, 15 bp, Artificial Sequence
  dgRNA
  Slc50a1
gtctcgatgatgcaa

SEQ ID NO: 51345 - DNA, 15 bp, Artificial Sequence
  dgRNA
  Slc50a1
tctcgatgatgcaag

SEQ ID NO: 51346 - DNA, 15 bp, Artificial Sequence
  dgRNA
  Slc50a1
ggggtgcgcagtgtg

SEQ ID NO: 51347 - DNA, 15 bp, Artificial Sequence
  dgRNA
  Gper1
aatacacatccagca

SEQ ID NO: 51348 - DNA, 15 bp, Artificial Sequence
  dgRNA
  Gper1
gctggccttaaaggg

SEQ ID NO: 51349 - DNA, 15 bp, Artificial Sequence
  dgRNA
  Gper1
cccagtgagtaggct

SEQ ID NO: 51350 - DNA, 15 bp, Artificial Sequence
  dgRNA
  Gper1
ccagtgagtaggctt

SEQ ID NO: 51351 - DNA, 15 bp, Artificial Sequence
  dgRNA
  Ubl3
gcgctattcccaagt

SEQ ID NO: 51352 - DNA, 15 bp, Artificial Sequence
  dgRNA
  Ubl3
tcccaagtcggctct

SEQ ID NO: 51353 - DNA, 15 bp, Artificial Sequence
  dgRNA
  Ubl3
cccaagtcggctctc

SEQ ID NO: 51354 - DNA, 15 bp, Artificial Sequence
  dgRNA
  Ubl3
ctctcgggcaccagc

SEQ ID NO: 51355 - DNA, 15 bp, Artificial Sequence
  dgRNA
  Kif2c
aaacctgagtaatgc

SEQ ID NO: 51356 - DNA, 15 bp, Artificial Sequence
  dgRNA
  Kif2c
gagttgttcctaaag

SEQ ID NO: 51357 - DNA, 15 bp, Artificial Sequence
  dgRNA
  Kif2c
ttcctaaagaggtac

SEQ ID NO: 51358 - DNA, 15 bp, Artificial Sequence
  dgRNA
  Kif2c
attgtgacctcatcg

SEQ ID NO: 51359 - DNA, 15 bp, Artificial Sequence
  dgRNA
  Spred1
tcgcccgcgccgtct

SEQ ID NO: 51360 - DNA, 15 bp, Artificial Sequence
  dgRNA
  Spred1
cttcgcactcgacct

SEQ ID NO: 51361 - DNA, 15 bp, Artificial Sequence
  dgRNA
  Spred1
cactcgacctcggcg

SEQ ID NO: 51362 - DNA, 15 bp, Artificial Sequence
  dgRNA
  Spred1
ggcgcggcaaaccgc

SEQ ID NO: 51363 - DNA, 15 bp, Artificial Sequence
  dgRNA
  Olfr1311
gtattggctctatgc

SEQ ID NO: 51364 - DNA, 15 bp, Artificial Sequence
  dgRNA
  Runx3
agattgggttgacac

SEQ ID NO: 51365 - DNA, 15 bp, Artificial Sequence
  dgRNA
  Runx3
gattgggttgacact

SEQ ID NO: 51366 - DNA, 15 bp, Artificial Sequence
  dgRNA
  Runx3
ctgcgaggagctggt

SEQ ID NO: 51367 - DNA, 15 bp, Artificial Sequence
  dgRNA
  Runx3
gccagctcgcggcct

SEQ ID NO: 51368 - DNA, 15 bp, Artificial Sequence
  dgRNA
  Yes1
ccggcaggcacgaca

SEQ ID NO: 51369 - DNA, 15 bp, Artificial Sequence
  dgRNA
  Yes1
caggcacgacacggc

SEQ ID NO: 51370 - DNA, 15 bp, Artificial Sequence
  dgRNA
  Yes1
aggcacgacacggcc

SEQ ID NO: 51371 - DNA, 15 bp, Artificial Sequence
  dgRNA
  Yes1
cctcccagcggcccg

SEQ ID NO: 51372 - DNA, 15 bp, Artificial Sequence
  dgRNA
  Itgb2l
agcaccagactcata

SEQ ID NO: 51373 - DNA, 15 bp, Artificial Sequence
  dgRNA
  Itgb2l
gctacaaggtaggag

SEQ ID NO: 51374 - DNA, 15 bp, Artificial Sequence
  dgRNA
  Itgb2l
cagcggctacaaggt

SEQ ID NO: 51375 - DNA, 15 bp, Artificial Sequence
  dgRNA
  Itgb2l
ctctcagcggctaca

SEQ ID NO: 51376 - DNA, 15 bp, Artificial Sequence
  dgRNA
  Olfr39
ctattaatgccaaca

SEQ ID NO: 51377 - DNA, 15 bp, Artificial Sequence
  dgRNA
  Olfr39
acttatttcgtctaa

SEQ ID NO: 51378 - DNA, 15 bp, Artificial Sequence
  dgRNA
  Tcf7
cgcagagacttttcc

SEQ ID NO: 51379 - DNA, 15 bp, Artificial Sequence
  dgRNA
  Tcf7
cggtgagtttttgcg

SEQ ID NO: 51380 - DNA, 15 bp, Artificial Sequence
  dgRNA
  Tcf7
gagtttttgcgcggc

SEQ ID NO: 51381 - DNA, 15 bp, Artificial Sequence
  dgRNA
  Tcf7
agtttttgcgcggct

SEQ ID NO: 51382 - DNA, 15 bp, Artificial Sequence
  dgRNA
  Hif1a
agacaagcacgtgag

SEQ ID NO: 51383 - DNA, 15 bp, Artificial Sequence
  dgRNA
  Hif1a
gacaagcacgtgagc

SEQ ID NO: 51384 - DNA, 15 bp, Artificial Sequence
  dgRNA
  Hif1a
acaagcacgtgagcg

SEQ ID NO: 51385 - DNA, 15 bp, Artificial Sequence
  dgRNA
  Hif1a
gcagctcgtcccagc

SEQ ID NO: 51386 - DNA, 15 bp, Artificial Sequence
  dgRNA
  Alx1
tgtctgaactaggcc

SEQ ID NO: 51387 - DNA, 15 bp, Artificial Sequence
  dgRNA
  Alx1
gtctgaactaggccg

SEQ ID NO: 51388 - DNA, 15 bp, Artificial Sequence
  dgRNA
  Alx1
ggacgcgccctaccc

SEQ ID NO: 51389 - DNA, 15 bp, Artificial Sequence
  dgRNA
  Alx1
gacgcgccctaccct

SEQ ID NO: 51390 - DNA, 15 bp, Artificial Sequence
  dgRNA
  Kcnd3
ctgggcaccctccgg

SEQ ID NO: 51391 - DNA, 15 bp, Artificial Sequence
  dgRNA
  Kcnd3
caccctccggcggct

SEQ ID NO: 51392 - DNA, 15 bp, Artificial Sequence
  dgRNA
  Kcnd3
cggcggctaggctcc

SEQ ID NO: 51393 - DNA, 15 bp, Artificial Sequence
  dgRNA
  Kcnd3
ggcggctaggctccc

SEQ ID NO: 51394 - DNA, 15 bp, Artificial Sequence
  dgRNA
  Gm20767
ggaggacttatcctc

SEQ ID NO: 51395 - DNA, 15 bp, Artificial Sequence
  dgRNA
  Gm20767
gaggacttatcctca

SEQ ID NO: 51396 - DNA, 15 bp, Artificial Sequence
  dgRNA
  Apln
ttctctctcgcgccc

SEQ ID NO: 51397 - DNA, 15 bp, Artificial Sequence
  dgRNA
  Apln
tctcgcgccctggat

SEQ ID NO: 51398 - DNA, 15 bp, Artificial Sequence
  dgRNA
  Apln
ctcgcgccctggata

SEQ ID NO: 51399 - DNA, 15 bp, Artificial Sequence
  dgRNA
  Apln
agcatgcttcccggg

SEQ ID NO: 51400 - DNA, 15 bp, Artificial Sequence
  dgRNA
  Tmem220
accgttctagacctg

SEQ ID NO: 51401 - DNA, 15 bp, Artificial Sequence
  dgRNA
  Tmem220
gttctagacctgagg

SEQ ID NO: 51402 - DNA, 15 bp, Artificial Sequence
  dgRNA
  Tmem220
tggccacgcccctct

SEQ ID NO: 51403 - DNA, 15 bp, Artificial Sequence
  dgRNA
  Tmem220
ggccacgcccctctg

SEQ ID NO: 51404 - DNA, 15 bp, Artificial Sequence
  dgRNA
  Olfr985
gttttgtcctttacc

SEQ ID NO: 51405 - DNA, 15 bp, Artificial Sequence
  dgRNA
  Olfr985
ggtgaattgtattgg

SEQ ID NO: 51406 - DNA, 15 bp, Artificial Sequence
  dgRNA
  Olfr985
gtggttcataaaagt

SEQ ID NO: 51407 - DNA, 15 bp, Artificial Sequence
  dgRNA
  Olfr985
gttcataaaagtcgg

SEQ ID NO: 51408 - DNA, 15 bp, Artificial Sequence
  dgRNA
  Cdk7
gtgcacgtggcagcg

SEQ ID NO: 51409 - DNA, 15 bp, Artificial Sequence
  dgRNA
  Cdk7
acgtggcagcgggga

SEQ ID NO: 51410 - DNA, 15 bp, Artificial Sequence
  dgRNA
  Cdk7
cgtggcagcggggaa

SEQ ID NO: 51411 - DNA, 15 bp, Artificial Sequence
  dgRNA
  Cdk7
caactcagcttccgt

SEQ ID NO: 51412 - DNA, 15 bp, Artificial Sequence
  dgRNA
  Nipbl
agctgcacttccggt

SEQ ID NO: 51413 - DNA, 15 bp, Artificial Sequence
  dgRNA
  Nipbl
aatgactccctccgc

SEQ ID NO: 51414 - DNA, 15 bp, Artificial Sequence
  dgRNA
  Nipbl
cggaagtgcagctgc

SEQ ID NO: 51415 - DNA, 15 bp, Artificial Sequence
  dgRNA
  Nipbl
gaacaaaatgccgac

SEQ ID NO: 51416 - DNA, 15 bp, Artificial Sequence
  dgRNA
  Cnpy4
cattacccagctgtc

SEQ ID NO: 51417 - DNA, 15 bp, Artificial Sequence
  dgRNA
  Cnpy4
cgctccacccacttt

SEQ ID NO: 51418 - DNA, 15 bp, Artificial Sequence
  dgRNA
  Cnpy4
cacccactttcgggc

SEQ ID NO: 51419 - DNA, 15 bp, Artificial Sequence
  dgRNA
  Cnpy4
ggtctattttgacat

SEQ ID NO: 51420 - DNA, 15 bp, Artificial Sequence
  dgRNA
  Fam76a
gagcgtcttccgagt

SEQ ID NO: 51421 - DNA, 15 bp, Artificial Sequence
  dgRNA
  Spata7
ccggacagttcactc

SEQ ID NO: 51422 - DNA, 15 bp, Artificial Sequence
  dgRNA
  Spata7
ctctggataactgcc

SEQ ID NO: 51423 - DNA, 15 bp, Artificial Sequence
  dgRNA
  Spata7
acagattgggacccg

SEQ ID NO: 51424 - DNA, 15 bp, Artificial Sequence
  dgRNA
  Spata7
tggccatcctcccgc

SEQ ID NO: 51425 - DNA, 15 bp, Artificial Sequence
  dgRNA
  Nr1d2
gacgtatccaaacag

SEQ ID NO: 51426 - DNA, 15 bp, Artificial Sequence
  dgRNA
  Nr1d2
acgtatccaaacaga

SEQ ID NO: 51427 - DNA, 15 bp, Artificial Sequence
  dgRNA
  Nr1d2
cgtatccaaacagag

SEQ ID NO: 51428 - DNA, 15 bp, Artificial Sequence
  dgRNA
  Nr1d2
gcggagccgggagaa

SEQ ID NO: 51429 - DNA, 15 bp, Artificial Sequence
  dgRNA
  Dennd4a
ggcccgcccacttgc

SEQ ID NO: 51430 - DNA, 15 bp, Artificial Sequence
  dgRNA
  Dennd4a
acccaccccctagct

SEQ ID NO: 51431 - DNA, 15 bp, Artificial Sequence
  dgRNA
  Dennd4a
ccctcgggtcagatt

SEQ ID NO: 51432 - DNA, 15 bp, Artificial Sequence
  dgRNA
  Dennd4a
gattcggcctgtgat

SEQ ID NO: 51433 - DNA, 15 bp, Artificial Sequence
  dgRNA
  Tbc1d21
gtagatttacttcct

SEQ ID NO: 51434 - DNA, 15 bp, Artificial Sequence
  dgRNA
  Tbc1d21
gattacagtgtacac

SEQ ID NO: 51435 - DNA, 15 bp, Artificial Sequence
  dgRNA
  Atxn7l1
cgaggcgaccctgcc

SEQ ID NO: 51436 - DNA, 15 bp, Artificial Sequence
  dgRNA
  Atxn7l1
cctgcccggctgaac

SEQ ID NO: 51437 - DNA, 15 bp, Artificial Sequence
  dgRNA
  Atxn7l1
gcccggctgaaccgg

SEQ ID NO: 51438 - DNA, 15 bp, Artificial Sequence
  dgRNA
  Atxn7l1
accggcggcgcactc

SEQ ID NO: 51439 - DNA, 15 bp, Artificial Sequence
  dgRNA
  Caskin2
cgctgatccaaccag

SEQ ID NO: 51440 - DNA, 15 bp, Artificial Sequence
  dgRNA
  Caskin2
ccagtggctcggctc

SEQ ID NO: 51441 - DNA, 15 bp, Artificial Sequence
  dgRNA
  Caskin2
ggctcggctctggac

SEQ ID NO: 51442 - DNA, 15 bp, Artificial Sequence
  dgRNA
  Caskin2
cggctctggactggc

SEQ ID NO: 51443 - DNA, 15 bp, Artificial Sequence
  dgRNA
  Nol4
catgcgcactgcccc

SEQ ID NO: 51444 - DNA, 15 bp, Artificial Sequence
  dgRNA
  Nol4
atgcgcactgccccc

SEQ ID NO: 51445 - DNA, 15 bp, Artificial Sequence
  dgRNA
  Nol4
cccgggatccctaaa

SEQ ID NO: 51446 - DNA, 15 bp, Artificial Sequence
  dgRNA
  Nol4
ccgggatccctaaat

SEQ ID NO: 51447 - DNA, 15 bp, Artificial Sequence
  dgRNA
  1110051M20Rik
cggaacttgtgtgat

SEQ ID NO: 51448 - DNA, 15 bp, Artificial Sequence
  dgRNA
  1110051M20Rik
ctctacgttgccagt

SEQ ID NO: 51449 - DNA, 15 bp, Artificial Sequence
  dgRNA
  1110051M20Rik
gccgcctgggtgcca

SEQ ID NO: 51450 - DNA, 15 bp, Artificial Sequence
  dgRNA
  1110051M20Rik
gacaggctgtaacct

SEQ ID NO: 51451 - DNA, 15 bp, Artificial Sequence
  dgRNA
  Trappc13
agggcgctactgtca

SEQ ID NO: 51452 - DNA, 15 bp, Artificial Sequence
  dgRNA
  Trappc13
attgcccggtggggg

SEQ ID NO: 51453 - DNA, 15 bp, Artificial Sequence
  dgRNA
  Trappc13
ttcattgcccggtgg

SEQ ID NO: 51454 - DNA, 15 bp, Artificial Sequence
  dgRNA
  Trappc13
tttcattgcccggtg

SEQ ID NO: 51455 - DNA, 15 bp, Artificial Sequence
  dgRNA
  Fxr1
gccggccatgcgctc

SEQ ID NO: 51456 - DNA, 15 bp, Artificial Sequence
  dgRNA
  Fxr1
gcccgagcgcccgcc

SEQ ID NO: 51457 - DNA, 15 bp, Artificial Sequence
  dgRNA
  Fxr1
ggccgcgcttcctga

SEQ ID NO: 51458 - DNA, 15 bp, Artificial Sequence
  dgRNA
  Fxr1
acgggaagagcccgt

SEQ ID NO: 51459 - DNA, 15 bp, Artificial Sequence
  dgRNA
  Atp6v0d2
gtcactggcaaaact

SEQ ID NO: 51460 - DNA, 15 bp, Artificial Sequence
  dgRNA
  Atp6v0d2
gtgcactcaaaccat

SEQ ID NO: 51461 - DNA, 15 bp, Artificial Sequence
  dgRNA
  Fam126a
aggccgcggtaggtc

SEQ ID NO: 51462 - DNA, 15 bp, Artificial Sequence
  dgRNA
  Fam126a
ggtccggagctgctc

SEQ ID NO: 51463 - DNA, 15 bp, Artificial Sequence
  dgRNA
  Fam126a
ccgcgagccgtacgc

SEQ ID NO: 51464 - DNA, 15 bp, Artificial Sequence
  dgRNA
  Fam126a
gtacgccggcccctg

SEQ ID NO: 51465 - DNA, 15 bp, Artificial Sequence
  dgRNA
  Olfr556
aagatactatatgag

SEQ ID NO: 51466 - DNA, 15 bp, Artificial Sequence
  dgRNA
  Rpl27
tcctagtggcagagt

SEQ ID NO: 51467 - DNA, 15 bp, Artificial Sequence
  dgRNA
  Rpl27
tccacacgccggaac

SEQ ID NO: 51468 - DNA, 15 bp, Artificial Sequence
  dgRNA
  Rpl27
gctgctaataaagct

SEQ ID NO: 51469 - DNA, 15 bp, Artificial Sequence
  dgRNA
  Rpl27
ccggcgtgtggaggg

SEQ ID NO: 51470 - DNA, 15 bp, Artificial Sequence
  dgRNA
  Cxcr6
gactctcaaattaag

SEQ ID NO: 51471 - DNA, 15 bp, Artificial Sequence
  dgRNA
  Cxcr6
actctcaaattaagt

SEQ ID NO: 51472 - DNA, 15 bp, Artificial Sequence
  dgRNA
  Cxcr6
tcaaattaagtgggc

SEQ ID NO: 51473 - DNA, 15 bp, Artificial Sequence
  dgRNA
  Cxcr6
gtcaagcttgtcatg

SEQ ID NO: 51474 - DNA, 15 bp, Artificial Sequence
  dgRNA
  Ankra2
cgcgtttccggctcc

SEQ ID NO: 51475 - DNA, 15 bp, Artificial Sequence
  dgRNA
  Fbxo42
gcactatcaaacaat

SEQ ID NO: 51476 - DNA, 15 bp, Artificial Sequence
  dgRNA
  Fbxo42
aaagctccgcgccct

SEQ ID NO: 51477 - DNA, 15 bp, Artificial Sequence
  dgRNA
  Fbxo42
cggcccttctcaata

SEQ ID NO: 51478 - DNA, 15 bp, Artificial Sequence
  dgRNA
  Fbxo42
tatggcgccgcccag

SEQ ID NO: 51479 - DNA, 15 bp, Artificial Sequence
  dgRNA
  Mrpl11
ctgtgcgcaccgctg

SEQ ID NO: 51480 - DNA, 15 bp, Artificial Sequence
  dgRNA
  Mrpl11
tgtgcgcaccgctga

SEQ ID NO: 51481 - DNA, 15 bp, Artificial Sequence
  dgRNA
  Mrpl11
gtactgaaaccatat

SEQ ID NO: 51482 - DNA, 15 bp, Artificial Sequence
  dgRNA
  Mrpl11
cttaaattccgtaat

SEQ ID NO: 51483 - DNA, 15 bp, Artificial Sequence
  dgRNA
  Nefm
tggtgcgggcccacg

SEQ ID NO: 51484 - DNA, 15 bp, Artificial Sequence
  dgRNA
  Nefm
cgggcccacgtggag

SEQ ID NO: 51485 - DNA, 15 bp, Artificial Sequence
  dgRNA
  Nefm
cgctgaatcaccgca

SEQ ID NO: 51486 - DNA, 15 bp, Artificial Sequence
  dgRNA
  Nefm
gccgcctccacgggg

SEQ ID NO: 51487 - DNA, 15 bp, Artificial Sequence
  dgRNA
  Galnt11
gagtgaacttcacta

SEQ ID NO: 51488 - DNA, 15 bp, Artificial Sequence
  dgRNA
  Galnt11
tcactaaggccctat

SEQ ID NO: 51489 - DNA, 15 bp, Artificial Sequence
  dgRNA
  Galnt11
gctccacactgggcg

SEQ ID NO: 51490 - DNA, 15 bp, Artificial Sequence
  dgRNA
  Galnt11
gggcctcgtgacgcc

SEQ ID NO: 51491 - DNA, 15 bp, Artificial Sequence
  dgRNA
  Dnm1
aaacgacaacaccca

SEQ ID NO: 51492 - DNA, 15 bp, Artificial Sequence
  dgRNA
  Dnm1
ccgcgcgccatctag

SEQ ID NO: 51493 - DNA, 15 bp, Artificial Sequence
  dgRNA
  Dnm1
cgcgccatctagcgg

SEQ ID NO: 51494 - DNA, 15 bp, Artificial Sequence
  dgRNA
  Dnm1
catctagcggcggcc

SEQ ID NO: 51495 - DNA, 15 bp, Artificial Sequence
  dgRNA
  Kcnt1
aaccttaagcccgcc

SEQ ID NO: 51496 - DNA, 15 bp, Artificial Sequence
  dgRNA
  Kcnt1
cttaagcccgcccgg

SEQ ID NO: 51497 - DNA, 15 bp, Artificial Sequence
  dgRNA
  Kcnt1
cccgcccggaggacc

SEQ ID NO: 51498 - DNA, 15 bp, Artificial Sequence
  dgRNA
  Kcnt1
ccgcccggaggaccc

SEQ ID NO: 51499 - DNA, 15 bp, Artificial Sequence
  dgRNA
  Smim6
gaggcaggtactgcg

SEQ ID NO: 51500 - DNA, 15 bp, Artificial Sequence
  dgRNA
  Smim6
aggtactgcggggaa

SEQ ID NO: 51501 - DNA, 15 bp, Artificial Sequence
  dgRNA
  Smim6
attcacccaaaccgc

SEQ ID NO: 51502 - DNA, 15 bp, Artificial Sequence
  dgRNA
  Smim6
acccaaaccgcagga

SEQ ID NO: 51503 - DNA, 15 bp, Artificial Sequence
  dgRNA
  Nrn1
ggtgattctctacca

SEQ ID NO: 51504 - DNA, 15 bp, Artificial Sequence
  dgRNA
  Nrn1
gtcatcccccacgtc

SEQ ID NO: 51505 - DNA, 15 bp, Artificial Sequence
  dgRNA
  Nrn1
cgtcaggcctgctcg

SEQ ID NO: 51506 - DNA, 15 bp, Artificial Sequence
  dgRNA
  Nrn1
gtcaggcctgctcgt

SEQ ID NO: 51507 - DNA, 15 bp, Artificial Sequence
  dgRNA
  Idh3b
tccttgttcaatact

SEQ ID NO: 51508 - DNA, 15 bp, Artificial Sequence
  dgRNA
  Idh3b
ttggccatatatatt

SEQ ID NO: 51509 - DNA, 15 bp, Artificial Sequence
  dgRNA
  Idh3b
gccaagtattgaaca

SEQ ID NO: 51510 - DNA, 15 bp, Artificial Sequence
  dgRNA
  Idh3b
gtaatgtagggtcac

SEQ ID NO: 51511 - DNA, 15 bp, Artificial Sequence
  dgRNA
  Dnaja1
gcgggttccttgagc

SEQ ID NO: 51512 - DNA, 15 bp, Artificial Sequence
  dgRNA
  Dnaja1
ccttgagccggcctc

SEQ ID NO: 51513 - DNA, 15 bp, Artificial Sequence
  dgRNA
  Dnaja1
gccggcctcgggctt

SEQ ID NO: 51514 - DNA, 15 bp, Artificial Sequence
  dgRNA
  Dnaja1
gcctcgggcttcgga

SEQ ID NO: 51515 - DNA, 15 bp, Artificial Sequence
  dgRNA
  Trpc4
cattcgggcagaccc

SEQ ID NO: 51516 - DNA, 15 bp, Artificial Sequence
  dgRNA
  Trpc4
tgggggcggtcctcc

SEQ ID NO: 51517 - DNA, 15 bp, Artificial Sequence
  dgRNA
  Trpc4
ggaacgcaacttttc

SEQ ID NO: 51518 - DNA, 15 bp, Artificial Sequence
  dgRNA
  Trpc4
gaacgcaacttttcc

SEQ ID NO: 51519 - DNA, 15 bp, Artificial Sequence
  dgRNA
  Mael
gccccctcacgcacg

SEQ ID NO: 51520 - DNA, 15 bp, Artificial Sequence
  dgRNA
  Mael
ccctcacgcacgagg

SEQ ID NO: 51521 - DNA, 15 bp, Artificial Sequence
  dgRNA
  Mael
tttcacccccacagc

SEQ ID NO: 51522 - DNA, 15 bp, Artificial Sequence
  dgRNA
  Mael
gcgctgcaccctgat

SEQ ID NO: 51523 - DNA, 15 bp, Artificial Sequence
  dgRNA
  Ncmap
agtcccctgagcggc

SEQ ID NO: 51524 - DNA, 15 bp, Artificial Sequence
  dgRNA
  Ncmap
cccctgagcggcagg

SEQ ID NO: 51525 - DNA, 15 bp, Artificial Sequence
  dgRNA
  Ncmap
aggagagagcgacgt

SEQ ID NO: 51526 - DNA, 15 bp, Artificial Sequence
  dgRNA
  Ncmap
acgtggggacactgc

SEQ ID NO: 51527 - DNA, 15 bp, Artificial Sequence
  dgRNA
  Gpr119
gatctcctgtcagac

SEQ ID NO: 51528 - DNA, 15 bp, Artificial Sequence
  dgRNA
  Gpr119
agcatcaatgaaggg

SEQ ID NO: 51529 - DNA, 15 bp, Artificial Sequence
  dgRNA
  Gpr119
agttgtctagtaact

SEQ ID NO: 51530 - DNA, 15 bp, Artificial Sequence
  dgRNA
  Gpr119
taacttggatagtag

SEQ ID NO: 51531 - DNA, 15 bp, Artificial Sequence
  dgRNA
  Npr1
aggagttaaaggacc

SEQ ID NO: 51532 - DNA, 15 bp, Artificial Sequence
  dgRNA
  Npr1
ttaaaggaccgggat

SEQ ID NO: 51533 - DNA, 15 bp, Artificial Sequence
  dgRNA
  Npr1
cgggattggctcccc

SEQ ID NO: 51534 - DNA, 15 bp, Artificial Sequence
  dgRNA
  Npr1
tcttgtcgccgaatc

SEQ ID NO: 51535 - DNA, 15 bp, Artificial Sequence
  dgRNA
  Actr6
tagcagtttctacta

SEQ ID NO: 51536 - DNA, 15 bp, Artificial Sequence
  dgRNA
  Actr6
ccgctgctcgacttc

SEQ ID NO: 51537 - DNA, 15 bp, Artificial Sequence
  dgRNA
  Actr6
gcgtactccgttgtc

SEQ ID NO: 51538 - DNA, 15 bp, Artificial Sequence
  dgRNA
  Actr6
cgtactccgttgtca

SEQ ID NO: 51539 - DNA, 15 bp, Artificial Sequence
  dgRNA
  Eny2
ggccgagcgaccaga

SEQ ID NO: 51540 - DNA, 15 bp, Artificial Sequence
  dgRNA
  Eny2
cgagcgaccagaagg

SEQ ID NO: 51541 - DNA, 15 bp, Artificial Sequence
  dgRNA
  Eny2
tctcacattataggc

SEQ ID NO: 51542 - DNA, 15 bp, Artificial Sequence
  dgRNA
  Eny2
acattataggcaggg

SEQ ID NO: 51543 - DNA, 15 bp, Artificial Sequence
  dgRNA
  Elovl2
gggcccacggcctcg

SEQ ID NO: 51544 - DNA, 15 bp, Artificial Sequence
  dgRNA
  Elovl2
ccacggcctcgcggc

SEQ ID NO: 51545 - DNA, 15 bp, Artificial Sequence
  dgRNA
  Elovl2
cctcgcggccggcgc

SEQ ID NO: 51546 - DNA, 15 bp, Artificial Sequence
  dgRNA
  Elovl2
ctcgcggccggcgcc

SEQ ID NO: 51547 - DNA, 15 bp, Artificial Sequence
  dgRNA
  9-Sep
gaatcttgtccccct

SEQ ID NO: 51548 - DNA, 15 bp, Artificial Sequence
  dgRNA
  9-Sep
cccgctgctgtggcc

SEQ ID NO: 51549 - DNA, 15 bp, Artificial Sequence
  dgRNA
  9-Sep
acatccgcccacatc

SEQ ID NO: 51550 - DNA, 15 bp, Artificial Sequence
  dgRNA
  9-Sep
cacatctggccgcgg

SEQ ID NO: 51551 - DNA, 15 bp, Artificial Sequence
  dgRNA
  Clstn1
gcagcgctgccgacg

SEQ ID NO: 51552 - DNA, 15 bp, Artificial Sequence
  dgRNA
  Clstn1
cagcgctgccgacga

SEQ ID NO: 51553 - DNA, 15 bp, Artificial Sequence
  dgRNA
  Clstn1
agcgctgccgacgag

SEQ ID NO: 51554 - DNA, 15 bp, Artificial Sequence
  dgRNA
  Clstn1
gctgccgacgagggg

SEQ ID NO: 51555 - DNA, 15 bp, Artificial Sequence
  dgRNA
  Impa1
cacggtaacttcaac

SEQ ID NO: 51556 - DNA, 15 bp, Artificial Sequence
  dgRNA
  Impa1
gaccagcccttacaa

SEQ ID NO: 51557 - DNA, 15 bp, Artificial Sequence
  dgRNA
  Impa1
aaggcaaattcggcc

SEQ ID NO: 51558 - DNA, 15 bp, Artificial Sequence
  dgRNA
  Impa1
tgagcgaagacgtga

SEQ ID NO: 51559 - DNA, 15 bp, Artificial Sequence
  dgRNA
  Vmn1r87
ttcgctacagtctcc

SEQ ID NO: 51560 - DNA, 15 bp, Artificial Sequence
  dgRNA
  Vmn1r87
gcgaaatgtgcacta

SEQ ID NO: 51561 - DNA, 15 bp, Artificial Sequence
  dgRNA
  Vmn1r87
tgttctgctaggata

SEQ ID NO: 51562 - DNA, 15 bp, Artificial Sequence
  dgRNA
  Olfr1408
gtacagatccatcct

SEQ ID NO: 51563 - DNA, 15 bp, Artificial Sequence
  dgRNA
  Olfr1408
agtgtactcagggtc

SEQ ID NO: 51564 - DNA, 15 bp, Artificial Sequence
  dgRNA
  Siah1a
aaccgccaccgagtg

SEQ ID NO: 51565 - DNA, 15 bp, Artificial Sequence
  dgRNA
  Siah1a
accgccaccgagtgc

SEQ ID NO: 51566 - DNA, 15 bp, Artificial Sequence
  dgRNA
  Siah1a
gcttctgcgcgtgcg

SEQ ID NO: 51567 - DNA, 15 bp, Artificial Sequence
  dgRNA
  Siah1a
gcgcgtgcgtggccg

SEQ ID NO: 51568 - DNA, 15 bp, Artificial Sequence
  dgRNA
  Ddc
tttaaccagaataca

SEQ ID NO: 51569 - DNA, 15 bp, Artificial Sequence
  dgRNA
  Ddc
caaggctaaaatgta

SEQ ID NO: 51570 - DNA, 15 bp, Artificial Sequence
  dgRNA
  Ddc
cgtgtagcccttctt

SEQ ID NO: 51571 - DNA, 15 bp, Artificial Sequence
  dgRNA
  Eif2s2
cttttcgaacctctt

SEQ ID NO: 51572 - DNA, 15 bp, Artificial Sequence
  dgRNA
  Eif2s2
gaagcgcacaagcgc

SEQ ID NO: 51573 - DNA, 15 bp, Artificial Sequence
  dgRNA
  Eif2s2
cagtatgcccggcgc

SEQ ID NO: 51574 - DNA, 15 bp, Artificial Sequence
  dgRNA
  Eif2s2
agtatgcccggcgcc

SEQ ID NO: 51575 - DNA, 15 bp, Artificial Sequence
  dgRNA
  Numa1
caggaacagcggatt

SEQ ID NO: 51576 - DNA, 15 bp, Artificial Sequence
  dgRNA
  Numa1
cagcggattaggttc

SEQ ID NO: 51577 - DNA, 15 bp, Artificial Sequence
  dgRNA
  Numa1
gctagagccctcaac

SEQ ID NO: 51578 - DNA, 15 bp, Artificial Sequence
  dgRNA
  Numa1
gagtatggcaggcgc

SEQ ID NO: 51579 - DNA, 15 bp, Artificial Sequence
  dgRNA
  Olfr554
atgtcttgctacatt

SEQ ID NO: 51580 - DNA, 15 bp, Artificial Sequence
  dgRNA
  Trim56
tgctggagtcgggtc

SEQ ID NO: 51581 - DNA, 15 bp, Artificial Sequence
  dgRNA
  Trim56
tattgccccggccag

SEQ ID NO: 51582 - DNA, 15 bp, Artificial Sequence
  dgRNA
  Trim56
attgccccggccaga

SEQ ID NO: 51583 - DNA, 15 bp, Artificial Sequence
  dgRNA
  Trim56
ttgccccggccagag

SEQ ID NO: 51584 - DNA, 15 bp, Artificial Sequence
  dgRNA
  Etnppl
tgcaattacaagatg

SEQ ID NO: 51585 - DNA, 15 bp, Artificial Sequence
  dgRNA
  Etnppl
aaggggaatgaccct

SEQ ID NO: 51586 - DNA, 15 bp, Artificial Sequence
  dgRNA
  Etnppl
cgcccccagtctgac

SEQ ID NO: 51587 - DNA, 15 bp, Artificial Sequence
  dgRNA
  Tppp2
acgttatagctgcag

SEQ ID NO: 51588 - DNA, 15 bp, Artificial Sequence
  dgRNA
  Trrap
ccgtttgcgacgcga

SEQ ID NO: 51589 - DNA, 15 bp, Artificial Sequence
  dgRNA
  Trrap
cgtttgcgacgcgaa

SEQ ID NO: 51590 - DNA, 15 bp, Artificial Sequence
  dgRNA
  Trrap
cgaagggattgagtg

SEQ ID NO: 51591 - DNA, 15 bp, Artificial Sequence
  dgRNA
  Trrap
ttgagtgaggagtcg

SEQ ID NO: 51592 - DNA, 15 bp, Artificial Sequence
  dgRNA
  Prl2c2
ctatattagtgtgca

SEQ ID NO: 51593 - DNA, 15 bp, Artificial Sequence
  dgRNA
  Rad54l
ggtctgttgagcctc

SEQ ID NO: 51594 - DNA, 15 bp, Artificial Sequence
  dgRNA
  Rad54l
ctgaacgcagccaat

SEQ ID NO: 51595 - DNA, 15 bp, Artificial Sequence
  dgRNA
  Rad54l
tgaacgcagccaata

SEQ ID NO: 51596 - DNA, 15 bp, Artificial Sequence
  dgRNA
  Rad54l
gaacgcagccaatag

SEQ ID NO: 51597 - DNA, 15 bp, Artificial Sequence
  dgRNA
  Ccdc185
gcattgtgaagtggc

SEQ ID NO: 51598 - DNA, 15 bp, Artificial Sequence
  dgRNA
  Ccdc185
tggcaggagcgtcac

SEQ ID NO: 51599 - DNA, 15 bp, Artificial Sequence
  dgRNA
  Ccdc185
gcgtcacaggccaca

SEQ ID NO: 51600 - DNA, 15 bp, Artificial Sequence
  dgRNA
  Ccdc185
ggccacatggatcac

SEQ ID NO: 51601 - DNA, 15 bp, Artificial Sequence
  dgRNA
  Ndrg4
gctgtgtggctcggg

SEQ ID NO: 51602 - DNA, 15 bp, Artificial Sequence
  dgRNA
  Ndrg4
cctaacagccaatgc

SEQ ID NO: 51603 - DNA, 15 bp, Artificial Sequence
  dgRNA
  Ndrg4
gccaatgcgggagcg

SEQ ID NO: 51604 - DNA, 15 bp, Artificial Sequence
  dgRNA
  Ndrg4
ccaatgcgggagcga

SEQ ID NO: 51605 - DNA, 15 bp, Artificial Sequence
  dgRNA
  Gucy2e
agatcctaatcggct

SEQ ID NO: 51606 - DNA, 15 bp, Artificial Sequence
  dgRNA
  Gucy2e
tcctaatcggcttgg

SEQ ID NO: 51607 - DNA, 15 bp, Artificial Sequence
  dgRNA
  Gucy2e
cctaatcggcttgga

SEQ ID NO: 51608 - DNA, 15 bp, Artificial Sequence
  dgRNA
  Gucy2e
gattaagggctgcag

SEQ ID NO: 51609 - DNA, 15 bp, Artificial Sequence
  dgRNA
  4933421I07Rik
gtcctgttgtacaca

SEQ ID NO: 51610 - DNA, 15 bp, Artificial Sequence
  dgRNA
  Il9r
ctcctggatcaggta

SEQ ID NO: 51611 - DNA, 15 bp, Artificial Sequence
  dgRNA
  Il9r
gcacccaaggacagt

SEQ ID NO: 51612 - DNA, 15 bp, Artificial Sequence
  dgRNA
  Il9r
gatgagtctctcagc

SEQ ID NO: 51613 - DNA, 15 bp, Artificial Sequence
  dgRNA
  9430038I01Rik
tcgacaagccactca

SEQ ID NO: 51614 - DNA, 15 bp, Artificial Sequence
  dgRNA
  9430038I01Rik
aagccactcacggct

SEQ ID NO: 51615 - DNA, 15 bp, Artificial Sequence
  dgRNA
  9430038I01Rik
agccactcacggctt

SEQ ID NO: 51616 - DNA, 15 bp, Artificial Sequence
  dgRNA
  9430038I01Rik
cggcttgggcttgcg

SEQ ID NO: 51617 - DNA, 15 bp, Artificial Sequence
  dgRNA
  Tdrd5
gggggagccggtcct

SEQ ID NO: 51618 - DNA, 15 bp, Artificial Sequence
  dgRNA
  Tdrd5
ccgcacccacacgct

SEQ ID NO: 51619 - DNA, 15 bp, Artificial Sequence
  dgRNA
  Tdrd5
cgctaaccgtcacac

SEQ ID NO: 51620 - DNA, 15 bp, Artificial Sequence
  dgRNA
  Tdrd5
ccgcgcccgctcgcg

SEQ ID NO: 51621 - DNA, 15 bp, Artificial Sequence
  dgRNA
  Lgi1
atgccgtcctatttt

SEQ ID NO: 51622 - DNA, 15 bp, Artificial Sequence
  dgRNA
  Lgi1
tttggtaacaattaa

SEQ ID NO: 51623 - DNA, 15 bp, Artificial Sequence
  dgRNA
  Lgi1
atctcgggaacctct

SEQ ID NO: 51624 - DNA, 15 bp, Artificial Sequence
  dgRNA
  Lgi1
aatctcgggaacctc

SEQ ID NO: 51625 - DNA, 15 bp, Artificial Sequence
  dgRNA
  Phf23
ccgccactcccctgg

SEQ ID NO: 51626 - DNA, 15 bp, Artificial Sequence
  dgRNA
  Phf23
cactcccctggtggt

SEQ ID NO: 51627 - DNA, 15 bp, Artificial Sequence
  dgRNA
  Phf23
actcccctggtggtg

SEQ ID NO: 51628 - DNA, 15 bp, Artificial Sequence
  dgRNA
  Phf23
tacgcaacggggagc

SEQ ID NO: 51629 - DNA, 15 bp, Artificial Sequence
  dgRNA
  Cdk20
gcgtttcttgtcacg

SEQ ID NO: 51630 - DNA, 15 bp, Artificial Sequence
  dgRNA
  Cdk20
tgtcacgtggtgcta

SEQ ID NO: 51631 - DNA, 15 bp, Artificial Sequence
  dgRNA
  Cdk20
gctatggccacgtcc

SEQ ID NO: 51632 - DNA, 15 bp, Artificial Sequence
  dgRNA
  Cdk20
gactgccgaaggctg

SEQ ID NO: 51633 - DNA, 15 bp, Artificial Sequence
  dgRNA
  Grid1
cctcgtagcatcccc

SEQ ID NO: 51634 - DNA, 15 bp, Artificial Sequence
  dgRNA
  Grid1
gtagcatcccccggc

SEQ ID NO: 51635 - DNA, 15 bp, Artificial Sequence
  dgRNA
  Grid1
tagcatcccccggcc

SEQ ID NO: 51636 - DNA, 15 bp, Artificial Sequence
  dgRNA
  Grid1
gggagcgcggagcac

SEQ ID NO: 51637 - DNA, 15 bp, Artificial Sequence
  dgRNA
  Fzd3
gaatgcctccagcgc

SEQ ID NO: 51638 - DNA, 15 bp, Artificial Sequence
  dgRNA
  Fzd3
aatgcctccagcgct

SEQ ID NO: 51639 - DNA, 15 bp, Artificial Sequence
  dgRNA
  Fzd3
caccaaaccgacgcg

SEQ ID NO: 51640 - DNA, 15 bp, Artificial Sequence
  dgRNA
  Fzd3
acgtcactatcacct

SEQ ID NO: 51641 - DNA, 15 bp, Artificial Sequence
  dgRNA
  Alox12b
tcagcgccctgcctg

SEQ ID NO: 51642 - DNA, 15 bp, Artificial Sequence
  dgRNA
  Alox12b
attggctgcagcgac

SEQ ID NO: 51643 - DNA, 15 bp, Artificial Sequence
  dgRNA
  Alox12b
gctgttcgcccccat

SEQ ID NO: 51644 - DNA, 15 bp, Artificial Sequence
  dgRNA
  Alox12b
gaggaaccgcaggca

SEQ ID NO: 51645 - DNA, 15 bp, Artificial Sequence
  dgRNA
  Epn2
ccttgggggcatatg

SEQ ID NO: 51646 - DNA, 15 bp, Artificial Sequence
  dgRNA
  Epn2
cttgggggcatatgt

SEQ ID NO: 51647 - DNA, 15 bp, Artificial Sequence
  dgRNA
  Epn2
aggggcggaccggtt

SEQ ID NO: 51648 - DNA, 15 bp, Artificial Sequence
  dgRNA
  Epn2
ggcggaccggtttgg

SEQ ID NO: 51649 - DNA, 15 bp, Artificial Sequence
  dgRNA
  Tmem259
cactgcaaacgagac

SEQ ID NO: 51650 - DNA, 15 bp, Artificial Sequence
  dgRNA
  Tmem259
ccggacaaagcttga

SEQ ID NO: 51651 - DNA, 15 bp, Artificial Sequence
  dgRNA
  Tmem259
tgccctttagcgctg

SEQ ID NO: 51652 - DNA, 15 bp, Artificial Sequence
  dgRNA
  Tmem259
tccgcccactactcg

SEQ ID NO: 51653 - DNA, 15 bp, Artificial Sequence
  dgRNA
  H2-M2
cctagagtctcctta

SEQ ID NO: 51654 - DNA, 15 bp, Artificial Sequence
  dgRNA
  H2-M2
aattcctcacaatcc

SEQ ID NO: 51655 - DNA, 15 bp, Artificial Sequence
  dgRNA
  H2-M2
gctggaattccccta

SEQ ID NO: 51656 - DNA, 15 bp, Artificial Sequence
  dgRNA
  H2-M2
gaggaattcccttgc

SEQ ID NO: 51657 - DNA, 15 bp, Artificial Sequence
  dgRNA
  Spats2l
aaggacgccttcagt

SEQ ID NO: 51658 - DNA, 15 bp, Artificial Sequence
  dgRNA
  Spats2l
aggacgccttcagta

SEQ ID NO: 51659 - DNA, 15 bp, Artificial Sequence
  dgRNA
  Spats2l
ggacgccttcagtag

SEQ ID NO: 51660 - DNA, 15 bp, Artificial Sequence
  dgRNA
  Spats2l
cgccttcagtagggg

SEQ ID NO: 51661 - DNA, 15 bp, Artificial Sequence
  dgRNA
  Cbr3
gctgaccccttcctt

SEQ ID NO: 51662 - DNA, 15 bp, Artificial Sequence
  dgRNA
  Cbr3
gaccactgcttagct

SEQ ID NO: 51663 - DNA, 15 bp, Artificial Sequence
  dgRNA
  Cbr3
gcttagctcggaacc

SEQ ID NO: 51664 - DNA, 15 bp, Artificial Sequence
  dgRNA
  Cbr3
gatctctacactggc

SEQ ID NO: 51665 - DNA, 15 bp, Artificial Sequence
  dgRNA
  Klhl28
aaccgagcgcttcca

SEQ ID NO: 51666 - DNA, 15 bp, Artificial Sequence
  dgRNA
  Klhl28
gcggacctcttgacc

SEQ ID NO: 51667 - DNA, 15 bp, Artificial Sequence
  dgRNA
  Klhl28
gaaaccaatctgccg

SEQ ID NO: 51668 - DNA, 15 bp, Artificial Sequence
  dgRNA
  Klhl28
accaatctgccgcgg

SEQ ID NO: 51669 - DNA, 15 bp, Artificial Sequence
  dgRNA
  Arpc1b
tctccgaacgaattc

SEQ ID NO: 51670 - DNA, 15 bp, Artificial Sequence
  dgRNA
  Arpc1b
ctccgaacgaattct

SEQ ID NO: 51671 - DNA, 15 bp, Artificial Sequence
  dgRNA
  Arpc1b
gacttaactgaggtc

SEQ ID NO: 51672 - DNA, 15 bp, Artificial Sequence
  dgRNA
  Arpc1b
taactgaggtccggg

SEQ ID NO: 51673 - DNA, 15 bp, Artificial Sequence
  dgRNA
  Stard10
tgttacttcgctatg

SEQ ID NO: 51674 - DNA, 15 bp, Artificial Sequence
  dgRNA
  Stard10
tttgccccttccccg

SEQ ID NO: 51675 - DNA, 15 bp, Artificial Sequence
  dgRNA
  Stard10
cttccccggggctta

SEQ ID NO: 51676 - DNA, 15 bp, Artificial Sequence
  dgRNA
  Stard10
ttccccggggcttac

SEQ ID NO: 51677 - DNA, 15 bp, Artificial Sequence
  dgRNA
  Me1
ctgcatcaggccccg

SEQ ID NO: 51678 - DNA, 15 bp, Artificial Sequence
  dgRNA
  Me1
tggcacccaggacgt

SEQ ID NO: 51679 - DNA, 15 bp, Artificial Sequence
  dgRNA
  Me1
ggcacccaggacgtt

SEQ ID NO: 51680 - DNA, 15 bp, Artificial Sequence
  dgRNA
  Me1
caggacgttggggtt

SEQ ID NO: 51681 - DNA, 15 bp, Artificial Sequence
  dgRNA
  Ctso
cttctgggcgtgcac

SEQ ID NO: 51682 - DNA, 15 bp, Artificial Sequence
  dgRNA
  Slc45a3
aattggaagggggcc

SEQ ID NO: 51683 - DNA, 15 bp, Artificial Sequence
  dgRNA
  Slc45a3
catatagcagtcacc

SEQ ID NO: 51684 - DNA, 15 bp, Artificial Sequence
  dgRNA
  Slc45a3
tataaatcgtagatg

SEQ ID NO: 51685 - DNA, 15 bp, Artificial Sequence
  dgRNA
  Slc45a3
aggcccccttccaat

SEQ ID NO: 51686 - DNA, 15 bp, Artificial Sequence
  dgRNA
  Terf1
actatccaaaacgcc

SEQ ID NO: 51687 - DNA, 15 bp, Artificial Sequence
  dgRNA
  Terf1
ctatccaaaacgcct

SEQ ID NO: 51688 - DNA, 15 bp, Artificial Sequence
  dgRNA
  Terf1
caaaacgcctgggct

SEQ ID NO: 51689 - DNA, 15 bp, Artificial Sequence
  dgRNA
  Terf1
gggctcggatcgaca

SEQ ID NO: 51690 - DNA, 15 bp, Artificial Sequence
  dgRNA
  Tom1l1
cacatcactccaccc

SEQ ID NO: 51691 - DNA, 15 bp, Artificial Sequence
  dgRNA
  Tom1l1
ccacctagagtcacg

SEQ ID NO: 51692 - DNA, 15 bp, Artificial Sequence
  dgRNA
  Tom1l1
tagagtcacgaggtg

SEQ ID NO: 51693 - DNA, 15 bp, Artificial Sequence
  dgRNA
  Tom1l1
agagtcacgaggtgc

SEQ ID NO: 51694 - DNA, 15 bp, Artificial Sequence
  dgRNA
  Ckap4
ctcggcctcccttcc

SEQ ID NO: 51695 - DNA, 15 bp, Artificial Sequence
  dgRNA
  Ckap4
tcccttcccgggagg

SEQ ID NO: 51696 - DNA, 15 bp, Artificial Sequence
  dgRNA
  Ckap4
ccttcccgggaggcg

SEQ ID NO: 51697 - DNA, 15 bp, Artificial Sequence
  dgRNA
  Ckap4
tcctccttccgcggc

SEQ ID NO: 51698 - DNA, 15 bp, Artificial Sequence
  dgRNA
  Pdp1
cgcccctgcctcgcc

SEQ ID NO: 51699 - DNA, 15 bp, Artificial Sequence
  dgRNA
  Gm1587
agtccggaatgtgat

SEQ ID NO: 51700 - DNA, 15 bp, Artificial Sequence
  dgRNA
  Gm1587
cggaatgtgattggt

SEQ ID NO: 51701 - DNA, 15 bp, Artificial Sequence
  dgRNA
  Gm1587
ccttctgcagtaatc

SEQ ID NO: 51702 - DNA, 15 bp, Artificial Sequence
  dgRNA
  Gm1587
gctccagacagaacg

SEQ ID NO: 51703 - DNA, 15 bp, Artificial Sequence
  dgRNA
  Evc
aagagtagcttgctc

SEQ ID NO: 51704 - DNA, 15 bp, Artificial Sequence
  dgRNA
  Evc
gcttgctccggagac

SEQ ID NO: 51705 - DNA, 15 bp, Artificial Sequence
  dgRNA
  Evc
gctccggagactggg

SEQ ID NO: 51706 - DNA, 15 bp, Artificial Sequence
  dgRNA
  Evc
ggtcctcgggctgaa

SEQ ID NO: 51707 - DNA, 15 bp, Artificial Sequence
  dgRNA
  Olfr310
atcataccatacaac

SEQ ID NO: 51708 - DNA, 15 bp, Artificial Sequence
  dgRNA
  Hspa13
ttgggccttcgtgcg

SEQ ID NO: 51709 - DNA, 15 bp, Artificial Sequence
  dgRNA
  Hspa13
tgggccttcgtgcgt

SEQ ID NO: 51710 - DNA, 15 bp, Artificial Sequence
  dgRNA
  Hspa13
gggccttcgtgcgtg

SEQ ID NO: 51711 - DNA, 15 bp, Artificial Sequence
  dgRNA
  Hspa13
ccttcgtgcgtgggg

SEQ ID NO: 51712 - DNA, 15 bp, Artificial Sequence
  dgRNA
  Zfp804a
ccgcccgcacctcgc

SEQ ID NO: 51713 - DNA, 15 bp, Artificial Sequence
  dgRNA
  Zfp804a
tctcgcacttgtaac

SEQ ID NO: 51714 - DNA, 15 bp, Artificial Sequence
  dgRNA
  Zfp804a
ccggccgtcgcctcc

SEQ ID NO: 51715 - DNA, 15 bp, Artificial Sequence
  dgRNA
  Zfp804a
tcgcctcccggcccc

SEQ ID NO: 51716 - DNA, 15 bp, Artificial Sequence
  dgRNA
  Camkv
tctaggaggtgctcc

SEQ ID NO: 51717 - DNA, 15 bp, Artificial Sequence
  dgRNA
  Camkv
ctaggaggtgctcca

SEQ ID NO: 51718 - DNA, 15 bp, Artificial Sequence
  dgRNA
  Camkv
gtagatccaaccctt

SEQ ID NO: 51719 - DNA, 15 bp, Artificial Sequence
  dgRNA
  Camkv
ccaaccctttggatc

SEQ ID NO: 51720 - DNA, 15 bp, Artificial Sequence
  dgRNA
  Cd209a
ggttcacttccagta

SEQ ID NO: 51721 - DNA, 15 bp, Artificial Sequence
  dgRNA
  Cd209a
accggaagagtgaga

SEQ ID NO: 51722 - DNA, 15 bp, Artificial Sequence
  dgRNA
  Cd209a
caccggaagagtgag

SEQ ID NO: 51723 - DNA, 15 bp, Artificial Sequence
  dgRNA
  Reg4
gataaggttaattat

SEQ ID NO: 51724 - DNA, 15 bp, Artificial Sequence
  dgRNA
  Reg4
gcaggactctaacgt

SEQ ID NO: 51725 - DNA, 15 bp, Artificial Sequence
  dgRNA
  Zfp825
taaaaggacctgccc

SEQ ID NO: 51726 - DNA, 15 bp, Artificial Sequence
  dgRNA
  Zfp825
ggacctgccccggac

SEQ ID NO: 51727 - DNA, 15 bp, Artificial Sequence
  dgRNA
  Zfp825
agtcacacaacgact

SEQ ID NO: 51728 - DNA, 15 bp, Artificial Sequence
  dgRNA
  Zfp825
cattcgggtagcttt

SEQ ID NO: 51729 - DNA, 15 bp, Artificial Sequence
  dgRNA
  Mrpl48
actcggtaacaaaga

SEQ ID NO: 51730 - DNA, 15 bp, Artificial Sequence
  dgRNA
  Mrpl48
gagcagaaagcgtct

SEQ ID NO: 51731 - DNA, 15 bp, Artificial Sequence
  dgRNA
  Mrpl48
agaaagcgtctcggt

SEQ ID NO: 51732 - DNA, 15 bp, Artificial Sequence
  dgRNA
  Mrpl48
cgtctcggtaggatt

SEQ ID NO: 51733 - DNA, 15 bp, Artificial Sequence
  dgRNA
  Selp
ttctgcagtatcaac

SEQ ID NO: 51734 - DNA, 15 bp, Artificial Sequence
  dgRNA
  Selp
acaggccaactttag

SEQ ID NO: 51735 - DNA, 15 bp, Artificial Sequence
  dgRNA
  Selp
ccaactttaggggaa

SEQ ID NO: 51736 - DNA, 15 bp, Artificial Sequence
  dgRNA
  Selp
ggtgtgaatcatgcc

SEQ ID NO: 51737 - DNA, 15 bp, Artificial Sequence
  dgRNA
  Fgfbp3
gcgtgcttctgcacg

SEQ ID NO: 51738 - DNA, 15 bp, Artificial Sequence
  dgRNA
  Fgfbp3
tgtcccattgataac

SEQ ID NO: 51739 - DNA, 15 bp, Artificial Sequence
  dgRNA
  Fgfbp3
gcgtgcagaagcacg

SEQ ID NO: 51740 - DNA, 15 bp, Artificial Sequence
  dgRNA
  Fgfbp3
tatcaatgggacaga

SEQ ID NO: 51741 - DNA, 15 bp, Artificial Sequence
  dgRNA
  Wiz
cctcagctcgtcccg

SEQ ID NO: 51742 - DNA, 15 bp, Artificial Sequence
  dgRNA
  Wiz
ctcagctcgtcccgc

SEQ ID NO: 51743 - DNA, 15 bp, Artificial Sequence
  dgRNA
  Wiz
tcagctcgtcccgcg

SEQ ID NO: 51744 - DNA, 15 bp, Artificial Sequence
  dgRNA
  Wiz
gggtctcccgccccg

SEQ ID NO: 51745 - DNA, 15 bp, Artificial Sequence
  dgRNA
  1810062G17Rik
ccacatccctggata

SEQ ID NO: 51746 - DNA, 15 bp, Artificial Sequence
  dgRNA
  1810062G17Rik
gccacccccctacca

SEQ ID NO: 51747 - DNA, 15 bp, Artificial Sequence
  dgRNA
  1810062G17Rik
gccacctccctaatt

SEQ ID NO: 51748 - DNA, 15 bp, Artificial Sequence
  dgRNA
  1810062G17Rik
aattaggtcccagcc

SEQ ID NO: 51749 - DNA, 15 bp, Artificial Sequence
  dgRNA
  Aff2
gctgattttgacagg

SEQ ID NO: 51750 - DNA, 15 bp, Artificial Sequence
  dgRNA
  Aff2
gtctgctccatgtcg

SEQ ID NO: 51751 - DNA, 15 bp, Artificial Sequence
  dgRNA
  Aff2
gtcaaaatcagctga

SEQ ID NO: 51752 - DNA, 15 bp, Artificial Sequence
  dgRNA
  Aff2
acacgttatcatcct

SEQ ID NO: 51753 - DNA, 15 bp, Artificial Sequence
  dgRNA
  Slc43a2
gtctccaagtccggc

SEQ ID NO: 51754 - DNA, 15 bp, Artificial Sequence
  dgRNA
  Slc43a2
aagtccggccggaac

SEQ ID NO: 51755 - DNA, 15 bp, Artificial Sequence
  dgRNA
  Slc43a2
ccggcttctgctcgc

SEQ ID NO: 51756 - DNA, 15 bp, Artificial Sequence
  dgRNA
  Slc43a2
cggcttctgctcgcc

SEQ ID NO: 51757 - DNA, 15 bp, Artificial Sequence
  dgRNA
  Tcam1
gccaatcctgttaag

SEQ ID NO: 51758 - DNA, 15 bp, Artificial Sequence
  dgRNA
  Tcam1
agcgtcacgagtttc

SEQ ID NO: 51759 - DNA, 15 bp, Artificial Sequence
  dgRNA
  Tcam1
gcgtcacgagtttct

SEQ ID NO: 51760 - DNA, 15 bp, Artificial Sequence
  dgRNA
  Tcam1
acttcggcgcagcac

SEQ ID NO: 51761 - DNA, 15 bp, Artificial Sequence
  dgRNA
  Arl9
gacacccaaagtttt

SEQ ID NO: 51762 - DNA, 15 bp, Artificial Sequence
  dgRNA
  Arl9
atattttattccggt

SEQ ID NO: 51763 - DNA, 15 bp, Artificial Sequence
  dgRNA
  Capn1
cacaaagattggcta

SEQ ID NO: 51764 - DNA, 15 bp, Artificial Sequence
  dgRNA
  Capn1
ttttttctgcacggt

SEQ ID NO: 51765 - DNA, 15 bp, Artificial Sequence
  dgRNA
  Capn1
tttttctgcacggtt

SEQ ID NO: 51766 - DNA, 15 bp, Artificial Sequence
  dgRNA
  Capn1
ttttctgcacggttg

SEQ ID NO: 51767 - DNA, 15 bp, Artificial Sequence
  dgRNA
  Fut7
aagttataccctgcg

SEQ ID NO: 51768 - DNA, 15 bp, Artificial Sequence
  dgRNA
  Fut7
agttataccctgcga

SEQ ID NO: 51769 - DNA, 15 bp, Artificial Sequence
  dgRNA
  Fut7
gttataccctgcgag

SEQ ID NO: 51770 - DNA, 15 bp, Artificial Sequence
  dgRNA
  Fut7
accctgcgaggggat

SEQ ID NO: 51771 - DNA, 15 bp, Artificial Sequence
  dgRNA
  Gcn1l1
gaaacagcacgatgg

SEQ ID NO: 51772 - DNA, 15 bp, Artificial Sequence
  dgRNA
  Gcn1l1
aaacagcacgatggg

SEQ ID NO: 51773 - DNA, 15 bp, Artificial Sequence
  dgRNA
  Gcn1l1
cacgatggggggtgt

SEQ ID NO: 51774 - DNA, 15 bp, Artificial Sequence
  dgRNA
  Gcn1l1
ggggggtgtcggtgc

SEQ ID NO: 51775 - DNA, 15 bp, Artificial Sequence
  dgRNA
  Aox3
gaaaacgccctctag

SEQ ID NO: 51776 - DNA, 15 bp, Artificial Sequence
  dgRNA
  Aox3
ctagtggctagcgcc

SEQ ID NO: 51777 - DNA, 15 bp, Artificial Sequence
  dgRNA
  Aox3
tagtggctagcgcct

SEQ ID NO: 51778 - DNA, 15 bp, Artificial Sequence
  dgRNA
  Aox3
agtggctagcgcctg

SEQ ID NO: 51779 - DNA, 15 bp, Artificial Sequence
  dgRNA
  Klc1
cgcttgctgctgagg

SEQ ID NO: 51780 - DNA, 15 bp, Artificial Sequence
  dgRNA
  Klc1
cggctgggctctgcg

SEQ ID NO: 51781 - DNA, 15 bp, Artificial Sequence
  dgRNA
  Klc1
ggctctgcgcggcct

SEQ ID NO: 51782 - DNA, 15 bp, Artificial Sequence
  dgRNA
  Klc1
cgcctcagcagcaag

SEQ ID NO: 51783 - DNA, 15 bp, Artificial Sequence
  dgRNA
  Olfr1242
aacccttgtactttc

SEQ ID NO: 51784 - DNA, 15 bp, Artificial Sequence
  dgRNA
  Olfr1242
gccacataagtattt

SEQ ID NO: 51785 - DNA, 15 bp, Artificial Sequence
  dgRNA
  Olfr1242
gtgcctgaaagtaca

SEQ ID NO: 51786 - DNA, 15 bp, Artificial Sequence
  dgRNA
  Olfr1242
tggtgaacatacagt

SEQ ID NO: 51787 - DNA, 15 bp, Artificial Sequence
  dgRNA
  Ikzf2
agccgatctgtttgc

SEQ ID NO: 51788 - DNA, 15 bp, Artificial Sequence
  dgRNA
  Ikzf2
tgctggattcggtct

SEQ ID NO: 51789 - DNA, 15 bp, Artificial Sequence
  dgRNA
  Ikzf2
cggcttcaactctgc

SEQ ID NO: 51790 - DNA, 15 bp, Artificial Sequence
  dgRNA
  Ikzf2
ggcttcaactctgca

SEQ ID NO: 51791 - DNA, 15 bp, Artificial Sequence
  dgRNA
  Rapgef1
gtggcgccgtggccg

SEQ ID NO: 51792 - DNA, 15 bp, Artificial Sequence
  dgRNA
  Rapgef1
tggcgccgtggccgc

SEQ ID NO: 51793 - DNA, 15 bp, Artificial Sequence
  dgRNA
  Rapgef1
tgggccccgcggcca

SEQ ID NO: 51794 - DNA, 15 bp, Artificial Sequence
  dgRNA
  Olfr203
aatcacccaatagat

SEQ ID NO: 51795 - DNA, 15 bp, Artificial Sequence
  dgRNA
  Olfr203
atcacccaatagatt

SEQ ID NO: 51796 - DNA, 15 bp, Artificial Sequence
  dgRNA
  Olfr203
gaagcccaatctatt

SEQ ID NO: 51797 - DNA, 15 bp, Artificial Sequence
  dgRNA
  Olfr203
agaagcccaatctat

SEQ ID NO: 51798 - DNA, 15 bp, Artificial Sequence
  dgRNA
  Zfp689
aagacttctcacaac

SEQ ID NO: 51799 - DNA, 15 bp, Artificial Sequence
  dgRNA
  Zfp689
ccggcttagagacac

SEQ ID NO: 51800 - DNA, 15 bp, Artificial Sequence
  dgRNA
  Zfp689
cccttaagaatccgt

SEQ ID NO: 51801 - DNA, 15 bp, Artificial Sequence
  dgRNA
  Zfp689
acgaatgcaatagat

SEQ ID NO: 51802 - DNA, 15 bp, Artificial Sequence
  dgRNA
  C4b
gcaccagatcaattt

SEQ ID NO: 51803 - DNA, 15 bp, Artificial Sequence
  dgRNA
  C4b
accagatcaattttg

SEQ ID NO: 51804 - DNA, 15 bp, Artificial Sequence
  dgRNA
  C4b
ttcttggccatcacg

SEQ ID NO: 51805 - DNA, 15 bp, Artificial Sequence
  dgRNA
  C4b
tggtttcccggctca

SEQ ID NO: 51806 - DNA, 15 bp, Artificial Sequence
  dgRNA
  Zic3
tcagctggggtcgcc

SEQ ID NO: 51807 - DNA, 15 bp, Artificial Sequence
  dgRNA
  Zic3
ggggtcgcccggcag

SEQ ID NO: 51808 - DNA, 15 bp, Artificial Sequence
  dgRNA
  Zic3
tgtgtcggtggccaa

SEQ ID NO: 51809 - DNA, 15 bp, Artificial Sequence
  dgRNA
  Zic3
gtgtcggtggccaat

SEQ ID NO: 51810 - DNA, 15 bp, Artificial Sequence
  dgRNA
  Agxt
tttcagacccctggc

SEQ ID NO: 51811 - DNA, 15 bp, Artificial Sequence
  dgRNA
  Agxt
ggacaaacattgatc

SEQ ID NO: 51812 - DNA, 15 bp, Artificial Sequence
  dgRNA
  Dera
gggtgatgacctggc

SEQ ID NO: 51813 - DNA, 15 bp, Artificial Sequence
  dgRNA
  Dera
ggtgatgacctggct

SEQ ID NO: 51814 - DNA, 15 bp, Artificial Sequence
  dgRNA
  Dera
aagtttaagtggtac

SEQ ID NO: 51815 - DNA, 15 bp, Artificial Sequence
  dgRNA
  Dera
ggtacaggaccgaag

SEQ ID NO: 51816 - DNA, 15 bp, Artificial Sequence
  dgRNA
  Jag2
cccgcgccgcctgtg

SEQ ID NO: 51817 - DNA, 15 bp, Artificial Sequence
  dgRNA
  Jag2
ccgcctgtgcgccgc

SEQ ID NO: 51818 - DNA, 15 bp, Artificial Sequence
  dgRNA
  Jag2
cgcctgtgcgccgcc

SEQ ID NO: 51819 - DNA, 15 bp, Artificial Sequence
  dgRNA
  Jag2
gtgcgccgccgggct

SEQ ID NO: 51820 - DNA, 15 bp, Artificial Sequence
  dgRNA
  Samhd1
ttttaatctggagcg

SEQ ID NO: 51821 - DNA, 15 bp, Artificial Sequence
  dgRNA
  Samhd1
ataacaccacccttt

SEQ ID NO: 51822 - DNA, 15 bp, Artificial Sequence
  dgRNA
  Samhd1
tttcggagaaacaca

SEQ ID NO: 51823 - DNA, 15 bp, Artificial Sequence
  dgRNA
  Samhd1
acaagggcggagttg

SEQ ID NO: 51824 - DNA, 15 bp, Artificial Sequence
  dgRNA
  Bscl2
ccagaggatcgcata

SEQ ID NO: 51825 - DNA, 15 bp, Artificial Sequence
  dgRNA
  Bscl2
cagaggatcgcataa

SEQ ID NO: 51826 - DNA, 15 bp, Artificial Sequence
  dgRNA
  Bscl2
gggatcgttccctat

SEQ ID NO: 51827 - DNA, 15 bp, Artificial Sequence
  dgRNA
  Bscl2
ggatcgttccctatt

SEQ ID NO: 51828 - DNA, 15 bp, Artificial Sequence
  dgRNA
  Txndc17
gcgtctagttgtctg

SEQ ID NO: 51829 - DNA, 15 bp, Artificial Sequence
  dgRNA
  Txndc17
cgtctagttgtctga

SEQ ID NO: 51830 - DNA, 15 bp, Artificial Sequence
  dgRNA
  Txndc17
aaaaggacggcccta

SEQ ID NO: 51831 - DNA, 15 bp, Artificial Sequence
  dgRNA
  Txndc17
agttatggctattca

SEQ ID NO: 51832 - DNA, 15 bp, Artificial Sequence
  dgRNA
  Lzic
ggtgggttgcttacc

SEQ ID NO: 51833 - DNA, 15 bp, Artificial Sequence
  dgRNA
  Lzic
cttaccaggccttga

SEQ ID NO: 51834 - DNA, 15 bp, Artificial Sequence
  dgRNA
  Lzic
cggccctagtcctcc

SEQ ID NO: 51835 - DNA, 15 bp, Artificial Sequence
  dgRNA
  Lzic
gagacaacctcggcc

SEQ ID NO: 51836 - DNA, 15 bp, Artificial Sequence
  dgRNA
  Celf2
gtaatggaacccagc

SEQ ID NO: 51837 - DNA, 15 bp, Artificial Sequence
  dgRNA
  Celf2
aacccagcgggaaga

SEQ ID NO: 51838 - DNA, 15 bp, Artificial Sequence
  dgRNA
  Celf2
aggggcggtacccag

SEQ ID NO: 51839 - DNA, 15 bp, Artificial Sequence
  dgRNA
  Celf2
attacctgcaaggct

SEQ ID NO: 51840 - DNA, 15 bp, Artificial Sequence
  dgRNA
  Fgfr1
gccgccgctgcgtac

SEQ ID NO: 51841 - DNA, 15 bp, Artificial Sequence
  dgRNA
  Fgfr1
ctgcgtactggagag

SEQ ID NO: 51842 - DNA, 15 bp, Artificial Sequence
  dgRNA
  Fgfr1
gcgtactggagagcg

SEQ ID NO: 51843 - DNA, 15 bp, Artificial Sequence
  dgRNA
  Fgfr1
cgtactggagagcgg

SEQ ID NO: 51844 - DNA, 15 bp, Artificial Sequence
  dgRNA
  Frg1
tggctcatccaatcc

SEQ ID NO: 51845 - DNA, 15 bp, Artificial Sequence
  dgRNA
  Frg1
catccaatccaggta

SEQ ID NO: 51846 - DNA, 15 bp, Artificial Sequence
  dgRNA
  Frg1
tggtctttacaacct

SEQ ID NO: 51847 - DNA, 15 bp, Artificial Sequence
  dgRNA
  Frg1
tacaacctcggcagc

SEQ ID NO: 51848 - DNA, 15 bp, Artificial Sequence
  dgRNA
  Tmsb15b2
gggggcgtgtcaagc

SEQ ID NO: 51849 - DNA, 15 bp, Artificial Sequence
  dgRNA
  Tmsb15b2
ggggcgtgtcaagcc

SEQ ID NO: 51850 - DNA, 15 bp, Artificial Sequence
  dgRNA
  Tmsb15b2
agagacgcctgtgta

SEQ ID NO: 51851 - DNA, 15 bp, Artificial Sequence
  dgRNA
  Tmsb15b2
tgattggacaaatcc

SEQ ID NO: 51852 - DNA, 15 bp, Artificial Sequence
  dgRNA
  Hnrnph2
gcgctctctttacct

SEQ ID NO: 51853 - DNA, 15 bp, Artificial Sequence
  dgRNA
  Hnrnph2
tacctgactgttcat

SEQ ID NO: 51854 - DNA, 15 bp, Artificial Sequence
  dgRNA
  Hnrnph2
aaatggggcgggcca

SEQ ID NO: 51855 - DNA, 15 bp, Artificial Sequence
  dgRNA
  Hnrnph2
tctcggcttaaactc

SEQ ID NO: 51856 - DNA, 15 bp, Artificial Sequence
  dgRNA
  Mpp6
tggaggacgcgcgct

SEQ ID NO: 51857 - DNA, 15 bp, Artificial Sequence
  dgRNA
  Mpp6
gacgcgcgctgggcc

SEQ ID NO: 51858 - DNA, 15 bp, Artificial Sequence
  dgRNA
  Mpp6
acgcgcgctgggcca

SEQ ID NO: 51859 - DNA, 15 bp, Artificial Sequence
  dgRNA
  Mpp6
gccagggcgacccta

SEQ ID NO: 51860 - DNA, 15 bp, Artificial Sequence
  dgRNA
  Shbg
tgcaggggatactag

SEQ ID NO: 51861 - DNA, 15 bp, Artificial Sequence
  dgRNA
  Shbg
aggggatactagtgg

SEQ ID NO: 51862 - DNA, 15 bp, Artificial Sequence
  dgRNA
  Shbg
ggggatactagtgga

SEQ ID NO: 51863 - DNA, 15 bp, Artificial Sequence
  dgRNA
  Shbg
ttcagaggggccgca

SEQ ID NO: 51864 - DNA, 15 bp, Artificial Sequence
  dgRNA
  Sox6
ctgctactctactat

SEQ ID NO: 51865 - DNA, 15 bp, Artificial Sequence
  dgRNA
  Sox6
gctatgttttcttcg

SEQ ID NO: 51866 - DNA, 15 bp, Artificial Sequence
  dgRNA
  Sox6
gttttcttcgtggaa

SEQ ID NO: 51867 - DNA, 15 bp, Artificial Sequence
  dgRNA
  Tssk4
cagagggaacttacc

SEQ ID NO: 51868 - DNA, 15 bp, Artificial Sequence
  dgRNA
  Tssk4
gccaatgatgaataa

SEQ ID NO: 51869 - DNA, 15 bp, Artificial Sequence
  dgRNA
  Tssk4
tctgtaaccaagata

SEQ ID NO: 51870 - DNA, 15 bp, Artificial Sequence
  dgRNA
  Tssk4
ggtaagttccctctg

SEQ ID NO: 51871 - DNA, 15 bp, Artificial Sequence
  dgRNA
  Vtn
ggagattaacgggac

SEQ ID NO: 51872 - DNA, 15 bp, Artificial Sequence
  dgRNA
  Vtn
cgggactggctcaga

SEQ ID NO: 51873 - DNA, 15 bp, Artificial Sequence
  dgRNA
  Vtn
tgaccctactgactt

SEQ ID NO: 51874 - DNA, 15 bp, Artificial Sequence
  dgRNA
  Vtn
tactgactttggtct

SEQ ID NO: 51875 - DNA, 15 bp, Artificial Sequence
  dgRNA
  Olfr372
ccttgctctgataac

SEQ ID NO: 51876 - DNA, 15 bp, Artificial Sequence
  dgRNA
  Olfr372
cagccgctcactgat

SEQ ID NO: 51877 - DNA, 15 bp, Artificial Sequence
  dgRNA
  Olfr372
tacaattatcccagt

SEQ ID NO: 51878 - DNA, 15 bp, Artificial Sequence
  dgRNA
  Olfr372
gtcgtggctcagggg

SEQ ID NO: 51879 - DNA, 15 bp, Artificial Sequence
  dgRNA
  Gprc6a
cggacatgttcttat

SEQ ID NO: 51880 - DNA, 15 bp, Artificial Sequence
  dgRNA
  Gprc6a
cggagcatgtgacag

SEQ ID NO: 51881 - DNA, 15 bp, Artificial Sequence
  dgRNA
  Insm2
cgtcctgagctccag

SEQ ID NO: 51882 - DNA, 15 bp, Artificial Sequence
  dgRNA
  Insm2
agcacgcacgatctg

SEQ ID NO: 51883 - DNA, 15 bp, Artificial Sequence
  dgRNA
  Insm2
caggcgccgagctct

SEQ ID NO: 51884 - DNA, 15 bp, Artificial Sequence
  dgRNA
  Insm2
gacgctgcacggttc

SEQ ID NO: 51885 - DNA, 15 bp, Artificial Sequence
  dgRNA
  Rnf6
ggggcgttgggtaca

SEQ ID NO: 51886 - DNA, 15 bp, Artificial Sequence
  dgRNA
  Rnf6
gggcgttgggtacac

SEQ ID NO: 51887 - DNA, 15 bp, Artificial Sequence
  dgRNA
  Rnf6
ggcgttgggtacacg

SEQ ID NO: 51888 - DNA, 15 bp, Artificial Sequence
  dgRNA
  Rnf6
gttgggtacacgggg

SEQ ID NO: 51889 - DNA, 15 bp, Artificial Sequence
  dgRNA
  Slc20a2
acagtcctcccgcga

SEQ ID NO: 51890 - DNA, 15 bp, Artificial Sequence
  dgRNA
  Slc20a2
cagtcctcccgcgac

SEQ ID NO: 51891 - DNA, 15 bp, Artificial Sequence
  dgRNA
  Slc20a2
gccgcacgctcccgc

SEQ ID NO: 51892 - DNA, 15 bp, Artificial Sequence
  dgRNA
  Slc20a2
ccgccggcgtctctg

SEQ ID NO: 51893 - DNA, 15 bp, Artificial Sequence
  dgRNA
  Ung
aagtggaacatttcg

SEQ ID NO: 51894 - DNA, 15 bp, Artificial Sequence
  dgRNA
  Ung
acatttcggggttaa

SEQ ID NO: 51895 - DNA, 15 bp, Artificial Sequence
  dgRNA
  Ung
tacatcagtaagact

SEQ ID NO: 51896 - DNA, 15 bp, Artificial Sequence
  dgRNA
  Ung
ccccgctttagagct

SEQ ID NO: 51897 - DNA, 15 bp, Artificial Sequence
  dgRNA
  Mrps14
caggagagatcgcgc

SEQ ID NO: 51898 - DNA, 15 bp, Artificial Sequence
  dgRNA
  Mrps14
ctcctactgcctaag

SEQ ID NO: 51899 - DNA, 15 bp, Artificial Sequence
  dgRNA
  Mrps14
tcctactgcctaagt

SEQ ID NO: 51900 - DNA, 15 bp, Artificial Sequence
  dgRNA
  Mrps14
tactgcctaagtggg

SEQ ID NO: 51901 - DNA, 15 bp, Artificial Sequence
  dgRNA
  Prl
gggctatcttaatga

SEQ ID NO: 51902 - DNA, 15 bp, Artificial Sequence
  dgRNA
  Prl
acggaaatagatgat

SEQ ID NO: 51903 - DNA, 15 bp, Artificial Sequence
  dgRNA
  Sfr1
tccgccccgtggccc

SEQ ID NO: 51904 - DNA, 15 bp, Artificial Sequence
  dgRNA
  Sfr1
cgtggcccaggcccg

SEQ ID NO: 51905 - DNA, 15 bp, Artificial Sequence
  dgRNA
  Sfr1
ccgcgcacgcgcagt

SEQ ID NO: 51906 - DNA, 15 bp, Artificial Sequence
  dgRNA
  Sfr1
gcagtcggagctgta

SEQ ID NO: 51907 - DNA, 15 bp, Artificial Sequence
  dgRNA
  Olfr654
ctcagacgttgatgc

SEQ ID NO: 51908 - DNA, 15 bp, Artificial Sequence
  dgRNA
  Olfr654
tactatcattagttc

SEQ ID NO: 51909 - DNA, 15 bp, Artificial Sequence
  dgRNA
  Olfr654
atatgttaagcagcc

SEQ ID NO: 51910 - DNA, 15 bp, Artificial Sequence
  dgRNA
  Olfr654
gatgcttaagatggg

SEQ ID NO: 51911 - DNA, 15 bp, Artificial Sequence
  dgRNA
  Olfr802
gaacagccccctgtt

SEQ ID NO: 51912 - DNA, 15 bp, Artificial Sequence
  dgRNA
  Olfr802
tctagatttggcaga

SEQ ID NO: 51913 - DNA, 15 bp, Artificial Sequence
  dgRNA
  Myo10
gtaggaagcccgagc

SEQ ID NO: 51914 - DNA, 15 bp, Artificial Sequence
  dgRNA
  Myo10
gcccgagcaggctgt

SEQ ID NO: 51915 - DNA, 15 bp, Artificial Sequence
  dgRNA
  Myo10
tgggcggggctataa

SEQ ID NO: 51916 - DNA, 15 bp, Artificial Sequence
  dgRNA
  Myo10
gggcggggctataat

SEQ ID NO: 51917 - DNA, 15 bp, Artificial Sequence
  dgRNA
  Map2k2
acacgcagccgaccc

SEQ ID NO: 51918 - DNA, 15 bp, Artificial Sequence
  dgRNA
  Map2k2
cacgcagccgacccc

SEQ ID NO: 51919 - DNA, 15 bp, Artificial Sequence
  dgRNA
  Map2k2
ccttctacagtaggc

SEQ ID NO: 51920 - DNA, 15 bp, Artificial Sequence
  dgRNA
  Map2k2
cttctacagtaggcc

SEQ ID NO: 51921 - DNA, 15 bp, Artificial Sequence
  dgRNA
  Adck4
cacgcctcctcagcg

SEQ ID NO: 51922 - DNA, 15 bp, Artificial Sequence
  dgRNA
  Adck4
agtttttgcaaacgt

SEQ ID NO: 51923 - DNA, 15 bp, Artificial Sequence
  dgRNA
  Adck4
tggctagctgatcaa

SEQ ID NO: 51924 - DNA, 15 bp, Artificial Sequence
  dgRNA
  Adck4
ggctagctgatcaaa

SEQ ID NO: 51925 - DNA, 15 bp, Artificial Sequence
  dgRNA
  Kcna6
gcggcttggttgggg

SEQ ID NO: 51926 - DNA, 15 bp, Artificial Sequence
  dgRNA
  Kcna6
cggcttggttggggt

SEQ ID NO: 51927 - DNA, 15 bp, Artificial Sequence
  dgRNA
  Kcna6
cgcgggaaagattac

SEQ ID NO: 51928 - DNA, 15 bp, Artificial Sequence
  dgRNA
  Kcna6
gcgggaaagattact

SEQ ID NO: 51929 - DNA, 15 bp, Artificial Sequence
  dgRNA
  Mmp11
gaattgagctctccc

SEQ ID NO: 51930 - DNA, 15 bp, Artificial Sequence
  dgRNA
  Mmp11
ctctcactagttcta

SEQ ID NO: 51931 - DNA, 15 bp, Artificial Sequence
  dgRNA
  Mmp11
tctcactagttctaa

SEQ ID NO: 51932 - DNA, 15 bp, Artificial Sequence
  dgRNA
  Mmp11
tcagaccgctgctgc

SEQ ID NO: 51933 - DNA, 15 bp, Artificial Sequence
  dgRNA
  Myo1b
gccagtgcgctttcc

SEQ ID NO: 51934 - DNA, 15 bp, Artificial Sequence
  dgRNA
  Myo1b
ccagtgcgctttcct

SEQ ID NO: 51935 - DNA, 15 bp, Artificial Sequence
  dgRNA
  Myo1b
ggtgtccccgcccgc

SEQ ID NO: 51936 - DNA, 15 bp, Artificial Sequence
  dgRNA
  Myo1b
gtgtccccgcccgcc

SEQ ID NO: 51937 - DNA, 15 bp, Artificial Sequence
  dgRNA
  Sf3b3
ggcgcggtgaccttt

SEQ ID NO: 51938 - DNA, 15 bp, Artificial Sequence
  dgRNA
  Sf3b3
cccgatcaaaaccat

SEQ ID NO: 51939 - DNA, 15 bp, Artificial Sequence
  dgRNA
  Sf3b3
catctatttatcagg

SEQ ID NO: 51940 - DNA, 15 bp, Artificial Sequence
  dgRNA
  Sf3b3
tctatttatcaggcg

SEQ ID NO: 51941 - DNA, 15 bp, Artificial Sequence
  dgRNA
  Rtp2
atagtaacaggttcc

SEQ ID NO: 51942 - DNA, 15 bp, Artificial Sequence
  dgRNA
  Rtp2
attgtaatgctgact

SEQ ID NO: 51943 - DNA, 15 bp, Artificial Sequence
  dgRNA
  Rtp2
gttactatgacagcc

SEQ ID NO: 51944 - DNA, 15 bp, Artificial Sequence
  dgRNA
  Loxl3
cgggcctccaacctg

SEQ ID NO: 51945 - DNA, 15 bp, Artificial Sequence
  dgRNA
  Loxl3
aagcttcattgagcc

SEQ ID NO: 51946 - DNA, 15 bp, Artificial Sequence
  dgRNA
  Loxl3
cttcattgagccggg

SEQ ID NO: 51947 - DNA, 15 bp, Artificial Sequence
  dgRNA
  Loxl3
ttgagccgggaggag

SEQ ID NO: 51948 - DNA, 15 bp, Artificial Sequence
  dgRNA
  Uncx
ggtcttccagttcgt

SEQ ID NO: 51949 - DNA, 15 bp, Artificial Sequence
  dgRNA
  Uncx
gtcttccagttcgtc

SEQ ID NO: 51950 - DNA, 15 bp, Artificial Sequence
  dgRNA
  Uncx
tccctccgccgctcg

SEQ ID NO: 51951 - DNA, 15 bp, Artificial Sequence
  dgRNA
  Uncx
cccgcagcccgggag

SEQ ID NO: 51952 - DNA, 15 bp, Artificial Sequence
  dgRNA
  Ppp1r13l
gcgtctgactccaaa

SEQ ID NO: 51953 - DNA, 15 bp, Artificial Sequence
  dgRNA
  Ppp1r13l
ggcgcctcgcccatt

SEQ ID NO: 51954 - DNA, 15 bp, Artificial Sequence
  dgRNA
  Ppp1r13l
gcgcctcgcccattc

SEQ ID NO: 51955 - DNA, 15 bp, Artificial Sequence
  dgRNA
  Ppp1r13l
gttccccctcctccg

SEQ ID NO: 51956 - DNA, 15 bp, Artificial Sequence
  dgRNA
  Lpcat1
gattacaatggttag

SEQ ID NO: 51957 - DNA, 15 bp, Artificial Sequence
  dgRNA
  Lpcat1
cgttgcgctgagaag

SEQ ID NO: 51958 - DNA, 15 bp, Artificial Sequence
  dgRNA
  Lpcat1
gttgcgctgagaagt

SEQ ID NO: 51959 - DNA, 15 bp, Artificial Sequence
  dgRNA
  Lpcat1
gcgacccaaaattta

SEQ ID NO: 51960 - DNA, 15 bp, Artificial Sequence
  dgRNA
  Tnrc18
tggccactcctcagg

SEQ ID NO: 51961 - DNA, 15 bp, Artificial Sequence
  dgRNA
  Tnrc18
aggtggtccagccaa

SEQ ID NO: 51962 - DNA, 15 bp, Artificial Sequence
  dgRNA
  Tnrc18
ctcccgggaaggtac

SEQ ID NO: 51963 - DNA, 15 bp, Artificial Sequence
  dgRNA
  Tnrc18
tcccgggaaggtaca

SEQ ID NO: 51964 - DNA, 15 bp, Artificial Sequence
  dgRNA
  Sypl2
gctgggctgttctag

SEQ ID NO: 51965 - DNA, 15 bp, Artificial Sequence
  dgRNA
  Sypl2
tgggctgttctagtg

SEQ ID NO: 51966 - DNA, 15 bp, Artificial Sequence
  dgRNA
  Sypl2
ttctggcaaaaaccc

SEQ ID NO: 51967 - DNA, 15 bp, Artificial Sequence
  dgRNA
  Sypl2
aaccccggagccttc

SEQ ID NO: 51968 - DNA, 15 bp, Artificial Sequence
  dgRNA
  Alg14
ccttgtagcgcttcc

SEQ ID NO: 51969 - DNA, 15 bp, Artificial Sequence
  dgRNA
  Alg14
cttgtagcgcttcct

SEQ ID NO: 51970 - DNA, 15 bp, Artificial Sequence
  dgRNA
  Alg14
catcacggacaaacc

SEQ ID NO: 51971 - DNA, 15 bp, Artificial Sequence
  dgRNA
  Alg14
tttgaccgcccaact

SEQ ID NO: 51972 - DNA, 15 bp, Artificial Sequence
  dgRNA
  Prdx5
tacctgcaggcgcag

SEQ ID NO: 51973 - DNA, 15 bp, Artificial Sequence
  dgRNA
  Prdx5
ggagcctccgggacc

SEQ ID NO: 51974 - DNA, 15 bp, Artificial Sequence
  dgRNA
  Prdx5
cgcccatatagttca

SEQ ID NO: 51975 - DNA, 15 bp, Artificial Sequence
  dgRNA
  Prdx5
tcgcccatatagttc

SEQ ID NO: 51976 - DNA, 15 bp, Artificial Sequence
  dgRNA
  Hoxa1
gcgtcacctacactg

SEQ ID NO: 51977 - DNA, 15 bp, Artificial Sequence
  dgRNA
  Hoxa1
tacactgaggagcgc

SEQ ID NO: 51978 - DNA, 15 bp, Artificial Sequence
  dgRNA
  Hoxa1
acactgaggagcgcc

SEQ ID NO: 51979 - DNA, 15 bp, Artificial Sequence
  dgRNA
  Hoxa1
cactgaggagcgccg

SEQ ID NO: 51980 - DNA, 15 bp, Artificial Sequence
  dgRNA
  Tkt
gtgattaattccaac

SEQ ID NO: 51981 - DNA, 15 bp, Artificial Sequence
  dgRNA
  Tkt
tgattaattccaaca

SEQ ID NO: 51982 - DNA, 15 bp, Artificial Sequence
  dgRNA
  Tkt
agagtccactaaatg

SEQ ID NO: 51983 - DNA, 15 bp, Artificial Sequence
  dgRNA
  Tkt
gagtccactaaatgc

SEQ ID NO: 51984 - DNA, 15 bp, Artificial Sequence
  dgRNA
  Thada
agaactgtttagtcg

SEQ ID NO: 51985 - DNA, 15 bp, Artificial Sequence
  dgRNA
  Thada
gaactgtttagtcgc

SEQ ID NO: 51986 - DNA, 15 bp, Artificial Sequence
  dgRNA
  Thada
tgcctcccttcgccg

SEQ ID NO: 51987 - DNA, 15 bp, Artificial Sequence
  dgRNA
  Thada
cccttcgccggggac

SEQ ID NO: 51988 - DNA, 15 bp, Artificial Sequence
  dgRNA
  Gosr2
gggcggactagttcg

SEQ ID NO: 51989 - DNA, 15 bp, Artificial Sequence
  dgRNA
  Gosr2
ggactagttcgaggc

SEQ ID NO: 51990 - DNA, 15 bp, Artificial Sequence
  dgRNA
  Gosr2
aaagcacgcgtcgtg

SEQ ID NO: 51991 - DNA, 15 bp, Artificial Sequence
  dgRNA
  Gosr2
agccaagcccgaccg

SEQ ID NO: 51992 - DNA, 15 bp, Artificial Sequence
  dgRNA
  Sirpb1b
gttgcatgcagcttc

SEQ ID NO: 51993 - DNA, 15 bp, Artificial Sequence
  dgRNA
  Slc26a3
aggtcaagaccatat

SEQ ID NO: 51994 - DNA, 15 bp, Artificial Sequence
  dgRNA
  Slc26a3
ggaaagactccaata

SEQ ID NO: 51995 - DNA, 15 bp, Artificial Sequence
  dgRNA
  Slc26a3
gttatgtagagcggt

SEQ ID NO: 51996 - DNA, 15 bp, Artificial Sequence
  dgRNA
  Slc26a3
ggttatgtagagcgg

SEQ ID NO: 51997 - DNA, 15 bp, Artificial Sequence
  dgRNA
  Ndufa4
atgcgaagaagtggt

SEQ ID NO: 51998 - DNA, 15 bp, Artificial Sequence
  dgRNA
  Ndufa4
tgcgaagaagtggtc

SEQ ID NO: 51999 - DNA, 15 bp, Artificial Sequence
  dgRNA
  Ndufa4
tggtcgggacattta

SEQ ID NO: 52000 - DNA, 15 bp, Artificial Sequence
  dgRNA
  Ndufa4
tagggcaatcgcgcg

SEQ ID NO: 52001 - DNA, 15 bp, Artificial Sequence
  dgRNA
  Slc25a31
cattcagttaatcac

SEQ ID NO: 52002 - DNA, 15 bp, Artificial Sequence
  dgRNA
  Slc25a31
attcagttaatcacc

SEQ ID NO: 52003 - DNA, 15 bp, Artificial Sequence
  dgRNA
  Slc25a31
agttaatcaccgggt

SEQ ID NO: 52004 - DNA, 15 bp, Artificial Sequence
  dgRNA
  Slc25a31
tcaccgggttggtgt

SEQ ID NO: 52005 - DNA, 15 bp, Artificial Sequence
  dgRNA
  Unkl
ccccgcgcgccagac

SEQ ID NO: 52006 - DNA, 15 bp, Artificial Sequence
  dgRNA
  Unkl
cgccagactggagtc

SEQ ID NO: 52007 - DNA, 15 bp, Artificial Sequence
  dgRNA
  Unkl
ctgcgttcgtagctc

SEQ ID NO: 52008 - DNA, 15 bp, Artificial Sequence
  dgRNA
  Unkl
tgcgttcgtagctca

SEQ ID NO: 52009 - DNA, 15 bp, Artificial Sequence
  dgRNA
  Socs3
cctctcggtgagtct

SEQ ID NO: 52010 - DNA, 15 bp, Artificial Sequence
  dgRNA
  Socs3
ctcggtgagtctcgg

SEQ ID NO: 52011 - DNA, 15 bp, Artificial Sequence
  dgRNA
  Socs3
tcggtgagtctcggc

SEQ ID NO: 52012 - DNA, 15 bp, Artificial Sequence
  dgRNA
  Socs3
agtctcggcgggtcc

SEQ ID NO: 52013 - DNA, 15 bp, Artificial Sequence
  dgRNA
  Plcd4
tgttgaccagtgccc

SEQ ID NO: 52014 - DNA, 15 bp, Artificial Sequence
  dgRNA
  Plcd4
gttgaccagtgccct

SEQ ID NO: 52015 - DNA, 15 bp, Artificial Sequence
  dgRNA
  Plcd4
ctttaagagttggat

SEQ ID NO: 52016 - DNA, 15 bp, Artificial Sequence
  dgRNA
  Plcd4
aagagttggataggc

SEQ ID NO: 52017 - DNA, 15 bp, Artificial Sequence
  dgRNA
  Rnase10
tggaatggtagtatc

SEQ ID NO: 52018 - DNA, 15 bp, Artificial Sequence
  dgRNA
  Gm3646
catgccagttagacc

SEQ ID NO: 52019 - DNA, 15 bp, Artificial Sequence
  dgRNA
  Gm3646
tatatagcagccagg

SEQ ID NO: 52020 - DNA, 15 bp, Artificial Sequence
  dgRNA
  Gm3646
ctatatatagcagcc

SEQ ID NO: 52021 - DNA, 15 bp, Artificial Sequence
  dgRNA
  Cic
gcaccaacaaccacg

SEQ ID NO: 52022 - DNA, 15 bp, Artificial Sequence
  dgRNA
  Cic
caccaacaaccacgt

SEQ ID NO: 52023 - DNA, 15 bp, Artificial Sequence
  dgRNA
  Cic
agagtagaaccggtg

SEQ ID NO: 52024 - DNA, 15 bp, Artificial Sequence
  dgRNA
  Cic
cctgccgttgctgat

SEQ ID NO: 52025 - DNA, 15 bp, Artificial Sequence
  dgRNA
  Coil
aatggggagctcgcg

SEQ ID NO: 52026 - DNA, 15 bp, Artificial Sequence
  dgRNA
  Coil
atggggagctcgcga

SEQ ID NO: 52027 - DNA, 15 bp, Artificial Sequence
  dgRNA
  Coil
tggggagctcgcgag

SEQ ID NO: 52028 - DNA, 15 bp, Artificial Sequence
  dgRNA
  Coil
cctacttgcgccccc

SEQ ID NO: 52029 - DNA, 15 bp, Artificial Sequence
  dgRNA
  Bub1b
tctccctgggttcga

SEQ ID NO: 52030 - DNA, 15 bp, Artificial Sequence
  dgRNA
  Bub1b
gcacgctgcagtgct

SEQ ID NO: 52031 - DNA, 15 bp, Artificial Sequence
  dgRNA
  Bub1b
tgctaggacaaccat

SEQ ID NO: 52032 - DNA, 15 bp, Artificial Sequence
  dgRNA
  Bub1b
gcgcgtgcttaaacc

SEQ ID NO: 52033 - DNA, 15 bp, Artificial Sequence
  dgRNA
  Psapl1
ggtagaatggccaag

SEQ ID NO: 52034 - DNA, 15 bp, Artificial Sequence
  dgRNA
  Psapl1
gacgggccagcaccc

SEQ ID NO: 52035 - DNA, 15 bp, Artificial Sequence
  dgRNA
  Psapl1
ggtaccttgctgagc

SEQ ID NO: 52036 - DNA, 15 bp, Artificial Sequence
  dgRNA
  Psapl1
ctggcccgtcctctc

SEQ ID NO: 52037 - DNA, 15 bp, Artificial Sequence
  dgRNA
  Col11a2
ctacctaatccctcc

SEQ ID NO: 52038 - DNA, 15 bp, Artificial Sequence
  dgRNA
  Col11a2
atccctccaggagta

SEQ ID NO: 52039 - DNA, 15 bp, Artificial Sequence
  dgRNA
  Col11a2
cagggctagcgagtg

SEQ ID NO: 52040 - DNA, 15 bp, Artificial Sequence
  dgRNA
  Col11a2
gctagcgagtgagga

SEQ ID NO: 52041 - DNA, 15 bp, Artificial Sequence
  dgRNA
  Phyh
ccagtcgcaaaattt

SEQ ID NO: 52042 - DNA, 15 bp, Artificial Sequence
  dgRNA
  Phyh
aaagacacagcggcg

SEQ ID NO: 52043 - DNA, 15 bp, Artificial Sequence
  dgRNA
  Phyh
cagcggcggggagca

SEQ ID NO: 52044 - DNA, 15 bp, Artificial Sequence
  dgRNA
  Phyh
ccaccctctactagg

SEQ ID NO: 52045 - DNA, 15 bp, Artificial Sequence
  dgRNA
  Syt8
agaccttcgctctca

SEQ ID NO: 52046 - DNA, 15 bp, Artificial Sequence
  dgRNA
  Syt8
gaccttcgctctcaa

SEQ ID NO: 52047 - DNA, 15 bp, Artificial Sequence
  dgRNA
  Syt8
gcagttccggtcatt

SEQ ID NO: 52048 - DNA, 15 bp, Artificial Sequence
  dgRNA
  Syt8
gttccggtcattagg

SEQ ID NO: 52049 - DNA, 15 bp, Artificial Sequence
  dgRNA
  Zfp473
ttgctcaccgttatt

SEQ ID NO: 52050 - DNA, 15 bp, Artificial Sequence
  dgRNA
  Zfp473
ttattcggccttctc

SEQ ID NO: 52051 - DNA, 15 bp, Artificial Sequence
  dgRNA
  Zfp473
tattcggccttctct

SEQ ID NO: 52052 - DNA, 15 bp, Artificial Sequence
  dgRNA
  Zfp473
attcggccttctctg

SEQ ID NO: 52053 - DNA, 15 bp, Artificial Sequence
  dgRNA
  Col4a5
aacgagaaatctttt

SEQ ID NO: 52054 - DNA, 15 bp, Artificial Sequence
  dgRNA
  Col4a5
tttggttggacttgt

SEQ ID NO: 52055 - DNA, 15 bp, Artificial Sequence
  dgRNA
  Col4a5
gcgtcactccctcgc

SEQ ID NO: 52056 - DNA, 15 bp, Artificial Sequence
  dgRNA
  Col4a5
tccctcgcaggttgc

SEQ ID NO: 52057 - DNA, 15 bp, Artificial Sequence
  dgRNA
  Mef2d
gcaggcggagggatc

SEQ ID NO: 52058 - DNA, 15 bp, Artificial Sequence
  dgRNA
  Mef2d
caggcggagggatct

SEQ ID NO: 52059 - DNA, 15 bp, Artificial Sequence
  dgRNA
  Mef2d
gggctccacgcgccg

SEQ ID NO: 52060 - DNA, 15 bp, Artificial Sequence
  dgRNA
  Mef2d
ggtcgcgcgccccaa

SEQ ID NO: 52061 - DNA, 15 bp, Artificial Sequence
  dgRNA
  Defb5
tgtaaaatcctaacg

SEQ ID NO: 52062 - DNA, 15 bp, Artificial Sequence
  dgRNA
  Defb5
aaaatcctaacgagg

SEQ ID NO: 52063 - DNA, 15 bp, Artificial Sequence
  dgRNA
  Defb5
gattttacactgact

SEQ ID NO: 52064 - DNA, 15 bp, Artificial Sequence
  dgRNA
  Defb5
tgctacctcctcgtt

SEQ ID NO: 52065 - DNA, 15 bp, Artificial Sequence
  dgRNA
  Tex13
acttccgatgagact

SEQ ID NO: 52066 - DNA, 15 bp, Artificial Sequence
  dgRNA
  Tex13
gcgtgagaggatgtc

SEQ ID NO: 52067 - DNA, 15 bp, Artificial Sequence
  dgRNA
  Tex13
cgcgaggtttactct

SEQ ID NO: 52068 - DNA, 15 bp, Artificial Sequence
  dgRNA
  Tex13
tctcaaagtctcgcg

SEQ ID NO: 52069 - DNA, 15 bp, Artificial Sequence
  dgRNA
  1700066B19Rik
tagaagggtggccca

SEQ ID NO: 52070 - DNA, 15 bp, Artificial Sequence
  dgRNA
  1700066B19Rik
ccggaactacaagcg

SEQ ID NO: 52071 - DNA, 15 bp, Artificial Sequence
  dgRNA
  1700066B19Rik
cggaactacaagcgc

SEQ ID NO: 52072 - DNA, 15 bp, Artificial Sequence
  dgRNA
  1700066B19Rik
acctaatccctccct

SEQ ID NO: 52073 - DNA, 15 bp, Artificial Sequence
  dgRNA
  Kdelr1
cttccatcagttagt

SEQ ID NO: 52074 - DNA, 15 bp, Artificial Sequence
  dgRNA
  Kdelr1
acgactctgcaaagc

SEQ ID NO: 52075 - DNA, 15 bp, Artificial Sequence
  dgRNA
  Kdelr1
ggttgcaggcgccag

SEQ ID NO: 52076 - DNA, 15 bp, Artificial Sequence
  dgRNA
  Kdelr1
gttgcaggcgccaga

SEQ ID NO: 52077 - DNA, 15 bp, Artificial Sequence
  dgRNA
  Sec22c
ggtgagactcgcacg

SEQ ID NO: 52078 - DNA, 15 bp, Artificial Sequence
  dgRNA
  Sec22c
gtgagactcgcacgt

SEQ ID NO: 52079 - DNA, 15 bp, Artificial Sequence
  dgRNA
  Sec22c
actcgcacgtgggcc

SEQ ID NO: 52080 - DNA, 15 bp, Artificial Sequence
  dgRNA
  Sec22c
ctcgcacgtgggcct

SEQ ID NO: 52081 - DNA, 15 bp, Artificial Sequence
  dgRNA
  Slc35a3
cactaaccaggggaa

SEQ ID NO: 52082 - DNA, 15 bp, Artificial Sequence
  dgRNA
  Slc35a3
agtgtcactaaccag

SEQ ID NO: 52083 - DNA, 15 bp, Artificial Sequence
  dgRNA
  Slc35a3
tagtgtcactaacca

SEQ ID NO: 52084 - DNA, 15 bp, Artificial Sequence
  dgRNA
  Slc35a3
ttagtgtcactaacc

SEQ ID NO: 52085 - DNA, 15 bp, Artificial Sequence
  dgRNA
  Clcnkb
gcttgctttctcgtg

SEQ ID NO: 52086 - DNA, 15 bp, Artificial Sequence
  dgRNA
  Clcnkb
cttgctttctcgtgt

SEQ ID NO: 52087 - DNA, 15 bp, Artificial Sequence
  dgRNA
  Clcnkb
ggcttccttaacccc

SEQ ID NO: 52088 - DNA, 15 bp, Artificial Sequence
  dgRNA
  Clcnkb
ttccttaaccccagg

SEQ ID NO: 52089 - DNA, 15 bp, Artificial Sequence
  dgRNA
  Klhl3
gatataccccaagct

SEQ ID NO: 52090 - DNA, 15 bp, Artificial Sequence
  dgRNA
  Klhl3
ggatataccccaagc

SEQ ID NO: 52091 - DNA, 15 bp, Artificial Sequence
  dgRNA
  Klhl3
cactgatagtagagt

SEQ ID NO: 52092 - DNA, 15 bp, Artificial Sequence
  dgRNA
  Klhl3
ggtggactatgccgc

SEQ ID NO: 52093 - DNA, 15 bp, Artificial Sequence
  dgRNA
  Bax
tctaccatgaatcta

SEQ ID NO: 52094 - DNA, 15 bp, Artificial Sequence
  dgRNA
  Bax
ctaccatgaatctat

SEQ ID NO: 52095 - DNA, 15 bp, Artificial Sequence
  dgRNA
  Bax
catcagttcggatta

SEQ ID NO: 52096 - DNA, 15 bp, Artificial Sequence
  dgRNA
  Bax
ttcatttagtacccg

SEQ ID NO: 52097 - DNA, 15 bp, Artificial Sequence
  dgRNA
  Sec11c
ctcgccacgcttccc

SEQ ID NO: 52098 - DNA, 15 bp, Artificial Sequence
  dgRNA
  Sec11c
ggtcttcactggccg

SEQ ID NO: 52099 - DNA, 15 bp, Artificial Sequence
  dgRNA
  Sec11c
ttgcccgaagcattc

SEQ ID NO: 52100 - DNA, 15 bp, Artificial Sequence
  dgRNA
  Sec11c
ctccaggtcctatgg

SEQ ID NO: 52101 - DNA, 15 bp, Artificial Sequence
  dgRNA
  Ckap2l
tcagaggcaccgctg

SEQ ID NO: 52102 - DNA, 15 bp, Artificial Sequence
  dgRNA
  Ckap2l
aagtgacctagccat

SEQ ID NO: 52103 - DNA, 15 bp, Artificial Sequence
  dgRNA
  Ckap2l
agtgacctagccata

SEQ ID NO: 52104 - DNA, 15 bp, Artificial Sequence
  dgRNA
  Ckap2l
gacctagccataggg

SEQ ID NO: 52105 - DNA, 15 bp, Artificial Sequence
  dgRNA
  Myt1
gagtcctaggtcatg

SEQ ID NO: 52106 - DNA, 15 bp, Artificial Sequence
  dgRNA
  Acot6
ccactactgtatgac

SEQ ID NO: 52107 - DNA, 15 bp, Artificial Sequence
  dgRNA
  Acot6
ccaacgtagacttcc

SEQ ID NO: 52108 - DNA, 15 bp, Artificial Sequence
  dgRNA
  Acot6
cctgtcatacagtag

SEQ ID NO: 52109 - DNA, 15 bp, Artificial Sequence
  dgRNA
  Acot6
aagtctacgttggag

SEQ ID NO: 52110 - DNA, 15 bp, Artificial Sequence
  dgRNA
  Ppt1
ggggaattgtcacct

SEQ ID NO: 52111 - DNA, 15 bp, Artificial Sequence
  dgRNA
  Ppt1
tcacctaggcgtcct

SEQ ID NO: 52112 - DNA, 15 bp, Artificial Sequence
  dgRNA
  Ppt1
cacctaggcgtcctt

SEQ ID NO: 52113 - DNA, 15 bp, Artificial Sequence
  dgRNA
  Ppt1
ttatatagtagagtc

SEQ ID NO: 52114 - DNA, 15 bp, Artificial Sequence
  dgRNA
  Phkb
gaccgagaaaagact

SEQ ID NO: 52115 - DNA, 15 bp, Artificial Sequence
  dgRNA
  Phkb
accgagaaaagactc

SEQ ID NO: 52116 - DNA, 15 bp, Artificial Sequence
  dgRNA
  Phkb
ccgagaaaagactcg

SEQ ID NO: 52117 - DNA, 15 bp, Artificial Sequence
  dgRNA
  Phkb
cggggtgcggcctca

SEQ ID NO: 52118 - DNA, 15 bp, Artificial Sequence
  dgRNA
  Mmrn2
attgacctgagtggt

SEQ ID NO: 52119 - DNA, 15 bp, Artificial Sequence
  dgRNA
  Mmrn2
gttggaggcctccaa

SEQ ID NO: 52120 - DNA, 15 bp, Artificial Sequence
  dgRNA
  Mmrn2
gcggatgagacttgc

SEQ ID NO: 52121 - DNA, 15 bp, Artificial Sequence
  dgRNA
  Mmrn2
cggatgagacttgcc

SEQ ID NO: 52122 - DNA, 15 bp, Artificial Sequence
  dgRNA
  Il1f9
tagtcacccagataa

SEQ ID NO: 52123 - DNA, 15 bp, Artificial Sequence
  dgRNA
  Il1f9
ataaaggacccagac

SEQ ID NO: 52124 - DNA, 15 bp, Artificial Sequence
  dgRNA
  Il1f9
ggacccagactggtt

SEQ ID NO: 52125 - DNA, 15 bp, Artificial Sequence
  dgRNA
  Il1f9
ctgggtgactaccag

SEQ ID NO: 52126 - DNA, 15 bp, Artificial Sequence
  dgRNA
  Fth1
cccgcccgcgccctg

SEQ ID NO: 52127 - DNA, 15 bp, Artificial Sequence
  dgRNA
  Fth1
cgcgccctgcgggtt

SEQ ID NO: 52128 - DNA, 15 bp, Artificial Sequence
  dgRNA
  Fth1
gcgccctgcgggttt

SEQ ID NO: 52129 - DNA, 15 bp, Artificial Sequence
  dgRNA
  Fth1
gggcaacacgcccac

SEQ ID NO: 52130 - DNA, 15 bp, Artificial Sequence
  dgRNA
  Slc14a2
cccaaataagacgca

SEQ ID NO: 52131 - DNA, 15 bp, Artificial Sequence
  dgRNA
  Slc14a2
tattatgcctattac

SEQ ID NO: 52132 - DNA, 15 bp, Artificial Sequence
  dgRNA
  Slc14a2
ccatgcgtcttattt

SEQ ID NO: 52133 - DNA, 15 bp, Artificial Sequence
  dgRNA
  Slc14a2
gccatgcgtcttatt

SEQ ID NO: 52134 - DNA, 15 bp, Artificial Sequence
  dgRNA
  Pdik1l
accgctggaaacgct

SEQ ID NO: 52135 - DNA, 15 bp, Artificial Sequence
  dgRNA
  Pdik1l
gctgtgcgccgcgcc

SEQ ID NO: 52136 - DNA, 15 bp, Artificial Sequence
  dgRNA
  Pdik1l
ctgtgcgccgcgcca

SEQ ID NO: 52137 - DNA, 15 bp, Artificial Sequence
  dgRNA
  Pdik1l
agcgacggagcgcaa

SEQ ID NO: 52138 - DNA, 15 bp, Artificial Sequence
  dgRNA
  Sfrp5
ataaaaagacgaagc

SEQ ID NO: 52139 - DNA, 15 bp, Artificial Sequence
  dgRNA
  Sfrp5
taaaaagacgaagca

SEQ ID NO: 52140 - DNA, 15 bp, Artificial Sequence
  dgRNA
  Sfrp5
agcagaatagttgac

SEQ ID NO: 52141 - DNA, 15 bp, Artificial Sequence
  dgRNA
  Sfrp5
aatagttgacgggtc

SEQ ID NO: 52142 - DNA, 15 bp, Artificial Sequence
  dgRNA
  Arhgap44
ttccgcacaggcgca

SEQ ID NO: 52143 - DNA, 15 bp, Artificial Sequence
  dgRNA
  Arhgap44
ccgcacaggcgcacg

SEQ ID NO: 52144 - DNA, 15 bp, Artificial Sequence
  dgRNA
  Arhgap44
cgcacggggaccacc

SEQ ID NO: 52145 - DNA, 15 bp, Artificial Sequence
  dgRNA
  Arhgap44
gaccacccggccagc

SEQ ID NO: 52146 - DNA, 15 bp, Artificial Sequence
  dgRNA
  Trim75
tgctattaattacat

SEQ ID NO: 52147 - DNA, 15 bp, Artificial Sequence
  dgRNA
  Trim75
gttggctcattattc

SEQ ID NO: 52148 - DNA, 15 bp, Artificial Sequence
  dgRNA
  Trim75
aattggccctcattg

SEQ ID NO: 52149 - DNA, 15 bp, Artificial Sequence
  dgRNA
  Trim75
tcattgaggtgtgtc

SEQ ID NO: 52150 - DNA, 15 bp, Artificial Sequence
  dgRNA
  Dido1
tttcgagatgcgaac

SEQ ID NO: 52151 - DNA, 15 bp, Artificial Sequence
  dgRNA
  Dido1
cgaactggcaaccaa

SEQ ID NO: 52152 - DNA, 15 bp, Artificial Sequence
  dgRNA
  Dido1
cgcgaatcgaccgcc

SEQ ID NO: 52153 - DNA, 15 bp, Artificial Sequence
  dgRNA
  Dido1
gcgaatcgaccgccc

SEQ ID NO: 52154 - DNA, 15 bp, Artificial Sequence
  dgRNA
  Rps14
cacctccgtaccacg

SEQ ID NO: 52155 - DNA, 15 bp, Artificial Sequence
  dgRNA
  Rps14
agcgcagtcgcctcc

SEQ ID NO: 52156 - DNA, 15 bp, Artificial Sequence
  dgRNA
  Rps14
cagtcgcctccaggc

SEQ ID NO: 52157 - DNA, 15 bp, Artificial Sequence
  dgRNA
  Rps14
gcagcacccgcgacc

SEQ ID NO: 52158 - DNA, 15 bp, Artificial Sequence
  dgRNA
  Nt5m
aagagtgctccagtc

SEQ ID NO: 52159 - DNA, 15 bp, Artificial Sequence
  dgRNA
  Nt5m
caggcggctgtaacc

SEQ ID NO: 52160 - DNA, 15 bp, Artificial Sequence
  dgRNA
  Nt5m
aggcggctgtaacct

SEQ ID NO: 52161 - DNA, 15 bp, Artificial Sequence
  dgRNA
  Nt5m
cgcgctcaccttctc

SEQ ID NO: 52162 - DNA, 15 bp, Artificial Sequence
  dgRNA
  Nlrp2
ctactccggggaagg

SEQ ID NO: 52163 - DNA, 15 bp, Artificial Sequence
  dgRNA
  Nlrp2
tatctactccgggga

SEQ ID NO: 52164 - DNA, 15 bp, Artificial Sequence
  dgRNA
  Nlrp2
gacttatctactccg

SEQ ID NO: 52165 - DNA, 15 bp, Artificial Sequence
  dgRNA
  Nlrp2
agacttatctactcc

SEQ ID NO: 52166 - DNA, 15 bp, Artificial Sequence
  dgRNA
  Atrip
gaaccgcctcaggtg

SEQ ID NO: 52167 - DNA, 15 bp, Artificial Sequence
  dgRNA
  Atrip
cgcctcaggtgtggt

SEQ ID NO: 52168 - DNA, 15 bp, Artificial Sequence
  dgRNA
  Atrip
ctcgatctcgcaacc

SEQ ID NO: 52169 - DNA, 15 bp, Artificial Sequence
  dgRNA
  Atrip
gtaccctggcatcac

SEQ ID NO: 52170 - DNA, 15 bp, Artificial Sequence
  dgRNA
  Lpp
cgccttctccatata

SEQ ID NO: 52171 - DNA, 15 bp, Artificial Sequence
  dgRNA
  Lpp
actcatctattggaa

SEQ ID NO: 52172 - DNA, 15 bp, Artificial Sequence
  dgRNA
  Lpp
aacatgccccacaca

SEQ ID NO: 52173 - DNA, 15 bp, Artificial Sequence
  dgRNA
  Lpp
tatggagaaggcggc

SEQ ID NO: 52174 - DNA, 15 bp, Artificial Sequence
  dgRNA
  Podxl2
gcgagtgtagggggc

SEQ ID NO: 52175 - DNA, 15 bp, Artificial Sequence
  dgRNA
  Podxl2
gcacaaaagcttgac

SEQ ID NO: 52176 - DNA, 15 bp, Artificial Sequence
  dgRNA
  Podxl2
agccgccaccacaga

SEQ ID NO: 52177 - DNA, 15 bp, Artificial Sequence
  dgRNA
  Podxl2
gccgccaccacagaa

SEQ ID NO: 52178 - DNA, 15 bp, Artificial Sequence
  dgRNA
  Ly6g6e
aaccccaactagaac

SEQ ID NO: 52179 - DNA, 15 bp, Artificial Sequence
  dgRNA
  Ly6g6e
accccaactagaacc

SEQ ID NO: 52180 - DNA, 15 bp, Artificial Sequence
  dgRNA
  Ly6g6e
cgggaacagcttgag

SEQ ID NO: 52181 - DNA, 15 bp, Artificial Sequence
  dgRNA
  Ly6g6e
aacagcttgagcggg

SEQ ID NO: 52182 - DNA, 15 bp, Artificial Sequence
  dgRNA
  Tmem92
gccttctttgttgga

SEQ ID NO: 52183 - DNA, 15 bp, Artificial Sequence
  dgRNA
  Pqlc3
agtggagcagactcg

SEQ ID NO: 52184 - DNA, 15 bp, Artificial Sequence
  dgRNA
  Pqlc3
gctcggggcgtgatc

SEQ ID NO: 52185 - DNA, 15 bp, Artificial Sequence
  dgRNA
  Pqlc3
ctcggggcgtgatca

SEQ ID NO: 52186 - DNA, 15 bp, Artificial Sequence
  dgRNA
  Pqlc3
gggcgtgatcagggc

SEQ ID NO: 52187 - DNA, 15 bp, Artificial Sequence
  dgRNA
  Mrgprb8
cttggggtgtatact

SEQ ID NO: 52188 - DNA, 15 bp, Artificial Sequence
  dgRNA
  Mrgprb8
agtctctaaacatac

SEQ ID NO: 52189 - DNA, 15 bp, Artificial Sequence
  dgRNA
  Mrgprb8
cacgaatgtagttga

SEQ ID NO: 52190 - DNA, 15 bp, Artificial Sequence
  dgRNA
  Armc7
gacgcatccccgctg

SEQ ID NO: 52191 - DNA, 15 bp, Artificial Sequence
  dgRNA
  Armc7
gcatccccgctgcgg

SEQ ID NO: 52192 - DNA, 15 bp, Artificial Sequence
  dgRNA
  Armc7
cggctgcgcagtgga

SEQ ID NO: 52193 - DNA, 15 bp, Artificial Sequence
  dgRNA
  Armc7
ccagctctagaaatc

SEQ ID NO: 52194 - DNA, 15 bp, Artificial Sequence
  dgRNA
  Tmem165
gtactggtaggagcc

SEQ ID NO: 52195 - DNA, 15 bp, Artificial Sequence
  dgRNA
  Tmem165
ctggtgggacccgag

SEQ ID NO: 52196 - DNA, 15 bp, Artificial Sequence
  dgRNA
  Tmem165
gacccgagaggacgc

SEQ ID NO: 52197 - DNA, 15 bp, Artificial Sequence
  dgRNA
  Tmem165
acccgagaggacgca

SEQ ID NO: 52198 - DNA, 15 bp, Artificial Sequence
  dgRNA
  Aifm1
ccgctgcctccgggc

SEQ ID NO: 52199 - DNA, 15 bp, Artificial Sequence
  dgRNA
  Aifm1
tccaggtttcttaag

SEQ ID NO: 52200 - DNA, 15 bp, Artificial Sequence
  dgRNA
  Aifm1
ggctcaacctactac

SEQ ID NO: 52201 - DNA, 15 bp, Artificial Sequence
  dgRNA
  Aifm1
gctcaacctactaca

SEQ ID NO: 52202 - DNA, 15 bp, Artificial Sequence
  dgRNA
  Nfat5
tcctgtcagcggcgc

SEQ ID NO: 52203 - DNA, 15 bp, Artificial Sequence
  dgRNA
  Nfat5
tgtcagcggcgccgg

SEQ ID NO: 52204 - DNA, 15 bp, Artificial Sequence
  dgRNA
  Nfat5
cgtcagtgtgcgctg

SEQ ID NO: 52205 - DNA, 15 bp, Artificial Sequence
  dgRNA
  Nfat5
aggagaagcccgaaa

SEQ ID NO: 52206 - DNA, 15 bp, Artificial Sequence
  dgRNA
  E430025E21Rik
ctctgcgtcatcact

SEQ ID NO: 52207 - DNA, 15 bp, Artificial Sequence
  dgRNA
  E430025E21Rik
cgatcacatgatgcc

SEQ ID NO: 52208 - DNA, 15 bp, Artificial Sequence
  dgRNA
  E430025E21Rik
atgatgcccgggccc

SEQ ID NO: 52209 - DNA, 15 bp, Artificial Sequence
  dgRNA
  E430025E21Rik
cgggccgccgcccct

SEQ ID NO: 52210 - DNA, 15 bp, Artificial Sequence
  dgRNA
  Zc3hav1l
gccctccctgttatc

SEQ ID NO: 52211 - DNA, 15 bp, Artificial Sequence
  dgRNA
  Zc3hav1l
tatccggtatctgcc

SEQ ID NO: 52212 - DNA, 15 bp, Artificial Sequence
  dgRNA
  Zc3hav1l
atgttgcaggggctc

SEQ ID NO: 52213 - DNA, 15 bp, Artificial Sequence
  dgRNA
  Zc3hav1l
ccccctacagctcgc

SEQ ID NO: 52214 - DNA, 15 bp, Artificial Sequence
  dgRNA
  Psors1c2
agacccggctgcccc

SEQ ID NO: 52215 - DNA, 15 bp, Artificial Sequence
  dgRNA
  Psors1c2
cccggcccccgggac

SEQ ID NO: 52216 - DNA, 15 bp, Artificial Sequence
  dgRNA
  Psors1c2
ccggcccccgggact

SEQ ID NO: 52217 - DNA, 15 bp, Artificial Sequence
  dgRNA
  Psors1c2
cggcccccgggactg

SEQ ID NO: 52218 - DNA, 15 bp, Artificial Sequence
  dgRNA
  Trim34a
gttttgccaatactt

SEQ ID NO: 52219 - DNA, 15 bp, Artificial Sequence
  dgRNA
  Bpifa5
gccgattgccgtatt

SEQ ID NO: 52220 - DNA, 15 bp, Artificial Sequence
  dgRNA
  Bpifa5
ccgattgccgtattc

SEQ ID NO: 52221 - DNA, 15 bp, Artificial Sequence
  dgRNA
  Bpifa5
aaaactcgatatggc

SEQ ID NO: 52222 - DNA, 15 bp, Artificial Sequence
  dgRNA
  Bpifa5
caagaaaactcgata

SEQ ID NO: 52223 - DNA, 15 bp, Artificial Sequence
  dgRNA
  Mgat2
gacttaccgagagac

SEQ ID NO: 52224 - DNA, 15 bp, Artificial Sequence
  dgRNA
  Mgat2
ccgcacgcgccgaac

SEQ ID NO: 52225 - DNA, 15 bp, Artificial Sequence
  dgRNA
  Mgat2
cgcgccgaacaggaa

SEQ ID NO: 52226 - DNA, 15 bp, Artificial Sequence
  dgRNA
  Mgat2
gcgccgaacaggaaa

SEQ ID NO: 52227 - DNA, 15 bp, Artificial Sequence
  dgRNA
  Klf9
cacgcggcggcggaa

SEQ ID NO: 52228 - DNA, 15 bp, Artificial Sequence
  dgRNA
  Klf9
ggcggcggaacggaa

SEQ ID NO: 52229 - DNA, 15 bp, Artificial Sequence
  dgRNA
  Klf9
gcggaacggaacggt

SEQ ID NO: 52230 - DNA, 15 bp, Artificial Sequence
  dgRNA
  Klf9
acggaacggtcggat

SEQ ID NO: 52231 - DNA, 15 bp, Artificial Sequence
  dgRNA
  Cd200r3
aagtcactcctaagt

SEQ ID NO: 52232 - DNA, 15 bp, Artificial Sequence
  dgRNA
  Cd200r3
tcagttcaccgactt

SEQ ID NO: 52233 - DNA, 15 bp, Artificial Sequence
  dgRNA
  Adamts13
cgagcccacaccccc

SEQ ID NO: 52234 - DNA, 15 bp, Artificial Sequence
  dgRNA
  Adamts13
gagcccacaccccct

SEQ ID NO: 52235 - DNA, 15 bp, Artificial Sequence
  dgRNA
  Adamts13
cccctgggtcctatt

SEQ ID NO: 52236 - DNA, 15 bp, Artificial Sequence
  dgRNA
  Adamts13
cctaataggacccag

SEQ ID NO: 52237 - DNA, 15 bp, Artificial Sequence
  dgRNA
  1700012B07Rik
ttcttcagccgacca

SEQ ID NO: 52238 - DNA, 15 bp, Artificial Sequence
  dgRNA
  1700012B07Rik
tcttcagccgaccaa

SEQ ID NO: 52239 - DNA, 15 bp, Artificial Sequence
  dgRNA
  1700012B07Rik
tccctcaagtgtcat

SEQ ID NO: 52240 - DNA, 15 bp, Artificial Sequence
  dgRNA
  1700012B07Rik
gttcttcggaaccct

SEQ ID NO: 52241 - DNA, 15 bp, Artificial Sequence
  dgRNA
  Xlr3c
ggtacaccagccaat

SEQ ID NO: 52242 - DNA, 15 bp, Artificial Sequence
  dgRNA
  Xlr3c
acattatatcagccg

SEQ ID NO: 52243 - DNA, 15 bp, Artificial Sequence
  dgRNA
  Xlr3c
tgttctccgattggc

SEQ ID NO: 52244 - DNA, 15 bp, Artificial Sequence
  dgRNA
  Xlr3c
ataatgttctccgat

SEQ ID NO: 52245 - DNA, 15 bp, Artificial Sequence
  dgRNA
  Pomgnt1
atgtgctctcgcccg

SEQ ID NO: 52246 - DNA, 15 bp, Artificial Sequence
  dgRNA
  Pomgnt1
cgaggtccactcgtg

SEQ ID NO: 52247 - DNA, 15 bp, Artificial Sequence
  dgRNA
  Pomgnt1
acaggcagagtacgc

SEQ ID NO: 52248 - DNA, 15 bp, Artificial Sequence
  dgRNA
  Pomgnt1
cgcgctgcagacgcc

SEQ ID NO: 52249 - DNA, 15 bp, Artificial Sequence
  dgRNA
  Npy5r
cctgtagccctagag

SEQ ID NO: 52250 - DNA, 15 bp, Artificial Sequence
  dgRNA
  Npy5r
cctagagcggctgcc

SEQ ID NO: 52251 - DNA, 15 bp, Artificial Sequence
  dgRNA
  Npy5r
ctagagcggctgccc

SEQ ID NO: 52252 - DNA, 15 bp, Artificial Sequence
  dgRNA
  Npy5r
tagagcggctgcccg

SEQ ID NO: 52253 - DNA, 15 bp, Artificial Sequence
  dgRNA
  Cacng2
ggccagcgctcattc

SEQ ID NO: 52254 - DNA, 15 bp, Artificial Sequence
  dgRNA
  Cacng2
ctcattccggaactg

SEQ ID NO: 52255 - DNA, 15 bp, Artificial Sequence
  dgRNA
  Cacng2
ccggaactgtggaac

SEQ ID NO: 52256 - DNA, 15 bp, Artificial Sequence
  dgRNA
  Cacng2
gaacaggagtccggg

SEQ ID NO: 52257 - DNA, 15 bp, Artificial Sequence
  dgRNA
  Cry2
tgaccaatggaacag

SEQ ID NO: 52258 - DNA, 15 bp, Artificial Sequence
  dgRNA
  Cry2
gcgatccagactcct

SEQ ID NO: 52259 - DNA, 15 bp, Artificial Sequence
  dgRNA
  Cry2
cgatccagactcctt

SEQ ID NO: 52260 - DNA, 15 bp, Artificial Sequence
  dgRNA
  Cry2
gggcggagtcatgcc

SEQ ID NO: 52261 - DNA, 15 bp, Artificial Sequence
  dgRNA
  Nkd1
gctcttggcgtgctt

SEQ ID NO: 52262 - DNA, 15 bp, Artificial Sequence
  dgRNA
  Nkd1
cgcctgcttatgcct

SEQ ID NO: 52263 - DNA, 15 bp, Artificial Sequence
  dgRNA
  Nkd1
ttaacctgctgttcg

SEQ ID NO: 52264 - DNA, 15 bp, Artificial Sequence
  dgRNA
  Nkd1
tacccagctgtcagt

SEQ ID NO: 52265 - DNA, 15 bp, Artificial Sequence
  dgRNA
  Arhgef3
cagctataaccggca

SEQ ID NO: 52266 - DNA, 15 bp, Artificial Sequence
  dgRNA
  Arhgef3
gacacttgtaacaga

SEQ ID NO: 52267 - DNA, 15 bp, Artificial Sequence
  dgRNA
  Arhgef3
atgcaacttaagtgg

SEQ ID NO: 52268 - DNA, 15 bp, Artificial Sequence
  dgRNA
  Arhgef3
tgcaacttaagtggc

SEQ ID NO: 52269 - DNA, 15 bp, Artificial Sequence
  dgRNA
  Olfr624
cgtttgtgtccgcat

SEQ ID NO: 52270 - DNA, 15 bp, Artificial Sequence
  dgRNA
  Olfr624
aatgatgtacaacca

SEQ ID NO: 52271 - DNA, 15 bp, Artificial Sequence
  dgRNA
  Tcaf2
agagcaattaggcac

SEQ ID NO: 52272 - DNA, 15 bp, Artificial Sequence
  dgRNA
  Tcaf2
tagcaccaagccagt

SEQ ID NO: 52273 - DNA, 15 bp, Artificial Sequence
  dgRNA
  Tcaf2
gtcagattcccggtc

SEQ ID NO: 52274 - DNA, 15 bp, Artificial Sequence
  dgRNA
  Tcaf2
gcagagcaactgtta

SEQ ID NO: 52275 - DNA, 15 bp, Artificial Sequence
  dgRNA
  Ppp2r5d
gctcgggtttcccca

SEQ ID NO: 52276 - DNA, 15 bp, Artificial Sequence
  dgRNA
  Ppp2r5d
agcccgacccttttc

SEQ ID NO: 52277 - DNA, 15 bp, Artificial Sequence
  dgRNA
  Ppp2r5d
gcccgacccttttca

SEQ ID NO: 52278 - DNA, 15 bp, Artificial Sequence
  dgRNA
  Ppp2r5d
cgacccttttcaggg

SEQ ID NO: 52279 - DNA, 15 bp, Artificial Sequence
  dgRNA
  Ninl
taccagctaggcccc

SEQ ID NO: 52280 - DNA, 15 bp, Artificial Sequence
  dgRNA
  Ninl
ggggcctagctggta

SEQ ID NO: 52281 - DNA, 15 bp, Artificial Sequence
  dgRNA
  Ninl
gggcttggacgggcg

SEQ ID NO: 52282 - DNA, 15 bp, Artificial Sequence
  dgRNA
  Ninl
ggggcttggacgggc

SEQ ID NO: 52283 - DNA, 15 bp, Artificial Sequence
  dgRNA
  Gm20594
gcactcataggaaat

SEQ ID NO: 52284 - DNA, 15 bp, Artificial Sequence
  dgRNA
  Gm20594
aggtagggcactcat

SEQ ID NO: 52285 - DNA, 15 bp, Artificial Sequence
  dgRNA
  Gm20594
tcaattcgtaggagc

SEQ ID NO: 52286 - DNA, 15 bp, Artificial Sequence
  dgRNA
  Gm20594
ggagaatcaattcgt

SEQ ID NO: 52287 - DNA, 15 bp, Artificial Sequence
  dgRNA
  Csnk1g2
gcgttccgttcctta

SEQ ID NO: 52288 - DNA, 15 bp, Artificial Sequence
  dgRNA
  Csnk1g2
cgcgcacgcctctcg

SEQ ID NO: 52289 - DNA, 15 bp, Artificial Sequence
  dgRNA
  Csnk1g2
acgcctctcgcggct

SEQ ID NO: 52290 - DNA, 15 bp, Artificial Sequence
  dgRNA
  Csnk1g2
gttgcgactgcgcag

SEQ ID NO: 52291 - DNA, 15 bp, Artificial Sequence
  dgRNA
  2510002D24Rik
catcggctagacacc

SEQ ID NO: 52292 - DNA, 15 bp, Artificial Sequence
  dgRNA
  2510002D24Rik
tagtgcgcgtttgct

SEQ ID NO: 52293 - DNA, 15 bp, Artificial Sequence
  dgRNA
  2510002D24Rik
tttcaaatccgtatg

SEQ ID NO: 52294 - DNA, 15 bp, Artificial Sequence
  dgRNA
  2510002D24Rik
gcattcggaaaaaac

SEQ ID NO: 52295 - DNA, 15 bp, Artificial Sequence
  dgRNA
  Il31
ccccaggccgagccg

SEQ ID NO: 52296 - DNA, 15 bp, Artificial Sequence
  dgRNA
  Il31
aggccgagccgaggc

SEQ ID NO: 52297 - DNA, 15 bp, Artificial Sequence
  dgRNA
  Il31
gcaatggttttgcca

SEQ ID NO: 52298 - DNA, 15 bp, Artificial Sequence
  dgRNA
  Il31
ggttttgccatgggc

SEQ ID NO: 52299 - DNA, 15 bp, Artificial Sequence
  dgRNA
  Smad5
tttaacgctttagat

SEQ ID NO: 52300 - DNA, 15 bp, Artificial Sequence
  dgRNA
  Smad5
ttagattggctagaa

SEQ ID NO: 52301 - DNA, 15 bp, Artificial Sequence
  dgRNA
  Smad5
gaccgtttcgctata

SEQ ID NO: 52302 - DNA, 15 bp, Artificial Sequence
  dgRNA
  Smad5
cgtttcgctataagg

SEQ ID NO: 52303 - DNA, 15 bp, Artificial Sequence
  dgRNA
  Sult6b1
gagcctgtccgcacc

SEQ ID NO: 52304 - DNA, 15 bp, Artificial Sequence
  dgRNA
  Sult6b1
agcctgtccgcacct

SEQ ID NO: 52305 - DNA, 15 bp, Artificial Sequence
  dgRNA
  Sult6b1
gcctcaccttttgcc

SEQ ID NO: 52306 - DNA, 15 bp, Artificial Sequence
  dgRNA
  Sult6b1
ggaggatattcaaac

SEQ ID NO: 52307 - DNA, 15 bp, Artificial Sequence
  dgRNA
  Ptpn1
ccgccgggggtcgct

SEQ ID NO: 52308 - DNA, 15 bp, Artificial Sequence
  dgRNA
  Ptpn1
cgccgggggtcgctt

SEQ ID NO: 52309 - DNA, 15 bp, Artificial Sequence
  dgRNA
  Ptpn1
gggtcgcttgggcaa

SEQ ID NO: 52310 - DNA, 15 bp, Artificial Sequence
  dgRNA
  Ptpn1
ggtcgcttgggcaac

SEQ ID NO: 52311 - DNA, 15 bp, Artificial Sequence
  dgRNA
  Galnt12
tgtcacgtaagttca

SEQ ID NO: 52312 - DNA, 15 bp, Artificial Sequence
  dgRNA
  Galnt12
acgtaagttcaagga

SEQ ID NO: 52313 - DNA, 15 bp, Artificial Sequence
  dgRNA
  Galnt12
cgtaagttcaaggaa

SEQ ID NO: 52314 - DNA, 15 bp, Artificial Sequence
  dgRNA
  Galnt12
cacactcacgccgca

SEQ ID NO: 52315 - DNA, 15 bp, Artificial Sequence
  dgRNA
  Snx29
tacccctggtgccag

SEQ ID NO: 52316 - DNA, 15 bp, Artificial Sequence
  dgRNA
  Snx29
gccaccttgtaagca

SEQ ID NO: 52317 - DNA, 15 bp, Artificial Sequence
  dgRNA
  Snx29
ccaccttgtaagcaa

SEQ ID NO: 52318 - DNA, 15 bp, Artificial Sequence
  dgRNA
  Snx29
ccttgtaagcaaggg

SEQ ID NO: 52319 - DNA, 15 bp, Artificial Sequence
  dgRNA
  Xrcc3
atcggcggtgaagac

SEQ ID NO: 52320 - DNA, 15 bp, Artificial Sequence
  dgRNA
  Xrcc3
ggcggtgaagaccgg

SEQ ID NO: 52321 - DNA, 15 bp, Artificial Sequence
  dgRNA
  Xrcc3
gcggtgaagaccgga

SEQ ID NO: 52322 - DNA, 15 bp, Artificial Sequence
  dgRNA
  Xrcc3
cggtgaagaccggag

SEQ ID NO: 52323 - DNA, 15 bp, Artificial Sequence
  dgRNA
  Taf2
ccgcccactcacgcc

SEQ ID NO: 52324 - DNA, 15 bp, Artificial Sequence
  dgRNA
  Taf2
cccggacaagacttc

SEQ ID NO: 52325 - DNA, 15 bp, Artificial Sequence
  dgRNA
  Taf2
ccggacaagacttcc

SEQ ID NO: 52326 - DNA, 15 bp, Artificial Sequence
  dgRNA
  Taf2
cgggttctgcctccg

SEQ ID NO: 52327 - DNA, 15 bp, Artificial Sequence
  dgRNA
  Psg27
gcagatatcagcgcc

SEQ ID NO: 52328 - DNA, 15 bp, Artificial Sequence
  dgRNA
  Zcchc13
gctttgtgatgtacg

SEQ ID NO: 52329 - DNA, 15 bp, Artificial Sequence
  dgRNA
  Zcchc13
tgtacgtggccattg

SEQ ID NO: 52330 - DNA, 15 bp, Artificial Sequence
  dgRNA
  Zcchc13
tcattaacgtcacag

SEQ ID NO: 52331 - DNA, 15 bp, Artificial Sequence
  dgRNA
  Zcchc13
tgcacacggcctcaa

SEQ ID NO: 52332 - DNA, 15 bp, Artificial Sequence
  dgRNA
  Tatdn1
caccatgactcgagg

SEQ ID NO: 52333 - DNA, 15 bp, Artificial Sequence
  dgRNA
  Tatdn1
gggtcaggtaggccg

SEQ ID NO: 52334 - DNA, 15 bp, Artificial Sequence
  dgRNA
  Tatdn1
ggtcaggtaggccgg

SEQ ID NO: 52335 - DNA, 15 bp, Artificial Sequence
  dgRNA
  Tatdn1
gaacgccatagcgtc

SEQ ID NO: 52336 - DNA, 15 bp, Artificial Sequence
  dgRNA
  Kcnh7
aaattggcgctgttt

SEQ ID NO: 52337 - DNA, 15 bp, Artificial Sequence
  dgRNA
  Kcnh7
gccccccgcgttcct

SEQ ID NO: 52338 - DNA, 15 bp, Artificial Sequence
  dgRNA
  Kcnh7
cctctcactcgacgc

SEQ ID NO: 52339 - DNA, 15 bp, Artificial Sequence
  dgRNA
  Kcnh7
tcactcgacgcaggc

SEQ ID NO: 52340 - DNA, 15 bp, Artificial Sequence
  dgRNA
  Fuca1
ccttaggcgagtcta

SEQ ID NO: 52341 - DNA, 15 bp, Artificial Sequence
  dgRNA
  Fuca1
cccttccaatgccag

SEQ ID NO: 52342 - DNA, 15 bp, Artificial Sequence
  dgRNA
  Fuca1
aatcgttactctgag

SEQ ID NO: 52343 - DNA, 15 bp, Artificial Sequence
  dgRNA
  Fuca1
cgttactctgagagg

SEQ ID NO: 52344 - DNA, 15 bp, Artificial Sequence
  dgRNA
  Ppif
ccggctcagtgtgta

SEQ ID NO: 52345 - DNA, 15 bp, Artificial Sequence
  dgRNA
  Ppif
cgattacgctgccag

SEQ ID NO: 52346 - DNA, 15 bp, Artificial Sequence
  dgRNA
  Ppif
ccagcggcaaccggc

SEQ ID NO: 52347 - DNA, 15 bp, Artificial Sequence
  dgRNA
  Ppif
cagcggcaaccggca

SEQ ID NO: 52348 - DNA, 15 bp, Artificial Sequence
  dgRNA
  Hist1h2bc
acgctactacttgat

SEQ ID NO: 52349 - DNA, 15 bp, Artificial Sequence
  dgRNA
  Hist1h2bc
aaacgccctataagt

SEQ ID NO: 52350 - DNA, 15 bp, Artificial Sequence
  dgRNA
  Hist1h2bc
tagcgtttactaccc

SEQ ID NO: 52351 - DNA, 15 bp, Artificial Sequence
  dgRNA
  Hist1h2bc
aagtagtgggttcat

SEQ ID NO: 52352 - DNA, 15 bp, Artificial Sequence
  dgRNA
  Ubn1
gcagccgggaacttc

SEQ ID NO: 52353 - DNA, 15 bp, Artificial Sequence
  dgRNA
  Ubn1
aacttcaggtcgccg

SEQ ID NO: 52354 - DNA, 15 bp, Artificial Sequence
  dgRNA
  Ubn1
cgcggcaccgcccat

SEQ ID NO: 52355 - DNA, 15 bp, Artificial Sequence
  dgRNA
  Ubn1
accgcccattggagt

SEQ ID NO: 52356 - DNA, 15 bp, Artificial Sequence
  dgRNA
  Olfr51
gtaaactacttctgc

SEQ ID NO: 52357 - DNA, 15 bp, Artificial Sequence
  dgRNA
  Olfr51
aaatggtttagtgat

SEQ ID NO: 52358 - DNA, 15 bp, Artificial Sequence
  dgRNA
  Ccna2
catacgctcctgcct

SEQ ID NO: 52359 - DNA, 15 bp, Artificial Sequence
  dgRNA
  Ccna2
cgccacccagcgacc

SEQ ID NO: 52360 - DNA, 15 bp, Artificial Sequence
  dgRNA
  Ccna2
ccttagctgaggcga

SEQ ID NO: 52361 - DNA, 15 bp, Artificial Sequence
  dgRNA
  Ccna2
aaggccgacacctcg

SEQ ID NO: 52362 - DNA, 15 bp, Artificial Sequence
  dgRNA
  Duxf3
aggagtccttacctt

SEQ ID NO: 52363 - DNA, 15 bp, Artificial Sequence
  dgRNA
  Tmtc3
tacatttcacgaccc

SEQ ID NO: 52364 - DNA, 15 bp, Artificial Sequence
  dgRNA
  Tmtc3
aagccctccttactg

SEQ ID NO: 52365 - DNA, 15 bp, Artificial Sequence
  dgRNA
  Tmtc3
gagagccgtgagatg

SEQ ID NO: 52366 - DNA, 15 bp, Artificial Sequence
  dgRNA
  Tmtc3
tgcagttcggcgtcg

SEQ ID NO: 52367 - DNA, 15 bp, Artificial Sequence
  dgRNA
  Vmn1r11
ctatgatgaacagtc

SEQ ID NO: 52368 - DNA, 15 bp, Artificial Sequence
  dgRNA
  Vmn1r11
cactctatttcccct

SEQ ID NO: 52369 - DNA, 15 bp, Artificial Sequence
  dgRNA
  Slc5a2
atggatcctaaaccc

SEQ ID NO: 52370 - DNA, 15 bp, Artificial Sequence
  dgRNA
  Slc5a2
atggtccagcgcccc

SEQ ID NO: 52371 - DNA, 15 bp, Artificial Sequence
  dgRNA
  Slc5a2
attaatccttccccc

SEQ ID NO: 52372 - DNA, 15 bp, Artificial Sequence
  dgRNA
  Slc5a2
taatccttcccccag

SEQ ID NO: 52373 - DNA, 15 bp, Artificial Sequence
  dgRNA
  Lhx1
ctcgctgctagtcgc

SEQ ID NO: 52374 - DNA, 15 bp, Artificial Sequence
  dgRNA
  Lhx1
gtcgccggcaccgcg

SEQ ID NO: 52375 - DNA, 15 bp, Artificial Sequence
  dgRNA
  Lhx1
tcgccggcaccgcgc

SEQ ID NO: 52376 - DNA, 15 bp, Artificial Sequence
  dgRNA
  Lhx1
ctgatcctctaaacg

SEQ ID NO: 52377 - DNA, 15 bp, Artificial Sequence
  dgRNA
  Phf21a
tctaaaaagtgcgag

SEQ ID NO: 52378 - DNA, 15 bp, Artificial Sequence
  dgRNA
  Phf20
actaagagggtacat

SEQ ID NO: 52379 - DNA, 15 bp, Artificial Sequence
  dgRNA
  Phf20
tgacctcagccgtca

SEQ ID NO: 52380 - DNA, 15 bp, Artificial Sequence
  dgRNA
  Phf20
gacctcagccgtcac

SEQ ID NO: 52381 - DNA, 15 bp, Artificial Sequence
  dgRNA
  Phf20
cgtcacgggtgagtg

SEQ ID NO: 52382 - DNA, 15 bp, Artificial Sequence
  dgRNA
  6430571L13Rik
ggtccaagctcccgc

SEQ ID NO: 52383 - DNA, 15 bp, Artificial Sequence
  dgRNA
  6430571L13Rik
gtccaagctcccgct

SEQ ID NO: 52384 - DNA, 15 bp, Artificial Sequence
  dgRNA
  6430571L13Rik
ctatatctgagcgac

SEQ ID NO: 52385 - DNA, 15 bp, Artificial Sequence
  dgRNA
  6430571L13Rik
tgctgatcgagcttt

SEQ ID NO: 52386 - DNA, 15 bp, Artificial Sequence
  dgRNA
  Tcf12
ggcgcagtgagcttg

SEQ ID NO: 52387 - DNA, 15 bp, Artificial Sequence
  dgRNA
  Tcf12
gccgccgcccgccgt

SEQ ID NO: 52388 - DNA, 15 bp, Artificial Sequence
  dgRNA
  Tcf12
gcggtcccacttcct

SEQ ID NO: 52389 - DNA, 15 bp, Artificial Sequence
  dgRNA
  Tcf12
cccacttcctcggcg

SEQ ID NO: 52390 - DNA, 15 bp, Artificial Sequence
  dgRNA
  Lgsn
atgagcatttgctgc

SEQ ID NO: 52391 - DNA, 15 bp, Artificial Sequence
  dgRNA
  Lgsn
ggctattctagggca

SEQ ID NO: 52392 - DNA, 15 bp, Artificial Sequence
  dgRNA
  Lgsn
gaggttctttccagg

SEQ ID NO: 52393 - DNA, 15 bp, Artificial Sequence
  dgRNA
  Lgsn
gtagacttcttacaa

SEQ ID NO: 52394 - DNA, 15 bp, Artificial Sequence
  dgRNA
  Sall1
acgatccagactcaa

SEQ ID NO: 52395 - DNA, 15 bp, Artificial Sequence
  dgRNA
  Sall1
aaggcgctccagaat

SEQ ID NO: 52396 - DNA, 15 bp, Artificial Sequence
  dgRNA
  Sall1
aggcgctccagaatt

SEQ ID NO: 52397 - DNA, 15 bp, Artificial Sequence
  dgRNA
  Sall1
ggcgctccagaattg

SEQ ID NO: 52398 - DNA, 15 bp, Artificial Sequence
  dgRNA
  B3gat2
cccgcaggcagcgcc

SEQ ID NO: 52399 - DNA, 15 bp, Artificial Sequence
  dgRNA
  B3gat2
agcgcctggtgccac

SEQ ID NO: 52400 - DNA, 15 bp, Artificial Sequence
  dgRNA
  B3gat2
gcgcctggtgccacc

SEQ ID NO: 52401 - DNA, 15 bp, Artificial Sequence
  dgRNA
  B3gat2
ccccgcagagagcct

SEQ ID NO: 52402 - DNA, 15 bp, Artificial Sequence
  dgRNA
  Klrc3
aaagcgccaattctt

SEQ ID NO: 52403 - DNA, 15 bp, Artificial Sequence
  dgRNA
  Scamp3
gttgtttcaaccaat

SEQ ID NO: 52404 - DNA, 15 bp, Artificial Sequence
  dgRNA
  Scamp3
accaattggagcaca

SEQ ID NO: 52405 - DNA, 15 bp, Artificial Sequence
  dgRNA
  Scamp3
gtggaccaagcacac

SEQ ID NO: 52406 - DNA, 15 bp, Artificial Sequence
  dgRNA
  Scamp3
gaccaagcacaccgg

SEQ ID NO: 52407 - DNA, 15 bp, Artificial Sequence
  dgRNA
  Pcnt
actttggcaaagtgc

SEQ ID NO: 52408 - DNA, 15 bp, Artificial Sequence
  dgRNA
  Pcnt
gtgcccagagcgcac

SEQ ID NO: 52409 - DNA, 15 bp, Artificial Sequence
  dgRNA
  Pcnt
cccagagcgcaccgg

SEQ ID NO: 52410 - DNA, 15 bp, Artificial Sequence
  dgRNA
  Pcnt
agcgcaccggaggca

SEQ ID NO: 52411 - DNA, 15 bp, Artificial Sequence
  dgRNA
  Olfr113
ggtgaatgtacaagt

SEQ ID NO: 52412 - DNA, 15 bp, Artificial Sequence
  dgRNA
  Olfr113
aggtgaatgtacaag

SEQ ID NO: 52413 - DNA, 15 bp, Artificial Sequence
  dgRNA
  Tirap
caaccgtgcgaaaga

SEQ ID NO: 52414 - DNA, 15 bp, Artificial Sequence
  dgRNA
  Tirap
gtgcgaaagaaggta

SEQ ID NO: 52415 - DNA, 15 bp, Artificial Sequence
  dgRNA
  Tirap
acacaagacaaaccg

SEQ ID NO: 52416 - DNA, 15 bp, Artificial Sequence
  dgRNA
  Tirap
gacaaaccgcggctc

SEQ ID NO: 52417 - DNA, 15 bp, Artificial Sequence
  dgRNA
  Fndc7
agtgcccctagttac

SEQ ID NO: 52418 - DNA, 15 bp, Artificial Sequence
  dgRNA
  Fndc7
gttacaggtgagcgc

SEQ ID NO: 52419 - DNA, 15 bp, Artificial Sequence
  dgRNA
  Fndc7
agagtcatgccaagc

SEQ ID NO: 52420 - DNA, 15 bp, Artificial Sequence
  dgRNA
  Fndc7
taactaggggcactg

SEQ ID NO: 52421 - DNA, 15 bp, Artificial Sequence
  dgRNA
  Prr13
ccctaaggctccgcc

SEQ ID NO: 52422 - DNA, 15 bp, Artificial Sequence
  dgRNA
  Prr13
taaggctccgcctgg

SEQ ID NO: 52423 - DNA, 15 bp, Artificial Sequence
  dgRNA
  Prr13
tggcggccagcgcaa

SEQ ID NO: 52424 - DNA, 15 bp, Artificial Sequence
  dgRNA
  Prr13
tattaactaggtcac

SEQ ID NO: 52425 - DNA, 15 bp, Artificial Sequence
  dgRNA
  Fgfr1op2
gtactaagccacggc

SEQ ID NO: 52426 - DNA, 15 bp, Artificial Sequence
  dgRNA
  Fgfr1op2
tactaagccacggcc

SEQ ID NO: 52427 - DNA, 15 bp, Artificial Sequence
  dgRNA
  Fgfr1op2
gcctcggctctggac

SEQ ID NO: 52428 - DNA, 15 bp, Artificial Sequence
  dgRNA
  Fgfr1op2
gcctccagtccgggc

SEQ ID NO: 52429 - DNA, 15 bp, Artificial Sequence
  dgRNA
  Tet1
taaaccgggctctag

SEQ ID NO: 52430 - DNA, 15 bp, Artificial Sequence
  dgRNA
  Lrrc28
tcaggctgcgctggt

SEQ ID NO: 52431 - DNA, 15 bp, Artificial Sequence
  dgRNA
  Ubqln2
caggagttttgcgct

SEQ ID NO: 52432 - DNA, 15 bp, Artificial Sequence
  dgRNA
  Ubqln2
ccgcgagacgctcgc

SEQ ID NO: 52433 - DNA, 15 bp, Artificial Sequence
  dgRNA
  Ubqln2
cgcgagacgctcgct

SEQ ID NO: 52434 - DNA, 15 bp, Artificial Sequence
  dgRNA
  Ubqln2
agacgctcgctgggc

SEQ ID NO: 52435 - DNA, 15 bp, Artificial Sequence
  dgRNA
  Rspo4
ttgtgtacctagagc

SEQ ID NO: 52436 - DNA, 15 bp, Artificial Sequence
  dgRNA
  Rspo4
cctgtgcacgtgcga

SEQ ID NO: 52437 - DNA, 15 bp, Artificial Sequence
  dgRNA
  Rspo4
ctgtgcacgtgcgag

SEQ ID NO: 52438 - DNA, 15 bp, Artificial Sequence
  dgRNA
  Rspo4
cacgtgcgaggggcg

SEQ ID NO: 52439 - DNA, 15 bp, Artificial Sequence
  dgRNA
  Alas2
gcctgagatacctta

SEQ ID NO: 52440 - DNA, 15 bp, Artificial Sequence
  dgRNA
  Alas2
gataccttaaggccg

SEQ ID NO: 52441 - DNA, 15 bp, Artificial Sequence
  dgRNA
  Alas2
accttaaggccgagg

SEQ ID NO: 52442 - DNA, 15 bp, Artificial Sequence
  dgRNA
  Alas2
aaggccgaggcggaa

SEQ ID NO: 52443 - DNA, 15 bp, Artificial Sequence
  dgRNA
  Ascl1
tgcaaggagcgggcg

SEQ ID NO: 52444 - DNA, 15 bp, Artificial Sequence
  dgRNA
  Ascl1
gcaaggagcgggcgc

SEQ ID NO: 52445 - DNA, 15 bp, Artificial Sequence
  dgRNA
  Ascl1
gcgggcgcgggcaac

SEQ ID NO: 52446 - DNA, 15 bp, Artificial Sequence
  dgRNA
  Ascl1
ggcgcgggcaactgg

SEQ ID NO: 52447 - DNA, 15 bp, Artificial Sequence
  dgRNA
  Kcnip4
ccgcctgcacctgca

SEQ ID NO: 52448 - DNA, 15 bp, Artificial Sequence
  dgRNA
  Kcnip4
cagctcccagcgtct

SEQ ID NO: 52449 - DNA, 15 bp, Artificial Sequence
  dgRNA
  Kcnip4
gcgtcttggtcgccc

SEQ ID NO: 52450 - DNA, 15 bp, Artificial Sequence
  dgRNA
  Kcnip4
tgtgcgctcccgtag

SEQ ID NO: 52451 - DNA, 15 bp, Artificial Sequence
  dgRNA
  Cln5
attgttgttacggtt

SEQ ID NO: 52452 - DNA, 15 bp, Artificial Sequence
  dgRNA
  Cln5
ttgttacggtttggc

SEQ ID NO: 52453 - DNA, 15 bp, Artificial Sequence
  dgRNA
  Cln5
cggtttggctggtga

SEQ ID NO: 52454 - DNA, 15 bp, Artificial Sequence
  dgRNA
  Cln5
ctggtgatggctgcg

SEQ ID NO: 52455 - DNA, 15 bp, Artificial Sequence
  dgRNA
  Bri3
cacggtcctctttcc

SEQ ID NO: 52456 - DNA, 15 bp, Artificial Sequence
  dgRNA
  Bri3
attctgtcccctgcg

SEQ ID NO: 52457 - DNA, 15 bp, Artificial Sequence
  dgRNA
  Bri3
atgtgatataaccca

SEQ ID NO: 52458 - DNA, 15 bp, Artificial Sequence
  dgRNA
  Zmynd19
gggcatcgtgcggct

SEQ ID NO: 52459 - DNA, 15 bp, Artificial Sequence
  dgRNA
  Zmynd19
atcgtgcggctcggc

SEQ ID NO: 52460 - DNA, 15 bp, Artificial Sequence
  dgRNA
  Zmynd19
tgcggctcggccggg

SEQ ID NO: 52461 - DNA, 15 bp, Artificial Sequence
  dgRNA
  Zmynd19
gctcggccgggtggc

SEQ ID NO: 52462 - DNA, 15 bp, Artificial Sequence
  dgRNA
  Faf1
ctgttgcgggtcctc

SEQ ID NO: 52463 - DNA, 15 bp, Artificial Sequence
  dgRNA
  Faf1
gggggagacgcacaa

SEQ ID NO: 52464 - DNA, 15 bp, Artificial Sequence
  dgRNA
  Faf1
gcgtccttgccacac

SEQ ID NO: 52465 - DNA, 15 bp, Artificial Sequence
  dgRNA
  Faf1
gccaaagcgcttgac

SEQ ID NO: 52466 - DNA, 15 bp, Artificial Sequence
  dgRNA
  Olfr898
cttgctaactgggtt

SEQ ID NO: 52467 - DNA, 15 bp, Artificial Sequence
  dgRNA
  Olfr898
gagttcttgctaact

SEQ ID NO: 52468 - DNA, 15 bp, Artificial Sequence
  dgRNA
  Zfp438
cgaccttctcgcttc

SEQ ID NO: 52469 - DNA, 15 bp, Artificial Sequence
  dgRNA
  Zfp438
gaccttctcgcttct

SEQ ID NO: 52470 - DNA, 15 bp, Artificial Sequence
  dgRNA
  Zfp438
gcctgcgaagctcac

SEQ ID NO: 52471 - DNA, 15 bp, Artificial Sequence
  dgRNA
  Zfp438
caggcacgcggcagt

SEQ ID NO: 52472 - DNA, 15 bp, Artificial Sequence
  dgRNA
  Ovca2
actgcgcagaccaga

SEQ ID NO: 52473 - DNA, 15 bp, Artificial Sequence
  dgRNA
  Ovca2
agaaggctacttcgc

SEQ ID NO: 52474 - DNA, 15 bp, Artificial Sequence
  dgRNA
  Ovca2
gccggctccctgaga

SEQ ID NO: 52475 - DNA, 15 bp, Artificial Sequence
  dgRNA
  Ovca2
ggagagccccgcctt

SEQ ID NO: 52476 - DNA, 15 bp, Artificial Sequence
  dgRNA
  Kcnc1
ccgtgcacacacccc

SEQ ID NO: 52477 - DNA, 15 bp, Artificial Sequence
  dgRNA
  Kcnc1
gggagcttggctcgt

SEQ ID NO: 52478 - DNA, 15 bp, Artificial Sequence
  dgRNA
  Kcnc1
cttggctcgttggtt

SEQ ID NO: 52479 - DNA, 15 bp, Artificial Sequence
  dgRNA
  Kcnc1
ttggctcgttggttg

SEQ ID NO: 52480 - DNA, 15 bp, Artificial Sequence
  dgRNA
  Mpzl3
aaagaaccgctgatg

SEQ ID NO: 52481 - DNA, 15 bp, Artificial Sequence
  dgRNA
  Mpzl3
aagaaccgctgatga

SEQ ID NO: 52482 - DNA, 15 bp, Artificial Sequence
  dgRNA
  Mpzl3
gctgatgagggtaac

SEQ ID NO: 52483 - DNA, 15 bp, Artificial Sequence
  dgRNA
  Mpzl3
gattgaggttgggtc

SEQ ID NO: 52484 - DNA, 15 bp, Artificial Sequence
  dgRNA
  Mrpl19
actccctcaaacaag

SEQ ID NO: 52485 - DNA, 15 bp, Artificial Sequence
  dgRNA
  Mrpl19
ccctcaaacaagcgg

SEQ ID NO: 52486 - DNA, 15 bp, Artificial Sequence
  dgRNA
  Mrpl19
caagcggcggtacac

SEQ ID NO: 52487 - DNA, 15 bp, Artificial Sequence
  dgRNA
  Mrpl19
aagcggcggtacacc

SEQ ID NO: 52488 - DNA, 15 bp, Artificial Sequence
  dgRNA
  Evc2
gcccttgtcaccctt

SEQ ID NO: 52489 - DNA, 15 bp, Artificial Sequence
  dgRNA
  Evc2
gtagcgggggtgatt

SEQ ID NO: 52490 - DNA, 15 bp, Artificial Sequence
  dgRNA
  Evc2
aggcacagcaagcga

SEQ ID NO: 52491 - DNA, 15 bp, Artificial Sequence
  dgRNA
  Evc2
ctcctacgcagcttg

SEQ ID NO: 52492 - DNA, 15 bp, Artificial Sequence
  dgRNA
  Ppip5k2
ttgacacctcgttaa

SEQ ID NO: 52493 - DNA, 15 bp, Artificial Sequence
  dgRNA
  Ppip5k2
gttaacggacccctg

SEQ ID NO: 52494 - DNA, 15 bp, Artificial Sequence
  dgRNA
  Ppip5k2
ttaacggacccctga

SEQ ID NO: 52495 - DNA, 15 bp, Artificial Sequence
  dgRNA
  Ppip5k2
tgcagccaccatccg

SEQ ID NO: 52496 - DNA, 15 bp, Artificial Sequence
  dgRNA
  Ctsz
tccgtgttatcacaa

SEQ ID NO: 52497 - DNA, 15 bp, Artificial Sequence
  dgRNA
  Ctsz
aggcagattatctcc

SEQ ID NO: 52498 - DNA, 15 bp, Artificial Sequence
  dgRNA
  Ctsz
ggcagattatctcct

SEQ ID NO: 52499 - DNA, 15 bp, Artificial Sequence
  dgRNA
  Ctsz
cagattatctcctgg

SEQ ID NO: 52500 - DNA, 15 bp, Artificial Sequence
  dgRNA
  Tsen15
agcacgggtttatga

SEQ ID NO: 52501 - DNA, 15 bp, Artificial Sequence
  dgRNA
  Tsen15
gcacgggtttatgaa

SEQ ID NO: 52502 - DNA, 15 bp, Artificial Sequence
  dgRNA
  Tsen15
acaacctgcccagac

SEQ ID NO: 52503 - DNA, 15 bp, Artificial Sequence
  dgRNA
  Tsen15
acctgcccagactgg

SEQ ID NO: 52504 - DNA, 15 bp, Artificial Sequence
  dgRNA
  Zfp708
acaagttgccgtcaa

SEQ ID NO: 52505 - DNA, 15 bp, Artificial Sequence
  dgRNA
  Zfp708
gttgccgtcaaaggc

SEQ ID NO: 52506 - DNA, 15 bp, Artificial Sequence
  dgRNA
  Zfp708
gcctaatccagtgac

SEQ ID NO: 52507 - DNA, 15 bp, Artificial Sequence
  dgRNA
  Zfp708
atgactccgctagac

SEQ ID NO: 52508 - DNA, 15 bp, Artificial Sequence
  dgRNA
  Lrrc24
cgctgtccaaggttc

SEQ ID NO: 52509 - DNA, 15 bp, Artificial Sequence
  dgRNA
  Lrrc24
cggctttgcgtccca

SEQ ID NO: 52510 - DNA, 15 bp, Artificial Sequence
  dgRNA
  Lrrc24
ttgcgtcccacggat

SEQ ID NO: 52511 - DNA, 15 bp, Artificial Sequence
  dgRNA
  Lrrc24
cggattggcctgcgc

SEQ ID NO: 52512 - DNA, 15 bp, Artificial Sequence
  dgRNA
  Rab13
cgcagagcgcacatg

SEQ ID NO: 52513 - DNA, 15 bp, Artificial Sequence
  dgRNA
  Rab13
acatgtggaccctgt

SEQ ID NO: 52514 - DNA, 15 bp, Artificial Sequence
  dgRNA
  Rab13
cgcaattagcgcaag

SEQ ID NO: 52515 - DNA, 15 bp, Artificial Sequence
  dgRNA
  Rab13
cgcaagaggaccgtg

SEQ ID NO: 52516 - DNA, 15 bp, Artificial Sequence
  dgRNA
  1700020N15Rik
gaccctaggaggcta

SEQ ID NO: 52517 - DNA, 15 bp, Artificial Sequence
  dgRNA
  1700020N15Rik
taggtggtctgctta

SEQ ID NO: 52518 - DNA, 15 bp, Artificial Sequence
  dgRNA
  1700020N15Rik
ctaggtggtctgctt

SEQ ID NO: 52519 - DNA, 15 bp, Artificial Sequence
  dgRNA
  1700020N15Rik
tttgttggccctgta

SEQ ID NO: 52520 - DNA, 15 bp, Artificial Sequence
  dgRNA
  Wdr72
accttggccctttgc

SEQ ID NO: 52521 - DNA, 15 bp, Artificial Sequence
  dgRNA
  Wdr72
tggaaagatcggccc

SEQ ID NO: 52522 - DNA, 15 bp, Artificial Sequence
  dgRNA
  Wdr72
atcggccctggtcag

SEQ ID NO: 52523 - DNA, 15 bp, Artificial Sequence
  dgRNA
  Wdr72
gccctggtcagcggc

SEQ ID NO: 52524 - DNA, 15 bp, Artificial Sequence
  dgRNA
  Krt42
aggggtgaattacac

SEQ ID NO: 52525 - DNA, 15 bp, Artificial Sequence
  dgRNA
  Krt42
aagcctcaggccggg

SEQ ID NO: 52526 - DNA, 15 bp, Artificial Sequence
  dgRNA
  Krt42
gacaaattacaaggt

SEQ ID NO: 52527 - DNA, 15 bp, Artificial Sequence
  dgRNA
  Krt42
tcagcctggctataa

SEQ ID NO: 52528 - DNA, 15 bp, Artificial Sequence
  dgRNA
  Slc5a9
gacactctgtcattg

SEQ ID NO: 52529 - DNA, 15 bp, Artificial Sequence
  dgRNA
  Slc5a9
gttgcccaggccccc

SEQ ID NO: 52530 - DNA, 15 bp, Artificial Sequence
  dgRNA
  Slc5a9
ggttcagagttgccc

SEQ ID NO: 52531 - DNA, 15 bp, Artificial Sequence
  dgRNA
  Slc5a9
taaacacactctgta

SEQ ID NO: 52532 - DNA, 15 bp, Artificial Sequence
  dgRNA
  Prr23a3
aacttctacggtttc

SEQ ID NO: 52533 - DNA, 15 bp, Artificial Sequence
  dgRNA
  Prr23a3
gaacttctacggttt

SEQ ID NO: 52534 - DNA, 15 bp, Artificial Sequence
  dgRNA
  Prr23a3
agattagaacttcta

SEQ ID NO: 52535 - DNA, 15 bp, Artificial Sequence
  dgRNA
  Prr23a3
tttttgacctatagg

SEQ ID NO: 52536 - DNA, 15 bp, Artificial Sequence
  dgRNA
  Dock10
tgagcgggagcgaag

SEQ ID NO: 52537 - DNA, 15 bp, Artificial Sequence
  dgRNA
  Dock10
tcttgtgagttgagc

SEQ ID NO: 52538 - DNA, 15 bp, Artificial Sequence
  dgRNA
  Dock10
cttgtgagttgagcg

SEQ ID NO: 52539 - DNA, 15 bp, Artificial Sequence
  dgRNA
  Dock10
gttccgcttcctgaa

SEQ ID NO: 52540 - DNA, 15 bp, Artificial Sequence
  dgRNA
  Olfr43
gagaagtcccatcag

SEQ ID NO: 52541 - DNA, 15 bp, Artificial Sequence
  dgRNA
  Mme
gaacaaccgggcacc

SEQ ID NO: 52542 - DNA, 15 bp, Artificial Sequence
  dgRNA
  Mme
accgggcaccgggag

SEQ ID NO: 52543 - DNA, 15 bp, Artificial Sequence
  dgRNA
  Mme
ccgggcaccgggagc

SEQ ID NO: 52544 - DNA, 15 bp, Artificial Sequence
  dgRNA
  Mme
cgggcaccgggagcg

SEQ ID NO: 52545 - DNA, 15 bp, Artificial Sequence
  dgRNA
  Olfr414
cgtgtaacctgttcg

SEQ ID NO: 52546 - DNA, 15 bp, Artificial Sequence
  dgRNA
  Olfr414
ttgcaggcattcaag

SEQ ID NO: 52547 - DNA, 15 bp, Artificial Sequence
  dgRNA
  Olfr414
ggcattcaagtggac

SEQ ID NO: 52548 - DNA, 15 bp, Artificial Sequence
  dgRNA
  Olfr414
gatgttcaacaattc

SEQ ID NO: 52549 - DNA, 15 bp, Artificial Sequence
  dgRNA
  Cd3g
catcaacacccctgc

SEQ ID NO: 52550 - DNA, 15 bp, Artificial Sequence
  dgRNA
  Cd3g
atcaacacccctgct

SEQ ID NO: 52551 - DNA, 15 bp, Artificial Sequence
  dgRNA
  Cd3g
gagggcggagacacc

SEQ ID NO: 52552 - DNA, 15 bp, Artificial Sequence
  dgRNA
  Cd3g
acctctatgcgcaat

SEQ ID NO: 52553 - DNA, 15 bp, Artificial Sequence
  dgRNA
  Ninj1
ccctagccatcgtga

SEQ ID NO: 52554 - DNA, 15 bp, Artificial Sequence
  dgRNA
  Ninj1
ggacatcaaggccgc

SEQ ID NO: 52555 - DNA, 15 bp, Artificial Sequence
  dgRNA
  Ninj1
agtgctatcctgctc

SEQ ID NO: 52556 - DNA, 15 bp, Artificial Sequence
  dgRNA
  Ninj1
cgcgattccagcagc

SEQ ID NO: 52557 - DNA, 15 bp, Artificial Sequence
  dgRNA
  Shox2
acagacgagactttg

SEQ ID NO: 52558 - DNA, 15 bp, Artificial Sequence
  dgRNA
  Shox2
cagacgagactttgc

SEQ ID NO: 52559 - DNA, 15 bp, Artificial Sequence
  dgRNA
  Shox2
ggatcccgcgctccc

SEQ ID NO: 52560 - DNA, 15 bp, Artificial Sequence
  dgRNA
  Shox2
gatcccgcgctccca

SEQ ID NO: 52561 - DNA, 15 bp, Artificial Sequence
  dgRNA
  Padi3
atatcagaacccttc

SEQ ID NO: 52562 - DNA, 15 bp, Artificial Sequence
  dgRNA
  Padi3
gcttgcgccctgagc

SEQ ID NO: 52563 - DNA, 15 bp, Artificial Sequence
  dgRNA
  Padi3
gcgccctgagctgga

SEQ ID NO: 52564 - DNA, 15 bp, Artificial Sequence
  dgRNA
  Padi3
cgccctgagctggag

SEQ ID NO: 52565 - DNA, 15 bp, Artificial Sequence
  dgRNA
  Olfr1313
tgttcggatatttgt

SEQ ID NO: 52566 - DNA, 15 bp, Artificial Sequence
  dgRNA
  Olfr1313
gtctttaggttggtt

SEQ ID NO: 52567 - DNA, 15 bp, Artificial Sequence
  dgRNA
  Olfr1313
ccccgattctccttt

SEQ ID NO: 52568 - DNA, 15 bp, Artificial Sequence
  dgRNA
  Olfr1313
tatccgaacaagttc

SEQ ID NO: 52569 - DNA, 15 bp, Artificial Sequence
  dgRNA
  Ppt2
gttccattgcccctc

SEQ ID NO: 52570 - DNA, 15 bp, Artificial Sequence
  dgRNA
  Ppt2
cgctgtccgcgttgc

SEQ ID NO: 52571 - DNA, 15 bp, Artificial Sequence
  dgRNA
  Ppt2
gctgtccgcgttgca

SEQ ID NO: 52572 - DNA, 15 bp, Artificial Sequence
  dgRNA
  Ppt2
ctgtccgcgttgcag

SEQ ID NO: 52573 - DNA, 15 bp, Artificial Sequence
  dgRNA
  Ivns1abp
ccggaagcggccggg

SEQ ID NO: 52574 - DNA, 15 bp, Artificial Sequence
  dgRNA
  Ivns1abp
gcggccgggaggcgt

SEQ ID NO: 52575 - DNA, 15 bp, Artificial Sequence
  dgRNA
  Ivns1abp
gccgggaggcgttgg

SEQ ID NO: 52576 - DNA, 15 bp, Artificial Sequence
  dgRNA
  Ivns1abp
tggcggcagcgcacg

SEQ ID NO: 52577 - DNA, 15 bp, Artificial Sequence
  dgRNA
  Aox1
gcttgtctcccacgc

SEQ ID NO: 52578 - DNA, 15 bp, Artificial Sequence
  dgRNA
  Aox1
ccaaaactttctggg

SEQ ID NO: 52579 - DNA, 15 bp, Artificial Sequence
  dgRNA
  Aox1
caaaactttctggga

SEQ ID NO: 52580 - DNA, 15 bp, Artificial Sequence
  dgRNA
  Aox1
ggttttggcatcgat

SEQ ID NO: 52581 - DNA, 15 bp, Artificial Sequence
  dgRNA
  Sephs1
gatgccaccgttcct

SEQ ID NO: 52582 - DNA, 15 bp, Artificial Sequence
  dgRNA
  Sephs1
atgccaccgttcctg

SEQ ID NO: 52583 - DNA, 15 bp, Artificial Sequence
  dgRNA
  Sephs1
aatcattgccgcgct

SEQ ID NO: 52584 - DNA, 15 bp, Artificial Sequence
  dgRNA
  Sephs1
atcattgccgcgctc

SEQ ID NO: 52585 - DNA, 15 bp, Artificial Sequence
  dgRNA
  Bend6
gggacgcagccggct

SEQ ID NO: 52586 - DNA, 15 bp, Artificial Sequence
  dgRNA
  Bend6
gggagcatcatcggg

SEQ ID NO: 52587 - DNA, 15 bp, Artificial Sequence
  dgRNA
  Bend6
catcgggtggccgcc

SEQ ID NO: 52588 - DNA, 15 bp, Artificial Sequence
  dgRNA
  Bend6
atcgggtggccgccc

SEQ ID NO: 52589 - DNA, 15 bp, Artificial Sequence
  dgRNA
  Galnt2
gcgatctctgcagac

SEQ ID NO: 52590 - DNA, 15 bp, Artificial Sequence
  dgRNA
  Galnt2
cacctgccactcccg

SEQ ID NO: 52591 - DNA, 15 bp, Artificial Sequence
  dgRNA
  Galnt2
acctgccactcccgg

SEQ ID NO: 52592 - DNA, 15 bp, Artificial Sequence
  dgRNA
  Galnt2
cccgggggcgcgcag

SEQ ID NO: 52593 - DNA, 15 bp, Artificial Sequence
  dgRNA
  Snx4
acctccctcggtcgc

SEQ ID NO: 52594 - DNA, 15 bp, Artificial Sequence
  dgRNA
  Snx4
ctcggtcgcaggtct

SEQ ID NO: 52595 - DNA, 15 bp, Artificial Sequence
  dgRNA
  Snx4
gtcgcaggtcttggc

SEQ ID NO: 52596 - DNA, 15 bp, Artificial Sequence
  dgRNA
  Snx4
ggtggtccagcgttc

SEQ ID NO: 52597 - DNA, 15 bp, Artificial Sequence
  dgRNA
  Klf16
tctctggaggaccga

SEQ ID NO: 52598 - DNA, 15 bp, Artificial Sequence
  dgRNA
  Klf16
ggaggaccgagggcg

SEQ ID NO: 52599 - DNA, 15 bp, Artificial Sequence
  dgRNA
  Klf16
gaccgagggcgcggc

SEQ ID NO: 52600 - DNA, 15 bp, Artificial Sequence
  dgRNA
  Klf16
cgagggcgcggcagg

SEQ ID NO: 52601 - DNA, 15 bp, Artificial Sequence
  dgRNA
  Agbl3
ctgcaatgctcaaac

SEQ ID NO: 52602 - DNA, 15 bp, Artificial Sequence
  dgRNA
  Agbl3
gtacagccgttgccc

SEQ ID NO: 52603 - DNA, 15 bp, Artificial Sequence
  dgRNA
  Agbl3
ggagagtttagcact

SEQ ID NO: 52604 - DNA, 15 bp, Artificial Sequence
  dgRNA
  Agbl3
gggagagtttagcac

SEQ ID NO: 52605 - DNA, 15 bp, Artificial Sequence
  dgRNA
  Fdft1
ccgcgcgtcctagcc

SEQ ID NO: 52606 - DNA, 15 bp, Artificial Sequence
  dgRNA
  Fdft1
cgcgtcctagcctgg

SEQ ID NO: 52607 - DNA, 15 bp, Artificial Sequence
  dgRNA
  Fdft1
gaggcgcgagcggcg

SEQ ID NO: 52608 - DNA, 15 bp, Artificial Sequence
  dgRNA
  Fdft1
cggcgcggccggttg

SEQ ID NO: 52609 - DNA, 15 bp, Artificial Sequence
  dgRNA
  Klhl13
agtaagggggtgaac

SEQ ID NO: 52610 - DNA, 15 bp, Artificial Sequence
  dgRNA
  Klhl13
aagggggtgaacggg

SEQ ID NO: 52611 - DNA, 15 bp, Artificial Sequence
  dgRNA
  Klhl13
tcacaaattgtctag

SEQ ID NO: 52612 - DNA, 15 bp, Artificial Sequence
  dgRNA
  Glipr1
gctgcaagccatata

SEQ ID NO: 52613 - DNA, 15 bp, Artificial Sequence
  dgRNA
  Glipr1
ggacttctccatata

SEQ ID NO: 52614 - DNA, 15 bp, Artificial Sequence
  dgRNA
  Glipr1
tcacgaaacttacac

SEQ ID NO: 52615 - DNA, 15 bp, Artificial Sequence
  dgRNA
  Sowahb
gcgtagccagagcgc

SEQ ID NO: 52616 - DNA, 15 bp, Artificial Sequence
  dgRNA
  Sowahb
gactccgacctatcc

SEQ ID NO: 52617 - DNA, 15 bp, Artificial Sequence
  dgRNA
  Sowahb
actccgacctatccc

SEQ ID NO: 52618 - DNA, 15 bp, Artificial Sequence
  dgRNA
  Sowahb
cgggaactttcgctg

SEQ ID NO: 52619 - DNA, 15 bp, Artificial Sequence
  dgRNA
  Dnmt3a
gagccagcgcggcca

SEQ ID NO: 52620 - DNA, 15 bp, Artificial Sequence
  dgRNA
  Dnmt3a
agccagcgcggccac

SEQ ID NO: 52621 - DNA, 15 bp, Artificial Sequence
  dgRNA
  Dnmt3a
gccagcgcggccacg

SEQ ID NO: 52622 - DNA, 15 bp, Artificial Sequence
  dgRNA
  Dnmt3a
ccagcgcggccacgg

SEQ ID NO: 52623 - DNA, 15 bp, Artificial Sequence
  dgRNA
  Tpsab1
gaccgagccccttct

SEQ ID NO: 52624 - DNA, 15 bp, Artificial Sequence
  dgRNA
  Tpsab1
cagacgcttgtgccc

SEQ ID NO: 52625 - DNA, 15 bp, Artificial Sequence
  dgRNA
  Tpsab1
cctccaagcttggat

SEQ ID NO: 52626 - DNA, 15 bp, Artificial Sequence
  dgRNA
  Tpsab1
caagcttggattgga

SEQ ID NO: 52627 - DNA, 15 bp, Artificial Sequence
  dgRNA
  Hs6st1
agggcgctccagagg

SEQ ID NO: 52628 - DNA, 15 bp, Artificial Sequence
  dgRNA
  Hs6st1
gctccagaggcggag

SEQ ID NO: 52629 - DNA, 15 bp, Artificial Sequence
  dgRNA
  Hs6st1
ccagaggcggagcgg

SEQ ID NO: 52630 - DNA, 15 bp, Artificial Sequence
  dgRNA
  Hs6st1
ggcggagcggaggat

SEQ ID NO: 52631 - DNA, 15 bp, Artificial Sequence
  dgRNA
  Zc3h7a
ggtatccaagcggtg

SEQ ID NO: 52632 - DNA, 15 bp, Artificial Sequence
  dgRNA
  Zc3h7a
gtatccaagcggtgt

SEQ ID NO: 52633 - DNA, 15 bp, Artificial Sequence
  dgRNA
  Zc3h7a
agagggcgatgatgc

SEQ ID NO: 52634 - DNA, 15 bp, Artificial Sequence
  dgRNA
  Zc3h7a
gagggcgatgatgct

SEQ ID NO: 52635 - DNA, 15 bp, Artificial Sequence
  dgRNA
  Sox12
caagcaaccagcgat

SEQ ID NO: 52636 - DNA, 15 bp, Artificial Sequence
  dgRNA
  Sox12
aagcaaccagcgatt

SEQ ID NO: 52637 - DNA, 15 bp, Artificial Sequence
  dgRNA
  Sox12
cgcgcagcgagcgcg

SEQ ID NO: 52638 - DNA, 15 bp, Artificial Sequence
  dgRNA
  Sox12
gcgcgaggcgtggcc

SEQ ID NO: 52639 - DNA, 15 bp, Artificial Sequence
  dgRNA
  Cldn34c1
cctccgctgatcccc

SEQ ID NO: 52640 - DNA, 15 bp, Artificial Sequence
  dgRNA
  Cldn34c1
ccgctgatcccctgg

SEQ ID NO: 52641 - DNA, 15 bp, Artificial Sequence
  dgRNA
  Cldn34c1
cgctgatcccctggc

SEQ ID NO: 52642 - DNA, 15 bp, Artificial Sequence
  dgRNA
  Cldn34c1
cccagccattatctt

SEQ ID NO: 52643 - DNA, 15 bp, Artificial Sequence
  dgRNA
  Olfr1507
ttctaactagtgact

SEQ ID NO: 52644 - DNA, 15 bp, Artificial Sequence
  dgRNA
  Olfr1507
ggcaagctgatgtta

SEQ ID NO: 52645 - DNA, 15 bp, Artificial Sequence
  dgRNA
  Olfr1507
tgatggtgttgcacc

SEQ ID NO: 52646 - DNA, 15 bp, Artificial Sequence
  dgRNA
  Olfr1507
cagctgttgcgttga

SEQ ID NO: 52647 - DNA, 15 bp, Artificial Sequence
  dgRNA
  Cacna1d
cccttgaactgcgaa

SEQ ID NO: 52648 - DNA, 15 bp, Artificial Sequence
  dgRNA
  Cacna1d
aactgcgaaaggaca

SEQ ID NO: 52649 - DNA, 15 bp, Artificial Sequence
  dgRNA
  Cacna1d
cctttcgcagttcaa

SEQ ID NO: 52650 - DNA, 15 bp, Artificial Sequence
  dgRNA
  Cacna1d
tcctttcgcagttca

SEQ ID NO: 52651 - DNA, 15 bp, Artificial Sequence
  dgRNA
  Hnrnph1
attgcaaaaaggcgc

SEQ ID NO: 52652 - DNA, 15 bp, Artificial Sequence
  dgRNA
  Hnrnph1
cgtgtaataatagga

SEQ ID NO: 52653 - DNA, 15 bp, Artificial Sequence
  dgRNA
  Hnrnph1
gtaataataggacgg

SEQ ID NO: 52654 - DNA, 15 bp, Artificial Sequence
  dgRNA
  Hnrnph1
taataataggacggc

SEQ ID NO: 52655 - DNA, 15 bp, Artificial Sequence
  dgRNA
  1700125H20Rik
ttttgctccgagttc

SEQ ID NO: 52656 - DNA, 15 bp, Artificial Sequence
  dgRNA
  1700125H20Rik
aacctgcccactacc

SEQ ID NO: 52657 - DNA, 15 bp, Artificial Sequence
  dgRNA
  1700125H20Rik
actatctccttcagc

SEQ ID NO: 52658 - DNA, 15 bp, Artificial Sequence
  dgRNA
  1700125H20Rik
actcatgcctcaggg

SEQ ID NO: 52659 - DNA, 15 bp, Artificial Sequence
  dgRNA
  Runx1
gaggggcgctctgta

SEQ ID NO: 52660 - DNA, 15 bp, Artificial Sequence
  dgRNA
  Trim16
atccaccgcaaaata

SEQ ID NO: 52661 - DNA, 15 bp, Artificial Sequence
  dgRNA
  Trim16
cgctcaaagccgcag

SEQ ID NO: 52662 - DNA, 15 bp, Artificial Sequence
  dgRNA
  Trim16
tccggaagagcctat

SEQ ID NO: 52663 - DNA, 15 bp, Artificial Sequence
  dgRNA
  Trim16
ccggaagagcctatg

SEQ ID NO: 52664 - DNA, 15 bp, Artificial Sequence
  dgRNA
  Glmn
acttgttcccacgta

SEQ ID NO: 52665 - DNA, 15 bp, Artificial Sequence
  dgRNA
  Glmn
cttgttcccacgtac

SEQ ID NO: 52666 - DNA, 15 bp, Artificial Sequence
  dgRNA
  Glmn
ggattcctcccccga

SEQ ID NO: 52667 - DNA, 15 bp, Artificial Sequence
  dgRNA
  Glmn
tcccccgaaggcact

SEQ ID NO: 52668 - DNA, 15 bp, Artificial Sequence
  dgRNA
  Msantd4
gttcagataaactga

SEQ ID NO: 52669 - DNA, 15 bp, Artificial Sequence
  dgRNA
  Msantd4
aagttatttgagcta

SEQ ID NO: 52670 - DNA, 15 bp, Artificial Sequence
  dgRNA
  Msantd4
ttatttgagctatgg

SEQ ID NO: 52671 - DNA, 15 bp, Artificial Sequence
  dgRNA
  Msantd4
aagctgtgtttagac

SEQ ID NO: 52672 - DNA, 15 bp, Artificial Sequence
  dgRNA
  Cdyl
ttgttgtcgtgccct

SEQ ID NO: 52673 - DNA, 15 bp, Artificial Sequence
  dgRNA
  Cdyl
aggggaccttttatg

SEQ ID NO: 52674 - DNA, 15 bp, Artificial Sequence
  dgRNA
  Cdyl
gacaagcatggccgt

SEQ ID NO: 52675 - DNA, 15 bp, Artificial Sequence
  dgRNA
  Cdyl
ggacaagcatggccg

SEQ ID NO: 52676 - DNA, 15 bp, Artificial Sequence
  dgRNA
  Gm7173
gggcgggacaagcac

SEQ ID NO: 52677 - DNA, 15 bp, Artificial Sequence
  dgRNA
  Gm7173
tgaggacagcgcgaa

SEQ ID NO: 52678 - DNA, 15 bp, Artificial Sequence
  dgRNA
  Gm7173
ccgcccacgcgcacg

SEQ ID NO: 52679 - DNA, 15 bp, Artificial Sequence
  dgRNA
  Gm7173
cgcccacgcgcacgt

SEQ ID NO: 52680 - DNA, 15 bp, Artificial Sequence
  dgRNA
  Myl2
ctcacgtgtccaccc

SEQ ID NO: 52681 - DNA, 15 bp, Artificial Sequence
  dgRNA
  Myl2
cgtgtccacccaggc

SEQ ID NO: 52682 - DNA, 15 bp, Artificial Sequence
  dgRNA
  Myl2
gtccacccaggcggg

SEQ ID NO: 52683 - DNA, 15 bp, Artificial Sequence
  dgRNA
  Myl2
ttcagaagaacggca

SEQ ID NO: 52684 - DNA, 15 bp, Artificial Sequence
  dgRNA
  Lbr
gcgcgagccaaagcg

SEQ ID NO: 52685 - DNA, 15 bp, Artificial Sequence
  dgRNA
  Lbr
agccaaagcgcggct

SEQ ID NO: 52686 - DNA, 15 bp, Artificial Sequence
  dgRNA
  Lbr
gcgcggcttggtgcc

SEQ ID NO: 52687 - DNA, 15 bp, Artificial Sequence
  dgRNA
  Lbr
cgcggcttggtgcct

SEQ ID NO: 52688 - DNA, 15 bp, Artificial Sequence
  dgRNA
  Akr1e1
ggagacggaattctt

SEQ ID NO: 52689 - DNA, 15 bp, Artificial Sequence
  dgRNA
  Akr1e1
ttcttaggatcatag

SEQ ID NO: 52690 - DNA, 15 bp, Artificial Sequence
  dgRNA
  Akr1e1
gatcatagaggattt

SEQ ID NO: 52691 - DNA, 15 bp, Artificial Sequence
  dgRNA
  Akr1e1
caaacccaattgctt

SEQ ID NO: 52692 - DNA, 15 bp, Artificial Sequence
  dgRNA
  Tubb3
ggcactaaggggcct

SEQ ID NO: 52693 - DNA, 15 bp, Artificial Sequence
  dgRNA
  Tubb3
ctattgtccccagag

SEQ ID NO: 52694 - DNA, 15 bp, Artificial Sequence
  dgRNA
  Tubb3
gagcggattgcccac

SEQ ID NO: 52695 - DNA, 15 bp, Artificial Sequence
  dgRNA
  Tubb3
cggattgcccaccgg

SEQ ID NO: 52696 - DNA, 15 bp, Artificial Sequence
  dgRNA
  Lad1
cttcttcaccgttgc

SEQ ID NO: 52697 - DNA, 15 bp, Artificial Sequence
  dgRNA
  Lad1
ctacacccaagacta

SEQ ID NO: 52698 - DNA, 15 bp, Artificial Sequence
  dgRNA
  Lad1
gctaagtcgatttcc

SEQ ID NO: 52699 - DNA, 15 bp, Artificial Sequence
  dgRNA
  Lad1
cctgaccccgatctt

SEQ ID NO: 52700 - DNA, 15 bp, Artificial Sequence
  dgRNA
  Klhl20
agtcagatcgactaa

SEQ ID NO: 52701 - DNA, 15 bp, Artificial Sequence
  dgRNA
  Klhl20
taatggtaccagtcc

SEQ ID NO: 52702 - DNA, 15 bp, Artificial Sequence
  dgRNA
  Klhl20
gaaacgctcagcgaa

SEQ ID NO: 52703 - DNA, 15 bp, Artificial Sequence
  dgRNA
  Klhl20
cttccggagccatga

SEQ ID NO: 52704 - DNA, 15 bp, Artificial Sequence
  dgRNA
  Olfr981
ccattattcttaaac

SEQ ID NO: 52705 - DNA, 15 bp, Artificial Sequence
  dgRNA
  Serpina1f
ctgcccttgatcacc

SEQ ID NO: 52706 - DNA, 15 bp, Artificial Sequence
  dgRNA
  Serpina1f
gcctaaatgacaaag

SEQ ID NO: 52707 - DNA, 15 bp, Artificial Sequence
  dgRNA
  Magea6
atatgccaaccactc

SEQ ID NO: 52708 - DNA, 15 bp, Artificial Sequence
  dgRNA
  Magea6
gttgggcccatgaat

SEQ ID NO: 52709 - DNA, 15 bp, Artificial Sequence
  dgRNA
  Gstt4
gagcttacacataac

SEQ ID NO: 52710 - DNA, 15 bp, Artificial Sequence
  dgRNA
  Gstt4
taagtacatcaaggt

SEQ ID NO: 52711 - DNA, 15 bp, Artificial Sequence
  dgRNA
  Gstt4
gattctaaggagagc

SEQ ID NO: 52712 - DNA, 15 bp, Artificial Sequence
  dgRNA
  Gstt4
cttgatgtacttatg

SEQ ID NO: 52713 - DNA, 15 bp, Artificial Sequence
  dgRNA
  Esrrg
ttgcccaccgtgctc

SEQ ID NO: 52714 - DNA, 15 bp, Artificial Sequence
  dgRNA
  Esrrg
caccgtgctccgggc

SEQ ID NO: 52715 - DNA, 15 bp, Artificial Sequence
  dgRNA
  Esrrg
aggctgcggctcggg

SEQ ID NO: 52716 - DNA, 15 bp, Artificial Sequence
  dgRNA
  Esrrg
cgcctccctcctgat

SEQ ID NO: 52717 - DNA, 15 bp, Artificial Sequence
  dgRNA
  Proca1
tggtacagacacttc

SEQ ID NO: 52718 - DNA, 15 bp, Artificial Sequence
  dgRNA
  Proca1
gacatcattaacaac

SEQ ID NO: 52719 - DNA, 15 bp, Artificial Sequence
  dgRNA
  Proca1
gttggttacaggact

SEQ ID NO: 52720 - DNA, 15 bp, Artificial Sequence
  dgRNA
  Proca1
atatgtgttggttac

SEQ ID NO: 52721 - DNA, 15 bp, Artificial Sequence
  dgRNA
  Cebpb
cgtcacccgcgtccg

SEQ ID NO: 52722 - DNA, 15 bp, Artificial Sequence
  dgRNA
  Cebpb
cgtccgtggccatcg

SEQ ID NO: 52723 - DNA, 15 bp, Artificial Sequence
  dgRNA
  Cebpb
gtccgtggccatcgc

SEQ ID NO: 52724 - DNA, 15 bp, Artificial Sequence
  dgRNA
  Cebpb
tccgtggccatcgcg

SEQ ID NO: 52725 - DNA, 15 bp, Artificial Sequence
  dgRNA
  E130309D02Rik
gaaggcttgggtgcg

SEQ ID NO: 52726 - DNA, 15 bp, Artificial Sequence
  dgRNA
  E130309D02Rik
ttgggtgcgtggtgc

SEQ ID NO: 52727 - DNA, 15 bp, Artificial Sequence
  dgRNA
  E130309D02Rik
aaactcttgcgaaga

SEQ ID NO: 52728 - DNA, 15 bp, Artificial Sequence
  dgRNA
  E130309D02Rik
ctcttgcgaagacgg

SEQ ID NO: 52729 - DNA, 15 bp, Artificial Sequence
  dgRNA
  Clec4a1
gagagttccaccctg

SEQ ID NO: 52730 - DNA, 15 bp, Artificial Sequence
  dgRNA
  Clec4a1
caaacgcatttgtca

SEQ ID NO: 52731 - DNA, 15 bp, Artificial Sequence
  dgRNA
  Clec4a1
agggtggaactctct

SEQ ID NO: 52732 - DNA, 15 bp, Artificial Sequence
  dgRNA
  Bag4
cgctttcccgacccg

SEQ ID NO: 52733 - DNA, 15 bp, Artificial Sequence
  dgRNA
  Bag4
tgaccgttccgcgct

SEQ ID NO: 52734 - DNA, 15 bp, Artificial Sequence
  dgRNA
  Bag4
cgcgctcggcgtgca

SEQ ID NO: 52735 - DNA, 15 bp, Artificial Sequence
  dgRNA
  Bag4
gcgctcggcgtgcaa

SEQ ID NO: 52736 - DNA, 15 bp, Artificial Sequence
  dgRNA
  Ttc1
tcactctcttcgagt

SEQ ID NO: 52737 - DNA, 15 bp, Artificial Sequence
  dgRNA
  Ttc1
cagcaatggcgccat

SEQ ID NO: 52738 - DNA, 15 bp, Artificial Sequence
  dgRNA
  Ttc1
attggccagcgcggc

SEQ ID NO: 52739 - DNA, 15 bp, Artificial Sequence
  dgRNA
  Ttc1
tgtgacgtcactgta

SEQ ID NO: 52740 - DNA, 15 bp, Artificial Sequence
  dgRNA
  Olfr1263
gctgtactaaattga

SEQ ID NO: 52741 - DNA, 15 bp, Artificial Sequence
  dgRNA
  Olfr1263
ttggataattcctaa

SEQ ID NO: 52742 - DNA, 15 bp, Artificial Sequence
  dgRNA
  Olfr1263
tcagatttgataggt

SEQ ID NO: 52743 - DNA, 15 bp, Artificial Sequence
  dgRNA
  Olfr15
gctcaactgacaacc

SEQ ID NO: 52744 - DNA, 15 bp, Artificial Sequence
  dgRNA
  Olfr15
ttgcatgaaagctcg

SEQ ID NO: 52745 - DNA, 15 bp, Artificial Sequence
  dgRNA
  Olfr15
tgaaagctcgtggcc

SEQ ID NO: 52746 - DNA, 15 bp, Artificial Sequence
  dgRNA
  Olfr15
gctcgtggccaggaa

SEQ ID NO: 52747 - DNA, 15 bp, Artificial Sequence
  dgRNA
  Fbln7
ccgcgtgtagttggc

SEQ ID NO: 52748 - DNA, 15 bp, Artificial Sequence
  dgRNA
  Fbln7
cgcgtgtagttggca

SEQ ID NO: 52749 - DNA, 15 bp, Artificial Sequence
  dgRNA
  Fbln7
gcgtgtagttggcag

SEQ ID NO: 52750 - DNA, 15 bp, Artificial Sequence
  dgRNA
  Fbln7
ctaggtctctcccgg

SEQ ID NO: 52751 - DNA, 15 bp, Artificial Sequence
  dgRNA
  2610028H24Rik
ggggtaagcggcatc

SEQ ID NO: 52752 - DNA, 15 bp, Artificial Sequence
  dgRNA
  2610028H24Rik
gtaagcggcatctgg

SEQ ID NO: 52753 - DNA, 15 bp, Artificial Sequence
  dgRNA
  2610028H24Rik
gaagtattgtctccc

SEQ ID NO: 52754 - DNA, 15 bp, Artificial Sequence
  dgRNA
  2610028H24Rik
ccactgatccgtgcc

SEQ ID NO: 52755 - DNA, 15 bp, Artificial Sequence
  dgRNA
  Olfr1058
gtctctactcaaaac

SEQ ID NO: 52756 - DNA, 15 bp, Artificial Sequence
  dgRNA
  Olfr1058
atacagacatttagc

SEQ ID NO: 52757 - DNA, 15 bp, Artificial Sequence
  dgRNA
  Slc34a3
tccaatgcctactgg

SEQ ID NO: 52758 - DNA, 15 bp, Artificial Sequence
  dgRNA
  Slc34a3
ccaccctaagagagt

SEQ ID NO: 52759 - DNA, 15 bp, Artificial Sequence
  dgRNA
  Slc34a3
caccctaagagagtt

SEQ ID NO: 52760 - DNA, 15 bp, Artificial Sequence
  dgRNA
  Slc34a3
ctaagagagttgggc

SEQ ID NO: 52761 - DNA, 15 bp, Artificial Sequence
  dgRNA
  Ccdc87
taggccgcaccgaac

SEQ ID NO: 52762 - DNA, 15 bp, Artificial Sequence
  dgRNA
  Ccdc87
ccgcaccgaaccggt

SEQ ID NO: 52763 - DNA, 15 bp, Artificial Sequence
  dgRNA
  Ccdc87
cgcaccgaaccggta

SEQ ID NO: 52764 - DNA, 15 bp, Artificial Sequence
  dgRNA
  Ccdc87
cacaactctactttg

SEQ ID NO: 52765 - DNA, 15 bp, Artificial Sequence
  dgRNA
  Fam166a
ccccctaccttgctc

SEQ ID NO: 52766 - DNA, 15 bp, Artificial Sequence
  dgRNA
  Fam166a
gagatgctgcaagat

SEQ ID NO: 52767 - DNA, 15 bp, Artificial Sequence
  dgRNA
  Fam166a
gggttaacagatggc

SEQ ID NO: 52768 - DNA, 15 bp, Artificial Sequence
  dgRNA
  Fam166a
ggttaacagatggct

SEQ ID NO: 52769 - DNA, 15 bp, Artificial Sequence
  dgRNA
  Nek9
tgcaaacccgccgtg

SEQ ID NO: 52770 - DNA, 15 bp, Artificial Sequence
  dgRNA
  Nek9
cttccacgacactcg

SEQ ID NO: 52771 - DNA, 15 bp, Artificial Sequence
  dgRNA
  Nek9
ttccacgacactcgc

SEQ ID NO: 52772 - DNA, 15 bp, Artificial Sequence
  dgRNA
  Nek9
cactcgcgggtgtga

SEQ ID NO: 52773 - DNA, 15 bp, Artificial Sequence
  dgRNA
  Ggnbp1
taacctcatcttgtt

SEQ ID NO: 52774 - DNA, 15 bp, Artificial Sequence
  dgRNA
  Ggnbp1
cttgttaggtgtgga

SEQ ID NO: 52775 - DNA, 15 bp, Artificial Sequence
  dgRNA
  Ggnbp1
ttccaaattcgagaa

SEQ ID NO: 52776 - DNA, 15 bp, Artificial Sequence
  dgRNA
  Ggnbp1
aacaacttagctccc

SEQ ID NO: 52777 - DNA, 15 bp, Artificial Sequence
  dgRNA
  Psmd12
gcctagaacctagct

SEQ ID NO: 52778 - DNA, 15 bp, Artificial Sequence
  dgRNA
  Psmd12
cctagaacctagctt

SEQ ID NO: 52779 - DNA, 15 bp, Artificial Sequence
  dgRNA
  Psmd12
aacctagcttgggcg

SEQ ID NO: 52780 - DNA, 15 bp, Artificial Sequence
  dgRNA
  Psmd12
aaccccgcccattct

SEQ ID NO: 52781 - DNA, 15 bp, Artificial Sequence
  dgRNA
  Igf2r
cctggcgctcgtgcc

SEQ ID NO: 52782 - DNA, 15 bp, Artificial Sequence
  dgRNA
  Igf2r
catgtgacccgggac

SEQ ID NO: 52783 - DNA, 15 bp, Artificial Sequence
  dgRNA
  Igf2r
atgtgacccgggact

SEQ ID NO: 52784 - DNA, 15 bp, Artificial Sequence
  dgRNA
  Igf2r
tgacccgggactggg

SEQ ID NO: 52785 - DNA, 15 bp, Artificial Sequence
  dgRNA
  Ppp1r17
actcaacgtagactc

SEQ ID NO: 52786 - DNA, 15 bp, Artificial Sequence
  dgRNA
  Ppp1r17
ctcaacgtagactcc

SEQ ID NO: 52787 - DNA, 15 bp, Artificial Sequence
  dgRNA
  Ppp1r17
tggtccctagataag

SEQ ID NO: 52788 - DNA, 15 bp, Artificial Sequence
  dgRNA
  Ppp1r17
ctagataagaggagc

SEQ ID NO: 52789 - DNA, 15 bp, Artificial Sequence
  dgRNA
  Zscan4b
taatagtagttgaat

SEQ ID NO: 52790 - DNA, 15 bp, Artificial Sequence
  dgRNA
  Hmox1
gatttatccccttac

SEQ ID NO: 52791 - DNA, 15 bp, Artificial Sequence
  dgRNA
  Hmox1
tatccccttacaggc

SEQ ID NO: 52792 - DNA, 15 bp, Artificial Sequence
  dgRNA
  Hmox1
atccccttacaggca

SEQ ID NO: 52793 - DNA, 15 bp, Artificial Sequence
  dgRNA
  Hmox1
ggcagggcccgcctc

SEQ ID NO: 52794 - DNA, 15 bp, Artificial Sequence
  dgRNA
  Mon1b
gtttcggttagaaac

SEQ ID NO: 52795 - DNA, 15 bp, Artificial Sequence
  dgRNA
  Mon1b
tttcggttagaaaca

SEQ ID NO: 52796 - DNA, 15 bp, Artificial Sequence
  dgRNA
  Mon1b
agcgcacactatctg

SEQ ID NO: 52797 - DNA, 15 bp, Artificial Sequence
  dgRNA
  Mon1b
gcacactatctgcgg

SEQ ID NO: 52798 - DNA, 15 bp, Artificial Sequence
  dgRNA
  Fcmr
ggcacctatgaatcc

SEQ ID NO: 52799 - DNA, 15 bp, Artificial Sequence
  dgRNA
  Fcmr
gcacctatgaatcct

SEQ ID NO: 52800 - DNA, 15 bp, Artificial Sequence
  dgRNA
  Fcmr
cctatgaatcctggg

SEQ ID NO: 52801 - DNA, 15 bp, Artificial Sequence
  dgRNA
  Phgr1
ttgaaccctcagccc

SEQ ID NO: 52802 - DNA, 15 bp, Artificial Sequence
  dgRNA
  Phgr1
acaaatactccctgg

SEQ ID NO: 52803 - DNA, 15 bp, Artificial Sequence
  dgRNA
  Phgr1
caaatactccctgga

SEQ ID NO: 52804 - DNA, 15 bp, Artificial Sequence
  dgRNA
  Phgr1
gactagtctccacct

SEQ ID NO: 52805 - DNA, 15 bp, Artificial Sequence
  dgRNA
  Sirpb1c
acactcgagacaaca

SEQ ID NO: 52806 - DNA, 15 bp, Artificial Sequence
  dgRNA
  Sirpb1c
tcgagtgtcttgtct

SEQ ID NO: 52807 - DNA, 15 bp, Artificial Sequence
  dgRNA
  Actr3b
gcgctgcctgcgacc

SEQ ID NO: 52808 - DNA, 15 bp, Artificial Sequence
  dgRNA
  Actr3b
cgccgctccccaccc

SEQ ID NO: 52809 - DNA, 15 bp, Artificial Sequence
  dgRNA
  Actr3b
aaggtgccgggtcgc

SEQ ID NO: 52810 - DNA, 15 bp, Artificial Sequence
  dgRNA
  Ncoa4
aagaagactttgcgc

SEQ ID NO: 52811 - DNA, 15 bp, Artificial Sequence
  dgRNA
  Ncoa4
gactttgcgcaggcg

SEQ ID NO: 52812 - DNA, 15 bp, Artificial Sequence
  dgRNA
  Ncoa4
tagagctcaacgtgg

SEQ ID NO: 52813 - DNA, 15 bp, Artificial Sequence
  dgRNA
  Ncoa4
tcttagagctcaacg

SEQ ID NO: 52814 - DNA, 15 bp, Artificial Sequence
  dgRNA
  Sult4a1
agccgcgctctgatg

SEQ ID NO: 52815 - DNA, 15 bp, Artificial Sequence
  dgRNA
  Sult4a1
gccgcgctctgatgc

SEQ ID NO: 52816 - DNA, 15 bp, Artificial Sequence
  dgRNA
  Sult4a1
gcttcccggaccccg

SEQ ID NO: 52817 - DNA, 15 bp, Artificial Sequence
  dgRNA
  Sult4a1
cccgaggctcgccct

SEQ ID NO: 52818 - DNA, 15 bp, Artificial Sequence
  dgRNA
  Sh2d7
tcatagatgctcgtg

SEQ ID NO: 52819 - DNA, 15 bp, Artificial Sequence
  dgRNA
  Sh2d7
cggatgaatctgtac

SEQ ID NO: 52820 - DNA, 15 bp, Artificial Sequence
  dgRNA
  Sh2d7
tgcgcactgtgttac

SEQ ID NO: 52821 - DNA, 15 bp, Artificial Sequence
  dgRNA
  Sh2d7
gcgcactgtgttaca

SEQ ID NO: 52822 - DNA, 15 bp, Artificial Sequence
  dgRNA
  Ap4b1
ccccggacctgcgct

SEQ ID NO: 52823 - DNA, 15 bp, Artificial Sequence
  dgRNA
  Ap4b1
cctgcgctcggcgct

SEQ ID NO: 52824 - DNA, 15 bp, Artificial Sequence
  dgRNA
  Ap4b1
gcgctcggcgcgacc

SEQ ID NO: 52825 - DNA, 15 bp, Artificial Sequence
  dgRNA
  Ap4b1
gtgtctcagggcgac

SEQ ID NO: 52826 - DNA, 15 bp, Artificial Sequence
  dgRNA
  Agbl2
gaatcagtaaaccgt

SEQ ID NO: 52827 - DNA, 15 bp, Artificial Sequence
  dgRNA
  Agbl2
ttacagatgagggcg

SEQ ID NO: 52828 - DNA, 15 bp, Artificial Sequence
  dgRNA
  Agbl2
gtagaacagtgccga

SEQ ID NO: 52829 - DNA, 15 bp, Artificial Sequence
  dgRNA
  Agbl2
agtagaacagtgccg

SEQ ID NO: 52830 - DNA, 15 bp, Artificial Sequence
  dgRNA
  Tmx2
ccgagttctaaacaa

SEQ ID NO: 52831 - DNA, 15 bp, Artificial Sequence
  dgRNA
  Tmx2
agaacttctcgctga

SEQ ID NO: 52832 - DNA, 15 bp, Artificial Sequence
  dgRNA
  Tmx2
ctgtcacaaacttgt

SEQ ID NO: 52833 - DNA, 15 bp, Artificial Sequence
  dgRNA
  Tmx2
ccgatttaacatttc

SEQ ID NO: 52834 - DNA, 15 bp, Artificial Sequence
  dgRNA
  Fbrsl1
aagcttccccccttt

SEQ ID NO: 52835 - DNA, 15 bp, Artificial Sequence
  dgRNA
  Fbrsl1
gcttcccccctttcg

SEQ ID NO: 52836 - DNA, 15 bp, Artificial Sequence
  dgRNA
  Fbrsl1
cttcccccctttcgg

SEQ ID NO: 52837 - DNA, 15 bp, Artificial Sequence
  dgRNA
  Fbrsl1
cccccctttcggggg

SEQ ID NO: 52838 - DNA, 15 bp, Artificial Sequence
  dgRNA
  Crygf
actgacctgattaaa

SEQ ID NO: 52839 - DNA, 15 bp, Artificial Sequence
  dgRNA
  Crygf
gcccgcagtgggaca

SEQ ID NO: 52840 - DNA, 15 bp, Artificial Sequence
  dgRNA
  Crygf
ggcccgcagtgggac

SEQ ID NO: 52841 - DNA, 15 bp, Artificial Sequence
  dgRNA
  Crygf
aaaggggcccgcagt

SEQ ID NO: 52842 - DNA, 15 bp, Artificial Sequence
  dgRNA
  7420426K07Rik
gcaatgcacaccata

SEQ ID NO: 52843 - DNA, 15 bp, Artificial Sequence
  dgRNA
  7420426K07Rik
cataaggacattcaa

SEQ ID NO: 52844 - DNA, 15 bp, Artificial Sequence
  dgRNA
  7420426K07Rik
ggctccgccttacct

SEQ ID NO: 52845 - DNA, 15 bp, Artificial Sequence
  dgRNA
  7420426K07Rik
tccgccttacctagg

SEQ ID NO: 52846 - DNA, 15 bp, Artificial Sequence
  dgRNA
  Spib
ttccatccccaatgg

SEQ ID NO: 52847 - DNA, 15 bp, Artificial Sequence
  dgRNA
  Spib
tccatccccaatggt

SEQ ID NO: 52848 - DNA, 15 bp, Artificial Sequence
  dgRNA
  Spib
agacccctcccagag

SEQ ID NO: 52849 - DNA, 15 bp, Artificial Sequence
  dgRNA
  Spib
cccatggcccgcccc

SEQ ID NO: 52850 - DNA, 15 bp, Artificial Sequence
  dgRNA
  Mos
tttctcttcagtcga

SEQ ID NO: 52851 - DNA, 15 bp, Artificial Sequence
  dgRNA
  Mos
gaagaattagttgga

SEQ ID NO: 52852 - DNA, 15 bp, Artificial Sequence
  dgRNA
  Mos
ggtgacgtgaacttt

SEQ ID NO: 52853 - DNA, 15 bp, Artificial Sequence
  dgRNA
  Mos
gtgacgtgaactttt

SEQ ID NO: 52854 - DNA, 15 bp, Artificial Sequence
  dgRNA
  Nlrp10
tttccgtctctagcc

SEQ ID NO: 52855 - DNA, 15 bp, Artificial Sequence
  dgRNA
  Nlrp10
gagttaagagatata

SEQ ID NO: 52856 - DNA, 15 bp, Artificial Sequence
  dgRNA
  Nlrp10
atgttaaccctgccc

SEQ ID NO: 52857 - DNA, 15 bp, Artificial Sequence
  dgRNA
  Nlrp10
taattggaggggcgg

SEQ ID NO: 52858 - DNA, 15 bp, Artificial Sequence
  dgRNA
  Top3a
gcggcaccgccatct

SEQ ID NO: 52859 - DNA, 15 bp, Artificial Sequence
  dgRNA
  Top3a
cagcgtcgcgtgacc

SEQ ID NO: 52860 - DNA, 15 bp, Artificial Sequence
  dgRNA
  Top3a
gtggcgccttttaag

SEQ ID NO: 52861 - DNA, 15 bp, Artificial Sequence
  dgRNA
  Top3a
cgcggtagcttccct

SEQ ID NO: 52862 - DNA, 15 bp, Artificial Sequence
  dgRNA
  Tcl1
gaaccctaggtttga

SEQ ID NO: 52863 - DNA, 15 bp, Artificial Sequence
  dgRNA
  Tcl1
aaccctaggtttgat

SEQ ID NO: 52864 - DNA, 15 bp, Artificial Sequence
  dgRNA
  Tcl1
accctaggtttgatg

SEQ ID NO: 52865 - DNA, 15 bp, Artificial Sequence
  dgRNA
  Tcl1
accccatcaaaccta

SEQ ID NO: 52866 - DNA, 15 bp, Artificial Sequence
  dgRNA
  Gjb5
cctagggcttttttc

SEQ ID NO: 52867 - DNA, 15 bp, Artificial Sequence
  dgRNA
  Gjb5
ctggagcttcaacgg

SEQ ID NO: 52868 - DNA, 15 bp, Artificial Sequence
  dgRNA
  Gjb5
cctggacctagccaa

SEQ ID NO: 52869 - DNA, 15 bp, Artificial Sequence
  dgRNA
  Gjb5
acctagccaatggct

SEQ ID NO: 52870 - DNA, 15 bp, Artificial Sequence
  dgRNA
  Slc15a2
cgctgattgtgccaa

SEQ ID NO: 52871 - DNA, 15 bp, Artificial Sequence
  dgRNA
  Cxcr4
gaacattatccggcc

SEQ ID NO: 52872 - DNA, 15 bp, Artificial Sequence
  dgRNA
  Cxcr4
tatccggccaggctc

SEQ ID NO: 52873 - DNA, 15 bp, Artificial Sequence
  dgRNA
  Cxcr4
gcgcatgcgccgccc

SEQ ID NO: 52874 - DNA, 15 bp, Artificial Sequence
  dgRNA
  Cxcr4
cgcatgcgccgcccc

SEQ ID NO: 52875 - DNA, 15 bp, Artificial Sequence
  dgRNA
  Pik3c2b
caaggggttccagcc

SEQ ID NO: 52876 - DNA, 15 bp, Artificial Sequence
  dgRNA
  Pik3c2b
acgacaatctgccag

SEQ ID NO: 52877 - DNA, 15 bp, Artificial Sequence
  dgRNA
  Pik3c2b
cgacaatctgccagc

SEQ ID NO: 52878 - DNA, 15 bp, Artificial Sequence
  dgRNA
  Pik3c2b
ctgccagcgggaagt

SEQ ID NO: 52879 - DNA, 15 bp, Artificial Sequence
  dgRNA
  Cep112
atgcgaactgcccga

SEQ ID NO: 52880 - DNA, 15 bp, Artificial Sequence
  dgRNA
  Cep112
tgcgaactgcccgaa

SEQ ID NO: 52881 - DNA, 15 bp, Artificial Sequence
  dgRNA
  Cep112
gaactgcccgaaggg

SEQ ID NO: 52882 - DNA, 15 bp, Artificial Sequence
  dgRNA
  Cep112
aaattcccgccccct

SEQ ID NO: 52883 - DNA, 15 bp, Artificial Sequence
  dgRNA
  Mocs1
cgggctagagtgctc

SEQ ID NO: 52884 - DNA, 15 bp, Artificial Sequence
  dgRNA
  Mocs1
gtcatttcggagggg

SEQ ID NO: 52885 - DNA, 15 bp, Artificial Sequence
  dgRNA
  Mocs1
agagtcatttcggag

SEQ ID NO: 52886 - DNA, 15 bp, Artificial Sequence
  dgRNA
  Mocs1
cagagtcatttcgga

SEQ ID NO: 52887 - DNA, 15 bp, Artificial Sequence
  dgRNA
  Cst13
gataggacctatctg

SEQ ID NO: 52888 - DNA, 15 bp, Artificial Sequence
  dgRNA
  Cst13
gcttacctcacaaag

SEQ ID NO: 52889 - DNA, 15 bp, Artificial Sequence
  dgRNA
  Cst13
ctggatacctcagat

SEQ ID NO: 52890 - DNA, 15 bp, Artificial Sequence
  dgRNA
  Cst13
gatgctgctctagtc

SEQ ID NO: 52891 - DNA, 15 bp, Artificial Sequence
  dgRNA
  Kbtbd11
gtagggcaaagctcg

SEQ ID NO: 52892 - DNA, 15 bp, Artificial Sequence
  dgRNA
  Kbtbd11
aacaggtcatgcccg

SEQ ID NO: 52893 - DNA, 15 bp, Artificial Sequence
  dgRNA
  Kbtbd11
acaggtcatgcccgc

SEQ ID NO: 52894 - DNA, 15 bp, Artificial Sequence
  dgRNA
  Kbtbd11
caggtcatgcccgcg

SEQ ID NO: 52895 - DNA, 15 bp, Artificial Sequence
  dgRNA
  Wscd2
aggtccaagggcgac

SEQ ID NO: 52896 - DNA, 15 bp, Artificial Sequence
  dgRNA
  Wscd2
tccggttaggtccaa

SEQ ID NO: 52897 - DNA, 15 bp, Artificial Sequence
  dgRNA
  Wscd2
ctccggttaggtcca

SEQ ID NO: 52898 - DNA, 15 bp, Artificial Sequence
  dgRNA
  Wscd2
agcttggctccggtt

SEQ ID NO: 52899 - DNA, 15 bp, Artificial Sequence
  dgRNA
  Psmg2
gcctcctcgtcctcg

SEQ ID NO: 52900 - DNA, 15 bp, Artificial Sequence
  dgRNA
  Psmg2
cggatcccgcgcgcg

SEQ ID NO: 52901 - DNA, 15 bp, Artificial Sequence
  dgRNA
  Psmg2
tcgacctacgccccc

SEQ ID NO: 52902 - DNA, 15 bp, Artificial Sequence
  dgRNA
  Psmg2
cgacctacgcccccc

SEQ ID NO: 52903 - DNA, 15 bp, Artificial Sequence
  dgRNA
  Aldoc
gtttacctcaggaag

SEQ ID NO: 52904 - DNA, 15 bp, Artificial Sequence
  dgRNA
  Aldoc
acgctgcatctcttc

SEQ ID NO: 52905 - DNA, 15 bp, Artificial Sequence
  dgRNA
  Aldoc
aagagatgcagcgtg

SEQ ID NO: 52906 - DNA, 15 bp, Artificial Sequence
  dgRNA
  Aldoc
gaagagatgcagcgt

SEQ ID NO: 52907 - DNA, 15 bp, Artificial Sequence
  dgRNA
  Dlx2
tacacgcacccaccg

SEQ ID NO: 52908 - DNA, 15 bp, Artificial Sequence
  dgRNA
  Dlx2
ccgccacgtgacacg

SEQ ID NO: 52909 - DNA, 15 bp, Artificial Sequence
  dgRNA
  Dlx2
cgccacgtgacacgc

SEQ ID NO: 52910 - DNA, 15 bp, Artificial Sequence
  dgRNA
  Dlx2
gtgacacgcgggtcc

SEQ ID NO: 52911 - DNA, 15 bp, Artificial Sequence
  dgRNA
  Ankrd37
gccgccaaagcgcaa

SEQ ID NO: 52912 - DNA, 15 bp, Artificial Sequence
  dgRNA
  Ankrd37
caaagcgcaaaggcc

SEQ ID NO: 52913 - DNA, 15 bp, Artificial Sequence
  dgRNA
  Ankrd37
tgcgcacgcgtgctg

SEQ ID NO: 52914 - DNA, 15 bp, Artificial Sequence
  dgRNA
  Ankrd37
cgtgctgcggccgcc

SEQ ID NO: 52915 - DNA, 15 bp, Artificial Sequence
  dgRNA
  Ppy
tctagaatgctgacc

SEQ ID NO: 52916 - DNA, 15 bp, Artificial Sequence
  dgRNA
  Ppy
cgtgtttcagaaacc

SEQ ID NO: 52917 - DNA, 15 bp, Artificial Sequence
  dgRNA
  Ppy
gtggtggttaaaggc

SEQ ID NO: 52918 - DNA, 15 bp, Artificial Sequence
  dgRNA
  Ppy
tgctgaggactataa

SEQ ID NO: 52919 - DNA, 15 bp, Artificial Sequence
  dgRNA
  Zfp174
actacgactcccaag

SEQ ID NO: 52920 - DNA, 15 bp, Artificial Sequence
  dgRNA
  Zfp174
gacccagtcctgtag

SEQ ID NO: 52921 - DNA, 15 bp, Artificial Sequence
  dgRNA
  Zfp174
aggcgggccttcccg

SEQ ID NO: 52922 - DNA, 15 bp, Artificial Sequence
  dgRNA
  Zfp174
ggcgggccttcccgt

SEQ ID NO: 52923 - DNA, 15 bp, Artificial Sequence
  dgRNA
  Krtap17-1
tggacaaatagcagt

SEQ ID NO: 52924 - DNA, 15 bp, Artificial Sequence
  dgRNA
  Krtap17-1
ggacaaatagcagtt

SEQ ID NO: 52925 - DNA, 15 bp, Artificial Sequence
  dgRNA
  Krtap17-1
agcagttgggacgag

SEQ ID NO: 52926 - DNA, 15 bp, Artificial Sequence
  dgRNA
  Krtap17-1
gcagttgggacgagt

SEQ ID NO: 52927 - DNA, 15 bp, Artificial Sequence
  dgRNA
  Vmn1r202
ctatggaaaacccac

SEQ ID NO: 52928 - DNA, 15 bp, Artificial Sequence
  dgRNA
  Vmn1r202
ccgctgacctggaga

SEQ ID NO: 52929 - DNA, 15 bp, Artificial Sequence
  dgRNA
  Vmn1r202
ttggttccgctgacc

SEQ ID NO: 52930 - DNA, 15 bp, Artificial Sequence
  dgRNA
  Wwp2
tttatacgtttgctc

SEQ ID NO: 52931 - DNA, 15 bp, Artificial Sequence
  dgRNA
  Wwp2
tgctcgggcacagcc

SEQ ID NO: 52932 - DNA, 15 bp, Artificial Sequence
  dgRNA
  Wwp2
tgatccttgcaatcc

SEQ ID NO: 52933 - DNA, 15 bp, Artificial Sequence
  dgRNA
  Wwp2
atcccggccctgagc

SEQ ID NO: 52934 - DNA, 15 bp, Artificial Sequence
  dgRNA
  Pcdhb7
tttaaaacgacaatt

SEQ ID NO: 52935 - DNA, 15 bp, Artificial Sequence
  dgRNA
  Pcdhb7
atcaaagtggacgca

SEQ ID NO: 52936 - DNA, 15 bp, Artificial Sequence
  dgRNA
  Olfr218
atctaaagccccgca

SEQ ID NO: 52937 - DNA, 15 bp, Artificial Sequence
  dgRNA
  Olfr218
tctaaagccccgcat

SEQ ID NO: 52938 - DNA, 15 bp, Artificial Sequence
  dgRNA
  Olfr218
aagccccgcatgggc

SEQ ID NO: 52939 - DNA, 15 bp, Artificial Sequence
  dgRNA
  Olfr218
tgactcaactattgg

SEQ ID NO: 52940 - DNA, 15 bp, Artificial Sequence
  dgRNA
  Prap1
agtctagtgctaaag

SEQ ID NO: 52941 - DNA, 15 bp, Artificial Sequence
  dgRNA
  Prap1
gtctagtgctaaagt

SEQ ID NO: 52942 - DNA, 15 bp, Artificial Sequence
  dgRNA
  Prap1
agtgctaaagtgggc

SEQ ID NO: 52943 - DNA, 15 bp, Artificial Sequence
  dgRNA
  Prap1
ggtcttagaactggc

SEQ ID NO: 52944 - DNA, 15 bp, Artificial Sequence
  dgRNA
  Dlgap1
gttcaaagtgcacaa

SEQ ID NO: 52945 - DNA, 15 bp, Artificial Sequence
  dgRNA
  Dlgap1
tctcaacgtccgttc

SEQ ID NO: 52946 - DNA, 15 bp, Artificial Sequence
  dgRNA
  Dlgap1
gacgttgagaagcct

SEQ ID NO: 52947 - DNA, 15 bp, Artificial Sequence
  dgRNA
  Dlgap1
caaatacgacatgaa

SEQ ID NO: 52948 - DNA, 15 bp, Artificial Sequence
  dgRNA
  AI987944
gcttggttgctggcc

SEQ ID NO: 52949 - DNA, 15 bp, Artificial Sequence
  dgRNA
  Wdr36
gtcacttcaaccaag

SEQ ID NO: 52950 - DNA, 15 bp, Artificial Sequence
  dgRNA
  Wdr36
gttccactcgcccgc

SEQ ID NO: 52951 - DNA, 15 bp, Artificial Sequence
  dgRNA
  Wdr36
cgcccgcaggctccg

SEQ ID NO: 52952 - DNA, 15 bp, Artificial Sequence
  dgRNA
  Wdr36
gcccgcaggctccga

SEQ ID NO: 52953 - DNA, 15 bp, Artificial Sequence
  dgRNA
  Nbeal1
tgagcgagggcactg

SEQ ID NO: 52954 - DNA, 15 bp, Artificial Sequence
  dgRNA
  Nbeal1
gctgcgcaggcatgc

SEQ ID NO: 52955 - DNA, 15 bp, Artificial Sequence
  dgRNA
  Nbeal1
ctgcgcaggcatgcc

SEQ ID NO: 52956 - DNA, 15 bp, Artificial Sequence
  dgRNA
  Nbeal1
gcgcaggcatgccgg

SEQ ID NO: 52957 - DNA, 15 bp, Artificial Sequence
  dgRNA
  Olfr437
atcataatggctgcc

SEQ ID NO: 52958 - DNA, 15 bp, Artificial Sequence
  dgRNA
  Hoxc4
ctcttcctgcgaaag

SEQ ID NO: 52959 - DNA, 15 bp, Artificial Sequence
  dgRNA
  Hoxc4
tcttcctgcgaaaga

SEQ ID NO: 52960 - DNA, 15 bp, Artificial Sequence
  dgRNA
  Hoxc4
cttcctgcgaaagag

SEQ ID NO: 52961 - DNA, 15 bp, Artificial Sequence
  dgRNA
  Hoxc4
acacgattgccataa

SEQ ID NO: 52962 - DNA, 15 bp, Artificial Sequence
  dgRNA
  Eif4a2
gtcatcgactcctgt

SEQ ID NO: 52963 - DNA, 15 bp, Artificial Sequence
  dgRNA
  Eif4a2
tcatcgactcctgta

SEQ ID NO: 52964 - DNA, 15 bp, Artificial Sequence
  dgRNA
  Eif4a2
gtagggcttcacctc

SEQ ID NO: 52965 - DNA, 15 bp, Artificial Sequence
  dgRNA
  Eif4a2
ccggtaacaaactcc

SEQ ID NO: 52966 - DNA, 15 bp, Artificial Sequence
  dgRNA
  L3hypdh
gcgggctagttttct

SEQ ID NO: 52967 - DNA, 15 bp, Artificial Sequence
  dgRNA
  L3hypdh
ccgcagagtagtctc

SEQ ID NO: 52968 - DNA, 15 bp, Artificial Sequence
  dgRNA
  L3hypdh
ccgcccctattttat

SEQ ID NO: 52969 - DNA, 15 bp, Artificial Sequence
  dgRNA
  L3hypdh
cgtgtctagtctccg

SEQ ID NO: 52970 - DNA, 15 bp, Artificial Sequence
  dgRNA
  Itga2
atgccgagggctccg

SEQ ID NO: 52971 - DNA, 15 bp, Artificial Sequence
  dgRNA
  Itga2
ctccgtgggcgtcca

SEQ ID NO: 52972 - DNA, 15 bp, Artificial Sequence
  dgRNA
  Itga2
cctttttcagagcgc

SEQ ID NO: 52973 - DNA, 15 bp, Artificial Sequence
  dgRNA
  Itga2
ttttcagagcgctgg

SEQ ID NO: 52974 - DNA, 15 bp, Artificial Sequence
  dgRNA
  Il6st
ccttcgatctagtct

SEQ ID NO: 52975 - DNA, 15 bp, Artificial Sequence
  dgRNA
  Il6st
gatctagtctaggaa

SEQ ID NO: 52976 - DNA, 15 bp, Artificial Sequence
  dgRNA
  Il6st
ctaggaaaggcgacc

SEQ ID NO: 52977 - DNA, 15 bp, Artificial Sequence
  dgRNA
  Il6st
cggaatcccggacgc

SEQ ID NO: 52978 - DNA, 15 bp, Artificial Sequence
  dgRNA
  Scp2d1
tagttctagttagtc

SEQ ID NO: 52979 - DNA, 15 bp, Artificial Sequence
  dgRNA
  Scp2d1
ggtctgatctggtgt

SEQ ID NO: 52980 - DNA, 15 bp, Artificial Sequence
  dgRNA
  Scp2d1
gtgttggtagtactt

SEQ ID NO: 52981 - DNA, 15 bp, Artificial Sequence
  dgRNA
  Scp2d1
cctacgtcatatttt

SEQ ID NO: 52982 - DNA, 15 bp, Artificial Sequence
  dgRNA
  Chpt1
agccaagcgtcgtca

SEQ ID NO: 52983 - DNA, 15 bp, Artificial Sequence
  dgRNA
  Chpt1
cggaaacctgagcaa

SEQ ID NO: 52984 - DNA, 15 bp, Artificial Sequence
  dgRNA
  Chpt1
aaagtcacagcggca

SEQ ID NO: 52985 - DNA, 15 bp, Artificial Sequence
  dgRNA
  Chpt1
tgagtctgaaagcgc

SEQ ID NO: 52986 - DNA, 15 bp, Artificial Sequence
  dgRNA
  Ccl11
ccacatgtcatctcc

SEQ ID NO: 52987 - DNA, 15 bp, Artificial Sequence
  dgRNA
  Ccl11
cttggcatctgttaa

SEQ ID NO: 52988 - DNA, 15 bp, Artificial Sequence
  dgRNA
  Ccl11
cacaaaaccgtggga

SEQ ID NO: 52989 - DNA, 15 bp, Artificial Sequence
  dgRNA
  Ccl11
acacaaaaccgtggg

SEQ ID NO: 52990 - DNA, 15 bp, Artificial Sequence
  dgRNA
  Tor1aip2
tcgttttcccaatct

SEQ ID NO: 52991 - DNA, 15 bp, Artificial Sequence
  dgRNA
  Tor1aip2
acgaaagaaaccgac

SEQ ID NO: 52992 - DNA, 15 bp, Artificial Sequence
  dgRNA
  Tor1aip2
taggcggatgctacg

SEQ ID NO: 52993 - DNA, 15 bp, Artificial Sequence
  dgRNA
  Tor1aip2
aacgagatcatttct

SEQ ID NO: 52994 - DNA, 15 bp, Artificial Sequence
  dgRNA
  4933430I17Rik
ctttccatgtcgcaa

SEQ ID NO: 52995 - DNA, 15 bp, Artificial Sequence
  dgRNA
  4933430I17Rik
atgtcgcaatggttt

SEQ ID NO: 52996 - DNA, 15 bp, Artificial Sequence
  dgRNA
  4933430I17Rik
ttccatccgcttcca

SEQ ID NO: 52997 - DNA, 15 bp, Artificial Sequence
  dgRNA
  4933430I17Rik
gcttccacggcatcc

SEQ ID NO: 52998 - DNA, 15 bp, Artificial Sequence
  dgRNA
  Tpm1
ggagaatcgggattt

SEQ ID NO: 52999 - DNA, 15 bp, Artificial Sequence
  dgRNA
  Tpm1
tcggagcgctccaaa

SEQ ID NO: 53000 - DNA, 15 bp, Artificial Sequence
  dgRNA
  Tpm1
ctccaaatggccagc

SEQ ID NO: 53001 - DNA, 15 bp, Artificial Sequence
  dgRNA
  Tpm1
agcaggagtcgcaat

SEQ ID NO: 53002 - DNA, 15 bp, Artificial Sequence
  dgRNA
  Lsamp
catcccctcttctta

SEQ ID NO: 53003 - DNA, 15 bp, Artificial Sequence
  dgRNA
  Lsamp
acccaaaggcgcatc

SEQ ID NO: 53004 - DNA, 15 bp, Artificial Sequence
  dgRNA
  Lsamp
atcaggctttcattg

SEQ ID NO: 53005 - DNA, 15 bp, Artificial Sequence
  dgRNA
  Lsamp
caaggggccacgctg

SEQ ID NO: 53006 - DNA, 15 bp, Artificial Sequence
  dgRNA
  Slc9a3r2
ggggggacgccggac

SEQ ID NO: 53007 - DNA, 15 bp, Artificial Sequence
  dgRNA
  Slc9a3r2
gggggacgccggaca

SEQ ID NO: 53008 - DNA, 15 bp, Artificial Sequence
  dgRNA
  Slc9a3r2
ggggacgccggacag

SEQ ID NO: 53009 - DNA, 15 bp, Artificial Sequence
  dgRNA
  Slc9a3r2
gacgccggacagggg

SEQ ID NO: 53010 - DNA, 15 bp, Artificial Sequence
  dgRNA
  Skp2
tgcaagtagttgaga

SEQ ID NO: 53011 - DNA, 15 bp, Artificial Sequence
  dgRNA
  St13
atggcctgtaaccac

SEQ ID NO: 53012 - DNA, 15 bp, Artificial Sequence
  dgRNA
  St13
ctgtaaccactggtc

SEQ ID NO: 53013 - DNA, 15 bp, Artificial Sequence
  dgRNA
  St13
cacagccgcgtcgcc

SEQ ID NO: 53014 - DNA, 15 bp, Artificial Sequence
  dgRNA
  St13
aaccagtcaactgct

SEQ ID NO: 53015 - DNA, 15 bp, Artificial Sequence
  dgRNA
  Tas2r134
agatatgcccatccc

SEQ ID NO: 53016 - DNA, 15 bp, Artificial Sequence
  dgRNA
  Tas2r134
attcagcaaggtgat

SEQ ID NO: 53017 - DNA, 15 bp, Artificial Sequence
  dgRNA
  Tas2r134
ctgtcccctccggca

SEQ ID NO: 53018 - DNA, 15 bp, Artificial Sequence
  dgRNA
  Tas2r134
cctatccctaagtcc

SEQ ID NO: 53019 - DNA, 15 bp, Artificial Sequence
  dgRNA
  Atp6v1a
tgggtccggataact

SEQ ID NO: 53020 - DNA, 15 bp, Artificial Sequence
  dgRNA
  Atp6v1a
tggcgatcctccagc

SEQ ID NO: 53021 - DNA, 15 bp, Artificial Sequence
  dgRNA
  Atp6v1a
gcaggcaaacctcac

SEQ ID NO: 53022 - DNA, 15 bp, Artificial Sequence
  dgRNA
  Atp6v1a
aacgtcttccagccc

SEQ ID NO: 53023 - DNA, 15 bp, Artificial Sequence
  dgRNA
  Zfp60
caacttccggtgccc

SEQ ID NO: 53024 - DNA, 15 bp, Artificial Sequence
  dgRNA
  Zfp60
cttccggtgccctgg

SEQ ID NO: 53025 - DNA, 15 bp, Artificial Sequence
  dgRNA
  Zfp60
ctggcggcgctatag

SEQ ID NO: 53026 - DNA, 15 bp, Artificial Sequence
  dgRNA
  Zfp60
cggcgctatagcgga

SEQ ID NO: 53027 - DNA, 15 bp, Artificial Sequence
  dgRNA
  Ilk
ccacccgtagcccgc

SEQ ID NO: 53028 - DNA, 15 bp, Artificial Sequence
  dgRNA
  Ilk
cacccgtagcccgca

SEQ ID NO: 53029 - DNA, 15 bp, Artificial Sequence
  dgRNA
  Ilk
cgtagcccgcagggc

SEQ ID NO: 53030 - DNA, 15 bp, Artificial Sequence
  dgRNA
  Ilk
agcccgcagggccgg

SEQ ID NO: 53031 - DNA, 15 bp, Artificial Sequence
  dgRNA
  Maf
ctcgccgcctcccat

SEQ ID NO: 53032 - DNA, 15 bp, Artificial Sequence
  dgRNA
  Maf
gccgcctcccattgg

SEQ ID NO: 53033 - DNA, 15 bp, Artificial Sequence
  dgRNA
  Maf
ttgagcctgacgtca

SEQ ID NO: 53034 - DNA, 15 bp, Artificial Sequence
  dgRNA
  Maf
tgagcctgacgtcac

SEQ ID NO: 53035 - DNA, 15 bp, Artificial Sequence
  dgRNA
  Pigz
gcgcatagatttaca

SEQ ID NO: 53036 - DNA, 15 bp, Artificial Sequence
  dgRNA
  Pigz
gaattagtcactgcc

SEQ ID NO: 53037 - DNA, 15 bp, Artificial Sequence
  dgRNA
  Pigz
agtcactgcccggtg

SEQ ID NO: 53038 - DNA, 15 bp, Artificial Sequence
  dgRNA
  Pigz
gtcactgcccggtgc

SEQ ID NO: 53039 - DNA, 15 bp, Artificial Sequence
  dgRNA
  Lrrc24
cgtacgtgtggctcg

SEQ ID NO: 53040 - DNA, 15 bp, Artificial Sequence
  dgRNA
  Lrrc24
gtacgtgtggctcga

SEQ ID NO: 53041 - DNA, 15 bp, Artificial Sequence
  dgRNA
  Lrrc24
tacgtgtggctcgag

SEQ ID NO: 53042 - DNA, 15 bp, Artificial Sequence
  dgRNA
  Lrrc24
aggttacttctgaca

SEQ ID NO: 53043 - DNA, 15 bp, Artificial Sequence
  dgRNA
  Il18
atccaacgccatctc

SEQ ID NO: 53044 - DNA, 15 bp, Artificial Sequence
  dgRNA
  Il18
gtccagagatggcgt

SEQ ID NO: 53045 - DNA, 15 bp, Artificial Sequence
  dgRNA
  Arfgap2
ggctgcggattggcc

SEQ ID NO: 53046 - DNA, 15 bp, Artificial Sequence
  dgRNA
  Arfgap2
tggccaggcgcagcg

SEQ ID NO: 53047 - DNA, 15 bp, Artificial Sequence
  dgRNA
  Arfgap2
gcggcgttcactctc

SEQ ID NO: 53048 - DNA, 15 bp, Artificial Sequence
  dgRNA
  Arfgap2
tcactctcaggcccg

SEQ ID NO: 53049 - DNA, 15 bp, Artificial Sequence
  dgRNA
  Olfr735
atcatattgatgggt

SEQ ID NO: 53050 - DNA, 15 bp, Artificial Sequence
  dgRNA
  Olfr735
tcactatcatattga

SEQ ID NO: 53051 - DNA, 15 bp, Artificial Sequence
  dgRNA
  Syf2
aaggttctttagagc

SEQ ID NO: 53052 - DNA, 15 bp, Artificial Sequence
  dgRNA
  Syf2
acgcagtccccaacc

SEQ ID NO: 53053 - DNA, 15 bp, Artificial Sequence
  dgRNA
  Syf2
gcgtcccattctatg

SEQ ID NO: 53054 - DNA, 15 bp, Artificial Sequence
  dgRNA
  Syf2
attctatgtggtgac

SEQ ID NO: 53055 - DNA, 15 bp, Artificial Sequence
  dgRNA
  Rps3
agagcactttcagac

SEQ ID NO: 53056 - DNA, 15 bp, Artificial Sequence
  dgRNA
  Rps3
ttccgcctacattac

SEQ ID NO: 53057 - DNA, 15 bp, Artificial Sequence
  dgRNA
  Rps3
acattacaggttgct

SEQ ID NO: 53058 - DNA, 15 bp, Artificial Sequence
  dgRNA
  Rps3
cactaacgaagtaga

SEQ ID NO: 53059 - DNA, 15 bp, Artificial Sequence
  dgRNA
  Il12a
gtcccgggacaagag

SEQ ID NO: 53060 - DNA, 15 bp, Artificial Sequence
  dgRNA
  Il12a
agagtggctactcgc

SEQ ID NO: 53061 - DNA, 15 bp, Artificial Sequence
  dgRNA
  Il12a
tggctactcgcaggc

SEQ ID NO: 53062 - DNA, 15 bp, Artificial Sequence
  dgRNA
  Il12a
ctttcgctctgagtg

SEQ ID NO: 53063 - DNA, 15 bp, Artificial Sequence
  dgRNA
  Edn2
cagcttgcttcaccg

SEQ ID NO: 53064 - DNA, 15 bp, Artificial Sequence
  dgRNA
  Edn2
agcttgcttcaccgt

SEQ ID NO: 53065 - DNA, 15 bp, Artificial Sequence
  dgRNA
  Edn2
tgcttcaccgtgggc

SEQ ID NO: 53066 - DNA, 15 bp, Artificial Sequence
  dgRNA
  Edn2
tcaccgtgggcaggg

SEQ ID NO: 53067 - DNA, 15 bp, Artificial Sequence
  dgRNA
  H2afy
agccgcgctacctac

SEQ ID NO: 53068 - DNA, 15 bp, Artificial Sequence
  dgRNA
  H2afy
gcgcagaccgatgcc

SEQ ID NO: 53069 - DNA, 15 bp, Artificial Sequence
  dgRNA
  H2afy
cgcagaccgatgcct

SEQ ID NO: 53070 - DNA, 15 bp, Artificial Sequence
  dgRNA
  H2afy
gcagaccgatgcctg

SEQ ID NO: 53071 - DNA, 15 bp, Artificial Sequence
  dgRNA
  Kctd10
ctcgctcaatgcagg

SEQ ID NO: 53072 - DNA, 15 bp, Artificial Sequence
  dgRNA
  Kctd10
gctcgctcaatgcag

SEQ ID NO: 53073 - DNA, 15 bp, Artificial Sequence
  dgRNA
  Kctd10
agctcgctcaatgca

SEQ ID NO: 53074 - DNA, 15 bp, Artificial Sequence
  dgRNA
  Kctd10
cagctcgctcaatgc

SEQ ID NO: 53075 - DNA, 15 bp, Artificial Sequence
  dgRNA
  Slc22a28
aagatttgcagatca

SEQ ID NO: 53076 - DNA, 15 bp, Artificial Sequence
  dgRNA
  Slc22a28
cttacacgattccca

SEQ ID NO: 53077 - DNA, 15 bp, Artificial Sequence
  dgRNA
  Llgl2
cccgccccacactac

SEQ ID NO: 53078 - DNA, 15 bp, Artificial Sequence
  dgRNA
  Llgl2
ccgccccacactact

SEQ ID NO: 53079 - DNA, 15 bp, Artificial Sequence
  dgRNA
  Llgl2
cgccccacactactg

SEQ ID NO: 53080 - DNA, 15 bp, Artificial Sequence
  dgRNA
  Llgl2
tactggggccacgat

SEQ ID NO: 53081 - DNA, 15 bp, Artificial Sequence
  dgRNA
  Gramd1a
tatcacgccccgccc

SEQ ID NO: 53082 - DNA, 15 bp, Artificial Sequence
  dgRNA
  Gramd1a
atgtccccctcccgg

SEQ ID NO: 53083 - DNA, 15 bp, Artificial Sequence
  dgRNA
  Gramd1a
gtccccctcccggcg

SEQ ID NO: 53084 - DNA, 15 bp, Artificial Sequence
  dgRNA
  Gramd1a
tccccctcccggcgg

SEQ ID NO: 53085 - DNA, 15 bp, Artificial Sequence
  dgRNA
  Cks2
aacggttctgccccc

SEQ ID NO: 53086 - DNA, 15 bp, Artificial Sequence
  dgRNA
  Cks2
tgcgcacgcgctgcg

SEQ ID NO: 53087 - DNA, 15 bp, Artificial Sequence
  dgRNA
  Cks2
aggcacttaacgact

SEQ ID NO: 53088 - DNA, 15 bp, Artificial Sequence
  dgRNA
  Cks2
tctcaatatctcttg

SEQ ID NO: 53089 - DNA, 15 bp, Artificial Sequence
  dgRNA
  Nlrp1a
ggcccattttcagga

SEQ ID NO: 53090 - DNA, 15 bp, Artificial Sequence
  dgRNA
  Slc52a3
gtaataaatttccaa

SEQ ID NO: 53091 - DNA, 15 bp, Artificial Sequence
  dgRNA
  Slc52a3
cttgttcccgaggga

SEQ ID NO: 53092 - DNA, 15 bp, Artificial Sequence
  dgRNA
  Slc52a3
ggtcctgcgggctgc

SEQ ID NO: 53093 - DNA, 15 bp, Artificial Sequence
  dgRNA
  Slc52a3
tcgggaacaagtcag

SEQ ID NO: 53094 - DNA, 15 bp, Artificial Sequence
  dgRNA
  Zdhhc23
ttattgctcaggcgt

SEQ ID NO: 53095 - DNA, 15 bp, Artificial Sequence
  dgRNA
  Zdhhc23
cgttaatgagaagca

SEQ ID NO: 53096 - DNA, 15 bp, Artificial Sequence
  dgRNA
  Zdhhc23
aaatccgtacactaa

SEQ ID NO: 53097 - DNA, 15 bp, Artificial Sequence
  dgRNA
  Zdhhc23
aatccgtacactaaa

SEQ ID NO: 53098 - DNA, 15 bp, Artificial Sequence
  dgRNA
  AA415398
cattagatggttaga

SEQ ID NO: 53099 - DNA, 15 bp, Artificial Sequence
  dgRNA
  Il11
gagccctgcatcagc

SEQ ID NO: 53100 - DNA, 15 bp, Artificial Sequence
  dgRNA
  Il11
gggatcccctcagca

SEQ ID NO: 53101 - DNA, 15 bp, Artificial Sequence
  dgRNA
  Il11
gatcccctcagcaag

SEQ ID NO: 53102 - DNA, 15 bp, Artificial Sequence
  dgRNA
  Il11
gtgagggtactgagg

SEQ ID NO: 53103 - DNA, 15 bp, Artificial Sequence
  dgRNA
  D330045A20Rik
cagatggagtttagt

SEQ ID NO: 53104 - DNA, 15 bp, Artificial Sequence
  dgRNA
  D330045A20Rik
ggagtttagtaggct

SEQ ID NO: 53105 - DNA, 15 bp, Artificial Sequence
  dgRNA
  D330045A20Rik
gagtttagtaggcta

SEQ ID NO: 53106 - DNA, 15 bp, Artificial Sequence
  dgRNA
  D330045A20Rik
ggaaagctgatgcgc

SEQ ID NO: 53107 - DNA, 15 bp, Artificial Sequence
  dgRNA
  Esp16
gtgggttgtgatact

SEQ ID NO: 53108 - DNA, 15 bp, Artificial Sequence
  dgRNA
  Atg5
actcgttccgagttc

SEQ ID NO: 53109 - DNA, 15 bp, Artificial Sequence
  dgRNA
  Atg5
tgtctgcgcacgctc

SEQ ID NO: 53110 - DNA, 15 bp, Artificial Sequence
  dgRNA
  Atg5
aggttgggccgcgct

SEQ ID NO: 53111 - DNA, 15 bp, Artificial Sequence
  dgRNA
  Atg5
ttgggccgcgctcgg

SEQ ID NO: 53112 - DNA, 15 bp, Artificial Sequence
  dgRNA
  Olfr1453
gtctgataattcttc

SEQ ID NO: 53113 - DNA, 15 bp, Artificial Sequence
  dgRNA
  Olfr1453
ctgtaattcagtaga

SEQ ID NO: 53114 - DNA, 15 bp, Artificial Sequence
  dgRNA
  Olfr1453
tagttattacagctt

SEQ ID NO: 53115 - DNA, 15 bp, Artificial Sequence
  dgRNA
  Gpr6
caagaaggattggcc

SEQ ID NO: 53116 - DNA, 15 bp, Artificial Sequence
  dgRNA
  Gpr6
aaggattggcctggc

SEQ ID NO: 53117 - DNA, 15 bp, Artificial Sequence
  dgRNA
  Gpr6
ttggcctggcgggtg

SEQ ID NO: 53118 - DNA, 15 bp, Artificial Sequence
  dgRNA
  Gpr6
agagcctgacgtcac

SEQ ID NO: 53119 - DNA, 15 bp, Artificial Sequence
  dgRNA
  Lnpep
cccgccgcccctggg

SEQ ID NO: 53120 - DNA, 15 bp, Artificial Sequence
  dgRNA
  Lnpep
cgcccctgggcggag

SEQ ID NO: 53121 - DNA, 15 bp, Artificial Sequence
  dgRNA
  Lnpep
ggcggagtgggccta

SEQ ID NO: 53122 - DNA, 15 bp, Artificial Sequence
  dgRNA
  Lnpep
gcgtccacgcctcag

SEQ ID NO: 53123 - DNA, 15 bp, Artificial Sequence
  dgRNA
  Dip2b
tgacctgcccccctc

SEQ ID NO: 53124 - DNA, 15 bp, Artificial Sequence
  dgRNA
  Dip2b
ctctggcatagttaa

SEQ ID NO: 53125 - DNA, 15 bp, Artificial Sequence
  dgRNA
  Dip2b
cacaaaggatccaac

SEQ ID NO: 53126 - DNA, 15 bp, Artificial Sequence
  dgRNA
  Dip2b
atacagctgatggta

SEQ ID NO: 53127 - DNA, 15 bp, Artificial Sequence
  dgRNA
  Defb46
ataagtgtaattgat

SEQ ID NO: 53128 - DNA, 15 bp, Artificial Sequence
  dgRNA
  Defb46
tgtggaaatctatcc

SEQ ID NO: 53129 - DNA, 15 bp, Artificial Sequence
  dgRNA
  Defb46
gttagtgtgagcacc

SEQ ID NO: 53130 - DNA, 15 bp, Artificial Sequence
  dgRNA
  Defb46
acctggtcctatcta

SEQ ID NO: 53131 - DNA, 15 bp, Artificial Sequence
  dgRNA
  Mt4
ccctgagcgtctcac

SEQ ID NO: 53132 - DNA, 15 bp, Artificial Sequence
  dgRNA
  Mt4
cactgggccgtgtgc

SEQ ID NO: 53133 - DNA, 15 bp, Artificial Sequence
  dgRNA
  Mt4
actgggccgtgtgca

SEQ ID NO: 53134 - DNA, 15 bp, Artificial Sequence
  dgRNA
  Mt4
cgtgtgcagggcgtc

SEQ ID NO: 53135 - DNA, 15 bp, Artificial Sequence
  dgRNA
  Olfr171
ctatgagacatttga

SEQ ID NO: 53136 - DNA, 15 bp, Artificial Sequence
  dgRNA
  Olfr171
tgtaggtaaaatagg

SEQ ID NO: 53137 - DNA, 15 bp, Artificial Sequence
  dgRNA
  Olfr171
tcaaatgtctcatag

SEQ ID NO: 53138 - DNA, 15 bp, Artificial Sequence
  dgRNA
  Serp1
caacagcggtgtgga

SEQ ID NO: 53139 - DNA, 15 bp, Artificial Sequence
  dgRNA
  Serp1
ggcgccatcttgtcc

SEQ ID NO: 53140 - DNA, 15 bp, Artificial Sequence
  dgRNA
  Serp1
gagaaacccacgcgc

SEQ ID NO: 53141 - DNA, 15 bp, Artificial Sequence
  dgRNA
  Serp1
agaaacccacgcgct

SEQ ID NO: 53142 - DNA, 15 bp, Artificial Sequence
  dgRNA
  Avil
caatagaccagggtg

SEQ ID NO: 53143 - DNA, 15 bp, Artificial Sequence
  dgRNA
  Avil
ttcgctgttttgcat

SEQ ID NO: 53144 - DNA, 15 bp, Artificial Sequence
  dgRNA
  Avil
gaataagtcaagccc

SEQ ID NO: 53145 - DNA, 15 bp, Artificial Sequence
  dgRNA
  Avil
aataagtcaagccca

SEQ ID NO: 53146 - DNA, 15 bp, Artificial Sequence
  dgRNA
  Pcbd2
ggtcgagctgcagag

SEQ ID NO: 53147 - DNA, 15 bp, Artificial Sequence
  dgRNA
  Pcbd2
ggagcgagctcagcg

SEQ ID NO: 53148 - DNA, 15 bp, Artificial Sequence
  dgRNA
  Pcbd2
ctcagcgcggcgttc

SEQ ID NO: 53149 - DNA, 15 bp, Artificial Sequence
  dgRNA
  Pcbd2
tcagcgcggcgttcc

SEQ ID NO: 53150 - DNA, 15 bp, Artificial Sequence
  dgRNA
  Clps
catagtcccatgaac

SEQ ID NO: 53151 - DNA, 15 bp, Artificial Sequence
  dgRNA
  Clps
gtcaaccaccttatc

SEQ ID NO: 53152 - DNA, 15 bp, Artificial Sequence
  dgRNA
  Clps
taagacaatagactc

SEQ ID NO: 53153 - DNA, 15 bp, Artificial Sequence
  dgRNA
  Clps
catgttatcacacta

SEQ ID NO: 53154 - DNA, 15 bp, Artificial Sequence
  dgRNA
  Rbm20
cgcgcagcagctcct

SEQ ID NO: 53155 - DNA, 15 bp, Artificial Sequence
  dgRNA
  Rbm20
ctcctgggcgtctcg

SEQ ID NO: 53156 - DNA, 15 bp, Artificial Sequence
  dgRNA
  Rbm20
gtctcgcggcttccg

SEQ ID NO: 53157 - DNA, 15 bp, Artificial Sequence
  dgRNA
  Rbm20
cggcttccgtggccc

SEQ ID NO: 53158 - DNA, 15 bp, Artificial Sequence
  dgRNA
  Zfp592
atagccgcaccgccc

SEQ ID NO: 53159 - DNA, 15 bp, Artificial Sequence
  dgRNA
  Zfp592
ccgcaccgccctggc

SEQ ID NO: 53160 - DNA, 15 bp, Artificial Sequence
  dgRNA
  Zfp592
ccctggccggtgccc

SEQ ID NO: 53161 - DNA, 15 bp, Artificial Sequence
  dgRNA
  Zfp592
cgcccttcccacccg

SEQ ID NO: 53162 - DNA, 15 bp, Artificial Sequence
  dgRNA
  Hoxd3
tgtgcaaaatccgca

SEQ ID NO: 53163 - DNA, 15 bp, Artificial Sequence
  dgRNA
  Hoxd3
atttgcggtcgtcat

SEQ ID NO: 53164 - DNA, 15 bp, Artificial Sequence
  dgRNA
  Hoxd3
ggtcgtcattggctg

SEQ ID NO: 53165 - DNA, 15 bp, Artificial Sequence
  dgRNA
  Hoxd3
gtcattggctgcggc

SEQ ID NO: 53166 - DNA, 15 bp, Artificial Sequence
  dgRNA
  Gaa
cgcgatgacgtccta

SEQ ID NO: 53167 - DNA, 15 bp, Artificial Sequence
  dgRNA
  Gaa
tcgccctcagccact

SEQ ID NO: 53168 - DNA, 15 bp, Artificial Sequence
  dgRNA
  Gaa
cgccctcagccacta

SEQ ID NO: 53169 - DNA, 15 bp, Artificial Sequence
  dgRNA
  Gaa
gccctcagccactag

SEQ ID NO: 53170 - DNA, 15 bp, Artificial Sequence
  dgRNA
  Mapk13
tctaggcagcctcgc

SEQ ID NO: 53171 - DNA, 15 bp, Artificial Sequence
  dgRNA
  Mapk13
gcacccctttcccgc

SEQ ID NO: 53172 - DNA, 15 bp, Artificial Sequence
  dgRNA
  Mapk13
cacccctttcccgca

SEQ ID NO: 53173 - DNA, 15 bp, Artificial Sequence
  dgRNA
  Mapk13
gcctggggcgttcgc

SEQ ID NO: 53174 - DNA, 15 bp, Artificial Sequence
  dgRNA
  L2hgdh
ctgcgtccctgcgcc

SEQ ID NO: 53175 - DNA, 15 bp, Artificial Sequence
  dgRNA
  L2hgdh
gtccctgcgcctggc

SEQ ID NO: 53176 - DNA, 15 bp, Artificial Sequence
  dgRNA
  L2hgdh
ccggcccttcgccct

SEQ ID NO: 53177 - DNA, 15 bp, Artificial Sequence
  dgRNA
  L2hgdh
acggcgctcgctcat

SEQ ID NO: 53178 - DNA, 15 bp, Artificial Sequence
  dgRNA
  Prnd
cgagggaaggtgttc

SEQ ID NO: 53179 - DNA, 15 bp, Artificial Sequence
  dgRNA
  Prnd
tgttccggagaagtg

SEQ ID NO: 53180 - DNA, 15 bp, Artificial Sequence
  dgRNA
  Prnd
gttccggagaagtga

SEQ ID NO: 53181 - DNA, 15 bp, Artificial Sequence
  dgRNA
  Prnd
agtagcagagaaccg

SEQ ID NO: 53182 - DNA, 15 bp, Artificial Sequence
  dgRNA
  Camsap3
ggttccgccttgggg

SEQ ID NO: 53183 - DNA, 15 bp, Artificial Sequence
  dgRNA
  Camsap3
ttccgccttggggcg

SEQ ID NO: 53184 - DNA, 15 bp, Artificial Sequence
  dgRNA
  Camsap3
gcgctcgaccgcacc

SEQ ID NO: 53185 - DNA, 15 bp, Artificial Sequence
  dgRNA
  Camsap3
ccgcacctggttcag

SEQ ID NO: 53186 - DNA, 15 bp, Artificial Sequence
  dgRNA
  Dennd6b
acactagccacctac

SEQ ID NO: 53187 - DNA, 15 bp, Artificial Sequence
  dgRNA
  Dennd6b
acctactggccgacc

SEQ ID NO: 53188 - DNA, 15 bp, Artificial Sequence
  dgRNA
  Dennd6b
cctactggccgaccc

SEQ ID NO: 53189 - DNA, 15 bp, Artificial Sequence
  dgRNA
  Dennd6b
cgcaatctccattat

SEQ ID NO: 53190 - DNA, 15 bp, Artificial Sequence
  dgRNA
  Ccdc124
actctaccaagatgg

SEQ ID NO: 53191 - DNA, 15 bp, Artificial Sequence
  dgRNA
  Ccdc124
gaaagttgagtacgc

SEQ ID NO: 53192 - DNA, 15 bp, Artificial Sequence
  dgRNA
  Ccdc124
ttgagtacgcaggcg

SEQ ID NO: 53193 - DNA, 15 bp, Artificial Sequence
  dgRNA
  Ccdc124
gcccatctcagatat

SEQ ID NO: 53194 - DNA, 15 bp, Artificial Sequence
  dgRNA
  Adgra2
taggcttgcacttga

SEQ ID NO: 53195 - DNA, 15 bp, Artificial Sequence
  dgRNA
  Adgra2
gcttgcacttgaagg

SEQ ID NO: 53196 - DNA, 15 bp, Artificial Sequence
  dgRNA
  Adgra2
cttgcacttgaagga

SEQ ID NO: 53197 - DNA, 15 bp, Artificial Sequence
  dgRNA
  Adgra2
gtatcaggcggcgct

SEQ ID NO: 53198 - DNA, 15 bp, Artificial Sequence
  dgRNA
  Uhrf1
ctccccacccaattg

SEQ ID NO: 53199 - DNA, 15 bp, Artificial Sequence
  dgRNA
  Uhrf1
cccacccaattgggg

SEQ ID NO: 53200 - DNA, 15 bp, Artificial Sequence
  dgRNA
  Uhrf1
ccaattgggtgggga

SEQ ID NO: 53201 - DNA, 15 bp, Artificial Sequence
  dgRNA
  Uhrf1
caccccaattgggtg

SEQ ID NO: 53202 - DNA, 15 bp, Artificial Sequence
  dgRNA
  Prkaa2
ccatcttcaccgccc

SEQ ID NO: 53203 - DNA, 15 bp, Artificial Sequence
  dgRNA
  Prkaa2
tttctcgggacgcct

SEQ ID NO: 53204 - DNA, 15 bp, Artificial Sequence
  dgRNA
  Prkaa2
tgcgtccacacgcgc

SEQ ID NO: 53205 - DNA, 15 bp, Artificial Sequence
  dgRNA
  Prkaa2
gcgtccacacgcgcc

SEQ ID NO: 53206 - DNA, 15 bp, Artificial Sequence
  dgRNA
  Kctd6
ccggcgtctcccggc

SEQ ID NO: 53207 - DNA, 15 bp, Artificial Sequence
  dgRNA
  Kctd6
cggcgtctcccggcc

SEQ ID NO: 53208 - DNA, 15 bp, Artificial Sequence
  dgRNA
  Kctd6
gctcgtgcagtgagt

SEQ ID NO: 53209 - DNA, 15 bp, Artificial Sequence
  dgRNA
  Kctd6
ctcgtgcagtgagtg

SEQ ID NO: 53210 - DNA, 15 bp, Artificial Sequence
  dgRNA
  Slfn8
cttgctacagtgagg

SEQ ID NO: 53211 - DNA, 15 bp, Artificial Sequence
  dgRNA
  Slfn8
acgaatagctaagaa

SEQ ID NO: 53212 - DNA, 15 bp, Artificial Sequence
  dgRNA
  Slfn8
cgaatagctaagaat

SEQ ID NO: 53213 - DNA, 15 bp, Artificial Sequence
  dgRNA
  Slfn8
gaatgggggcttagc

SEQ ID NO: 53214 - DNA, 15 bp, Artificial Sequence
  dgRNA
  Ap3b2
tagatgttccaaccc

SEQ ID NO: 53215 - DNA, 15 bp, Artificial Sequence
  dgRNA
  Ap3b2
ccaggcctgcgagta

SEQ ID NO: 53216 - DNA, 15 bp, Artificial Sequence
  dgRNA
  Ap3b2
tgggcgggtccgtgg

SEQ ID NO: 53217 - DNA, 15 bp, Artificial Sequence
  dgRNA
  Ap3b2
gggtccgtggaggtc

SEQ ID NO: 53218 - DNA, 15 bp, Artificial Sequence
  dgRNA
  Spint3
accagttagacctca

SEQ ID NO: 53219 - DNA, 15 bp, Artificial Sequence
  dgRNA
  Spint3
gttagacctcatggc

SEQ ID NO: 53220 - DNA, 15 bp, Artificial Sequence
  dgRNA
  Luzp1
tccggagcctagccc

SEQ ID NO: 53221 - DNA, 15 bp, Artificial Sequence
  dgRNA
  Luzp1
cctagcccaggtccg

SEQ ID NO: 53222 - DNA, 15 bp, Artificial Sequence
  dgRNA
  Luzp1
ccggggcacctagct

SEQ ID NO: 53223 - DNA, 15 bp, Artificial Sequence
  dgRNA
  Luzp1
ggaccaaaggaggcg

SEQ ID NO: 53224 - DNA, 15 bp, Artificial Sequence
  dgRNA
  Tal1
ttcgggagccagtgt

SEQ ID NO: 53225 - DNA, 15 bp, Artificial Sequence
  dgRNA
  Tal1
cagtgttggctcgga

SEQ ID NO: 53226 - DNA, 15 bp, Artificial Sequence
  dgRNA
  Tal1
agtgttggctcggat

SEQ ID NO: 53227 - DNA, 15 bp, Artificial Sequence
  dgRNA
  Tal1
gttggctcggatggg

SEQ ID NO: 53228 - DNA, 15 bp, Artificial Sequence
  dgRNA
  Foxo3
gcgcgggaccccaac

SEQ ID NO: 53229 - DNA, 15 bp, Artificial Sequence
  dgRNA
  Foxo3
cgcgggaccccaacc

SEQ ID NO: 53230 - DNA, 15 bp, Artificial Sequence
  dgRNA
  Foxo3
gggaccccaaccggg

SEQ ID NO: 53231 - DNA, 15 bp, Artificial Sequence
  dgRNA
  Foxo3
ggaccccaaccggga

SEQ ID NO: 53232 - DNA, 15 bp, Artificial Sequence
  dgRNA
  Magoh
ctagcgctcagtgtt

SEQ ID NO: 53233 - DNA, 15 bp, Artificial Sequence
  dgRNA
  Magoh
ctcgatatacaacca

SEQ ID NO: 53234 - DNA, 15 bp, Artificial Sequence
  dgRNA
  Magoh
tcgatatacaaccaa

SEQ ID NO: 53235 - DNA, 15 bp, Artificial Sequence
  dgRNA
  Magoh
cgatatacaaccaag

SEQ ID NO: 53236 - DNA, 15 bp, Artificial Sequence
  dgRNA
  Npw
tgagtgcgacatgtg

SEQ ID NO: 53237 - DNA, 15 bp, Artificial Sequence
  dgRNA
  Npw
gtgcgacatgtgcgg

SEQ ID NO: 53238 - DNA, 15 bp, Artificial Sequence
  dgRNA
  Npw
gcgacatgtgcggcg

SEQ ID NO: 53239 - DNA, 15 bp, Artificial Sequence
  dgRNA
  Npw
cgacatgtgcggcgg

SEQ ID NO: 53240 - DNA, 15 bp, Artificial Sequence
  dgRNA
  Ltk
aactcactagtttgt

SEQ ID NO: 53241 - DNA, 15 bp, Artificial Sequence
  dgRNA
  Ltk
ttgttggtgtgccat

SEQ ID NO: 53242 - DNA, 15 bp, Artificial Sequence
  dgRNA
  Ltk
ggcagtagcttttgt

SEQ ID NO: 53243 - DNA, 15 bp, Artificial Sequence
  dgRNA
  Ltk
acctttgtgataggc

SEQ ID NO: 53244 - DNA, 15 bp, Artificial Sequence
  dgRNA
  Lrrc4c
ggattcgtgtcccca

SEQ ID NO: 53245 - DNA, 15 bp, Artificial Sequence
  dgRNA
  Lrrc4c
atggaaactagattc

SEQ ID NO: 53246 - DNA, 15 bp, Artificial Sequence
  dgRNA
  Lrrc4c
tgcggttaccttccc

SEQ ID NO: 53247 - DNA, 15 bp, Artificial Sequence
  dgRNA
  Lrrc4c
agatggtatggcttg

SEQ ID NO: 53248 - DNA, 15 bp, Artificial Sequence
  dgRNA
  Pus1
aaacggcatctagac

SEQ ID NO: 53249 - DNA, 15 bp, Artificial Sequence
  dgRNA
  Pus1
ggcttggatcctggt

SEQ ID NO: 53250 - DNA, 15 bp, Artificial Sequence
  dgRNA
  Pus1
tgggtccaccccgct

SEQ ID NO: 53251 - DNA, 15 bp, Artificial Sequence
  dgRNA
  Pus1
acttttgtccgcctt

SEQ ID NO: 53252 - DNA, 15 bp, Artificial Sequence
  dgRNA
  Slain2
ttagcccagcccggc

SEQ ID NO: 53253 - DNA, 15 bp, Artificial Sequence
  dgRNA
  Slain2
cacaccccttccggc

SEQ ID NO: 53254 - DNA, 15 bp, Artificial Sequence
  dgRNA
  Slain2
caccccttccggccg

SEQ ID NO: 53255 - DNA, 15 bp, Artificial Sequence
  dgRNA
  Slain2
atgaccacgcccctc

SEQ ID NO: 53256 - DNA, 15 bp, Artificial Sequence
  dgRNA
  Wnt3a
cggccccagccccgg

SEQ ID NO: 53257 - DNA, 15 bp, Artificial Sequence
  dgRNA
  Wnt3a
cgccgcccagggcct

SEQ ID NO: 53258 - DNA, 15 bp, Artificial Sequence
  dgRNA
  Wnt3a
cctcggcccgccgcc

SEQ ID NO: 53259 - DNA, 15 bp, Artificial Sequence
  dgRNA
  Wnt3a
ggccgccggcccacc

SEQ ID NO: 53260 - DNA, 15 bp, Artificial Sequence
  dgRNA
  Sostdc1
caactctgaaatcgc

SEQ ID NO: 53261 - DNA, 15 bp, Artificial Sequence
  dgRNA
  Sostdc1
gcccgtcttctccat

SEQ ID NO: 53262 - DNA, 15 bp, Artificial Sequence
  dgRNA
  Sostdc1
gtaaaattcttttgc

SEQ ID NO: 53263 - DNA, 15 bp, Artificial Sequence
  dgRNA
  Sostdc1
tctacgagctgaagc

SEQ ID NO: 53264 - DNA, 15 bp, Artificial Sequence
  dgRNA
  Ubtd1
gagtgacaggctccg

SEQ ID NO: 53265 - DNA, 15 bp, Artificial Sequence
  dgRNA
  Ubtd1
agtgacaggctccgg

SEQ ID NO: 53266 - DNA, 15 bp, Artificial Sequence
  dgRNA
  Ubtd1
gtgacaggctccggg

SEQ ID NO: 53267 - DNA, 15 bp, Artificial Sequence
  dgRNA
  Ubtd1
gggccggccccagct

SEQ ID NO: 53268 - DNA, 15 bp, Artificial Sequence
  dgRNA
  Nit2
gaatgtgcacaaagt

SEQ ID NO: 53269 - DNA, 15 bp, Artificial Sequence
  dgRNA
  Nit2
tgtgcacaaagtcgg

SEQ ID NO: 53270 - DNA, 15 bp, Artificial Sequence
  dgRNA
  Nit2
cctcaaagctcatcg

SEQ ID NO: 53271 - DNA, 15 bp, Artificial Sequence
  dgRNA
  Nit2
ccccttctgcgcgcg

SEQ ID NO: 53272 - DNA, 15 bp, Artificial Sequence
  dgRNA
  Cysltr2
cggcagggcaattct

SEQ ID NO: 53273 - DNA, 15 bp, Artificial Sequence
  dgRNA
  Cysltr2
ggcagggcaattcta

SEQ ID NO: 53274 - DNA, 15 bp, Artificial Sequence
  dgRNA
  Cysltr2
ttctcgccttgctat

SEQ ID NO: 53275 - DNA, 15 bp, Artificial Sequence
  dgRNA
  Cysltr2
atgattggtttttgc

SEQ ID NO: 53276 - DNA, 15 bp, Artificial Sequence
  dgRNA
  Il1rap
gcggcggaaagtaag

SEQ ID NO: 53277 - DNA, 15 bp, Artificial Sequence
  dgRNA
  Rpl7a
tcggagcctgcggtc

SEQ ID NO: 53278 - DNA, 15 bp, Artificial Sequence
  dgRNA
  Rpl7a
ctgcggtccggtgcc

SEQ ID NO: 53279 - DNA, 15 bp, Artificial Sequence
  dgRNA
  Rpl7a
tgcggtccggtgcca

SEQ ID NO: 53280 - DNA, 15 bp, Artificial Sequence
  dgRNA
  Rpl7a
acgaacgcgcagccg

SEQ ID NO: 53281 - DNA, 15 bp, Artificial Sequence
  dgRNA
  Chrm3
gccaagccagcacgc

SEQ ID NO: 53282 - DNA, 15 bp, Artificial Sequence
  dgRNA
  Chrm3
ccaagccagcacgcg

SEQ ID NO: 53283 - DNA, 15 bp, Artificial Sequence
  dgRNA
  Chrm3
acgcggggagaagcg

SEQ ID NO: 53284 - DNA, 15 bp, Artificial Sequence
  dgRNA
  Chrm3
gaagcgaggagcccg

SEQ ID NO: 53285 - DNA, 15 bp, Artificial Sequence
  dgRNA
  Slco4a1
cttgtaagggaatct

SEQ ID NO: 53286 - DNA, 15 bp, Artificial Sequence
  dgRNA
  Slco4a1
agggcttcatcatcc

SEQ ID NO: 53287 - DNA, 15 bp, Artificial Sequence
  dgRNA
  Slco4a1
ccgggctaatcagct

SEQ ID NO: 53288 - DNA, 15 bp, Artificial Sequence
  dgRNA
  Slco4a1
ttggcctaatcccac

SEQ ID NO: 53289 - DNA, 15 bp, Artificial Sequence
  dgRNA
  Mus81
agtgtacccccacac

SEQ ID NO: 53290 - DNA, 15 bp, Artificial Sequence
  dgRNA
  Mus81
atcgtagaagaggct

SEQ ID NO: 53291 - DNA, 15 bp, Artificial Sequence
  dgRNA
  Mus81
tatcgtagaagaggc

SEQ ID NO: 53292 - DNA, 15 bp, Artificial Sequence
  dgRNA
  Mus81
tcactatcgtagaag

SEQ ID NO: 53293 - DNA, 15 bp, Artificial Sequence
  dgRNA
  Sbk1
tggcgcctggcggga

SEQ ID NO: 53294 - DNA, 15 bp, Artificial Sequence
  dgRNA
  Sbk1
cgcggagcgcgcacc

SEQ ID NO: 53295 - DNA, 15 bp, Artificial Sequence
  dgRNA
  Sbk1
agcgcgcacccggcg

SEQ ID NO: 53296 - DNA, 15 bp, Artificial Sequence
  dgRNA
  Sbk1
gcgcacccggcgcgg

SEQ ID NO: 53297 - DNA, 15 bp, Artificial Sequence
  dgRNA
  Zdhhc11
cggagtccccacctg

SEQ ID NO: 53298 - DNA, 15 bp, Artificial Sequence
  dgRNA
  Zdhhc11
ggagtccccacctgt

SEQ ID NO: 53299 - DNA, 15 bp, Artificial Sequence
  dgRNA
  Zdhhc11
agtaggtcgtctcct

SEQ ID NO: 53300 - DNA, 15 bp, Artificial Sequence
  dgRNA
  Zdhhc11
cgtctccttggttgc

SEQ ID NO: 53301 - DNA, 15 bp, Artificial Sequence
  dgRNA
  Xkr5
tgtcttacagccgtt

SEQ ID NO: 53302 - DNA, 15 bp, Artificial Sequence
  dgRNA
  Xkr5
cttacagccgttagg

SEQ ID NO: 53303 - DNA, 15 bp, Artificial Sequence
  dgRNA
  Xkr5
agccgttaggaggct

SEQ ID NO: 53304 - DNA, 15 bp, Artificial Sequence
  dgRNA
  Xkr5
cccctaagaacctgt

SEQ ID NO: 53305 - DNA, 15 bp, Artificial Sequence
  dgRNA
  Grk5
cgactacaatatgtt

SEQ ID NO: 53306 - DNA, 15 bp, Artificial Sequence
  dgRNA
  Grk5
aagctgctctgtgcg

SEQ ID NO: 53307 - DNA, 15 bp, Artificial Sequence
  dgRNA
  Grk5
gatcccgagagtccc

SEQ ID NO: 53308 - DNA, 15 bp, Artificial Sequence
  dgRNA
  Grk5
agacgcgccgtcgcc

SEQ ID NO: 53309 - DNA, 15 bp, Artificial Sequence
  dgRNA
  Syt10
gcgccagcctgccat

SEQ ID NO: 53310 - DNA, 15 bp, Artificial Sequence
  dgRNA
  Syt10
cgccgcccagcaccc

SEQ ID NO: 53311 - DNA, 15 bp, Artificial Sequence
  dgRNA
  Syt10
cccctcgctccccgc

SEQ ID NO: 53312 - DNA, 15 bp, Artificial Sequence
  dgRNA
  Syt10
tcgctccccgccggc

SEQ ID NO: 53313 - DNA, 15 bp, Artificial Sequence
  dgRNA
  Tirap
tggcgagcgccccct

SEQ ID NO: 53314 - DNA, 15 bp, Artificial Sequence
  dgRNA
  Tirap
ggcgagcgcccccta

SEQ ID NO: 53315 - DNA, 15 bp, Artificial Sequence
  dgRNA
  Tirap
gcgccccctagggtc

SEQ ID NO: 53316 - DNA, 15 bp, Artificial Sequence
  dgRNA
  Tirap
cccctagggtccggc

SEQ ID NO: 53317 - DNA, 15 bp, Artificial Sequence
  dgRNA
  Emc1
agcccggcatgcacc

SEQ ID NO: 53318 - DNA, 15 bp, Artificial Sequence
  dgRNA
  Emc1
cagcccggcatgcac

SEQ ID NO: 53319 - DNA, 15 bp, Artificial Sequence
  dgRNA
  Pax9
tgtatttagtcaccc

SEQ ID NO: 53320 - DNA, 15 bp, Artificial Sequence
  dgRNA
  Pax9
ttagtcacccaggtg

SEQ ID NO: 53321 - DNA, 15 bp, Artificial Sequence
  dgRNA
  Pax9
gccagaaacagacgg

SEQ ID NO: 53322 - DNA, 15 bp, Artificial Sequence
  dgRNA
  Pax9
gaaacagacggcgga

SEQ ID NO: 53323 - DNA, 15 bp, Artificial Sequence
  dgRNA
  Mybpc1
cgtgcactgctgagt

SEQ ID NO: 53324 - DNA, 15 bp, Artificial Sequence
  dgRNA
  Mybpc1
cggcacacgcttctg

SEQ ID NO: 53325 - DNA, 15 bp, Artificial Sequence
  dgRNA
  Mybpc1
acgcttctgtggaac

SEQ ID NO: 53326 - DNA, 15 bp, Artificial Sequence
  dgRNA
  Mybpc1
catactacatgagcc

SEQ ID NO: 53327 - DNA, 15 bp, Artificial Sequence
  dgRNA
  Pbx4
cggtagtcgttacca

SEQ ID NO: 53328 - DNA, 15 bp, Artificial Sequence
  dgRNA
  Pbx4
tggcaaccccaacca

SEQ ID NO: 53329 - DNA, 15 bp, Artificial Sequence
  dgRNA
  Pbx4
ggcaaccccaaccat

SEQ ID NO: 53330 - DNA, 15 bp, Artificial Sequence
  dgRNA
  Pbx4
tctagctagtcgctg

SEQ ID NO: 53331 - DNA, 15 bp, Artificial Sequence
  dgRNA
  Mkl2
tgctcgtcagatgat

SEQ ID NO: 53332 - DNA, 15 bp, Artificial Sequence
  dgRNA
  Mkl2
gctcgtcagatgatt

SEQ ID NO: 53333 - DNA, 15 bp, Artificial Sequence
  dgRNA
  Mkl2
gaagcagccagcgcg

SEQ ID NO: 53334 - DNA, 15 bp, Artificial Sequence
  dgRNA
  Mkl2
aagcagccagcgcgg

SEQ ID NO: 53335 - DNA, 15 bp, Artificial Sequence
  dgRNA
  Tmem102
gctgcacctgtatcg

SEQ ID NO: 53336 - DNA, 15 bp, Artificial Sequence
  dgRNA
  Tmem102
tgaacgaactctcac

SEQ ID NO: 53337 - DNA, 15 bp, Artificial Sequence
  dgRNA
  Tmem102
acgaactctcacagg

SEQ ID NO: 53338 - DNA, 15 bp, Artificial Sequence
  dgRNA
  Tmem102
gaggcggaaccagtc

SEQ ID NO: 53339 - DNA, 15 bp, Artificial Sequence
  dgRNA
  Gif
cacctttacatacca

SEQ ID NO: 53340 - DNA, 15 bp, Artificial Sequence
  dgRNA
  Gif
tttacataccatgga

SEQ ID NO: 53341 - DNA, 15 bp, Artificial Sequence
  dgRNA
  Gif
taagtaaactcagat

SEQ ID NO: 53342 - DNA, 15 bp, Artificial Sequence
  dgRNA
  Gif
ctcagataggcaaat

SEQ ID NO: 53343 - DNA, 15 bp, Artificial Sequence
  dgRNA
  Zfp770
gattccaataagagc

SEQ ID NO: 53344 - DNA, 15 bp, Artificial Sequence
  dgRNA
  Zfp770
ggacttccacaatga

SEQ ID NO: 53345 - DNA, 15 bp, Artificial Sequence
  dgRNA
  Zfp770
tccacaatgaagggt

SEQ ID NO: 53346 - DNA, 15 bp, Artificial Sequence
  dgRNA
  Zfp770
gggtcggtaacagta

SEQ ID NO: 53347 - DNA, 15 bp, Artificial Sequence
  dgRNA
  Sphk1
actaggctgtgtatt

SEQ ID NO: 53348 - DNA, 15 bp, Artificial Sequence
  dgRNA
  Sphk1
atttggcgcccttga

SEQ ID NO: 53349 - DNA, 15 bp, Artificial Sequence
  dgRNA
  Sphk1
ggcgtagagatcctc

SEQ ID NO: 53350 - DNA, 15 bp, Artificial Sequence
  dgRNA
  Sphk1
cacttaaacacggcc

SEQ ID NO: 53351 - DNA, 15 bp, Artificial Sequence
  dgRNA
  Flt3l
catacacttcgaagc

SEQ ID NO: 53352 - DNA, 15 bp, Artificial Sequence
  dgRNA
  Flt3l
cttcgctatcctttc

SEQ ID NO: 53353 - DNA, 15 bp, Artificial Sequence
  dgRNA
  Flt3l
ttcgctatcctttca

SEQ ID NO: 53354 - DNA, 15 bp, Artificial Sequence
  dgRNA
  Flt3l
ccacttgttaccact

SEQ ID NO: 53355 - DNA, 15 bp, Artificial Sequence
  dgRNA
  3830403N18Rik
atcgaagcagtaaaa

SEQ ID NO: 53356 - DNA, 15 bp, Artificial Sequence
  dgRNA
  3830403N18Rik
ttgggacagcggggg

SEQ ID NO: 53357 - DNA, 15 bp, Artificial Sequence
  dgRNA
  3830403N18Rik
attgggacagcgggg

SEQ ID NO: 53358 - DNA, 15 bp, Artificial Sequence
  dgRNA
  3830403N18Rik
gattgggacagcggg

SEQ ID NO: 53359 - DNA, 15 bp, Artificial Sequence
  dgRNA
  Dync1i2
attccttgcctctag

SEQ ID NO: 53360 - DNA, 15 bp, Artificial Sequence
  dgRNA
  Dync1i2
ttccttgcctctagt

SEQ ID NO: 53361 - DNA, 15 bp, Artificial Sequence
  dgRNA
  Dync1i2
gagcttcgctcgccc

SEQ ID NO: 53362 - DNA, 15 bp, Artificial Sequence
  dgRNA
  Dync1i2
ttcgctcgcccaggc

SEQ ID NO: 53363 - DNA, 15 bp, Artificial Sequence
  dgRNA
  Ccnc
tgtcgaccggcgtca

SEQ ID NO: 53364 - DNA, 15 bp, Artificial Sequence
  dgRNA
  Ccnc
ggcgtcaaggcgacg

SEQ ID NO: 53365 - DNA, 15 bp, Artificial Sequence
  dgRNA
  Ccnc
gcgtcaaggcgacga

SEQ ID NO: 53366 - DNA, 15 bp, Artificial Sequence
  dgRNA
  Ccnc
tcgtcgccttgacgc

SEQ ID NO: 53367 - DNA, 15 bp, Artificial Sequence
  dgRNA
  Gm11938
agcacaggtatataa

SEQ ID NO: 53368 - DNA, 15 bp, Artificial Sequence
  dgRNA
  Gm11938
gcacaggtatataaa

SEQ ID NO: 53369 - DNA, 15 bp, Artificial Sequence
  dgRNA
  Gm11938
agggacccgacccag

SEQ ID NO: 53370 - DNA, 15 bp, Artificial Sequence
  dgRNA
  Myef2
tcactccccaagtcg

SEQ ID NO: 53371 - DNA, 15 bp, Artificial Sequence
  dgRNA
  Myef2
cactccccaagtcgc

SEQ ID NO: 53372 - DNA, 15 bp, Artificial Sequence
  dgRNA
  Myef2
actccccaagtcgcg

SEQ ID NO: 53373 - DNA, 15 bp, Artificial Sequence
  dgRNA
  Myef2
gctctcgcgagatcc

SEQ ID NO: 53374 - DNA, 15 bp, Artificial Sequence
  dgRNA
  Cyhr1
ctccggatcccctcc

SEQ ID NO: 53375 - DNA, 15 bp, Artificial Sequence
  dgRNA
  Cyhr1
tctgttcaccttcga

SEQ ID NO: 53376 - DNA, 15 bp, Artificial Sequence
  dgRNA
  Cyhr1
gttcaccttcgaggg

SEQ ID NO: 53377 - DNA, 15 bp, Artificial Sequence
  dgRNA
  Cyhr1
ttcaccttcgagggt

SEQ ID NO: 53378 - DNA, 15 bp, Artificial Sequence
  dgRNA
  Serbp1
cttgattcgttacga

SEQ ID NO: 53379 - DNA, 15 bp, Artificial Sequence
  dgRNA
  Serbp1
ttgattcgttacgaa

SEQ ID NO: 53380 - DNA, 15 bp, Artificial Sequence
  dgRNA
  Serbp1
attcgttacgaaggg

SEQ ID NO: 53381 - DNA, 15 bp, Artificial Sequence
  dgRNA
  Serbp1
cgttacgaagggtgg

SEQ ID NO: 53382 - DNA, 15 bp, Artificial Sequence
  dgRNA
  Lrrc72
tgaaagccatcgacc

SEQ ID NO: 53383 - DNA, 15 bp, Artificial Sequence
  dgRNA
  Lrrc72
cttactattgtgtgc

SEQ ID NO: 53384 - DNA, 15 bp, Artificial Sequence
  dgRNA
  Lrrc72
taaggacctggtcga

SEQ ID NO: 53385 - DNA, 15 bp, Artificial Sequence
  dgRNA
  Lrrc72
aatgggttaaggacc

SEQ ID NO: 53386 - DNA, 15 bp, Artificial Sequence
  dgRNA
  Ndp
attaagcagctggtc

SEQ ID NO: 53387 - DNA, 15 bp, Artificial Sequence
  dgRNA
  Ndp
taacgattaagcagc

SEQ ID NO: 53388 - DNA, 15 bp, Artificial Sequence
  dgRNA
  Ndp
agagacacacggttt

SEQ ID NO: 53389 - DNA, 15 bp, Artificial Sequence
  dgRNA
  Ndp
ttgtacactaataag

SEQ ID NO: 53390 - DNA, 15 bp, Artificial Sequence
  dgRNA
  Ston1
gagtaccaaccctga

SEQ ID NO: 53391 - DNA, 15 bp, Artificial Sequence
  dgRNA
  Ston1
tgagagttccttatt

SEQ ID NO: 53392 - DNA, 15 bp, Artificial Sequence
  dgRNA
  Ston1
taaccagatggaccc

SEQ ID NO: 53393 - DNA, 15 bp, Artificial Sequence
  dgRNA
  Ston1
tactttgtaaccaga

SEQ ID NO: 53394 - DNA, 15 bp, Artificial Sequence
  dgRNA
  Fbxo38
gattccgggtatttc

SEQ ID NO: 53395 - DNA, 15 bp, Artificial Sequence
  dgRNA
  Fbxo38
ccgggtatttccggt

SEQ ID NO: 53396 - DNA, 15 bp, Artificial Sequence
  dgRNA
  Fbxo38
cgggtatttccggta

SEQ ID NO: 53397 - DNA, 15 bp, Artificial Sequence
  dgRNA
  Fbxo38
gaacgcctacgtcac

SEQ ID NO: 53398 - DNA, 15 bp, Artificial Sequence
  dgRNA
  Adgrd1
taacagactggtgtt

SEQ ID NO: 53399 - DNA, 15 bp, Artificial Sequence
  dgRNA
  Adgrd1
cccaaagccacgggc

SEQ ID NO: 53400 - DNA, 15 bp, Artificial Sequence
  dgRNA
  Adgrd1
ccacgggctggactc

SEQ ID NO: 53401 - DNA, 15 bp, Artificial Sequence
  dgRNA
  Adgrd1
gactctgggccaacg

SEQ ID NO: 53402 - DNA, 15 bp, Artificial Sequence
  dgRNA
  Olfr862
cactgtagaggtaac

SEQ ID NO: 53403 - DNA, 15 bp, Artificial Sequence
  dgRNA
  Olfr862
aattaagcactgtag

SEQ ID NO: 53404 - DNA, 15 bp, Artificial Sequence
  dgRNA
  Traf6
gcactggtccgagga

SEQ ID NO: 53405 - DNA, 15 bp, Artificial Sequence
  dgRNA
  Traf6
cactggtccgaggaa

SEQ ID NO: 53406 - DNA, 15 bp, Artificial Sequence
  dgRNA
  Traf6
tacgtgattaatgta

SEQ ID NO: 53407 - DNA, 15 bp, Artificial Sequence
  dgRNA
  Traf6
gaaaacttctttgcg

SEQ ID NO: 53408 - DNA, 15 bp, Artificial Sequence
  dgRNA
  Smg8
cgctaagaccttgca

SEQ ID NO: 53409 - DNA, 15 bp, Artificial Sequence
  dgRNA
  Smg8
gcaagggacacgaaa

SEQ ID NO: 53410 - DNA, 15 bp, Artificial Sequence
  dgRNA
  Smg8
gacacgaaaaggcaa

SEQ ID NO: 53411 - DNA, 15 bp, Artificial Sequence
  dgRNA
  Smg8
gacacccggaactca

SEQ ID NO: 53412 - DNA, 15 bp, Artificial Sequence
  dgRNA
  2900011O08Rik
agaaagcctatctac

SEQ ID NO: 53413 - DNA, 15 bp, Artificial Sequence
  dgRNA
  2900011O08Rik
ctactggtttcagtg

SEQ ID NO: 53414 - DNA, 15 bp, Artificial Sequence
  dgRNA
  2900011O08Rik
atggatctagcattg

SEQ ID NO: 53415 - DNA, 15 bp, Artificial Sequence
  dgRNA
  2900011O08Rik
tagataggctttctg

SEQ ID NO: 53416 - DNA, 15 bp, Artificial Sequence
  dgRNA
  Zdhhc6
ctccagagaaacggc

SEQ ID NO: 53417 - DNA, 15 bp, Artificial Sequence
  dgRNA
  Zdhhc6
caaactctaagttgc

SEQ ID NO: 53418 - DNA, 15 bp, Artificial Sequence
  dgRNA
  Zdhhc6
tctaagttgcaggcg

SEQ ID NO: 53419 - DNA, 15 bp, Artificial Sequence
  dgRNA
  Zdhhc6
ctaagttgcaggcgc

SEQ ID NO: 53420 - DNA, 15 bp, Artificial Sequence
  dgRNA
  Acrbp
ctatactcaacagcc

SEQ ID NO: 53421 - DNA, 15 bp, Artificial Sequence
  dgRNA
  Acrbp
gtctccacaaaaccg

SEQ ID NO: 53422 - DNA, 15 bp, Artificial Sequence
  dgRNA
  Acrbp
atagtacacacctcc

SEQ ID NO: 53423 - DNA, 15 bp, Artificial Sequence
  dgRNA
  Acrbp
tagtacacacctcct

SEQ ID NO: 53424 - DNA, 15 bp, Artificial Sequence
  dgRNA
  Ffar2
atcttatactagcat

SEQ ID NO: 53425 - DNA, 15 bp, Artificial Sequence
  dgRNA
  Ffar2
gatcttatactagca

SEQ ID NO: 53426 - DNA, 15 bp, Artificial Sequence
  dgRNA
  Ffar2
cataaggaacttggt

SEQ ID NO: 53427 - DNA, 15 bp, Artificial Sequence
  dgRNA
  Ffar2
gagccaaaaatcata

SEQ ID NO: 53428 - DNA, 15 bp, Artificial Sequence
  dgRNA
  Atrn
tccgcgctaagaccc

SEQ ID NO: 53429 - DNA, 15 bp, Artificial Sequence
  dgRNA
  Atrn
accctggcattgagc

SEQ ID NO: 53430 - DNA, 15 bp, Artificial Sequence
  dgRNA
  Atrn
acatgctgggcacgc

SEQ ID NO: 53431 - DNA, 15 bp, Artificial Sequence
  dgRNA
  Atrn
cacgccggaagacca

SEQ ID NO: 53432 - DNA, 15 bp, Artificial Sequence
  dgRNA
  Trip11
caaaagcagctgcgc

SEQ ID NO: 53433 - DNA, 15 bp, Artificial Sequence
  dgRNA
  Trip11
aagcagctgcgcagg

SEQ ID NO: 53434 - DNA, 15 bp, Artificial Sequence
  dgRNA
  Trip11
ccgccactgcctttt

SEQ ID NO: 53435 - DNA, 15 bp, Artificial Sequence
  dgRNA
  Trip11
attatccagcgtctg

SEQ ID NO: 53436 - DNA, 15 bp, Artificial Sequence
  dgRNA
  Ccr2
ggagtgttatatgtt

SEQ ID NO: 53437 - DNA, 15 bp, Artificial Sequence
  dgRNA
  Ccdc71
gccttctatgtgcac

SEQ ID NO: 53438 - DNA, 15 bp, Artificial Sequence
  dgRNA
  Ccdc71
catactggatcagat

SEQ ID NO: 53439 - DNA, 15 bp, Artificial Sequence
  dgRNA
  Ccdc71
tggatcagataggtt

SEQ ID NO: 53440 - DNA, 15 bp, Artificial Sequence
  dgRNA
  Ccdc71
gacttgtcacctccg

SEQ ID NO: 53441 - DNA, 15 bp, Artificial Sequence
  dgRNA
  Smg1
aggcttggggcgcgc

SEQ ID NO: 53442 - DNA, 15 bp, Artificial Sequence
  dgRNA
  Smg1
ggcaccgcccctcct

SEQ ID NO: 53443 - DNA, 15 bp, Artificial Sequence
  dgRNA
  Smg1
aggctcctagggcgc

SEQ ID NO: 53444 - DNA, 15 bp, Artificial Sequence
  dgRNA
  Smg1
catgccgtgcggcag

SEQ ID NO: 53445 - DNA, 15 bp, Artificial Sequence
  dgRNA
  Neu4
tgtggtcctagactt

SEQ ID NO: 53446 - DNA, 15 bp, Artificial Sequence
  dgRNA
  Neu4
gtggtcctagacttt

SEQ ID NO: 53447 - DNA, 15 bp, Artificial Sequence
  dgRNA
  Neu4
cctgttcggtctgag

SEQ ID NO: 53448 - DNA, 15 bp, Artificial Sequence
  dgRNA
  Neu4
gtctgagcggacgcg

SEQ ID NO: 53449 - DNA, 15 bp, Artificial Sequence
  dgRNA
  Snw1
gaatttcgtatgcta

SEQ ID NO: 53450 - DNA, 15 bp, Artificial Sequence
  dgRNA
  Snw1
gcactttcaacagac

SEQ ID NO: 53451 - DNA, 15 bp, Artificial Sequence
  dgRNA
  Snw1
gcccagagggccgtt

SEQ ID NO: 53452 - DNA, 15 bp, Artificial Sequence
  dgRNA
  Snw1
gtgttcctcgttccc

SEQ ID NO: 53453 - DNA, 15 bp, Artificial Sequence
  dgRNA
  Shisa4
gagctgttcattagg

SEQ ID NO: 53454 - DNA, 15 bp, Artificial Sequence
  dgRNA
  Shisa4
ctgttcattaggagg

SEQ ID NO: 53455 - DNA, 15 bp, Artificial Sequence
  dgRNA
  Shisa4
gtctgggataatgat

SEQ ID NO: 53456 - DNA, 15 bp, Artificial Sequence
  dgRNA
  Shisa4
ataatgattggtctc

SEQ ID NO: 53457 - DNA, 15 bp, Artificial Sequence
  dgRNA
  Mgea5
ggtggcgagccaaaa

SEQ ID NO: 53458 - DNA, 15 bp, Artificial Sequence
  dgRNA
  Mgea5
cgccgcacacctccg

SEQ ID NO: 53459 - DNA, 15 bp, Artificial Sequence
  dgRNA
  Mgea5
cctccgcggtgttca

SEQ ID NO: 53460 - DNA, 15 bp, Artificial Sequence
  dgRNA
  Mgea5
gcaaataaagcgcaa

SEQ ID NO: 53461 - DNA, 15 bp, Artificial Sequence
  dgRNA
  Gsg2
gctccaagtcccgct

SEQ ID NO: 53462 - DNA, 15 bp, Artificial Sequence
  dgRNA
  Gsg2
ctgccggcttccggg

SEQ ID NO: 53463 - DNA, 15 bp, Artificial Sequence
  dgRNA
  Gsg2
ggcttccgggaggtc

SEQ ID NO: 53464 - DNA, 15 bp, Artificial Sequence
  dgRNA
  Gsg2
tccgggaggtcaggc

SEQ ID NO: 53465 - DNA, 15 bp, Artificial Sequence
  dgRNA
  Krt4
atgggccgttgccaa

SEQ ID NO: 53466 - DNA, 15 bp, Artificial Sequence
  dgRNA
  Krt4
cgcatataagccaca

SEQ ID NO: 53467 - DNA, 15 bp, Artificial Sequence
  dgRNA
  Krt4
gcatataagccacaa

SEQ ID NO: 53468 - DNA, 15 bp, Artificial Sequence
  dgRNA
  Krt4
aagccacaagggccg

SEQ ID NO: 53469 - DNA, 15 bp, Artificial Sequence
  dgRNA
  Rsad2
ccggaagccaaggaa

SEQ ID NO: 53470 - DNA, 15 bp, Artificial Sequence
  dgRNA
  Rsad2
ggcctgcgcgtccta

SEQ ID NO: 53471 - DNA, 15 bp, Artificial Sequence
  dgRNA
  Rsad2
cctaaggttcagtct

SEQ ID NO: 53472 - DNA, 15 bp, Artificial Sequence
  dgRNA
  Rsad2
gtttaactgagtcaa

SEQ ID NO: 53473 - DNA, 15 bp, Artificial Sequence
  dgRNA
  Slbp
ggccggtcgggatct

SEQ ID NO: 53474 - DNA, 15 bp, Artificial Sequence
  dgRNA
  Slbp
tggactgcatctcgg

SEQ ID NO: 53475 - DNA, 15 bp, Artificial Sequence
  dgRNA
  Slbp
ggactgcatctcggt

SEQ ID NO: 53476 - DNA, 15 bp, Artificial Sequence
  dgRNA
  Slbp
tgcatctcggtgggc

SEQ ID NO: 53477 - DNA, 15 bp, Artificial Sequence
  dgRNA
  Pyroxd1
ttcaagatgtgggcg

SEQ ID NO: 53478 - DNA, 15 bp, Artificial Sequence
  dgRNA
  Pyroxd1
gggcgtggtaacagc

SEQ ID NO: 53479 - DNA, 15 bp, Artificial Sequence
  dgRNA
  Pyroxd1
caaacgcaaaacacg

SEQ ID NO: 53480 - DNA, 15 bp, Artificial Sequence
  dgRNA
  Pyroxd1
aaacgcaaaacacgt

SEQ ID NO: 53481 - DNA, 15 bp, Artificial Sequence
  dgRNA
  Galm
tgcgcaaaataaagt

SEQ ID NO: 53482 - DNA, 15 bp, Artificial Sequence
  dgRNA
  Galm
gtaaggcatctttag

SEQ ID NO: 53483 - DNA, 15 bp, Artificial Sequence
  dgRNA
  Galm
cgtaaggcatcttta

SEQ ID NO: 53484 - DNA, 15 bp, Artificial Sequence
  dgRNA
  Galm
gcgtaaggcatcttt

SEQ ID NO: 53485 - DNA, 15 bp, Artificial Sequence
  dgRNA
  Gck
gtgtgataggcacca

SEQ ID NO: 53486 - DNA, 15 bp, Artificial Sequence
  dgRNA
  Gck
acctgggaactaagc

SEQ ID NO: 53487 - DNA, 15 bp, Artificial Sequence
  dgRNA
  Gck
taatgtctaccaagc

SEQ ID NO: 53488 - DNA, 15 bp, Artificial Sequence
  dgRNA
  Gck
gctctaatgagacaa

SEQ ID NO: 53489 - DNA, 15 bp, Artificial Sequence
  dgRNA
  Ddx25
cccaagcggggctgt

SEQ ID NO: 53490 - DNA, 15 bp, Artificial Sequence
  dgRNA
  Ddx25
ccaagcggggctgtc

SEQ ID NO: 53491 - DNA, 15 bp, Artificial Sequence
  dgRNA
  Ddx25
cgagagcctgcagcg

SEQ ID NO: 53492 - DNA, 15 bp, Artificial Sequence
  dgRNA
  Ddx25
tgctgtgcggatggc

SEQ ID NO: 53493 - DNA, 15 bp, Artificial Sequence
  dgRNA
  Fbrsl1
cattgcgcgccaacc

SEQ ID NO: 53494 - DNA, 15 bp, Artificial Sequence
  dgRNA
  Fbrsl1
attgcgcgccaacct

SEQ ID NO: 53495 - DNA, 15 bp, Artificial Sequence
  dgRNA
  Fbrsl1
ttgcgcgccaacctg

SEQ ID NO: 53496 - DNA, 15 bp, Artificial Sequence
  dgRNA
  Fbrsl1
aacctggggtaccac

SEQ ID NO: 53497 - DNA, 15 bp, Artificial Sequence
  dgRNA
  Grid2ip
tacagtccggattgg

SEQ ID NO: 53498 - DNA, 15 bp, Artificial Sequence
  dgRNA
  Grid2ip
cggcttgctgaaagc

SEQ ID NO: 53499 - DNA, 15 bp, Artificial Sequence
  dgRNA
  Grid2ip
atgacaccaccaatc

SEQ ID NO: 53500 - DNA, 15 bp, Artificial Sequence
  dgRNA
  Grid2ip
actaagacggggggt

SEQ ID NO: 53501 - DNA, 15 bp, Artificial Sequence
  dgRNA
  Sat2
gaagcttaagtagtc

SEQ ID NO: 53502 - DNA, 15 bp, Artificial Sequence
  dgRNA
  Sat2
gcagagtccagtcac

SEQ ID NO: 53503 - DNA, 15 bp, Artificial Sequence
  dgRNA
  Sat2
ctggacagcgaggcg

SEQ ID NO: 53504 - DNA, 15 bp, Artificial Sequence
  dgRNA
  Sat2
gacagcgaggcgagg

SEQ ID NO: 53505 - DNA, 15 bp, Artificial Sequence
  dgRNA
  Calm3
ctcatttccgccacg

SEQ ID NO: 53506 - DNA, 15 bp, Artificial Sequence
  dgRNA
  Calm3
atttccgccacgagg

SEQ ID NO: 53507 - DNA, 15 bp, Artificial Sequence
  dgRNA
  Calm3
tttccgccacgaggc

SEQ ID NO: 53508 - DNA, 15 bp, Artificial Sequence
  dgRNA
  Calm3
aggcgggtccaatag

SEQ ID NO: 53509 - DNA, 15 bp, Artificial Sequence
  dgRNA
  Hypm
gtttcctcaaaatcg

SEQ ID NO: 53510 - DNA, 15 bp, Artificial Sequence
  dgRNA
  Hypm
cctcaaaatcgaggt

SEQ ID NO: 53511 - DNA, 15 bp, Artificial Sequence
  dgRNA
  Hypm
ctcaaaatcgaggta

SEQ ID NO: 53512 - DNA, 15 bp, Artificial Sequence
  dgRNA
  Hypm
aaaatcgaggtaggg

SEQ ID NO: 53513 - DNA, 15 bp, Artificial Sequence
  dgRNA
  Angptl2
ccaggccgccaaagc

SEQ ID NO: 53514 - DNA, 15 bp, Artificial Sequence
  dgRNA
  Angptl2
gccgccaaagcaggc

SEQ ID NO: 53515 - DNA, 15 bp, Artificial Sequence
  dgRNA
  Angptl2
tagtgtgacatcacc

SEQ ID NO: 53516 - DNA, 15 bp, Artificial Sequence
  dgRNA
  Angptl2
gggatcctcttgcac

SEQ ID NO: 53517 - DNA, 15 bp, Artificial Sequence
  dgRNA
  Phactr3
tcaagctactagtcc

SEQ ID NO: 53518 - DNA, 15 bp, Artificial Sequence
  dgRNA
  Phactr3
caagctactagtcca

SEQ ID NO: 53519 - DNA, 15 bp, Artificial Sequence
  dgRNA
  Phactr3
tacgtaattaacccc

SEQ ID NO: 53520 - DNA, 15 bp, Artificial Sequence
  dgRNA
  Phactr3
atctcctgaccagac

SEQ ID NO: 53521 - DNA, 15 bp, Artificial Sequence
  dgRNA
  Olfr492
tgatggcgacagaac

SEQ ID NO: 53522 - DNA, 15 bp, Artificial Sequence
  dgRNA
  Pla2g4c
ggctaatgtgcctta

SEQ ID NO: 53523 - DNA, 15 bp, Artificial Sequence
  dgRNA
  Pla2g4c
taaggactattcatc

SEQ ID NO: 53524 - DNA, 15 bp, Artificial Sequence
  dgRNA
  Pla2g4c
aaggactattcatct

SEQ ID NO: 53525 - DNA, 15 bp, Artificial Sequence
  dgRNA
  Pla2g4c
gtaactaggtccttg

SEQ ID NO: 53526 - DNA, 15 bp, Artificial Sequence
  dgRNA
  Pdzd9
ccttgcagcgccccc

SEQ ID NO: 53527 - DNA, 15 bp, Artificial Sequence
  dgRNA
  Pdzd9
ggccattcgaagaga

SEQ ID NO: 53528 - DNA, 15 bp, Artificial Sequence
  dgRNA
  Pdzd9
attcgaagagatgga

SEQ ID NO: 53529 - DNA, 15 bp, Artificial Sequence
  dgRNA
  Pdzd9
gagatggacggatcg

SEQ ID NO: 53530 - DNA, 15 bp, Artificial Sequence
  dgRNA
  Gm2a
cgccccttcctccgc

SEQ ID NO: 53531 - DNA, 15 bp, Artificial Sequence
  dgRNA
  Gm2a
tgcagtaggccgttg

SEQ ID NO: 53532 - DNA, 15 bp, Artificial Sequence
  dgRNA
  Gm2a
gcagtaggccgttga

SEQ ID NO: 53533 - DNA, 15 bp, Artificial Sequence
  dgRNA
  Gm2a
gtaggccgttgaggg

SEQ ID NO: 53534 - DNA, 15 bp, Artificial Sequence
  dgRNA
  Ebi3
gggtgagattgtaag

SEQ ID NO: 53535 - DNA, 15 bp, Artificial Sequence
  dgRNA
  Ebi3
attgtaagtggtgag

SEQ ID NO: 53536 - DNA, 15 bp, Artificial Sequence
  dgRNA
  Ebi3
ctggggcttccccgt

SEQ ID NO: 53537 - DNA, 15 bp, Artificial Sequence
  dgRNA
  Ebi3
ccgttggccatcagc

SEQ ID NO: 53538 - DNA, 15 bp, Artificial Sequence
  dgRNA
  Atp13a3
tgttctcgccctgcc

SEQ ID NO: 53539 - DNA, 15 bp, Artificial Sequence
  dgRNA
  Atp13a3
cccgggcgccgacag

SEQ ID NO: 53540 - DNA, 15 bp, Artificial Sequence
  dgRNA
  Atp13a3
gccgacagcggagcg

SEQ ID NO: 53541 - DNA, 15 bp, Artificial Sequence
  dgRNA
  Atp13a3
ggacgcccctgagcc

SEQ ID NO: 53542 - DNA, 15 bp, Artificial Sequence
  dgRNA
  Pla2g4a
ttcatgcacacccct

SEQ ID NO: 53543 - DNA, 15 bp, Artificial Sequence
  dgRNA
  Pla2g4a
attttctgactcgaa

SEQ ID NO: 53544 - DNA, 15 bp, Artificial Sequence
  dgRNA
  Pla2g4a
gttagtcttcaccag

SEQ ID NO: 53545 - DNA, 15 bp, Artificial Sequence
  dgRNA
  Pla2g4a
aacatgtgacctaac

SEQ ID NO: 53546 - DNA, 15 bp, Artificial Sequence
  dgRNA
  Hs3st3b1
gttccgagagacgat

SEQ ID NO: 53547 - DNA, 15 bp, Artificial Sequence
  dgRNA
  Hs3st3b1
ttggctgtttcgact

SEQ ID NO: 53548 - DNA, 15 bp, Artificial Sequence
  dgRNA
  Hs3st3b1
tggctgtttcgactt

SEQ ID NO: 53549 - DNA, 15 bp, Artificial Sequence
  dgRNA
  Hs3st3b1
gctgctcgcgcctcc

SEQ ID NO: 53550 - DNA, 15 bp, Artificial Sequence
  dgRNA
  Sgip1
cactagctgcatcca

SEQ ID NO: 53551 - DNA, 15 bp, Artificial Sequence
  dgRNA
  Sgip1
ccatggccggtcttt

SEQ ID NO: 53552 - DNA, 15 bp, Artificial Sequence
  dgRNA
  Sgip1
catggccggtctttc

SEQ ID NO: 53553 - DNA, 15 bp, Artificial Sequence
  dgRNA
  Sgip1
agcggcagctttgtg

SEQ ID NO: 53554 - DNA, 15 bp, Artificial Sequence
  dgRNA
  Zmat4
agtcctgcccgggac

SEQ ID NO: 53555 - DNA, 15 bp, Artificial Sequence
  dgRNA
  Zmat4
gccaatcacaagagc

SEQ ID NO: 53556 - DNA, 15 bp, Artificial Sequence
  dgRNA
  Zmat4
catcgctagcacagt

SEQ ID NO: 53557 - DNA, 15 bp, Artificial Sequence
  dgRNA
  Zmat4
ggttctcctcccgcc

SEQ ID NO: 53558 - DNA, 15 bp, Artificial Sequence
  dgRNA
  Mboat7
ctccgtcatcccgtc

SEQ ID NO: 53559 - DNA, 15 bp, Artificial Sequence
  dgRNA
  Mboat7
tccggtctgcacaaa

SEQ ID NO: 53560 - DNA, 15 bp, Artificial Sequence
  dgRNA
  Mboat7
ccggtctgcacaaat

SEQ ID NO: 53561 - DNA, 15 bp, Artificial Sequence
  dgRNA
  Mboat7
caaatgggaccttga

SEQ ID NO: 53562 - DNA, 15 bp, Artificial Sequence
  dgRNA
  Snap91
ccgccgtcgcccgcc

SEQ ID NO: 53563 - DNA, 15 bp, Artificial Sequence
  dgRNA
  Snap91
cgccgtcgcccgcca

SEQ ID NO: 53564 - DNA, 15 bp, Artificial Sequence
  dgRNA
  Snap91
agggatgctcgcgtg

SEQ ID NO: 53565 - DNA, 15 bp, Artificial Sequence
  dgRNA
  Snap91
tcccgtttaaagccg

SEQ ID NO: 53566 - DNA, 15 bp, Artificial Sequence
  dgRNA
  1700020A23Rik
ggtgcagagaattac

SEQ ID NO: 53567 - DNA, 15 bp, Artificial Sequence
  dgRNA
  1700020A23Rik
cctgtccttaattca

SEQ ID NO: 53568 - DNA, 15 bp, Artificial Sequence
  dgRNA
  1700020A23Rik
actggtggcctaggt

SEQ ID NO: 53569 - DNA, 15 bp, Artificial Sequence
  dgRNA
  1700020A23Rik
ccttgaattaaggac

SEQ ID NO: 53570 - DNA, 15 bp, Artificial Sequence
  dgRNA
  Trem2
cctggctacagcgtc

SEQ ID NO: 53571 - DNA, 15 bp, Artificial Sequence
  dgRNA
  Trem2
ctggctacagcgtca

SEQ ID NO: 53572 - DNA, 15 bp, Artificial Sequence
  dgRNA
  Trem2
cctgacgctgtagcc

SEQ ID NO: 53573 - DNA, 15 bp, Artificial Sequence
  dgRNA
  Trem2
agcctcatttgaggg

SEQ ID NO: 53574 - DNA, 15 bp, Artificial Sequence
  dgRNA
  Ifngr1
taagagattgcgtat

SEQ ID NO: 53575 - DNA, 15 bp, Artificial Sequence
  dgRNA
  Ifngr1
ttggtcccgcctctc

SEQ ID NO: 53576 - DNA, 15 bp, Artificial Sequence
  dgRNA
  Ifngr1
accctttgccccgtg

SEQ ID NO: 53577 - DNA, 15 bp, Artificial Sequence
  dgRNA
  Ifngr1
acgcccctcagtccc

SEQ ID NO: 53578 - DNA, 15 bp, Artificial Sequence
  dgRNA
  Vdac1
cagcctcggcgactc

SEQ ID NO: 53579 - DNA, 15 bp, Artificial Sequence
  dgRNA
  Vdac1
cgacactatccgctg

SEQ ID NO: 53580 - DNA, 15 bp, Artificial Sequence
  dgRNA
  Vdac1
tccgctgaggtccct

SEQ ID NO: 53581 - DNA, 15 bp, Artificial Sequence
  dgRNA
  Vdac1
caccgctctgtgtgc

SEQ ID NO: 53582 - DNA, 15 bp, Artificial Sequence
  dgRNA
  2210016F16Rik
ctgagcggccctccg

SEQ ID NO: 53583 - DNA, 15 bp, Artificial Sequence
  dgRNA
  2210016F16Rik
cgaggcacctagcct

SEQ ID NO: 53584 - DNA, 15 bp, Artificial Sequence
  dgRNA
  2210016F16Rik
aggcacctagcctcg

SEQ ID NO: 53585 - DNA, 15 bp, Artificial Sequence
  dgRNA
  2210016F16Rik
gcctcggggtggcgc

SEQ ID NO: 53586 - DNA, 15 bp, Artificial Sequence
  dgRNA
  Fam101a
ggctcagctggcggc

SEQ ID NO: 53587 - DNA, 15 bp, Artificial Sequence
  dgRNA
  Fam101a
ccgtggtgctgactt

SEQ ID NO: 53588 - DNA, 15 bp, Artificial Sequence
  dgRNA
  Fam101a
tcgctcccgcccccc

SEQ ID NO: 53589 - DNA, 15 bp, Artificial Sequence
  dgRNA
  Rab27a
ctttcagaaggggcg

SEQ ID NO: 53590 - DNA, 15 bp, Artificial Sequence
  dgRNA
  Rab27a
gacccgatccgtgcc

SEQ ID NO: 53591 - DNA, 15 bp, Artificial Sequence
  dgRNA
  Rab27a
gatccgtgccaggcg

SEQ ID NO: 53592 - DNA, 15 bp, Artificial Sequence
  dgRNA
  Rab27a
gagcagtcgtttctg

SEQ ID NO: 53593 - DNA, 15 bp, Artificial Sequence
  dgRNA
  Setd2
gggtgcgcgtcgctt

SEQ ID NO: 53594 - DNA, 15 bp, Artificial Sequence
  dgRNA
  Setd2
ggtgcgcgtcgcttc

SEQ ID NO: 53595 - DNA, 15 bp, Artificial Sequence
  dgRNA
  Setd2
gcgggcggttgctgg

SEQ ID NO: 53596 - DNA, 15 bp, Artificial Sequence
  dgRNA
  Setd2
cgggcggttgctgga

SEQ ID NO: 53597 - DNA, 15 bp, Artificial Sequence
  dgRNA
  Fgd5
taagcccagactgac

SEQ ID NO: 53598 - DNA, 15 bp, Artificial Sequence
  dgRNA
  Fgd5
cggcaaatgcagcaa

SEQ ID NO: 53599 - DNA, 15 bp, Artificial Sequence
  dgRNA
  Fgd5
ggcaaatgcagcaat

SEQ ID NO: 53600 - DNA, 15 bp, Artificial Sequence
  dgRNA
  Fgd5
ccggggcctgtacga

SEQ ID NO: 53601 - DNA, 15 bp, Artificial Sequence
  dgRNA
  Pde3b
atgcgcatcctgacg

SEQ ID NO: 53602 - DNA, 15 bp, Artificial Sequence
  dgRNA
  Pde3b
tgcgcatcctgacgc

SEQ ID NO: 53603 - DNA, 15 bp, Artificial Sequence
  dgRNA
  Pde3b
tcctgacgcgggccg

SEQ ID NO: 53604 - DNA, 15 bp, Artificial Sequence
  dgRNA
  Pde3b
ccgcggccgccccag

SEQ ID NO: 53605 - DNA, 15 bp, Artificial Sequence
  dgRNA
  Epcam
gtagggcccacctgc

SEQ ID NO: 53606 - DNA, 15 bp, Artificial Sequence
  dgRNA
  Epcam
ttatcccaccggtat

SEQ ID NO: 53607 - DNA, 15 bp, Artificial Sequence
  dgRNA
  Epcam
ccggtatcggcctat

SEQ ID NO: 53608 - DNA, 15 bp, Artificial Sequence
  dgRNA
  Epcam
ctgaccaacccaaac

SEQ ID NO: 53609 - DNA, 15 bp, Artificial Sequence
  dgRNA
  Rab3il1
tggaccaaaagtgca

SEQ ID NO: 53610 - DNA, 15 bp, Artificial Sequence
  dgRNA
  Rab3il1
tcccgttcactctgg

SEQ ID NO: 53611 - DNA, 15 bp, Artificial Sequence
  dgRNA
  Rab3il1
cccgttcactctggc

SEQ ID NO: 53612 - DNA, 15 bp, Artificial Sequence
  dgRNA
  Rab3il1
cgggtcattgtcccc

SEQ ID NO: 53613 - DNA, 15 bp, Artificial Sequence
  dgRNA
  Timeless
gggtagtaggatagc

SEQ ID NO: 53614 - DNA, 15 bp, Artificial Sequence
  dgRNA
  Timeless
ggagatagcatcaac

SEQ ID NO: 53615 - DNA, 15 bp, Artificial Sequence
  dgRNA
  Timeless
tcaaccggtgcatct

SEQ ID NO: 53616 - DNA, 15 bp, Artificial Sequence
  dgRNA
  Timeless
tcagggcttaaagcc

SEQ ID NO: 53617 - DNA, 15 bp, Artificial Sequence
  dgRNA
  Ift81
gtagacggttcgcaa

SEQ ID NO: 53618 - DNA, 15 bp, Artificial Sequence
  dgRNA
  Ift81
gaggttcggaacccc

SEQ ID NO: 53619 - DNA, 15 bp, Artificial Sequence
  dgRNA
  Ift81
aagctttccagcccg

SEQ ID NO: 53620 - DNA, 15 bp, Artificial Sequence
  dgRNA
  Ift81
tcctccccgagccag

SEQ ID NO: 53621 - DNA, 15 bp, Artificial Sequence
  dgRNA
  Izumo1r
ctgttaagacatccc

SEQ ID NO: 53622 - DNA, 15 bp, Artificial Sequence
  dgRNA
  Izumo1r
tgttaagacatccct

SEQ ID NO: 53623 - DNA, 15 bp, Artificial Sequence
  dgRNA
  Izumo1r
ctgtccggcggggtg

SEQ ID NO: 53624 - DNA, 15 bp, Artificial Sequence
  dgRNA
  Izumo1r
tctgtccggcggggt

SEQ ID NO: 53625 - DNA, 15 bp, Artificial Sequence
  dgRNA
  Mfsd7a
caagttacctctaaa

SEQ ID NO: 53626 - DNA, 15 bp, Artificial Sequence
  dgRNA
  Mfsd7a
cacgttcgcagtggt

SEQ ID NO: 53627 - DNA, 15 bp, Artificial Sequence
  dgRNA
  Mfsd7a
ggaacacgttcgcag

SEQ ID NO: 53628 - DNA, 15 bp, Artificial Sequence
  dgRNA
  Mfsd7a
tgtgtggcctgtact

SEQ ID NO: 53629 - DNA, 15 bp, Artificial Sequence
  dgRNA
  Ace2
attaactaaatgtcc

SEQ ID NO: 53630 - DNA, 15 bp, Artificial Sequence
  dgRNA
  Ace2
ctgttaaagatacac

SEQ ID NO: 53631 - DNA, 15 bp, Artificial Sequence
  dgRNA
  Gns
gcctaaccagtggcg

SEQ ID NO: 53632 - DNA, 15 bp, Artificial Sequence
  dgRNA
  Gns
accagtggcgaggcc

SEQ ID NO: 53633 - DNA, 15 bp, Artificial Sequence
  dgRNA
  Gns
aggccaggctccgcg

SEQ ID NO: 53634 - DNA, 15 bp, Artificial Sequence
  dgRNA
  Gns
tctccgccgctcccc

SEQ ID NO: 53635 - DNA, 15 bp, Artificial Sequence
  dgRNA
  Olfr629
gcaagtttaataata

SEQ ID NO: 53636 - DNA, 15 bp, Artificial Sequence
  dgRNA
  Cirbp
cctcctagtcgctag

SEQ ID NO: 53637 - DNA, 15 bp, Artificial Sequence
  dgRNA
  Cirbp
ctcctagtcgctagc

SEQ ID NO: 53638 - DNA, 15 bp, Artificial Sequence
  dgRNA
  Cirbp
ctagtcgctagcggg

SEQ ID NO: 53639 - DNA, 15 bp, Artificial Sequence
  dgRNA
  Cirbp
tagtcgctagcgggc

SEQ ID NO: 53640 - DNA, 15 bp, Artificial Sequence
  dgRNA
  Bst1
tggggtccctccacg

SEQ ID NO: 53641 - DNA, 15 bp, Artificial Sequence
  dgRNA
  Bst1
gaggcgtcttttgcc

SEQ ID NO: 53642 - DNA, 15 bp, Artificial Sequence
  dgRNA
  Bst1
taatttctgtcgtaa

SEQ ID NO: 53643 - DNA, 15 bp, Artificial Sequence
  dgRNA
  Bst1
ctgtcgtaatggaag

SEQ ID NO: 53644 - DNA, 15 bp, Artificial Sequence
  dgRNA
  Igtp
tctatacctggaatc

SEQ ID NO: 53645 - DNA, 15 bp, Artificial Sequence
  dgRNA
  Igtp
agctgttcgggcatc

SEQ ID NO: 53646 - DNA, 15 bp, Artificial Sequence
  dgRNA
  Igtp
actgggccagattcc

SEQ ID NO: 53647 - DNA, 15 bp, Artificial Sequence
  dgRNA
  Slitrk5
aataaacaagtgccg

SEQ ID NO: 53648 - DNA, 15 bp, Artificial Sequence
  dgRNA
  Slitrk5
acaagtgccgcggac

SEQ ID NO: 53649 - DNA, 15 bp, Artificial Sequence
  dgRNA
  Slitrk5
caagtgccgcggacc

SEQ ID NO: 53650 - DNA, 15 bp, Artificial Sequence
  dgRNA
  Slitrk5
ttattgtcgcgccgc

SEQ ID NO: 53651 - DNA, 15 bp, Artificial Sequence
  dgRNA
  Tomm7
cagggagcccctatc

SEQ ID NO: 53652 - DNA, 15 bp, Artificial Sequence
  dgRNA
  Tomm7
caacaaaaacgaggc

SEQ ID NO: 53653 - DNA, 15 bp, Artificial Sequence
  dgRNA
  Tomm7
agcagtgaacccgca

SEQ ID NO: 53654 - DNA, 15 bp, Artificial Sequence
  dgRNA
  Tomm7
agtgaacccgcaagg

SEQ ID NO: 53655 - DNA, 15 bp, Artificial Sequence
  dgRNA
  Herpud1
gagggcaccctgaca

SEQ ID NO: 53656 - DNA, 15 bp, Artificial Sequence
  dgRNA
  Herpud1
ctcccgcgccgctgt

SEQ ID NO: 53657 - DNA, 15 bp, Artificial Sequence
  dgRNA
  Herpud1
tcccgcgccgctgtc

SEQ ID NO: 53658 - DNA, 15 bp, Artificial Sequence
  dgRNA
  Herpud1
aggatgacgcaacca

SEQ ID NO: 53659 - DNA, 15 bp, Artificial Sequence
  dgRNA
  Pde4b
taaagaacacctagc

SEQ ID NO: 53660 - DNA, 15 bp, Artificial Sequence
  dgRNA
  Pde4b
aacacctagctggaa

SEQ ID NO: 53661 - DNA, 15 bp, Artificial Sequence
  dgRNA
  Pde4b
cacctagctggaacg

SEQ ID NO: 53662 - DNA, 15 bp, Artificial Sequence
  dgRNA
  Pde4b
acctagctggaacgg

SEQ ID NO: 53663 - DNA, 15 bp, Artificial Sequence
  dgRNA
  Gzmd
gctaagctggaataa

SEQ ID NO: 53664 - DNA, 15 bp, Artificial Sequence
  dgRNA
  Gpr19
agatcagagccaatc

SEQ ID NO: 53665 - DNA, 15 bp, Artificial Sequence
  dgRNA
  Gpr19
cggatcatgtggctt

SEQ ID NO: 53666 - DNA, 15 bp, Artificial Sequence
  dgRNA
  Gpr19
acggatcatgtggct

SEQ ID NO: 53667 - DNA, 15 bp, Artificial Sequence
  dgRNA
  Gpr19
gggaaacggatcatg

SEQ ID NO: 53668 - DNA, 15 bp, Artificial Sequence
  dgRNA
  Zfp280d
gagcgcggacgcgcg

SEQ ID NO: 53669 - DNA, 15 bp, Artificial Sequence
  dgRNA
  Zfp280d
cgcgcgaggccaacc

SEQ ID NO: 53670 - DNA, 15 bp, Artificial Sequence
  dgRNA
  Zfp280d
cggagcctacccatg

SEQ ID NO: 53671 - DNA, 15 bp, Artificial Sequence
  dgRNA
  Zfp280d
tgaggcactgcgccc

SEQ ID NO: 53672 - DNA, 15 bp, Artificial Sequence
  dgRNA
  Max
ctcgctgccaacacc

SEQ ID NO: 53673 - DNA, 15 bp, Artificial Sequence
  dgRNA
  Max
tcgctgccaacaccc

SEQ ID NO: 53674 - DNA, 15 bp, Artificial Sequence
  dgRNA
  Max
caacacccggggcgc

SEQ ID NO: 53675 - DNA, 15 bp, Artificial Sequence
  dgRNA
  Max
gtcaacaagcgagtc

SEQ ID NO: 53676 - DNA, 15 bp, Artificial Sequence
  dgRNA
  Abhd18
cggaccggcagccta

SEQ ID NO: 53677 - DNA, 15 bp, Artificial Sequence
  dgRNA
  Abhd18
ggaccggcagcctaa

SEQ ID NO: 53678 - DNA, 15 bp, Artificial Sequence
  dgRNA
  Abhd18
gaagtgtgaagcgtg

SEQ ID NO: 53679 - DNA, 15 bp, Artificial Sequence
  dgRNA
  Abhd18
gcgtgtgggccctgc

SEQ ID NO: 53680 - DNA, 15 bp, Artificial Sequence
  dgRNA
  Ggn
ttctaagggtgatcc

SEQ ID NO: 53681 - DNA, 15 bp, Artificial Sequence
  dgRNA
  Ggn
gtgatccaggtttga

SEQ ID NO: 53682 - DNA, 15 bp, Artificial Sequence
  dgRNA
  Ggn
tgatccaggtttgaa

SEQ ID NO: 53683 - DNA, 15 bp, Artificial Sequence
  dgRNA
  Ggn
gggctgcactcaagc

SEQ ID NO: 53684 - DNA, 15 bp, Artificial Sequence
  dgRNA
  1700123I01Rik
taggtgttcttgcgc

SEQ ID NO: 53685 - DNA, 15 bp, Artificial Sequence
  dgRNA
  1700123I01Rik
aaatctgcgcgtgcg

SEQ ID NO: 53686 - DNA, 15 bp, Artificial Sequence
  dgRNA
  1700123I01Rik
tctgcgcgtgcgcgg

SEQ ID NO: 53687 - DNA, 15 bp, Artificial Sequence
  dgRNA
  1700123I01Rik
cgtgcgcggaggatt

SEQ ID NO: 53688 - DNA, 15 bp, Artificial Sequence
  dgRNA
  Syce2
caaactgtagatcga

SEQ ID NO: 53689 - DNA, 15 bp, Artificial Sequence
  dgRNA
  Syce2
aaactgtagatcgaa

SEQ ID NO: 53690 - DNA, 15 bp, Artificial Sequence
  dgRNA
  Syce2
aactgtagatcgaag

SEQ ID NO: 53691 - DNA, 15 bp, Artificial Sequence
  dgRNA
  Syce2
tgtagatcgaagggg

SEQ ID NO: 53692 - DNA, 15 bp, Artificial Sequence
  dgRNA
  Map7d1
agcgtgcccccagct

SEQ ID NO: 53693 - DNA, 15 bp, Artificial Sequence
  dgRNA
  Map7d1
tcggcgtccgccctg

SEQ ID NO: 53694 - DNA, 15 bp, Artificial Sequence
  dgRNA
  Map7d1
tgcggcgaccacaga

SEQ ID NO: 53695 - DNA, 15 bp, Artificial Sequence
  dgRNA
  Map7d1
agcatcgtgaagttc

SEQ ID NO: 53696 - DNA, 15 bp, Artificial Sequence
  dgRNA
  Rin1
tggtcctcccttagc

SEQ ID NO: 53697 - DNA, 15 bp, Artificial Sequence
  dgRNA
  Rin1
ggtcctcccttagcc

SEQ ID NO: 53698 - DNA, 15 bp, Artificial Sequence
  dgRNA
  Rin1
gtcctcccttagccg

SEQ ID NO: 53699 - DNA, 15 bp, Artificial Sequence
  dgRNA
  Rin1
atgatgacactggca

SEQ ID NO: 53700 - DNA, 15 bp, Artificial Sequence
  dgRNA
  Scgb2b12
aggcatatttgcgga

SEQ ID NO: 53701 - DNA, 15 bp, Artificial Sequence
  dgRNA
  Scgb2b12
ggcatatttgcggat

SEQ ID NO: 53702 - DNA, 15 bp, Artificial Sequence
  dgRNA
  Scgb2b12
atttgcggatgggtg

SEQ ID NO: 53703 - DNA, 15 bp, Artificial Sequence
  dgRNA
  Scgb2b12
cgcaaatatgccttc

SEQ ID NO: 53704 - DNA, 15 bp, Artificial Sequence
  dgRNA
  Olfr119
gaattattgcctcag

SEQ ID NO: 53705 - DNA, 15 bp, Artificial Sequence
  dgRNA
  Olfr119
atgatagatacacta

SEQ ID NO: 53706 - DNA, 15 bp, Artificial Sequence
  dgRNA
  Mettl8
ccttttccgccccta

SEQ ID NO: 53707 - DNA, 15 bp, Artificial Sequence
  dgRNA
  Mettl8
ccgtcaggcagagcg

SEQ ID NO: 53708 - DNA, 15 bp, Artificial Sequence
  dgRNA
  Mettl8
cgtcaggcagagcga

SEQ ID NO: 53709 - DNA, 15 bp, Artificial Sequence
  dgRNA
  Mettl8
tctcctggccctaat

SEQ ID NO: 53710 - DNA, 15 bp, Artificial Sequence
  dgRNA
  Try10
tagggacatgtgata

SEQ ID NO: 53711 - DNA, 15 bp, Artificial Sequence
  dgRNA
  Armcx3
tcctgttttggtaat

SEQ ID NO: 53712 - DNA, 15 bp, Artificial Sequence
  dgRNA
  Armcx3
taacaaggcctagta

SEQ ID NO: 53713 - DNA, 15 bp, Artificial Sequence
  dgRNA
  Armcx3
aacaaggcctagtat

SEQ ID NO: 53714 - DNA, 15 bp, Artificial Sequence
  dgRNA
  Armcx3
acaaggcctagtatg

SEQ ID NO: 53715 - DNA, 15 bp, Artificial Sequence
  dgRNA
  Zfp820
tctaccaaaatgttt

SEQ ID NO: 53716 - DNA, 15 bp, Artificial Sequence
  dgRNA
  Zfp820
cagcccgaaggatcc

SEQ ID NO: 53717 - DNA, 15 bp, Artificial Sequence
  dgRNA
  Zfp820
cgttttgctacgttt

SEQ ID NO: 53718 - DNA, 15 bp, Artificial Sequence
  dgRNA
  Zfp820
agtatccctgctccg

SEQ ID NO: 53719 - DNA, 15 bp, Artificial Sequence
  dgRNA
  Slamf1
ataaatgagcaatcc

SEQ ID NO: 53720 - DNA, 15 bp, Artificial Sequence
  dgRNA
  Slamf1
aaacccggttgagac

SEQ ID NO: 53721 - DNA, 15 bp, Artificial Sequence
  dgRNA
  Slamf1
tgctcatttatgatc

SEQ ID NO: 53722 - DNA, 15 bp, Artificial Sequence
  dgRNA
  Ap2b1
gcgacagacacgacc

SEQ ID NO: 53723 - DNA, 15 bp, Artificial Sequence
  dgRNA
  Ap2b1
cacgacctggccgtt

SEQ ID NO: 53724 - DNA, 15 bp, Artificial Sequence
  dgRNA
  Ap2b1
cacccagatgacgtc

SEQ ID NO: 53725 - DNA, 15 bp, Artificial Sequence
  dgRNA
  Ap2b1
ccagatgacgtcagg

SEQ ID NO: 53726 - DNA, 15 bp, Artificial Sequence
  dgRNA
  2-Mar
ggttgaagagtcatg

SEQ ID NO: 53727 - DNA, 15 bp, Artificial Sequence
  dgRNA
  2-Mar
gagggatcactttaa

SEQ ID NO: 53728 - DNA, 15 bp, Artificial Sequence
  dgRNA
  2-Mar
ggatcactttaaagg

SEQ ID NO: 53729 - DNA, 15 bp, Artificial Sequence
  dgRNA
  2-Mar
cgctgtcacccgcga

SEQ ID NO: 53730 - DNA, 15 bp, Artificial Sequence
  dgRNA
  Trim80
gtgagaacccataca

SEQ ID NO: 53731 - DNA, 15 bp, Artificial Sequence
  dgRNA
  Trim80
ctgtagtctgcccca

SEQ ID NO: 53732 - DNA, 15 bp, Artificial Sequence
  dgRNA
  Trim80
tgtagtctgccccat

SEQ ID NO: 53733 - DNA, 15 bp, Artificial Sequence
  dgRNA
  Trim80
catctatgtctctcg

SEQ ID NO: 53734 - DNA, 15 bp, Artificial Sequence
  dgRNA
  Ces4a
gcgctcttcagtcca

SEQ ID NO: 53735 - DNA, 15 bp, Artificial Sequence
  dgRNA
  Ces4a
cgctcttcagtccat

SEQ ID NO: 53736 - DNA, 15 bp, Artificial Sequence
  dgRNA
  Ces4a
tgagggctccagtct

SEQ ID NO: 53737 - DNA, 15 bp, Artificial Sequence
  dgRNA
  Ces4a
tggctcctactcaat

SEQ ID NO: 53738 - DNA, 15 bp, Artificial Sequence
  dgRNA
  2810408A11Rik
ggggtgtaacaataa

SEQ ID NO: 53739 - DNA, 15 bp, Artificial Sequence
  dgRNA
  2810408A11Rik
tgcggaggaactccc

SEQ ID NO: 53740 - DNA, 15 bp, Artificial Sequence
  dgRNA
  2810408A11Rik
tatcagacttcagcc

SEQ ID NO: 53741 - DNA, 15 bp, Artificial Sequence
  dgRNA
  Mafb
aggcctcaacggctt

SEQ ID NO: 53742 - DNA, 15 bp, Artificial Sequence
  dgRNA
  Mafb
ggcctcaacggcttc

SEQ ID NO: 53743 - DNA, 15 bp, Artificial Sequence
  dgRNA
  Mafb
gcctcaacggcttcg

SEQ ID NO: 53744 - DNA, 15 bp, Artificial Sequence
  dgRNA
  Mafb
tccagtcagctgacg

SEQ ID NO: 53745 - DNA, 15 bp, Artificial Sequence
  dgRNA
  Cfap77
atcactccgaagaac

SEQ ID NO: 53746 - DNA, 15 bp, Artificial Sequence
  dgRNA
  Cfap77
actccgaagaactgg

SEQ ID NO: 53747 - DNA, 15 bp, Artificial Sequence
  dgRNA
  Cfap77
ctccgaagaactggc

SEQ ID NO: 53748 - DNA, 15 bp, Artificial Sequence
  dgRNA
  Cfap77
tccgaagaactggcg

SEQ ID NO: 53749 - DNA, 15 bp, Artificial Sequence
  dgRNA
  Olfr1314
gtagcactgttcttc

SEQ ID NO: 53750 - DNA, 15 bp, Artificial Sequence
  dgRNA
  Clasp1
aacggtttaaaacct

SEQ ID NO: 53751 - DNA, 15 bp, Artificial Sequence
  dgRNA
  Clasp1
cttgtacgcatattc

SEQ ID NO: 53752 - DNA, 15 bp, Artificial Sequence
  dgRNA
  Clasp1
acgcgctgtcagcta

SEQ ID NO: 53753 - DNA, 15 bp, Artificial Sequence
  dgRNA
  Clasp1
cgcgctgtcagctac

SEQ ID NO: 53754 - DNA, 15 bp, Artificial Sequence
  dgRNA
  Luc7l2
gctcactctctaggg

SEQ ID NO: 53755 - DNA, 15 bp, Artificial Sequence
  dgRNA
  Luc7l2
gttcacgccgtcgtg

SEQ ID NO: 53756 - DNA, 15 bp, Artificial Sequence
  dgRNA
  Luc7l2
ccgactccctactcg

SEQ ID NO: 53757 - DNA, 15 bp, Artificial Sequence
  dgRNA
  Luc7l2
cgactccctactcgc

SEQ ID NO: 53758 - DNA, 15 bp, Artificial Sequence
  dgRNA
  Csnk1e
ccgagcgcagcgcag

SEQ ID NO: 53759 - DNA, 15 bp, Artificial Sequence
  dgRNA
  Csnk1e
cgagcgcagcgcagc

SEQ ID NO: 53760 - DNA, 15 bp, Artificial Sequence
  dgRNA
  Csnk1e
cgcagcgcagcgggc

SEQ ID NO: 53761 - DNA, 15 bp, Artificial Sequence
  dgRNA
  Csnk1e
gcagcgcagcgggcc

SEQ ID NO: 53762 - DNA, 15 bp, Artificial Sequence
  dgRNA
  Ncbp1
cgagcccacgccccc

SEQ ID NO: 53763 - DNA, 15 bp, Artificial Sequence
  dgRNA
  Ncbp1
gccgtcacctttctc

SEQ ID NO: 53764 - DNA, 15 bp, Artificial Sequence
  dgRNA
  Ncbp1
agtctcctaagtcgt

SEQ ID NO: 53765 - DNA, 15 bp, Artificial Sequence
  dgRNA
  Ncbp1
ctaagtcgtcggcgc

SEQ ID NO: 53766 - DNA, 15 bp, Artificial Sequence
  dgRNA
  Olfr93
ttgtggcaactaaac

SEQ ID NO: 53767 - DNA, 15 bp, Artificial Sequence
  dgRNA
  Olfr93
gacctacttggtgat

SEQ ID NO: 53768 - DNA, 15 bp, Artificial Sequence
  dgRNA
  Olfr93
tcatgacatgccagg

SEQ ID NO: 53769 - DNA, 15 bp, Artificial Sequence
  dgRNA
  Olfr93
ttgtcatgacatgcc

SEQ ID NO: 53770 - DNA, 15 bp, Artificial Sequence
  dgRNA
  Meis2
gttgcttgatgatga

SEQ ID NO: 53771 - DNA, 15 bp, Artificial Sequence
  dgRNA
  Meis2
ccagcgctgagcgag

SEQ ID NO: 53772 - DNA, 15 bp, Artificial Sequence
  dgRNA
  Meis2
cagcgctgagcgagc

SEQ ID NO: 53773 - DNA, 15 bp, Artificial Sequence
  dgRNA
  Meis2
cgctgagcgagcggg

SEQ ID NO: 53774 - DNA, 15 bp, Artificial Sequence
  dgRNA
  4933411K16Rik
agacctgatccttac

SEQ ID NO: 53775 - DNA, 15 bp, Artificial Sequence
  dgRNA
  4933411K16Rik
gagggcatcctaggg

SEQ ID NO: 53776 - DNA, 15 bp, Artificial Sequence
  dgRNA
  4933411K16Rik
atcctagggagggcg

SEQ ID NO: 53777 - DNA, 15 bp, Artificial Sequence
  dgRNA
  4933411K16Rik
ggcaagcttcctgta

SEQ ID NO: 53778 - DNA, 15 bp, Artificial Sequence
  dgRNA
  Gstt3
ctagagggattagct

SEQ ID NO: 53779 - DNA, 15 bp, Artificial Sequence
  dgRNA
  Gstt3
tagagggattagctg

SEQ ID NO: 53780 - DNA, 15 bp, Artificial Sequence
  dgRNA
  Gstt3
atcatttccctcacg

SEQ ID NO: 53781 - DNA, 15 bp, Artificial Sequence
  dgRNA
  Gstt3
ttccctcacggggtg

SEQ ID NO: 53782 - DNA, 15 bp, Artificial Sequence
  dgRNA
  BC029214
aagcggaagagcaca

SEQ ID NO: 53783 - DNA, 15 bp, Artificial Sequence
  dgRNA
  BC029214
gctcttccgcttttc

SEQ ID NO: 53784 - DNA, 15 bp, Artificial Sequence
  dgRNA
  BC029214
cgggaagcactcgga

SEQ ID NO: 53785 - DNA, 15 bp, Artificial Sequence
  dgRNA
  BC029214
gcgggaagcactcgg

SEQ ID NO: 53786 - DNA, 15 bp, Artificial Sequence
  dgRNA
  Myt1
gacatcgcctttagc

SEQ ID NO: 53787 - DNA, 15 bp, Artificial Sequence
  dgRNA
  Myt1
ggagttcgcacactg

SEQ ID NO: 53788 - DNA, 15 bp, Artificial Sequence
  dgRNA
  Myt1
gagttcgcacactga

SEQ ID NO: 53789 - DNA, 15 bp, Artificial Sequence
  dgRNA
  Myt1
agttcgcacactgag

SEQ ID NO: 53790 - DNA, 15 bp, Artificial Sequence
  dgRNA
  Hist1h1c
caaactcgagagatt

SEQ ID NO: 53791 - DNA, 15 bp, Artificial Sequence
  dgRNA
  Hist1h1c
aagttgggcgcagcg

SEQ ID NO: 53792 - DNA, 15 bp, Artificial Sequence
  dgRNA
  Hist1h1c
ctatatatacagcgc

SEQ ID NO: 53793 - DNA, 15 bp, Artificial Sequence
  dgRNA
  Hist1h1c
tatatatacagcgcc

SEQ ID NO: 53794 - DNA, 15 bp, Artificial Sequence
  dgRNA
  Rbbp9
gttgccaggacataa

SEQ ID NO: 53795 - DNA, 15 bp, Artificial Sequence
  dgRNA
  Rbbp9
agccagaaaatgcgt

SEQ ID NO: 53796 - DNA, 15 bp, Artificial Sequence
  dgRNA
  Rbbp9
aatgcgtaggcctgc

SEQ ID NO: 53797 - DNA, 15 bp, Artificial Sequence
  dgRNA
  Rbbp9
acatcccttatgtcc

SEQ ID NO: 53798 - DNA, 15 bp, Artificial Sequence
  dgRNA
  Csl
catgttccccactcg

SEQ ID NO: 53799 - DNA, 15 bp, Artificial Sequence
  dgRNA
  Csl
atgttccccactcgg

SEQ ID NO: 53800 - DNA, 15 bp, Artificial Sequence
  dgRNA
  Csl
ggcaccagtattcca

SEQ ID NO: 53801 - DNA, 15 bp, Artificial Sequence
  dgRNA
  Csl
caccagtattccaag

SEQ ID NO: 53802 - DNA, 15 bp, Artificial Sequence
  dgRNA
  Hspa12a
gcgctaatgacagca

SEQ ID NO: 53803 - DNA, 15 bp, Artificial Sequence
  dgRNA
  Hspa12a
cgctaatgacagcac

SEQ ID NO: 53804 - DNA, 15 bp, Artificial Sequence
  dgRNA
  Hspa12a
gctaatgacagcacg

SEQ ID NO: 53805 - DNA, 15 bp, Artificial Sequence
  dgRNA
  Hspa12a
cacggggtgtggcct

SEQ ID NO: 53806 - DNA, 15 bp, Artificial Sequence
  dgRNA
  Prdx6
agtccccgcaattct

SEQ ID NO: 53807 - DNA, 15 bp, Artificial Sequence
  dgRNA
  Prdx6
ccttcctattgcacg

SEQ ID NO: 53808 - DNA, 15 bp, Artificial Sequence
  dgRNA
  Prdx6
cagccgccagactcg

SEQ ID NO: 53809 - DNA, 15 bp, Artificial Sequence
  dgRNA
  Prdx6
ggggacttgtagatc

SEQ ID NO: 53810 - DNA, 15 bp, Artificial Sequence
  dgRNA
  Sprr2f
acaatgataatatcc

SEQ ID NO: 53811 - DNA, 15 bp, Artificial Sequence
  dgRNA
  Sprr2f
cacgccagtcatgca

SEQ ID NO: 53812 - DNA, 15 bp, Artificial Sequence
  dgRNA
  Sprr2f
ctgcccactatcagt

SEQ ID NO: 53813 - DNA, 15 bp, Artificial Sequence
  dgRNA
  Sprr2f
gttagttatataaag

SEQ ID NO: 53814 - DNA, 15 bp, Artificial Sequence
  dgRNA
  Dusp16
ccacactaccccccc

SEQ ID NO: 53815 - DNA, 15 bp, Artificial Sequence
  dgRNA
  Dusp16
gcgggcatcaccgtt

SEQ ID NO: 53816 - DNA, 15 bp, Artificial Sequence
  dgRNA
  Dusp16
cgggcatcaccgttt

SEQ ID NO: 53817 - DNA, 15 bp, Artificial Sequence
  dgRNA
  Dusp16
gggcatcaccgtttg

SEQ ID NO: 53818 - DNA, 15 bp, Artificial Sequence
  dgRNA
  Cptp
tcagacgcccggccg

SEQ ID NO: 53819 - DNA, 15 bp, Artificial Sequence
  dgRNA
  Cptp
ctccgcactgcgcgc

SEQ ID NO: 53820 - DNA, 15 bp, Artificial Sequence
  dgRNA
  Cptp
ttcctgccctcgcgc

SEQ ID NO: 53821 - DNA, 15 bp, Artificial Sequence
  dgRNA
  Cptp
tcgcgccggaaacgc

SEQ ID NO: 53822 - DNA, 15 bp, Artificial Sequence
  dgRNA
  Crxos
tgggcgcactgagca

SEQ ID NO: 53823 - DNA, 15 bp, Artificial Sequence
  dgRNA
  Crxos
ttgggcgcactgagc

SEQ ID NO: 53824 - DNA, 15 bp, Artificial Sequence
  dgRNA
  Smarcad1
tattagctctgtagc

SEQ ID NO: 53825 - DNA, 15 bp, Artificial Sequence
  dgRNA
  Smarcad1
gctctgtagccggcg

SEQ ID NO: 53826 - DNA, 15 bp, Artificial Sequence
  dgRNA
  Smarcad1
gccggcgcggtgaaa

SEQ ID NO: 53827 - DNA, 15 bp, Artificial Sequence
  dgRNA
  Smarcad1
tgaccacgcgacgct

SEQ ID NO: 53828 - DNA, 15 bp, Artificial Sequence
  dgRNA
  Gpr180
cgtaaacagcatccc

SEQ ID NO: 53829 - DNA, 15 bp, Artificial Sequence
  dgRNA
  Gpr180
ggctccatttaaaac

SEQ ID NO: 53830 - DNA, 15 bp, Artificial Sequence
  dgRNA
  Gpr180
cgggaattagcagca

SEQ ID NO: 53831 - DNA, 15 bp, Artificial Sequence
  dgRNA
  Gpr180
accacggccgatgat

SEQ ID NO: 53832 - DNA, 15 bp, Artificial Sequence
  dgRNA
  Cts7
tccacattacactaa

SEQ ID NO: 53833 - DNA, 15 bp, Artificial Sequence
  dgRNA
  Cts7
acccttatagccaat

SEQ ID NO: 53834 - DNA, 15 bp, Artificial Sequence
  dgRNA
  Cts7
tagccaattggtaga

SEQ ID NO: 53835 - DNA, 15 bp, Artificial Sequence
  dgRNA
  Cts7
tttaaactcatagtg

SEQ ID NO: 53836 - DNA, 15 bp, Artificial Sequence
  dgRNA
  Neurog3
aggagcgggctcgcg

SEQ ID NO: 53837 - DNA, 15 bp, Artificial Sequence
  dgRNA
  Neurog3
gcgtggcgcagcccc

SEQ ID NO: 53838 - DNA, 15 bp, Artificial Sequence
  dgRNA
  Neurog3
cgtggcgcagcccct

SEQ ID NO: 53839 - DNA, 15 bp, Artificial Sequence
  dgRNA
  Neurog3
attggcccgtggtgc

SEQ ID NO: 53840 - DNA, 15 bp, Artificial Sequence
  dgRNA
  Ptbp1
ttactctcacgttgg

SEQ ID NO: 53841 - DNA, 15 bp, Artificial Sequence
  dgRNA
  Ptbp1
tgcctgcttgcaata

SEQ ID NO: 53842 - DNA, 15 bp, Artificial Sequence
  dgRNA
  Ptbp1
tacccactctcaaga

SEQ ID NO: 53843 - DNA, 15 bp, Artificial Sequence
  dgRNA
  Ptbp1
caagatggcgtccca

SEQ ID NO: 53844 - DNA, 15 bp, Artificial Sequence
  dgRNA
  Plekha7
gtttttggcggtgca

SEQ ID NO: 53845 - DNA, 15 bp, Artificial Sequence
  dgRNA
  Plekha7
tcgtcacctacagcc

SEQ ID NO: 53846 - DNA, 15 bp, Artificial Sequence
  dgRNA
  Plekha7
tgggtgctcgctgca

SEQ ID NO: 53847 - DNA, 15 bp, Artificial Sequence
  dgRNA
  Plekha7
gggtgctcgctgcaa

SEQ ID NO: 53848 - DNA, 15 bp, Artificial Sequence
  dgRNA
  Xcl1
agcccctcgcaaccc

SEQ ID NO: 53849 - DNA, 15 bp, Artificial Sequence
  dgRNA
  Xcl1
gtgtgctgaccattg

SEQ ID NO: 53850 - DNA, 15 bp, Artificial Sequence
  dgRNA
  Xcl1
attgagggtaataaa

SEQ ID NO: 53851 - DNA, 15 bp, Artificial Sequence
  dgRNA
  Xcl1
aggggctttcggggt

SEQ ID NO: 53852 - DNA, 15 bp, Artificial Sequence
  dgRNA
  Ptcra
aggttatgagagggt

SEQ ID NO: 53853 - DNA, 15 bp, Artificial Sequence
  dgRNA
  Ptcra
tgaagagcacttcat

SEQ ID NO: 53854 - DNA, 15 bp, Artificial Sequence
  dgRNA
  Elavl3
tggcacgcagagtct

SEQ ID NO: 53855 - DNA, 15 bp, Artificial Sequence
  dgRNA
  Elavl3
cacctgccgcgccgt

SEQ ID NO: 53856 - DNA, 15 bp, Artificial Sequence
  dgRNA
  Elavl3
acctgccgcgccgtc

SEQ ID NO: 53857 - DNA, 15 bp, Artificial Sequence
  dgRNA
  Elavl3
gcgccgtcgggagcc

SEQ ID NO: 53858 - DNA, 15 bp, Artificial Sequence
  dgRNA
  Fbxo44
agtgcgcgggtgagg

SEQ ID NO: 53859 - DNA, 15 bp, Artificial Sequence
  dgRNA
  Fbxo44
gtgcgcgggtgaggc

SEQ ID NO: 53860 - DNA, 15 bp, Artificial Sequence
  dgRNA
  Fbxo44
tgcgcgggtgaggcg

SEQ ID NO: 53861 - DNA, 15 bp, Artificial Sequence
  dgRNA
  Fbxo44
atcgtgaaccaactc

SEQ ID NO: 53862 - DNA, 15 bp, Artificial Sequence
  dgRNA
  Fam114a1
ctccttacaacctgc

SEQ ID NO: 53863 - DNA, 15 bp, Artificial Sequence
  dgRNA
  Fam114a1
cccagtgcttcgtaa

SEQ ID NO: 53864 - DNA, 15 bp, Artificial Sequence
  dgRNA
  Fam114a1
ttcgtaatggaaggc

SEQ ID NO: 53865 - DNA, 15 bp, Artificial Sequence
  dgRNA
  Fam114a1
tcgtaatggaaggca

SEQ ID NO: 53866 - DNA, 15 bp, Artificial Sequence
  dgRNA
  Olfr988
tgattcaactcatgt

SEQ ID NO: 53867 - DNA, 15 bp, Artificial Sequence
  dgRNA
  Prl7d1
ttagttctatgtaca

SEQ ID NO: 53868 - DNA, 15 bp, Artificial Sequence
  dgRNA
  Gapdhs
cttgaaatcctatgt

SEQ ID NO: 53869 - DNA, 15 bp, Artificial Sequence
  dgRNA
  Gapdhs
atgtaggactctcta

SEQ ID NO: 53870 - DNA, 15 bp, Artificial Sequence
  dgRNA
  Gapdhs
taaggactctagagc

SEQ ID NO: 53871 - DNA, 15 bp, Artificial Sequence
  dgRNA
  Gapdhs
ttctggtatctagag

SEQ ID NO: 53872 - DNA, 15 bp, Artificial Sequence
  dgRNA
  Cxcl9
cccgtttatgtgaaa

SEQ ID NO: 53873 - DNA, 15 bp, Artificial Sequence
  dgRNA
  Cxcl9
aggacgatcaatttg

SEQ ID NO: 53874 - DNA, 15 bp, Artificial Sequence
  dgRNA
  Cxcl9
caatcagagacggga

SEQ ID NO: 53875 - DNA, 15 bp, Artificial Sequence
  dgRNA
  Cxcl9
gggagtttatagtaa

SEQ ID NO: 53876 - DNA, 15 bp, Artificial Sequence
  dgRNA
  Rell1
agtgggcggggctcg

SEQ ID NO: 53877 - DNA, 15 bp, Artificial Sequence
  dgRNA
  Rell1
gtggggccacggctt

SEQ ID NO: 53878 - DNA, 15 bp, Artificial Sequence
  dgRNA
  Rell1
cacggcttgggcgcg

SEQ ID NO: 53879 - DNA, 15 bp, Artificial Sequence
  dgRNA
  Rell1
ggctgacgcgaccca

SEQ ID NO: 53880 - DNA, 15 bp, Artificial Sequence
  dgRNA
  Trib1
gcgcgcaccaatcag

SEQ ID NO: 53881 - DNA, 15 bp, Artificial Sequence
  dgRNA
  Trib1
tcccgcccacttccc

SEQ ID NO: 53882 - DNA, 15 bp, Artificial Sequence
  dgRNA
  Trib1
gggaacctgacgtca

SEQ ID NO: 53883 - DNA, 15 bp, Artificial Sequence
  dgRNA
  Trib1
tgggctacgggcccg

SEQ ID NO: 53884 - DNA, 15 bp, Artificial Sequence
  dgRNA
  Abcb7
acaatggtagtctga

SEQ ID NO: 53885 - DNA, 15 bp, Artificial Sequence
  dgRNA
  Abcb7
aaaagcccgagtcac

SEQ ID NO: 53886 - DNA, 15 bp, Artificial Sequence
  dgRNA
  Abcb7
aagcccgagtcactg

SEQ ID NO: 53887 - DNA, 15 bp, Artificial Sequence
  dgRNA
  Abcb7
agcccgagtcactgg

SEQ ID NO: 53888 - DNA, 15 bp, Artificial Sequence
  dgRNA
  Tpm1
cgcgcagtggttcca

SEQ ID NO: 53889 - DNA, 15 bp, Artificial Sequence
  dgRNA
  Tpm1
gcgcagtggttccat

SEQ ID NO: 53890 - DNA, 15 bp, Artificial Sequence
  dgRNA
  Tpm1
gggcagctagttccc

SEQ ID NO: 53891 - DNA, 15 bp, Artificial Sequence
  dgRNA
  Tpm1
ggcagctagttcccg

SEQ ID NO: 53892 - DNA, 15 bp, Artificial Sequence
  dgRNA
  Fam124b
ttgtggtccaccaaa

SEQ ID NO: 53893 - DNA, 15 bp, Artificial Sequence
  dgRNA
  Fam124b
gtaagaaccacccac

SEQ ID NO: 53894 - DNA, 15 bp, Artificial Sequence
  dgRNA
  Fam124b
taagaaccacccact

SEQ ID NO: 53895 - DNA, 15 bp, Artificial Sequence
  dgRNA
  Fam124b
ccacccactgggcgt

SEQ ID NO: 53896 - DNA, 15 bp, Artificial Sequence
  dgRNA
  Nudc
cccgcccactgcctt

SEQ ID NO: 53897 - DNA, 15 bp, Artificial Sequence
  dgRNA
  Nudc
cctcggcttagccaa

SEQ ID NO: 53898 - DNA, 15 bp, Artificial Sequence
  dgRNA
  Nudc
aagcgggttgtgttc

SEQ ID NO: 53899 - DNA, 15 bp, Artificial Sequence
  dgRNA
  Nudc
agcgggttgtgttcc

SEQ ID NO: 53900 - DNA, 15 bp, Artificial Sequence
  dgRNA
  Rassf10
ggcagacccgtccgc

SEQ ID NO: 53901 - DNA, 15 bp, Artificial Sequence
  dgRNA
  Rassf10
gcagacccgtccgca

SEQ ID NO: 53902 - DNA, 15 bp, Artificial Sequence
  dgRNA
  Rassf10
acccgtccgcagggc

SEQ ID NO: 53903 - DNA, 15 bp, Artificial Sequence
  dgRNA
  Rassf10
cccgtccgcagggct

SEQ ID NO: 53904 - DNA, 15 bp, Artificial Sequence
  dgRNA
  Olfr771
ctgtttaccgctctc

SEQ ID NO: 53905 - DNA, 15 bp, Artificial Sequence
  dgRNA
  Pdzk1
tcacctgagtatggt

SEQ ID NO: 53906 - DNA, 15 bp, Artificial Sequence
  dgRNA
  Pdzk1
cctagttcttgctgt

SEQ ID NO: 53907 - DNA, 15 bp, Artificial Sequence
  dgRNA
  Pdzk1
gctcccacgtcttaa

SEQ ID NO: 53908 - DNA, 15 bp, Artificial Sequence
  dgRNA
  Pdzk1
aaggctacgtcacaa

SEQ ID NO: 53909 - DNA, 15 bp, Artificial Sequence
  dgRNA
  Trh
atagacctccggagc

SEQ ID NO: 53910 - DNA, 15 bp, Artificial Sequence
  dgRNA
  Trh
tagacctccggagca

SEQ ID NO: 53911 - DNA, 15 bp, Artificial Sequence
  dgRNA
  Trh
gcctcctcgctcgct

SEQ ID NO: 53912 - DNA, 15 bp, Artificial Sequence
  dgRNA
  Trh
cgctcggcccccacc

SEQ ID NO: 53913 - DNA, 15 bp, Artificial Sequence
  dgRNA
  Ckmt1
gttcgggaatccctg

SEQ ID NO: 53914 - DNA, 15 bp, Artificial Sequence
  dgRNA
  Ckmt1
gaccaccctcatcct

SEQ ID NO: 53915 - DNA, 15 bp, Artificial Sequence
  dgRNA
  Ckmt1
gtcttcttaattacc

SEQ ID NO: 53916 - DNA, 15 bp, Artificial Sequence
  dgRNA
  Ckmt1
cccgcacacctagcg

SEQ ID NO: 53917 - DNA, 15 bp, Artificial Sequence
  dgRNA
  Gabrb1
ttgcatagagacagc

SEQ ID NO: 53918 - DNA, 15 bp, Artificial Sequence
  dgRNA
  Gabrb1
actacccagagaacg

SEQ ID NO: 53919 - DNA, 15 bp, Artificial Sequence
  dgRNA
  Gabrb1
cggagcacctcagac

SEQ ID NO: 53920 - DNA, 15 bp, Artificial Sequence
  dgRNA
  Gabrb1
gttgcctgttccact

SEQ ID NO: 53921 - DNA, 15 bp, Artificial Sequence
  dgRNA
  Dap
aacgaaaccccgcgc

SEQ ID NO: 53922 - DNA, 15 bp, Artificial Sequence
  dgRNA
  Dap
acgaaaccccgcgct

SEQ ID NO: 53923 - DNA, 15 bp, Artificial Sequence
  dgRNA
  Dap
cgaaaccccgcgctg

SEQ ID NO: 53924 - DNA, 15 bp, Artificial Sequence
  dgRNA
  Dap
tctcgaaccaccagc

SEQ ID NO: 53925 - DNA, 15 bp, Artificial Sequence
  dgRNA
  Tiparp
gcgcgcccctccgtc

SEQ ID NO: 53926 - DNA, 15 bp, Artificial Sequence
  dgRNA
  Tiparp
tccggagcacgcgca

SEQ ID NO: 53927 - DNA, 15 bp, Artificial Sequence
  dgRNA
  Tiparp
ccggagcacgcgcac

SEQ ID NO: 53928 - DNA, 15 bp, Artificial Sequence
  dgRNA
  Tiparp
gagcacgcgcacggg

SEQ ID NO: 53929 - DNA, 15 bp, Artificial Sequence
  dgRNA
  Pold1
gggtagcatccactg

SEQ ID NO: 53930 - DNA, 15 bp, Artificial Sequence
  dgRNA
  Pold1
ctaacgctcctgcag

SEQ ID NO: 53931 - DNA, 15 bp, Artificial Sequence
  dgRNA
  Pold1
taacgctcctgcagt

SEQ ID NO: 53932 - DNA, 15 bp, Artificial Sequence
  dgRNA
  Pold1
tgcagtgggcgctcg

SEQ ID NO: 53933 - DNA, 15 bp, Artificial Sequence
  dgRNA
  Csnk1g2
caggatactcggtgc

SEQ ID NO: 53934 - DNA, 15 bp, Artificial Sequence
  dgRNA
  Csnk1g2
ctcgtgtgctacagc

SEQ ID NO: 53935 - DNA, 15 bp, Artificial Sequence
  dgRNA
  Csnk1g2
gcttgtccccttagg

SEQ ID NO: 53936 - DNA, 15 bp, Artificial Sequence
  dgRNA
  Csnk1g2
cttgtccccttaggc

SEQ ID NO: 53937 - DNA, 15 bp, Artificial Sequence
  dgRNA
  Pank2
cagagtgcctgtcgt

SEQ ID NO: 53938 - DNA, 15 bp, Artificial Sequence
  dgRNA
  Pank2
cctgtcgttggatgg

SEQ ID NO: 53939 - DNA, 15 bp, Artificial Sequence
  dgRNA
  Pank2
cgttggatggtggcg

SEQ ID NO: 53940 - DNA, 15 bp, Artificial Sequence
  dgRNA
  Pank2
gtggcgcggtctctt

SEQ ID NO: 53941 - DNA, 15 bp, Artificial Sequence
  dgRNA
  Gtf2h1
attaggttcttccgc

SEQ ID NO: 53942 - DNA, 15 bp, Artificial Sequence
  dgRNA
  Gtf2h1
ttaggttcttccgct

SEQ ID NO: 53943 - DNA, 15 bp, Artificial Sequence
  dgRNA
  Gtf2h1
ggttcttccgctggg

SEQ ID NO: 53944 - DNA, 15 bp, Artificial Sequence
  dgRNA
  Gtf2h1
gttcttccgctggga

SEQ ID NO: 53945 - DNA, 15 bp, Artificial Sequence
  dgRNA
  Fchsd1
gagctcccgaccgcc

SEQ ID NO: 53946 - DNA, 15 bp, Artificial Sequence
  dgRNA
  Fchsd1
cacgctgcgtccgcc

SEQ ID NO: 53947 - DNA, 15 bp, Artificial Sequence
  dgRNA
  Fchsd1
gctgcgtccgcccgg

SEQ ID NO: 53948 - DNA, 15 bp, Artificial Sequence
  dgRNA
  Fchsd1
gtccgcccggtggcc

SEQ ID NO: 53949 - DNA, 15 bp, Artificial Sequence
  dgRNA
  Gkn2
ttgcagagtgaccaa

SEQ ID NO: 53950 - DNA, 15 bp, Artificial Sequence
  dgRNA
  Gkn2
tgcagagtgaccaat

SEQ ID NO: 53951 - DNA, 15 bp, Artificial Sequence
  dgRNA
  Gkn2
gacttcactgatacc

SEQ ID NO: 53952 - DNA, 15 bp, Artificial Sequence
  dgRNA
  Gkn2
gtctcagtcctgata

SEQ ID NO: 53953 - DNA, 15 bp, Artificial Sequence
  dgRNA
  Tmed5
accccgcccaccacg

SEQ ID NO: 53954 - DNA, 15 bp, Artificial Sequence
  dgRNA
  Tmed5
ccccgcccaccacgc

SEQ ID NO: 53955 - DNA, 15 bp, Artificial Sequence
  dgRNA
  Tmed5
cccgcccaccacgcg

SEQ ID NO: 53956 - DNA, 15 bp, Artificial Sequence
  dgRNA
  Tmed5
gcggggctctgcgaa

SEQ ID NO: 53957 - DNA, 15 bp, Artificial Sequence
  dgRNA
  Tpm2
ccgcctgtcactcag

SEQ ID NO: 53958 - DNA, 15 bp, Artificial Sequence
  dgRNA
  Tpm2
gaagcgctgagcccc

SEQ ID NO: 53959 - DNA, 15 bp, Artificial Sequence
  dgRNA
  Tpm2
tgagcccccggccca

SEQ ID NO: 53960 - DNA, 15 bp, Artificial Sequence
  dgRNA
  Tpm2
gagcccccggcccaa

SEQ ID NO: 53961 - DNA, 15 bp, Artificial Sequence
  dgRNA
  Pcdhb17
agaacacacaccgag

SEQ ID NO: 53962 - DNA, 15 bp, Artificial Sequence
  dgRNA
  Pcdhb17
gagaacacacaccga

SEQ ID NO: 53963 - DNA, 15 bp, Artificial Sequence
  dgRNA
  Acsm2
tacttgtagggccat

SEQ ID NO: 53964 - DNA, 15 bp, Artificial Sequence
  dgRNA
  Acsm2
agtatgtctcttggc

SEQ ID NO: 53965 - DNA, 15 bp, Artificial Sequence
  dgRNA
  Acsm2
tacaagtatgtctct

SEQ ID NO: 53966 - DNA, 15 bp, Artificial Sequence
  dgRNA
  Mrps23
cacccacccggacgc

SEQ ID NO: 53967 - DNA, 15 bp, Artificial Sequence
  dgRNA
  Mrps23
cggacgcaggacctg

SEQ ID NO: 53968 - DNA, 15 bp, Artificial Sequence
  dgRNA
  Mrps23
tcgtttgcttctgcc

SEQ ID NO: 53969 - DNA, 15 bp, Artificial Sequence
  dgRNA
  Mrps23
cctggttccgccgtc

SEQ ID NO: 53970 - DNA, 15 bp, Artificial Sequence
  dgRNA
  Olfr854
gctgctactgcaatc

SEQ ID NO: 53971 - DNA, 15 bp, Artificial Sequence
  dgRNA
  Olfr854
tggggctcataattc

SEQ ID NO: 53972 - DNA, 15 bp, Artificial Sequence
  dgRNA
  Olfr854
ggggctcataattct

SEQ ID NO: 53973 - DNA, 15 bp, Artificial Sequence
  dgRNA
  Olfr854
gggctcataattctg

SEQ ID NO: 53974 - DNA, 15 bp, Artificial Sequence
  dgRNA
  Sult1d1
acacagttcaccagt

SEQ ID NO: 53975 - DNA, 15 bp, Artificial Sequence
  dgRNA
  Sult1d1
ttcaccagtaggttc

SEQ ID NO: 53976 - DNA, 15 bp, Artificial Sequence
  dgRNA
  Sult1d1
acaacacgcaaaaca

SEQ ID NO: 53977 - DNA, 15 bp, Artificial Sequence
  dgRNA
  Sult1d1
acacgcaaaacatgg

SEQ ID NO: 53978 - DNA, 15 bp, Artificial Sequence
  dgRNA
  Sowahc
ggctgcgagcccgcg

SEQ ID NO: 53979 - DNA, 15 bp, Artificial Sequence
  dgRNA
  Sowahc
agcccgcgcggagcc

SEQ ID NO: 53980 - DNA, 15 bp, Artificial Sequence
  dgRNA
  Sowahc
cgcggagcccggaag

SEQ ID NO: 53981 - DNA, 15 bp, Artificial Sequence
  dgRNA
  Sowahc
gcggagcccggaagt

SEQ ID NO: 53982 - DNA, 15 bp, Artificial Sequence
  dgRNA
  Serpinb3d
taagactttgcaagc

SEQ ID NO: 53983 - DNA, 15 bp, Artificial Sequence
  dgRNA
  Muc20
cacccggctgcctcc

SEQ ID NO: 53984 - DNA, 15 bp, Artificial Sequence
  dgRNA
  Muc20
ctacccagtcacacc

SEQ ID NO: 53985 - DNA, 15 bp, Artificial Sequence
  dgRNA
  Muc20
ctcctcccggggttg

SEQ ID NO: 53986 - DNA, 15 bp, Artificial Sequence
  dgRNA
  Muc20
cggggttgaggaagc

SEQ ID NO: 53987 - DNA, 15 bp, Artificial Sequence
  dgRNA
  Ubr7
aacgccacccggaag

SEQ ID NO: 53988 - DNA, 15 bp, Artificial Sequence
  dgRNA
  Ubr7
gcggaagccagcctg

SEQ ID NO: 53989 - DNA, 15 bp, Artificial Sequence
  dgRNA
  Ubr7
gccagcctgcggccg

SEQ ID NO: 53990 - DNA, 15 bp, Artificial Sequence
  dgRNA
  Ubr7
agcctgcggccgggg

SEQ ID NO: 53991 - DNA, 15 bp, Artificial Sequence
  dgRNA
  2610002M06Rik
gaactagaagtccgg

SEQ ID NO: 53992 - DNA, 15 bp, Artificial Sequence
  dgRNA
  2610002M06Rik
aactagaagtccggt

SEQ ID NO: 53993 - DNA, 15 bp, Artificial Sequence
  dgRNA
  2610002M06Rik
agtccggtgggatgc

SEQ ID NO: 53994 - DNA, 15 bp, Artificial Sequence
  dgRNA
  2610002M06Rik
gtgggatgccggacc

SEQ ID NO: 53995 - DNA, 15 bp, Artificial Sequence
  dgRNA
  Bsdc1
cgagcctgccgaaat

SEQ ID NO: 53996 - DNA, 15 bp, Artificial Sequence
  dgRNA
  Bsdc1
ctgccgaaattggcc

SEQ ID NO: 53997 - DNA, 15 bp, Artificial Sequence
  dgRNA
  Bsdc1
gaggccactgtagtc

SEQ ID NO: 53998 - DNA, 15 bp, Artificial Sequence
  dgRNA
  Bsdc1
gtagtcagggactac

SEQ ID NO: 53999 - DNA, 15 bp, Artificial Sequence
  dgRNA
  Stmn2
aaagtatagcctcct

SEQ ID NO: 54000 - DNA, 15 bp, Artificial Sequence
  dgRNA
  Stmn2
aggcaccactccact

SEQ ID NO: 54001 - DNA, 15 bp, Artificial Sequence
  dgRNA
  Stmn2
cttggactgtactat

SEQ ID NO: 54002 - DNA, 15 bp, Artificial Sequence
  dgRNA
  Stmn2
ttggactgtactatt

SEQ ID NO: 54003 - DNA, 15 bp, Artificial Sequence
  dgRNA
  Trim23
agccggagtagacag

SEQ ID NO: 54004 - DNA, 15 bp, Artificial Sequence
  dgRNA
  Trim23
gccggagtagacagt

SEQ ID NO: 54005 - DNA, 15 bp, Artificial Sequence
  dgRNA
  Trim23
tagacagtgggcggc

SEQ ID NO: 54006 - DNA, 15 bp, Artificial Sequence
  dgRNA
  Trim23
gcggcagggcagccg

SEQ ID NO: 54007 - DNA, 15 bp, Artificial Sequence
  dgRNA
  Abca3
cgcagacgcacgatc

SEQ ID NO: 54008 - DNA, 15 bp, Artificial Sequence
  dgRNA
  Abca3
tccggaatgttgaac

SEQ ID NO: 54009 - DNA, 15 bp, Artificial Sequence
  dgRNA
  Abca3
ccggaatgttgaact

SEQ ID NO: 54010 - DNA, 15 bp, Artificial Sequence
  dgRNA
  Abca3
gccctctgtcggagc

SEQ ID NO: 54011 - DNA, 15 bp, Artificial Sequence
  dgRNA
  Tas2r121
atactcatcgacatt

SEQ ID NO: 54012 - DNA, 15 bp, Artificial Sequence
  dgRNA
  Tas2r121
agtttttgagactac

SEQ ID NO: 54013 - DNA, 15 bp, Artificial Sequence
  dgRNA
  Nxt1
cgtagctgcccgtcg

SEQ ID NO: 54014 - DNA, 15 bp, Artificial Sequence
  dgRNA
  Nxt1
gtagctgcccgtcgc

SEQ ID NO: 54015 - DNA, 15 bp, Artificial Sequence
  dgRNA
  Nxt1
tagctgcccgtcgcg

SEQ ID NO: 54016 - DNA, 15 bp, Artificial Sequence
  dgRNA
  Nxt1
cccgtcgcggggagg

SEQ ID NO: 54017 - DNA, 15 bp, Artificial Sequence
  dgRNA
  Wbscr17
gggaatatccagttg

SEQ ID NO: 54018 - DNA, 15 bp, Artificial Sequence
  dgRNA
  Wbscr17
tgcctagacctcaac

SEQ ID NO: 54019 - DNA, 15 bp, Artificial Sequence
  dgRNA
  Wbscr17
gcatgttcgggtttg

SEQ ID NO: 54020 - DNA, 15 bp, Artificial Sequence
  dgRNA
  Wbscr17
ggcatgttcgggttt

SEQ ID NO: 54021 - DNA, 15 bp, Artificial Sequence
  dgRNA
  Tgfbrap1
ccacatcccccgcca

SEQ ID NO: 54022 - DNA, 15 bp, Artificial Sequence
  dgRNA
  Tgfbrap1
gccatggttgtcgcc

SEQ ID NO: 54023 - DNA, 15 bp, Artificial Sequence
  dgRNA
  Tgfbrap1
cgccaggagaccccc

SEQ ID NO: 54024 - DNA, 15 bp, Artificial Sequence
  dgRNA
  Tgfbrap1
aggagaccccctggc

SEQ ID NO: 54025 - DNA, 15 bp, Artificial Sequence
  dgRNA
  Syt15
gagtgactccgtacc

SEQ ID NO: 54026 - DNA, 15 bp, Artificial Sequence
  dgRNA
  Syt15
gactccgtacctggc

SEQ ID NO: 54027 - DNA, 15 bp, Artificial Sequence
  dgRNA
  Syt15
actccgtacctggca

SEQ ID NO: 54028 - DNA, 15 bp, Artificial Sequence
  dgRNA
  Syt15
ctccgtacctggcag

SEQ ID NO: 54029 - DNA, 15 bp, Artificial Sequence
  dgRNA
  Nob1
tgcacatagcccccc

SEQ ID NO: 54030 - DNA, 15 bp, Artificial Sequence
  dgRNA
  Nob1
atagccccccaggca

SEQ ID NO: 54031 - DNA, 15 bp, Artificial Sequence
  dgRNA
  Nob1
tgcgcgcagtcctga

SEQ ID NO: 54032 - DNA, 15 bp, Artificial Sequence
  dgRNA
  Nob1
gcgcgcagtcctgaa

SEQ ID NO: 54033 - DNA, 15 bp, Artificial Sequence
  dgRNA
  Parl
cttccaaggtggcgc

SEQ ID NO: 54034 - DNA, 15 bp, Artificial Sequence
  dgRNA
  Parl
cgctggtctgagaag

SEQ ID NO: 54035 - DNA, 15 bp, Artificial Sequence
  dgRNA
  Parl
aagaccggaactgaa

SEQ ID NO: 54036 - DNA, 15 bp, Artificial Sequence
  dgRNA
  Parl
aactgaacggcctcc

SEQ ID NO: 54037 - DNA, 15 bp, Artificial Sequence
  dgRNA
  Anapc5
gacagcgtgaactac

SEQ ID NO: 54038 - DNA, 15 bp, Artificial Sequence
  dgRNA
  Prpf40a
aggcgacgccgagcg

SEQ ID NO: 54039 - DNA, 15 bp, Artificial Sequence
  dgRNA
  Prpf40a
acgccgagcgaggca

SEQ ID NO: 54040 - DNA, 15 bp, Artificial Sequence
  dgRNA
  Prpf40a
cgccgagcgaggcag

SEQ ID NO: 54041 - DNA, 15 bp, Artificial Sequence
  dgRNA
  Prpf40a
gccgagcgaggcagg

SEQ ID NO: 54042 - DNA, 15 bp, Artificial Sequence
  dgRNA
  Tspan14
gcaaagagcgggggc

SEQ ID NO: 54043 - DNA, 15 bp, Artificial Sequence
  dgRNA
  Tspan14
caaagagcgggggcg

SEQ ID NO: 54044 - DNA, 15 bp, Artificial Sequence
  dgRNA
  Tspan14
gtgcgccagacgcac

SEQ ID NO: 54045 - DNA, 15 bp, Artificial Sequence
  dgRNA
  Tspan14
tgcgccagacgcact

SEQ ID NO: 54046 - DNA, 15 bp, Artificial Sequence
  dgRNA
  Arhgef33
cactagtaacttctt

SEQ ID NO: 54047 - DNA, 15 bp, Artificial Sequence
  dgRNA
  Arhgef33
tcttgcgtttctcga

SEQ ID NO: 54048 - DNA, 15 bp, Artificial Sequence
  dgRNA
  Arhgef33
gtcctccccctgaag

SEQ ID NO: 54049 - DNA, 15 bp, Artificial Sequence
  dgRNA
  Arhgef33
cttgattagctgacc

SEQ ID NO: 54050 - DNA, 15 bp, Artificial Sequence
  dgRNA
  Pygl
caagcgagccagccg

SEQ ID NO: 54051 - DNA, 15 bp, Artificial Sequence
  dgRNA
  Pygl
ccacaccgagagacg

SEQ ID NO: 54052 - DNA, 15 bp, Artificial Sequence
  dgRNA
  Pygl
gcgcactacgtgacc

SEQ ID NO: 54053 - DNA, 15 bp, Artificial Sequence
  dgRNA
  Pygl
gtgacctggacgttc

SEQ ID NO: 54054 - DNA, 15 bp, Artificial Sequence
  dgRNA
  Dus4l
aaggcagggcgaccc

SEQ ID NO: 54055 - DNA, 15 bp, Artificial Sequence
  dgRNA
  Dus4l
gccttaccgtcctgc

SEQ ID NO: 54056 - DNA, 15 bp, Artificial Sequence
  dgRNA
  Dus4l
gcaggatcgcctgca

SEQ ID NO: 54057 - DNA, 15 bp, Artificial Sequence
  dgRNA
  Dus4l
tcgccgccactactg

SEQ ID NO: 54058 - DNA, 15 bp, Artificial Sequence
  dgRNA
  Wdfy4
tacttagtctgaatg

SEQ ID NO: 54059 - DNA, 15 bp, Artificial Sequence
  dgRNA
  Wdfy4
acttagtctgaatgc

SEQ ID NO: 54060 - DNA, 15 bp, Artificial Sequence
  dgRNA
  Wdfy4
cttagtctgaatgcg

SEQ ID NO: 54061 - DNA, 15 bp, Artificial Sequence
  dgRNA
  Wdfy4
ggagggacgattggc

SEQ ID NO: 54062 - DNA, 15 bp, Artificial Sequence
  dgRNA
  Arel1
caccgagtctatatc

SEQ ID NO: 54063 - DNA, 15 bp, Artificial Sequence
  dgRNA
  Arel1
agttcgaagggagta

SEQ ID NO: 54064 - DNA, 15 bp, Artificial Sequence
  dgRNA
  Arel1
tagttcgaagggagt

SEQ ID NO: 54065 - DNA, 15 bp, Artificial Sequence
  dgRNA
  Arel1
tggccttagttcgaa

SEQ ID NO: 54066 - DNA, 15 bp, Artificial Sequence
  dgRNA
  Gen1
gcacgcgccccgctg

SEQ ID NO: 54067 - DNA, 15 bp, Artificial Sequence
  dgRNA
  Gen1
ggcggatctagacag

SEQ ID NO: 54068 - DNA, 15 bp, Artificial Sequence
  dgRNA
  Gen1
cggatctagacagcg

SEQ ID NO: 54069 - DNA, 15 bp, Artificial Sequence
  dgRNA
  Gen1
ggatctagacagcgg

SEQ ID NO: 54070 - DNA, 15 bp, Artificial Sequence
  dgRNA
  Rfxank
gtctgtggatccgat

SEQ ID NO: 54071 - DNA, 15 bp, Artificial Sequence
  dgRNA
  Rfxank
tctgtggatccgatt

SEQ ID NO: 54072 - DNA, 15 bp, Artificial Sequence
  dgRNA
  Rfxank
ctgtggatccgattg

SEQ ID NO: 54073 - DNA, 15 bp, Artificial Sequence
  dgRNA
  Rfxank
ccgattggggcagac

SEQ ID NO: 54074 - DNA, 15 bp, Artificial Sequence
  dgRNA
  Mecr
ccctacaccaatacc

SEQ ID NO: 54075 - DNA, 15 bp, Artificial Sequence
  dgRNA
  Mecr
cctacaccaatacct

SEQ ID NO: 54076 - DNA, 15 bp, Artificial Sequence
  dgRNA
  Mecr
gggcgcggtcacgag

SEQ ID NO: 54077 - DNA, 15 bp, Artificial Sequence
  dgRNA
  Mecr
ggcgcggtcacgagc

SEQ ID NO: 54078 - DNA, 15 bp, Artificial Sequence
  dgRNA
  Auh
aacattaatgctacc

SEQ ID NO: 54079 - DNA, 15 bp, Artificial Sequence
  dgRNA
  Auh
acattaatgctaccc

SEQ ID NO: 54080 - DNA, 15 bp, Artificial Sequence
  dgRNA
  Auh
ttaatgctacccggg

SEQ ID NO: 54081 - DNA, 15 bp, Artificial Sequence
  dgRNA
  Auh
ctacccgggcggccg

SEQ ID NO: 54082 - DNA, 15 bp, Artificial Sequence
  dgRNA
  Wapl
ggagcgagcggctgt

SEQ ID NO: 54083 - DNA, 15 bp, Artificial Sequence
  dgRNA
  Wapl
gcgagcggctgttgg

SEQ ID NO: 54084 - DNA, 15 bp, Artificial Sequence
  dgRNA
  Izumo2
tcagccaggctttag

SEQ ID NO: 54085 - DNA, 15 bp, Artificial Sequence
  dgRNA
  Izumo2
aatatgttaactacc

SEQ ID NO: 54086 - DNA, 15 bp, Artificial Sequence
  dgRNA
  Izumo2
actcggagtgttctg

SEQ ID NO: 54087 - DNA, 15 bp, Artificial Sequence
  dgRNA
  Izumo2
gaggtcgcccctgtg

SEQ ID NO: 54088 - DNA, 15 bp, Artificial Sequence
  dgRNA
  Sla
atgcaaatttagtcc

SEQ ID NO: 54089 - DNA, 15 bp, Artificial Sequence
  dgRNA
  Sla
ctgtctgcattaacc

SEQ ID NO: 54090 - DNA, 15 bp, Artificial Sequence
  dgRNA
  Hyal6
aggatacaatctgat

SEQ ID NO: 54091 - DNA, 15 bp, Artificial Sequence
  dgRNA
  Hyal6
tacaatctgattggc

SEQ ID NO: 54092 - DNA, 15 bp, Artificial Sequence
  dgRNA
  Hyal6
taagagagtctctac

SEQ ID NO: 54093 - DNA, 15 bp, Artificial Sequence
  dgRNA
  Hyal6
tttgggctgttaact

SEQ ID NO: 54094 - DNA, 15 bp, Artificial Sequence
  dgRNA
  Grik5
caggccggcccggct

SEQ ID NO: 54095 - DNA, 15 bp, Artificial Sequence
  dgRNA
  Grik5
aggccggcccggcta

SEQ ID NO: 54096 - DNA, 15 bp, Artificial Sequence
  dgRNA
  Grik5
ggccggcccggctag

SEQ ID NO: 54097 - DNA, 15 bp, Artificial Sequence
  dgRNA
  Grik5
cggcccggctagggg

SEQ ID NO: 54098 - DNA, 15 bp, Artificial Sequence
  dgRNA
  Il22
accctggtgtcccga

SEQ ID NO: 54099 - DNA, 15 bp, Artificial Sequence
  dgRNA
  Il22
agacaatcatctgct

SEQ ID NO: 54100 - DNA, 15 bp, Artificial Sequence
  dgRNA
  Il22
agtgcttacctgttt

SEQ ID NO: 54101 - DNA, 15 bp, Artificial Sequence
  dgRNA
  Il22
gatgattgtctgtag

SEQ ID NO: 54102 - DNA, 15 bp, Artificial Sequence
  dgRNA
  Emc4
ttcactccagcacga

SEQ ID NO: 54103 - DNA, 15 bp, Artificial Sequence
  dgRNA
  Emc4
gagaggtgtactcgc

SEQ ID NO: 54104 - DNA, 15 bp, Artificial Sequence
  dgRNA
  Emc4
agaggtgtactcgca

SEQ ID NO: 54105 - DNA, 15 bp, Artificial Sequence
  dgRNA
  Emc4
ggtgtactcgcaggg

SEQ ID NO: 54106 - DNA, 15 bp, Artificial Sequence
  dgRNA
  Hspb3
gattgcacactttgc

SEQ ID NO: 54107 - DNA, 15 bp, Artificial Sequence
  dgRNA
  Hspb3
agtgcgatccctgcc

SEQ ID NO: 54108 - DNA, 15 bp, Artificial Sequence
  dgRNA
  Hspb3
ctggcccacttgtac

SEQ ID NO: 54109 - DNA, 15 bp, Artificial Sequence
  dgRNA
  Hspb3
aaatgcaactcgcag

SEQ ID NO: 54110 - DNA, 15 bp, Artificial Sequence
  dgRNA
  Actrt3
cagcgtgtttgagaa

SEQ ID NO: 54111 - DNA, 15 bp, Artificial Sequence
  dgRNA
  Actrt3
tttgcaagggtagcc

SEQ ID NO: 54112 - DNA, 15 bp, Artificial Sequence
  dgRNA
  Actrt3
ggtagcccggttttc

SEQ ID NO: 54113 - DNA, 15 bp, Artificial Sequence
  dgRNA
  Actrt3
atggaaagcggtcgc

SEQ ID NO: 54114 - DNA, 15 bp, Artificial Sequence
  dgRNA
  Gzmk
cttcacccgttgtac

SEQ ID NO: 54115 - DNA, 15 bp, Artificial Sequence
  dgRNA
  Gzmk
cccccagactaatag

SEQ ID NO: 54116 - DNA, 15 bp, Artificial Sequence
  dgRNA
  Gzmk
gaaaaatctaacgtc

SEQ ID NO: 54117 - DNA, 15 bp, Artificial Sequence
  dgRNA
  Gzmk
aaaaatctaacgtct

SEQ ID NO: 54118 - DNA, 15 bp, Artificial Sequence
  dgRNA
  Dlgap1
agtaataattgttcg

SEQ ID NO: 54119 - DNA, 15 bp, Artificial Sequence
  dgRNA
  Dlgap1
gtaataattgttcgt

SEQ ID NO: 54120 - DNA, 15 bp, Artificial Sequence
  dgRNA
  Dlgap1
taataattgttcgtg

SEQ ID NO: 54121 - DNA, 15 bp, Artificial Sequence
  dgRNA
  Dlgap1
taattgttcgtgggg

SEQ ID NO: 54122 - DNA, 15 bp, Artificial Sequence
  dgRNA
  Adgra1
gttgtctgaatcggt

SEQ ID NO: 54123 - DNA, 15 bp, Artificial Sequence
  dgRNA
  Adgra1
gcagcaaaccctggt

SEQ ID NO: 54124 - DNA, 15 bp, Artificial Sequence
  dgRNA
  Adgra1
agtgtgacgggcagc

SEQ ID NO: 54125 - DNA, 15 bp, Artificial Sequence
  dgRNA
  Adgra1
gggcagccggccgcc

SEQ ID NO: 54126 - DNA, 15 bp, Artificial Sequence
  dgRNA
  Tap1
gcaacttgcagactg

SEQ ID NO: 54127 - DNA, 15 bp, Artificial Sequence
  dgRNA
  Tap1
ccccatcatcgcgca

SEQ ID NO: 54128 - DNA, 15 bp, Artificial Sequence
  dgRNA
  Tap1
cccatcatcgcgcaa

SEQ ID NO: 54129 - DNA, 15 bp, Artificial Sequence
  dgRNA
  Tap1
ccatcatcgcgcaag

SEQ ID NO: 54130 - DNA, 15 bp, Artificial Sequence
  dgRNA
  Rps10
tccggacacaactca

SEQ ID NO: 54131 - DNA, 15 bp, Artificial Sequence
  dgRNA
  Rps10
ccggacacaactcac

SEQ ID NO: 54132 - DNA, 15 bp, Artificial Sequence
  dgRNA
  Rps10
gggctagcaatctcc

SEQ ID NO: 54133 - DNA, 15 bp, Artificial Sequence
  dgRNA
  Rps10
ctagcaatctccagg

SEQ ID NO: 54134 - DNA, 15 bp, Artificial Sequence
  dgRNA
  Tgfb1i1
aacattacaggtacc

SEQ ID NO: 54135 - DNA, 15 bp, Artificial Sequence
  dgRNA
  Tgfb1i1
ttaccgagacagtct

SEQ ID NO: 54136 - DNA, 15 bp, Artificial Sequence
  dgRNA
  Tgfb1i1
cgagacagtcttgga

SEQ ID NO: 54137 - DNA, 15 bp, Artificial Sequence
  dgRNA
  Tgfb1i1
gactcaaactgtccg

SEQ ID NO: 54138 - DNA, 15 bp, Artificial Sequence
  dgRNA
  Reps1
ggacgcggccgagcc

SEQ ID NO: 54139 - DNA, 15 bp, Artificial Sequence
  dgRNA
  Reps1
cccacgccgagcttg

SEQ ID NO: 54140 - DNA, 15 bp, Artificial Sequence
  dgRNA
  Reps1
gcgcgccaccgccgc

SEQ ID NO: 54141 - DNA, 15 bp, Artificial Sequence
  dgRNA
  Reps1
cgccgccggctgccc

SEQ ID NO: 54142 - DNA, 15 bp, Artificial Sequence
  dgRNA
  Aldh3a1
acccgtgtgaagcag

SEQ ID NO: 54143 - DNA, 15 bp, Artificial Sequence
  dgRNA
  Aldh3a1
gtcacgcgaacttcc

SEQ ID NO: 54144 - DNA, 15 bp, Artificial Sequence
  dgRNA
  Aldh3a1
tcacgcgaacttcct

SEQ ID NO: 54145 - DNA, 15 bp, Artificial Sequence
  dgRNA
  Aldh3a1
cacgcgaacttcctg

SEQ ID NO: 54146 - DNA, 15 bp, Artificial Sequence
  dgRNA
  Chrnb3
ttaataagataagtc

SEQ ID NO: 54147 - DNA, 15 bp, Artificial Sequence
  dgRNA
  Chrnb3
cagtgtctgtcgtgg

SEQ ID NO: 54148 - DNA, 15 bp, Artificial Sequence
  dgRNA
  Atg2b
ttatccttcctcgtc

SEQ ID NO: 54149 - DNA, 15 bp, Artificial Sequence
  dgRNA
  Atg2b
tcgtccggagactgc

SEQ ID NO: 54150 - DNA, 15 bp, Artificial Sequence
  dgRNA
  Atg2b
cgtccggagactgct

SEQ ID NO: 54151 - DNA, 15 bp, Artificial Sequence
  dgRNA
  Atg2b
gtccggagactgctg

SEQ ID NO: 54152 - DNA, 15 bp, Artificial Sequence
  dgRNA
  Gprc5c
ccaccgtgagtctgt

SEQ ID NO: 54153 - DNA, 15 bp, Artificial Sequence
  dgRNA
  Gprc5c
ggtgcgtgcgatcgc

SEQ ID NO: 54154 - DNA, 15 bp, Artificial Sequence
  dgRNA
  Gprc5c
gtgcgtgcgatcgct

SEQ ID NO: 54155 - DNA, 15 bp, Artificial Sequence
  dgRNA
  Gprc5c
accccgaacctcttt

SEQ ID NO: 54156 - DNA, 15 bp, Artificial Sequence
  dgRNA
  Hoxb8
ttacagccgtttttt

SEQ ID NO: 54157 - DNA, 15 bp, Artificial Sequence
  dgRNA
  Hoxb8
tacagccgttttttt

SEQ ID NO: 54158 - DNA, 15 bp, Artificial Sequence
  dgRNA
  Hoxb8
acagccgtttttttg

SEQ ID NO: 54159 - DNA, 15 bp, Artificial Sequence
  dgRNA
  Hoxb8
cagccgtttttttgg

SEQ ID NO: 54160 - DNA, 15 bp, Artificial Sequence
  dgRNA
  Spdye4a
ggttgccagattgga

SEQ ID NO: 54161 - DNA, 15 bp, Artificial Sequence
  dgRNA
  Spdye4a
ggccgatgacatcat

SEQ ID NO: 54162 - DNA, 15 bp, Artificial Sequence
  dgRNA
  Spdye4a
tccgctcctcctgat

SEQ ID NO: 54163 - DNA, 15 bp, Artificial Sequence
  dgRNA
  Spdye4a
atcggccttccaatc

SEQ ID NO: 54164 - DNA, 15 bp, Artificial Sequence
  dgRNA
  Arid1b
gtcacgacctgaaca

SEQ ID NO: 54165 - DNA, 15 bp, Artificial Sequence
  dgRNA
  Arid1b
atagcgcgagcgccg

SEQ ID NO: 54166 - DNA, 15 bp, Artificial Sequence
  dgRNA
  Arid1b
gcgcgagcgccgcgg

SEQ ID NO: 54167 - DNA, 15 bp, Artificial Sequence
  dgRNA
  Arid1b
caacagcgcgcagag

SEQ ID NO: 54168 - DNA, 15 bp, Artificial Sequence
  dgRNA
  Adgre1
cactagccagattta

SEQ ID NO: 54169 - DNA, 15 bp, Artificial Sequence
  dgRNA
  Adgre1
gtccacctctgatgg

SEQ ID NO: 54170 - DNA, 15 bp, Artificial Sequence
  dgRNA
  Lonrf1
cagcgcccaagttat

SEQ ID NO: 54171 - DNA, 15 bp, Artificial Sequence
  dgRNA
  Lonrf1
caagttataggcctg

SEQ ID NO: 54172 - DNA, 15 bp, Artificial Sequence
  dgRNA
  Lonrf1
gacctcggttacaag

SEQ ID NO: 54173 - DNA, 15 bp, Artificial Sequence
  dgRNA
  Lonrf1
gaggtgtcagctcga

SEQ ID NO: 54174 - DNA, 15 bp, Artificial Sequence
  dgRNA
  Slc4a1
ctcctaccagagacc

SEQ ID NO: 54175 - DNA, 15 bp, Artificial Sequence
  dgRNA
  Slc4a1
agccttagttcacaa

SEQ ID NO: 54176 - DNA, 15 bp, Artificial Sequence
  dgRNA
  Slc4a1
atcggagaaatcccc

SEQ ID NO: 54177 - DNA, 15 bp, Artificial Sequence
  dgRNA
  Slc4a1
cggagaaatccccag

SEQ ID NO: 54178 - DNA, 15 bp, Artificial Sequence
  dgRNA
  Smad4
ctcagccagagccgc

SEQ ID NO: 54179 - DNA, 15 bp, Artificial Sequence
  dgRNA
  Smad4
tcagccagagccgcc

SEQ ID NO: 54180 - DNA, 15 bp, Artificial Sequence
  dgRNA
  Smad4
ccgccgggctgcccg

SEQ ID NO: 54181 - DNA, 15 bp, Artificial Sequence
  dgRNA
  Smad4
cgccgggctgcccgc

SEQ ID NO: 54182 - DNA, 15 bp, Artificial Sequence
  dgRNA
  Hnrnpl
aagcgttcacctata

SEQ ID NO: 54183 - DNA, 15 bp, Artificial Sequence
  dgRNA
  Hnrnpl
tataaggagtgcgat

SEQ ID NO: 54184 - DNA, 15 bp, Artificial Sequence
  dgRNA
  Hnrnpl
gcgattggcgaacag

SEQ ID NO: 54185 - DNA, 15 bp, Artificial Sequence
  dgRNA
  Hnrnpl
attggcgaacagagg

SEQ ID NO: 54186 - DNA, 15 bp, Artificial Sequence
  dgRNA
  Lrr1
atcctccgggcgctc

SEQ ID NO: 54187 - DNA, 15 bp, Artificial Sequence
  dgRNA
  Lrr1
ctccggagcacgcag

SEQ ID NO: 54188 - DNA, 15 bp, Artificial Sequence
  dgRNA
  Lrr1
ttccaccattctacg

SEQ ID NO: 54189 - DNA, 15 bp, Artificial Sequence
  dgRNA
  Lrr1
acgtggaaactggag

SEQ ID NO: 54190 - DNA, 15 bp, Artificial Sequence
  dgRNA
  Qk
cctcagccgcgaccc

SEQ ID NO: 54191 - DNA, 15 bp, Artificial Sequence
  dgRNA
  Qk
gaccccggccccgcg

SEQ ID NO: 54192 - DNA, 15 bp, Artificial Sequence
  dgRNA
  Qk
accccggccccgcgc

SEQ ID NO: 54193 - DNA, 15 bp, Artificial Sequence
  dgRNA
  Qk
ccggccccgcgcggg

SEQ ID NO: 54194 - DNA, 15 bp, Artificial Sequence
  dgRNA
  Rasal2
tccaccagcagctcg

SEQ ID NO: 54195 - DNA, 15 bp, Artificial Sequence
  dgRNA
  Rasal2
gatccccgcaccgag

SEQ ID NO: 54196 - DNA, 15 bp, Artificial Sequence
  dgRNA
  Rasal2
ccccgcaccgagagg

SEQ ID NO: 54197 - DNA, 15 bp, Artificial Sequence
  dgRNA
  Rasal2
gcaccgagaggcggt

SEQ ID NO: 54198 - DNA, 15 bp, Artificial Sequence
  dgRNA
  Ccdc152
tccatgaaagcacct

SEQ ID NO: 54199 - DNA, 15 bp, Artificial Sequence
  dgRNA
  Ccdc152
taggaggatgtaaat

SEQ ID NO: 54200 - DNA, 15 bp, Artificial Sequence
  dgRNA
  Ccdc152
ggatgtaaattggtg

SEQ ID NO: 54201 - DNA, 15 bp, Artificial Sequence
  dgRNA
  Ccdc152
attggtggggctcta

SEQ ID NO: 54202 - DNA, 15 bp, Artificial Sequence
  dgRNA
  Catsperd
ctgcgtagacctaac

SEQ ID NO: 54203 - DNA, 15 bp, Artificial Sequence
  dgRNA
  Catsperd
tgcgtagacctaacc

SEQ ID NO: 54204 - DNA, 15 bp, Artificial Sequence
  dgRNA
  Catsperd
tccgacacgtccaaa

SEQ ID NO: 54205 - DNA, 15 bp, Artificial Sequence
  dgRNA
  Catsperd
aaaaggtcctgctag

SEQ ID NO: 54206 - DNA, 15 bp, Artificial Sequence
  dgRNA
  Gc
cctccatatagaata

SEQ ID NO: 54207 - DNA, 15 bp, Artificial Sequence
  dgRNA
  Gc
gaagtgtacccctac

SEQ ID NO: 54208 - DNA, 15 bp, Artificial Sequence
  dgRNA
  Gc
actcctatgtattga

SEQ ID NO: 54209 - DNA, 15 bp, Artificial Sequence
  dgRNA
  Gc
ttaatgtaccagtag

SEQ ID NO: 54210 - DNA, 15 bp, Artificial Sequence
  dgRNA
  Poln
cctggcactcccgtg

SEQ ID NO: 54211 - DNA, 15 bp, Artificial Sequence
  dgRNA
  Poln
tcccgtgaggcactg

SEQ ID NO: 54212 - DNA, 15 bp, Artificial Sequence
  dgRNA
  Poln
gcactgcggcgcgcg

SEQ ID NO: 54213 - DNA, 15 bp, Artificial Sequence
  dgRNA
  Poln
cctcacgggagtgcc

SEQ ID NO: 54214 - DNA, 15 bp, Artificial Sequence
  dgRNA
  Zkscan16
ccagataatagccta

SEQ ID NO: 54215 - DNA, 15 bp, Artificial Sequence
  dgRNA
  Zkscan16
caggccagcggaccc

SEQ ID NO: 54216 - DNA, 15 bp, Artificial Sequence
  dgRNA
  Zkscan16
aggccagcggacccc

SEQ ID NO: 54217 - DNA, 15 bp, Artificial Sequence
  dgRNA
  Zkscan16
tcctagcctttgcgc

SEQ ID NO: 54218 - DNA, 15 bp, Artificial Sequence
  dgRNA
  Slc12a2
cggtgcggaggaggc

SEQ ID NO: 54219 - DNA, 15 bp, Artificial Sequence
  dgRNA
  Slc12a2
aggccggcgctctcc

SEQ ID NO: 54220 - DNA, 15 bp, Artificial Sequence
  dgRNA
  Slc12a2
ggccggcgctctcca

SEQ ID NO: 54221 - DNA, 15 bp, Artificial Sequence
  dgRNA
  Slc12a2
ggcgctctccagggt

SEQ ID NO: 54222 - DNA, 15 bp, Artificial Sequence
  dgRNA
  Atp2a1
ctgacccctcctgct

SEQ ID NO: 54223 - DNA, 15 bp, Artificial Sequence
  dgRNA
  Atp2a1
agccaatccctgacc

SEQ ID NO: 54224 - DNA, 15 bp, Artificial Sequence
  dgRNA
  Atp2a1
ccccactccctcata

SEQ ID NO: 54225 - DNA, 15 bp, Artificial Sequence
  dgRNA
  Atp2a1
caagggacgcaaagg

SEQ ID NO: 54226 - DNA, 15 bp, Artificial Sequence
  dgRNA
  Cldn8
ccatccccctcttat

SEQ ID NO: 54227 - DNA, 15 bp, Artificial Sequence
  dgRNA
  Cldn8
caactcaggatacct

SEQ ID NO: 54228 - DNA, 15 bp, Artificial Sequence
  dgRNA
  Cldn8
tgtctaaaccaactc

SEQ ID NO: 54229 - DNA, 15 bp, Artificial Sequence
  dgRNA
  Cldn8
ttagccaataagagg

SEQ ID NO: 54230 - DNA, 15 bp, Artificial Sequence
  dgRNA
  Flt3
ccccgcgcatgaaga

SEQ ID NO: 54231 - DNA, 15 bp, Artificial Sequence
  dgRNA
  Flt3
cgcgcatgaagaagg

SEQ ID NO: 54232 - DNA, 15 bp, Artificial Sequence
  dgRNA
  Flt3
taaagcagaggtccg

SEQ ID NO: 54233 - DNA, 15 bp, Artificial Sequence
  dgRNA
  Flt3
ccggggactcaacca

SEQ ID NO: 54234 - DNA, 15 bp, Artificial Sequence
  dgRNA
  Plscr3
cgtgcctgaactgag

SEQ ID NO: 54235 - DNA, 15 bp, Artificial Sequence
  dgRNA
  Plscr3
ggtcaacgctgtgac

SEQ ID NO: 54236 - DNA, 15 bp, Artificial Sequence
  dgRNA
  Plscr3
gtcaacgctgtgaca

SEQ ID NO: 54237 - DNA, 15 bp, Artificial Sequence
  dgRNA
  Plscr3
tcaacgctgtgacag

SEQ ID NO: 54238 - DNA, 15 bp, Artificial Sequence
  dgRNA
  Crtam
ccaagatgttccacc

SEQ ID NO: 54239 - DNA, 15 bp, Artificial Sequence
  dgRNA
  Crtam
accaggaggtgtttt

SEQ ID NO: 54240 - DNA, 15 bp, Artificial Sequence
  dgRNA
  Crtam
ccaggaggtgtttta

SEQ ID NO: 54241 - DNA, 15 bp, Artificial Sequence
  dgRNA
  Crtam
gggcagctaactaaa

SEQ ID NO: 54242 - DNA, 15 bp, Artificial Sequence
  dgRNA
  Abca1
gcggcgcactgtcgc

SEQ ID NO: 54243 - DNA, 15 bp, Artificial Sequence
  dgRNA
  Abca1
actgtcgccggttta

SEQ ID NO: 54244 - DNA, 15 bp, Artificial Sequence
  dgRNA
  Abca1
ctgtcgccggtttaa

SEQ ID NO: 54245 - DNA, 15 bp, Artificial Sequence
  dgRNA
  Abca1
tgtcgccggtttaag

SEQ ID NO: 54246 - DNA, 15 bp, Artificial Sequence
  dgRNA
  Aifm2
ccccaacccttgttc

SEQ ID NO: 54247 - DNA, 15 bp, Artificial Sequence
  dgRNA
  Aifm2
acccttgttccggag

SEQ ID NO: 54248 - DNA, 15 bp, Artificial Sequence
  dgRNA
  Aifm2
ccttgttccggagag

SEQ ID NO: 54249 - DNA, 15 bp, Artificial Sequence
  dgRNA
  Aifm2
agctgaaatgttccg

SEQ ID NO: 54250 - DNA, 15 bp, Artificial Sequence
  dgRNA
  Ccl25
gcataaagtgcctca

SEQ ID NO: 54251 - DNA, 15 bp, Artificial Sequence
  dgRNA
  Ccl25
gtgcctcaaggttca

SEQ ID NO: 54252 - DNA, 15 bp, Artificial Sequence
  dgRNA
  Ccl25
tgcctcaaggttcat

SEQ ID NO: 54253 - DNA, 15 bp, Artificial Sequence
  dgRNA
  Ccl25
gcctcaaggttcatg

SEQ ID NO: 54254 - DNA, 15 bp, Artificial Sequence
  dgRNA
  Capsl
tgcttcagcgttccc

SEQ ID NO: 54255 - DNA, 15 bp, Artificial Sequence
  dgRNA
  Capsl
aggcggaagttctac

SEQ ID NO: 54256 - DNA, 15 bp, Artificial Sequence
  dgRNA
  Capsl
cactcctcgttacct

SEQ ID NO: 54257 - DNA, 15 bp, Artificial Sequence
  dgRNA
  Capsl
ctgtcattcatatgc

SEQ ID NO: 54258 - DNA, 15 bp, Artificial Sequence
  dgRNA
  Adarb1
acgcacgacctgttt

SEQ ID NO: 54259 - DNA, 15 bp, Artificial Sequence
  dgRNA
  Adarb1
cgccgcgagcgagtc

SEQ ID NO: 54260 - DNA, 15 bp, Artificial Sequence
  dgRNA
  Adarb1
agcgagtccggacgt

SEQ ID NO: 54261 - DNA, 15 bp, Artificial Sequence
  dgRNA
  Adarb1
tccggacgtcggctc

SEQ ID NO: 54262 - DNA, 15 bp, Artificial Sequence
  dgRNA
  Rpl41
tcccatactggaaac

SEQ ID NO: 54263 - DNA, 15 bp, Artificial Sequence
  dgRNA
  Rpl41
ttaaaatagacggaa

SEQ ID NO: 54264 - DNA, 15 bp, Artificial Sequence
  dgRNA
  Rpl41
aatagacggaaaggt

SEQ ID NO: 54265 - DNA, 15 bp, Artificial Sequence
  dgRNA
  Rpl41
atagacggaaaggtg

SEQ ID NO: 54266 - DNA, 15 bp, Artificial Sequence
  dgRNA
  Qrich1
aagccccgccccgca

SEQ ID NO: 54267 - DNA, 15 bp, Artificial Sequence
  dgRNA
  Qrich1
ccccgccccgcatgg

SEQ ID NO: 54268 - DNA, 15 bp, Artificial Sequence
  dgRNA
  Qrich1
cccgccccgcatgga

SEQ ID NO: 54269 - DNA, 15 bp, Artificial Sequence
  dgRNA
  Qrich1
ccgccccgcatggag

SEQ ID NO: 54270 - DNA, 15 bp, Artificial Sequence
  dgRNA
  Gm5901
gctctatcacctatt

SEQ ID NO: 54271 - DNA, 15 bp, Artificial Sequence
  dgRNA
  Gm5901
tctatgacctcatgc

SEQ ID NO: 54272 - DNA, 15 bp, Artificial Sequence
  dgRNA
  Gm5901
acagcccaaagtagg

SEQ ID NO: 54273 - DNA, 15 bp, Artificial Sequence
  dgRNA
  Gm5901
cgggcctaatctctc

SEQ ID NO: 54274 - DNA, 15 bp, Artificial Sequence
  dgRNA
  Trim26
cgccgagatttctct

SEQ ID NO: 54275 - DNA, 15 bp, Artificial Sequence
  dgRNA
  Trim26
ccgccgagatttctc

SEQ ID NO: 54276 - DNA, 15 bp, Artificial Sequence
  dgRNA
  Hck
gggcgggtcaaacct

SEQ ID NO: 54277 - DNA, 15 bp, Artificial Sequence
  dgRNA
  Hck
tggttagcgcccttg

SEQ ID NO: 54278 - DNA, 15 bp, Artificial Sequence
  dgRNA
  Hck
agcgcccttgaggac

SEQ ID NO: 54279 - DNA, 15 bp, Artificial Sequence
  dgRNA
  Hck
gcgcccttgaggaca

SEQ ID NO: 54280 - DNA, 15 bp, Artificial Sequence
  dgRNA
  Rnf216
aaggttctgcagtcg

SEQ ID NO: 54281 - DNA, 15 bp, Artificial Sequence
  dgRNA
  Rnf216
tgcagtcgtggagcc

SEQ ID NO: 54282 - DNA, 15 bp, Artificial Sequence
  dgRNA
  Rnf216
ggatggaggccggct

SEQ ID NO: 54283 - DNA, 15 bp, Artificial Sequence
  dgRNA
  Rnf216
atggtctcgctctcc

SEQ ID NO: 54284 - DNA, 15 bp, Artificial Sequence
  dgRNA
  Ntrk3
tgcgggtggcggtac

SEQ ID NO: 54285 - DNA, 15 bp, Artificial Sequence
  dgRNA
  Ntrk3
gcgagagccgagagc

SEQ ID NO: 54286 - DNA, 15 bp, Artificial Sequence
  dgRNA
  Ntrk3
ccgagagccggcgag

SEQ ID NO: 54287 - DNA, 15 bp, Artificial Sequence
  dgRNA
  Ntrk3
cgagagccggcgagt

SEQ ID NO: 54288 - DNA, 15 bp, Artificial Sequence
  dgRNA
  Pitpnb
gcgcctgcgtactct

SEQ ID NO: 54289 - DNA, 15 bp, Artificial Sequence
  dgRNA
  Tesc
ggggatctttcacac

SEQ ID NO: 54290 - DNA, 15 bp, Artificial Sequence
  dgRNA
  Tesc
gggatctttcacact

SEQ ID NO: 54291 - DNA, 15 bp, Artificial Sequence
  dgRNA
  Tesc
tctgtcccagcgccg

SEQ ID NO: 54292 - DNA, 15 bp, Artificial Sequence
  dgRNA
  Tesc
ccgaggctccgccgc

SEQ ID NO: 54293 - DNA, 15 bp, Artificial Sequence
  dgRNA
  Map3k11
tccagtttgcgttac

SEQ ID NO: 54294 - DNA, 15 bp, Artificial Sequence
  dgRNA
  Map3k11
ccagtttgcgttacc

SEQ ID NO: 54295 - DNA, 15 bp, Artificial Sequence
  dgRNA
  Map3k11
gtcacacccccgact

SEQ ID NO: 54296 - DNA, 15 bp, Artificial Sequence
  dgRNA
  Map3k11
tcacacccccgactt

SEQ ID NO: 54297 - DNA, 15 bp, Artificial Sequence
  dgRNA
  Zswim3
atcccaagggctccg

SEQ ID NO: 54298 - DNA, 15 bp, Artificial Sequence
  dgRNA
  Zswim3
gacgcagattgtgat

SEQ ID NO: 54299 - DNA, 15 bp, Artificial Sequence
  dgRNA
  Zswim3
ctatcttaagattgg

SEQ ID NO: 54300 - DNA, 15 bp, Artificial Sequence
  dgRNA
  Zswim3
acatccgcgtgtgat

SEQ ID NO: 54301 - DNA, 15 bp, Artificial Sequence
  dgRNA
  Pgap3
accgtgtaaaataga

SEQ ID NO: 54302 - DNA, 15 bp, Artificial Sequence
  dgRNA
  Pgap3
ccgtgtaaaatagaa

SEQ ID NO: 54303 - DNA, 15 bp, Artificial Sequence
  dgRNA
  Pgap3
cacttaatttgctcc

SEQ ID NO: 54304 - DNA, 15 bp, Artificial Sequence
  dgRNA
  Pgap3
acttaatttgctcct

SEQ ID NO: 54305 - DNA, 15 bp, Artificial Sequence
  dgRNA
  Enpp5
agtccctcaatatca

SEQ ID NO: 54306 - DNA, 15 bp, Artificial Sequence
  dgRNA
  Enpp5
tatcacggacacaac

SEQ ID NO: 54307 - DNA, 15 bp, Artificial Sequence
  dgRNA
  Enpp5
cacaacaggcctacc

SEQ ID NO: 54308 - DNA, 15 bp, Artificial Sequence
  dgRNA
  Enpp5
acaacaggcctacca

SEQ ID NO: 54309 - DNA, 15 bp, Artificial Sequence
  dgRNA
  Pde4b
tgcaaatccgagcag

SEQ ID NO: 54310 - DNA, 15 bp, Artificial Sequence
  dgRNA
  Pde4b
aatccgagcagtgga

SEQ ID NO: 54311 - DNA, 15 bp, Artificial Sequence
  dgRNA
  Pde4b
ccaatagcgtttgat

SEQ ID NO: 54312 - DNA, 15 bp, Artificial Sequence
  dgRNA
  Pde4b
atagcgtttgatagg

SEQ ID NO: 54313 - DNA, 15 bp, Artificial Sequence
  dgRNA
  Lin37
ctatgatagttactt

SEQ ID NO: 54314 - DNA, 15 bp, Artificial Sequence
  dgRNA
  Lin37
tagttacttaggagc

SEQ ID NO: 54315 - DNA, 15 bp, Artificial Sequence
  dgRNA
  Lin37
aatcccgaaaagcct

SEQ ID NO: 54316 - DNA, 15 bp, Artificial Sequence
  dgRNA
  Lin37
atcccgaaaagcctt

SEQ ID NO: 54317 - DNA, 15 bp, Artificial Sequence
  dgRNA
  Relt
cgatgcggagcagcg

SEQ ID NO: 54318 - DNA, 15 bp, Artificial Sequence
  dgRNA
  Relt
cggagcagcgtggcc

SEQ ID NO: 54319 - DNA, 15 bp, Artificial Sequence
  dgRNA
  Relt
agcagcgtggcctgg

SEQ ID NO: 54320 - DNA, 15 bp, Artificial Sequence
  dgRNA
  Relt
gcagcgtggcctggc

SEQ ID NO: 54321 - DNA, 15 bp, Artificial Sequence
  dgRNA
  H2-M5
gccattaggtcatta

SEQ ID NO: 54322 - DNA, 15 bp, Artificial Sequence
  dgRNA
  H2-M5
tagaccttctaaaca

SEQ ID NO: 54323 - DNA, 15 bp, Artificial Sequence
  dgRNA
  H2-M5
ggaactcaaaggtta

SEQ ID NO: 54324 - DNA, 15 bp, Artificial Sequence
  dgRNA
  H2-M5
atatgcagtcagttc

SEQ ID NO: 54325 - DNA, 15 bp, Artificial Sequence
  dgRNA
  Dio3
ctgggacccgcccgc

SEQ ID NO: 54326 - DNA, 15 bp, Artificial Sequence
  dgRNA
  Dio3
tgggacccgcccgct

SEQ ID NO: 54327 - DNA, 15 bp, Artificial Sequence
  dgRNA
  Dio3
cgcccgctgggacct

SEQ ID NO: 54328 - DNA, 15 bp, Artificial Sequence
  dgRNA
  Dio3
ccgctgggacctagg

SEQ ID NO: 54329 - DNA, 15 bp, Artificial Sequence
  dgRNA
  Magea5
tcagccctctatatc

SEQ ID NO: 54330 - DNA, 15 bp, Artificial Sequence
  dgRNA
  4931406P16Rik
cccagaaacctttac

SEQ ID NO: 54331 - DNA, 15 bp, Artificial Sequence
  dgRNA
  4931406P16Rik
gtaaatggatttgac

SEQ ID NO: 54332 - DNA, 15 bp, Artificial Sequence
  dgRNA
  4931406P16Rik
ccaaatctcctgtaa

SEQ ID NO: 54333 - DNA, 15 bp, Artificial Sequence
  dgRNA
  4931406P16Rik
agcatttaggcggaa

SEQ ID NO: 54334 - DNA, 15 bp, Artificial Sequence
  dgRNA
  Wdr86
gtcagcgagagtgac

SEQ ID NO: 54335 - DNA, 15 bp, Artificial Sequence
  dgRNA
  Wdr86
tcagcgagagtgaca

SEQ ID NO: 54336 - DNA, 15 bp, Artificial Sequence
  dgRNA
  Wdr86
gcctaggcagttgga

SEQ ID NO: 54337 - DNA, 15 bp, Artificial Sequence
  dgRNA
  Wdr86
cgtacatgaagcacg

SEQ ID NO: 54338 - DNA, 15 bp, Artificial Sequence
  dgRNA
  Zkscan3
aaaagtctttttacg

SEQ ID NO: 54339 - DNA, 15 bp, Artificial Sequence
  dgRNA
  Zkscan3
tacgaggcaaccaag

SEQ ID NO: 54340 - DNA, 15 bp, Artificial Sequence
  dgRNA
  Zkscan3
gaggacggaaaaaac

SEQ ID NO: 54341 - DNA, 15 bp, Artificial Sequence
  dgRNA
  Zkscan3
gacggaaaaaactgg

SEQ ID NO: 54342 - DNA, 15 bp, Artificial Sequence
  dgRNA
  Tars
cctcactacacagtc

SEQ ID NO: 54343 - DNA, 15 bp, Artificial Sequence
  dgRNA
  Tars
acagtctggaactaa

SEQ ID NO: 54344 - DNA, 15 bp, Artificial Sequence
  dgRNA
  Tars
cagtctggaactaat

SEQ ID NO: 54345 - DNA, 15 bp, Artificial Sequence
  dgRNA
  Tars
agggttcgtcattct

SEQ ID NO: 54346 - DNA, 15 bp, Artificial Sequence
  dgRNA
  Cyp3a16
acttatatgctggga

SEQ ID NO: 54347 - DNA, 15 bp, Artificial Sequence
  dgRNA
  Parvb
gaccgtacatgtttg

SEQ ID NO: 54348 - DNA, 15 bp, Artificial Sequence
  dgRNA
  Parvb
accgtacatgtttgt

SEQ ID NO: 54349 - DNA, 15 bp, Artificial Sequence
  dgRNA
  Parvb
gggactaattgattc

SEQ ID NO: 54350 - DNA, 15 bp, Artificial Sequence
  dgRNA
  Parvb
gaggctgcacaaaag

SEQ ID NO: 54351 - DNA, 15 bp, Artificial Sequence
  dgRNA
  Mfsd10
tgcttctaatgcatc

SEQ ID NO: 54352 - DNA, 15 bp, Artificial Sequence
  dgRNA
  Mfsd10
tctatacttggctgc

SEQ ID NO: 54353 - DNA, 15 bp, Artificial Sequence
  dgRNA
  Mfsd10
ctatacttggctgct

SEQ ID NO: 54354 - DNA, 15 bp, Artificial Sequence
  dgRNA
  Mfsd10
gttcccgccacagca

SEQ ID NO: 54355 - DNA, 15 bp, Artificial Sequence
  dgRNA
  Dhcr24
cacgccgactagaag

SEQ ID NO: 54356 - DNA, 15 bp, Artificial Sequence
  dgRNA
  Dhcr24
acgccgactagaaga

SEQ ID NO: 54357 - DNA, 15 bp, Artificial Sequence
  dgRNA
  Dhcr24
ccgactagaagaggg

SEQ ID NO: 54358 - DNA, 15 bp, Artificial Sequence
  dgRNA
  Dhcr24
agccaatgaacgcag

SEQ ID NO: 54359 - DNA, 15 bp, Artificial Sequence
  dgRNA
  Frmd4a
gcctgcccccaacta

SEQ ID NO: 54360 - DNA, 15 bp, Artificial Sequence
  dgRNA
  Frmd4a
gccctccagcgagtg

SEQ ID NO: 54361 - DNA, 15 bp, Artificial Sequence
  dgRNA
  Frmd4a
gctcttacacattaa

SEQ ID NO: 54362 - DNA, 15 bp, Artificial Sequence
  dgRNA
  Frmd4a
ttacacattaacggc

SEQ ID NO: 54363 - DNA, 15 bp, Artificial Sequence
  dgRNA
  4930503B20Rik
gattccccaccacta

SEQ ID NO: 54364 - DNA, 15 bp, Artificial Sequence
  dgRNA
  4930503B20Rik
tgtggtagcgtgtga

SEQ ID NO: 54365 - DNA, 15 bp, Artificial Sequence
  dgRNA
  4930503B20Rik
ggccactataaaaac

SEQ ID NO: 54366 - DNA, 15 bp, Artificial Sequence
  dgRNA
  Gin1
ccaccgcggaaccgc

SEQ ID NO: 54367 - DNA, 15 bp, Artificial Sequence
  dgRNA
  Gin1
cggaaccgctggcac

SEQ ID NO: 54368 - DNA, 15 bp, Artificial Sequence
  dgRNA
  Gin1
gcactggcacacctc

SEQ ID NO: 54369 - DNA, 15 bp, Artificial Sequence
  dgRNA
  Gin1
ctgcccgccctccac

SEQ ID NO: 54370 - DNA, 15 bp, Artificial Sequence
  dgRNA
  Olfr1318
tgatagattccggaa

SEQ ID NO: 54371 - DNA, 15 bp, Artificial Sequence
  dgRNA
  Olfr1318
gacctatagctaaac

SEQ ID NO: 54372 - DNA, 15 bp, Artificial Sequence
  dgRNA
  Olfr1318
gtttagctataggtc

SEQ ID NO: 54373 - DNA, 15 bp, Artificial Sequence
  dgRNA
  Olfr1318
tacctgtttagctat

SEQ ID NO: 54374 - DNA, 15 bp, Artificial Sequence
  dgRNA
  Vmn2r17
aaggctattattgtc

SEQ ID NO: 54375 - DNA, 15 bp, Artificial Sequence
  dgRNA
  Vmn2r17
tatatgtccattgca

SEQ ID NO: 54376 - DNA, 15 bp, Artificial Sequence
  dgRNA
  Sgol2a
gtgtccctttatccg

SEQ ID NO: 54377 - DNA, 15 bp, Artificial Sequence
  dgRNA
  Sgol2a
tttatccgtggtgaa

SEQ ID NO: 54378 - DNA, 15 bp, Artificial Sequence
  dgRNA
  Sgol2a
atggccctctctgtc

SEQ ID NO: 54379 - DNA, 15 bp, Artificial Sequence
  dgRNA
  Sgol2a
tcgctgcagcccgcc

SEQ ID NO: 54380 - DNA, 15 bp, Artificial Sequence
  dgRNA
  Ola1
cgccctcctcctcgt

SEQ ID NO: 54381 - DNA, 15 bp, Artificial Sequence
  dgRNA
  Ola1
taggccccgcccatc

SEQ ID NO: 54382 - DNA, 15 bp, Artificial Sequence
  dgRNA
  Ola1
ccgcccatccgggcc

SEQ ID NO: 54383 - DNA, 15 bp, Artificial Sequence
  dgRNA
  Ola1
cgcccatccgggccc

SEQ ID NO: 54384 - DNA, 15 bp, Artificial Sequence
  dgRNA
  Tmem163
ctgcttgggcaggcg

SEQ ID NO: 54385 - DNA, 15 bp, Artificial Sequence
  dgRNA
  Tmem163
tccgggagagaaaaa

SEQ ID NO: 54386 - DNA, 15 bp, Artificial Sequence
  dgRNA
  Tmem163
tctcctgcccacgcg

SEQ ID NO: 54387 - DNA, 15 bp, Artificial Sequence
  dgRNA
  Tmem163
cggccacaggctccg

SEQ ID NO: 54388 - DNA, 15 bp, Artificial Sequence
  dgRNA
  Spock2
cgcagccctgcgctg

SEQ ID NO: 54389 - DNA, 15 bp, Artificial Sequence
  dgRNA
  Spock2
ccctgcgctgcggct

SEQ ID NO: 54390 - DNA, 15 bp, Artificial Sequence
  dgRNA
  Spock2
gcgctgcggcttggc

SEQ ID NO: 54391 - DNA, 15 bp, Artificial Sequence
  dgRNA
  Spock2
gcggcttggctggct

SEQ ID NO: 54392 - DNA, 15 bp, Artificial Sequence
  dgRNA
  Ccdc53
tgctgagcgagagcg

SEQ ID NO: 54393 - DNA, 15 bp, Artificial Sequence
  dgRNA
  Ccdc53
gctgagcgagagcga

SEQ ID NO: 54394 - DNA, 15 bp, Artificial Sequence
  dgRNA
  Ccdc53
ctgagcgagagcgag

SEQ ID NO: 54395 - DNA, 15 bp, Artificial Sequence
  dgRNA
  Ccdc53
cgagagcgagggggc

SEQ ID NO: 54396 - DNA, 15 bp, Artificial Sequence
  dgRNA
  Fam122a
catgacgcactaagc

SEQ ID NO: 54397 - DNA, 15 bp, Artificial Sequence
  dgRNA
  Fam122a
ctggcgccgcgagaa

SEQ ID NO: 54398 - DNA, 15 bp, Artificial Sequence
  dgRNA
  Fam122a
tggcgccgcgagaac

SEQ ID NO: 54399 - DNA, 15 bp, Artificial Sequence
  dgRNA
  Fam122a
gagaacgggcgtgcc

SEQ ID NO: 54400 - DNA, 15 bp, Artificial Sequence
  dgRNA
  Slc47a1
cctacattagggtgc

SEQ ID NO: 54401 - DNA, 15 bp, Artificial Sequence
  dgRNA
  Slc47a1
cctttggagatgcgc

SEQ ID NO: 54402 - DNA, 15 bp, Artificial Sequence
  dgRNA
  Slc47a1
gagatgcgcaggcct

SEQ ID NO: 54403 - DNA, 15 bp, Artificial Sequence
  dgRNA
  Slc47a1
agatgcgcaggcctt

SEQ ID NO: 54404 - DNA, 15 bp, Artificial Sequence
  dgRNA
  Fancb
cccatagtgttgtcc

SEQ ID NO: 54405 - DNA, 15 bp, Artificial Sequence
  dgRNA
  Fancb
ccatagtgttgtccg

SEQ ID NO: 54406 - DNA, 15 bp, Artificial Sequence
  dgRNA
  Fancb
tgttgtccggggtag

SEQ ID NO: 54407 - DNA, 15 bp, Artificial Sequence
  dgRNA
  Fancb
tgtccggggtagagg

SEQ ID NO: 54408 - DNA, 15 bp, Artificial Sequence
  dgRNA
  Zfp606
tcccaatagtcctcg

SEQ ID NO: 54409 - DNA, 15 bp, Artificial Sequence
  dgRNA
  Zfp606
cctcgcggtgtgtcc

SEQ ID NO: 54410 - DNA, 15 bp, Artificial Sequence
  dgRNA
  Zfp606
tgtcctggtcgactc

SEQ ID NO: 54411 - DNA, 15 bp, Artificial Sequence
  dgRNA
  Zfp606
gtcctggtcgactct

SEQ ID NO: 54412 - DNA, 15 bp, Artificial Sequence
  dgRNA
  Mlkl
gaatcagccaactag

SEQ ID NO: 54413 - DNA, 15 bp, Artificial Sequence
  dgRNA
  Mlkl
actaggggcttcaac

SEQ ID NO: 54414 - DNA, 15 bp, Artificial Sequence
  dgRNA
  Mlkl
ctaggggcttcaact

SEQ ID NO: 54415 - DNA, 15 bp, Artificial Sequence
  dgRNA
  Mlkl
tggcatatctccagt

SEQ ID NO: 54416 - DNA, 15 bp, Artificial Sequence
  dgRNA
  Nodal
tgtttttggatgaac

SEQ ID NO: 54417 - DNA, 15 bp, Artificial Sequence
  dgRNA
  Nodal
ctggagaggaccgcg

SEQ ID NO: 54418 - DNA, 15 bp, Artificial Sequence
  dgRNA
  Nodal
tggagaggaccgcga

SEQ ID NO: 54419 - DNA, 15 bp, Artificial Sequence
  dgRNA
  Nodal
ggagaggaccgcgag

SEQ ID NO: 54420 - DNA, 15 bp, Artificial Sequence
  dgRNA
  Tufm
gcagatcacttccgg

SEQ ID NO: 54421 - DNA, 15 bp, Artificial Sequence
  dgRNA
  1-Mar
gtgcagcccggtggc

SEQ ID NO: 54422 - DNA, 15 bp, Artificial Sequence
  dgRNA
  1-Mar
aaacgtgcagcccgg

SEQ ID NO: 54423 - DNA, 15 bp, Artificial Sequence
  dgRNA
  1-Mar
cacaaacgtgcagcc

SEQ ID NO: 54424 - DNA, 15 bp, Artificial Sequence
  dgRNA
  Ppp1r14d
ggtttatgttactgt

SEQ ID NO: 54425 - DNA, 15 bp, Artificial Sequence
  dgRNA
  Ppp1r14d
ggctctgaatgccac

SEQ ID NO: 54426 - DNA, 15 bp, Artificial Sequence
  dgRNA
  Ppp1r14d
tctctagttagtgcc

SEQ ID NO: 54427 - DNA, 15 bp, Artificial Sequence
  dgRNA
  Hoxd10
aacgcgcactatcac

SEQ ID NO: 54428 - DNA, 15 bp, Artificial Sequence
  dgRNA
  Hoxd10
ttgtccgtgcttacg

SEQ ID NO: 54429 - DNA, 15 bp, Artificial Sequence
  dgRNA
  Hoxd10
gcttacgcggccagc

SEQ ID NO: 54430 - DNA, 15 bp, Artificial Sequence
  dgRNA
  Hoxd10
acgcggccagccggc

SEQ ID NO: 54431 - DNA, 15 bp, Artificial Sequence
  dgRNA
  Vmn2r91
gattgagaatccaat

SEQ ID NO: 54432 - DNA, 15 bp, Artificial Sequence
  dgRNA
  9130011E15Rik
gggctagttctctcg

SEQ ID NO: 54433 - DNA, 15 bp, Artificial Sequence
  dgRNA
  9130011E15Rik
tctcgcggtgtctgt

SEQ ID NO: 54434 - DNA, 15 bp, Artificial Sequence
  dgRNA
  9130011E15Rik
ctcgcggtgtctgtt

SEQ ID NO: 54435 - DNA, 15 bp, Artificial Sequence
  dgRNA
  9130011E15Rik
ttttgcgatgcttgc

SEQ ID NO: 54436 - DNA, 15 bp, Artificial Sequence
  dgRNA
  Zp1
atccttgatagaccc

SEQ ID NO: 54437 - DNA, 15 bp, Artificial Sequence
  dgRNA
  Zp1
ttgatagacccagga

SEQ ID NO: 54438 - DNA, 15 bp, Artificial Sequence
  dgRNA
  Zp1
tccatagccccttgt

SEQ ID NO: 54439 - DNA, 15 bp, Artificial Sequence
  dgRNA
  Zp1
ctcctttgcccctag

SEQ ID NO: 54440 - DNA, 15 bp, Artificial Sequence
  dgRNA
  Rpf2
cggcaccgtctcttc

SEQ ID NO: 54441 - DNA, 15 bp, Artificial Sequence
  dgRNA
  Rpf2
ctcttccggcgctcg

SEQ ID NO: 54442 - DNA, 15 bp, Artificial Sequence
  dgRNA
  Rpf2
ttccggcgctcgcgg

SEQ ID NO: 54443 - DNA, 15 bp, Artificial Sequence
  dgRNA
  Rpf2
ctcgcggcggcttcc

SEQ ID NO: 54444 - DNA, 15 bp, Artificial Sequence
  dgRNA
  Sec23ip
agtctcgcgagaccg

SEQ ID NO: 54445 - DNA, 15 bp, Artificial Sequence
  dgRNA
  Sec23ip
aggctgtcacgtgat

SEQ ID NO: 54446 - DNA, 15 bp, Artificial Sequence
  dgRNA
  Sec23ip
gtcacgtgataggct

SEQ ID NO: 54447 - DNA, 15 bp, Artificial Sequence
  dgRNA
  Sec23ip
tcacgtgataggctt

SEQ ID NO: 54448 - DNA, 15 bp, Artificial Sequence
  dgRNA
  Taok3
gatcctagatgctcc

SEQ ID NO: 54449 - DNA, 15 bp, Artificial Sequence
  dgRNA
  Taok3
cctgcaagggccaat

SEQ ID NO: 54450 - DNA, 15 bp, Artificial Sequence
  dgRNA
  Taok3
aggacactaccaccc

SEQ ID NO: 54451 - DNA, 15 bp, Artificial Sequence
  dgRNA
  Taok3
ctagtgatcacctga

SEQ ID NO: 54452 - DNA, 15 bp, Artificial Sequence
  dgRNA
  Tpd52l1
tgcgcgtttgtgtgc

SEQ ID NO: 54453 - DNA, 15 bp, Artificial Sequence
  dgRNA
  Tpd52l1
cgtttgtgtgctgga

SEQ ID NO: 54454 - DNA, 15 bp, Artificial Sequence
  dgRNA
  Tpd52l1
actgggtgcgcagag

SEQ ID NO: 54455 - DNA, 15 bp, Artificial Sequence
  dgRNA
  Tpd52l1
ggtgcgcagagcggc

SEQ ID NO: 54456 - DNA, 15 bp, Artificial Sequence
  dgRNA
  Tmem104
ggcgtccccaacgac

SEQ ID NO: 54457 - DNA, 15 bp, Artificial Sequence
  dgRNA
  Tmem104
cgtcagcgtctgtcc

SEQ ID NO: 54458 - DNA, 15 bp, Artificial Sequence
  dgRNA
  Tmem104
ctgtcccggagaaac

SEQ ID NO: 54459 - DNA, 15 bp, Artificial Sequence
  dgRNA
  Tmem104
tccgcatgcgcgtag

SEQ ID NO: 54460 - DNA, 15 bp, Artificial Sequence
  dgRNA
  Nlrp6
taggatgccacaccc

SEQ ID NO: 54461 - DNA, 15 bp, Artificial Sequence
  dgRNA
  Nlrp6
gcgtgaaaatcaaga

SEQ ID NO: 54462 - DNA, 15 bp, Artificial Sequence
  dgRNA
  Nlrp6
ggcgtgaaaatcaag

SEQ ID NO: 54463 - DNA, 15 bp, Artificial Sequence
  dgRNA
  Nlrp6
agctgactcacaacc

SEQ ID NO: 54464 - DNA, 15 bp, Artificial Sequence
  dgRNA
  Wwtr1
aggctggctccggcc

SEQ ID NO: 54465 - DNA, 15 bp, Artificial Sequence
  dgRNA
  Wwtr1
ctggctccggccagg

SEQ ID NO: 54466 - DNA, 15 bp, Artificial Sequence
  dgRNA
  Wwtr1
cccgcctctttccta

SEQ ID NO: 54467 - DNA, 15 bp, Artificial Sequence
  dgRNA
  Wwtr1
ccgcctctttcctaa

SEQ ID NO: 54468 - DNA, 15 bp, Artificial Sequence
  dgRNA
  Plekhm3
aaacatcctcggtct

SEQ ID NO: 54469 - DNA, 15 bp, Artificial Sequence
  dgRNA
  Plekhm3
aacatcctcggtctt

SEQ ID NO: 54470 - DNA, 15 bp, Artificial Sequence
  dgRNA
  Plekhm3
gcctgctcctcccgt

SEQ ID NO: 54471 - DNA, 15 bp, Artificial Sequence
  dgRNA
  Plekhm3
tgctcctcccgtagg

SEQ ID NO: 54472 - DNA, 15 bp, Artificial Sequence
  dgRNA
  Hmga1
cgagcagcctggcgt

SEQ ID NO: 54473 - DNA, 15 bp, Artificial Sequence
  dgRNA
  Prr5
tgtggtggcttccga

SEQ ID NO: 54474 - DNA, 15 bp, Artificial Sequence
  dgRNA
  Prr5
gtggtggcttccgaa

SEQ ID NO: 54475 - DNA, 15 bp, Artificial Sequence
  dgRNA
  Prr5
cttccgaagggaaga

SEQ ID NO: 54476 - DNA, 15 bp, Artificial Sequence
  dgRNA
  Prr5
gccctttggccgcag

SEQ ID NO: 54477 - DNA, 15 bp, Artificial Sequence
  dgRNA
  Prdm5
aacgcagagatggtg

SEQ ID NO: 54478 - DNA, 15 bp, Artificial Sequence
  dgRNA
  Prdm5
tgaggagggtcgatg

SEQ ID NO: 54479 - DNA, 15 bp, Artificial Sequence
  dgRNA
  Prdm5
ggtcgatgtggctac

SEQ ID NO: 54480 - DNA, 15 bp, Artificial Sequence
  dgRNA
  Prdm5
tcctcatctcggagc

SEQ ID NO: 54481 - DNA, 15 bp, Artificial Sequence
  dgRNA
  Cryga
aaatgacaaagcgcg

SEQ ID NO: 54482 - DNA, 15 bp, Artificial Sequence
  dgRNA
  Cryga
cttacacatcccccc

SEQ ID NO: 54483 - DNA, 15 bp, Artificial Sequence
  dgRNA
  Cryga
ggctctcgttctctc

SEQ ID NO: 54484 - DNA, 15 bp, Artificial Sequence
  dgRNA
  Cryga
tcatttgggatcatg

SEQ ID NO: 54485 - DNA, 15 bp, Artificial Sequence
  dgRNA
  Ip6k3
ggcattcaggcctag

SEQ ID NO: 54486 - DNA, 15 bp, Artificial Sequence
  dgRNA
  Ip6k3
agcctagatctggac

SEQ ID NO: 54487 - DNA, 15 bp, Artificial Sequence
  dgRNA
  Ip6k3
gatctaggctgtcag

SEQ ID NO: 54488 - DNA, 15 bp, Artificial Sequence
  dgRNA
  Ip6k3
ttcccgtccagatct

SEQ ID NO: 54489 - DNA, 15 bp, Artificial Sequence
  dgRNA
  Gstm3
ttgggggcacccatt

SEQ ID NO: 54490 - DNA, 15 bp, Artificial Sequence
  dgRNA
  Gstm3
tgggggcacccatta

SEQ ID NO: 54491 - DNA, 15 bp, Artificial Sequence
  dgRNA
  Gstm3
gggggcacccattag

SEQ ID NO: 54492 - DNA, 15 bp, Artificial Sequence
  dgRNA
  Gstm3
gcacccattaggggg

SEQ ID NO: 54493 - DNA, 15 bp, Artificial Sequence
  dgRNA
  Cdh19
atcagaatgccctta

SEQ ID NO: 54494 - DNA, 15 bp, Artificial Sequence
  dgRNA
  Cdh19
tccgttcttagtctg

SEQ ID NO: 54495 - DNA, 15 bp, Artificial Sequence
  dgRNA
  Cdh19
gttcaaagtaccata

SEQ ID NO: 54496 - DNA, 15 bp, Artificial Sequence
  dgRNA
  Herpud2
tggtcgcgccttccg

SEQ ID NO: 54497 - DNA, 15 bp, Artificial Sequence
  dgRNA
  Herpud2
ggtcgcgccttccga

SEQ ID NO: 54498 - DNA, 15 bp, Artificial Sequence
  dgRNA
  Herpud2
gccttccgagggacc

SEQ ID NO: 54499 - DNA, 15 bp, Artificial Sequence
  dgRNA
  Herpud2
gacccggcgccccac

SEQ ID NO: 54500 - DNA, 15 bp, Artificial Sequence
  dgRNA
  Adgrf1
gaaacgggaagtctt

SEQ ID NO: 54501 - DNA, 15 bp, Artificial Sequence
  dgRNA
  Adgrf1
tctgagtgggcggga

SEQ ID NO: 54502 - DNA, 15 bp, Artificial Sequence
  dgRNA
  Adgrf1
ttgggcatgcagatc

SEQ ID NO: 54503 - DNA, 15 bp, Artificial Sequence
  dgRNA
  Adgrf1
ggacaaatatgctct

SEQ ID NO: 54504 - DNA, 15 bp, Artificial Sequence
  dgRNA
  Mta1
aagggccactcggcc

SEQ ID NO: 54505 - DNA, 15 bp, Artificial Sequence
  dgRNA
  Mta1
gggccactcggccag

SEQ ID NO: 54506 - DNA, 15 bp, Artificial Sequence
  dgRNA
  Mta1
tcggccaggggcacg

SEQ ID NO: 54507 - DNA, 15 bp, Artificial Sequence
  dgRNA
  Mta1
cggccaggggcacgc

SEQ ID NO: 54508 - DNA, 15 bp, Artificial Sequence
  dgRNA
  Htr2a
aagaatgggggcgcg

SEQ ID NO: 54509 - DNA, 15 bp, Artificial Sequence
  dgRNA
  Htr2a
agaatgggggcgcgc

SEQ ID NO: 54510 - DNA, 15 bp, Artificial Sequence
  dgRNA
  Htr2a
gaatgggggcgcgcg

SEQ ID NO: 54511 - DNA, 15 bp, Artificial Sequence
  dgRNA
  Htr2a
aatgggggcgcgcgg

SEQ ID NO: 54512 - DNA, 15 bp, Artificial Sequence
  dgRNA
  Slc25a3
tcacctgcccgtcca

SEQ ID NO: 54513 - DNA, 15 bp, Artificial Sequence
  dgRNA
  Slc25a3
tcctgcgcactagca

SEQ ID NO: 54514 - DNA, 15 bp, Artificial Sequence
  dgRNA
  Slc25a3
gcgcactagcagggc

SEQ ID NO: 54515 - DNA, 15 bp, Artificial Sequence
  dgRNA
  Slc25a3
actagcagggccgga

SEQ ID NO: 54516 - DNA, 15 bp, Artificial Sequence
  dgRNA
  Olfr447
caagtcaagaatatt

SEQ ID NO: 54517 - DNA, 15 bp, Artificial Sequence
  dgRNA
  Olfr447
gtcaagaatattagg

SEQ ID NO: 54518 - DNA, 15 bp, Artificial Sequence
  dgRNA
  Olfr447
tcaagaatattagga

SEQ ID NO: 54519 - DNA, 15 bp, Artificial Sequence
  dgRNA
  Mapre2
cggtcactagtttag

SEQ ID NO: 54520 - DNA, 15 bp, Artificial Sequence
  dgRNA
  Mapre2
ggtcactagtttagc

SEQ ID NO: 54521 - DNA, 15 bp, Artificial Sequence
  dgRNA
  Mapre2
ttagcgggtctgacc

SEQ ID NO: 54522 - DNA, 15 bp, Artificial Sequence
  dgRNA
  Mapre2
tccacctcgtaccta

SEQ ID NO: 54523 - DNA, 15 bp, Artificial Sequence
  dgRNA
  Hps1
tgtcaccggctcagc

SEQ ID NO: 54524 - DNA, 15 bp, Artificial Sequence
  dgRNA
  Hps1
atacctacttatgcc

SEQ ID NO: 54525 - DNA, 15 bp, Artificial Sequence
  dgRNA
  Hps1
atgccagggtgaacg

SEQ ID NO: 54526 - DNA, 15 bp, Artificial Sequence
  dgRNA
  Hps1
agggtgaacgtggca

SEQ ID NO: 54527 - DNA, 15 bp, Artificial Sequence
  dgRNA
  Papss1
gcctagctccagccg

SEQ ID NO: 54528 - DNA, 15 bp, Artificial Sequence
  dgRNA
  Papss1
gaggcgatcactagc

SEQ ID NO: 54529 - DNA, 15 bp, Artificial Sequence
  dgRNA
  Papss1
ccactgctcggcccc

SEQ ID NO: 54530 - DNA, 15 bp, Artificial Sequence
  dgRNA
  Papss1
cactgctcggccccg

SEQ ID NO: 54531 - DNA, 15 bp, Artificial Sequence
  dgRNA
  Fbxo3
gtaagatttagggag

SEQ ID NO: 54532 - DNA, 15 bp, Artificial Sequence
  dgRNA
  Fbxo3
gagatataaaatgcg

SEQ ID NO: 54533 - DNA, 15 bp, Artificial Sequence
  dgRNA
  Fbxo3
agcagcgcccccgca

SEQ ID NO: 54534 - DNA, 15 bp, Artificial Sequence
  dgRNA
  Fbxo3
tacactaaccctacc

SEQ ID NO: 54535 - DNA, 15 bp, Artificial Sequence
  dgRNA
  Arsg
gttatgagtcgctgc

SEQ ID NO: 54536 - DNA, 15 bp, Artificial Sequence
  dgRNA
  Arsg
ttatgagtcgctgca

SEQ ID NO: 54537 - DNA, 15 bp, Artificial Sequence
  dgRNA
  Arsg
cgctgcagggcacca

SEQ ID NO: 54538 - DNA, 15 bp, Artificial Sequence
  dgRNA
  Arsg
ggcaccaaggcccct

SEQ ID NO: 54539 - DNA, 15 bp, Artificial Sequence
  dgRNA
  Adcy7
acattggttgcagcc

SEQ ID NO: 54540 - DNA, 15 bp, Artificial Sequence
  dgRNA
  Adcy7
agggcagacgagatc

SEQ ID NO: 54541 - DNA, 15 bp, Artificial Sequence
  dgRNA
  Adcy7
ctctggtctcctcgg

SEQ ID NO: 54542 - DNA, 15 bp, Artificial Sequence
  dgRNA
  Adcy7
tggtctcctcggagg

SEQ ID NO: 54543 - DNA, 15 bp, Artificial Sequence
  dgRNA
  Ugt1a1
cctcccactatgtca

SEQ ID NO: 54544 - DNA, 15 bp, Artificial Sequence
  dgRNA
  Ugt1a1
gacagctttagtcat

SEQ ID NO: 54545 - DNA, 15 bp, Artificial Sequence
  dgRNA
  Ugt1a1
caatcaatcattaac

SEQ ID NO: 54546 - DNA, 15 bp, Artificial Sequence
  dgRNA
  Ugt1a1
attaactggttgcac

SEQ ID NO: 54547 - DNA, 15 bp, Artificial Sequence
  dgRNA
  Cdk12
gtgccgaggaactct

SEQ ID NO: 54548 - DNA, 15 bp, Artificial Sequence
  dgRNA
  Cdk12
ccccccacctcatgt

SEQ ID NO: 54549 - DNA, 15 bp, Artificial Sequence
  dgRNA
  Cdk12
cccacctcatgtagg

SEQ ID NO: 54550 - DNA, 15 bp, Artificial Sequence
  dgRNA
  Cdk12
ccacctcatgtagga

SEQ ID NO: 54551 - DNA, 15 bp, Artificial Sequence
  dgRNA
  Gm4737
tgaacttgtcactag

SEQ ID NO: 54552 - DNA, 15 bp, Artificial Sequence
  dgRNA
  Ptgfrn
ggcaaagcgccgggt

SEQ ID NO: 54553 - DNA, 15 bp, Artificial Sequence
  dgRNA
  Ptgfrn
aaagcgccgggtggg

SEQ ID NO: 54554 - DNA, 15 bp, Artificial Sequence
  dgRNA
  Ptgfrn
ccgggtgggaggcgc

SEQ ID NO: 54555 - DNA, 15 bp, Artificial Sequence
  dgRNA
  Ptgfrn
ggcgggcggacgcca

SEQ ID NO: 54556 - DNA, 15 bp, Artificial Sequence
  dgRNA
  Spata2
gctcgtgcctccccg

SEQ ID NO: 54557 - DNA, 15 bp, Artificial Sequence
  dgRNA
  Spata2
ctccccgcggtccct

SEQ ID NO: 54558 - DNA, 15 bp, Artificial Sequence
  dgRNA
  Spata2
cggtccctaggagtg

SEQ ID NO: 54559 - DNA, 15 bp, Artificial Sequence
  dgRNA
  Spata2
tgaggtccggttcta

SEQ ID NO: 54560 - DNA, 15 bp, Artificial Sequence
  dgRNA
  Olfr5
caagggaatcctccc

SEQ ID NO: 54561 - DNA, 15 bp, Artificial Sequence
  dgRNA
  Olfr5
accagctctagacct

SEQ ID NO: 54562 - DNA, 15 bp, Artificial Sequence
  dgRNA
  Olfr5
aaccagctctagacc

SEQ ID NO: 54563 - DNA, 15 bp, Artificial Sequence
  dgRNA
  Olfr5
tcagtacatcttgag

SEQ ID NO: 54564 - DNA, 15 bp, Artificial Sequence
  dgRNA
  Spata16
gccgtagctccccga

SEQ ID NO: 54565 - DNA, 15 bp, Artificial Sequence
  dgRNA
  Spata16
gtagctccccgatgg

SEQ ID NO: 54566 - DNA, 15 bp, Artificial Sequence
  dgRNA
  Spata16
tagctccccgatggt

SEQ ID NO: 54567 - DNA, 15 bp, Artificial Sequence
  dgRNA
  Spata16
atggtgggccgagcc

SEQ ID NO: 54568 - DNA, 15 bp, Artificial Sequence
  dgRNA
  H2-M3
tcgggtacttttgcc

SEQ ID NO: 54569 - DNA, 15 bp, Artificial Sequence
  dgRNA
  H2-M3
aattcccattctaat

SEQ ID NO: 54570 - DNA, 15 bp, Artificial Sequence
  dgRNA
  H2-M3
gcgtcatcagtatcc

SEQ ID NO: 54571 - DNA, 15 bp, Artificial Sequence
  dgRNA
  H2-M3
agcgtcatcagtatc

SEQ ID NO: 54572 - DNA, 15 bp, Artificial Sequence
  dgRNA
  Plekhg3
gttaatcattagcca

SEQ ID NO: 54573 - DNA, 15 bp, Artificial Sequence
  dgRNA
  Plekhg3
aatcattagccacgg

SEQ ID NO: 54574 - DNA, 15 bp, Artificial Sequence
  dgRNA
  Plekhg3
ggccgctgtctacag

SEQ ID NO: 54575 - DNA, 15 bp, Artificial Sequence
  dgRNA
  Plekhg3
gccgctgtctacagc

SEQ ID NO: 54576 - DNA, 15 bp, Artificial Sequence
  dgRNA
  Esr2
tcatcgtcagtctat

SEQ ID NO: 54577 - DNA, 15 bp, Artificial Sequence
  dgRNA
  Esr2
tcagtctattggaag

SEQ ID NO: 54578 - DNA, 15 bp, Artificial Sequence
  dgRNA
  Esr2
cagtctattggaagc

SEQ ID NO: 54579 - DNA, 15 bp, Artificial Sequence
  dgRNA
  Esr2
agtctattggaagcg

SEQ ID NO: 54580 - DNA, 15 bp, Artificial Sequence
  dgRNA
  Wfdc3
ttgactaagagtgtt

SEQ ID NO: 54581 - DNA, 15 bp, Artificial Sequence
  dgRNA
  Wfdc3
gttaggtatatccca

SEQ ID NO: 54582 - DNA, 15 bp, Artificial Sequence
  dgRNA
  Wfdc3
tcccacggcagcatt

SEQ ID NO: 54583 - DNA, 15 bp, Artificial Sequence
  dgRNA
  Wfdc3
ggtgaaccagaccag

SEQ ID NO: 54584 - DNA, 15 bp, Artificial Sequence
  dgRNA
  Zc3h18
gatgacgttgcacaa

SEQ ID NO: 54585 - DNA, 15 bp, Artificial Sequence
  dgRNA
  Zc3h18
acgttgcacaatggc

SEQ ID NO: 54586 - DNA, 15 bp, Artificial Sequence
  dgRNA
  Zc3h18
aatggccggcccccg

SEQ ID NO: 54587 - DNA, 15 bp, Artificial Sequence
  dgRNA
  Zc3h18
atggccggcccccgc

SEQ ID NO: 54588 - DNA, 15 bp, Artificial Sequence
  dgRNA
  Ctxn1
taggagaggcttccg

SEQ ID NO: 54589 - DNA, 15 bp, Artificial Sequence
  dgRNA
  Ctxn1
aggagaggcttccgt

SEQ ID NO: 54590 - DNA, 15 bp, Artificial Sequence
  dgRNA
  Ctxn1
gcccatgtcctggcg

SEQ ID NO: 54591 - DNA, 15 bp, Artificial Sequence
  dgRNA
  Ctxn1
gtcctggcgaggtcc

SEQ ID NO: 54592 - DNA, 15 bp, Artificial Sequence
  dgRNA
  Rhox6
cgttcaggcttaacc

SEQ ID NO: 54593 - DNA, 15 bp, Artificial Sequence
  dgRNA
  Rhox6
gttcaggcttaacca

SEQ ID NO: 54594 - DNA, 15 bp, Artificial Sequence
  dgRNA
  Rhox6
cttaaccagggctac

SEQ ID NO: 54595 - DNA, 15 bp, Artificial Sequence
  dgRNA
  Rhox6
ctggttaagcctgaa

SEQ ID NO: 54596 - DNA, 15 bp, Artificial Sequence
  dgRNA
  Sgms2
tctagttcctcccaa

SEQ ID NO: 54597 - DNA, 15 bp, Artificial Sequence
  dgRNA
  Sgms2
cttagtagtcccctg

SEQ ID NO: 54598 - DNA, 15 bp, Artificial Sequence
  dgRNA
  Sgms2
tcccctgaggtagat

SEQ ID NO: 54599 - DNA, 15 bp, Artificial Sequence
  dgRNA
  Sgms2
cgaagatcttcctct

SEQ ID NO: 54600 - DNA, 15 bp, Artificial Sequence
  dgRNA
  Pde4b
agcccccaaacaagt

SEQ ID NO: 54601 - DNA, 15 bp, Artificial Sequence
  dgRNA
  Pde4b
ttgccctagtcagtg

SEQ ID NO: 54602 - DNA, 15 bp, Artificial Sequence
  dgRNA
  Pde4b
ccctagtcagtgtgg

SEQ ID NO: 54603 - DNA, 15 bp, Artificial Sequence
  dgRNA
  Pde4b
cctagtcagtgtggt

SEQ ID NO: 54604 - DNA, 15 bp, Artificial Sequence
  dgRNA
  Selenbp1
gtaatttcaacagcc

SEQ ID NO: 54605 - DNA, 15 bp, Artificial Sequence
  dgRNA
  Selenbp1
cacctctcccccaat

SEQ ID NO: 54606 - DNA, 15 bp, Artificial Sequence
  dgRNA
  Selenbp1
catctgagccatttt

SEQ ID NO: 54607 - DNA, 15 bp, Artificial Sequence
  dgRNA
  Selenbp1
tatgcaaccaattgg

SEQ ID NO: 54608 - DNA, 15 bp, Artificial Sequence
  dgRNA
  Prss36
gccacaccccaatca

SEQ ID NO: 54609 - DNA, 15 bp, Artificial Sequence
  dgRNA
  Prss36
ccacaccccaatcaa

SEQ ID NO: 54610 - DNA, 15 bp, Artificial Sequence
  dgRNA
  Prss36
ccccaatcaagggtg

SEQ ID NO: 54611 - DNA, 15 bp, Artificial Sequence
  dgRNA
  Prss36
aggtgagtcatgcca

SEQ ID NO: 54612 - DNA, 15 bp, Artificial Sequence
  dgRNA
  Ttn
agaaggcttcctacg

SEQ ID NO: 54613 - DNA, 15 bp, Artificial Sequence
  dgRNA
  Ttn
ttcctacgtggctct

SEQ ID NO: 54614 - DNA, 15 bp, Artificial Sequence
  dgRNA
  Ttn
tcctacgtggctcta

SEQ ID NO: 54615 - DNA, 15 bp, Artificial Sequence
  dgRNA
  Ttn
ctagactaatccgtt

SEQ ID NO: 54616 - DNA, 15 bp, Artificial Sequence
  dgRNA
  Cfi
aacactttctattgg

SEQ ID NO: 54617 - DNA, 15 bp, Artificial Sequence
  dgRNA
  Cfi
gcctcaggaatttac

SEQ ID NO: 54618 - DNA, 15 bp, Artificial Sequence
  dgRNA
  Cfi
gttccgataaagctc

SEQ ID NO: 54619 - DNA, 15 bp, Artificial Sequence
  dgRNA
  Gucy2f
ggcagtcgtctgtgg

SEQ ID NO: 54620 - DNA, 15 bp, Artificial Sequence
  dgRNA
  Gucy2f
ggtgcgtatgtctag

SEQ ID NO: 54621 - DNA, 15 bp, Artificial Sequence
  dgRNA
  Gucy2f
tgggtcaatgcattt

SEQ ID NO: 54622 - DNA, 15 bp, Artificial Sequence
  dgRNA
  Gucy2f
ctctcactcggctac

SEQ ID NO: 54623 - DNA, 15 bp, Artificial Sequence
  dgRNA
  Fam19a4
gcgcacacagcagta

SEQ ID NO: 54624 - DNA, 15 bp, Artificial Sequence
  dgRNA
  Fam19a4
acacagcagtacggt

SEQ ID NO: 54625 - DNA, 15 bp, Artificial Sequence
  dgRNA
  Fam19a4
agcagtacggtaggg

SEQ ID NO: 54626 - DNA, 15 bp, Artificial Sequence
  dgRNA
  Fam19a4
tacggtagggaggtg

SEQ ID NO: 54627 - DNA, 15 bp, Artificial Sequence
  dgRNA
  Ces2g
gtcgctgtatttatc

SEQ ID NO: 54628 - DNA, 15 bp, Artificial Sequence
  dgRNA
  Ces2g
ttagtcagaagtaac

SEQ ID NO: 54629 - DNA, 15 bp, Artificial Sequence
  dgRNA
  Sez6l
atcactaacttctca

SEQ ID NO: 54630 - DNA, 15 bp, Artificial Sequence
  dgRNA
  Sez6l
aggctgcccccggaa

SEQ ID NO: 54631 - DNA, 15 bp, Artificial Sequence
  dgRNA
  Sez6l
ccccggaacggccct

SEQ ID NO: 54632 - DNA, 15 bp, Artificial Sequence
  dgRNA
  Sez6l
ccctcgctcgctcgc

SEQ ID NO: 54633 - DNA, 15 bp, Artificial Sequence
  dgRNA
  Rspo3
gacccgggacccctt

SEQ ID NO: 54634 - DNA, 15 bp, Artificial Sequence
  dgRNA
  Rspo3
ttattgaggtcgctc

SEQ ID NO: 54635 - DNA, 15 bp, Artificial Sequence
  dgRNA
  Rspo3
tattgaggtcgctcc

SEQ ID NO: 54636 - DNA, 15 bp, Artificial Sequence
  dgRNA
  Rspo3
cgcctaaggggtccc

SEQ ID NO: 54637 - DNA, 15 bp, Artificial Sequence
  dgRNA
  Ubxn4
gtcaacgtgccgtag

SEQ ID NO: 54638 - DNA, 15 bp, Artificial Sequence
  dgRNA
  Ubxn4
gtaagagtaaatgct

SEQ ID NO: 54639 - DNA, 15 bp, Artificial Sequence
  dgRNA
  Ubxn4
tgttaatttgcggaa

SEQ ID NO: 54640 - DNA, 15 bp, Artificial Sequence
  dgRNA
  Ubxn4
aattgtagtcttccg

SEQ ID NO: 54641 - DNA, 15 bp, Artificial Sequence
  dgRNA
  Arhgap42
tggtttggggcgcac

SEQ ID NO: 54642 - DNA, 15 bp, Artificial Sequence
  dgRNA
  Arhgap42
ggtttggggcgcaca

SEQ ID NO: 54643 - DNA, 15 bp, Artificial Sequence
  dgRNA
  Arhgap42
cagtgggcccagacg

SEQ ID NO: 54644 - DNA, 15 bp, Artificial Sequence
  dgRNA
  Arhgap42
gggcccagacgggga

SEQ ID NO: 54645 - DNA, 15 bp, Artificial Sequence
  dgRNA
  Lmo4
cccgcggctggctcg

SEQ ID NO: 54646 - DNA, 15 bp, Artificial Sequence
  dgRNA
  Lmo4
ccgcggctggctcgc

SEQ ID NO: 54647 - DNA, 15 bp, Artificial Sequence
  dgRNA
  Lmo4
cgcggctggctcgcg

SEQ ID NO: 54648 - DNA, 15 bp, Artificial Sequence
  dgRNA
  Lmo4
ctggctcgcggggct

SEQ ID NO: 54649 - DNA, 15 bp, Artificial Sequence
  dgRNA
  Scarf2
cccgcagtgcttcgc

SEQ ID NO: 54650 - DNA, 15 bp, Artificial Sequence
  dgRNA
  Scarf2
ccccgagttcgtgca

SEQ ID NO: 54651 - DNA, 15 bp, Artificial Sequence
  dgRNA
  Scarf2
agttcgtgcatggcc

SEQ ID NO: 54652 - DNA, 15 bp, Artificial Sequence
  dgRNA
  Scarf2
tcgtgcatggccagg

SEQ ID NO: 54653 - DNA, 15 bp, Artificial Sequence
  dgRNA
  Olfr510
gtaattatacatgct

SEQ ID NO: 54654 - DNA, 15 bp, Artificial Sequence
  dgRNA
  Pram1
gtgttaaaactaagg

SEQ ID NO: 54655 - DNA, 15 bp, Artificial Sequence
  dgRNA
  Pram1
actaagggggacaat

SEQ ID NO: 54656 - DNA, 15 bp, Artificial Sequence
  dgRNA
  Pram1
aatcaagaggctagt

SEQ ID NO: 54657 - DNA, 15 bp, Artificial Sequence
  dgRNA
  Pram1
aatgacctgactttg

SEQ ID NO: 54658 - DNA, 15 bp, Artificial Sequence
  dgRNA
  Abcc2
gcataggttgtgtac

SEQ ID NO: 54659 - DNA, 15 bp, Artificial Sequence
  dgRNA
  Abcc2
atttggtcacactac

SEQ ID NO: 54660 - DNA, 15 bp, Artificial Sequence
  dgRNA
  Abcc2
tttggtcacactaca

SEQ ID NO: 54661 - DNA, 15 bp, Artificial Sequence
  dgRNA
  Abcc2
ttggtcacactacag

SEQ ID NO: 54662 - DNA, 15 bp, Artificial Sequence
  dgRNA
  Fam26f
gctccctacagtctt

SEQ ID NO: 54663 - DNA, 15 bp, Artificial Sequence
  dgRNA
  Fam26f
agggactttatttgt

SEQ ID NO: 54664 - DNA, 15 bp, Artificial Sequence
  dgRNA
  Fam26f
ggactttaccagaac

SEQ ID NO: 54665 - DNA, 15 bp, Artificial Sequence
  dgRNA
  Fam26f
acatcccaagactgt

SEQ ID NO: 54666 - DNA, 15 bp, Artificial Sequence
  dgRNA
  Ptdss2
tgtacagtctctgtc

SEQ ID NO: 54667 - DNA, 15 bp, Artificial Sequence
  dgRNA
  Ptdss2
gtcaggcggagcacg

SEQ ID NO: 54668 - DNA, 15 bp, Artificial Sequence
  dgRNA
  Ptdss2
cggtctcctagcaac

SEQ ID NO: 54669 - DNA, 15 bp, Artificial Sequence
  dgRNA
  Ptdss2
ccgcgtccctcccac

SEQ ID NO: 54670 - DNA, 15 bp, Artificial Sequence
  dgRNA
  Cd81
ccagaacgcttactc

SEQ ID NO: 54671 - DNA, 15 bp, Artificial Sequence
  dgRNA
  Cd81
cagaacgcttactct

SEQ ID NO: 54672 - DNA, 15 bp, Artificial Sequence
  dgRNA
  Cd81
ccacccaagtacccc

SEQ ID NO: 54673 - DNA, 15 bp, Artificial Sequence
  dgRNA
  Cd81
caagtacccctggtc

SEQ ID NO: 54674 - DNA, 15 bp, Artificial Sequence
  dgRNA
  Slc26a1
aagataaccagcatc

SEQ ID NO: 54675 - DNA, 15 bp, Artificial Sequence
  dgRNA
  Slc26a1
tcacgcagttcctct

SEQ ID NO: 54676 - DNA, 15 bp, Artificial Sequence
  dgRNA
  Slc26a1
cacgcagttcctctg

SEQ ID NO: 54677 - DNA, 15 bp, Artificial Sequence
  dgRNA
  Slc26a1
agtaagctgaagctc

SEQ ID NO: 54678 - DNA, 15 bp, Artificial Sequence
  dgRNA
  Hoxb7
cgcgggggtcgacag

SEQ ID NO: 54679 - DNA, 15 bp, Artificial Sequence
  dgRNA
  Hoxb7
ccaatccgcagagct

SEQ ID NO: 54680 - DNA, 15 bp, Artificial Sequence
  dgRNA
  Hoxb7
attactgggagcctc

SEQ ID NO: 54681 - DNA, 15 bp, Artificial Sequence
  dgRNA
  Hoxb7
aggccgtcataccat

SEQ ID NO: 54682 - DNA, 15 bp, Artificial Sequence
  dgRNA
  Olfr669
attacacttatgagt

SEQ ID NO: 54683 - DNA, 15 bp, Artificial Sequence
  dgRNA
  Polr2i
ggccgccgctgcttc

SEQ ID NO: 54684 - DNA, 15 bp, Artificial Sequence
  dgRNA
  Polr2i
gccgccgctgcttct

SEQ ID NO: 54685 - DNA, 15 bp, Artificial Sequence
  dgRNA
  Polr2i
tcccgccccttgttc

SEQ ID NO: 54686 - DNA, 15 bp, Artificial Sequence
  dgRNA
  Polr2i
gttctccacctaaca

SEQ ID NO: 54687 - DNA, 15 bp, Artificial Sequence
  dgRNA
  Nkain1
cgcctccctccgggg

SEQ ID NO: 54688 - DNA, 15 bp, Artificial Sequence
  dgRNA
  Nkain1
ggccgagccacgtgg

SEQ ID NO: 54689 - DNA, 15 bp, Artificial Sequence
  dgRNA
  Nkain1
gccgagccacgtggt

SEQ ID NO: 54690 - DNA, 15 bp, Artificial Sequence
  dgRNA
  Nkain1
agccacgtggtgggc

SEQ ID NO: 54691 - DNA, 15 bp, Artificial Sequence
  dgRNA
  Aamp
cgtcgctctttcggc

SEQ ID NO: 54692 - DNA, 15 bp, Artificial Sequence
  dgRNA
  Aamp
gtcgctctttcggcc

SEQ ID NO: 54693 - DNA, 15 bp, Artificial Sequence
  dgRNA
  Aamp
acgcctacttcctcc

SEQ ID NO: 54694 - DNA, 15 bp, Artificial Sequence
  dgRNA
  Aamp
cgcctacttcctccc

SEQ ID NO: 54695 - DNA, 15 bp, Artificial Sequence
  dgRNA
  Ppp2r5c
agccggaaaatgccc

SEQ ID NO: 54696 - DNA, 15 bp, Artificial Sequence
  dgRNA
  Ppp2r5c
gctctttccgcttgc

SEQ ID NO: 54697 - DNA, 15 bp, Artificial Sequence
  dgRNA
  Ppp2r5c
gtgcattaaaaacct

SEQ ID NO: 54698 - DNA, 15 bp, Artificial Sequence
  dgRNA
  Ppp2r5c
aaagagcgttctgtt

SEQ ID NO: 54699 - DNA, 15 bp, Artificial Sequence
  dgRNA
  Smc3
tcaggtccgtctaag

SEQ ID NO: 54700 - DNA, 15 bp, Artificial Sequence
  dgRNA
  Smc3
caggtccgtctaaga

SEQ ID NO: 54701 - DNA, 15 bp, Artificial Sequence
  dgRNA
  Smc3
cgtctaagagggccg

SEQ ID NO: 54702 - DNA, 15 bp, Artificial Sequence
  dgRNA
  Smc3
gtctaagagggccgc

SEQ ID NO: 54703 - DNA, 15 bp, Artificial Sequence
  dgRNA
  Cep126
tagtttccgtcgcga

SEQ ID NO: 54704 - DNA, 15 bp, Artificial Sequence
  dgRNA
  Cep126
ccgtcgcgaaggacg

SEQ ID NO: 54705 - DNA, 15 bp, Artificial Sequence
  dgRNA
  Cep126
cgaaggacgcggcgt

SEQ ID NO: 54706 - DNA, 15 bp, Artificial Sequence
  dgRNA
  Cep126
ggacgcggcgtcggt

SEQ ID NO: 54707 - DNA, 15 bp, Artificial Sequence
  dgRNA
  Fhdc1
cgagggcgagctcag

SEQ ID NO: 54708 - DNA, 15 bp, Artificial Sequence
  dgRNA
  Fhdc1
gggcgagctcagtgg

SEQ ID NO: 54709 - DNA, 15 bp, Artificial Sequence
  dgRNA
  Fhdc1
gtggcggtgctgttc

SEQ ID NO: 54710 - DNA, 15 bp, Artificial Sequence
  dgRNA
  Fhdc1
tgctgttcgggttga

SEQ ID NO: 54711 - DNA, 15 bp, Artificial Sequence
  dgRNA
  Arhgef10
ctcgcaggaatgcgc

SEQ ID NO: 54712 - DNA, 15 bp, Artificial Sequence
  dgRNA
  Arhgef10
gaatgcgctggcgcg

SEQ ID NO: 54713 - DNA, 15 bp, Artificial Sequence
  dgRNA
  Arhgef10
aatgcgctggcgcga

SEQ ID NO: 54714 - DNA, 15 bp, Artificial Sequence
  dgRNA
  Arhgef10
cgctggcgcgagggt

SEQ ID NO: 54715 - DNA, 15 bp, Artificial Sequence
  dgRNA
  4930432M17Rik
gcagaatctacatct

SEQ ID NO: 54716 - DNA, 15 bp, Artificial Sequence
  dgRNA
  4930432M17Rik
agcagaatctacatc

SEQ ID NO: 54717 - DNA, 15 bp, Artificial Sequence
  dgRNA
  Myh9
agactcctgttggat

SEQ ID NO: 54718 - DNA, 15 bp, Artificial Sequence
  dgRNA
  Myh9
gactcctgttggatt

SEQ ID NO: 54719 - DNA, 15 bp, Artificial Sequence
  dgRNA
  Myh9
gagggcggggactct

SEQ ID NO: 54720 - DNA, 15 bp, Artificial Sequence
  dgRNA
  Myh9
ccacccacgagccgg

SEQ ID NO: 54721 - DNA, 15 bp, Artificial Sequence
  dgRNA
  Gipc1
tatttagagcgagta

SEQ ID NO: 54722 - DNA, 15 bp, Artificial Sequence
  dgRNA
  Gipc1
tagagcgagtaaggt

SEQ ID NO: 54723 - DNA, 15 bp, Artificial Sequence
  dgRNA
  Gipc1
ccactgctcgcacaa

SEQ ID NO: 54724 - DNA, 15 bp, Artificial Sequence
  dgRNA
  Gipc1
cactgctcgcacaat

SEQ ID NO: 54725 - DNA, 15 bp, Artificial Sequence
  dgRNA
  Vps26b
aaccggaatattaca

SEQ ID NO: 54726 - DNA, 15 bp, Artificial Sequence
  dgRNA
  Vps26b
cggaatattacaagg

SEQ ID NO: 54727 - DNA, 15 bp, Artificial Sequence
  dgRNA
  Vps26b
acttgacggaacatc

SEQ ID NO: 54728 - DNA, 15 bp, Artificial Sequence
  dgRNA
  Vps26b
cttgacggaacatct

SEQ ID NO: 54729 - DNA, 15 bp, Artificial Sequence
  dgRNA
  Crb1
tattaggagcaatca

SEQ ID NO: 54730 - DNA, 15 bp, Artificial Sequence
  dgRNA
  Crb1
gttcacggaagcctg

SEQ ID NO: 54731 - DNA, 15 bp, Artificial Sequence
  dgRNA
  Crb1
ttcacggaagcctga

SEQ ID NO: 54732 - DNA, 15 bp, Artificial Sequence
  dgRNA
  Crb1
tcacggaagcctgag

SEQ ID NO: 54733 - DNA, 15 bp, Artificial Sequence
  dgRNA
  Xkr6
cgggcgccgtgcgat

SEQ ID NO: 54734 - DNA, 15 bp, Artificial Sequence
  dgRNA
  Xkr6
gggcgccgtgcgatt

SEQ ID NO: 54735 - DNA, 15 bp, Artificial Sequence
  dgRNA
  Xkr6
ggcgccgtgcgattg

SEQ ID NO: 54736 - DNA, 15 bp, Artificial Sequence
  dgRNA
  Xkr6
gcgccgtgcgattgg

SEQ ID NO: 54737 - DNA, 15 bp, Artificial Sequence
  dgRNA
  Zcchc9
ctagactgcacattc

SEQ ID NO: 54738 - DNA, 15 bp, Artificial Sequence
  dgRNA
  Zcchc9
tagactgcacattct

SEQ ID NO: 54739 - DNA, 15 bp, Artificial Sequence
  dgRNA
  Zcchc9
tgggaccgcacagac

SEQ ID NO: 54740 - DNA, 15 bp, Artificial Sequence
  dgRNA
  Zcchc9
gggaccgcacagact

SEQ ID NO: 54741 - DNA, 15 bp, Artificial Sequence
  dgRNA
  Lima1
aatagaagttcaccc

SEQ ID NO: 54742 - DNA, 15 bp, Artificial Sequence
  dgRNA
  Lima1
tgtagttacattgga

SEQ ID NO: 54743 - DNA, 15 bp, Artificial Sequence
  dgRNA
  Xkr9
tatcaatagatagag

SEQ ID NO: 54744 - DNA, 15 bp, Artificial Sequence
  dgRNA
  Xkr9
gcacacgtgactaac

SEQ ID NO: 54745 - DNA, 15 bp, Artificial Sequence
  dgRNA
  Xkr9
accatttaatagtta

SEQ ID NO: 54746 - DNA, 15 bp, Artificial Sequence
  dgRNA
  Xkr9
actctatctattgat

SEQ ID NO: 54747 - DNA, 15 bp, Artificial Sequence
  dgRNA
  Hmcn1
agccgggctccgggt

SEQ ID NO: 54748 - DNA, 15 bp, Artificial Sequence
  dgRNA
  Hmcn1
gaccaacccggagcc

SEQ ID NO: 54749 - DNA, 15 bp, Artificial Sequence
  dgRNA
  Rnf219
ataggggaaatgccg

SEQ ID NO: 54750 - DNA, 15 bp, Artificial Sequence
  dgRNA
  Rnf219
gaaatgccggggtga

SEQ ID NO: 54751 - DNA, 15 bp, Artificial Sequence
  dgRNA
  Rnf219
tccgtcccctcgccc

SEQ ID NO: 54752 - DNA, 15 bp, Artificial Sequence
  dgRNA
  Rnf219
cgccccggctcgctg

SEQ ID NO: 54753 - DNA, 15 bp, Artificial Sequence
  dgRNA
  Hmgcs1
gtccccgcctctcat

SEQ ID NO: 54754 - DNA, 15 bp, Artificial Sequence
  dgRNA
  Hmgcs1
tggctgaaagcggat

SEQ ID NO: 54755 - DNA, 15 bp, Artificial Sequence
  dgRNA
  Hmgcs1
ggctgaaagcggatc

SEQ ID NO: 54756 - DNA, 15 bp, Artificial Sequence
  dgRNA
  Hmgcs1
gctgaaagcggatcg

SEQ ID NO: 54757 - DNA, 15 bp, Artificial Sequence
  dgRNA
  Vmn1r210
agggggacaagtttc

SEQ ID NO: 54758 - DNA, 15 bp, Artificial Sequence
  dgRNA
  Vmn1r210
gggggacaagtttca

SEQ ID NO: 54759 - DNA, 15 bp, Artificial Sequence
  dgRNA
  Vmn1r210
aaagtggatacatcc

SEQ ID NO: 54760 - DNA, 15 bp, Artificial Sequence
  dgRNA
  Vmn1r210
gtaatgttgcaggtt

SEQ ID NO: 54761 - DNA, 15 bp, Artificial Sequence
  dgRNA
  Glg1
acagttcctccggga

SEQ ID NO: 54762 - DNA, 15 bp, Artificial Sequence
  dgRNA
  Glg1
cactttcccgccagc

SEQ ID NO: 54763 - DNA, 15 bp, Artificial Sequence
  dgRNA
  Glg1
actttcccgccagcc

SEQ ID NO: 54764 - DNA, 15 bp, Artificial Sequence
  dgRNA
  Glg1
ccgccagccgggtcc

SEQ ID NO: 54765 - DNA, 15 bp, Artificial Sequence
  dgRNA
  Vmn1r68
attggtaaaggcctc

SEQ ID NO: 54766 - DNA, 15 bp, Artificial Sequence
  dgRNA
  Vmn1r68
atagtattgtaagat

SEQ ID NO: 54767 - DNA, 15 bp, Artificial Sequence
  dgRNA
  Vmn1r68
gggatcacagtggtt

SEQ ID NO: 54768 - DNA, 15 bp, Artificial Sequence
  dgRNA
  Hsf3
agtttgcggttcatg

SEQ ID NO: 54769 - DNA, 15 bp, Artificial Sequence
  dgRNA
  Vwa3a
tagccacttgctagc

SEQ ID NO: 54770 - DNA, 15 bp, Artificial Sequence
  dgRNA
  Vwa3a
tagctgggggaccct

SEQ ID NO: 54771 - DNA, 15 bp, Artificial Sequence
  dgRNA
  Vwa3a
actgcagcacaatcc

SEQ ID NO: 54772 - DNA, 15 bp, Artificial Sequence
  dgRNA
  Vwa3a
cagacacccttaagt

SEQ ID NO: 54773 - DNA, 15 bp, Artificial Sequence
  dgRNA
  Manf
ccctccgcaccccta

SEQ ID NO: 54774 - DNA, 15 bp, Artificial Sequence
  dgRNA
  Manf
ccctatggaccgccc

SEQ ID NO: 54775 - DNA, 15 bp, Artificial Sequence
  dgRNA
  Manf
aaccgacaactgtct

SEQ ID NO: 54776 - DNA, 15 bp, Artificial Sequence
  dgRNA
  Manf
gtagcgtggagccgc

SEQ ID NO: 54777 - DNA, 15 bp, Artificial Sequence
  dgRNA
  Foxi1
gagctcttgtcactt

SEQ ID NO: 54778 - DNA, 15 bp, Artificial Sequence
  dgRNA
  Foxi1
tgtcacttggggtac

SEQ ID NO: 54779 - DNA, 15 bp, Artificial Sequence
  dgRNA
  Foxi1
ttagcatgtcattag

SEQ ID NO: 54780 - DNA, 15 bp, Artificial Sequence
  dgRNA
  Foxi1
tagcatgtcattagt

SEQ ID NO: 54781 - DNA, 15 bp, Artificial Sequence
  dgRNA
  M1ap
gaggtccggagctcg

SEQ ID NO: 54782 - DNA, 15 bp, Artificial Sequence
  dgRNA
  M1ap
aggtccggagctcgc

SEQ ID NO: 54783 - DNA, 15 bp, Artificial Sequence
  dgRNA
  M1ap
ggagctcgcgggtga

SEQ ID NO: 54784 - DNA, 15 bp, Artificial Sequence
  dgRNA
  M1ap
gagctcgcgggtgag

SEQ ID NO: 54785 - DNA, 15 bp, Artificial Sequence
  dgRNA
  Qtrt1
tcactcggtaagcca

SEQ ID NO: 54786 - DNA, 15 bp, Artificial Sequence
  dgRNA
  Qtrt1
aacggtgacagctat

SEQ ID NO: 54787 - DNA, 15 bp, Artificial Sequence
  dgRNA
  Qtrt1
gacagctatgggatc

SEQ ID NO: 54788 - DNA, 15 bp, Artificial Sequence
  dgRNA
  Qtrt1
gagcacccaagcgtg

SEQ ID NO: 54789 - DNA, 15 bp, Artificial Sequence
  dgRNA
  Slc35a1
catggaaggccgtga

SEQ ID NO: 54790 - DNA, 15 bp, Artificial Sequence
  dgRNA
  Slc35a1
aaaagtccgagttct

SEQ ID NO: 54791 - DNA, 15 bp, Artificial Sequence
  dgRNA
  Slc35a1
tcggagcctctctaa

SEQ ID NO: 54792 - DNA, 15 bp, Artificial Sequence
  dgRNA
  Slc35a1
acggtcttcacacaa

SEQ ID NO: 54793 - DNA, 15 bp, Artificial Sequence
  dgRNA
  Snupn
tgcgatcagtactga

SEQ ID NO: 54794 - DNA, 15 bp, Artificial Sequence
  dgRNA
  Snupn
gaaggctccgtatcg

SEQ ID NO: 54795 - DNA, 15 bp, Artificial Sequence
  dgRNA
  Snupn
agcctaaaccaaatc

SEQ ID NO: 54796 - DNA, 15 bp, Artificial Sequence
  dgRNA
  Snupn
agagtcgctcagttc

SEQ ID NO: 54797 - DNA, 15 bp, Artificial Sequence
  dgRNA
  Inpp5e
cggaagactacagaa

SEQ ID NO: 54798 - DNA, 15 bp, Artificial Sequence
  dgRNA
  Inpp5e
aacggaacctgagcc

SEQ ID NO: 54799 - DNA, 15 bp, Artificial Sequence
  dgRNA
  Inpp5e
acggaacctgagcca

SEQ ID NO: 54800 - DNA, 15 bp, Artificial Sequence
  dgRNA
  Inpp5e
agctggggcgaaccc

SEQ ID NO: 54801 - DNA, 15 bp, Artificial Sequence
  dgRNA
  Slc43a1
gatcgcctcccttgt

SEQ ID NO: 54802 - DNA, 15 bp, Artificial Sequence
  dgRNA
  Slc43a1
ctcccttgttggcgg

SEQ ID NO: 54803 - DNA, 15 bp, Artificial Sequence
  dgRNA
  Slc43a1
tggcggtggctaccg

SEQ ID NO: 54804 - DNA, 15 bp, Artificial Sequence
  dgRNA
  Slc43a1
tggctaccgcggccc

SEQ ID NO: 54805 - DNA, 15 bp, Artificial Sequence
  dgRNA
  Pdlim7
cggcgtccgcggagg

SEQ ID NO: 54806 - DNA, 15 bp, Artificial Sequence
  dgRNA
  Pdlim7
ggcgtccgcggaggc

SEQ ID NO: 54807 - DNA, 15 bp, Artificial Sequence
  dgRNA
  Pdlim7
gcgtccgcggaggcg

SEQ ID NO: 54808 - DNA, 15 bp, Artificial Sequence
  dgRNA
  Rc3h2
ccctgtagctcccga

SEQ ID NO: 54809 - DNA, 15 bp, Artificial Sequence
  dgRNA
  Rc3h2
tcccgatggagtttg

SEQ ID NO: 54810 - DNA, 15 bp, Artificial Sequence
  dgRNA
  Rc3h2
cagggacagccccgt

SEQ ID NO: 54811 - DNA, 15 bp, Artificial Sequence
  dgRNA
  Rc3h2
tccatcgggagctac

SEQ ID NO: 54812 - DNA, 15 bp, Artificial Sequence
  dgRNA
  Rln3
gaaacttgctcggtg

SEQ ID NO: 54813 - DNA, 15 bp, Artificial Sequence
  dgRNA
  Rln3
ccctgtctgcgtgaa

SEQ ID NO: 54814 - DNA, 15 bp, Artificial Sequence
  dgRNA
  Rln3
ggttatctcttagca

SEQ ID NO: 54815 - DNA, 15 bp, Artificial Sequence
  dgRNA
  Rln3
gataacccaggtcag

SEQ ID NO: 54816 - DNA, 15 bp, Artificial Sequence
  dgRNA
  Gpr135
cgttcctgcgtaaat

SEQ ID NO: 54817 - DNA, 15 bp, Artificial Sequence
  dgRNA
  Gpr135
tcctgcgtaaatagg

SEQ ID NO: 54818 - DNA, 15 bp, Artificial Sequence
  dgRNA
  Gpr135
tccaccagtcccgag

SEQ ID NO: 54819 - DNA, 15 bp, Artificial Sequence
  dgRNA
  Gpr135
ccgcagctgccgttc

SEQ ID NO: 54820 - DNA, 15 bp, Artificial Sequence
  dgRNA
  Dcdc2a
gggaagcgaatgagc

SEQ ID NO: 54821 - DNA, 15 bp, Artificial Sequence
  dgRNA
  Dcdc2a
aagcgaatgagcagg

SEQ ID NO: 54822 - DNA, 15 bp, Artificial Sequence
  dgRNA
  Dcdc2a
ttagtgtgcaagaag

SEQ ID NO: 54823 - DNA, 15 bp, Artificial Sequence
  dgRNA
  Dcdc2a
gtgatgcgtgatgct

SEQ ID NO: 54824 - DNA, 15 bp, Artificial Sequence
  dgRNA
  Upk2
gctaactaagctgcc

SEQ ID NO: 54825 - DNA, 15 bp, Artificial Sequence
  dgRNA
  Upk2
agagcatcccccttt

SEQ ID NO: 54826 - DNA, 15 bp, Artificial Sequence
  dgRNA
  Upk2
ccccctttaggcccg

SEQ ID NO: 54827 - DNA, 15 bp, Artificial Sequence
  dgRNA
  Upk2
cccctttaggcccga

SEQ ID NO: 54828 - DNA, 15 bp, Artificial Sequence
  dgRNA
  Calml4
acaatcacccttctc

SEQ ID NO: 54829 - DNA, 15 bp, Artificial Sequence
  dgRNA
  Calml4
cccttctcaggacgg

SEQ ID NO: 54830 - DNA, 15 bp, Artificial Sequence
  dgRNA
  Calml4
ccttctcaggacggt

SEQ ID NO: 54831 - DNA, 15 bp, Artificial Sequence
  dgRNA
  Calml4
cttctcaggacggtg

SEQ ID NO: 54832 - DNA, 15 bp, Artificial Sequence
  dgRNA
  2610318N02Rik
ggtggagccaaaact

SEQ ID NO: 54833 - DNA, 15 bp, Artificial Sequence
  dgRNA
  2610318N02Rik
caaaactcgggcgcc

SEQ ID NO: 54834 - DNA, 15 bp, Artificial Sequence
  dgRNA
  2610318N02Rik
gggcgcctggccaat

SEQ ID NO: 54835 - DNA, 15 bp, Artificial Sequence
  dgRNA
  2610318N02Rik
tggccaatcggagcc

SEQ ID NO: 54836 - DNA, 15 bp, Artificial Sequence
  dgRNA
  Rapgef4
ggattttctactgta

SEQ ID NO: 54837 - DNA, 15 bp, Artificial Sequence
  dgRNA
  Rapgef4
gtagggttacttccc

SEQ ID NO: 54838 - DNA, 15 bp, Artificial Sequence
  dgRNA
  Rapgef4
tgcctccggagaagc

SEQ ID NO: 54839 - DNA, 15 bp, Artificial Sequence
  dgRNA
  Rapgef4
tgcaaatttctggcc

SEQ ID NO: 54840 - DNA, 15 bp, Artificial Sequence
  dgRNA
  Sdk1
ctgcaatccccgccg

SEQ ID NO: 54841 - DNA, 15 bp, Artificial Sequence
  dgRNA
  Sdk1
tgcaatccccgccgc

SEQ ID NO: 54842 - DNA, 15 bp, Artificial Sequence
  dgRNA
  Sdk1
ccgccgcgggtccct

SEQ ID NO: 54843 - DNA, 15 bp, Artificial Sequence
  dgRNA
  Sdk1
cgccgcgggtcccta

SEQ ID NO: 54844 - DNA, 15 bp, Artificial Sequence
  dgRNA
  Igfbp4
tcttcggcggggcaa

SEQ ID NO: 54845 - DNA, 15 bp, Artificial Sequence
  dgRNA
  Igfbp4
atgttgtagcggtgg

SEQ ID NO: 54846 - DNA, 15 bp, Artificial Sequence
  dgRNA
  Igfbp4
cggtggcggcgactc

SEQ ID NO: 54847 - DNA, 15 bp, Artificial Sequence
  dgRNA
  Igfbp4
cctcggggacggcgc

SEQ ID NO: 54848 - DNA, 15 bp, Artificial Sequence
  dgRNA
  Gap43
ggtgagcaatagctg

SEQ ID NO: 54849 - DNA, 15 bp, Artificial Sequence
  dgRNA
  Gap43
ttagcagcaactgta

SEQ ID NO: 54850 - DNA, 15 bp, Artificial Sequence
  dgRNA
  Dgkz
ctggcctgttactga

SEQ ID NO: 54851 - DNA, 15 bp, Artificial Sequence
  dgRNA
  Dgkz
ggctgtcactcggcc

SEQ ID NO: 54852 - DNA, 15 bp, Artificial Sequence
  dgRNA
  Dgkz
ggcttgggacgacgt

SEQ ID NO: 54853 - DNA, 15 bp, Artificial Sequence
  dgRNA
  Dgkz
gacgacgtgggagag

SEQ ID NO: 54854 - DNA, 15 bp, Artificial Sequence
  dgRNA
  Lce1j
tagatgcagtatgcc

SEQ ID NO: 54855 - DNA, 15 bp, Artificial Sequence
  dgRNA
  Lce1j
atgatatgactatgt

SEQ ID NO: 54856 - DNA, 15 bp, Artificial Sequence
  dgRNA
  Lce1j
aaggaccgatggaca

SEQ ID NO: 54857 - DNA, 15 bp, Artificial Sequence
  dgRNA
  Scgb2b27
agttaaggcatctac

SEQ ID NO: 54858 - DNA, 15 bp, Artificial Sequence
  dgRNA
  Scgb2b27
tgataatcgtttata

SEQ ID NO: 54859 - DNA, 15 bp, Artificial Sequence
  dgRNA
  Scgb2b27
tcgtttataaggaag

SEQ ID NO: 54860 - DNA, 15 bp, Artificial Sequence
  dgRNA
  Scgb2b27
ccttaacttgcagga

SEQ ID NO: 54861 - DNA, 15 bp, Artificial Sequence
  dgRNA
  Ppfibp1
tttatccgcgcccta

SEQ ID NO: 54862 - DNA, 15 bp, Artificial Sequence
  dgRNA
  Ppfibp1
ccctacggaccgcag

SEQ ID NO: 54863 - DNA, 15 bp, Artificial Sequence
  dgRNA
  Ppfibp1
cggaccgcagcggac

SEQ ID NO: 54864 - DNA, 15 bp, Artificial Sequence
  dgRNA
  Ppfibp1
ggaccgcagcggacc

SEQ ID NO: 54865 - DNA, 15 bp, Artificial Sequence
  dgRNA
  Caap1
agcaaacagatccgt

SEQ ID NO: 54866 - DNA, 15 bp, Artificial Sequence
  dgRNA
  Caap1
cgtagtaaaacgcgc

SEQ ID NO: 54867 - DNA, 15 bp, Artificial Sequence
  dgRNA
  Caap1
gtagtaaaacgcgcc

SEQ ID NO: 54868 - DNA, 15 bp, Artificial Sequence
  dgRNA
  Caap1
aaaacgcgccgggac

SEQ ID NO: 54869 - DNA, 15 bp, Artificial Sequence
  dgRNA
  Nova1
ggctaggagcgggaa

SEQ ID NO: 54870 - DNA, 15 bp, Artificial Sequence
  dgRNA
  Nova1
gtgtcggctaggagc

SEQ ID NO: 54871 - DNA, 15 bp, Artificial Sequence
  dgRNA
  Nova1
agtgtcggctaggag

SEQ ID NO: 54872 - DNA, 15 bp, Artificial Sequence
  dgRNA
  Nova1
agtgcagtgtcggct

SEQ ID NO: 54873 - DNA, 15 bp, Artificial Sequence
  dgRNA
  Shmt1
cgggcgaatcgcgcg

SEQ ID NO: 54874 - DNA, 15 bp, Artificial Sequence
  dgRNA
  Shmt1
gggcgaatcgcgcgt

SEQ ID NO: 54875 - DNA, 15 bp, Artificial Sequence
  dgRNA
  Shmt1
tcgcgcgtgggcagc

SEQ ID NO: 54876 - DNA, 15 bp, Artificial Sequence
  dgRNA
  Shmt1
cgcgcgtgggcagct

SEQ ID NO: 54877 - DNA, 15 bp, Artificial Sequence
  dgRNA
  Sepw1
cggcgaggggctctc

SEQ ID NO: 54878 - DNA, 15 bp, Artificial Sequence
  dgRNA
  Sepw1
cagagacgctgtcta

SEQ ID NO: 54879 - DNA, 15 bp, Artificial Sequence
  dgRNA
  Sepw1
tggagtcttgcgttg

SEQ ID NO: 54880 - DNA, 15 bp, Artificial Sequence
  dgRNA
  Sepw1
tgaggttcgcgcccc

SEQ ID NO: 54881 - DNA, 15 bp, Artificial Sequence
  dgRNA
  Dlg1
gcggagagagcggcg

SEQ ID NO: 54882 - DNA, 15 bp, Artificial Sequence
  dgRNA
  Dlg1
cggagagagcggcgc

SEQ ID NO: 54883 - DNA, 15 bp, Artificial Sequence
  dgRNA
  Dlg1
ggagagagcggcgcg

SEQ ID NO: 54884 - DNA, 15 bp, Artificial Sequence
  dgRNA
  Dlg1
gagagagcggcgcgg

SEQ ID NO: 54885 - DNA, 15 bp, Artificial Sequence
  dgRNA
  Wipf2
tactgaaagcctcgc

SEQ ID NO: 54886 - DNA, 15 bp, Artificial Sequence
  dgRNA
  Wipf2
tgaaagcctcgcagg

SEQ ID NO: 54887 - DNA, 15 bp, Artificial Sequence
  dgRNA
  Wipf2
cgggacttccaactg

SEQ ID NO: 54888 - DNA, 15 bp, Artificial Sequence
  dgRNA
  Wipf2
gcgaccttctcaaga

SEQ ID NO: 54889 - DNA, 15 bp, Artificial Sequence
  dgRNA
  Ankrd24
gggagaggccgtcct

SEQ ID NO: 54890 - DNA, 15 bp, Artificial Sequence
  dgRNA
  Ankrd24
ggagaggccgtcctt

SEQ ID NO: 54891 - DNA, 15 bp, Artificial Sequence
  dgRNA
  Ankrd24
gagaggccgtccttg

SEQ ID NO: 54892 - DNA, 15 bp, Artificial Sequence
  dgRNA
  Ankrd24
ccaccccaacctgat

SEQ ID NO: 54893 - DNA, 15 bp, Artificial Sequence
  dgRNA
  Rpl18
aagcctcggtttact

SEQ ID NO: 54894 - DNA, 15 bp, Artificial Sequence
  dgRNA
  Rpl18
cagagacgccagttc

SEQ ID NO: 54895 - DNA, 15 bp, Artificial Sequence
  dgRNA
  Rpl18
acgagtgcgtctcgc

SEQ ID NO: 54896 - DNA, 15 bp, Artificial Sequence
  dgRNA
  Rpl18
gacccggagcctctc

SEQ ID NO: 54897 - DNA, 15 bp, Artificial Sequence
  dgRNA
  Thtpa
ttccttagtgatcgg

SEQ ID NO: 54898 - DNA, 15 bp, Artificial Sequence
  dgRNA
  Thtpa
tccttagtgatcggt

SEQ ID NO: 54899 - DNA, 15 bp, Artificial Sequence
  dgRNA
  Thtpa
tagtgatcggtgggc

SEQ ID NO: 54900 - DNA, 15 bp, Artificial Sequence
  dgRNA
  Thtpa
atcggtgggcaggaa

SEQ ID NO: 54901 - DNA, 15 bp, Artificial Sequence
  dgRNA
  Slc32a1
gcccccgcacagctc

SEQ ID NO: 54902 - DNA, 15 bp, Artificial Sequence
  dgRNA
  Slc32a1
tggaagatagttccg

SEQ ID NO: 54903 - DNA, 15 bp, Artificial Sequence
  dgRNA
  Slc32a1
ggaagatagttccga

SEQ ID NO: 54904 - DNA, 15 bp, Artificial Sequence
  dgRNA
  Slc32a1
agatagttccgaggg

SEQ ID NO: 54905 - DNA, 15 bp, Artificial Sequence
  dgRNA
  C8g
acgctgagagccccg

SEQ ID NO: 54906 - DNA, 15 bp, Artificial Sequence
  dgRNA
  C8g
gccccgaggcatcga

SEQ ID NO: 54907 - DNA, 15 bp, Artificial Sequence
  dgRNA
  C8g
ttgcgcctgcgcctc

SEQ ID NO: 54908 - DNA, 15 bp, Artificial Sequence
  dgRNA
  C8g
aacagtactcactcc

SEQ ID NO: 54909 - DNA, 15 bp, Artificial Sequence
  dgRNA
  Trub1
attaggtgtttgcgt

SEQ ID NO: 54910 - DNA, 15 bp, Artificial Sequence
  dgRNA
  Trub1
ttggatagtttacag

SEQ ID NO: 54911 - DNA, 15 bp, Artificial Sequence
  dgRNA
  Trub1
acgactaagagcatt

SEQ ID NO: 54912 - DNA, 15 bp, Artificial Sequence
  dgRNA
  Trub1
cctataccgagccta

SEQ ID NO: 54913 - DNA, 15 bp, Artificial Sequence
  dgRNA
  Emd
ctcacaagccggttt

SEQ ID NO: 54914 - DNA, 15 bp, Artificial Sequence
  dgRNA
  Emd
agctccgcccctcgg

SEQ ID NO: 54915 - DNA, 15 bp, Artificial Sequence
  dgRNA
  Emd
cggcctagctctcaa

SEQ ID NO: 54916 - DNA, 15 bp, Artificial Sequence
  dgRNA
  Emd
tgatttgaccaaaac

SEQ ID NO: 54917 - DNA, 15 bp, Artificial Sequence
  dgRNA
  Apoc3
cccgctgtcccatcc

SEQ ID NO: 54918 - DNA, 15 bp, Artificial Sequence
  dgRNA
  Apoc3
gagccaatataaaac

SEQ ID NO: 54919 - DNA, 15 bp, Artificial Sequence
  dgRNA
  Apoc3
tattggctccaggat

SEQ ID NO: 54920 - DNA, 15 bp, Artificial Sequence
  dgRNA
  Apoc3
tgacctgttttatat

SEQ ID NO: 54921 - DNA, 15 bp, Artificial Sequence
  dgRNA
  Gpr61
ctggacactattgtc

SEQ ID NO: 54922 - DNA, 15 bp, Artificial Sequence
  dgRNA
  Gpr61
gtggctcaaaggggc

SEQ ID NO: 54923 - DNA, 15 bp, Artificial Sequence
  dgRNA
  Gpr61
cctcatacttctttc

SEQ ID NO: 54924 - DNA, 15 bp, Artificial Sequence
  dgRNA
  Gpr61
cctttgagccacttc

SEQ ID NO: 54925 - DNA, 15 bp, Artificial Sequence
  dgRNA
  Glrx5
cactagcaagcctgt

SEQ ID NO: 54926 - DNA, 15 bp, Artificial Sequence
  dgRNA
  Glrx5
caagcctgtaggacg

SEQ ID NO: 54927 - DNA, 15 bp, Artificial Sequence
  dgRNA
  Glrx5
taggacgcggctccc

SEQ ID NO: 54928 - DNA, 15 bp, Artificial Sequence
  dgRNA
  Glrx5
aggacgcggctccca

SEQ ID NO: 54929 - DNA, 15 bp, Artificial Sequence
  dgRNA
  Grhl1
ccgccgagcaccgcg

SEQ ID NO: 54930 - DNA, 15 bp, Artificial Sequence
  dgRNA
  Grhl1
gtggcccccgccctc

SEQ ID NO: 54931 - DNA, 15 bp, Artificial Sequence
  dgRNA
  Grhl1
ctccggtccgccccc

SEQ ID NO: 54932 - DNA, 15 bp, Artificial Sequence
  dgRNA
  Grhl1
tccatctcaccaatc

SEQ ID NO: 54933 - DNA, 15 bp, Artificial Sequence
  dgRNA
  Card19
gcgtagtatagagtt

SEQ ID NO: 54934 - DNA, 15 bp, Artificial Sequence
  dgRNA
  Card19
cgtagtatagagtta

SEQ ID NO: 54935 - DNA, 15 bp, Artificial Sequence
  dgRNA
  Card19
gcccgagccgcccca

SEQ ID NO: 54936 - DNA, 15 bp, Artificial Sequence
  dgRNA
  Card19
gtgcgaagtacagaa

SEQ ID NO: 54937 - DNA, 15 bp, Artificial Sequence
  dgRNA
  Drap1
gttcgtactttagct

SEQ ID NO: 54938 - DNA, 15 bp, Artificial Sequence
  dgRNA
  Drap1
ttcgtactttagctt

SEQ ID NO: 54939 - DNA, 15 bp, Artificial Sequence
  dgRNA
  Drap1
tcgtactttagcttg

SEQ ID NO: 54940 - DNA, 15 bp, Artificial Sequence
  dgRNA
  Drap1
cgtactttagcttgg

SEQ ID NO: 54941 - DNA, 15 bp, Artificial Sequence
  dgRNA
  Zmynd19
gtttcctagtcccat

SEQ ID NO: 54942 - DNA, 15 bp, Artificial Sequence
  dgRNA
  Zmynd19
gtcccattggtcact

SEQ ID NO: 54943 - DNA, 15 bp, Artificial Sequence
  dgRNA
  Zmynd19
ttggtcacttggccg

SEQ ID NO: 54944 - DNA, 15 bp, Artificial Sequence
  dgRNA
  Zmynd19
gcggcgcgccacgac

SEQ ID NO: 54945 - DNA, 15 bp, Artificial Sequence
  dgRNA
  Mctp1
actaacagtttgcaa

SEQ ID NO: 54946 - DNA, 15 bp, Artificial Sequence
  dgRNA
  Mctp1
ctaacagtttgcaaa

SEQ ID NO: 54947 - DNA, 15 bp, Artificial Sequence
  dgRNA
  Mctp1
ttgagtcatatcctg

SEQ ID NO: 54948 - DNA, 15 bp, Artificial Sequence
  dgRNA
  Mctp1
gtatttaaacctcac

SEQ ID NO: 54949 - DNA, 15 bp, Artificial Sequence
  dgRNA
  Cntn6
aatcttttatgccac

SEQ ID NO: 54950 - DNA, 15 bp, Artificial Sequence
  dgRNA
  Cntn6
ggtatccaacaggaa

SEQ ID NO: 54951 - DNA, 15 bp, Artificial Sequence
  dgRNA
  Cntn6
tattaggtatccaac

SEQ ID NO: 54952 - DNA, 15 bp, Artificial Sequence
  dgRNA
  Cntn6
gactaactacttatt

SEQ ID NO: 54953 - DNA, 15 bp, Artificial Sequence
  dgRNA
  Nipal2
cattcctgcgctgac

SEQ ID NO: 54954 - DNA, 15 bp, Artificial Sequence
  dgRNA
  Nipal2
tgcgctgacaggtgt

SEQ ID NO: 54955 - DNA, 15 bp, Artificial Sequence
  dgRNA
  Nipal2
acaggtgtaggcacc

SEQ ID NO: 54956 - DNA, 15 bp, Artificial Sequence
  dgRNA
  Nipal2
caggtgtaggcaccg

SEQ ID NO: 54957 - DNA, 15 bp, Artificial Sequence
  dgRNA
  Zfp287
cactaacttttatcg

SEQ ID NO: 54958 - DNA, 15 bp, Artificial Sequence
  dgRNA
  Zfp287
atcgtggttccattc

SEQ ID NO: 54959 - DNA, 15 bp, Artificial Sequence
  dgRNA
  Zfp287
gttccattctggacc

SEQ ID NO: 54960 - DNA, 15 bp, Artificial Sequence
  dgRNA
  Zfp287
cagttggctcaattc

SEQ ID NO: 54961 - DNA, 15 bp, Artificial Sequence
  dgRNA
  Gm813
tctctctgctcgttt

SEQ ID NO: 54962 - DNA, 15 bp, Artificial Sequence
  dgRNA
  Gm813
acttgttacaagggg

SEQ ID NO: 54963 - DNA, 15 bp, Artificial Sequence
  dgRNA
  Gm813
cttgttacaaggggt

SEQ ID NO: 54964 - DNA, 15 bp, Artificial Sequence
  dgRNA
  Gm813
aatactcgttctgaa

SEQ ID NO: 54965 - DNA, 15 bp, Artificial Sequence
  dgRNA
  Nipa1
tgcctttgaaagcgt

SEQ ID NO: 54966 - DNA, 15 bp, Artificial Sequence
  dgRNA
  Nipa1
ttgaaagcgtgggaa

SEQ ID NO: 54967 - DNA, 15 bp, Artificial Sequence
  dgRNA
  Nipa1
tacttaagtgagagt

SEQ ID NO: 54968 - DNA, 15 bp, Artificial Sequence
  dgRNA
  Nipa1
ttcccacgctttcaa

SEQ ID NO: 54969 - DNA, 15 bp, Artificial Sequence
  dgRNA
  Vmn1r88
taaagtgggtcaggt

SEQ ID NO: 54970 - DNA, 15 bp, Artificial Sequence
  dgRNA
  Gm4951
acactcccctgtgat

SEQ ID NO: 54971 - DNA, 15 bp, Artificial Sequence
  dgRNA
  Gm4951
cactcccctgtgatt

SEQ ID NO: 54972 - DNA, 15 bp, Artificial Sequence
  dgRNA
  Gm4951
ttgctacccaatcac

SEQ ID NO: 54973 - DNA, 15 bp, Artificial Sequence
  dgRNA
  Gm4951
gtactctgctgattt

SEQ ID NO: 54974 - DNA, 15 bp, Artificial Sequence
  dgRNA
  Il17re
agcccaagtgcatgt

SEQ ID NO: 54975 - DNA, 15 bp, Artificial Sequence
  dgRNA
  Il17re
gcatgtggggtacgc

SEQ ID NO: 54976 - DNA, 15 bp, Artificial Sequence
  dgRNA
  Il17re
tgtggggtacgcagg

SEQ ID NO: 54977 - DNA, 15 bp, Artificial Sequence
  dgRNA
  Il17re
ttcagcgtagacaaa

SEQ ID NO: 54978 - DNA, 15 bp, Artificial Sequence
  dgRNA
  Tspyl4
atcgacaaaattacc

SEQ ID NO: 54979 - DNA, 15 bp, Artificial Sequence
  dgRNA
  Tspyl4
ccagttctcgcgcta

SEQ ID NO: 54980 - DNA, 15 bp, Artificial Sequence
  dgRNA
  Tspyl4
acggttagttgcagc

SEQ ID NO: 54981 - DNA, 15 bp, Artificial Sequence
  dgRNA
  Tspyl4
gtatcctgacgtcac

SEQ ID NO: 54982 - DNA, 15 bp, Artificial Sequence
  dgRNA
  Tctex1d4
atagcaggaacactt

SEQ ID NO: 54983 - DNA, 15 bp, Artificial Sequence
  dgRNA
  Tctex1d4
gccttcctcgcccac

SEQ ID NO: 54984 - DNA, 15 bp, Artificial Sequence
  dgRNA
  Tctex1d4
gggcttggagttcta

SEQ ID NO: 54985 - DNA, 15 bp, Artificial Sequence
  dgRNA
  Tctex1d4
agagagggtccacgg

SEQ ID NO: 54986 - DNA, 15 bp, Artificial Sequence
  dgRNA
  Cyp2d22
atcggtctcacctcc

SEQ ID NO: 54987 - DNA, 15 bp, Artificial Sequence
  dgRNA
  Cyp2d22
tcggtctcacctccc

SEQ ID NO: 54988 - DNA, 15 bp, Artificial Sequence
  dgRNA
  Cyp2d22
ctcacctcccgggag

SEQ ID NO: 54989 - DNA, 15 bp, Artificial Sequence
  dgRNA
  Cyp2d22
accgatttgaggagg

SEQ ID NO: 54990 - DNA, 15 bp, Artificial Sequence
  dgRNA
  Mettl24
ctagccagactttac

SEQ ID NO: 54991 - DNA, 15 bp, Artificial Sequence
  dgRNA
  Mettl24
cacccagccctgtta

SEQ ID NO: 54992 - DNA, 15 bp, Artificial Sequence
  dgRNA
  Mettl24
cggctgggcaggata

SEQ ID NO: 54993 - DNA, 15 bp, Artificial Sequence
  dgRNA
  Mettl24
aggataaggttacgc

SEQ ID NO: 54994 - DNA, 15 bp, Artificial Sequence
  dgRNA
  Zfp235
gcttggaacatatgg

SEQ ID NO: 54995 - DNA, 15 bp, Artificial Sequence
  dgRNA
  Zfp235
gaggctttagtagtc

SEQ ID NO: 54996 - DNA, 15 bp, Artificial Sequence
  dgRNA
  Zfp235
tccgctgacgcattc

SEQ ID NO: 54997 - DNA, 15 bp, Artificial Sequence
  dgRNA
  Zfp235
ccgctgacgcattct

SEQ ID NO: 54998 - DNA, 15 bp, Artificial Sequence
  dgRNA
  Ugt2b38
ccatcaccatagttc

SEQ ID NO: 54999 - DNA, 15 bp, Artificial Sequence
  dgRNA
  Mypop
tcagcgctaaatgtg

SEQ ID NO: 55000 - DNA, 15 bp, Artificial Sequence
  dgRNA
  Mypop
ggtaaagcaaggcga

SEQ ID NO: 55001 - DNA, 15 bp, Artificial Sequence
  dgRNA
  Mypop
gtaaagcaaggcgac

SEQ ID NO: 55002 - DNA, 15 bp, Artificial Sequence
  dgRNA
  Mypop
cgcttgcgcagtgct

SEQ ID NO: 55003 - DNA, 15 bp, Artificial Sequence
  dgRNA
  Crisp2
aaagaagttctcccg

SEQ ID NO: 55004 - DNA, 15 bp, Artificial Sequence
  dgRNA
  Crisp2
gcggtgactgagaga

SEQ ID NO: 55005 - DNA, 15 bp, Artificial Sequence
  dgRNA
  Crisp2
gacaccgcccccacg

SEQ ID NO: 55006 - DNA, 15 bp, Artificial Sequence
  dgRNA
  Crisp2
accgcccccacgtgg

SEQ ID NO: 55007 - DNA, 15 bp, Artificial Sequence
  dgRNA
  Gjb3
gatacactgcctccc

SEQ ID NO: 55008 - DNA, 15 bp, Artificial Sequence
  dgRNA
  Gjb3
atcagggatgcaaac

SEQ ID NO: 55009 - DNA, 15 bp, Artificial Sequence
  dgRNA
  Gjb3
tgcaaacagggcggg

SEQ ID NO: 55010 - DNA, 15 bp, Artificial Sequence
  dgRNA
  Gjb3
ttgaaactttgcagc

SEQ ID NO: 55011 - DNA, 15 bp, Artificial Sequence
  dgRNA
  Ifnab
aagcgaaaacagagt

SEQ ID NO: 55012 - DNA, 15 bp, Artificial Sequence
  dgRNA
  Golim4
agcggggagcccgag

SEQ ID NO: 55013 - DNA, 15 bp, Artificial Sequence
  dgRNA
  Golim4
gcggggagcccgagt

SEQ ID NO: 55014 - DNA, 15 bp, Artificial Sequence
  dgRNA
  Actn3
gcgaacccactatct

SEQ ID NO: 55015 - DNA, 15 bp, Artificial Sequence
  dgRNA
  Actn3
ccctcgccccctatc

SEQ ID NO: 55016 - DNA, 15 bp, Artificial Sequence
  dgRNA
  Actn3
agtacgaacccgatc

SEQ ID NO: 55017 - DNA, 15 bp, Artificial Sequence
  dgRNA
  Actn3
gtacgaacccgatct

SEQ ID NO: 55018 - DNA, 15 bp, Artificial Sequence
  dgRNA
  Spata19
acttgccaaccaatc

SEQ ID NO: 55019 - DNA, 15 bp, Artificial Sequence
  dgRNA
  Spata19
ttgccaaccaatcag

SEQ ID NO: 55020 - DNA, 15 bp, Artificial Sequence
  dgRNA
  Spata19
tgccaaccaatcagg

SEQ ID NO: 55021 - DNA, 15 bp, Artificial Sequence
  dgRNA
  Spata19
tggacgatatacaaa

SEQ ID NO: 55022 - DNA, 15 bp, Artificial Sequence
  dgRNA
  Olfr586
gttttaccccatgtt

SEQ ID NO: 55023 - DNA, 15 bp, Artificial Sequence
  dgRNA
  Olfr586
cttaaagatttcaac

SEQ ID NO: 55024 - DNA, 15 bp, Artificial Sequence
  dgRNA
  Olfr586
aatgcacctaacatg

SEQ ID NO: 55025 - DNA, 15 bp, Artificial Sequence
  dgRNA
  Olfr586
aaatgcacctaacat

SEQ ID NO: 55026 - DNA, 15 bp, Artificial Sequence
  dgRNA
  Gm765
agactaagtcacgaa

SEQ ID NO: 55027 - DNA, 15 bp, Artificial Sequence
  dgRNA
  Gm765
ctaagtcacgaatgg

SEQ ID NO: 55028 - DNA, 15 bp, Artificial Sequence
  dgRNA
  Gm765
taagtcacgaatggt

SEQ ID NO: 55029 - DNA, 15 bp, Artificial Sequence
  dgRNA
  Gm765
gtcacgaatggtggg

SEQ ID NO: 55030 - DNA, 15 bp, Artificial Sequence
  dgRNA
  Olfr1120
aaataattgcacttc

SEQ ID NO: 55031 - DNA, 15 bp, Artificial Sequence
  dgRNA
  Olfr1120
aactgcataacagta

SEQ ID NO: 55032 - DNA, 15 bp, Artificial Sequence
  dgRNA
  Tal2
agggctgacgggaca

SEQ ID NO: 55033 - DNA, 15 bp, Artificial Sequence
  dgRNA
  Tal2
gctgacgggacaagg

SEQ ID NO: 55034 - DNA, 15 bp, Artificial Sequence
  dgRNA
  Tal2
ctgacgggacaaggt

SEQ ID NO: 55035 - DNA, 15 bp, Artificial Sequence
  dgRNA
  Tal2
tgacgggacaaggtg

SEQ ID NO: 55036 - DNA, 15 bp, Artificial Sequence
  dgRNA
  Fam20c
cctacttcctactag

SEQ ID NO: 55037 - DNA, 15 bp, Artificial Sequence
  dgRNA
  Fam20c
tcctactaggggttg

SEQ ID NO: 55038 - DNA, 15 bp, Artificial Sequence
  dgRNA
  Fam20c
gatttagcatcccag

SEQ ID NO: 55039 - DNA, 15 bp, Artificial Sequence
  dgRNA
  Fam20c
atttagcatcccaga

SEQ ID NO: 55040 - DNA, 15 bp, Artificial Sequence
  dgRNA
  Ncaph2
cggaatccgtcagtc

SEQ ID NO: 55041 - DNA, 15 bp, Artificial Sequence
  dgRNA
  Ncaph2
atccgtcagtccggt

SEQ ID NO: 55042 - DNA, 15 bp, Artificial Sequence
  dgRNA
  Ncaph2
tccgtcagtccggtc

SEQ ID NO: 55043 - DNA, 15 bp, Artificial Sequence
  dgRNA
  Ncaph2
acggagccccgcccc

SEQ ID NO: 55044 - DNA, 15 bp, Artificial Sequence
  dgRNA
  Srek1ip1
agagaatttgtagcg

SEQ ID NO: 55045 - DNA, 15 bp, Artificial Sequence
  dgRNA
  Srek1ip1
tataatacgagctaa

SEQ ID NO: 55046 - DNA, 15 bp, Artificial Sequence
  dgRNA
  Srek1ip1
ataatacgagctaaa

SEQ ID NO: 55047 - DNA, 15 bp, Artificial Sequence
  dgRNA
  Srek1ip1
ccaatccgtaaatcc

SEQ ID NO: 55048 - DNA, 15 bp, Artificial Sequence
  dgRNA
  Tmem215
caccctctaatctgc

SEQ ID NO: 55049 - DNA, 15 bp, Artificial Sequence
  dgRNA
  Tmem215
ttcttcgctgttcag

SEQ ID NO: 55050 - DNA, 15 bp, Artificial Sequence
  dgRNA
  Tmem215
aagtcctcgtctaca

SEQ ID NO: 55051 - DNA, 15 bp, Artificial Sequence
  dgRNA
  Tmem215
ggccccaagagtgcc

SEQ ID NO: 55052 - DNA, 15 bp, Artificial Sequence
  dgRNA
  Olfr111
taggaacttgattcc

SEQ ID NO: 55053 - DNA, 15 bp, Artificial Sequence
  dgRNA
  Olfr111
cacatatatcttgag

SEQ ID NO: 55054 - DNA, 15 bp, Artificial Sequence
  dgRNA
  Olfr111
tatatcttgagaggc

SEQ ID NO: 55055 - DNA, 15 bp, Artificial Sequence
  dgRNA
  Olfr111
gaactgcttcattcg

SEQ ID NO: 55056 - DNA, 15 bp, Artificial Sequence
  dgRNA
  Cacybp
tccccaaacctttga

SEQ ID NO: 55057 - DNA, 15 bp, Artificial Sequence
  dgRNA
  Cacybp
tttgaaggttagttc

SEQ ID NO: 55058 - DNA, 15 bp, Artificial Sequence
  dgRNA
  Cacybp
tgaaggttagttccg

SEQ ID NO: 55059 - DNA, 15 bp, Artificial Sequence
  dgRNA
  Cacybp
ttccggggctaggtc

SEQ ID NO: 55060 - DNA, 15 bp, Artificial Sequence
  dgRNA
  Tmem45b
gggacactcggaagc

SEQ ID NO: 55061 - DNA, 15 bp, Artificial Sequence
  dgRNA
  Tmem45b
ggacactcggaagca

SEQ ID NO: 55062 - DNA, 15 bp, Artificial Sequence
  dgRNA
  Tmem45b
ggtcgtgctagcagc

SEQ ID NO: 55063 - DNA, 15 bp, Artificial Sequence
  dgRNA
  Tmem45b
gtcgtgctagcagca

SEQ ID NO: 55064 - DNA, 15 bp, Artificial Sequence
  dgRNA
  Lpp
cgcgtcccctcctcc

SEQ ID NO: 55065 - DNA, 15 bp, Artificial Sequence
  dgRNA
  Lpp
ggaagtgcattgccc

SEQ ID NO: 55066 - DNA, 15 bp, Artificial Sequence
  dgRNA
  Lpp
cccgtccggctagtg

SEQ ID NO: 55067 - DNA, 15 bp, Artificial Sequence
  dgRNA
  Lpp
gtccggctagtgcgg

SEQ ID NO: 55068 - DNA, 15 bp, Artificial Sequence
  dgRNA
  Olfr380
tccctagatatatgt

SEQ ID NO: 55069 - DNA, 15 bp, Artificial Sequence
  dgRNA
  Olfr380
accaacatatatcta

SEQ ID NO: 55070 - DNA, 15 bp, Artificial Sequence
  dgRNA
  Cyp1a1
gcctgtacctacatc

SEQ ID NO: 55071 - DNA, 15 bp, Artificial Sequence
  dgRNA
  Cyp1a1
cctacatcaggtatc

SEQ ID NO: 55072 - DNA, 15 bp, Artificial Sequence
  dgRNA
  Cyp1a1
ctagagcactcccta

SEQ ID NO: 55073 - DNA, 15 bp, Artificial Sequence
  dgRNA
  Cyp1a1
cctcggtcccaccac

SEQ ID NO: 55074 - DNA, 15 bp, Artificial Sequence
  dgRNA
  Gsap
gctttgtcacccctt

SEQ ID NO: 55075 - DNA, 15 bp, Artificial Sequence
  dgRNA
  Gsap
gccagcgccagcggc

SEQ ID NO: 55076 - DNA, 15 bp, Artificial Sequence
  dgRNA
  Gsap
ccagcgccagcggca

SEQ ID NO: 55077 - DNA, 15 bp, Artificial Sequence
  dgRNA
  Gsap
cgccagcggcagggg

SEQ ID NO: 55078 - DNA, 15 bp, Artificial Sequence
  dgRNA
  Eya2
actcaccatcagaac

SEQ ID NO: 55079 - DNA, 15 bp, Artificial Sequence
  dgRNA
  Eya2
aaacgcttacctagt

SEQ ID NO: 55080 - DNA, 15 bp, Artificial Sequence
  dgRNA
  Eya2
cttgaggtgtatgaa

SEQ ID NO: 55081 - DNA, 15 bp, Artificial Sequence
  dgRNA
  Tfdp1
gggattgtgcaagaa

SEQ ID NO: 55082 - DNA, 15 bp, Artificial Sequence
  dgRNA
  Tfdp1
ctgcctcgtgctggt

SEQ ID NO: 55083 - DNA, 15 bp, Artificial Sequence
  dgRNA
  Tfdp1
tgcctcgtgctggtg

SEQ ID NO: 55084 - DNA, 15 bp, Artificial Sequence
  dgRNA
  Tfdp1
ttgcacaatcccgac

SEQ ID NO: 55085 - DNA, 15 bp, Artificial Sequence
  dgRNA
  Cys1
tcgagtccctgtcca

SEQ ID NO: 55086 - DNA, 15 bp, Artificial Sequence
  dgRNA
  Cys1
acctctcactccggc

SEQ ID NO: 55087 - DNA, 15 bp, Artificial Sequence
  dgRNA
  Cys1
aagattgcgaccccc

SEQ ID NO: 55088 - DNA, 15 bp, Artificial Sequence
  dgRNA
  Cys1
ggggtggttagattg

SEQ ID NO: 55089 - DNA, 15 bp, Artificial Sequence
  dgRNA
  Cdkn2a
tggctgtcaccgcga

SEQ ID NO: 55090 - DNA, 15 bp, Artificial Sequence
  dgRNA
  Cdkn2a
ggctgtcaccgcgat

SEQ ID NO: 55091 - DNA, 15 bp, Artificial Sequence
  dgRNA
  Cdkn2a
tgtcaccgcgatggg

SEQ ID NO: 55092 - DNA, 15 bp, Artificial Sequence
  dgRNA
  Cdkn2a
ggcgagcgaagcgag

SEQ ID NO: 55093 - DNA, 15 bp, Artificial Sequence
  dgRNA
  Traf7
cagcgacttttgttt

SEQ ID NO: 55094 - DNA, 15 bp, Artificial Sequence
  dgRNA
  Traf7
cgacttttgttttgg

SEQ ID NO: 55095 - DNA, 15 bp, Artificial Sequence
  dgRNA
  Traf7
gctcgaatatcctcc

SEQ ID NO: 55096 - DNA, 15 bp, Artificial Sequence
  dgRNA
  Traf7
cagtacagaggtcgc

SEQ ID NO: 55097 - DNA, 15 bp, Artificial Sequence
  dgRNA
  Dtx2
cgccgagtttcactc

SEQ ID NO: 55098 - DNA, 15 bp, Artificial Sequence
  dgRNA
  Dtx2
cactccggctgcctc

SEQ ID NO: 55099 - DNA, 15 bp, Artificial Sequence
  dgRNA
  Dtx2
cggctgcctccggct

SEQ ID NO: 55100 - DNA, 15 bp, Artificial Sequence
  dgRNA
  Dtx2
cctccggctcggagt

SEQ ID NO: 55101 - DNA, 15 bp, Artificial Sequence
  dgRNA
  Gtf2ird1
gctgagttaataatc

SEQ ID NO: 55102 - DNA, 15 bp, Artificial Sequence
  dgRNA
  Galnt1
gcatccggggcgggt

SEQ ID NO: 55103 - DNA, 15 bp, Artificial Sequence
  dgRNA
  Galnt1
gaagcgactgcaccg

SEQ ID NO: 55104 - DNA, 15 bp, Artificial Sequence
  dgRNA
  Galnt1
ccgcggaaccaagcg

SEQ ID NO: 55105 - DNA, 15 bp, Artificial Sequence
  dgRNA
  Galnt1
cggaaccaagcgcgg

SEQ ID NO: 55106 - DNA, 15 bp, Artificial Sequence
  dgRNA
  Fgf20
cccggcgcgcatgaa

SEQ ID NO: 55107 - DNA, 15 bp, Artificial Sequence
  dgRNA
  Fgf20
gacccgcatatatac

SEQ ID NO: 55108 - DNA, 15 bp, Artificial Sequence
  dgRNA
  Fgf20
acccgcatatatacc

SEQ ID NO: 55109 - DNA, 15 bp, Artificial Sequence
  dgRNA
  Fgf20
ggagtgtatgtacac

SEQ ID NO: 55110 - DNA, 15 bp, Artificial Sequence
  dgRNA
  Hpn
ccctacattgcttaa

SEQ ID NO: 55111 - DNA, 15 bp, Artificial Sequence
  dgRNA
  Hpn
tatcagtgtttatcg

SEQ ID NO: 55112 - DNA, 15 bp, Artificial Sequence
  dgRNA
  Hpn
cactggcacaacaaa

SEQ ID NO: 55113 - DNA, 15 bp, Artificial Sequence
  dgRNA
  Hpn
cttgggcaactactt

SEQ ID NO: 55114 - DNA, 15 bp, Artificial Sequence
  dgRNA
  Hpcal1
agagtgggcgcaccg

SEQ ID NO: 55115 - DNA, 15 bp, Artificial Sequence
  dgRNA
  Hpcal1
gagtgggcgcaccga

SEQ ID NO: 55116 - DNA, 15 bp, Artificial Sequence
  dgRNA
  Hpcal1
ccgagggtccagcag

SEQ ID NO: 55117 - DNA, 15 bp, Artificial Sequence
  dgRNA
  Hpcal1
cgagggtccagcagc

SEQ ID NO: 55118 - DNA, 15 bp, Artificial Sequence
  dgRNA
  Rad1
caaggcgctcgcttc

SEQ ID NO: 55119 - DNA, 15 bp, Artificial Sequence
  dgRNA
  Rad1
tcgcttccggtctcg

SEQ ID NO: 55120 - DNA, 15 bp, Artificial Sequence
  dgRNA
  Rad1
cgaggtagactctct

SEQ ID NO: 55121 - DNA, 15 bp, Artificial Sequence
  dgRNA
  Rad1
gactctctaggcaca

SEQ ID NO: 55122 - DNA, 15 bp, Artificial Sequence
  dgRNA
  Orai1
ggcgagccaggggct

SEQ ID NO: 55123 - DNA, 15 bp, Artificial Sequence
  dgRNA
  Orai1
tgggggcggagccgt

SEQ ID NO: 55124 - DNA, 15 bp, Artificial Sequence
  dgRNA
  Orai1
gggcggagccgtcgg

SEQ ID NO: 55125 - DNA, 15 bp, Artificial Sequence
  dgRNA
  Orai1
cggagccgtcggagg

SEQ ID NO: 55126 - DNA, 15 bp, Artificial Sequence
  dgRNA
  Col4a2
gcgcccggggcggca

SEQ ID NO: 55127 - DNA, 15 bp, Artificial Sequence
  dgRNA
  Col4a2
cgcccggggcggcag

SEQ ID NO: 55128 - DNA, 15 bp, Artificial Sequence
  dgRNA
  Col4a2
gaccagcagagacgg

SEQ ID NO: 55129 - DNA, 15 bp, Artificial Sequence
  dgRNA
  Col4a2
accagcagagacggc

SEQ ID NO: 55130 - DNA, 15 bp, Artificial Sequence
  dgRNA
  Rnf148
tataaacccctggat

SEQ ID NO: 55131 - DNA, 15 bp, Artificial Sequence
  dgRNA
  Rnf148
aagcaataagtcaag

SEQ ID NO: 55132 - DNA, 15 bp, Artificial Sequence
  dgRNA
  Rnf148
atcctattggtcaaa

SEQ ID NO: 55133 - DNA, 15 bp, Artificial Sequence
  dgRNA
  Rnf148
atactgagatcctat

SEQ ID NO: 55134 - DNA, 15 bp, Artificial Sequence
  dgRNA
  Ano1
gggccaagctagagt

SEQ ID NO: 55135 - DNA, 15 bp, Artificial Sequence
  dgRNA
  Ano1
gcacctcccatgcag

SEQ ID NO: 55136 - DNA, 15 bp, Artificial Sequence
  dgRNA
  Ano1
cgagggcgcggctgc

SEQ ID NO: 55137 - DNA, 15 bp, Artificial Sequence
  dgRNA
  Ano1
tgaccccgtgacccc

SEQ ID NO: 55138 - DNA, 15 bp, Artificial Sequence
  dgRNA
  Slc46a3
ccttcgcagagctgc

SEQ ID NO: 55139 - DNA, 15 bp, Artificial Sequence
  dgRNA
  Slc46a3
ttgcccagcaactcg

SEQ ID NO: 55140 - DNA, 15 bp, Artificial Sequence
  dgRNA
  Slc46a3
cagccgctgaacctt

SEQ ID NO: 55141 - DNA, 15 bp, Artificial Sequence
  dgRNA
  Slc46a3
agccgctgaaccttc

SEQ ID NO: 55142 - DNA, 15 bp, Artificial Sequence
  dgRNA
  Olfr507
ggtgttgctagatca

SEQ ID NO: 55143 - DNA, 15 bp, Artificial Sequence
  dgRNA
  Eif4a3
atccctatcccgagc

SEQ ID NO: 55144 - DNA, 15 bp, Artificial Sequence
  dgRNA
  Eif4a3
atcccgagccggctg

SEQ ID NO: 55145 - DNA, 15 bp, Artificial Sequence
  dgRNA
  Eif4a3
aaggagccgagagta

SEQ ID NO: 55146 - DNA, 15 bp, Artificial Sequence
  dgRNA
  Eif4a3
agtacggagagccgc

SEQ ID NO: 55147 - DNA, 15 bp, Artificial Sequence
  dgRNA
  Dcp2
ctcagtcaaaggcgg

SEQ ID NO: 55148 - DNA, 15 bp, Artificial Sequence
  dgRNA
  Dcp2
tcagtcaaaggcggc

SEQ ID NO: 55149 - DNA, 15 bp, Artificial Sequence
  dgRNA
  Dcp2
aaggcggcgggaagt

SEQ ID NO: 55150 - DNA, 15 bp, Artificial Sequence
  dgRNA
  Dcp2
aaacaaacgtctcat

SEQ ID NO: 55151 - DNA, 15 bp, Artificial Sequence
  dgRNA
  Ccdc62
cccgctgcgacgctc

SEQ ID NO: 55152 - DNA, 15 bp, Artificial Sequence
  dgRNA
  Ccdc62
ccttagaggggccga

SEQ ID NO: 55153 - DNA, 15 bp, Artificial Sequence
  dgRNA
  Ccdc62
ggggccgaaggcttc

SEQ ID NO: 55154 - DNA, 15 bp, Artificial Sequence
  dgRNA
  Ccdc62
cgaaggcttccggcg

SEQ ID NO: 55155 - DNA, 15 bp, Artificial Sequence
  dgRNA
  Fahd1
gaggacgacactgat

SEQ ID NO: 55156 - DNA, 15 bp, Artificial Sequence
  dgRNA
  Fahd1
gagggcgtggcattt

SEQ ID NO: 55157 - DNA, 15 bp, Artificial Sequence
  dgRNA
  Fahd1
gatggattgagggcg

SEQ ID NO: 55158 - DNA, 15 bp, Artificial Sequence
  dgRNA
  Fahd1
gtcactgatggattg

SEQ ID NO: 55159 - DNA, 15 bp, Artificial Sequence
  dgRNA
  1700013G24Rik
aaagccacattagtc

SEQ ID NO: 55160 - DNA, 15 bp, Artificial Sequence
  dgRNA
  1700013G24Rik
aggacccatctgttc

SEQ ID NO: 55161 - DNA, 15 bp, Artificial Sequence
  dgRNA
  1700013G24Rik
ggtcggaatgacccc

SEQ ID NO: 55162 - DNA, 15 bp, Artificial Sequence
  dgRNA
  1700013G24Rik
cggaatgaccccagg

SEQ ID NO: 55163 - DNA, 15 bp, Artificial Sequence
  dgRNA
  Olfr1034
aggcgatatgtagaa

SEQ ID NO: 55164 - DNA, 15 bp, Artificial Sequence
  dgRNA
  1700019G17Rik
tataggaccccacca

SEQ ID NO: 55165 - DNA, 15 bp, Artificial Sequence
  dgRNA
  1700019G17Rik
aacttgcttgccctc

SEQ ID NO: 55166 - DNA, 15 bp, Artificial Sequence
  dgRNA
  1700019G17Rik
ttgcttgccctcagg

SEQ ID NO: 55167 - DNA, 15 bp, Artificial Sequence
  dgRNA
  1700019G17Rik
caggctaaatgctac

SEQ ID NO: 55168 - DNA, 15 bp, Artificial Sequence
  dgRNA
  Prodh2
atctgtcgtactgtc

SEQ ID NO: 55169 - DNA, 15 bp, Artificial Sequence
  dgRNA
  Prodh2
ggctgaaaggttatt

SEQ ID NO: 55170 - DNA, 15 bp, Artificial Sequence
  dgRNA
  Prodh2
gctgaaaggttattg

SEQ ID NO: 55171 - DNA, 15 bp, Artificial Sequence
  dgRNA
  Prodh2
taactgccccccagc

SEQ ID NO: 55172 - DNA, 15 bp, Artificial Sequence
  dgRNA
  R3hcc1l
cggttatgattgagc

SEQ ID NO: 55173 - DNA, 15 bp, Artificial Sequence
  dgRNA
  R3hcc1l
gcgctttcacagctg

SEQ ID NO: 55174 - DNA, 15 bp, Artificial Sequence
  dgRNA
  R3hcc1l
cgctttcacagctga

SEQ ID NO: 55175 - DNA, 15 bp, Artificial Sequence
  dgRNA
  R3hcc1l
gaggatggacgatac

SEQ ID NO: 55176 - DNA, 15 bp, Artificial Sequence
  dgRNA
  Capn10
acaaatgcccgaccc

SEQ ID NO: 55177 - DNA, 15 bp, Artificial Sequence
  dgRNA
  Capn10
caaccaccaccgcga

SEQ ID NO: 55178 - DNA, 15 bp, Artificial Sequence
  dgRNA
  Capn10
caccaccgcgacgga

SEQ ID NO: 55179 - DNA, 15 bp, Artificial Sequence
  dgRNA
  Capn10
gctctggatcctaag

SEQ ID NO: 55180 - DNA, 15 bp, Artificial Sequence
  dgRNA
  Ctbp2
cttgcgggctaccat

SEQ ID NO: 55181 - DNA, 15 bp, Artificial Sequence
  dgRNA
  Ctbp2
ttgcgggctaccatt

SEQ ID NO: 55182 - DNA, 15 bp, Artificial Sequence
  dgRNA
  Ctbp2
tgcgggctaccattg

SEQ ID NO: 55183 - DNA, 15 bp, Artificial Sequence
  dgRNA
  Ctbp2
gctttttgcctacta

SEQ ID NO: 55184 - DNA, 15 bp, Artificial Sequence
  dgRNA
  AU022751
cactagaagtttccc

SEQ ID NO: 55185 - DNA, 15 bp, Artificial Sequence
  dgRNA
  AU022751
ctcctccggctcagc

SEQ ID NO: 55186 - DNA, 15 bp, Artificial Sequence
  dgRNA
  AU022751
gcaggatgcattgcc

SEQ ID NO: 55187 - DNA, 15 bp, Artificial Sequence
  dgRNA
  AU022751
gcattgccaggtgga

SEQ ID NO: 55188 - DNA, 15 bp, Artificial Sequence
  dgRNA
  Pik3ap1
agcaggggtcggcgc

SEQ ID NO: 55189 - DNA, 15 bp, Artificial Sequence
  dgRNA
  Pik3ap1
gcaggggtcggcgcc

SEQ ID NO: 55190 - DNA, 15 bp, Artificial Sequence
  dgRNA
  Pik3ap1
gtcggcgccgggagc

SEQ ID NO: 55191 - DNA, 15 bp, Artificial Sequence
  dgRNA
  Pik3ap1
tggcggctggtcgtg

SEQ ID NO: 55192 - DNA, 15 bp, Artificial Sequence
  dgRNA
  Slc27a1
gccttcgagtggcgc

SEQ ID NO: 55193 - DNA, 15 bp, Artificial Sequence
  dgRNA
  Slc27a1
ggaaggtcggccaag

SEQ ID NO: 55194 - DNA, 15 bp, Artificial Sequence
  dgRNA
  Slc27a1
aacaagctagtccgc

SEQ ID NO: 55195 - DNA, 15 bp, Artificial Sequence
  dgRNA
  Slc27a1
acaagctagtccgca

SEQ ID NO: 55196 - DNA, 15 bp, Artificial Sequence
  dgRNA
  Grin3b
ttcaataatgttgac

SEQ ID NO: 55197 - DNA, 15 bp, Artificial Sequence
  dgRNA
  Grin3b
tcaataatgttgacc

SEQ ID NO: 55198 - DNA, 15 bp, Artificial Sequence
  dgRNA
  Grin3b
taatgttgaccgggc

SEQ ID NO: 55199 - DNA, 15 bp, Artificial Sequence
  dgRNA
  Grin3b
cactcggacagtttt

SEQ ID NO: 55200 - DNA, 15 bp, Artificial Sequence
  dgRNA
  Foxn1
tcttctccccgtttt

SEQ ID NO: 55201 - DNA, 15 bp, Artificial Sequence
  dgRNA
  Foxn1
ttggcagcaacccct

SEQ ID NO: 55202 - DNA, 15 bp, Artificial Sequence
  dgRNA
  Foxn1
ggcagcaacccctcg

SEQ ID NO: 55203 - DNA, 15 bp, Artificial Sequence
  dgRNA
  Foxn1
caacccctcggggca

SEQ ID NO: 55204 - DNA, 15 bp, Artificial Sequence
  dgRNA
  Gm14597
gacaaaatgcatagg

SEQ ID NO: 55205 - DNA, 15 bp, Artificial Sequence
  dgRNA
  Gm14597
cccgaagcttgccat

SEQ ID NO: 55206 - DNA, 15 bp, Artificial Sequence
  dgRNA
  Gm14597
atgctgcgctcccat

SEQ ID NO: 55207 - DNA, 15 bp, Artificial Sequence
  dgRNA
  Gm14597
tgcgctcccattggt

SEQ ID NO: 55208 - DNA, 15 bp, Artificial Sequence
  dgRNA
  Olfr133
gctcaaagctctata

SEQ ID NO: 55209 - DNA, 15 bp, Artificial Sequence
  dgRNA
  Olfr133
tcctaaccatcacga

SEQ ID NO: 55210 - DNA, 15 bp, Artificial Sequence
  dgRNA
  Olfr133
atggcatttcaagcg

SEQ ID NO: 55211 - DNA, 15 bp, Artificial Sequence
  dgRNA
  Olfr133
gccatcgtgatggtt

SEQ ID NO: 55212 - DNA, 15 bp, Artificial Sequence
  dgRNA
  Sgcd
gtgtacagaatgtct

SEQ ID NO: 55213 - DNA, 15 bp, Artificial Sequence
  dgRNA
  Sgcd
atgagcgctcttgca

SEQ ID NO: 55214 - DNA, 15 bp, Artificial Sequence
  dgRNA
  Sgcd
cacaaactttgctct

SEQ ID NO: 55215 - DNA, 15 bp, Artificial Sequence
  dgRNA
  Sgcd
tggcgtctgtcggct

SEQ ID NO: 55216 - DNA, 15 bp, Artificial Sequence
  dgRNA
  Ripk2
gggaggagaccgcgg

SEQ ID NO: 55217 - DNA, 15 bp, Artificial Sequence
  dgRNA
  Ripk2
ggaggagaccgcgga

SEQ ID NO: 55218 - DNA, 15 bp, Artificial Sequence
  dgRNA
  Ripk2
ggagaccgcggaggg

SEQ ID NO: 55219 - DNA, 15 bp, Artificial Sequence
  dgRNA
  Ripk2
ggctccgccctccgc

SEQ ID NO: 55220 - DNA, 15 bp, Artificial Sequence
  dgRNA
  Cdk10
cctctgcgctccgag

SEQ ID NO: 55221 - DNA, 15 bp, Artificial Sequence
  dgRNA
  Cdk10
catgcgcctgcgccg

SEQ ID NO: 55222 - DNA, 15 bp, Artificial Sequence
  dgRNA
  Cdk10
atgcgcctgcgccga

SEQ ID NO: 55223 - DNA, 15 bp, Artificial Sequence
  dgRNA
  Cdk10
gttttgatcaactgg

SEQ ID NO: 55224 - DNA, 15 bp, Artificial Sequence
  dgRNA
  Scamp4
ctcaaagtgtcacaa

SEQ ID NO: 55225 - DNA, 15 bp, Artificial Sequence
  dgRNA
  Scamp4
aagcagccacgcgca

SEQ ID NO: 55226 - DNA, 15 bp, Artificial Sequence
  dgRNA
  Scamp4
acgcgcacggcctta

SEQ ID NO: 55227 - DNA, 15 bp, Artificial Sequence
  dgRNA
  Scamp4
cgcgcacggccttaa

SEQ ID NO: 55228 - DNA, 15 bp, Artificial Sequence
  dgRNA
  Gldn
cgcacttgtctcctc

SEQ ID NO: 55229 - DNA, 15 bp, Artificial Sequence
  dgRNA
  Gldn
cccgcctgtccctct

SEQ ID NO: 55230 - DNA, 15 bp, Artificial Sequence
  dgRNA
  Gldn
acccgcttcgccaga

SEQ ID NO: 55231 - DNA, 15 bp, Artificial Sequence
  dgRNA
  Gldn
cccgcttcgccagac

SEQ ID NO: 55232 - DNA, 15 bp, Artificial Sequence
  dgRNA
  Rpusd3
tgaccaatctacgca

SEQ ID NO: 55233 - DNA, 15 bp, Artificial Sequence
  dgRNA
  Rpusd3
ccaatctacgcacgg

SEQ ID NO: 55234 - DNA, 15 bp, Artificial Sequence
  dgRNA
  Rpusd3
cgcacggaggatgta

SEQ ID NO: 55235 - DNA, 15 bp, Artificial Sequence
  dgRNA
  Rpusd3
gcacggaggatgtac

SEQ ID NO: 55236 - DNA, 15 bp, Artificial Sequence
  dgRNA
  Plcxd3
cagagcacggacgtc

SEQ ID NO: 55237 - DNA, 15 bp, Artificial Sequence
  dgRNA
  Abat
ttgctccggccctcg

SEQ ID NO: 55238 - DNA, 15 bp, Artificial Sequence
  dgRNA
  Abat
cctcgcggccctcct

SEQ ID NO: 55239 - DNA, 15 bp, Artificial Sequence
  dgRNA
  Abat
ctcctcggagacccc

SEQ ID NO: 55240 - DNA, 15 bp, Artificial Sequence
  dgRNA
  Abat
ggcgcatcctatcca

SEQ ID NO: 55241 - DNA, 15 bp, Artificial Sequence
  dgRNA
  Pak4
tcattctccacctag

SEQ ID NO: 55242 - DNA, 15 bp, Artificial Sequence
  dgRNA
  Pak4
ctagcggtctccgat

SEQ ID NO: 55243 - DNA, 15 bp, Artificial Sequence
  dgRNA
  Pak4
tagcggtctccgatt

SEQ ID NO: 55244 - DNA, 15 bp, Artificial Sequence
  dgRNA
  Pak4
ttagggaaccctgcc

SEQ ID NO: 55245 - DNA, 15 bp, Artificial Sequence
  dgRNA
  Gsdma2
ttctcgtctcaggcc

SEQ ID NO: 55246 - DNA, 15 bp, Artificial Sequence
  dgRNA
  Gsdma2
tctcgtctcaggcca

SEQ ID NO: 55247 - DNA, 15 bp, Artificial Sequence
  dgRNA
  Gsdma2
acagactgatactgg

SEQ ID NO: 55248 - DNA, 15 bp, Artificial Sequence
  dgRNA
  Gsdma2
gcctgagacgagaag

SEQ ID NO: 55249 - DNA, 15 bp, Artificial Sequence
  dgRNA
  Cdca8
cagttagcacgactc

SEQ ID NO: 55250 - DNA, 15 bp, Artificial Sequence
  dgRNA
  Cdca8
ggagtcgcgaaaaga

SEQ ID NO: 55251 - DNA, 15 bp, Artificial Sequence
  dgRNA
  Cdca8
tgccgcaatgacatc

SEQ ID NO: 55252 - DNA, 15 bp, Artificial Sequence
  dgRNA
  Cdca8
gccgcaatgacatct

SEQ ID NO: 55253 - DNA, 15 bp, Artificial Sequence
  dgRNA
  Copz2
ttcacctgaaagact

SEQ ID NO: 55254 - DNA, 15 bp, Artificial Sequence
  dgRNA
  Copz2
ccaagtagggagacg

SEQ ID NO: 55255 - DNA, 15 bp, Artificial Sequence
  dgRNA
  Copz2
ggttctgcaacgacg

SEQ ID NO: 55256 - DNA, 15 bp, Artificial Sequence
  dgRNA
  Copz2
gttctgcaacgacgt

SEQ ID NO: 55257 - DNA, 15 bp, Artificial Sequence
  dgRNA
  Prrg3
cgcccctcagcagca

SEQ ID NO: 55258 - DNA, 15 bp, Artificial Sequence
  dgRNA
  Prrg3
agcacgggcgcagtc

SEQ ID NO: 55259 - DNA, 15 bp, Artificial Sequence
  dgRNA
  Prrg3
gcacgggcgcagtca

SEQ ID NO: 55260 - DNA, 15 bp, Artificial Sequence
  dgRNA
  Prrg3
cacgggcgcagtcag

SEQ ID NO: 55261 - DNA, 15 bp, Artificial Sequence
  dgRNA
  Uqcc3
agagcttaacctttg

SEQ ID NO: 55262 - DNA, 15 bp, Artificial Sequence
  dgRNA
  Uqcc3
ctatgatttgaggcc

SEQ ID NO: 55263 - DNA, 15 bp, Artificial Sequence
  dgRNA
  Scml4
tttctatggcaacgg

SEQ ID NO: 55264 - DNA, 15 bp, Artificial Sequence
  dgRNA
  Scml4
ctatggcaacggagg

SEQ ID NO: 55265 - DNA, 15 bp, Artificial Sequence
  dgRNA
  Scml4
atggcaacggaggag

SEQ ID NO: 55266 - DNA, 15 bp, Artificial Sequence
  dgRNA
  Scml4
gacaaggctaatgtt

SEQ ID NO: 55267 - DNA, 15 bp, Artificial Sequence
  dgRNA
  Ccdc28a
ctttcccgcagccgc

SEQ ID NO: 55268 - DNA, 15 bp, Artificial Sequence
  dgRNA
  Ccdc28a
acctgaaggcggcta

SEQ ID NO: 55269 - DNA, 15 bp, Artificial Sequence
  dgRNA
  Ccdc28a
cctgaaggcggctat

SEQ ID NO: 55270 - DNA, 15 bp, Artificial Sequence
  dgRNA
  Ccdc28a
gcggctatgggaaga

SEQ ID NO: 55271 - DNA, 15 bp, Artificial Sequence
  dgRNA
  Vgll2
ttaaatgcgctctag

SEQ ID NO: 55272 - DNA, 15 bp, Artificial Sequence
  dgRNA
  Vgll2
taaatgcgctctagc

SEQ ID NO: 55273 - DNA, 15 bp, Artificial Sequence
  dgRNA
  Tpm1
ttgaccgccagacga

SEQ ID NO: 55274 - DNA, 15 bp, Artificial Sequence
  dgRNA
  Tpm1
gacgatggctctgag

SEQ ID NO: 55275 - DNA, 15 bp, Artificial Sequence
  dgRNA
  Tpm1
actctcgcccagtgc

SEQ ID NO: 55276 - DNA, 15 bp, Artificial Sequence
  dgRNA
  Tpm1
ggaaccacccggaat

SEQ ID NO: 55277 - DNA, 15 bp, Artificial Sequence
  dgRNA
  Mrps27
ctgagcccgtcaccc

SEQ ID NO: 55278 - DNA, 15 bp, Artificial Sequence
  dgRNA
  Mrps27
tgagcccgtcacccc

SEQ ID NO: 55279 - DNA, 15 bp, Artificial Sequence
  dgRNA
  Mrps27
atgcagcgaaggacg

SEQ ID NO: 55280 - DNA, 15 bp, Artificial Sequence
  dgRNA
  Mrps27
ggacgcggcacccgc

SEQ ID NO: 55281 - DNA, 15 bp, Artificial Sequence
  dgRNA
  Plagl2
gtggcggtgcccacg

SEQ ID NO: 55282 - DNA, 15 bp, Artificial Sequence
  dgRNA
  Plagl2
gcggtgcccacgcgg

SEQ ID NO: 55283 - DNA, 15 bp, Artificial Sequence
  dgRNA
  Plagl2
cggcgcccatgtcga

SEQ ID NO: 55284 - DNA, 15 bp, Artificial Sequence
  dgRNA
  Plagl2
agtgccacggcccgg

SEQ ID NO: 55285 - DNA, 15 bp, Artificial Sequence
  dgRNA
  Brpf1
cagattcgccacaaa

SEQ ID NO: 55286 - DNA, 15 bp, Artificial Sequence
  dgRNA
  Brpf1
gccacaaacggcccg

SEQ ID NO: 55287 - DNA, 15 bp, Artificial Sequence
  dgRNA
  Brpf1
aggcagcgcgaggct

SEQ ID NO: 55288 - DNA, 15 bp, Artificial Sequence
  dgRNA
  Brpf1
cggacaggcagcgcg

SEQ ID NO: 55289 - DNA, 15 bp, Artificial Sequence
  dgRNA
  D15Ertd621e
gtcaccccaatgcgc

SEQ ID NO: 55290 - DNA, 15 bp, Artificial Sequence
  dgRNA
  D15Ertd621e
cccaatgcgcaggcg

SEQ ID NO: 55291 - DNA, 15 bp, Artificial Sequence
  dgRNA
  D15Ertd621e
atgcgcaggcgcggc

SEQ ID NO: 55292 - DNA, 15 bp, Artificial Sequence
  dgRNA
  D15Ertd621e
caggcgcggctggct

SEQ ID NO: 55293 - DNA, 15 bp, Artificial Sequence
  dgRNA
  Glrp1
ggagggcctgcgagt

SEQ ID NO: 55294 - DNA, 15 bp, Artificial Sequence
  dgRNA
  Glrp1
gagggcctgcgagtg

SEQ ID NO: 55295 - DNA, 15 bp, Artificial Sequence
  dgRNA
  Glrp1
ctcctgtctccggaa

SEQ ID NO: 55296 - DNA, 15 bp, Artificial Sequence
  dgRNA
  Glrp1
tcctgtctccggaat

SEQ ID NO: 55297 - DNA, 15 bp, Artificial Sequence
  dgRNA
  Efcab11
caagaaaaatcgagt

SEQ ID NO: 55298 - DNA, 15 bp, Artificial Sequence
  dgRNA
  Efcab11
agaaaaatcgagtag

SEQ ID NO: 55299 - DNA, 15 bp, Artificial Sequence
  dgRNA
  Efcab11
aaaatcgagtagggg

SEQ ID NO: 55300 - DNA, 15 bp, Artificial Sequence
  dgRNA
  Efcab11
aaatcgagtaggggc

SEQ ID NO: 55301 - DNA, 15 bp, Artificial Sequence
  dgRNA
  Stxbp5
gatgatttaagccgc

SEQ ID NO: 55302 - DNA, 15 bp, Artificial Sequence
  dgRNA
  Stxbp5
atttaagccgccggc

SEQ ID NO: 55303 - DNA, 15 bp, Artificial Sequence
  dgRNA
  Stxbp5
tttaagccgccggcc

SEQ ID NO: 55304 - DNA, 15 bp, Artificial Sequence
  dgRNA
  Stxbp5
taagccgccggccgg

SEQ ID NO: 55305 - DNA, 15 bp, Artificial Sequence
  dgRNA
  Fxr1
ctgggtagccgccca

SEQ ID NO: 55306 - DNA, 15 bp, Artificial Sequence
  dgRNA
  Fxr1
aggacccgcgcagag

SEQ ID NO: 55307 - DNA, 15 bp, Artificial Sequence
  dgRNA
  Fxr1
gagcggcgccgctag

SEQ ID NO: 55308 - DNA, 15 bp, Artificial Sequence
  dgRNA
  Fxr1
cgctagcggagagcc

SEQ ID NO: 55309 - DNA, 15 bp, Artificial Sequence
  dgRNA
  Sap18
tacgttaagctgacc

SEQ ID NO: 55310 - DNA, 15 bp, Artificial Sequence
  dgRNA
  Sap18
acgttaagctgacct

SEQ ID NO: 55311 - DNA, 15 bp, Artificial Sequence
  dgRNA
  Sap18
acgtgctcactgccc

SEQ ID NO: 55312 - DNA, 15 bp, Artificial Sequence
  dgRNA
  Sap18
tgcgcagtgctctac

SEQ ID NO: 55313 - DNA, 15 bp, Artificial Sequence
  dgRNA
  Spg21
cgcaaatctcagaac

SEQ ID NO: 55314 - DNA, 15 bp, Artificial Sequence
  dgRNA
  Spg21
cccttcctcgccatc

SEQ ID NO: 55315 - DNA, 15 bp, Artificial Sequence
  dgRNA
  Spg21
ctggtcccgcctcct

SEQ ID NO: 55316 - DNA, 15 bp, Artificial Sequence
  dgRNA
  Spg21
aggctgtaggccccg

SEQ ID NO: 55317 - DNA, 15 bp, Artificial Sequence
  dgRNA
  Wdr89
aggtgttgtatggcg

SEQ ID NO: 55318 - DNA, 15 bp, Artificial Sequence
  dgRNA
  Wdr89
ctgccctcgtccaat

SEQ ID NO: 55319 - DNA, 15 bp, Artificial Sequence
  dgRNA
  Wdr89
cctcgtccaatcgga

SEQ ID NO: 55320 - DNA, 15 bp, Artificial Sequence
  dgRNA
  Wdr89
gcaagcaaaggcgcg

SEQ ID NO: 55321 - DNA, 15 bp, Artificial Sequence
  dgRNA
  Qsox2
ggtgaaaattgcttg

SEQ ID NO: 55322 - DNA, 15 bp, Artificial Sequence
  dgRNA
  Qsox2
gtgaaaattgcttgc

SEQ ID NO: 55323 - DNA, 15 bp, Artificial Sequence
  dgRNA
  Qsox2
agggccaatgaccag

SEQ ID NO: 55324 - DNA, 15 bp, Artificial Sequence
  dgRNA
  Qsox2
ggcggagcagactta

SEQ ID NO: 55325 - DNA, 15 bp, Artificial Sequence
  dgRNA
  Plppr5
gagactgcaattcgg

SEQ ID NO: 55326 - DNA, 15 bp, Artificial Sequence
  dgRNA
  Plppr5
ttcggcggcgccacc

SEQ ID NO: 55327 - DNA, 15 bp, Artificial Sequence
  dgRNA
  Plppr5
ggacactttgcgttc

SEQ ID NO: 55328 - DNA, 15 bp, Artificial Sequence
  dgRNA
  Plppr5
cactttgcgttccgg

SEQ ID NO: 55329 - DNA, 15 bp, Artificial Sequence
  dgRNA
  Hspa5
ccaatgagtcagccc

SEQ ID NO: 55330 - DNA, 15 bp, Artificial Sequence
  dgRNA
  Hspa5
caatgagtcagcccg

SEQ ID NO: 55331 - DNA, 15 bp, Artificial Sequence
  dgRNA
  Hspa5
aatgagtcagcccgg

SEQ ID NO: 55332 - DNA, 15 bp, Artificial Sequence
  dgRNA
  Hspa5
atgagtcagcccggg

SEQ ID NO: 55333 - DNA, 15 bp, Artificial Sequence
  dgRNA
  Tex15
agagatgatcatcat

SEQ ID NO: 55334 - DNA, 15 bp, Artificial Sequence
  dgRNA
  Tex15
gagatgatcatcatt

SEQ ID NO: 55335 - DNA, 15 bp, Artificial Sequence
  dgRNA
  Ackr1
cgtgttcgtttcctg

SEQ ID NO: 55336 - DNA, 15 bp, Artificial Sequence
  dgRNA
  Ackr1
cccgatgctagccca

SEQ ID NO: 55337 - DNA, 15 bp, Artificial Sequence
  dgRNA
  Ackr1
gtgaggtccacaaag

SEQ ID NO: 55338 - DNA, 15 bp, Artificial Sequence
  dgRNA
  Ackr1
ggtgaggtccacaaa

SEQ ID NO: 55339 - DNA, 15 bp, Artificial Sequence
  dgRNA
  Crybb3
aggccatcggttccc

SEQ ID NO: 55340 - DNA, 15 bp, Artificial Sequence
  dgRNA
  Crybb3
tcagacttgtgcaag

SEQ ID NO: 55341 - DNA, 15 bp, Artificial Sequence
  dgRNA
  Crybb3
gaggtgactggcctt

SEQ ID NO: 55342 - DNA, 15 bp, Artificial Sequence
  dgRNA
  Crybb3
aggtgactggcctta

SEQ ID NO: 55343 - DNA, 15 bp, Artificial Sequence
  dgRNA
  Olfr99
caatcaatgctgtga

SEQ ID NO: 55344 - DNA, 15 bp, Artificial Sequence
  dgRNA
  Olfr99
gcattgattgagcaa

SEQ ID NO: 55345 - DNA, 15 bp, Artificial Sequence
  dgRNA
  0610010K14Rik
gcgggacttcctgcg

SEQ ID NO: 55346 - DNA, 15 bp, Artificial Sequence
  dgRNA
  0610010K14Rik
cgggacttcctgcgc

SEQ ID NO: 55347 - DNA, 15 bp, Artificial Sequence
  dgRNA
  0610010K14Rik
gcgcgggagcccgag

SEQ ID NO: 55348 - DNA, 15 bp, Artificial Sequence
  dgRNA
  0610010K14Rik
gggagcccgagcggc

SEQ ID NO: 55349 - DNA, 15 bp, Artificial Sequence
  dgRNA
  Krtap15
ggtatataagggccc

SEQ ID NO: 55350 - DNA, 15 bp, Artificial Sequence
  dgRNA
  Krtap15
gcccaggttagacgg

SEQ ID NO: 55351 - DNA, 15 bp, Artificial Sequence
  dgRNA
  Krtap15
tactttaaccttcaa

SEQ ID NO: 55352 - DNA, 15 bp, Artificial Sequence
  dgRNA
  Krtap15
tgagactgcttaatt

SEQ ID NO: 55353 - DNA, 15 bp, Artificial Sequence
  dgRNA
  Olfr1417
gggtgtaaaaacagt

SEQ ID NO: 55354 - DNA, 15 bp, Artificial Sequence
  dgRNA
  Olfr1417
ggatttgagctgaca

SEQ ID NO: 55355 - DNA, 15 bp, Artificial Sequence
  dgRNA
  Olfr1417
gatttgagctgacaa

SEQ ID NO: 55356 - DNA, 15 bp, Artificial Sequence
  dgRNA
  Olfr1417
ttgagctgacaaggg

SEQ ID NO: 55357 - DNA, 15 bp, Artificial Sequence
  dgRNA
  Gadd45g
aaagcggcagatttg

SEQ ID NO: 55358 - DNA, 15 bp, Artificial Sequence
  dgRNA
  Gadd45g
gcacccctccccacg

SEQ ID NO: 55359 - DNA, 15 bp, Artificial Sequence
  dgRNA
  Gadd45g
ccccacgtggccttc

SEQ ID NO: 55360 - DNA, 15 bp, Artificial Sequence
  dgRNA
  Gadd45g
tctggcacgagccgc

SEQ ID NO: 55361 - DNA, 15 bp, Artificial Sequence
  dgRNA
  Fbxw7
ggctctctaaatatt

SEQ ID NO: 55362 - DNA, 15 bp, Artificial Sequence
  dgRNA
  Rars2
gagtcctgttctccg

SEQ ID NO: 55363 - DNA, 15 bp, Artificial Sequence
  dgRNA
  Rars2
cccatcaaacctcgt

SEQ ID NO: 55364 - DNA, 15 bp, Artificial Sequence
  dgRNA
  Rars2
tcggacttgccaaac

SEQ ID NO: 55365 - DNA, 15 bp, Artificial Sequence
  dgRNA
  Rars2
ggcaccgcgaatctg

SEQ ID NO: 55366 - DNA, 15 bp, Artificial Sequence
  dgRNA
  Rnf13
gcttgcccgctgttg

SEQ ID NO: 55367 - DNA, 15 bp, Artificial Sequence
  dgRNA
  Rnf13
cttctccgacttgct

SEQ ID NO: 55368 - DNA, 15 bp, Artificial Sequence
  dgRNA
  Rnf13
ttctccgacttgctt

SEQ ID NO: 55369 - DNA, 15 bp, Artificial Sequence
  dgRNA
  Rnf13
ccgacttgcttgggt

SEQ ID NO: 55370 - DNA, 15 bp, Artificial Sequence
  dgRNA
  C130079G13Rik
tccaatgcttgcatc

SEQ ID NO: 55371 - DNA, 15 bp, Artificial Sequence
  dgRNA
  C130079G13Rik
ccaatgcttgcatct

SEQ ID NO: 55372 - DNA, 15 bp, Artificial Sequence
  dgRNA
  C130079G13Rik
aagactaattcatgc

SEQ ID NO: 55373 - DNA, 15 bp, Artificial Sequence
  dgRNA
  C130079G13Rik
gcaatattctctaac

SEQ ID NO: 55374 - DNA, 15 bp, Artificial Sequence
  dgRNA
  Trem1
ctgatgtcagcccgc

SEQ ID NO: 55375 - DNA, 15 bp, Artificial Sequence
  dgRNA
  Trem1
tgatgtcagcccgca

SEQ ID NO: 55376 - DNA, 15 bp, Artificial Sequence
  dgRNA
  Trem1
tcagtaaggaagttc

SEQ ID NO: 55377 - DNA, 15 bp, Artificial Sequence
  dgRNA
  Trem1
gggctgacatcagta

SEQ ID NO: 55378 - DNA, 15 bp, Artificial Sequence
  dgRNA
  Fbxo10
gatccgcccgcttcc

SEQ ID NO: 55379 - DNA, 15 bp, Artificial Sequence
  dgRNA
  Fbxo10
ttcccaccccttcgg

SEQ ID NO: 55380 - DNA, 15 bp, Artificial Sequence
  dgRNA
  Fbxo10
agcctaacagcaccc

SEQ ID NO: 55381 - DNA, 15 bp, Artificial Sequence
  dgRNA
  Fbxo10
aggctcctaggggcc

SEQ ID NO: 55382 - DNA, 15 bp, Artificial Sequence
  dgRNA
  Gpr39
aaggctgcaagagcg

SEQ ID NO: 55383 - DNA, 15 bp, Artificial Sequence
  dgRNA
  Gpr39
ggctgcaagagcgag

SEQ ID NO: 55384 - DNA, 15 bp, Artificial Sequence
  dgRNA
  Gpr39
gctgcaagagcgagg

SEQ ID NO: 55385 - DNA, 15 bp, Artificial Sequence
  dgRNA
  Gpr39
gctgctaagcagaat

SEQ ID NO: 55386 - DNA, 15 bp, Artificial Sequence
  dgRNA
  Rnft1
ctagggactcgggac

SEQ ID NO: 55387 - DNA, 15 bp, Artificial Sequence
  dgRNA
  Rnft1
tagggactcgggaca

SEQ ID NO: 55388 - DNA, 15 bp, Artificial Sequence
  dgRNA
  Rnft1
cgggacagggcctaa

SEQ ID NO: 55389 - DNA, 15 bp, Artificial Sequence
  dgRNA
  Rnft1
gggccgggatgagcg

SEQ ID NO: 55390 - DNA, 15 bp, Artificial Sequence
  dgRNA
  Taar2
agcgttagcattcac

SEQ ID NO: 55391 - DNA, 15 bp, Artificial Sequence
  dgRNA
  Taar2
gcgttagcattcaca

SEQ ID NO: 55392 - DNA, 15 bp, Artificial Sequence
  dgRNA
  Taar2
aacaattggtctcaa

SEQ ID NO: 55393 - DNA, 15 bp, Artificial Sequence
  dgRNA
  Acy1
tttcctcgccctatc

SEQ ID NO: 55394 - DNA, 15 bp, Artificial Sequence
  dgRNA
  Acy1
cctcgccctatccgg

SEQ ID NO: 55395 - DNA, 15 bp, Artificial Sequence
  dgRNA
  Acy1
tatccggaggctgca

SEQ ID NO: 55396 - DNA, 15 bp, Artificial Sequence
  dgRNA
  Acy1
atccggaggctgcaa

SEQ ID NO: 55397 - DNA, 15 bp, Artificial Sequence
  dgRNA
  Kif1b
ggtcaccttccgcgt

SEQ ID NO: 55398 - DNA, 15 bp, Artificial Sequence
  dgRNA
  Kif1b
cttccgcgtcggtct

SEQ ID NO: 55399 - DNA, 15 bp, Artificial Sequence
  dgRNA
  Kif1b
gtcggtctcggttgc

SEQ ID NO: 55400 - DNA, 15 bp, Artificial Sequence
  dgRNA
  Kif1b
tcggtctcggttgct

SEQ ID NO: 55401 - DNA, 15 bp, Artificial Sequence
  dgRNA
  Timm50
atggtggcggtcctt

SEQ ID NO: 55402 - DNA, 15 bp, Artificial Sequence
  dgRNA
  Timm50
tggtggcggtcctta

SEQ ID NO: 55403 - DNA, 15 bp, Artificial Sequence
  dgRNA
  Timm50
ggtccttagggcccc

SEQ ID NO: 55404 - DNA, 15 bp, Artificial Sequence
  dgRNA
  Timm50
ttcgcgctcagccag

SEQ ID NO: 55405 - DNA, 15 bp, Artificial Sequence
  dgRNA
  4930524B15Rik
gtcctcgcctcacac

SEQ ID NO: 55406 - DNA, 15 bp, Artificial Sequence
  dgRNA
  4930524B15Rik
cgcctcacacaggtc

SEQ ID NO: 55407 - DNA, 15 bp, Artificial Sequence
  dgRNA
  4930524B15Rik
caggtctggccccaa

SEQ ID NO: 55408 - DNA, 15 bp, Artificial Sequence
  dgRNA
  4930524B15Rik
acgggactgacctag

SEQ ID NO: 55409 - DNA, 15 bp, Artificial Sequence
  dgRNA
  Abca14
cttcaaccgtcttgc

SEQ ID NO: 55410 - DNA, 15 bp, Artificial Sequence
  dgRNA
  Abca14
ccaaactcagtagag

SEQ ID NO: 55411 - DNA, 15 bp, Artificial Sequence
  dgRNA
  Abca14
acaggggctacactc

SEQ ID NO: 55412 - DNA, 15 bp, Artificial Sequence
  dgRNA
  Abca14
cttccagcgcgcgcc

SEQ ID NO: 55413 - DNA, 15 bp, Artificial Sequence
  dgRNA
  Yipf4
ggccacttccggtgt

SEQ ID NO: 55414 - DNA, 15 bp, Artificial Sequence
  dgRNA
  Yipf4
cttccggtgttggag

SEQ ID NO: 55415 - DNA, 15 bp, Artificial Sequence
  dgRNA
  Yipf4
atcagaatcttctcg

SEQ ID NO: 55416 - DNA, 15 bp, Artificial Sequence
  dgRNA
  Yipf4
tcagaatcttctcgc

SEQ ID NO: 55417 - DNA, 15 bp, Artificial Sequence
  dgRNA
  Mical2
cgtccgaagctgcaa

SEQ ID NO: 55418 - DNA, 15 bp, Artificial Sequence
  dgRNA
  Mical2
cagcctggtactaac

SEQ ID NO: 55419 - DNA, 15 bp, Artificial Sequence
  dgRNA
  Mical2
agcctggtactaact

SEQ ID NO: 55420 - DNA, 15 bp, Artificial Sequence
  dgRNA
  Mical2
tggtactaactggga

SEQ ID NO: 55421 - DNA, 15 bp, Artificial Sequence
  dgRNA
  Olfr703
caattacctcaaagg

SEQ ID NO: 55422 - DNA, 15 bp, Artificial Sequence
  dgRNA
  Mylip
ctcccgcagctccac

SEQ ID NO: 55423 - DNA, 15 bp, Artificial Sequence
  dgRNA
  Mylip
ctccacaggcggtgc

SEQ ID NO: 55424 - DNA, 15 bp, Artificial Sequence
  dgRNA
  Mylip
tccacaggcggtgcc

SEQ ID NO: 55425 - DNA, 15 bp, Artificial Sequence
  dgRNA
  Mylip
acaggcggtgccggg

SEQ ID NO: 55426 - DNA, 15 bp, Artificial Sequence
  dgRNA
  Psmb2
ctctaaaattcgact

SEQ ID NO: 55427 - DNA, 15 bp, Artificial Sequence
  dgRNA
  Psmb2
tcgacttggtagata

SEQ ID NO: 55428 - DNA, 15 bp, Artificial Sequence
  dgRNA
  Psmb2
tccgcaatctcagcg

SEQ ID NO: 55429 - DNA, 15 bp, Artificial Sequence
  dgRNA
  Psmb2
ctgctctctcgcgag

SEQ ID NO: 55430 - DNA, 15 bp, Artificial Sequence
  dgRNA
  Scrib
cattttgtgggcggg

SEQ ID NO: 55431 - DNA, 15 bp, Artificial Sequence
  dgRNA
  Scrib
attttgtgggcgggc

SEQ ID NO: 55432 - DNA, 15 bp, Artificial Sequence
  dgRNA
  Scrib
ttacacctgctagta

SEQ ID NO: 55433 - DNA, 15 bp, Artificial Sequence
  dgRNA
  Scrib
tacacctgctagtat

SEQ ID NO: 55434 - DNA, 15 bp, Artificial Sequence
  dgRNA
  Cep170b
gtgatcgcccgttcc

SEQ ID NO: 55435 - DNA, 15 bp, Artificial Sequence
  dgRNA
  Cep170b
cctggttgcccgatc

SEQ ID NO: 55436 - DNA, 15 bp, Artificial Sequence
  dgRNA
  Cep170b
cccgatccggtgcgc

SEQ ID NO: 55437 - DNA, 15 bp, Artificial Sequence
  dgRNA
  Cep170b
ccgatccggtgcgcc

SEQ ID NO: 55438 - DNA, 15 bp, Artificial Sequence
  dgRNA
  Olfr957
atgcctaatatgttt

SEQ ID NO: 55439 - DNA, 15 bp, Artificial Sequence
  dgRNA
  Olfr957
atatgtttgggtccc

SEQ ID NO: 55440 - DNA, 15 bp, Artificial Sequence
  dgRNA
  Olfr957
ctatgactattgata

SEQ ID NO: 55441 - DNA, 15 bp, Artificial Sequence
  dgRNA
  Olfr957
aatcaaatatcagac

SEQ ID NO: 55442 - DNA, 15 bp, Artificial Sequence
  dgRNA
  Zbtb49
agccgaccccgccaa

SEQ ID NO: 55443 - DNA, 15 bp, Artificial Sequence
  dgRNA
  Zbtb49
gccaacggtctcaac

SEQ ID NO: 55444 - DNA, 15 bp, Artificial Sequence
  dgRNA
  Zbtb49
gtctcaaccggccgc

SEQ ID NO: 55445 - DNA, 15 bp, Artificial Sequence
  dgRNA
  Zbtb49
tctcaaccggccgcc

SEQ ID NO: 55446 - DNA, 15 bp, Artificial Sequence
  dgRNA
  Pcdha11
tacactttgagccac

SEQ ID NO: 55447 - DNA, 15 bp, Artificial Sequence
  dgRNA
  Pcdha11
ctagtaactaattag

SEQ ID NO: 55448 - DNA, 15 bp, Artificial Sequence
  dgRNA
  Pcdha11
ctctcttcgctcatc

SEQ ID NO: 55449 - DNA, 15 bp, Artificial Sequence
  dgRNA
  Pcdha11
aacaacggcaccctg

SEQ ID NO: 55450 - DNA, 15 bp, Artificial Sequence
  dgRNA
  Serpinb7
caattcaaagttgtc

SEQ ID NO: 55451 - DNA, 15 bp, Artificial Sequence
  dgRNA
  Olfr1012
atacagtgttcaccc

SEQ ID NO: 55452 - DNA, 15 bp, Artificial Sequence
  dgRNA
  Olfr1012
tgctgattatgttac

SEQ ID NO: 55453 - DNA, 15 bp, Artificial Sequence
  dgRNA
  Olfr1012
tacagctacatgggt

SEQ ID NO: 55454 - DNA, 15 bp, Artificial Sequence
  dgRNA
  Olfr1012
aacataatcagcacc

SEQ ID NO: 55455 - DNA, 15 bp, Artificial Sequence
  dgRNA
  Pex5l
caggctgactacttg

SEQ ID NO: 55456 - DNA, 15 bp, Artificial Sequence
  dgRNA
  Pex5l
tcaattgaggcaagg

SEQ ID NO: 55457 - DNA, 15 bp, Artificial Sequence
  dgRNA
  Pex5l
gtttcaattgaggca

SEQ ID NO: 55458 - DNA, 15 bp, Artificial Sequence
  dgRNA
  Pex5l
ctgtccaagtgtgag

SEQ ID NO: 55459 - DNA, 15 bp, Artificial Sequence
  dgRNA
  Il13ra1
tgacaggtggtggcg

SEQ ID NO: 55460 - DNA, 15 bp, Artificial Sequence
  dgRNA
  Il13ra1
caggtggtggcgcgg

SEQ ID NO: 55461 - DNA, 15 bp, Artificial Sequence
  dgRNA
  Il13ra1
aggtggtggcgcgga

SEQ ID NO: 55462 - DNA, 15 bp, Artificial Sequence
  dgRNA
  Il13ra1
gcgcggagggaggcc

SEQ ID NO: 55463 - DNA, 15 bp, Artificial Sequence
  dgRNA
  Spon2
cgagctgctttcctt

SEQ ID NO: 55464 - DNA, 15 bp, Artificial Sequence
  dgRNA
  Spon2
cttcggctggccaag

SEQ ID NO: 55465 - DNA, 15 bp, Artificial Sequence
  dgRNA
  Spon2
ttcggctggccaagt

SEQ ID NO: 55466 - DNA, 15 bp, Artificial Sequence
  dgRNA
  Spon2
acccctatgagaaag

SEQ ID NO: 55467 - DNA, 15 bp, Artificial Sequence
  dgRNA
  Pafah2
cgcttctccgacacc

SEQ ID NO: 55468 - DNA, 15 bp, Artificial Sequence
  dgRNA
  Pafah2
gcttctccgacacca

SEQ ID NO: 55469 - DNA, 15 bp, Artificial Sequence
  dgRNA
  Pafah2
cttctccgacaccag

SEQ ID NO: 55470 - DNA, 15 bp, Artificial Sequence
  dgRNA
  Pafah2
ttctccgacaccagg

SEQ ID NO: 55471 - DNA, 15 bp, Artificial Sequence
  dgRNA
  Aldh18a1
cgcccctatactctg

SEQ ID NO: 55472 - DNA, 15 bp, Artificial Sequence
  dgRNA
  Aldh18a1
tatactctgcgggcg

SEQ ID NO: 55473 - DNA, 15 bp, Artificial Sequence
  dgRNA
  Aldh18a1
tgcgggcgcggagcc

SEQ ID NO: 55474 - DNA, 15 bp, Artificial Sequence
  dgRNA
  Aldh18a1
gcgggcgcggagcct

SEQ ID NO: 55475 - DNA, 15 bp, Artificial Sequence
  dgRNA
  Reg3b
cacctgaggtaaagc

SEQ ID NO: 55476 - DNA, 15 bp, Artificial Sequence
  dgRNA
  Reg3b
aagcaggtcggctaa

SEQ ID NO: 55477 - DNA, 15 bp, Artificial Sequence
  dgRNA
  Reg3b
agcaggtcggctaac

SEQ ID NO: 55478 - DNA, 15 bp, Artificial Sequence
  dgRNA
  Reg3b
cggctaacgggaaag

SEQ ID NO: 55479 - DNA, 15 bp, Artificial Sequence
  dgRNA
  Sesn2
cttgtcgatgctgat

SEQ ID NO: 55480 - DNA, 15 bp, Artificial Sequence
  dgRNA
  Sesn2
tcgatgctgattgga

SEQ ID NO: 55481 - DNA, 15 bp, Artificial Sequence
  dgRNA
  Sesn2
tgctgattggacgga

SEQ ID NO: 55482 - DNA, 15 bp, Artificial Sequence
  dgRNA
  Sesn2
gattggacggaaggt

SEQ ID NO: 55483 - DNA, 15 bp, Artificial Sequence
  dgRNA
  Lama2
accctttaaaggccc

SEQ ID NO: 55484 - DNA, 15 bp, Artificial Sequence
  dgRNA
  Lama2
cccacccttgggcgg

SEQ ID NO: 55485 - DNA, 15 bp, Artificial Sequence
  dgRNA
  Lama2
cccttgggcggtggc

SEQ ID NO: 55486 - DNA, 15 bp, Artificial Sequence
  dgRNA
  Lama2
ccttgggcggtggca

SEQ ID NO: 55487 - DNA, 15 bp, Artificial Sequence
  dgRNA
  Trpt1
gcttgatctactccc

SEQ ID NO: 55488 - DNA, 15 bp, Artificial Sequence
  dgRNA
  Trpt1
tctactcccaggatc

SEQ ID NO: 55489 - DNA, 15 bp, Artificial Sequence
  dgRNA
  Trpt1
gatctcggaatttag

SEQ ID NO: 55490 - DNA, 15 bp, Artificial Sequence
  dgRNA
  Trpt1
tcggaatttagcggc

SEQ ID NO: 55491 - DNA, 15 bp, Artificial Sequence
  dgRNA
  Olfr368
ggttctagtcttaac

SEQ ID NO: 55492 - DNA, 15 bp, Artificial Sequence
  dgRNA
  Olfr368
agctatgcccatcat

SEQ ID NO: 55493 - DNA, 15 bp, Artificial Sequence
  dgRNA
  Olfr368
aagctatgcccatca

SEQ ID NO: 55494 - DNA, 15 bp, Artificial Sequence
  dgRNA
  Tcea2
ccccctggcattcgg

SEQ ID NO: 55495 - DNA, 15 bp, Artificial Sequence
  dgRNA
  Tcea2
cccctggcattcggt

SEQ ID NO: 55496 - DNA, 15 bp, Artificial Sequence
  dgRNA
  Tcea2
cattcggtgggcacg

SEQ ID NO: 55497 - DNA, 15 bp, Artificial Sequence
  dgRNA
  Tcea2
attcggtgggcacgt

SEQ ID NO: 55498 - DNA, 15 bp, Artificial Sequence
  dgRNA
  Hhipl2
tccgtcctgcctaca

SEQ ID NO: 55499 - DNA, 15 bp, Artificial Sequence
  dgRNA
  Hhipl2
tatgcattgtgcagt

SEQ ID NO: 55500 - DNA, 15 bp, Artificial Sequence
  dgRNA
  Hhipl2
agggtgttttgccat

SEQ ID NO: 55501 - DNA, 15 bp, Artificial Sequence
  dgRNA
  Hhipl2
gggtgttttgccatg

SEQ ID NO: 55502 - DNA, 15 bp, Artificial Sequence
  dgRNA
  Fbxl14
cgagcagcccggggc

SEQ ID NO: 55503 - DNA, 15 bp, Artificial Sequence
  dgRNA
  Fbxl14
gggcagtttgaaccg

SEQ ID NO: 55504 - DNA, 15 bp, Artificial Sequence
  dgRNA
  Fbxl14
agtttgaaccgcgga

SEQ ID NO: 55505 - DNA, 15 bp, Artificial Sequence
  dgRNA
  Fbxl14
gcggacggcagacaa

SEQ ID NO: 55506 - DNA, 15 bp, Artificial Sequence
  dgRNA
  Ssx2ip
gcccgccgaggaaag

SEQ ID NO: 55507 - DNA, 15 bp, Artificial Sequence
  dgRNA
  Ssx2ip
gaggaaagcggcgag

SEQ ID NO: 55508 - DNA, 15 bp, Artificial Sequence
  dgRNA
  Ssx2ip
gaaagcggcgagagg

SEQ ID NO: 55509 - DNA, 15 bp, Artificial Sequence
  dgRNA
  Ssx2ip
aaagcggcgagaggc

SEQ ID NO: 55510 - DNA, 15 bp, Artificial Sequence
  dgRNA
  Ccrl2
gacacgtttgtactc

SEQ ID NO: 55511 - DNA, 15 bp, Artificial Sequence
  dgRNA
  Ccrl2
aactgttatctactc

SEQ ID NO: 55512 - DNA, 15 bp, Artificial Sequence
  dgRNA
  Ccrl2
actgttatctactca

SEQ ID NO: 55513 - DNA, 15 bp, Artificial Sequence
  dgRNA
  Ccrl2
tggggtggtgcgtct

SEQ ID NO: 55514 - DNA, 15 bp, Artificial Sequence
  dgRNA
  Ogfod1
gtgaatacgctccgg

SEQ ID NO: 55515 - DNA, 15 bp, Artificial Sequence
  dgRNA
  Ogfod1
atacgctccggaggc

SEQ ID NO: 55516 - DNA, 15 bp, Artificial Sequence
  dgRNA
  Ogfod1
catttgaccaattgc

SEQ ID NO: 55517 - DNA, 15 bp, Artificial Sequence
  dgRNA
  Ogfod1
ttgaccaattgctgg

SEQ ID NO: 55518 - DNA, 15 bp, Artificial Sequence
  dgRNA
  Zfp236
ccggcgttcaaggtc

SEQ ID NO: 55519 - DNA, 15 bp, Artificial Sequence
  dgRNA
  Zfp236
cggcgttcaaggtcc

SEQ ID NO: 55520 - DNA, 15 bp, Artificial Sequence
  dgRNA
  Zfp236
gttcaaggtccggga

SEQ ID NO: 55521 - DNA, 15 bp, Artificial Sequence
  dgRNA
  Zfp236
gcaggccggctatgc

SEQ ID NO: 55522 - DNA, 15 bp, Artificial Sequence
  dgRNA
  Mapk1
gagctacccagcgct

SEQ ID NO: 55523 - DNA, 15 bp, Artificial Sequence
  dgRNA
  Mapk1
agctacccagcgctt

SEQ ID NO: 55524 - DNA, 15 bp, Artificial Sequence
  dgRNA
  Mapk1
ggagacccaagcgct

SEQ ID NO: 55525 - DNA, 15 bp, Artificial Sequence
  dgRNA
  Mapk1
cggagacccaagcgc

SEQ ID NO: 55526 - DNA, 15 bp, Artificial Sequence
  dgRNA
  Atp2b2
ggaaacgagtcctca

SEQ ID NO: 55527 - DNA, 15 bp, Artificial Sequence
  dgRNA
  Atp2b2
gcccacctgcgtgag

SEQ ID NO: 55528 - DNA, 15 bp, Artificial Sequence
  dgRNA
  Atp2b2
cacctgcgtgagtgg

SEQ ID NO: 55529 - DNA, 15 bp, Artificial Sequence
  dgRNA
  Atp2b2
acctgcgtgagtggc

SEQ ID NO: 55530 - DNA, 15 bp, Artificial Sequence
  dgRNA
  Acd
tctagagttgtactg

SEQ ID NO: 55531 - DNA, 15 bp, Artificial Sequence
  dgRNA
  Acd
gctaggtcagtcagc

SEQ ID NO: 55532 - DNA, 15 bp, Artificial Sequence
  dgRNA
  Acd
gggaagagcttgcgc

SEQ ID NO: 55533 - DNA, 15 bp, Artificial Sequence
  dgRNA
  Acd
aggcgcagaaccgcg

SEQ ID NO: 55534 - DNA, 15 bp, Artificial Sequence
  dgRNA
  Bcat1
agagtccacgtttcg

SEQ ID NO: 55535 - DNA, 15 bp, Artificial Sequence
  dgRNA
  Bcat1
ctgtaggactgttgc

SEQ ID NO: 55536 - DNA, 15 bp, Artificial Sequence
  dgRNA
  Bcat1
ccgaagcacaaatgc

SEQ ID NO: 55537 - DNA, 15 bp, Artificial Sequence
  dgRNA
  Bcat1
gctgcaaatccagat

SEQ ID NO: 55538 - DNA, 15 bp, Artificial Sequence
  dgRNA
  Mina
cgttctgtgaccttt

SEQ ID NO: 55539 - DNA, 15 bp, Artificial Sequence
  dgRNA
  Mina
gacctttaggttcat

SEQ ID NO: 55540 - DNA, 15 bp, Artificial Sequence
  dgRNA
  Mina
cctgtagctgtaggc

SEQ ID NO: 55541 - DNA, 15 bp, Artificial Sequence
  dgRNA
  Mina
cagggatgtggtccg

SEQ ID NO: 55542 - DNA, 15 bp, Artificial Sequence
  dgRNA
  Exd2
gagcgaaagttcaat

SEQ ID NO: 55543 - DNA, 15 bp, Artificial Sequence
  dgRNA
  Exd2
ctttaaccgagaacc

SEQ ID NO: 55544 - DNA, 15 bp, Artificial Sequence
  dgRNA
  Exd2
tttaaccgagaacct

SEQ ID NO: 55545 - DNA, 15 bp, Artificial Sequence
  dgRNA
  Exd2
ttaaccgagaacctg

SEQ ID NO: 55546 - DNA, 15 bp, Artificial Sequence
  dgRNA
  Ndufv2
acaagagcctcgaga

SEQ ID NO: 55547 - DNA, 15 bp, Artificial Sequence
  dgRNA
  Ndufv2
tgtttgttgaggacg

SEQ ID NO: 55548 - DNA, 15 bp, Artificial Sequence
  dgRNA
  Aldh2
agtgatgcgttcacc

SEQ ID NO: 55549 - DNA, 15 bp, Artificial Sequence
  dgRNA
  Aldh2
gttcacctggttgaa

SEQ ID NO: 55550 - DNA, 15 bp, Artificial Sequence
  dgRNA
  Aldh2
gagccccaaactggg

SEQ ID NO: 55551 - DNA, 15 bp, Artificial Sequence
  dgRNA
  Aldh2
ggtgagaatcttggc

SEQ ID NO: 55552 - DNA, 15 bp, Artificial Sequence
  dgRNA
  Derl2
tctcgacgaatgtaa

SEQ ID NO: 55553 - DNA, 15 bp, Artificial Sequence
  dgRNA
  Derl2
cgaccgccacagaca

SEQ ID NO: 55554 - DNA, 15 bp, Artificial Sequence
  dgRNA
  Derl2
tcccgtactaccccg

SEQ ID NO: 55555 - DNA, 15 bp, Artificial Sequence
  dgRNA
  Derl2
ggccgcgatgcatgc

SEQ ID NO: 55556 - DNA, 15 bp, Artificial Sequence
  dgRNA
  Erh
ctgtacctgttccta

SEQ ID NO: 55557 - DNA, 15 bp, Artificial Sequence
  dgRNA
  Erh
tgtacctgttcctag

SEQ ID NO: 55558 - DNA, 15 bp, Artificial Sequence
  dgRNA
  Erh
acctgttcctagggg

SEQ ID NO: 55559 - DNA, 15 bp, Artificial Sequence
  dgRNA
  Erh
taggggtggcaccgc

SEQ ID NO: 55560 - DNA, 15 bp, Artificial Sequence
  dgRNA
  8-Sep
acctgcaaacgcact

SEQ ID NO: 55561 - DNA, 15 bp, Artificial Sequence
  dgRNA
  8-Sep
aacctgcaaacgcac

SEQ ID NO: 55562 - DNA, 15 bp, Artificial Sequence
  dgRNA
  Bms1
gggcccagcgccgcg

SEQ ID NO: 55563 - DNA, 15 bp, Artificial Sequence
  dgRNA
  Bms1
gaagccaggtcgcgc

SEQ ID NO: 55564 - DNA, 15 bp, Artificial Sequence
  dgRNA
  Bms1
gcccgactctcagag

SEQ ID NO: 55565 - DNA, 15 bp, Artificial Sequence
  dgRNA
  Bms1
gtggctgggacccga

SEQ ID NO: 55566 - DNA, 15 bp, Artificial Sequence
  dgRNA
  Poldip3
gagcccataaggctc

SEQ ID NO: 55567 - DNA, 15 bp, Artificial Sequence
  dgRNA
  Poldip3
aagcgagcaccgcaa

SEQ ID NO: 55568 - DNA, 15 bp, Artificial Sequence
  dgRNA
  Poldip3
caccgcaaaggctca

SEQ ID NO: 55569 - DNA, 15 bp, Artificial Sequence
  dgRNA
  Poldip3
accgcaaaggctcac

SEQ ID NO: 55570 - DNA, 15 bp, Artificial Sequence
  dgRNA
  Dao
ctgctcactagagcg

SEQ ID NO: 55571 - DNA, 15 bp, Artificial Sequence
  dgRNA
  Dao
gagcgaggacacata

SEQ ID NO: 55572 - DNA, 15 bp, Artificial Sequence
  dgRNA
  Dao
aagtaggactcagtc

SEQ ID NO: 55573 - DNA, 15 bp, Artificial Sequence
  dgRNA
  Dao
cttcggcaatggagg

SEQ ID NO: 55574 - DNA, 15 bp, Artificial Sequence
  dgRNA
  Igfbp2
ccgaaagacaaaccc

SEQ ID NO: 55575 - DNA, 15 bp, Artificial Sequence
  dgRNA
  Igfbp2
aaagacaaacccggg

SEQ ID NO: 55576 - DNA, 15 bp, Artificial Sequence
  dgRNA
  Igfbp2
acaaacccgggaggg

SEQ ID NO: 55577 - DNA, 15 bp, Artificial Sequence
  dgRNA
  Igfbp2
tgcgggtggagcaag

SEQ ID NO: 55578 - DNA, 15 bp, Artificial Sequence
  dgRNA
  Gucy1a3
ttggaggatggcgac

SEQ ID NO: 55579 - DNA, 15 bp, Artificial Sequence
  dgRNA
  Gucy1a3
ggatggcgactgggc

SEQ ID NO: 55580 - DNA, 15 bp, Artificial Sequence
  dgRNA
  Gucy1a3
gggactcagagccgc

SEQ ID NO: 55581 - DNA, 15 bp, Artificial Sequence
  dgRNA
  Gucy1a3
tgtgtgagaaacccg

SEQ ID NO: 55582 - DNA, 15 bp, Artificial Sequence
  dgRNA
  BC016579
tcagctaaccaaagc

SEQ ID NO: 55583 - DNA, 15 bp, Artificial Sequence
  dgRNA
  BC016579
caggtccgccaccgc

SEQ ID NO: 55584 - DNA, 15 bp, Artificial Sequence
  dgRNA
  BC016579
caccgcaggcctatc

SEQ ID NO: 55585 - DNA, 15 bp, Artificial Sequence
  dgRNA
  BC016579
atctggcgccgcccg

SEQ ID NO: 55586 - DNA, 15 bp, Artificial Sequence
  dgRNA
  Socs7
tcgccaccccgatgc

SEQ ID NO: 55587 - DNA, 15 bp, Artificial Sequence
  dgRNA
  Socs7
cgccaccccgatgca

SEQ ID NO: 55588 - DNA, 15 bp, Artificial Sequence
  dgRNA
  Socs7
gccaccccgatgcag

SEQ ID NO: 55589 - DNA, 15 bp, Artificial Sequence
  dgRNA
  Socs7
ccaccccgatgcagg

SEQ ID NO: 55590 - DNA, 15 bp, Artificial Sequence
  dgRNA
  Lpar6
ccccggaaagcattt

SEQ ID NO: 55591 - DNA, 15 bp, Artificial Sequence
  dgRNA
  Lpar6
aacacccaactcagc

SEQ ID NO: 55592 - DNA, 15 bp, Artificial Sequence
  dgRNA
  Lpar6
acacccaactcagct

SEQ ID NO: 55593 - DNA, 15 bp, Artificial Sequence
  dgRNA
  Lpar6
ccaaaatgctttccg

SEQ ID NO: 55594 - DNA, 15 bp, Artificial Sequence
  dgRNA
  Gbf1
aatcctcgtatccgt

SEQ ID NO: 55595 - DNA, 15 bp, Artificial Sequence
  dgRNA
  Gbf1
ctttcccttgtaatc

SEQ ID NO: 55596 - DNA, 15 bp, Artificial Sequence
  dgRNA
  Gbf1
atttctttcttcgat

SEQ ID NO: 55597 - DNA, 15 bp, Artificial Sequence
  dgRNA
  Gbf1
cttcgattggatagt

SEQ ID NO: 55598 - DNA, 15 bp, Artificial Sequence
  dgRNA
  Vmn2r117
gggcagaattgattg

SEQ ID NO: 55599 - DNA, 15 bp, Artificial Sequence
  dgRNA
  2310039H08Rik
ccaagacgaccctcc

SEQ ID NO: 55600 - DNA, 15 bp, Artificial Sequence
  dgRNA
  2310039H08Rik
atctacacgtgccaa

SEQ ID NO: 55601 - DNA, 15 bp, Artificial Sequence
  dgRNA
  2310039H08Rik
tctacacgtgccaaa

SEQ ID NO: 55602 - DNA, 15 bp, Artificial Sequence
  dgRNA
  2310039H08Rik
ccgggagggtcgtct

SEQ ID NO: 55603 - DNA, 15 bp, Artificial Sequence
  dgRNA
  Chkb
ccatcgtccattcat

SEQ ID NO: 55604 - DNA, 15 bp, Artificial Sequence
  dgRNA
  Chkb
ggctcgtaagctttg

SEQ ID NO: 55605 - DNA, 15 bp, Artificial Sequence
  dgRNA
  Chkb
ctgtccaaccgccca

SEQ ID NO: 55606 - DNA, 15 bp, Artificial Sequence
  dgRNA
  Chkb
ccgcccacggcgctc

SEQ ID NO: 55607 - DNA, 15 bp, Artificial Sequence
  dgRNA
  Lipt2
atcctgcctggactt

SEQ ID NO: 55608 - DNA, 15 bp, Artificial Sequence
  dgRNA
  Lipt2
gacttcgggtcacac

SEQ ID NO: 55609 - DNA, 15 bp, Artificial Sequence
  dgRNA
  Lipt2
tcgggtcacacaggt

SEQ ID NO: 55610 - DNA, 15 bp, Artificial Sequence
  dgRNA
  Lipt2
tcgggctgaagctca

SEQ ID NO: 55611 - DNA, 15 bp, Artificial Sequence
  dgRNA
  Armcx4
ggtgatgacacttgt

SEQ ID NO: 55612 - DNA, 15 bp, Artificial Sequence
  dgRNA
  Armcx4
atgagtgacagggcg

SEQ ID NO: 55613 - DNA, 15 bp, Artificial Sequence
  dgRNA
  Armcx4
cagggcggggcgctc

SEQ ID NO: 55614 - DNA, 15 bp, Artificial Sequence
  dgRNA
  Armcx4
agggcggggcgctct

SEQ ID NO: 55615 - DNA, 15 bp, Artificial Sequence
  dgRNA
  Ehhadh
acatgtgattgacgt

SEQ ID NO: 55616 - DNA, 15 bp, Artificial Sequence
  dgRNA
  Ehhadh
tgtgattgacgttgg

SEQ ID NO: 55617 - DNA, 15 bp, Artificial Sequence
  dgRNA
  Ehhadh
gaagatcgcgctcct

SEQ ID NO: 55618 - DNA, 15 bp, Artificial Sequence
  dgRNA
  Ehhadh
agcgcagcccgcccc

SEQ ID NO: 55619 - DNA, 15 bp, Artificial Sequence
  dgRNA
  Cdc27
tttccgtgtctcgct

SEQ ID NO: 55620 - DNA, 15 bp, Artificial Sequence
  dgRNA
  Cdc27
tcgctcggaagagct

SEQ ID NO: 55621 - DNA, 15 bp, Artificial Sequence
  dgRNA
  Cdc27
agctcggcagccact

SEQ ID NO: 55622 - DNA, 15 bp, Artificial Sequence
  dgRNA
  Cdc27
cccatcccccggtaa

SEQ ID NO: 55623 - DNA, 15 bp, Artificial Sequence
  dgRNA
  Tmem106b
cagaagctttcaccc

SEQ ID NO: 55624 - DNA, 15 bp, Artificial Sequence
  dgRNA
  Tmem106b
aacttcccttcaaac

SEQ ID NO: 55625 - DNA, 15 bp, Artificial Sequence
  dgRNA
  Tmem106b
cgtagtgtccattcc

SEQ ID NO: 55626 - DNA, 15 bp, Artificial Sequence
  dgRNA
  Tmem106b
gtagtgtccattcca

SEQ ID NO: 55627 - DNA, 15 bp, Artificial Sequence
  dgRNA
  Mip
aagagtcctctataa

SEQ ID NO: 55628 - DNA, 15 bp, Artificial Sequence
  dgRNA
  Mip
gagtcctctataaag

SEQ ID NO: 55629 - DNA, 15 bp, Artificial Sequence
  dgRNA
  Mip
ggggactgtcaaccc

SEQ ID NO: 55630 - DNA, 15 bp, Artificial Sequence
  dgRNA
  Mip
actgtcaacccaggc

SEQ ID NO: 55631 - DNA, 15 bp, Artificial Sequence
  dgRNA
  Kdsr
agcctcccacgacgt

SEQ ID NO: 55632 - DNA, 15 bp, Artificial Sequence
  dgRNA
  Kdsr
ctcccacgacgttgg

SEQ ID NO: 55633 - DNA, 15 bp, Artificial Sequence
  dgRNA
  Kdsr
tcccacgacgttggc

SEQ ID NO: 55634 - DNA, 15 bp, Artificial Sequence
  dgRNA
  Kdsr
cacgacgttggcggg

SEQ ID NO: 55635 - DNA, 15 bp, Artificial Sequence
  dgRNA
  Kcnmb2
aaaattcgaaagcag

SEQ ID NO: 55636 - DNA, 15 bp, Artificial Sequence
  dgRNA
  Kcnmb2
aaattcgaaagcagt

SEQ ID NO: 55637 - DNA, 15 bp, Artificial Sequence
  dgRNA
  Kcnmb2
aattcgaaagcagtg

SEQ ID NO: 55638 - DNA, 15 bp, Artificial Sequence
  dgRNA
  Kcnmb2
cagcgtgcctgtcat

SEQ ID NO: 55639 - DNA, 15 bp, Artificial Sequence
  dgRNA
  Wisp1
agccctcctagagcg

SEQ ID NO: 55640 - DNA, 15 bp, Artificial Sequence
  dgRNA
  Wisp1
cctcctagagcgtgg

SEQ ID NO: 55641 - DNA, 15 bp, Artificial Sequence
  dgRNA
  Wisp1
attcaccttaccctg

SEQ ID NO: 55642 - DNA, 15 bp, Artificial Sequence
  dgRNA
  Wisp1
agagctgtcagagcg

SEQ ID NO: 55643 - DNA, 15 bp, Artificial Sequence
  dgRNA
  Ufl1
aggaaccttgcaaaa

SEQ ID NO: 55644 - DNA, 15 bp, Artificial Sequence
  dgRNA
  Ufl1
gaagccgcttcccgc

SEQ ID NO: 55645 - DNA, 15 bp, Artificial Sequence
  dgRNA
  Ufl1
ggccacgcccagctg

SEQ ID NO: 55646 - DNA, 15 bp, Artificial Sequence
  dgRNA
  Ufl1
acgcccagctgaggg

SEQ ID NO: 55647 - DNA, 15 bp, Artificial Sequence
  dgRNA
  Lcmt1
cgccaccagcatgtc

SEQ ID NO: 55648 - DNA, 15 bp, Artificial Sequence
  dgRNA
  Lcmt1
gccaccagcatgtcc

SEQ ID NO: 55649 - DNA, 15 bp, Artificial Sequence
  dgRNA
  Lcmt1
aacttccgggttgtg

SEQ ID NO: 55650 - DNA, 15 bp, Artificial Sequence
  dgRNA
  Lcmt1
acttccgggttgtgc

SEQ ID NO: 55651 - DNA, 15 bp, Artificial Sequence
  dgRNA
  Sap25
tgggagcgtgccacg

SEQ ID NO: 55652 - DNA, 15 bp, Artificial Sequence
  dgRNA
  Sap25
tggctgaagaaacgc

SEQ ID NO: 55653 - DNA, 15 bp, Artificial Sequence
  dgRNA
  Sap25
aagaaacgctggcgc

SEQ ID NO: 55654 - DNA, 15 bp, Artificial Sequence
  dgRNA
  Sap25
ctggcgcaggcgtcg

SEQ ID NO: 55655 - DNA, 15 bp, Artificial Sequence
  dgRNA
  Rassf2
ctggcagcccgcgcg

SEQ ID NO: 55656 - DNA, 15 bp, Artificial Sequence
  dgRNA
  Rassf2
gcagcccgcgcgagg

SEQ ID NO: 55657 - DNA, 15 bp, Artificial Sequence
  dgRNA
  Rassf2
cagcccgcgcgaggt

SEQ ID NO: 55658 - DNA, 15 bp, Artificial Sequence
  dgRNA
  Rassf2
agcccgcgcgaggtg

SEQ ID NO: 55659 - DNA, 15 bp, Artificial Sequence
  dgRNA
  Cercam
cttccgaggtccaca

SEQ ID NO: 55660 - DNA, 15 bp, Artificial Sequence
  dgRNA
  Cercam
aggtccacacggaga

SEQ ID NO: 55661 - DNA, 15 bp, Artificial Sequence
  dgRNA
  Cercam
gagaaggcggacccc

SEQ ID NO: 55662 - DNA, 15 bp, Artificial Sequence
  dgRNA
  Cercam
accccaggacgcgtc

SEQ ID NO: 55663 - DNA, 15 bp, Artificial Sequence
  dgRNA
  Gabra4
cctcccccgaactcg

SEQ ID NO: 55664 - DNA, 15 bp, Artificial Sequence
  dgRNA
  Gabra4
aggtcccatagactg

SEQ ID NO: 55665 - DNA, 15 bp, Artificial Sequence
  dgRNA
  Gabra4
actgtggtacctaca

SEQ ID NO: 55666 - DNA, 15 bp, Artificial Sequence
  dgRNA
  Gabra4
ctgtggtacctacaa

SEQ ID NO: 55667 - DNA, 15 bp, Artificial Sequence
  dgRNA
  Ttc28
actctggcgccttca

SEQ ID NO: 55668 - DNA, 15 bp, Artificial Sequence
  dgRNA
  Ttc28
ggcgccttcacgggc

SEQ ID NO: 55669 - DNA, 15 bp, Artificial Sequence
  dgRNA
  Ttc28
gcgccttcacgggcc

SEQ ID NO: 55670 - DNA, 15 bp, Artificial Sequence
  dgRNA
  Ttc28
ccgcgtggtgccctc

SEQ ID NO: 55671 - DNA, 15 bp, Artificial Sequence
  dgRNA
  Wdr37
gacttccgcagttac

SEQ ID NO: 55672 - DNA, 15 bp, Artificial Sequence
  dgRNA
  Wdr37
cagttaccggaagta

SEQ ID NO: 55673 - DNA, 15 bp, Artificial Sequence
  dgRNA
  Wdr37
agttaccggaagtac

SEQ ID NO: 55674 - DNA, 15 bp, Artificial Sequence
  dgRNA
  Wdr37
tacttccggtaactg

SEQ ID NO: 55675 - DNA, 15 bp, Artificial Sequence
  dgRNA
  Olfr677
gaagcgcttaatgag

SEQ ID NO: 55676 - DNA, 15 bp, Artificial Sequence
  dgRNA
  Olfr677
agtaatttagcttgc

SEQ ID NO: 55677 - DNA, 15 bp, Artificial Sequence
  dgRNA
  Olfr677
gcgcttccattatca

SEQ ID NO: 55678 - DNA, 15 bp, Artificial Sequence
  dgRNA
  Ciita
tgtggtcacccaatt

SEQ ID NO: 55679 - DNA, 15 bp, Artificial Sequence
  dgRNA
  Ciita
tggctaagggagcat

SEQ ID NO: 55680 - DNA, 15 bp, Artificial Sequence
  dgRNA
  Ciita
catgggcaaattaga

SEQ ID NO: 55681 - DNA, 15 bp, Artificial Sequence
  dgRNA
  Ciita
cttgtgggccaaatt

SEQ ID NO: 55682 - DNA, 15 bp, Artificial Sequence
  dgRNA
  A4gnt
gatagagccccaagc

SEQ ID NO: 55683 - DNA, 15 bp, Artificial Sequence
  dgRNA
  A4gnt
tggggctctatcacg

SEQ ID NO: 55684 - DNA, 15 bp, Artificial Sequence
  dgRNA
  A4gnt
ttggggctctatcac

SEQ ID NO: 55685 - DNA, 15 bp, Artificial Sequence
  dgRNA
  A4gnt
cttggggctctatca

SEQ ID NO: 55686 - DNA, 15 bp, Artificial Sequence
  dgRNA
  Thap11
ttttacctttcgctt

SEQ ID NO: 55687 - DNA, 15 bp, Artificial Sequence
  dgRNA
  Thap11
aggacgagcttcatc

SEQ ID NO: 55688 - DNA, 15 bp, Artificial Sequence
  dgRNA
  Thap11
taatcgactctgaac

SEQ ID NO: 55689 - DNA, 15 bp, Artificial Sequence
  dgRNA
  Thap11
ctgaacaggatatcg

SEQ ID NO: 55690 - DNA, 15 bp, Artificial Sequence
  dgRNA
  Ube2a
ccctgttaaatcacc

SEQ ID NO: 55691 - DNA, 15 bp, Artificial Sequence
  dgRNA
  Ube2a
atcaccgggacttga

SEQ ID NO: 55692 - DNA, 15 bp, Artificial Sequence
  dgRNA
  Ube2a
tgggacgtgattgac

SEQ ID NO: 55693 - DNA, 15 bp, Artificial Sequence
  dgRNA
  Ube2a
ttgacaggtcaactt

SEQ ID NO: 55694 - DNA, 15 bp, Artificial Sequence
  dgRNA
  Fastk
cttgttctacgagaa

SEQ ID NO: 55695 - DNA, 15 bp, Artificial Sequence
  dgRNA
  Fastk
gctcaagctacccca

SEQ ID NO: 55696 - DNA, 15 bp, Artificial Sequence
  dgRNA
  Fastk
gaggaccgccactcc

SEQ ID NO: 55697 - DNA, 15 bp, Artificial Sequence
  dgRNA
  Fastk
tcagcgcaagctctg

SEQ ID NO: 55698 - DNA, 15 bp, Artificial Sequence
  dgRNA
  Sgol1
agtcgctagatctct

SEQ ID NO: 55699 - DNA, 15 bp, Artificial Sequence
  dgRNA
  Sgol1
gcggacgccgagcca

SEQ ID NO: 55700 - DNA, 15 bp, Artificial Sequence
  dgRNA
  Sgol1
cagctgcgcgtgcgc

SEQ ID NO: 55701 - DNA, 15 bp, Artificial Sequence
  dgRNA
  Sgol1
tgatgccattccccg

SEQ ID NO: 55702 - DNA, 15 bp, Artificial Sequence
  dgRNA
  Cep70
tagccgcagcaagtc

SEQ ID NO: 55703 - DNA, 15 bp, Artificial Sequence
  dgRNA
  Cep70
agccgcagcaagtcc

SEQ ID NO: 55704 - DNA, 15 bp, Artificial Sequence
  dgRNA
  Cep70
cagcaagtccgggtc

SEQ ID NO: 55705 - DNA, 15 bp, Artificial Sequence
  dgRNA
  Cep70
caagtccgggtccgg

SEQ ID NO: 55706 - DNA, 15 bp, Artificial Sequence
  dgRNA
  Nr5a2
ctgtcactttataac

SEQ ID NO: 55707 - DNA, 15 bp, Artificial Sequence
  dgRNA
  Nr5a2
cttatcaaccggcac

SEQ ID NO: 55708 - DNA, 15 bp, Artificial Sequence
  dgRNA
  Nr5a2
ttatcaaccggcaca

SEQ ID NO: 55709 - DNA, 15 bp, Artificial Sequence
  dgRNA
  Nr5a2
gacatggtttacagc

SEQ ID NO: 55710 - DNA, 15 bp, Artificial Sequence
  dgRNA
  Cadps
gtagtgaagctcttt

SEQ ID NO: 55711 - DNA, 15 bp, Artificial Sequence
  dgRNA
  Cadps
tcgccctctccgccg

SEQ ID NO: 55712 - DNA, 15 bp, Artificial Sequence
  dgRNA
  Cadps
ctccgccgcggacac

SEQ ID NO: 55713 - DNA, 15 bp, Artificial Sequence
  dgRNA
  Cadps
cgctcgctccccaat

SEQ ID NO: 55714 - DNA, 15 bp, Artificial Sequence
  dgRNA
  Tor1aip1
ccggtggtgggcaac

SEQ ID NO: 55715 - DNA, 15 bp, Artificial Sequence
  dgRNA
  Tor1aip1
cgggggcgctggtcc

SEQ ID NO: 55716 - DNA, 15 bp, Artificial Sequence
  dgRNA
  Tor1aip1
caccaccgggggcgc

SEQ ID NO: 55717 - DNA, 15 bp, Artificial Sequence
  dgRNA
  Tor1aip1
gttgcccaccaccgg

SEQ ID NO: 55718 - DNA, 15 bp, Artificial Sequence
  dgRNA
  Selt
aagagcaacaattac

SEQ ID NO: 55719 - DNA, 15 bp, Artificial Sequence
  dgRNA
  Selt
ttcgccctttctccc

SEQ ID NO: 55720 - DNA, 15 bp, Artificial Sequence
  dgRNA
  Selt
tcccagaacgggcgc

SEQ ID NO: 55721 - DNA, 15 bp, Artificial Sequence
  dgRNA
  Selt
aacgggcgcaggctc

SEQ ID NO: 55722 - DNA, 15 bp, Artificial Sequence
  dgRNA
  Chl1
cgagctagtcgtctc

SEQ ID NO: 55723 - DNA, 15 bp, Artificial Sequence
  dgRNA
  Chl1
ctagtcgtctccggc

SEQ ID NO: 55724 - DNA, 15 bp, Artificial Sequence
  dgRNA
  Chl1
gtcgtctccggcagg

SEQ ID NO: 55725 - DNA, 15 bp, Artificial Sequence
  dgRNA
  Chl1
tcgtctccggcagga

SEQ ID NO: 55726 - DNA, 15 bp, Artificial Sequence
  dgRNA
  Arhgap27
gaagcccgaatgcag

SEQ ID NO: 55727 - DNA, 15 bp, Artificial Sequence
  dgRNA
  Arhgap27
aagcccgaatgcagt

SEQ ID NO: 55728 - DNA, 15 bp, Artificial Sequence
  dgRNA
  Arhgap27
cgaatgcagtgggcg

SEQ ID NO: 55729 - DNA, 15 bp, Artificial Sequence
  dgRNA
  Arhgap27
gaatgcagtgggcgt

SEQ ID NO: 55730 - DNA, 15 bp, Artificial Sequence
  dgRNA
  Supt6
tcgtgagaatgcagt

SEQ ID NO: 55731 - DNA, 15 bp, Artificial Sequence
  dgRNA
  Supt6
tgcagtcggacattg

SEQ ID NO: 55732 - DNA, 15 bp, Artificial Sequence
  dgRNA
  Supt6
tgagtagcttcacca

SEQ ID NO: 55733 - DNA, 15 bp, Artificial Sequence
  dgRNA
  Supt6
taacgacagccatgt

SEQ ID NO: 55734 - DNA, 15 bp, Artificial Sequence
  dgRNA
  Rgag4
gcagtaccttgcaac

SEQ ID NO: 55735 - DNA, 15 bp, Artificial Sequence
  dgRNA
  Rgag4
ccttgcaacaggctc

SEQ ID NO: 55736 - DNA, 15 bp, Artificial Sequence
  dgRNA
  Rgag4
gttcctctacactcg

SEQ ID NO: 55737 - DNA, 15 bp, Artificial Sequence
  dgRNA
  Rgag4
ttcctctacactcgg

SEQ ID NO: 55738 - DNA, 15 bp, Artificial Sequence
  dgRNA
  Mdh1b
agaagcgagagcctt

SEQ ID NO: 55739 - DNA, 15 bp, Artificial Sequence
  dgRNA
  Mdh1b
atctattgttgttta

SEQ ID NO: 55740 - DNA, 15 bp, Artificial Sequence
  dgRNA
  Mdh1b
ttttagtacccgccg

SEQ ID NO: 55741 - DNA, 15 bp, Artificial Sequence
  dgRNA
  Mdh1b
cccgccgcggttgcc

SEQ ID NO: 55742 - DNA, 15 bp, Artificial Sequence
  dgRNA
  Pex2
aagcctcttcacgcc

SEQ ID NO: 55743 - DNA, 15 bp, Artificial Sequence
  dgRNA
  Pex2
tcccggcccagaggg

SEQ ID NO: 55744 - DNA, 15 bp, Artificial Sequence
  dgRNA
  Pex2
ctgtcccggcccaga

SEQ ID NO: 55745 - DNA, 15 bp, Artificial Sequence
  dgRNA
  Pex2
gctgtcccggcccag

SEQ ID NO: 55746 - DNA, 15 bp, Artificial Sequence
  dgRNA
  Lage3
caacctataaatccc

SEQ ID NO: 55747 - DNA, 15 bp, Artificial Sequence
  dgRNA
  Lage3
cttccccgttcgcgc

SEQ ID NO: 55748 - DNA, 15 bp, Artificial Sequence
  dgRNA
  Lage3
tcgcgcaggcgcgtg

SEQ ID NO: 55749 - DNA, 15 bp, Artificial Sequence
  dgRNA
  Lage3
caggcgcgtgtggaa

SEQ ID NO: 55750 - DNA, 15 bp, Artificial Sequence
  dgRNA
  Engase
cgacttggttgtcgc

SEQ ID NO: 55751 - DNA, 15 bp, Artificial Sequence
  dgRNA
  Engase
attgtttcattcgtc

SEQ ID NO: 55752 - DNA, 15 bp, Artificial Sequence
  dgRNA
  Engase
tagaccccgcccatc

SEQ ID NO: 55753 - DNA, 15 bp, Artificial Sequence
  dgRNA
  Engase
cccgccccgtctctc

SEQ ID NO: 55754 - DNA, 15 bp, Artificial Sequence
  dgRNA
  Rps3a1
gagagttcccaccct

SEQ ID NO: 55755 - DNA, 15 bp, Artificial Sequence
  dgRNA
  Rps3a1
gagttcccaccctcg

SEQ ID NO: 55756 - DNA, 15 bp, Artificial Sequence
  dgRNA
  Rps3a1
ccaccctcggggcaa

SEQ ID NO: 55757 - DNA, 15 bp, Artificial Sequence
  dgRNA
  Rps3a1
agcctagccagcccg

SEQ ID NO: 55758 - DNA, 15 bp, Artificial Sequence
  dgRNA
  Tcf7l1
gtctcttgccccggc

SEQ ID NO: 55759 - DNA, 15 bp, Artificial Sequence
  dgRNA
  Tcf7l1
tctcttgccccggct

SEQ ID NO: 55760 - DNA, 15 bp, Artificial Sequence
  dgRNA
  Tcf7l1
cttgccccggctggg

SEQ ID NO: 55761 - DNA, 15 bp, Artificial Sequence
  dgRNA
  Tcf7l1
ccggctgggcggtgc

SEQ ID NO: 55762 - DNA, 15 bp, Artificial Sequence
  dgRNA
  Phtf1
tcgggaccagcctcc

SEQ ID NO: 55763 - DNA, 15 bp, Artificial Sequence
  dgRNA
  Phtf1
cgggaccagcctccc

SEQ ID NO: 55764 - DNA, 15 bp, Artificial Sequence
  dgRNA
  Phtf1
gggaccagcctcccg

SEQ ID NO: 55765 - DNA, 15 bp, Artificial Sequence
  dgRNA
  Phtf1
cctcccggggaccga

SEQ ID NO: 55766 - DNA, 15 bp, Artificial Sequence
  dgRNA
  Ccr4
gcctagctttgcgtt

SEQ ID NO: 55767 - DNA, 15 bp, Artificial Sequence
  dgRNA
  Ccr4
cctagctttgcgttt

SEQ ID NO: 55768 - DNA, 15 bp, Artificial Sequence
  dgRNA
  Ccr4
caagaagccccacat

SEQ ID NO: 55769 - DNA, 15 bp, Artificial Sequence
  dgRNA
  Ccr4
aacgcaaagctaggc

SEQ ID NO: 55770 - DNA, 15 bp, Artificial Sequence
  dgRNA
  Kbtbd4
gctcacccctgccta

SEQ ID NO: 55771 - DNA, 15 bp, Artificial Sequence
  dgRNA
  Kbtbd4
cacgacaccagaccc

SEQ ID NO: 55772 - DNA, 15 bp, Artificial Sequence
  dgRNA
  Kbtbd4
tgccgactaagtagc

SEQ ID NO: 55773 - DNA, 15 bp, Artificial Sequence
  dgRNA
  Kbtbd4
ccggagaacacacgc

SEQ ID NO: 55774 - DNA, 15 bp, Artificial Sequence
  dgRNA
  Gmnc
gtgaatattataacc

SEQ ID NO: 55775 - DNA, 15 bp, Artificial Sequence
  dgRNA
  Gmnc
ggtgcagattagaca

SEQ ID NO: 55776 - DNA, 15 bp, Artificial Sequence
  dgRNA
  Gmnc
cattgattagacacg

SEQ ID NO: 55777 - DNA, 15 bp, Artificial Sequence
  dgRNA
  Gmnc
attgattagacacgg

SEQ ID NO: 55778 - DNA, 15 bp, Artificial Sequence
  dgRNA
  Olfr65
acctagaaagccccc

SEQ ID NO: 55779 - DNA, 15 bp, Artificial Sequence
  dgRNA
  Olfr65
caagtagcatcatca

SEQ ID NO: 55780 - DNA, 15 bp, Artificial Sequence
  dgRNA
  Olfr65
aagtagcatcatcaa

SEQ ID NO: 55781 - DNA, 15 bp, Artificial Sequence
  dgRNA
  Olfr65
ctacatatacttcca

SEQ ID NO: 55782 - DNA, 15 bp, Artificial Sequence
  dgRNA
  Arhgap12
tccgccccgccctcc

SEQ ID NO: 55783 - DNA, 15 bp, Artificial Sequence
  dgRNA
  Arhgap12
gcccctctcgtcacg

SEQ ID NO: 55784 - DNA, 15 bp, Artificial Sequence
  dgRNA
  Arhgap12
cgcttcgacgtgccc

SEQ ID NO: 55785 - DNA, 15 bp, Artificial Sequence
  dgRNA
  Arhgap12
ttaagagggggattg

SEQ ID NO: 55786 - DNA, 15 bp, Artificial Sequence
  dgRNA
  Col6a6
cggcaggctgattcc

SEQ ID NO: 55787 - DNA, 15 bp, Artificial Sequence
  dgRNA
  Col6a6
ctggttttactgacc

SEQ ID NO: 55788 - DNA, 15 bp, Artificial Sequence
  dgRNA
  Col6a6
gcaaacaagtgctgc

SEQ ID NO: 55789 - DNA, 15 bp, Artificial Sequence
  dgRNA
  Col6a6
ggtagagctttgatt

SEQ ID NO: 55790 - DNA, 15 bp, Artificial Sequence
  dgRNA
  Clca3a2
aggatcttacagata

SEQ ID NO: 55791 - DNA, 15 bp, Artificial Sequence
  dgRNA
  Clca3a2
aggtacatcaagcct

SEQ ID NO: 55792 - DNA, 15 bp, Artificial Sequence
  dgRNA
  Clca3a2
acatcaagcctgggc

SEQ ID NO: 55793 - DNA, 15 bp, Artificial Sequence
  dgRNA
  Itih3
ctaggcccagactag

SEQ ID NO: 55794 - DNA, 15 bp, Artificial Sequence
  dgRNA
  Itih3
gactagaggcaatgt

SEQ ID NO: 55795 - DNA, 15 bp, Artificial Sequence
  dgRNA
  Itih3
gggctagacccccca

SEQ ID NO: 55796 - DNA, 15 bp, Artificial Sequence
  dgRNA
  Itih3
cattgcctctagtct

SEQ ID NO: 55797 - DNA, 15 bp, Artificial Sequence
  dgRNA
  Il1r2
tgctccccgtgagca

SEQ ID NO: 55798 - DNA, 15 bp, Artificial Sequence
  dgRNA
  Il1r2
ccgtgagcagggaaa

SEQ ID NO: 55799 - DNA, 15 bp, Artificial Sequence
  dgRNA
  Il1r2
tgtgtgtcgctagaa

SEQ ID NO: 55800 - DNA, 15 bp, Artificial Sequence
  dgRNA
  Il1r2
tgccatatggggaag

SEQ ID NO: 55801 - DNA, 15 bp, Artificial Sequence
  dgRNA
  Fam133b
gatttgactacagag

SEQ ID NO: 55802 - DNA, 15 bp, Artificial Sequence
  dgRNA
  Fam133b
ggttaagtgggtcac

SEQ ID NO: 55803 - DNA, 15 bp, Artificial Sequence
  dgRNA
  Fam133b
gctcctgggaaccgc

SEQ ID NO: 55804 - DNA, 15 bp, Artificial Sequence
  dgRNA
  Fam133b
ggcggtcgctagcgc

SEQ ID NO: 55805 - DNA, 15 bp, Artificial Sequence
  dgRNA
  Rasgrp4
cgtgcgtgacagaga

SEQ ID NO: 55806 - DNA, 15 bp, Artificial Sequence
  dgRNA
  Rasgrp4
gtgcgtgacagagac

SEQ ID NO: 55807 - DNA, 15 bp, Artificial Sequence
  dgRNA
  Rasgrp4
tgcgtgacagagacg

SEQ ID NO: 55808 - DNA, 15 bp, Artificial Sequence
  dgRNA
  Rasgrp4
gcgtgacagagacgg

SEQ ID NO: 55809 - DNA, 15 bp, Artificial Sequence
  dgRNA
  Tnn
gtaatcaacgtaaga

SEQ ID NO: 55810 - DNA, 15 bp, Artificial Sequence
  dgRNA
  Tnn
cttgatttaaaccca

SEQ ID NO: 55811 - DNA, 15 bp, Artificial Sequence
  dgRNA
  Tnn
aatcaatgggactcc

SEQ ID NO: 55812 - DNA, 15 bp, Artificial Sequence
  dgRNA
  Eif3i
cattcctgaggctcg

SEQ ID NO: 55813 - DNA, 15 bp, Artificial Sequence
  dgRNA
  Eif3i
aggctcggggatgcc

SEQ ID NO: 55814 - DNA, 15 bp, Artificial Sequence
  dgRNA
  Eif3i
ctcccgagccagagt

SEQ ID NO: 55815 - DNA, 15 bp, Artificial Sequence
  dgRNA
  Eif3i
cagagtcggagcccg

SEQ ID NO: 55816 - DNA, 15 bp, Artificial Sequence
  dgRNA
  Otud7b
cgcggggtcacgcgc

SEQ ID NO: 55817 - DNA, 15 bp, Artificial Sequence
  dgRNA
  Otud7b
gcggggtcacgcgcc

SEQ ID NO: 55818 - DNA, 15 bp, Artificial Sequence
  dgRNA
  Otud7b
gggcaagcgccaaac

SEQ ID NO: 55819 - DNA, 15 bp, Artificial Sequence
  dgRNA
  Otud7b
cccaaagcggtcccg

SEQ ID NO: 55820 - DNA, 15 bp, Artificial Sequence
  dgRNA
  Efna4
aacaaagggacgctt

SEQ ID NO: 55821 - DNA, 15 bp, Artificial Sequence
  dgRNA
  Efna4
acgctttggctaacc

SEQ ID NO: 55822 - DNA, 15 bp, Artificial Sequence
  dgRNA
  Efna4
taacctggagcgctc

SEQ ID NO: 55823 - DNA, 15 bp, Artificial Sequence
  dgRNA
  Efna4
aacctggagcgctcg

SEQ ID NO: 55824 - DNA, 15 bp, Artificial Sequence
  dgRNA
  Atp6v0d1
tccgctaggcgctcc

SEQ ID NO: 55825 - DNA, 15 bp, Artificial Sequence
  dgRNA
  Atp6v0d1
ccgctaggcgctcca

SEQ ID NO: 55826 - DNA, 15 bp, Artificial Sequence
  dgRNA
  Atp6v0d1
ctttccttagtgcgc

SEQ ID NO: 55827 - DNA, 15 bp, Artificial Sequence
  dgRNA
  Atp6v0d1
ttagtgcgcaggcgc

SEQ ID NO: 55828 - DNA, 15 bp, Artificial Sequence
  dgRNA
  Snrpn
tcaaatttccgcagt

SEQ ID NO: 55829 - DNA, 15 bp, Artificial Sequence
  dgRNA
  Snrpn
ctcaagcattccttt

SEQ ID NO: 55830 - DNA, 15 bp, Artificial Sequence
  dgRNA
  Snrpn
ggacattccggtcag

SEQ ID NO: 55831 - DNA, 15 bp, Artificial Sequence
  dgRNA
  Snrpn
gacattccggtcaga

SEQ ID NO: 55832 - DNA, 15 bp, Artificial Sequence
  dgRNA
  Adrm1
cggtgcccatcaccc

SEQ ID NO: 55833 - DNA, 15 bp, Artificial Sequence
  dgRNA
  Adrm1
tgcagcgccgccccg

SEQ ID NO: 55834 - DNA, 15 bp, Artificial Sequence
  dgRNA
  Adrm1
gcagcgccgccccgc

SEQ ID NO: 55835 - DNA, 15 bp, Artificial Sequence
  dgRNA
  Adrm1
cagcgccgccccgcg

SEQ ID NO: 55836 - DNA, 15 bp, Artificial Sequence
  dgRNA
  Pacs1
ggtagcagccgcccg

SEQ ID NO: 55837 - DNA, 15 bp, Artificial Sequence
  dgRNA
  Pacs1
agcagccgcccgagg

SEQ ID NO: 55838 - DNA, 15 bp, Artificial Sequence
  dgRNA
  Pacs1
gccgcccgaggaggg

SEQ ID NO: 55839 - DNA, 15 bp, Artificial Sequence
  dgRNA
  Pacs1
gcccgaggagggcgg

SEQ ID NO: 55840 - DNA, 15 bp, Artificial Sequence
  dgRNA
  Olfr600
ggacgacttgctaag

SEQ ID NO: 55841 - DNA, 15 bp, Artificial Sequence
  dgRNA
  Map7d2
cctcaaatggggaat

SEQ ID NO: 55842 - DNA, 15 bp, Artificial Sequence
  dgRNA
  Map7d2
gctatatttggtacc

SEQ ID NO: 55843 - DNA, 15 bp, Artificial Sequence
  dgRNA
  Map7d2
aaccagacttaagac

SEQ ID NO: 55844 - DNA, 15 bp, Artificial Sequence
  dgRNA
  Map7d2
cctattccccatttg

SEQ ID NO: 55845 - DNA, 15 bp, Artificial Sequence
  dgRNA
  Saysd1
ctgagttctgcggcc

SEQ ID NO: 55846 - DNA, 15 bp, Artificial Sequence
  dgRNA
  Saysd1
tgagttctgcggccc

SEQ ID NO: 55847 - DNA, 15 bp, Artificial Sequence
  dgRNA
  Saysd1
ggcccgggcaagagc

SEQ ID NO: 55848 - DNA, 15 bp, Artificial Sequence
  dgRNA
  Saysd1
agccggaacatctga

SEQ ID NO: 55849 - DNA, 15 bp, Artificial Sequence
  dgRNA
  Tomm22
aggctggcgacacca

SEQ ID NO: 55850 - DNA, 15 bp, Artificial Sequence
  dgRNA
  Tomm22
ggctggcgacaccaa

SEQ ID NO: 55851 - DNA, 15 bp, Artificial Sequence
  dgRNA
  Tomm22
gctggcgacaccaag

SEQ ID NO: 55852 - DNA, 15 bp, Artificial Sequence
  dgRNA
  Tomm22
ctggcgacaccaagg

SEQ ID NO: 55853 - DNA, 15 bp, Artificial Sequence
  dgRNA
  Spink6
ttgatgagactcacg

SEQ ID NO: 55854 - DNA, 15 bp, Artificial Sequence
  dgRNA
  Spink6
ggcatttctttaagc

SEQ ID NO: 55855 - DNA, 15 bp, Artificial Sequence
  dgRNA
  Spink6
atgcctaaactgtat

SEQ ID NO: 55856 - DNA, 15 bp, Artificial Sequence
  dgRNA
  Spink6
gtataggactgcata

SEQ ID NO: 55857 - DNA, 15 bp, Artificial Sequence
  dgRNA
  Lypd6b
cctactcgcgttcac

SEQ ID NO: 55858 - DNA, 15 bp, Artificial Sequence
  dgRNA
  Lypd6b
ctactcgcgttcact

SEQ ID NO: 55859 - DNA, 15 bp, Artificial Sequence
  dgRNA
  Lypd6b
cgcgttcactgggct

SEQ ID NO: 55860 - DNA, 15 bp, Artificial Sequence
  dgRNA
  Lypd6b
ccgggcgcaggaccc

SEQ ID NO: 55861 - DNA, 15 bp, Artificial Sequence
  dgRNA
  Hsf1
tgccgcttccggcag

SEQ ID NO: 55862 - DNA, 15 bp, Artificial Sequence
  dgRNA
  Hsf1
gccgcttccggcagc

SEQ ID NO: 55863 - DNA, 15 bp, Artificial Sequence
  dgRNA
  Hsf1
cgtgtgcccccagcc

SEQ ID NO: 55864 - DNA, 15 bp, Artificial Sequence
  dgRNA
  Hsf1
aggctccgccctacc

SEQ ID NO: 55865 - DNA, 15 bp, Artificial Sequence
  dgRNA
  Nup37
ggtgcaagcggaggg

SEQ ID NO: 55866 - DNA, 15 bp, Artificial Sequence
  dgRNA
  Nup37
gcgcagccaggacgc

SEQ ID NO: 55867 - DNA, 15 bp, Artificial Sequence
  dgRNA
  Nup37
agccaggacgccgga

SEQ ID NO: 55868 - DNA, 15 bp, Artificial Sequence
  dgRNA
  Nup37
aggtttgaatcgcct

SEQ ID NO: 55869 - DNA, 15 bp, Artificial Sequence
  dgRNA
  Fam131a
taccaggtaggcgtc

SEQ ID NO: 55870 - DNA, 15 bp, Artificial Sequence
  dgRNA
  Fam131a
ggttggtagcatttc

SEQ ID NO: 55871 - DNA, 15 bp, Artificial Sequence
  dgRNA
  Fam131a
ctggggaccaccaac

SEQ ID NO: 55872 - DNA, 15 bp, Artificial Sequence
  dgRNA
  Fam131a
tagttgtgatgtacg

SEQ ID NO: 55873 - DNA, 15 bp, Artificial Sequence
  dgRNA
  Hmgcs2
aggggcctcgataag

SEQ ID NO: 55874 - DNA, 15 bp, Artificial Sequence
  dgRNA
  Hmgcs2
ggcctcgataagcgg

SEQ ID NO: 55875 - DNA, 15 bp, Artificial Sequence
  dgRNA
  Hmgcs2
ctcgataagcggagg

SEQ ID NO: 55876 - DNA, 15 bp, Artificial Sequence
  dgRNA
  Hmgcs2
tcgataagcggaggc

SEQ ID NO: 55877 - DNA, 15 bp, Artificial Sequence
  dgRNA
  Ube2e3
gggagcgcgctcgcg

SEQ ID NO: 55878 - DNA, 15 bp, Artificial Sequence
  dgRNA
  Ube2e3
ggagcgcgctcgcgc

SEQ ID NO: 55879 - DNA, 15 bp, Artificial Sequence
  dgRNA
  Ube2e3
gagcgcgctcgcgcg

SEQ ID NO: 55880 - DNA, 15 bp, Artificial Sequence
  dgRNA
  Ube2e3
agcgcgctcgcgcgg

SEQ ID NO: 55881 - DNA, 15 bp, Artificial Sequence
  dgRNA
  Batf
cctgccggaagatac

SEQ ID NO: 55882 - DNA, 15 bp, Artificial Sequence
  dgRNA
  Batf
ctgccggaagatact

SEQ ID NO: 55883 - DNA, 15 bp, Artificial Sequence
  dgRNA
  Batf
tgccggaagatactg

SEQ ID NO: 55884 - DNA, 15 bp, Artificial Sequence
  dgRNA
  Batf
gccggaagatactgg

SEQ ID NO: 55885 - DNA, 15 bp, Artificial Sequence
  dgRNA
  Pmvk
attttatgacaactc

SEQ ID NO: 55886 - DNA, 15 bp, Artificial Sequence
  dgRNA
  Pmvk
taattctaacctcta

SEQ ID NO: 55887 - DNA, 15 bp, Artificial Sequence
  dgRNA
  Pmvk
aattctaacctctag

SEQ ID NO: 55888 - DNA, 15 bp, Artificial Sequence
  dgRNA
  Pmvk
cctctaggggaaacc

SEQ ID NO: 55889 - DNA, 15 bp, Artificial Sequence
  dgRNA
  Syt9
cgagcgcccccgtcc

SEQ ID NO: 55890 - DNA, 15 bp, Artificial Sequence
  dgRNA
  Syt9
gagcgcccccgtccc

SEQ ID NO: 55891 - DNA, 15 bp, Artificial Sequence
  dgRNA
  Syt9
tcccgggtccctacc

SEQ ID NO: 55892 - DNA, 15 bp, Artificial Sequence
  dgRNA
  Syt9
ggcgcgcctgctctg

SEQ ID NO: 55893 - DNA, 15 bp, Artificial Sequence
  dgRNA
  Cyp2j11
accacgataaagctt

SEQ ID NO: 55894 - DNA, 15 bp, Artificial Sequence
  dgRNA
  Cyp2j11
acgataaagcttagg

SEQ ID NO: 55895 - DNA, 15 bp, Artificial Sequence
  dgRNA
  Cyp2j11
cgataaagcttagga

SEQ ID NO: 55896 - DNA, 15 bp, Artificial Sequence
  dgRNA
  Cyp2j11
gagtagtttggataa

SEQ ID NO: 55897 - DNA, 15 bp, Artificial Sequence
  dgRNA
  Slco2a1
gagtgtcagcgggtc

SEQ ID NO: 55898 - DNA, 15 bp, Artificial Sequence
  dgRNA
  Slco2a1
ctgtcgagtgtcagc

SEQ ID NO: 55899 - DNA, 15 bp, Artificial Sequence
  dgRNA
  Slco2a1
gctgtcgagtgtcag

SEQ ID NO: 55900 - DNA, 15 bp, Artificial Sequence
  dgRNA
  Slco2a1
gccaaggtaaactgc

SEQ ID NO: 55901 - DNA, 15 bp, Artificial Sequence
  dgRNA
  Creld1
cgtgtatctgttccg

SEQ ID NO: 55902 - DNA, 15 bp, Artificial Sequence
  dgRNA
  Creld1
cggacaggtgcagcc

SEQ ID NO: 55903 - DNA, 15 bp, Artificial Sequence
  dgRNA
  Creld1
gcccggagccgcttc

SEQ ID NO: 55904 - DNA, 15 bp, Artificial Sequence
  dgRNA
  Creld1
ggagccgcttctggt

SEQ ID NO: 55905 - DNA, 15 bp, Artificial Sequence
  dgRNA
  Gstt1
taaaccggccacaag

SEQ ID NO: 55906 - DNA, 15 bp, Artificial Sequence
  dgRNA
  Gstt1
ctagattccagttgc

SEQ ID NO: 55907 - DNA, 15 bp, Artificial Sequence
  dgRNA
  Gstt1
tagattccagttgca

SEQ ID NO: 55908 - DNA, 15 bp, Artificial Sequence
  dgRNA
  Gstt1
ccccctttagaaaga

SEQ ID NO: 55909 - DNA, 15 bp, Artificial Sequence
  dgRNA
  H2-M10.5
gaactgttgcaagtt

SEQ ID NO: 55910 - DNA, 15 bp, Artificial Sequence
  dgRNA
  H2-M10.5
agtggagtctcaatc

SEQ ID NO: 55911 - DNA, 15 bp, Artificial Sequence
  dgRNA
  Vrk2
acagaactaggccta

SEQ ID NO: 55912 - DNA, 15 bp, Artificial Sequence
  dgRNA
  Vrk2
cacccagatagatac

SEQ ID NO: 55913 - DNA, 15 bp, Artificial Sequence
  dgRNA
  Vrk2
gccctcccagttaca

SEQ ID NO: 55914 - DNA, 15 bp, Artificial Sequence
  dgRNA
  Vrk2
agttacaaggctgtc

SEQ ID NO: 55915 - DNA, 15 bp, Artificial Sequence
  dgRNA
  Pfkl
gttgatcctagctgc

SEQ ID NO: 55916 - DNA, 15 bp, Artificial Sequence
  dgRNA
  Pfkl
acctggggagttcgg

SEQ ID NO: 55917 - DNA, 15 bp, Artificial Sequence
  dgRNA
  Pfkl
ggggagttcggtggc

SEQ ID NO: 55918 - DNA, 15 bp, Artificial Sequence
  dgRNA
  Pfkl
gttcggtggcgggcc

SEQ ID NO: 55919 - DNA, 15 bp, Artificial Sequence
  dgRNA
  Ano2
tccctactactactc

SEQ ID NO: 55920 - DNA, 15 bp, Artificial Sequence
  dgRNA
  Ano2
ccctactactactca

SEQ ID NO: 55921 - DNA, 15 bp, Artificial Sequence
  dgRNA
  Ano2
ctatagccggcagac

SEQ ID NO: 55922 - DNA, 15 bp, Artificial Sequence
  dgRNA
  Ano2
gcagactggtgccac

SEQ ID NO: 55923 - DNA, 15 bp, Artificial Sequence
  dgRNA
  Pfn1
atatagcctttggcg

SEQ ID NO: 55924 - DNA, 15 bp, Artificial Sequence
  dgRNA
  Pfn1
gctttccatcgaact

SEQ ID NO: 55925 - DNA, 15 bp, Artificial Sequence
  dgRNA
  Pfn1
gcaaattttgcaaag

SEQ ID NO: 55926 - DNA, 15 bp, Artificial Sequence
  dgRNA
  Pfn1
caaattttgcaaagt

SEQ ID NO: 55927 - DNA, 15 bp, Artificial Sequence
  dgRNA
  Klhl32
cgcgctccatgggga

SEQ ID NO: 55928 - DNA, 15 bp, Artificial Sequence
  dgRNA
  Klhl32
ccatagtagcagcag

SEQ ID NO: 55929 - DNA, 15 bp, Artificial Sequence
  dgRNA
  Klhl32
gcctgcgggagtagc

SEQ ID NO: 55930 - DNA, 15 bp, Artificial Sequence
  dgRNA
  Klhl32
gtgacccgcgacaag

SEQ ID NO: 55931 - DNA, 15 bp, Artificial Sequence
  dgRNA
  Tnni2
ggacaggccagcgcc

SEQ ID NO: 55932 - DNA, 15 bp, Artificial Sequence
  dgRNA
  Tnni2
gacaggccagcgcct

SEQ ID NO: 55933 - DNA, 15 bp, Artificial Sequence
  dgRNA
  Tnni2
agcgcctgggctgac

SEQ ID NO: 55934 - DNA, 15 bp, Artificial Sequence
  dgRNA
  Tnni2
ctgggctgaccggcc

SEQ ID NO: 55935 - DNA, 15 bp, Artificial Sequence
  dgRNA
  Olfr54
gatcaggctcctgga

SEQ ID NO: 55936 - DNA, 15 bp, Artificial Sequence
  dgRNA
  Mfsd2a
ttcctcgggcgagtc

SEQ ID NO: 55937 - DNA, 15 bp, Artificial Sequence
  dgRNA
  Mfsd2a
ctcgggcgagtcagg

SEQ ID NO: 55938 - DNA, 15 bp, Artificial Sequence
  dgRNA
  Mfsd2a
tcgggcgagtcaggt

SEQ ID NO: 55939 - DNA, 15 bp, Artificial Sequence
  dgRNA
  Mfsd2a
gtagttaggagcacg

SEQ ID NO: 55940 - DNA, 15 bp, Artificial Sequence
  dgRNA
  Rnf113a2
acagcaatacttgat

SEQ ID NO: 55941 - DNA, 15 bp, Artificial Sequence
  dgRNA
  Rnf113a2
cttgattggagatct

SEQ ID NO: 55942 - DNA, 15 bp, Artificial Sequence
  dgRNA
  Rnf113a2
ctttagcgggctagc

SEQ ID NO: 55943 - DNA, 15 bp, Artificial Sequence
  dgRNA
  Rnf113a2
agtctattagggaga

SEQ ID NO: 55944 - DNA, 15 bp, Artificial Sequence
  dgRNA
  Gabrb3
gattcggcactcact

SEQ ID NO: 55945 - DNA, 15 bp, Artificial Sequence
  dgRNA
  Gabrb3
cgccatgcaaagggc

SEQ ID NO: 55946 - DNA, 15 bp, Artificial Sequence
  dgRNA
  Gabrb3
aggcgggaaagcccg

SEQ ID NO: 55947 - DNA, 15 bp, Artificial Sequence
  dgRNA
  Gabrb3
ggcgggaaagcccgc

SEQ ID NO: 55948 - DNA, 15 bp, Artificial Sequence
  dgRNA
  Kcnk2
gcggggaggcgagcc

SEQ ID NO: 55949 - DNA, 15 bp, Artificial Sequence
  dgRNA
  Kcnk2
ggaggcgagcccggg

SEQ ID NO: 55950 - DNA, 15 bp, Artificial Sequence
  dgRNA
  Kcnk2
gaggcgagcccgggc

SEQ ID NO: 55951 - DNA, 15 bp, Artificial Sequence
  dgRNA
  Kcnk2
aggcgagcccgggcg

SEQ ID NO: 55952 - DNA, 15 bp, Artificial Sequence
  dgRNA
  Ik
tttgcgccgaccgct

SEQ ID NO: 55953 - DNA, 15 bp, Artificial Sequence
  dgRNA
  Ik
ccgctcggctagcag

SEQ ID NO: 55954 - DNA, 15 bp, Artificial Sequence
  dgRNA
  Ik
cctttcaccctcaat

SEQ ID NO: 55955 - DNA, 15 bp, Artificial Sequence
  dgRNA
  Ik
caatcggaccaatag

SEQ ID NO: 55956 - DNA, 15 bp, Artificial Sequence
  dgRNA
  Cables2
aatggacagggaccg

SEQ ID NO: 55957 - DNA, 15 bp, Artificial Sequence
  dgRNA
  Cables2
aatgggcgggagcga

SEQ ID NO: 55958 - DNA, 15 bp, Artificial Sequence
  dgRNA
  Cables2
atgggcgggagcgac

SEQ ID NO: 55959 - DNA, 15 bp, Artificial Sequence
  dgRNA
  Cables2
tgggcgggagcgacg

SEQ ID NO: 55960 - DNA, 15 bp, Artificial Sequence
  dgRNA
  Cckbr
acgaatttccagaac

SEQ ID NO: 55961 - DNA, 15 bp, Artificial Sequence
  dgRNA
  Cckbr
cgaatttccagaact

SEQ ID NO: 55962 - DNA, 15 bp, Artificial Sequence
  dgRNA
  Cckbr
ggacattggtatgag

SEQ ID NO: 55963 - DNA, 15 bp, Artificial Sequence
  dgRNA
  Cckbr
cattggtatgagagg

SEQ ID NO: 55964 - DNA, 15 bp, Artificial Sequence
  dgRNA
  Polr1c
tggagcacgcgcgcg

SEQ ID NO: 55965 - DNA, 15 bp, Artificial Sequence
  dgRNA
  Polr1c
ggagcacgcgcgcgt

SEQ ID NO: 55966 - DNA, 15 bp, Artificial Sequence
  dgRNA
  Polr1c
gaagagcgtgcgacc

SEQ ID NO: 55967 - DNA, 15 bp, Artificial Sequence
  dgRNA
  Polr1c
aagagcgtgcgaccc

SEQ ID NO: 55968 - DNA, 15 bp, Artificial Sequence
  dgRNA
  Vmn2r95
gtactggacactatt

SEQ ID NO: 55969 - DNA, 15 bp, Artificial Sequence
  dgRNA
  Vmn2r95
aactgttttttcacg

SEQ ID NO: 55970 - DNA, 15 bp, Artificial Sequence
  dgRNA
  Vmn2r95
gttgatgactcagtc

SEQ ID NO: 55971 - DNA, 15 bp, Artificial Sequence
  dgRNA
  Ccm2l
cacccttcagttgca

SEQ ID NO: 55972 - DNA, 15 bp, Artificial Sequence
  dgRNA
  Ccm2l
ccaccatcagatggg

SEQ ID NO: 55973 - DNA, 15 bp, Artificial Sequence
  dgRNA
  Ccm2l
ggtggagtttccgac

SEQ ID NO: 55974 - DNA, 15 bp, Artificial Sequence
  dgRNA
  Ccm2l
gtggagtttccgacc

SEQ ID NO: 55975 - DNA, 15 bp, Artificial Sequence
  dgRNA
  Vamp7
cgttgacccgaccta

SEQ ID NO: 55976 - DNA, 15 bp, Artificial Sequence
  dgRNA
  Vamp7
gacctaaggcagacg

SEQ ID NO: 55977 - DNA, 15 bp, Artificial Sequence
  dgRNA
  Vamp7
gtgcagtacgggttc

SEQ ID NO: 55978 - DNA, 15 bp, Artificial Sequence
  dgRNA
  Vamp7
tgcagtacgggttct

SEQ ID NO: 55979 - DNA, 15 bp, Artificial Sequence
  dgRNA
  Pdcl2
tagtagacgagaaga

SEQ ID NO: 55980 - DNA, 15 bp, Artificial Sequence
  dgRNA
  Pdcl2
aagatggagcgcaac

SEQ ID NO: 55981 - DNA, 15 bp, Artificial Sequence
  dgRNA
  Pdcl2
agggcccatagaccc

SEQ ID NO: 55982 - DNA, 15 bp, Artificial Sequence
  dgRNA
  Pdcl2
aacctcagcgttgcc

SEQ ID NO: 55983 - DNA, 15 bp, Artificial Sequence
  dgRNA
  Hdac10
ggcggtactggtcgt

SEQ ID NO: 55984 - DNA, 15 bp, Artificial Sequence
  dgRNA
  Hdac10
gccacacgtagttgt

SEQ ID NO: 55985 - DNA, 15 bp, Artificial Sequence
  dgRNA
  Hdac10
acacgtagttgtcgg

SEQ ID NO: 55986 - DNA, 15 bp, Artificial Sequence
  dgRNA
  Hdac10
agcgcgcgcaatccc

SEQ ID NO: 55987 - DNA, 15 bp, Artificial Sequence
  dgRNA
  Acox2
tttgcccaacgacac

SEQ ID NO: 55988 - DNA, 15 bp, Artificial Sequence
  dgRNA
  Acox2
cccaacgacactggc

SEQ ID NO: 55989 - DNA, 15 bp, Artificial Sequence
  dgRNA
  Acox2
cctcatgcaatactc

SEQ ID NO: 55990 - DNA, 15 bp, Artificial Sequence
  dgRNA
  Acox2
gaagattgggcctat

SEQ ID NO: 55991 - DNA, 15 bp, Artificial Sequence
  dgRNA
  Wdr81
gaaccaaacgagcct

SEQ ID NO: 55992 - DNA, 15 bp, Artificial Sequence
  dgRNA
  Wdr81
gacgaagccccctaa

SEQ ID NO: 55993 - DNA, 15 bp, Artificial Sequence
  dgRNA
  Wdr81
ccccctaaaggcagt

SEQ ID NO: 55994 - DNA, 15 bp, Artificial Sequence
  dgRNA
  Wdr81
aggcgggatctcgcc

SEQ ID NO: 55995 - DNA, 15 bp, Artificial Sequence
  dgRNA
  Amy1
attatgttgcaatag

SEQ ID NO: 55996 - DNA, 15 bp, Artificial Sequence
  dgRNA
  Amy1
atgttgcaatagagg

SEQ ID NO: 55997 - DNA, 15 bp, Artificial Sequence
  dgRNA
  Amy1
caatataggggttaa

SEQ ID NO: 55998 - DNA, 15 bp, Artificial Sequence
  dgRNA
  Acsl1
ggcaccgcgggtctg

SEQ ID NO: 55999 - DNA, 15 bp, Artificial Sequence
  dgRNA
  Acsl1
gcaccgcgggtctga

SEQ ID NO: 56000 - DNA, 15 bp, Artificial Sequence
  dgRNA
  Acsl1
caccgcgggtctgag

SEQ ID NO: 56001 - DNA, 15 bp, Artificial Sequence
  dgRNA
  Acsl1
tggatcagcccagat

SEQ ID NO: 56002 - DNA, 15 bp, Artificial Sequence
  dgRNA
  2210016L21Rik
aaggtggtggtctcc

SEQ ID NO: 56003 - DNA, 15 bp, Artificial Sequence
  dgRNA
  2210016L21Rik
accgttcgccgccaa

SEQ ID NO: 56004 - DNA, 15 bp, Artificial Sequence
  dgRNA
  2210016L21Rik
gttcgccgccaatgg

SEQ ID NO: 56005 - DNA, 15 bp, Artificial Sequence
  dgRNA
  2210016L21Rik
ccgccaatggtggtc

SEQ ID NO: 56006 - DNA, 15 bp, Artificial Sequence
  dgRNA
  Zfp429
caccgctgtgaccac

SEQ ID NO: 56007 - DNA, 15 bp, Artificial Sequence
  dgRNA
  Zfp429
accgctgtgaccact

SEQ ID NO: 56008 - DNA, 15 bp, Artificial Sequence
  dgRNA
  Zfp429
taatgcgaccccatt

SEQ ID NO: 56009 - DNA, 15 bp, Artificial Sequence
  dgRNA
  Zfp429
gtttggagaggtacg

SEQ ID NO: 56010 - DNA, 15 bp, Artificial Sequence
  dgRNA
  Reck
ttgaagaccgcagcc

SEQ ID NO: 56011 - DNA, 15 bp, Artificial Sequence
  dgRNA
  Reck
tgaagaccgcagccc

SEQ ID NO: 56012 - DNA, 15 bp, Artificial Sequence
  dgRNA
  Reck
ggagcccgagtccga

SEQ ID NO: 56013 - DNA, 15 bp, Artificial Sequence
  dgRNA
  Reck
aaggcgacacacagc

SEQ ID NO: 56014 - DNA, 15 bp, Artificial Sequence
  dgRNA
  Tmem55a
cctgtactggattac

SEQ ID NO: 56015 - DNA, 15 bp, Artificial Sequence
  dgRNA
  Tmem55a
gcctgtactggatta

SEQ ID NO: 56016 - DNA, 15 bp, Artificial Sequence
  dgRNA
  Tmem55a
ctgaaaggcctgtac

SEQ ID NO: 56017 - DNA, 15 bp, Artificial Sequence
  dgRNA
  Tmem55a
aaactaagggaaccg

SEQ ID NO: 56018 - DNA, 15 bp, Artificial Sequence
  dgRNA
  Abhd5
cctagcgccccgtcc

SEQ ID NO: 56019 - DNA, 15 bp, Artificial Sequence
  dgRNA
  Abhd5
ctagcgccccgtcca

SEQ ID NO: 56020 - DNA, 15 bp, Artificial Sequence
  dgRNA
  Abhd5
ggcagtccacacggg

SEQ ID NO: 56021 - DNA, 15 bp, Artificial Sequence
  dgRNA
  Abhd5
ggaatgacgcattaa

SEQ ID NO: 56022 - DNA, 15 bp, Artificial Sequence
  dgRNA
  Gcat
tctagcccagatacc

SEQ ID NO: 56023 - DNA, 15 bp, Artificial Sequence
  dgRNA
  Gcat
acacacgctgatcct

SEQ ID NO: 56024 - DNA, 15 bp, Artificial Sequence
  dgRNA
  Gcat
atctgaccaggtatc

SEQ ID NO: 56025 - DNA, 15 bp, Artificial Sequence
  dgRNA
  Olfr1099
atcatacttctattt

SEQ ID NO: 56026 - DNA, 15 bp, Artificial Sequence
  dgRNA
  Hhex
acagcccgtgcgtct

SEQ ID NO: 56027 - DNA, 15 bp, Artificial Sequence
  dgRNA
  Hhex
cagcccgtgcgtctc

SEQ ID NO: 56028 - DNA, 15 bp, Artificial Sequence
  dgRNA
  Hhex
agcccgtgcgtctcg

SEQ ID NO: 56029 - DNA, 15 bp, Artificial Sequence
  dgRNA
  Hhex
gcccgtgcgtctcgg

SEQ ID NO: 56030 - DNA, 15 bp, Artificial Sequence
  dgRNA
  Tmub2
ccgcctccgacctcc

SEQ ID NO: 56031 - DNA, 15 bp, Artificial Sequence
  dgRNA
  Tmub2
cctccgacctccagg

SEQ ID NO: 56032 - DNA, 15 bp, Artificial Sequence
  dgRNA
  Tmub2
cctccaggaggtccg

SEQ ID NO: 56033 - DNA, 15 bp, Artificial Sequence
  dgRNA
  Tmub2
cgaggccacgcctaa

SEQ ID NO: 56034 - DNA, 15 bp, Artificial Sequence
  dgRNA
  Itga8
gactcgaaatctagc

SEQ ID NO: 56035 - DNA, 15 bp, Artificial Sequence
  dgRNA
  Itga8
tctagcgggctcaac

SEQ ID NO: 56036 - DNA, 15 bp, Artificial Sequence
  dgRNA
  Itga8
agaactagccgctag

SEQ ID NO: 56037 - DNA, 15 bp, Artificial Sequence
  dgRNA
  Itga8
gaactagccgctaga

SEQ ID NO: 56038 - DNA, 15 bp, Artificial Sequence
  dgRNA
  4930579G24Rik
cctagaagcatagcg

SEQ ID NO: 56039 - DNA, 15 bp, Artificial Sequence
  dgRNA
  4930579G24Rik
cgaggctgatttgct

SEQ ID NO: 56040 - DNA, 15 bp, Artificial Sequence
  dgRNA
  4930579G24Rik
gtagtgtttagctcc

SEQ ID NO: 56041 - DNA, 15 bp, Artificial Sequence
  dgRNA
  4930579G24Rik
gagcctggtgacgcc

SEQ ID NO: 56042 - DNA, 15 bp, Artificial Sequence
  dgRNA
  Supt5
tcgaccttctcaaga

SEQ ID NO: 56043 - DNA, 15 bp, Artificial Sequence
  dgRNA
  Supt5
ccgcgtaaaccactt

SEQ ID NO: 56044 - DNA, 15 bp, Artificial Sequence
  dgRNA
  Supt5
ccactttggccactc

SEQ ID NO: 56045 - DNA, 15 bp, Artificial Sequence
  dgRNA
  Supt5
tggccactccggaga

SEQ ID NO: 56046 - DNA, 15 bp, Artificial Sequence
  dgRNA
  Ftl1
cgtgacttcatctca

SEQ ID NO: 56047 - DNA, 15 bp, Artificial Sequence
  dgRNA
  Ftl1
ccctcagctccggat

SEQ ID NO: 56048 - DNA, 15 bp, Artificial Sequence
  dgRNA
  Ftl1
cacgccaccgccgat

SEQ ID NO: 56049 - DNA, 15 bp, Artificial Sequence
  dgRNA
  Ftl1
ccgattggttagtct

SEQ ID NO: 56050 - DNA, 15 bp, Artificial Sequence
  dgRNA
  Hps5
tcctccggtctcgag

SEQ ID NO: 56051 - DNA, 15 bp, Artificial Sequence
  dgRNA
  Hps5
tccggtctcgagcgg

SEQ ID NO: 56052 - DNA, 15 bp, Artificial Sequence
  dgRNA
  Hps5
agcggcggagagttt

SEQ ID NO: 56053 - DNA, 15 bp, Artificial Sequence
  dgRNA
  Hps5
gcggcggagagtttc

SEQ ID NO: 56054 - DNA, 15 bp, Artificial Sequence
  dgRNA
  Bcl2
acgtgtaacttgtag

SEQ ID NO: 56055 - DNA, 15 bp, Artificial Sequence
  dgRNA
  Bcl2
tttcaaacgcgtcca

SEQ ID NO: 56056 - DNA, 15 bp, Artificial Sequence
  dgRNA
  Bcl2
gaggcgggacgacct

SEQ ID NO: 56057 - DNA, 15 bp, Artificial Sequence
  dgRNA
  Olfr125
aggtcctatgtacaa

SEQ ID NO: 56058 - DNA, 15 bp, Artificial Sequence
  dgRNA
  Olfr125
taatattgacaagtc

SEQ ID NO: 56059 - DNA, 15 bp, Artificial Sequence
  dgRNA
  Olfr125
gtatcctttgtacat

SEQ ID NO: 56060 - DNA, 15 bp, Artificial Sequence
  dgRNA
  Serpinb13
gtaatgactagggag

SEQ ID NO: 56061 - DNA, 15 bp, Artificial Sequence
  dgRNA
  Trpm7
gtcacgtggctgccg

SEQ ID NO: 56062 - DNA, 15 bp, Artificial Sequence
  dgRNA
  Trpm7
ccgcggccccgtctc

SEQ ID NO: 56063 - DNA, 15 bp, Artificial Sequence
  dgRNA
  Trpm7
cggccccgtctccgg

SEQ ID NO: 56064 - DNA, 15 bp, Artificial Sequence
  dgRNA
  Trpm7
ccccgtctccggcgg

SEQ ID NO: 56065 - DNA, 15 bp, Artificial Sequence
  dgRNA
  Aldh1b1
gctggacctaagatt

SEQ ID NO: 56066 - DNA, 15 bp, Artificial Sequence
  dgRNA
  Aldh1b1
acctaagattaggct

SEQ ID NO: 56067 - DNA, 15 bp, Artificial Sequence
  dgRNA
  Aldh1b1
cctaagattaggcta

SEQ ID NO: 56068 - DNA, 15 bp, Artificial Sequence
  dgRNA
  Aldh1b1
ctaagattaggctag

SEQ ID NO: 56069 - DNA, 15 bp, Artificial Sequence
  dgRNA
  Ralgapb
ccaccgaagcccgaa

SEQ ID NO: 56070 - DNA, 15 bp, Artificial Sequence
  dgRNA
  Ralgapb
caccgaagcccgaaa

SEQ ID NO: 56071 - DNA, 15 bp, Artificial Sequence
  dgRNA
  Ralgapb
ccgaagcccgaaagg

SEQ ID NO: 56072 - DNA, 15 bp, Artificial Sequence
  dgRNA
  Ralgapb
cgaaagggggcggtg

SEQ ID NO: 56073 - DNA, 15 bp, Artificial Sequence
  dgRNA
  Cep57
cgttgccgttcccgc

SEQ ID NO: 56074 - DNA, 15 bp, Artificial Sequence
  dgRNA
  Cep57
tgctgaggcggatga

SEQ ID NO: 56075 - DNA, 15 bp, Artificial Sequence
  dgRNA
  Cep57
cagcgcctgctgagg

SEQ ID NO: 56076 - DNA, 15 bp, Artificial Sequence
  dgRNA
  Cep57
gcgtctgaaaaggga

SEQ ID NO: 56077 - DNA, 15 bp, Artificial Sequence
  dgRNA
  Cacna1s
accccgtctcaagcc

SEQ ID NO: 56078 - DNA, 15 bp, Artificial Sequence
  dgRNA
  Cacna1s
ctcctcgggggcaga

SEQ ID NO: 56079 - DNA, 15 bp, Artificial Sequence
  dgRNA
  Cacna1s
tcctcgggggcagat

SEQ ID NO: 56080 - DNA, 15 bp, Artificial Sequence
  dgRNA
  Cacna1s
cctcgggggcagatg

SEQ ID NO: 56081 - DNA, 15 bp, Artificial Sequence
  dgRNA
  Cd200r4
gaaggagttatgctt

SEQ ID NO: 56082 - DNA, 15 bp, Artificial Sequence
  dgRNA
  Cd200r4
ggcaattccatttta

SEQ ID NO: 56083 - DNA, 15 bp, Artificial Sequence
  dgRNA
  Tacr1
ctgagagggtagtcg

SEQ ID NO: 56084 - DNA, 15 bp, Artificial Sequence
  dgRNA
  Tacr1
tgagagggtagtcgc

SEQ ID NO: 56085 - DNA, 15 bp, Artificial Sequence
  dgRNA
  Tacr1
gagagggtagtcgcg

SEQ ID NO: 56086 - DNA, 15 bp, Artificial Sequence
  dgRNA
  Tacr1
gtcgcggggctccct

SEQ ID NO: 56087 - DNA, 15 bp, Artificial Sequence
  dgRNA
  Tprkb
tctaggcccgaccag

SEQ ID NO: 56088 - DNA, 15 bp, Artificial Sequence
  dgRNA
  Tprkb
ctaggcccgaccagt

SEQ ID NO: 56089 - DNA, 15 bp, Artificial Sequence
  dgRNA
  Tprkb
taggcccgaccagtg

SEQ ID NO: 56090 - DNA, 15 bp, Artificial Sequence
  dgRNA
  Tprkb
aggcccgaccagtgg

SEQ ID NO: 56091 - DNA, 15 bp, Artificial Sequence
  dgRNA
  Ccdc173
ggcctgggtcgcagc

SEQ ID NO: 56092 - DNA, 15 bp, Artificial Sequence
  dgRNA
  Ccdc173
catcagcaccagcgt

SEQ ID NO: 56093 - DNA, 15 bp, Artificial Sequence
  dgRNA
  Ccdc173
agcaccagcgtcggc

SEQ ID NO: 56094 - DNA, 15 bp, Artificial Sequence
  dgRNA
  Ccdc173
ccagcgtcggccggt

SEQ ID NO: 56095 - DNA, 15 bp, Artificial Sequence
  dgRNA
  Fkbp4
ccgcccccgaggcgg

SEQ ID NO: 56096 - DNA, 15 bp, Artificial Sequence
  dgRNA
  Fkbp4
cgcccccgaggcgga

SEQ ID NO: 56097 - DNA, 15 bp, Artificial Sequence
  dgRNA
  Fkbp4
gcccccgaggcggag

SEQ ID NO: 56098 - DNA, 15 bp, Artificial Sequence
  dgRNA
  Fkbp4
gaggggaccaattgc

SEQ ID NO: 56099 - DNA, 15 bp, Artificial Sequence
  dgRNA
  Etv6
aggcgtcctccgcct

SEQ ID NO: 56100 - DNA, 15 bp, Artificial Sequence
  dgRNA
  Etv6
ggcgtcctccgcctc

SEQ ID NO: 56101 - DNA, 15 bp, Artificial Sequence
  dgRNA
  Etv6
gcgtcctccgcctcg

SEQ ID NO: 56102 - DNA, 15 bp, Artificial Sequence
  dgRNA
  Etv6
tcctccgcctcgggg

SEQ ID NO: 56103 - DNA, 15 bp, Artificial Sequence
  dgRNA
  Pank3
tacgagaccagagcc

SEQ ID NO: 56104 - DNA, 15 bp, Artificial Sequence
  dgRNA
  Pank3
acgagaccagagccc

SEQ ID NO: 56105 - DNA, 15 bp, Artificial Sequence
  dgRNA
  Pank3
agcccgggaattgcc

SEQ ID NO: 56106 - DNA, 15 bp, Artificial Sequence
  dgRNA
  Pank3
tgccaggaccgccca

SEQ ID NO: 56107 - DNA, 15 bp, Artificial Sequence
  dgRNA
  Kmt2c
ctcggcgccgccctc

SEQ ID NO: 56108 - DNA, 15 bp, Artificial Sequence
  dgRNA
  Kmt2c
cgccggccccagcct

SEQ ID NO: 56109 - DNA, 15 bp, Artificial Sequence
  dgRNA
  Kmt2c
ccccagccttggccg

SEQ ID NO: 56110 - DNA, 15 bp, Artificial Sequence
  dgRNA
  Kmt2c
ccgggggcggccgca

SEQ ID NO: 56111 - DNA, 15 bp, Artificial Sequence
  dgRNA
  Dab2ip
tcttgcagaccggat

SEQ ID NO: 56112 - DNA, 15 bp, Artificial Sequence
  dgRNA
  Dab2ip
cttgcagaccggatt

SEQ ID NO: 56113 - DNA, 15 bp, Artificial Sequence
  dgRNA
  Dab2ip
accggattgggatac

SEQ ID NO: 56114 - DNA, 15 bp, Artificial Sequence
  dgRNA
  Dab2ip
ttaactagccatgat

SEQ ID NO: 56115 - DNA, 15 bp, Artificial Sequence
  dgRNA
  Klk1b4
ggcctactgtagagc

SEQ ID NO: 56116 - DNA, 15 bp, Artificial Sequence
  dgRNA
  Klk1b4
agagcaggtgcaacg

SEQ ID NO: 56117 - DNA, 15 bp, Artificial Sequence
  dgRNA
  Klk1b4
gcacgaacagagctt

SEQ ID NO: 56118 - DNA, 15 bp, Artificial Sequence
  dgRNA
  Gareml
acgaggggaaaacct

SEQ ID NO: 56119 - DNA, 15 bp, Artificial Sequence
  dgRNA
  Gareml
cctcggacacccacc

SEQ ID NO: 56120 - DNA, 15 bp, Artificial Sequence
  dgRNA
  Gareml
cggccagagtcccat

SEQ ID NO: 56121 - DNA, 15 bp, Artificial Sequence
  dgRNA
  Gareml
gagcaccctgtcacc

SEQ ID NO: 56122 - DNA, 15 bp, Artificial Sequence
  dgRNA
  Abca6
tttccggagttgaaa

SEQ ID NO: 56123 - DNA, 15 bp, Artificial Sequence
  dgRNA
  Abca6
ttccggagttgaaag

SEQ ID NO: 56124 - DNA, 15 bp, Artificial Sequence
  dgRNA
  Abca6
tccggagttgaaagg

SEQ ID NO: 56125 - DNA, 15 bp, Artificial Sequence
  dgRNA
  Abca6
tgatgagatcaagat

SEQ ID NO: 56126 - DNA, 15 bp, Artificial Sequence
  dgRNA
  Odf3b
tccctttccacggtc

SEQ ID NO: 56127 - DNA, 15 bp, Artificial Sequence
  dgRNA
  Odf3b
tggtaccgaagcgcc

SEQ ID NO: 56128 - DNA, 15 bp, Artificial Sequence
  dgRNA
  Odf3b
ggtaccgaagcgcct

SEQ ID NO: 56129 - DNA, 15 bp, Artificial Sequence
  dgRNA
  Odf3b
cgaagcgcctgggat

SEQ ID NO: 56130 - DNA, 15 bp, Artificial Sequence
  dgRNA
  Syne1
gtaacctgctcttgc

SEQ ID NO: 56131 - DNA, 15 bp, Artificial Sequence
  dgRNA
  Syne1
cccttcttaccctcg

SEQ ID NO: 56132 - DNA, 15 bp, Artificial Sequence
  dgRNA
  Syne1
cgtggcctacattcc

SEQ ID NO: 56133 - DNA, 15 bp, Artificial Sequence
  dgRNA
  Syne1
acggctcaaaagaaa

SEQ ID NO: 56134 - DNA, 15 bp, Artificial Sequence
  dgRNA
  Clec4g
cgactgaccattagc

SEQ ID NO: 56135 - DNA, 15 bp, Artificial Sequence
  dgRNA
  Clec4g
ttgaggccaccgaca

SEQ ID NO: 56136 - DNA, 15 bp, Artificial Sequence
  dgRNA
  Clec4g
gccaccgacatggaa

SEQ ID NO: 56137 - DNA, 15 bp, Artificial Sequence
  dgRNA
  Clec4g
ggctaggactgtgag

SEQ ID NO: 56138 - DNA, 15 bp, Artificial Sequence
  dgRNA
  Ifna13
ccctttggtagggcg

SEQ ID NO: 56139 - DNA, 15 bp, Artificial Sequence
  dgRNA
  Ifna13
cgtggaacaaaaaag

SEQ ID NO: 56140 - DNA, 15 bp, Artificial Sequence
  dgRNA
  Ifna13
ccacgccctaccaaa

SEQ ID NO: 56141 - DNA, 15 bp, Artificial Sequence
  dgRNA
  Ifna13
tccacgccctaccaa

SEQ ID NO: 56142 - DNA, 15 bp, Artificial Sequence
  dgRNA
  Kctd11
ttactgtgcgccacc

SEQ ID NO: 56143 - DNA, 15 bp, Artificial Sequence
  dgRNA
  Kctd11
tactgtgcgccacct

SEQ ID NO: 56144 - DNA, 15 bp, Artificial Sequence
  dgRNA
  Kctd11
actgtgcgccacctg

SEQ ID NO: 56145 - DNA, 15 bp, Artificial Sequence
  dgRNA
  Kctd11
cgccacctgggggcc

SEQ ID NO: 56146 - DNA, 15 bp, Artificial Sequence
  dgRNA
  Arhgef28
cggctggccagaggt

SEQ ID NO: 56147 - DNA, 15 bp, Artificial Sequence
  dgRNA
  Arhgef28
ggaccagggggcgca

SEQ ID NO: 56148 - DNA, 15 bp, Artificial Sequence
  dgRNA
  Arhgef28
gaccagggggcgcag

SEQ ID NO: 56149 - DNA, 15 bp, Artificial Sequence
  dgRNA
  Arhgef28
accagggggcgcagg

SEQ ID NO: 56150 - DNA, 15 bp, Artificial Sequence
  dgRNA
  Slc2a6
tccacgctcttagcc

SEQ ID NO: 56151 - DNA, 15 bp, Artificial Sequence
  dgRNA
  Slc2a6
tcttagcctggcgaa

SEQ ID NO: 56152 - DNA, 15 bp, Artificial Sequence
  dgRNA
  Slc2a6
cttagcctggcgaaa

SEQ ID NO: 56153 - DNA, 15 bp, Artificial Sequence
  dgRNA
  Slc2a6
ggcgaaagggtgctc

SEQ ID NO: 56154 - DNA, 15 bp, Artificial Sequence
  dgRNA
  S100a9
accatgtatctaaca

SEQ ID NO: 56155 - DNA, 15 bp, Artificial Sequence
  dgRNA
  S100a9
gcttggagcttgttt

SEQ ID NO: 56156 - DNA, 15 bp, Artificial Sequence
  dgRNA
  S100a9
tacatggttatctcg

SEQ ID NO: 56157 - DNA, 15 bp, Artificial Sequence
  dgRNA
  S100a9
gatacatggttatct

SEQ ID NO: 56158 - DNA, 15 bp, Artificial Sequence
  dgRNA
  Dmtn
caacaggtcggtgca

SEQ ID NO: 56159 - DNA, 15 bp, Artificial Sequence
  dgRNA
  Dmtn
aacaggtcggtgcaa

SEQ ID NO: 56160 - DNA, 15 bp, Artificial Sequence
  dgRNA
  Dmtn
acaggtcggtgcaag

SEQ ID NO: 56161 - DNA, 15 bp, Artificial Sequence
  dgRNA
  Dmtn
ggtcggtgcaagggg

SEQ ID NO: 56162 - DNA, 15 bp, Artificial Sequence
  dgRNA
  Irgq
gcgtgatgatgacgt

SEQ ID NO: 56163 - DNA, 15 bp, Artificial Sequence
  dgRNA
  Irgq
gctaagcttactgcg

SEQ ID NO: 56164 - DNA, 15 bp, Artificial Sequence
  dgRNA
  Irgq
ctaagcttactgcgt

SEQ ID NO: 56165 - DNA, 15 bp, Artificial Sequence
  dgRNA
  Irgq
ctgcacgtactgcgc

SEQ ID NO: 56166 - DNA, 15 bp, Artificial Sequence
  dgRNA
  Dcun1d1
gggtgttacatgtta

SEQ ID NO: 56167 - DNA, 15 bp, Artificial Sequence
  dgRNA
  Dcun1d1
gatcacgggagtact

SEQ ID NO: 56168 - DNA, 15 bp, Artificial Sequence
  dgRNA
  Dcun1d1
atcacgggagtacta

SEQ ID NO: 56169 - DNA, 15 bp, Artificial Sequence
  dgRNA
  Dcun1d1
agtactagggccagg

SEQ ID NO: 56170 - DNA, 15 bp, Artificial Sequence
  dgRNA
  Rnaseh1
taggcactcggcagc

SEQ ID NO: 56171 - DNA, 15 bp, Artificial Sequence
  dgRNA
  Rnaseh1
aggcactcggcagct

SEQ ID NO: 56172 - DNA, 15 bp, Artificial Sequence
  dgRNA
  Rnaseh1
cgcccctctccgcga

SEQ ID NO: 56173 - DNA, 15 bp, Artificial Sequence
  dgRNA
  Rnaseh1
gcccctctccgcgac

SEQ ID NO: 56174 - DNA, 15 bp, Artificial Sequence
  dgRNA
  Plat
tcgatgacatcagta

SEQ ID NO: 56175 - DNA, 15 bp, Artificial Sequence
  dgRNA
  Plat
ggtgaataatcaaac

SEQ ID NO: 56176 - DNA, 15 bp, Artificial Sequence
  dgRNA
  Plat
caccggctgctccat

SEQ ID NO: 56177 - DNA, 15 bp, Artificial Sequence
  dgRNA
  Plat
atccttcaaattggc

SEQ ID NO: 56178 - DNA, 15 bp, Artificial Sequence
  dgRNA
  Duoxa1
tggtcgccccagcct

SEQ ID NO: 56179 - DNA, 15 bp, Artificial Sequence
  dgRNA
  Duoxa1
cctgggactgcggat

SEQ ID NO: 56180 - DNA, 15 bp, Artificial Sequence
  dgRNA
  Duoxa1
ctgcggataggctcc

SEQ ID NO: 56181 - DNA, 15 bp, Artificial Sequence
  dgRNA
  Duoxa1
cccgctcctccgttc

SEQ ID NO: 56182 - DNA, 15 bp, Artificial Sequence
  dgRNA
  Ifitm1
gtaacctatgcactg

SEQ ID NO: 56183 - DNA, 15 bp, Artificial Sequence
  dgRNA
  Ifitm1
taggacagcttgaaa

SEQ ID NO: 56184 - DNA, 15 bp, Artificial Sequence
  dgRNA
  Ifitm1
tccgagtttgctttg

SEQ ID NO: 56185 - DNA, 15 bp, Artificial Sequence
  dgRNA
  Ifitm1
cagaagggaacaacg

SEQ ID NO: 56186 - DNA, 15 bp, Artificial Sequence
  dgRNA
  Cldn18
atggcggaaaacaaa

SEQ ID NO: 56187 - DNA, 15 bp, Artificial Sequence
  dgRNA
  Cldn18
cttggtaccatgttg

SEQ ID NO: 56188 - DNA, 15 bp, Artificial Sequence
  dgRNA
  Cldn18
gaaattatctcgctt

SEQ ID NO: 56189 - DNA, 15 bp, Artificial Sequence
  dgRNA
  Cldn18
aagcccaggcggcgc

SEQ ID NO: 56190 - DNA, 15 bp, Artificial Sequence
  dgRNA
  Klrb1
gttgcaaatgtgagt

SEQ ID NO: 56191 - DNA, 15 bp, Artificial Sequence
  dgRNA
  Klrb1
gcataatgttgatag

SEQ ID NO: 56192 - DNA, 15 bp, Artificial Sequence
  dgRNA
  Klrb1
tatcgttaaaactga

SEQ ID NO: 56193 - DNA, 15 bp, Artificial Sequence
  dgRNA
  Tmed2
actagcaggttctgt

SEQ ID NO: 56194 - DNA, 15 bp, Artificial Sequence
  dgRNA
  Tmed2
agtccacgtgatcat

SEQ ID NO: 56195 - DNA, 15 bp, Artificial Sequence
  dgRNA
  Tmed2
attggcccacgtcga

SEQ ID NO: 56196 - DNA, 15 bp, Artificial Sequence
  dgRNA
  Tmed2
ttggcccacgtcgaa

SEQ ID NO: 56197 - DNA, 15 bp, Artificial Sequence
  dgRNA
  Adcy6
gtggcgagataagaa

SEQ ID NO: 56198 - DNA, 15 bp, Artificial Sequence
  dgRNA
  Adcy6
tggcgagataagaac

SEQ ID NO: 56199 - DNA, 15 bp, Artificial Sequence
  dgRNA
  Adcy6
ggcgagataagaacg

SEQ ID NO: 56200 - DNA, 15 bp, Artificial Sequence
  dgRNA
  Wdr5b
gtcaacttcctgtcc

SEQ ID NO: 56201 - DNA, 15 bp, Artificial Sequence
  dgRNA
  Wdr5b
ggcgcgtgcgcagcc

SEQ ID NO: 56202 - DNA, 15 bp, Artificial Sequence
  dgRNA
  Wdr5b
cgtgcgcagcctggc

SEQ ID NO: 56203 - DNA, 15 bp, Artificial Sequence
  dgRNA
  Wdr5b
tacctagcgtcgtcc

SEQ ID NO: 56204 - DNA, 15 bp, Artificial Sequence
  dgRNA
  Hey1
gccggcactttccca

SEQ ID NO: 56205 - DNA, 15 bp, Artificial Sequence
  dgRNA
  Hey1
ctttcccacggcccg

SEQ ID NO: 56206 - DNA, 15 bp, Artificial Sequence
  dgRNA
  Hey1
gcgcgtgcggctcac

SEQ ID NO: 56207 - DNA, 15 bp, Artificial Sequence
  dgRNA
  Hey1
cgtgcggctcaccgg

SEQ ID NO: 56208 - DNA, 15 bp, Artificial Sequence
  dgRNA
  Sp5
tttaattgcaagtgg

SEQ ID NO: 56209 - DNA, 15 bp, Artificial Sequence
  dgRNA
  Sp5
caagcgcgagtctcc

SEQ ID NO: 56210 - DNA, 15 bp, Artificial Sequence
  dgRNA
  Sp5
gcgcgagtctccagg

SEQ ID NO: 56211 - DNA, 15 bp, Artificial Sequence
  dgRNA
  Sp5
agtctccaggcggca

SEQ ID NO: 56212 - DNA, 15 bp, Artificial Sequence
  dgRNA
  Fam198a
aggcgctgaacccag

SEQ ID NO: 56213 - DNA, 15 bp, Artificial Sequence
  dgRNA
  Fam198a
ggcgctgaacccagt

SEQ ID NO: 56214 - DNA, 15 bp, Artificial Sequence
  dgRNA
  Fam198a
cgctgaacccagtgg

SEQ ID NO: 56215 - DNA, 15 bp, Artificial Sequence
  dgRNA
  Fam198a
ttcagcgcctgggct

SEQ ID NO: 56216 - DNA, 15 bp, Artificial Sequence
  dgRNA
  Prok1
ttgtatccgctctga

SEQ ID NO: 56217 - DNA, 15 bp, Artificial Sequence
  dgRNA
  Prok1
ccgctctgacggtga

SEQ ID NO: 56218 - DNA, 15 bp, Artificial Sequence
  dgRNA
  Prok1
cgctctgacggtgat

SEQ ID NO: 56219 - DNA, 15 bp, Artificial Sequence
  dgRNA
  Prok1
agctcatctgaataa

SEQ ID NO: 56220 - DNA, 15 bp, Artificial Sequence
  dgRNA
  Vps37a
gctagcacccggcgg

SEQ ID NO: 56221 - DNA, 15 bp, Artificial Sequence
  dgRNA
  Vps37a
agcacccggcggcgg

SEQ ID NO: 56222 - DNA, 15 bp, Artificial Sequence
  dgRNA
  Vps37a
tggcggtggcggtac

SEQ ID NO: 56223 - DNA, 15 bp, Artificial Sequence
  dgRNA
  Vps37a
cggtggcggtaccgg

SEQ ID NO: 56224 - DNA, 15 bp, Artificial Sequence
  dgRNA
  Klc2
agtcacctccgaagc

SEQ ID NO: 56225 - DNA, 15 bp, Artificial Sequence
  dgRNA
  Klc2
tccgaagccggtaag

SEQ ID NO: 56226 - DNA, 15 bp, Artificial Sequence
  dgRNA
  Klc2
tgcgtctctagagcg

SEQ ID NO: 56227 - DNA, 15 bp, Artificial Sequence
  dgRNA
  Klc2
gtctctagagcgcgg

SEQ ID NO: 56228 - DNA, 15 bp, Artificial Sequence
  dgRNA
  Vapb
aacagttctccccgc

SEQ ID NO: 56229 - DNA, 15 bp, Artificial Sequence
  dgRNA
  Vapb
ctcccaagcctcgag

SEQ ID NO: 56230 - DNA, 15 bp, Artificial Sequence
  dgRNA
  Vapb
ccacgccccctgtct

SEQ ID NO: 56231 - DNA, 15 bp, Artificial Sequence
  dgRNA
  Vapb
ccgccctctaccgcc

SEQ ID NO: 56232 - DNA, 15 bp, Artificial Sequence
  dgRNA
  Ccdc178
aaggaccgctaatcc

SEQ ID NO: 56233 - DNA, 15 bp, Artificial Sequence
  dgRNA
  Ccdc178
aggaccgctaatcca

SEQ ID NO: 56234 - DNA, 15 bp, Artificial Sequence
  dgRNA
  Ccdc178
gagaaagtcgctgga

SEQ ID NO: 56235 - DNA, 15 bp, Artificial Sequence
  dgRNA
  Ccdc178
agaaagtcgctggat

SEQ ID NO: 56236 - DNA, 15 bp, Artificial Sequence
  dgRNA
  Morc1
agcgctgagaacacc

SEQ ID NO: 56237 - DNA, 15 bp, Artificial Sequence
  dgRNA
  Morc1
cgctgagaacaccag

SEQ ID NO: 56238 - DNA, 15 bp, Artificial Sequence
  dgRNA
  Morc1
aacaccagggggcga

SEQ ID NO: 56239 - DNA, 15 bp, Artificial Sequence
  dgRNA
  Morc1
gacgccttcgccccc

SEQ ID NO: 56240 - DNA, 15 bp, Artificial Sequence
  dgRNA
  Igsf3
gtccgcagctgcgtg

SEQ ID NO: 56241 - DNA, 15 bp, Artificial Sequence
  dgRNA
  Igsf3
cagagagcgccgggg

SEQ ID NO: 56242 - DNA, 15 bp, Artificial Sequence
  dgRNA
  Igsf3
agagcgccggggcgg

SEQ ID NO: 56243 - DNA, 15 bp, Artificial Sequence
  dgRNA
  Igsf3
gagcgccggggcggt

SEQ ID NO: 56244 - DNA, 15 bp, Artificial Sequence
  dgRNA
  Apela
catgtgggatcaata

SEQ ID NO: 56245 - DNA, 15 bp, Artificial Sequence
  dgRNA
  Apela
aacagattgcaatgg

SEQ ID NO: 56246 - DNA, 15 bp, Artificial Sequence
  dgRNA
  Apela
gtaaacagattgaat

SEQ ID NO: 56247 - DNA, 15 bp, Artificial Sequence
  dgRNA
  Apela
tagagctctaactga

SEQ ID NO: 56248 - DNA, 15 bp, Artificial Sequence
  dgRNA
  Kdelr3
acttggtgcctacgc

SEQ ID NO: 56249 - DNA, 15 bp, Artificial Sequence
  dgRNA
  Kdelr3
tacgcaggaccagag

SEQ ID NO: 56250 - DNA, 15 bp, Artificial Sequence
  dgRNA
  Kdelr3
ggaggggctcggctt

SEQ ID NO: 56251 - DNA, 15 bp, Artificial Sequence
  dgRNA
  Kdelr3
agctgccccgcctgt

SEQ ID NO: 56252 - DNA, 15 bp, Artificial Sequence
  dgRNA
  Zhx1
acctcccgcagcgcc

SEQ ID NO: 56253 - DNA, 15 bp, Artificial Sequence
  dgRNA
  Zhx1
accgggcgctgcggg

SEQ ID NO: 56254 - DNA, 15 bp, Artificial Sequence
  dgRNA
  Zhx1
agaaccgggcgctgc

SEQ ID NO: 56255 - DNA, 15 bp, Artificial Sequence
  dgRNA
  Zhx1
tagaaccgggcgctg

SEQ ID NO: 56256 - DNA, 15 bp, Artificial Sequence
  dgRNA
  Mrps11
aggacgcagcctcaa

SEQ ID NO: 56257 - DNA, 15 bp, Artificial Sequence
  dgRNA
  Mrps11
aaagagtacgcccta

SEQ ID NO: 56258 - DNA, 15 bp, Artificial Sequence
  dgRNA
  Mrps11
aagagtacgccctac

SEQ ID NO: 56259 - DNA, 15 bp, Artificial Sequence
  dgRNA
  Mrps11
tcccacaaggtaccg

SEQ ID NO: 56260 - DNA, 15 bp, Artificial Sequence
  dgRNA
  Arf6
ccagcaggttccgcg

SEQ ID NO: 56261 - DNA, 15 bp, Artificial Sequence
  dgRNA
  Arf6
ggttccgcgaggcgc

SEQ ID NO: 56262 - DNA, 15 bp, Artificial Sequence
  dgRNA
  Arf6
gccggcgttgagccc

SEQ ID NO: 56263 - DNA, 15 bp, Artificial Sequence
  dgRNA
  Arf6
ccggcgttgagcccc

SEQ ID NO: 56264 - DNA, 15 bp, Artificial Sequence
  dgRNA
  Nyap2
ccagccagcgcaagc

SEQ ID NO: 56265 - DNA, 15 bp, Artificial Sequence
  dgRNA
  Nyap2
caagctggttgtcat

SEQ ID NO: 56266 - DNA, 15 bp, Artificial Sequence
  dgRNA
  Nyap2
tgcgctggctggctc

SEQ ID NO: 56267 - DNA, 15 bp, Artificial Sequence
  dgRNA
  Nyap2
ccagcttgcgctggc

SEQ ID NO: 56268 - DNA, 15 bp, Artificial Sequence
  dgRNA
  Vmn2r109
ttacttgccttctat

SEQ ID NO: 56269 - DNA, 15 bp, Artificial Sequence
  dgRNA
  Chad
ggcccccagccatcg

SEQ ID NO: 56270 - DNA, 15 bp, Artificial Sequence
  dgRNA
  Chad
cccagccatcgagga

SEQ ID NO: 56271 - DNA, 15 bp, Artificial Sequence
  dgRNA
  Chad
ccagccatcgaggat

SEQ ID NO: 56272 - DNA, 15 bp, Artificial Sequence
  dgRNA
  Chad
cagccatcgaggatg

SEQ ID NO: 56273 - DNA, 15 bp, Artificial Sequence
  dgRNA
  Pinx1
ccccggacaactcta

SEQ ID NO: 56274 - DNA, 15 bp, Artificial Sequence
  dgRNA
  Pinx1
tccgcttcatgcagt

SEQ ID NO: 56275 - DNA, 15 bp, Artificial Sequence
  dgRNA
  Pinx1
gtagcgagtcgcgcg

SEQ ID NO: 56276 - DNA, 15 bp, Artificial Sequence
  dgRNA
  Pinx1
gtacatttaaagagc

SEQ ID NO: 56277 - DNA, 15 bp, Artificial Sequence
  dgRNA
  Wdr76
gaaacaacttccggt

SEQ ID NO: 56278 - DNA, 15 bp, Artificial Sequence
  dgRNA
  Wdr76
aaacaacttccggta

SEQ ID NO: 56279 - DNA, 15 bp, Artificial Sequence
  dgRNA
  Wdr76
aacaacttccggtag

SEQ ID NO: 56280 - DNA, 15 bp, Artificial Sequence
  dgRNA
  Wdr76
acaacttccggtagg

SEQ ID NO: 56281 - DNA, 15 bp, Artificial Sequence
  dgRNA
  Wdr61
caaccccgcacgcca

SEQ ID NO: 56282 - DNA, 15 bp, Artificial Sequence
  dgRNA
  Wdr61
gcacgccaaggcagc

SEQ ID NO: 56283 - DNA, 15 bp, Artificial Sequence
  dgRNA
  Wdr61
cgccaaggcagcagg

SEQ ID NO: 56284 - DNA, 15 bp, Artificial Sequence
  dgRNA
  Wdr61
aggggggcgctctgc

SEQ ID NO: 56285 - DNA, 15 bp, Artificial Sequence
  dgRNA
  Znfx1
atggcgcgtcgcttc

SEQ ID NO: 56286 - DNA, 15 bp, Artificial Sequence
  dgRNA
  Znfx1
tggcgcgtcgcttcc

SEQ ID NO: 56287 - DNA, 15 bp, Artificial Sequence
  dgRNA
  Znfx1
ccgggcgcgaccgct

SEQ ID NO: 56288 - DNA, 15 bp, Artificial Sequence
  dgRNA
  Znfx1
gaccgcttggcgtcc

SEQ ID NO: 56289 - DNA, 15 bp, Artificial Sequence
  dgRNA
  Tfdp2
tccgcctctggccct

SEQ ID NO: 56290 - DNA, 15 bp, Artificial Sequence
  dgRNA
  Tfdp2
ccctgggggcgagcc

SEQ ID NO: 56291 - DNA, 15 bp, Artificial Sequence
  dgRNA
  Tfdp2
cctgggggcgagcct

SEQ ID NO: 56292 - DNA, 15 bp, Artificial Sequence
  dgRNA
  Tfdp2
tccctacacgcactg

SEQ ID NO: 56293 - DNA, 15 bp, Artificial Sequence
  dgRNA
  Olfr60
ggtttccaaaaagtc

SEQ ID NO: 56294 - DNA, 15 bp, Artificial Sequence
  dgRNA
  Olfr60
ctataccagactttt

SEQ ID NO: 56295 - DNA, 15 bp, Artificial Sequence
  dgRNA
  Tmem150c
agattaacatgactc

SEQ ID NO: 56296 - DNA, 15 bp, Artificial Sequence
  dgRNA
  Tmem150c
gattaacatgactct

SEQ ID NO: 56297 - DNA, 15 bp, Artificial Sequence
  dgRNA
  Tmem150c
cagtgacaaaagttg

SEQ ID NO: 56298 - DNA, 15 bp, Artificial Sequence
  dgRNA
  Tmem150c
gcaagtttggctgta

SEQ ID NO: 56299 - DNA, 15 bp, Artificial Sequence
  dgRNA
  Sik3
aacagggacccacgc

SEQ ID NO: 56300 - DNA, 15 bp, Artificial Sequence
  dgRNA
  Sik3
aaggtcgagctcgcc

SEQ ID NO: 56301 - DNA, 15 bp, Artificial Sequence
  dgRNA
  Sik3
cgagctcgcccggtg

SEQ ID NO: 56302 - DNA, 15 bp, Artificial Sequence
  dgRNA
  Sik3
cgcccggtgaggtca

SEQ ID NO: 56303 - DNA, 15 bp, Artificial Sequence
  dgRNA
  Acad10
aggccgagcggcccg

SEQ ID NO: 56304 - DNA, 15 bp, Artificial Sequence
  dgRNA
  Acad10
cgagcggcccgcggt

SEQ ID NO: 56305 - DNA, 15 bp, Artificial Sequence
  dgRNA
  Acad10
ccgcctcagaagccg

SEQ ID NO: 56306 - DNA, 15 bp, Artificial Sequence
  dgRNA
  Acad10
ccgccgcctcagcag

SEQ ID NO: 56307 - DNA, 15 bp, Artificial Sequence
  dgRNA
  Snrpe
ctcgacttcaaagag

SEQ ID NO: 56308 - DNA, 15 bp, Artificial Sequence
  dgRNA
  Snrpe
aaagagcggttgagt

SEQ ID NO: 56309 - DNA, 15 bp, Artificial Sequence
  dgRNA
  Snrpe
agcggttgagtcgga

SEQ ID NO: 56310 - DNA, 15 bp, Artificial Sequence
  dgRNA
  Snrpe
gagtcggaaggccgc

SEQ ID NO: 56311 - DNA, 15 bp, Artificial Sequence
  dgRNA
  Hsd3b6
agaagccccccaacc

SEQ ID NO: 56312 - DNA, 15 bp, Artificial Sequence
  dgRNA
  Hsd3b6
ggaaacacctaatta

SEQ ID NO: 56313 - DNA, 15 bp, Artificial Sequence
  dgRNA
  Hsd3b6
ggcccaccccgattg

SEQ ID NO: 56314 - DNA, 15 bp, Artificial Sequence
  dgRNA
  Hsd3b6
gcccaccccgattgt

SEQ ID NO: 56315 - DNA, 15 bp, Artificial Sequence
  dgRNA
  Gdf3
ctgctgaccaacccg

SEQ ID NO: 56316 - DNA, 15 bp, Artificial Sequence
  dgRNA
  Gdf3
tgctgaccaacccgc

SEQ ID NO: 56317 - DNA, 15 bp, Artificial Sequence
  dgRNA
  Gdf3
gctgaccaacccgcg

SEQ ID NO: 56318 - DNA, 15 bp, Artificial Sequence
  dgRNA
  Gdf3
cccgcggggagtaga

SEQ ID NO: 56319 - DNA, 15 bp, Artificial Sequence
  dgRNA
  Oscp1
cacggcagatacgcg

SEQ ID NO: 56320 - DNA, 15 bp, Artificial Sequence
  dgRNA
  Oscp1
gcagatacgcgcggc

SEQ ID NO: 56321 - DNA, 15 bp, Artificial Sequence
  dgRNA
  Oscp1
atacgcgcggctggc

SEQ ID NO: 56322 - DNA, 15 bp, Artificial Sequence
  dgRNA
  Oscp1
tggctggaacgctcc

SEQ ID NO: 56323 - DNA, 15 bp, Artificial Sequence
  dgRNA
  Sptb
cacagccgggttctc

SEQ ID NO: 56324 - DNA, 15 bp, Artificial Sequence
  dgRNA
  Sptb
accttgcttacaagc

SEQ ID NO: 56325 - DNA, 15 bp, Artificial Sequence
  dgRNA
  Sptb
tacaagcaggagccg

SEQ ID NO: 56326 - DNA, 15 bp, Artificial Sequence
  dgRNA
  Sptb
cggcctccagcccgc

SEQ ID NO: 56327 - DNA, 15 bp, Artificial Sequence
  dgRNA
  Cbfa2t2
gcggcctaacggcgg

SEQ ID NO: 56328 - DNA, 15 bp, Artificial Sequence
  dgRNA
  Cbfa2t2
gcctaacggcggcgg

SEQ ID NO: 56329 - DNA, 15 bp, Artificial Sequence
  dgRNA
  Eif3l
aaaagcccgttttgc

SEQ ID NO: 56330 - DNA, 15 bp, Artificial Sequence
  dgRNA
  Eif3l
aaagcccgttttgca

SEQ ID NO: 56331 - DNA, 15 bp, Artificial Sequence
  dgRNA
  Eif3l
gaactctgatagttt

SEQ ID NO: 56332 - DNA, 15 bp, Artificial Sequence
  dgRNA
  Eif3l
gctacttcgcttccc

SEQ ID NO: 56333 - DNA, 15 bp, Artificial Sequence
  dgRNA
  Galnt15
atgcctccctatgaa

SEQ ID NO: 56334 - DNA, 15 bp, Artificial Sequence
  dgRNA
  Galnt15
ttttggatcggctct

SEQ ID NO: 56335 - DNA, 15 bp, Artificial Sequence
  dgRNA
  Galnt15
tttggatcggctctt

SEQ ID NO: 56336 - DNA, 15 bp, Artificial Sequence
  dgRNA
  Galnt15
ttggatcggctcttg

SEQ ID NO: 56337 - DNA, 15 bp, Artificial Sequence
  dgRNA
  Numb
cactgtcactccgag

SEQ ID NO: 56338 - DNA, 15 bp, Artificial Sequence
  dgRNA
  Numb
gctataaccctcgtg

SEQ ID NO: 56339 - DNA, 15 bp, Artificial Sequence
  dgRNA
  Numb
ctataaccctcgtgt

SEQ ID NO: 56340 - DNA, 15 bp, Artificial Sequence
  dgRNA
  Numb
ctcgtgtgggccctc

SEQ ID NO: 56341 - DNA, 15 bp, Artificial Sequence
  dgRNA
  Rtn4ip1
acttctcggagagtc

SEQ ID NO: 56342 - DNA, 15 bp, Artificial Sequence
  dgRNA
  Rtn4ip1
gccctcggagtcagc

SEQ ID NO: 56343 - DNA, 15 bp, Artificial Sequence
  dgRNA
  Rtn4ip1
gtcagccggtagcac

SEQ ID NO: 56344 - DNA, 15 bp, Artificial Sequence
  dgRNA
  Rtn4ip1
tcagccggtagcacc

SEQ ID NO: 56345 - DNA, 15 bp, Artificial Sequence
  dgRNA
  Wscd1
gcgtactgctgcgag

SEQ ID NO: 56346 - DNA, 15 bp, Artificial Sequence
  dgRNA
  Wscd1
actcagatgcagacg

SEQ ID NO: 56347 - DNA, 15 bp, Artificial Sequence
  dgRNA
  Defb33
gaaatagcttgaaac

SEQ ID NO: 56348 - DNA, 15 bp, Artificial Sequence
  dgRNA
  Defb33
gtctgactagtcagc

SEQ ID NO: 56349 - DNA, 15 bp, Artificial Sequence
  dgRNA
  Defb33
tctgactagtcagca

SEQ ID NO: 56350 - DNA, 15 bp, Artificial Sequence
  dgRNA
  Defb33
tcagcagggtcatag

SEQ ID NO: 56351 - DNA, 15 bp, Artificial Sequence
  dgRNA
  Mzf1
acaaaagagatccgg

SEQ ID NO: 56352 - DNA, 15 bp, Artificial Sequence
  dgRNA
  Mzf1
tttcagtggttccgc

SEQ ID NO: 56353 - DNA, 15 bp, Artificial Sequence
  dgRNA
  Mzf1
ccgcaggtagcccag

SEQ ID NO: 56354 - DNA, 15 bp, Artificial Sequence
  dgRNA
  Mzf1
ctaagggaccaaacc

SEQ ID NO: 56355 - DNA, 15 bp, Artificial Sequence
  dgRNA
  Gprasp2
tacagtgggtccggg

SEQ ID NO: 56356 - DNA, 15 bp, Artificial Sequence
  dgRNA
  Gprasp2
acagtgggtccggga

SEQ ID NO: 56357 - DNA, 15 bp, Artificial Sequence
  dgRNA
  Gprasp2
cagtgggtccgggag

SEQ ID NO: 56358 - DNA, 15 bp, Artificial Sequence
  dgRNA
  Gprasp2
acctagagtctatga

SEQ ID NO: 56359 - DNA, 15 bp, Artificial Sequence
  dgRNA
  Sertad3
taccagactccaccg

SEQ ID NO: 56360 - DNA, 15 bp, Artificial Sequence
  dgRNA
  Sertad3
gtagccaacctaaac

SEQ ID NO: 56361 - DNA, 15 bp, Artificial Sequence
  dgRNA
  Sertad3
aacctaaaccggacc

SEQ ID NO: 56362 - DNA, 15 bp, Artificial Sequence
  dgRNA
  Sertad3
gacccggcccagtga

SEQ ID NO: 56363 - DNA, 15 bp, Artificial Sequence
  dgRNA
  Scgb2b2
ttcttcagattgggc

SEQ ID NO: 56364 - DNA, 15 bp, Artificial Sequence
  dgRNA
  Scgb2b2
ctccccagttcaagg

SEQ ID NO: 56365 - DNA, 15 bp, Artificial Sequence
  dgRNA
  Olfr1196
ttaattaagcccttt

SEQ ID NO: 56366 - DNA, 15 bp, Artificial Sequence
  dgRNA
  Jph2
gcaggcccagcggat

SEQ ID NO: 56367 - DNA, 15 bp, Artificial Sequence
  dgRNA
  Jph2
tccctccggctctga

SEQ ID NO: 56368 - DNA, 15 bp, Artificial Sequence
  dgRNA
  Jph2
ctccggctctgaagg

SEQ ID NO: 56369 - DNA, 15 bp, Artificial Sequence
  dgRNA
  Jph2
ccaatggccttgtta

SEQ ID NO: 56370 - DNA, 15 bp, Artificial Sequence
  dgRNA
  Tepp
gatgcttgtcttatg

SEQ ID NO: 56371 - DNA, 15 bp, Artificial Sequence
  dgRNA
  Tepp
gatgtccagtgccta

SEQ ID NO: 56372 - DNA, 15 bp, Artificial Sequence
  dgRNA
  Tepp
ttcgtcctcacaatc

SEQ ID NO: 56373 - DNA, 15 bp, Artificial Sequence
  dgRNA
  Tepp
acaatcaggttgcac

SEQ ID NO: 56374 - DNA, 15 bp, Artificial Sequence
  dgRNA
  Rab3a
ggcctctaaagacgt

SEQ ID NO: 56375 - DNA, 15 bp, Artificial Sequence
  dgRNA
  Rab3a
cgctgatttgatatt

SEQ ID NO: 56376 - DNA, 15 bp, Artificial Sequence
  dgRNA
  Rab3a
agccccgtcttccag

SEQ ID NO: 56377 - DNA, 15 bp, Artificial Sequence
  dgRNA
  Rab3a
ttccagtggcttacc

SEQ ID NO: 56378 - DNA, 15 bp, Artificial Sequence
  dgRNA
  Olfr1030
aaaccactccgggtg

SEQ ID NO: 56379 - DNA, 15 bp, Artificial Sequence
  dgRNA
  Ost4
agtgggtttaggcga

SEQ ID NO: 56380 - DNA, 15 bp, Artificial Sequence
  dgRNA
  Ost4
gagtgggtttaggcg

SEQ ID NO: 56381 - DNA, 15 bp, Artificial Sequence
  dgRNA
  Dennd2d
agagttctactcctc

SEQ ID NO: 56382 - DNA, 15 bp, Artificial Sequence
  dgRNA
  Dennd2d
ctcctccggatagtt

SEQ ID NO: 56383 - DNA, 15 bp, Artificial Sequence
  dgRNA
  Dennd2d
tagtttggaaacacc

SEQ ID NO: 56384 - DNA, 15 bp, Artificial Sequence
  dgRNA
  Dennd2d
ggtgaagtttcacaa

SEQ ID NO: 56385 - DNA, 15 bp, Artificial Sequence
  dgRNA
  Pard3
gccagcgcgactcgg

SEQ ID NO: 56386 - DNA, 15 bp, Artificial Sequence
  dgRNA
  Pard3
cgactcggtggctct

SEQ ID NO: 56387 - DNA, 15 bp, Artificial Sequence
  dgRNA
  Pard3
gactcggtggctctc

SEQ ID NO: 56388 - DNA, 15 bp, Artificial Sequence
  dgRNA
  Pard3
gctctcgggctctaa

SEQ ID NO: 56389 - DNA, 15 bp, Artificial Sequence
  dgRNA
  Aqp11
gtggagtacagtttc

SEQ ID NO: 56390 - DNA, 15 bp, Artificial Sequence
  dgRNA
  Aqp11
gctctagcaccagcg

SEQ ID NO: 56391 - DNA, 15 bp, Artificial Sequence
  dgRNA
  Aqp11
agcaccagcgtggtg

SEQ ID NO: 56392 - DNA, 15 bp, Artificial Sequence
  dgRNA
  Aqp11
gcgtggtgcggtctt

SEQ ID NO: 56393 - DNA, 15 bp, Artificial Sequence
  dgRNA
  Cdk16
taaaaaaccgtacag

SEQ ID NO: 56394 - DNA, 15 bp, Artificial Sequence
  dgRNA
  Cdk16
aaaaccgtacagagg

SEQ ID NO: 56395 - DNA, 15 bp, Artificial Sequence
  dgRNA
  Cdk16
accgtacagaggagg

SEQ ID NO: 56396 - DNA, 15 bp, Artificial Sequence
  dgRNA
  Cdk16
ctcagccctgacgca

SEQ ID NO: 56397 - DNA, 15 bp, Artificial Sequence
  dgRNA
  Mkl1
gtgtctgatctccga

SEQ ID NO: 56398 - DNA, 15 bp, Artificial Sequence
  dgRNA
  Mkl1
gggctaacgcagttt

SEQ ID NO: 56399 - DNA, 15 bp, Artificial Sequence
  dgRNA
  Mkl1
caaaactctactaga

SEQ ID NO: 56400 - DNA, 15 bp, Artificial Sequence
  dgRNA
  Mkl1
tcctctctaggggca

SEQ ID NO: 56401 - DNA, 15 bp, Artificial Sequence
  dgRNA
  Ubqlnl
tcagatcatgccctt

SEQ ID NO: 56402 - DNA, 15 bp, Artificial Sequence
  dgRNA
  Ubqlnl
cagatcatgccctta

SEQ ID NO: 56403 - DNA, 15 bp, Artificial Sequence
  dgRNA
  Ubqlnl
agatcatgcccttag

SEQ ID NO: 56404 - DNA, 15 bp, Artificial Sequence
  dgRNA
  Ubqlnl
tcatgcccttagggg

SEQ ID NO: 56405 - DNA, 15 bp, Artificial Sequence
  dgRNA
  Itih2
gttattcaaacagca

SEQ ID NO: 56406 - DNA, 15 bp, Artificial Sequence
  dgRNA
  Itih2
actttgctcaaattc

SEQ ID NO: 56407 - DNA, 15 bp, Artificial Sequence
  dgRNA
  Zfp407
gacacgcagagccgc

SEQ ID NO: 56408 - DNA, 15 bp, Artificial Sequence
  dgRNA
  Zfp407
gccgccggccattcg

SEQ ID NO: 56409 - DNA, 15 bp, Artificial Sequence
  dgRNA
  Zfp407
ccgccggccattcga

SEQ ID NO: 56410 - DNA, 15 bp, Artificial Sequence
  dgRNA
  Zfp407
cgccggccattcgag

SEQ ID NO: 56411 - DNA, 15 bp, Artificial Sequence
  dgRNA
  Tm9sf1
cccgcacaacttgca

SEQ ID NO: 56412 - DNA, 15 bp, Artificial Sequence
  dgRNA
  Tm9sf1
tccagaaagcctcgg

SEQ ID NO: 56413 - DNA, 15 bp, Artificial Sequence
  dgRNA
  Tm9sf1
ccagaaagcctcgga

SEQ ID NO: 56414 - DNA, 15 bp, Artificial Sequence
  dgRNA
  Tm9sf1
cagaaagcctcggag

SEQ ID NO: 56415 - DNA, 15 bp, Artificial Sequence
  dgRNA
  Nfs1
ccaccaccctcgcga

SEQ ID NO: 56416 - DNA, 15 bp, Artificial Sequence
  dgRNA
  Nfs1
ccaccctcgcgatgg

SEQ ID NO: 56417 - DNA, 15 bp, Artificial Sequence
  dgRNA
  Nfs1
ccgcacgcgcgacgc

SEQ ID NO: 56418 - DNA, 15 bp, Artificial Sequence
  dgRNA
  Nfs1
acgcaggccactgtc

SEQ ID NO: 56419 - DNA, 15 bp, Artificial Sequence
  dgRNA
  C1ra
cgaggtgtacaggtg

SEQ ID NO: 56420 - DNA, 15 bp, Artificial Sequence
  dgRNA
  C1ra
ggcaccgaggtgtac

SEQ ID NO: 56421 - DNA, 15 bp, Artificial Sequence
  dgRNA
  C1ra
caattcttattcacc

SEQ ID NO: 56422 - DNA, 15 bp, Artificial Sequence
  dgRNA
  C1ra
tgtggaggcacttaa

SEQ ID NO: 56423 - DNA, 15 bp, Artificial Sequence
  dgRNA
  Morc4
ggaggagcgtctgtc

SEQ ID NO: 56424 - DNA, 15 bp, Artificial Sequence
  dgRNA
  Gm5622
tcctaggagtggatc

SEQ ID NO: 56425 - DNA, 15 bp, Artificial Sequence
  dgRNA
  Gm5622
agtggatcgggccca

SEQ ID NO: 56426 - DNA, 15 bp, Artificial Sequence
  dgRNA
  Gm5622
gcccgatccactcct

SEQ ID NO: 56427 - DNA, 15 bp, Artificial Sequence
  dgRNA
  Rspo1
ctaacccaagaaaag

SEQ ID NO: 56428 - DNA, 15 bp, Artificial Sequence
  dgRNA
  Rspo1
gtgcgggtcggagaa

SEQ ID NO: 56429 - DNA, 15 bp, Artificial Sequence
  dgRNA
  Rspo1
tgcgggtcggagaaa

SEQ ID NO: 56430 - DNA, 15 bp, Artificial Sequence
  dgRNA
  Rspo1
tcgccatacagcaga

SEQ ID NO: 56431 - DNA, 15 bp, Artificial Sequence
  dgRNA
  Scgb1b24
ttgactaagatatta

SEQ ID NO: 56432 - DNA, 15 bp, Artificial Sequence
  dgRNA
  Scgb1b24
gggaggcatcgggtg

SEQ ID NO: 56433 - DNA, 15 bp, Artificial Sequence
  dgRNA
  Scgb1b24
ggtggggttcaaata

SEQ ID NO: 56434 - DNA, 15 bp, Artificial Sequence
  dgRNA
  Scgb1b24
cgtgtgcttgtgtca

SEQ ID NO: 56435 - DNA, 15 bp, Artificial Sequence
  dgRNA
  Got1l1
tagccagcaatgagt

SEQ ID NO: 56436 - DNA, 15 bp, Artificial Sequence
  dgRNA
  Got1l1
tgaacattgctaccc

SEQ ID NO: 56437 - DNA, 15 bp, Artificial Sequence
  dgRNA
  Got1l1
aacattccatggccc

SEQ ID NO: 56438 - DNA, 15 bp, Artificial Sequence
  dgRNA
  Got1l1
atgttcaggacgtac

SEQ ID NO: 56439 - DNA, 15 bp, Artificial Sequence
  dgRNA
  Il18r1
gcgccctctgcctga

SEQ ID NO: 56440 - DNA, 15 bp, Artificial Sequence
  dgRNA
  Il18r1
gggtgtggcgcgcac

SEQ ID NO: 56441 - DNA, 15 bp, Artificial Sequence
  dgRNA
  Il18r1
ggtgtggcgcgcaca

SEQ ID NO: 56442 - DNA, 15 bp, Artificial Sequence
  dgRNA
  Il18r1
tgtggttgagtagac

SEQ ID NO: 56443 - DNA, 15 bp, Artificial Sequence
  dgRNA
  Abcg8
aactgaggagccaat

SEQ ID NO: 56444 - DNA, 15 bp, Artificial Sequence
  dgRNA
  Abcg8
ccttatctcgacaat

SEQ ID NO: 56445 - DNA, 15 bp, Artificial Sequence
  dgRNA
  Abcg8
acacggtgtgtttat

SEQ ID NO: 56446 - DNA, 15 bp, Artificial Sequence
  dgRNA
  Abcg8
gccctggagccggac

SEQ ID NO: 56447 - DNA, 15 bp, Artificial Sequence
  dgRNA
  Zfand2a
tctagaaaataggcg

SEQ ID NO: 56448 - DNA, 15 bp, Artificial Sequence
  dgRNA
  Zfand2a
ctagaaaataggcgg

SEQ ID NO: 56449 - DNA, 15 bp, Artificial Sequence
  dgRNA
  Zfand2a
tagaaaataggcggg

SEQ ID NO: 56450 - DNA, 15 bp, Artificial Sequence
  dgRNA
  Zfand2a
aataggcggggggat

SEQ ID NO: 56451 - DNA, 15 bp, Artificial Sequence
  dgRNA
  Pten
tgttgtacctttgcc

SEQ ID NO: 56452 - DNA, 15 bp, Artificial Sequence
  dgRNA
  Pten
aagccggcgtagctc

SEQ ID NO: 56453 - DNA, 15 bp, Artificial Sequence
  dgRNA
  Pten
agccggcgtagctcc

SEQ ID NO: 56454 - DNA, 15 bp, Artificial Sequence
  dgRNA
  Pten
tccgggagcgagccg

SEQ ID NO: 56455 - DNA, 15 bp, Artificial Sequence
  dgRNA
  Nsl1
catagctactcctgc

SEQ ID NO: 56456 - DNA, 15 bp, Artificial Sequence
  dgRNA
  Nsl1
tctcgactgcaagcc

SEQ ID NO: 56457 - DNA, 15 bp, Artificial Sequence
  dgRNA
  Nsl1
cgactgcaagccagg

SEQ ID NO: 56458 - DNA, 15 bp, Artificial Sequence
  dgRNA
  Nsl1
caggcggcggaactc

SEQ ID NO: 56459 - DNA, 15 bp, Artificial Sequence
  dgRNA
  Gmeb2
acagaacacctaatt

SEQ ID NO: 56460 - DNA, 15 bp, Artificial Sequence
  dgRNA
  Gmeb2
aacacctaattgggc

SEQ ID NO: 56461 - DNA, 15 bp, Artificial Sequence
  dgRNA
  Gmeb2
gcagaccacacgcgc

SEQ ID NO: 56462 - DNA, 15 bp, Artificial Sequence
  dgRNA
  Gmeb2
cgcacaagagtccta

SEQ ID NO: 56463 - DNA, 15 bp, Artificial Sequence
  dgRNA
  BC068281
tggtgatcaactagc

SEQ ID NO: 56464 - DNA, 15 bp, Artificial Sequence
  dgRNA
  BC068281
cttgagtggcattaa

SEQ ID NO: 56465 - DNA, 15 bp, Artificial Sequence
  dgRNA
  BC068281
aggcaatcttgccta

SEQ ID NO: 56466 - DNA, 15 bp, Artificial Sequence
  dgRNA
  BC068281
caaaggggcgtggtg

SEQ ID NO: 56467 - DNA, 15 bp, Artificial Sequence
  dgRNA
  Myh8
atgagaaggcccacc

SEQ ID NO: 56468 - DNA, 15 bp, Artificial Sequence
  dgRNA
  Myh8
ctacaaacttcgccg

SEQ ID NO: 56469 - DNA, 15 bp, Artificial Sequence
  dgRNA
  Myh8
tacaaacttcgccga

SEQ ID NO: 56470 - DNA, 15 bp, Artificial Sequence
  dgRNA
  Myh8
ttgacagcgcctggt

SEQ ID NO: 56471 - DNA, 15 bp, Artificial Sequence
  dgRNA
  Aph1b
gactagaggacctcg

SEQ ID NO: 56472 - DNA, 15 bp, Artificial Sequence
  dgRNA
  Aph1b
gccgtccactctgat

SEQ ID NO: 56473 - DNA, 15 bp, Artificial Sequence
  dgRNA
  Aph1b
cactctgataggcta

SEQ ID NO: 56474 - DNA, 15 bp, Artificial Sequence
  dgRNA
  Aph1b
ctatggaactcttcc

SEQ ID NO: 56475 - DNA, 15 bp, Artificial Sequence
  dgRNA
  Kctd18
atcctgttccaccag

SEQ ID NO: 56476 - DNA, 15 bp, Artificial Sequence
  dgRNA
  Kctd18
gaggggcctagactc

SEQ ID NO: 56477 - DNA, 15 bp, Artificial Sequence
  dgRNA
  Kctd18
actccgggaaaattc

SEQ ID NO: 56478 - DNA, 15 bp, Artificial Sequence
  dgRNA
  Kctd18
attcaggaacgttct

SEQ ID NO: 56479 - DNA, 15 bp, Artificial Sequence
  dgRNA
  Fam102b
gcccagcttccccgg

SEQ ID NO: 56480 - DNA, 15 bp, Artificial Sequence
  dgRNA
  Fam102b
cccagcttccccggc

SEQ ID NO: 56481 - DNA, 15 bp, Artificial Sequence
  dgRNA
  Fam102b
ccagcttccccggcg

SEQ ID NO: 56482 - DNA, 15 bp, Artificial Sequence
  dgRNA
  Fam102b
ctcctccgccctccg

SEQ ID NO: 56483 - DNA, 15 bp, Artificial Sequence
  dgRNA
  Abcb1a
atacttgagtcaagc

SEQ ID NO: 56484 - DNA, 15 bp, Artificial Sequence
  dgRNA
  Abcb1a
tacttgagtcaagct

SEQ ID NO: 56485 - DNA, 15 bp, Artificial Sequence
  dgRNA
  Abcb1a
agctggttaacctcc

SEQ ID NO: 56486 - DNA, 15 bp, Artificial Sequence
  dgRNA
  Abcb1a
ccaggtcaaactcac

SEQ ID NO: 56487 - DNA, 15 bp, Artificial Sequence
  dgRNA
  Mga
tactaaaatgcgaaa

SEQ ID NO: 56488 - DNA, 15 bp, Artificial Sequence
  dgRNA
  Mga
aatgcgaaaaggcta

SEQ ID NO: 56489 - DNA, 15 bp, Artificial Sequence
  dgRNA
  Mga
aaaaggctacggctt

SEQ ID NO: 56490 - DNA, 15 bp, Artificial Sequence
  dgRNA
  Mga
acggcttcggctccg

SEQ ID NO: 56491 - DNA, 15 bp, Artificial Sequence
  dgRNA
  Ankrd33
acttcccacgatgaa

SEQ ID NO: 56492 - DNA, 15 bp, Artificial Sequence
  dgRNA
  Ankrd33
gaaagatcagcccgg

SEQ ID NO: 56493 - DNA, 15 bp, Artificial Sequence
  dgRNA
  Ankrd33
ccatccaagtctagc

SEQ ID NO: 56494 - DNA, 15 bp, Artificial Sequence
  dgRNA
  Ankrd33
gtctagcaggatctt

SEQ ID NO: 56495 - DNA, 15 bp, Artificial Sequence
  dgRNA
  Sh2b3
cggagggcggcctgg

SEQ ID NO: 56496 - DNA, 15 bp, Artificial Sequence
  dgRNA
  Sh2b3
gcggagggcggcctg

SEQ ID NO: 56497 - DNA, 15 bp, Artificial Sequence
  dgRNA
  Sh2b3
ggcggagggcggcct

SEQ ID NO: 56498 - DNA, 15 bp, Artificial Sequence
  dgRNA
  Depdc1b
tccactgtgtgccgg

SEQ ID NO: 56499 - DNA, 15 bp, Artificial Sequence
  dgRNA
  Depdc1b
tgtgccggcggtacg

SEQ ID NO: 56500 - DNA, 15 bp, Artificial Sequence
  dgRNA
  Depdc1b
catccgagcgcccat

SEQ ID NO: 56501 - DNA, 15 bp, Artificial Sequence
  dgRNA
  Depdc1b
gagcgcccattggcg

SEQ ID NO: 56502 - DNA, 15 bp, Artificial Sequence
  dgRNA
  Comt
gctcagctcaataag

SEQ ID NO: 56503 - DNA, 15 bp, Artificial Sequence
  dgRNA
  Comt
cagctcaataagagg

SEQ ID NO: 56504 - DNA, 15 bp, Artificial Sequence
  dgRNA
  Comt
ctagaaccgatcatg

SEQ ID NO: 56505 - DNA, 15 bp, Artificial Sequence
  dgRNA
  Comt
tagaaccgatcatga

SEQ ID NO: 56506 - DNA, 15 bp, Artificial Sequence
  dgRNA
  Cib1
cacttgatttaggtg

SEQ ID NO: 56507 - DNA, 15 bp, Artificial Sequence
  dgRNA
  Cib1
ttgatttaggtgagg

SEQ ID NO: 56508 - DNA, 15 bp, Artificial Sequence
  dgRNA
  Cib1
ggcggatgcatctca

SEQ ID NO: 56509 - DNA, 15 bp, Artificial Sequence
  dgRNA
  Cib1
tgcacagacgggtcc

SEQ ID NO: 56510 - DNA, 15 bp, Artificial Sequence
  dgRNA
  Pcmtd1
aaacagcgacagaat

SEQ ID NO: 56511 - DNA, 15 bp, Artificial Sequence
  dgRNA
  Pcmtd1
cagcgacagaatagg

SEQ ID NO: 56512 - DNA, 15 bp, Artificial Sequence
  dgRNA
  Pcmtd1
gagccccagctctcg

SEQ ID NO: 56513 - DNA, 15 bp, Artificial Sequence
  dgRNA
  Pcmtd1
ctctcgcggcatccg

SEQ ID NO: 56514 - DNA, 15 bp, Artificial Sequence
  dgRNA
  Catsperb
taagacttataggct

SEQ ID NO: 56515 - DNA, 15 bp, Artificial Sequence
  dgRNA
  Catsperb
ttagtagcagctgat

SEQ ID NO: 56516 - DNA, 15 bp, Artificial Sequence
  dgRNA
  Catsperb
gctcttaccaaagtt

SEQ ID NO: 56517 - DNA, 15 bp, Artificial Sequence
  dgRNA
  Lmo1
atgcaagctgcactc

SEQ ID NO: 56518 - DNA, 15 bp, Artificial Sequence
  dgRNA
  Lmo1
gggaacccaagcgcg

SEQ ID NO: 56519 - DNA, 15 bp, Artificial Sequence
  dgRNA
  Lmo1
ccaagcgcgcggctg

SEQ ID NO: 56520 - DNA, 15 bp, Artificial Sequence
  dgRNA
  Lmo1
agcgcgcggctgcgg

SEQ ID NO: 56521 - DNA, 15 bp, Artificial Sequence
  dgRNA
  St8sia2
ggccgctagagttag

SEQ ID NO: 56522 - DNA, 15 bp, Artificial Sequence
  dgRNA
  St8sia2
gccgctagagttagt

SEQ ID NO: 56523 - DNA, 15 bp, Artificial Sequence
  dgRNA
  St8sia2
ctgtcaaactgcgcc

SEQ ID NO: 56524 - DNA, 15 bp, Artificial Sequence
  dgRNA
  St8sia2
ctggagcccagtgcg

SEQ ID NO: 56525 - DNA, 15 bp, Artificial Sequence
  dgRNA
  Pcdh11x
gcgggggcgagactg

SEQ ID NO: 56526 - DNA, 15 bp, Artificial Sequence
  dgRNA
  Pcdh11x
tcaggagcggtgcgg

SEQ ID NO: 56527 - DNA, 15 bp, Artificial Sequence
  dgRNA
  Pcdh11x
ctcaggagcggtgcg

SEQ ID NO: 56528 - DNA, 15 bp, Artificial Sequence
  dgRNA
  Pcdh11x
cctcaggagcggtgc

SEQ ID NO: 56529 - DNA, 15 bp, Artificial Sequence
  dgRNA
  Thap2
ccccgtctgagacgc

SEQ ID NO: 56530 - DNA, 15 bp, Artificial Sequence
  dgRNA
  Thap2
tggacctagtctctt

SEQ ID NO: 56531 - DNA, 15 bp, Artificial Sequence
  dgRNA
  Thap2
ggacctagtctcttt

SEQ ID NO: 56532 - DNA, 15 bp, Artificial Sequence
  dgRNA
  Thap2
tctctttgggacccc

SEQ ID NO: 56533 - DNA, 15 bp, Artificial Sequence
  dgRNA
  Ctns
cttgcacagggctcg

SEQ ID NO: 56534 - DNA, 15 bp, Artificial Sequence
  dgRNA
  Ctns
tcgcggcttcaagtc

SEQ ID NO: 56535 - DNA, 15 bp, Artificial Sequence
  dgRNA
  Ctns
tctagtctcttgtag

SEQ ID NO: 56536 - DNA, 15 bp, Artificial Sequence
  dgRNA
  Ctns
atctagtctcttgta

SEQ ID NO: 56537 - DNA, 15 bp, Artificial Sequence
  dgRNA
  Nudt2
aggcagatctcgcga

SEQ ID NO: 56538 - DNA, 15 bp, Artificial Sequence
  dgRNA
  Nudt2
aaaaaaccacgcctc

SEQ ID NO: 56539 - DNA, 15 bp, Artificial Sequence
  dgRNA
  Nudt2
aaaaccacgcctcag

SEQ ID NO: 56540 - DNA, 15 bp, Artificial Sequence
  dgRNA
  Nudt2
accacgcctcagggg

SEQ ID NO: 56541 - DNA, 15 bp, Artificial Sequence
  dgRNA
  Il1rl1
gaggtgtttagagat

SEQ ID NO: 56542 - DNA, 15 bp, Artificial Sequence
  dgRNA
  Hoxd4
gcaagttgaaaagcc

SEQ ID NO: 56543 - DNA, 15 bp, Artificial Sequence
  dgRNA
  Hoxd4
acctctctcgcattc

SEQ ID NO: 56544 - DNA, 15 bp, Artificial Sequence
  dgRNA
  Hoxd4
cgcattctggatatt

SEQ ID NO: 56545 - DNA, 15 bp, Artificial Sequence
  dgRNA
  Hoxd4
gccaaaggttattta

SEQ ID NO: 56546 - DNA, 15 bp, Artificial Sequence
  dgRNA
  P2rx5
ctctatttccccacg

SEQ ID NO: 56547 - DNA, 15 bp, Artificial Sequence
  dgRNA
  P2rx5
ttcgagcgagtcccg

SEQ ID NO: 56548 - DNA, 15 bp, Artificial Sequence
  dgRNA
  P2rx5
tcgagcgagtcccgt

SEQ ID NO: 56549 - DNA, 15 bp, Artificial Sequence
  dgRNA
  P2rx5
agcgagtcccgtggg

SEQ ID NO: 56550 - DNA, 15 bp, Artificial Sequence
  dgRNA
  Atxn2
cggggagagcgaacg

SEQ ID NO: 56551 - DNA, 15 bp, Artificial Sequence
  dgRNA
  Atxn2
tcacgtgtccctgat

SEQ ID NO: 56552 - DNA, 15 bp, Artificial Sequence
  dgRNA
  Atxn2
ccctgatcggccccc

SEQ ID NO: 56553 - DNA, 15 bp, Artificial Sequence
  dgRNA
  Atxn2
cctgatcggcccccc

SEQ ID NO: 56554 - DNA, 15 bp, Artificial Sequence
  dgRNA
  Eci3
tctttcgttccactc

SEQ ID NO: 56555 - DNA, 15 bp, Artificial Sequence
  dgRNA
  Eci3
cattcttaagcgtct

SEQ ID NO: 56556 - DNA, 15 bp, Artificial Sequence
  dgRNA
  Eci3
cccgagaaggtttca

SEQ ID NO: 56557 - DNA, 15 bp, Artificial Sequence
  dgRNA
  Eci3
gcccgagaaggtttc

SEQ ID NO: 56558 - DNA, 15 bp, Artificial Sequence
  dgRNA
  Fhdc1
caggggtttcgcggc

SEQ ID NO: 56559 - DNA, 15 bp, Artificial Sequence
  dgRNA
  Fhdc1
cgcggctggcctcca

SEQ ID NO: 56560 - DNA, 15 bp, Artificial Sequence
  dgRNA
  Fhdc1
gagatggtccgagac

SEQ ID NO: 56561 - DNA, 15 bp, Artificial Sequence
  dgRNA
  Fhdc1
agtgcggggcactca

SEQ ID NO: 56562 - DNA, 15 bp, Artificial Sequence
  dgRNA
  Mcts2
ggcccgttagctccc

SEQ ID NO: 56563 - DNA, 15 bp, Artificial Sequence
  dgRNA
  Mcts2
gcccgttagctcccg

SEQ ID NO: 56564 - DNA, 15 bp, Artificial Sequence
  dgRNA
  Mcts2
cccgttagctcccgg

SEQ ID NO: 56565 - DNA, 15 bp, Artificial Sequence
  dgRNA
  Mcts2
agtccgaacgcgaag

SEQ ID NO: 56566 - DNA, 15 bp, Artificial Sequence
  dgRNA
  Il1f5
ggtgtgaaaccattc

SEQ ID NO: 56567 - DNA, 15 bp, Artificial Sequence
  dgRNA
  Il1f5
gtacttaaaggacca

SEQ ID NO: 56568 - DNA, 15 bp, Artificial Sequence
  dgRNA
  Il1f5
accaatgatccaggg

SEQ ID NO: 56569 - DNA, 15 bp, Artificial Sequence
  dgRNA
  Il1f5
tacaccaatgatcca

SEQ ID NO: 56570 - DNA, 15 bp, Artificial Sequence
  dgRNA
  Vmn2r67
gatatcttacggaca

SEQ ID NO: 56571 - DNA, 15 bp, Artificial Sequence
  dgRNA
  Vmn2r67
atactctatatcctt

SEQ ID NO: 56572 - DNA, 15 bp, Artificial Sequence
  dgRNA
  Vmn2r67
tgtacctactattaa

SEQ ID NO: 56573 - DNA, 15 bp, Artificial Sequence
  dgRNA
  Hs1bp3
atggcatgaggtgcc

SEQ ID NO: 56574 - DNA, 15 bp, Artificial Sequence
  dgRNA
  Hs1bp3
ggtgccaggcttaag

SEQ ID NO: 56575 - DNA, 15 bp, Artificial Sequence
  dgRNA
  Hs1bp3
taagaggtggctatg

SEQ ID NO: 56576 - DNA, 15 bp, Artificial Sequence
  dgRNA
  Hs1bp3
acatccgctgccacc

SEQ ID NO: 56577 - DNA, 15 bp, Artificial Sequence
  dgRNA
  Dnajc22
aacggcagcgccatc

SEQ ID NO: 56578 - DNA, 15 bp, Artificial Sequence
  dgRNA
  Dnajc22
atgaagtgctgcaag

SEQ ID NO: 56579 - DNA, 15 bp, Artificial Sequence
  dgRNA
  Dnajc22
agaggtgcgcactgc

SEQ ID NO: 56580 - DNA, 15 bp, Artificial Sequence
  dgRNA
  Dnajc22
gaggtgcgcactgcc

SEQ ID NO: 56581 - DNA, 15 bp, Artificial Sequence
  dgRNA
  Tmem174
atactctgttaacca

SEQ ID NO: 56582 - DNA, 15 bp, Artificial Sequence
  dgRNA
  Tmem174
aacgacaatgttggg

SEQ ID NO: 56583 - DNA, 15 bp, Artificial Sequence
  dgRNA
  Tmem174
gacaacgacaatgtt

SEQ ID NO: 56584 - DNA, 15 bp, Artificial Sequence
  dgRNA
  Tmem174
cgacaacgacaatgt

SEQ ID NO: 56585 - DNA, 15 bp, Artificial Sequence
  dgRNA
  Def8
gctgatacactgtac

SEQ ID NO: 56586 - DNA, 15 bp, Artificial Sequence
  dgRNA
  Nkain3
aacatgtacctctcc

SEQ ID NO: 56587 - DNA, 15 bp, Artificial Sequence
  dgRNA
  Nkain3
acatgtacctctcca

SEQ ID NO: 56588 - DNA, 15 bp, Artificial Sequence
  dgRNA
  Nkain3
tctccagggcagcgt

SEQ ID NO: 56589 - DNA, 15 bp, Artificial Sequence
  dgRNA
  Nkain3
ggtaaacctagctcc

SEQ ID NO: 56590 - DNA, 15 bp, Artificial Sequence
  dgRNA
  Gsr
tcgtaatatccagct

SEQ ID NO: 56591 - DNA, 15 bp, Artificial Sequence
  dgRNA
  Gsr
atccagcttggagtg

SEQ ID NO: 56592 - DNA, 15 bp, Artificial Sequence
  dgRNA
  Gsr
ctcatttcttagccg

SEQ ID NO: 56593 - DNA, 15 bp, Artificial Sequence
  dgRNA
  Gsr
tcatttcttagccgt

SEQ ID NO: 56594 - DNA, 15 bp, Artificial Sequence
  dgRNA
  Pxk
ggcgccaagagagca

SEQ ID NO: 56595 - DNA, 15 bp, Artificial Sequence
  dgRNA
  Pxk
gcgccaagagagcaa

SEQ ID NO: 56596 - DNA, 15 bp, Artificial Sequence
  dgRNA
  Pxk
ccctgccgtgaagaa

SEQ ID NO: 56597 - DNA, 15 bp, Artificial Sequence
  dgRNA
  Pxk
gtgaagaacggcgct

SEQ ID NO: 56598 - DNA, 15 bp, Artificial Sequence
  dgRNA
  Ago1
ctgcacggctacgag

SEQ ID NO: 56599 - DNA, 15 bp, Artificial Sequence
  dgRNA
  Ago1
acgagtggccgccag

SEQ ID NO: 56600 - DNA, 15 bp, Artificial Sequence
  dgRNA
  Ago1
ttcccgtccgcccca

SEQ ID NO: 56601 - DNA, 15 bp, Artificial Sequence
  dgRNA
  Ago1
tcccgtccgccccat

SEQ ID NO: 56602 - DNA, 15 bp, Artificial Sequence
  dgRNA
  1700024G13Rik
ttgagttagtttaag

SEQ ID NO: 56603 - DNA, 15 bp, Artificial Sequence
  dgRNA
  Rs1
ttcccctacaaatag

SEQ ID NO: 56604 - DNA, 15 bp, Artificial Sequence
  dgRNA
  Rs1
ggttatttactcagc

SEQ ID NO: 56605 - DNA, 15 bp, Artificial Sequence
  dgRNA
  Rs1
gtcggagaaagaatt

SEQ ID NO: 56606 - DNA, 15 bp, Artificial Sequence
  dgRNA
  Rs1
tcggagaaagaatta

SEQ ID NO: 56607 - DNA, 15 bp, Artificial Sequence
  dgRNA
  Olfr782
gtattgcccctttgg

SEQ ID NO: 56608 - DNA, 15 bp, Artificial Sequence
  dgRNA
  Olfr782
ggtattgcccctttg

SEQ ID NO: 56609 - DNA, 15 bp, Artificial Sequence
  dgRNA
  Olfr782
tggtattgccccttt

SEQ ID NO: 56610 - DNA, 15 bp, Artificial Sequence
  dgRNA
  Olfr782
atggtattgcccctt

SEQ ID NO: 56611 - DNA, 15 bp, Artificial Sequence
  dgRNA
  5031414D18Rik
agaacggagccctgt

SEQ ID NO: 56612 - DNA, 15 bp, Artificial Sequence
  dgRNA
  5031414D18Rik
ccctgtaggcgaagc

SEQ ID NO: 56613 - DNA, 15 bp, Artificial Sequence
  dgRNA
  5031414D18Rik
cctgtaggcgaagca

SEQ ID NO: 56614 - DNA, 15 bp, Artificial Sequence
  dgRNA
  5031414D18Rik
ccgtgcgccacctag

SEQ ID NO: 56615 - DNA, 15 bp, Artificial Sequence
  dgRNA
  Dcc
ggcaaacgcagctgc

SEQ ID NO: 56616 - DNA, 15 bp, Artificial Sequence
  dgRNA
  Dcc
cccctaagcttcgct

SEQ ID NO: 56617 - DNA, 15 bp, Artificial Sequence
  dgRNA
  Dcc
ccgccccccattgcg

SEQ ID NO: 56618 - DNA, 15 bp, Artificial Sequence
  dgRNA
  Dcc
cagttcgtttccctc

SEQ ID NO: 56619 - DNA, 15 bp, Artificial Sequence
  dgRNA
  Clrn2
aaaccctagtctgtt

SEQ ID NO: 56620 - DNA, 15 bp, Artificial Sequence
  dgRNA
  Clrn2
ctgttgggagatata

SEQ ID NO: 56621 - DNA, 15 bp, Artificial Sequence
  dgRNA
  Clrn2
tagggttacttcctt

SEQ ID NO: 56622 - DNA, 15 bp, Artificial Sequence
  dgRNA
  Clrn2
gctatatcaagcaag

SEQ ID NO: 56623 - DNA, 15 bp, Artificial Sequence
  dgRNA
  Clstn3
gctccccagtcgcat

SEQ ID NO: 56624 - DNA, 15 bp, Artificial Sequence
  dgRNA
  Clstn3
cccccttgcagcacc

SEQ ID NO: 56625 - DNA, 15 bp, Artificial Sequence
  dgRNA
  Clstn3
gggtagaagatacga

SEQ ID NO: 56626 - DNA, 15 bp, Artificial Sequence
  dgRNA
  Clstn3
ctgcgggggctagag

SEQ ID NO: 56627 - DNA, 15 bp, Artificial Sequence
  dgRNA
  Prph
ctccccggagaccgc

SEQ ID NO: 56628 - DNA, 15 bp, Artificial Sequence
  dgRNA
  Prph
tccccggagaccgca

SEQ ID NO: 56629 - DNA, 15 bp, Artificial Sequence
  dgRNA
  Prph
aaagccgccccgcat

SEQ ID NO: 56630 - DNA, 15 bp, Artificial Sequence
  dgRNA
  Prph
attcccccttgttgc

SEQ ID NO: 56631 - DNA, 15 bp, Artificial Sequence
  dgRNA
  Get4
tcccgcccaagacct

SEQ ID NO: 56632 - DNA, 15 bp, Artificial Sequence
  dgRNA
  Get4
agagccccaccccgt

SEQ ID NO: 56633 - DNA, 15 bp, Artificial Sequence
  dgRNA
  Get4
cccgtcggcttttcc

SEQ ID NO: 56634 - DNA, 15 bp, Artificial Sequence
  dgRNA
  Get4
ctcagaccccccctc

SEQ ID NO: 56635 - DNA, 15 bp, Artificial Sequence
  dgRNA
  Lrrk2
aaccgctttcctgaa

SEQ ID NO: 56636 - DNA, 15 bp, Artificial Sequence
  dgRNA
  Lrrk2
accgctttcctgaaa

SEQ ID NO: 56637 - DNA, 15 bp, Artificial Sequence
  dgRNA
  Lrrk2
ccgctttcctgaaag

SEQ ID NO: 56638 - DNA, 15 bp, Artificial Sequence
  dgRNA
  Lrrk2
tgaaaggggccaact

SEQ ID NO: 56639 - DNA, 15 bp, Artificial Sequence
  dgRNA
  Klk13
taagtaggtggcttc

SEQ ID NO: 56640 - DNA, 15 bp, Artificial Sequence
  dgRNA
  Klk13
gtttagggaataagt

SEQ ID NO: 56641 - DNA, 15 bp, Artificial Sequence
  dgRNA
  Klk13
agcccggatgggatg

SEQ ID NO: 56642 - DNA, 15 bp, Artificial Sequence
  dgRNA
  Klk13
aagcccggatgggat

SEQ ID NO: 56643 - DNA, 15 bp, Artificial Sequence
  dgRNA
  Olfr417
taaattttgctaaac

SEQ ID NO: 56644 - DNA, 15 bp, Artificial Sequence
  dgRNA
  Olfr417
tacgaatataacaca

SEQ ID NO: 56645 - DNA, 15 bp, Artificial Sequence
  dgRNA
  Smco2
cctgaggccagttga

SEQ ID NO: 56646 - DNA, 15 bp, Artificial Sequence
  dgRNA
  Smco2
tggccctagccctag

SEQ ID NO: 56647 - DNA, 15 bp, Artificial Sequence
  dgRNA
  Smco2
ggctaagaggcgagc

SEQ ID NO: 56648 - DNA, 15 bp, Artificial Sequence
  dgRNA
  Smco2
ggagcttcgcatgct

SEQ ID NO: 56649 - DNA, 15 bp, Artificial Sequence
  dgRNA
  Uhmk1
ttccttgcgcattca

SEQ ID NO: 56650 - DNA, 15 bp, Artificial Sequence
  dgRNA
  Uhmk1
caattttccccctgg

SEQ ID NO: 56651 - DNA, 15 bp, Artificial Sequence
  dgRNA
  Uhmk1
tcccccacttccggc

SEQ ID NO: 56652 - DNA, 15 bp, Artificial Sequence
  dgRNA
  Uhmk1
gcgcaaggaaggccc

SEQ ID NO: 56653 - DNA, 15 bp, Artificial Sequence
  dgRNA
  Il25
ccctctaaaagatag

SEQ ID NO: 56654 - DNA, 15 bp, Artificial Sequence
  dgRNA
  Il25
taaatgctaccctca

SEQ ID NO: 56655 - DNA, 15 bp, Artificial Sequence
  dgRNA
  Il25
ccactatcttttaga

SEQ ID NO: 56656 - DNA, 15 bp, Artificial Sequence
  dgRNA
  Il25
tccactatcttttag

SEQ ID NO: 56657 - DNA, 15 bp, Artificial Sequence
  dgRNA
  Erf
aagccaagagccggc

SEQ ID NO: 56658 - DNA, 15 bp, Artificial Sequence
  dgRNA
  Erf
ccggccggtcctcag

SEQ ID NO: 56659 - DNA, 15 bp, Artificial Sequence
  dgRNA
  Erf
tcagtggctgcgcgc

SEQ ID NO: 56660 - DNA, 15 bp, Artificial Sequence
  dgRNA
  Erf
tgtgagtgcgcggga

SEQ ID NO: 56661 - DNA, 15 bp, Artificial Sequence
  dgRNA
  Odf1
aagaatcttacaacg

SEQ ID NO: 56662 - DNA, 15 bp, Artificial Sequence
  dgRNA
  Odf1
cttacaacgaggctc

SEQ ID NO: 56663 - DNA, 15 bp, Artificial Sequence
  dgRNA
  Odf1
ggctcaggcctttaa

SEQ ID NO: 56664 - DNA, 15 bp, Artificial Sequence
  dgRNA
  Odf1
gctcaggcctttaat

SEQ ID NO: 56665 - DNA, 15 bp, Artificial Sequence
  dgRNA
  Hltf
atgttttaccgtgca

SEQ ID NO: 56666 - DNA, 15 bp, Artificial Sequence
  dgRNA
  Hltf
ccgtgcaaggcgtct

SEQ ID NO: 56667 - DNA, 15 bp, Artificial Sequence
  dgRNA
  Hltf
aggcgtctcggactg

SEQ ID NO: 56668 - DNA, 15 bp, Artificial Sequence
  dgRNA
  Hltf
gactgcggaagaacc

SEQ ID NO: 56669 - DNA, 15 bp, Artificial Sequence
  dgRNA
  Rexo1
gcacccgcgaaagtc

SEQ ID NO: 56670 - DNA, 15 bp, Artificial Sequence
  dgRNA
  Rexo1
gcgaaagtccggtgc

SEQ ID NO: 56671 - DNA, 15 bp, Artificial Sequence
  dgRNA
  Rexo1
aagtccggtgccgga

SEQ ID NO: 56672 - DNA, 15 bp, Artificial Sequence
  dgRNA
  Rexo1
tgccggaaggttctc

SEQ ID NO: 56673 - DNA, 15 bp, Artificial Sequence
  dgRNA
  Olig1
ctgtggcacccgcgc

SEQ ID NO: 56674 - DNA, 15 bp, Artificial Sequence
  dgRNA
  Olig1
cacgataaccctctc

SEQ ID NO: 56675 - DNA, 15 bp, Artificial Sequence
  dgRNA
  Olig1
atgaacactcgcctg

SEQ ID NO: 56676 - DNA, 15 bp, Artificial Sequence
  dgRNA
  Olig1
agctcacgcctccat

SEQ ID NO: 56677 - DNA, 15 bp, Artificial Sequence
  dgRNA
  Olfr393
cctgcaaaaggtagt

SEQ ID NO: 56678 - DNA, 15 bp, Artificial Sequence
  dgRNA
  Olfr393
gcaaaaggtagttgg

SEQ ID NO: 56679 - DNA, 15 bp, Artificial Sequence
  dgRNA
  Olfr393
ccaactaccttttgc

SEQ ID NO: 56680 - DNA, 15 bp, Artificial Sequence
  dgRNA
  Snrpf
ccaagtccgttcgcc

SEQ ID NO: 56681 - DNA, 15 bp, Artificial Sequence
  dgRNA
  Snrpf
caagtccgttcgcca

SEQ ID NO: 56682 - DNA, 15 bp, Artificial Sequence
  dgRNA
  Snrpf
ccgaagcaaagacat

SEQ ID NO: 56683 - DNA, 15 bp, Artificial Sequence
  dgRNA
  Snrpf
cgaagcaaagacatt

SEQ ID NO: 56684 - DNA, 15 bp, Artificial Sequence
  dgRNA
  Haghl
atcgcgacagggaag

SEQ ID NO: 56685 - DNA, 15 bp, Artificial Sequence
  dgRNA
  Haghl
gaagtggtgatgtcg

SEQ ID NO: 56686 - DNA, 15 bp, Artificial Sequence
  dgRNA
  Haghl
gtggtgatgtcgcgg

SEQ ID NO: 56687 - DNA, 15 bp, Artificial Sequence
  dgRNA
  Haghl
tggtgatgtcgcggt

SEQ ID NO: 56688 - DNA, 15 bp, Artificial Sequence
  dgRNA
  Sugp1
gtgcggcctgtgcgg

SEQ ID NO: 56689 - DNA, 15 bp, Artificial Sequence
  dgRNA
  Sugp1
ggcggaagcaccttg

SEQ ID NO: 56690 - DNA, 15 bp, Artificial Sequence
  dgRNA
  Sugp1
gcggaagcaccttga

SEQ ID NO: 56691 - DNA, 15 bp, Artificial Sequence
  dgRNA
  Sugp1
cggaagcaccttgag

SEQ ID NO: 56692 - DNA, 15 bp, Artificial Sequence
  dgRNA
  Hs3st5
tgcctattggagcta

SEQ ID NO: 56693 - DNA, 15 bp, Artificial Sequence
  dgRNA
  Hs3st5
acaggagcggctacg

SEQ ID NO: 56694 - DNA, 15 bp, Artificial Sequence
  dgRNA
  Hs3st5
caggagcggctacga

SEQ ID NO: 56695 - DNA, 15 bp, Artificial Sequence
  dgRNA
  Hs3st5
aggagcggctacgag

SEQ ID NO: 56696 - DNA, 15 bp, Artificial Sequence
  dgRNA
  Morn5
caagtcccctttggc

SEQ ID NO: 56697 - DNA, 15 bp, Artificial Sequence
  dgRNA
  Morn5
caagcgcactgctct

SEQ ID NO: 56698 - DNA, 15 bp, Artificial Sequence
  dgRNA
  Morn5
aagcgcactgctcta

SEQ ID NO: 56699 - DNA, 15 bp, Artificial Sequence
  dgRNA
  Morn5
ctgctctagggccgc

SEQ ID NO: 56700 - DNA, 15 bp, Artificial Sequence
  dgRNA
  Pld1
aaagtgttagaaccg

SEQ ID NO: 56701 - DNA, 15 bp, Artificial Sequence
  dgRNA
  Pld1
gttagaaccgaggca

SEQ ID NO: 56702 - DNA, 15 bp, Artificial Sequence
  dgRNA
  Pld1
gaaggccggcggcag

SEQ ID NO: 56703 - DNA, 15 bp, Artificial Sequence
  dgRNA
  Pld1
cagaggctgtcaccg

SEQ ID NO: 56704 - DNA, 15 bp, Artificial Sequence
  dgRNA
  Fbxw11
tgagcggagagagcg

SEQ ID NO: 56705 - DNA, 15 bp, Artificial Sequence
  dgRNA
  Sgsm2
gcgggttcgcgccct

SEQ ID NO: 56706 - DNA, 15 bp, Artificial Sequence
  dgRNA
  Sgsm2
cgggttcgcgccctc

SEQ ID NO: 56707 - DNA, 15 bp, Artificial Sequence
  dgRNA
  Sgsm2
gggttcgcgccctcg

SEQ ID NO: 56708 - DNA, 15 bp, Artificial Sequence
  dgRNA
  Sgsm2
ttcgcgccctcgggg

SEQ ID NO: 56709 - DNA, 15 bp, Artificial Sequence
  dgRNA
  Arfgap3
actaacgctgagatc

SEQ ID NO: 56710 - DNA, 15 bp, Artificial Sequence
  dgRNA
  Arfgap3
ctaacgctgagatct

SEQ ID NO: 56711 - DNA, 15 bp, Artificial Sequence
  dgRNA
  Arfgap3
taacgctgagatctg

SEQ ID NO: 56712 - DNA, 15 bp, Artificial Sequence
  dgRNA
  Arfgap3
ggggaaggtttgcgg

SEQ ID NO: 56713 - DNA, 15 bp, Artificial Sequence
  dgRNA
  Cflar
ctaaaaacccggccc

SEQ ID NO: 56714 - DNA, 15 bp, Artificial Sequence
  dgRNA
  Cflar
cccaggatgcgagcc

SEQ ID NO: 56715 - DNA, 15 bp, Artificial Sequence
  dgRNA
  Cflar
gagcagtcagcatag

SEQ ID NO: 56716 - DNA, 15 bp, Artificial Sequence
  dgRNA
  Cflar
ctcgcatcctgggcc

SEQ ID NO: 56717 - DNA, 15 bp, Artificial Sequence
  dgRNA
  Ifi47
cggccaagacatcag

SEQ ID NO: 56718 - DNA, 15 bp, Artificial Sequence
  dgRNA
  Ifi47
tcggccaagacatca

SEQ ID NO: 56719 - DNA, 15 bp, Artificial Sequence
  dgRNA
  Ifi47
ctcggccaagacatc

SEQ ID NO: 56720 - DNA, 15 bp, Artificial Sequence
  dgRNA
  Zfp58
gctgtcaagcatagt

SEQ ID NO: 56721 - DNA, 15 bp, Artificial Sequence
  dgRNA
  Zfp58
gccagtgacaaatcc

SEQ ID NO: 56722 - DNA, 15 bp, Artificial Sequence
  dgRNA
  Zfp58
gccctagctgatttc

SEQ ID NO: 56723 - DNA, 15 bp, Artificial Sequence
  dgRNA
  Zfp58
ccctagctgatttcc

SEQ ID NO: 56724 - DNA, 15 bp, Artificial Sequence
  dgRNA
  Cachd1
ggtcccccagtatcc

SEQ ID NO: 56725 - DNA, 15 bp, Artificial Sequence
  dgRNA
  Cachd1
ggcccccagcgtccc

SEQ ID NO: 56726 - DNA, 15 bp, Artificial Sequence
  dgRNA
  Cachd1
gcccccagcgtccca

SEQ ID NO: 56727 - DNA, 15 bp, Artificial Sequence
  dgRNA
  Cachd1
gcgtcgccccgtgca

SEQ ID NO: 56728 - DNA, 15 bp, Artificial Sequence
  dgRNA
  Krt10
cctctcagtatataa

SEQ ID NO: 56729 - DNA, 15 bp, Artificial Sequence
  dgRNA
  Krt10
gttgaaactgagaat

SEQ ID NO: 56730 - DNA, 15 bp, Artificial Sequence
  dgRNA
  Krt10
gccctgagtacagat

SEQ ID NO: 56731 - DNA, 15 bp, Artificial Sequence
  dgRNA
  Krt10
cctttatatactgag

SEQ ID NO: 56732 - DNA, 15 bp, Artificial Sequence
  dgRNA
  Acyp2
gtgtcaaataaacgt

SEQ ID NO: 56733 - DNA, 15 bp, Artificial Sequence
  dgRNA
  Acyp2
tcaaataaacgtcgg

SEQ ID NO: 56734 - DNA, 15 bp, Artificial Sequence
  dgRNA
  Acyp2
caaataaacgtcggt

SEQ ID NO: 56735 - DNA, 15 bp, Artificial Sequence
  dgRNA
  Acyp2
tgggtagatattagt

SEQ ID NO: 56736 - DNA, 15 bp, Artificial Sequence
  dgRNA
  Cd84
gtttccggagctgga

SEQ ID NO: 56737 - DNA, 15 bp, Artificial Sequence
  dgRNA
  Cd84
tggtgtttccggagc

SEQ ID NO: 56738 - DNA, 15 bp, Artificial Sequence
  dgRNA
  2810004N23Rik
gtccctggcggggcc

SEQ ID NO: 56739 - DNA, 15 bp, Artificial Sequence
  dgRNA
  2810004N23Rik
tccctggcggggcct

SEQ ID NO: 56740 - DNA, 15 bp, Artificial Sequence
  dgRNA
  2810004N23Rik
ggctggtctgctaca

SEQ ID NO: 56741 - DNA, 15 bp, Artificial Sequence
  dgRNA
  2810004N23Rik
ctgtagtgcagccgc

SEQ ID NO: 56742 - DNA, 15 bp, Artificial Sequence
  dgRNA
  Ola1
gatcccagacgaagc

SEQ ID NO: 56743 - DNA, 15 bp, Artificial Sequence
  dgRNA
  Ola1
gacgaagcaggagcc

SEQ ID NO: 56744 - DNA, 15 bp, Artificial Sequence
  dgRNA
  Ola1
gctcctgcttcgtct

SEQ ID NO: 56745 - DNA, 15 bp, Artificial Sequence
  dgRNA
  Ola1
ggctcctgcttcgtc

SEQ ID NO: 56746 - DNA, 15 bp, Artificial Sequence
  dgRNA
  Cox11
ggaaacaaaagtgcg

SEQ ID NO: 56747 - DNA, 15 bp, Artificial Sequence
  dgRNA
  Cox11
cgaacttaccctctt

SEQ ID NO: 56748 - DNA, 15 bp, Artificial Sequence
  dgRNA
  Cox11
gaacttaccctcttc

SEQ ID NO: 56749 - DNA, 15 bp, Artificial Sequence
  dgRNA
  Cox11
cgccactgctaactg

SEQ ID NO: 56750 - DNA, 15 bp, Artificial Sequence
  dgRNA
  Tpp1
acgtcactagttact

SEQ ID NO: 56751 - DNA, 15 bp, Artificial Sequence
  dgRNA
  Tpp1
cactagttactaggc

SEQ ID NO: 56752 - DNA, 15 bp, Artificial Sequence
  dgRNA
  Tpp1
actagttactaggca

SEQ ID NO: 56753 - DNA, 15 bp, Artificial Sequence
  dgRNA
  Tpp1
gagcatctaagccca

SEQ ID NO: 56754 - DNA, 15 bp, Artificial Sequence
  dgRNA
  Nlrp9a
cattgagttgtatcc

SEQ ID NO: 56755 - DNA, 15 bp, Artificial Sequence
  dgRNA
  Tex38
gatgttgtgtactag

SEQ ID NO: 56756 - DNA, 15 bp, Artificial Sequence
  dgRNA
  Tex38
tgtactagaggttac

SEQ ID NO: 56757 - DNA, 15 bp, Artificial Sequence
  dgRNA
  Tex38
ctagaggttactgga

SEQ ID NO: 56758 - DNA, 15 bp, Artificial Sequence
  dgRNA
  Tex38
tagaggttactggat

SEQ ID NO: 56759 - DNA, 15 bp, Artificial Sequence
  dgRNA
  Rcan2
agcttcggcttgtgt

SEQ ID NO: 56760 - DNA, 15 bp, Artificial Sequence
  dgRNA
  Rcan2
caggcagcgttcgtg

SEQ ID NO: 56761 - DNA, 15 bp, Artificial Sequence
  dgRNA
  Rcan2
ggactaaatcaattc

SEQ ID NO: 56762 - DNA, 15 bp, Artificial Sequence
  dgRNA
  Rcan2
gcgccttttatctct

SEQ ID NO: 56763 - DNA, 15 bp, Artificial Sequence
  dgRNA
  Fbln5
tccgtgaagccgcct

SEQ ID NO: 56764 - DNA, 15 bp, Artificial Sequence
  dgRNA
  Fbln5
gccccgctccgccct

SEQ ID NO: 56765 - DNA, 15 bp, Artificial Sequence
  dgRNA
  Fbln5
ccccgctccgccctg

SEQ ID NO: 56766 - DNA, 15 bp, Artificial Sequence
  dgRNA
  Fbln5
cgctccgccctgggg

SEQ ID NO: 56767 - DNA, 15 bp, Artificial Sequence
  dgRNA
  Dusp11
acatagctacaaaac

SEQ ID NO: 56768 - DNA, 15 bp, Artificial Sequence
  dgRNA
  Dusp11
cacagtcgaaaccga

SEQ ID NO: 56769 - DNA, 15 bp, Artificial Sequence
  dgRNA
  Dusp11
gtcgaaaccgaaggc

SEQ ID NO: 56770 - DNA, 15 bp, Artificial Sequence
  dgRNA
  Dusp11
cgtgtgtcgtcagca

SEQ ID NO: 56771 - DNA, 15 bp, Artificial Sequence
  dgRNA
  Olfr457
ctaggttaaagcacc

SEQ ID NO: 56772 - DNA, 15 bp, Artificial Sequence
  dgRNA
  Olfr457
attgcagttggacct

SEQ ID NO: 56773 - DNA, 15 bp, Artificial Sequence
  dgRNA
  Fam65a
acaagctggttgaca

SEQ ID NO: 56774 - DNA, 15 bp, Artificial Sequence
  dgRNA
  Fam65a
gctggttgacacggt

SEQ ID NO: 56775 - DNA, 15 bp, Artificial Sequence
  dgRNA
  Fam65a
ccgggtaactcgcga

SEQ ID NO: 56776 - DNA, 15 bp, Artificial Sequence
  dgRNA
  Fam65a
ggtaactcgcgaagg

SEQ ID NO: 56777 - DNA, 15 bp, Artificial Sequence
  dgRNA
  Ly6g5b
gaggaagtcatctat

SEQ ID NO: 56778 - DNA, 15 bp, Artificial Sequence
  dgRNA
  Ly6g5b
gatcctgaccagagg

SEQ ID NO: 56779 - DNA, 15 bp, Artificial Sequence
  dgRNA
  Ly6g5b
cagaatgggtttgac

SEQ ID NO: 56780 - DNA, 15 bp, Artificial Sequence
  dgRNA
  Alg9
gcgtagcatttcttc

SEQ ID NO: 56781 - DNA, 15 bp, Artificial Sequence
  dgRNA
  Alg9
gaatcctggcctcac

SEQ ID NO: 56782 - DNA, 15 bp, Artificial Sequence
  dgRNA
  Alg9
aacacggctggctgg

SEQ ID NO: 56783 - DNA, 15 bp, Artificial Sequence
  dgRNA
  Alg9
tacaacacggctggc

SEQ ID NO: 56784 - DNA, 15 bp, Artificial Sequence
  dgRNA
  Pacsin3
cgctgcggggtcacc

SEQ ID NO: 56785 - DNA, 15 bp, Artificial Sequence
  dgRNA
  Pacsin3
ggggtcacccggctc

SEQ ID NO: 56786 - DNA, 15 bp, Artificial Sequence
  dgRNA
  Pacsin3
gcggagaagccgagc

SEQ ID NO: 56787 - DNA, 15 bp, Artificial Sequence
  dgRNA
  Pacsin3
ctctgaaatcccgag

SEQ ID NO: 56788 - DNA, 15 bp, Artificial Sequence
  dgRNA
  Vsig1
aaggatttaagtgcg

SEQ ID NO: 56789 - DNA, 15 bp, Artificial Sequence
  dgRNA
  Vsig1
aggggacacaccccg

SEQ ID NO: 56790 - DNA, 15 bp, Artificial Sequence
  dgRNA
  Vsig1
ggggacacaccccgg

SEQ ID NO: 56791 - DNA, 15 bp, Artificial Sequence
  dgRNA
  Vsig1
caccccgggggaaaa

SEQ ID NO: 56792 - DNA, 15 bp, Artificial Sequence
  dgRNA
  Mtmr3
cgtgaccaacgagcc

SEQ ID NO: 56793 - DNA, 15 bp, Artificial Sequence
  dgRNA
  Mtmr3
tcgcccatcccgtga

SEQ ID NO: 56794 - DNA, 15 bp, Artificial Sequence
  dgRNA
  Mtmr3
cagcggacagcgcgc

SEQ ID NO: 56795 - DNA, 15 bp, Artificial Sequence
  dgRNA
  Mtmr3
cacgccccaggatgt

SEQ ID NO: 56796 - DNA, 15 bp, Artificial Sequence
  dgRNA
  Vmn2r84
gtccctggatacata

SEQ ID NO: 56797 - DNA, 15 bp, Artificial Sequence
  dgRNA
  Vmn2r84
ggtccctggatacat

SEQ ID NO: 56798 - DNA, 15 bp, Artificial Sequence
  dgRNA
  Vmn2r84
ttatgtaatggtccc

SEQ ID NO: 56799 - DNA, 15 bp, Artificial Sequence
  dgRNA
  Rdh10
cccgacgcatccgct

SEQ ID NO: 56800 - DNA, 15 bp, Artificial Sequence
  dgRNA
  Rdh10
tgtcctaggaagacg

SEQ ID NO: 56801 - DNA, 15 bp, Artificial Sequence
  dgRNA
  Rdh10
ccgctgcagcagcgc

SEQ ID NO: 56802 - DNA, 15 bp, Artificial Sequence
  dgRNA
  Rdh10
cgctgcagcagcgcc

SEQ ID NO: 56803 - DNA, 15 bp, Artificial Sequence
  dgRNA
  Dhx34
aggcgcagaccattt

SEQ ID NO: 56804 - DNA, 15 bp, Artificial Sequence
  dgRNA
  Dhx34
taggaccggaagttg

SEQ ID NO: 56805 - DNA, 15 bp, Artificial Sequence
  dgRNA
  Dhx34
gcgtccgtgctattt

SEQ ID NO: 56806 - DNA, 15 bp, Artificial Sequence
  dgRNA
  Dhx34
tccgtgctatttcgg

SEQ ID NO: 56807 - DNA, 15 bp, Artificial Sequence
  dgRNA
  Ctdsp1
gcactttggaatgcg

SEQ ID NO: 56808 - DNA, 15 bp, Artificial Sequence
  dgRNA
  Ctdsp1
ctttggaatgcgtgg

SEQ ID NO: 56809 - DNA, 15 bp, Artificial Sequence
  dgRNA
  Ctdsp1
tggaatgcgtggagg

SEQ ID NO: 56810 - DNA, 15 bp, Artificial Sequence
  dgRNA
  Ctdsp1
gagccccgacgtcct

SEQ ID NO: 56811 - DNA, 15 bp, Artificial Sequence
  dgRNA
  Lrrc73
cgagagccgtgctgc

SEQ ID NO: 56812 - DNA, 15 bp, Artificial Sequence
  dgRNA
  Lrrc73
gagagccgtgctgcc

SEQ ID NO: 56813 - DNA, 15 bp, Artificial Sequence
  dgRNA
  Lrrc73
cgtgctgccgggccc

SEQ ID NO: 56814 - DNA, 15 bp, Artificial Sequence
  dgRNA
  Lrrc73
gtgctgccgggcccc

SEQ ID NO: 56815 - DNA, 15 bp, Artificial Sequence
  dgRNA
  Adad1
gtgtgtccctaagtc

SEQ ID NO: 56816 - DNA, 15 bp, Artificial Sequence
  dgRNA
  Adad1
tccctaagtcgggcg

SEQ ID NO: 56817 - DNA, 15 bp, Artificial Sequence
  dgRNA
  Adad1
gaatgcaacctgaca

SEQ ID NO: 56818 - DNA, 15 bp, Artificial Sequence
  dgRNA
  Adad1
acaaggccggaagaa

SEQ ID NO: 56819 - DNA, 15 bp, Artificial Sequence
  dgRNA
  Trmt12
caaaaatggctgccg

SEQ ID NO: 56820 - DNA, 15 bp, Artificial Sequence
  dgRNA
  Trmt12
taatacttcgagatc

SEQ ID NO: 56821 - DNA, 15 bp, Artificial Sequence
  dgRNA
  Trmt12
tgagtcgatatcctc

SEQ ID NO: 56822 - DNA, 15 bp, Artificial Sequence
  dgRNA
  Trmt12
ggttagtctgtactt

SEQ ID NO: 56823 - DNA, 15 bp, Artificial Sequence
  dgRNA
  Prr13
gtcacaggggcggtg

SEQ ID NO: 56824 - DNA, 15 bp, Artificial Sequence
  dgRNA
  Cspp1
agggttggctcggct

SEQ ID NO: 56825 - DNA, 15 bp, Artificial Sequence
  dgRNA
  Cspp1
taagatcagtcttgc

SEQ ID NO: 56826 - DNA, 15 bp, Artificial Sequence
  dgRNA
  Cspp1
gaaacgagaacatgc

SEQ ID NO: 56827 - DNA, 15 bp, Artificial Sequence
  dgRNA
  Cspp1
ttcgtgtgaactgcg

SEQ ID NO: 56828 - DNA, 15 bp, Artificial Sequence
  dgRNA
  Dock10
cagcggttcaacagc

SEQ ID NO: 56829 - DNA, 15 bp, Artificial Sequence
  dgRNA
  Dock10
tagttagctgctcac

SEQ ID NO: 56830 - DNA, 15 bp, Artificial Sequence
  dgRNA
  Olfr201
agtaatatgtacact

SEQ ID NO: 56831 - DNA, 15 bp, Artificial Sequence
  dgRNA
  Mib2
gcataacgcgtccgt

SEQ ID NO: 56832 - DNA, 15 bp, Artificial Sequence
  dgRNA
  Mib2
cgtgtacgtcatgct

SEQ ID NO: 56833 - DNA, 15 bp, Artificial Sequence
  dgRNA
  Mib2
gtgtacgtcatgctc

SEQ ID NO: 56834 - DNA, 15 bp, Artificial Sequence
  dgRNA
  Mib2
tgtacgtcatgctcg

SEQ ID NO: 56835 - DNA, 15 bp, Artificial Sequence
  dgRNA
  Ate1
gaatattatcttggt

SEQ ID NO: 56836 - DNA, 15 bp, Artificial Sequence
  dgRNA
  Ate1
acgttctttgcaaat

SEQ ID NO: 56837 - DNA, 15 bp, Artificial Sequence
  dgRNA
  Ate1
caaagaacgtgtttt

SEQ ID NO: 56838 - DNA, 15 bp, Artificial Sequence
  dgRNA
  Olfr558
attataggagactgg

SEQ ID NO: 56839 - DNA, 15 bp, Artificial Sequence
  dgRNA
  Olfr558
gtactcccaacaaga

SEQ ID NO: 56840 - DNA, 15 bp, Artificial Sequence
  dgRNA
  Odf2l
ttccacagaaaccgc

SEQ ID NO: 56841 - DNA, 15 bp, Artificial Sequence
  dgRNA
  Odf2l
ggcctgcggtttctg

SEQ ID NO: 56842 - DNA, 15 bp, Artificial Sequence
  dgRNA
  Odf2l
ctagtaaccggcctg

SEQ ID NO: 56843 - DNA, 15 bp, Artificial Sequence
  dgRNA
  Odf2l
aacgttgctagtaac

SEQ ID NO: 56844 - DNA, 15 bp, Artificial Sequence
  dgRNA
  Olfr147
ccatagagtgttccc

SEQ ID NO: 56845 - DNA, 15 bp, Artificial Sequence
  dgRNA
  Olfr147
catagagtgttccct

SEQ ID NO: 56846 - DNA, 15 bp, Artificial Sequence
  dgRNA
  Olfr147
atagagtgttccctg

SEQ ID NO: 56847 - DNA, 15 bp, Artificial Sequence
  dgRNA
  Olfr147
gggaggacctgttcc

SEQ ID NO: 56848 - DNA, 15 bp, Artificial Sequence
  dgRNA
  Fcer2a
aaggtaataatagcc

SEQ ID NO: 56849 - DNA, 15 bp, Artificial Sequence
  dgRNA
  Fcer2a
agcccggacttcccc

SEQ ID NO: 56850 - DNA, 15 bp, Artificial Sequence
  dgRNA
  Fcer2a
ggtgagcccataatt

SEQ ID NO: 56851 - DNA, 15 bp, Artificial Sequence
  dgRNA
  Fcer2a
gtgctccctagaacc

SEQ ID NO: 56852 - DNA, 15 bp, Artificial Sequence
  dgRNA
  Pip4k2a
cgctagcgcccaacg

SEQ ID NO: 56853 - DNA, 15 bp, Artificial Sequence
  dgRNA
  Pip4k2a
aagccgcccgccgcc

SEQ ID NO: 56854 - DNA, 15 bp, Artificial Sequence
  dgRNA
  Pip4k2a
cgcctggaccagccg

SEQ ID NO: 56855 - DNA, 15 bp, Artificial Sequence
  dgRNA
  Pip4k2a
gcctggaccagccga

SEQ ID NO: 56856 - DNA, 15 bp, Artificial Sequence
  dgRNA
  Trim50
cttttttcccagacg

SEQ ID NO: 56857 - DNA, 15 bp, Artificial Sequence
  dgRNA
  Trim50
gctcagagtcatagt

SEQ ID NO: 56858 - DNA, 15 bp, Artificial Sequence
  dgRNA
  Trim50
cccgtctgggaaaaa

SEQ ID NO: 56859 - DNA, 15 bp, Artificial Sequence
  dgRNA
  Isca2
ttcgccccgctctat

SEQ ID NO: 56860 - DNA, 15 bp, Artificial Sequence
  dgRNA
  Isca2
ggtaccgacccactt

SEQ ID NO: 56861 - DNA, 15 bp, Artificial Sequence
  dgRNA
  Isca2
acccacttcggcaag

SEQ ID NO: 56862 - DNA, 15 bp, Artificial Sequence
  dgRNA
  Isca2
ctcgctatacccaat

SEQ ID NO: 56863 - DNA, 15 bp, Artificial Sequence
  dgRNA
  Parp9
gcttggagtcgagat

SEQ ID NO: 56864 - DNA, 15 bp, Artificial Sequence
  dgRNA
  Parp9
tggagtcgagatcgg

SEQ ID NO: 56865 - DNA, 15 bp, Artificial Sequence
  dgRNA
  Parp9
agtcgagatcggtgg

SEQ ID NO: 56866 - DNA, 15 bp, Artificial Sequence
  dgRNA
  Bnipl
ccgcccccacacaag

SEQ ID NO: 56867 - DNA, 15 bp, Artificial Sequence
  dgRNA
  Bnipl
ggcaaacctgctcct

SEQ ID NO: 56868 - DNA, 15 bp, Artificial Sequence
  dgRNA
  Bnipl
gcaaacctgctcctt

SEQ ID NO: 56869 - DNA, 15 bp, Artificial Sequence
  dgRNA
  Pcdhgb2
tctgagcgtcgctgt

SEQ ID NO: 56870 - DNA, 15 bp, Artificial Sequence
  dgRNA
  Pcdhgb2
tttcccagacgcgtt

SEQ ID NO: 56871 - DNA, 15 bp, Artificial Sequence
  dgRNA
  Pcdhgb2
gacgcgttaggaaac

SEQ ID NO: 56872 - DNA, 15 bp, Artificial Sequence
  dgRNA
  Pcdhgb2
acgcgttaggaaact

SEQ ID NO: 56873 - DNA, 15 bp, Artificial Sequence
  dgRNA
  Jade1
agccgcacgccctac

SEQ ID NO: 56874 - DNA, 15 bp, Artificial Sequence
  dgRNA
  Jade1
gccgcacgccctacc

SEQ ID NO: 56875 - DNA, 15 bp, Artificial Sequence
  dgRNA
  Jade1
gcacgccctaccggg

SEQ ID NO: 56876 - DNA, 15 bp, Artificial Sequence
  dgRNA
  Jade1
cacgccctaccggga

SEQ ID NO: 56877 - DNA, 15 bp, Artificial Sequence
  dgRNA
  Spty2d1
cgccgcgaagatcct

SEQ ID NO: 56878 - DNA, 15 bp, Artificial Sequence
  dgRNA
  Spty2d1
gccgcgaagatcctc

SEQ ID NO: 56879 - DNA, 15 bp, Artificial Sequence
  dgRNA
  Spty2d1
cattttgcgtctgat

SEQ ID NO: 56880 - DNA, 15 bp, Artificial Sequence
  dgRNA
  Spty2d1
ttgagccaacgccaa

SEQ ID NO: 56881 - DNA, 15 bp, Artificial Sequence
  dgRNA
  Adcyap1
ctcgcccacttcctt

SEQ ID NO: 56882 - DNA, 15 bp, Artificial Sequence
  dgRNA
  Adcyap1
gcggaagtcgggagt

SEQ ID NO: 56883 - DNA, 15 bp, Artificial Sequence
  dgRNA
  Adcyap1
gcagcttgcggaagt

SEQ ID NO: 56884 - DNA, 15 bp, Artificial Sequence
  dgRNA
  Adcyap1
ctatctggcagcttg

SEQ ID NO: 56885 - DNA, 15 bp, Artificial Sequence
  dgRNA
  Hhla1
tcactgccccaagtt

SEQ ID NO: 56886 - DNA, 15 bp, Artificial Sequence
  dgRNA
  Hhla1
cactgccccaagttt

SEQ ID NO: 56887 - DNA, 15 bp, Artificial Sequence
  dgRNA
  Glp1r
cctggcccgggacgc

SEQ ID NO: 56888 - DNA, 15 bp, Artificial Sequence
  dgRNA
  Glp1r
ggcccgggacgctgg

SEQ ID NO: 56889 - DNA, 15 bp, Artificial Sequence
  dgRNA
  Glp1r
cgctggaggccggtc

SEQ ID NO: 56890 - DNA, 15 bp, Artificial Sequence
  dgRNA
  Glp1r
aggccggtctggccc

SEQ ID NO: 56891 - DNA, 15 bp, Artificial Sequence
  dgRNA
  Mroh5
gcgcgccaagcagga

SEQ ID NO: 56892 - DNA, 15 bp, Artificial Sequence
  dgRNA
  Mroh5
caggacggccagctt

SEQ ID NO: 56893 - DNA, 15 bp, Artificial Sequence
  dgRNA
  Mroh5
aggacggccagcttc

SEQ ID NO: 56894 - DNA, 15 bp, Artificial Sequence
  dgRNA
  Mroh5
acggccagcttcggg

SEQ ID NO: 56895 - DNA, 15 bp, Artificial Sequence
  dgRNA
  Dydc1
tttgcctccactgat

SEQ ID NO: 56896 - DNA, 15 bp, Artificial Sequence
  dgRNA
  Dydc1
ttgcctccactgatt

SEQ ID NO: 56897 - DNA, 15 bp, Artificial Sequence
  dgRNA
  Dydc1
ctgattgggtagcaa

SEQ ID NO: 56898 - DNA, 15 bp, Artificial Sequence
  dgRNA
  Dydc1
cgtgctctcgttgcc

SEQ ID NO: 56899 - DNA, 15 bp, Artificial Sequence
  dgRNA
  Map3k15
tgagctccgctccgc

SEQ ID NO: 56900 - DNA, 15 bp, Artificial Sequence
  dgRNA
  Map3k15
cgctccgccggccgc

SEQ ID NO: 56901 - DNA, 15 bp, Artificial Sequence
  dgRNA
  Map3k15
ccgccggagaacccg

SEQ ID NO: 56902 - DNA, 15 bp, Artificial Sequence
  dgRNA
  Map3k15
gtcacctgcccgccc

SEQ ID NO: 56903 - DNA, 15 bp, Artificial Sequence
  dgRNA
  Nif3l1
caccatgctgcaggg

SEQ ID NO: 56904 - DNA, 15 bp, Artificial Sequence
  dgRNA
  Nif3l1
caccctgcagcatgg

SEQ ID NO: 56905 - DNA, 15 bp, Artificial Sequence
  dgRNA
  Fam234a
gtacgccccttccgc

SEQ ID NO: 56906 - DNA, 15 bp, Artificial Sequence
  dgRNA
  Fam234a
agtgacgcacagttc

SEQ ID NO: 56907 - DNA, 15 bp, Artificial Sequence
  dgRNA
  Fam234a
gacgcacagttcagg

SEQ ID NO: 56908 - DNA, 15 bp, Artificial Sequence
  dgRNA
  Fam234a
acgcacagttcaggt

SEQ ID NO: 56909 - DNA, 15 bp, Artificial Sequence
  dgRNA
  Suv39h1
gtgaatgcctgcgcg

SEQ ID NO: 56910 - DNA, 15 bp, Artificial Sequence
  dgRNA
  Suv39h1
caagccctttatgac

SEQ ID NO: 56911 - DNA, 15 bp, Artificial Sequence
  dgRNA
  Suv39h1
ggctgacgccgcgat

SEQ ID NO: 56912 - DNA, 15 bp, Artificial Sequence
  dgRNA
  Suv39h1
gcaatatgactgaca

SEQ ID NO: 56913 - DNA, 15 bp, Artificial Sequence
  dgRNA
  Ino80e
taaagggggtgagta

SEQ ID NO: 56914 - DNA, 15 bp, Artificial Sequence
  dgRNA
  Ino80e
gatgtctccgggttc

SEQ ID NO: 56915 - DNA, 15 bp, Artificial Sequence
  dgRNA
  Ino80e
atgtctccgggttct

SEQ ID NO: 56916 - DNA, 15 bp, Artificial Sequence
  dgRNA
  Ino80e
cgccctgtccgccgc

SEQ ID NO: 56917 - DNA, 15 bp, Artificial Sequence
  dgRNA
  Cbx5
gttccgcctgctgcc

SEQ ID NO: 56918 - DNA, 15 bp, Artificial Sequence
  dgRNA
  Cbx5
gaacacgtgaaatgg

SEQ ID NO: 56919 - DNA, 15 bp, Artificial Sequence
  dgRNA
  Cbx5
acgtgaaatggcggg

SEQ ID NO: 56920 - DNA, 15 bp, Artificial Sequence
  dgRNA
  Cbx5
cgtgaaatggcgggc

SEQ ID NO: 56921 - DNA, 15 bp, Artificial Sequence
  dgRNA
  Efcab6
ggacagcatttccgg

SEQ ID NO: 56922 - DNA, 15 bp, Artificial Sequence
  dgRNA
  Efcab6
ggcccgaatcttgtc

SEQ ID NO: 56923 - DNA, 15 bp, Artificial Sequence
  dgRNA
  Efcab6
aactcctctacttgt

SEQ ID NO: 56924 - DNA, 15 bp, Artificial Sequence
  dgRNA
  Efcab6
actcctctacttgtc

SEQ ID NO: 56925 - DNA, 15 bp, Artificial Sequence
  dgRNA
  Egr1
ctcgcgatgccggag

SEQ ID NO: 56926 - DNA, 15 bp, Artificial Sequence
  dgRNA
  Egr1
ccggagcgggtcgca

SEQ ID NO: 56927 - DNA, 15 bp, Artificial Sequence
  dgRNA
  Egr1
gagcgggtcgcaggg

SEQ ID NO: 56928 - DNA, 15 bp, Artificial Sequence
  dgRNA
  Egr1
cgggtcgcagggtgg

SEQ ID NO: 56929 - DNA, 15 bp, Artificial Sequence
  dgRNA
  Birc2
tcgtccgagtcccag

SEQ ID NO: 56930 - DNA, 15 bp, Artificial Sequence
  dgRNA
  Birc2
aaagcccgagcacgc

SEQ ID NO: 56931 - DNA, 15 bp, Artificial Sequence
  dgRNA
  Birc2
cgcaggcgcgagcgc

SEQ ID NO: 56932 - DNA, 15 bp, Artificial Sequence
  dgRNA
  Birc2
cgcgagcgcaggcgc

SEQ ID NO: 56933 - DNA, 15 bp, Artificial Sequence
  dgRNA
  Taar7f
ggtatactgtgaatt

SEQ ID NO: 56934 - DNA, 15 bp, Artificial Sequence
  dgRNA
  Dnah7b
cacccacccttaagg

SEQ ID NO: 56935 - DNA, 15 bp, Artificial Sequence
  dgRNA
  Dnah7b
acccacccttaagga

SEQ ID NO: 56936 - DNA, 15 bp, Artificial Sequence
  dgRNA
  Dnah7b
cccttaaggagggtg

SEQ ID NO: 56937 - DNA, 15 bp, Artificial Sequence
  dgRNA
  Dnah7b
accctccttaagggt

SEQ ID NO: 56938 - DNA, 15 bp, Artificial Sequence
  dgRNA
  Csmd3
ctcactagtgctttc

SEQ ID NO: 56939 - DNA, 15 bp, Artificial Sequence
  dgRNA
  Csmd3
ctggtgtaggttgta

SEQ ID NO: 56940 - DNA, 15 bp, Artificial Sequence
  dgRNA
  Csmd3
cagaatccggagtag

SEQ ID NO: 56941 - DNA, 15 bp, Artificial Sequence
  dgRNA
  Csmd3
actctgtgcccccgt

SEQ ID NO: 56942 - DNA, 15 bp, Artificial Sequence
  dgRNA
  Smox
tcggccctacggtcc

SEQ ID NO: 56943 - DNA, 15 bp, Artificial Sequence
  dgRNA
  Smox
gccctacggtcccgg

SEQ ID NO: 56944 - DNA, 15 bp, Artificial Sequence
  dgRNA
  Smox
ctacggtcccggcgg

SEQ ID NO: 56945 - DNA, 15 bp, Artificial Sequence
  dgRNA
  Smox
cccggcggcggctgc

SEQ ID NO: 56946 - DNA, 15 bp, Artificial Sequence
  dgRNA
  Tmem86b
gtcgtccttccttcc

SEQ ID NO: 56947 - DNA, 15 bp, Artificial Sequence
  dgRNA
  Tmem86b
ccagggttggttgta

SEQ ID NO: 56948 - DNA, 15 bp, Artificial Sequence
  dgRNA
  Tmem86b
agggctacccctctg

SEQ ID NO: 56949 - DNA, 15 bp, Artificial Sequence
  dgRNA
  Tmem86b
ttccttataattggc

SEQ ID NO: 56950 - DNA, 15 bp, Artificial Sequence
  dgRNA
  Esam
ccggctgtttgagcc

SEQ ID NO: 56951 - DNA, 15 bp, Artificial Sequence
  dgRNA
  Esam
cggctgtttgagcct

SEQ ID NO: 56952 - DNA, 15 bp, Artificial Sequence
  dgRNA
  Esam
ctagcgcgccgcgcc

SEQ ID NO: 56953 - DNA, 15 bp, Artificial Sequence
  dgRNA
  Esam
ccgcgcccggcagga

SEQ ID NO: 56954 - DNA, 15 bp, Artificial Sequence
  dgRNA
  Sumf1
accacgaaactagag

SEQ ID NO: 56955 - DNA, 15 bp, Artificial Sequence
  dgRNA
  Sumf1
ccacgaaactagaga

SEQ ID NO: 56956 - DNA, 15 bp, Artificial Sequence
  dgRNA
  Sumf1
cacgaaactagagag

SEQ ID NO: 56957 - DNA, 15 bp, Artificial Sequence
  dgRNA
  Sumf1
cacattgtctgcgga

SEQ ID NO: 56958 - DNA, 15 bp, Artificial Sequence
  dgRNA
  Olfr869
gtaattatgagctct

SEQ ID NO: 56959 - DNA, 15 bp, Artificial Sequence
  dgRNA
  Olfr869
caacgttccactgtc

SEQ ID NO: 56960 - DNA, 15 bp, Artificial Sequence
  dgRNA
  Olfr869
aacgttccactgtca

SEQ ID NO: 56961 - DNA, 15 bp, Artificial Sequence
  dgRNA
  Olfr869
acgtgtgttctccac

SEQ ID NO: 56962 - DNA, 15 bp, Artificial Sequence
  dgRNA
  Kirrel3
ggaggagcccgccag

SEQ ID NO: 56963 - DNA, 15 bp, Artificial Sequence
  dgRNA
  Kirrel3
ggaagccgtgtgcct

SEQ ID NO: 56964 - DNA, 15 bp, Artificial Sequence
  dgRNA
  Kirrel3
tggatctgctccgag

SEQ ID NO: 56965 - DNA, 15 bp, Artificial Sequence
  dgRNA
  Kirrel3
ggatctgctccgagt

SEQ ID NO: 56966 - DNA, 15 bp, Artificial Sequence
  dgRNA
  Slc16a5
ccctacctgtaccat

SEQ ID NO: 56967 - DNA, 15 bp, Artificial Sequence
  dgRNA
  Slc16a5
cctccttgatactta

SEQ ID NO: 56968 - DNA, 15 bp, Artificial Sequence
  dgRNA
  Slc16a5
cttgatacttagggc

SEQ ID NO: 56969 - DNA, 15 bp, Artificial Sequence
  dgRNA
  Slc16a5
tagggctggagcata

SEQ ID NO: 56970 - DNA, 15 bp, Artificial Sequence
  dgRNA
  Arl5b
cgcgtttcttcagag

SEQ ID NO: 56971 - DNA, 15 bp, Artificial Sequence
  dgRNA
  Arl5b
agggagcgcgcgccg

SEQ ID NO: 56972 - DNA, 15 bp, Artificial Sequence
  dgRNA
  Arl5b
caccggaagtgtaca

SEQ ID NO: 56973 - DNA, 15 bp, Artificial Sequence
  dgRNA
  Arl5b
gacccgccacgtccc

SEQ ID NO: 56974 - DNA, 15 bp, Artificial Sequence
  dgRNA
  Sntg1
gtgcctaggccttgc

SEQ ID NO: 56975 - DNA, 15 bp, Artificial Sequence
  dgRNA
  Sntg1
gcccctgcgggaacc

SEQ ID NO: 56976 - DNA, 15 bp, Artificial Sequence
  dgRNA
  Sntg1
cccctgcgggaaccc

SEQ ID NO: 56977 - DNA, 15 bp, Artificial Sequence
  dgRNA
  Sntg1
gggaacccgggctgt

SEQ ID NO: 56978 - DNA, 15 bp, Artificial Sequence
  dgRNA
  Tank
ccaaggagcttggcg

SEQ ID NO: 56979 - DNA, 15 bp, Artificial Sequence
  dgRNA
  Tank
cggggctttgtgggc

SEQ ID NO: 56980 - DNA, 15 bp, Artificial Sequence
  dgRNA
  Tank
tgcagaggcgggacg

SEQ ID NO: 56981 - DNA, 15 bp, Artificial Sequence
  dgRNA
  Tank
gcagaggcgggacgt

SEQ ID NO: 56982 - DNA, 15 bp, Artificial Sequence
  dgRNA
  Zdhhc19
ggactctggcgtgag

SEQ ID NO: 56983 - DNA, 15 bp, Artificial Sequence
  dgRNA
  Zdhhc19
gcgtgagtggtgagc

SEQ ID NO: 56984 - DNA, 15 bp, Artificial Sequence
  dgRNA
  Zdhhc19
tcacgccagagtcca

SEQ ID NO: 56985 - DNA, 15 bp, Artificial Sequence
  dgRNA
  Fam221a
aagggcgggactaag

SEQ ID NO: 56986 - DNA, 15 bp, Artificial Sequence
  dgRNA
  Fam221a
agggcgggactaagc

SEQ ID NO: 56987 - DNA, 15 bp, Artificial Sequence
  dgRNA
  Fam221a
aagcgggtgaaacag

SEQ ID NO: 56988 - DNA, 15 bp, Artificial Sequence
  dgRNA
  Fam221a
agcgggtgaaacaga

SEQ ID NO: 56989 - DNA, 15 bp, Artificial Sequence
  dgRNA
  4921524J17Rik
gccagtaaccatttc

SEQ ID NO: 56990 - DNA, 15 bp, Artificial Sequence
  dgRNA
  4921524J17Rik
gttctggggccgacg

SEQ ID NO: 56991 - DNA, 15 bp, Artificial Sequence
  dgRNA
  4921524J17Rik
ttctggggccgacga

SEQ ID NO: 56992 - DNA, 15 bp, Artificial Sequence
  dgRNA
  4921524J17Rik
tctggggccgacgag

SEQ ID NO: 56993 - DNA, 15 bp, Artificial Sequence
  dgRNA
  Cabs1
attaatgctcattct

SEQ ID NO: 56994 - DNA, 15 bp, Artificial Sequence
  dgRNA
  Cabs1
cccctgtcattacct

SEQ ID NO: 56995 - DNA, 15 bp, Artificial Sequence
  dgRNA
  Cabs1
agtactcccttgccc

SEQ ID NO: 56996 - DNA, 15 bp, Artificial Sequence
  dgRNA
  Cabs1
gtactcccttgccca

SEQ ID NO: 56997 - DNA, 15 bp, Artificial Sequence
  dgRNA
  Otx1
agcgcgcgaccgggg

SEQ ID NO: 56998 - DNA, 15 bp, Artificial Sequence
  dgRNA
  Otx1
gcgcgcgaccggggc

SEQ ID NO: 56999 - DNA, 15 bp, Artificial Sequence
  dgRNA
  Otx1
cgcgcgaccggggcg

SEQ ID NO: 57000 - DNA, 15 bp, Artificial Sequence
  dgRNA
  Otx1
cgcgcggaggtaacc

SEQ ID NO: 57001 - DNA, 15 bp, Artificial Sequence
  dgRNA
  Ascl2
ctggagccacgcgcc

SEQ ID NO: 57002 - DNA, 15 bp, Artificial Sequence
  dgRNA
  Ascl2
gcgtacgcttccttc

SEQ ID NO: 57003 - DNA, 15 bp, Artificial Sequence
  dgRNA
  Ascl2
ttctggccccggcat

SEQ ID NO: 57004 - DNA, 15 bp, Artificial Sequence
  dgRNA
  Ascl2
cgcgccaattgtcat

SEQ ID NO: 57005 - DNA, 15 bp, Artificial Sequence
  dgRNA
  Cnot1
attggtttaaatccg

SEQ ID NO: 57006 - DNA, 15 bp, Artificial Sequence
  dgRNA
  Cnot1
ttggtttaaatccgc

SEQ ID NO: 57007 - DNA, 15 bp, Artificial Sequence
  dgRNA
  Cnot1
tccgcgggtacccat

SEQ ID NO: 57008 - DNA, 15 bp, Artificial Sequence
  dgRNA
  Cnot1
gtacccatcggcgat

SEQ ID NO: 57009 - DNA, 15 bp, Artificial Sequence
  dgRNA
  Parva
ggaacccatccatgc

SEQ ID NO: 57010 - DNA, 15 bp, Artificial Sequence
  dgRNA
  Parva
acccatccatgcagg

SEQ ID NO: 57011 - DNA, 15 bp, Artificial Sequence
  dgRNA
  Parva
gagaccgcagcagct

SEQ ID NO: 57012 - DNA, 15 bp, Artificial Sequence
  dgRNA
  Parva
acctcctgcatggat

SEQ ID NO: 57013 - DNA, 15 bp, Artificial Sequence
  dgRNA
  Disp2
tggcggatttctctt

SEQ ID NO: 57014 - DNA, 15 bp, Artificial Sequence
  dgRNA
  Disp2
gccccgcccagcgac

SEQ ID NO: 57015 - DNA, 15 bp, Artificial Sequence
  dgRNA
  Disp2
ccagcgactggcctc

SEQ ID NO: 57016 - DNA, 15 bp, Artificial Sequence
  dgRNA
  Disp2
tgtcacgaaggttgt

SEQ ID NO: 57017 - DNA, 15 bp, Artificial Sequence
  dgRNA
  Clic6
cagaaaacgctaaag

SEQ ID NO: 57018 - DNA, 15 bp, Artificial Sequence
  dgRNA
  Clic6
ccaggccacccaaag

SEQ ID NO: 57019 - DNA, 15 bp, Artificial Sequence
  dgRNA
  Clic6
cgcccaagccctaag

SEQ ID NO: 57020 - DNA, 15 bp, Artificial Sequence
  dgRNA
  Clic6
gagccatttaaatca

SEQ ID NO: 57021 - DNA, 15 bp, Artificial Sequence
  dgRNA
  Hdac6
gcccaatggaaaaga

SEQ ID NO: 57022 - DNA, 15 bp, Artificial Sequence
  dgRNA
  Hdac6
gggatcaggtgcccg

SEQ ID NO: 57023 - DNA, 15 bp, Artificial Sequence
  dgRNA
  Hdac6
tgcccggggccacac

SEQ ID NO: 57024 - DNA, 15 bp, Artificial Sequence
  dgRNA
  Hdac6
ggccacacaggtcgc

SEQ ID NO: 57025 - DNA, 15 bp, Artificial Sequence
  dgRNA
  Ccdc171
cgcgtaccccacccc

SEQ ID NO: 57026 - DNA, 15 bp, Artificial Sequence
  dgRNA
  Ccdc171
ataccccgcctgccg

SEQ ID NO: 57027 - DNA, 15 bp, Artificial Sequence
  dgRNA
  Ccdc171
taccccgcctgccgc

SEQ ID NO: 57028 - DNA, 15 bp, Artificial Sequence
  dgRNA
  Ccdc171
gagcgcgcgcggttg

SEQ ID NO: 57029 - DNA, 15 bp, Artificial Sequence
  dgRNA
  Odf2
gggcaaaatggcgga

SEQ ID NO: 57030 - DNA, 15 bp, Artificial Sequence
  dgRNA
  Odf2
ggcaaaatggcggag

SEQ ID NO: 57031 - DNA, 15 bp, Artificial Sequence
  dgRNA
  Odf2
gcggaggggactcgg

SEQ ID NO: 57032 - DNA, 15 bp, Artificial Sequence
  dgRNA
  Odf2
tccgccattttgccc

SEQ ID NO: 57033 - DNA, 15 bp, Artificial Sequence
  dgRNA
  Npy2r
acccactcctacccg

SEQ ID NO: 57034 - DNA, 15 bp, Artificial Sequence
  dgRNA
  Npy2r
gggtccctgatcgag

SEQ ID NO: 57035 - DNA, 15 bp, Artificial Sequence
  dgRNA
  Npy2r
atcgagtggctttag

SEQ ID NO: 57036 - DNA, 15 bp, Artificial Sequence
  dgRNA
  Npy2r
accgagaagccgagc

SEQ ID NO: 57037 - DNA, 15 bp, Artificial Sequence
  dgRNA
  Eml3
ctgcgggccggaagc

SEQ ID NO: 57038 - DNA, 15 bp, Artificial Sequence
  dgRNA
  Eml3
tgcgggccggaagcc

SEQ ID NO: 57039 - DNA, 15 bp, Artificial Sequence
  dgRNA
  Eml3
gcctggcggggtgaa

SEQ ID NO: 57040 - DNA, 15 bp, Artificial Sequence
  dgRNA
  Eml3
gtgtgtccccgcctc

SEQ ID NO: 57041 - DNA, 15 bp, Artificial Sequence
  dgRNA
  Mrps6
ggtgcgtgccgagcg

SEQ ID NO: 57042 - DNA, 15 bp, Artificial Sequence
  dgRNA
  Mrps6
tgccgagcgaggaga

SEQ ID NO: 57043 - DNA, 15 bp, Artificial Sequence
  dgRNA
  Mrps6
ggagacggcctccga

SEQ ID NO: 57044 - DNA, 15 bp, Artificial Sequence
  dgRNA
  Mrps6
gagacggcctccgac

SEQ ID NO: 57045 - DNA, 15 bp, Artificial Sequence
  dgRNA
  Slc15a3
tgcagacgggctaag

SEQ ID NO: 57046 - DNA, 15 bp, Artificial Sequence
  dgRNA
  Slc15a3
gcagacgggctaaga

SEQ ID NO: 57047 - DNA, 15 bp, Artificial Sequence
  dgRNA
  Slc15a3
acgggctaagagggc

SEQ ID NO: 57048 - DNA, 15 bp, Artificial Sequence
  dgRNA
  Slc15a3
aataccgggtgacgt

SEQ ID NO: 57049 - DNA, 15 bp, Artificial Sequence
  dgRNA
  Jup
gcgcataaacagagg

SEQ ID NO: 57050 - DNA, 15 bp, Artificial Sequence
  dgRNA
  Jup
aaacagaggcggccg

SEQ ID NO: 57051 - DNA, 15 bp, Artificial Sequence
  dgRNA
  Jup
aggcggccgtggtag

SEQ ID NO: 57052 - DNA, 15 bp, Artificial Sequence
  dgRNA
  Jup
ccgtggtagaggtcc

SEQ ID NO: 57053 - DNA, 15 bp, Artificial Sequence
  dgRNA
  Olfr1446
gcccgcattatcttc

SEQ ID NO: 57054 - DNA, 15 bp, Artificial Sequence
  dgRNA
  Olfr1446
tgtacaaatactagt

SEQ ID NO: 57055 - DNA, 15 bp, Artificial Sequence
  dgRNA
  Olfr1446
gcatagctagtgaag

SEQ ID NO: 57056 - DNA, 15 bp, Artificial Sequence
  dgRNA
  Olfr1446
gctttagaattaact

SEQ ID NO: 57057 - DNA, 15 bp, Artificial Sequence
  dgRNA
  Bmpr1b
cctgtgtgggcgtct

SEQ ID NO: 57058 - DNA, 15 bp, Artificial Sequence
  dgRNA
  Bmpr1b
tagaaaacaatcggg

SEQ ID NO: 57059 - DNA, 15 bp, Artificial Sequence
  dgRNA
  Bmpr1b
agaaaacaatcggga

SEQ ID NO: 57060 - DNA, 15 bp, Artificial Sequence
  dgRNA
  Bmpr1b
gaaaacaatcgggag

SEQ ID NO: 57061 - DNA, 15 bp, Artificial Sequence
  dgRNA
  Plekhh3
ccgcggtttcaagct

SEQ ID NO: 57062 - DNA, 15 bp, Artificial Sequence
  dgRNA
  Plekhh3
cgcggtttcaagctt

SEQ ID NO: 57063 - DNA, 15 bp, Artificial Sequence
  dgRNA
  Plekhh3
attggtctccctgac

SEQ ID NO: 57064 - DNA, 15 bp, Artificial Sequence
  dgRNA
  Plekhh3
tccctgaccggcgcc

SEQ ID NO: 57065 - DNA, 15 bp, Artificial Sequence
  dgRNA
  Gm5113
tgcgtctgcgcactc

SEQ ID NO: 57066 - DNA, 15 bp, Artificial Sequence
  dgRNA
  Gm5113
gcgtctgcgcactca

SEQ ID NO: 57067 - DNA, 15 bp, Artificial Sequence
  dgRNA
  Gm5113
tctccgcgacatctc

SEQ ID NO: 57068 - DNA, 15 bp, Artificial Sequence
  dgRNA
  Gm5113
ctccgcgacatctca

SEQ ID NO: 57069 - DNA, 15 bp, Artificial Sequence
  dgRNA
  Olfr309
atagaggatattgcc

SEQ ID NO: 57070 - DNA, 15 bp, Artificial Sequence
  dgRNA
  Gpatch2
ctcgcccctttctcc

SEQ ID NO: 57071 - DNA, 15 bp, Artificial Sequence
  dgRNA
  Gpatch2
atttcgagctgctga

SEQ ID NO: 57072 - DNA, 15 bp, Artificial Sequence
  dgRNA
  Gpatch2
tttcgagctgctgat

SEQ ID NO: 57073 - DNA, 15 bp, Artificial Sequence
  dgRNA
  Gpatch2
gctaaggtgagcgaa

SEQ ID NO: 57074 - DNA, 15 bp, Artificial Sequence
  dgRNA
  Slc37a2
gatcatgagtcagcg

SEQ ID NO: 57075 - DNA, 15 bp, Artificial Sequence
  dgRNA
  Slc37a2
catgagtcagcgcgg

SEQ ID NO: 57076 - DNA, 15 bp, Artificial Sequence
  dgRNA
  Slc37a2
ctgcgggctctcttt

SEQ ID NO: 57077 - DNA, 15 bp, Artificial Sequence
  dgRNA
  Slc37a2
tctgcgggctctctt

SEQ ID NO: 57078 - DNA, 15 bp, Artificial Sequence
  dgRNA
  Arrb1
accccacctcccgac

SEQ ID NO: 57079 - DNA, 15 bp, Artificial Sequence
  dgRNA
  Arrb1
tctcccgcgcacgcc

SEQ ID NO: 57080 - DNA, 15 bp, Artificial Sequence
  dgRNA
  Arrb1
gtgtgctcacagtcg

SEQ ID NO: 57081 - DNA, 15 bp, Artificial Sequence
  dgRNA
  Arrb1
agcctgtcgggaggt

SEQ ID NO: 57082 - DNA, 15 bp, Artificial Sequence
  dgRNA
  Pcgf3
cggcggagtttctcc

SEQ ID NO: 57083 - DNA, 15 bp, Artificial Sequence
  dgRNA
  Pcgf3
cgcgcctgcgctctc

SEQ ID NO: 57084 - DNA, 15 bp, Artificial Sequence
  dgRNA
  Pcgf3
gcaccccacccctat

SEQ ID NO: 57085 - DNA, 15 bp, Artificial Sequence
  dgRNA
  Pcgf3
ggctccgcctttcag

SEQ ID NO: 57086 - DNA, 15 bp, Artificial Sequence
  dgRNA
  Rnf149
ctgcggcacagaccc

SEQ ID NO: 57087 - DNA, 15 bp, Artificial Sequence
  dgRNA
  Rnf149
cactcctcacgcccg

SEQ ID NO: 57088 - DNA, 15 bp, Artificial Sequence
  dgRNA
  Rnf149
actcctcacgcccgc

SEQ ID NO: 57089 - DNA, 15 bp, Artificial Sequence
  dgRNA
  Rnf149
ctcacgcccgcgggc

SEQ ID NO: 57090 - DNA, 15 bp, Artificial Sequence
  dgRNA
  Olfr1454
gcccacattttgtac

SEQ ID NO: 57091 - DNA, 15 bp, Artificial Sequence
  dgRNA
  Olfr1454
gcaatccagtaaaag

SEQ ID NO: 57092 - DNA, 15 bp, Artificial Sequence
  dgRNA
  Olfr1454
tagttgttacagctc

SEQ ID NO: 57093 - DNA, 15 bp, Artificial Sequence
  dgRNA
  Olfr790
tatccagctttacga

SEQ ID NO: 57094 - DNA, 15 bp, Artificial Sequence
  dgRNA
  Olfr790
tctccttcgtaaagc

SEQ ID NO: 57095 - DNA, 15 bp, Artificial Sequence
  dgRNA
  Olfr790
tcgtaggtgttaaga

SEQ ID NO: 57096 - DNA, 15 bp, Artificial Sequence
  dgRNA
  Olfr790
caattatgatgtcgt

SEQ ID NO: 57097 - DNA, 15 bp, Artificial Sequence
  dgRNA
  Sucnr1
tgccttcggcttttc

SEQ ID NO: 57098 - DNA, 15 bp, Artificial Sequence
  dgRNA
  Sucnr1
ctcctgaaaagccga

SEQ ID NO: 57099 - DNA, 15 bp, Artificial Sequence
  dgRNA
  Sucnr1
ctccaagtcattcag

SEQ ID NO: 57100 - DNA, 15 bp, Artificial Sequence
  dgRNA
  Nagk
agcgtactcagcaca

SEQ ID NO: 57101 - DNA, 15 bp, Artificial Sequence
  dgRNA
  Nagk
gtgcgctcatgagcc

SEQ ID NO: 57102 - DNA, 15 bp, Artificial Sequence
  dgRNA
  Nagk
tgcgctcatgagcca

SEQ ID NO: 57103 - DNA, 15 bp, Artificial Sequence
  dgRNA
  Nagk
gggtggtctggacgt

SEQ ID NO: 57104 - DNA, 15 bp, Artificial Sequence
  dgRNA
  Egflam
gagccgccctccctc

SEQ ID NO: 57105 - DNA, 15 bp, Artificial Sequence
  dgRNA
  Egflam
ccgccctccctccgg

SEQ ID NO: 57106 - DNA, 15 bp, Artificial Sequence
  dgRNA
  Egflam
gtgcgtccctcccct

SEQ ID NO: 57107 - DNA, 15 bp, Artificial Sequence
  dgRNA
  Egflam
tggccgccggaggga

SEQ ID NO: 57108 - DNA, 15 bp, Artificial Sequence
  dgRNA
  Mettl3
gagagaactaccgtg

SEQ ID NO: 57109 - DNA, 15 bp, Artificial Sequence
  dgRNA
  Mettl3
cgtgaggattacgtc

SEQ ID NO: 57110 - DNA, 15 bp, Artificial Sequence
  dgRNA
  Mettl3
aggattacgtccggc

SEQ ID NO: 57111 - DNA, 15 bp, Artificial Sequence
  dgRNA
  Mettl3
gagtgtttgacgggt

SEQ ID NO: 57112 - DNA, 15 bp, Artificial Sequence
  dgRNA
  Olfr523
cctcccctaggtgac

SEQ ID NO: 57113 - DNA, 15 bp, Artificial Sequence
  dgRNA
  Olfr523
ctacaagcacgggca

SEQ ID NO: 57114 - DNA, 15 bp, Artificial Sequence
  dgRNA
  Olfr523
tccaggtactcccaa

SEQ ID NO: 57115 - DNA, 15 bp, Artificial Sequence
  dgRNA
  Olfr523
ccaggtactcccaag

SEQ ID NO: 57116 - DNA, 15 bp, Artificial Sequence
  dgRNA
  Wdr82
ctgccctcgagagag

SEQ ID NO: 57117 - DNA, 15 bp, Artificial Sequence
  dgRNA
  Wdr82
tgccctcgagagaga

SEQ ID NO: 57118 - DNA, 15 bp, Artificial Sequence
  dgRNA
  Wdr82
atgctccacgcccgc

SEQ ID NO: 57119 - DNA, 15 bp, Artificial Sequence
  dgRNA
  Wdr82
cacaccccagaaccg

SEQ ID NO: 57120 - DNA, 15 bp, Artificial Sequence
  dgRNA
  Dbn1
tcctcgtccccaacc

SEQ ID NO: 57121 - DNA, 15 bp, Artificial Sequence
  dgRNA
  Osbpl1a
cctgtgggctaagcg

SEQ ID NO: 57122 - DNA, 15 bp, Artificial Sequence
  dgRNA
  Osbpl1a
gaggtcccaatgagc

SEQ ID NO: 57123 - DNA, 15 bp, Artificial Sequence
  dgRNA
  Osbpl1a
aggtcccaatgagct

SEQ ID NO: 57124 - DNA, 15 bp, Artificial Sequence
  dgRNA
  Osbpl1a
gagctgggcgaggtt

SEQ ID NO: 57125 - DNA, 15 bp, Artificial Sequence
  dgRNA
  G3bp2
aaccggcctaaagtc

SEQ ID NO: 57126 - DNA, 15 bp, Artificial Sequence
  dgRNA
  G3bp2
gaaccggcctaaagt

SEQ ID NO: 57127 - DNA, 15 bp, Artificial Sequence
  dgRNA
  G3bp2
ccagggaaccggaac

SEQ ID NO: 57128 - DNA, 15 bp, Artificial Sequence
  dgRNA
  G3bp2
gcgtccggaaagcca

SEQ ID NO: 57129 - DNA, 15 bp, Artificial Sequence
  dgRNA
  Sdr39u1
ctagagttgttcttt

SEQ ID NO: 57130 - DNA, 15 bp, Artificial Sequence
  dgRNA
  Sdr39u1
tactataactccttc

SEQ ID NO: 57131 - DNA, 15 bp, Artificial Sequence
  dgRNA
  Sdr39u1
taactccttccgggt

SEQ ID NO: 57132 - DNA, 15 bp, Artificial Sequence
  dgRNA
  Sdr39u1
aactccttccgggtc

SEQ ID NO: 57133 - DNA, 15 bp, Artificial Sequence
  dgRNA
  Mrgpra1
agatgcagtcagtac

SEQ ID NO: 57134 - DNA, 15 bp, Artificial Sequence
  dgRNA
  Marveld3
accacgactgccccc

SEQ ID NO: 57135 - DNA, 15 bp, Artificial Sequence
  dgRNA
  Marveld3
acgactgccccctgg

SEQ ID NO: 57136 - DNA, 15 bp, Artificial Sequence
  dgRNA
  Marveld3
caggtgcgccctctc

SEQ ID NO: 57137 - DNA, 15 bp, Artificial Sequence
  dgRNA
  Marveld3
ccctctccgggccgc

SEQ ID NO: 57138 - DNA, 15 bp, Artificial Sequence
  dgRNA
  Ifitm2
acaagtctagatccc

SEQ ID NO: 57139 - DNA, 15 bp, Artificial Sequence
  dgRNA
  Ifitm2
tggaagtttatacag

SEQ ID NO: 57140 - DNA, 15 bp, Artificial Sequence
  dgRNA
  Ifitm2
gtaatttgatactca

SEQ ID NO: 57141 - DNA, 15 bp, Artificial Sequence
  dgRNA
  Ifitm2
cacagtaaggccctc

SEQ ID NO: 57142 - DNA, 15 bp, Artificial Sequence
  dgRNA
  Psmb11
acatgtctcactccc

SEQ ID NO: 57143 - DNA, 15 bp, Artificial Sequence
  dgRNA
  Sipa1l1
ggggaccagtcgctt

SEQ ID NO: 57144 - DNA, 15 bp, Artificial Sequence
  dgRNA
  Sipa1l1
tcgcttcggcctccg

SEQ ID NO: 57145 - DNA, 15 bp, Artificial Sequence
  dgRNA
  Sipa1l1
gcctccgcggcgcaa

SEQ ID NO: 57146 - DNA, 15 bp, Artificial Sequence
  dgRNA
  Sipa1l1
cggcgcaacggagcg

SEQ ID NO: 57147 - DNA, 15 bp, Artificial Sequence
  dgRNA
  Mrps10
ccaggaccgcttccg

SEQ ID NO: 57148 - DNA, 15 bp, Artificial Sequence
  dgRNA
  Mrps10
cccaggaccgcttcc

SEQ ID NO: 57149 - DNA, 15 bp, Artificial Sequence
  dgRNA
  Ndfip1
ctcaaccctgcaaga

SEQ ID NO: 57150 - DNA, 15 bp, Artificial Sequence
  dgRNA
  Ndfip1
cgacttcagcgactc

SEQ ID NO: 57151 - DNA, 15 bp, Artificial Sequence
  dgRNA
  Ndfip1
actccggagtagctg

SEQ ID NO: 57152 - DNA, 15 bp, Artificial Sequence
  dgRNA
  Ndfip1
ccggagtagctgcgg

SEQ ID NO: 57153 - DNA, 15 bp, Artificial Sequence
  dgRNA
  Anxa8
aaccacacctactat

SEQ ID NO: 57154 - DNA, 15 bp, Artificial Sequence
  dgRNA
  Anxa8
accacacctactatc

SEQ ID NO: 57155 - DNA, 15 bp, Artificial Sequence
  dgRNA
  Anxa8
ccacacctactatcg

SEQ ID NO: 57156 - DNA, 15 bp, Artificial Sequence
  dgRNA
  Anxa8
ccccgatagtaggtg

SEQ ID NO: 57157 - DNA, 15 bp, Artificial Sequence
  dgRNA
  Ankrd26
ctccgccttaaaccc

SEQ ID NO: 57158 - DNA, 15 bp, Artificial Sequence
  dgRNA
  Ankrd26
tccgccttaaacccc

SEQ ID NO: 57159 - DNA, 15 bp, Artificial Sequence
  dgRNA
  Ankrd26
gttagagaacccgct

SEQ ID NO: 57160 - DNA, 15 bp, Artificial Sequence
  dgRNA
  Ankrd26
cgtgcgcacgcgtgc

SEQ ID NO: 57161 - DNA, 15 bp, Artificial Sequence
  dgRNA
  Mfsd11
gctagccacagcgtg

SEQ ID NO: 57162 - DNA, 15 bp, Artificial Sequence
  dgRNA
  Mfsd11
ccccccacggggcgc

SEQ ID NO: 57163 - DNA, 15 bp, Artificial Sequence
  dgRNA
  Mfsd11
cccccacggggcgcc

SEQ ID NO: 57164 - DNA, 15 bp, Artificial Sequence
  dgRNA
  Mfsd11
gactacatttcccgg

SEQ ID NO: 57165 - DNA, 15 bp, Artificial Sequence
  dgRNA
  Fgl1
cctctaatcaaataa

SEQ ID NO: 57166 - DNA, 15 bp, Artificial Sequence
  dgRNA
  Fgl1
ctctaatcaaataat

SEQ ID NO: 57167 - DNA, 15 bp, Artificial Sequence
  dgRNA
  Fgl1
atcagttttactgga

SEQ ID NO: 57168 - DNA, 15 bp, Artificial Sequence
  dgRNA
  Fgl1
ccattatttgattag

SEQ ID NO: 57169 - DNA, 15 bp, Artificial Sequence
  dgRNA
  Atg12
cacggaggcgcgtca

SEQ ID NO: 57170 - DNA, 15 bp, Artificial Sequence
  dgRNA
  Atg12
atagcgctccatact

SEQ ID NO: 57171 - DNA, 15 bp, Artificial Sequence
  dgRNA
  Atg12
aacatactatctacc

SEQ ID NO: 57172 - DNA, 15 bp, Artificial Sequence
  dgRNA
  Atg12
acgcttcctgtgtca

SEQ ID NO: 57173 - DNA, 15 bp, Artificial Sequence
  dgRNA
  Pip4k2c
cagaacgttcgccta

SEQ ID NO: 57174 - DNA, 15 bp, Artificial Sequence
  dgRNA
  Pip4k2c
agtgcaacccgagcc

SEQ ID NO: 57175 - DNA, 15 bp, Artificial Sequence
  dgRNA
  Pip4k2c
agccaggtgaccgcc

SEQ ID NO: 57176 - DNA, 15 bp, Artificial Sequence
  dgRNA
  Pip4k2c
accgcccggcagccg

SEQ ID NO: 57177 - DNA, 15 bp, Artificial Sequence
  dgRNA
  Nol6
tcctcccttcccgaa

SEQ ID NO: 57178 - DNA, 15 bp, Artificial Sequence
  dgRNA
  Nol6
cctcccttcccgaaa

SEQ ID NO: 57179 - DNA, 15 bp, Artificial Sequence
  dgRNA
  Nol6
cccgaaagggaagtg

SEQ ID NO: 57180 - DNA, 15 bp, Artificial Sequence
  dgRNA
  Nol6
gcttccggtgtgatg

SEQ ID NO: 57181 - DNA, 15 bp, Artificial Sequence
  dgRNA
  Rwdd2a
aatcacagcccggaa

SEQ ID NO: 57182 - DNA, 15 bp, Artificial Sequence
  dgRNA
  Rwdd2a
cgccccgaccaatcg

SEQ ID NO: 57183 - DNA, 15 bp, Artificial Sequence
  dgRNA
  Rwdd2a
cccgaccaatcgcgg

SEQ ID NO: 57184 - DNA, 15 bp, Artificial Sequence
  dgRNA
  Rwdd2a
ccgaccaatcgcggc

SEQ ID NO: 57185 - DNA, 15 bp, Artificial Sequence
  dgRNA
  Olfr118
ctatcataattgctg

SEQ ID NO: 57186 - DNA, 15 bp, Artificial Sequence
  dgRNA
  Tmod1
tccgattattttaag

SEQ ID NO: 57187 - DNA, 15 bp, Artificial Sequence
  dgRNA
  Tmod1
tctcaatgctgtgta

SEQ ID NO: 57188 - DNA, 15 bp, Artificial Sequence
  dgRNA
  Tmod1
cgttcaattctgcgt

SEQ ID NO: 57189 - DNA, 15 bp, Artificial Sequence
  dgRNA
  Tmod1
ttgcacgtccacaga

SEQ ID NO: 57190 - DNA, 15 bp, Artificial Sequence
  dgRNA
  Gli3
gggccggtgactcag

SEQ ID NO: 57191 - DNA, 15 bp, Artificial Sequence
  dgRNA
  Gli3
ggccggtgactcaga

SEQ ID NO: 57192 - DNA, 15 bp, Artificial Sequence
  dgRNA
  Gli3
gagggatcagattac

SEQ ID NO: 57193 - DNA, 15 bp, Artificial Sequence
  dgRNA
  Gli3
cctgaaactgatgcg

SEQ ID NO: 57194 - DNA, 15 bp, Artificial Sequence
  dgRNA
  Krt32
gagtataaaaaggcc

SEQ ID NO: 57195 - DNA, 15 bp, Artificial Sequence
  dgRNA
  Krt32
tatacttggccccag

SEQ ID NO: 57196 - DNA, 15 bp, Artificial Sequence
  dgRNA
  Krt32
gttgatgtttatact

SEQ ID NO: 57197 - DNA, 15 bp, Artificial Sequence
  dgRNA
  Krt32
taaagtattctcatg

SEQ ID NO: 57198 - DNA, 15 bp, Artificial Sequence
  dgRNA
  Echdc1
tcatttgcagccaat

SEQ ID NO: 57199 - DNA, 15 bp, Artificial Sequence
  dgRNA
  Echdc1
atttgcagccaattg

SEQ ID NO: 57200 - DNA, 15 bp, Artificial Sequence
  dgRNA
  Echdc1
ggggtacgaagtatt

SEQ ID NO: 57201 - DNA, 15 bp, Artificial Sequence
  dgRNA
  Echdc1
gggtacgaagtattt

SEQ ID NO: 57202 - DNA, 15 bp, Artificial Sequence
  dgRNA
  Agtr2
gatttttaaactccg

SEQ ID NO: 57203 - DNA, 15 bp, Artificial Sequence
  dgRNA
  Sar1b
gtggtccggagcaca

SEQ ID NO: 57204 - DNA, 15 bp, Artificial Sequence
  dgRNA
  Sar1b
ccggagcacagggat

SEQ ID NO: 57205 - DNA, 15 bp, Artificial Sequence
  dgRNA
  Sar1b
ggtggcgagaccgca

SEQ ID NO: 57206 - DNA, 15 bp, Artificial Sequence
  dgRNA
  Sar1b
ggcgagaccgcaagg

SEQ ID NO: 57207 - DNA, 15 bp, Artificial Sequence
  dgRNA
  Tulp4
cagcccgcgcgagcc

SEQ ID NO: 57208 - DNA, 15 bp, Artificial Sequence
  dgRNA
  Tulp4
agcccgcgcgagccc

SEQ ID NO: 57209 - DNA, 15 bp, Artificial Sequence
  dgRNA
  Tulp4
cagcaccacccgccg

SEQ ID NO: 57210 - DNA, 15 bp, Artificial Sequence
  dgRNA
  Tulp4
agcaccacccgccgc

SEQ ID NO: 57211 - DNA, 15 bp, Artificial Sequence
  dgRNA
  Ssbp1
ggcgacatcagccgg

SEQ ID NO: 57212 - DNA, 15 bp, Artificial Sequence
  dgRNA
  Ssbp1
atctcgcgagctttg

SEQ ID NO: 57213 - DNA, 15 bp, Artificial Sequence
  dgRNA
  Ssbp1
tctcgcgagctttgc

SEQ ID NO: 57214 - DNA, 15 bp, Artificial Sequence
  dgRNA
  Ssbp1
tcgttgaaatgccgc

SEQ ID NO: 57215 - DNA, 15 bp, Artificial Sequence
  dgRNA
  Leng9
cgttaggctggtgac

SEQ ID NO: 57216 - DNA, 15 bp, Artificial Sequence
  dgRNA
  Leng9
aacccgacctctaca

SEQ ID NO: 57217 - DNA, 15 bp, Artificial Sequence
  dgRNA
  Leng9
ccgacctctacaagg

SEQ ID NO: 57218 - DNA, 15 bp, Artificial Sequence
  dgRNA
  Leng9
aggataagaccaatg

SEQ ID NO: 57219 - DNA, 15 bp, Artificial Sequence
  dgRNA
  Tmem120b
tactacctacacacg

SEQ ID NO: 57220 - DNA, 15 bp, Artificial Sequence
  dgRNA
  Tmem120b
gttgcacccgccacg

SEQ ID NO: 57221 - DNA, 15 bp, Artificial Sequence
  dgRNA
  Tmem120b
gcccatgcgcatgcg

SEQ ID NO: 57222 - DNA, 15 bp, Artificial Sequence
  dgRNA
  Tmem120b
cccatgcgcatgcgc

SEQ ID NO: 57223 - DNA, 15 bp, Artificial Sequence
  dgRNA
  Zfp386
gtgaacttgattggc

SEQ ID NO: 57224 - DNA, 15 bp, Artificial Sequence
  dgRNA
  Zfp386
ctcgcgatattgtca

SEQ ID NO: 57225 - DNA, 15 bp, Artificial Sequence
  dgRNA
  Zfp386
gtcgcgtacgggatg

SEQ ID NO: 57226 - DNA, 15 bp, Artificial Sequence
  dgRNA
  Zfp386
acaaaggtcgcgtac

SEQ ID NO: 57227 - DNA, 15 bp, Artificial Sequence
  dgRNA
  Plekhb2
cggtgacgcaggacc

SEQ ID NO: 57228 - DNA, 15 bp, Artificial Sequence
  dgRNA
  Plekhb2
tggacgcgcgagtcc

SEQ ID NO: 57229 - DNA, 15 bp, Artificial Sequence
  dgRNA
  Rps27l
taatgcctaatgccc

SEQ ID NO: 57230 - DNA, 15 bp, Artificial Sequence
  dgRNA
  Rps27l
cgggcctccgaagcc

SEQ ID NO: 57231 - DNA, 15 bp, Artificial Sequence
  dgRNA
  Rps27l
tccgaagcccggcct

SEQ ID NO: 57232 - DNA, 15 bp, Artificial Sequence
  dgRNA
  Rps27l
cccggcctgggtgca

SEQ ID NO: 57233 - DNA, 15 bp, Artificial Sequence
  dgRNA
  Pkib
gtaccatagaatata

SEQ ID NO: 57234 - DNA, 15 bp, Artificial Sequence
  dgRNA
  Pkib
actccttatattcta

SEQ ID NO: 57235 - DNA, 15 bp, Artificial Sequence
  dgRNA
  Moxd2
ctcaagttatataag

SEQ ID NO: 57236 - DNA, 15 bp, Artificial Sequence
  dgRNA
  Moxd2
gatacatataagtcc

SEQ ID NO: 57237 - DNA, 15 bp, Artificial Sequence
  dgRNA
  Moxd2
atacatataagtcca

SEQ ID NO: 57238 - DNA, 15 bp, Artificial Sequence
  dgRNA
  Moxd2
atctatacttgtgcc

SEQ ID NO: 57239 - DNA, 15 bp, Artificial Sequence
  dgRNA
  Snx1
ggcacaaagacccgg

SEQ ID NO: 57240 - DNA, 15 bp, Artificial Sequence
  dgRNA
  Snx1
ttgcggttcagtgct

SEQ ID NO: 57241 - DNA, 15 bp, Artificial Sequence
  dgRNA
  Snx1
gttcagtgcttggat

SEQ ID NO: 57242 - DNA, 15 bp, Artificial Sequence
  dgRNA
  Snx1
tctgtcacgcttcta

SEQ ID NO: 57243 - DNA, 15 bp, Artificial Sequence
  dgRNA
  Trip4
tccttagcaacagcg

SEQ ID NO: 57244 - DNA, 15 bp, Artificial Sequence
  dgRNA
  Trip4
ccttagcaacagcgt

SEQ ID NO: 57245 - DNA, 15 bp, Artificial Sequence
  dgRNA
  Trip4
cttagcaacagcgtg

SEQ ID NO: 57246 - DNA, 15 bp, Artificial Sequence
  dgRNA
  Trip4
cgtggggttgctaag

SEQ ID NO: 57247 - DNA, 15 bp, Artificial Sequence
  dgRNA
  Olfr724
tataacattatatgc

SEQ ID NO: 57248 - DNA, 15 bp, Artificial Sequence
  dgRNA
  Slc7a8
ttcctccgtgatctt

SEQ ID NO: 57249 - DNA, 15 bp, Artificial Sequence
  dgRNA
  Slc7a8
ctccgtgatctttgg

SEQ ID NO: 57250 - DNA, 15 bp, Artificial Sequence
  dgRNA
  Slc7a8
aggagatgcggctta

SEQ ID NO: 57251 - DNA, 15 bp, Artificial Sequence
  dgRNA
  Slc7a8
gatgcggcttaagga

SEQ ID NO: 57252 - DNA, 15 bp, Artificial Sequence
  dgRNA
  Ddr2
aagtcaagcagtatt

SEQ ID NO: 57253 - DNA, 15 bp, Artificial Sequence
  dgRNA
  Ddr2
agaacccggggtgct

SEQ ID NO: 57254 - DNA, 15 bp, Artificial Sequence
  dgRNA
  Ddr2
gaacccggggtgctt

SEQ ID NO: 57255 - DNA, 15 bp, Artificial Sequence
  dgRNA
  Ddr2
tgggatctcatggat

SEQ ID NO: 57256 - DNA, 15 bp, Artificial Sequence
  dgRNA
  Mesdc2
ctatggggcggagtc

SEQ ID NO: 57257 - DNA, 15 bp, Artificial Sequence
  dgRNA
  Mesdc2
aggaggcggtaccct

SEQ ID NO: 57258 - DNA, 15 bp, Artificial Sequence
  dgRNA
  Mesdc2
ggaggcggtacccta

SEQ ID NO: 57259 - DNA, 15 bp, Artificial Sequence
  dgRNA
  Mesdc2
gaggcggtaccctag

SEQ ID NO: 57260 - DNA, 15 bp, Artificial Sequence
  dgRNA
  Gm525
attacagaatgcact

SEQ ID NO: 57261 - DNA, 15 bp, Artificial Sequence
  dgRNA
  Gm525
ctccaagccgcactc

SEQ ID NO: 57262 - DNA, 15 bp, Artificial Sequence
  dgRNA
  Gm525
caagccgcactcagg

SEQ ID NO: 57263 - DNA, 15 bp, Artificial Sequence
  dgRNA
  Gm525
aggatgaaaattcgc

SEQ ID NO: 57264 - DNA, 15 bp, Artificial Sequence
  dgRNA
  Mrpl49
tgcagcgcgaccgcg

SEQ ID NO: 57265 - DNA, 15 bp, Artificial Sequence
  dgRNA
  Mrpl49
gaccgcgcggatcgc

SEQ ID NO: 57266 - DNA, 15 bp, Artificial Sequence
  dgRNA
  Mrpl49
cgcgcggatcgctgg

SEQ ID NO: 57267 - DNA, 15 bp, Artificial Sequence
  dgRNA
  Mrpl49
ccttacgctgtacgc

SEQ ID NO: 57268 - DNA, 15 bp, Artificial Sequence
  dgRNA
  Acox1
ttgctttccttggcg

SEQ ID NO: 57269 - DNA, 15 bp, Artificial Sequence
  dgRNA
  Acox1
tggcgaggagccgct

SEQ ID NO: 57270 - DNA, 15 bp, Artificial Sequence
  dgRNA
  Acox1
ggcgaggagccgctc

SEQ ID NO: 57271 - DNA, 15 bp, Artificial Sequence
  dgRNA
  Acox1
gcgaggagccgctcg

SEQ ID NO: 57272 - DNA, 15 bp, Artificial Sequence
  dgRNA
  Ramp1
ttgtcctacagacgt

SEQ ID NO: 57273 - DNA, 15 bp, Artificial Sequence
  dgRNA
  Ramp1
agacgttggttgtca

SEQ ID NO: 57274 - DNA, 15 bp, Artificial Sequence
  dgRNA
  Ramp1
gttggttgtcagggc

SEQ ID NO: 57275 - DNA, 15 bp, Artificial Sequence
  dgRNA
  Ramp1
acaaccaacgtctgt

SEQ ID NO: 57276 - DNA, 15 bp, Artificial Sequence
  dgRNA
  Car7
cctcccgcgaaccac

SEQ ID NO: 57277 - DNA, 15 bp, Artificial Sequence
  dgRNA
  Car7
ctcccgcgaaccact

SEQ ID NO: 57278 - DNA, 15 bp, Artificial Sequence
  dgRNA
  Car7
cgcctccgcgcagcg

SEQ ID NO: 57279 - DNA, 15 bp, Artificial Sequence
  dgRNA
  Car7
gcctccgcgcagcgc

SEQ ID NO: 57280 - DNA, 15 bp, Artificial Sequence
  dgRNA
  Zfp82
cgcgcaacgccctgt

SEQ ID NO: 57281 - DNA, 15 bp, Artificial Sequence
  dgRNA
  Zfp82
cgccctgtaggctct

SEQ ID NO: 57282 - DNA, 15 bp, Artificial Sequence
  dgRNA
  Zfp82
ccctgtaggctctcg

SEQ ID NO: 57283 - DNA, 15 bp, Artificial Sequence
  dgRNA
  Zfp82
tgtcacctcagcgcg

SEQ ID NO: 57284 - DNA, 15 bp, Artificial Sequence
  dgRNA
  Dclk2
cgcgcccgagagcgc

SEQ ID NO: 57285 - DNA, 15 bp, Artificial Sequence
  dgRNA
  Dclk2
cccgagagcgcaggc

SEQ ID NO: 57286 - DNA, 15 bp, Artificial Sequence
  dgRNA
  Dclk2
ggccggatgcgaacc

SEQ ID NO: 57287 - DNA, 15 bp, Artificial Sequence
  dgRNA
  Dclk2
gccggatgcgaaccc

SEQ ID NO: 57288 - DNA, 15 bp, Artificial Sequence
  dgRNA
  Pramel7
gatgcctactatgag

SEQ ID NO: 57289 - DNA, 15 bp, Artificial Sequence
  dgRNA
  Pramel7
cctaatttttccccc

SEQ ID NO: 57290 - DNA, 15 bp, Artificial Sequence
  dgRNA
  Pramel7
ttaacccctcatagt

SEQ ID NO: 57291 - DNA, 15 bp, Artificial Sequence
  dgRNA
  Pde7b
acctcagctaatcac

SEQ ID NO: 57292 - DNA, 15 bp, Artificial Sequence
  dgRNA
  Pde7b
gtcactctcgaaatg

SEQ ID NO: 57293 - DNA, 15 bp, Artificial Sequence
  dgRNA
  Pde7b
actccagtaagctgc

SEQ ID NO: 57294 - DNA, 15 bp, Artificial Sequence
  dgRNA
  Pde7b
ggcgcagaagccgat

SEQ ID NO: 57295 - DNA, 15 bp, Artificial Sequence
  dgRNA
  Ccdc59
gactactttaagttg

SEQ ID NO: 57296 - DNA, 15 bp, Artificial Sequence
  dgRNA
  Ccdc59
cagattagaacccag

SEQ ID NO: 57297 - DNA, 15 bp, Artificial Sequence
  dgRNA
  Ccdc59
gattagaacccagag

SEQ ID NO: 57298 - DNA, 15 bp, Artificial Sequence
  dgRNA
  Ccdc59
ccgccgagttccacc

SEQ ID NO: 57299 - DNA, 15 bp, Artificial Sequence
  dgRNA
  Olfr462
acctcttcagagacg

SEQ ID NO: 57300 - DNA, 15 bp, Artificial Sequence
  dgRNA
  Olfr462
gccccgcatgcttac

SEQ ID NO: 57301 - DNA, 15 bp, Artificial Sequence
  dgRNA
  Olfr462
ccccgcatgcttaca

SEQ ID NO: 57302 - DNA, 15 bp, Artificial Sequence
  dgRNA
  Olfr462
acctcgtctctgaag

SEQ ID NO: 57303 - DNA, 15 bp, Artificial Sequence
  dgRNA
  Rhox5
gttcccggggacacc

SEQ ID NO: 57304 - DNA, 15 bp, Artificial Sequence
  dgRNA
  Rhox5
ttcccggggacacca

SEQ ID NO: 57305 - DNA, 15 bp, Artificial Sequence
  dgRNA
  Rhox5
tcccggggacaccag

SEQ ID NO: 57306 - DNA, 15 bp, Artificial Sequence
  dgRNA
  Rhox5
tcattgatcctattc

SEQ ID NO: 57307 - DNA, 15 bp, Artificial Sequence
  dgRNA
  Fam46b
gtgttggcccgtgat

SEQ ID NO: 57308 - DNA, 15 bp, Artificial Sequence
  dgRNA
  Fam46b
tgttggcccgtgata

SEQ ID NO: 57309 - DNA, 15 bp, Artificial Sequence
  dgRNA
  Fam46b
gttggcccgtgatag

SEQ ID NO: 57310 - DNA, 15 bp, Artificial Sequence
  dgRNA
  Fam46b
ttggcccgtgatagg

SEQ ID NO: 57311 - DNA, 15 bp, Artificial Sequence
  dgRNA
  B4galt5
ggccccgcccttact

SEQ ID NO: 57312 - DNA, 15 bp, Artificial Sequence
  dgRNA
  B4galt5
tactcggtccccatc

SEQ ID NO: 57313 - DNA, 15 bp, Artificial Sequence
  dgRNA
  B4galt5
ccccgccctcctaac

SEQ ID NO: 57314 - DNA, 15 bp, Artificial Sequence
  dgRNA
  B4galt5
agctcctctggtcgt

SEQ ID NO: 57315 - DNA, 15 bp, Artificial Sequence
  dgRNA
  Mapre3
ggggttgtccgcttc

SEQ ID NO: 57316 - DNA, 15 bp, Artificial Sequence
  dgRNA
  Mapre3
ccgcttctggccgcc

SEQ ID NO: 57317 - DNA, 15 bp, Artificial Sequence
  dgRNA
  Mapre3
ggccgcccggttgcc

SEQ ID NO: 57318 - DNA, 15 bp, Artificial Sequence
  dgRNA
  Mapre3
ccggttgcctggaga

SEQ ID NO: 57319 - DNA, 15 bp, Artificial Sequence
  dgRNA
  Col6a5
cggcttccctaagac

SEQ ID NO: 57320 - DNA, 15 bp, Artificial Sequence
  dgRNA
  Col6a5
ctaagaccggtacag

SEQ ID NO: 57321 - DNA, 15 bp, Artificial Sequence
  dgRNA
  Col6a5
taagaccggtacagt

SEQ ID NO: 57322 - DNA, 15 bp, Artificial Sequence
  dgRNA
  Col6a5
ggggaagcccggcca

SEQ ID NO: 57323 - DNA, 15 bp, Artificial Sequence
  dgRNA
  Zfp300
ctccgctgtacgaaa

SEQ ID NO: 57324 - DNA, 15 bp, Artificial Sequence
  dgRNA
  Zfp300
gctcccttaaaaaca

SEQ ID NO: 57325 - DNA, 15 bp, Artificial Sequence
  dgRNA
  Zfp300
aaaaacacggcttat

SEQ ID NO: 57326 - DNA, 15 bp, Artificial Sequence
  dgRNA
  Zfp300
agcgctgacagcttc

SEQ ID NO: 57327 - DNA, 15 bp, Artificial Sequence
  dgRNA
  Ssbp4
tgctggagcgcgtcc

SEQ ID NO: 57328 - DNA, 15 bp, Artificial Sequence
  dgRNA
  Ssbp4
gctggagcgcgtccc

SEQ ID NO: 57329 - DNA, 15 bp, Artificial Sequence
  dgRNA
  Ssbp4
gggcttgaatatctt

SEQ ID NO: 57330 - DNA, 15 bp, Artificial Sequence
  dgRNA
  Ssbp4
ggcttgaatatcttt

SEQ ID NO: 57331 - DNA, 15 bp, Artificial Sequence
  dgRNA
  Krtap8-1
acataacttgtttga

SEQ ID NO: 57332 - DNA, 15 bp, Artificial Sequence
  dgRNA
  Krtap8-1
ttgtgtagtgcaaat

SEQ ID NO: 57333 - DNA, 15 bp, Artificial Sequence
  dgRNA
  Krtap8-1
gccacaccccccagt

SEQ ID NO: 57334 - DNA, 15 bp, Artificial Sequence
  dgRNA
  Krtap8-1
cacaccccccagtcg

SEQ ID NO: 57335 - DNA, 15 bp, Artificial Sequence
  dgRNA
  Aspa
atccaaatatggtca

SEQ ID NO: 57336 - DNA, 15 bp, Artificial Sequence
  dgRNA
  Aspa
aaatatggtcaaggg

SEQ ID NO: 57337 - DNA, 15 bp, Artificial Sequence
  dgRNA
  Aspa
atatggtcaagggag

SEQ ID NO: 57338 - DNA, 15 bp, Artificial Sequence
  dgRNA
  Aspa
gtccatagaataaac

SEQ ID NO: 57339 - DNA, 15 bp, Artificial Sequence
  dgRNA
  Cops4
gataataatcagtcc

SEQ ID NO: 57340 - DNA, 15 bp, Artificial Sequence
  dgRNA
  Cops4
tcagtcccggaactt

SEQ ID NO: 57341 - DNA, 15 bp, Artificial Sequence
  dgRNA
  Cops4
cagtcccggaactta

SEQ ID NO: 57342 - DNA, 15 bp, Artificial Sequence
  dgRNA
  Cops4
cgtcctttgacttgc

SEQ ID NO: 57343 - DNA, 15 bp, Artificial Sequence
  dgRNA
  Kctd17
cctggtactcgcccg

SEQ ID NO: 57344 - DNA, 15 bp, Artificial Sequence
  dgRNA
  Kctd17
ctcgcccgcggcgtg

SEQ ID NO: 57345 - DNA, 15 bp, Artificial Sequence
  dgRNA
  Kctd17
gcccgcggcgtgcgg

SEQ ID NO: 57346 - DNA, 15 bp, Artificial Sequence
  dgRNA
  Kctd17
cccgcggcgtgcgga

SEQ ID NO: 57347 - DNA, 15 bp, Artificial Sequence
  dgRNA
  Snf8
ggccaacacagctct

SEQ ID NO: 57348 - DNA, 15 bp, Artificial Sequence
  dgRNA
  Snf8
catctgtcgctctcc

SEQ ID NO: 57349 - DNA, 15 bp, Artificial Sequence
  dgRNA
  Snf8
gtttgcgatgtcgtc

SEQ ID NO: 57350 - DNA, 15 bp, Artificial Sequence
  dgRNA
  Snf8
gtcgtctggacttcc

SEQ ID NO: 57351 - DNA, 15 bp, Artificial Sequence
  dgRNA
  Serpina3b
gtagaagactcttag

SEQ ID NO: 57352 - DNA, 15 bp, Artificial Sequence
  dgRNA
  Serpina3b
tggatgtcctcattg

SEQ ID NO: 57353 - DNA, 15 bp, Artificial Sequence
  dgRNA
  Serpina3b
tcttctacacaacat

SEQ ID NO: 57354 - DNA, 15 bp, Artificial Sequence
  dgRNA
  Serpina3b
gtgacaaggacttac

SEQ ID NO: 57355 - DNA, 15 bp, Artificial Sequence
  dgRNA
  1110008P14Rik
ttgctccgctgacag

SEQ ID NO: 57356 - DNA, 15 bp, Artificial Sequence
  dgRNA
  1110008P14Rik
gcgggtcactgcggc

SEQ ID NO: 57357 - DNA, 15 bp, Artificial Sequence
  dgRNA
  1110008P14Rik
cgggtcactgcggcc

SEQ ID NO: 57358 - DNA, 15 bp, Artificial Sequence
  dgRNA
  1110008P14Rik
cactgcggccgggag

SEQ ID NO: 57359 - DNA, 15 bp, Artificial Sequence
  dgRNA
  Teddm1b
gcagtcaattcacca

SEQ ID NO: 57360 - DNA, 15 bp, Artificial Sequence
  dgRNA
  Teddm1b
gggaacgagatgatg

SEQ ID NO: 57361 - DNA, 15 bp, Artificial Sequence
  dgRNA
  Teddm1b
cacccctcactcaag

SEQ ID NO: 57362 - DNA, 15 bp, Artificial Sequence
  dgRNA
  Teddm1b
aagagggctcctgtc

SEQ ID NO: 57363 - DNA, 15 bp, Artificial Sequence
  dgRNA
  Nrxn3
tgctgcactaagatt

SEQ ID NO: 57364 - DNA, 15 bp, Artificial Sequence
  dgRNA
  Nrxn3
gcactaagattcgga

SEQ ID NO: 57365 - DNA, 15 bp, Artificial Sequence
  dgRNA
  Nrxn3
tcacgaacaacactg

SEQ ID NO: 57366 - DNA, 15 bp, Artificial Sequence
  dgRNA
  Nrxn3
cacgaacaacactga

SEQ ID NO: 57367 - DNA, 15 bp, Artificial Sequence
  dgRNA
  Zmym4
gattaggcctagcct

SEQ ID NO: 57368 - DNA, 15 bp, Artificial Sequence
  dgRNA
  Zmym4
tcaccgcgcacgctc

SEQ ID NO: 57369 - DNA, 15 bp, Artificial Sequence
  dgRNA
  Zmym4
gcgcacgctcaggac

SEQ ID NO: 57370 - DNA, 15 bp, Artificial Sequence
  dgRNA
  Zmym4
cgcacgctcaggacc

SEQ ID NO: 57371 - DNA, 15 bp, Artificial Sequence
  dgRNA
  Dlgap4
cctttcaagaccggc

SEQ ID NO: 57372 - DNA, 15 bp, Artificial Sequence
  dgRNA
  Dlgap4
caagaccggccggcc

SEQ ID NO: 57373 - DNA, 15 bp, Artificial Sequence
  dgRNA
  Dlgap4
aagaccggccggcca

SEQ ID NO: 57374 - DNA, 15 bp, Artificial Sequence
  dgRNA
  Dlgap4
agggcgtgggccgcg

SEQ ID NO: 57375 - DNA, 15 bp, Artificial Sequence
  dgRNA
  Ermp1
catttctaggtttat

SEQ ID NO: 57376 - DNA, 15 bp, Artificial Sequence
  dgRNA
  Ermp1
ttccgtccgctcact

SEQ ID NO: 57377 - DNA, 15 bp, Artificial Sequence
  dgRNA
  Ermp1
cgtccgctcactagg

SEQ ID NO: 57378 - DNA, 15 bp, Artificial Sequence
  dgRNA
  Ermp1
ccagcagactgtcaa

SEQ ID NO: 57379 - DNA, 15 bp, Artificial Sequence
  dgRNA
  Nudt3
ccgtggggtcgcggg

SEQ ID NO: 57380 - DNA, 15 bp, Artificial Sequence
  dgRNA
  Nudt3
gcgccgcgcctcacc

SEQ ID NO: 57381 - DNA, 15 bp, Artificial Sequence
  dgRNA
  Nudt3
ccgcgccagcttccg

SEQ ID NO: 57382 - DNA, 15 bp, Artificial Sequence
  dgRNA
  Nudt3
acgctctcccgcgcc

SEQ ID NO: 57383 - DNA, 15 bp, Artificial Sequence
  dgRNA
  Olfr517
ataacaatatgattc

SEQ ID NO: 57384 - DNA, 15 bp, Artificial Sequence
  dgRNA
  Olfr517
gaatagctacacaat

SEQ ID NO: 57385 - DNA, 15 bp, Artificial Sequence
  dgRNA
  Rpl35a
taaagttcttgagcg

SEQ ID NO: 57386 - DNA, 15 bp, Artificial Sequence
  dgRNA
  Rpl35a
ttcttgagcgcggct

SEQ ID NO: 57387 - DNA, 15 bp, Artificial Sequence
  dgRNA
  Rpl35a
ctggcgcagtgtgag

SEQ ID NO: 57388 - DNA, 15 bp, Artificial Sequence
  dgRNA
  Rpl35a
tgagcggcctaagcg

SEQ ID NO: 57389 - DNA, 15 bp, Artificial Sequence
  dgRNA
  Klhl34
cttactttgtctgag

SEQ ID NO: 57390 - DNA, 15 bp, Artificial Sequence
  dgRNA
  Klhl34
gccaaatctggatga

SEQ ID NO: 57391 - DNA, 15 bp, Artificial Sequence
  dgRNA
  Klhl34
ggttttaagctgagc

SEQ ID NO: 57392 - DNA, 15 bp, Artificial Sequence
  dgRNA
  Klhl34
atcagcctttgctag

SEQ ID NO: 57393 - DNA, 15 bp, Artificial Sequence
  dgRNA
  Dst
ccgcgtgctgagtca

SEQ ID NO: 57394 - DNA, 15 bp, Artificial Sequence
  dgRNA
  Dst
ctccatcagtcgttc

SEQ ID NO: 57395 - DNA, 15 bp, Artificial Sequence
  dgRNA
  Dst
tccatcagtcgttcc

SEQ ID NO: 57396 - DNA, 15 bp, Artificial Sequence
  dgRNA
  Dst
ccatcagtcgttccg

SEQ ID NO: 57397 - DNA, 15 bp, Artificial Sequence
  dgRNA
  Tspan12
tgcaacaaatcaata

SEQ ID NO: 57398 - DNA, 15 bp, Artificial Sequence
  dgRNA
  Tspan12
atcaataaggttcac

SEQ ID NO: 57399 - DNA, 15 bp, Artificial Sequence
  dgRNA
  Tspan12
tcaataaggttcaca

SEQ ID NO: 57400 - DNA, 15 bp, Artificial Sequence
  dgRNA
  Tspan12
atgacaagtcaccgg

SEQ ID NO: 57401 - DNA, 15 bp, Artificial Sequence
  dgRNA
  Barx1
caaggcagtgacgcg

SEQ ID NO: 57402 - DNA, 15 bp, Artificial Sequence
  dgRNA
  Barx1
gcagtgacgcggggc

SEQ ID NO: 57403 - DNA, 15 bp, Artificial Sequence
  dgRNA
  Barx1
gacgcggggctggcc

SEQ ID NO: 57404 - DNA, 15 bp, Artificial Sequence
  dgRNA
  Barx1
aggctagaggcgcgg

SEQ ID NO: 57405 - DNA, 15 bp, Artificial Sequence
  dgRNA
  Olfr829
ggttctggaggttat

SEQ ID NO: 57406 - DNA, 15 bp, Artificial Sequence
  dgRNA
  Olfr829
tcacgatatctagag

SEQ ID NO: 57407 - DNA, 15 bp, Artificial Sequence
  dgRNA
  Olfr829
tagatatcgtgattt

SEQ ID NO: 57408 - DNA, 15 bp, Artificial Sequence
  dgRNA
  Olfr829
ctagatatcgtgatt

SEQ ID NO: 57409 - DNA, 15 bp, Artificial Sequence
  dgRNA
  Grb14
aggtccccacgcttc

SEQ ID NO: 57410 - DNA, 15 bp, Artificial Sequence
  dgRNA
  Grb14
gcgcccccgagtgcc

SEQ ID NO: 57411 - DNA, 15 bp, Artificial Sequence
  dgRNA
  Grb14
cgcccccgagtgccc

SEQ ID NO: 57412 - DNA, 15 bp, Artificial Sequence
  dgRNA
  Grb14
gcccgggctacgcgc

SEQ ID NO: 57413 - DNA, 15 bp, Artificial Sequence
  dgRNA
  Mpc2
aagaggaagtccgac

SEQ ID NO: 57414 - DNA, 15 bp, Artificial Sequence
  dgRNA
  Mpc2
gcgtcatcttcagtt

SEQ ID NO: 57415 - DNA, 15 bp, Artificial Sequence
  dgRNA
  Mpc2
cgtcatcttcagttc

SEQ ID NO: 57416 - DNA, 15 bp, Artificial Sequence
  dgRNA
  Mpc2
tcttcagttcgggag

SEQ ID NO: 57417 - DNA, 15 bp, Artificial Sequence
  dgRNA
  Mia
cgtctctagttatcc

SEQ ID NO: 57418 - DNA, 15 bp, Artificial Sequence
  dgRNA
  Mia
gtctctagttatcca

SEQ ID NO: 57419 - DNA, 15 bp, Artificial Sequence
  dgRNA
  Mia
tctctagttatccag

SEQ ID NO: 57420 - DNA, 15 bp, Artificial Sequence
  dgRNA
  Mia
ctctagttatccagg

SEQ ID NO: 57421 - DNA, 15 bp, Artificial Sequence
  dgRNA
  Dennd1c
ctagacttcccaacc

SEQ ID NO: 57422 - DNA, 15 bp, Artificial Sequence
  dgRNA
  Dennd1c
gttcctcacagaggg

SEQ ID NO: 57423 - DNA, 15 bp, Artificial Sequence
  dgRNA
  Dennd1c
ggcgggggcctcctt

SEQ ID NO: 57424 - DNA, 15 bp, Artificial Sequence
  dgRNA
  Dennd1c
ggggcctcctttggc

SEQ ID NO: 57425 - DNA, 15 bp, Artificial Sequence
  dgRNA
  Htr2b
aatcaggtcatgaac

SEQ ID NO: 57426 - DNA, 15 bp, Artificial Sequence
  dgRNA
  Htr2b
aggtcatgaactggt

SEQ ID NO: 57427 - DNA, 15 bp, Artificial Sequence
  dgRNA
  Htr2b
ggaacacgattaacg

SEQ ID NO: 57428 - DNA, 15 bp, Artificial Sequence
  dgRNA
  Htr2b
aacaacctctctggc

SEQ ID NO: 57429 - DNA, 15 bp, Artificial Sequence
  dgRNA
  Cdkn3
gtccacgccctcaac

SEQ ID NO: 57430 - DNA, 15 bp, Artificial Sequence
  dgRNA
  Cdkn3
cacgccctcaactgg

SEQ ID NO: 57431 - DNA, 15 bp, Artificial Sequence
  dgRNA
  Cdkn3
gccctcaactggcgg

SEQ ID NO: 57432 - DNA, 15 bp, Artificial Sequence
  dgRNA
  Cdkn3
ccctcaactggcgga

SEQ ID NO: 57433 - DNA, 15 bp, Artificial Sequence
  dgRNA
  Mrpl22
aggacgacgcattcc

SEQ ID NO: 57434 - DNA, 15 bp, Artificial Sequence
  dgRNA
  Mrpl22
tgacttttccggtcc

SEQ ID NO: 57435 - DNA, 15 bp, Artificial Sequence
  dgRNA
  Mrpl22
tccggtcccggaagc

SEQ ID NO: 57436 - DNA, 15 bp, Artificial Sequence
  dgRNA
  Mrpl22
cccggaagccggcct

SEQ ID NO: 57437 - DNA, 15 bp, Artificial Sequence
  dgRNA
  Ap1m2
gcgtgaatggataca

SEQ ID NO: 57438 - DNA, 15 bp, Artificial Sequence
  dgRNA
  Ap1m2
cgtgaatggatacat

SEQ ID NO: 57439 - DNA, 15 bp, Artificial Sequence
  dgRNA
  Ap1m2
gggtaggcggatgcg

SEQ ID NO: 57440 - DNA, 15 bp, Artificial Sequence
  dgRNA
  Ap1m2
ggatgcgaggatcga

SEQ ID NO: 57441 - DNA, 15 bp, Artificial Sequence
  dgRNA
  E330034G19Rik
cctagagcaaatctc

SEQ ID NO: 57442 - DNA, 15 bp, Artificial Sequence
  dgRNA
  E330034G19Rik
cattggctaagatcc

SEQ ID NO: 57443 - DNA, 15 bp, Artificial Sequence
  dgRNA
  E330034G19Rik
tagctcttccaaagt

SEQ ID NO: 57444 - DNA, 15 bp, Artificial Sequence
  dgRNA
  Gan
ggcacagctccttaa

SEQ ID NO: 57445 - DNA, 15 bp, Artificial Sequence
  dgRNA
  Gan
cgcacgcgctgccga

SEQ ID NO: 57446 - DNA, 15 bp, Artificial Sequence
  dgRNA
  Gan
cgctgccgatggcgc

SEQ ID NO: 57447 - DNA, 15 bp, Artificial Sequence
  dgRNA
  Gan
gagcttcactcagtc

SEQ ID NO: 57448 - DNA, 15 bp, Artificial Sequence
  dgRNA
  Sesn3
ctacctaactaaccc

SEQ ID NO: 57449 - DNA, 15 bp, Artificial Sequence
  dgRNA
  Sesn3
tacctaactaaccca

SEQ ID NO: 57450 - DNA, 15 bp, Artificial Sequence
  dgRNA
  Sesn3
ttcagcatcgagcct

SEQ ID NO: 57451 - DNA, 15 bp, Artificial Sequence
  dgRNA
  Sesn3
taaacttaacttgcc

SEQ ID NO: 57452 - DNA, 15 bp, Artificial Sequence
  dgRNA
  Ago2
cgccccggccgcgtc

SEQ ID NO: 57453 - DNA, 15 bp, Artificial Sequence
  dgRNA
  Ago2
ccggggcggatcgag

SEQ ID NO: 57454 - DNA, 15 bp, Artificial Sequence
  dgRNA
  Ago2
ggcggatcgagcggc

SEQ ID NO: 57455 - DNA, 15 bp, Artificial Sequence
  dgRNA
  Ago2
ggatcgagcggccgg

SEQ ID NO: 57456 - DNA, 15 bp, Artificial Sequence
  dgRNA
  Nts
gcaacagctgcaatt

SEQ ID NO: 57457 - DNA, 15 bp, Artificial Sequence
  dgRNA
  Nts
caacagctgcaatta

SEQ ID NO: 57458 - DNA, 15 bp, Artificial Sequence
  dgRNA
  Nts
cgtcactttccatca

SEQ ID NO: 57459 - DNA, 15 bp, Artificial Sequence
  dgRNA
  Nts
atcaaggttcacggg

SEQ ID NO: 57460 - DNA, 15 bp, Artificial Sequence
  dgRNA
  Stk10
gggccggccacccgg

SEQ ID NO: 57461 - DNA, 15 bp, Artificial Sequence
  dgRNA
  Stk10
ctccagagtgccccg

SEQ ID NO: 57462 - DNA, 15 bp, Artificial Sequence
  dgRNA
  Stk10
gagtgccccgcggcg

SEQ ID NO: 57463 - DNA, 15 bp, Artificial Sequence
  dgRNA
  Stk10
agtgccccgcggcgc

SEQ ID NO: 57464 - DNA, 15 bp, Artificial Sequence
  dgRNA
  Vegfc
cggctcctttcactt

SEQ ID NO: 57465 - DNA, 15 bp, Artificial Sequence
  dgRNA
  Vegfc
ctttcacttcgggcg

SEQ ID NO: 57466 - DNA, 15 bp, Artificial Sequence
  dgRNA
  Vegfc
tttcacttcgggcga

SEQ ID NO: 57467 - DNA, 15 bp, Artificial Sequence
  dgRNA
  Vegfc
ttcacttcgggcgag

SEQ ID NO: 57468 - DNA, 15 bp, Artificial Sequence
  dgRNA
  Gm8369
tgcctctaagtcaat

SEQ ID NO: 57469 - DNA, 15 bp, Artificial Sequence
  dgRNA
  Gm8369
gcctctaagtcaatt

SEQ ID NO: 57470 - DNA, 15 bp, Artificial Sequence
  dgRNA
  Gm8369
cctctaagtcaattg

SEQ ID NO: 57471 - DNA, 15 bp, Artificial Sequence
  dgRNA
  Gm8369
ctctaagtcaattgg

SEQ ID NO: 57472 - DNA, 15 bp, Artificial Sequence
  dgRNA
  Ahsa1
gaacgccagaagtta

SEQ ID NO: 57473 - DNA, 15 bp, Artificial Sequence
  dgRNA
  Ahsa1
aagttacggaaccta

SEQ ID NO: 57474 - DNA, 15 bp, Artificial Sequence
  dgRNA
  Ahsa1
acggaacctacggct

SEQ ID NO: 57475 - DNA, 15 bp, Artificial Sequence
  dgRNA
  Ahsa1
tacggctcggcgagc

SEQ ID NO: 57476 - DNA, 15 bp, Artificial Sequence
  dgRNA
  Agmo
ggctcgactgcagag

SEQ ID NO: 57477 - DNA, 15 bp, Artificial Sequence
  dgRNA
  Agmo
actctgataaagtgg

SEQ ID NO: 57478 - DNA, 15 bp, Artificial Sequence
  dgRNA
  Hexim1
ctaagcgatggaaga

SEQ ID NO: 57479 - DNA, 15 bp, Artificial Sequence
  dgRNA
  Hexim1
tggaagaaggcggcc

SEQ ID NO: 57480 - DNA, 15 bp, Artificial Sequence
  dgRNA
  Hexim1
tacgcattctatgat

SEQ ID NO: 57481 - DNA, 15 bp, Artificial Sequence
  dgRNA
  Hexim1
attggctacgttgca

SEQ ID NO: 57482 - DNA, 15 bp, Artificial Sequence
  dgRNA
  Susd5
tccctaataggatgg

SEQ ID NO: 57483 - DNA, 15 bp, Artificial Sequence
  dgRNA
  Susd5
aaccctgcgtgacga

SEQ ID NO: 57484 - DNA, 15 bp, Artificial Sequence
  dgRNA
  Susd5
cgacggtcctcccct

SEQ ID NO: 57485 - DNA, 15 bp, Artificial Sequence
  dgRNA
  Susd5
gacggtcctcccctc

SEQ ID NO: 57486 - DNA, 15 bp, Artificial Sequence
  dgRNA
  Tmem216
gactgccatactcta

SEQ ID NO: 57487 - DNA, 15 bp, Artificial Sequence
  dgRNA
  Tmem216
actgccatactctaa

SEQ ID NO: 57488 - DNA, 15 bp, Artificial Sequence
  dgRNA
  Tmem216
cttcaaattgcggcc

SEQ ID NO: 57489 - DNA, 15 bp, Artificial Sequence
  dgRNA
  Tmem216
ttcaaattgcggcca

SEQ ID NO: 57490 - DNA, 15 bp, Artificial Sequence
  dgRNA
  Nsd1
gggtctagttaccag

SEQ ID NO: 57491 - DNA, 15 bp, Artificial Sequence
  dgRNA
  Nsd1
ggtctagttaccaga

SEQ ID NO: 57492 - DNA, 15 bp, Artificial Sequence
  dgRNA
  Nsd1
cggtaaacactctac

SEQ ID NO: 57493 - DNA, 15 bp, Artificial Sequence
  dgRNA
  Nsd1
ggtaaacactctact

SEQ ID NO: 57494 - DNA, 15 bp, Artificial Sequence
  dgRNA
  Rasa2
ctagaggtccgttcg

SEQ ID NO: 57495 - DNA, 15 bp, Artificial Sequence
  dgRNA
  Rasa2
tagaggtccgttcgt

SEQ ID NO: 57496 - DNA, 15 bp, Artificial Sequence
  dgRNA
  Rasa2
agaggtccgttcgtg

SEQ ID NO: 57497 - DNA, 15 bp, Artificial Sequence
  dgRNA
  Rasa2
gaggtccgttcgtgg

SEQ ID NO: 57498 - DNA, 15 bp, Artificial Sequence
  dgRNA
  Olfr1370
atcagtttagtagag

SEQ ID NO: 57499 - DNA, 15 bp, Artificial Sequence
  dgRNA
  Olfr1370
tagcaaagtctagga

SEQ ID NO: 57500 - DNA, 15 bp, Artificial Sequence
  dgRNA
  Pla2g10
caaacgggaagcctg

SEQ ID NO: 57501 - DNA, 15 bp, Artificial Sequence
  dgRNA
  Pla2g10
cttcccgtttgtgga

SEQ ID NO: 57502 - DNA, 15 bp, Artificial Sequence
  dgRNA
  Pla2g10
caggcttcccgtttg

SEQ ID NO: 57503 - DNA, 15 bp, Artificial Sequence
  dgRNA
  Pla2g10
cgtgcagtctgcctc

SEQ ID NO: 57504 - DNA, 15 bp, Artificial Sequence
  dgRNA
  3110062M04Rik
ccggaacccacggga

SEQ ID NO: 57505 - DNA, 15 bp, Artificial Sequence
  dgRNA
  3110062M04Rik
ttcccgtgggttccg

SEQ ID NO: 57506 - DNA, 15 bp, Artificial Sequence
  dgRNA
  3110062M04Rik
tgcggtccttcccgt

SEQ ID NO: 57507 - DNA, 15 bp, Artificial Sequence
  dgRNA
  3110062M04Rik
ctgcggtccttcccg

SEQ ID NO: 57508 - DNA, 15 bp, Artificial Sequence
  dgRNA
  Rnpepl1
tccctgcgaaagcga

SEQ ID NO: 57509 - DNA, 15 bp, Artificial Sequence
  dgRNA
  Rnpepl1
atagttgcagcgcgc

SEQ ID NO: 57510 - DNA, 15 bp, Artificial Sequence
  dgRNA
  Rnpepl1
gctcgcgccgcgtct

SEQ ID NO: 57511 - DNA, 15 bp, Artificial Sequence
  dgRNA
  Rnpepl1
cgcgtctcggtgcac

SEQ ID NO: 57512 - DNA, 15 bp, Artificial Sequence
  dgRNA
  Psen2
ttcttacgagacgag

SEQ ID NO: 57513 - DNA, 15 bp, Artificial Sequence
  dgRNA
  Psen2
tcttacgagacgaga

SEQ ID NO: 57514 - DNA, 15 bp, Artificial Sequence
  dgRNA
  Psen2
gggtttacttattcg

SEQ ID NO: 57515 - DNA, 15 bp, Artificial Sequence
  dgRNA
  Psen2
tcgaggctagagctc

SEQ ID NO: 57516 - DNA, 15 bp, Artificial Sequence
  dgRNA
  Zfp367
aaagtatgagagcgg

SEQ ID NO: 57517 - DNA, 15 bp, Artificial Sequence
  dgRNA
  Zfp367
cggcggccaatgacg

SEQ ID NO: 57518 - DNA, 15 bp, Artificial Sequence
  dgRNA
  Zfp367
aatgacgtggcagta

SEQ ID NO: 57519 - DNA, 15 bp, Artificial Sequence
  dgRNA
  Zfp367
gacccgcgctcgaat

SEQ ID NO: 57520 - DNA, 15 bp, Artificial Sequence
  dgRNA
  2310036O22Rik
taactcgtatctagc

SEQ ID NO: 57521 - DNA, 15 bp, Artificial Sequence
  dgRNA
  2310036O22Rik
gtatctagcaggatt

SEQ ID NO: 57522 - DNA, 15 bp, Artificial Sequence
  dgRNA
  2310036O22Rik
aggattagggaaccg

SEQ ID NO: 57523 - DNA, 15 bp, Artificial Sequence
  dgRNA
  2310036O22Rik
aaagggaccggcttc

SEQ ID NO: 57524 - DNA, 15 bp, Artificial Sequence
  dgRNA
  Kcnv1
ttcttgcacctgaca

SEQ ID NO: 57525 - DNA, 15 bp, Artificial Sequence
  dgRNA
  Kcnv1
gctctacctatatct

SEQ ID NO: 57526 - DNA, 15 bp, Artificial Sequence
  dgRNA
  Kcnv1
ctacctatatctagg

SEQ ID NO: 57527 - DNA, 15 bp, Artificial Sequence
  dgRNA
  Kcnv1
tacctatatctagga

SEQ ID NO: 57528 - DNA, 15 bp, Artificial Sequence
  dgRNA
  Cyp3a59
gatacagccagtaca

SEQ ID NO: 57529 - DNA, 15 bp, Artificial Sequence
  dgRNA
  Snd1
tctttcagcgcttcc

SEQ ID NO: 57530 - DNA, 15 bp, Artificial Sequence
  dgRNA
  Snd1
gctccgcacccgttt

SEQ ID NO: 57531 - DNA, 15 bp, Artificial Sequence
  dgRNA
  Snd1
ctccgcacccgtttt

SEQ ID NO: 57532 - DNA, 15 bp, Artificial Sequence
  dgRNA
  Snd1
ccgttttgggaccaa

SEQ ID NO: 57533 - DNA, 15 bp, Artificial Sequence
  dgRNA
  Cxcr2
ataggacacctccct

SEQ ID NO: 57534 - DNA, 15 bp, Artificial Sequence
  dgRNA
  Cxcr2
taggacacctccctt

SEQ ID NO: 57535 - DNA, 15 bp, Artificial Sequence
  dgRNA
  Cxcr2
aggacacctcccttg

SEQ ID NO: 57536 - DNA, 15 bp, Artificial Sequence
  dgRNA
  Cxcr2
ggacacctcccttgg

SEQ ID NO: 57537 - DNA, 15 bp, Artificial Sequence
  dgRNA
  Pdss1
cgtccactcggagct

SEQ ID NO: 57538 - DNA, 15 bp, Artificial Sequence
  dgRNA
  Pdss1
gcattgcgaaaacaa

SEQ ID NO: 57539 - DNA, 15 bp, Artificial Sequence
  dgRNA
  Pdss1
ggcctcagggttagc

SEQ ID NO: 57540 - DNA, 15 bp, Artificial Sequence
  dgRNA
  Pdss1
agggttagcaggtac

SEQ ID NO: 57541 - DNA, 15 bp, Artificial Sequence
  dgRNA
  En1
ccgcgcgcgcccatt

SEQ ID NO: 57542 - DNA, 15 bp, Artificial Sequence
  dgRNA
  En1
tgtcagcgcgagttc

SEQ ID NO: 57543 - DNA, 15 bp, Artificial Sequence
  dgRNA
  En1
gttctggctcgccat

SEQ ID NO: 57544 - DNA, 15 bp, Artificial Sequence
  dgRNA
  En1
ggtctcacacacgtg

SEQ ID NO: 57545 - DNA, 15 bp, Artificial Sequence
  dgRNA
  Nudcd3
tgtggtattataaga

SEQ ID NO: 57546 - DNA, 15 bp, Artificial Sequence
  dgRNA
  Nudcd3
accagacacctacgc

SEQ ID NO: 57547 - DNA, 15 bp, Artificial Sequence
  dgRNA
  Nudcd3
ccacgtgacacctcc

SEQ ID NO: 57548 - DNA, 15 bp, Artificial Sequence
  dgRNA
  Nudcd3
cacgtgacacctcca

SEQ ID NO: 57549 - DNA, 15 bp, Artificial Sequence
  dgRNA
  Ptpre
atcctcccagtgtaa

SEQ ID NO: 57550 - DNA, 15 bp, Artificial Sequence
  dgRNA
  Ptpre
gagggtgagcgcccg

SEQ ID NO: 57551 - DNA, 15 bp, Artificial Sequence
  dgRNA
  Ptpre
cccccgccgcggagc

SEQ ID NO: 57552 - DNA, 15 bp, Artificial Sequence
  dgRNA
  Ptpre
gacactctatcaggg

SEQ ID NO: 57553 - DNA, 15 bp, Artificial Sequence
  dgRNA
  Cdca2
tgtacccacccaccg

SEQ ID NO: 57554 - DNA, 15 bp, Artificial Sequence
  dgRNA
  Cdca2
cacccaccgaggtaa

SEQ ID NO: 57555 - DNA, 15 bp, Artificial Sequence
  dgRNA
  Cdca2
caccgaggtaacggt

SEQ ID NO: 57556 - DNA, 15 bp, Artificial Sequence
  dgRNA
  Cdca2
ggtaacggttggtat

SEQ ID NO: 57557 - DNA, 15 bp, Artificial Sequence
  dgRNA
  Npc1
taaggcacgcccaca

SEQ ID NO: 57558 - DNA, 15 bp, Artificial Sequence
  dgRNA
  Npc1
aaggcacgcccacaa

SEQ ID NO: 57559 - DNA, 15 bp, Artificial Sequence
  dgRNA
  Npc1
aggcacgcccacaag

SEQ ID NO: 57560 - DNA, 15 bp, Artificial Sequence
  dgRNA
  Npc1
cacgcccacaagggg

SEQ ID NO: 57561 - DNA, 15 bp, Artificial Sequence
  dgRNA
  Rexo2
acatccgaaaacacg

SEQ ID NO: 57562 - DNA, 15 bp, Artificial Sequence
  dgRNA
  Rexo2
tccgaaaacacgtgg

SEQ ID NO: 57563 - DNA, 15 bp, Artificial Sequence
  dgRNA
  Rexo2
ccgaaaacacgtggc

SEQ ID NO: 57564 - DNA, 15 bp, Artificial Sequence
  dgRNA
  Rexo2
cgaaaacacgtggcg

SEQ ID NO: 57565 - DNA, 15 bp, Artificial Sequence
  dgRNA
  Ccnt1
tcggaggggtcattc

SEQ ID NO: 57566 - DNA, 15 bp, Artificial Sequence
  dgRNA
  Ccnt1
ggtcattccggaagt

SEQ ID NO: 57567 - DNA, 15 bp, Artificial Sequence
  dgRNA
  Ccnt1
tccggaagtcggcgc

SEQ ID NO: 57568 - DNA, 15 bp, Artificial Sequence
  dgRNA
  Ccnt1
cggcgctggaatctt

SEQ ID NO: 57569 - DNA, 15 bp, Artificial Sequence
  dgRNA
  Sgsh
ccgaggactcagcgc

SEQ ID NO: 57570 - DNA, 15 bp, Artificial Sequence
  dgRNA
  Sgsh
cggacgctgagactc

SEQ ID NO: 57571 - DNA, 15 bp, Artificial Sequence
  dgRNA
  Sgsh
cagggtcttccgaag

SEQ ID NO: 57572 - DNA, 15 bp, Artificial Sequence
  dgRNA
  Sgsh
ggtcttccgaagtgg

SEQ ID NO: 57573 - DNA, 15 bp, Artificial Sequence
  dgRNA
  Pdpn
actgtttactgcacg

SEQ ID NO: 57574 - DNA, 15 bp, Artificial Sequence
  dgRNA
  Acat3
acacccggaaccccc

SEQ ID NO: 57575 - DNA, 15 bp, Artificial Sequence
  dgRNA
  Acat3
gagagcgatcagcgt

SEQ ID NO: 57576 - DNA, 15 bp, Artificial Sequence
  dgRNA
  Acat3
gtgtgcaaggtctag

SEQ ID NO: 57577 - DNA, 15 bp, Artificial Sequence
  dgRNA
  Acat3
ggtgtgcaaggtcta

SEQ ID NO: 57578 - DNA, 15 bp, Artificial Sequence
  dgRNA
  Usp3
gcgtaaccagcaggg

SEQ ID NO: 57579 - DNA, 15 bp, Artificial Sequence
  dgRNA
  Usp3
cgtaaccagcagggt

SEQ ID NO: 57580 - DNA, 15 bp, Artificial Sequence
  dgRNA
  Usp3
cggggccgccggaga

SEQ ID NO: 57581 - DNA, 15 bp, Artificial Sequence
  dgRNA
  Usp3
ggccgccggagaagg

SEQ ID NO: 57582 - DNA, 15 bp, Artificial Sequence
  dgRNA
  Mmp10
aagtttactaggttg

SEQ ID NO: 57583 - DNA, 15 bp, Artificial Sequence
  dgRNA
  Mmp10
agtttactaggttga

SEQ ID NO: 57584 - DNA, 15 bp, Artificial Sequence
  dgRNA
  Mmp10
ctccctataaaagag

SEQ ID NO: 57585 - DNA, 15 bp, Artificial Sequence
  dgRNA
  Mmp10
aagagtggccactaa

SEQ ID NO: 57586 - DNA, 15 bp, Artificial Sequence
  dgRNA
  Zdhhc8
tttccgttgtcctgt

SEQ ID NO: 57587 - DNA, 15 bp, Artificial Sequence
  dgRNA
  Zdhhc8
tcctgtcggtccaga

SEQ ID NO: 57588 - DNA, 15 bp, Artificial Sequence
  dgRNA
  Zdhhc8
cctgtcggtccagat

SEQ ID NO: 57589 - DNA, 15 bp, Artificial Sequence
  dgRNA
  Zdhhc8
ggcgctgcgcgtgcg

SEQ ID NO: 57590 - DNA, 15 bp, Artificial Sequence
  dgRNA
  Pla2g4b
gtggccaactccagg

SEQ ID NO: 57591 - DNA, 15 bp, Artificial Sequence
  dgRNA
  Pla2g4b
tccagcattagctta

SEQ ID NO: 57592 - DNA, 15 bp, Artificial Sequence
  dgRNA
  Pla2g4b
ccagttggcttacct

SEQ ID NO: 57593 - DNA, 15 bp, Artificial Sequence
  dgRNA
  Pla2g4b
gatacctcctggagt

SEQ ID NO: 57594 - DNA, 15 bp, Artificial Sequence
  dgRNA
  Scrn2
gactcttatctgata

SEQ ID NO: 57595 - DNA, 15 bp, Artificial Sequence
  dgRNA
  Scrn2
ccgggactcttaagc

SEQ ID NO: 57596 - DNA, 15 bp, Artificial Sequence
  dgRNA
  Scrn2
tagcgcgcaccctcg

SEQ ID NO: 57597 - DNA, 15 bp, Artificial Sequence
  dgRNA
  Scrn2
agacggtgacattgc

SEQ ID NO: 57598 - DNA, 15 bp, Artificial Sequence
  dgRNA
  Vmac
cactgggtgccgtcg

SEQ ID NO: 57599 - DNA, 15 bp, Artificial Sequence
  dgRNA
  Vmac
ccgtcggggacctca

SEQ ID NO: 57600 - DNA, 15 bp, Artificial Sequence
  dgRNA
  Vmac
atcgccatacctagc

SEQ ID NO: 57601 - DNA, 15 bp, Artificial Sequence
  dgRNA
  Vmac
cgaccctaaagcgtc

SEQ ID NO: 57602 - DNA, 15 bp, Artificial Sequence
  dgRNA
  Armc8
aactccacctactag

SEQ ID NO: 57603 - DNA, 15 bp, Artificial Sequence
  dgRNA
  Armc8
cacctactagcggtt

SEQ ID NO: 57604 - DNA, 15 bp, Artificial Sequence
  dgRNA
  Armc8
acagctcgtcgagcc

SEQ ID NO: 57605 - DNA, 15 bp, Artificial Sequence
  dgRNA
  Armc8
cagctcgtcgagcca

SEQ ID NO: 57606 - DNA, 15 bp, Artificial Sequence
  dgRNA
  Swap70
ggtgggcattccttt

SEQ ID NO: 57607 - DNA, 15 bp, Artificial Sequence
  dgRNA
  Swap70
tgcgagctttgaaaa

SEQ ID NO: 57608 - DNA, 15 bp, Artificial Sequence
  dgRNA
  Swap70
tttacgtccccgtag

SEQ ID NO: 57609 - DNA, 15 bp, Artificial Sequence
  dgRNA
  Swap70
ttacgtccccgtagt

SEQ ID NO: 57610 - DNA, 15 bp, Artificial Sequence
  dgRNA
  Akap4
gccaacaatgatcac

SEQ ID NO: 57611 - DNA, 15 bp, Artificial Sequence
  dgRNA
  Akap4
gatcactggccaaaa

SEQ ID NO: 57612 - DNA, 15 bp, Artificial Sequence
  dgRNA
  Akap4
agaatcctaaggcta

SEQ ID NO: 57613 - DNA, 15 bp, Artificial Sequence
  dgRNA
  Akap4
ttatctatatccatt

SEQ ID NO: 57614 - DNA, 15 bp, Artificial Sequence
  dgRNA
  Emc6
tccctggttaacaaa

SEQ ID NO: 57615 - DNA, 15 bp, Artificial Sequence
  dgRNA
  Emc6
catctggagcgctgt

SEQ ID NO: 57616 - DNA, 15 bp, Artificial Sequence
  dgRNA
  Emc6
atctggagcgctgtt

SEQ ID NO: 57617 - DNA, 15 bp, Artificial Sequence
  dgRNA
  Emc6
cgctgttgggctttc

SEQ ID NO: 57618 - DNA, 15 bp, Artificial Sequence
  dgRNA
  Taf1
gacccgcgcagttga

SEQ ID NO: 57619 - DNA, 15 bp, Artificial Sequence
  dgRNA
  Taf1
acccgcgcagttgat

SEQ ID NO: 57620 - DNA, 15 bp, Artificial Sequence
  dgRNA
  Taf1
cgcgcagttgatggg

SEQ ID NO: 57621 - DNA, 15 bp, Artificial Sequence
  dgRNA
  Taf1
gcgcagttgatgggc

SEQ ID NO: 57622 - DNA, 15 bp, Artificial Sequence
  dgRNA
  Agxt2
atattagaagaggcg

SEQ ID NO: 57623 - DNA, 15 bp, Artificial Sequence
  dgRNA
  Mybl1
cgcagattcaaacgg

SEQ ID NO: 57624 - DNA, 15 bp, Artificial Sequence
  dgRNA
  Mybl1
aaacggcggctcttg

SEQ ID NO: 57625 - DNA, 15 bp, Artificial Sequence
  dgRNA
  Mybl1
aacggcggctcttga

SEQ ID NO: 57626 - DNA, 15 bp, Artificial Sequence
  dgRNA
  Mybl1
ggcggctcttgaggg

SEQ ID NO: 57627 - DNA, 15 bp, Artificial Sequence
  dgRNA
  Eif2b1
agtatccctcccgcc

SEQ ID NO: 57628 - DNA, 15 bp, Artificial Sequence
  dgRNA
  Eif2b1
caccctcaccgtcag

SEQ ID NO: 57629 - DNA, 15 bp, Artificial Sequence
  dgRNA
  Eif2b1
gtgaagcgccgccca

SEQ ID NO: 57630 - DNA, 15 bp, Artificial Sequence
  dgRNA
  Eif2b1
tgaagcgccgcccac

SEQ ID NO: 57631 - DNA, 15 bp, Artificial Sequence
  dgRNA
  Mtss1l
gccccttaatcagac

SEQ ID NO: 57632 - DNA, 15 bp, Artificial Sequence
  dgRNA
  Mtss1l
gacaactcagtcacc

SEQ ID NO: 57633 - DNA, 15 bp, Artificial Sequence
  dgRNA
  Mtss1l
gcccaacctccctat

SEQ ID NO: 57634 - DNA, 15 bp, Artificial Sequence
  dgRNA
  Mtss1l
cccaacctccctatt

SEQ ID NO: 57635 - DNA, 15 bp, Artificial Sequence
  dgRNA
  Vmn1r209
gaggctacagtaaac

SEQ ID NO: 57636 - DNA, 15 bp, Artificial Sequence
  dgRNA
  Vmn1r209
gtttactgtagcctc

SEQ ID NO: 57637 - DNA, 15 bp, Artificial Sequence
  dgRNA
  Vmn1r209
gaaaaacttgtatcc

SEQ ID NO: 57638 - DNA, 15 bp, Artificial Sequence
  dgRNA
  Vegfb
tttcccctgcagcgg

SEQ ID NO: 57639 - DNA, 15 bp, Artificial Sequence
  dgRNA
  Vegfb
ttcccctgcagcggc

SEQ ID NO: 57640 - DNA, 15 bp, Artificial Sequence
  dgRNA
  Vegfb
cctgcagcggcggga

SEQ ID NO: 57641 - DNA, 15 bp, Artificial Sequence
  dgRNA
  Vegfb
gcgtttggaggggac

SEQ ID NO: 57642 - DNA, 15 bp, Artificial Sequence
  dgRNA
  Cdc73
gccttgagaccgcac

SEQ ID NO: 57643 - DNA, 15 bp, Artificial Sequence
  dgRNA
  Cdc73
ccttgagaccgcacc

SEQ ID NO: 57644 - DNA, 15 bp, Artificial Sequence
  dgRNA
  Cdc73
cttgagaccgcaccg

SEQ ID NO: 57645 - DNA, 15 bp, Artificial Sequence
  dgRNA
  Cdc73
gaccgcaccggggcc

SEQ ID NO: 57646 - DNA, 15 bp, Artificial Sequence
  dgRNA
  Scgb1b30
gcagtgatcttctta

SEQ ID NO: 57647 - DNA, 15 bp, Artificial Sequence
  dgRNA
  Scgb1b30
tcctggtcaacatcc

SEQ ID NO: 57648 - DNA, 15 bp, Artificial Sequence
  dgRNA
  Masp2
cagatcaaaggtgat

SEQ ID NO: 57649 - DNA, 15 bp, Artificial Sequence
  dgRNA
  Masp2
aaaggtgataggcgc

SEQ ID NO: 57650 - DNA, 15 bp, Artificial Sequence
  dgRNA
  Bspry
caggcggaaccagtg

SEQ ID NO: 57651 - DNA, 15 bp, Artificial Sequence
  dgRNA
  Bspry
gtgtgggtcagcgcg

SEQ ID NO: 57652 - DNA, 15 bp, Artificial Sequence
  dgRNA
  Bspry
tgtgggtcagcgcgc

SEQ ID NO: 57653 - DNA, 15 bp, Artificial Sequence
  dgRNA
  Bspry
gcgcgggcgcagcct

SEQ ID NO: 57654 - DNA, 15 bp, Artificial Sequence
  dgRNA
  Olfr1221
gtatgaaatgtagag

SEQ ID NO: 57655 - DNA, 15 bp, Artificial Sequence
  dgRNA
  Olfr1221
atctacaataatcag

SEQ ID NO: 57656 - DNA, 15 bp, Artificial Sequence
  dgRNA
  Chia1
cgctagtatatgaac

SEQ ID NO: 57657 - DNA, 15 bp, Artificial Sequence
  dgRNA
  Chia1
tagtatatgaacagg

SEQ ID NO: 57658 - DNA, 15 bp, Artificial Sequence
  dgRNA
  Chia1
ggctattaagattca

SEQ ID NO: 57659 - DNA, 15 bp, Artificial Sequence
  dgRNA
  Chia1
cgttctttcattgtg

SEQ ID NO: 57660 - DNA, 15 bp, Artificial Sequence
  dgRNA
  Pdgfrb
cgccttccccaagct

SEQ ID NO: 57661 - DNA, 15 bp, Artificial Sequence
  dgRNA
  Pdgfrb
ctgattggccaagct

SEQ ID NO: 57662 - DNA, 15 bp, Artificial Sequence
  dgRNA
  Pdgfrb
agggccgattctgat

SEQ ID NO: 57663 - DNA, 15 bp, Artificial Sequence
  dgRNA
  Gcsh
cctagattgcggact

SEQ ID NO: 57664 - DNA, 15 bp, Artificial Sequence
  dgRNA
  Gcsh
ctccgccctccagtg

SEQ ID NO: 57665 - DNA, 15 bp, Artificial Sequence
  dgRNA
  Gcsh
cacacgcccctcgcg

SEQ ID NO: 57666 - DNA, 15 bp, Artificial Sequence
  dgRNA
  Gcsh
acacgcccctcgcgc

SEQ ID NO: 57667 - DNA, 15 bp, Artificial Sequence
  dgRNA
  Cartpt
gcagagcctcgttcc

SEQ ID NO: 57668 - DNA, 15 bp, Artificial Sequence
  dgRNA
  Cartpt
tcgttcccgggctcc

SEQ ID NO: 57669 - DNA, 15 bp, Artificial Sequence
  dgRNA
  Cartpt
ggcattgacgtcaaa

SEQ ID NO: 57670 - DNA, 15 bp, Artificial Sequence
  dgRNA
  Cartpt
agcgctgcctacaga

SEQ ID NO: 57671 - DNA, 15 bp, Artificial Sequence
  dgRNA
  Dip2b
ggcgtcatatgcagc

SEQ ID NO: 57672 - DNA, 15 bp, Artificial Sequence
  dgRNA
  Dip2b
tgccgcatcttccca

SEQ ID NO: 57673 - DNA, 15 bp, Artificial Sequence
  dgRNA
  Dip2b
gctctccaagatccg

SEQ ID NO: 57674 - DNA, 15 bp, Artificial Sequence
  dgRNA
  Dip2b
caagatccgcggtag

SEQ ID NO: 57675 - DNA, 15 bp, Artificial Sequence
  dgRNA
  Tomm20l
taagttgagataacg

SEQ ID NO: 57676 - DNA, 15 bp, Artificial Sequence
  dgRNA
  Tomm20l
aagttgagataacgt

SEQ ID NO: 57677 - DNA, 15 bp, Artificial Sequence
  dgRNA
  Tomm20l
agttgagataacgtg

SEQ ID NO: 57678 - DNA, 15 bp, Artificial Sequence
  dgRNA
  Tomm20l
gccaattgaagtgca

SEQ ID NO: 57679 - DNA, 15 bp, Artificial Sequence
  dgRNA
  Bicd1
gatgcggactccaac

SEQ ID NO: 57680 - DNA, 15 bp, Artificial Sequence
  dgRNA
  Fgf9
cagcgcatgcctttc

SEQ ID NO: 57681 - DNA, 15 bp, Artificial Sequence
  dgRNA
  Fgf9
cctgtaatatcgccc

SEQ ID NO: 57682 - DNA, 15 bp, Artificial Sequence
  dgRNA
  Fgf9
gcacttacgttgcta

SEQ ID NO: 57683 - DNA, 15 bp, Artificial Sequence
  dgRNA
  Fgf9
atctcacgttggcgg

SEQ ID NO: 57684 - DNA, 15 bp, Artificial Sequence
  dgRNA
  Akap14
gcctgcatcgcctcc

SEQ ID NO: 57685 - DNA, 15 bp, Artificial Sequence
  dgRNA
  Akap14
cctgcatcgcctcct

SEQ ID NO: 57686 - DNA, 15 bp, Artificial Sequence
  dgRNA
  Akap14
ggtcgaatagcatgt

SEQ ID NO: 57687 - DNA, 15 bp, Artificial Sequence
  dgRNA
  Akap14
ctgccatcgttgctg

SEQ ID NO: 57688 - DNA, 15 bp, Artificial Sequence
  dgRNA
  Epg5
gcggggagagtgcta

SEQ ID NO: 57689 - DNA, 15 bp, Artificial Sequence
  dgRNA
  Epg5
ctgtctttcgtgtac

SEQ ID NO: 57690 - DNA, 15 bp, Artificial Sequence
  dgRNA
  Epg5
agtcctttactagtt

SEQ ID NO: 57691 - DNA, 15 bp, Artificial Sequence
  dgRNA
  Epg5
aagttgcagcccgta

SEQ ID NO: 57692 - DNA, 15 bp, Artificial Sequence
  dgRNA
  Dhx8
gtcgccctctgctga

SEQ ID NO: 57693 - DNA, 15 bp, Artificial Sequence
  dgRNA
  Dhx8
gctgacggatcacag

SEQ ID NO: 57694 - DNA, 15 bp, Artificial Sequence
  dgRNA
  Dhx8
aaacctaaaggcggg

SEQ ID NO: 57695 - DNA, 15 bp, Artificial Sequence
  dgRNA
  Dhx8
cttcccccccgctag

SEQ ID NO: 57696 - DNA, 15 bp, Artificial Sequence
  dgRNA
  Trim13
tgaggctatgtcggt

SEQ ID NO: 57697 - DNA, 15 bp, Artificial Sequence
  dgRNA
  Trim13
gaggctatgtcggtt

SEQ ID NO: 57698 - DNA, 15 bp, Artificial Sequence
  dgRNA
  Trim13
gctatgtcggttggg

SEQ ID NO: 57699 - DNA, 15 bp, Artificial Sequence
  dgRNA
  Trim13
ctccccccatcttgg

SEQ ID NO: 57700 - DNA, 15 bp, Artificial Sequence
  dgRNA
  Hmox2
agagttctcctatct

SEQ ID NO: 57701 - DNA, 15 bp, Artificial Sequence
  dgRNA
  Fam129a
ccactccctccacga

SEQ ID NO: 57702 - DNA, 15 bp, Artificial Sequence
  dgRNA
  Fam129a
cactccctccacgat

SEQ ID NO: 57703 - DNA, 15 bp, Artificial Sequence
  dgRNA
  Fam129a
cctccacgatgggtc

SEQ ID NO: 57704 - DNA, 15 bp, Artificial Sequence
  dgRNA
  Fam129a
ctccacgatgggtct

SEQ ID NO: 57705 - DNA, 15 bp, Artificial Sequence
  dgRNA
  Wnt16
ctagttagacagtca

SEQ ID NO: 57706 - DNA, 15 bp, Artificial Sequence
  dgRNA
  Wnt16
gttagacagtcacgg

SEQ ID NO: 57707 - DNA, 15 bp, Artificial Sequence
  dgRNA
  Wnt16
cagatggtgaggtac

SEQ ID NO: 57708 - DNA, 15 bp, Artificial Sequence
  dgRNA
  Wnt16
actccaggcgcggtc

SEQ ID NO: 57709 - DNA, 15 bp, Artificial Sequence
  dgRNA
  Noct
agtccaaattacgtc

SEQ ID NO: 57710 - DNA, 15 bp, Artificial Sequence
  dgRNA
  Noct
cccaagcagttgttt

SEQ ID NO: 57711 - DNA, 15 bp, Artificial Sequence
  dgRNA
  Noct
tccagccctccaatc

SEQ ID NO: 57712 - DNA, 15 bp, Artificial Sequence
  dgRNA
  Noct
gggccagacgtaatt

SEQ ID NO: 57713 - DNA, 15 bp, Artificial Sequence
  dgRNA
  Olfr618
gattcagtgacaccc

SEQ ID NO: 57714 - DNA, 15 bp, Artificial Sequence
  dgRNA
  Olfr618
tcagacactaaatct

SEQ ID NO: 57715 - DNA, 15 bp, Artificial Sequence
  dgRNA
  Galnt4
gtgagccaggcgcga

SEQ ID NO: 57716 - DNA, 15 bp, Artificial Sequence
  dgRNA
  Galnt4
tgagccaggcgcgat

SEQ ID NO: 57717 - DNA, 15 bp, Artificial Sequence
  dgRNA
  Galnt4
gcgatgggatgtacc

SEQ ID NO: 57718 - DNA, 15 bp, Artificial Sequence
  dgRNA
  Galnt4
gtacccggccactct

SEQ ID NO: 57719 - DNA, 15 bp, Artificial Sequence
  dgRNA
  Stk38
ccgctctgcactcgt

SEQ ID NO: 57720 - DNA, 15 bp, Artificial Sequence
  dgRNA
  Stk38
cgctctgcactcgta

SEQ ID NO: 57721 - DNA, 15 bp, Artificial Sequence
  dgRNA
  Stk38
ctcgtagggcctcct

SEQ ID NO: 57722 - DNA, 15 bp, Artificial Sequence
  dgRNA
  Stk38
agggcctcctcggct

SEQ ID NO: 57723 - DNA, 15 bp, Artificial Sequence
  dgRNA
  Zfp142
ccctgcaattctcga

SEQ ID NO: 57724 - DNA, 15 bp, Artificial Sequence
  dgRNA
  Zfp142
tcgatggttccgctt

SEQ ID NO: 57725 - DNA, 15 bp, Artificial Sequence
  dgRNA
  Zfp142
cgatggttccgcttt

SEQ ID NO: 57726 - DNA, 15 bp, Artificial Sequence
  dgRNA
  Zfp142
gatggttccgctttg

SEQ ID NO: 57727 - DNA, 15 bp, Artificial Sequence
  dgRNA
  Srl
ggagaggccactact

SEQ ID NO: 57728 - DNA, 15 bp, Artificial Sequence
  dgRNA
  Srl
acccacagtagccct

SEQ ID NO: 57729 - DNA, 15 bp, Artificial Sequence
  dgRNA
  Srl
cccacagtagccctt

SEQ ID NO: 57730 - DNA, 15 bp, Artificial Sequence
  dgRNA
  Srl
ccacagtagcccttg

SEQ ID NO: 57731 - DNA, 15 bp, Artificial Sequence
  dgRNA
  Mtbp
cttccccgccacact

SEQ ID NO: 57732 - DNA, 15 bp, Artificial Sequence
  dgRNA
  Mtbp
ttccccgccacactc

SEQ ID NO: 57733 - DNA, 15 bp, Artificial Sequence
  dgRNA
  Mtbp
cactcgggtccccgc

SEQ ID NO: 57734 - DNA, 15 bp, Artificial Sequence
  dgRNA
  Mtbp
ggtccccgccggtag

SEQ ID NO: 57735 - DNA, 15 bp, Artificial Sequence
  dgRNA
  Anxa4
ggagtctggttgtgc

SEQ ID NO: 57736 - DNA, 15 bp, Artificial Sequence
  dgRNA
  Anxa4
gagtctggttgtgca

SEQ ID NO: 57737 - DNA, 15 bp, Artificial Sequence
  dgRNA
  Anxa4
ctcgctgtcctcagt

SEQ ID NO: 57738 - DNA, 15 bp, Artificial Sequence
  dgRNA
  Anxa4
tgcgtgatctgcctc

SEQ ID NO: 57739 - DNA, 15 bp, Artificial Sequence
  dgRNA
  Fgr
tttggccggaacctt

SEQ ID NO: 57740 - DNA, 15 bp, Artificial Sequence
  dgRNA
  Fgr
ttggccggaaccttt

SEQ ID NO: 57741 - DNA, 15 bp, Artificial Sequence
  dgRNA
  Fgr
ccggaacctttggga

SEQ ID NO: 57742 - DNA, 15 bp, Artificial Sequence
  dgRNA
  Fgr
gcgcagggacagcgc

SEQ ID NO: 57743 - DNA, 15 bp, Artificial Sequence
  dgRNA
  AU021092
tgcgggttgcaattt

SEQ ID NO: 57744 - DNA, 15 bp, Artificial Sequence
  dgRNA
  AU021092
ttgcgggttgcaatt

SEQ ID NO: 57745 - DNA, 15 bp, Artificial Sequence
  dgRNA
  AU021092
gccagttctggatat

SEQ ID NO: 57746 - DNA, 15 bp, Artificial Sequence
  dgRNA
  AU021092
ggccagttctggata

SEQ ID NO: 57747 - DNA, 15 bp, Artificial Sequence
  dgRNA
  Serpinf2
ctgggtagccttgat

SEQ ID NO: 57748 - DNA, 15 bp, Artificial Sequence
  dgRNA
  Serpinf2
tttaaccggatgtac

SEQ ID NO: 57749 - DNA, 15 bp, Artificial Sequence
  dgRNA
  Serpinf2
aacacaagctgaacg

SEQ ID NO: 57750 - DNA, 15 bp, Artificial Sequence
  dgRNA
  Serpinf2
acacaagctgaacgg

SEQ ID NO: 57751 - DNA, 15 bp, Artificial Sequence
  dgRNA
  Dnajb2
gcgtgtcgtacgcag

SEQ ID NO: 57752 - DNA, 15 bp, Artificial Sequence
  dgRNA
  Dnajb2
gcagtggccgcgagc

SEQ ID NO: 57753 - DNA, 15 bp, Artificial Sequence
  dgRNA
  Dnajb2
ccgcgagccgggcag

SEQ ID NO: 57754 - DNA, 15 bp, Artificial Sequence
  dgRNA
  Dnajb2
cgcgagccgggcagc

SEQ ID NO: 57755 - DNA, 15 bp, Artificial Sequence
  dgRNA
  Pi4k2b
atccactgcaatggc

SEQ ID NO: 57756 - DNA, 15 bp, Artificial Sequence
  dgRNA
  Pi4k2b
tggctggcaacgctc

SEQ ID NO: 57757 - DNA, 15 bp, Artificial Sequence
  dgRNA
  Pi4k2b
ggctggcaacgctct

SEQ ID NO: 57758 - DNA, 15 bp, Artificial Sequence
  dgRNA
  Pi4k2b
gagttgagacacagg

SEQ ID NO: 57759 - DNA, 15 bp, Artificial Sequence
  dgRNA
  Cdh18
caaaagtatgtacgg

SEQ ID NO: 57760 - DNA, 15 bp, Artificial Sequence
  dgRNA
  Cdh18
aaaagtatgtacggt

SEQ ID NO: 57761 - DNA, 15 bp, Artificial Sequence
  dgRNA
  Cdh18
aaagtatgtacggtg

SEQ ID NO: 57762 - DNA, 15 bp, Artificial Sequence
  dgRNA
  Cdh18
gtatgtacggtgggg

SEQ ID NO: 57763 - DNA, 15 bp, Artificial Sequence
  dgRNA
  Cd2
cacctatttcggtta

SEQ ID NO: 57764 - DNA, 15 bp, Artificial Sequence
  dgRNA
  Cd2
ctatttcggttaagg

SEQ ID NO: 57765 - DNA, 15 bp, Artificial Sequence
  dgRNA
  Cd2
tatttcggttaagga

SEQ ID NO: 57766 - DNA, 15 bp, Artificial Sequence
  dgRNA
  Cd2
atgagtcgttttgat

SEQ ID NO: 57767 - DNA, 15 bp, Artificial Sequence
  dgRNA
  Sos2
ccgagggccctctgg

SEQ ID NO: 57768 - DNA, 15 bp, Artificial Sequence
  dgRNA
  Sos2
tgactcgggcggacc

SEQ ID NO: 57769 - DNA, 15 bp, Artificial Sequence
  dgRNA
  Sos2
ctcgggcggacccgg

SEQ ID NO: 57770 - DNA, 15 bp, Artificial Sequence
  dgRNA
  Sos2
cggacccggcggtgg

SEQ ID NO: 57771 - DNA, 15 bp, Artificial Sequence
  dgRNA
  Gab2
tgaggacgcagctgc

SEQ ID NO: 57772 - DNA, 15 bp, Artificial Sequence
  dgRNA
  Gab2
cgacagctcgtctca

SEQ ID NO: 57773 - DNA, 15 bp, Artificial Sequence
  dgRNA
  Gab2
tcgtctcacggcctc

SEQ ID NO: 57774 - DNA, 15 bp, Artificial Sequence
  dgRNA
  Gab2
cgtctcacggcctcc

SEQ ID NO: 57775 - DNA, 15 bp, Artificial Sequence
  dgRNA
  Carnmt1
cccgtcccactccag

SEQ ID NO: 57776 - DNA, 15 bp, Artificial Sequence
  dgRNA
  Carnmt1
ccgtcccactccagc

SEQ ID NO: 57777 - DNA, 15 bp, Artificial Sequence
  dgRNA
  Carnmt1
agcgggccagattcg

SEQ ID NO: 57778 - DNA, 15 bp, Artificial Sequence
  dgRNA
  Carnmt1
cgtggccccgcccac

SEQ ID NO: 57779 - DNA, 15 bp, Artificial Sequence
  dgRNA
  Arf4
cgcctacccgaacct

SEQ ID NO: 57780 - DNA, 15 bp, Artificial Sequence
  dgRNA
  Arf4
ctactactattcatc

SEQ ID NO: 57781 - DNA, 15 bp, Artificial Sequence
  dgRNA
  Arf4
tactactattcatcc

SEQ ID NO: 57782 - DNA, 15 bp, Artificial Sequence
  dgRNA
  Arf4
tactattcatccggg

SEQ ID NO: 57783 - DNA, 15 bp, Artificial Sequence
  dgRNA
  Sufu
tgacgccccgcccct

SEQ ID NO: 57784 - DNA, 15 bp, Artificial Sequence
  dgRNA
  Sufu
gcggggagctccaag

SEQ ID NO: 57785 - DNA, 15 bp, Artificial Sequence
  dgRNA
  Sufu
cgcggggagctccaa

SEQ ID NO: 57786 - DNA, 15 bp, Artificial Sequence
  dgRNA
  Sufu
ccgcggggagctcca

SEQ ID NO: 57787 - DNA, 15 bp, Artificial Sequence
  dgRNA
  Arhgap19
agaccaatagtagca

SEQ ID NO: 57788 - DNA, 15 bp, Artificial Sequence
  dgRNA
  Arhgap19
gaacggttcttattt

SEQ ID NO: 57789 - DNA, 15 bp, Artificial Sequence
  dgRNA
  Arhgap19
cggttcttatttagg

SEQ ID NO: 57790 - DNA, 15 bp, Artificial Sequence
  dgRNA
  Arhgap19
ggttcttatttaggc

SEQ ID NO: 57791 - DNA, 15 bp, Artificial Sequence
  dgRNA
  Tmem42
cacggtcctcgctac

SEQ ID NO: 57792 - DNA, 15 bp, Artificial Sequence
  dgRNA
  Tmem42
ggattcccatccccc

SEQ ID NO: 57793 - DNA, 15 bp, Artificial Sequence
  dgRNA
  Tmem42
atcccccaggttcgc

SEQ ID NO: 57794 - DNA, 15 bp, Artificial Sequence
  dgRNA
  Tmem42
gttcgccggagccgc

SEQ ID NO: 57795 - DNA, 15 bp, Artificial Sequence
  dgRNA
  Rhox10
ctctcttgggatgcg

SEQ ID NO: 57796 - DNA, 15 bp, Artificial Sequence
  dgRNA
  Rhox10
agcactccttttgtc

SEQ ID NO: 57797 - DNA, 15 bp, Artificial Sequence
  dgRNA
  Rhox10
aactacgtgcctccg

SEQ ID NO: 57798 - DNA, 15 bp, Artificial Sequence
  dgRNA
  Rhox10
actacgtgcctccgt

SEQ ID NO: 57799 - DNA, 15 bp, Artificial Sequence
  dgRNA
  Zw10
ccggcgggaacagac

SEQ ID NO: 57800 - DNA, 15 bp, Artificial Sequence
  dgRNA
  Zw10
cgtttgaaaacctgt

SEQ ID NO: 57801 - DNA, 15 bp, Artificial Sequence
  dgRNA
  Zw10
gacgcctgcgcactt

SEQ ID NO: 57802 - DNA, 15 bp, Artificial Sequence
  dgRNA
  Zw10
acgccactgaaacag

SEQ ID NO: 57803 - DNA, 15 bp, Artificial Sequence
  dgRNA
  Acap2
ctcagggcgtctgcg

SEQ ID NO: 57804 - DNA, 15 bp, Artificial Sequence
  dgRNA
  Acap2
gggcgtctgcgcggt

SEQ ID NO: 57805 - DNA, 15 bp, Artificial Sequence
  dgRNA
  Acap2
gacgcctgtgcaccg

SEQ ID NO: 57806 - DNA, 15 bp, Artificial Sequence
  dgRNA
  Acap2
cctgtgcaccgcggt

SEQ ID NO: 57807 - DNA, 15 bp, Artificial Sequence
  dgRNA
  Hdac2
gcttgtgcgcacctc

SEQ ID NO: 57808 - DNA, 15 bp, Artificial Sequence
  dgRNA
  Hdac2
acactactgtcgccc

SEQ ID NO: 57809 - DNA, 15 bp, Artificial Sequence
  dgRNA
  Hdac2
tactgtcgccctggc

SEQ ID NO: 57810 - DNA, 15 bp, Artificial Sequence
  dgRNA
  Hdac2
tgtcgccctggccgg

SEQ ID NO: 57811 - DNA, 15 bp, Artificial Sequence
  dgRNA
  Ascc2
ggattgccttaaccc

SEQ ID NO: 57812 - DNA, 15 bp, Artificial Sequence
  dgRNA
  Ascc2
ttgccttaacccagg

SEQ ID NO: 57813 - DNA, 15 bp, Artificial Sequence
  dgRNA
  Ascc2
cttaacccaggaggg

SEQ ID NO: 57814 - DNA, 15 bp, Artificial Sequence
  dgRNA
  Ascc2
agggtggccaccaag

SEQ ID NO: 57815 - DNA, 15 bp, Artificial Sequence
  dgRNA
  Txnip
accattttccccgct

SEQ ID NO: 57816 - DNA, 15 bp, Artificial Sequence
  dgRNA
  Txnip
cgtgtccacgcgccc

SEQ ID NO: 57817 - DNA, 15 bp, Artificial Sequence
  dgRNA
  Txnip
gtccacgcgccccgg

SEQ ID NO: 57818 - DNA, 15 bp, Artificial Sequence
  dgRNA
  Txnip
ggcggcctcgctgat

SEQ ID NO: 57819 - DNA, 15 bp, Artificial Sequence
  dgRNA
  Trmt2b
ggagccccgcagcac

SEQ ID NO: 57820 - DNA, 15 bp, Artificial Sequence
  dgRNA
  Phf20l1
tcttgaccccaccaa

SEQ ID NO: 57821 - DNA, 15 bp, Artificial Sequence
  dgRNA
  Phf20l1
gaatagtcctccaat

SEQ ID NO: 57822 - DNA, 15 bp, Artificial Sequence
  dgRNA
  Phf20l1
tgcgccgcgccagcc

SEQ ID NO: 57823 - DNA, 15 bp, Artificial Sequence
  dgRNA
  Phf20l1
aacccagcccgcttc

SEQ ID NO: 57824 - DNA, 15 bp, Artificial Sequence
  dgRNA
  Nacc2
ttcggtgcccggtgc

SEQ ID NO: 57825 - DNA, 15 bp, Artificial Sequence
  dgRNA
  Nacc2
tgaacgctaagtgct

SEQ ID NO: 57826 - DNA, 15 bp, Artificial Sequence
  dgRNA
  Nacc2
cgctaagtgctcgga

SEQ ID NO: 57827 - DNA, 15 bp, Artificial Sequence
  dgRNA
  Nacc2
ccacgcagcaactct

SEQ ID NO: 57828 - DNA, 15 bp, Artificial Sequence
  dgRNA
  Rdh11
caaccgtgactctct

SEQ ID NO: 57829 - DNA, 15 bp, Artificial Sequence
  dgRNA
  Rdh11
ccgtgactctctagg

SEQ ID NO: 57830 - DNA, 15 bp, Artificial Sequence
  dgRNA
  Sim2
ctggaggtggcgacg

SEQ ID NO: 57831 - DNA, 15 bp, Artificial Sequence
  dgRNA
  Sim2
gaggtggcgacgcgg

SEQ ID NO: 57832 - DNA, 15 bp, Artificial Sequence
  dgRNA
  Sim2
gacgcggaggcgcgc

SEQ ID NO: 57833 - DNA, 15 bp, Artificial Sequence
  dgRNA
  Sim2
cgcgccggcgactca

SEQ ID NO: 57834 - DNA, 15 bp, Artificial Sequence
  dgRNA
  Nkain1
aaggtgacacggcta

SEQ ID NO: 57835 - DNA, 15 bp, Artificial Sequence
  dgRNA
  Nkain1
gaccacccccgccca

SEQ ID NO: 57836 - DNA, 15 bp, Artificial Sequence
  dgRNA
  Nkain1
ggaccacccccgccc

SEQ ID NO: 57837 - DNA, 15 bp, Artificial Sequence
  dgRNA
  Nkain1
tagccgtgtcacctt

SEQ ID NO: 57838 - DNA, 15 bp, Artificial Sequence
  dgRNA
  Mppe1
atgggttaatgaccc

SEQ ID NO: 57839 - DNA, 15 bp, Artificial Sequence
  dgRNA
  Mppe1
cagcacattcagtgc

SEQ ID NO: 57840 - DNA, 15 bp, Artificial Sequence
  dgRNA
  Mecom
tgtccctataggact

SEQ ID NO: 57841 - DNA, 15 bp, Artificial Sequence
  dgRNA
  Mecom
gtccctataggactt

SEQ ID NO: 57842 - DNA, 15 bp, Artificial Sequence
  dgRNA
  Mecom
gacctctcccgccag

SEQ ID NO: 57843 - DNA, 15 bp, Artificial Sequence
  dgRNA
  Mecom
ctctcccgccagagg

SEQ ID NO: 57844 - DNA, 15 bp, Artificial Sequence
  dgRNA
  Gpn1
tgccaaaagccggtc

SEQ ID NO: 57845 - DNA, 15 bp, Artificial Sequence
  dgRNA
  Gpn1
ggcacccactgcagt

SEQ ID NO: 57846 - DNA, 15 bp, Artificial Sequence
  dgRNA
  Gpn1
tgcagtaggttcgag

SEQ ID NO: 57847 - DNA, 15 bp, Artificial Sequence
  dgRNA
  Gpn1
taggttcgagcggtt

SEQ ID NO: 57848 - DNA, 15 bp, Artificial Sequence
  dgRNA
  Nr2c1
tccctccacacctac

SEQ ID NO: 57849 - DNA, 15 bp, Artificial Sequence
  dgRNA
  Nr2c1
ctccacacctacagg

SEQ ID NO: 57850 - DNA, 15 bp, Artificial Sequence
  dgRNA
  Nr2c1
ttccagaaccgccgc

SEQ ID NO: 57851 - DNA, 15 bp, Artificial Sequence
  dgRNA
  Nr2c1
accgccgctggactc

SEQ ID NO: 57852 - DNA, 15 bp, Artificial Sequence
  dgRNA
  Dnajc5b
tccggagatttcaaa

SEQ ID NO: 57853 - DNA, 15 bp, Artificial Sequence
  dgRNA
  Dnajc5b
gactgttagtgatgt

SEQ ID NO: 57854 - DNA, 15 bp, Artificial Sequence
  dgRNA
  Dnajc5b
accttttgaaatctc

SEQ ID NO: 57855 - DNA, 15 bp, Artificial Sequence
  dgRNA
  Dnajc5b
gctctagtctatgct

SEQ ID NO: 57856 - DNA, 15 bp, Artificial Sequence
  dgRNA
  Edn3
agcaccggcagagtg

SEQ ID NO: 57857 - DNA, 15 bp, Artificial Sequence
  dgRNA
  Edn3
cttcaagcagctgtt

SEQ ID NO: 57858 - DNA, 15 bp, Artificial Sequence
  dgRNA
  Edn3
taccccatccaccca

SEQ ID NO: 57859 - DNA, 15 bp, Artificial Sequence
  dgRNA
  Edn3
cacccacggggagcg

SEQ ID NO: 57860 - DNA, 15 bp, Artificial Sequence
  dgRNA
  Calr4
aggcctgccaacgaa

SEQ ID NO: 57861 - DNA, 15 bp, Artificial Sequence
  dgRNA
  Calr4
ggcctgccaacgaaa

SEQ ID NO: 57862 - DNA, 15 bp, Artificial Sequence
  dgRNA
  Calr4
tgccaacgaaagggc

SEQ ID NO: 57863 - DNA, 15 bp, Artificial Sequence
  dgRNA
  Calr4
tattatagcactgtg

SEQ ID NO: 57864 - DNA, 15 bp, Artificial Sequence
  dgRNA
  Lamp1
cctactttccatttc

SEQ ID NO: 57865 - DNA, 15 bp, Artificial Sequence
  dgRNA
  Lamp1
ccatttcgggacact

SEQ ID NO: 57866 - DNA, 15 bp, Artificial Sequence
  dgRNA
  Lamp1
catttcgggacactc

SEQ ID NO: 57867 - DNA, 15 bp, Artificial Sequence
  dgRNA
  Lamp1
tcgggagaaaggccg

SEQ ID NO: 57868 - DNA, 15 bp, Artificial Sequence
  dgRNA
  Lgi3
tggtagggcacgctg

SEQ ID NO: 57869 - DNA, 15 bp, Artificial Sequence
  dgRNA
  Lgi3
agggcacgctgcgga

SEQ ID NO: 57870 - DNA, 15 bp, Artificial Sequence
  dgRNA
  Lgi3
gggcacgctgcggac

SEQ ID NO: 57871 - DNA, 15 bp, Artificial Sequence
  dgRNA
  Lgi3
ctctcccgcgggcgc

SEQ ID NO: 57872 - DNA, 15 bp, Artificial Sequence
  dgRNA
  Cmpk1
cttgcctcttcggtt

SEQ ID NO: 57873 - DNA, 15 bp, Artificial Sequence
  dgRNA
  Cmpk1
ttaggccgcttctct

SEQ ID NO: 57874 - DNA, 15 bp, Artificial Sequence
  dgRNA
  Cmpk1
taggccgcttctctt

SEQ ID NO: 57875 - DNA, 15 bp, Artificial Sequence
  dgRNA
  Cmpk1
gggagattgaaccac

SEQ ID NO: 57876 - DNA, 15 bp, Artificial Sequence
  dgRNA
  Cmtr1
ggcgagagtagacaa

SEQ ID NO: 57877 - DNA, 15 bp, Artificial Sequence
  dgRNA
  Cmtr1
ccccccattctttcg

SEQ ID NO: 57878 - DNA, 15 bp, Artificial Sequence
  dgRNA
  Cmtr1
gtcccccttccgcgc

SEQ ID NO: 57879 - DNA, 15 bp, Artificial Sequence
  dgRNA
  Cmtr1
tccgcgcaggcgcct

SEQ ID NO: 57880 - DNA, 15 bp, Artificial Sequence
  dgRNA
  Polr2l
gggtgggcacgagca

SEQ ID NO: 57881 - DNA, 15 bp, Artificial Sequence
  dgRNA
  Polr2l
aacaccgccgcttca

SEQ ID NO: 57882 - DNA, 15 bp, Artificial Sequence
  dgRNA
  Polr2l
cttcagggtaatcat

SEQ ID NO: 57883 - DNA, 15 bp, Artificial Sequence
  dgRNA
  Polr2l
ggtaatcatgggagc

SEQ ID NO: 57884 - DNA, 15 bp, Artificial Sequence
  dgRNA
  Clic1
ctttctgcacctccg

SEQ ID NO: 57885 - DNA, 15 bp, Artificial Sequence
  dgRNA
  Clic1
ggcactccaagacac

SEQ ID NO: 57886 - DNA, 15 bp, Artificial Sequence
  dgRNA
  Clic1
acggaggtgcagaaa

SEQ ID NO: 57887 - DNA, 15 bp, Artificial Sequence
  dgRNA
  Clic1
cacggaggtgcagaa

SEQ ID NO: 57888 - DNA, 15 bp, Artificial Sequence
  dgRNA
  D7Ertd443e
ctaactgttccctac

SEQ ID NO: 57889 - DNA, 15 bp, Artificial Sequence
  dgRNA
  D7Ertd443e
ttaaccccaaattag

SEQ ID NO: 57890 - DNA, 15 bp, Artificial Sequence
  dgRNA
  D7Ertd443e
aatgatttcgtcagt

SEQ ID NO: 57891 - DNA, 15 bp, Artificial Sequence
  dgRNA
  D7Ertd443e
ttcgtcagttggatc

SEQ ID NO: 57892 - DNA, 15 bp, Artificial Sequence
  dgRNA
  Fbxo27
gatgctttcgattag

SEQ ID NO: 57893 - DNA, 15 bp, Artificial Sequence
  dgRNA
  Fbxo27
tgctttcgattagcg

SEQ ID NO: 57894 - DNA, 15 bp, Artificial Sequence
  dgRNA
  Fbxo27
ttttcttgtaaatcg

SEQ ID NO: 57895 - DNA, 15 bp, Artificial Sequence
  dgRNA
  Fbxo27
taaatcgcggatgac

SEQ ID NO: 57896 - DNA, 15 bp, Artificial Sequence
  dgRNA
  Tcp11l1
gccaccgcactccct

SEQ ID NO: 57897 - DNA, 15 bp, Artificial Sequence
  dgRNA
  Tcp11l1
gattcccgagcccct

SEQ ID NO: 57898 - DNA, 15 bp, Artificial Sequence
  dgRNA
  Tcp11l1
gggagagccggccgc

SEQ ID NO: 57899 - DNA, 15 bp, Artificial Sequence
  dgRNA
  Tcp11l1
gccgccggtccgtac

SEQ ID NO: 57900 - DNA, 15 bp, Artificial Sequence
  dgRNA
  Ciapin1
ttccccctcgcgccc

SEQ ID NO: 57901 - DNA, 15 bp, Artificial Sequence
  dgRNA
  Ciapin1
cctcgcgccccggct

SEQ ID NO: 57902 - DNA, 15 bp, Artificial Sequence
  dgRNA
  Ciapin1
gcgccccggctcggc

SEQ ID NO: 57903 - DNA, 15 bp, Artificial Sequence
  dgRNA
  Ciapin1
aggcaccgcagctgc

SEQ ID NO: 57904 - DNA, 15 bp, Artificial Sequence
  dgRNA
  Cd55b
gcccactggacaact

SEQ ID NO: 57905 - DNA, 15 bp, Artificial Sequence
  dgRNA
  Cd55b
tcccctgggtgaaac

SEQ ID NO: 57906 - DNA, 15 bp, Artificial Sequence
  dgRNA
  Cd55b
ccgccctcattaacg

SEQ ID NO: 57907 - DNA, 15 bp, Artificial Sequence
  dgRNA
  Cd55b
cgccctcattaacga

SEQ ID NO: 57908 - DNA, 15 bp, Artificial Sequence
  dgRNA
  Zfp57
tagtacaaggaatta

SEQ ID NO: 57909 - DNA, 15 bp, Artificial Sequence
  dgRNA
  Zfp57
gtaaatacttatctt

SEQ ID NO: 57910 - DNA, 15 bp, Artificial Sequence
  dgRNA
  Zfp57
gtgaagaccaacagt

SEQ ID NO: 57911 - DNA, 15 bp, Artificial Sequence
  dgRNA
  Zfp57
agaccaacagtaggc

SEQ ID NO: 57912 - DNA, 15 bp, Artificial Sequence
  dgRNA
  Slain2
gttctttcagcccgc

SEQ ID NO: 57913 - DNA, 15 bp, Artificial Sequence
  dgRNA
  Slain2
ctttcagcccgcggg

SEQ ID NO: 57914 - DNA, 15 bp, Artificial Sequence
  dgRNA
  Slain2
tcccccgacgctctg

SEQ ID NO: 57915 - DNA, 15 bp, Artificial Sequence
  dgRNA
  Slain2
tctgaggtcaccgac

SEQ ID NO: 57916 - DNA, 15 bp, Artificial Sequence
  dgRNA
  Tex21
atgtccactaatatc

SEQ ID NO: 57917 - DNA, 15 bp, Artificial Sequence
  dgRNA
  Tex21
gcgttcacctagcaa

SEQ ID NO: 57918 - DNA, 15 bp, Artificial Sequence
  dgRNA
  Tex21
ttcaccagatattag

SEQ ID NO: 57919 - DNA, 15 bp, Artificial Sequence
  dgRNA
  Tex21
gcagttatttcccta

SEQ ID NO: 57920 - DNA, 15 bp, Artificial Sequence
  dgRNA
  Slitrk3
actcgggaaagccaa

SEQ ID NO: 57921 - DNA, 15 bp, Artificial Sequence
  dgRNA
  Slitrk3
tcctcgagtagaccg

SEQ ID NO: 57922 - DNA, 15 bp, Artificial Sequence
  dgRNA
  Slitrk3
gtagaccgaggccgc

SEQ ID NO: 57923 - DNA, 15 bp, Artificial Sequence
  dgRNA
  Slitrk3
accgaggccgcaggc

SEQ ID NO: 57924 - DNA, 15 bp, Artificial Sequence
  dgRNA
  St3gal6
cccgccgccctttcc

SEQ ID NO: 57925 - DNA, 15 bp, Artificial Sequence
  dgRNA
  St3gal6
gtgattttcctgtcg

SEQ ID NO: 57926 - DNA, 15 bp, Artificial Sequence
  dgRNA
  St3gal6
cccagcgagagcaag

SEQ ID NO: 57927 - DNA, 15 bp, Artificial Sequence
  dgRNA
  St3gal6
gcgagagcaagcggc

SEQ ID NO: 57928 - DNA, 15 bp, Artificial Sequence
  dgRNA
  Tead3
ctgagacgacgagcg

SEQ ID NO: 57929 - DNA, 15 bp, Artificial Sequence
  dgRNA
  Tead3
acgacgagcgaggaa

SEQ ID NO: 57930 - DNA, 15 bp, Artificial Sequence
  dgRNA
  Tead3
cgacgagcgaggaat

SEQ ID NO: 57931 - DNA, 15 bp, Artificial Sequence
  dgRNA
  Tead3
gacgagcgaggaatg

SEQ ID NO: 57932 - DNA, 15 bp, Artificial Sequence
  dgRNA
  Vmn2r28
aattcctacagggcc

SEQ ID NO: 57933 - DNA, 15 bp, Artificial Sequence
  dgRNA
  Vmn2r28
gaataatatattacc

SEQ ID NO: 57934 - DNA, 15 bp, Artificial Sequence
  dgRNA
  Poc1a
aaggcgctaataacc

SEQ ID NO: 57935 - DNA, 15 bp, Artificial Sequence
  dgRNA
  Poc1a
ccatggcgccttgat

SEQ ID NO: 57936 - DNA, 15 bp, Artificial Sequence
  dgRNA
  Poc1a
aaactccgcccgccc

SEQ ID NO: 57937 - DNA, 15 bp, Artificial Sequence
  dgRNA
  Poc1a
cgccccggagcatct

SEQ ID NO: 57938 - DNA, 15 bp, Artificial Sequence
  dgRNA
  Kcnj5
ggaggagaacccggg

SEQ ID NO: 57939 - DNA, 15 bp, Artificial Sequence
  dgRNA
  Kcnj5
ctagatagaagggcg

SEQ ID NO: 57940 - DNA, 15 bp, Artificial Sequence
  dgRNA
  Kcnj5
aagggcgaggcagac

SEQ ID NO: 57941 - DNA, 15 bp, Artificial Sequence
  dgRNA
  Kcnj5
gaggcagaccggtga

SEQ ID NO: 57942 - DNA, 15 bp, Artificial Sequence
  dgRNA
  Akap10
gctgcgcagcagtgc

SEQ ID NO: 57943 - DNA, 15 bp, Artificial Sequence
  dgRNA
  Akap10
gcgcagcagtgctgg

SEQ ID NO: 57944 - DNA, 15 bp, Artificial Sequence
  dgRNA
  Akap10
gggggcttcccgaag

SEQ ID NO: 57945 - DNA, 15 bp, Artificial Sequence
  dgRNA
  Akap10
ggcttcccgaagagg

SEQ ID NO: 57946 - DNA, 15 bp, Artificial Sequence
  dgRNA
  Mgat1
taagagctcactgaa

SEQ ID NO: 57947 - DNA, 15 bp, Artificial Sequence
  dgRNA
  Mgat1
actcacgggccagga

SEQ ID NO: 57948 - DNA, 15 bp, Artificial Sequence
  dgRNA
  Mgat1
tactcacgggccagg

SEQ ID NO: 57949 - DNA, 15 bp, Artificial Sequence
  dgRNA
  Mgat1
aggtactcacgggcc

SEQ ID NO: 57950 - DNA, 15 bp, Artificial Sequence
  dgRNA
  Asb12
gtcaatcagcccttc

SEQ ID NO: 57951 - DNA, 15 bp, Artificial Sequence
  dgRNA
  Asb12
taacacagtcaaggg

SEQ ID NO: 57952 - DNA, 15 bp, Artificial Sequence
  dgRNA
  Asb12
gataggcatctggta

SEQ ID NO: 57953 - DNA, 15 bp, Artificial Sequence
  dgRNA
  Alppl2
acagattcaggacgt

SEQ ID NO: 57954 - DNA, 15 bp, Artificial Sequence
  dgRNA
  Alppl2
ttcaggacgttggcc

SEQ ID NO: 57955 - DNA, 15 bp, Artificial Sequence
  dgRNA
  Alppl2
gttcacaggataggg

SEQ ID NO: 57956 - DNA, 15 bp, Artificial Sequence
  dgRNA
  Alppl2
ttcacaggatagggt

SEQ ID NO: 57957 - DNA, 15 bp, Artificial Sequence
  dgRNA
  Snrpd3
cgcctaatcccttcc

SEQ ID NO: 57958 - DNA, 15 bp, Artificial Sequence
  dgRNA
  Snrpd3
tccaggtctgggcgc

SEQ ID NO: 57959 - DNA, 15 bp, Artificial Sequence
  dgRNA
  Snrpd3
gaacccgctacccgt

SEQ ID NO: 57960 - DNA, 15 bp, Artificial Sequence
  dgRNA
  Snrpd3
ttccctgaaacgctc

SEQ ID NO: 57961 - DNA, 15 bp, Artificial Sequence
  dgRNA
  Mre11a
cgagaacttcctttc

SEQ ID NO: 57962 - DNA, 15 bp, Artificial Sequence
  dgRNA
  Mre11a
gccccttcgctgctc

SEQ ID NO: 57963 - DNA, 15 bp, Artificial Sequence
  dgRNA
  Mre11a
ttcgctgctcaggat

SEQ ID NO: 57964 - DNA, 15 bp, Artificial Sequence
  dgRNA
  Mre11a
atgtcacgtcatcaa

SEQ ID NO: 57965 - DNA, 15 bp, Artificial Sequence
  dgRNA
  Lrrc66
gattctaaatatggc

SEQ ID NO: 57966 - DNA, 15 bp, Artificial Sequence
  dgRNA
  Lrrc66
atgcgacctctctgc

SEQ ID NO: 57967 - DNA, 15 bp, Artificial Sequence
  dgRNA
  Lrrc66
aggcttctctccgag

SEQ ID NO: 57968 - DNA, 15 bp, Artificial Sequence
  dgRNA
  Lrrc66
cgagtggccgaggaa

SEQ ID NO: 57969 - DNA, 15 bp, Artificial Sequence
  dgRNA
  Btbd9
gcggccacaccctca

SEQ ID NO: 57970 - DNA, 15 bp, Artificial Sequence
  dgRNA
  Btbd9
gggcccagtactgga

SEQ ID NO: 57971 - DNA, 15 bp, Artificial Sequence
  dgRNA
  Btbd9
gcagtggctccgacc

SEQ ID NO: 57972 - DNA, 15 bp, Artificial Sequence
  dgRNA
  Btbd9
cagtggctccgacct

SEQ ID NO: 57973 - DNA, 15 bp, Artificial Sequence
  dgRNA
  Hnrnpd
gcgccgttcttccgt

SEQ ID NO: 57974 - DNA, 15 bp, Artificial Sequence
  dgRNA
  Hnrnpd
tccgtcggccatttt

SEQ ID NO: 57975 - DNA, 15 bp, Artificial Sequence
  dgRNA
  Hnrnpd
gtcggccattttagg

SEQ ID NO: 57976 - DNA, 15 bp, Artificial Sequence
  dgRNA
  Hnrnpd
tggccgacggaagaa

SEQ ID NO: 57977 - DNA, 15 bp, Artificial Sequence
  dgRNA
  Gstp2
gcactgtggccgact

SEQ ID NO: 57978 - DNA, 15 bp, Artificial Sequence
  dgRNA
  Gstp2
cactgtggccgactc

SEQ ID NO: 57979 - DNA, 15 bp, Artificial Sequence
  dgRNA
  Gstp2
gctagtgtctcgggc

SEQ ID NO: 57980 - DNA, 15 bp, Artificial Sequence
  dgRNA
  Gstp2
gcagagatccaatac

SEQ ID NO: 57981 - DNA, 15 bp, Artificial Sequence
  dgRNA
  Ick
agtctgcggctcccc

SEQ ID NO: 57982 - DNA, 15 bp, Artificial Sequence
  dgRNA
  Ick
tgcggctcccccggg

SEQ ID NO: 57983 - DNA, 15 bp, Artificial Sequence
  dgRNA
  Ick
gcggctcccccgggt

SEQ ID NO: 57984 - DNA, 15 bp, Artificial Sequence
  dgRNA
  Ick
cctctgccgagcatc

SEQ ID NO: 57985 - DNA, 15 bp, Artificial Sequence
  dgRNA
  Map3k4
ctcagccgcccgccg

SEQ ID NO: 57986 - DNA, 15 bp, Artificial Sequence
  dgRNA
  Map3k4
ccgtagcccagcgtt

SEQ ID NO: 57987 - DNA, 15 bp, Artificial Sequence
  dgRNA
  Map3k4
agcccagcgttcggc

SEQ ID NO: 57988 - DNA, 15 bp, Artificial Sequence
  dgRNA
  Map3k4
ccgccgttcccaaga

SEQ ID NO: 57989 - DNA, 15 bp, Artificial Sequence
  dgRNA
  Pomc
gcctccgcgctttcc

SEQ ID NO: 57990 - DNA, 15 bp, Artificial Sequence
  dgRNA
  Pomc
gccttgcgctcagcc

SEQ ID NO: 57991 - DNA, 15 bp, Artificial Sequence
  dgRNA
  Pomc
gcgctcagccaggac

SEQ ID NO: 57992 - DNA, 15 bp, Artificial Sequence
  dgRNA
  Pomc
cgctcagccaggacc

SEQ ID NO: 57993 - DNA, 15 bp, Artificial Sequence
  dgRNA
  Skil
gccgggagccacaat

SEQ ID NO: 57994 - DNA, 15 bp, Artificial Sequence
  dgRNA
  Skil
cgggctgcacactgc

SEQ ID NO: 57995 - DNA, 15 bp, Artificial Sequence
  dgRNA
  Skil
attgtggctcccggc

SEQ ID NO: 57996 - DNA, 15 bp, Artificial Sequence
  dgRNA
  Skil
tattgtggctcccgg

SEQ ID NO: 57997 - DNA, 15 bp, Artificial Sequence
  dgRNA
  Rapgef4
cgccgggaggcgcgc

SEQ ID NO: 57998 - DNA, 15 bp, Artificial Sequence
  dgRNA
  Rapgef4
cgcgggaggtggccg

SEQ ID NO: 57999 - DNA, 15 bp, Artificial Sequence
  dgRNA
  Rapgef4
gaggtggccgcggcc

SEQ ID NO: 58000 - DNA, 15 bp, Artificial Sequence
  dgRNA
  Rapgef4
ggtggccgcggcccg

SEQ ID NO: 58001 - DNA, 15 bp, Artificial Sequence
  dgRNA
  Cntln
aggcacttcggactc

SEQ ID NO: 58002 - DNA, 15 bp, Artificial Sequence
  dgRNA
  Cntln
tcggactcgggacag

SEQ ID NO: 58003 - DNA, 15 bp, Artificial Sequence
  dgRNA
  Cntln
gactcgggacagtgg

SEQ ID NO: 58004 - DNA, 15 bp, Artificial Sequence
  dgRNA
  Cntln
cagcaatgaacttgc

SEQ ID NO: 58005 - DNA, 15 bp, Artificial Sequence
  dgRNA
  Zfp119b
tcaccatagaactcc

SEQ ID NO: 58006 - DNA, 15 bp, Artificial Sequence
  dgRNA
  Zfp119b
cattaggtcataatt

SEQ ID NO: 58007 - DNA, 15 bp, Artificial Sequence
  dgRNA
  Zfp119b
attaggtcataattg

SEQ ID NO: 58008 - DNA, 15 bp, Artificial Sequence
  dgRNA
  Zfp119b
aggtcataattgggg

SEQ ID NO: 58009 - DNA, 15 bp, Artificial Sequence
  dgRNA
  Slc11a2
gggctcccgcccggc

SEQ ID NO: 58010 - DNA, 15 bp, Artificial Sequence
  dgRNA
  Slc11a2
ccggccggccaatca

SEQ ID NO: 58011 - DNA, 15 bp, Artificial Sequence
  dgRNA
  Slc11a2
cggccggccaatcac

SEQ ID NO: 58012 - DNA, 15 bp, Artificial Sequence
  dgRNA
  Slc11a2
ccggccaatcacggg

SEQ ID NO: 58013 - DNA, 15 bp, Artificial Sequence
  dgRNA
  Impg1
aacctgtaagtgaga

SEQ ID NO: 58014 - DNA, 15 bp, Artificial Sequence
  dgRNA
  Impg1
gaggttaataagata

SEQ ID NO: 58015 - DNA, 15 bp, Artificial Sequence
  dgRNA
  Impg1
gagattactcctgag

SEQ ID NO: 58016 - DNA, 15 bp, Artificial Sequence
  dgRNA
  Impg1
actgacacggagcac

SEQ ID NO: 58017 - DNA, 15 bp, Artificial Sequence
  dgRNA
  Fis1
gcagcgcgcgttcac

SEQ ID NO: 58018 - DNA, 15 bp, Artificial Sequence
  dgRNA
  Fis1
ctctcgctccgccct

SEQ ID NO: 58019 - DNA, 15 bp, Artificial Sequence
  dgRNA
  Fis1
gcccttggtctcgct

SEQ ID NO: 58020 - DNA, 15 bp, Artificial Sequence
  dgRNA
  Fis1
ctagagacgtcccca

SEQ ID NO: 58021 - DNA, 15 bp, Artificial Sequence
  dgRNA
  4930402H24Rik
atggcttccttgcgg

SEQ ID NO: 58022 - DNA, 15 bp, Artificial Sequence
  dgRNA
  4930402H24Rik
gaggattgtttcaaa

SEQ ID NO: 58023 - DNA, 15 bp, Artificial Sequence
  dgRNA
  4930402H24Rik
aagaacgtttgccca

SEQ ID NO: 58024 - DNA, 15 bp, Artificial Sequence
  dgRNA
  4930402H24Rik
cgtttgcccagggac

SEQ ID NO: 58025 - DNA, 15 bp, Artificial Sequence
  dgRNA
  Cck
tgcaaagtgcccccc

SEQ ID NO: 58026 - DNA, 15 bp, Artificial Sequence
  dgRNA
  Cck
gcaaagtgcccccct

SEQ ID NO: 58027 - DNA, 15 bp, Artificial Sequence
  dgRNA
  Cck
aagtgcccccctggg

SEQ ID NO: 58028 - DNA, 15 bp, Artificial Sequence
  dgRNA
  Cck
agtgcccccctggga

SEQ ID NO: 58029 - DNA, 15 bp, Artificial Sequence
  dgRNA
  Pafah1b3
ggagcgtcccttccc

SEQ ID NO: 58030 - DNA, 15 bp, Artificial Sequence
  dgRNA
  Pafah1b3
gagccaccccctccg

SEQ ID NO: 58031 - DNA, 15 bp, Artificial Sequence
  dgRNA
  Pafah1b3
cccctccgcggatct

SEQ ID NO: 58032 - DNA, 15 bp, Artificial Sequence
  dgRNA
  Pafah1b3
tactagttcgaggac

SEQ ID NO: 58033 - DNA, 15 bp, Artificial Sequence
  dgRNA
  Cdc37l1
agacgtggccacgcc

SEQ ID NO: 58034 - DNA, 15 bp, Artificial Sequence
  dgRNA
  Cdc37l1
gcccggtcacgcccc

SEQ ID NO: 58035 - DNA, 15 bp, Artificial Sequence
  dgRNA
  Cdc37l1
ccggaaatgacgtcc

SEQ ID NO: 58036 - DNA, 15 bp, Artificial Sequence
  dgRNA
  Cdc37l1
aaatgacgtcccggc

SEQ ID NO: 58037 - DNA, 15 bp, Artificial Sequence
  dgRNA
  Gbas
ccccgtgtacattcc

SEQ ID NO: 58038 - DNA, 15 bp, Artificial Sequence
  dgRNA
  Gbas
cctgaactcccctcg

SEQ ID NO: 58039 - DNA, 15 bp, Artificial Sequence
  dgRNA
  Gbas
ctgaactcccctcgc

SEQ ID NO: 58040 - DNA, 15 bp, Artificial Sequence
  dgRNA
  Gbas
ccctcgcgggatcta

SEQ ID NO: 58041 - DNA, 15 bp, Artificial Sequence
  dgRNA
  Ap4s1
atcagtaagcgctaa

SEQ ID NO: 58042 - DNA, 15 bp, Artificial Sequence
  dgRNA
  Ap4s1
tccaagtgagtagag

SEQ ID NO: 58043 - DNA, 15 bp, Artificial Sequence
  dgRNA
  Ap4s1
gtagagcggcatcgc

SEQ ID NO: 58044 - DNA, 15 bp, Artificial Sequence
  dgRNA
  Ap4s1
atcgcaggtacttaa

SEQ ID NO: 58045 - DNA, 15 bp, Artificial Sequence
  dgRNA
  H60b
aaacggaagcaactg

SEQ ID NO: 58046 - DNA, 15 bp, Artificial Sequence
  dgRNA
  H60b
taagtctgacaatat

SEQ ID NO: 58047 - DNA, 15 bp, Artificial Sequence
  dgRNA
  H60b
gacaatattggacca

SEQ ID NO: 58048 - DNA, 15 bp, Artificial Sequence
  dgRNA
  H60b
agccaggaggcgcgc

SEQ ID NO: 58049 - DNA, 15 bp, Artificial Sequence
  dgRNA
  Fzd5
ttccgctgcccgctc

SEQ ID NO: 58050 - DNA, 15 bp, Artificial Sequence
  dgRNA
  Fzd5
tccgctgcccgctcc

SEQ ID NO: 58051 - DNA, 15 bp, Artificial Sequence
  dgRNA
  Fzd5
ctgcccgctccgggc

SEQ ID NO: 58052 - DNA, 15 bp, Artificial Sequence
  dgRNA
  Fzd5
tgcccgctccgggcg

SEQ ID NO: 58053 - DNA, 15 bp, Artificial Sequence
  dgRNA
  Trim33
ccgccccgcgacgcg

SEQ ID NO: 58054 - DNA, 15 bp, Artificial Sequence
  dgRNA
  Trim33
cgccccgcgacgcga

SEQ ID NO: 58055 - DNA, 15 bp, Artificial Sequence
  dgRNA
  Trim33
cccgcgacgcgaggg

SEQ ID NO: 58056 - DNA, 15 bp, Artificial Sequence
  dgRNA
  Trim33
ccgcgacgcgagggc

SEQ ID NO: 58057 - DNA, 15 bp, Artificial Sequence
  dgRNA
  Lca5
agtccagtaaccaat

SEQ ID NO: 58058 - DNA, 15 bp, Artificial Sequence
  dgRNA
  Lca5
aggccggtcctcccg

SEQ ID NO: 58059 - DNA, 15 bp, Artificial Sequence
  dgRNA
  Lca5
tcccgcggtgcaagc

SEQ ID NO: 58060 - DNA, 15 bp, Artificial Sequence
  dgRNA
  Lca5
cccgcggtgcaagct

SEQ ID NO: 58061 - DNA, 15 bp, Artificial Sequence
  dgRNA
  Pigyl
cgtcaatcaagacca

SEQ ID NO: 58062 - DNA, 15 bp, Artificial Sequence
  dgRNA
  Pigyl
gtcaatcaagaccac

SEQ ID NO: 58063 - DNA, 15 bp, Artificial Sequence
  dgRNA
  Pigyl
tcaatcaagaccacg

SEQ ID NO: 58064 - DNA, 15 bp, Artificial Sequence
  dgRNA
  Pigyl
caatcaagaccacgg

SEQ ID NO: 58065 - DNA, 15 bp, Artificial Sequence
  dgRNA
  Slc25a29
cttccttgcgccgtg

SEQ ID NO: 58066 - DNA, 15 bp, Artificial Sequence
  dgRNA
  Slc25a29
ttccttgcgccgtgc

SEQ ID NO: 58067 - DNA, 15 bp, Artificial Sequence
  dgRNA
  Slc25a29
cttgcgccgtgcggg

SEQ ID NO: 58068 - DNA, 15 bp, Artificial Sequence
  dgRNA
  Slc25a29
ttgcgccgtgcgggc

SEQ ID NO: 58069 - DNA, 15 bp, Artificial Sequence
  dgRNA
  Cyp2c70
gaaaaaagtaacgtt

SEQ ID NO: 58070 - DNA, 15 bp, Artificial Sequence
  dgRNA
  Cyp2c70
agtaacgttaggaaa

SEQ ID NO: 58071 - DNA, 15 bp, Artificial Sequence
  dgRNA
  Cyp2c70
gtaacgttaggaaac

SEQ ID NO: 58072 - DNA, 15 bp, Artificial Sequence
  dgRNA
  Cyp2c70
gtactaaagataaag

SEQ ID NO: 58073 - DNA, 15 bp, Artificial Sequence
  dgRNA
  Foxp1
gtaaggctcacaagc

SEQ ID NO: 58074 - DNA, 15 bp, Artificial Sequence
  dgRNA
  Foxp1
gctacagcaagcgta

SEQ ID NO: 58075 - DNA, 15 bp, Artificial Sequence
  dgRNA
  Foxp1
gccattctgacggtg

SEQ ID NO: 58076 - DNA, 15 bp, Artificial Sequence
  dgRNA
  Foxp1
cccctctagagatgg

SEQ ID NO: 58077 - DNA, 15 bp, Artificial Sequence
  dgRNA
  Fars2
aaaaagcacgctgga

SEQ ID NO: 58078 - DNA, 15 bp, Artificial Sequence
  dgRNA
  Fars2
cgcctggctcgcgcg

SEQ ID NO: 58079 - DNA, 15 bp, Artificial Sequence
  dgRNA
  Fars2
ggctcgcgcgcggcc

SEQ ID NO: 58080 - DNA, 15 bp, Artificial Sequence
  dgRNA
  Fars2
cgcgtcctgcgcgag

SEQ ID NO: 58081 - DNA, 15 bp, Artificial Sequence
  dgRNA
  Mrpl39
agaatgctgctccaa

SEQ ID NO: 58082 - DNA, 15 bp, Artificial Sequence
  dgRNA
  Mrpl39
gaatgctgctccaac

SEQ ID NO: 58083 - DNA, 15 bp, Artificial Sequence
  dgRNA
  Mrpl39
ccaacgggaacgtgc

SEQ ID NO: 58084 - DNA, 15 bp, Artificial Sequence
  dgRNA
  Mrpl39
cacggtttgcgtttc

SEQ ID NO: 58085 - DNA, 15 bp, Artificial Sequence
  dgRNA
  Esf1
tggccggccaagcag

SEQ ID NO: 58086 - DNA, 15 bp, Artificial Sequence
  dgRNA
  Esf1
ggccggccaagcagt

SEQ ID NO: 58087 - DNA, 15 bp, Artificial Sequence
  dgRNA
  Esf1
cccgggcgccacagc

SEQ ID NO: 58088 - DNA, 15 bp, Artificial Sequence
  dgRNA
  Esf1
ccgggcgccacagca

SEQ ID NO: 58089 - DNA, 15 bp, Artificial Sequence
  dgRNA
  Irak4
gcttccgtgagaaag

SEQ ID NO: 58090 - DNA, 15 bp, Artificial Sequence
  dgRNA
  Irak4
cgcctagcctcttac

SEQ ID NO: 58091 - DNA, 15 bp, Artificial Sequence
  dgRNA
  Irak4
gcctagcctcttaca

SEQ ID NO: 58092 - DNA, 15 bp, Artificial Sequence
  dgRNA
  Irak4
gggacaggctccggt

SEQ ID NO: 58093 - DNA, 15 bp, Artificial Sequence
  dgRNA
  Myl1
ttcacgtctagatgc

SEQ ID NO: 58094 - DNA, 15 bp, Artificial Sequence
  dgRNA
  Myl1
cctaaaaatagcccc

SEQ ID NO: 58095 - DNA, 15 bp, Artificial Sequence
  dgRNA
  Myl1
ctgatgctagatatg

SEQ ID NO: 58096 - DNA, 15 bp, Artificial Sequence
  dgRNA
  Exoc3
gcgccaaacgtcaga

SEQ ID NO: 58097 - DNA, 15 bp, Artificial Sequence
  dgRNA
  Exoc3
ccaaacgtcagacgg

SEQ ID NO: 58098 - DNA, 15 bp, Artificial Sequence
  dgRNA
  Exoc3
tcagacggcggagcc

SEQ ID NO: 58099 - DNA, 15 bp, Artificial Sequence
  dgRNA
  Exoc3
cgtacagcgccttca

SEQ ID NO: 58100 - DNA, 15 bp, Artificial Sequence
  dgRNA
  Cenpv
ccttcgctgatcaaa

SEQ ID NO: 58101 - DNA, 15 bp, Artificial Sequence
  dgRNA
  Cenpv
cttcgctgatcaaac

SEQ ID NO: 58102 - DNA, 15 bp, Artificial Sequence
  dgRNA
  Cenpv
gctacctgcaagcgc

SEQ ID NO: 58103 - DNA, 15 bp, Artificial Sequence
  dgRNA
  Cenpv
tgcaagcgcaggtgc

SEQ ID NO: 58104 - DNA, 15 bp, Artificial Sequence
  dgRNA
  Trmo
cggagggtatggtgc

SEQ ID NO: 58105 - DNA, 15 bp, Artificial Sequence
  dgRNA
  Trmo
gtgcaggctgtcgcg

SEQ ID NO: 58106 - DNA, 15 bp, Artificial Sequence
  dgRNA
  Trmo
gccgccatcgccgcg

SEQ ID NO: 58107 - DNA, 15 bp, Artificial Sequence
  dgRNA
  Trmo
gccatcgccgcgtgg

SEQ ID NO: 58108 - DNA, 15 bp, Artificial Sequence
  dgRNA
  Olfr1107
tcttgtagcacacta

SEQ ID NO: 58109 - DNA, 15 bp, Artificial Sequence
  dgRNA
  Olfr1107
cttgtagcacactat

SEQ ID NO: 58110 - DNA, 15 bp, Artificial Sequence
  dgRNA
  Gabpa
tcgttcgacgctcac

SEQ ID NO: 58111 - DNA, 15 bp, Artificial Sequence
  dgRNA
  Gabpa
cgacgctcaccggac

SEQ ID NO: 58112 - DNA, 15 bp, Artificial Sequence
  dgRNA
  Gabpa
caggaagcgcctcga

SEQ ID NO: 58113 - DNA, 15 bp, Artificial Sequence
  dgRNA
  Gabpa
aggaagcgcctcgaa

SEQ ID NO: 58114 - DNA, 15 bp, Artificial Sequence
  dgRNA
  Ankrd17
actcggtctccccag

SEQ ID NO: 58115 - DNA, 15 bp, Artificial Sequence
  dgRNA
  Ankrd17
ccaggcgcactcccc

SEQ ID NO: 58116 - DNA, 15 bp, Artificial Sequence
  dgRNA
  Ankrd17
ggcgcactcccccgg

SEQ ID NO: 58117 - DNA, 15 bp, Artificial Sequence
  dgRNA
  Ankrd17
cccggcggctccttc

SEQ ID NO: 58118 - DNA, 15 bp, Artificial Sequence
  dgRNA
  Trafd1
cggagaaatgaccct

SEQ ID NO: 58119 - DNA, 15 bp, Artificial Sequence
  dgRNA
  Trafd1
gaggaggcggacccg

SEQ ID NO: 58120 - DNA, 15 bp, Artificial Sequence
  dgRNA
  Trafd1
gcggacccgaggaaa

SEQ ID NO: 58121 - DNA, 15 bp, Artificial Sequence
  dgRNA
  Trafd1
agcgctgtggtccaa

SEQ ID NO: 58122 - DNA, 15 bp, Artificial Sequence
  dgRNA
  Crct1
aatgggctcctccca

SEQ ID NO: 58123 - DNA, 15 bp, Artificial Sequence
  dgRNA
  Crct1
tgtaggtggtgcacg

SEQ ID NO: 58124 - DNA, 15 bp, Artificial Sequence
  dgRNA
  Crct1
agatagcactgtagg

SEQ ID NO: 58125 - DNA, 15 bp, Artificial Sequence
  dgRNA
  Prob1
acgctgcacctgtgt

SEQ ID NO: 58126 - DNA, 15 bp, Artificial Sequence
  dgRNA
  Prob1
ggagaaagttcggca

SEQ ID NO: 58127 - DNA, 15 bp, Artificial Sequence
  dgRNA
  Prob1
gagaaagttcggcat

SEQ ID NO: 58128 - DNA, 15 bp, Artificial Sequence
  dgRNA
  Prob1
agaaagttcggcatg

SEQ ID NO: 58129 - DNA, 15 bp, Artificial Sequence
  dgRNA
  Sbno1
cttcccgacagcccg

SEQ ID NO: 58130 - DNA, 15 bp, Artificial Sequence
  dgRNA
  Sbno1
cccgcggacctcaac

SEQ ID NO: 58131 - DNA, 15 bp, Artificial Sequence
  dgRNA
  Sbno1
gcggacctcaaccgg

SEQ ID NO: 58132 - DNA, 15 bp, Artificial Sequence
  dgRNA
  Sbno1
cggacctcaaccggt

SEQ ID NO: 58133 - DNA, 15 bp, Artificial Sequence
  dgRNA
  Hjurp
accggaagtgctccc

SEQ ID NO: 58134 - DNA, 15 bp, Artificial Sequence
  dgRNA
  Hjurp
ccggaagtgctccct

SEQ ID NO: 58135 - DNA, 15 bp, Artificial Sequence
  dgRNA
  Hjurp
cctgggagcggcggc

SEQ ID NO: 58136 - DNA, 15 bp, Artificial Sequence
  dgRNA
  Hjurp
cggcggccggaaacg

SEQ ID NO: 58137 - DNA, 15 bp, Artificial Sequence
  dgRNA
  4933412E24Rik
cgtagtagaaacccc

SEQ ID NO: 58138 - DNA, 15 bp, Artificial Sequence
  dgRNA
  4933412E24Rik
ggaacttgcaccttg

SEQ ID NO: 58139 - DNA, 15 bp, Artificial Sequence
  dgRNA
  4933412E24Rik
tttctactacgactc

SEQ ID NO: 58140 - DNA, 15 bp, Artificial Sequence
  dgRNA
  4933412E24Rik
caagtctcaaggtgc

SEQ ID NO: 58141 - DNA, 15 bp, Artificial Sequence
  dgRNA
  Ywhag
agcagtgtagtactg

SEQ ID NO: 58142 - DNA, 15 bp, Artificial Sequence
  dgRNA
  Ywhag
aagcccagtaaatgc

SEQ ID NO: 58143 - DNA, 15 bp, Artificial Sequence
  dgRNA
  Ywhag
aaatgcaggaccggg

SEQ ID NO: 58144 - DNA, 15 bp, Artificial Sequence
  dgRNA
  Ywhag
aatgcaggaccgggc

SEQ ID NO: 58145 - DNA, 15 bp, Artificial Sequence
  dgRNA
  Fanca
aggtgtattgcacca

SEQ ID NO: 58146 - DNA, 15 bp, Artificial Sequence
  dgRNA
  Fanca
aacgcagccagactc

SEQ ID NO: 58147 - DNA, 15 bp, Artificial Sequence
  dgRNA
  Fanca
acgcagccagactcc

SEQ ID NO: 58148 - DNA, 15 bp, Artificial Sequence
  dgRNA
  Fanca
agtactacaaccaag

SEQ ID NO: 58149 - DNA, 15 bp, Artificial Sequence
  dgRNA
  Zfp786
tccgtcttcactcct

SEQ ID NO: 58150 - DNA, 15 bp, Artificial Sequence
  dgRNA
  Zfp786
ccgtcttcactccta

SEQ ID NO: 58151 - DNA, 15 bp, Artificial Sequence
  dgRNA
  Zfp786
ttccccagtcacggg

SEQ ID NO: 58152 - DNA, 15 bp, Artificial Sequence
  dgRNA
  Zfp786
tccccagtcacggga

SEQ ID NO: 58153 - DNA, 15 bp, Artificial Sequence
  dgRNA
  Arhgap10
aggaagaggcgttcg

SEQ ID NO: 58154 - DNA, 15 bp, Artificial Sequence
  dgRNA
  Arhgap10
agaggcgttcgggga

SEQ ID NO: 58155 - DNA, 15 bp, Artificial Sequence
  dgRNA
  Arhgap10
gaggcgttcggggaa

SEQ ID NO: 58156 - DNA, 15 bp, Artificial Sequence
  dgRNA
  Arhgap10
cgttcggggaagggc

SEQ ID NO: 58157 - DNA, 15 bp, Artificial Sequence
  dgRNA
  Cd300ld
gcatctactcattag

SEQ ID NO: 58158 - DNA, 15 bp, Artificial Sequence
  dgRNA
  Cd300ld
atgagtagatgcaat

SEQ ID NO: 58159 - DNA, 15 bp, Artificial Sequence
  dgRNA
  Cd300ld
acagccgggtgaaca

SEQ ID NO: 58160 - DNA, 15 bp, Artificial Sequence
  dgRNA
  Cd300ld
gacagccgggtgaac

SEQ ID NO: 58161 - DNA, 15 bp, Artificial Sequence
  dgRNA
  Stard13
ttaagcgcagcttga

SEQ ID NO: 58162 - DNA, 15 bp, Artificial Sequence
  dgRNA
  Stard13
gctggtacagcctcg

SEQ ID NO: 58163 - DNA, 15 bp, Artificial Sequence
  dgRNA
  Stard13
cctcgcggtcgcgtt

SEQ ID NO: 58164 - DNA, 15 bp, Artificial Sequence
  dgRNA
  Stard13
gcggtcgcgttcggc

SEQ ID NO: 58165 - DNA, 15 bp, Artificial Sequence
  dgRNA
  Tbc1d16
ccagggcagggtccg

SEQ ID NO: 58166 - DNA, 15 bp, Artificial Sequence
  dgRNA
  Tbc1d16
agggtccggggtact

SEQ ID NO: 58167 - DNA, 15 bp, Artificial Sequence
  dgRNA
  Tbc1d16
ggggtactaggcgcg

SEQ ID NO: 58168 - DNA, 15 bp, Artificial Sequence
  dgRNA
  Tbc1d16
cagaaagccccgagc

SEQ ID NO: 58169 - DNA, 15 bp, Artificial Sequence
  dgRNA
  Thumpd1
cgttttacactctgc

SEQ ID NO: 58170 - DNA, 15 bp, Artificial Sequence
  dgRNA
  Thumpd1
cgtccagagcccact

SEQ ID NO: 58171 - DNA, 15 bp, Artificial Sequence
  dgRNA
  Thumpd1
ttgtcactttatgcg

SEQ ID NO: 58172 - DNA, 15 bp, Artificial Sequence
  dgRNA
  Thumpd1
actttatgcgaggac

SEQ ID NO: 58173 - DNA, 15 bp, Artificial Sequence
  dgRNA
  Sumo3
gccaaaacgttcctc

SEQ ID NO: 58174 - DNA, 15 bp, Artificial Sequence
  dgRNA
  Sumo3
ccaaaacgttcctct

SEQ ID NO: 58175 - DNA, 15 bp, Artificial Sequence
  dgRNA
  Sumo3
ccgtgcctccctgcg

SEQ ID NO: 58176 - DNA, 15 bp, Artificial Sequence
  dgRNA
  Sumo3
cccagaggaacgttt

SEQ ID NO: 58177 - DNA, 15 bp, Artificial Sequence
  dgRNA
  Mylk4
aggttgctcctgatt

SEQ ID NO: 58178 - DNA, 15 bp, Artificial Sequence
  dgRNA
  Mylk4
tcaacttcccaaatc

SEQ ID NO: 58179 - DNA, 15 bp, Artificial Sequence
  dgRNA
  Cysltr1
ggctatttgtaggcg

SEQ ID NO: 58180 - DNA, 15 bp, Artificial Sequence
  dgRNA
  Cysltr1
aggctatttgtaggc

SEQ ID NO: 58181 - DNA, 15 bp, Artificial Sequence
  dgRNA
  Cysltr1
taggctatttgtagg

SEQ ID NO: 58182 - DNA, 15 bp, Artificial Sequence
  dgRNA
  Cysltr1
gactggagggtgctt

SEQ ID NO: 58183 - DNA, 15 bp, Artificial Sequence
  dgRNA
  Taar9
tttagattgctagaa

SEQ ID NO: 58184 - DNA, 15 bp, Artificial Sequence
  dgRNA
  Taar9
tacaattaccaagac

SEQ ID NO: 58185 - DNA, 15 bp, Artificial Sequence
  dgRNA
  Taar9
aattgtaaacttccc

SEQ ID NO: 58186 - DNA, 15 bp, Artificial Sequence
  dgRNA
  Ifnar1
cagtctttccggaag

SEQ ID NO: 58187 - DNA, 15 bp, Artificial Sequence
  dgRNA
  Ifnar1
agtctttccggaagt

SEQ ID NO: 58188 - DNA, 15 bp, Artificial Sequence
  dgRNA
  Ifnar1
gtctttccggaagtg

SEQ ID NO: 58189 - DNA, 15 bp, Artificial Sequence
  dgRNA
  Ifnar1
tctttccggaagtgg

SEQ ID NO: 58190 - DNA, 15 bp, Artificial Sequence
  dgRNA
  Dsc3
aaagggacgcgggta

SEQ ID NO: 58191 - DNA, 15 bp, Artificial Sequence
  dgRNA
  Dsc3
ggacgcgggtaaggt

SEQ ID NO: 58192 - DNA, 15 bp, Artificial Sequence
  dgRNA
  Dsc3
gacgcgggtaaggtt

SEQ ID NO: 58193 - DNA, 15 bp, Artificial Sequence
  dgRNA
  Dsc3
gcgggtaaggttggg

SEQ ID NO: 58194 - DNA, 15 bp, Artificial Sequence
  dgRNA
  Esx1
taagggtgtgcgagc

SEQ ID NO: 58195 - DNA, 15 bp, Artificial Sequence
  dgRNA
  Esx1
gagctggtgcgaact

SEQ ID NO: 58196 - DNA, 15 bp, Artificial Sequence
  dgRNA
  Esx1
gccccttagtgctct

SEQ ID NO: 58197 - DNA, 15 bp, Artificial Sequence
  dgRNA
  Esx1
tgctctgggacgcct

SEQ ID NO: 58198 - DNA, 15 bp, Artificial Sequence
  dgRNA
  Sdr42e1
ggatgacgatagcta

SEQ ID NO: 58199 - DNA, 15 bp, Artificial Sequence
  dgRNA
  Sdr42e1
gatgacgatagctaa

SEQ ID NO: 58200 - DNA, 15 bp, Artificial Sequence
  dgRNA
  Hcst
tcacggaagcttctc

SEQ ID NO: 58201 - DNA, 15 bp, Artificial Sequence
  dgRNA
  Hcst
gagccaacaacactt

SEQ ID NO: 58202 - DNA, 15 bp, Artificial Sequence
  dgRNA
  Hcst
agagccaacaacact

SEQ ID NO: 58203 - DNA, 15 bp, Artificial Sequence
  dgRNA
  Hcst
cggtggagtggcaag

SEQ ID NO: 58204 - DNA, 15 bp, Artificial Sequence
  dgRNA
  Dtl
tgtacgcatgcgcct

SEQ ID NO: 58205 - DNA, 15 bp, Artificial Sequence
  dgRNA
  Dtl
gcctcggtcgccccg

SEQ ID NO: 58206 - DNA, 15 bp, Artificial Sequence
  dgRNA
  Dtl
tcgccagttcctctc

SEQ ID NO: 58207 - DNA, 15 bp, Artificial Sequence
  dgRNA
  Dtl
cgccagttcctctct

SEQ ID NO: 58208 - DNA, 15 bp, Artificial Sequence
  dgRNA
  Pex5l
tatgaagacaccctc

SEQ ID NO: 58209 - DNA, 15 bp, Artificial Sequence
  dgRNA
  Pex5l
catgtagcccgtgtc

SEQ ID NO: 58210 - DNA, 15 bp, Artificial Sequence
  dgRNA
  Pex5l
gagtgaggtcatagg

SEQ ID NO: 58211 - DNA, 15 bp, Artificial Sequence
  dgRNA
  Pex5l
gttaaatagtgccag

SEQ ID NO: 58212 - DNA, 15 bp, Artificial Sequence
  dgRNA
  Atf6
tgctgaaatcctcgt

SEQ ID NO: 58213 - DNA, 15 bp, Artificial Sequence
  dgRNA
  Atf6
gctgaaatcctcgta

SEQ ID NO: 58214 - DNA, 15 bp, Artificial Sequence
  dgRNA
  Atf6
acgtctccttagctt

SEQ ID NO: 58215 - DNA, 15 bp, Artificial Sequence
  dgRNA
  Atf6
cccagttcccgcgtg

SEQ ID NO: 58216 - DNA, 15 bp, Artificial Sequence
  dgRNA
  Mapkap1
gccccagtgcttgta

SEQ ID NO: 58217 - DNA, 15 bp, Artificial Sequence
  dgRNA
  Mapkap1
aagctcttgggtacg

SEQ ID NO: 58218 - DNA, 15 bp, Artificial Sequence
  dgRNA
  Mapkap1
gtacggggataatga

SEQ ID NO: 58219 - DNA, 15 bp, Artificial Sequence
  dgRNA
  Mapkap1
atccttacaagcact

SEQ ID NO: 58220 - DNA, 15 bp, Artificial Sequence
  dgRNA
  Pvrl3
aggagactcggcggg

SEQ ID NO: 58221 - DNA, 15 bp, Artificial Sequence
  dgRNA
  Pvrl3
actcggcgggcggct

SEQ ID NO: 58222 - DNA, 15 bp, Artificial Sequence
  dgRNA
  Pvrl3
gctcggccggcgtcc

SEQ ID NO: 58223 - DNA, 15 bp, Artificial Sequence
  dgRNA
  Pvrl3
gtccaggcagcccgg

SEQ ID NO: 58224 - DNA, 15 bp, Artificial Sequence
  dgRNA
  Vmn1r35
agctatactcatccg

SEQ ID NO: 58225 - DNA, 15 bp, Artificial Sequence
  dgRNA
  Vmn1r35
cgaggatcctaagtt

SEQ ID NO: 58226 - DNA, 15 bp, Artificial Sequence
  dgRNA
  D630003M21Rik
ggagtggaccaacgt

SEQ ID NO: 58227 - DNA, 15 bp, Artificial Sequence
  dgRNA
  D630003M21Rik
gagtggaccaacgtc

SEQ ID NO: 58228 - DNA, 15 bp, Artificial Sequence
  dgRNA
  D630003M21Rik
tgtcacccgcagcgg

SEQ ID NO: 58229 - DNA, 15 bp, Artificial Sequence
  dgRNA
  D630003M21Rik
cacccgcagcggcgg

SEQ ID NO: 58230 - DNA, 15 bp, Artificial Sequence
  dgRNA
  Naprt
gcactgacctctagg

SEQ ID NO: 58231 - DNA, 15 bp, Artificial Sequence
  dgRNA
  Naprt
caagcaccagcatag

SEQ ID NO: 58232 - DNA, 15 bp, Artificial Sequence
  dgRNA
  Naprt
cccaagcaccagcat

SEQ ID NO: 58233 - DNA, 15 bp, Artificial Sequence
  dgRNA
  Naprt
ctgagagccccctag

SEQ ID NO: 58234 - DNA, 15 bp, Artificial Sequence
  dgRNA
  Slc38a5
tctaaactgggagcg

SEQ ID NO: 58235 - DNA, 15 bp, Artificial Sequence
  dgRNA
  Slc38a5
ctaaactgggagcgg

SEQ ID NO: 58236 - DNA, 15 bp, Artificial Sequence
  dgRNA
  Slc38a5
gagggcggccctagg

SEQ ID NO: 58237 - DNA, 15 bp, Artificial Sequence
  dgRNA
  Slc38a5
agggcggccctagga

SEQ ID NO: 58238 - DNA, 15 bp, Artificial Sequence
  dgRNA
  Slc12a8
tgttggccccatctg

SEQ ID NO: 58239 - DNA, 15 bp, Artificial Sequence
  dgRNA
  Slc12a8
cttgttggccccatc

SEQ ID NO: 58240 - DNA, 15 bp, Artificial Sequence
  dgRNA
  Slc12a8
aagtagaaaccttgt

SEQ ID NO: 58241 - DNA, 15 bp, Artificial Sequence
  dgRNA
  Slc12a8
actgagaaaggtcgt

SEQ ID NO: 58242 - DNA, 15 bp, Artificial Sequence
  dgRNA
  Zfp41
cacgggatcacagag

SEQ ID NO: 58243 - DNA, 15 bp, Artificial Sequence
  dgRNA
  Zfp41
tagagcgacaccaga

SEQ ID NO: 58244 - DNA, 15 bp, Artificial Sequence
  dgRNA
  Zfp41
agagcgacaccagaa

SEQ ID NO: 58245 - DNA, 15 bp, Artificial Sequence
  dgRNA
  Zfp41
agggcgtgaacgagc

SEQ ID NO: 58246 - DNA, 15 bp, Artificial Sequence
  dgRNA
  Zc3h3
attgcgggccacttc

SEQ ID NO: 58247 - DNA, 15 bp, Artificial Sequence
  dgRNA
  Zc3h3
ggcgcttcaagatga

SEQ ID NO: 58248 - DNA, 15 bp, Artificial Sequence
  dgRNA
  Zc3h3
cgcatgcgtccttcc

SEQ ID NO: 58249 - DNA, 15 bp, Artificial Sequence
  dgRNA
  Zc3h3
gcatgcgtccttcca

SEQ ID NO: 58250 - DNA, 15 bp, Artificial Sequence
  dgRNA
  Slc22a12
cgctttcatctgcag

SEQ ID NO: 58251 - DNA, 15 bp, Artificial Sequence
  dgRNA
  Slc22a12
gcagtggtgttgtcc

SEQ ID NO: 58252 - DNA, 15 bp, Artificial Sequence
  dgRNA
  Slc22a12
ggatgcggcaagatc

SEQ ID NO: 58253 - DNA, 15 bp, Artificial Sequence
  dgRNA
  Slc22a12
ccgcccccatcttca

SEQ ID NO: 58254 - DNA, 15 bp, Artificial Sequence
  dgRNA
  Rin3
ccccccacgagcgtg

SEQ ID NO: 58255 - DNA, 15 bp, Artificial Sequence
  dgRNA
  Rin3
tgcggatcccccagc

SEQ ID NO: 58256 - DNA, 15 bp, Artificial Sequence
  dgRNA
  Rin3
gcggatcccccagca

SEQ ID NO: 58257 - DNA, 15 bp, Artificial Sequence
  dgRNA
  Rin3
actaagggtgaaact

SEQ ID NO: 58258 - DNA, 15 bp, Artificial Sequence
  dgRNA
  Tor1a
acactgttacttgat

SEQ ID NO: 58259 - DNA, 15 bp, Artificial Sequence
  dgRNA
  Tor1a
ttacttgatggggat

SEQ ID NO: 58260 - DNA, 15 bp, Artificial Sequence
  dgRNA
  Tor1a
tacttgatggggata

SEQ ID NO: 58261 - DNA, 15 bp, Artificial Sequence
  dgRNA
  Tor1a
ggtagccactagcgt

SEQ ID NO: 58262 - DNA, 15 bp, Artificial Sequence
  dgRNA
  Sult3a1
gtctaaaattgtggc

SEQ ID NO: 58263 - DNA, 15 bp, Artificial Sequence
  dgRNA
  Sult3a1
gtaatagttactgag

SEQ ID NO: 58264 - DNA, 15 bp, Artificial Sequence
  dgRNA
  Dcxr
tctgccctctatagt

SEQ ID NO: 58265 - DNA, 15 bp, Artificial Sequence
  dgRNA
  Dcxr
ctgccctctatagtt

SEQ ID NO: 58266 - DNA, 15 bp, Artificial Sequence
  dgRNA
  Dcxr
atagttgggtcagtc

SEQ ID NO: 58267 - DNA, 15 bp, Artificial Sequence
  dgRNA
  Dcxr
ctgcttagcgagttc

SEQ ID NO: 58268 - DNA, 15 bp, Artificial Sequence
  dgRNA
  Cfap45
atagttgagccctcc

SEQ ID NO: 58269 - DNA, 15 bp, Artificial Sequence
  dgRNA
  Cfap45
gccctccgggaccca

SEQ ID NO: 58270 - DNA, 15 bp, Artificial Sequence
  dgRNA
  Cfap45
tttaaagtctgaacc

SEQ ID NO: 58271 - DNA, 15 bp, Artificial Sequence
  dgRNA
  Cfap45
gaacctggcttgaac

SEQ ID NO: 58272 - DNA, 15 bp, Artificial Sequence
  dgRNA
  Rab5a
tgtcggttcagatca

SEQ ID NO: 58273 - DNA, 15 bp, Artificial Sequence
  dgRNA
  Rab5a
cggttcagatcaagg

SEQ ID NO: 58274 - DNA, 15 bp, Artificial Sequence
  dgRNA
  Rab5a
aaggaggcgttagag

SEQ ID NO: 58275 - DNA, 15 bp, Artificial Sequence
  dgRNA
  Rab5a
ctcccttagcgcacc

SEQ ID NO: 58276 - DNA, 15 bp, Artificial Sequence
  dgRNA
  Evl
gccagtctcgggcct

SEQ ID NO: 58277 - DNA, 15 bp, Artificial Sequence
  dgRNA
  Evl
cgctattttctacct

SEQ ID NO: 58278 - DNA, 15 bp, Artificial Sequence
  dgRNA
  Evl
gcctaggcccgagac

SEQ ID NO: 58279 - DNA, 15 bp, Artificial Sequence
  dgRNA
  Evl
gggccccaccagtgt

SEQ ID NO: 58280 - DNA, 15 bp, Artificial Sequence
  dgRNA
  Fpr1
ttggatatactctca

SEQ ID NO: 58281 - DNA, 15 bp, Artificial Sequence
  dgRNA
  Fpr1
atttggtgaccaggt

SEQ ID NO: 58282 - DNA, 15 bp, Artificial Sequence
  dgRNA
  Fpr1
aatgcattgggtaac

SEQ ID NO: 58283 - DNA, 15 bp, Artificial Sequence
  dgRNA
  Fnip2
gagcgagctgtcagc

SEQ ID NO: 58284 - DNA, 15 bp, Artificial Sequence
  dgRNA
  Fnip2
agcgagctgtcagcc

SEQ ID NO: 58285 - DNA, 15 bp, Artificial Sequence
  dgRNA
  Fnip2
gctccgtcatatgac

SEQ ID NO: 58286 - DNA, 15 bp, Artificial Sequence
  dgRNA
  Fnip2
cgtcatatgaccggc

SEQ ID NO: 58287 - DNA, 15 bp, Artificial Sequence
  dgRNA
  Maml2
tataagccattcagg

SEQ ID NO: 58288 - DNA, 15 bp, Artificial Sequence
  dgRNA
  Maml2
aaggtataattggat

SEQ ID NO: 58289 - DNA, 15 bp, Artificial Sequence
  dgRNA
  Maml2
ggcttatatcttagg

SEQ ID NO: 58290 - DNA, 15 bp, Artificial Sequence
  dgRNA
  Maml2
aatggcttatatctt

SEQ ID NO: 58291 - DNA, 15 bp, Artificial Sequence
  dgRNA
  Adam30
agcttaattcactgc

SEQ ID NO: 58292 - DNA, 15 bp, Artificial Sequence
  dgRNA
  Adam30
gcttaattcactgcc

SEQ ID NO: 58293 - DNA, 15 bp, Artificial Sequence
  dgRNA
  Adam30
attcactgccgggtt

SEQ ID NO: 58294 - DNA, 15 bp, Artificial Sequence
  dgRNA
  Adam30
ttcactgccgggtta

SEQ ID NO: 58295 - DNA, 15 bp, Artificial Sequence
  dgRNA
  Olfr551
atcactaaggttcaa

SEQ ID NO: 58296 - DNA, 15 bp, Artificial Sequence
  dgRNA
  Olfr551
gggttagtatcacta

SEQ ID NO: 58297 - DNA, 15 bp, Artificial Sequence
  dgRNA
  Olfr551
agattgtaaggccct

SEQ ID NO: 58298 - DNA, 15 bp, Artificial Sequence
  dgRNA
  Npc1l1
gcaccatctgatgta

SEQ ID NO: 58299 - DNA, 15 bp, Artificial Sequence
  dgRNA
  Npc1l1
caccatctgatgtaa

SEQ ID NO: 58300 - DNA, 15 bp, Artificial Sequence
  dgRNA
  Npc1l1
aattattaaccagta

SEQ ID NO: 58301 - DNA, 15 bp, Artificial Sequence
  dgRNA
  Npc1l1
acggcccagtcctat

SEQ ID NO: 58302 - DNA, 15 bp, Artificial Sequence
  dgRNA
  Tmem179
ctcacgacccctgcc

SEQ ID NO: 58303 - DNA, 15 bp, Artificial Sequence
  dgRNA
  Tmem179
cctatcctgcagccg

SEQ ID NO: 58304 - DNA, 15 bp, Artificial Sequence
  dgRNA
  Tmem179
ctatcctgcagccgc

SEQ ID NO: 58305 - DNA, 15 bp, Artificial Sequence
  dgRNA
  Tmem179
cgcgggaactgtccg

SEQ ID NO: 58306 - DNA, 15 bp, Artificial Sequence
  dgRNA
  9130008F23Rik
gggtggagatcaata

SEQ ID NO: 58307 - DNA, 15 bp, Artificial Sequence
  dgRNA
  9130008F23Rik
gtaaaccaagatagg

SEQ ID NO: 58308 - DNA, 15 bp, Artificial Sequence
  dgRNA
  9130008F23Rik
cggaaattcgcagtg

SEQ ID NO: 58309 - DNA, 15 bp, Artificial Sequence
  dgRNA
  9130008F23Rik
ccctccgagtttagc

SEQ ID NO: 58310 - DNA, 15 bp, Artificial Sequence
  dgRNA
  Omd
gctccagtaattcaa

SEQ ID NO: 58311 - DNA, 15 bp, Artificial Sequence
  dgRNA
  Omd
ttcgctaaagaattt

SEQ ID NO: 58312 - DNA, 15 bp, Artificial Sequence
  dgRNA
  H60c
ttattaggcagtatt

SEQ ID NO: 58313 - DNA, 15 bp, Artificial Sequence
  dgRNA
  H60c
atgactatgcaattt

SEQ ID NO: 58314 - DNA, 15 bp, Artificial Sequence
  dgRNA
  H60c
tgactatgcaatttc

SEQ ID NO: 58315 - DNA, 15 bp, Artificial Sequence
  dgRNA
  H60c
atgcaatttcgggct

SEQ ID NO: 58316 - DNA, 15 bp, Artificial Sequence
  dgRNA
  Mkrn1
gccgcggcatcgctg

SEQ ID NO: 58317 - DNA, 15 bp, Artificial Sequence
  dgRNA
  Mkrn1
ccgcggcatcgctgc

SEQ ID NO: 58318 - DNA, 15 bp, Artificial Sequence
  dgRNA
  Mkrn1
cgggtttcagactgc

SEQ ID NO: 58319 - DNA, 15 bp, Artificial Sequence
  dgRNA
  Mkrn1
ttcagactgcgggct

SEQ ID NO: 58320 - DNA, 15 bp, Artificial Sequence
  dgRNA
  Srgn
acagcaaacgcctag

SEQ ID NO: 58321 - DNA, 15 bp, Artificial Sequence
  dgRNA
  Srgn
cagcaaacgcctagg

SEQ ID NO: 58322 - DNA, 15 bp, Artificial Sequence
  dgRNA
  Srgn
ctagggggagtccgg

SEQ ID NO: 58323 - DNA, 15 bp, Artificial Sequence
  dgRNA
  Srgn
ggtggagtttcatca

SEQ ID NO: 58324 - DNA, 15 bp, Artificial Sequence
  dgRNA
  Apex1
gtgcctcacggctcc

SEQ ID NO: 58325 - DNA, 15 bp, Artificial Sequence
  dgRNA
  Apex1
cggctcccggtcgtg

SEQ ID NO: 58326 - DNA, 15 bp, Artificial Sequence
  dgRNA
  Apex1
cccagaaccaagcga

SEQ ID NO: 58327 - DNA, 15 bp, Artificial Sequence
  dgRNA
  Apex1
ccagaaccaagcgaa

SEQ ID NO: 58328 - DNA, 15 bp, Artificial Sequence
  dgRNA
  Rnf146
tctctgaccattaag

SEQ ID NO: 58329 - DNA, 15 bp, Artificial Sequence
  dgRNA
  Rnf146
accattaagtggcta

SEQ ID NO: 58330 - DNA, 15 bp, Artificial Sequence
  dgRNA
  Rnf146
gaggtaggtgcttaa

SEQ ID NO: 58331 - DNA, 15 bp, Artificial Sequence
  dgRNA
  Rnf146
gtaggtgcttaaagg

SEQ ID NO: 58332 - DNA, 15 bp, Artificial Sequence
  dgRNA
  Fscn1
cagaaaaacactccg

SEQ ID NO: 58333 - DNA, 15 bp, Artificial Sequence
  dgRNA
  Fscn1
actccggggaagcgc

SEQ ID NO: 58334 - DNA, 15 bp, Artificial Sequence
  dgRNA
  Fscn1
ctccggggaagcgca

SEQ ID NO: 58335 - DNA, 15 bp, Artificial Sequence
  dgRNA
  Fscn1
tccggggaagcgcag

SEQ ID NO: 58336 - DNA, 15 bp, Artificial Sequence
  dgRNA
  Gprc5c
cgtgatcttggagac

SEQ ID NO: 58337 - DNA, 15 bp, Artificial Sequence
  dgRNA
  Gprc5c
ctgggctcttcggga

SEQ ID NO: 58338 - DNA, 15 bp, Artificial Sequence
  dgRNA
  Gprc5c
gatcacgcacgaaag

SEQ ID NO: 58339 - DNA, 15 bp, Artificial Sequence
  dgRNA
  Gprc5c
cacgcacgaaagagg

SEQ ID NO: 58340 - DNA, 15 bp, Artificial Sequence
  dgRNA
  Olfr907
gaagtttgggtggta

SEQ ID NO: 58341 - DNA, 15 bp, Artificial Sequence
  dgRNA
  Olfr907
acttctatataattg

SEQ ID NO: 58342 - DNA, 15 bp, Artificial Sequence
  dgRNA
  Bmp8b
ggtgatacctacctc

SEQ ID NO: 58343 - DNA, 15 bp, Artificial Sequence
  dgRNA
  Bmp8b
gtgatacctacctcc

SEQ ID NO: 58344 - DNA, 15 bp, Artificial Sequence
  dgRNA
  Bmp8b
cacctttagtagtag

SEQ ID NO: 58345 - DNA, 15 bp, Artificial Sequence
  dgRNA
  Bmp8b
acgtgtgtccgcgct

SEQ ID NO: 58346 - DNA, 15 bp, Artificial Sequence
  dgRNA
  Gpr35
ctaccagggacattc

SEQ ID NO: 58347 - DNA, 15 bp, Artificial Sequence
  dgRNA
  Gpr35
ttgccagtagatgag

SEQ ID NO: 58348 - DNA, 15 bp, Artificial Sequence
  dgRNA
  Gpr35
gtagactaaggctgc

SEQ ID NO: 58349 - DNA, 15 bp, Artificial Sequence
  dgRNA
  Gpr35
gaagtccacaagtga

SEQ ID NO: 58350 - DNA, 15 bp, Artificial Sequence
  dgRNA
  Elmo3
gttgctgagactggg

SEQ ID NO: 58351 - DNA, 15 bp, Artificial Sequence
  dgRNA
  Elmo3
ggtgggtcaccttac

SEQ ID NO: 58352 - DNA, 15 bp, Artificial Sequence
  dgRNA
  Elmo3
gtcaccttactggaa

SEQ ID NO: 58353 - DNA, 15 bp, Artificial Sequence
  dgRNA
  Elmo3
tcaccttactggaat

SEQ ID NO: 58354 - DNA, 15 bp, Artificial Sequence
  dgRNA
  Snx15
aaagaaacgtttcgg

SEQ ID NO: 58355 - DNA, 15 bp, Artificial Sequence
  dgRNA
  Snx15
tttcggaggtctgta

SEQ ID NO: 58356 - DNA, 15 bp, Artificial Sequence
  dgRNA
  Snx15
cggaggtctgtaagg

SEQ ID NO: 58357 - DNA, 15 bp, Artificial Sequence
  dgRNA
  Snx15
aggagggtttacgtt

SEQ ID NO: 58358 - DNA, 15 bp, Artificial Sequence
  dgRNA
  Chrdl1
tactagccaaaggag

SEQ ID NO: 58359 - DNA, 15 bp, Artificial Sequence
  dgRNA
  Chrdl1
gggggcgctgcgtga

SEQ ID NO: 58360 - DNA, 15 bp, Artificial Sequence
  dgRNA
  Chrdl1
ggggcgctgcgtgat

SEQ ID NO: 58361 - DNA, 15 bp, Artificial Sequence
  dgRNA
  Chrdl1
cgcacactttctccc

SEQ ID NO: 58362 - DNA, 15 bp, Artificial Sequence
  dgRNA
  Rp9
aacgagtcgcagaag

SEQ ID NO: 58363 - DNA, 15 bp, Artificial Sequence
  dgRNA
  Rp9
acgagtcgcagaagt

SEQ ID NO: 58364 - DNA, 15 bp, Artificial Sequence
  dgRNA
  Rp9
ggcctgcaggcgact

SEQ ID NO: 58365 - DNA, 15 bp, Artificial Sequence
  dgRNA
  Rp9
gcgacttggagcacc

SEQ ID NO: 58366 - DNA, 15 bp, Artificial Sequence
  dgRNA
  Il10rb
gatcacttcgaattc

SEQ ID NO: 58367 - DNA, 15 bp, Artificial Sequence
  dgRNA
  Il10rb
atcacttcgaattcc

SEQ ID NO: 58368 - DNA, 15 bp, Artificial Sequence
  dgRNA
  Il10rb
aacagaagcgcggat

SEQ ID NO: 58369 - DNA, 15 bp, Artificial Sequence
  dgRNA
  Il10rb
acagaagcgcggatt

SEQ ID NO: 58370 - DNA, 15 bp, Artificial Sequence
  dgRNA
  Jakmip2
cctctcaaggcgaca

SEQ ID NO: 58371 - DNA, 15 bp, Artificial Sequence
  dgRNA
  Jakmip2
cttgccacttgcaat

SEQ ID NO: 58372 - DNA, 15 bp, Artificial Sequence
  dgRNA
  Jakmip2
tgcttctaccgcagc

SEQ ID NO: 58373 - DNA, 15 bp, Artificial Sequence
  dgRNA
  Jakmip2
gcttctaccgcagca

SEQ ID NO: 58374 - DNA, 15 bp, Artificial Sequence
  dgRNA
  Mrpl3
aaccatctaatccat

SEQ ID NO: 58375 - DNA, 15 bp, Artificial Sequence
  dgRNA
  Mrpl3
agagccatttggata

SEQ ID NO: 58376 - DNA, 15 bp, Artificial Sequence
  dgRNA
  Mrpl3
cggaaccatagttac

SEQ ID NO: 58377 - DNA, 15 bp, Artificial Sequence
  dgRNA
  Mrpl3
ccatagttacaggta

SEQ ID NO: 58378 - DNA, 15 bp, Artificial Sequence
  dgRNA
  Clpsl2
gcacaaatgcccggt

SEQ ID NO: 58379 - DNA, 15 bp, Artificial Sequence
  dgRNA
  Clpsl2
tgccaaagcctagcc

SEQ ID NO: 58380 - DNA, 15 bp, Artificial Sequence
  dgRNA
  Clpsl2
ccatcgggcccacgc

SEQ ID NO: 58381 - DNA, 15 bp, Artificial Sequence
  dgRNA
  Clpsl2
cgggcccacgctggc

SEQ ID NO: 58382 - DNA, 15 bp, Artificial Sequence
  dgRNA
  Ibtk
gtgtcgaccgcacca

SEQ ID NO: 58383 - DNA, 15 bp, Artificial Sequence
  dgRNA
  Ibtk
cgaccgcaccaaggc

SEQ ID NO: 58384 - DNA, 15 bp, Artificial Sequence
  dgRNA
  Ibtk
gcaccaaggccggca

SEQ ID NO: 58385 - DNA, 15 bp, Artificial Sequence
  dgRNA
  Ibtk
ggggtcatgctcctt

SEQ ID NO: 58386 - DNA, 15 bp, Artificial Sequence
  dgRNA
  Znhit1
gactgcagaaaacgc

SEQ ID NO: 58387 - DNA, 15 bp, Artificial Sequence
  dgRNA
  Znhit1
agtggggggacccat

SEQ ID NO: 58388 - DNA, 15 bp, Artificial Sequence
  dgRNA
  Znhit1
tgtacgggtgagtgg

SEQ ID NO: 58389 - DNA, 15 bp, Artificial Sequence
  dgRNA
  Znhit1
ctgtacgggtgagtg

SEQ ID NO: 58390 - DNA, 15 bp, Artificial Sequence
  dgRNA
  Trpv4
ctaccagcctttgat

SEQ ID NO: 58391 - DNA, 15 bp, Artificial Sequence
  dgRNA
  Trpv4
gagctgccgggcaag

SEQ ID NO: 58392 - DNA, 15 bp, Artificial Sequence
  dgRNA
  Trpv4
agctgccgggcaagc

SEQ ID NO: 58393 - DNA, 15 bp, Artificial Sequence
  dgRNA
  Trpv4
gggcaagcgggttcc

SEQ ID NO: 58394 - DNA, 15 bp, Artificial Sequence
  dgRNA
  BC030867
ctttcaaccagaacg

SEQ ID NO: 58395 - DNA, 15 bp, Artificial Sequence
  dgRNA
  BC030867
aacgtggcagccggc

SEQ ID NO: 58396 - DNA, 15 bp, Artificial Sequence
  dgRNA
  BC030867
agccggctggactag

SEQ ID NO: 58397 - DNA, 15 bp, Artificial Sequence
  dgRNA
  BC030867
gccggctggactaga

SEQ ID NO: 58398 - DNA, 15 bp, Artificial Sequence
  dgRNA
  Abcg3
ccgcacctgtcccaa

SEQ ID NO: 58399 - DNA, 15 bp, Artificial Sequence
  dgRNA
  Abcg3
cgcacctgtcccaaa

SEQ ID NO: 58400 - DNA, 15 bp, Artificial Sequence
  dgRNA
  Abcg3
gcacctgtcccaaag

SEQ ID NO: 58401 - DNA, 15 bp, Artificial Sequence
  dgRNA
  Abcg3
gggttcagccagatc

SEQ ID NO: 58402 - DNA, 15 bp, Artificial Sequence
  dgRNA
  Adamts17
cctaactacgcacgt

SEQ ID NO: 58403 - DNA, 15 bp, Artificial Sequence
  dgRNA
  Adamts17
cacgttggtttcgac

SEQ ID NO: 58404 - DNA, 15 bp, Artificial Sequence
  dgRNA
  Adamts17
cggccctaaccaata

SEQ ID NO: 58405 - DNA, 15 bp, Artificial Sequence
  dgRNA
  Adamts17
ctaaccaatacggac

SEQ ID NO: 58406 - DNA, 15 bp, Artificial Sequence
  dgRNA
  Senp3
ctaagcgcctagctt

SEQ ID NO: 58407 - DNA, 15 bp, Artificial Sequence
  dgRNA
  Senp3
ttggtccaatccttg

SEQ ID NO: 58408 - DNA, 15 bp, Artificial Sequence
  dgRNA
  Senp3
tggtccaatccttgc

SEQ ID NO: 58409 - DNA, 15 bp, Artificial Sequence
  dgRNA
  Senp3
ggtccaatccttgcg

SEQ ID NO: 58410 - DNA, 15 bp, Artificial Sequence
  dgRNA
  Slc35e1
aaagcgtttaagtga

SEQ ID NO: 58411 - DNA, 15 bp, Artificial Sequence
  dgRNA
  Slc35e1
cgtttaagtgagggt

SEQ ID NO: 58412 - DNA, 15 bp, Artificial Sequence
  dgRNA
  Slc35e1
cgccgacgacgtgta

SEQ ID NO: 58413 - DNA, 15 bp, Artificial Sequence
  dgRNA
  Slc35e1
gccgacgacgtgtac

SEQ ID NO: 58414 - DNA, 15 bp, Artificial Sequence
  dgRNA
  4930430F08Rik
atcgatactaagtag

SEQ ID NO: 58415 - DNA, 15 bp, Artificial Sequence
  dgRNA
  4930430F08Rik
ccaagtatacaacat

SEQ ID NO: 58416 - DNA, 15 bp, Artificial Sequence
  dgRNA
  4930430F08Rik
caagtatacaacatc

SEQ ID NO: 58417 - DNA, 15 bp, Artificial Sequence
  dgRNA
  4930430F08Rik
tacaacatcgggtaa

SEQ ID NO: 58418 - DNA, 15 bp, Artificial Sequence
  dgRNA
  Hoxa10
caggcgtgcgtcttc

SEQ ID NO: 58419 - DNA, 15 bp, Artificial Sequence
  dgRNA
  Hoxa10
atttatatcaatcgc

SEQ ID NO: 58420 - DNA, 15 bp, Artificial Sequence
  dgRNA
  Hoxa10
caatcgcgggctccg

SEQ ID NO: 58421 - DNA, 15 bp, Artificial Sequence
  dgRNA
  Hoxa10
aatcgcgggctccga

SEQ ID NO: 58422 - DNA, 15 bp, Artificial Sequence
  dgRNA
  Ces3b
tggcctccaaccaat

SEQ ID NO: 58423 - DNA, 15 bp, Artificial Sequence
  dgRNA
  Ces3b
tgcccgattggttgg

SEQ ID NO: 58424 - DNA, 15 bp, Artificial Sequence
  dgRNA
  Ces3b
gtctgcccgattggt

SEQ ID NO: 58425 - DNA, 15 bp, Artificial Sequence
  dgRNA
  Ces3b
cttggtctgcccgat

SEQ ID NO: 58426 - DNA, 15 bp, Artificial Sequence
  dgRNA
  Pi4k2a
cgcggtctccacaga

SEQ ID NO: 58427 - DNA, 15 bp, Artificial Sequence
  dgRNA
  Pi4k2a
gtgacgcgaaagcta

SEQ ID NO: 58428 - DNA, 15 bp, Artificial Sequence
  dgRNA
  Pi4k2a
acgcgaaagctaagg

SEQ ID NO: 58429 - DNA, 15 bp, Artificial Sequence
  dgRNA
  Pi4k2a
aggccgcgattgcgt

SEQ ID NO: 58430 - DNA, 15 bp, Artificial Sequence
  dgRNA
  Ptges2
caagtaaattcgcaa

SEQ ID NO: 58431 - DNA, 15 bp, Artificial Sequence
  dgRNA
  Ptges2
aaattcgcaaaggcc

SEQ ID NO: 58432 - DNA, 15 bp, Artificial Sequence
  dgRNA
  Ptges2
aattcgcaaaggcct

SEQ ID NO: 58433 - DNA, 15 bp, Artificial Sequence
  dgRNA
  Ptges2
attcgcaaaggcctg

SEQ ID NO: 58434 - DNA, 15 bp, Artificial Sequence
  dgRNA
  Psmc4
ggccgcgaagcagga

SEQ ID NO: 58435 - DNA, 15 bp, Artificial Sequence
  dgRNA
  Psmc4
cgcgcaacatccttg

SEQ ID NO: 58436 - DNA, 15 bp, Artificial Sequence
  dgRNA
  Psmc4
gcgcaacatccttgc

SEQ ID NO: 58437 - DNA, 15 bp, Artificial Sequence
  dgRNA
  Psmc4
tggagcgcagagcgc

SEQ ID NO: 58438 - DNA, 15 bp, Artificial Sequence
  dgRNA
  Noxred1
aagcgcaccaccacg

SEQ ID NO: 58439 - DNA, 15 bp, Artificial Sequence
  dgRNA
  Noxred1
gctatctgttactgc

SEQ ID NO: 58440 - DNA, 15 bp, Artificial Sequence
  dgRNA
  Noxred1
catgagtcctcgtgg

SEQ ID NO: 58441 - DNA, 15 bp, Artificial Sequence
  dgRNA
  Noxred1
gctcatgagtcctcg

SEQ ID NO: 58442 - DNA, 15 bp, Artificial Sequence
  dgRNA
  Pigw
cggggcgtgcacacg

SEQ ID NO: 58443 - DNA, 15 bp, Artificial Sequence
  dgRNA
  Pigw
cgtgcacacgcggcg

SEQ ID NO: 58444 - DNA, 15 bp, Artificial Sequence
  dgRNA
  Pigw
gtgcacacgcggcgc

SEQ ID NO: 58445 - DNA, 15 bp, Artificial Sequence
  dgRNA
  Pigw
cacgtggcccgtccc

SEQ ID NO: 58446 - DNA, 15 bp, Artificial Sequence
  dgRNA
  Apopt1
gccgtcctcgcagag

SEQ ID NO: 58447 - DNA, 15 bp, Artificial Sequence
  dgRNA
  Apopt1
ccgtcctcgcagagc

SEQ ID NO: 58448 - DNA, 15 bp, Artificial Sequence
  dgRNA
  Apopt1
cgtcagcagtgagcc

SEQ ID NO: 58449 - DNA, 15 bp, Artificial Sequence
  dgRNA
  Apopt1
tcagcagtgagcccg

SEQ ID NO: 58450 - DNA, 15 bp, Artificial Sequence
  dgRNA
  Car12
cccccaagtaacctg

SEQ ID NO: 58451 - DNA, 15 bp, Artificial Sequence
  dgRNA
  Car12
agaggaccgccgcag

SEQ ID NO: 58452 - DNA, 15 bp, Artificial Sequence
  dgRNA
  Car12
gaggaccgccgcagt

SEQ ID NO: 58453 - DNA, 15 bp, Artificial Sequence
  dgRNA
  Car12
cgcagtgggccactg

SEQ ID NO: 58454 - DNA, 15 bp, Artificial Sequence
  dgRNA
  Polr1a
caatttgccaagccg

SEQ ID NO: 58455 - DNA, 15 bp, Artificial Sequence
  dgRNA
  Polr1a
aagtaagtttattcg

SEQ ID NO: 58456 - DNA, 15 bp, Artificial Sequence
  dgRNA
  Polr1a
cttggcaaattggct

SEQ ID NO: 58457 - DNA, 15 bp, Artificial Sequence
  dgRNA
  Polr1a
cgcggcttggcaaat

SEQ ID NO: 58458 - DNA, 15 bp, Artificial Sequence
  dgRNA
  Gga2
gtccagtatcttttc

SEQ ID NO: 58459 - DNA, 15 bp, Artificial Sequence
  dgRNA
  Gga2
aatacctaactagct

SEQ ID NO: 58460 - DNA, 15 bp, Artificial Sequence
  dgRNA
  Gga2
aaagacctcgtgagt

SEQ ID NO: 58461 - DNA, 15 bp, Artificial Sequence
  dgRNA
  Gga2
gacctcgtgagttgg

SEQ ID NO: 58462 - DNA, 15 bp, Artificial Sequence
  dgRNA
  Rbm27
gataccatcttgcac

SEQ ID NO: 58463 - DNA, 15 bp, Artificial Sequence
  dgRNA
  Rbm27
ataccatcttgcacc

SEQ ID NO: 58464 - DNA, 15 bp, Artificial Sequence
  dgRNA
  Rbm27
cgccctcactgggta

SEQ ID NO: 58465 - DNA, 15 bp, Artificial Sequence
  dgRNA
  Rbm27
actgggtacggcttg

SEQ ID NO: 58466 - DNA, 15 bp, Artificial Sequence
  dgRNA
  Dnajc6
ggctgcgctgtggtc

SEQ ID NO: 58467 - DNA, 15 bp, Artificial Sequence
  dgRNA
  Dnajc6
acgttgctctgggaa

SEQ ID NO: 58468 - DNA, 15 bp, Artificial Sequence
  dgRNA
  Dnajc6
cacgttgctctggga

SEQ ID NO: 58469 - DNA, 15 bp, Artificial Sequence
  dgRNA
  Dnajc6
ggttcacgttgctct

SEQ ID NO: 58470 - DNA, 15 bp, Artificial Sequence
  dgRNA
  Stk4
ggtgtcgctgacact

SEQ ID NO: 58471 - DNA, 15 bp, Artificial Sequence
  dgRNA
  Stk4
gtgtcgctgacactc

SEQ ID NO: 58472 - DNA, 15 bp, Artificial Sequence
  dgRNA
  Stk4
cactcgggccactag

SEQ ID NO: 58473 - DNA, 15 bp, Artificial Sequence
  dgRNA
  Stk4
tagaggccgcccgag

SEQ ID NO: 58474 - DNA, 15 bp, Artificial Sequence
  dgRNA
  B3gat1
cctgggccccgcccg

SEQ ID NO: 58475 - DNA, 15 bp, Artificial Sequence
  dgRNA
  B3gat1
gacgccccagaggga

SEQ ID NO: 58476 - DNA, 15 bp, Artificial Sequence
  dgRNA
  B3gat1
gtgataccaagctag

SEQ ID NO: 58477 - DNA, 15 bp, Artificial Sequence
  dgRNA
  B3gat1
ataccaagctagagg

SEQ ID NO: 58478 - DNA, 15 bp, Artificial Sequence
  dgRNA
  Ube2j1
gccgcccgtctcccc

SEQ ID NO: 58479 - DNA, 15 bp, Artificial Sequence
  dgRNA
  Ube2j1
ccgcccgtctcccca

SEQ ID NO: 58480 - DNA, 15 bp, Artificial Sequence
  dgRNA
  Ube2j1
ggcgggcgggattcg

SEQ ID NO: 58481 - DNA, 15 bp, Artificial Sequence
  dgRNA
  Ube2j1
gcgggcgggattcgc

SEQ ID NO: 58482 - DNA, 15 bp, Artificial Sequence
  dgRNA
  Pdcd10
cccacctattgccta

SEQ ID NO: 58483 - DNA, 15 bp, Artificial Sequence
  dgRNA
  Pdcd10
tctcgcacagccttc

SEQ ID NO: 58484 - DNA, 15 bp, Artificial Sequence
  dgRNA
  Pdcd10
ctcgcacagccttct

SEQ ID NO: 58485 - DNA, 15 bp, Artificial Sequence
  dgRNA
  Pdcd10
tagtcttactattgc

SEQ ID NO: 58486 - DNA, 15 bp, Artificial Sequence
  dgRNA
  Prkg2
taagttgcctcacgc

SEQ ID NO: 58487 - DNA, 15 bp, Artificial Sequence
  dgRNA
  Prkg2
gttgcctcacgccgg

SEQ ID NO: 58488 - DNA, 15 bp, Artificial Sequence
  dgRNA
  Prkg2
ctcacgccggaggtt

SEQ ID NO: 58489 - DNA, 15 bp, Artificial Sequence
  dgRNA
  Prkg2
tcacgccggaggttc

SEQ ID NO: 58490 - DNA, 15 bp, Artificial Sequence
  dgRNA
  Sfswap
tcgtcacatcctagg

SEQ ID NO: 58491 - DNA, 15 bp, Artificial Sequence
  dgRNA
  Sfswap
gaggcctccaaaaaa

SEQ ID NO: 58492 - DNA, 15 bp, Artificial Sequence
  dgRNA
  Sfswap
atcgcaagatcaagt

SEQ ID NO: 58493 - DNA, 15 bp, Artificial Sequence
  dgRNA
  Sfswap
ggctcaaacagcttg

SEQ ID NO: 58494 - DNA, 15 bp, Artificial Sequence
  dgRNA
  2310061I04Rik
tcccctcattttgct

SEQ ID NO: 58495 - DNA, 15 bp, Artificial Sequence
  dgRNA
  2310061I04Rik
gctaggcctgacaag

SEQ ID NO: 58496 - DNA, 15 bp, Artificial Sequence
  dgRNA
  2310061I04Rik
gacaagaggctgcgc

SEQ ID NO: 58497 - DNA, 15 bp, Artificial Sequence
  dgRNA
  2310061I04Rik
gctgcgcaggcgccc

SEQ ID NO: 58498 - DNA, 15 bp, Artificial Sequence
  dgRNA
  Mmp1a
gctgctggatagtcc

SEQ ID NO: 58499 - DNA, 15 bp, Artificial Sequence
  dgRNA
  Mmp1a
ctaactcaactgcta

SEQ ID NO: 58500 - DNA, 15 bp, Artificial Sequence
  dgRNA
  Sema6c
ttgccccaccccata

SEQ ID NO: 58501 - DNA, 15 bp, Artificial Sequence
  dgRNA
  Sema6c
ccccatagggtcttc

SEQ ID NO: 58502 - DNA, 15 bp, Artificial Sequence
  dgRNA
  Sema6c
gtctgcctgcaacaa

SEQ ID NO: 58503 - DNA, 15 bp, Artificial Sequence
  dgRNA
  Sema6c
tccagggccggcaca

SEQ ID NO: 58504 - DNA, 15 bp, Artificial Sequence
  dgRNA
  Akr7a5
ttagctgggcgcgtc

SEQ ID NO: 58505 - DNA, 15 bp, Artificial Sequence
  dgRNA
  Akr7a5
gccggtgtcagcttc

SEQ ID NO: 58506 - DNA, 15 bp, Artificial Sequence
  dgRNA
  Akr7a5
aggatccgagcccgc

SEQ ID NO: 58507 - DNA, 15 bp, Artificial Sequence
  dgRNA
  Akr7a5
ggatccgagcccgcc

SEQ ID NO: 58508 - DNA, 15 bp, Artificial Sequence
  dgRNA
  Gucy2g
ctctcatataagttc

SEQ ID NO: 58509 - DNA, 15 bp, Artificial Sequence
  dgRNA
  Gucy2g
agttctgggcacgaa

SEQ ID NO: 58510 - DNA, 15 bp, Artificial Sequence
  dgRNA
  Gucy2g
gcacgaatggtcaag

SEQ ID NO: 58511 - DNA, 15 bp, Artificial Sequence
  dgRNA
  Gucy2g
agtgtcactaattaa

SEQ ID NO: 58512 - DNA, 15 bp, Artificial Sequence
  dgRNA
  Kctd2
acggaagagagttgc

SEQ ID NO: 58513 - DNA, 15 bp, Artificial Sequence
  dgRNA
  Kctd2
cggaagttctctcct

SEQ ID NO: 58514 - DNA, 15 bp, Artificial Sequence
  dgRNA
  Kctd2
atccgaacgagcaat

SEQ ID NO: 58515 - DNA, 15 bp, Artificial Sequence
  dgRNA
  Kctd2
cgaacgagcaatagg

SEQ ID NO: 58516 - DNA, 15 bp, Artificial Sequence
  dgRNA
  Nop58
tctcgcgatatttta

SEQ ID NO: 58517 - DNA, 15 bp, Artificial Sequence
  dgRNA
  Nop58
aaggccgtctctttc

SEQ ID NO: 58518 - DNA, 15 bp, Artificial Sequence
  dgRNA
  Nop58
ttccggattctactg

SEQ ID NO: 58519 - DNA, 15 bp, Artificial Sequence
  dgRNA
  Nop58
tccggattctactgt

SEQ ID NO: 58520 - DNA, 15 bp, Artificial Sequence
  dgRNA
  Fam3b
tagccccaggtgaac

SEQ ID NO: 58521 - DNA, 15 bp, Artificial Sequence
  dgRNA
  Fam3b
gatcctcccatttgc

SEQ ID NO: 58522 - DNA, 15 bp, Artificial Sequence
  dgRNA
  Fam3b
gctacagacggccaa

SEQ ID NO: 58523 - DNA, 15 bp, Artificial Sequence
  dgRNA
  Fam3b
cagctggtagcaccc

SEQ ID NO: 58524 - DNA, 15 bp, Artificial Sequence
  dgRNA
  St8sia5
agacgcgctgttccc

SEQ ID NO: 58525 - DNA, 15 bp, Artificial Sequence
  dgRNA
  St8sia5
tcagctccatgcgcc

SEQ ID NO: 58526 - DNA, 15 bp, Artificial Sequence
  dgRNA
  St8sia5
cgagccagcccagag

SEQ ID NO: 58527 - DNA, 15 bp, Artificial Sequence
  dgRNA
  St8sia5
gagtgggcggcgcgt

SEQ ID NO: 58528 - DNA, 15 bp, Artificial Sequence
  dgRNA
  Agfg2
ggggcgtggttctga

SEQ ID NO: 58529 - DNA, 15 bp, Artificial Sequence
  dgRNA
  Agfg2
ccaattaaagcaagg

SEQ ID NO: 58530 - DNA, 15 bp, Artificial Sequence
  dgRNA
  Agfg2
atcagcgtgccgaac

SEQ ID NO: 58531 - DNA, 15 bp, Artificial Sequence
  dgRNA
  Agfg2
gtgccgaacaggacg

SEQ ID NO: 58532 - DNA, 15 bp, Artificial Sequence
  dgRNA
  Clca1
tattgtaggcaaatg

SEQ ID NO: 58533 - DNA, 15 bp, Artificial Sequence
  dgRNA
  Clca1
ccatttagggtcaag

SEQ ID NO: 58534 - DNA, 15 bp, Artificial Sequence
  dgRNA
  Clca1
tgcctacaatataag

SEQ ID NO: 58535 - DNA, 15 bp, Artificial Sequence
  dgRNA
  Clca1
cctcttgaccctaaa

SEQ ID NO: 58536 - DNA, 15 bp, Artificial Sequence
  dgRNA
  Cd163
gtggatgaccacgga

SEQ ID NO: 58537 - DNA, 15 bp, Artificial Sequence
  dgRNA
  Cd163
agtggatgaccacgg

SEQ ID NO: 58538 - DNA, 15 bp, Artificial Sequence
  dgRNA
  Ffar2
atgctcgcttgcaga

SEQ ID NO: 58539 - DNA, 15 bp, Artificial Sequence
  dgRNA
  Ffar2
tctgcaagcgagcat

SEQ ID NO: 58540 - DNA, 15 bp, Artificial Sequence
  dgRNA
  Ffar2
ttctgcaagcgagca

SEQ ID NO: 58541 - DNA, 15 bp, Artificial Sequence
  dgRNA
  Dbr1
gattgctagcacgca

SEQ ID NO: 58542 - DNA, 15 bp, Artificial Sequence
  dgRNA
  Dbr1
attgctagcacgcaa

SEQ ID NO: 58543 - DNA, 15 bp, Artificial Sequence
  dgRNA
  Dbr1
atcacgaagacagac

SEQ ID NO: 58544 - DNA, 15 bp, Artificial Sequence
  dgRNA
  Dbr1
aaagtttcccccctc

SEQ ID NO: 58545 - DNA, 15 bp, Artificial Sequence
  dgRNA
  G6pc3
ggttcccaggttcat

SEQ ID NO: 58546 - DNA, 15 bp, Artificial Sequence
  dgRNA
  G6pc3
atcggtcccctgacc

SEQ ID NO: 58547 - DNA, 15 bp, Artificial Sequence
  dgRNA
  G6pc3
gacccggaacagcag

SEQ ID NO: 58548 - DNA, 15 bp, Artificial Sequence
  dgRNA
  G6pc3
acccggaacagcagc

SEQ ID NO: 58549 - DNA, 15 bp, Artificial Sequence
  dgRNA
  Maats1
gcgacctgaggagct

SEQ ID NO: 58550 - DNA, 15 bp, Artificial Sequence
  dgRNA
  Maats1
ggcgacctgaggagc

SEQ ID NO: 58551 - DNA, 15 bp, Artificial Sequence
  dgRNA
  Maats1
acgtggggcgacctg

SEQ ID NO: 58552 - DNA, 15 bp, Artificial Sequence
  dgRNA
  Maats1
tagattttgggatac

SEQ ID NO: 58553 - DNA, 15 bp, Artificial Sequence
  dgRNA
  Bcl2l1
gacaccgacatcgaa

SEQ ID NO: 58554 - DNA, 15 bp, Artificial Sequence
  dgRNA
  Bcl2l1
ctcaaatcgctcgcc

SEQ ID NO: 58555 - DNA, 15 bp, Artificial Sequence
  dgRNA
  Bcl2l1
tcaaatcgctcgcca

SEQ ID NO: 58556 - DNA, 15 bp, Artificial Sequence
  dgRNA
  Bcl2l1
caaatcgctcgccag

SEQ ID NO: 58557 - DNA, 15 bp, Artificial Sequence
  dgRNA
  Nr1h5
gttttaacccaagag

SEQ ID NO: 58558 - DNA, 15 bp, Artificial Sequence
  dgRNA
  Nr1h5
aaacagggcaattac

SEQ ID NO: 58559 - DNA, 15 bp, Artificial Sequence
  dgRNA
  Nr1h5
ctcttgggttaaaac

SEQ ID NO: 58560 - DNA, 15 bp, Artificial Sequence
  dgRNA
  Nr1h5
acgttgcatccactt

SEQ ID NO: 58561 - DNA, 15 bp, Artificial Sequence
  dgRNA
  Olfr982
cagctttattgcgca

SEQ ID NO: 58562 - DNA, 15 bp, Artificial Sequence
  dgRNA
  Olfr982
gctaaaaagattaac

SEQ ID NO: 58563 - DNA, 15 bp, Artificial Sequence
  dgRNA
  Osgep
ggcccttcagcgagc

SEQ ID NO: 58564 - DNA, 15 bp, Artificial Sequence
  dgRNA
  Osgep
gcccttcagcgagca

SEQ ID NO: 58565 - DNA, 15 bp, Artificial Sequence
  dgRNA
  Osgep
aaacgcgctagaaca

SEQ ID NO: 58566 - DNA, 15 bp, Artificial Sequence
  dgRNA
  Osgep
tcacggcacaaagaa

SEQ ID NO: 58567 - DNA, 15 bp, Artificial Sequence
  dgRNA
  Pip5kl1
catcgccaggaggct

SEQ ID NO: 58568 - DNA, 15 bp, Artificial Sequence
  dgRNA
  Pip5kl1
ggtccgaccacgatc

SEQ ID NO: 58569 - DNA, 15 bp, Artificial Sequence
  dgRNA
  Pip5kl1
acgatcaggatgcag

SEQ ID NO: 58570 - DNA, 15 bp, Artificial Sequence
  dgRNA
  Pip5kl1
aggatcctacatcct

SEQ ID NO: 58571 - DNA, 15 bp, Artificial Sequence
  dgRNA
  Bola3
gggttctggctgcgg

SEQ ID NO: 58572 - DNA, 15 bp, Artificial Sequence
  dgRNA
  Bola3
cggaggagtgcgacc

SEQ ID NO: 58573 - DNA, 15 bp, Artificial Sequence
  dgRNA
  Bola3
ggaggagtgcgacct

SEQ ID NO: 58574 - DNA, 15 bp, Artificial Sequence
  dgRNA
  Bola3
gaggagtgcgacctg

SEQ ID NO: 58575 - DNA, 15 bp, Artificial Sequence
  dgRNA
  Pla2g5
ccaatgcaggcccca

SEQ ID NO: 58576 - DNA, 15 bp, Artificial Sequence
  dgRNA
  Pla2g5
aatgcaggccccacg

SEQ ID NO: 58577 - DNA, 15 bp, Artificial Sequence
  dgRNA
  Pla2g5
ccacgggggttagtc

SEQ ID NO: 58578 - DNA, 15 bp, Artificial Sequence
  dgRNA
  Pla2g5
cacgggggttagtca

SEQ ID NO: 58579 - DNA, 15 bp, Artificial Sequence
  dgRNA
  Tnxb
gagtttgttgccagt

SEQ ID NO: 58580 - DNA, 15 bp, Artificial Sequence
  dgRNA
  Flnb
gctgggcagtacatc

SEQ ID NO: 58581 - DNA, 15 bp, Artificial Sequence
  dgRNA
  Flnb
ggcagtacatcaggt

SEQ ID NO: 58582 - DNA, 15 bp, Artificial Sequence
  dgRNA
  Flnb
gcagtacatcaggtt

SEQ ID NO: 58583 - DNA, 15 bp, Artificial Sequence
  dgRNA
  Flnb
cagtacatcaggttg

SEQ ID NO: 58584 - DNA, 15 bp, Artificial Sequence
  dgRNA
  3110002H16Rik
taatcggacagagga

SEQ ID NO: 58585 - DNA, 15 bp, Artificial Sequence
  dgRNA
  3110002H16Rik
aatcggacagaggaa

SEQ ID NO: 58586 - DNA, 15 bp, Artificial Sequence
  dgRNA
  3110002H16Rik
caaatatgtcaccat

SEQ ID NO: 58587 - DNA, 15 bp, Artificial Sequence
  dgRNA
  3110002H16Rik
aaggggcgtgtcttc

SEQ ID NO: 58588 - DNA, 15 bp, Artificial Sequence
  dgRNA
  Ccl12
gaggaaatcacccct

SEQ ID NO: 58589 - DNA, 15 bp, Artificial Sequence
  dgRNA
  Ccl12
aaaggtattcagctg

SEQ ID NO: 58590 - DNA, 15 bp, Artificial Sequence
  dgRNA
  Ccl12
cagcgaaacagatgg

SEQ ID NO: 58591 - DNA, 15 bp, Artificial Sequence
  dgRNA
  Ccl12
acagcgaaacagatg

SEQ ID NO: 58592 - DNA, 15 bp, Artificial Sequence
  dgRNA
  Uqcc1
cttctgtcgagcgtc

SEQ ID NO: 58593 - DNA, 15 bp, Artificial Sequence
  dgRNA
  Uqcc1
gaccacctccttttc

SEQ ID NO: 58594 - DNA, 15 bp, Artificial Sequence
  dgRNA
  Uqcc1
gctgttaggggttaa

SEQ ID NO: 58595 - DNA, 15 bp, Artificial Sequence
  dgRNA
  Uqcc1
ttaggggttaacgga

SEQ ID NO: 58596 - DNA, 15 bp, Artificial Sequence
  dgRNA
  Ntm
atgattgcagcttgt

SEQ ID NO: 58597 - DNA, 15 bp, Artificial Sequence
  dgRNA
  Ntm
attgcagcttgtagg

SEQ ID NO: 58598 - DNA, 15 bp, Artificial Sequence
  dgRNA
  Ntm
ttgcagcttgtagga

SEQ ID NO: 58599 - DNA, 15 bp, Artificial Sequence
  dgRNA
  Ntm
gtaggagggctgtcc

SEQ ID NO: 58600 - DNA, 15 bp, Artificial Sequence
  dgRNA
  Arhgap31
acacttaagtgtcga

SEQ ID NO: 58601 - DNA, 15 bp, Artificial Sequence
  dgRNA
  Arhgap31
cttaagtgtcgacgg

SEQ ID NO: 58602 - DNA, 15 bp, Artificial Sequence
  dgRNA
  Arhgap31
gtcgacggaggagaa

SEQ ID NO: 58603 - DNA, 15 bp, Artificial Sequence
  dgRNA
  Arhgap31
agcctgactggcggc

SEQ ID NO: 58604 - DNA, 15 bp, Artificial Sequence
  dgRNA
  Sh3rf1
ggggcgtgaaggcgc

SEQ ID NO: 58605 - DNA, 15 bp, Artificial Sequence
  dgRNA
  Sh3rf1
gaagctgccgcccgc

SEQ ID NO: 58606 - DNA, 15 bp, Artificial Sequence
  dgRNA
  Sh3rf1
aagctgccgcccgct

SEQ ID NO: 58607 - DNA, 15 bp, Artificial Sequence
  dgRNA
  Sh3rf1
agctgccgcccgctg

SEQ ID NO: 58608 - DNA, 15 bp, Artificial Sequence
  dgRNA
  Cryge
tgccctgtccccccg

SEQ ID NO: 58609 - DNA, 15 bp, Artificial Sequence
  dgRNA
  Cryge
gccctgtccccccgc

SEQ ID NO: 58610 - DNA, 15 bp, Artificial Sequence
  dgRNA
  Cryge
ctgacccggctaaga

SEQ ID NO: 58611 - DNA, 15 bp, Artificial Sequence
  dgRNA
  Cryge
actgacccggctaag

SEQ ID NO: 58612 - DNA, 15 bp, Artificial Sequence
  dgRNA
  Pcsk1
acagtatttatgaac

SEQ ID NO: 58613 - DNA, 15 bp, Artificial Sequence
  dgRNA
  Pcsk1
cttctccaccccgcc

SEQ ID NO: 58614 - DNA, 15 bp, Artificial Sequence
  dgRNA
  Pcsk1
tctgacgtcaagaga

SEQ ID NO: 58615 - DNA, 15 bp, Artificial Sequence
  dgRNA
  Pcsk1
gtgactaaaataggc

SEQ ID NO: 58616 - DNA, 15 bp, Artificial Sequence
  dgRNA
  Slc35f5
ttcgctacccagggg

SEQ ID NO: 58617 - DNA, 15 bp, Artificial Sequence
  dgRNA
  Slc35f5
ggggcggagcttgac

SEQ ID NO: 58618 - DNA, 15 bp, Artificial Sequence
  dgRNA
  Slc35f5
gggcggagcttgact

SEQ ID NO: 58619 - DNA, 15 bp, Artificial Sequence
  dgRNA
  Slc35f5
tagctaattgctcaa

SEQ ID NO: 58620 - DNA, 15 bp, Artificial Sequence
  dgRNA
  Car14
ctgaccgagagttcc

SEQ ID NO: 58621 - DNA, 15 bp, Artificial Sequence
  dgRNA
  Car14
tgaccgagagttcca

SEQ ID NO: 58622 - DNA, 15 bp, Artificial Sequence
  dgRNA
  Car14
gaccgagagttccag

SEQ ID NO: 58623 - DNA, 15 bp, Artificial Sequence
  dgRNA
  Car14
ggacacccgtacgag

SEQ ID NO: 58624 - DNA, 15 bp, Artificial Sequence
  dgRNA
  Nap1l4
actacatatagctcg

SEQ ID NO: 58625 - DNA, 15 bp, Artificial Sequence
  dgRNA
  Nap1l4
ctacatatagctcgc

SEQ ID NO: 58626 - DNA, 15 bp, Artificial Sequence
  dgRNA
  Nap1l4
atagctcgcgggctt

SEQ ID NO: 58627 - DNA, 15 bp, Artificial Sequence
  dgRNA
  Nap1l4
ctcgcgggcttaggc

SEQ ID NO: 58628 - DNA, 15 bp, Artificial Sequence
  dgRNA
  Pamr1
agaaggagcgggctc

SEQ ID NO: 58629 - DNA, 15 bp, Artificial Sequence
  dgRNA
  Pamr1
tagatcgctgtgcac

SEQ ID NO: 58630 - DNA, 15 bp, Artificial Sequence
  dgRNA
  Pamr1
actggcctccaggcg

SEQ ID NO: 58631 - DNA, 15 bp, Artificial Sequence
  dgRNA
  Pamr1
gtggtcacgactccc

SEQ ID NO: 58632 - DNA, 15 bp, Artificial Sequence
  dgRNA
  Cpm
cctcaataccctgca

SEQ ID NO: 58633 - DNA, 15 bp, Artificial Sequence
  dgRNA
  Cpm
cagggcacgttgtcc

SEQ ID NO: 58634 - DNA, 15 bp, Artificial Sequence
  dgRNA
  Cpm
agggcacgttgtcct

SEQ ID NO: 58635 - DNA, 15 bp, Artificial Sequence
  dgRNA
  Cpm
ggagatcccgcccca

SEQ ID NO: 58636 - DNA, 15 bp, Artificial Sequence
  dgRNA
  Nudt17
ggggcgccaggcaag

SEQ ID NO: 58637 - DNA, 15 bp, Artificial Sequence
  dgRNA
  Nudt17
gcgccaggcaagcgg

SEQ ID NO: 58638 - DNA, 15 bp, Artificial Sequence
  dgRNA
  Nudt17
ttgcctggcgccccc

SEQ ID NO: 58639 - DNA, 15 bp, Artificial Sequence
  dgRNA
  Nudt17
tggccaccgcttgcc

SEQ ID NO: 58640 - DNA, 15 bp, Artificial Sequence
  dgRNA
  Vps25
agcccggacatgctg

SEQ ID NO: 58641 - DNA, 15 bp, Artificial Sequence
  dgRNA
  Vps25
ccggacatgctgagg

SEQ ID NO: 58642 - DNA, 15 bp, Artificial Sequence
  dgRNA
  Vps25
cgcctcagcatgtcc

SEQ ID NO: 58643 - DNA, 15 bp, Artificial Sequence
  dgRNA
  Vps25
ccgcctcagcatgtc

SEQ ID NO: 58644 - DNA, 15 bp, Artificial Sequence
  dgRNA
  Psg17
gacacgtaggaaagt

SEQ ID NO: 58645 - DNA, 15 bp, Artificial Sequence
  dgRNA
  Psg17
acgtaggaaagttgg

SEQ ID NO: 58646 - DNA, 15 bp, Artificial Sequence
  dgRNA
  Psg17
gaacaactcatctaa

SEQ ID NO: 58647 - DNA, 15 bp, Artificial Sequence
  dgRNA
  Nr2e3
gatggaccgaccccc

SEQ ID NO: 58648 - DNA, 15 bp, Artificial Sequence
  dgRNA
  Nr2e3
acccccaggcatgtt

SEQ ID NO: 58649 - DNA, 15 bp, Artificial Sequence
  dgRNA
  Nr2e3
catgttaggcagcct

SEQ ID NO: 58650 - DNA, 15 bp, Artificial Sequence
  dgRNA
  Nr2e3
gtaatgctgcaggtg

SEQ ID NO: 58651 - DNA, 15 bp, Artificial Sequence
  dgRNA
  Nup88
aacagctcaggattg

SEQ ID NO: 58652 - DNA, 15 bp, Artificial Sequence
  dgRNA
  Msh6
ccgccaacccgagct

SEQ ID NO: 58653 - DNA, 15 bp, Artificial Sequence
  dgRNA
  Msh6
cgccaacccgagctt

SEQ ID NO: 58654 - DNA, 15 bp, Artificial Sequence
  dgRNA
  Msh6
gccaacccgagcttg

SEQ ID NO: 58655 - DNA, 15 bp, Artificial Sequence
  dgRNA
  Msh6
ccaacccgagcttgg

SEQ ID NO: 58656 - DNA, 15 bp, Artificial Sequence
  dgRNA
  Ces1d
tgttggatgggtttc

SEQ ID NO: 58657 - DNA, 15 bp, Artificial Sequence
  dgRNA
  Ces1d
tgggtaaactcctag

SEQ ID NO: 58658 - DNA, 15 bp, Artificial Sequence
  dgRNA
  Ces1d
gggtaaactcctagt

SEQ ID NO: 58659 - DNA, 15 bp, Artificial Sequence
  dgRNA
  Ces1d
aactcctagtgggcg

SEQ ID NO: 58660 - DNA, 15 bp, Artificial Sequence
  dgRNA
  Ece2
tccttagtcccgccc

SEQ ID NO: 58661 - DNA, 15 bp, Artificial Sequence
  dgRNA
  Ece2
gccagggcgggacta

SEQ ID NO: 58662 - DNA, 15 bp, Artificial Sequence
  dgRNA
  Fcgr1
taccataatgcaagc

SEQ ID NO: 58663 - DNA, 15 bp, Artificial Sequence
  dgRNA
  Fcgr1
ggatgatcttaactc

SEQ ID NO: 58664 - DNA, 15 bp, Artificial Sequence
  dgRNA
  Wrap53
ttatgcgccctctgc

SEQ ID NO: 58665 - DNA, 15 bp, Artificial Sequence
  dgRNA
  Wrap53
aagaattacccccag

SEQ ID NO: 58666 - DNA, 15 bp, Artificial Sequence
  dgRNA
  Wrap53
attacccccagggga

SEQ ID NO: 58667 - DNA, 15 bp, Artificial Sequence
  dgRNA
  Wrap53
cccccaggggacggt

SEQ ID NO: 58668 - DNA, 15 bp, Artificial Sequence
  dgRNA
  Col27a1
cccctcaggatggat

SEQ ID NO: 58669 - DNA, 15 bp, Artificial Sequence
  dgRNA
  Col27a1
gtggacggtcgcgcg

SEQ ID NO: 58670 - DNA, 15 bp, Artificial Sequence
  dgRNA
  Col27a1
atcccttgctgcgtc

SEQ ID NO: 58671 - DNA, 15 bp, Artificial Sequence
  dgRNA
  Col27a1
cttgctgcgtccggc

SEQ ID NO: 58672 - DNA, 15 bp, Artificial Sequence
  dgRNA
  Magi2
ctcttaattgctaaa

SEQ ID NO: 58673 - DNA, 15 bp, Artificial Sequence
  dgRNA
  Magi2
cttaattgctaaaag

SEQ ID NO: 58674 - DNA, 15 bp, Artificial Sequence
  dgRNA
  Magi2
gagattgagcctttt

SEQ ID NO: 58675 - DNA, 15 bp, Artificial Sequence
  dgRNA
  Magi2
cattacaaagccgag

SEQ ID NO: 58676 - DNA, 15 bp, Artificial Sequence
  dgRNA
  Tcaf3
gtcatagtgagcatc

SEQ ID NO: 58677 - DNA, 15 bp, Artificial Sequence
  dgRNA
  Tcaf3
tcatagtgagcatct

SEQ ID NO: 58678 - DNA, 15 bp, Artificial Sequence
  dgRNA
  Tcaf3
gtattctaacttctc

SEQ ID NO: 58679 - DNA, 15 bp, Artificial Sequence
  dgRNA
  Tcaf3
ctcaggcttgagtac

SEQ ID NO: 58680 - DNA, 15 bp, Artificial Sequence
  dgRNA
  4930590J08Rik
ctgtagaatgcccaa

SEQ ID NO: 58681 - DNA, 15 bp, Artificial Sequence
  dgRNA
  4930590J08Rik
catttgccagaggcg

SEQ ID NO: 58682 - DNA, 15 bp, Artificial Sequence
  dgRNA
  4930590J08Rik
cgtggctaattcccc

SEQ ID NO: 58683 - DNA, 15 bp, Artificial Sequence
  dgRNA
  4930590J08Rik
gtggctaattcccct

SEQ ID NO: 58684 - DNA, 15 bp, Artificial Sequence
  dgRNA
  Mxd1
cagccaatggggcgt

SEQ ID NO: 58685 - DNA, 15 bp, Artificial Sequence
  dgRNA
  Mxd1
agccaatggggcgtg

SEQ ID NO: 58686 - DNA, 15 bp, Artificial Sequence
  dgRNA
  Mxd1
gggccttgtcaagcc

SEQ ID NO: 58687 - DNA, 15 bp, Artificial Sequence
  dgRNA
  Mxd1
tcaagcccggccaac

SEQ ID NO: 58688 - DNA, 15 bp, Artificial Sequence
  dgRNA
  Krt16
aatagggtgttagac

SEQ ID NO: 58689 - DNA, 15 bp, Artificial Sequence
  dgRNA
  Krt16
ggtcccgccttcccc

SEQ ID NO: 58690 - DNA, 15 bp, Artificial Sequence
  dgRNA
  Krt16
gggttgttcagccca

SEQ ID NO: 58691 - DNA, 15 bp, Artificial Sequence
  dgRNA
  Krt16
tgggttgttcagccc

SEQ ID NO: 58692 - DNA, 15 bp, Artificial Sequence
  dgRNA
  Uqcr11
cagattagtactacg

SEQ ID NO: 58693 - DNA, 15 bp, Artificial Sequence
  dgRNA
  Uqcr11
cttcggcgccacccc

SEQ ID NO: 58694 - DNA, 15 bp, Artificial Sequence
  dgRNA
  Uqcr11
cgccacccccggaaa

SEQ ID NO: 58695 - DNA, 15 bp, Artificial Sequence
  dgRNA
  Uqcr11
cacccccggaaaagg

SEQ ID NO: 58696 - DNA, 15 bp, Artificial Sequence
  dgRNA
  Hao1
cgtgctttccaccac

SEQ ID NO: 58697 - DNA, 15 bp, Artificial Sequence
  dgRNA
  Hao1
aataacggaattgtc

SEQ ID NO: 58698 - DNA, 15 bp, Artificial Sequence
  dgRNA
  Hao1
ataacggaattgtct

SEQ ID NO: 58699 - DNA, 15 bp, Artificial Sequence
  dgRNA
  Hao1
taacggaattgtctg

SEQ ID NO: 58700 - DNA, 15 bp, Artificial Sequence
  dgRNA
  Prkcdbp
cttactcgcagatcc

SEQ ID NO: 58701 - DNA, 15 bp, Artificial Sequence
  dgRNA
  Prkcdbp
ttactcgcagatccc

SEQ ID NO: 58702 - DNA, 15 bp, Artificial Sequence
  dgRNA
  Prkcdbp
tactcgcagatcccg

SEQ ID NO: 58703 - DNA, 15 bp, Artificial Sequence
  dgRNA
  Prkcdbp
tcgcagatcccgggg

SEQ ID NO: 58704 - DNA, 15 bp, Artificial Sequence
  dgRNA
  Ikbkg
gttgtctcgctctgc

SEQ ID NO: 58705 - DNA, 15 bp, Artificial Sequence
  dgRNA
  Ikbkg
ctcgctctgccggct

SEQ ID NO: 58706 - DNA, 15 bp, Artificial Sequence
  dgRNA
  Ikbkg
gtagaaaagcttatc

SEQ ID NO: 58707 - DNA, 15 bp, Artificial Sequence
  dgRNA
  Ikbkg
tatcaggcacgacaa

SEQ ID NO: 58708 - DNA, 15 bp, Artificial Sequence
  dgRNA
  Wif1
ccacacgtgtctctt

SEQ ID NO: 58709 - DNA, 15 bp, Artificial Sequence
  dgRNA
  Wif1
acgtgtctcttcggg

SEQ ID NO: 58710 - DNA, 15 bp, Artificial Sequence
  dgRNA
  Wif1
gtctcttcgggcggc

SEQ ID NO: 58711 - DNA, 15 bp, Artificial Sequence
  dgRNA
  Wif1
tcttcgggcggcagg

SEQ ID NO: 58712 - DNA, 15 bp, Artificial Sequence
  dgRNA
  Nt5c
ttcagcatgcgaagc

SEQ ID NO: 58713 - DNA, 15 bp, Artificial Sequence
  dgRNA
  Nt5c
tatttcggatcttag

SEQ ID NO: 58714 - DNA, 15 bp, Artificial Sequence
  dgRNA
  Nt5c
ggatcttagaggtta

SEQ ID NO: 58715 - DNA, 15 bp, Artificial Sequence
  dgRNA
  Nt5c
gatcttagaggttat

SEQ ID NO: 58716 - DNA, 15 bp, Artificial Sequence
  dgRNA
  4930544D05Rik
tcatgacaatgagcg

SEQ ID NO: 58717 - DNA, 15 bp, Artificial Sequence
  dgRNA
  4930544D05Rik
ctcaacgtatctttg

SEQ ID NO: 58718 - DNA, 15 bp, Artificial Sequence
  dgRNA
  4930544D05Rik
ttatattcgtcatgg

SEQ ID NO: 58719 - DNA, 15 bp, Artificial Sequence
  dgRNA
  4930544D05Rik
atcttatattcgtca

SEQ ID NO: 58720 - DNA, 15 bp, Artificial Sequence
  dgRNA
  Fam71e1
gccatacagcccgct

SEQ ID NO: 58721 - DNA, 15 bp, Artificial Sequence
  dgRNA
  Fam71e1
cccgctaggaaacac

SEQ ID NO: 58722 - DNA, 15 bp, Artificial Sequence
  dgRNA
  Fam71e1
ccgctaggaaacaca

SEQ ID NO: 58723 - DNA, 15 bp, Artificial Sequence
  dgRNA
  Fam71e1
cctgctcccgcagtc

SEQ ID NO: 58724 - DNA, 15 bp, Artificial Sequence
  dgRNA
  Btg1
tctcatcccggcctc

SEQ ID NO: 58725 - DNA, 15 bp, Artificial Sequence
  dgRNA
  Btg1
ctcatcccggcctct

SEQ ID NO: 58726 - DNA, 15 bp, Artificial Sequence
  dgRNA
  Btg1
tctgggcacgccccc

SEQ ID NO: 58727 - DNA, 15 bp, Artificial Sequence
  dgRNA
  Btg1
gggcacgccccctgg

SEQ ID NO: 58728 - DNA, 15 bp, Artificial Sequence
  dgRNA
  Qrfpr
ctcaccagccttagg

SEQ ID NO: 58729 - DNA, 15 bp, Artificial Sequence
  dgRNA
  Qrfpr
actgtacgcccagag

SEQ ID NO: 58730 - DNA, 15 bp, Artificial Sequence
  dgRNA
  Qrfpr
caggcaagttaaatc

SEQ ID NO: 58731 - DNA, 15 bp, Artificial Sequence
  dgRNA
  Qrfpr
cgcctaaggctggtg

SEQ ID NO: 58732 - DNA, 15 bp, Artificial Sequence
  dgRNA
  Zbtb12
gggggagcgtgaaat

SEQ ID NO: 58733 - DNA, 15 bp, Artificial Sequence
  dgRNA
  Zbtb12
ggggagcgtgaaata

SEQ ID NO: 58734 - DNA, 15 bp, Artificial Sequence
  dgRNA
  Zbtb12
gggagcgtgaaatag

SEQ ID NO: 58735 - DNA, 15 bp, Artificial Sequence
  dgRNA
  Zbtb12
ggagcgtgaaatagg

SEQ ID NO: 58736 - DNA, 15 bp, Artificial Sequence
  dgRNA
  Csdc2
tcacaaggtggtgtc

SEQ ID NO: 58737 - DNA, 15 bp, Artificial Sequence
  dgRNA
  Csdc2
ttgctctaccaggtc

SEQ ID NO: 58738 - DNA, 15 bp, Artificial Sequence
  dgRNA
  Csdc2
ataatttgctctacc

SEQ ID NO: 58739 - DNA, 15 bp, Artificial Sequence
  dgRNA
  Csdc2
accaccttgtgagcc

SEQ ID NO: 58740 - DNA, 15 bp, Artificial Sequence
  dgRNA
  D8Ertd82e
cggtgcggagttcct

SEQ ID NO: 58741 - DNA, 15 bp, Artificial Sequence
  dgRNA
  D8Ertd82e
ggtgcggagttccta

SEQ ID NO: 58742 - DNA, 15 bp, Artificial Sequence
  dgRNA
  D8Ertd82e
gagttcctagggacc

SEQ ID NO: 58743 - DNA, 15 bp, Artificial Sequence
  dgRNA
  D8Ertd82e
agttcctagggacct

SEQ ID NO: 58744 - DNA, 15 bp, Artificial Sequence
  dgRNA
  Gm9
cacaaaccttaggca

SEQ ID NO: 58745 - DNA, 15 bp, Artificial Sequence
  dgRNA
  Gm9
ccaatcatcagcccg

SEQ ID NO: 58746 - DNA, 15 bp, Artificial Sequence
  dgRNA
  Gm9
tgcagattggactaa

SEQ ID NO: 58747 - DNA, 15 bp, Artificial Sequence
  dgRNA
  Gm9
ctgcagattggacta

SEQ ID NO: 58748 - DNA, 15 bp, Artificial Sequence
  dgRNA
  Krt36
gacattgtaatgaga

SEQ ID NO: 58749 - DNA, 15 bp, Artificial Sequence
  dgRNA
  Krt36
acattgtaatgagat

SEQ ID NO: 58750 - DNA, 15 bp, Artificial Sequence
  dgRNA
  Krt36
tttctgggaccggac

SEQ ID NO: 58751 - DNA, 15 bp, Artificial Sequence
  dgRNA
  Krt36
ttctgggaccggaca

SEQ ID NO: 58752 - DNA, 15 bp, Artificial Sequence
  dgRNA
  Skap2
ttcgctcccttcctt

SEQ ID NO: 58753 - DNA, 15 bp, Artificial Sequence
  dgRNA
  Skap2
gctcccttccttcgg

SEQ ID NO: 58754 - DNA, 15 bp, Artificial Sequence
  dgRNA
  Skap2
gctcgcttccgcgta

SEQ ID NO: 58755 - DNA, 15 bp, Artificial Sequence
  dgRNA
  Skap2
ctcgcttccgcgtat

SEQ ID NO: 58756 - DNA, 15 bp, Artificial Sequence
  dgRNA
  Osgin2
ccgagccccgagcct

SEQ ID NO: 58757 - DNA, 15 bp, Artificial Sequence
  dgRNA
  Osgin2
agcctaggcctcgtg

SEQ ID NO: 58758 - DNA, 15 bp, Artificial Sequence
  dgRNA
  Osgin2
ggcctcgtgaggacc

SEQ ID NO: 58759 - DNA, 15 bp, Artificial Sequence
  dgRNA
  Osgin2
cggaccgcagcgccg

SEQ ID NO: 58760 - DNA, 15 bp, Artificial Sequence
  dgRNA
  Tubal3
agactaaggtgtagt

SEQ ID NO: 58761 - DNA, 15 bp, Artificial Sequence
  dgRNA
  Tubal3
taggcccagtatggc

SEQ ID NO: 58762 - DNA, 15 bp, Artificial Sequence
  dgRNA
  Tubal3
ccgggccctgtgata

SEQ ID NO: 58763 - DNA, 15 bp, Artificial Sequence
  dgRNA
  Tubal3
tactgggcctaaaca

SEQ ID NO: 58764 - DNA, 15 bp, Artificial Sequence
  dgRNA
  Dyrk1b
gggcgggtggccacg

SEQ ID NO: 58765 - DNA, 15 bp, Artificial Sequence
  dgRNA
  Dyrk1b
ggcgggtggccacgc

SEQ ID NO: 58766 - DNA, 15 bp, Artificial Sequence
  dgRNA
  Dyrk1b
gcgggtggccacgcg

SEQ ID NO: 58767 - DNA, 15 bp, Artificial Sequence
  dgRNA
  Dyrk1b
ggtggccacgcgggg

SEQ ID NO: 58768 - DNA, 15 bp, Artificial Sequence
  dgRNA
  Krit1
gctatagctagcgtc

SEQ ID NO: 58769 - DNA, 15 bp, Artificial Sequence
  dgRNA
  Krit1
agctagcgtcgggct

SEQ ID NO: 58770 - DNA, 15 bp, Artificial Sequence
  dgRNA
  Krit1
aaccccgcgagctca

SEQ ID NO: 58771 - DNA, 15 bp, Artificial Sequence
  dgRNA
  Krit1
ggccgccgcgcgaag

SEQ ID NO: 58772 - DNA, 15 bp, Artificial Sequence
  dgRNA
  Gjd2
ccatctccggcgcag

SEQ ID NO: 58773 - DNA, 15 bp, Artificial Sequence
  dgRNA
  Gjd2
catctccggcgcagc

SEQ ID NO: 58774 - DNA, 15 bp, Artificial Sequence
  dgRNA
  Gjd2
atctccggcgcagcg

SEQ ID NO: 58775 - DNA, 15 bp, Artificial Sequence
  dgRNA
  Gjd2
tctccggcgcagcgg

SEQ ID NO: 58776 - DNA, 15 bp, Artificial Sequence
  dgRNA
  Rassf7
gccactacctaactc

SEQ ID NO: 58777 - DNA, 15 bp, Artificial Sequence
  dgRNA
  Rassf7
ccactacctaactca

SEQ ID NO: 58778 - DNA, 15 bp, Artificial Sequence
  dgRNA
  Rassf7
acacctggttgcctc

SEQ ID NO: 58779 - DNA, 15 bp, Artificial Sequence
  dgRNA
  Rassf7
acctggttgcctccg

SEQ ID NO: 58780 - DNA, 15 bp, Artificial Sequence
  dgRNA
  Csnk1a1
aaagacaggccgcac

SEQ ID NO: 58781 - DNA, 15 bp, Artificial Sequence
  dgRNA
  Csnk1a1
aagacaggccgcacc

SEQ ID NO: 58782 - DNA, 15 bp, Artificial Sequence
  dgRNA
  Csnk1a1
gcctgcgcagtctgc

SEQ ID NO: 58783 - DNA, 15 bp, Artificial Sequence
  dgRNA
  Csnk1a1
ggcattgcagcgcgc

SEQ ID NO: 58784 - DNA, 15 bp, Artificial Sequence
  dgRNA
  Rpl3
atttgtcaatcctag

SEQ ID NO: 58785 - DNA, 15 bp, Artificial Sequence
  dgRNA
  Rpl3
gtcaatcctagtggg

SEQ ID NO: 58786 - DNA, 15 bp, Artificial Sequence
  dgRNA
  Rpl3
tcaatcctagtgggc

SEQ ID NO: 58787 - DNA, 15 bp, Artificial Sequence
  dgRNA
  Rpl3
cacgttcgcacgctc

SEQ ID NO: 58788 - DNA, 15 bp, Artificial Sequence
  dgRNA
  Il2rg
acctagggtcctgaa

SEQ ID NO: 58789 - DNA, 15 bp, Artificial Sequence
  dgRNA
  Il2rg
cctctctctacagcg

SEQ ID NO: 58790 - DNA, 15 bp, Artificial Sequence
  dgRNA
  Il2rg
acagcgtggtttcta

SEQ ID NO: 58791 - DNA, 15 bp, Artificial Sequence
  dgRNA
  Il2rg
caggaccctaggtcc

SEQ ID NO: 58792 - DNA, 15 bp, Artificial Sequence
  dgRNA
  Pdcd2l
aggtggtctccgtcc

SEQ ID NO: 58793 - DNA, 15 bp, Artificial Sequence
  dgRNA
  Pdcd2l
cctttggggcggagt

SEQ ID NO: 58794 - DNA, 15 bp, Artificial Sequence
  dgRNA
  Pdcd2l
ctttggggcggagtc

SEQ ID NO: 58795 - DNA, 15 bp, Artificial Sequence
  dgRNA
  Pdcd2l
tttggggcggagtcg

SEQ ID NO: 58796 - DNA, 15 bp, Artificial Sequence
  dgRNA
  Cept1
agtcccccctcttta

SEQ ID NO: 58797 - DNA, 15 bp, Artificial Sequence
  dgRNA
  Cept1
ttgccgtaaagaggg

SEQ ID NO: 58798 - DNA, 15 bp, Artificial Sequence
  dgRNA
  Cept1
attgccgtaaagagg

SEQ ID NO: 58799 - DNA, 15 bp, Artificial Sequence
  dgRNA
  Cept1
gattgccgtaaagag

SEQ ID NO: 58800 - DNA, 15 bp, Artificial Sequence
  dgRNA
  Trim72
gctaaatcagtagca

SEQ ID NO: 58801 - DNA, 15 bp, Artificial Sequence
  dgRNA
  Trim72
tggagtgggtaaccg

SEQ ID NO: 58802 - DNA, 15 bp, Artificial Sequence
  dgRNA
  Trim72
tgataaatgcctagt

SEQ ID NO: 58803 - DNA, 15 bp, Artificial Sequence
  dgRNA
  Trim72
gataaatgcctagtt

SEQ ID NO: 58804 - DNA, 15 bp, Artificial Sequence
  dgRNA
  Urgcp
ctccgggcagcgggc

SEQ ID NO: 58805 - DNA, 15 bp, Artificial Sequence
  dgRNA
  Urgcp
gcgggccggcctggc

SEQ ID NO: 58806 - DNA, 15 bp, Artificial Sequence
  dgRNA
  Urgcp
ggccggcctggccgg

SEQ ID NO: 58807 - DNA, 15 bp, Artificial Sequence
  dgRNA
  Urgcp
gccggtggctgccgt

SEQ ID NO: 58808 - DNA, 15 bp, Artificial Sequence
  dgRNA
  Hspb9
taaccccgcacattc

SEQ ID NO: 58809 - DNA, 15 bp, Artificial Sequence
  dgRNA
  Hspb9
gctgcagcgcttgca

SEQ ID NO: 58810 - DNA, 15 bp, Artificial Sequence
  dgRNA
  Hspb9
ggggttgaaaaggtc

SEQ ID NO: 58811 - DNA, 15 bp, Artificial Sequence
  dgRNA
  Hspb9
gcaacggggttgaaa

SEQ ID NO: 58812 - DNA, 15 bp, Artificial Sequence
  dgRNA
  Tm2d1
cagcgaggttttcga

SEQ ID NO: 58813 - DNA, 15 bp, Artificial Sequence
  dgRNA
  Tm2d1
tcagcgaggttttcg

SEQ ID NO: 58814 - DNA, 15 bp, Artificial Sequence
  dgRNA
  Tm2d1
acagctacatcagcg

SEQ ID NO: 58815 - DNA, 15 bp, Artificial Sequence
  dgRNA
  Tm2d1
ctccctaggataact

SEQ ID NO: 58816 - DNA, 15 bp, Artificial Sequence
  dgRNA
  Zmynd8
tagtcaccaacctcc

SEQ ID NO: 58817 - DNA, 15 bp, Artificial Sequence
  dgRNA
  Zmynd8
ctttgcgtaacttct

SEQ ID NO: 58818 - DNA, 15 bp, Artificial Sequence
  dgRNA
  Zmynd8
tttgcgtaacttctt

SEQ ID NO: 58819 - DNA, 15 bp, Artificial Sequence
  dgRNA
  Zmynd8
acttgtgtgcggcta

SEQ ID NO: 58820 - DNA, 15 bp, Artificial Sequence
  dgRNA
  Smg5
ataaagtgtcccccg

SEQ ID NO: 58821 - DNA, 15 bp, Artificial Sequence
  dgRNA
  Smg5
gctcggttgacttcc

SEQ ID NO: 58822 - DNA, 15 bp, Artificial Sequence
  dgRNA
  Smg5
atttttcgcgagact

SEQ ID NO: 58823 - DNA, 15 bp, Artificial Sequence
  dgRNA
  Smg5
tttcgcgagacttgg

SEQ ID NO: 58824 - DNA, 15 bp, Artificial Sequence
  dgRNA
  Agrp
gatgaggccaggcgt

SEQ ID NO: 58825 - DNA, 15 bp, Artificial Sequence
  dgRNA
  Agrp
caacacagggcggaa

SEQ ID NO: 58826 - DNA, 15 bp, Artificial Sequence
  dgRNA
  Agrp
gaatcttactatgta

SEQ ID NO: 58827 - DNA, 15 bp, Artificial Sequence
  dgRNA
  Agrp
tgtaacaggacccat

SEQ ID NO: 58828 - DNA, 15 bp, Artificial Sequence
  dgRNA
  Angptl4
ttgcaccctaaaact

SEQ ID NO: 58829 - DNA, 15 bp, Artificial Sequence
  dgRNA
  Angptl4
cactcgctccgcccc

SEQ ID NO: 58830 - DNA, 15 bp, Artificial Sequence
  dgRNA
  Angptl4
actcgctccgccccc

SEQ ID NO: 58831 - DNA, 15 bp, Artificial Sequence
  dgRNA
  Angptl4
tatgaagagttcttg

SEQ ID NO: 58832 - DNA, 15 bp, Artificial Sequence
  dgRNA
  Kremen2
gtggggggcaccgct

SEQ ID NO: 58833 - DNA, 15 bp, Artificial Sequence
  dgRNA
  Kremen2
ggggggcaccgcttg

SEQ ID NO: 58834 - DNA, 15 bp, Artificial Sequence
  dgRNA
  Kremen2
tggggaattccgcca

SEQ ID NO: 58835 - DNA, 15 bp, Artificial Sequence
  dgRNA
  Kremen2
aattccgccaaggca

SEQ ID NO: 58836 - DNA, 15 bp, Artificial Sequence
  dgRNA
  Ssbp2
cctagcgcccgggtt

SEQ ID NO: 58837 - DNA, 15 bp, Artificial Sequence
  dgRNA
  Ssbp2
agcgcccgggttcgg

SEQ ID NO: 58838 - DNA, 15 bp, Artificial Sequence
  dgRNA
  Ssbp2
gcgcccgggttcgga

SEQ ID NO: 58839 - DNA, 15 bp, Artificial Sequence
  dgRNA
  Ssbp2
cgcccgggttcggag

SEQ ID NO: 58840 - DNA, 15 bp, Artificial Sequence
  dgRNA
  Endod1
cctctaccaaaaacc

SEQ ID NO: 58841 - DNA, 15 bp, Artificial Sequence
  dgRNA
  Endod1
aaacccggctttaac

SEQ ID NO: 58842 - DNA, 15 bp, Artificial Sequence
  dgRNA
  Endod1
aacccggctttaaca

SEQ ID NO: 58843 - DNA, 15 bp, Artificial Sequence
  dgRNA
  Endod1
ggggtctgatgcgga

SEQ ID NO: 58844 - DNA, 15 bp, Artificial Sequence
  dgRNA
  Hilpda
cttctagaaggcggc

SEQ ID NO: 58845 - DNA, 15 bp, Artificial Sequence
  dgRNA
  Hilpda
agaaggcggccggtg

SEQ ID NO: 58846 - DNA, 15 bp, Artificial Sequence
  dgRNA
  Hilpda
cgacgctgctgacgc

SEQ ID NO: 58847 - DNA, 15 bp, Artificial Sequence
  dgRNA
  Hilpda
gacgctgctgacgca

SEQ ID NO: 58848 - DNA, 15 bp, Artificial Sequence
  dgRNA
  Ccdc127
gcgcctgccatttcg

SEQ ID NO: 58849 - DNA, 15 bp, Artificial Sequence
  dgRNA
  Ccdc127
aaactgcgccaaccc

SEQ ID NO: 58850 - DNA, 15 bp, Artificial Sequence
  dgRNA
  Ccdc127
gcgcaccgagtcgcg

SEQ ID NO: 58851 - DNA, 15 bp, Artificial Sequence
  dgRNA
  Ccdc127
cgcaccgagtcgcgc

SEQ ID NO: 58852 - DNA, 15 bp, Artificial Sequence
  dgRNA
  Wdsub1
agggaaccggcctac

SEQ ID NO: 58853 - DNA, 15 bp, Artificial Sequence
  dgRNA
  Wdsub1
ctaccggagctgccg

SEQ ID NO: 58854 - DNA, 15 bp, Artificial Sequence
  dgRNA
  Wdsub1
taccggagctgccgc

SEQ ID NO: 58855 - DNA, 15 bp, Artificial Sequence
  dgRNA
  Wdsub1
acgcatgcgcgggca

SEQ ID NO: 58856 - DNA, 15 bp, Artificial Sequence
  dgRNA
  Mixl1
cctcattccgtcccc

SEQ ID NO: 58857 - DNA, 15 bp, Artificial Sequence
  dgRNA
  Mixl1
ccgtccccgggtcag

SEQ ID NO: 58858 - DNA, 15 bp, Artificial Sequence
  dgRNA
  Mixl1
aagcgattattcccg

SEQ ID NO: 58859 - DNA, 15 bp, Artificial Sequence
  dgRNA
  Mixl1
tattcccgcggcgtc

SEQ ID NO: 58860 - DNA, 15 bp, Artificial Sequence
  dgRNA
  Sphk1
aagttcgcgggtggc

SEQ ID NO: 58861 - DNA, 15 bp, Artificial Sequence
  dgRNA
  Sphk1
cgggtgacccgaccc

SEQ ID NO: 58862 - DNA, 15 bp, Artificial Sequence
  dgRNA
  Sphk1
gtcaggacagcacta

SEQ ID NO: 58863 - DNA, 15 bp, Artificial Sequence
  dgRNA
  Sphk1
gacagcactagggtc

SEQ ID NO: 58864 - DNA, 15 bp, Artificial Sequence
  dgRNA
  Sf3a2
ctcattcgcccaccc

SEQ ID NO: 58865 - DNA, 15 bp, Artificial Sequence
  dgRNA
  Sf3a2
acccaggaaccgcgc

SEQ ID NO: 58866 - DNA, 15 bp, Artificial Sequence
  dgRNA
  Sf3a2
agccgcagccccgac

SEQ ID NO: 58867 - DNA, 15 bp, Artificial Sequence
  dgRNA
  Sf3a2
caccgctgcccttct

SEQ ID NO: 58868 - DNA, 15 bp, Artificial Sequence
  dgRNA
  Dlgap4
ttccgtccttctgtc

SEQ ID NO: 58869 - DNA, 15 bp, Artificial Sequence
  dgRNA
  Dlgap4
cgggccactggccct

SEQ ID NO: 58870 - DNA, 15 bp, Artificial Sequence
  dgRNA
  Dlgap4
gggccactggccctc

SEQ ID NO: 58871 - DNA, 15 bp, Artificial Sequence
  dgRNA
  Dlgap4
ctgctctcgcgctct

SEQ ID NO: 58872 - DNA, 15 bp, Artificial Sequence
  dgRNA
  Api5
cgttttgccaccagt

SEQ ID NO: 58873 - DNA, 15 bp, Artificial Sequence
  dgRNA
  Api5
gttttgccaccagta

SEQ ID NO: 58874 - DNA, 15 bp, Artificial Sequence
  dgRNA
  Api5
ttcaagtccttctcg

SEQ ID NO: 58875 - DNA, 15 bp, Artificial Sequence
  dgRNA
  Api5
tttcgtaccgccgag

SEQ ID NO: 58876 - DNA, 15 bp, Artificial Sequence
  dgRNA
  Hivep2
ctgcggtgactttac

SEQ ID NO: 58877 - DNA, 15 bp, Artificial Sequence
  dgRNA
  Hivep2
cgtcgcgccctcctt

SEQ ID NO: 58878 - DNA, 15 bp, Artificial Sequence
  dgRNA
  Hivep2
tcggccgctgtcacc

SEQ ID NO: 58879 - DNA, 15 bp, Artificial Sequence
  dgRNA
  Hivep2
tgtcacccggactgc

SEQ ID NO: 58880 - DNA, 15 bp, Artificial Sequence
  dgRNA
  Adam32
ctgtctaggtactcc

SEQ ID NO: 58881 - DNA, 15 bp, Artificial Sequence
  dgRNA
  Zc3h7b
aaaccctagccaaaa

SEQ ID NO: 58882 - DNA, 15 bp, Artificial Sequence
  dgRNA
  Zc3h7b
aggagatcctgaccg

SEQ ID NO: 58883 - DNA, 15 bp, Artificial Sequence
  dgRNA
  Zc3h7b
gtgtagctttacgct

SEQ ID NO: 58884 - DNA, 15 bp, Artificial Sequence
  dgRNA
  Zc3h7b
ttaaaagcgggttgg

SEQ ID NO: 58885 - DNA, 15 bp, Artificial Sequence
  dgRNA
  Exosc9
tctccactgcgatgc

SEQ ID NO: 58886 - DNA, 15 bp, Artificial Sequence
  dgRNA
  Exosc9
ctccactgcgatgcc

SEQ ID NO: 58887 - DNA, 15 bp, Artificial Sequence
  dgRNA
  Exosc9
actgcgatgccgggc

SEQ ID NO: 58888 - DNA, 15 bp, Artificial Sequence
  dgRNA
  Exosc9
cgggcaggaccaacc

SEQ ID NO: 58889 - DNA, 15 bp, Artificial Sequence
  dgRNA
  Myf6
tcgctgtaatcactt

SEQ ID NO: 58890 - DNA, 15 bp, Artificial Sequence
  dgRNA
  Myf6
cgctgtaatcacttt

SEQ ID NO: 58891 - DNA, 15 bp, Artificial Sequence
  dgRNA
  Myf6
ggcatttaattagtg

SEQ ID NO: 58892 - DNA, 15 bp, Artificial Sequence
  dgRNA
  Slc39a13
agaatccgccccgag

SEQ ID NO: 58893 - DNA, 15 bp, Artificial Sequence
  dgRNA
  Slc39a13
agtgcgctgaccgcg

SEQ ID NO: 58894 - DNA, 15 bp, Artificial Sequence
  dgRNA
  Slc39a13
gtgcgctgaccgcgc

SEQ ID NO: 58895 - DNA, 15 bp, Artificial Sequence
  dgRNA
  Slc39a13
cgcgcgggtccccca

SEQ ID NO: 58896 - DNA, 15 bp, Artificial Sequence
  dgRNA
  Arhgap22
tcagagcaatttgca

SEQ ID NO: 58897 - DNA, 15 bp, Artificial Sequence
  dgRNA
  Arhgap22
ttccgctgatgaatc

SEQ ID NO: 58898 - DNA, 15 bp, Artificial Sequence
  dgRNA
  Arhgap22
cgcagttgtcactgc

SEQ ID NO: 58899 - DNA, 15 bp, Artificial Sequence
  dgRNA
  Arhgap22
atttttcgcccccaa

SEQ ID NO: 58900 - DNA, 15 bp, Artificial Sequence
  dgRNA
  Efnb2
cagcggggctcgtcc

SEQ ID NO: 58901 - DNA, 15 bp, Artificial Sequence
  dgRNA
  Efnb2
agcggggctcgtcct

SEQ ID NO: 58902 - DNA, 15 bp, Artificial Sequence
  dgRNA
  Efnb2
gcggggctcgtcctg

SEQ ID NO: 58903 - DNA, 15 bp, Artificial Sequence
  dgRNA
  Efnb2
cggggctcgtcctgg

SEQ ID NO: 58904 - DNA, 15 bp, Artificial Sequence
  dgRNA
  Car3
gctcttgtaattcat

SEQ ID NO: 58905 - DNA, 15 bp, Artificial Sequence
  dgRNA
  Car3
accgctgacctaata

SEQ ID NO: 58906 - DNA, 15 bp, Artificial Sequence
  dgRNA
  Car3
ggtcatgcacactgc

SEQ ID NO: 58907 - DNA, 15 bp, Artificial Sequence
  dgRNA
  Car3
accttgccggacaac

SEQ ID NO: 58908 - DNA, 15 bp, Artificial Sequence
  dgRNA
  Adam19
gatcatcccttcccc

SEQ ID NO: 58909 - DNA, 15 bp, Artificial Sequence
  dgRNA
  Adam19
gtcagcgatgctccc

SEQ ID NO: 58910 - DNA, 15 bp, Artificial Sequence
  dgRNA
  Adam19
tcagcgatgctcccg

SEQ ID NO: 58911 - DNA, 15 bp, Artificial Sequence
  dgRNA
  Adam19
cagcgatgctcccgg

SEQ ID NO: 58912 - DNA, 15 bp, Artificial Sequence
  dgRNA
  Arih1
gctcccgtcctgctc

SEQ ID NO: 58913 - DNA, 15 bp, Artificial Sequence
  dgRNA
  Arih1
cgtcctgctcaggct

SEQ ID NO: 58914 - DNA, 15 bp, Artificial Sequence
  dgRNA
  Arih1
gctcaggctcggccg

SEQ ID NO: 58915 - DNA, 15 bp, Artificial Sequence
  dgRNA
  Arih1
ctcaggctcggccgt

SEQ ID NO: 58916 - DNA, 15 bp, Artificial Sequence
  dgRNA
  Rhobtb2
atcgggggcgtgtct

SEQ ID NO: 58917 - DNA, 15 bp, Artificial Sequence
  dgRNA
  Rhobtb2
tcgggggcgtgtctc

SEQ ID NO: 58918 - DNA, 15 bp, Artificial Sequence
  dgRNA
  Rhobtb2
ggcgtgtctcgggcg

SEQ ID NO: 58919 - DNA, 15 bp, Artificial Sequence
  dgRNA
  Rhobtb2
ctcgggcgtggcctc

SEQ ID NO: 58920 - DNA, 15 bp, Artificial Sequence
  dgRNA
  Capn7
tctagcaggcggaag

SEQ ID NO: 58921 - DNA, 15 bp, Artificial Sequence
  dgRNA
  Capn7
ccctcagcttcgccc

SEQ ID NO: 58922 - DNA, 15 bp, Artificial Sequence
  dgRNA
  Capn7
gagccccgcctgctt

SEQ ID NO: 58923 - DNA, 15 bp, Artificial Sequence
  dgRNA
  Capn7
ccccgcctgcttcgg

SEQ ID NO: 58924 - DNA, 15 bp, Artificial Sequence
  dgRNA
  Pola1
ccccggtcctcgccg

SEQ ID NO: 58925 - DNA, 15 bp, Artificial Sequence
  dgRNA
  Pola1
tcccgcttttcgctc

SEQ ID NO: 58926 - DNA, 15 bp, Artificial Sequence
  dgRNA
  Pola1
cccgcttttcgctca

SEQ ID NO: 58927 - DNA, 15 bp, Artificial Sequence
  dgRNA
  Pola1
ccgcttttcgctcag

SEQ ID NO: 58928 - DNA, 15 bp, Artificial Sequence
  dgRNA
  Pex26
agcagcatcgaaccc

SEQ ID NO: 58929 - DNA, 15 bp, Artificial Sequence
  dgRNA
  Pex26
aacggactccttcag

SEQ ID NO: 58930 - DNA, 15 bp, Artificial Sequence
  dgRNA
  Pex26
ccgttcgtcctcttc

SEQ ID NO: 58931 - DNA, 15 bp, Artificial Sequence
  dgRNA
  Pex26
ggagtccgttgagaa

SEQ ID NO: 58932 - DNA, 15 bp, Artificial Sequence
  dgRNA
  Olfr1277
tgaaccttctaactt

SEQ ID NO: 58933 - DNA, 15 bp, Artificial Sequence
  dgRNA
  Adamts7
agtctttgttgccgg

SEQ ID NO: 58934 - DNA, 15 bp, Artificial Sequence
  dgRNA
  Adamts7
agtgcagctgcccgg

SEQ ID NO: 58935 - DNA, 15 bp, Artificial Sequence
  dgRNA
  Adamts7
ccggcggctagagtc

SEQ ID NO: 58936 - DNA, 15 bp, Artificial Sequence
  dgRNA
  Adamts7
tcaggacccggacct

SEQ ID NO: 58937 - DNA, 15 bp, Artificial Sequence
  dgRNA
  Ppp1r3a
gcatcaaagctactc

SEQ ID NO: 58938 - DNA, 15 bp, Artificial Sequence
  dgRNA
  Ppp1r3a
gctagcctgcctcca

SEQ ID NO: 58939 - DNA, 15 bp, Artificial Sequence
  dgRNA
  Ppp1r3a
gtcagctctataaat

SEQ ID NO: 58940 - DNA, 15 bp, Artificial Sequence
  dgRNA
  Ranbp3
tctcctgcgcatgcg

SEQ ID NO: 58941 - DNA, 15 bp, Artificial Sequence
  dgRNA
  Ranbp3
ctcctgcgcatgcgt

SEQ ID NO: 58942 - DNA, 15 bp, Artificial Sequence
  dgRNA
  Ranbp3
ggaccaatagcaaac

SEQ ID NO: 58943 - DNA, 15 bp, Artificial Sequence
  dgRNA
  Ranbp3
tcttccctttgcggg

SEQ ID NO: 58944 - DNA, 15 bp, Artificial Sequence
  dgRNA
  Kcnn1
gggagctttaagcat

SEQ ID NO: 58945 - DNA, 15 bp, Artificial Sequence
  dgRNA
  Kcnn1
agctttaagcatggg

SEQ ID NO: 58946 - DNA, 15 bp, Artificial Sequence
  dgRNA
  Kcnn1
agcctgcggggtcat

SEQ ID NO: 58947 - DNA, 15 bp, Artificial Sequence
  dgRNA
  Kcnn1
gcctgcggggtcatg

SEQ ID NO: 58948 - DNA, 15 bp, Artificial Sequence
  dgRNA
  Fmnl2
cgaaactacgcgtcc

SEQ ID NO: 58949 - DNA, 15 bp, Artificial Sequence
  dgRNA
  Fmnl2
gtcccggcagtccgc

SEQ ID NO: 58950 - DNA, 15 bp, Artificial Sequence
  dgRNA
  Fmnl2
tcccggcagtccgcg

SEQ ID NO: 58951 - DNA, 15 bp, Artificial Sequence
  dgRNA
  Fmnl2
cggcagtccgcgggg

SEQ ID NO: 58952 - DNA, 15 bp, Artificial Sequence
  dgRNA
  Olfr811
gtcagtcaagtaatg

SEQ ID NO: 58953 - DNA, 15 bp, Artificial Sequence
  dgRNA
  Fam25c
gcttgtgcacagtac

SEQ ID NO: 58954 - DNA, 15 bp, Artificial Sequence
  dgRNA
  Fam25c
cttgtgcacagtact

SEQ ID NO: 58955 - DNA, 15 bp, Artificial Sequence
  dgRNA
  Fam25c
agcctactactggct

SEQ ID NO: 58956 - DNA, 15 bp, Artificial Sequence
  dgRNA
  Fam25c
actactggctaggta

SEQ ID NO: 58957 - DNA, 15 bp, Artificial Sequence
  dgRNA
  Pum2
tcaccctcggtactt

SEQ ID NO: 58958 - DNA, 15 bp, Artificial Sequence
  dgRNA
  Pum2
ccctcggtacttcgg

SEQ ID NO: 58959 - DNA, 15 bp, Artificial Sequence
  dgRNA
  Pum2
ggtacttcggtggtt

SEQ ID NO: 58960 - DNA, 15 bp, Artificial Sequence
  dgRNA
  Pum2
acttcggtggttcgg

SEQ ID NO: 58961 - DNA, 15 bp, Artificial Sequence
  dgRNA
  Col5a3
gcattctagggctag

SEQ ID NO: 58962 - DNA, 15 bp, Artificial Sequence
  dgRNA
  Col5a3
cattctagggctagt

SEQ ID NO: 58963 - DNA, 15 bp, Artificial Sequence
  dgRNA
  Col5a3
tagggctagtgggcg

SEQ ID NO: 58964 - DNA, 15 bp, Artificial Sequence
  dgRNA
  Col5a3
cgtggcccatcgtct

SEQ ID NO: 58965 - DNA, 15 bp, Artificial Sequence
  dgRNA
  Capn2
gctcgccctccccac

SEQ ID NO: 58966 - DNA, 15 bp, Artificial Sequence
  dgRNA
  Capn2
ccgagagccgtccga

SEQ ID NO: 58967 - DNA, 15 bp, Artificial Sequence
  dgRNA
  Capn2
agagccgtccgaagg

SEQ ID NO: 58968 - DNA, 15 bp, Artificial Sequence
  dgRNA
  Capn2
cgaaggtggcagcat

SEQ ID NO: 58969 - DNA, 15 bp, Artificial Sequence
  dgRNA
  Olfr288
tggccttaatactgc

SEQ ID NO: 58970 - DNA, 15 bp, Artificial Sequence
  dgRNA
  Olfr288
cagccagcagtatta

SEQ ID NO: 58971 - DNA, 15 bp, Artificial Sequence
  dgRNA
  Hsf3
ataaaaattgccccc

SEQ ID NO: 58972 - DNA, 15 bp, Artificial Sequence
  dgRNA
  Hsf3
taaaaattgccccct

SEQ ID NO: 58973 - DNA, 15 bp, Artificial Sequence
  dgRNA
  Hsf3
tctcctggtaatagc

SEQ ID NO: 58974 - DNA, 15 bp, Artificial Sequence
  dgRNA
  Hsf3
tgcttacaattgtcc

SEQ ID NO: 58975 - DNA, 15 bp, Artificial Sequence
  dgRNA
  Adam22
ctactctggtgcgcg

SEQ ID NO: 58976 - DNA, 15 bp, Artificial Sequence
  dgRNA
  Adam22
ctggtgcgcgcggcc

SEQ ID NO: 58977 - DNA, 15 bp, Artificial Sequence
  dgRNA
  Adam22
gccgggtgcggcgcg

SEQ ID NO: 58978 - DNA, 15 bp, Artificial Sequence
  dgRNA
  Adam22
cgggtgcggcgcgtg

SEQ ID NO: 58979 - DNA, 15 bp, Artificial Sequence
  dgRNA
  Rab3b
caaactatagaatgt

SEQ ID NO: 58980 - DNA, 15 bp, Artificial Sequence
  dgRNA
  Rab3b
gtcacccagatatat

SEQ ID NO: 58981 - DNA, 15 bp, Artificial Sequence
  dgRNA
  Rab3b
tcacccagatatata

SEQ ID NO: 58982 - DNA, 15 bp, Artificial Sequence
  dgRNA
  Rab3b
gatatatagggtgta

SEQ ID NO: 58983 - DNA, 15 bp, Artificial Sequence
  dgRNA
  Dclk1
agtccttctagcgac

SEQ ID NO: 58984 - DNA, 15 bp, Artificial Sequence
  dgRNA
  Dclk1
gtccttctagcgact

SEQ ID NO: 58985 - DNA, 15 bp, Artificial Sequence
  dgRNA
  Dclk1
tccttctagcgactg

SEQ ID NO: 58986 - DNA, 15 bp, Artificial Sequence
  dgRNA
  Dclk1
ttctagcgactgggg

SEQ ID NO: 58987 - DNA, 15 bp, Artificial Sequence
  dgRNA
  Inpp5d
gtcagttaagctggt

SEQ ID NO: 58988 - DNA, 15 bp, Artificial Sequence
  dgRNA
  Avpr1b
gagccaaccgacaag

SEQ ID NO: 58989 - DNA, 15 bp, Artificial Sequence
  dgRNA
  Avpr1b
ctgccgcttgtcggt

SEQ ID NO: 58990 - DNA, 15 bp, Artificial Sequence
  dgRNA
  Avpr1b
gaggctgccgcttgt

SEQ ID NO: 58991 - DNA, 15 bp, Artificial Sequence
  dgRNA
  Avpr1b
ggattcctagtccag

SEQ ID NO: 58992 - DNA, 15 bp, Artificial Sequence
  dgRNA
  Sh2d4a
cccaggttcccaaat

SEQ ID NO: 58993 - DNA, 15 bp, Artificial Sequence
  dgRNA
  Sh2d4a
cctacaagtcaaatg

SEQ ID NO: 58994 - DNA, 15 bp, Artificial Sequence
  dgRNA
  Sh2d4a
agacccccactgagg

SEQ ID NO: 58995 - DNA, 15 bp, Artificial Sequence
  dgRNA
  Sh2d4a
cccactgaggtggta

SEQ ID NO: 58996 - DNA, 15 bp, Artificial Sequence
  dgRNA
  Hes7
ccgggagcctcgtgc

SEQ ID NO: 58997 - DNA, 15 bp, Artificial Sequence
  dgRNA
  Hes7
cgggagcctcgtgcc

SEQ ID NO: 58998 - DNA, 15 bp, Artificial Sequence
  dgRNA
  Hes7
gggagcctcgtgccg

SEQ ID NO: 58999 - DNA, 15 bp, Artificial Sequence
  dgRNA
  Hes7
ccggggtccttgagc

SEQ ID NO: 59000 - DNA, 15 bp, Artificial Sequence
  dgRNA
  Iscu
ccttgcacgccgctt

SEQ ID NO: 59001 - DNA, 15 bp, Artificial Sequence
  dgRNA
  Iscu
ttcccgctctgcgcc

SEQ ID NO: 59002 - DNA, 15 bp, Artificial Sequence
  dgRNA
  Iscu
ccccttccgagggcg

SEQ ID NO: 59003 - DNA, 15 bp, Artificial Sequence
  dgRNA
  Iscu
cgagggcgcggtcag

SEQ ID NO: 59004 - DNA, 15 bp, Artificial Sequence
  dgRNA
  Pianp
tgtgaagctgcgctt

SEQ ID NO: 59005 - DNA, 15 bp, Artificial Sequence
  dgRNA
  Pianp
gctgcgcttaggtag

SEQ ID NO: 59006 - DNA, 15 bp, Artificial Sequence
  dgRNA
  Pianp
ctgcgcttaggtaga

SEQ ID NO: 59007 - DNA, 15 bp, Artificial Sequence
  dgRNA
  Pianp
tgcgcttaggtagag

SEQ ID NO: 59008 - DNA, 15 bp, Artificial Sequence
  dgRNA
  Nos1ap
tctggttcagccgtg

SEQ ID NO: 59009 - DNA, 15 bp, Artificial Sequence
  dgRNA
  Nos1ap
ctggttcagccgtga

SEQ ID NO: 59010 - DNA, 15 bp, Artificial Sequence
  dgRNA
  Nos1ap
gattggctatgactg

SEQ ID NO: 59011 - DNA, 15 bp, Artificial Sequence
  dgRNA
  Nos1ap
taccccctttgacaa

SEQ ID NO: 59012 - DNA, 15 bp, Artificial Sequence
  dgRNA
  Ubqln4
gccctccgcgctgtc

SEQ ID NO: 59013 - DNA, 15 bp, Artificial Sequence
  dgRNA
  Ubqln4
ccgcgctgtccggcc

SEQ ID NO: 59014 - DNA, 15 bp, Artificial Sequence
  dgRNA
  Ubqln4
cgcgctgtccggccc

SEQ ID NO: 59015 - DNA, 15 bp, Artificial Sequence
  dgRNA
  Ubqln4
gctgcgcaccctgct

SEQ ID NO: 59016 - DNA, 15 bp, Artificial Sequence
  dgRNA
  Scnn1a
cttgcccgtggccga

SEQ ID NO: 59017 - DNA, 15 bp, Artificial Sequence
  dgRNA
  Scnn1a
ttgcccgtggccgac

SEQ ID NO: 59018 - DNA, 15 bp, Artificial Sequence
  dgRNA
  Scnn1a
cccgtggccgacggg

SEQ ID NO: 59019 - DNA, 15 bp, Artificial Sequence
  dgRNA
  Scnn1a
ccgacgggcggtctc

SEQ ID NO: 59020 - DNA, 15 bp, Artificial Sequence
  dgRNA
  Mmp3
gtggtcccatttgga

SEQ ID NO: 59021 - DNA, 15 bp, Artificial Sequence
  dgRNA
  Mmp3
tggtgattaatctcc

SEQ ID NO: 59022 - DNA, 15 bp, Artificial Sequence
  dgRNA
  Map3k3
gcgttgggagagagc

SEQ ID NO: 59023 - DNA, 15 bp, Artificial Sequence
  dgRNA
  Map3k3
cgttgggagagagcg

SEQ ID NO: 59024 - DNA, 15 bp, Artificial Sequence
  dgRNA
  Map3k3
ctcctggttattggc

SEQ ID NO: 59025 - DNA, 15 bp, Artificial Sequence
  dgRNA
  Map3k3
gcggctgcatgcgat

SEQ ID NO: 59026 - DNA, 15 bp, Artificial Sequence
  dgRNA
  Drd3
tgcctgctattatat

SEQ ID NO: 59027 - DNA, 15 bp, Artificial Sequence
  dgRNA
  Drd3
atgttccatcagtat

SEQ ID NO: 59028 - DNA, 15 bp, Artificial Sequence
  dgRNA
  Drd3
ttaggaagcctctat

SEQ ID NO: 59029 - DNA, 15 bp, Artificial Sequence
  dgRNA
  Drd3
atttagggacgaaac

SEQ ID NO: 59030 - DNA, 15 bp, Artificial Sequence
  dgRNA
  Dbx1
cgaatgaagcccgag

SEQ ID NO: 59031 - DNA, 15 bp, Artificial Sequence
  dgRNA
  Dbx1
ggcggcaacaaaggc

SEQ ID NO: 59032 - DNA, 15 bp, Artificial Sequence
  dgRNA
  Dbx1
atggggcggcaacaa

SEQ ID NO: 59033 - DNA, 15 bp, Artificial Sequence
  dgRNA
  Dbx1
atggccctcacaatg

SEQ ID NO: 59034 - DNA, 15 bp, Artificial Sequence
  dgRNA
  Gm5127
ttagtagacttcctt

SEQ ID NO: 59035 - DNA, 15 bp, Artificial Sequence
  dgRNA
  Gm5127
gtctaagtatggagc

SEQ ID NO: 59036 - DNA, 15 bp, Artificial Sequence
  dgRNA
  Stmn4
ggtaccactaattga

SEQ ID NO: 59037 - DNA, 15 bp, Artificial Sequence
  dgRNA
  Eya1
aatgcaacaattgag

SEQ ID NO: 59038 - DNA, 15 bp, Artificial Sequence
  dgRNA
  Btbd16
gacacattatcaata

SEQ ID NO: 59039 - DNA, 15 bp, Artificial Sequence
  dgRNA
  Btbd16
ttatcaataaggcac

SEQ ID NO: 59040 - DNA, 15 bp, Artificial Sequence
  dgRNA
  Btbd16
gttgcgaaaatattt

SEQ ID NO: 59041 - DNA, 15 bp, Artificial Sequence
  dgRNA
  Btbd16
tagcataaccatgcc

SEQ ID NO: 59042 - DNA, 15 bp, Artificial Sequence
  dgRNA
  Tifab
atcctccattacgta

SEQ ID NO: 59043 - DNA, 15 bp, Artificial Sequence
  dgRNA
  Tifab
ccccagacagttgga

SEQ ID NO: 59044 - DNA, 15 bp, Artificial Sequence
  dgRNA
  Tifab
ggaacctcataaccc

SEQ ID NO: 59045 - DNA, 15 bp, Artificial Sequence
  dgRNA
  Tifab
gagcatgaacactca

SEQ ID NO: 59046 - DNA, 15 bp, Artificial Sequence
  dgRNA
  Cbarp
ccaggcacccctgcg

SEQ ID NO: 59047 - DNA, 15 bp, Artificial Sequence
  dgRNA
  Cbarp
gcacccctgcgggga

SEQ ID NO: 59048 - DNA, 15 bp, Artificial Sequence
  dgRNA
  Cbarp
cacccctgcggggat

SEQ ID NO: 59049 - DNA, 15 bp, Artificial Sequence
  dgRNA
  Cbarp
acccctgcggggatg

SEQ ID NO: 59050 - DNA, 15 bp, Artificial Sequence
  dgRNA
  Cd9
aagaccccgagacgg

SEQ ID NO: 59051 - DNA, 15 bp, Artificial Sequence
  dgRNA
  Cd9
agaccccgagacggt

SEQ ID NO: 59052 - DNA, 15 bp, Artificial Sequence
  dgRNA
  Cd9
cgaagtcccagaacc

SEQ ID NO: 59053 - DNA, 15 bp, Artificial Sequence
  dgRNA
  Cd9
aggggattagagcat

SEQ ID NO: 59054 - DNA, 15 bp, Artificial Sequence
  dgRNA
  1190007I07Rik
aggaatggcaaacgc

SEQ ID NO: 59055 - DNA, 15 bp, Artificial Sequence
  dgRNA
  1190007I07Rik
tggcaaacgcaggat

SEQ ID NO: 59056 - DNA, 15 bp, Artificial Sequence
  dgRNA
  1190007I07Rik
ggcaaacgcaggatt

SEQ ID NO: 59057 - DNA, 15 bp, Artificial Sequence
  dgRNA
  1190007I07Rik
ggacagtgaccaacc

SEQ ID NO: 59058 - DNA, 15 bp, Artificial Sequence
  dgRNA
  Olfr1197
caagattattaatag

SEQ ID NO: 59059 - DNA, 15 bp, Artificial Sequence
  dgRNA
  Olfr1197
ttaactaagcccatt

SEQ ID NO: 59060 - DNA, 15 bp, Artificial Sequence
  dgRNA
  Gng2
ggggtggatttctta

SEQ ID NO: 59061 - DNA, 15 bp, Artificial Sequence
  dgRNA
  Gng2
tttcttagggaagcg

SEQ ID NO: 59062 - DNA, 15 bp, Artificial Sequence
  dgRNA
  Gng2
gaggaacattgattc

SEQ ID NO: 59063 - DNA, 15 bp, Artificial Sequence
  dgRNA
  Gng2
acattgattcaggct

SEQ ID NO: 59064 - DNA, 15 bp, Artificial Sequence
  dgRNA
  Foxj3
gtcgggaagtagttc

SEQ ID NO: 59065 - DNA, 15 bp, Artificial Sequence
  dgRNA
  Foxj3
tcgggaagtagttcc

SEQ ID NO: 59066 - DNA, 15 bp, Artificial Sequence
  dgRNA
  Foxj3
gtagttccgggtgcg

SEQ ID NO: 59067 - DNA, 15 bp, Artificial Sequence
  dgRNA
  Foxj3
ccgggtgcgcggccc

SEQ ID NO: 59068 - DNA, 15 bp, Artificial Sequence
  dgRNA
  Ppara
tctcgccctgagccg

SEQ ID NO: 59069 - DNA, 15 bp, Artificial Sequence
  dgRNA
  Ppara
cggggcccgggccta

SEQ ID NO: 59070 - DNA, 15 bp, Artificial Sequence
  dgRNA
  Ppara
ggggcccgggcctag

SEQ ID NO: 59071 - DNA, 15 bp, Artificial Sequence
  dgRNA
  Ppara
cccgggcctaggggg

SEQ ID NO: 59072 - DNA, 15 bp, Artificial Sequence
  dgRNA
  Ankrd13d
agttccggctgttcc

SEQ ID NO: 59073 - DNA, 15 bp, Artificial Sequence
  dgRNA
  Ankrd13d
gttccggctgttcct

SEQ ID NO: 59074 - DNA, 15 bp, Artificial Sequence
  dgRNA
  Ankrd13d
ttcctggggcgcatg

SEQ ID NO: 59075 - DNA, 15 bp, Artificial Sequence
  dgRNA
  Ankrd13d
cgcatgtggttgccc

SEQ ID NO: 59076 - DNA, 15 bp, Artificial Sequence
  dgRNA
  Gpr87
cctctggataccttc

SEQ ID NO: 59077 - DNA, 15 bp, Artificial Sequence
  dgRNA
  Gpr87
gattcctgccggttc

SEQ ID NO: 59078 - DNA, 15 bp, Artificial Sequence
  dgRNA
  Gpr87
gggtgattcacctga

SEQ ID NO: 59079 - DNA, 15 bp, Artificial Sequence
  dgRNA
  Gpr87
accggcaggaatctg

SEQ ID NO: 59080 - DNA, 15 bp, Artificial Sequence
  dgRNA
  Hist1h2ae
ccttattggctgcag

SEQ ID NO: 59081 - DNA, 15 bp, Artificial Sequence
  dgRNA
  Hist1h2ae
aatggtgtcactaac

SEQ ID NO: 59082 - DNA, 15 bp, Artificial Sequence
  dgRNA
  Hist1h2ae
caatacaatctaatt

SEQ ID NO: 59083 - DNA, 15 bp, Artificial Sequence
  dgRNA
  Hist1h2ae
cctctgcagccaata

SEQ ID NO: 59084 - DNA, 15 bp, Artificial Sequence
  dgRNA
  Gabpb1
acgccaaaagttcca

SEQ ID NO: 59085 - DNA, 15 bp, Artificial Sequence
  dgRNA
  Gabpb1
cgccaaaagttccac

SEQ ID NO: 59086 - DNA, 15 bp, Artificial Sequence
  dgRNA
  Gabpb1
aagttccacgggtag

SEQ ID NO: 59087 - DNA, 15 bp, Artificial Sequence
  dgRNA
  Gabpb1
gtaaaatacgtcact

SEQ ID NO: 59088 - DNA, 15 bp, Artificial Sequence
  dgRNA
  Lman2l
gcaacgccccttgcc

SEQ ID NO: 59089 - DNA, 15 bp, Artificial Sequence
  dgRNA
  Lman2l
caacgccccttgcct

SEQ ID NO: 59090 - DNA, 15 bp, Artificial Sequence
  dgRNA
  Lman2l
tactagtcagccaat

SEQ ID NO: 59091 - DNA, 15 bp, Artificial Sequence
  dgRNA
  Lman2l
tagtcagccaatcgg

SEQ ID NO: 59092 - DNA, 15 bp, Artificial Sequence
  dgRNA
  A630095N17Rik
ggagtaaccgaggct

SEQ ID NO: 59093 - DNA, 15 bp, Artificial Sequence
  dgRNA
  A630095N17Rik
ccgaggcttggacta

SEQ ID NO: 59094 - DNA, 15 bp, Artificial Sequence
  dgRNA
  A630095N17Rik
cgaggcttggactaa

SEQ ID NO: 59095 - DNA, 15 bp, Artificial Sequence
  dgRNA
  A630095N17Rik
gactaagggtgaagc

SEQ ID NO: 59096 - DNA, 15 bp, Artificial Sequence
  dgRNA
  Olfr1357
tcttaacagggaacc

SEQ ID NO: 59097 - DNA, 15 bp, Artificial Sequence
  dgRNA
  Olfr1357
cttaacagggaacct

SEQ ID NO: 59098 - DNA, 15 bp, Artificial Sequence
  dgRNA
  Olfr1357
gcagatatttgcagt

SEQ ID NO: 59099 - DNA, 15 bp, Artificial Sequence
  dgRNA
  Gas7
cacgggagcagattt

SEQ ID NO: 59100 - DNA, 15 bp, Artificial Sequence
  dgRNA
  Gas7
aactgtgcaatgtag

SEQ ID NO: 59101 - DNA, 15 bp, Artificial Sequence
  dgRNA
  Gas7
gggtgctcagcgcac

SEQ ID NO: 59102 - DNA, 15 bp, Artificial Sequence
  dgRNA
  Gas7
agcgcactggccccg

SEQ ID NO: 59103 - DNA, 15 bp, Artificial Sequence
  dgRNA
  Zmym3
cgcaaagagactgtg

SEQ ID NO: 59104 - DNA, 15 bp, Artificial Sequence
  dgRNA
  Zmym3
aattcaagctcctac

SEQ ID NO: 59105 - DNA, 15 bp, Artificial Sequence
  dgRNA
  Zmym3
tcaagctcctacagg

SEQ ID NO: 59106 - DNA, 15 bp, Artificial Sequence
  dgRNA
  Il21
atctgcatcttagac

SEQ ID NO: 59107 - DNA, 15 bp, Artificial Sequence
  dgRNA
  Psma6
tccagaacgcactaa

SEQ ID NO: 59108 - DNA, 15 bp, Artificial Sequence
  dgRNA
  Psma6
gaacgcactaacggc

SEQ ID NO: 59109 - DNA, 15 bp, Artificial Sequence
  dgRNA
  Psma6
ccacccggaagcccg

SEQ ID NO: 59110 - DNA, 15 bp, Artificial Sequence
  dgRNA
  Psma6
aagcccgcggaccgc

SEQ ID NO: 59111 - DNA, 15 bp, Artificial Sequence
  dgRNA
  Clint1
agccctctcacgctc

SEQ ID NO: 59112 - DNA, 15 bp, Artificial Sequence
  dgRNA
  Clint1
gccctctcacgctcc

SEQ ID NO: 59113 - DNA, 15 bp, Artificial Sequence
  dgRNA
  Clint1
ccctctcacgctccg

SEQ ID NO: 59114 - DNA, 15 bp, Artificial Sequence
  dgRNA
  Clint1
cctctcacgctccgg

SEQ ID NO: 59115 - DNA, 15 bp, Artificial Sequence
  dgRNA
  Lce3f
ccttttatccttgtc

SEQ ID NO: 59116 - DNA, 15 bp, Artificial Sequence
  dgRNA
  Tmem29
tgggtagctagattc

SEQ ID NO: 59117 - DNA, 15 bp, Artificial Sequence
  dgRNA
  Tmem29
gattcaggtaagtga

SEQ ID NO: 59118 - DNA, 15 bp, Artificial Sequence
  dgRNA
  Tmem29
taagtgagggccgag

SEQ ID NO: 59119 - DNA, 15 bp, Artificial Sequence
  dgRNA
  Tmem29
tgagtgcgtcagaag

SEQ ID NO: 59120 - DNA, 15 bp, Artificial Sequence
  dgRNA
  Epsti1
aagtccaagggtgtc

SEQ ID NO: 59121 - DNA, 15 bp, Artificial Sequence
  dgRNA
  Epsti1
agtccaagggtgtcc

SEQ ID NO: 59122 - DNA, 15 bp, Artificial Sequence
  dgRNA
  Epsti1
tctgaacccagcggg

SEQ ID NO: 59123 - DNA, 15 bp, Artificial Sequence
  dgRNA
  Epsti1
caggtgatcgggctc

SEQ ID NO: 59124 - DNA, 15 bp, Artificial Sequence
  dgRNA
  Dpep1
attcgacctctgcgc

SEQ ID NO: 59125 - DNA, 15 bp, Artificial Sequence
  dgRNA
  Dpep1
tcaggttactggcta

SEQ ID NO: 59126 - DNA, 15 bp, Artificial Sequence
  dgRNA
  Dpep1
ctatcattccccaga

SEQ ID NO: 59127 - DNA, 15 bp, Artificial Sequence
  dgRNA
  Dpep1
tgctctgcgttactg

SEQ ID NO: 59128 - DNA, 15 bp, Artificial Sequence
  dgRNA
  Olfr344
tgagctactaatatt

SEQ ID NO: 59129 - DNA, 15 bp, Artificial Sequence
  dgRNA
  Ssh1
tggccttgccttcgg

SEQ ID NO: 59130 - DNA, 15 bp, Artificial Sequence
  dgRNA
  Ssh1
tgcccgcgagtctag

SEQ ID NO: 59131 - DNA, 15 bp, Artificial Sequence
  dgRNA
  Ssh1
ccgcgagtctagcgg

SEQ ID NO: 59132 - DNA, 15 bp, Artificial Sequence
  dgRNA
  Ssh1
cgagtctagcggcgg

SEQ ID NO: 59133 - DNA, 15 bp, Artificial Sequence
  dgRNA
  Chrm4
tccagtaaacggtag

SEQ ID NO: 59134 - DNA, 15 bp, Artificial Sequence
  dgRNA
  Chrm4
tcctctaccgtttac

SEQ ID NO: 59135 - DNA, 15 bp, Artificial Sequence
  dgRNA
  Chrm4
ggaggaactttatcc

SEQ ID NO: 59136 - DNA, 15 bp, Artificial Sequence
  dgRNA
  Tsen54
gagtttttgcacatc

SEQ ID NO: 59137 - DNA, 15 bp, Artificial Sequence
  dgRNA
  Tsen54
acctgcacatcgagc

SEQ ID NO: 59138 - DNA, 15 bp, Artificial Sequence
  dgRNA
  Tsen54
cctgcacatcgagct

SEQ ID NO: 59139 - DNA, 15 bp, Artificial Sequence
  dgRNA
  Tsen54
tcgagctgggtcccg

SEQ ID NO: 59140 - DNA, 15 bp, Artificial Sequence
  dgRNA
  Hdx
gtccggagctgatct

SEQ ID NO: 59141 - DNA, 15 bp, Artificial Sequence
  dgRNA
  Hdx
tccggagctgatctc

SEQ ID NO: 59142 - DNA, 15 bp, Artificial Sequence
  dgRNA
  Hdx
atctcgggctctcat

SEQ ID NO: 59143 - DNA, 15 bp, Artificial Sequence
  dgRNA
  Hdx
attggccgctgtctt

SEQ ID NO: 59144 - DNA, 15 bp, Artificial Sequence
  dgRNA
  Flot2
ccgggagtctgccct

SEQ ID NO: 59145 - DNA, 15 bp, Artificial Sequence
  dgRNA
  Flot2
cgggagtctgcccta

SEQ ID NO: 59146 - DNA, 15 bp, Artificial Sequence
  dgRNA
  Flot2
tagggccggtgcccg

SEQ ID NO: 59147 - DNA, 15 bp, Artificial Sequence
  dgRNA
  Flot2
actgaggtgccccaa

SEQ ID NO: 59148 - DNA, 15 bp, Artificial Sequence
  dgRNA
  Rab28
tccccacgagcaaac

SEQ ID NO: 59149 - DNA, 15 bp, Artificial Sequence
  dgRNA
  Rab28
ccccacgagcaaacc

SEQ ID NO: 59150 - DNA, 15 bp, Artificial Sequence
  dgRNA
  Rab28
gcaaaccgggacgcc

SEQ ID NO: 59151 - DNA, 15 bp, Artificial Sequence
  dgRNA
  Rab28
gtgatggttggagcg

SEQ ID NO: 59152 - DNA, 15 bp, Artificial Sequence
  dgRNA
  Thrap3
ggcgtcagcaacgcc

SEQ ID NO: 59153 - DNA, 15 bp, Artificial Sequence
  dgRNA
  Thrap3
gcgtcagcaacgccc

SEQ ID NO: 59154 - DNA, 15 bp, Artificial Sequence
  dgRNA
  Thrap3
ccacccaggcgggag

SEQ ID NO: 59155 - DNA, 15 bp, Artificial Sequence
  dgRNA
  Thrap3
acccaggcgggagcg

SEQ ID NO: 59156 - DNA, 15 bp, Artificial Sequence
  dgRNA
  Mrvi1
tctctagcaatcccg

SEQ ID NO: 59157 - DNA, 15 bp, Artificial Sequence
  dgRNA
  Mrvi1
ctctagcaatcccga

SEQ ID NO: 59158 - DNA, 15 bp, Artificial Sequence
  dgRNA
  Mrvi1
ccgagggtttaagat

SEQ ID NO: 59159 - DNA, 15 bp, Artificial Sequence
  dgRNA
  Mrvi1
ccgcctccaaatccc

SEQ ID NO: 59160 - DNA, 15 bp, Artificial Sequence
  dgRNA
  Scpep1
acacgggccgggctg

SEQ ID NO: 59161 - DNA, 15 bp, Artificial Sequence
  dgRNA
  Scpep1
cctacttagtaacca

SEQ ID NO: 59162 - DNA, 15 bp, Artificial Sequence
  dgRNA
  Scpep1
tcgagagccctttgt

SEQ ID NO: 59163 - DNA, 15 bp, Artificial Sequence
  dgRNA
  Scpep1
ctgggtgggtccgac

SEQ ID NO: 59164 - DNA, 15 bp, Artificial Sequence
  dgRNA
  1700006A11Rik
atggcacgagcctca

SEQ ID NO: 59165 - DNA, 15 bp, Artificial Sequence
  dgRNA
  1700006A11Rik
gaccaaatgacacat

SEQ ID NO: 59166 - DNA, 15 bp, Artificial Sequence
  dgRNA
  Eif4enif1
gtgaccgctagcaac

SEQ ID NO: 59167 - DNA, 15 bp, Artificial Sequence
  dgRNA
  Eif4enif1
ccaccccgctcgcgc

SEQ ID NO: 59168 - DNA, 15 bp, Artificial Sequence
  dgRNA
  Eif4enif1
ccgctcgcgccggcg

SEQ ID NO: 59169 - DNA, 15 bp, Artificial Sequence
  dgRNA
  Eif4enif1
cgcgccggcgtggcg

SEQ ID NO: 59170 - DNA, 15 bp, Artificial Sequence
  dgRNA
  Sla
ctcatgccagcgact

SEQ ID NO: 59171 - DNA, 15 bp, Artificial Sequence
  dgRNA
  Sla
agcgacttggctgcc

SEQ ID NO: 59172 - DNA, 15 bp, Artificial Sequence
  dgRNA
  Sla
gtaagaggcggatgc

SEQ ID NO: 59173 - DNA, 15 bp, Artificial Sequence
  dgRNA
  Sla
cgctggcatgagccc

SEQ ID NO: 59174 - DNA, 15 bp, Artificial Sequence
  dgRNA
  Siah2
gctcccgcccgactc

SEQ ID NO: 59175 - DNA, 15 bp, Artificial Sequence
  dgRNA
  Siah2
ctcccgcccgactcc

SEQ ID NO: 59176 - DNA, 15 bp, Artificial Sequence
  dgRNA
  Siah2
cgcgtgtcaagctac

SEQ ID NO: 59177 - DNA, 15 bp, Artificial Sequence
  dgRNA
  Siah2
gctccagcgcgtcaa

SEQ ID NO: 59178 - DNA, 15 bp, Artificial Sequence
  dgRNA
  Sepsecs
atgcgcggaagtcga

SEQ ID NO: 59179 - DNA, 15 bp, Artificial Sequence
  dgRNA
  Sepsecs
cgcggaagtcgaagg

SEQ ID NO: 59180 - DNA, 15 bp, Artificial Sequence
  dgRNA
  Sepsecs
cgaaggcggcgtctt

SEQ ID NO: 59181 - DNA, 15 bp, Artificial Sequence
  dgRNA
  Sepsecs
gaaggcggcgtctta

SEQ ID NO: 59182 - DNA, 15 bp, Artificial Sequence
  dgRNA
  Ccdc117
gttctgtatagggat

SEQ ID NO: 59183 - DNA, 15 bp, Artificial Sequence
  dgRNA
  Ccdc117
ttctgtatagggatt

SEQ ID NO: 59184 - DNA, 15 bp, Artificial Sequence
  dgRNA
  Ccdc117
attctggccgggtga

SEQ ID NO: 59185 - DNA, 15 bp, Artificial Sequence
  dgRNA
  Ccdc117
ctcctgcaattcgtc

SEQ ID NO: 59186 - DNA, 15 bp, Artificial Sequence
  dgRNA
  Hspb2
ccctgcgacagctga

SEQ ID NO: 59187 - DNA, 15 bp, Artificial Sequence
  dgRNA
  Hspb2
cctgcgacagctgaa

SEQ ID NO: 59188 - DNA, 15 bp, Artificial Sequence
  dgRNA
  Hspb2
ggacttagggggtcc

SEQ ID NO: 59189 - DNA, 15 bp, Artificial Sequence
  dgRNA
  Hspb2
tcgcaggggcctggt

SEQ ID NO: 59190 - DNA, 15 bp, Artificial Sequence
  dgRNA
  Olfr1122
ataaatcttatgtcc

SEQ ID NO: 59191 - DNA, 15 bp, Artificial Sequence
  dgRNA
  Olfr1122
cccgttcatctcatc

SEQ ID NO: 59192 - DNA, 15 bp, Artificial Sequence
  dgRNA
  Olfr1122
agctatatttcagta

SEQ ID NO: 59193 - DNA, 15 bp, Artificial Sequence
  dgRNA
  Olfr1122
gattaaaatgaaccc

SEQ ID NO: 59194 - DNA, 15 bp, Artificial Sequence
  dgRNA
  Cyp11a1
tattcgtcatcacct

SEQ ID NO: 59195 - DNA, 15 bp, Artificial Sequence
  dgRNA
  Cyp11a1
attcgtcatcaccta

SEQ ID NO: 59196 - DNA, 15 bp, Artificial Sequence
  dgRNA
  Cyp11a1
ttcgtcatcacctag

SEQ ID NO: 59197 - DNA, 15 bp, Artificial Sequence
  dgRNA
  Cyp11a1
catgcaaaacccgca

SEQ ID NO: 59198 - DNA, 15 bp, Artificial Sequence
  dgRNA
  Hif1a
attatcttgcctcac

SEQ ID NO: 59199 - DNA, 15 bp, Artificial Sequence
  dgRNA
  Lhx4
gcagccggcacgcga

SEQ ID NO: 59200 - DNA, 15 bp, Artificial Sequence
  dgRNA
  Lhx4
cagccggcacgcgaa

SEQ ID NO: 59201 - DNA, 15 bp, Artificial Sequence
  dgRNA
  Lhx4
cacgcgaagggtgga

SEQ ID NO: 59202 - DNA, 15 bp, Artificial Sequence
  dgRNA
  Lhx4
acgcgaagggtggag

SEQ ID NO: 59203 - DNA, 15 bp, Artificial Sequence
  dgRNA
  Nmrk2
gctcgtgactttttt

SEQ ID NO: 59204 - DNA, 15 bp, Artificial Sequence
  dgRNA
  Nmrk2
tctcacaagtgcttg

SEQ ID NO: 59205 - DNA, 15 bp, Artificial Sequence
  dgRNA
  Nmrk2
gggggcctcttcccc

SEQ ID NO: 59206 - DNA, 15 bp, Artificial Sequence
  dgRNA
  Nmrk2
gggcctcttcccccg

SEQ ID NO: 59207 - DNA, 15 bp, Artificial Sequence
  dgRNA
  Ufm1
ctaactgtgggctat

SEQ ID NO: 59208 - DNA, 15 bp, Artificial Sequence
  dgRNA
  Ufm1
tccgacacaattttc

SEQ ID NO: 59209 - DNA, 15 bp, Artificial Sequence
  dgRNA
  Ufm1
ttttcaggcgctgtg

SEQ ID NO: 59210 - DNA, 15 bp, Artificial Sequence
  dgRNA
  Ufm1
tgtggatagccgcgc

SEQ ID NO: 59211 - DNA, 15 bp, Artificial Sequence
  dgRNA
  Dlg2
ctgttaggctacaaa

SEQ ID NO: 59212 - DNA, 15 bp, Artificial Sequence
  dgRNA
  Dlg2
ggtaaagtatctaat

SEQ ID NO: 59213 - DNA, 15 bp, Artificial Sequence
  dgRNA
  Dlg2
taataggacaacact

SEQ ID NO: 59214 - DNA, 15 bp, Artificial Sequence
  dgRNA
  Dlg2
aataggacaacactc

SEQ ID NO: 59215 - DNA, 15 bp, Artificial Sequence
  dgRNA
  Atp6v1c2
tccggagcttgagct

SEQ ID NO: 59216 - DNA, 15 bp, Artificial Sequence
  dgRNA
  Atp6v1c2
ccggagcttgagctt

SEQ ID NO: 59217 - DNA, 15 bp, Artificial Sequence
  dgRNA
  Atp6v1c2
agcgccacaccgaca

SEQ ID NO: 59218 - DNA, 15 bp, Artificial Sequence
  dgRNA
  Atp6v1c2
ccgacacggacatca

SEQ ID NO: 59219 - DNA, 15 bp, Artificial Sequence
  dgRNA
  Mapkapk5
cttggctgcatccac

SEQ ID NO: 59220 - DNA, 15 bp, Artificial Sequence
  dgRNA
  Mapkapk5
attccgcttctcttt

SEQ ID NO: 59221 - DNA, 15 bp, Artificial Sequence
  dgRNA
  Mapkapk5
cgcttctctttcggc

SEQ ID NO: 59222 - DNA, 15 bp, Artificial Sequence
  dgRNA
  Mapkapk5
ctctttcggcaggcc

SEQ ID NO: 59223 - DNA, 15 bp, Artificial Sequence
  dgRNA
  Mxd3
gcagcttgcagcgcc

SEQ ID NO: 59224 - DNA, 15 bp, Artificial Sequence
  dgRNA
  Mxd3
gcagcgcccggtgtc

SEQ ID NO: 59225 - DNA, 15 bp, Artificial Sequence
  dgRNA
  Mxd3
cagcgcccggtgtcc

SEQ ID NO: 59226 - DNA, 15 bp, Artificial Sequence
  dgRNA
  Mxd3
ccgggctgcctgacc

SEQ ID NO: 59227 - DNA, 15 bp, Artificial Sequence
  dgRNA
  Zfp108
ggaaccttctcgttc

SEQ ID NO: 59228 - DNA, 15 bp, Artificial Sequence
  dgRNA
  Zfp108
gatgaacttccgccg

SEQ ID NO: 59229 - DNA, 15 bp, Artificial Sequence
  dgRNA
  Zfp108
tccgccgaggcattc

SEQ ID NO: 59230 - DNA, 15 bp, Artificial Sequence
  dgRNA
  Zfp108
ccgccgaggcattct

SEQ ID NO: 59231 - DNA, 15 bp, Artificial Sequence
  dgRNA
  Olfr342
aatagatgtactaag

SEQ ID NO: 59232 - DNA, 15 bp, Artificial Sequence
  dgRNA
  Olfr342
cttgactattcattg

SEQ ID NO: 59233 - DNA, 15 bp, Artificial Sequence
  dgRNA
  Zfp558
acccggacaaacttt

SEQ ID NO: 59234 - DNA, 15 bp, Artificial Sequence
  dgRNA
  Zfp558
cccggacaaactttt

SEQ ID NO: 59235 - DNA, 15 bp, Artificial Sequence
  dgRNA
  Zfp558
ggacaaacttttggg

SEQ ID NO: 59236 - DNA, 15 bp, Artificial Sequence
  dgRNA
  Zfp558
cggaagtgaacctcg

SEQ ID NO: 59237 - DNA, 15 bp, Artificial Sequence
  dgRNA
  Rgp1
gcaacaaagtcgcca

SEQ ID NO: 59238 - DNA, 15 bp, Artificial Sequence
  dgRNA
  Rgp1
tctctagatcctagg

SEQ ID NO: 59239 - DNA, 15 bp, Artificial Sequence
  dgRNA
  Rgp1
ctctagatcctaggc

SEQ ID NO: 59240 - DNA, 15 bp, Artificial Sequence
  dgRNA
  Rgp1
gatcctaggcgggaa

SEQ ID NO: 59241 - DNA, 15 bp, Artificial Sequence
  dgRNA
  Hn1l
gctgtaagcgcgatg

SEQ ID NO: 59242 - DNA, 15 bp, Artificial Sequence
  dgRNA
  Hn1l
ctgtaagcgcgatgc

SEQ ID NO: 59243 - DNA, 15 bp, Artificial Sequence
  dgRNA
  Hn1l
gcacgactctacgat

SEQ ID NO: 59244 - DNA, 15 bp, Artificial Sequence
  dgRNA
  Hn1l
catgattggcgcgag

SEQ ID NO: 59245 - DNA, 15 bp, Artificial Sequence
  dgRNA
  Prdx2
gctccgggccatgcc

SEQ ID NO: 59246 - DNA, 15 bp, Artificial Sequence
  dgRNA
  Prdx2
ccccaacgcgccccg

SEQ ID NO: 59247 - DNA, 15 bp, Artificial Sequence
  dgRNA
  Prdx2
cgcgccccgtggccg

SEQ ID NO: 59248 - DNA, 15 bp, Artificial Sequence
  dgRNA
  Prdx2
atcttggcgtccgaa

SEQ ID NO: 59249 - DNA, 15 bp, Artificial Sequence
  dgRNA
  Txlna
agaggaggacgccgc

SEQ ID NO: 59250 - DNA, 15 bp, Artificial Sequence
  dgRNA
  Txlna
gccgccggacgtccg

SEQ ID NO: 59251 - DNA, 15 bp, Artificial Sequence
  dgRNA
  Txlna
ggtgaagtatgtcta

SEQ ID NO: 59252 - DNA, 15 bp, Artificial Sequence
  dgRNA
  Txlna
gtgaagtatgtctat

SEQ ID NO: 59253 - DNA, 15 bp, Artificial Sequence
  dgRNA
  Treml2
acgtgagtccgtgag

SEQ ID NO: 59254 - DNA, 15 bp, Artificial Sequence
  dgRNA
  Treml2
tttgcaactgtgagc

SEQ ID NO: 59255 - DNA, 15 bp, Artificial Sequence
  dgRNA
  Treml2
ctgaagtgactagcc

SEQ ID NO: 59256 - DNA, 15 bp, Artificial Sequence
  dgRNA
  Treml2
cacggactcacgtgc

SEQ ID NO: 59257 - DNA, 15 bp, Artificial Sequence
  dgRNA
  Dctpp1
ttaagaagtttcgcc

SEQ ID NO: 59258 - DNA, 15 bp, Artificial Sequence
  dgRNA
  Dctpp1
taagaagtttcgcct

SEQ ID NO: 59259 - DNA, 15 bp, Artificial Sequence
  dgRNA
  Dctpp1
gaagtttcgcctggg

SEQ ID NO: 59260 - DNA, 15 bp, Artificial Sequence
  dgRNA
  Dctpp1
gggcggaagaactcg

SEQ ID NO: 59261 - DNA, 15 bp, Artificial Sequence
  dgRNA
  Npm3
tatatatccccgggt

SEQ ID NO: 59262 - DNA, 15 bp, Artificial Sequence
  dgRNA
  Npm3
ccccgggttggaaga

SEQ ID NO: 59263 - DNA, 15 bp, Artificial Sequence
  dgRNA
  Npm3
cccgggttggaagaa

SEQ ID NO: 59264 - DNA, 15 bp, Artificial Sequence
  dgRNA
  Npm3
ccgggttggaagaag

SEQ ID NO: 59265 - DNA, 15 bp, Artificial Sequence
  dgRNA
  Arl5a
tcaaatccccgacat

SEQ ID NO: 59266 - DNA, 15 bp, Artificial Sequence
  dgRNA
  Arl5a
ccctccgcgccgcag

SEQ ID NO: 59267 - DNA, 15 bp, Artificial Sequence
  dgRNA
  Arl5a
ccctcgctccgcctc

SEQ ID NO: 59268 - DNA, 15 bp, Artificial Sequence
  dgRNA
  Arl5a
ctccgcctccgggca

SEQ ID NO: 59269 - DNA, 15 bp, Artificial Sequence
  dgRNA
  Meox2
ccagggcccgacggg

SEQ ID NO: 59270 - DNA, 15 bp, Artificial Sequence
  dgRNA
  Meox2
cagggcccgacgggc

SEQ ID NO: 59271 - DNA, 15 bp, Artificial Sequence
  dgRNA
  Meox2
ccgacgggcgggcgt

SEQ ID NO: 59272 - DNA, 15 bp, Artificial Sequence
  dgRNA
  Meox2
cgacgggcgggcgtt

SEQ ID NO: 59273 - DNA, 15 bp, Artificial Sequence
  dgRNA
  Grm5
aactcaacactctct

SEQ ID NO: 59274 - DNA, 15 bp, Artificial Sequence
  dgRNA
  Grm5
tgtacatactagctc

SEQ ID NO: 59275 - DNA, 15 bp, Artificial Sequence
  dgRNA
  Slc25a19
gcttctcaagggggt

SEQ ID NO: 59276 - DNA, 15 bp, Artificial Sequence
  dgRNA
  Slc25a19
gactacagtacctag

SEQ ID NO: 59277 - DNA, 15 bp, Artificial Sequence
  dgRNA
  Slc25a19
gtacctagcggtatc

SEQ ID NO: 59278 - DNA, 15 bp, Artificial Sequence
  dgRNA
  Slc25a19
caacgattcgtccag

SEQ ID NO: 59279 - DNA, 15 bp, Artificial Sequence
  dgRNA
  Mdfi
gctctgagcgagggg

SEQ ID NO: 59280 - DNA, 15 bp, Artificial Sequence
  dgRNA
  Mdfi
ggaaaccagacgagc

SEQ ID NO: 59281 - DNA, 15 bp, Artificial Sequence
  dgRNA
  Mdfi
cgagctggcttcctg

SEQ ID NO: 59282 - DNA, 15 bp, Artificial Sequence
  dgRNA
  Mdfi
gcctcggacgccccg

SEQ ID NO: 59283 - DNA, 15 bp, Artificial Sequence
  dgRNA
  1700029P11Rik
atgctcccataatct

SEQ ID NO: 59284 - DNA, 15 bp, Artificial Sequence
  dgRNA
  1700029P11Rik
ctcccataatctcgg

SEQ ID NO: 59285 - DNA, 15 bp, Artificial Sequence
  dgRNA
  1700029P11Rik
tgtagatatcagtta

SEQ ID NO: 59286 - DNA, 15 bp, Artificial Sequence
  dgRNA
  1700029P11Rik
gtagatatcagttaa

SEQ ID NO: 59287 - DNA, 15 bp, Artificial Sequence
  dgRNA
  Wbp1l
gagccgagccggaag

SEQ ID NO: 59288 - DNA, 15 bp, Artificial Sequence
  dgRNA
  Wbp1l
agccgagccggaagc

SEQ ID NO: 59289 - DNA, 15 bp, Artificial Sequence
  dgRNA
  Wbp1l
cgagccggaagcggg

SEQ ID NO: 59290 - DNA, 15 bp, Artificial Sequence
  dgRNA
  Wbp1l
ctcccgcttccggct

SEQ ID NO: 59291 - DNA, 15 bp, Artificial Sequence
  dgRNA
  Rac3
gttaagcatcagtct

SEQ ID NO: 59292 - DNA, 15 bp, Artificial Sequence
  dgRNA
  Rac3
cagtctcggccgccc

SEQ ID NO: 59293 - DNA, 15 bp, Artificial Sequence
  dgRNA
  Rac3
gcgcatccatttctg

SEQ ID NO: 59294 - DNA, 15 bp, Artificial Sequence
  dgRNA
  Rac3
acctgagctacaccg

SEQ ID NO: 59295 - DNA, 15 bp, Artificial Sequence
  dgRNA
  Sertad1
tgtcatcgccccaca

SEQ ID NO: 59296 - DNA, 15 bp, Artificial Sequence
  dgRNA
  Sertad1
gtcatcgccccacaa

SEQ ID NO: 59297 - DNA, 15 bp, Artificial Sequence
  dgRNA
  Sertad1
gctgtcccttcgctc

SEQ ID NO: 59298 - DNA, 15 bp, Artificial Sequence
  dgRNA
  Sertad1
ggaacggccccgctc

SEQ ID NO: 59299 - DNA, 15 bp, Artificial Sequence
  dgRNA
  Tnpo2
tcacgtgactcaact

SEQ ID NO: 59300 - DNA, 15 bp, Artificial Sequence
  dgRNA
  Tnpo2
gactcaacttggcca

SEQ ID NO: 59301 - DNA, 15 bp, Artificial Sequence
  dgRNA
  Tnpo2
ctctccgattggctt

SEQ ID NO: 59302 - DNA, 15 bp, Artificial Sequence
  dgRNA
  Tnpo2
ccgattggctttggt

SEQ ID NO: 59303 - DNA, 15 bp, Artificial Sequence
  dgRNA
  Polr1b
gcgcgtagttttaac

SEQ ID NO: 59304 - DNA, 15 bp, Artificial Sequence
  dgRNA
  Polr1b
ggtctaatcacgcca

SEQ ID NO: 59305 - DNA, 15 bp, Artificial Sequence
  dgRNA
  Polr1b
ggcgggccgaacaag

SEQ ID NO: 59306 - DNA, 15 bp, Artificial Sequence
  dgRNA
  Polr1b
atggcgtgattagac

SEQ ID NO: 59307 - DNA, 15 bp, Artificial Sequence
  dgRNA
  1-Sep
tgcgcacacaagtag

SEQ ID NO: 59308 - DNA, 15 bp, Artificial Sequence
  dgRNA
  Cfp
gtaaggtggggtatt

SEQ ID NO: 59309 - DNA, 15 bp, Artificial Sequence
  dgRNA
  Cfp
aggtggggtattagg

SEQ ID NO: 59310 - DNA, 15 bp, Artificial Sequence
  dgRNA
  Cfp
tttcactcaatgctt

SEQ ID NO: 59311 - DNA, 15 bp, Artificial Sequence
  dgRNA
  Olfr357
gcatcttccttgatt

SEQ ID NO: 59312 - DNA, 15 bp, Artificial Sequence
  dgRNA
  Tipin
ttcgtgttctaaacc

SEQ ID NO: 59313 - DNA, 15 bp, Artificial Sequence
  dgRNA
  Tipin
ccggagacctatttc

SEQ ID NO: 59314 - DNA, 15 bp, Artificial Sequence
  dgRNA
  Tipin
ccgtcccagacattc

SEQ ID NO: 59315 - DNA, 15 bp, Artificial Sequence
  dgRNA
  Tipin
cccagacattccgga

SEQ ID NO: 59316 - DNA, 15 bp, Artificial Sequence
  dgRNA
  Tmem171
tccggagcggcgcgc

SEQ ID NO: 59317 - DNA, 15 bp, Artificial Sequence
  dgRNA
  Tmem171
gcgcgccggtgcctc

SEQ ID NO: 59318 - DNA, 15 bp, Artificial Sequence
  dgRNA
  Tmem171
cgccggtgcctcagg

SEQ ID NO: 59319 - DNA, 15 bp, Artificial Sequence
  dgRNA
  Tmem171
gccggtgcctcagga

SEQ ID NO: 59320 - DNA, 15 bp, Artificial Sequence
  dgRNA
  Kank3
tgtaggcccgccctc

SEQ ID NO: 59321 - DNA, 15 bp, Artificial Sequence
  dgRNA
  Kank3
aggcccgccctcagg

SEQ ID NO: 59322 - DNA, 15 bp, Artificial Sequence
  dgRNA
  Kank3
ggcccgccctcaggc

SEQ ID NO: 59323 - DNA, 15 bp, Artificial Sequence
  dgRNA
  Kank3
ctgcccccgcccaga

SEQ ID NO: 59324 - DNA, 15 bp, Artificial Sequence
  dgRNA
  Trp53rka
gtctacaggtcctag

SEQ ID NO: 59325 - DNA, 15 bp, Artificial Sequence
  dgRNA
  Trp53rka
cggaaccaaactagc

SEQ ID NO: 59326 - DNA, 15 bp, Artificial Sequence
  dgRNA
  Trp53rka
gtggggcggtgttaa

SEQ ID NO: 59327 - DNA, 15 bp, Artificial Sequence
  dgRNA
  Trp53rka
gggcggtgttaatgg

SEQ ID NO: 59328 - DNA, 15 bp, Artificial Sequence
  dgRNA
  Rab7
catacaaattaggca

SEQ ID NO: 59329 - DNA, 15 bp, Artificial Sequence
  dgRNA
  Rab7
ttaggcatggctgtt

SEQ ID NO: 59330 - DNA, 15 bp, Artificial Sequence
  dgRNA
  Rab7
acaaactcacgcagg

SEQ ID NO: 59331 - DNA, 15 bp, Artificial Sequence
  dgRNA
  Rab7
gcaggctttattaag

SEQ ID NO: 59332 - DNA, 15 bp, Artificial Sequence
  dgRNA
  Suclg2
acggagctagaaagg

SEQ ID NO: 59333 - DNA, 15 bp, Artificial Sequence
  dgRNA
  Suclg2
gggacggagctagaa

SEQ ID NO: 59334 - DNA, 15 bp, Artificial Sequence
  dgRNA
  Suclg2
agcccgcccgggccc

SEQ ID NO: 59335 - DNA, 15 bp, Artificial Sequence
  dgRNA
  Suclg2
ggagggagcccgccc

SEQ ID NO: 59336 - DNA, 15 bp, Artificial Sequence
  dgRNA
  Tfb1m
aacctgcaccgcttt

SEQ ID NO: 59337 - DNA, 15 bp, Artificial Sequence
  dgRNA
  Tfb1m
cagtttcgtcatttc

SEQ ID NO: 59338 - DNA, 15 bp, Artificial Sequence
  dgRNA
  Tfb1m
ttcgtcatttccggc

SEQ ID NO: 59339 - DNA, 15 bp, Artificial Sequence
  dgRNA
  Tfb1m
ctccatccaaccagg

SEQ ID NO: 59340 - DNA, 15 bp, Artificial Sequence
  dgRNA
  Dnajc15
accccgggctttgac

SEQ ID NO: 59341 - DNA, 15 bp, Artificial Sequence
  dgRNA
  Dnajc15
ccccgggctttgaca

SEQ ID NO: 59342 - DNA, 15 bp, Artificial Sequence
  dgRNA
  Dnajc15
tcagtttatcggaga

SEQ ID NO: 59343 - DNA, 15 bp, Artificial Sequence
  dgRNA
  Dnajc15
gagcgcgaacttaac

SEQ ID NO: 59344 - DNA, 15 bp, Artificial Sequence
  dgRNA
  Cfap126
gatctatagaataat

SEQ ID NO: 59345 - DNA, 15 bp, Artificial Sequence
  dgRNA
  Cfap126
ttgaaggaaggacgt

SEQ ID NO: 59346 - DNA, 15 bp, Artificial Sequence
  dgRNA
  Cfap126
atagatcataggtgc

SEQ ID NO: 59347 - DNA, 15 bp, Artificial Sequence
  dgRNA
  Cfap126
tattctatagatcat

SEQ ID NO: 59348 - DNA, 15 bp, Artificial Sequence
  dgRNA
  Insig2
gcgcgcagaggcaac

SEQ ID NO: 59349 - DNA, 15 bp, Artificial Sequence
  dgRNA
  Insig2
tcagcgtgaagccgc

SEQ ID NO: 59350 - DNA, 15 bp, Artificial Sequence
  dgRNA
  Insig2
cagcgtgaagccgcc

SEQ ID NO: 59351 - DNA, 15 bp, Artificial Sequence
  dgRNA
  Insig2
cgtgaagccgccggg

SEQ ID NO: 59352 - DNA, 15 bp, Artificial Sequence
  dgRNA
  Olfr877
cgtgctagttccata

SEQ ID NO: 59353 - DNA, 15 bp, Artificial Sequence
  dgRNA
  Olfr877
tcctctaggagtgtc

SEQ ID NO: 59354 - DNA, 15 bp, Artificial Sequence
  dgRNA
  Fmn2
gtactagagatagac

SEQ ID NO: 59355 - DNA, 15 bp, Artificial Sequence
  dgRNA
  Fmn2
acgggttttcctact

SEQ ID NO: 59356 - DNA, 15 bp, Artificial Sequence
  dgRNA
  Fmn2
ctacttggttgcagg

SEQ ID NO: 59357 - DNA, 15 bp, Artificial Sequence
  dgRNA
  Fmn2
gtacttcataattgg

SEQ ID NO: 59358 - DNA, 15 bp, Artificial Sequence
  dgRNA
  Adnp
gccgccattttggct

SEQ ID NO: 59359 - DNA, 15 bp, Artificial Sequence
  dgRNA
  Adnp
ccgccattttggcta

SEQ ID NO: 59360 - DNA, 15 bp, Artificial Sequence
  dgRNA
  Adnp
cattttggctagggc

SEQ ID NO: 59361 - DNA, 15 bp, Artificial Sequence
  dgRNA
  Adnp
ggctagggcaggttc

SEQ ID NO: 59362 - DNA, 15 bp, Artificial Sequence
  dgRNA
  Ank3
gaccataaataacag

SEQ ID NO: 59363 - DNA, 15 bp, Artificial Sequence
  dgRNA
  Ank3
gacactagagttccc

SEQ ID NO: 59364 - DNA, 15 bp, Artificial Sequence
  dgRNA
  Ank3
ggttgggaaactgct

SEQ ID NO: 59365 - DNA, 15 bp, Artificial Sequence
  dgRNA
  Ank3
tcggctgggaacacc

SEQ ID NO: 59366 - DNA, 15 bp, Artificial Sequence
  dgRNA
  Pitpnm3
gctgcggtggccgcg

SEQ ID NO: 59367 - DNA, 15 bp, Artificial Sequence
  dgRNA
  Pitpnm3
gtggccgcgcggctc

SEQ ID NO: 59368 - DNA, 15 bp, Artificial Sequence
  dgRNA
  Pitpnm3
tggccgcgcggctcc

SEQ ID NO: 59369 - DNA, 15 bp, Artificial Sequence
  dgRNA
  Pitpnm3
ccgcgcggctccggg

SEQ ID NO: 59370 - DNA, 15 bp, Artificial Sequence
  dgRNA
  Crebbp
ccacccgagcgcgct

SEQ ID NO: 59371 - DNA, 15 bp, Artificial Sequence
  dgRNA
  Crebbp
cggctctttccgccg

SEQ ID NO: 59372 - DNA, 15 bp, Artificial Sequence
  dgRNA
  Crebbp
tctttccgccgcggc

SEQ ID NO: 59373 - DNA, 15 bp, Artificial Sequence
  dgRNA
  Crebbp
ggccggcgcaggtgg

SEQ ID NO: 59374 - DNA, 15 bp, Artificial Sequence
  dgRNA
  Olfr1090
tagctcttacatact

SEQ ID NO: 59375 - DNA, 15 bp, Artificial Sequence
  dgRNA
  Olfr616
attagtgttgactta

SEQ ID NO: 59376 - DNA, 15 bp, Artificial Sequence
  dgRNA
  Olfr616
ttagtgttgacttat

SEQ ID NO: 59377 - DNA, 15 bp, Artificial Sequence
  dgRNA
  Olfr616
taactatgtgcagct

SEQ ID NO: 59378 - DNA, 15 bp, Artificial Sequence
  dgRNA
  Sdpr
gatttagccaatcag

SEQ ID NO: 59379 - DNA, 15 bp, Artificial Sequence
  dgRNA
  Sdpr
ctcatgattgaaata

SEQ ID NO: 59380 - DNA, 15 bp, Artificial Sequence
  dgRNA
  Sdpr
gagttcatttagagg

SEQ ID NO: 59381 - DNA, 15 bp, Artificial Sequence
  dgRNA
  Sdpr
catgagttcatttag

SEQ ID NO: 59382 - DNA, 15 bp, Artificial Sequence
  dgRNA
  Aph1a
ccaccaagtattcat

SEQ ID NO: 59383 - DNA, 15 bp, Artificial Sequence
  dgRNA
  Aph1a
tattcattggccttc

SEQ ID NO: 59384 - DNA, 15 bp, Artificial Sequence
  dgRNA
  Aph1a
attcattggccttcc

SEQ ID NO: 59385 - DNA, 15 bp, Artificial Sequence
  dgRNA
  Aph1a
ttcattggccttccg

SEQ ID NO: 59386 - DNA, 15 bp, Artificial Sequence
  dgRNA
  Prom1
cctagaggacgcaac

SEQ ID NO: 59387 - DNA, 15 bp, Artificial Sequence
  dgRNA
  Prom1
agtcctggagtcccg

SEQ ID NO: 59388 - DNA, 15 bp, Artificial Sequence
  dgRNA
  Prom1
ccgtggtcctgactc

SEQ ID NO: 59389 - DNA, 15 bp, Artificial Sequence
  dgRNA
  Prom1
acccttagccaaccc

SEQ ID NO: 59390 - DNA, 15 bp, Artificial Sequence
  dgRNA
  9230110F15Rik
tcccaggatatgggc

SEQ ID NO: 59391 - DNA, 15 bp, Artificial Sequence
  dgRNA
  Pprc1
tcccagaaatcctcg

SEQ ID NO: 59392 - DNA, 15 bp, Artificial Sequence
  dgRNA
  Pprc1
cccagaaatcctcga

SEQ ID NO: 59393 - DNA, 15 bp, Artificial Sequence
  dgRNA
  Pprc1
agaaatcctcgaggg

SEQ ID NO: 59394 - DNA, 15 bp, Artificial Sequence
  dgRNA
  Pprc1
tcctcgagggaggtc

SEQ ID NO: 59395 - DNA, 15 bp, Artificial Sequence
  dgRNA
  Slc39a13
ccgtgtggccactgc

SEQ ID NO: 59396 - DNA, 15 bp, Artificial Sequence
  dgRNA
  Slc39a13
ccgccctgttgatcc

SEQ ID NO: 59397 - DNA, 15 bp, Artificial Sequence
  dgRNA
  Slc39a13
atcccggttcccgcg

SEQ ID NO: 59398 - DNA, 15 bp, Artificial Sequence
  dgRNA
  Slc39a13
tcccggttcccgcgt

SEQ ID NO: 59399 - DNA, 15 bp, Artificial Sequence
  dgRNA
  G6pc2
cccctaaattgcccc

SEQ ID NO: 59400 - DNA, 15 bp, Artificial Sequence
  dgRNA
  G6pc2
gcagatgagcttttc

SEQ ID NO: 59401 - DNA, 15 bp, Artificial Sequence
  dgRNA
  G6pc2
tcacatgtcacgtaa

SEQ ID NO: 59402 - DNA, 15 bp, Artificial Sequence
  dgRNA
  G6pc2
gctcagtgcatcaca

SEQ ID NO: 59403 - DNA, 15 bp, Artificial Sequence
  dgRNA
  Cyp7b1
ttcctgtcaccggag

SEQ ID NO: 59404 - DNA, 15 bp, Artificial Sequence
  dgRNA
  Cyp7b1
gtcaccggagcggag

SEQ ID NO: 59405 - DNA, 15 bp, Artificial Sequence
  dgRNA
  Cyp7b1
gcgaggcggaacgct

SEQ ID NO: 59406 - DNA, 15 bp, Artificial Sequence
  dgRNA
  Cyp7b1
cgaggcggaacgctt

SEQ ID NO: 59407 - DNA, 15 bp, Artificial Sequence
  dgRNA
  Wnk1
gagccgcagcagctt

SEQ ID NO: 59408 - DNA, 15 bp, Artificial Sequence
  dgRNA
  Wnk1
gtcccgcgtcgccct

SEQ ID NO: 59409 - DNA, 15 bp, Artificial Sequence
  dgRNA
  Wnk1
tcccgcgtcgccctc

SEQ ID NO: 59410 - DNA, 15 bp, Artificial Sequence
  dgRNA
  Wnk1
cccgcgtcgccctcg

SEQ ID NO: 59411 - DNA, 15 bp, Artificial Sequence
  dgRNA
  S100b
gatcaagtccagttg

SEQ ID NO: 59412 - DNA, 15 bp, Artificial Sequence
  dgRNA
  S100b
cagggtaccactcaa

SEQ ID NO: 59413 - DNA, 15 bp, Artificial Sequence
  dgRNA
  S100b
agggtaccactcaat

SEQ ID NO: 59414 - DNA, 15 bp, Artificial Sequence
  dgRNA
  S100b
gggtaccactcaatg

SEQ ID NO: 59415 - DNA, 15 bp, Artificial Sequence
  dgRNA
  Rrnad1
gaaggtggtgggccg

SEQ ID NO: 59416 - DNA, 15 bp, Artificial Sequence
  dgRNA
  Rrnad1
gtgggccgcgggaag

SEQ ID NO: 59417 - DNA, 15 bp, Artificial Sequence
  dgRNA
  Rrnad1
cggaacagagtgcgc

SEQ ID NO: 59418 - DNA, 15 bp, Artificial Sequence
  dgRNA
  Rrnad1
agtgcgccggaaccg

SEQ ID NO: 59419 - DNA, 15 bp, Artificial Sequence
  dgRNA
  Mrps26
aaacttgtgaacaag

SEQ ID NO: 59420 - DNA, 15 bp, Artificial Sequence
  dgRNA
  Mrps26
gtagctgtctttagc

SEQ ID NO: 59421 - DNA, 15 bp, Artificial Sequence
  dgRNA
  Mrps26
ctctacccgagagtc

SEQ ID NO: 59422 - DNA, 15 bp, Artificial Sequence
  dgRNA
  Mrps26
agtccggacgtgcat

SEQ ID NO: 59423 - DNA, 15 bp, Artificial Sequence
  dgRNA
  Meioc
agcctagggcgaagt

SEQ ID NO: 59424 - DNA, 15 bp, Artificial Sequence
  dgRNA
  Meioc
tagtcttgtctctgg

SEQ ID NO: 59425 - DNA, 15 bp, Artificial Sequence
  dgRNA
  Meioc
gggggcaacagaccc

SEQ ID NO: 59426 - DNA, 15 bp, Artificial Sequence
  dgRNA
  Meioc
gaggcggtcgcccat

SEQ ID NO: 59427 - DNA, 15 bp, Artificial Sequence
  dgRNA
  Gm4981
gagtcgattctccca

SEQ ID NO: 59428 - DNA, 15 bp, Artificial Sequence
  dgRNA
  Gm4981
gtgagtacttctggc

SEQ ID NO: 59429 - DNA, 15 bp, Artificial Sequence
  dgRNA
  Gm4981
ctggcaggccgtcat

SEQ ID NO: 59430 - DNA, 15 bp, Artificial Sequence
  dgRNA
  Gm4981
cctaccccttcctcg

SEQ ID NO: 59431 - DNA, 15 bp, Artificial Sequence
  dgRNA
  Pex1
gccatgcctttatgg

SEQ ID NO: 59432 - DNA, 15 bp, Artificial Sequence
  dgRNA
  Pex1
tgcctttatggaggc

SEQ ID NO: 59433 - DNA, 15 bp, Artificial Sequence
  dgRNA
  Pex1
ttagtgtccctgccg

SEQ ID NO: 59434 - DNA, 15 bp, Artificial Sequence
  dgRNA
  Pex1
tagtgtccctgccga

SEQ ID NO: 59435 - DNA, 15 bp, Artificial Sequence
  dgRNA
  Mif4gd
cgccaagcgagggag

SEQ ID NO: 59436 - DNA, 15 bp, Artificial Sequence
  dgRNA
  Mif4gd
agcgagggagcggcc

SEQ ID NO: 59437 - DNA, 15 bp, Artificial Sequence
  dgRNA
  Mif4gd
gcgagggagcggccc

SEQ ID NO: 59438 - DNA, 15 bp, Artificial Sequence
  dgRNA
  Mif4gd
cgagggagcggcccg

SEQ ID NO: 59439 - DNA, 15 bp, Artificial Sequence
  dgRNA
  Stx18
gagttaaacagcacg

SEQ ID NO: 59440 - DNA, 15 bp, Artificial Sequence
  dgRNA
  Stx18
ccgttgttgataata

SEQ ID NO: 59441 - DNA, 15 bp, Artificial Sequence
  dgRNA
  Dhx33
tcccctgttgttact

SEQ ID NO: 59442 - DNA, 15 bp, Artificial Sequence
  dgRNA
  Dhx33
cccctgttgttactc

SEQ ID NO: 59443 - DNA, 15 bp, Artificial Sequence
  dgRNA
  Dhx33
ctcgggccgtttttt

SEQ ID NO: 59444 - DNA, 15 bp, Artificial Sequence
  dgRNA
  Dhx33
cgaccttgctctcac

SEQ ID NO: 59445 - DNA, 15 bp, Artificial Sequence
  dgRNA
  Ppm1m
tactctgacgcaagc

SEQ ID NO: 59446 - DNA, 15 bp, Artificial Sequence
  dgRNA
  Ppm1m
cgtcttcacttcgct

SEQ ID NO: 59447 - DNA, 15 bp, Artificial Sequence
  dgRNA
  Ppm1m
cacttcgctaggcct

SEQ ID NO: 59448 - DNA, 15 bp, Artificial Sequence
  dgRNA
  Ppm1m
actggccgcacacac

SEQ ID NO: 59449 - DNA, 15 bp, Artificial Sequence
  dgRNA
  Frem3
actccagaattccat

SEQ ID NO: 59450 - DNA, 15 bp, Artificial Sequence
  dgRNA
  Frem3
gatcccgccagatcc

SEQ ID NO: 59451 - DNA, 15 bp, Artificial Sequence
  dgRNA
  Frem3
gagggcggggatgct

SEQ ID NO: 59452 - DNA, 15 bp, Artificial Sequence
  dgRNA
  Frem3
gagagactctgcggg

SEQ ID NO: 59453 - DNA, 15 bp, Artificial Sequence
  dgRNA
  Spink13
cctctgtcatatcat

SEQ ID NO: 59454 - DNA, 15 bp, Artificial Sequence
  dgRNA
  Spink13
tcataggcattttgc

SEQ ID NO: 59455 - DNA, 15 bp, Artificial Sequence
  dgRNA
  Spink13
aacaccattcgtgac

SEQ ID NO: 59456 - DNA, 15 bp, Artificial Sequence
  dgRNA
  Spink13
cctatgatatgacag

SEQ ID NO: 59457 - DNA, 15 bp, Artificial Sequence
  dgRNA
  Banf2
ggctggcgatctaca

SEQ ID NO: 59458 - DNA, 15 bp, Artificial Sequence
  dgRNA
  Banf2
caatgtgacccattc

SEQ ID NO: 59459 - DNA, 15 bp, Artificial Sequence
  dgRNA
  Banf2
acccattcagggtct

SEQ ID NO: 59460 - DNA, 15 bp, Artificial Sequence
  dgRNA
  Banf2
gactgatttatctca

SEQ ID NO: 59461 - DNA, 15 bp, Artificial Sequence
  dgRNA
  Olfr1102
gaaagattgattgtc

SEQ ID NO: 59462 - DNA, 15 bp, Artificial Sequence
  dgRNA
  Olfr1102
agattctataaacga

SEQ ID NO: 59463 - DNA, 15 bp, Artificial Sequence
  dgRNA
  Zbtb46
gctgcgcccagccgg

SEQ ID NO: 59464 - DNA, 15 bp, Artificial Sequence
  dgRNA
  Zbtb46
gcccagccggcggag

SEQ ID NO: 59465 - DNA, 15 bp, Artificial Sequence
  dgRNA
  Zbtb46
cccagccggcggagc

SEQ ID NO: 59466 - DNA, 15 bp, Artificial Sequence
  dgRNA
  Zbtb46
ccagccggcggagcg

SEQ ID NO: 59467 - DNA, 15 bp, Artificial Sequence
  dgRNA
  Dnmt3l
cctcccctcacgtgc

SEQ ID NO: 59468 - DNA, 15 bp, Artificial Sequence
  dgRNA
  Dnmt3l
ctcccctcacgtgct

SEQ ID NO: 59469 - DNA, 15 bp, Artificial Sequence
  dgRNA
  Dnmt3l
tccctacctacggta

SEQ ID NO: 59470 - DNA, 15 bp, Artificial Sequence
  dgRNA
  Dnmt3l
ggagcccagcacgtg

SEQ ID NO: 59471 - DNA, 15 bp, Artificial Sequence
  dgRNA
  4933427D14Rik
tgtcttgggcgtaga

SEQ ID NO: 59472 - DNA, 15 bp, Artificial Sequence
  dgRNA
  4933427D14Rik
cttgggcgtagatgg

SEQ ID NO: 59473 - DNA, 15 bp, Artificial Sequence
  dgRNA
  4933427D14Rik
ggacctcatgattcc

SEQ ID NO: 59474 - DNA, 15 bp, Artificial Sequence
  dgRNA
  4933427D14Rik
tgtagggtaacaaat

SEQ ID NO: 59475 - DNA, 15 bp, Artificial Sequence
  dgRNA
  Whsc1
tgacatacctatact

SEQ ID NO: 59476 - DNA, 15 bp, Artificial Sequence
  dgRNA
  Ust
tccagcgtcgagccc

SEQ ID NO: 59477 - DNA, 15 bp, Artificial Sequence
  dgRNA
  Ust
ccagcgtcgagccca

SEQ ID NO: 59478 - DNA, 15 bp, Artificial Sequence
  dgRNA
  Ust
cgtcgagcccagggt

SEQ ID NO: 59479 - DNA, 15 bp, Artificial Sequence
  dgRNA
  Ust
tcgcgccagagagaa

SEQ ID NO: 59480 - DNA, 15 bp, Artificial Sequence
  dgRNA
  Dhx40
gatggcttcggctcc

SEQ ID NO: 59481 - DNA, 15 bp, Artificial Sequence
  dgRNA
  Dhx40
atggcttcggctcct

SEQ ID NO: 59482 - DNA, 15 bp, Artificial Sequence
  dgRNA
  Dhx40
ttcggctcctgggaa

SEQ ID NO: 59483 - DNA, 15 bp, Artificial Sequence
  dgRNA
  Dhx40
tcggctcctgggaaa

SEQ ID NO: 59484 - DNA, 15 bp, Artificial Sequence
  dgRNA
  Krtap4-2
tgggctttgccaaat

SEQ ID NO: 59485 - DNA, 15 bp, Artificial Sequence
  dgRNA
  Krtap4-2
ccaaattggatagct

SEQ ID NO: 59486 - DNA, 15 bp, Artificial Sequence
  dgRNA
  Krtap4-2
cagggtataaaaagc

SEQ ID NO: 59487 - DNA, 15 bp, Artificial Sequence
  dgRNA
  Krtap4-2
ccaagctatccaatt

SEQ ID NO: 59488 - DNA, 15 bp, Artificial Sequence
  dgRNA
  Abca2
ggtgcaggcgggcgc

SEQ ID NO: 59489 - DNA, 15 bp, Artificial Sequence
  dgRNA
  Abca2
ggcgcgggcgccccc

SEQ ID NO: 59490 - DNA, 15 bp, Artificial Sequence
  dgRNA
  Abca2
cccctggcggctacc

SEQ ID NO: 59491 - DNA, 15 bp, Artificial Sequence
  dgRNA
  Abca2
ccctggcggctaccc

SEQ ID NO: 59492 - DNA, 15 bp, Artificial Sequence
  dgRNA
  Pcbp3
cgggctgcgcaggag

SEQ ID NO: 59493 - DNA, 15 bp, Artificial Sequence
  dgRNA
  Pcbp3
tggctggttgcacgg

SEQ ID NO: 59494 - DNA, 15 bp, Artificial Sequence
  dgRNA
  Pcbp3
ggctggttgcacgga

SEQ ID NO: 59495 - DNA, 15 bp, Artificial Sequence
  dgRNA
  Pcbp3
ctggttgcacggagg

SEQ ID NO: 59496 - DNA, 15 bp, Artificial Sequence
  dgRNA
  Nrgn
ttgggactctagaac

SEQ ID NO: 59497 - DNA, 15 bp, Artificial Sequence
  dgRNA
  Nrgn
ctatctatgggcggt

SEQ ID NO: 59498 - DNA, 15 bp, Artificial Sequence
  dgRNA
  Nrgn
tatctatgggcggta

SEQ ID NO: 59499 - DNA, 15 bp, Artificial Sequence
  dgRNA
  Nrgn
cgacgtacatctgcc

SEQ ID NO: 59500 - DNA, 15 bp, Artificial Sequence
  dgRNA
  Spats1
agggtgcaccgcaca

SEQ ID NO: 59501 - DNA, 15 bp, Artificial Sequence
  dgRNA
  Spats1
gcacacggccacccg

SEQ ID NO: 59502 - DNA, 15 bp, Artificial Sequence
  dgRNA
  Spats1
cccaggccggagcgc

SEQ ID NO: 59503 - DNA, 15 bp, Artificial Sequence
  dgRNA
  Spats1
ccaggccggagcgcc

SEQ ID NO: 59504 - DNA, 15 bp, Artificial Sequence
  dgRNA
  Slx4
taaccagactgtatt

SEQ ID NO: 59505 - DNA, 15 bp, Artificial Sequence
  dgRNA
  Slx4
tcctcttgtacaccg

SEQ ID NO: 59506 - DNA, 15 bp, Artificial Sequence
  dgRNA
  Slx4
cctcttgtacaccgt

SEQ ID NO: 59507 - DNA, 15 bp, Artificial Sequence
  dgRNA
  Slx4
aagcacgcacacacg

SEQ ID NO: 59508 - DNA, 15 bp, Artificial Sequence
  dgRNA
  Zbtb18
ctcctaatttgatca

SEQ ID NO: 59509 - DNA, 15 bp, Artificial Sequence
  dgRNA
  Zbtb18
tttttagccctctca

SEQ ID NO: 59510 - DNA, 15 bp, Artificial Sequence
  dgRNA
  Zbtb18
gccctctcaaggatt

SEQ ID NO: 59511 - DNA, 15 bp, Artificial Sequence
  dgRNA
  Zbtb18
ttgatgttagctgta

SEQ ID NO: 59512 - DNA, 15 bp, Artificial Sequence
  dgRNA
  Selplg
ggtgcttactgtgag

SEQ ID NO: 59513 - DNA, 15 bp, Artificial Sequence
  dgRNA
  Selplg
gggtgcttactgtga

SEQ ID NO: 59514 - DNA, 15 bp, Artificial Sequence
  dgRNA
  Selplg
ggggtgcttactgtg

SEQ ID NO: 59515 - DNA, 15 bp, Artificial Sequence
  dgRNA
  Selplg
tgatggcggtttgtt

SEQ ID NO: 59516 - DNA, 15 bp, Artificial Sequence
  dgRNA
  Ugp2
tgcgcccgcctccct

SEQ ID NO: 59517 - DNA, 15 bp, Artificial Sequence
  dgRNA
  Ugp2
gcgcccgcctccctc

SEQ ID NO: 59518 - DNA, 15 bp, Artificial Sequence
  dgRNA
  Ugp2
ctccgcgtgtctcat

SEQ ID NO: 59519 - DNA, 15 bp, Artificial Sequence
  dgRNA
  Ugp2
attggccaggtcctt

SEQ ID NO: 59520 - DNA, 15 bp, Artificial Sequence
  dgRNA
  Bbof1
cccggctccaacccc

SEQ ID NO: 59521 - DNA, 15 bp, Artificial Sequence
  dgRNA
  Bbof1
cgcgccgccctggcg

SEQ ID NO: 59522 - DNA, 15 bp, Artificial Sequence
  dgRNA
  Bbof1
ggacgcccgccgcct

SEQ ID NO: 59523 - DNA, 15 bp, Artificial Sequence
  dgRNA
  Bbof1
cgggtgtcgggcgcg

SEQ ID NO: 59524 - DNA, 15 bp, Artificial Sequence
  dgRNA
  Ms4a6b
attgcatgcagctag

SEQ ID NO: 59525 - DNA, 15 bp, Artificial Sequence
  dgRNA
  Ms4a6b
ttgcatgcagctagt

SEQ ID NO: 59526 - DNA, 15 bp, Artificial Sequence
  dgRNA
  Ms4a6b
tcactctatcaaaac

SEQ ID NO: 59527 - DNA, 15 bp, Artificial Sequence
  dgRNA
  Ms4a6b
gtgcttaacaggttg

SEQ ID NO: 59528 - DNA, 15 bp, Artificial Sequence
  dgRNA
  Rnf220
ggtctcttcatcatc

SEQ ID NO: 59529 - DNA, 15 bp, Artificial Sequence
  dgRNA
  Rnf220
tccccgtctgtctaa

SEQ ID NO: 59530 - DNA, 15 bp, Artificial Sequence
  dgRNA
  Rnf220
ccgtctgtctaatgg

SEQ ID NO: 59531 - DNA, 15 bp, Artificial Sequence
  dgRNA
  Rnf220
cgtctgtctaatgga

SEQ ID NO: 59532 - DNA, 15 bp, Artificial Sequence
  dgRNA
  7530416G11Rik
ggataccactgctca

SEQ ID NO: 59533 - DNA, 15 bp, Artificial Sequence
  dgRNA
  7530416G11Rik
tggcaggccccattc

SEQ ID NO: 59534 - DNA, 15 bp, Artificial Sequence
  dgRNA
  7530416G11Rik
tctaattctgctgac

SEQ ID NO: 59535 - DNA, 15 bp, Artificial Sequence
  dgRNA
  7530416G11Rik
ccctccagcctgaat

SEQ ID NO: 59536 - DNA, 15 bp, Artificial Sequence
  dgRNA
  Trim45
ctctggaggacgaca

SEQ ID NO: 59537 - DNA, 15 bp, Artificial Sequence
  dgRNA
  Trim45
tggctccgaactgcg

SEQ ID NO: 59538 - DNA, 15 bp, Artificial Sequence
  dgRNA
  Trim45
gaggcccgccccttt

SEQ ID NO: 59539 - DNA, 15 bp, Artificial Sequence
  dgRNA
  Trim45
cccgcccctttcgga

SEQ ID NO: 59540 - DNA, 15 bp, Artificial Sequence
  dgRNA
  Slc6a2
ccccccggagctggg

SEQ ID NO: 59541 - DNA, 15 bp, Artificial Sequence
  dgRNA
  Slc6a2
cccttgagtcaactc

SEQ ID NO: 59542 - DNA, 15 bp, Artificial Sequence
  dgRNA
  Slc6a2
tccctcagggcccgc

SEQ ID NO: 59543 - DNA, 15 bp, Artificial Sequence
  dgRNA
  Slc6a2
ggcccgcaggaaact

SEQ ID NO: 59544 - DNA, 15 bp, Artificial Sequence
  dgRNA
  Stx3
tcctacaactctgcc

SEQ ID NO: 59545 - DNA, 15 bp, Artificial Sequence
  dgRNA
  Stx3
cttcttttctcgtac

SEQ ID NO: 59546 - DNA, 15 bp, Artificial Sequence
  dgRNA
  Stx3
tgatttatatagcta

SEQ ID NO: 59547 - DNA, 15 bp, Artificial Sequence
  dgRNA
  Stx3
gacgtttgtttgatt

SEQ ID NO: 59548 - DNA, 15 bp, Artificial Sequence
  dgRNA
  Mllt1
gttctgactgtcgcc

SEQ ID NO: 59549 - DNA, 15 bp, Artificial Sequence
  dgRNA
  Mllt1
ctgactgtcgcccgg

SEQ ID NO: 59550 - DNA, 15 bp, Artificial Sequence
  dgRNA
  Mllt1
tgactgtcgcccggc

SEQ ID NO: 59551 - DNA, 15 bp, Artificial Sequence
  dgRNA
  Mllt1
gggcccccaccagcc

SEQ ID NO: 59552 - DNA, 15 bp, Artificial Sequence
  dgRNA
  Pan2
tcagtttgtccccgg

SEQ ID NO: 59553 - DNA, 15 bp, Artificial Sequence
  dgRNA
  Pan2
tccgtaaccttgttt

SEQ ID NO: 59554 - DNA, 15 bp, Artificial Sequence
  dgRNA
  Pan2
accttgttttggcgg

SEQ ID NO: 59555 - DNA, 15 bp, Artificial Sequence
  dgRNA
  Pan2
ggcgctgcctgtacc

SEQ ID NO: 59556 - DNA, 15 bp, Artificial Sequence
  dgRNA
  Exoc5
agccacactgcccgc

SEQ ID NO: 59557 - DNA, 15 bp, Artificial Sequence
  dgRNA
  Exoc5
gccacactgcccgca

SEQ ID NO: 59558 - DNA, 15 bp, Artificial Sequence
  dgRNA
  Exoc5
ctgcccgcagggcca

SEQ ID NO: 59559 - DNA, 15 bp, Artificial Sequence
  dgRNA
  Exoc5
gcgatgtagaaacta

SEQ ID NO: 59560 - DNA, 15 bp, Artificial Sequence
  dgRNA
  Olfr1331
cagataccaatcttc

SEQ ID NO: 59561 - DNA, 15 bp, Artificial Sequence
  dgRNA
  Bnip3l
atgccccgcccagcc

SEQ ID NO: 59562 - DNA, 15 bp, Artificial Sequence
  dgRNA
  Bnip3l
tcacgccccctatcc

SEQ ID NO: 59563 - DNA, 15 bp, Artificial Sequence
  dgRNA
  Bnip3l
cacgccccctatcct

SEQ ID NO: 59564 - DNA, 15 bp, Artificial Sequence
  dgRNA
  Bnip3l
tgtcatcacatggtc

SEQ ID NO: 59565 - DNA, 15 bp, Artificial Sequence
  dgRNA
  Ica1l
cggaagagctcagcg

SEQ ID NO: 59566 - DNA, 15 bp, Artificial Sequence
  dgRNA
  Ica1l
tcagcgcggcccgag

SEQ ID NO: 59567 - DNA, 15 bp, Artificial Sequence
  dgRNA
  Ica1l
gcggcccgagcggcg

SEQ ID NO: 59568 - DNA, 15 bp, Artificial Sequence
  dgRNA
  Ica1l
agctcttccgcgcac

SEQ ID NO: 59569 - DNA, 15 bp, Artificial Sequence
  dgRNA
  Pbx1
cgctgggtggaaagt

SEQ ID NO: 59570 - DNA, 15 bp, Artificial Sequence
  dgRNA
  Pbx1
gaggagcccactttc

SEQ ID NO: 59571 - DNA, 15 bp, Artificial Sequence
  dgRNA
  Pbx1
ctagccaatcataga

SEQ ID NO: 59572 - DNA, 15 bp, Artificial Sequence
  dgRNA
  Pbx1
tagccaatcatagaa

SEQ ID NO: 59573 - DNA, 15 bp, Artificial Sequence
  dgRNA
  Cyp2j9
ccatacatgctcaag

SEQ ID NO: 59574 - DNA, 15 bp, Artificial Sequence
  dgRNA
  Cyp2j9
tgacggagagtcttg

SEQ ID NO: 59575 - DNA, 15 bp, Artificial Sequence
  dgRNA
  Cyp2j9
ttgaggcggggccaa

SEQ ID NO: 59576 - DNA, 15 bp, Artificial Sequence
  dgRNA
  Cyp2j9
gccaaggggatgttt

SEQ ID NO: 59577 - DNA, 15 bp, Artificial Sequence
  dgRNA
  Gmcl1
atcccgagatctgtt

SEQ ID NO: 59578 - DNA, 15 bp, Artificial Sequence
  dgRNA
  Gmcl1
cccctccgttgaagc

SEQ ID NO: 59579 - DNA, 15 bp, Artificial Sequence
  dgRNA
  Gmcl1
ttgaagccggaaccg

SEQ ID NO: 59580 - DNA, 15 bp, Artificial Sequence
  dgRNA
  Gmcl1
aagtcagacacgcac

SEQ ID NO: 59581 - DNA, 15 bp, Artificial Sequence
  dgRNA
  Utp3
ccacaaaaggatccg

SEQ ID NO: 59582 - DNA, 15 bp, Artificial Sequence
  dgRNA
  Utp3
aaaggatccgcggaa

SEQ ID NO: 59583 - DNA, 15 bp, Artificial Sequence
  dgRNA
  Utp3
gaacggaaatatcct

SEQ ID NO: 59584 - DNA, 15 bp, Artificial Sequence
  dgRNA
  Utp3
cctagcgttcctacc

SEQ ID NO: 59585 - DNA, 15 bp, Artificial Sequence
  dgRNA
  Eya1
gcatttaaaccaata

SEQ ID NO: 59586 - DNA, 15 bp, Artificial Sequence
  dgRNA
  Eya1
taaaccaataaggtt

SEQ ID NO: 59587 - DNA, 15 bp, Artificial Sequence
  dgRNA
  Eya1
ttgtcctaaccttat

SEQ ID NO: 59588 - DNA, 15 bp, Artificial Sequence
  dgRNA
  Rnf168
ttcctgttcggatct

SEQ ID NO: 59589 - DNA, 15 bp, Artificial Sequence
  dgRNA
  Rnf168
ccgagcgaccaaaag

SEQ ID NO: 59590 - DNA, 15 bp, Artificial Sequence
  dgRNA
  Rnf168
cgagcgaccaaaagc

SEQ ID NO: 59591 - DNA, 15 bp, Artificial Sequence
  dgRNA
  Rnf168
gcgaccaaaagcggg

SEQ ID NO: 59592 - DNA, 15 bp, Artificial Sequence
  dgRNA
  Gss
cctctttagccttgc

SEQ ID NO: 59593 - DNA, 15 bp, Artificial Sequence
  dgRNA
  Gss
ctctttagccttgcg

SEQ ID NO: 59594 - DNA, 15 bp, Artificial Sequence
  dgRNA
  Gss
tttagccttgcgggg

SEQ ID NO: 59595 - DNA, 15 bp, Artificial Sequence
  dgRNA
  Gss
cggggcggtctgcgc

SEQ ID NO: 59596 - DNA, 15 bp, Artificial Sequence
  dgRNA
  Tslp
ttccatagatttggc

SEQ ID NO: 59597 - DNA, 15 bp, Artificial Sequence
  dgRNA
  Tslp
agcccgtaggcgttt

SEQ ID NO: 59598 - DNA, 15 bp, Artificial Sequence
  dgRNA
  Tslp
cacctaaacgcctac

SEQ ID NO: 59599 - DNA, 15 bp, Artificial Sequence
  dgRNA
  Tslp
acacctaaacgccta

SEQ ID NO: 59600 - DNA, 15 bp, Artificial Sequence
  dgRNA
  Kdm3a
ctgttgccgccgtcg

SEQ ID NO: 59601 - DNA, 15 bp, Artificial Sequence
  dgRNA
  Kdm3a
tgttgccgccgtcgt

SEQ ID NO: 59602 - DNA, 15 bp, Artificial Sequence
  dgRNA
  Kdm3a
cgtcgtgggtgactc

SEQ ID NO: 59603 - DNA, 15 bp, Artificial Sequence
  dgRNA
  Kdm3a
gtcgtgggtgactca

SEQ ID NO: 59604 - DNA, 15 bp, Artificial Sequence
  dgRNA
  Sh3gl3
caccctgtcacacta

SEQ ID NO: 59605 - DNA, 15 bp, Artificial Sequence
  dgRNA
  Sh3gl3
gtcctagttagccaa

SEQ ID NO: 59606 - DNA, 15 bp, Artificial Sequence
  dgRNA
  Sh3gl3
tgtcctagttagcca

SEQ ID NO: 59607 - DNA, 15 bp, Artificial Sequence
  dgRNA
  Sh3gl3
cttaacaagcatgag

SEQ ID NO: 59608 - DNA, 15 bp, Artificial Sequence
  dgRNA
  Rgs7bp
gccttaagccccaat

SEQ ID NO: 59609 - DNA, 15 bp, Artificial Sequence
  dgRNA
  Rgs7bp
gcaattgatgttccc

SEQ ID NO: 59610 - DNA, 15 bp, Artificial Sequence
  dgRNA
  Rgs7bp
tcccgggaatttgat

SEQ ID NO: 59611 - DNA, 15 bp, Artificial Sequence
  dgRNA
  Rgs7bp
taagtgcataaactg

SEQ ID NO: 59612 - DNA, 15 bp, Artificial Sequence
  dgRNA
  Fabp5
cgagtcgcagcttgc

SEQ ID NO: 59613 - DNA, 15 bp, Artificial Sequence
  dgRNA
  Fabp5
cgtgacgtcccagtc

SEQ ID NO: 59614 - DNA, 15 bp, Artificial Sequence
  dgRNA
  Fabp5
cggcgcagccaggcc

SEQ ID NO: 59615 - DNA, 15 bp, Artificial Sequence
  dgRNA
  Fabp5
caaggcgcacaagtc

SEQ ID NO: 59616 - DNA, 15 bp, Artificial Sequence
  dgRNA
  Olfr315
aatcatcctcagacc

SEQ ID NO: 59617 - DNA, 15 bp, Artificial Sequence
  dgRNA
  Olfr315
tgacttgcgagttcc

SEQ ID NO: 59618 - DNA, 15 bp, Artificial Sequence
  dgRNA
  Olfr315
accatacctggtctg

SEQ ID NO: 59619 - DNA, 15 bp, Artificial Sequence
  dgRNA
  Golgb1
gtacctacacaggac

SEQ ID NO: 59620 - DNA, 15 bp, Artificial Sequence
  dgRNA
  Golgb1
taagccctgtcactt

SEQ ID NO: 59621 - DNA, 15 bp, Artificial Sequence
  dgRNA
  Golgb1
ataagccctgtcact

SEQ ID NO: 59622 - DNA, 15 bp, Artificial Sequence
  dgRNA
  Golgb1
ggcaacggtgaccgt

SEQ ID NO: 59623 - DNA, 15 bp, Artificial Sequence
  dgRNA
  Ten1
gattgaaggtggcgg

SEQ ID NO: 59624 - DNA, 15 bp, Artificial Sequence
  dgRNA
  Ten1
gctccttgcgcagat

SEQ ID NO: 59625 - DNA, 15 bp, Artificial Sequence
  dgRNA
  Ten1
ctccttgcgcagatc

SEQ ID NO: 59626 - DNA, 15 bp, Artificial Sequence
  dgRNA
  Ten1
gatcgggattcatga

SEQ ID NO: 59627 - DNA, 15 bp, Artificial Sequence
  dgRNA
  Mafk
tgagacaactgcacg

SEQ ID NO: 59628 - DNA, 15 bp, Artificial Sequence
  dgRNA
  Mafk
cacgtggaagcatgt

SEQ ID NO: 59629 - DNA, 15 bp, Artificial Sequence
  dgRNA
  Mafk
ggggcgtggccatca

SEQ ID NO: 59630 - DNA, 15 bp, Artificial Sequence
  dgRNA
  Mafk
gggcgtggccatcag

SEQ ID NO: 59631 - DNA, 15 bp, Artificial Sequence
  dgRNA
  Taf4a
gccgcagccaatcgg

SEQ ID NO: 59632 - DNA, 15 bp, Artificial Sequence
  dgRNA
  Taf4a
ccaatcggaggccac

SEQ ID NO: 59633 - DNA, 15 bp, Artificial Sequence
  dgRNA
  Taf4a
caatcggaggccaca

SEQ ID NO: 59634 - DNA, 15 bp, Artificial Sequence
  dgRNA
  Taf4a
aatcggaggccacag

SEQ ID NO: 59635 - DNA, 15 bp, Artificial Sequence
  dgRNA
  Spred1
ctcgcgccctgcctg

SEQ ID NO: 59636 - DNA, 15 bp, Artificial Sequence
  dgRNA
  Spred1
gctggagcgcgtccg

SEQ ID NO: 59637 - DNA, 15 bp, Artificial Sequence
  dgRNA
  Spred1
accaggcgcgccgcg

SEQ ID NO: 59638 - DNA, 15 bp, Artificial Sequence
  dgRNA
  Spred1
ccaggcgcgccgcgc

SEQ ID NO: 59639 - DNA, 15 bp, Artificial Sequence
  dgRNA
  Ppp1ca
cgcccgaggccctct

SEQ ID NO: 59640 - DNA, 15 bp, Artificial Sequence
  dgRNA
  Ppp1ca
gcccgaggccctctc

SEQ ID NO: 59641 - DNA, 15 bp, Artificial Sequence
  dgRNA
  Ppp1ca
ggccctctcgggctg

SEQ ID NO: 59642 - DNA, 15 bp, Artificial Sequence
  dgRNA
  Ppp1ca
cggagcttcccgtcc

SEQ ID NO: 59643 - DNA, 15 bp, Artificial Sequence
  dgRNA
  Btbd17
caacacaatagcccc

SEQ ID NO: 59644 - DNA, 15 bp, Artificial Sequence
  dgRNA
  Btbd17
aacacaatagcccct

SEQ ID NO: 59645 - DNA, 15 bp, Artificial Sequence
  dgRNA
  Btbd17
acacaatagcccctg

SEQ ID NO: 59646 - DNA, 15 bp, Artificial Sequence
  dgRNA
  Btbd17
cttaagtagttgcct

SEQ ID NO: 59647 - DNA, 15 bp, Artificial Sequence
  dgRNA
  Lpo
ccattaatcctacca

SEQ ID NO: 59648 - DNA, 15 bp, Artificial Sequence
  dgRNA
  Lpo
atttgctagaaggta

SEQ ID NO: 59649 - DNA, 15 bp, Artificial Sequence
  dgRNA
  Lpo
tttgctagaaggtaa

SEQ ID NO: 59650 - DNA, 15 bp, Artificial Sequence
  dgRNA
  Lpo
agcccgcacaccatc

SEQ ID NO: 59651 - DNA, 15 bp, Artificial Sequence
  dgRNA
  Scn5a
gggcgtgcgccccgc

SEQ ID NO: 59652 - DNA, 15 bp, Artificial Sequence
  dgRNA
  Scn5a
tgcgccccgccgggc

SEQ ID NO: 59653 - DNA, 15 bp, Artificial Sequence
  dgRNA
  Scn5a
gcgccccgccgggca

SEQ ID NO: 59654 - DNA, 15 bp, Artificial Sequence
  dgRNA
  Scn5a
ccccgccgggcaggg

SEQ ID NO: 59655 - DNA, 15 bp, Artificial Sequence
  dgRNA
  Iltifb
gctcgtcgggtagca

SEQ ID NO: 59656 - DNA, 15 bp, Artificial Sequence
  dgRNA
  Iltifb
gggaacatgctcgtc

SEQ ID NO: 59657 - DNA, 15 bp, Artificial Sequence
  dgRNA
  Iltifb
ggggaacatgctcgt

SEQ ID NO: 59658 - DNA, 15 bp, Artificial Sequence
  dgRNA
  Usp32
atgacgtgctacgtg

SEQ ID NO: 59659 - DNA, 15 bp, Artificial Sequence
  dgRNA
  Usp32
gtgctacgtgtggcg

SEQ ID NO: 59660 - DNA, 15 bp, Artificial Sequence
  dgRNA
  Usp32
tgcgcgctcttagcg

SEQ ID NO: 59661 - DNA, 15 bp, Artificial Sequence
  dgRNA
  Usp32
gcgcgctcttagcgt

SEQ ID NO: 59662 - DNA, 15 bp, Artificial Sequence
  dgRNA
  Lypd8
gaacaccacctacac

SEQ ID NO: 59663 - DNA, 15 bp, Artificial Sequence
  dgRNA
  Lypd8
aagggtcactacagt

SEQ ID NO: 59664 - DNA, 15 bp, Artificial Sequence
  dgRNA
  Lypd8
agggtcactacagtt

SEQ ID NO: 59665 - DNA, 15 bp, Artificial Sequence
  dgRNA
  Lypd8
tcactacagttgggc

SEQ ID NO: 59666 - DNA, 15 bp, Artificial Sequence
  dgRNA
  Omt2a
gcattaagactagag

SEQ ID NO: 59667 - DNA, 15 bp, Artificial Sequence
  dgRNA
  Kiz
tgtcttcgcccctcc

SEQ ID NO: 59668 - DNA, 15 bp, Artificial Sequence
  dgRNA
  Kiz
cccggacccacaccg

SEQ ID NO: 59669 - DNA, 15 bp, Artificial Sequence
  dgRNA
  Kiz
ctaaccccgcctcct

SEQ ID NO: 59670 - DNA, 15 bp, Artificial Sequence
  dgRNA
  Kiz
ggtgtgggtccggga

SEQ ID NO: 59671 - DNA, 15 bp, Artificial Sequence
  dgRNA
  Sox7
ggatcggggcaggct

SEQ ID NO: 59672 - DNA, 15 bp, Artificial Sequence
  dgRNA
  Sox7
gatcggggcaggctc

SEQ ID NO: 59673 - DNA, 15 bp, Artificial Sequence
  dgRNA
  Sox7
gctcgggaggcggag

SEQ ID NO: 59674 - DNA, 15 bp, Artificial Sequence
  dgRNA
  Sox7
ggcggaggggcggac

SEQ ID NO: 59675 - DNA, 15 bp, Artificial Sequence
  dgRNA
  Olfr1264
attactccaggagat

SEQ ID NO: 59676 - DNA, 15 bp, Artificial Sequence
  dgRNA
  Smco4
gtaaacagtccagcc

SEQ ID NO: 59677 - DNA, 15 bp, Artificial Sequence
  dgRNA
  Smco4
aacaattttagtagt

SEQ ID NO: 59678 - DNA, 15 bp, Artificial Sequence
  dgRNA
  Smco4
cctatcttagcacac

SEQ ID NO: 59679 - DNA, 15 bp, Artificial Sequence
  dgRNA
  Sap30l
cctggcaccggagac

SEQ ID NO: 59680 - DNA, 15 bp, Artificial Sequence
  dgRNA
  Sap30l
ggagaccggcagcga

SEQ ID NO: 59681 - DNA, 15 bp, Artificial Sequence
  dgRNA
  Sap30l
agcgatggcgcccaa

SEQ ID NO: 59682 - DNA, 15 bp, Artificial Sequence
  dgRNA
  Sap30l
gcgatggcgcccaat

SEQ ID NO: 59683 - DNA, 15 bp, Artificial Sequence
  dgRNA
  Wrnip1
agcagcgccacagaa

SEQ ID NO: 59684 - DNA, 15 bp, Artificial Sequence
  dgRNA
  Wrnip1
accgaagaagacgag

SEQ ID NO: 59685 - DNA, 15 bp, Artificial Sequence
  dgRNA
  Wrnip1
ccgaagaagacgaga

SEQ ID NO: 59686 - DNA, 15 bp, Artificial Sequence
  dgRNA
  Wrnip1
gagggcctgttgtga

SEQ ID NO: 59687 - DNA, 15 bp, Artificial Sequence
  dgRNA
  Stk16
ccaagtgggaaccct

SEQ ID NO: 59688 - DNA, 15 bp, Artificial Sequence
  dgRNA
  Stk16
aaaccaatacacccc

SEQ ID NO: 59689 - DNA, 15 bp, Artificial Sequence
  dgRNA
  Stk16
caccccaggtctagc

SEQ ID NO: 59690 - DNA, 15 bp, Artificial Sequence
  dgRNA
  Stk16
ccgcctcttgttgct

SEQ ID NO: 59691 - DNA, 15 bp, Artificial Sequence
  dgRNA
  Mcl1
ccgcgagccaaggcc

SEQ ID NO: 59692 - DNA, 15 bp, Artificial Sequence
  dgRNA
  Mcl1
cgccaaccgtagccg

SEQ ID NO: 59693 - DNA, 15 bp, Artificial Sequence
  dgRNA
  Mcl1
gccgcgagagcgctc

SEQ ID NO: 59694 - DNA, 15 bp, Artificial Sequence
  dgRNA
  Mcl1
cgagagcgctccggc

SEQ ID NO: 59695 - DNA, 15 bp, Artificial Sequence
  dgRNA
  1700113H08Rik
atctttttaagctga

SEQ ID NO: 59696 - DNA, 15 bp, Artificial Sequence
  dgRNA
  1700113H08Rik
gtccacttgcgatgc

SEQ ID NO: 59697 - DNA, 15 bp, Artificial Sequence
  dgRNA
  1700113H08Rik
gttgccgggagactg

SEQ ID NO: 59698 - DNA, 15 bp, Artificial Sequence
  dgRNA
  1700113H08Rik
ttgccgggagactga

SEQ ID NO: 59699 - DNA, 15 bp, Artificial Sequence
  dgRNA
  Paqr5
caaatttcagctaag

SEQ ID NO: 59700 - DNA, 15 bp, Artificial Sequence
  dgRNA
  Paqr5
gctaaggggcacctg

SEQ ID NO: 59701 - DNA, 15 bp, Artificial Sequence
  dgRNA
  Paqr5
aggctgaagggacgc

SEQ ID NO: 59702 - DNA, 15 bp, Artificial Sequence
  dgRNA
  Paqr5
cgcgggaagctttga

SEQ ID NO: 59703 - DNA, 15 bp, Artificial Sequence
  dgRNA
  Nsg2
acgtttgtcctatgc

SEQ ID NO: 59704 - DNA, 15 bp, Artificial Sequence
  dgRNA
  Nsg2
cgtttgtcctatgca

SEQ ID NO: 59705 - DNA, 15 bp, Artificial Sequence
  dgRNA
  Nsg2
gtttgtcctatgcag

SEQ ID NO: 59706 - DNA, 15 bp, Artificial Sequence
  dgRNA
  Nsg2
gtggtgccagatgac

SEQ ID NO: 59707 - DNA, 15 bp, Artificial Sequence
  dgRNA
  Defb45
tacagtgatatacct

SEQ ID NO: 59708 - DNA, 15 bp, Artificial Sequence
  dgRNA
  Defb45
taccttggccattgt

SEQ ID NO: 59709 - DNA, 15 bp, Artificial Sequence
  dgRNA
  Defb45
gacagactgtacccg

SEQ ID NO: 59710 - DNA, 15 bp, Artificial Sequence
  dgRNA
  Defb45
acagactgtacccgt

SEQ ID NO: 59711 - DNA, 15 bp, Artificial Sequence
  dgRNA
  Zmym2
tatttcactccactt

SEQ ID NO: 59712 - DNA, 15 bp, Artificial Sequence
  dgRNA
  Zmym2
gtaggctgttttgcg

SEQ ID NO: 59713 - DNA, 15 bp, Artificial Sequence
  dgRNA
  Zmym2
taggctgttttgcgt

SEQ ID NO: 59714 - DNA, 15 bp, Artificial Sequence
  dgRNA
  Zmym2
gttttgcgtgggctt

SEQ ID NO: 59715 - DNA, 15 bp, Artificial Sequence
  dgRNA
  Sphk1
agtcaccttctcgga

SEQ ID NO: 59716 - DNA, 15 bp, Artificial Sequence
  dgRNA
  Sphk1
ttctcggaaggcact

SEQ ID NO: 59717 - DNA, 15 bp, Artificial Sequence
  dgRNA
  Sphk1
tctcggaaggcactc

SEQ ID NO: 59718 - DNA, 15 bp, Artificial Sequence
  dgRNA
  Sphk1
ctcggaaggcactcg

SEQ ID NO: 59719 - DNA, 15 bp, Artificial Sequence
  dgRNA
  D2hgdh
tctagttcaggccta

SEQ ID NO: 59720 - DNA, 15 bp, Artificial Sequence
  dgRNA
  D2hgdh
ggcctacggttctgc

SEQ ID NO: 59721 - DNA, 15 bp, Artificial Sequence
  dgRNA
  D2hgdh
gcctacggttctgca

SEQ ID NO: 59722 - DNA, 15 bp, Artificial Sequence
  dgRNA
  D2hgdh
cctacggttctgcag

SEQ ID NO: 59723 - DNA, 15 bp, Artificial Sequence
  dgRNA
  Tmem184a
acaggtggccgtggt

SEQ ID NO: 59724 - DNA, 15 bp, Artificial Sequence
  dgRNA
  Tmem184a
ccgtggtgggccccc

SEQ ID NO: 59725 - DNA, 15 bp, Artificial Sequence
  dgRNA
  Tmem184a
cgtggtgggccccca

SEQ ID NO: 59726 - DNA, 15 bp, Artificial Sequence
  dgRNA
  Tmem184a
gtaggggcggtggcc

SEQ ID NO: 59727 - DNA, 15 bp, Artificial Sequence
  dgRNA
  Dnajc27
agcctttggcatgac

SEQ ID NO: 59728 - DNA, 15 bp, Artificial Sequence
  dgRNA
  Dnajc27
gcctttggcatgact

SEQ ID NO: 59729 - DNA, 15 bp, Artificial Sequence
  dgRNA
  Dnajc27
accaatcttgatgcc

SEQ ID NO: 59730 - DNA, 15 bp, Artificial Sequence
  dgRNA
  Dnajc27
ccaatcgcctgcaac

SEQ ID NO: 59731 - DNA, 15 bp, Artificial Sequence
  dgRNA
  Cfap46
caagagttcttgacc

SEQ ID NO: 59732 - DNA, 15 bp, Artificial Sequence
  dgRNA
  Cfap46
ctactcccagcgtca

SEQ ID NO: 59733 - DNA, 15 bp, Artificial Sequence
  dgRNA
  Cfap46
gagctcccgcgtcct

SEQ ID NO: 59734 - DNA, 15 bp, Artificial Sequence
  dgRNA
  Cfap46
cccgcgtccttggtc

SEQ ID NO: 59735 - DNA, 15 bp, Artificial Sequence
  dgRNA
  Cxx1c
ttgggtcccacccac

SEQ ID NO: 59736 - DNA, 15 bp, Artificial Sequence
  dgRNA
  Cxx1c
agcgcccccccgacc

SEQ ID NO: 59737 - DNA, 15 bp, Artificial Sequence
  dgRNA
  Cxx1c
ggggcgctcttctaa

SEQ ID NO: 59738 - DNA, 15 bp, Artificial Sequence
  dgRNA
  Cxx1c
gggggcgctcttcta

SEQ ID NO: 59739 - DNA, 15 bp, Artificial Sequence
  dgRNA
  Egln3
acaggttagctagag

SEQ ID NO: 59740 - DNA, 15 bp, Artificial Sequence
  dgRNA
  Egln3
cagcaccagtccaag

SEQ ID NO: 59741 - DNA, 15 bp, Artificial Sequence
  dgRNA
  Egln3
ggagggcagtcccgg

SEQ ID NO: 59742 - DNA, 15 bp, Artificial Sequence
  dgRNA
  Egln3
gcgggaccatgacgt

SEQ ID NO: 59743 - DNA, 15 bp, Artificial Sequence
  dgRNA
  Khsrp
ttccgaagctctgac

SEQ ID NO: 59744 - DNA, 15 bp, Artificial Sequence
  dgRNA
  Khsrp
ctctgactggtcgcc

SEQ ID NO: 59745 - DNA, 15 bp, Artificial Sequence
  dgRNA
  Khsrp
tttacggcccacgat

SEQ ID NO: 59746 - DNA, 15 bp, Artificial Sequence
  dgRNA
  Khsrp
acggcccacgattgg

SEQ ID NO: 59747 - DNA, 15 bp, Artificial Sequence
  dgRNA
  Cdh10
tctccgtgtgaggaa

SEQ ID NO: 59748 - DNA, 15 bp, Artificial Sequence
  dgRNA
  Cdh10
aagccgttcctcaca

SEQ ID NO: 59749 - DNA, 15 bp, Artificial Sequence
  dgRNA
  Cdh10
gaaccaaagaaagcg

SEQ ID NO: 59750 - DNA, 15 bp, Artificial Sequence
  dgRNA
  Cdh10
taactctggacggca

SEQ ID NO: 59751 - DNA, 15 bp, Artificial Sequence
  dgRNA
  Lect2
acacgcaggatccac

SEQ ID NO: 59752 - DNA, 15 bp, Artificial Sequence
  dgRNA
  Lect2
tatttctgatagcgt

SEQ ID NO: 59753 - DNA, 15 bp, Artificial Sequence
  dgRNA
  Lect2
ggctttggccggccg

SEQ ID NO: 59754 - DNA, 15 bp, Artificial Sequence
  dgRNA
  Lect2
gatcctgcgtgtttc

SEQ ID NO: 59755 - DNA, 15 bp, Artificial Sequence
  dgRNA
  Tymp
taacccgacccttaa

SEQ ID NO: 59756 - DNA, 15 bp, Artificial Sequence
  dgRNA
  Tymp
gacccttaaaggtcc

SEQ ID NO: 59757 - DNA, 15 bp, Artificial Sequence
  dgRNA
  Tymp
aattagccagatagc

SEQ ID NO: 59758 - DNA, 15 bp, Artificial Sequence
  dgRNA
  Tymp
agcttaagtggtgat

SEQ ID NO: 59759 - DNA, 15 bp, Artificial Sequence
  dgRNA
  Atr
ctttgttgggtcgtc

SEQ ID NO: 59760 - DNA, 15 bp, Artificial Sequence
  dgRNA
  Atr
ccagatcctagctta

SEQ ID NO: 59761 - DNA, 15 bp, Artificial Sequence
  dgRNA
  Atr
agcaaaaaatacccg

SEQ ID NO: 59762 - DNA, 15 bp, Artificial Sequence
  dgRNA
  Atr
aaatacccgtggagt

SEQ ID NO: 59763 - DNA, 15 bp, Artificial Sequence
  dgRNA
  Morn4
tgggactaatgagat

SEQ ID NO: 59764 - DNA, 15 bp, Artificial Sequence
  dgRNA
  Morn4
aagatggcacgaaag

SEQ ID NO: 59765 - DNA, 15 bp, Artificial Sequence
  dgRNA
  Morn4
agatggcacgaaaga

SEQ ID NO: 59766 - DNA, 15 bp, Artificial Sequence
  dgRNA
  Morn4
ggcacgaaagagggc

SEQ ID NO: 59767 - DNA, 15 bp, Artificial Sequence
  dgRNA
  9430020K01Rik
gcctgctccctaagg

SEQ ID NO: 59768 - DNA, 15 bp, Artificial Sequence
  dgRNA
  9430020K01Rik
aaccaagtcaggcgg

SEQ ID NO: 59769 - DNA, 15 bp, Artificial Sequence
  dgRNA
  9430020K01Rik
accaagtcaggcggt

SEQ ID NO: 59770 - DNA, 15 bp, Artificial Sequence
  dgRNA
  9430020K01Rik
aagtcaggcggtggg

SEQ ID NO: 59771 - DNA, 15 bp, Artificial Sequence
  dgRNA
  Gm6377
cccacccattttcat

SEQ ID NO: 59772 - DNA, 15 bp, Artificial Sequence
  dgRNA
  Gm6377
ttaggtttgcagtcc

SEQ ID NO: 59773 - DNA, 15 bp, Artificial Sequence
  dgRNA
  Gm6377
cccaatgaaaatggg

SEQ ID NO: 59774 - DNA, 15 bp, Artificial Sequence
  dgRNA
  Gm6377
accatgtaccaaaag

SEQ ID NO: 59775 - DNA, 15 bp, Artificial Sequence
  dgRNA
  Vmn2r94
gacccatgtattact

SEQ ID NO: 59776 - DNA, 15 bp, Artificial Sequence
  dgRNA
  Vmn2r94
actaggatgttctcc

SEQ ID NO: 59777 - DNA, 15 bp, Artificial Sequence
  dgRNA
  Vmn2r94
gacttaattcctgtc

SEQ ID NO: 59778 - DNA, 15 bp, Artificial Sequence
  dgRNA
  Vmn2r94
atcctagtaatacat

SEQ ID NO: 59779 - DNA, 15 bp, Artificial Sequence
  dgRNA
  Wbp1l
agatatgtcacgaga

SEQ ID NO: 59780 - DNA, 15 bp, Artificial Sequence
  dgRNA
  Wbp1l
tatgtcacgagaagg

SEQ ID NO: 59781 - DNA, 15 bp, Artificial Sequence
  dgRNA
  Wbp1l
atgtcacgagaaggt

SEQ ID NO: 59782 - DNA, 15 bp, Artificial Sequence
  dgRNA
  Wbp1l
gtcacgagaaggtgg

SEQ ID NO: 59783 - DNA, 15 bp, Artificial Sequence
  dgRNA
  Uri1
cagcgccaagcgaat

SEQ ID NO: 59784 - DNA, 15 bp, Artificial Sequence
  dgRNA
  Uri1
agcgccaagcgaatt

SEQ ID NO: 59785 - DNA, 15 bp, Artificial Sequence
  dgRNA
  Uri1
ctccaccccacccgg

SEQ ID NO: 59786 - DNA, 15 bp, Artificial Sequence
  dgRNA
  Uri1
tagccccgcccccta

SEQ ID NO: 59787 - DNA, 15 bp, Artificial Sequence
  dgRNA
  Ms4a13
cggccattctatctt

SEQ ID NO: 59788 - DNA, 15 bp, Artificial Sequence
  dgRNA
  Ms4a13
aagaggatcgaagtg

SEQ ID NO: 59789 - DNA, 15 bp, Artificial Sequence
  dgRNA
  Ms4a13
agaggatcgaagtga

SEQ ID NO: 59790 - DNA, 15 bp, Artificial Sequence
  dgRNA
  Ms4a13
tcgaagtgagggacc

SEQ ID NO: 59791 - DNA, 15 bp, Artificial Sequence
  dgRNA
  Gm6792
ggaatacaagcaagt

SEQ ID NO: 59792 - DNA, 15 bp, Artificial Sequence
  dgRNA
  Gm6792
atagcaggtgccagt

SEQ ID NO: 59793 - DNA, 15 bp, Artificial Sequence
  dgRNA
  Gm6792
atgagaatcaccagc

SEQ ID NO: 59794 - DNA, 15 bp, Artificial Sequence
  dgRNA
  Gm6792
cctccaggtcgctgg

SEQ ID NO: 59795 - DNA, 15 bp, Artificial Sequence
  dgRNA
  Olfr725
ataaagccttaatca

SEQ ID NO: 59796 - DNA, 15 bp, Artificial Sequence
  dgRNA
  Olfr725
tataaagccttaatc

SEQ ID NO: 59797 - DNA, 15 bp, Artificial Sequence
  dgRNA
  Ccdc137
cggttggggcactgg

SEQ ID NO: 59798 - DNA, 15 bp, Artificial Sequence
  dgRNA
  Ccdc137
cactggcggccgctc

SEQ ID NO: 59799 - DNA, 15 bp, Artificial Sequence
  dgRNA
  Ccdc137
cggccgctcaggccg

SEQ ID NO: 59800 - DNA, 15 bp, Artificial Sequence
  dgRNA
  Ccdc137
ggccgctcaggccgc

SEQ ID NO: 59801 - DNA, 15 bp, Artificial Sequence
  dgRNA
  R3hdm1
gtcccgcagtgataa

SEQ ID NO: 59802 - DNA, 15 bp, Artificial Sequence
  dgRNA
  R3hdm1
tcccgcagtgataat

SEQ ID NO: 59803 - DNA, 15 bp, Artificial Sequence
  dgRNA
  R3hdm1
cccgcagtgataatg

SEQ ID NO: 59804 - DNA, 15 bp, Artificial Sequence
  dgRNA
  R3hdm1
ccgcagtgataatgg

SEQ ID NO: 59805 - DNA, 15 bp, Artificial Sequence
  dgRNA
  Slc24a4
actgattgctcccgg

SEQ ID NO: 59806 - DNA, 15 bp, Artificial Sequence
  dgRNA
  Slc24a4
cgcgctgaagagcag

SEQ ID NO: 59807 - DNA, 15 bp, Artificial Sequence
  dgRNA
  Slc24a4
gcgctgaagagcagt

SEQ ID NO: 59808 - DNA, 15 bp, Artificial Sequence
  dgRNA
  Slc24a4
gcggctccaagcgcc

SEQ ID NO: 59809 - DNA, 15 bp, Artificial Sequence
  dgRNA
  Fkbp3
gcgccacgcatgccc

SEQ ID NO: 59810 - DNA, 15 bp, Artificial Sequence
  dgRNA
  Fkbp3
cacccttcagggccg

SEQ ID NO: 59811 - DNA, 15 bp, Artificial Sequence
  dgRNA
  Fkbp3
gctgcgtagaaagtg

SEQ ID NO: 59812 - DNA, 15 bp, Artificial Sequence
  dgRNA
  Fkbp3
ctgcgtagaaagtgt

SEQ ID NO: 59813 - DNA, 15 bp, Artificial Sequence
  dgRNA
  Sptlc2
gctccacctacgacc

SEQ ID NO: 59814 - DNA, 15 bp, Artificial Sequence
  dgRNA
  Sptlc2
acctacgacctggct

SEQ ID NO: 59815 - DNA, 15 bp, Artificial Sequence
  dgRNA
  Sptlc2
cctacgacctggcta

SEQ ID NO: 59816 - DNA, 15 bp, Artificial Sequence
  dgRNA
  Sptlc2
cgcccctctcgcctt

SEQ ID NO: 59817 - DNA, 15 bp, Artificial Sequence
  dgRNA
  Ccdc160
cagtggccgccctac

SEQ ID NO: 59818 - DNA, 15 bp, Artificial Sequence
  dgRNA
  Ccdc160
agtggccgccctacc

SEQ ID NO: 59819 - DNA, 15 bp, Artificial Sequence
  dgRNA
  Ccdc160
tcaacctgcagcgac

SEQ ID NO: 59820 - DNA, 15 bp, Artificial Sequence
  dgRNA
  Ccdc160
ttaaatccatccgcc

SEQ ID NO: 59821 - DNA, 15 bp, Artificial Sequence
  dgRNA
  Orc2
ggctgtcccagtttc

SEQ ID NO: 59822 - DNA, 15 bp, Artificial Sequence
  dgRNA
  Orc2
aaggggtcacaccaa

SEQ ID NO: 59823 - DNA, 15 bp, Artificial Sequence
  dgRNA
  Lonp2
gagtgacagaccgga

SEQ ID NO: 59824 - DNA, 15 bp, Artificial Sequence
  dgRNA
  Lonp2
aaggcttagccgctg

SEQ ID NO: 59825 - DNA, 15 bp, Artificial Sequence
  dgRNA
  Lonp2
agccgctgcggcctc

SEQ ID NO: 59826 - DNA, 15 bp, Artificial Sequence
  dgRNA
  Lonp2
gctgcggcctccgga

SEQ ID NO: 59827 - DNA, 15 bp, Artificial Sequence
  dgRNA
  Tsc1
gagacgcttcacgcc

SEQ ID NO: 59828 - DNA, 15 bp, Artificial Sequence
  dgRNA
  Tsc1
agacgcttcacgcca

SEQ ID NO: 59829 - DNA, 15 bp, Artificial Sequence
  dgRNA
  Tsc1
gacgcttcacgccag

SEQ ID NO: 59830 - DNA, 15 bp, Artificial Sequence
  dgRNA
  Tsc1
acgcttcacgccagg

SEQ ID NO: 59831 - DNA, 15 bp, Artificial Sequence
  dgRNA
  Zfp2
taggggagcaatcgc

SEQ ID NO: 59832 - DNA, 15 bp, Artificial Sequence
  dgRNA
  Zfp2
ttgcgcctgcgcaac

SEQ ID NO: 59833 - DNA, 15 bp, Artificial Sequence
  dgRNA
  Zfp2
ctggaagccctgtcg

SEQ ID NO: 59834 - DNA, 15 bp, Artificial Sequence
  dgRNA
  Zfp2
tggaagccctgtcga

SEQ ID NO: 59835 - DNA, 15 bp, Artificial Sequence
  dgRNA
  Eno4
gaacagtgacaaacg

SEQ ID NO: 59836 - DNA, 15 bp, Artificial Sequence
  dgRNA
  Eno4
cgaagcattgaagaa

SEQ ID NO: 59837 - DNA, 15 bp, Artificial Sequence
  dgRNA
  Eno4
aaggcgaagtgcgga

SEQ ID NO: 59838 - DNA, 15 bp, Artificial Sequence
  dgRNA
  Eno4
aggcgaagtgcggac

SEQ ID NO: 59839 - DNA, 15 bp, Artificial Sequence
  dgRNA
  Ints12
ccgcccagctcgagc

SEQ ID NO: 59840 - DNA, 15 bp, Artificial Sequence
  dgRNA
  Ints12
cgcccagctcgagcc

SEQ ID NO: 59841 - DNA, 15 bp, Artificial Sequence
  dgRNA
  Ints12
cgagccgggactccg

SEQ ID NO: 59842 - DNA, 15 bp, Artificial Sequence
  dgRNA
  Ints12
ctccgaggctacttc

SEQ ID NO: 59843 - DNA, 15 bp, Artificial Sequence
  dgRNA
  Gls
cgctcaagggagggc

SEQ ID NO: 59844 - DNA, 15 bp, Artificial Sequence
  dgRNA
  Iqca
cagttgccacggaaa

SEQ ID NO: 59845 - DNA, 15 bp, Artificial Sequence
  dgRNA
  Iqca
aacggaaacataagc

SEQ ID NO: 59846 - DNA, 15 bp, Artificial Sequence
  dgRNA
  Iqca
ctgaagacgctctag

SEQ ID NO: 59847 - DNA, 15 bp, Artificial Sequence
  dgRNA
  Iqca
tgaagacgctctagt

SEQ ID NO: 59848 - DNA, 15 bp, Artificial Sequence
  dgRNA
  Ccdc155
gaaactataatagtt

SEQ ID NO: 59849 - DNA, 15 bp, Artificial Sequence
  dgRNA
  Ccdc155
gggtacctattaatg

SEQ ID NO: 59850 - DNA, 15 bp, Artificial Sequence
  dgRNA
  Ccdc155
ggtacctattaatgc

SEQ ID NO: 59851 - DNA, 15 bp, Artificial Sequence
  dgRNA
  Ccdc155
gtacctattaatgcg

SEQ ID NO: 59852 - DNA, 15 bp, Artificial Sequence
  dgRNA
  Bambi
acttgccagcgccag

SEQ ID NO: 59853 - DNA, 15 bp, Artificial Sequence
  dgRNA
  Bambi
cttgccagcgccagc

SEQ ID NO: 59854 - DNA, 15 bp, Artificial Sequence
  dgRNA
  Bambi
gcgccagcgggagcc

SEQ ID NO: 59855 - DNA, 15 bp, Artificial Sequence
  dgRNA
  Bambi
ccagcgggagcccgg

SEQ ID NO: 59856 - DNA, 15 bp, Artificial Sequence
  dgRNA
  Uspl1
gcgctggagtggcgg

SEQ ID NO: 59857 - DNA, 15 bp, Artificial Sequence
  dgRNA
  Uspl1
gctgctggaaagcgc

SEQ ID NO: 59858 - DNA, 15 bp, Artificial Sequence
  dgRNA
  Slc51a
agtactgaccacgtg

SEQ ID NO: 59859 - DNA, 15 bp, Artificial Sequence
  dgRNA
  Slc51a
tcttcttgacctatc

SEQ ID NO: 59860 - DNA, 15 bp, Artificial Sequence
  dgRNA
  Slc51a
cttagcacgtggtgg

SEQ ID NO: 59861 - DNA, 15 bp, Artificial Sequence
  dgRNA
  Slc51a
gcttagcacgtggtg

SEQ ID NO: 59862 - DNA, 15 bp, Artificial Sequence
  dgRNA
  Olfr1362
caaaatttgccaacg

SEQ ID NO: 59863 - DNA, 15 bp, Artificial Sequence
  dgRNA
  Olfr1362
tacttggtagttaaa

SEQ ID NO: 59864 - DNA, 15 bp, Artificial Sequence
  dgRNA
  Olfr1362
aaaggacgtctgcta

SEQ ID NO: 59865 - DNA, 15 bp, Artificial Sequence
  dgRNA
  Olfr1362
gacgtctgctatgga

SEQ ID NO: 59866 - DNA, 15 bp, Artificial Sequence
  dgRNA
  Myh1
ttaacccaatgtgag

SEQ ID NO: 59867 - DNA, 15 bp, Artificial Sequence
  dgRNA
  Myh1
gaggggaattaggct

SEQ ID NO: 59868 - DNA, 15 bp, Artificial Sequence
  dgRNA
  Myh1
tataaaagtacccct

SEQ ID NO: 59869 - DNA, 15 bp, Artificial Sequence
  dgRNA
  Myh1
catattaaggatgtt

SEQ ID NO: 59870 - DNA, 15 bp, Artificial Sequence
  dgRNA
  Hrh2
gcggctttcagaacg

SEQ ID NO: 59871 - DNA, 15 bp, Artificial Sequence
  dgRNA
  Hrh2
gctttcagaacgagg

SEQ ID NO: 59872 - DNA, 15 bp, Artificial Sequence
  dgRNA
  Hrh2
cgaggaggagcgagt

SEQ ID NO: 59873 - DNA, 15 bp, Artificial Sequence
  dgRNA
  Hrh2
cggggacgaggaagt

SEQ ID NO: 59874 - DNA, 15 bp, Artificial Sequence
  dgRNA
  Xab2
gcccaagggccaata

SEQ ID NO: 59875 - DNA, 15 bp, Artificial Sequence
  dgRNA
  Xab2
gggccaatacggaag

SEQ ID NO: 59876 - DNA, 15 bp, Artificial Sequence
  dgRNA
  Xab2
aatacggaagcggag

SEQ ID NO: 59877 - DNA, 15 bp, Artificial Sequence
  dgRNA
  Xab2
ggaagcggagtggtc

SEQ ID NO: 59878 - DNA, 15 bp, Artificial Sequence
  dgRNA
  Eif4b
acaagtctgtgcgcc

SEQ ID NO: 59879 - DNA, 15 bp, Artificial Sequence
  dgRNA
  Eif4b
caggagactccgccc

SEQ ID NO: 59880 - DNA, 15 bp, Artificial Sequence
  dgRNA
  Eif4b
aggagactccgcccc

SEQ ID NO: 59881 - DNA, 15 bp, Artificial Sequence
  dgRNA
  Eif4b
gccccgggcgcagat

SEQ ID NO: 59882 - DNA, 15 bp, Artificial Sequence
  dgRNA
  Cd3eap
gcgtttctgacgaac

SEQ ID NO: 59883 - DNA, 15 bp, Artificial Sequence
  dgRNA
  Cd3eap
cgtttctgacgaaca

SEQ ID NO: 59884 - DNA, 15 bp, Artificial Sequence
  dgRNA
  Cd3eap
ctgatttccccctgc

SEQ ID NO: 59885 - DNA, 15 bp, Artificial Sequence
  dgRNA
  Cd3eap
gagtggaggttatcc

SEQ ID NO: 59886 - DNA, 15 bp, Artificial Sequence
  dgRNA
  Prdm13
tatcgtaactgtctc

SEQ ID NO: 59887 - DNA, 15 bp, Artificial Sequence
  dgRNA
  Prdm13
atcgtaactgtctca

SEQ ID NO: 59888 - DNA, 15 bp, Artificial Sequence
  dgRNA
  Prdm13
caataccccatgctg

SEQ ID NO: 59889 - DNA, 15 bp, Artificial Sequence
  dgRNA
  Prdm13
gattaatggtcccgc

SEQ ID NO: 59890 - DNA, 15 bp, Artificial Sequence
  dgRNA
  Fmod
gacatctggctacaa

SEQ ID NO: 59891 - DNA, 15 bp, Artificial Sequence
  dgRNA
  Fmod
acatctggctacaag

SEQ ID NO: 59892 - DNA, 15 bp, Artificial Sequence
  dgRNA
  Fmod
agtgcagactcccgg

SEQ ID NO: 59893 - DNA, 15 bp, Artificial Sequence
  dgRNA
  Fmod
gtgcagactcccgga

SEQ ID NO: 59894 - DNA, 15 bp, Artificial Sequence
  dgRNA
  Prr18
cgcccctgcgaatgt

SEQ ID NO: 59895 - DNA, 15 bp, Artificial Sequence
  dgRNA
  Prr18
gcccctgcgaatgtc

SEQ ID NO: 59896 - DNA, 15 bp, Artificial Sequence
  dgRNA
  Prr18
tagcagcccgggact

SEQ ID NO: 59897 - DNA, 15 bp, Artificial Sequence
  dgRNA
  Prr18
cagcccggcgcgtct

SEQ ID NO: 59898 - DNA, 15 bp, Artificial Sequence
  dgRNA
  Tusc3
ccagcgttgggtcag

SEQ ID NO: 59899 - DNA, 15 bp, Artificial Sequence
  dgRNA
  Tusc3
gcccactaagcacac

SEQ ID NO: 59900 - DNA, 15 bp, Artificial Sequence
  dgRNA
  Tusc3
ctctgacccaacgct

SEQ ID NO: 59901 - DNA, 15 bp, Artificial Sequence
  dgRNA
  Tusc3
cctctgacccaacgc

SEQ ID NO: 59902 - DNA, 15 bp, Artificial Sequence
  dgRNA
  Olfr1270
aatgttagtgtacta

SEQ ID NO: 59903 - DNA, 15 bp, Artificial Sequence
  dgRNA
  Olfr1270
ggaatgattagtaag

SEQ ID NO: 59904 - DNA, 15 bp, Artificial Sequence
  dgRNA
  Olfr1270
gaatgattagtaagt

SEQ ID NO: 59905 - DNA, 15 bp, Artificial Sequence
  dgRNA
  Fbxo21
gaatcaggacgcgaa

SEQ ID NO: 59906 - DNA, 15 bp, Artificial Sequence
  dgRNA
  Fbxo21
gtcctccaagcggag

SEQ ID NO: 59907 - DNA, 15 bp, Artificial Sequence
  dgRNA
  Fbxo21
tccaagcggagtggg

SEQ ID NO: 59908 - DNA, 15 bp, Artificial Sequence
  dgRNA
  Fbxo21
ccaagcggagtgggc

SEQ ID NO: 59909 - DNA, 15 bp, Artificial Sequence
  dgRNA
  Dyrk1a
cgctgctgccgatcg

SEQ ID NO: 59910 - DNA, 15 bp, Artificial Sequence
  dgRNA
  Dyrk1a
tgccgatcgcggccc

SEQ ID NO: 59911 - DNA, 15 bp, Artificial Sequence
  dgRNA
  Dyrk1a
gatcgcggcccaggt

SEQ ID NO: 59912 - DNA, 15 bp, Artificial Sequence
  dgRNA
  Dyrk1a
atcgcggcccaggtc

SEQ ID NO: 59913 - DNA, 15 bp, Artificial Sequence
  dgRNA
  Klhl33
ttccaatgtattccg

SEQ ID NO: 59914 - DNA, 15 bp, Artificial Sequence
  dgRNA
  Klhl33
atgtattccgtggct

SEQ ID NO: 59915 - DNA, 15 bp, Artificial Sequence
  dgRNA
  Klhl33
ccgtggcttggccta

SEQ ID NO: 59916 - DNA, 15 bp, Artificial Sequence
  dgRNA
  Klhl33
ggcctatggccttgc

SEQ ID NO: 59917 - DNA, 15 bp, Artificial Sequence
  dgRNA
  Cd300lg
catgatgaattacac

SEQ ID NO: 59918 - DNA, 15 bp, Artificial Sequence
  dgRNA
  Cd300lg
gattaaggctaagta

SEQ ID NO: 59919 - DNA, 15 bp, Artificial Sequence
  dgRNA
  Cd300lg
attaaggctaagtag

SEQ ID NO: 59920 - DNA, 15 bp, Artificial Sequence
  dgRNA
  Cd300lg
aggctaagtaggggc

SEQ ID NO: 59921 - DNA, 15 bp, Artificial Sequence
  dgRNA
  Sfmbt1
cgcgagcaaagcggc

SEQ ID NO: 59922 - DNA, 15 bp, Artificial Sequence
  dgRNA
  Sfmbt1
caaagcggcgggtta

SEQ ID NO: 59923 - DNA, 15 bp, Artificial Sequence
  dgRNA
  Sfmbt1
ggcgggttatggacc

SEQ ID NO: 59924 - DNA, 15 bp, Artificial Sequence
  dgRNA
  Sfmbt1
gcgggttatggaccc

SEQ ID NO: 59925 - DNA, 15 bp, Artificial Sequence
  dgRNA
  Phlda1
tacccacccccgcag

SEQ ID NO: 59926 - DNA, 15 bp, Artificial Sequence
  dgRNA
  Phlda1
agagcccacctgcta

SEQ ID NO: 59927 - DNA, 15 bp, Artificial Sequence
  dgRNA
  Phlda1
ggaagggccggtccg

SEQ ID NO: 59928 - DNA, 15 bp, Artificial Sequence
  dgRNA
  Phlda1
gaagggccggtccgt

SEQ ID NO: 59929 - DNA, 15 bp, Artificial Sequence
  dgRNA
  Thrb
taatcacgtggaaag

SEQ ID NO: 59930 - DNA, 15 bp, Artificial Sequence
  dgRNA
  Thrb
tggccccagcataat

SEQ ID NO: 59931 - DNA, 15 bp, Artificial Sequence
  dgRNA
  Thrb
tctttccacgtgatt

SEQ ID NO: 59932 - DNA, 15 bp, Artificial Sequence
  dgRNA
  Thrb
gtgcctattatgctg

SEQ ID NO: 59933 - DNA, 15 bp, Artificial Sequence
  dgRNA
  Hist1h2bf
aaggacctatgccat

SEQ ID NO: 59934 - DNA, 15 bp, Artificial Sequence
  dgRNA
  Hist1h2bf
aatgagaagcattcg

SEQ ID NO: 59935 - DNA, 15 bp, Artificial Sequence
  dgRNA
  Hist1h2bf
ggggcgcacgttgat

SEQ ID NO: 59936 - DNA, 15 bp, Artificial Sequence
  dgRNA
  Hist1h2bf
gggcgcacgttgatt

SEQ ID NO: 59937 - DNA, 15 bp, Artificial Sequence
  dgRNA
  Oat
gagctcaagcgccac

SEQ ID NO: 59938 - DNA, 15 bp, Artificial Sequence
  dgRNA
  Oat
agcagactgcgcact

SEQ ID NO: 59939 - DNA, 15 bp, Artificial Sequence
  dgRNA
  Oat
gcagactgcgcactt

SEQ ID NO: 59940 - DNA, 15 bp, Artificial Sequence
  dgRNA
  Oat
cagactgcgcacttg

SEQ ID NO: 59941 - DNA, 15 bp, Artificial Sequence
  dgRNA
  Ccdc191
gccagaattacgcaa

SEQ ID NO: 59942 - DNA, 15 bp, Artificial Sequence
  dgRNA
  Ccdc191
ccgcgcaacgcctcc

SEQ ID NO: 59943 - DNA, 15 bp, Artificial Sequence
  dgRNA
  Ccdc191
cgcgcaacgcctcct

SEQ ID NO: 59944 - DNA, 15 bp, Artificial Sequence
  dgRNA
  Ccdc191
tgggagtagtagttc

SEQ ID NO: 59945 - DNA, 15 bp, Artificial Sequence
  dgRNA
  Tmem56
gcttgcggtccttca

SEQ ID NO: 59946 - DNA, 15 bp, Artificial Sequence
  dgRNA
  Tmem56
cttgcggtccttcaa

SEQ ID NO: 59947 - DNA, 15 bp, Artificial Sequence
  dgRNA
  Tmem56
tcaagggtgttctcc

SEQ ID NO: 59948 - DNA, 15 bp, Artificial Sequence
  dgRNA
  Tmem56
caagggtgttctccg

SEQ ID NO: 59949 - DNA, 15 bp, Artificial Sequence
  dgRNA
  Cbx2
cgcttcgccgccctc

SEQ ID NO: 59950 - DNA, 15 bp, Artificial Sequence
  dgRNA
  Cbx2
caatagctttccgca

SEQ ID NO: 59951 - DNA, 15 bp, Artificial Sequence
  dgRNA
  Cbx2
cagggacctgcgatc

SEQ ID NO: 59952 - DNA, 15 bp, Artificial Sequence
  dgRNA
  Cbx2
acctgcgatccggag

SEQ ID NO: 59953 - DNA, 15 bp, Artificial Sequence
  dgRNA
  Olfr498
tcacagatttaatct

SEQ ID NO: 59954 - DNA, 15 bp, Artificial Sequence
  dgRNA
  Olfr498
cagttaaccggggca

SEQ ID NO: 59955 - DNA, 15 bp, Artificial Sequence
  dgRNA
  Olfr498
catttcagttaaccg

SEQ ID NO: 59956 - DNA, 15 bp, Artificial Sequence
  dgRNA
  Olfr498
tcatttcagttaacc

SEQ ID NO: 59957 - DNA, 15 bp, Artificial Sequence
  dgRNA
  Sohlh1
gtctgcacgtgaagc

SEQ ID NO: 59958 - DNA, 15 bp, Artificial Sequence
  dgRNA
  Sohlh1
agtcaaacacgagaa

SEQ ID NO: 59959 - DNA, 15 bp, Artificial Sequence
  dgRNA
  Sohlh1
gtcaaacacgagaag

SEQ ID NO: 59960 - DNA, 15 bp, Artificial Sequence
  dgRNA
  Sohlh1
acacgagaaggggcg

SEQ ID NO: 59961 - DNA, 15 bp, Artificial Sequence
  dgRNA
  Fam167b
gggccaagccggctg

SEQ ID NO: 59962 - DNA, 15 bp, Artificial Sequence
  dgRNA
  Fam167b
ctgcccccacccgga

SEQ ID NO: 59963 - DNA, 15 bp, Artificial Sequence
  dgRNA
  Fam167b
tgcccccacccggat

SEQ ID NO: 59964 - DNA, 15 bp, Artificial Sequence
  dgRNA
  Fam167b
cggatgggcatcacg

SEQ ID NO: 59965 - DNA, 15 bp, Artificial Sequence
  dgRNA
  Tmem150b
gatctaaatgtatta

SEQ ID NO: 59966 - DNA, 15 bp, Artificial Sequence
  dgRNA
  Tmem150b
aaggtgagggcccta

SEQ ID NO: 59967 - DNA, 15 bp, Artificial Sequence
  dgRNA
  Tmem150b
ggccctaagggaacc

SEQ ID NO: 59968 - DNA, 15 bp, Artificial Sequence
  dgRNA
  Tmem150b
gggaacccggagcct

SEQ ID NO: 59969 - DNA, 15 bp, Artificial Sequence
  dgRNA
  Slc4a10
gagtgcccggctgag

SEQ ID NO: 59970 - DNA, 15 bp, Artificial Sequence
  dgRNA
  Slc4a10
gttctgtaacacctc

SEQ ID NO: 59971 - DNA, 15 bp, Artificial Sequence
  dgRNA
  Anp32b
ccggaagaaggcgcg

SEQ ID NO: 59972 - DNA, 15 bp, Artificial Sequence
  dgRNA
  Anp32b
tgcccgtcgacctcc

SEQ ID NO: 59973 - DNA, 15 bp, Artificial Sequence
  dgRNA
  Anp32b
ggagagcgcgggtgc

SEQ ID NO: 59974 - DNA, 15 bp, Artificial Sequence
  dgRNA
  Anp32b
gagcgcgggtgccgg

SEQ ID NO: 59975 - DNA, 15 bp, Artificial Sequence
  dgRNA
  Apba2
tcaagggattcgggc

SEQ ID NO: 59976 - DNA, 15 bp, Artificial Sequence
  dgRNA
  Apba2
gggattcgggccggc

SEQ ID NO: 59977 - DNA, 15 bp, Artificial Sequence
  dgRNA
  Apba2
ggattcgggccggcc

SEQ ID NO: 59978 - DNA, 15 bp, Artificial Sequence
  dgRNA
  Apba2
gattcgggccggccg

SEQ ID NO: 59979 - DNA, 15 bp, Artificial Sequence
  dgRNA
  Hsd11b1
tggattggctacccc

SEQ ID NO: 59980 - DNA, 15 bp, Artificial Sequence
  dgRNA
  Hsd11b1
ttggctacccctggc

SEQ ID NO: 59981 - DNA, 15 bp, Artificial Sequence
  dgRNA
  Hsd11b1
atacattgtatcagg

SEQ ID NO: 59982 - DNA, 15 bp, Artificial Sequence
  dgRNA
  Hsd11b1
ccagccataaccatt

SEQ ID NO: 59983 - DNA, 15 bp, Artificial Sequence
  dgRNA
  Slco2b1
ggaggtactatgcat

SEQ ID NO: 59984 - DNA, 15 bp, Artificial Sequence
  dgRNA
  Slco2b1
gtactgagcctttcc

SEQ ID NO: 59985 - DNA, 15 bp, Artificial Sequence
  dgRNA
  Slco2b1
gcagccttgcaccac

SEQ ID NO: 59986 - DNA, 15 bp, Artificial Sequence
  dgRNA
  Slco2b1
cactcattcccggaa

SEQ ID NO: 59987 - DNA, 15 bp, Artificial Sequence
  dgRNA
  Samhd1
gcttgcgcaatgggc

SEQ ID NO: 59988 - DNA, 15 bp, Artificial Sequence
  dgRNA
  Samhd1
cttgcgcaatgggcc

SEQ ID NO: 59989 - DNA, 15 bp, Artificial Sequence
  dgRNA
  Samhd1
cgggcgcgagcgccc

SEQ ID NO: 59990 - DNA, 15 bp, Artificial Sequence
  dgRNA
  Samhd1
gggcgcgagcgcccc

SEQ ID NO: 59991 - DNA, 15 bp, Artificial Sequence
  dgRNA
  Pisd
tcgtgactgagcaca

SEQ ID NO: 59992 - DNA, 15 bp, Artificial Sequence
  dgRNA
  Pisd
agatttttcgggcac

SEQ ID NO: 59993 - DNA, 15 bp, Artificial Sequence
  dgRNA
  Pisd
tttcgggcacaggag

SEQ ID NO: 59994 - DNA, 15 bp, Artificial Sequence
  dgRNA
  Pisd
gctgtcccatcgccc

SEQ ID NO: 59995 - DNA, 15 bp, Artificial Sequence
  dgRNA
  Cyb5d2
tcacgttcagaatct

SEQ ID NO: 59996 - DNA, 15 bp, Artificial Sequence
  dgRNA
  Cyb5d2
gcagaggcggctaga

SEQ ID NO: 59997 - DNA, 15 bp, Artificial Sequence
  dgRNA
  Cyb5d2
cgtggagcagaaaag

SEQ ID NO: 59998 - DNA, 15 bp, Artificial Sequence
  dgRNA
  Cyb5d2
gcgtggagcagaaaa

SEQ ID NO: 59999 - DNA, 15 bp, Artificial Sequence
  dgRNA
  Memo1
ccggggggcggctcg

SEQ ID NO: 60000 - DNA, 15 bp, Artificial Sequence
  dgRNA
  Memo1
ctcgcggaagcagct

SEQ ID NO: 60001 - DNA, 15 bp, Artificial Sequence
  dgRNA
  Memo1
ggaagcagctcgggc

SEQ ID NO: 60002 - DNA, 15 bp, Artificial Sequence
  dgRNA
  Memo1
gaagcagctcgggca

SEQ ID NO: 60003 - DNA, 15 bp, Artificial Sequence
  dgRNA
  Lgals1
agactccacttctgg

SEQ ID NO: 60004 - DNA, 15 bp, Artificial Sequence
  dgRNA
  Lgals1
gtcctgacatgcaat

SEQ ID NO: 60005 - DNA, 15 bp, Artificial Sequence
  dgRNA
  Lgals1
aattggctgaactcc

SEQ ID NO: 60006 - DNA, 15 bp, Artificial Sequence
  dgRNA
  Lgals1
ttggctgaactcccg

SEQ ID NO: 60007 - DNA, 15 bp, Artificial Sequence
  dgRNA
  Gm5150
gattctggtcccgac

SEQ ID NO: 60008 - DNA, 15 bp, Artificial Sequence
  dgRNA
  Gm5150
attctggtcccgaca

SEQ ID NO: 60009 - DNA, 15 bp, Artificial Sequence
  dgRNA
  Olfr683
tatgctatctccttg

SEQ ID NO: 60010 - DNA, 15 bp, Artificial Sequence
  dgRNA
  Olfr683
ggtattcatagtgag

SEQ ID NO: 60011 - DNA, 15 bp, Artificial Sequence
  dgRNA
  Olfr683
ctatgaatacccaca

SEQ ID NO: 60012 - DNA, 15 bp, Artificial Sequence
  dgRNA
  Kcnn2
acccgcgtttatttt

SEQ ID NO: 60013 - DNA, 15 bp, Artificial Sequence
  dgRNA
  Kcnn2
cgcacgcacacccct

SEQ ID NO: 60014 - DNA, 15 bp, Artificial Sequence
  dgRNA
  Kcnn2
ccctcggtagcctca

SEQ ID NO: 60015 - DNA, 15 bp, Artificial Sequence
  dgRNA
  Kcnn2
acaaccctgatcagt

SEQ ID NO: 60016 - DNA, 15 bp, Artificial Sequence
  dgRNA
  Tma16
ctccccgcctttgtg

SEQ ID NO: 60017 - DNA, 15 bp, Artificial Sequence
  dgRNA
  Tma16
ccgggctgtaaaaca

SEQ ID NO: 60018 - DNA, 15 bp, Artificial Sequence
  dgRNA
  Tma16
gtaaaacaaggcggg

SEQ ID NO: 60019 - DNA, 15 bp, Artificial Sequence
  dgRNA
  Tma16
tacgtctcagtttct

SEQ ID NO: 60020 - DNA, 15 bp, Artificial Sequence
  dgRNA
  Olfr770
tatgaaccagttgtt

SEQ ID NO: 60021 - DNA, 15 bp, Artificial Sequence
  dgRNA
  Abcd2
ctcctgtttaagtat

SEQ ID NO: 60022 - DNA, 15 bp, Artificial Sequence
  dgRNA
  Abcd2
ctctcttcgttttta

SEQ ID NO: 60023 - DNA, 15 bp, Artificial Sequence
  dgRNA
  Abcd2
ccaatgagacgcctg

SEQ ID NO: 60024 - DNA, 15 bp, Artificial Sequence
  dgRNA
  Abcd2
caatgagacgcctgt

SEQ ID NO: 60025 - DNA, 15 bp, Artificial Sequence
  dgRNA
  Arhgef4
taattgctgcagctc

SEQ ID NO: 60026 - DNA, 15 bp, Artificial Sequence
  dgRNA
  Arhgef4
caacccaggctttag

SEQ ID NO: 60027 - DNA, 15 bp, Artificial Sequence
  dgRNA
  Tmem180
ggagataagtacttc

SEQ ID NO: 60028 - DNA, 15 bp, Artificial Sequence
  dgRNA
  Tmem180
gtacttcaggaatcc

SEQ ID NO: 60029 - DNA, 15 bp, Artificial Sequence
  dgRNA
  Tmem180
atgcccgttttcttt

SEQ ID NO: 60030 - DNA, 15 bp, Artificial Sequence
  dgRNA
  Tmem180
tgcccgttttctttt

SEQ ID NO: 60031 - DNA, 15 bp, Artificial Sequence
  dgRNA
  Olfr11
taatgttttagcata

SEQ ID NO: 60032 - DNA, 15 bp, Artificial Sequence
  dgRNA
  Gpbp1l1
ccggcgtcgcgccga

SEQ ID NO: 60033 - DNA, 15 bp, Artificial Sequence
  dgRNA
  Gpbp1l1
cggcgtcgcgccgaa

SEQ ID NO: 60034 - DNA, 15 bp, Artificial Sequence
  dgRNA
  Gpbp1l1
cgcgccgaagggcgc

SEQ ID NO: 60035 - DNA, 15 bp, Artificial Sequence
  dgRNA
  Gpbp1l1
gcgccgaagggcgcc

SEQ ID NO: 60036 - DNA, 15 bp, Artificial Sequence
  dgRNA
  Sorcs2
gcggtggcttgcgcg

SEQ ID NO: 60037 - DNA, 15 bp, Artificial Sequence
  dgRNA
  Sorcs2
tggcttgcgcgcggc

SEQ ID NO: 60038 - DNA, 15 bp, Artificial Sequence
  dgRNA
  Sorcs2
ttgcgcgcggccggc

SEQ ID NO: 60039 - DNA, 15 bp, Artificial Sequence
  dgRNA
  Sorcs2
cgcgcggccggcagg

SEQ ID NO: 60040 - DNA, 15 bp, Artificial Sequence
  dgRNA
  Dscr3
agcagccgcagagcg

SEQ ID NO: 60041 - DNA, 15 bp, Artificial Sequence
  dgRNA
  Dscr3
cgcttcccgaaacct

SEQ ID NO: 60042 - DNA, 15 bp, Artificial Sequence
  dgRNA
  Dscr3
cttggctctgcgtcg

SEQ ID NO: 60043 - DNA, 15 bp, Artificial Sequence
  dgRNA
  Dscr3
ttggctctgcgtcgt

SEQ ID NO: 60044 - DNA, 15 bp, Artificial Sequence
  dgRNA
  Tmsb15b1
aagatgtgtccaatc

SEQ ID NO: 60045 - DNA, 15 bp, Artificial Sequence
  dgRNA
  Tmsb15b1
cagggacgcctgtgt

SEQ ID NO: 60046 - DNA, 15 bp, Artificial Sequence
  dgRNA
  Tmsb15b1
agggacgcctgtgta

SEQ ID NO: 60047 - DNA, 15 bp, Artificial Sequence
  dgRNA
  Tmsb15b1
tgattggacacatct

SEQ ID NO: 60048 - DNA, 15 bp, Artificial Sequence
  dgRNA
  Frzb
actttctgcaggcgg

SEQ ID NO: 60049 - DNA, 15 bp, Artificial Sequence
  dgRNA
  Frzb
ggcggaggtgcgctc

SEQ ID NO: 60050 - DNA, 15 bp, Artificial Sequence
  dgRNA
  Frzb
ctcgggtttgctgtg

SEQ ID NO: 60051 - DNA, 15 bp, Artificial Sequence
  dgRNA
  Frzb
gagctgcgggcaacg

SEQ ID NO: 60052 - DNA, 15 bp, Artificial Sequence
  dgRNA
  Col18a1
taccagattgctcac

SEQ ID NO: 60053 - DNA, 15 bp, Artificial Sequence
  dgRNA
  Col18a1
tcaccgggtcctctc

SEQ ID NO: 60054 - DNA, 15 bp, Artificial Sequence
  dgRNA
  Col18a1
caatgtctccaacgc

SEQ ID NO: 60055 - DNA, 15 bp, Artificial Sequence
  dgRNA
  Col18a1
ccaatgtctccaacg

SEQ ID NO: 60056 - DNA, 15 bp, Artificial Sequence
  dgRNA
  Pcdhgb4
acgttattcagtgta

SEQ ID NO: 60057 - DNA, 15 bp, Artificial Sequence
  dgRNA
  Pcdhgb4
ccagactagagattc

SEQ ID NO: 60058 - DNA, 15 bp, Artificial Sequence
  dgRNA
  Pcdhgb4
ggattatgtcgccag

SEQ ID NO: 60059 - DNA, 15 bp, Artificial Sequence
  dgRNA
  Pcdhgb4
tagtctggccaacag

SEQ ID NO: 60060 - DNA, 15 bp, Artificial Sequence
  dgRNA
  Thap3
gccgccatctttttt

SEQ ID NO: 60061 - DNA, 15 bp, Artificial Sequence
  dgRNA
  Thap3
cgccatcttttttag

SEQ ID NO: 60062 - DNA, 15 bp, Artificial Sequence
  dgRNA
  Thap3
ctcggcggcctcggg

SEQ ID NO: 60063 - DNA, 15 bp, Artificial Sequence
  dgRNA
  Thap3
gctcggcggcctcgg

SEQ ID NO: 60064 - DNA, 15 bp, Artificial Sequence
  dgRNA
  Msh2
ctgaaattttaccta

SEQ ID NO: 60065 - DNA, 15 bp, Artificial Sequence
  dgRNA
  Msh2
tataacgcacactca

SEQ ID NO: 60066 - DNA, 15 bp, Artificial Sequence
  dgRNA
  Msh2
acgcacactcaaggc

SEQ ID NO: 60067 - DNA, 15 bp, Artificial Sequence
  dgRNA
  Msh2
cgcacactcaaggct

SEQ ID NO: 60068 - DNA, 15 bp, Artificial Sequence
  dgRNA
  Obfc1
accgtctgagggaat

SEQ ID NO: 60069 - DNA, 15 bp, Artificial Sequence
  dgRNA
  Obfc1
cgggatttgagcagc

SEQ ID NO: 60070 - DNA, 15 bp, Artificial Sequence
  dgRNA
  Obfc1
caggaattcccgggc

SEQ ID NO: 60071 - DNA, 15 bp, Artificial Sequence
  dgRNA
  Obfc1
attcccgggctggct

SEQ ID NO: 60072 - DNA, 15 bp, Artificial Sequence
  dgRNA
  Pcdhb20
acatggtggcgctat

SEQ ID NO: 60073 - DNA, 15 bp, Artificial Sequence
  dgRNA
  1600002H07Rik
ctatcttatctacag

SEQ ID NO: 60074 - DNA, 15 bp, Artificial Sequence
  dgRNA
  1600002H07Rik
ctttgcgtcctcccg

SEQ ID NO: 60075 - DNA, 15 bp, Artificial Sequence
  dgRNA
  1600002H07Rik
tttgcgtcctcccgt

SEQ ID NO: 60076 - DNA, 15 bp, Artificial Sequence
  dgRNA
  1600002H07Rik
cgtcctcccgtggga

SEQ ID NO: 60077 - DNA, 15 bp, Artificial Sequence
  dgRNA
  Impa2
tgggacaaagagcgt

SEQ ID NO: 60078 - DNA, 15 bp, Artificial Sequence
  dgRNA
  Impa2
gggacaaagagcgta

SEQ ID NO: 60079 - DNA, 15 bp, Artificial Sequence
  dgRNA
  Impa2
acaaagagcgtaggg

SEQ ID NO: 60080 - DNA, 15 bp, Artificial Sequence
  dgRNA
  Impa2
caaagagcgtagggc

SEQ ID NO: 60081 - DNA, 15 bp, Artificial Sequence
  dgRNA
  Sugt1
gcttacaagccatgc

SEQ ID NO: 60082 - DNA, 15 bp, Artificial Sequence
  dgRNA
  Sugt1
atgccggatccccca

SEQ ID NO: 60083 - DNA, 15 bp, Artificial Sequence
  dgRNA
  Sugt1
tgccggatcccccac

SEQ ID NO: 60084 - DNA, 15 bp, Artificial Sequence
  dgRNA
  Sugt1
tcccccacgggcgta

SEQ ID NO: 60085 - DNA, 15 bp, Artificial Sequence
  dgRNA
  Sox13
cggaggctgtcggag

SEQ ID NO: 60086 - DNA, 15 bp, Artificial Sequence
  dgRNA
  Sox13
tttcgcagaagcgag

SEQ ID NO: 60087 - DNA, 15 bp, Artificial Sequence
  dgRNA
  Sox13
tgctccagtcccgcc

SEQ ID NO: 60088 - DNA, 15 bp, Artificial Sequence
  dgRNA
  Sox13
gctccagtcccgcct

SEQ ID NO: 60089 - DNA, 15 bp, Artificial Sequence
  dgRNA
  Slfn2
ctaaaggcgttaaca

SEQ ID NO: 60090 - DNA, 15 bp, Artificial Sequence
  dgRNA
  Slfn2
taaaggcgttaacaa

SEQ ID NO: 60091 - DNA, 15 bp, Artificial Sequence
  dgRNA
  Slfn2
gagtccctccagtcc

SEQ ID NO: 60092 - DNA, 15 bp, Artificial Sequence
  dgRNA
  Gfra2
gcgccgccagccgcc

SEQ ID NO: 60093 - DNA, 15 bp, Artificial Sequence
  dgRNA
  Gfra2
cgccgccagccgcca

SEQ ID NO: 60094 - DNA, 15 bp, Artificial Sequence
  dgRNA
  Gfra2
gccgccagggagccg

SEQ ID NO: 60095 - DNA, 15 bp, Artificial Sequence
  dgRNA
  Gfra2
ccccgagcagaggag

SEQ ID NO: 60096 - DNA, 15 bp, Artificial Sequence
  dgRNA
  Krt13
ggtaactgggcttgt

SEQ ID NO: 60097 - DNA, 15 bp, Artificial Sequence
  dgRNA
  Krt13
tggaggacgcataaa

SEQ ID NO: 60098 - DNA, 15 bp, Artificial Sequence
  dgRNA
  Krt13
aaaggcatgcacggc

SEQ ID NO: 60099 - DNA, 15 bp, Artificial Sequence
  dgRNA
  Krt13
aaggcatgcacggca

SEQ ID NO: 60100 - DNA, 15 bp, Artificial Sequence
  dgRNA
  Myod1
gcacagagtcgcggg

SEQ ID NO: 60101 - DNA, 15 bp, Artificial Sequence
  dgRNA
  Myod1
cacagagtcgcggga

SEQ ID NO: 60102 - DNA, 15 bp, Artificial Sequence
  dgRNA
  Myod1
acagagtcgcgggag

SEQ ID NO: 60103 - DNA, 15 bp, Artificial Sequence
  dgRNA
  Myod1
cagagtcgcgggagg

SEQ ID NO: 60104 - DNA, 15 bp, Artificial Sequence
  dgRNA
  Slc24a5
catcagagtcccgca

SEQ ID NO: 60105 - DNA, 15 bp, Artificial Sequence
  dgRNA
  Slc24a5
tccccccgcaggcac

SEQ ID NO: 60106 - DNA, 15 bp, Artificial Sequence
  dgRNA
  Slc24a5
ccccccgcaggcact

SEQ ID NO: 60107 - DNA, 15 bp, Artificial Sequence
  dgRNA
  Slc24a5
cccccgcaggcactg

SEQ ID NO: 60108 - DNA, 15 bp, Artificial Sequence
  dgRNA
  Rpl27a
cactccgacgatgac

SEQ ID NO: 60109 - DNA, 15 bp, Artificial Sequence
  dgRNA
  Rpl27a
gatgaccggccgcag

SEQ ID NO: 60110 - DNA, 15 bp, Artificial Sequence
  dgRNA
  Rpl27a
cagcggcgctcgact

SEQ ID NO: 60111 - DNA, 15 bp, Artificial Sequence
  dgRNA
  Rpl27a
agcggcgctcgacta

SEQ ID NO: 60112 - DNA, 15 bp, Artificial Sequence
  dgRNA
  H3f3a
gggcagacggcccct

SEQ ID NO: 60113 - DNA, 15 bp, Artificial Sequence
  dgRNA
  H3f3a
cagacggcccctcgg

SEQ ID NO: 60114 - DNA, 15 bp, Artificial Sequence
  dgRNA
  H3f3a
agacggcccctcggc

SEQ ID NO: 60115 - DNA, 15 bp, Artificial Sequence
  dgRNA
  H3f3a
tgtacacaccgcgag

SEQ ID NO: 60116 - DNA, 15 bp, Artificial Sequence
  dgRNA
  Bcorl1
cccttcctggagcgg

SEQ ID NO: 60117 - DNA, 15 bp, Artificial Sequence
  dgRNA
  Bcorl1
agcggaggactggct

SEQ ID NO: 60118 - DNA, 15 bp, Artificial Sequence
  dgRNA
  Bcorl1
ctccgttcttccccg

SEQ ID NO: 60119 - DNA, 15 bp, Artificial Sequence
  dgRNA
  Bcorl1
tccccgtggccagtg

SEQ ID NO: 60120 - DNA, 15 bp, Artificial Sequence
  dgRNA
  Gadl1
tgtacaagacccttt

SEQ ID NO: 60121 - DNA, 15 bp, Artificial Sequence
  dgRNA
  Gadl1
gagcagggcttaatg

SEQ ID NO: 60122 - DNA, 15 bp, Artificial Sequence
  dgRNA
  Gadl1
ttggaaaactccccc

SEQ ID NO: 60123 - DNA, 15 bp, Artificial Sequence
  dgRNA
  Gadl1
attcttcaggtagtc

SEQ ID NO: 60124 - DNA, 15 bp, Artificial Sequence
  dgRNA
  Ndufa2
cccctaacaagacag

SEQ ID NO: 60125 - DNA, 15 bp, Artificial Sequence
  dgRNA
  Ndufa2
gcgtcatccaatcga

SEQ ID NO: 60126 - DNA, 15 bp, Artificial Sequence
  dgRNA
  Ndufa2
atcgacggcgaagac

SEQ ID NO: 60127 - DNA, 15 bp, Artificial Sequence
  dgRNA
  Ndufa2
gacggcgaagactgg

SEQ ID NO: 60128 - DNA, 15 bp, Artificial Sequence
  dgRNA
  Epsti1
agtgacctcaaatca

SEQ ID NO: 60129 - DNA, 15 bp, Artificial Sequence
  dgRNA
  Epsti1
gaagctggacacccg

SEQ ID NO: 60130 - DNA, 15 bp, Artificial Sequence
  dgRNA
  Epsti1
ggtgtccctgatttg

SEQ ID NO: 60131 - DNA, 15 bp, Artificial Sequence
  dgRNA
  Epsti1
cttgagctgtttaag

SEQ ID NO: 60132 - DNA, 15 bp, Artificial Sequence
  dgRNA
  Olfr1416
tcccagtttaagacc

SEQ ID NO: 60133 - DNA, 15 bp, Artificial Sequence
  dgRNA
  Olfr1416
cctatcacaggaatc

SEQ ID NO: 60134 - DNA, 15 bp, Artificial Sequence
  dgRNA
  Olfr1416
gggtgtctactgaag

SEQ ID NO: 60135 - DNA, 15 bp, Artificial Sequence
  dgRNA
  Olfr1416
gccaggtcttaaact

SEQ ID NO: 60136 - DNA, 15 bp, Artificial Sequence
  dgRNA
  Rd3l
tttttagagctctac

SEQ ID NO: 60137 - DNA, 15 bp, Artificial Sequence
  dgRNA
  Rd3l
gcataaaaatacggc

SEQ ID NO: 60138 - DNA, 15 bp, Artificial Sequence
  dgRNA
  Rd3l
gagcatcacaccacg

SEQ ID NO: 60139 - DNA, 15 bp, Artificial Sequence
  dgRNA
  Rd3l
aggaagagtgccgcg

SEQ ID NO: 60140 - DNA, 15 bp, Artificial Sequence
  dgRNA
  Mex3c
cgccctcgcgcgctc

SEQ ID NO: 60141 - DNA, 15 bp, Artificial Sequence
  dgRNA
  Mex3c
cctcgcgcgctccgg

SEQ ID NO: 60142 - DNA, 15 bp, Artificial Sequence
  dgRNA
  Mex3c
gcgctccggcggccc

SEQ ID NO: 60143 - DNA, 15 bp, Artificial Sequence
  dgRNA
  Mex3c
tggcgctcctcagcc

SEQ ID NO: 60144 - DNA, 15 bp, Artificial Sequence
  dgRNA
  Vmn1r233
ttgaagatgccctac

SEQ ID NO: 60145 - DNA, 15 bp, Artificial Sequence
  dgRNA
  Vmn1r233
tctgtgatacactac

SEQ ID NO: 60146 - DNA, 15 bp, Artificial Sequence
  dgRNA
  Vmn1r233
catatttaacctgta

SEQ ID NO: 60147 - DNA, 15 bp, Artificial Sequence
  dgRNA
  Gla
cacgtgagcaactct

SEQ ID NO: 60148 - DNA, 15 bp, Artificial Sequence
  dgRNA
  Gla
ctctcggcttaaact

SEQ ID NO: 60149 - DNA, 15 bp, Artificial Sequence
  dgRNA
  Gla
tctcggcttaaactc

SEQ ID NO: 60150 - DNA, 15 bp, Artificial Sequence
  dgRNA
  Gla
ggtctcgttggaggt

SEQ ID NO: 60151 - DNA, 15 bp, Artificial Sequence
  dgRNA
  Crlf1
gaggatgggacgttc

SEQ ID NO: 60152 - DNA, 15 bp, Artificial Sequence
  dgRNA
  Crlf1
tgggacgttcaggag

SEQ ID NO: 60153 - DNA, 15 bp, Artificial Sequence
  dgRNA
  Crlf1
ttcaggagtggtaac

SEQ ID NO: 60154 - DNA, 15 bp, Artificial Sequence
  dgRNA
  Crlf1
gtggtaactgggcgg

SEQ ID NO: 60155 - DNA, 15 bp, Artificial Sequence
  dgRNA
  Foxg1
ctgatttcgccctac

SEQ ID NO: 60156 - DNA, 15 bp, Artificial Sequence
  dgRNA
  Foxg1
agctcttacccttct

SEQ ID NO: 60157 - DNA, 15 bp, Artificial Sequence
  dgRNA
  Foxg1
cttgaaacaccagta

SEQ ID NO: 60158 - DNA, 15 bp, Artificial Sequence
  dgRNA
  Vmn2r13
tgtctgcacaaaaaa

SEQ ID NO: 60159 - DNA, 15 bp, Artificial Sequence
  dgRNA
  Gprc5b
ggctagggttcaagt

SEQ ID NO: 60160 - DNA, 15 bp, Artificial Sequence
  dgRNA
  Gprc5b
tagggttcaagtggg

SEQ ID NO: 60161 - DNA, 15 bp, Artificial Sequence
  dgRNA
  Gprc5b
agggtccacaaggtc

SEQ ID NO: 60162 - DNA, 15 bp, Artificial Sequence
  dgRNA
  Gprc5b
tgtggaccctcactc

SEQ ID NO: 60163 - DNA, 15 bp, Artificial Sequence
  dgRNA
  Mrvi1
gcctacccatatcaa

SEQ ID NO: 60164 - DNA, 15 bp, Artificial Sequence
  dgRNA
  Mrvi1
cacaaggagtcaact

SEQ ID NO: 60165 - DNA, 15 bp, Artificial Sequence
  dgRNA
  Mrvi1
gagtcaacttggtaa

SEQ ID NO: 60166 - DNA, 15 bp, Artificial Sequence
  dgRNA
  Mrvi1
atagtcccattctat

SEQ ID NO: 60167 - DNA, 15 bp, Artificial Sequence
  dgRNA
  Asb11
agagttcgtggtaac

SEQ ID NO: 60168 - DNA, 15 bp, Artificial Sequence
  dgRNA
  Asb11
cactcggtgccggtc

SEQ ID NO: 60169 - DNA, 15 bp, Artificial Sequence
  dgRNA
  Asb11
tctgacgtggtgact

SEQ ID NO: 60170 - DNA, 15 bp, Artificial Sequence
  dgRNA
  Asb11
ctctgacgtggtgac

SEQ ID NO: 60171 - DNA, 15 bp, Artificial Sequence
  dgRNA
  Clic3
gtagcacggacactc

SEQ ID NO: 60172 - DNA, 15 bp, Artificial Sequence
  dgRNA
  Clic3
tgtctgttgcctagg

SEQ ID NO: 60173 - DNA, 15 bp, Artificial Sequence
  dgRNA
  Clic3
cctaggtggctcctt

SEQ ID NO: 60174 - DNA, 15 bp, Artificial Sequence
  dgRNA
  Clic3
ggcgggcccactgcc

SEQ ID NO: 60175 - DNA, 15 bp, Artificial Sequence
  dgRNA
  Rbm4
acgctaaaatggcgg

SEQ ID NO: 60176 - DNA, 15 bp, Artificial Sequence
  dgRNA
  Rbm4
aaaacgctaaaatgg

SEQ ID NO: 60177 - DNA, 15 bp, Artificial Sequence
  dgRNA
  Rbm4
gacaaaacgctaaaa

SEQ ID NO: 60178 - DNA, 15 bp, Artificial Sequence
  dgRNA
  Tmem41b
cacgattttaagaac

SEQ ID NO: 60179 - DNA, 15 bp, Artificial Sequence
  dgRNA
  Tmem41b
gtaacccatttgctg

SEQ ID NO: 60180 - DNA, 15 bp, Artificial Sequence
  dgRNA
  Tmem41b
ttgctgcggaacgaa

SEQ ID NO: 60181 - DNA, 15 bp, Artificial Sequence
  dgRNA
  Tmem41b
gcgcgcagacacttc

SEQ ID NO: 60182 - DNA, 15 bp, Artificial Sequence
  dgRNA
  Sntb1
acccgtcgaaaatag

SEQ ID NO: 60183 - DNA, 15 bp, Artificial Sequence
  dgRNA
  Sntb1
cccgtcgaaaataga

SEQ ID NO: 60184 - DNA, 15 bp, Artificial Sequence
  dgRNA
  Sntb1
ggtttgtgacccggt

SEQ ID NO: 60185 - DNA, 15 bp, Artificial Sequence
  dgRNA
  Sntb1
gtgacccggtaggtt

SEQ ID NO: 60186 - DNA, 15 bp, Artificial Sequence
  dgRNA
  Csn3
ctaagactgacctgc

SEQ ID NO: 60187 - DNA, 15 bp, Artificial Sequence
  dgRNA
  Csn3
tgtcatcatcctatt

SEQ ID NO: 60188 - DNA, 15 bp, Artificial Sequence
  dgRNA
  Csn3
tattgggtgaaaagt

SEQ ID NO: 60189 - DNA, 15 bp, Artificial Sequence
  dgRNA
  Csn3
ctccgttatttatct

SEQ ID NO: 60190 - DNA, 15 bp, Artificial Sequence
  dgRNA
  Rsg1
gatcctgcttaggga

SEQ ID NO: 60191 - DNA, 15 bp, Artificial Sequence
  dgRNA
  Rsg1
cctacaaagacccgc

SEQ ID NO: 60192 - DNA, 15 bp, Artificial Sequence
  dgRNA
  Rsg1
gacccgccggaattc

SEQ ID NO: 60193 - DNA, 15 bp, Artificial Sequence
  dgRNA
  Rsg1
ccggcgggtctttgt

SEQ ID NO: 60194 - DNA, 15 bp, Artificial Sequence
  dgRNA
  Usp25
tgggccgggccgccg

SEQ ID NO: 60195 - DNA, 15 bp, Artificial Sequence
  dgRNA
  Usp25
gccgccgcggctcag

SEQ ID NO: 60196 - DNA, 15 bp, Artificial Sequence
  dgRNA
  Usp25
ggctcagcggcgctg

SEQ ID NO: 60197 - DNA, 15 bp, Artificial Sequence
  dgRNA
  Usp25
gcggcgctgaggatc

SEQ ID NO: 60198 - DNA, 15 bp, Artificial Sequence
  dgRNA
  Lrrc56
ggcagtgccggaact

SEQ ID NO: 60199 - DNA, 15 bp, Artificial Sequence
  dgRNA
  Lrrc56
gcagtgccggaactt

SEQ ID NO: 60200 - DNA, 15 bp, Artificial Sequence
  dgRNA
  Cab39l
tctgcagtcccgagg

SEQ ID NO: 60201 - DNA, 15 bp, Artificial Sequence
  dgRNA
  Cab39l
cggcttcacctcagc

SEQ ID NO: 60202 - DNA, 15 bp, Artificial Sequence
  dgRNA
  Cab39l
gcttcacctcagcgg

SEQ ID NO: 60203 - DNA, 15 bp, Artificial Sequence
  dgRNA
  Cab39l
tccacacagtttccg

SEQ ID NO: 60204 - DNA, 15 bp, Artificial Sequence
  dgRNA
  Gm5346
gacaattaacttaga

SEQ ID NO: 60205 - DNA, 15 bp, Artificial Sequence
  dgRNA
  Gm5346
ggcaaacatagttat

SEQ ID NO: 60206 - DNA, 15 bp, Artificial Sequence
  dgRNA
  Gm5346
agtcataagggtggt

SEQ ID NO: 60207 - DNA, 15 bp, Artificial Sequence
  dgRNA
  Gm5346
acggttgagtcataa

SEQ ID NO: 60208 - DNA, 15 bp, Artificial Sequence
  dgRNA
  Srpk2
ctttaataaaacccg

SEQ ID NO: 60209 - DNA, 15 bp, Artificial Sequence
  dgRNA
  Srpk2
gtgcatagtttagca

SEQ ID NO: 60210 - DNA, 15 bp, Artificial Sequence
  dgRNA
  Srpk2
ccgggttttattaaa

SEQ ID NO: 60211 - DNA, 15 bp, Artificial Sequence
  dgRNA
  Srpk2
cccgggttttattaa

SEQ ID NO: 60212 - DNA, 15 bp, Artificial Sequence
  dgRNA
  Hipk1
gtggccccggaccgc

SEQ ID NO: 60213 - DNA, 15 bp, Artificial Sequence
  dgRNA
  Hipk1
tggccccggaccgca

SEQ ID NO: 60214 - DNA, 15 bp, Artificial Sequence
  dgRNA
  Hipk1
ggccccggaccgcag

SEQ ID NO: 60215 - DNA, 15 bp, Artificial Sequence
  dgRNA
  Hipk1
cccggaccgcagggg

SEQ ID NO: 60216 - DNA, 15 bp, Artificial Sequence
  dgRNA
  Was
tggccccgcacaaaa

SEQ ID NO: 60217 - DNA, 15 bp, Artificial Sequence
  dgRNA
  Was
ggccccgcacaaaaa

SEQ ID NO: 60218 - DNA, 15 bp, Artificial Sequence
  dgRNA
  Was
cgcacaaaaagggag

SEQ ID NO: 60219 - DNA, 15 bp, Artificial Sequence
  dgRNA
  Was
atctagccacgcaaa

SEQ ID NO: 60220 - DNA, 15 bp, Artificial Sequence
  dgRNA
  Srrm4
ttatgcagatggcgg

SEQ ID NO: 60221 - DNA, 15 bp, Artificial Sequence
  dgRNA
  Srrm4
tatgcagatggcggc

SEQ ID NO: 60222 - DNA, 15 bp, Artificial Sequence
  dgRNA
  Srrm4
aaaacccgggcgcgc

SEQ ID NO: 60223 - DNA, 15 bp, Artificial Sequence
  dgRNA
  Srrm4
cccgcaggtctgagg

SEQ ID NO: 60224 - DNA, 15 bp, Artificial Sequence
  dgRNA
  Ddx42
ggttccccatcgccg

SEQ ID NO: 60225 - DNA, 15 bp, Artificial Sequence
  dgRNA
  Ddx42
gaccagattcccgtc

SEQ ID NO: 60226 - DNA, 15 bp, Artificial Sequence
  dgRNA
  Ddx42
ccagattcccgtccg

SEQ ID NO: 60227 - DNA, 15 bp, Artificial Sequence
  dgRNA
  Ddx42
agttatgttgcgttc

SEQ ID NO: 60228 - DNA, 15 bp, Artificial Sequence
  dgRNA
  Nrk
ggtgcgggcggctag

SEQ ID NO: 60229 - DNA, 15 bp, Artificial Sequence
  dgRNA
  Nrk
cgggcggctagaggc

SEQ ID NO: 60230 - DNA, 15 bp, Artificial Sequence
  dgRNA
  Nrk
gcgcggctgcccacc

SEQ ID NO: 60231 - DNA, 15 bp, Artificial Sequence
  dgRNA
  Nrk
cccttcgagctcctc

SEQ ID NO: 60232 - DNA, 15 bp, Artificial Sequence
  dgRNA
  1700007K13Rik
cagcggatctccctg

SEQ ID NO: 60233 - DNA, 15 bp, Artificial Sequence
  dgRNA
  1700007K13Rik
cagcgtgtggaagct

SEQ ID NO: 60234 - DNA, 15 bp, Artificial Sequence
  dgRNA
  1700007K13Rik
tttgttattcgccct

SEQ ID NO: 60235 - DNA, 15 bp, Artificial Sequence
  dgRNA
  1700007K13Rik
ttgttattcgccctc

SEQ ID NO: 60236 - DNA, 15 bp, Artificial Sequence
  dgRNA
  4930579F01Rik
ataatttgttccagc

SEQ ID NO: 60237 - DNA, 15 bp, Artificial Sequence
  dgRNA
  Gatad1
aggcaatggtaagtc

SEQ ID NO: 60238 - DNA, 15 bp, Artificial Sequence
  dgRNA
  Gatad1
aatggtaagtctggc

SEQ ID NO: 60239 - DNA, 15 bp, Artificial Sequence
  dgRNA
  Gatad1
ccacttccggccagt

SEQ ID NO: 60240 - DNA, 15 bp, Artificial Sequence
  dgRNA
  Gatad1
cttccggccagtagg

SEQ ID NO: 60241 - DNA, 15 bp, Artificial Sequence
  dgRNA
  Insr
aagttgcgggtttta

SEQ ID NO: 60242 - DNA, 15 bp, Artificial Sequence
  dgRNA
  Insr
agttgcgggttttac

SEQ ID NO: 60243 - DNA, 15 bp, Artificial Sequence
  dgRNA
  Insr
gttgcgggttttacg

SEQ ID NO: 60244 - DNA, 15 bp, Artificial Sequence
  dgRNA
  Insr
gggttttacggggca

SEQ ID NO: 60245 - DNA, 15 bp, Artificial Sequence
  dgRNA
  BC017158
cacaactatttcccc

SEQ ID NO: 60246 - DNA, 15 bp, Artificial Sequence
  dgRNA
  BC017158
tctccctcttccgat

SEQ ID NO: 60247 - DNA, 15 bp, Artificial Sequence
  dgRNA
  BC017158
ccctatattgctcct

SEQ ID NO: 60248 - DNA, 15 bp, Artificial Sequence
  dgRNA
  BC017158
cctatattgctccta

SEQ ID NO: 60249 - DNA, 15 bp, Artificial Sequence
  dgRNA
  Wfs1
cagtattgtaatagc

SEQ ID NO: 60250 - DNA, 15 bp, Artificial Sequence
  dgRNA
  Wfs1
gcagaggcgggccaa

SEQ ID NO: 60251 - DNA, 15 bp, Artificial Sequence
  dgRNA
  Wfs1
gaggcgggccaaagg

SEQ ID NO: 60252 - DNA, 15 bp, Artificial Sequence
  dgRNA
  Wfs1
cgcgagacttgttcc

SEQ ID NO: 60253 - DNA, 15 bp, Artificial Sequence
  dgRNA
  Cep19
agctgcggtcaccga

SEQ ID NO: 60254 - DNA, 15 bp, Artificial Sequence
  dgRNA
  Cep19
gacccgaacagaact

SEQ ID NO: 60255 - DNA, 15 bp, Artificial Sequence
  dgRNA
  Cep19
taacacttccaccct

SEQ ID NO: 60256 - DNA, 15 bp, Artificial Sequence
  dgRNA
  Cep19
tctccctacaactcc

SEQ ID NO: 60257 - DNA, 15 bp, Artificial Sequence
  dgRNA
  Pigc
agtaattcccactga

SEQ ID NO: 60258 - DNA, 15 bp, Artificial Sequence
  dgRNA
  Pigc
taggagcagattgcc

SEQ ID NO: 60259 - DNA, 15 bp, Artificial Sequence
  dgRNA
  Pigc
ggagcaatcagtaga

SEQ ID NO: 60260 - DNA, 15 bp, Artificial Sequence
  dgRNA
  Pigc
gcagcagtgacctcg

SEQ ID NO: 60261 - DNA, 15 bp, Artificial Sequence
  dgRNA
  Ceacam13
aggccatataattct

SEQ ID NO: 60262 - DNA, 15 bp, Artificial Sequence
  dgRNA
  Ceacam13
ggagggactcctacc

SEQ ID NO: 60263 - DNA, 15 bp, Artificial Sequence
  dgRNA
  Ceacam13
gaattatatggcctg

SEQ ID NO: 60264 - DNA, 15 bp, Artificial Sequence
  dgRNA
  Ceacam13
agaattatatggcct

SEQ ID NO: 60265 - DNA, 15 bp, Artificial Sequence
  dgRNA
  B3galt5
tctttcggtggtcac

SEQ ID NO: 60266 - DNA, 15 bp, Artificial Sequence
  dgRNA
  B3galt5
ctttcggtggtcact

SEQ ID NO: 60267 - DNA, 15 bp, Artificial Sequence
  dgRNA
  B3galt5
caggaccctgcggtt

SEQ ID NO: 60268 - DNA, 15 bp, Artificial Sequence
  dgRNA
  B3galt5
ccgcagcggccctag

SEQ ID NO: 60269 - DNA, 15 bp, Artificial Sequence
  dgRNA
  H2-Eb2
tccacccactggtgc

SEQ ID NO: 60270 - DNA, 15 bp, Artificial Sequence
  dgRNA
  H2-Eb2
gccaacctggctgac

SEQ ID NO: 60271 - DNA, 15 bp, Artificial Sequence
  dgRNA
  Ccdc189
ttcaccggacgtcac

SEQ ID NO: 60272 - DNA, 15 bp, Artificial Sequence
  dgRNA
  Ccdc189
ccagacgcacagcgc

SEQ ID NO: 60273 - DNA, 15 bp, Artificial Sequence
  dgRNA
  Ccdc189
gcgtcagagccgctc

SEQ ID NO: 60274 - DNA, 15 bp, Artificial Sequence
  dgRNA
  Ccdc189
gagccgctccggatg

SEQ ID NO: 60275 - DNA, 15 bp, Artificial Sequence
  dgRNA
  Zbtb48
ccaactagctggagt

SEQ ID NO: 60276 - DNA, 15 bp, Artificial Sequence
  dgRNA
  Zbtb48
gcctagcgcccagct

SEQ ID NO: 60277 - DNA, 15 bp, Artificial Sequence
  dgRNA
  Zbtb48
cagcttggcgttact

SEQ ID NO: 60278 - DNA, 15 bp, Artificial Sequence
  dgRNA
  Zbtb48
cgttactaggcgact

SEQ ID NO: 60279 - DNA, 15 bp, Artificial Sequence
  dgRNA
  Rab27b
aacagtggactaagg

SEQ ID NO: 60280 - DNA, 15 bp, Artificial Sequence
  dgRNA
  Rab27b
gactaaggaggttta

SEQ ID NO: 60281 - DNA, 15 bp, Artificial Sequence
  dgRNA
  Rab27b
ggggctgccattgag

SEQ ID NO: 60282 - DNA, 15 bp, Artificial Sequence
  dgRNA
  Tirap
tttgtgaaacgccaa

SEQ ID NO: 60283 - DNA, 15 bp, Artificial Sequence
  dgRNA
  Tirap
ctttgtgaaacgcca

SEQ ID NO: 60284 - DNA, 15 bp, Artificial Sequence
  dgRNA
  Tirap
tctggccaaaagtgc

SEQ ID NO: 60285 - DNA, 15 bp, Artificial Sequence
  dgRNA
  Ptprr
gtggtcccaacctcg

SEQ ID NO: 60286 - DNA, 15 bp, Artificial Sequence
  dgRNA
  Ptprr
cgctgcaagacagcg

SEQ ID NO: 60287 - DNA, 15 bp, Artificial Sequence
  dgRNA
  Ptprr
acaagcctcgaggtt

SEQ ID NO: 60288 - DNA, 15 bp, Artificial Sequence
  dgRNA
  Ptprr
aacaagcctcgaggt

SEQ ID NO: 60289 - DNA, 15 bp, Artificial Sequence
  dgRNA
  Crhbp
ttcggctatgcgttc

SEQ ID NO: 60290 - DNA, 15 bp, Artificial Sequence
  dgRNA
  Crhbp
tgcgttcaggtcact

SEQ ID NO: 60291 - DNA, 15 bp, Artificial Sequence
  dgRNA
  Crhbp
cttgatgaataatgc

SEQ ID NO: 60292 - DNA, 15 bp, Artificial Sequence
  dgRNA
  Crhbp
ttgatgaataatgcg

SEQ ID NO: 60293 - DNA, 15 bp, Artificial Sequence
  dgRNA
  Mrps18c
cggacagacacccgc

SEQ ID NO: 60294 - DNA, 15 bp, Artificial Sequence
  dgRNA
  Mrps18c
acagacacccgccgg

SEQ ID NO: 60295 - DNA, 15 bp, Artificial Sequence
  dgRNA
  Mrps18c
acccgccggcggatg

SEQ ID NO: 60296 - DNA, 15 bp, Artificial Sequence
  dgRNA
  Mrps18c
cccgccggcggatgc

SEQ ID NO: 60297 - DNA, 15 bp, Artificial Sequence
  dgRNA
  Mapre2
ccaaaagcactacag

SEQ ID NO: 60298 - DNA, 15 bp, Artificial Sequence
  dgRNA
  Mapre2
tgcccgcgcgtgaag

SEQ ID NO: 60299 - DNA, 15 bp, Artificial Sequence
  dgRNA
  Mapre2
gcccgcgcgtgaaga

SEQ ID NO: 60300 - DNA, 15 bp, Artificial Sequence
  dgRNA
  Mapre2
gcgcgtgaagaggga

SEQ ID NO: 60301 - DNA, 15 bp, Artificial Sequence
  dgRNA
  Zc3h15
gaactctctacgcca

SEQ ID NO: 60302 - DNA, 15 bp, Artificial Sequence
  dgRNA
  Zc3h15
aactctctacgccag

SEQ ID NO: 60303 - DNA, 15 bp, Artificial Sequence
  dgRNA
  Zc3h15
gggtctatacaagtg

SEQ ID NO: 60304 - DNA, 15 bp, Artificial Sequence
  dgRNA
  Zc3h15
tatacaagtgaggtg

SEQ ID NO: 60305 - DNA, 15 bp, Artificial Sequence
  dgRNA
  2510039O18Rik
ttccaacaagccgtt

SEQ ID NO: 60306 - DNA, 15 bp, Artificial Sequence
  dgRNA
  2510039O18Rik
tccaaatcccgcccc

SEQ ID NO: 60307 - DNA, 15 bp, Artificial Sequence
  dgRNA
  2510039O18Rik
ctcagcgacgcctta

SEQ ID NO: 60308 - DNA, 15 bp, Artificial Sequence
  dgRNA
  2510039O18Rik
gcgacgccttacggc

SEQ ID NO: 60309 - DNA, 15 bp, Artificial Sequence
  dgRNA
  Slc16a9
tattcagttccacac

SEQ ID NO: 60310 - DNA, 15 bp, Artificial Sequence
  dgRNA
  Slc16a9
cctcgcaaatgcaca

SEQ ID NO: 60311 - DNA, 15 bp, Artificial Sequence
  dgRNA
  Slc16a9
aatgcacacggtgct

SEQ ID NO: 60312 - DNA, 15 bp, Artificial Sequence
  dgRNA
  Slc16a9
cacacggtgcttggc

SEQ ID NO: 60313 - DNA, 15 bp, Artificial Sequence
  dgRNA
  Blm
ccataatcacctgac

SEQ ID NO: 60314 - DNA, 15 bp, Artificial Sequence
  dgRNA
  Blm
ccggtcagctgcatt

SEQ ID NO: 60315 - DNA, 15 bp, Artificial Sequence
  dgRNA
  Blm
cagctgcattcggat

SEQ ID NO: 60316 - DNA, 15 bp, Artificial Sequence
  dgRNA
  Blm
agctgcattcggatt

SEQ ID NO: 60317 - DNA, 15 bp, Artificial Sequence
  dgRNA
  Pigk
ggaaggtgtatgcgg

SEQ ID NO: 60318 - DNA, 15 bp, Artificial Sequence
  dgRNA
  Pigk
caaggccactaccat

SEQ ID NO: 60319 - DNA, 15 bp, Artificial Sequence
  dgRNA
  Pigk
acacccccccgtgca

SEQ ID NO: 60320 - DNA, 15 bp, Artificial Sequence
  dgRNA
  Pigk
ccccgtgcacggcag

SEQ ID NO: 60321 - DNA, 15 bp, Artificial Sequence
  dgRNA
  Slc35g1
aagacccgaggcgcc

SEQ ID NO: 60322 - DNA, 15 bp, Artificial Sequence
  dgRNA
  Slc35g1
agacccgaggcgcca

SEQ ID NO: 60323 - DNA, 15 bp, Artificial Sequence
  dgRNA
  Slc35g1
ctagcccgactgccc

SEQ ID NO: 60324 - DNA, 15 bp, Artificial Sequence
  dgRNA
  Slc35g1
tagcccgactgccct

SEQ ID NO: 60325 - DNA, 15 bp, Artificial Sequence
  dgRNA
  Olfr164
gaacatcaggtgata

SEQ ID NO: 60326 - DNA, 15 bp, Artificial Sequence
  dgRNA
  Olfr164
ctatcattgaacatc

SEQ ID NO: 60327 - DNA, 15 bp, Artificial Sequence
  dgRNA
  Cdhr5
tatgtgtagttcccg

SEQ ID NO: 60328 - DNA, 15 bp, Artificial Sequence
  dgRNA
  Cdhr5
gttagtgccggccag

SEQ ID NO: 60329 - DNA, 15 bp, Artificial Sequence
  dgRNA
  Cdhr5
ttagtgccggccagc

SEQ ID NO: 60330 - DNA, 15 bp, Artificial Sequence
  dgRNA
  Cdhr5
gaggccatctgtaaa

SEQ ID NO: 60331 - DNA, 15 bp, Artificial Sequence
  dgRNA
  Glmn
ggggagggtccggtc

SEQ ID NO: 60332 - DNA, 15 bp, Artificial Sequence
  dgRNA
  Glmn
gggagggtccggtcc

SEQ ID NO: 60333 - DNA, 15 bp, Artificial Sequence
  dgRNA
  Glmn
ggagggtccggtccg

SEQ ID NO: 60334 - DNA, 15 bp, Artificial Sequence
  dgRNA
  Glmn
gagggtccggtccgg

SEQ ID NO: 60335 - DNA, 15 bp, Artificial Sequence
  dgRNA
  Tpst1
ggccaaaagccgttc

SEQ ID NO: 60336 - DNA, 15 bp, Artificial Sequence
  dgRNA
  Tpst1
tcattgaagtggatc

SEQ ID NO: 60337 - DNA, 15 bp, Artificial Sequence
  dgRNA
  Tpst1
ttttgctcaaccagc

SEQ ID NO: 60338 - DNA, 15 bp, Artificial Sequence
  dgRNA
  Tpst1
ctcctgaacggcttt

SEQ ID NO: 60339 - DNA, 15 bp, Artificial Sequence
  dgRNA
  Mettl17
aaacacgcccaagcc

SEQ ID NO: 60340 - DNA, 15 bp, Artificial Sequence
  dgRNA
  Mettl17
acgcccaagccgggt

SEQ ID NO: 60341 - DNA, 15 bp, Artificial Sequence
  dgRNA
  Mettl17
ccacgccccttctga

SEQ ID NO: 60342 - DNA, 15 bp, Artificial Sequence
  dgRNA
  Mettl17
agcccctcccacgaa

SEQ ID NO: 60343 - DNA, 15 bp, Artificial Sequence
  dgRNA
  Lsm2
cgccgccgctcgcgg

SEQ ID NO: 60344 - DNA, 15 bp, Artificial Sequence
  dgRNA
  Lsm2
gccgccgctcgcggc

SEQ ID NO: 60345 - DNA, 15 bp, Artificial Sequence
  dgRNA
  Lsm2
gccgctcgcggcggg

SEQ ID NO: 60346 - DNA, 15 bp, Artificial Sequence
  dgRNA
  Lsm2
gcggttcgaaccgtg

SEQ ID NO: 60347 - DNA, 15 bp, Artificial Sequence
  dgRNA
  Osmr
aactgaactatagct

SEQ ID NO: 60348 - DNA, 15 bp, Artificial Sequence
  dgRNA
  Osmr
ctatagcttggagca

SEQ ID NO: 60349 - DNA, 15 bp, Artificial Sequence
  dgRNA
  Osmr
ggtatagtgtgcaag

SEQ ID NO: 60350 - DNA, 15 bp, Artificial Sequence
  dgRNA
  Osmr
gtatagtgtgcaagt

SEQ ID NO: 60351 - DNA, 15 bp, Artificial Sequence
  dgRNA
  2-Sep
tatggccaaccgccg

SEQ ID NO: 60352 - DNA, 15 bp, Artificial Sequence
  dgRNA
  2-Sep
atggccaaccgccgt

SEQ ID NO: 60353 - DNA, 15 bp, Artificial Sequence
  dgRNA
  2-Sep
gccaaccgccgtggg

SEQ ID NO: 60354 - DNA, 15 bp, Artificial Sequence
  dgRNA
  2-Sep
ccaaccgccgtggga

SEQ ID NO: 60355 - DNA, 15 bp, Artificial Sequence
  dgRNA
  Prom1
agtgaatgaccacct

SEQ ID NO: 60356 - DNA, 15 bp, Artificial Sequence
  dgRNA
  Prom1
tcaaagtaccatccc

SEQ ID NO: 60357 - DNA, 15 bp, Artificial Sequence
  dgRNA
  Prom1
gaacggtctccaagg

SEQ ID NO: 60358 - DNA, 15 bp, Artificial Sequence
  dgRNA
  Prom1
gaagaacggtctcca

SEQ ID NO: 60359 - DNA, 15 bp, Artificial Sequence
  dgRNA
  Vwa9
gctattcgctgcctc

SEQ ID NO: 60360 - DNA, 15 bp, Artificial Sequence
  dgRNA
  Vwa9
ctattcgctgcctcc

SEQ ID NO: 60361 - DNA, 15 bp, Artificial Sequence
  dgRNA
  Vwa9
ttcccttatgtcgca

SEQ ID NO: 60362 - DNA, 15 bp, Artificial Sequence
  dgRNA
  Vwa9
acggcccttaagttc

SEQ ID NO: 60363 - DNA, 15 bp, Artificial Sequence
  dgRNA
  Tek
taagccttggatgaa

SEQ ID NO: 60364 - DNA, 15 bp, Artificial Sequence
  dgRNA
  Tek
taccgcctgcttctg

SEQ ID NO: 60365 - DNA, 15 bp, Artificial Sequence
  dgRNA
  Tek
cacttggtatcagca

SEQ ID NO: 60366 - DNA, 15 bp, Artificial Sequence
  dgRNA
  Tek
gcacttggtatcagc

SEQ ID NO: 60367 - DNA, 15 bp, Artificial Sequence
  dgRNA
  Mcpt9
tattagagggggatc

SEQ ID NO: 60368 - DNA, 15 bp, Artificial Sequence
  dgRNA
  Olfr10
cgtaattcctaatcc

SEQ ID NO: 60369 - DNA, 15 bp, Artificial Sequence
  dgRNA
  Olfr10
atgatttagtattac

SEQ ID NO: 60370 - DNA, 15 bp, Artificial Sequence
  dgRNA
  Olfr10
tacagtgcaggtcaa

SEQ ID NO: 60371 - DNA, 15 bp, Artificial Sequence
  dgRNA
  Olfr10
gattgaccctggatt

SEQ ID NO: 60372 - DNA, 15 bp, Artificial Sequence
  dgRNA
  Prmt3
catacatcagcatac

SEQ ID NO: 60373 - DNA, 15 bp, Artificial Sequence
  dgRNA
  Prmt3
atctctgccgccaga

SEQ ID NO: 60374 - DNA, 15 bp, Artificial Sequence
  dgRNA
  Prmt3
ggcgctgcgataagt

SEQ ID NO: 60375 - DNA, 15 bp, Artificial Sequence
  dgRNA
  Prmt3
caaccttgtaagcgc

SEQ ID NO: 60376 - DNA, 15 bp, Artificial Sequence
  dgRNA
  Dbh
gagagtgtctaaaca

SEQ ID NO: 60377 - DNA, 15 bp, Artificial Sequence
  dgRNA
  Dbh
taaacacggactatt

SEQ ID NO: 60378 - DNA, 15 bp, Artificial Sequence
  dgRNA
  Dbh
aaacacggactattt

SEQ ID NO: 60379 - DNA, 15 bp, Artificial Sequence
  dgRNA
  Dbh
aacacggactatttg

SEQ ID NO: 60380 - DNA, 15 bp, Artificial Sequence
  dgRNA
  Unc5cl
ctcccgagcttcacc

SEQ ID NO: 60381 - DNA, 15 bp, Artificial Sequence
  dgRNA
  Unc5cl
agcttcacctggaat

SEQ ID NO: 60382 - DNA, 15 bp, Artificial Sequence
  dgRNA
  Unc5cl
taagccccgactctg

SEQ ID NO: 60383 - DNA, 15 bp, Artificial Sequence
  dgRNA
  Unc5cl
agccccgactctgtg

SEQ ID NO: 60384 - DNA, 15 bp, Artificial Sequence
  dgRNA
  1700003E16Rik
tgaaggcccacgcca

SEQ ID NO: 60385 - DNA, 15 bp, Artificial Sequence
  dgRNA
  1700003E16Rik
ccacgccaaggttag

SEQ ID NO: 60386 - DNA, 15 bp, Artificial Sequence
  dgRNA
  1700003E16Rik
gacgccgcgatccta

SEQ ID NO: 60387 - DNA, 15 bp, Artificial Sequence
  dgRNA
  1700003E16Rik
cgacgcaccgacgca

SEQ ID NO: 60388 - DNA, 15 bp, Artificial Sequence
  dgRNA
  Tbc1d17
tccaccaagccgctc

SEQ ID NO: 60389 - DNA, 15 bp, Artificial Sequence
  dgRNA
  Tbc1d17
tgtcctcgagaaaaa

SEQ ID NO: 60390 - DNA, 15 bp, Artificial Sequence
  dgRNA
  Tbc1d17
tgccagtataaaata

SEQ ID NO: 60391 - DNA, 15 bp, Artificial Sequence
  dgRNA
  Tbc1d17
cgagcgatcacgagt

SEQ ID NO: 60392 - DNA, 15 bp, Artificial Sequence
  dgRNA
  Ccdc162
gtggcccttcacacg

SEQ ID NO: 60393 - DNA, 15 bp, Artificial Sequence
  dgRNA
  Ccdc162
gcccttcacacgggg

SEQ ID NO: 60394 - DNA, 15 bp, Artificial Sequence
  dgRNA
  Ccdc162
ccttcacacggggcg

SEQ ID NO: 60395 - DNA, 15 bp, Artificial Sequence
  dgRNA
  Ccdc162
gggcggggtgtgcct

SEQ ID NO: 60396 - DNA, 15 bp, Artificial Sequence
  dgRNA
  Rprd1b
ctaaggattcgtttc

SEQ ID NO: 60397 - DNA, 15 bp, Artificial Sequence
  dgRNA
  Rprd1b
ctggacgctcctaag

SEQ ID NO: 60398 - DNA, 15 bp, Artificial Sequence
  dgRNA
  Rprd1b
acgctcctaagcggc

SEQ ID NO: 60399 - DNA, 15 bp, Artificial Sequence
  dgRNA
  Rprd1b
cgctcctaagcggct

SEQ ID NO: 60400 - DNA, 15 bp, Artificial Sequence
  dgRNA
  Faap24
cttccgttcgattat

SEQ ID NO: 60401 - DNA, 15 bp, Artificial Sequence
  dgRNA
  Faap24
cacccaataaaacgc

SEQ ID NO: 60402 - DNA, 15 bp, Artificial Sequence
  dgRNA
  Faap24
aataaaacgctggcc

SEQ ID NO: 60403 - DNA, 15 bp, Artificial Sequence
  dgRNA
  Faap24
ataaaacgctggcca

SEQ ID NO: 60404 - DNA, 15 bp, Artificial Sequence
  dgRNA
  Plek
ctcgtcaccccagag

SEQ ID NO: 60405 - DNA, 15 bp, Artificial Sequence
  dgRNA
  Plek
tcgtcaccccagaga

SEQ ID NO: 60406 - DNA, 15 bp, Artificial Sequence
  dgRNA
  Afp
tgctctgttaattat

SEQ ID NO: 60407 - DNA, 15 bp, Artificial Sequence
  dgRNA
  Afp
cctaacttcaacgta

SEQ ID NO: 60408 - DNA, 15 bp, Artificial Sequence
  dgRNA
  Afp
aggttactagttaac

SEQ ID NO: 60409 - DNA, 15 bp, Artificial Sequence
  dgRNA
  Afp
aggcatcccttaaac

SEQ ID NO: 60410 - DNA, 15 bp, Artificial Sequence
  dgRNA
  Gipc2
gaggggctttggtcg

SEQ ID NO: 60411 - DNA, 15 bp, Artificial Sequence
  dgRNA
  Gipc2
aggggctttggtcgt

SEQ ID NO: 60412 - DNA, 15 bp, Artificial Sequence
  dgRNA
  Gipc2
acggactcactctgt

SEQ ID NO: 60413 - DNA, 15 bp, Artificial Sequence
  dgRNA
  Gipc2
aattgcaatggttgg

SEQ ID NO: 60414 - DNA, 15 bp, Artificial Sequence
  dgRNA
  Tex43
ccattgttacatcaa

SEQ ID NO: 60415 - DNA, 15 bp, Artificial Sequence
  dgRNA
  Tex43
ccattgatgtaacaa

SEQ ID NO: 60416 - DNA, 15 bp, Artificial Sequence
  dgRNA
  Zfp366
taagttccctgcaat

SEQ ID NO: 60417 - DNA, 15 bp, Artificial Sequence
  dgRNA
  Zfp366
cagatgagtaccttc

SEQ ID NO: 60418 - DNA, 15 bp, Artificial Sequence
  dgRNA
  Zfp366
cttaaaggactcgca

SEQ ID NO: 60419 - DNA, 15 bp, Artificial Sequence
  dgRNA
  Zfp366
acttaaaggactcgc

SEQ ID NO: 60420 - DNA, 15 bp, Artificial Sequence
  dgRNA
  Foxr2
ccatccaaaggaggt

SEQ ID NO: 60421 - DNA, 15 bp, Artificial Sequence
  dgRNA
  Foxr2
gccatccaaaggagg

SEQ ID NO: 60422 - DNA, 15 bp, Artificial Sequence
  dgRNA
  Foxr2
gggaaggacgttagg

SEQ ID NO: 60423 - DNA, 15 bp, Artificial Sequence
  dgRNA
  Foxr2
taagggaaggacgtt

SEQ ID NO: 60424 - DNA, 15 bp, Artificial Sequence
  dgRNA
  Bglap
ggatataaatgctac

SEQ ID NO: 60425 - DNA, 15 bp, Artificial Sequence
  dgRNA
  Bglap
tgattgcggctgcct

SEQ ID NO: 60426 - DNA, 15 bp, Artificial Sequence
  dgRNA
  Bglap
gtgattgcggctgcc

SEQ ID NO: 60427 - DNA, 15 bp, Artificial Sequence
  dgRNA
  Gde1
aacccgaagcgccct

SEQ ID NO: 60428 - DNA, 15 bp, Artificial Sequence
  dgRNA
  Gde1
gcgcccttggaaccc

SEQ ID NO: 60429 - DNA, 15 bp, Artificial Sequence
  dgRNA
  Gde1
ccatgacagcggttc

SEQ ID NO: 60430 - DNA, 15 bp, Artificial Sequence
  dgRNA
  Gde1
ccaacgccgaagctc

SEQ ID NO: 60431 - DNA, 15 bp, Artificial Sequence
  dgRNA
  Cldn12
caatcacacgcatga

SEQ ID NO: 60432 - DNA, 15 bp, Artificial Sequence
  dgRNA
  Cldn12
tcaatcacacgcatg

SEQ ID NO: 60433 - DNA, 15 bp, Artificial Sequence
  dgRNA
  Lama3
agatcaacgctcgcc

SEQ ID NO: 60434 - DNA, 15 bp, Artificial Sequence
  dgRNA
  Lama3
gatcaacgctcgcct

SEQ ID NO: 60435 - DNA, 15 bp, Artificial Sequence
  dgRNA
  Lama3
cgctcgcctgggaac

SEQ ID NO: 60436 - DNA, 15 bp, Artificial Sequence
  dgRNA
  Lama3
gaaagttctacaggc

SEQ ID NO: 60437 - DNA, 15 bp, Artificial Sequence
  dgRNA
  Rarg
acgtttgcaaatttg

SEQ ID NO: 60438 - DNA, 15 bp, Artificial Sequence
  dgRNA
  Rarg
cccctttcgctctcc

SEQ ID NO: 60439 - DNA, 15 bp, Artificial Sequence
  dgRNA
  Rarg
cgcacatatattcat

SEQ ID NO: 60440 - DNA, 15 bp, Artificial Sequence
  dgRNA
  Rarg
cgtctactagctgag

SEQ ID NO: 60441 - DNA, 15 bp, Artificial Sequence
  dgRNA
  Olfr430
tgaaatagtcccact

SEQ ID NO: 60442 - DNA, 15 bp, Artificial Sequence
  dgRNA
  Olfr430
gattctgatatatat

SEQ ID NO: 60443 - DNA, 15 bp, Artificial Sequence
  dgRNA
  Olfr430
gcaatccctctaatt

SEQ ID NO: 60444 - DNA, 15 bp, Artificial Sequence
  dgRNA
  Olfr430
actaacagctagatc

SEQ ID NO: 60445 - DNA, 15 bp, Artificial Sequence
  dgRNA
  Ap4e1
gactcgtgcgccccc

SEQ ID NO: 60446 - DNA, 15 bp, Artificial Sequence
  dgRNA
  Ap4e1
tcgtgcgcccccagg

SEQ ID NO: 60447 - DNA, 15 bp, Artificial Sequence
  dgRNA
  Ap4e1
ccaggcggtgtttcc

SEQ ID NO: 60448 - DNA, 15 bp, Artificial Sequence
  dgRNA
  Ap4e1
ctgctcgtcctgctc

SEQ ID NO: 60449 - DNA, 15 bp, Artificial Sequence
  dgRNA
  Ptprg
gacgcgcgcccccgc

SEQ ID NO: 60450 - DNA, 15 bp, Artificial Sequence
  dgRNA
  Ptprg
ccgccggcggcagct

SEQ ID NO: 60451 - DNA, 15 bp, Artificial Sequence
  dgRNA
  Ptprg
cgccggcggcagctc

SEQ ID NO: 60452 - DNA, 15 bp, Artificial Sequence
  dgRNA
  Ptprg
gccggcggcagctcg

SEQ ID NO: 60453 - DNA, 15 bp, Artificial Sequence
  dgRNA
  Knop1
gtctcggcgccgcca

SEQ ID NO: 60454 - DNA, 15 bp, Artificial Sequence
  dgRNA
  Knop1
gcgccgccatggacg

SEQ ID NO: 60455 - DNA, 15 bp, Artificial Sequence
  dgRNA
  Knop1
acccagggcaccggg

SEQ ID NO: 60456 - DNA, 15 bp, Artificial Sequence
  dgRNA
  Knop1
cgggaggccgcgacc

SEQ ID NO: 60457 - DNA, 15 bp, Artificial Sequence
  dgRNA
  Clrn3
ttctgcacgtcttta

SEQ ID NO: 60458 - DNA, 15 bp, Artificial Sequence
  dgRNA
  Clrn3
ctaggcaatcctttc

SEQ ID NO: 60459 - DNA, 15 bp, Artificial Sequence
  dgRNA
  Clrn3
cagaaacggttgtta

SEQ ID NO: 60460 - DNA, 15 bp, Artificial Sequence
  dgRNA
  Zfp777
gccccgagcaggccg

SEQ ID NO: 60461 - DNA, 15 bp, Artificial Sequence
  dgRNA
  Zfp777
caggccggggcccga

SEQ ID NO: 60462 - DNA, 15 bp, Artificial Sequence
  dgRNA
  Zfp777
cagccccggcgggtg

SEQ ID NO: 60463 - DNA, 15 bp, Artificial Sequence
  dgRNA
  Zfp777
ctgccagcccgccca

SEQ ID NO: 60464 - DNA, 15 bp, Artificial Sequence
  dgRNA
  Gm2897
ctcaccaccgtgcca

SEQ ID NO: 60465 - DNA, 15 bp, Artificial Sequence
  dgRNA
  Gm2897
cggaggtggtgacaa

SEQ ID NO: 60466 - DNA, 15 bp, Artificial Sequence
  dgRNA
  Gm2897
acggtggtgagccct

SEQ ID NO: 60467 - DNA, 15 bp, Artificial Sequence
  dgRNA
  Gm2897
gaccgacggagggca

SEQ ID NO: 60468 - DNA, 15 bp, Artificial Sequence
  dgRNA
  Slc12a8
aagaactcttccacg

SEQ ID NO: 60469 - DNA, 15 bp, Artificial Sequence
  dgRNA
  Slc12a8
cccagcaggtaagtc

SEQ ID NO: 60470 - DNA, 15 bp, Artificial Sequence
  dgRNA
  Slc12a8
ggtaagtctggttac

SEQ ID NO: 60471 - DNA, 15 bp, Artificial Sequence
  dgRNA
  Slc12a8
ggccatcagacagac

SEQ ID NO: 60472 - DNA, 15 bp, Artificial Sequence
  dgRNA
  Rbfox1
cgtcccttccttgtc

SEQ ID NO: 60473 - DNA, 15 bp, Artificial Sequence
  dgRNA
  Rbfox1
agctaccaaaatgga

SEQ ID NO: 60474 - DNA, 15 bp, Artificial Sequence
  dgRNA
  Rbfox1
tcggagctaccaaaa

SEQ ID NO: 60475 - DNA, 15 bp, Artificial Sequence
  dgRNA
  Rbfox1
agctgcagggtcggt

SEQ ID NO: 60476 - DNA, 15 bp, Artificial Sequence
  dgRNA
  Tmem237
aaccccctccgctcc

SEQ ID NO: 60477 - DNA, 15 bp, Artificial Sequence
  dgRNA
  Tmem237
cgctcctggggacgc

SEQ ID NO: 60478 - DNA, 15 bp, Artificial Sequence
  dgRNA
  Tmem237
cgccggccgacgctg

SEQ ID NO: 60479 - DNA, 15 bp, Artificial Sequence
  dgRNA
  Tmem237
gttttcctagttcga

SEQ ID NO: 60480 - DNA, 15 bp, Artificial Sequence
  dgRNA
  Dctn5
cctgccgagccacac

SEQ ID NO: 60481 - DNA, 15 bp, Artificial Sequence
  dgRNA
  Dctn5
gcgcgctagccgctc

SEQ ID NO: 60482 - DNA, 15 bp, Artificial Sequence
  dgRNA
  Dctn5
ctgcgcacgcgcagc

SEQ ID NO: 60483 - DNA, 15 bp, Artificial Sequence
  dgRNA
  Dctn5
gccgagcgatcgagc

SEQ ID NO: 60484 - DNA, 15 bp, Artificial Sequence
  dgRNA
  Tmed10
tgtacgaaaaactcc

SEQ ID NO: 60485 - DNA, 15 bp, Artificial Sequence
  dgRNA
  Tmed10
gtacgaaaaactcct

SEQ ID NO: 60486 - DNA, 15 bp, Artificial Sequence
  dgRNA
  Tmed10
tacgaaaaactcctg

SEQ ID NO: 60487 - DNA, 15 bp, Artificial Sequence
  dgRNA
  Tmed10
atctccaaaatggcg

SEQ ID NO: 60488 - DNA, 15 bp, Artificial Sequence
  dgRNA
  Tmc5
ggccggcaaagcttt

SEQ ID NO: 60489 - DNA, 15 bp, Artificial Sequence
  dgRNA
  Tmc5
ccttccggcatcccc

SEQ ID NO: 60490 - DNA, 15 bp, Artificial Sequence
  dgRNA
  Tmc5
cttccggcatcccct

SEQ ID NO: 60491 - DNA, 15 bp, Artificial Sequence
  dgRNA
  Tmc5
ttccggcatcccctg

SEQ ID NO: 60492 - DNA, 15 bp, Artificial Sequence
  dgRNA
  Acsm1
cttgagtagcccatg

SEQ ID NO: 60493 - DNA, 15 bp, Artificial Sequence
  dgRNA
  Acsm1
tagcccatgaggatg

SEQ ID NO: 60494 - DNA, 15 bp, Artificial Sequence
  dgRNA
  Acsm1
tactcaaggtggaac

SEQ ID NO: 60495 - DNA, 15 bp, Artificial Sequence
  dgRNA
  Acsm1
atgggctactcaagg

SEQ ID NO: 60496 - DNA, 15 bp, Artificial Sequence
  dgRNA
  Nicn1
taaagaacggctcga

SEQ ID NO: 60497 - DNA, 15 bp, Artificial Sequence
  dgRNA
  Nicn1
ggctcgacggttgcc

SEQ ID NO: 60498 - DNA, 15 bp, Artificial Sequence
  dgRNA
  Nicn1
ttgcccggagcagcc

SEQ ID NO: 60499 - DNA, 15 bp, Artificial Sequence
  dgRNA
  Nicn1
ccggagcagcccggg

SEQ ID NO: 60500 - DNA, 15 bp, Artificial Sequence
  dgRNA
  Nacc1
tacagaaccgagacc

SEQ ID NO: 60501 - DNA, 15 bp, Artificial Sequence
  dgRNA
  Nacc1
acagaaccgagaccc

SEQ ID NO: 60502 - DNA, 15 bp, Artificial Sequence
  dgRNA
  Nacc1
gaaccgagacccggg

SEQ ID NO: 60503 - DNA, 15 bp, Artificial Sequence
  dgRNA
  Nacc1
gaagcgctcgaagcg

SEQ ID NO: 60504 - DNA, 15 bp, Artificial Sequence
  dgRNA
  Olfr850
accagcataaagatc

SEQ ID NO: 60505 - DNA, 15 bp, Artificial Sequence
  dgRNA
  Olfr850
cacctaagacctttt

SEQ ID NO: 60506 - DNA, 15 bp, Artificial Sequence
  dgRNA
  a
actcgggagaaatat

SEQ ID NO: 60507 - DNA, 15 bp, Artificial Sequence
  dgRNA
  a
ctcgggagaaatata

SEQ ID NO: 60508 - DNA, 15 bp, Artificial Sequence
  dgRNA
  a
cgagtctgaacctac

SEQ ID NO: 60509 - DNA, 15 bp, Artificial Sequence
  dgRNA
  a
gagtctgaacctact

SEQ ID NO: 60510 - DNA, 15 bp, Artificial Sequence
  dgRNA
  Tab2
tcctcagcccgcgcc

SEQ ID NO: 60511 - DNA, 15 bp, Artificial Sequence
  dgRNA
  Tab2
gggacgcgtcccctc

SEQ ID NO: 60512 - DNA, 15 bp, Artificial Sequence
  dgRNA
  Tab2
cgtcccctccggcca

SEQ ID NO: 60513 - DNA, 15 bp, Artificial Sequence
  dgRNA
  Tab2
ccggccacggcgagc

SEQ ID NO: 60514 - DNA, 15 bp, Artificial Sequence
  dgRNA
  Pld2
ccggggtccgcatcc

SEQ ID NO: 60515 - DNA, 15 bp, Artificial Sequence
  dgRNA
  Pld2
cggggtccgcatcca

SEQ ID NO: 60516 - DNA, 15 bp, Artificial Sequence
  dgRNA
  Pld2
tccgcatccagggtg

SEQ ID NO: 60517 - DNA, 15 bp, Artificial Sequence
  dgRNA
  Pld2
ccgcatccagggtgc

SEQ ID NO: 60518 - DNA, 15 bp, Artificial Sequence
  dgRNA
  Sln
taaattggcagccaa

SEQ ID NO: 60519 - DNA, 15 bp, Artificial Sequence
  dgRNA
  Sln
ccccccagtacaaat

SEQ ID NO: 60520 - DNA, 15 bp, Artificial Sequence
  dgRNA
  Sln
ccagtacaaattggc

SEQ ID NO: 60521 - DNA, 15 bp, Artificial Sequence
  dgRNA
  Sln
ccctcagactacatt

SEQ ID NO: 60522 - DNA, 15 bp, Artificial Sequence
  dgRNA
  Adal
cttaacttaagttag

SEQ ID NO: 60523 - DNA, 15 bp, Artificial Sequence
  dgRNA
  Adal
ttaacttaagttagt

SEQ ID NO: 60524 - DNA, 15 bp, Artificial Sequence
  dgRNA
  Adal
taagttagtgggagc

SEQ ID NO: 60525 - DNA, 15 bp, Artificial Sequence
  dgRNA
  Adal
aggtgtgtctgcaat

SEQ ID NO: 60526 - DNA, 15 bp, Artificial Sequence
  dgRNA
  Gtf2b
gcctccggagatcaa

SEQ ID NO: 60527 - DNA, 15 bp, Artificial Sequence
  dgRNA
  Gtf2b
cctccggagatcaaa

SEQ ID NO: 60528 - DNA, 15 bp, Artificial Sequence
  dgRNA
  Gtf2b
ctccggagatcaaag

SEQ ID NO: 60529 - DNA, 15 bp, Artificial Sequence
  dgRNA
  Gtf2b
ccctttgatctccgg

SEQ ID NO: 60530 - DNA, 15 bp, Artificial Sequence
  dgRNA
  Hmha1
ccttgagctagccta

SEQ ID NO: 60531 - DNA, 15 bp, Artificial Sequence
  dgRNA
  Hmha1
gcctatggagatatg

SEQ ID NO: 60532 - DNA, 15 bp, Artificial Sequence
  dgRNA
  Hmha1
atgaccggcctaagc

SEQ ID NO: 60533 - DNA, 15 bp, Artificial Sequence
  dgRNA
  Hmha1
cggcctaagccggtt

SEQ ID NO: 60534 - DNA, 15 bp, Artificial Sequence
  dgRNA
  Car8
agggtattaggactt

SEQ ID NO: 60535 - DNA, 15 bp, Artificial Sequence
  dgRNA
  Car8
cagtttgattttcgc

SEQ ID NO: 60536 - DNA, 15 bp, Artificial Sequence
  dgRNA
  Car8
tgcctgtcccgattg

SEQ ID NO: 60537 - DNA, 15 bp, Artificial Sequence
  dgRNA
  Car8
gcctgtcccgattgt

SEQ ID NO: 60538 - DNA, 15 bp, Artificial Sequence
  dgRNA
  Dnajb6
gctccgagaatcttc

SEQ ID NO: 60539 - DNA, 15 bp, Artificial Sequence
  dgRNA
  Dnajb6
caagtccgacgcgca

SEQ ID NO: 60540 - DNA, 15 bp, Artificial Sequence
  dgRNA
  Dnajb6
gtccgacgcgcacgg

SEQ ID NO: 60541 - DNA, 15 bp, Artificial Sequence
  dgRNA
  Dnajb6
gcgcacgttagcttc

SEQ ID NO: 60542 - DNA, 15 bp, Artificial Sequence
  dgRNA
  Zfp24
cagtcactctgcgaa

SEQ ID NO: 60543 - DNA, 15 bp, Artificial Sequence
  dgRNA
  Zfp24
tctgcgaaaggcgcc

SEQ ID NO: 60544 - DNA, 15 bp, Artificial Sequence
  dgRNA
  Zfp24
caccgcgcgtcccca

SEQ ID NO: 60545 - DNA, 15 bp, Artificial Sequence
  dgRNA
  Zfp24
ggcaaccccgggcat

SEQ ID NO: 60546 - DNA, 15 bp, Artificial Sequence
  dgRNA
  Uba6
ggaagtgacgcgttt

SEQ ID NO: 60547 - DNA, 15 bp, Artificial Sequence
  dgRNA
  Uba6
ttgccccgccccaac

SEQ ID NO: 60548 - DNA, 15 bp, Artificial Sequence
  dgRNA
  Uba6
ccccaaccggaagtc

SEQ ID NO: 60549 - DNA, 15 bp, Artificial Sequence
  dgRNA
  Uba6
aaaacgcgtcacttc

SEQ ID NO: 60550 - DNA, 15 bp, Artificial Sequence
  dgRNA
  Alb
tggcaaacatacgca

SEQ ID NO: 60551 - DNA, 15 bp, Artificial Sequence
  dgRNA
  Alb
ggcaaacatacgcaa

SEQ ID NO: 60552 - DNA, 15 bp, Artificial Sequence
  dgRNA
  Alb
ggtatgattttgtaa

SEQ ID NO: 60553 - DNA, 15 bp, Artificial Sequence
  dgRNA
  Alb
aaccaatgaaatgcg

SEQ ID NO: 60554 - DNA, 15 bp, Artificial Sequence
  dgRNA
  Gm9513
gttcgtaaaaatctg

SEQ ID NO: 60555 - DNA, 15 bp, Artificial Sequence
  dgRNA
  Gm9513
tatctatgctccccc

SEQ ID NO: 60556 - DNA, 15 bp, Artificial Sequence
  dgRNA
  Gm9513
ttcctaatatcccat

SEQ ID NO: 60557 - DNA, 15 bp, Artificial Sequence
  dgRNA
  Gm9513
tgcccctcctaactt

SEQ ID NO: 60558 - DNA, 15 bp, Artificial Sequence
  dgRNA
  Gnas
gaggtgcccgcgcat

SEQ ID NO: 60559 - DNA, 15 bp, Artificial Sequence
  dgRNA
  Gnas
ctcaccccccgcctg

SEQ ID NO: 60560 - DNA, 15 bp, Artificial Sequence
  dgRNA
  Gnas
tgagcacgtcctcag

SEQ ID NO: 60561 - DNA, 15 bp, Artificial Sequence
  dgRNA
  Gnas
gagcacgtcctcagt

SEQ ID NO: 60562 - DNA, 15 bp, Artificial Sequence
  dgRNA
  Fnta
aacctgcattcggga

SEQ ID NO: 60563 - DNA, 15 bp, Artificial Sequence
  dgRNA
  Fnta
acctgcattcgggaa

SEQ ID NO: 60564 - DNA, 15 bp, Artificial Sequence
  dgRNA
  Fnta
tcgggaagggggccc

SEQ ID NO: 60565 - DNA, 15 bp, Artificial Sequence
  dgRNA
  Fnta
ggacagtaggtattc

SEQ ID NO: 60566 - DNA, 15 bp, Artificial Sequence
  dgRNA
  Ap1s3
gagcagcccggtgcg

SEQ ID NO: 60567 - DNA, 15 bp, Artificial Sequence
  dgRNA
  Ap1s3
cagcccggtgcgggg

SEQ ID NO: 60568 - DNA, 15 bp, Artificial Sequence
  dgRNA
  Ap1s3
ctctcctgcgccacg

SEQ ID NO: 60569 - DNA, 15 bp, Artificial Sequence
  dgRNA
  Ap1s3
gctctcctgcgccac

SEQ ID NO: 60570 - DNA, 15 bp, Artificial Sequence
  dgRNA
  Wfdc11
gggtgcatcttgttc

SEQ ID NO: 60571 - DNA, 15 bp, Artificial Sequence
  dgRNA
  Wfdc11
ccaccttaagatctg

SEQ ID NO: 60572 - DNA, 15 bp, Artificial Sequence
  dgRNA
  Wfdc11
aaggtgggtacatac

SEQ ID NO: 60573 - DNA, 15 bp, Artificial Sequence
  dgRNA
  Wfdc11
ctcagatcttaaggt

SEQ ID NO: 60574 - DNA, 15 bp, Artificial Sequence
  dgRNA
  Cenpw
aagcagtgggttcgc

SEQ ID NO: 60575 - DNA, 15 bp, Artificial Sequence
  dgRNA
  Cenpw
tccagcctgcgcttc

SEQ ID NO: 60576 - DNA, 15 bp, Artificial Sequence
  dgRNA
  Cenpw
gcgcttccggtgctg

SEQ ID NO: 60577 - DNA, 15 bp, Artificial Sequence
  dgRNA
  Cenpw
cttccggtgctgcgg

SEQ ID NO: 60578 - DNA, 15 bp, Artificial Sequence
  dgRNA
  Olfr1415
tgccaagtcttaaac

SEQ ID NO: 60579 - DNA, 15 bp, Artificial Sequence
  dgRNA
  Olfr220
ttaattgctagaggc

SEQ ID NO: 60580 - DNA, 15 bp, Artificial Sequence
  dgRNA
  Olfr220
agtttaatcaatctc

SEQ ID NO: 60581 - DNA, 15 bp, Artificial Sequence
  dgRNA
  Olfr220
gtttaatcaatctca

SEQ ID NO: 60582 - DNA, 15 bp, Artificial Sequence
  dgRNA
  Olfr220
catcaattaggtata

SEQ ID NO: 60583 - DNA, 15 bp, Artificial Sequence
  dgRNA
  Lce1k
gtcacagagtcatgt

SEQ ID NO: 60584 - DNA, 15 bp, Artificial Sequence
  dgRNA
  Lce1k
gtgacaggtcatgac

SEQ ID NO: 60585 - DNA, 15 bp, Artificial Sequence
  dgRNA
  Il18rap
tcgaatgttaacatt

SEQ ID NO: 60586 - DNA, 15 bp, Artificial Sequence
  dgRNA
  Il18rap
gttaacatttggtac

SEQ ID NO: 60587 - DNA, 15 bp, Artificial Sequence
  dgRNA
  Il18rap
acggtttctcaacag

SEQ ID NO: 60588 - DNA, 15 bp, Artificial Sequence
  dgRNA
  Il18rap
cacggtttctcaaca

SEQ ID NO: 60589 - DNA, 15 bp, Artificial Sequence
  dgRNA
  Dda1
gtcgccacccacgtc

SEQ ID NO: 60590 - DNA, 15 bp, Artificial Sequence
  dgRNA
  Dda1
cccaagccccgggcg

SEQ ID NO: 60591 - DNA, 15 bp, Artificial Sequence
  dgRNA
  Dda1
cgaactcgacgacga

SEQ ID NO: 60592 - DNA, 15 bp, Artificial Sequence
  dgRNA
  Dda1
actcgacgacgaagg

SEQ ID NO: 60593 - DNA, 15 bp, Artificial Sequence
  dgRNA
  Slc22a2
cagagacgaactcac

SEQ ID NO: 60594 - DNA, 15 bp, Artificial Sequence
  dgRNA
  Slc22a2
agagacgaactcaca

SEQ ID NO: 60595 - DNA, 15 bp, Artificial Sequence
  dgRNA
  Slc22a2
aagatcttcccccat

SEQ ID NO: 60596 - DNA, 15 bp, Artificial Sequence
  dgRNA
  Slc22a2
cttcccccattggag

SEQ ID NO: 60597 - DNA, 15 bp, Artificial Sequence
  dgRNA
  Olfr653
gaatggacatttagt

SEQ ID NO: 60598 - DNA, 15 bp, Artificial Sequence
  dgRNA
  AC151602.2
tttttttgggcccca

SEQ ID NO: 60599 - DNA, 15 bp, Artificial Sequence
  dgRNA
  AC151602.2
caggttggcgacgtc

SEQ ID NO: 60600 - DNA, 15 bp, Artificial Sequence
  dgRNA
  AC151602.2
gacgtcaggcccctg

SEQ ID NO: 60601 - DNA, 15 bp, Artificial Sequence
  dgRNA
  Cdc42ep4
ctgcggaccgcacgt

SEQ ID NO: 60602 - DNA, 15 bp, Artificial Sequence
  dgRNA
  Cdc42ep4
cgcacgtcggttccg

SEQ ID NO: 60603 - DNA, 15 bp, Artificial Sequence
  dgRNA
  Cdc42ep4
tccgcggcagagcac

SEQ ID NO: 60604 - DNA, 15 bp, Artificial Sequence
  dgRNA
  Cdc42ep4
ccgcggcagagcact

SEQ ID NO: 60605 - DNA, 15 bp, Artificial Sequence
  dgRNA
  Acr
gaggtcttccgacag

SEQ ID NO: 60606 - DNA, 15 bp, Artificial Sequence
  dgRNA
  Acr
ttccgacagaggaga

SEQ ID NO: 60607 - DNA, 15 bp, Artificial Sequence
  dgRNA
  Acr
tccgacagaggagat

SEQ ID NO: 60608 - DNA, 15 bp, Artificial Sequence
  dgRNA
  Acr
tcaggagaatctact

SEQ ID NO: 60609 - DNA, 15 bp, Artificial Sequence
  dgRNA
  Sdf2l1
cagccactgctttat

SEQ ID NO: 60610 - DNA, 15 bp, Artificial Sequence
  dgRNA
  Sdf2l1
ccactgctttattgg

SEQ ID NO: 60611 - DNA, 15 bp, Artificial Sequence
  dgRNA
  Sdf2l1
cactgctttattggc

SEQ ID NO: 60612 - DNA, 15 bp, Artificial Sequence
  dgRNA
  Sdf2l1
ttattggcgggtcct

SEQ ID NO: 60613 - DNA, 15 bp, Artificial Sequence
  dgRNA
  Il21r
cgaagcctccgctgg

SEQ ID NO: 60614 - DNA, 15 bp, Artificial Sequence
  dgRNA
  Il21r
ttcggtgtctatctg

SEQ ID NO: 60615 - DNA, 15 bp, Artificial Sequence
  dgRNA
  Il21r
caccagcggaggctt

SEQ ID NO: 60616 - DNA, 15 bp, Artificial Sequence
  dgRNA
  Il21r
tgcgactgaaacaca

SEQ ID NO: 60617 - DNA, 15 bp, Artificial Sequence
  dgRNA
  Sod1
cgactttccccgctc

SEQ ID NO: 60618 - DNA, 15 bp, Artificial Sequence
  dgRNA
  Sod1
ccgctcaggctcctc

SEQ ID NO: 60619 - DNA, 15 bp, Artificial Sequence
  dgRNA
  Sod1
cagtccgcacgctcc

SEQ ID NO: 60620 - DNA, 15 bp, Artificial Sequence
  dgRNA
  Sod1
ccccagcgtgccccg

SEQ ID NO: 60621 - DNA, 15 bp, Artificial Sequence
  dgRNA
  Dgat1
tccgcgtcttcgatt

SEQ ID NO: 60622 - DNA, 15 bp, Artificial Sequence
  dgRNA
  Dgat1
gcctccgctcggcct

SEQ ID NO: 60623 - DNA, 15 bp, Artificial Sequence
  dgRNA
  Dgat1
gcctcggactacaaa

SEQ ID NO: 60624 - DNA, 15 bp, Artificial Sequence
  dgRNA
  Dgat1
gacgtatagcactct

SEQ ID NO: 60625 - DNA, 15 bp, Artificial Sequence
  dgRNA
  Oas1d
gcgcctgccacctgc

SEQ ID NO: 60626 - DNA, 15 bp, Artificial Sequence
  dgRNA
  Zfp473
agcagcgagcagacg

SEQ ID NO: 60627 - DNA, 15 bp, Artificial Sequence
  dgRNA
  Zfp473
tcgcacggccggtgg

SEQ ID NO: 60628 - DNA, 15 bp, Artificial Sequence
  dgRNA
  Zfp473
gtcgcacggccggtg

SEQ ID NO: 60629 - DNA, 15 bp, Artificial Sequence
  dgRNA
  Zfp473
tgtcgcacggccggt

SEQ ID NO: 60630 - DNA, 15 bp, Artificial Sequence
  dgRNA
  Opa3
cgagcggccgtttaa

SEQ ID NO: 60631 - DNA, 15 bp, Artificial Sequence
  dgRNA
  Opa3
tgcatacccaacgta

SEQ ID NO: 60632 - DNA, 15 bp, Artificial Sequence
  dgRNA
  Opa3
aacgtacggacgtcg

SEQ ID NO: 60633 - DNA, 15 bp, Artificial Sequence
  dgRNA
  Opa3
gtcgaggcgtcgacg

SEQ ID NO: 60634 - DNA, 15 bp, Artificial Sequence
  dgRNA
  Zcchc18
cgaatgaaatgtaaa

SEQ ID NO: 60635 - DNA, 15 bp, Artificial Sequence
  dgRNA
  Zcchc18
gcagccccctctagc

SEQ ID NO: 60636 - DNA, 15 bp, Artificial Sequence
  dgRNA
  Zcchc18
gcaggttcccccctc

SEQ ID NO: 60637 - DNA, 15 bp, Artificial Sequence
  dgRNA
  Zcchc18
gttcccccctctggc

SEQ ID NO: 60638 - DNA, 15 bp, Artificial Sequence
  dgRNA
  Jade2
ccggagccaaacaac

SEQ ID NO: 60639 - DNA, 15 bp, Artificial Sequence
  dgRNA
  Jade2
gggggaacacgacag

SEQ ID NO: 60640 - DNA, 15 bp, Artificial Sequence
  dgRNA
  Jade2
gggaacacgacaggg

SEQ ID NO: 60641 - DNA, 15 bp, Artificial Sequence
  dgRNA
  Jade2
acgacaggggggtgc

SEQ ID NO: 60642 - DNA, 15 bp, Artificial Sequence
  dgRNA
  Bcl11a
gccattggcttgtcc

SEQ ID NO: 60643 - DNA, 15 bp, Artificial Sequence
  dgRNA
  Bcl11a
gacgttcaagttcgc

SEQ ID NO: 60644 - DNA, 15 bp, Artificial Sequence
  dgRNA
  Bcl11a
acgttcaagttcgca

SEQ ID NO: 60645 - DNA, 15 bp, Artificial Sequence
  dgRNA
  Bcl11a
atggccagtgcgggg

SEQ ID NO: 60646 - DNA, 15 bp, Artificial Sequence
  dgRNA
  Aadacl2
tccagtgcttacatt

SEQ ID NO: 60647 - DNA, 15 bp, Artificial Sequence
  dgRNA
  Pnck
tggctaccagaccac

SEQ ID NO: 60648 - DNA, 15 bp, Artificial Sequence
  dgRNA
  Pnck
cagcaagcataacta

SEQ ID NO: 60649 - DNA, 15 bp, Artificial Sequence
  dgRNA
  Pnck
gggaattgccttaca

SEQ ID NO: 60650 - DNA, 15 bp, Artificial Sequence
  dgRNA
  Pnck
cagccaccgcgtgct

SEQ ID NO: 60651 - DNA, 15 bp, Artificial Sequence
  dgRNA
  Otop3
tcggacctgacgact

SEQ ID NO: 60652 - DNA, 15 bp, Artificial Sequence
  dgRNA
  Otop3
gcaccccattccact

SEQ ID NO: 60653 - DNA, 15 bp, Artificial Sequence
  dgRNA
  Otop3
accccattccacttg

SEQ ID NO: 60654 - DNA, 15 bp, Artificial Sequence
  dgRNA
  Otop3
cccattccacttggg

SEQ ID NO: 60655 - DNA, 15 bp, Artificial Sequence
  dgRNA
  Rimbp2
cttcgtgagagacac

SEQ ID NO: 60656 - DNA, 15 bp, Artificial Sequence
  dgRNA
  Rimbp2
gtgagagacaccggc

SEQ ID NO: 60657 - DNA, 15 bp, Artificial Sequence
  dgRNA
  Rimbp2
tgagagacaccggca

SEQ ID NO: 60658 - DNA, 15 bp, Artificial Sequence
  dgRNA
  Rimbp2
gacaccggcagggaa

SEQ ID NO: 60659 - DNA, 15 bp, Artificial Sequence
  dgRNA
  Proz
actacatattccctg

SEQ ID NO: 60660 - DNA, 15 bp, Artificial Sequence
  dgRNA
  Proz
acatattccctgcgg

SEQ ID NO: 60661 - DNA, 15 bp, Artificial Sequence
  dgRNA
  Proz
gctgtgcccggaccc

SEQ ID NO: 60662 - DNA, 15 bp, Artificial Sequence
  dgRNA
  Proz
tgcccggacccagga

SEQ ID NO: 60663 - DNA, 15 bp, Artificial Sequence
  dgRNA
  Atp2a2
ggcctgctggcggcg

SEQ ID NO: 60664 - DNA, 15 bp, Artificial Sequence
  dgRNA
  Atp2a2
gcctgctggcggcgt

SEQ ID NO: 60665 - DNA, 15 bp, Artificial Sequence
  dgRNA
  Atp2a2
cgcggtgcgcgcgcg

SEQ ID NO: 60666 - DNA, 15 bp, Artificial Sequence
  dgRNA
  Atp2a2
gcggtgcgcgcgcgc

SEQ ID NO: 60667 - DNA, 15 bp, Artificial Sequence
  dgRNA
  Ddx26b
tacaaccctcaagct

SEQ ID NO: 60668 - DNA, 15 bp, Artificial Sequence
  dgRNA
  Ddx26b
ataattggcagccaa

SEQ ID NO: 60669 - DNA, 15 bp, Artificial Sequence
  dgRNA
  Ddx26b
ttgagggttgtagtt

SEQ ID NO: 60670 - DNA, 15 bp, Artificial Sequence
  dgRNA
  Ddx26b
ttgggccaagcttga

SEQ ID NO: 60671 - DNA, 15 bp, Artificial Sequence
  dgRNA
  Olfr467
tgatgtaacttggtc

SEQ ID NO: 60672 - DNA, 15 bp, Artificial Sequence
  dgRNA
  Olfr467
gatgtaacttggtct

SEQ ID NO: 60673 - DNA, 15 bp, Artificial Sequence
  dgRNA
  Olfr467
gggctaaatgtggag

SEQ ID NO: 60674 - DNA, 15 bp, Artificial Sequence
  dgRNA
  Slc12a5
cgcagaccctcagtc

SEQ ID NO: 60675 - DNA, 15 bp, Artificial Sequence
  dgRNA
  Slc12a5
caggcagccgctgcg

SEQ ID NO: 60676 - DNA, 15 bp, Artificial Sequence
  dgRNA
  Slc12a5
cctgccgttattttt

SEQ ID NO: 60677 - DNA, 15 bp, Artificial Sequence
  dgRNA
  Slc12a5
ttatttttagggcgc

SEQ ID NO: 60678 - DNA, 15 bp, Artificial Sequence
  dgRNA
  Ccdc85b
cacgaggccccgccc

SEQ ID NO: 60679 - DNA, 15 bp, Artificial Sequence
  dgRNA
  Ccdc85b
actgcctacggtcct

SEQ ID NO: 60680 - DNA, 15 bp, Artificial Sequence
  dgRNA
  Ccdc85b
gaggcaaccggcccg

SEQ ID NO: 60681 - DNA, 15 bp, Artificial Sequence
  dgRNA
  Ccdc85b
gcaaccggcccgagg

SEQ ID NO: 60682 - DNA, 15 bp, Artificial Sequence
  dgRNA
  Mmachc
ggaaatacgtttccc

SEQ ID NO: 60683 - DNA, 15 bp, Artificial Sequence
  dgRNA
  Mmachc
tcccgtgaagctcgt

SEQ ID NO: 60684 - DNA, 15 bp, Artificial Sequence
  dgRNA
  Mmachc
cccgtgaagctcgtc

SEQ ID NO: 60685 - DNA, 15 bp, Artificial Sequence
  dgRNA
  Mmachc
aagctcgtcgggaca

SEQ ID NO: 60686 - DNA, 15 bp, Artificial Sequence
  dgRNA
  Myo18b
ccccagctggttcaa

SEQ ID NO: 60687 - DNA, 15 bp, Artificial Sequence
  dgRNA
  Myo18b
ctcacgggctaattt

SEQ ID NO: 60688 - DNA, 15 bp, Artificial Sequence
  dgRNA
  Myo18b
tgctatctcagtagc

SEQ ID NO: 60689 - DNA, 15 bp, Artificial Sequence
  dgRNA
  Myo18b
gctatctcagtagct

SEQ ID NO: 60690 - DNA, 15 bp, Artificial Sequence
  dgRNA
  Msto1
tgaattattagctac

SEQ ID NO: 60691 - DNA, 15 bp, Artificial Sequence
  dgRNA
  Msto1
tattagctacaggag

SEQ ID NO: 60692 - DNA, 15 bp, Artificial Sequence
  dgRNA
  Msto1
acccgccacagtctg

SEQ ID NO: 60693 - DNA, 15 bp, Artificial Sequence
  dgRNA
  Msto1
agtctgaggcgcaga

SEQ ID NO: 60694 - DNA, 15 bp, Artificial Sequence
  dgRNA
  Traf3
tttccagcgcgcgag

SEQ ID NO: 60695 - DNA, 15 bp, Artificial Sequence
  dgRNA
  Traf3
ggaagtgccagcgcg

SEQ ID NO: 60696 - DNA, 15 bp, Artificial Sequence
  dgRNA
  Traf3
gaagtgccagcgcga

SEQ ID NO: 60697 - DNA, 15 bp, Artificial Sequence
  dgRNA
  Traf3
gcgcgagggtgcgtg

SEQ ID NO: 60698 - DNA, 15 bp, Artificial Sequence
  dgRNA
  Spast
agccaccggccgcgg

SEQ ID NO: 60699 - DNA, 15 bp, Artificial Sequence
  dgRNA
  Spast
gccaccggccgcggc

SEQ ID NO: 60700 - DNA, 15 bp, Artificial Sequence
  dgRNA
  Spast
accggccgcggcggg

SEQ ID NO: 60701 - DNA, 15 bp, Artificial Sequence
  dgRNA
  Spast
acggggttgtgctcc

SEQ ID NO: 60702 - DNA, 15 bp, Artificial Sequence
  dgRNA
  Col24a1
gtgggtacatctcaa

SEQ ID NO: 60703 - DNA, 15 bp, Artificial Sequence
  dgRNA
  Col24a1
ctgaccctgctaggt

SEQ ID NO: 60704 - DNA, 15 bp, Artificial Sequence
  dgRNA
  Col24a1
accctgctaggttgg

SEQ ID NO: 60705 - DNA, 15 bp, Artificial Sequence
  dgRNA
  Col24a1
tggaagaaggttgcg

SEQ ID NO: 60706 - DNA, 15 bp, Artificial Sequence
  dgRNA
  Bmp5
ataaaattgcgaaaa

SEQ ID NO: 60707 - DNA, 15 bp, Artificial Sequence
  dgRNA
  Bmp5
aaattgcgaaaatgg

SEQ ID NO: 60708 - DNA, 15 bp, Artificial Sequence
  dgRNA
  Bmp5
gtacgcgttccaggg

SEQ ID NO: 60709 - DNA, 15 bp, Artificial Sequence
  dgRNA
  Bmp5
ggtgtacgcgttcca

SEQ ID NO: 60710 - DNA, 15 bp, Artificial Sequence
  dgRNA
  Clic4
cgcgctgcccagcct

SEQ ID NO: 60711 - DNA, 15 bp, Artificial Sequence
  dgRNA
  Clic4
ctagtggtcggtccg

SEQ ID NO: 60712 - DNA, 15 bp, Artificial Sequence
  dgRNA
  Clic4
aagccacgcccctca

SEQ ID NO: 60713 - DNA, 15 bp, Artificial Sequence
  dgRNA
  Clic4
cgcggattggccggg

SEQ ID NO: 60714 - DNA, 15 bp, Artificial Sequence
  dgRNA
  Npffr2
tctccgttttactct

SEQ ID NO: 60715 - DNA, 15 bp, Artificial Sequence
  dgRNA
  Npffr2
tctggatactatccc

SEQ ID NO: 60716 - DNA, 15 bp, Artificial Sequence
  dgRNA
  Npffr2
ggccaaagtttatcc

SEQ ID NO: 60717 - DNA, 15 bp, Artificial Sequence
  dgRNA
  Npffr2
gccaaagtttatcct

SEQ ID NO: 60718 - DNA, 15 bp, Artificial Sequence
  dgRNA
  Pfkfb3
gtcccaacttcatta

SEQ ID NO: 60719 - DNA, 15 bp, Artificial Sequence
  dgRNA
  Pfkfb3
caccacacagcccga

SEQ ID NO: 60720 - DNA, 15 bp, Artificial Sequence
  dgRNA
  Pfkfb3
acagcccgaaggaac

SEQ ID NO: 60721 - DNA, 15 bp, Artificial Sequence
  dgRNA
  Pfkfb3
gcccgaaggaactgg

SEQ ID NO: 60722 - DNA, 15 bp, Artificial Sequence
  dgRNA
  Gm6588
tcgagtcccacccac

SEQ ID NO: 60723 - DNA, 15 bp, Artificial Sequence
  dgRNA
  Gm6588
gctccgccccctatc

SEQ ID NO: 60724 - DNA, 15 bp, Artificial Sequence
  dgRNA
  Gm6588
aacccacttggttcc

SEQ ID NO: 60725 - DNA, 15 bp, Artificial Sequence
  dgRNA
  Gm6588
ggtcctgtaatgggg

SEQ ID NO: 60726 - DNA, 15 bp, Artificial Sequence
  dgRNA
  Pde4dip
caaagtccgctttac

SEQ ID NO: 60727 - DNA, 15 bp, Artificial Sequence
  dgRNA
  Pde4dip
aaagtccgctttacc

SEQ ID NO: 60728 - DNA, 15 bp, Artificial Sequence
  dgRNA
  Pde4dip
ctttaccgggctagc

SEQ ID NO: 60729 - DNA, 15 bp, Artificial Sequence
  dgRNA
  Pde4dip
gctagcaggcgagaa

SEQ ID NO: 60730 - DNA, 15 bp, Artificial Sequence
  dgRNA
  Olfr292
tccatctgggcattt

SEQ ID NO: 60731 - DNA, 15 bp, Artificial Sequence
  dgRNA
  Olfr292
attttggcccaatta

SEQ ID NO: 60732 - DNA, 15 bp, Artificial Sequence
  dgRNA
  Ifih1
aaaccgatctgtggg

SEQ ID NO: 60733 - DNA, 15 bp, Artificial Sequence
  dgRNA
  Ifih1
cgatctgtgggtgga

SEQ ID NO: 60734 - DNA, 15 bp, Artificial Sequence
  dgRNA
  Ifih1
acttaaagctccctg

SEQ ID NO: 60735 - DNA, 15 bp, Artificial Sequence
  dgRNA
  Ifih1
gggtgaacgtcccag

SEQ ID NO: 60736 - DNA, 15 bp, Artificial Sequence
  dgRNA
  Krr1
ggttgcaatgcatcc

SEQ ID NO: 60737 - DNA, 15 bp, Artificial Sequence
  dgRNA
  Krr1
gttgcaatgcatcct

SEQ ID NO: 60738 - DNA, 15 bp, Artificial Sequence
  dgRNA
  Krr1
ccgtccccgccccat

SEQ ID NO: 60739 - DNA, 15 bp, Artificial Sequence
  dgRNA
  Krr1
cttgtatagccctgt

SEQ ID NO: 60740 - DNA, 15 bp, Artificial Sequence
  dgRNA
  Fau
atatgcgcgcgcagc

SEQ ID NO: 60741 - DNA, 15 bp, Artificial Sequence
  dgRNA
  Fau
tatgcgcgcgcagcc

SEQ ID NO: 60742 - DNA, 15 bp, Artificial Sequence
  dgRNA
  Fau
tccctctgcgcgcgc

SEQ ID NO: 60743 - DNA, 15 bp, Artificial Sequence
  dgRNA
  Fau
cgcgcgcaggccaca

SEQ ID NO: 60744 - DNA, 15 bp, Artificial Sequence
  dgRNA
  Pcsk1n
gcccttatactgcca

SEQ ID NO: 60745 - DNA, 15 bp, Artificial Sequence
  dgRNA
  Pcsk1n
tccatggcgatgcgc

SEQ ID NO: 60746 - DNA, 15 bp, Artificial Sequence
  dgRNA
  Pcsk1n
gcgcctgcgtacagt

SEQ ID NO: 60747 - DNA, 15 bp, Artificial Sequence
  dgRNA
  Pcsk1n
acggggacgcgggga

SEQ ID NO: 60748 - DNA, 15 bp, Artificial Sequence
  dgRNA
  Ednra
agcgctcttgcagtt

SEQ ID NO: 60749 - DNA, 15 bp, Artificial Sequence
  dgRNA
  Ednra
gttgtgccctgtttt

SEQ ID NO: 60750 - DNA, 15 bp, Artificial Sequence
  dgRNA
  Ednra
tggttagtctaggat

SEQ ID NO: 60751 - DNA, 15 bp, Artificial Sequence
  dgRNA
  Ednra
ttggttagtctagga

SEQ ID NO: 60752 - DNA, 15 bp, Artificial Sequence
  dgRNA
  Usp24
tctctctgcgctccg

SEQ ID NO: 60753 - DNA, 15 bp, Artificial Sequence
  dgRNA
  Usp24
cacctcagacacgtt

SEQ ID NO: 60754 - DNA, 15 bp, Artificial Sequence
  dgRNA
  Usp24
gcgcacgcccctccc

SEQ ID NO: 60755 - DNA, 15 bp, Artificial Sequence
  dgRNA
  Usp24
tccctggccccggcc

SEQ ID NO: 60756 - DNA, 15 bp, Artificial Sequence
  dgRNA
  Hoxa10
agcgagctttctgaa

SEQ ID NO: 60757 - DNA, 15 bp, Artificial Sequence
  dgRNA
  Hoxa10
gcgagctttctgaaa

SEQ ID NO: 60758 - DNA, 15 bp, Artificial Sequence
  dgRNA
  Hoxa10
cgagctttctgaaag

SEQ ID NO: 60759 - DNA, 15 bp, Artificial Sequence
  dgRNA
  Hoxa10
ctggggggcgaaagg

SEQ ID NO: 60760 - DNA, 15 bp, Artificial Sequence
  dgRNA
  Krtap2-4
gggctctcttttcat

SEQ ID NO: 60761 - DNA, 15 bp, Artificial Sequence
  dgRNA
  Krtap2-4
tgttcaggtatataa

SEQ ID NO: 60762 - DNA, 15 bp, Artificial Sequence
  dgRNA
  Krtap2-4
ccaacggccatttcc

SEQ ID NO: 60763 - DNA, 15 bp, Artificial Sequence
  dgRNA
  Glra2
ctgaaatttataggc

SEQ ID NO: 60764 - DNA, 15 bp, Artificial Sequence
  dgRNA
  Glra2
gtgcgataacaacta

SEQ ID NO: 60765 - DNA, 15 bp, Artificial Sequence
  dgRNA
  Glra2
gagtgactgattctt

SEQ ID NO: 60766 - DNA, 15 bp, Artificial Sequence
  dgRNA
  Glra2
gcgggggtcggagag

SEQ ID NO: 60767 - DNA, 15 bp, Artificial Sequence
  dgRNA
  Hdac5
tccgaatgttgttgt

SEQ ID NO: 60768 - DNA, 15 bp, Artificial Sequence
  dgRNA
  Hgsnat
gcggttttctcccga

SEQ ID NO: 60769 - DNA, 15 bp, Artificial Sequence
  dgRNA
  Hgsnat
cggttttctcccgat

SEQ ID NO: 60770 - DNA, 15 bp, Artificial Sequence
  dgRNA
  Hgsnat
gctgccctcctatgg

SEQ ID NO: 60771 - DNA, 15 bp, Artificial Sequence
  dgRNA
  Hgsnat
atggtggacactagc

SEQ ID NO: 60772 - DNA, 15 bp, Artificial Sequence
  dgRNA
  Hnrnpk
cgcgccaaactccct

SEQ ID NO: 60773 - DNA, 15 bp, Artificial Sequence
  dgRNA
  Hnrnpk
gcgccaaactccctc

SEQ ID NO: 60774 - DNA, 15 bp, Artificial Sequence
  dgRNA
  Hnrnpk
cgccaaactccctcg

SEQ ID NO: 60775 - DNA, 15 bp, Artificial Sequence
  dgRNA
  Hnrnpk
cgcagtcgcccctcc

SEQ ID NO: 60776 - DNA, 15 bp, Artificial Sequence
  dgRNA
  Cat
gtctcttcctatccg

SEQ ID NO: 60777 - DNA, 15 bp, Artificial Sequence
  dgRNA
  Cat
tctcttcctatccgg

SEQ ID NO: 60778 - DNA, 15 bp, Artificial Sequence
  dgRNA
  Cat
ctcttcctatccggg

SEQ ID NO: 60779 - DNA, 15 bp, Artificial Sequence
  dgRNA
  Cat
cggggggtccacctc

SEQ ID NO: 60780 - DNA, 15 bp, Artificial Sequence
  dgRNA
  Cxx1a
ctatagatctaaagt

SEQ ID NO: 60781 - DNA, 15 bp, Artificial Sequence
  dgRNA
  Cxx1a
caatgtcccgctcaa

SEQ ID NO: 60782 - DNA, 15 bp, Artificial Sequence
  dgRNA
  Cxx1a
cccttcccgagacct

SEQ ID NO: 60783 - DNA, 15 bp, Artificial Sequence
  dgRNA
  Cxx1a
ccttcccgagacctt

SEQ ID NO: 60784 - DNA, 15 bp, Artificial Sequence
  dgRNA
  Naaladl1
gccaaaatgtggtcc

SEQ ID NO: 60785 - DNA, 15 bp, Artificial Sequence
  dgRNA
  Naaladl1
tggcttttcaccata

SEQ ID NO: 60786 - DNA, 15 bp, Artificial Sequence
  dgRNA
  Naaladl1
accacccatgagtaa

SEQ ID NO: 60787 - DNA, 15 bp, Artificial Sequence
  dgRNA
  Naaladl1
aatggttaaccaaac

SEQ ID NO: 60788 - DNA, 15 bp, Artificial Sequence
  dgRNA
  Scyl1
tacaaggccacaagt

SEQ ID NO: 60789 - DNA, 15 bp, Artificial Sequence
  dgRNA
  Scyl1
ttcagatgaccatct

SEQ ID NO: 60790 - DNA, 15 bp, Artificial Sequence
  dgRNA
  Scyl1
cgctccgccctgccc

SEQ ID NO: 60791 - DNA, 15 bp, Artificial Sequence
  dgRNA
  Scyl1
gctccgccctgccca

SEQ ID NO: 60792 - DNA, 15 bp, Artificial Sequence
  dgRNA
  Blvrb
actcccttccctaga

SEQ ID NO: 60793 - DNA, 15 bp, Artificial Sequence
  dgRNA
  Blvrb
tccctagaaggggcg

SEQ ID NO: 60794 - DNA, 15 bp, Artificial Sequence
  dgRNA
  Blvrb
cgtctaagcgcctat

SEQ ID NO: 60795 - DNA, 15 bp, Artificial Sequence
  dgRNA
  Blvrb
gcgcctatcggagaa

SEQ ID NO: 60796 - DNA, 15 bp, Artificial Sequence
  dgRNA
  Palm
ctgtggctctctcgc

SEQ ID NO: 60797 - DNA, 15 bp, Artificial Sequence
  dgRNA
  Palm
ggctctctcgcgggt

SEQ ID NO: 60798 - DNA, 15 bp, Artificial Sequence
  dgRNA
  Palm
gctctctcgcgggtc

SEQ ID NO: 60799 - DNA, 15 bp, Artificial Sequence
  dgRNA
  Palm
ctctctcgcgggtcg

SEQ ID NO: 60800 - DNA, 15 bp, Artificial Sequence
  dgRNA
  Uts2
tggaggggacgtatg

SEQ ID NO: 60801 - DNA, 15 bp, Artificial Sequence
  dgRNA
  Uts2
gacgtatgaggtcac

SEQ ID NO: 60802 - DNA, 15 bp, Artificial Sequence
  dgRNA
  Uts2
tactggcttgttgac

SEQ ID NO: 60803 - DNA, 15 bp, Artificial Sequence
  dgRNA
  Uts2
atttattggctaggg

SEQ ID NO: 60804 - DNA, 15 bp, Artificial Sequence
  dgRNA
  Rpia
tagacagcagttacc

SEQ ID NO: 60805 - DNA, 15 bp, Artificial Sequence
  dgRNA
  Rpia
gttacccggaccttc

SEQ ID NO: 60806 - DNA, 15 bp, Artificial Sequence
  dgRNA
  Rpia
tccggacagaaagtc

SEQ ID NO: 60807 - DNA, 15 bp, Artificial Sequence
  dgRNA
  Rpia
ggcgatttgcacact

SEQ ID NO: 60808 - DNA, 15 bp, Artificial Sequence
  dgRNA
  Pcdh19
gtgtaagtttccgct

SEQ ID NO: 60809 - DNA, 15 bp, Artificial Sequence
  dgRNA
  Pcdh19
ccccgcctcgcgcct

SEQ ID NO: 60810 - DNA, 15 bp, Artificial Sequence
  dgRNA
  Pcdh19
gtcccgccccaagac

SEQ ID NO: 60811 - DNA, 15 bp, Artificial Sequence
  dgRNA
  Pcdh19
caagaccggagccgc

SEQ ID NO: 60812 - DNA, 15 bp, Artificial Sequence
  dgRNA
  Zpld1
agcattgaaagggcc

SEQ ID NO: 60813 - DNA, 15 bp, Artificial Sequence
  dgRNA
  Smim13
agcagcgttgactcc

SEQ ID NO: 60814 - DNA, 15 bp, Artificial Sequence
  dgRNA
  Smim13
gcagcgttgactcct

SEQ ID NO: 60815 - DNA, 15 bp, Artificial Sequence
  dgRNA
  Smim13
gttgactcctgggag

SEQ ID NO: 60816 - DNA, 15 bp, Artificial Sequence
  dgRNA
  Smim13
gtggtagttcgttgc

SEQ ID NO: 60817 - DNA, 15 bp, Artificial Sequence
  dgRNA
  Lars
ttgtagttcaactta

SEQ ID NO: 60818 - DNA, 15 bp, Artificial Sequence
  dgRNA
  Lars
aggtaacatcactgc

SEQ ID NO: 60819 - DNA, 15 bp, Artificial Sequence
  dgRNA
  Lars
actgccggtgtcgcc

SEQ ID NO: 60820 - DNA, 15 bp, Artificial Sequence
  dgRNA
  Lars
ctgccggtgtcgcct

SEQ ID NO: 60821 - DNA, 15 bp, Artificial Sequence
  dgRNA
  Rnmtl1
cgcgctagccccgct

SEQ ID NO: 60822 - DNA, 15 bp, Artificial Sequence
  dgRNA
  Rnmtl1
agccccgctcggtcc

SEQ ID NO: 60823 - DNA, 15 bp, Artificial Sequence
  dgRNA
  Rnmtl1
gcagagctcgacgag

SEQ ID NO: 60824 - DNA, 15 bp, Artificial Sequence
  dgRNA
  Rnmtl1
ctcgacgagtggcca

SEQ ID NO: 60825 - DNA, 15 bp, Artificial Sequence
  dgRNA
  Tac2
agtagctctgtatac

SEQ ID NO: 60826 - DNA, 15 bp, Artificial Sequence
  dgRNA
  Tac2
gagtatctaaacccc

SEQ ID NO: 60827 - DNA, 15 bp, Artificial Sequence
  dgRNA
  Tac2
agtatctaaacccca

SEQ ID NO: 60828 - DNA, 15 bp, Artificial Sequence
  dgRNA
  Tac2
gtttagatactcacc

SEQ ID NO: 60829 - DNA, 15 bp, Artificial Sequence
  dgRNA
  Tsnaxip1
atttgctgtattgac

SEQ ID NO: 60830 - DNA, 15 bp, Artificial Sequence
  dgRNA
  Tsnaxip1
tccagagtgctcacg

SEQ ID NO: 60831 - DNA, 15 bp, Artificial Sequence
  dgRNA
  Tsnaxip1
ccagagtgctcacgg

SEQ ID NO: 60832 - DNA, 15 bp, Artificial Sequence
  dgRNA
  Tsnaxip1
gagtgctcacggggg

SEQ ID NO: 60833 - DNA, 15 bp, Artificial Sequence
  dgRNA
  Taf13
ccaatcccaaggccg

SEQ ID NO: 60834 - DNA, 15 bp, Artificial Sequence
  dgRNA
  Taf13
tcccaaggccggggt

SEQ ID NO: 60835 - DNA, 15 bp, Artificial Sequence
  dgRNA
  Taf13
cccaaggccggggtt

SEQ ID NO: 60836 - DNA, 15 bp, Artificial Sequence
  dgRNA
  Taf13
ctctctgcgcaacgc

SEQ ID NO: 60837 - DNA, 15 bp, Artificial Sequence
  dgRNA
  Frs2
ttagcaaggagcccg

SEQ ID NO: 60838 - DNA, 15 bp, Artificial Sequence
  dgRNA
  Frs2
tagcaaggagcccgg

SEQ ID NO: 60839 - DNA, 15 bp, Artificial Sequence
  dgRNA
  Frs2
cgggggcgggtccgc

SEQ ID NO: 60840 - DNA, 15 bp, Artificial Sequence
  dgRNA
  Frs2
gggtccgctggcgcc

SEQ ID NO: 60841 - DNA, 15 bp, Artificial Sequence
  dgRNA
  Slc30a8
atgaggctagtgtag

SEQ ID NO: 60842 - DNA, 15 bp, Artificial Sequence
  dgRNA
  Slc30a8
atttgcagctcactc

SEQ ID NO: 60843 - DNA, 15 bp, Artificial Sequence
  dgRNA
  Napb
gaagtctacctccaa

SEQ ID NO: 60844 - DNA, 15 bp, Artificial Sequence
  dgRNA
  Napb
gacaaactggcatta

SEQ ID NO: 60845 - DNA, 15 bp, Artificial Sequence
  dgRNA
  Napb
cgtggccttctggag

SEQ ID NO: 60846 - DNA, 15 bp, Artificial Sequence
  dgRNA
  Napb
tcccggactccctgg

SEQ ID NO: 60847 - DNA, 15 bp, Artificial Sequence
  dgRNA
  Sema6c
gtattattggtgaag

SEQ ID NO: 60848 - DNA, 15 bp, Artificial Sequence
  dgRNA
  Sema6c
cgcttagtattccat

SEQ ID NO: 60849 - DNA, 15 bp, Artificial Sequence
  dgRNA
  Sema6c
gcttagtattccatt

SEQ ID NO: 60850 - DNA, 15 bp, Artificial Sequence
  dgRNA
  Sema6c
tattccattgggcgg

SEQ ID NO: 60851 - DNA, 15 bp, Artificial Sequence
  dgRNA
  Mal2
gcagacagttagtgc

SEQ ID NO: 60852 - DNA, 15 bp, Artificial Sequence
  dgRNA
  Mal2
accctgactgtcgct

SEQ ID NO: 60853 - DNA, 15 bp, Artificial Sequence
  dgRNA
  Mal2
ccctgactgtcgcta

SEQ ID NO: 60854 - DNA, 15 bp, Artificial Sequence
  dgRNA
  Mal2
tgactgtcgctaggg

SEQ ID NO: 60855 - DNA, 15 bp, Artificial Sequence
  dgRNA
  Ggct
gccagtagccactct

SEQ ID NO: 60856 - DNA, 15 bp, Artificial Sequence
  dgRNA
  Ggct
agactcgccaatcag

SEQ ID NO: 60857 - DNA, 15 bp, Artificial Sequence
  dgRNA
  Ggct
aatcagcggcgcctc

SEQ ID NO: 60858 - DNA, 15 bp, Artificial Sequence
  dgRNA
  Ggct
agcggcgcctcaggc

SEQ ID NO: 60859 - DNA, 15 bp, Artificial Sequence
  dgRNA
  Galk1
cgcgttggcttgcgc

SEQ ID NO: 60860 - DNA, 15 bp, Artificial Sequence
  dgRNA
  Galk1
ccccgctctgcaggt

SEQ ID NO: 60861 - DNA, 15 bp, Artificial Sequence
  dgRNA
  Galk1
gcggggccgtcgtag

SEQ ID NO: 60862 - DNA, 15 bp, Artificial Sequence
  dgRNA
  Galk1
cggggccgtcgtagc

SEQ ID NO: 60863 - DNA, 15 bp, Artificial Sequence
  dgRNA
  Gm4841
ggggcataagccaga

SEQ ID NO: 60864 - DNA, 15 bp, Artificial Sequence
  dgRNA
  Gm4841
atgtacaaatccttc

SEQ ID NO: 60865 - DNA, 15 bp, Artificial Sequence
  dgRNA
  Ywhae
ttcccgcctcgccac

SEQ ID NO: 60866 - DNA, 15 bp, Artificial Sequence
  dgRNA
  Ywhae
tcccgcctcgccaca

SEQ ID NO: 60867 - DNA, 15 bp, Artificial Sequence
  dgRNA
  Ywhae
cgcccgctgtgccga

SEQ ID NO: 60868 - DNA, 15 bp, Artificial Sequence
  dgRNA
  Ywhae
ccgctgtgccgacgg

SEQ ID NO: 60869 - DNA, 15 bp, Artificial Sequence
  dgRNA
  Gdf6
ccccacctcccggcg

SEQ ID NO: 60870 - DNA, 15 bp, Artificial Sequence
  dgRNA
  Gdf6
cccacctcccggcga

SEQ ID NO: 60871 - DNA, 15 bp, Artificial Sequence
  dgRNA
  Gdf6
ccacctcccggcgag

SEQ ID NO: 60872 - DNA, 15 bp, Artificial Sequence
  dgRNA
  Gdf6
cctcccggcgagggg

SEQ ID NO: 60873 - DNA, 15 bp, Artificial Sequence
  dgRNA
  Slc4a4
ctgagcccccggcga

SEQ ID NO: 60874 - DNA, 15 bp, Artificial Sequence
  dgRNA
  Slc4a4
agcccccggcgaggg

SEQ ID NO: 60875 - DNA, 15 bp, Artificial Sequence
  dgRNA
  Slc4a4
gggcggcgcagccag

SEQ ID NO: 60876 - DNA, 15 bp, Artificial Sequence
  dgRNA
  Slc4a4
ccctcctccgaagct

SEQ ID NO: 60877 - DNA, 15 bp, Artificial Sequence
  dgRNA
  Mslnl
ggtgcgtgctatgcc

SEQ ID NO: 60878 - DNA, 15 bp, Artificial Sequence
  dgRNA
  Mslnl
gtgcgtgctatgcct

SEQ ID NO: 60879 - DNA, 15 bp, Artificial Sequence
  dgRNA
  Mslnl
tatgcctgggcccaa

SEQ ID NO: 60880 - DNA, 15 bp, Artificial Sequence
  dgRNA
  Mslnl
gatacaagcattacc

SEQ ID NO: 60881 - DNA, 15 bp, Artificial Sequence
  dgRNA
  Eef2
gagctagccacgccc

SEQ ID NO: 60882 - DNA, 15 bp, Artificial Sequence
  dgRNA
  Eef2
ccgcagccactccca

SEQ ID NO: 60883 - DNA, 15 bp, Artificial Sequence
  dgRNA
  Eef2
agacccgtccacagc

SEQ ID NO: 60884 - DNA, 15 bp, Artificial Sequence
  dgRNA
  Eef2
ggctcctagccaacc

SEQ ID NO: 60885 - DNA, 15 bp, Artificial Sequence
  dgRNA
  Kdm3a
ttcagcataaccaat

SEQ ID NO: 60886 - DNA, 15 bp, Artificial Sequence
  dgRNA
  Kdm3a
aacgtagaatttcct

SEQ ID NO: 60887 - DNA, 15 bp, Artificial Sequence
  dgRNA
  Kdm3a
gactcaaccaatcat

SEQ ID NO: 60888 - DNA, 15 bp, Artificial Sequence
  dgRNA
  Kdm3a
tcaaccaatcatcgg

SEQ ID NO: 60889 - DNA, 15 bp, Artificial Sequence
  dgRNA
  Trpc5
gcgcctgtgtgaatg

SEQ ID NO: 60890 - DNA, 15 bp, Artificial Sequence
  dgRNA
  Trpc5
tcccggtgtcggctt

SEQ ID NO: 60891 - DNA, 15 bp, Artificial Sequence
  dgRNA
  Trpc5
tggcttgctgcgtga

SEQ ID NO: 60892 - DNA, 15 bp, Artificial Sequence
  dgRNA
  Trpc5
ggcttgctgcgtgaa

SEQ ID NO: 60893 - DNA, 15 bp, Artificial Sequence
  dgRNA
  Tubb5
cttctttttgcagcg

SEQ ID NO: 60894 - DNA, 15 bp, Artificial Sequence
  dgRNA
  Tubb5
gactgcgctcgccac

SEQ ID NO: 60895 - DNA, 15 bp, Artificial Sequence
  dgRNA
  Tubb5
aaaccaatggccgcc

SEQ ID NO: 60896 - DNA, 15 bp, Artificial Sequence
  dgRNA
  Tubb5
cgcctggcacgtgat

SEQ ID NO: 60897 - DNA, 15 bp, Artificial Sequence
  dgRNA
  Prkrip1
tgcctcgtacctccg

SEQ ID NO: 60898 - DNA, 15 bp, Artificial Sequence
  dgRNA
  Prkrip1
gagagtgcgcgtgcg

SEQ ID NO: 60899 - DNA, 15 bp, Artificial Sequence
  dgRNA
  Prkrip1
gtgcgcgtgcgcggt

SEQ ID NO: 60900 - DNA, 15 bp, Artificial Sequence
  dgRNA
  Prkrip1
aacgcgaggtcagtg

SEQ ID NO: 60901 - DNA, 15 bp, Artificial Sequence
  dgRNA
  Frmd7
ccaagtgggcccggc

SEQ ID NO: 60902 - DNA, 15 bp, Artificial Sequence
  dgRNA
  Frmd7
gcccggctggaagca

SEQ ID NO: 60903 - DNA, 15 bp, Artificial Sequence
  dgRNA
  Frmd7
ttgctcgcagcccaa

SEQ ID NO: 60904 - DNA, 15 bp, Artificial Sequence
  dgRNA
  Frmd7
gtgaagcacacccaa

SEQ ID NO: 60905 - DNA, 15 bp, Artificial Sequence
  dgRNA
  Ces1a
tctgatagttgagtc

SEQ ID NO: 60906 - DNA, 15 bp, Artificial Sequence
  dgRNA
  Ces1a
ggctatgtatggctt

SEQ ID NO: 60907 - DNA, 15 bp, Artificial Sequence
  dgRNA
  Ces1a
tcatgattaggccac

SEQ ID NO: 60908 - DNA, 15 bp, Artificial Sequence
  dgRNA
  Ces1a
ataagctctttcccg

SEQ ID NO: 60909 - DNA, 15 bp, Artificial Sequence
  dgRNA
  Cyp27a1
tagaggtcttgcagc

SEQ ID NO: 60910 - DNA, 15 bp, Artificial Sequence
  dgRNA
  Cyp27a1
ggcgtttgtgtgttc

SEQ ID NO: 60911 - DNA, 15 bp, Artificial Sequence
  dgRNA
  Cyp27a1
aggacagatcctgat

SEQ ID NO: 60912 - DNA, 15 bp, Artificial Sequence
  dgRNA
  Cyp27a1
agatcctgattggaa

SEQ ID NO: 60913 - DNA, 15 bp, Artificial Sequence
  dgRNA
  Mid1
ctagcgaggaccgcc

SEQ ID NO: 60914 - DNA, 15 bp, Artificial Sequence
  dgRNA
  Mid1
gggcgcaggctagcg

SEQ ID NO: 60915 - DNA, 15 bp, Artificial Sequence
  dgRNA
  Mid1
tgaaaagtcgggcgc

SEQ ID NO: 60916 - DNA, 15 bp, Artificial Sequence
  dgRNA
  Olfr912
atacgagttcaatat

SEQ ID NO: 60917 - DNA, 15 bp, Artificial Sequence
  dgRNA
  Olfr912
tgacctcatctctta

SEQ ID NO: 60918 - DNA, 15 bp, Artificial Sequence
  dgRNA
  Pam
gagactatcgggccc

SEQ ID NO: 60919 - DNA, 15 bp, Artificial Sequence
  dgRNA
  Pam
accctccgacccgcc

SEQ ID NO: 60920 - DNA, 15 bp, Artificial Sequence
  dgRNA
  Pam
ccctccgacccgccc

SEQ ID NO: 60921 - DNA, 15 bp, Artificial Sequence
  dgRNA
  Pam
cgcgctccccgggag

SEQ ID NO: 60922 - DNA, 15 bp, Artificial Sequence
  dgRNA
  Setd8
ggcggacgcctgggc

SEQ ID NO: 60923 - DNA, 15 bp, Artificial Sequence
  dgRNA
  Setd8
ccacgcatgcacacg

SEQ ID NO: 60924 - DNA, 15 bp, Artificial Sequence
  dgRNA
  Setd8
atgcacacgcggccc

SEQ ID NO: 60925 - DNA, 15 bp, Artificial Sequence
  dgRNA
  Setd8
acgcggccccggtac

SEQ ID NO: 60926 - DNA, 15 bp, Artificial Sequence
  dgRNA
  4930402F06Rik
atgtggttctccccg

SEQ ID NO: 60927 - DNA, 15 bp, Artificial Sequence
  dgRNA
  4930402F06Rik
tgttaggcattgact

SEQ ID NO: 60928 - DNA, 15 bp, Artificial Sequence
  dgRNA
  4930402F06Rik
gttaggcattgacta

SEQ ID NO: 60929 - DNA, 15 bp, Artificial Sequence
  dgRNA
  4930402F06Rik
agtgagctgtcgctc

SEQ ID NO: 60930 - DNA, 15 bp, Artificial Sequence
  dgRNA
  Rnf44
gcgagtagagaggcg

SEQ ID NO: 60931 - DNA, 15 bp, Artificial Sequence
  dgRNA
  Rnf44
gcgaggtgagctatg

SEQ ID NO: 60932 - DNA, 15 bp, Artificial Sequence
  dgRNA
  Rnf44
ctatgaggtcatcgc

SEQ ID NO: 60933 - DNA, 15 bp, Artificial Sequence
  dgRNA
  Rnf44
catcgcaggcctgcc

SEQ ID NO: 60934 - DNA, 15 bp, Artificial Sequence
  dgRNA
  Acss2
ctcgcctgtcacctc

SEQ ID NO: 60935 - DNA, 15 bp, Artificial Sequence
  dgRNA
  Acss2
cggctccaccccttc

SEQ ID NO: 60936 - DNA, 15 bp, Artificial Sequence
  dgRNA
  Acss2
ggggtgtagcccggc

SEQ ID NO: 60937 - DNA, 15 bp, Artificial Sequence
  dgRNA
  Acss2
gcccgtggagtgatg

SEQ ID NO: 60938 - DNA, 15 bp, Artificial Sequence
  dgRNA
  Dpy19l3
gtgcgccgcacgaga

SEQ ID NO: 60939 - DNA, 15 bp, Artificial Sequence
  dgRNA
  Dpy19l3
tgcgccgcacgagac

SEQ ID NO: 60940 - DNA, 15 bp, Artificial Sequence
  dgRNA
  Dpy19l3
gcgccgcacgagacg

SEQ ID NO: 60941 - DNA, 15 bp, Artificial Sequence
  dgRNA
  Dpy19l3
ccgcacgagacgggg

SEQ ID NO: 60942 - DNA, 15 bp, Artificial Sequence
  dgRNA
  Rgs3
taaaggattggccag

SEQ ID NO: 60943 - DNA, 15 bp, Artificial Sequence
  dgRNA
  Rgs3
aggattggccagcgg

SEQ ID NO: 60944 - DNA, 15 bp, Artificial Sequence
  dgRNA
  Rgs3
cacatccttggggcg

SEQ ID NO: 60945 - DNA, 15 bp, Artificial Sequence
  dgRNA
  Rgs3
acatccttggggcgg

SEQ ID NO: 60946 - DNA, 15 bp, Artificial Sequence
  dgRNA
  Wnt7b
agcacagcccctaag

SEQ ID NO: 60947 - DNA, 15 bp, Artificial Sequence
  dgRNA
  Wnt7b
ccgcgcagtgcctcc

SEQ ID NO: 60948 - DNA, 15 bp, Artificial Sequence
  dgRNA
  Wnt7b
atgcgctctccgtag

SEQ ID NO: 60949 - DNA, 15 bp, Artificial Sequence
  dgRNA
  Wnt7b
ggtgtttctcgccaa

SEQ ID NO: 60950 - DNA, 15 bp, Artificial Sequence
  dgRNA
  Impact
agtgcggcctgcaaa

SEQ ID NO: 60951 - DNA, 15 bp, Artificial Sequence
  dgRNA
  Impact
ccgctgcctgcacgc

SEQ ID NO: 60952 - DNA, 15 bp, Artificial Sequence
  dgRNA
  Impact
cgctgcctgcacgca

SEQ ID NO: 60953 - DNA, 15 bp, Artificial Sequence
  dgRNA
  Impact
gttggctgtcagttc

SEQ ID NO: 60954 - DNA, 15 bp, Artificial Sequence
  dgRNA
  Fhad1
ttagtgatcactatt

SEQ ID NO: 60955 - DNA, 15 bp, Artificial Sequence
  dgRNA
  Fhad1
agctagtccatcacc

SEQ ID NO: 60956 - DNA, 15 bp, Artificial Sequence
  dgRNA
  Fhad1
ccaattcatccactc

SEQ ID NO: 60957 - DNA, 15 bp, Artificial Sequence
  dgRNA
  Fhad1
ctggaccctcctgta

SEQ ID NO: 60958 - DNA, 15 bp, Artificial Sequence
  dgRNA
  Clec4f
acagtccccttctta

SEQ ID NO: 60959 - DNA, 15 bp, Artificial Sequence
  dgRNA
  Clec4f
cagtccccttcttag

SEQ ID NO: 60960 - DNA, 15 bp, Artificial Sequence
  dgRNA
  Clec4f
tgtaactccaagagg

SEQ ID NO: 60961 - DNA, 15 bp, Artificial Sequence
  dgRNA
  Clec4f
ggaaacattcttgag

SEQ ID NO: 60962 - DNA, 15 bp, Artificial Sequence
  dgRNA
  Rps6ka6
atactacagattccc

SEQ ID NO: 60963 - DNA, 15 bp, Artificial Sequence
  dgRNA
  Rps6ka6
tttaatacatgagcg

SEQ ID NO: 60964 - DNA, 15 bp, Artificial Sequence
  dgRNA
  Rps6ka6
caaagtgggtttgtc

SEQ ID NO: 60965 - DNA, 15 bp, Artificial Sequence
  dgRNA
  Ascl4
aaatacttcgtgcta

SEQ ID NO: 60966 - DNA, 15 bp, Artificial Sequence
  dgRNA
  Ascl4
aatacttcgtgctat

SEQ ID NO: 60967 - DNA, 15 bp, Artificial Sequence
  dgRNA
  Ascl4
ttgttatatcctgag

SEQ ID NO: 60968 - DNA, 15 bp, Artificial Sequence
  dgRNA
  Ascl4
tgttatatcctgagt

SEQ ID NO: 60969 - DNA, 15 bp, Artificial Sequence
  dgRNA
  Hsd17b10
caagctggagccgct

SEQ ID NO: 60970 - DNA, 15 bp, Artificial Sequence
  dgRNA
  Hsd17b10
ataggttcctaaccc

SEQ ID NO: 60971 - DNA, 15 bp, Artificial Sequence
  dgRNA
  Hsd17b10
taggttcctaaccct

SEQ ID NO: 60972 - DNA, 15 bp, Artificial Sequence
  dgRNA
  Hsd17b10
aaggtccgggacagc

SEQ ID NO: 60973 - DNA, 15 bp, Artificial Sequence
  dgRNA
  RP23-41B18.5
ggtacactgaacacc

SEQ ID NO: 60974 - DNA, 15 bp, Artificial Sequence
  dgRNA
  RP23-41B18.5
ggtgcaatatgctac

SEQ ID NO: 60975 - DNA, 15 bp, Artificial Sequence
  dgRNA
  RP23-41B18.5
cctggcagacgtggt

SEQ ID NO: 60976 - DNA, 15 bp, Artificial Sequence
  dgRNA
  RP23-41B18.5
agtgtaccagcttcc

SEQ ID NO: 60977 - DNA, 15 bp, Artificial Sequence
  dgRNA
  Cdk8
gacggctgccagctc

SEQ ID NO: 60978 - DNA, 15 bp, Artificial Sequence
  dgRNA
  Cdk8
tccggagtcgctcac

SEQ ID NO: 60979 - DNA, 15 bp, Artificial Sequence
  dgRNA
  Cdk8
ggagtcgctcacagg

SEQ ID NO: 60980 - DNA, 15 bp, Artificial Sequence
  dgRNA
  Cdk8
gagtcgctcacaggt

SEQ ID NO: 60981 - DNA, 15 bp, Artificial Sequence
  dgRNA
  Uchl3
tcatgaactaggaca

SEQ ID NO: 60982 - DNA, 15 bp, Artificial Sequence
  dgRNA
  Uchl3
ttcattagtaactcc

SEQ ID NO: 60983 - DNA, 15 bp, Artificial Sequence
  dgRNA
  Uchl3
tcattagtaactcca

SEQ ID NO: 60984 - DNA, 15 bp, Artificial Sequence
  dgRNA
  Uchl3
gggctgagtctccgt

SEQ ID NO: 60985 - DNA, 15 bp, Artificial Sequence
  dgRNA
  Fam98c
tgagagtcggacagt

SEQ ID NO: 60986 - DNA, 15 bp, Artificial Sequence
  dgRNA
  Fam98c
gagagtcggacagta

SEQ ID NO: 60987 - DNA, 15 bp, Artificial Sequence
  dgRNA
  Fam98c
ggacaagttacctga

SEQ ID NO: 60988 - DNA, 15 bp, Artificial Sequence
  dgRNA
  Fam98c
gacaagttacctgaa

SEQ ID NO: 60989 - DNA, 15 bp, Artificial Sequence
  dgRNA
  Blmh
agatctgccgtccca

SEQ ID NO: 60990 - DNA, 15 bp, Artificial Sequence
  dgRNA
  Blmh
cccatggctaatttt

SEQ ID NO: 60991 - DNA, 15 bp, Artificial Sequence
  dgRNA
  Blmh
tcacaaaacctcctc

SEQ ID NO: 60992 - DNA, 15 bp, Artificial Sequence
  dgRNA
  Blmh
gcttgggatcccggg

SEQ ID NO: 60993 - DNA, 15 bp, Artificial Sequence
  dgRNA
  Ube2o
gcgtcccctagcgac

SEQ ID NO: 60994 - DNA, 15 bp, Artificial Sequence
  dgRNA
  Ube2o
cgtcccctagcgacc

SEQ ID NO: 60995 - DNA, 15 bp, Artificial Sequence
  dgRNA
  Ube2o
cccctagcgaccggg

SEQ ID NO: 60996 - DNA, 15 bp, Artificial Sequence
  dgRNA
  Ube2o
ctagcgaccgggcgg

SEQ ID NO: 60997 - DNA, 15 bp, Artificial Sequence
  dgRNA
  Sms
tactttaagactaca

SEQ ID NO: 60998 - DNA, 15 bp, Artificial Sequence
  dgRNA
  Sms
actttaagactacag

SEQ ID NO: 60999 - DNA, 15 bp, Artificial Sequence
  dgRNA
  Sms
ttaagactacagggg

SEQ ID NO: 61000 - DNA, 15 bp, Artificial Sequence
  dgRNA
  Sms
tttcttcaaatggtc

SEQ ID NO: 61001 - DNA, 15 bp, Artificial Sequence
  dgRNA
  Cit
gcctcaggatagcgg

SEQ ID NO: 61002 - DNA, 15 bp, Artificial Sequence
  dgRNA
  Cit
cctcaggatagcggg

SEQ ID NO: 61003 - DNA, 15 bp, Artificial Sequence
  dgRNA
  Cit
gctgggggtagcccg

SEQ ID NO: 61004 - DNA, 15 bp, Artificial Sequence
  dgRNA
  Cit
gtagcccggggtctg

SEQ ID NO: 61005 - DNA, 15 bp, Artificial Sequence
  dgRNA
  Rpl30
aacgcccagaaccga

SEQ ID NO: 61006 - DNA, 15 bp, Artificial Sequence
  dgRNA
  Rpl30
cccagaaccgaaggc

SEQ ID NO: 61007 - DNA, 15 bp, Artificial Sequence
  dgRNA
  Rpl30
gcctgcgttgtaacc

SEQ ID NO: 61008 - DNA, 15 bp, Artificial Sequence
  dgRNA
  Rpl30
gttctgcttgtgacc

SEQ ID NO: 61009 - DNA, 15 bp, Artificial Sequence
  dgRNA
  Sec31a
cctcctcacgccgcg

SEQ ID NO: 61010 - DNA, 15 bp, Artificial Sequence
  dgRNA
  Sec31a
actagcctaccggag

SEQ ID NO: 61011 - DNA, 15 bp, Artificial Sequence
  dgRNA
  Sec31a
cggagtggctgctcc

SEQ ID NO: 61012 - DNA, 15 bp, Artificial Sequence
  dgRNA
  Sec31a
ggaagtgctgtcccg

SEQ ID NO: 61013 - DNA, 15 bp, Artificial Sequence
  dgRNA
  4931429L15Rik
cttatgggggcatgt

SEQ ID NO: 61014 - DNA, 15 bp, Artificial Sequence
  dgRNA
  4931429L15Rik
gtggggggcttacgc

SEQ ID NO: 61015 - DNA, 15 bp, Artificial Sequence
  dgRNA
  4931429L15Rik
tggggggcttacgca

SEQ ID NO: 61016 - DNA, 15 bp, Artificial Sequence
  dgRNA
  4931429L15Rik
ggggggcttacgcag

SEQ ID NO: 61017 - DNA, 15 bp, Artificial Sequence
  dgRNA
  Fbxo6
atccagtcgcctgtc

SEQ ID NO: 61018 - DNA, 15 bp, Artificial Sequence
  dgRNA
  Fbxo6
taagtctatttatcc

SEQ ID NO: 61019 - DNA, 15 bp, Artificial Sequence
  dgRNA
  Fbxo6
atctgccccacccat

SEQ ID NO: 61020 - DNA, 15 bp, Artificial Sequence
  dgRNA
  Fbxo6
taccagacaggcgac

SEQ ID NO: 61021 - DNA, 15 bp, Artificial Sequence
  dgRNA
  Pitpnm1
gaatgggcaacctcg

SEQ ID NO: 61022 - DNA, 15 bp, Artificial Sequence
  dgRNA
  Pitpnm1
aatgggcaacctcgt

SEQ ID NO: 61023 - DNA, 15 bp, Artificial Sequence
  dgRNA
  Pitpnm1
ctcgtgggaagatga

SEQ ID NO: 61024 - DNA, 15 bp, Artificial Sequence
  dgRNA
  Pitpnm1
tcgtgggaagatgat

SEQ ID NO: 61025 - DNA, 15 bp, Artificial Sequence
  dgRNA
  Cep112
cgcagggttgggaca

SEQ ID NO: 61026 - DNA, 15 bp, Artificial Sequence
  dgRNA
  Cep112
tcgcagggttgggac

SEQ ID NO: 61027 - DNA, 15 bp, Artificial Sequence
  dgRNA
  Cep112
agttatcgcagggtt

SEQ ID NO: 61028 - DNA, 15 bp, Artificial Sequence
  dgRNA
  Cep112
aagttatcgcagggt

SEQ ID NO: 61029 - DNA, 15 bp, Artificial Sequence
  dgRNA
  Uqcr10
gcgcgttgaaacttt

SEQ ID NO: 61030 - DNA, 15 bp, Artificial Sequence
  dgRNA
  Uqcr10
accatttcctgcgtt

SEQ ID NO: 61031 - DNA, 15 bp, Artificial Sequence
  dgRNA
  Uqcr10
actgataatgtgcac

SEQ ID NO: 61032 - DNA, 15 bp, Artificial Sequence
  dgRNA
  Uqcr10
cgcgccctgctttat

SEQ ID NO: 61033 - DNA, 15 bp, Artificial Sequence
  dgRNA
  Cd48
cttgttgatctctag

SEQ ID NO: 61034 - DNA, 15 bp, Artificial Sequence
  dgRNA
  Cd48
ttgttgatctctagt

SEQ ID NO: 61035 - DNA, 15 bp, Artificial Sequence
  dgRNA
  Cd48
tgatctctagtgggt

SEQ ID NO: 61036 - DNA, 15 bp, Artificial Sequence
  dgRNA
  Cd48
acctcatacgacttc

SEQ ID NO: 61037 - DNA, 15 bp, Artificial Sequence
  dgRNA
  Hypk
tggcctatcaggtct

SEQ ID NO: 61038 - DNA, 15 bp, Artificial Sequence
  dgRNA
  Hypk
ggcctatcaggtcta

SEQ ID NO: 61039 - DNA, 15 bp, Artificial Sequence
  dgRNA
  Hypk
tgaacagatagtcga

SEQ ID NO: 61040 - DNA, 15 bp, Artificial Sequence
  dgRNA
  Hypk
cgaatgatcccgaat

SEQ ID NO: 61041 - DNA, 15 bp, Artificial Sequence
  dgRNA
  Kansl1l
tcagaacgctcccag

SEQ ID NO: 61042 - DNA, 15 bp, Artificial Sequence
  dgRNA
  Kansl1l
tcccagcggcttccg

SEQ ID NO: 61043 - DNA, 15 bp, Artificial Sequence
  dgRNA
  Kansl1l
cccagcggcttccgc

SEQ ID NO: 61044 - DNA, 15 bp, Artificial Sequence
  dgRNA
  Kansl1l
cccgtctcatttgca

SEQ ID NO: 61045 - DNA, 15 bp, Artificial Sequence
  dgRNA
  Htr7
cagcccggccgggct

SEQ ID NO: 61046 - DNA, 15 bp, Artificial Sequence
  dgRNA
  Htr7
ctcccccgtgcccgt
